United States Patent 7,691,997 (FUNCTIONAL AND HYPERFUNCTIONAL SIRNA) - sequence listing, part 34

SEQ ID NO: 1378527 - RNA, 19 nt, Homo sapiens
gaaccaauaggcaagacaa

SEQ ID NO: 1378528 - RNA, 19 nt, Homo sapiens
ccacaugucaagaaaugaa

SEQ ID NO: 1378529 - RNA, 19 nt, Homo sapiens
ccucauaccucugcgacuu

SEQ ID NO: 1378530 - RNA, 19 nt, Homo sapiens
agacuacaccugagccuuu

SEQ ID NO: 1378531 - RNA, 19 nt, Homo sapiens
gcugguauucuagcucuua

SEQ ID NO: 1378532 - RNA, 19 nt, Homo sapiens
caaugaaaaucccagauga

SEQ ID NO: 1378533 - RNA, 19 nt, Homo sapiens
gugcucagccuucccagaa

SEQ ID NO: 1378534 - RNA, 19 nt, Homo sapiens
caacagaaaacauucacua

SEQ ID NO: 1378535 - RNA, 19 nt, Homo sapiens
aaacucagaacaucuaaag

SEQ ID NO: 1378536 - RNA, 19 nt, Homo sapiens
cauccaagaagaauaugaa

SEQ ID NO: 1378537 - RNA, 19 nt, Homo sapiens
uaaaggcuucuguuccaaa

SEQ ID NO: 1378538 - RNA, 19 nt, Homo sapiens
guauugaaacuguaaacug

SEQ ID NO: 1378539 - RNA, 19 nt, Homo sapiens
cuccacaugucaagaaaug

SEQ ID NO: 1378540 - RNA, 19 nt, Homo sapiens
cagaagauauccucauacc

SEQ ID NO: 1378541 - RNA, 19 nt, Homo sapiens
acuaaaggcuucuguucca

SEQ ID NO: 1378542 - RNA, 19 nt, Homo sapiens
uuccuaagauugcugguau

SEQ ID NO: 1378543 - RNA, 19 nt, Homo sapiens
ccaauaggcaagacaacga

SEQ ID NO: 1378544 - RNA, 19 nt, Homo sapiens
caaccaagaacaaugaaaa

SEQ ID NO: 1378545 - RNA, 19 nt, Homo sapiens
ccaggaggaaccaguguga

SEQ ID NO: 1378546 - RNA, 19 nt, Homo sapiens
acuccaugcugcucagaaa

SEQ ID NO: 1378547 - RNA, 19 nt, Homo sapiens
ucgccaagccaaucuuuga

SEQ ID NO: 1378548 - RNA, 19 nt, Homo sapiens
caagacaacgaggcaguga

SEQ ID NO: 1378549 - RNA, 19 nt, Homo sapiens
guuauagaaugagucuuca

SEQ ID NO: 1378550 - RNA, 19 nt, Homo sapiens
gguacaaccaagaacaaug

SEQ ID NO: 1378551 - RNA, 19 nt, Homo sapiens
guuucaaguuccagauguu

SEQ ID NO: 1378552 - RNA, 19 nt, Homo sapiens
gcucaucaccucccagacu

SEQ ID NO: 1378553 - RNA, 19 nt, Homo sapiens
gacuacaccugagccuuuc

SEQ ID NO: 1378554 - RNA, 19 nt, Homo sapiens
uuucugacuucauccaaga

SEQ ID NO: 1378555 - RNA, 19 nt, Homo sapiens
cacagauguugguagagaa

SEQ ID NO: 1378556 - RNA, 19 nt, Homo sapiens
gcaccuucuccucacaauu

SEQ ID NO: 1378557 - RNA, 19 nt, Homo sapiens
aagauuccuuggcuuagug

SEQ ID NO: 1378558 - RNA, 19 nt, Homo sapiens
cuaaaggcuucuguuccaa

SEQ ID NO: 1378559 - RNA, 19 nt, Homo sapiens
ccugagccuuuccaugaug

SEQ ID NO: 1378560 - RNA, 19 nt, Homo sapiens
uaucuaaggccaggaggaa

SEQ ID NO: 1378561 - RNA, 19 nt, Homo sapiens
gagucuucaucaacccaaa

SEQ ID NO: 1378562 - RNA, 19 nt, Homo sapiens
uuacuucgucuccuaacaa

SEQ ID NO: 1378563 - RNA, 19 nt, Homo sapiens
uacuucgucuccuaacaaa

SEQ ID NO: 1378564 - RNA, 19 nt, Homo sapiens
uuaccucuauguucuuucu

SEQ ID NO: 1378565 - RNA, 19 nt, Homo sapiens
agagacaacguucuuccuu

SEQ ID NO: 1378566 - RNA, 19 nt, Homo sapiens
cagaaaacauucacuacag

SEQ ID NO: 1378567 - RNA, 19 nt, Homo sapiens
ccaauuuuguuucaaguuc

SEQ ID NO: 1378568 - RNA, 19 nt, Homo sapiens
cagcugucuuccacggauu

SEQ ID NO: 1378569 - RNA, 19 nt, Homo sapiens
agaaaacauucacuacaga

SEQ ID NO: 1378570 - RNA, 19 nt, Homo sapiens
gugcuccacaugucaagaa

SEQ ID NO: 1378571 - RNA, 19 nt, Homo sapiens
ucaaguuccagauguuuua

SEQ ID NO: 1378572 - RNA, 19 nt, Homo sapiens
gaaaaucccagaugaucca

SEQ ID NO: 1378573 - RNA, 19 nt, Homo sapiens
cgacuuuucugacuucauc

SEQ ID NO: 1378574 - RNA, 19 nt, Homo sapiens
ucuuaccucuauguucuuu

SEQ ID NO: 1378575 - RNA, 19 nt, Homo sapiens
uucuagcucuuaccucuau

SEQ ID NO: 1378576 - RNA, 19 nt, Homo sapiens
ccagacucccagagagaaa

SEQ ID NO: 1378577 - RNA, 19 nt, Homo sapiens
ccagaaaggaaccaauagg

SEQ ID NO: 1378578 - RNA, 19 nt, Homo sapiens
acagauguugguagagaaa

SEQ ID NO: 1378579 - RNA, 19 nt, Homo sapiens
gcaucugucucccuucauu

SEQ ID NO: 1378580 - RNA, 19 nt, Homo sapiens
guagugagauguaacaaaa

SEQ ID NO: 1378581 - RNA, 19 nt, Homo sapiens
cagaagccaucacugcuau

SEQ ID NO: 1378582 - RNA, 19 nt, Homo sapiens
ggauggggcuauucacuuu

SEQ ID NO: 1378583 - RNA, 19 nt, Homo sapiens
caaaugagaauagcacugu

SEQ ID NO: 1378584 - RNA, 19 nt, Homo sapiens
ggaaccaacuuuucucugu

SEQ ID NO: 1378585 - RNA, 19 nt, Homo sapiens
ccagaagccaucacugcua

SEQ ID NO: 1378586 - RNA, 19 nt, Homo sapiens
gcaaauacagaccacuucu

SEQ ID NO: 1378587 - RNA, 19 nt, Homo sapiens
gggcaaauacagaccacuu

SEQ ID NO: 1378588 - RNA, 19 nt, Homo sapiens
gaagccaucacugcuauca

SEQ ID NO: 1378589 - RNA, 19 nt, Homo sapiens
gcggguugcuggcuuguac

SEQ ID NO: 1378590 - RNA, 19 nt, Homo sapiens
gaccacuucugcaaaugag

SEQ ID NO: 1378591 - RNA, 19 nt, Homo sapiens
cagauccacccagugcuua

SEQ ID NO: 1378592 - RNA, 19 nt, Homo sapiens
gagggacacggaccaggaa

SEQ ID NO: 1378593 - RNA, 19 nt, Homo sapiens
aaugagaauagcacuguuu

SEQ ID NO: 1378594 - RNA, 19 nt, Homo sapiens
agccaucacugcuaucauc

SEQ ID NO: 1378595 - RNA, 19 nt, Homo sapiens
aaaugagaauagcacuguu

SEQ ID NO: 1378596 - RNA, 19 nt, Homo sapiens
cugcaucugucucccuuca

SEQ ID NO: 1378597 - RNA, 19 nt, Homo sapiens
ugcggaagcuucgggagaa

SEQ ID NO: 1378598 - RNA, 19 nt, Homo sapiens
ccucuccuuucuuucaguu

SEQ ID NO: 1378599 - RNA, 19 nt, Homo sapiens
ggcaaauacagaccacuuc

SEQ ID NO: 1378600 - RNA, 19 nt, Homo sapiens
agaccacuucugcaaauga

SEQ ID NO: 1378601 - RNA, 19 nt, Homo sapiens
ucagauccacccagugcuu

SEQ ID NO: 1378602 - RNA, 19 nt, Homo sapiens
ucccuucauugcuguguga

SEQ ID NO: 1378603 - RNA, 19 nt, Homo sapiens
gcaucugucucccuucauu

SEQ ID NO: 1378604 - RNA, 19 nt, Homo sapiens
guagugagauguaacaaaa

SEQ ID NO: 1378605 - RNA, 19 nt, Homo sapiens
cagaagccaucacugcuau

SEQ ID NO: 1378606 - RNA, 19 nt, Homo sapiens
ggauggggcuauucacuuu

SEQ ID NO: 1378607 - RNA, 19 nt, Homo sapiens
caaaugagaauagcacugu

SEQ ID NO: 1378608 - RNA, 19 nt, Homo sapiens
ccagaagccaucacugcua

SEQ ID NO: 1378609 - RNA, 19 nt, Homo sapiens
gcaaauacagaccacuucu

SEQ ID NO: 1378610 - RNA, 19 nt, Homo sapiens
gggcaaauacagaccacuu

SEQ ID NO: 1378611 - RNA, 19 nt, Homo sapiens
gaagccaucacugcuauca

SEQ ID NO: 1378612 - RNA, 19 nt, Homo sapiens
gaccacuucugcaaaugag

SEQ ID NO: 1378613 - RNA, 19 nt, Homo sapiens
cagauccacccagugcuua

SEQ ID NO: 1378614 - RNA, 19 nt, Homo sapiens
gagggacacggaccaggaa

SEQ ID NO: 1378615 - RNA, 19 nt, Homo sapiens
aaugagaauagcacuguuu

SEQ ID NO: 1378616 - RNA, 19 nt, Homo sapiens
agccaucacugcuaucauc

SEQ ID NO: 1378617 - RNA, 19 nt, Homo sapiens
aaaugagaauagcacuguu

SEQ ID NO: 1378618 - RNA, 19 nt, Homo sapiens
cugcaucugucucccuuca

SEQ ID NO: 1378619 - RNA, 19 nt, Homo sapiens
ugcggaagcuucgggagaa

SEQ ID NO: 1378620 - RNA, 19 nt, Homo sapiens
ggcaaauacagaccacuuc

SEQ ID NO: 1378621 - RNA, 19 nt, Homo sapiens
agaccacuucugcaaauga

SEQ ID NO: 1378622 - RNA, 19 nt, Homo sapiens
ucagauccacccagugcuu

SEQ ID NO: 1378623 - RNA, 19 nt, Homo sapiens
ucccuucauugcuguguga

SEQ ID NO: 1378624 - RNA, 19 nt, Homo sapiens
ccacagauaugcucgcaau

SEQ ID NO: 1378625 - RNA, 19 nt, Homo sapiens
gcaucugucucccuucauu

SEQ ID NO: 1378626 - RNA, 19 nt, Homo sapiens
guagugagauguaacaaaa

SEQ ID NO: 1378627 - RNA, 19 nt, Homo sapiens
gugcacggguacauacaua

SEQ ID NO: 1378628 - RNA, 19 nt, Homo sapiens
cagaagccaucacugcuau

SEQ ID NO: 1378629 - RNA, 19 nt, Homo sapiens
ggauggggcuauucacuuu

SEQ ID NO: 1378630 - RNA, 19 nt, Homo sapiens
caaaugagaauagcacugu

SEQ ID NO: 1378631 - RNA, 19 nt, Homo sapiens
ggaaccaacuuuucucugu

SEQ ID NO: 1378632 - RNA, 19 nt, Homo sapiens
ccagaagccaucacugcua

SEQ ID NO: 1378633 - RNA, 19 nt, Homo sapiens
cagauaugcucgcaaugca

SEQ ID NO: 1378634 - RNA, 19 nt, Homo sapiens
gaaugaggccucgcugugu

SEQ ID NO: 1378635 - RNA, 19 nt, Homo sapiens
ucucaaaguguugggauua

SEQ ID NO: 1378636 - RNA, 19 nt, Homo sapiens
gcaaauacagaccacuucu

SEQ ID NO: 1378637 - RNA, 19 nt, Homo sapiens
uuacaggcgugagccauug

SEQ ID NO: 1378638 - RNA, 19 nt, Homo sapiens
gaagccaucacugcuauca

SEQ ID NO: 1378639 - RNA, 19 nt, Homo sapiens
gggcaaauacagaccacuu

SEQ ID NO: 1378640 - RNA, 19 nt, Homo sapiens
aaugaggccucgcuguguu

SEQ ID NO: 1378641 - RNA, 19 nt, Homo sapiens
gcggguugcuggcuuguac

SEQ ID NO: 1378642 - RNA, 19 nt, Homo sapiens
gaccacuucugcaaaugag

SEQ ID NO: 1378643 - RNA, 19 nt, Homo sapiens
cagauccacccagugcuua

SEQ ID NO: 1378644 - RNA, 19 nt, Homo sapiens
aaugagaauagcacuguuu

SEQ ID NO: 1378645 - RNA, 19 nt, Homo sapiens
ucaaaguguugggauuaca

SEQ ID NO: 1378646 - RNA, 19 nt, Homo sapiens
agccaucacugcuaucauc

SEQ ID NO: 1378647 - RNA, 19 nt, Homo sapiens
aaaugagaauagcacuguu

SEQ ID NO: 1378648 - RNA, 19 nt, Homo sapiens
cugcaucugucucccuuca

SEQ ID NO: 1378649 - RNA, 19 nt, Homo sapiens
ugcggaagcuucgggagaa

SEQ ID NO: 1378650 - RNA, 19 nt, Homo sapiens
ccucuccuuucuuucaguu

SEQ ID NO: 1378651 - RNA, 19 nt, Homo sapiens
agaccacuucugcaaauga

SEQ ID NO: 1378652 - RNA, 19 nt, Homo sapiens
ggcaaauacagaccacuuc

SEQ ID NO: 1378653 - RNA, 19 nt, Homo sapiens
gcgaggcucaggugcacaa

SEQ ID NO: 1378654 - RNA, 19 nt, Homo sapiens
ucagauccacccagugcuu

SEQ ID NO: 1378655 - RNA, 19 nt, Homo sapiens
ucccuucauugcuguguga

SEQ ID NO: 1378656 - RNA, 19 nt, Homo sapiens
gaauuugacugaugaauga

SEQ ID NO: 1378657 - RNA, 19 nt, Homo sapiens
gaagagcguuucuaauaaa

SEQ ID NO: 1378658 - RNA, 19 nt, Homo sapiens
ggagacaccuuccggcuua

SEQ ID NO: 1378659 - RNA, 19 nt, Homo sapiens
gagcguauccuuaccauua

SEQ ID NO: 1378660 - RNA, 19 nt, Homo sapiens
gugaugugcuguuuauuua

SEQ ID NO: 1378661 - RNA, 19 nt, Homo sapiens
ugaagagcguuucuaauaa

SEQ ID NO: 1378662 - RNA, 19 nt, Homo sapiens
gaaaauugccucugaauaa

SEQ ID NO: 1378663 - RNA, 19 nt, Homo sapiens
cagagagccuguuuccuua

SEQ ID NO: 1378664 - RNA, 19 nt, Homo sapiens
gaaugaagagcguuucuaa

SEQ ID NO: 1378665 - RNA, 19 nt, Homo sapiens
gcaggagacuuucuauugu

SEQ ID NO: 1378666 - RNA, 19 nt, Homo sapiens
gagcguuucuaauaaaguu

SEQ ID NO: 1378667 - RNA, 19 nt, Homo sapiens
gagagccuguuuccuuauu

SEQ ID NO: 1378668 - RNA, 19 nt, Homo sapiens
ccaggacacucaguucuuu

SEQ ID NO: 1378669 - RNA, 19 nt, Homo sapiens
augaagagcguuucuaaua

SEQ ID NO: 1378670 - RNA, 19 nt, Homo sapiens
ggcaggagacuuucuauug

SEQ ID NO: 1378671 - RNA, 19 nt, Homo sapiens
gaugugcuguuuauuuauc

SEQ ID NO: 1378672 - RNA, 19 nt, Homo sapiens
gacacucaguucuuucaaa

SEQ ID NO: 1378673 - RNA, 19 nt, Homo sapiens
ucagagagccuguuuccuu

SEQ ID NO: 1378674 - RNA, 19 nt, Homo sapiens
gcggagaggacaguacuua

SEQ ID NO: 1378675 - RNA, 19 nt, Homo sapiens
gcccgacccuccugucauu

SEQ ID NO: 1378676 - RNA, 19 nt, Homo sapiens
cggcauggcugucacaaag

SEQ ID NO: 1378677 - RNA, 19 nt, Homo sapiens
ugccaccucuuauauguuu

SEQ ID NO: 1378678 - RNA, 19 nt, Homo sapiens
gcugccaccucuuauaugu

SEQ ID NO: 1378679 - RNA, 19 nt, Homo sapiens
gcacagacacagacacaca

SEQ ID NO: 1378680 - RNA, 19 nt, Homo sapiens
ucacagcagugggauauca

SEQ ID NO: 1378681 - RNA, 19 nt, Homo sapiens
ggaaacgaaaggucucuug

SEQ ID NO: 1378682 - RNA, 19 nt, Homo sapiens
ucaaaugugugugugaugu

SEQ ID NO: 1378683 - RNA, 19 nt, Homo sapiens
gggaagagcguauccuuac

SEQ ID NO: 1378684 - RNA, 19 nt, Homo sapiens
caaguuuguuuccuguuuc

SEQ ID NO: 1378685 - RNA, 19 nt, Homo sapiens
ggagaggacaguacuuagu

SEQ ID NO: 1378686 - RNA, 19 nt, Homo sapiens
caggagacuuucuauugug

SEQ ID NO: 1378687 - RNA, 19 nt, Homo sapiens
gagccuguuuccuuauuca

SEQ ID NO: 1378688 - RNA, 19 nt, Homo sapiens
ggauaugggagacacauuc

SEQ ID NO: 1378689 - RNA, 19 nt, Homo sapiens
ugugugaugugcuguuuau

SEQ ID NO: 1378690 - RNA, 19 nt, Homo sapiens
ggaaaauugccucugaaua

SEQ ID NO: 1378691 - RNA, 19 nt, Homo sapiens
ugugaugugcuguuuauuu

SEQ ID NO: 1378692 - RNA, 19 nt, Homo sapiens
aauugccucugaauaauga

SEQ ID NO: 1378693 - RNA, 19 nt, Homo sapiens
gagaggacaguacuuaguc

SEQ ID NO: 1378694 - RNA, 19 nt, Homo sapiens
aaaggucucuugccaacag

SEQ ID NO: 1378695 - RNA, 19 nt, Homo sapiens
ugaauuugacugaugaaug

SEQ ID NO: 1378696 - RNA, 19 nt, Homo sapiens
gaagagcguauccuuacca

SEQ ID NO: 1378697 - RNA, 19 nt, Homo sapiens
cauuuaggcaggagacuuu

SEQ ID NO: 1378698 - RNA, 19 nt, Homo sapiens
ccuguuuccuuauucaaga

SEQ ID NO: 1378699 - RNA, 19 nt, Homo sapiens
gaagucaccaugcgcuaca

SEQ ID NO: 1378700 - RNA, 19 nt, Homo sapiens
aaugugaauuugacugaug

SEQ ID NO: 1378701 - RNA, 19 nt, Homo sapiens
caucacagcagugggauau

SEQ ID NO: 1378702 - RNA, 19 nt, Homo sapiens
gcgcuugcccucucuuuua

SEQ ID NO: 1378703 - RNA, 19 nt, Homo sapiens
gacaguacuuaguccaaag

SEQ ID NO: 1378704 - RNA, 19 nt, Homo sapiens
gcguauccuuaccauuauu

SEQ ID NO: 1378705 - RNA, 19 nt, Homo sapiens
cacagcagccaccguauug

SEQ ID NO: 1378706 - RNA, 19 nt, Homo sapiens
aggcagcccucccaaguca

SEQ ID NO: 1378707 - RNA, 19 nt, Homo sapiens
uuugaacguuguuuaccua

SEQ ID NO: 1378708 - RNA, 19 nt, Homo sapiens
gcuuaccucuuugaacguu

SEQ ID NO: 1378709 - RNA, 19 nt, Homo sapiens
gcagccaccguauugauca

SEQ ID NO: 1378710 - RNA, 19 nt, Homo sapiens
ccaccuuaaugugaauuug

SEQ ID NO: 1378711 - RNA, 19 nt, Homo sapiens
gggccuuccuggaguguca

SEQ ID NO: 1378712 - RNA, 19 nt, Homo sapiens
gaucagagagccuguuucc

SEQ ID NO: 1378713 - RNA, 19 nt, Homo sapiens
gaaauccugccaccaacca

SEQ ID NO: 1378714 - RNA, 19 nt, Homo sapiens
gcugcugccaccucuuaua

SEQ ID NO: 1378715 - RNA, 19 nt, Homo sapiens
gcauggcugucacaaagcu

SEQ ID NO: 1378716 - RNA, 19 nt, Homo sapiens
ccucuuugaacguuguuua

SEQ ID NO: 1378717 - RNA, 19 nt, Homo sapiens
ccuuccggcuuaccucuuu

SEQ ID NO: 1378718 - RNA, 19 nt, Homo sapiens
gcucaacgucuucgucaag

SEQ ID NO: 1378719 - RNA, 19 nt, Homo sapiens
agacagggccagggagaaa

SEQ ID NO: 1378720 - RNA, 19 nt, Homo sapiens
gcccagacaccucucuuca

SEQ ID NO: 1378721 - RNA, 19 nt, Homo sapiens
acacagcagccaccguauu

SEQ ID NO: 1378722 - RNA, 19 nt, Homo sapiens
aggaugugguaccaacuuu

SEQ ID NO: 1378723 - RNA, 19 nt, Homo sapiens
gcagcccucccaagucaga

SEQ ID NO: 1378724 - RNA, 19 nt, Homo sapiens
ugaaugaagagcguuucua

SEQ ID NO: 1378725 - RNA, 19 nt, Homo sapiens
caccuuaaugugaauuuga

SEQ ID NO: 1378726 - RNA, 19 nt, Homo sapiens
cugcugcugccaccucuua

SEQ ID NO: 1378727 - RNA, 19 nt, Homo sapiens
ggacucugugccacuuuga

SEQ ID NO: 1378728 - RNA, 19 nt, Homo sapiens
ccaccguauugaucagaga

SEQ ID NO: 1378729 - RNA, 19 nt, Homo sapiens
ggacacucaguucuuucaa

SEQ ID NO: 1378730 - RNA, 19 nt, Homo sapiens
ugacuggaaggguggauau

SEQ ID NO: 1378731 - RNA, 19 nt, Homo sapiens
ggaagagcguauccuuacc

SEQ ID NO: 1378732 - RNA, 19 nt, Homo sapiens
gccucugaauaaugaauga

SEQ ID NO: 1378733 - RNA, 19 nt, Homo sapiens
ucaagggcaagaagcugua

SEQ ID NO: 1378734 - RNA, 19 nt, Homo sapiens
ggaugugguaccaacuuug

SEQ ID NO: 1378735 - RNA, 19 nt, Homo sapiens
agggaagagcguauccuua

SEQ ID NO: 1378736 - RNA, 19 nt, Homo sapiens
gauaugggagacacauucu

SEQ ID NO: 1378737 - RNA, 19 nt, Homo sapiens
cacccacgcuguaguuggu

SEQ ID NO: 1378738 - RNA, 19 nt, Homo sapiens
cagcacagacacagacaca

SEQ ID NO: 1378739 - RNA, 19 nt, Homo sapiens
aaaacuaucugcaguacca

SEQ ID NO: 1378740 - RNA, 19 nt, Homo sapiens
ugugugugaugugcuguuu

SEQ ID NO: 1378741 - RNA, 19 nt, Homo sapiens
ggaaugcggagaggacagu

SEQ ID NO: 1378742 - RNA, 19 nt, Homo sapiens
uggaccagcuguuggacau

SEQ ID NO: 1378743 - RNA, 19 nt, Homo sapiens
caaaugugugugugaugug

SEQ ID NO: 1378744 - RNA, 19 nt, Homo sapiens
cagcagccaccguauugau

SEQ ID NO: 1378745 - RNA, 19 nt, Homo sapiens
cagggaagagcguauccuu

SEQ ID NO: 1378746 - RNA, 19 nt, Homo sapiens
gagggcacacucagcuuca

SEQ ID NO: 1378747 - RNA, 19 nt, Homo sapiens
uuaggacucugugccacuu

SEQ ID NO: 1378748 - RNA, 19 nt, Homo sapiens
aaauugccucugaauaaug

SEQ ID NO: 1378749 - RNA, 19 nt, Homo sapiens
cuggaaauccugccaccaa

SEQ ID NO: 1378750 - RNA, 19 nt, Homo sapiens
gaacaaaacuugaggguaa

SEQ ID NO: 1378751 - RNA, 19 nt, Homo sapiens
gaaggaggcuagaagauga

SEQ ID NO: 1378752 - RNA, 19 nt, Homo sapiens
gguagaagauuauugcuuu

SEQ ID NO: 1378753 - RNA, 19 nt, Homo sapiens
uggaagaacuuugcuauua

SEQ ID NO: 1378754 - RNA, 19 nt, Homo sapiens
gacaguacauaaaggaaua

SEQ ID NO: 1378755 - RNA, 19 nt, Homo sapiens
guaaagggccagauuguaa

SEQ ID NO: 1378756 - RNA, 19 nt, Homo sapiens
ggaagaagauuuauuucag

SEQ ID NO: 1378757 - RNA, 19 nt, Homo sapiens
gaacuaauggugcuaauuc

SEQ ID NO: 1378758 - RNA, 19 nt, Homo sapiens
ggaagaacuuugcuauuag

SEQ ID NO: 1378759 - RNA, 19 nt, Homo sapiens
guacgugaauugcuuggua

SEQ ID NO: 1378760 - RNA, 19 nt, Homo sapiens
ucagagaaauggaaaguga

SEQ ID NO: 1378761 - RNA, 19 nt, Homo sapiens
gcagugguacaaauuauua

SEQ ID NO: 1378762 - RNA, 19 nt, Homo sapiens
gaggguaaauaaacauuga

SEQ ID NO: 1378763 - RNA, 19 nt, Homo sapiens
uuacaucugugauuucuga

SEQ ID NO: 1378764 - RNA, 19 nt, Homo sapiens
gcggacauguucccgauuu

SEQ ID NO: 1378765 - RNA, 19 nt, Homo sapiens
gugaaaccaugaagagaaa

SEQ ID NO: 1378766 - RNA, 19 nt, Homo sapiens
gucaguaccuccuacguuu

SEQ ID NO: 1378767 - RNA, 19 nt, Homo sapiens
gaaagguccacuucuaguu

SEQ ID NO: 1378768 - RNA, 19 nt, Homo sapiens
gcagccagguugaucuuug

SEQ ID NO: 1378769 - RNA, 19 nt, Homo sapiens
gugaauugcuugguacaaa

SEQ ID NO: 1378770 - RNA, 19 nt, Homo sapiens
gggcuggccuugcuuuaug

SEQ ID NO: 1378771 - RNA, 19 nt, Homo sapiens
aaacuggaagcuuucauua

SEQ ID NO: 1378772 - RNA, 19 nt, Homo sapiens
gaauuuggucuguaucuga

SEQ ID NO: 1378773 - RNA, 19 nt, Homo sapiens
ggaauagaagguacuuuau

SEQ ID NO: 1378774 - RNA, 19 nt, Homo sapiens
ucacagggaaggauucuaa

SEQ ID NO: 1378775 - RNA, 19 nt, Homo sapiens
ggaaagacgggagaagaaa

SEQ ID NO: 1378776 - RNA, 19 nt, Homo sapiens
gaagguacuuuaucauagc

SEQ ID NO: 1378777 - RNA, 19 nt, Homo sapiens
gguaugcaguacagcagua

SEQ ID NO: 1378778 - RNA, 19 nt, Homo sapiens
gaagccagguucccaaggu

SEQ ID NO: 1378779 - RNA, 19 nt, Homo sapiens
acaaacuccugcccaauga

SEQ ID NO: 1378780 - RNA, 19 nt, Homo sapiens
aaacaaagcgaccagaaau

SEQ ID NO: 1378781 - RNA, 19 nt, Homo sapiens
ggccagauuguaaauauuu

SEQ ID NO: 1378782 - RNA, 19 nt, Homo sapiens
gaaguugccaauccaaguu

SEQ ID NO: 1378783 - RNA, 19 nt, Homo sapiens
gaauagaagguacuuuauc

SEQ ID NO: 1378784 - RNA, 19 nt, Homo sapiens
gcaaugugguacgugaauu

SEQ ID NO: 1378785 - RNA, 19 nt, Homo sapiens
uaacuacucaacucuguuu

SEQ ID NO: 1378786 - RNA, 19 nt, Homo sapiens
agaaauggcuguguugaca

SEQ ID NO: 1378787 - RNA, 19 nt, Homo sapiens
aaugucagcuuucccugua

SEQ ID NO: 1378788 - RNA, 19 nt, Homo sapiens
gcuauugcccgguaagaaa

SEQ ID NO: 1378789 - RNA, 19 nt, Homo sapiens
uacuaaggguagaagauua

SEQ ID NO: 1378790 - RNA, 19 nt, Homo sapiens
uagcaagagucgaaagaga

SEQ ID NO: 1378791 - RNA, 19 nt, Homo sapiens
ggaaagugaaagugagauu

SEQ ID NO: 1378792 - RNA, 19 nt, Homo sapiens
cuguagaacuggauucauu

SEQ ID NO: 1378793 - RNA, 19 nt, Homo sapiens
aggaauagaagguacuuua

SEQ ID NO: 1378794 - RNA, 19 nt, Homo sapiens
ggugaaaccaugaagagaa

SEQ ID NO: 1378795 - RNA, 19 nt, Homo sapiens
gaaagacgggagaagaaau

SEQ ID NO: 1378796 - RNA, 19 nt, Homo sapiens
ugaacuccuugccucuuua

SEQ ID NO: 1378797 - RNA, 19 nt, Homo sapiens
gcaggaaagccaccacaga

SEQ ID NO: 1378798 - RNA, 19 nt, Homo sapiens
aauaaagguuggcaaacuu

SEQ ID NO: 1378799 - RNA, 19 nt, Homo sapiens
gggaaagacgggagaagaa

SEQ ID NO: 1378800 - RNA, 19 nt, Homo sapiens
guaauuaagacccaucaga

SEQ ID NO: 1378801 - RNA, 19 nt, Homo sapiens
agaagguacuuuaucauag

SEQ ID NO: 1378802 - RNA, 19 nt, Homo sapiens
gagaacgaguugaauacca

SEQ ID NO: 1378803 - RNA, 19 nt, Homo sapiens
agggaaagguccacuucua

SEQ ID NO: 1378804 - RNA, 19 nt, Homo sapiens
gacgggagaagaaauugua

SEQ ID NO: 1378805 - RNA, 19 nt, Homo sapiens
gcgcuguucugcucuggaa

SEQ ID NO: 1378806 - RNA, 19 nt, Homo sapiens
cugcagaccagcucuauuu

SEQ ID NO: 1378807 - RNA, 19 nt, Homo sapiens
caggaguugugcagcauuu

SEQ ID NO: 1378808 - RNA, 19 nt, Homo sapiens
ugucugcuguagucuauuu

SEQ ID NO: 1378809 - RNA, 19 nt, Homo sapiens
ccacagacaguacauaaag

SEQ ID NO: 1378810 - RNA, 19 nt, Homo sapiens
cauaacuacucaacucugu

SEQ ID NO: 1378811 - RNA, 19 nt, Homo sapiens
uaaagggccagauuguaaa

SEQ ID NO: 1378812 - RNA, 19 nt, Homo sapiens
caaagcgaccagaaauuga

SEQ ID NO: 1378813 - RNA, 19 nt, Homo sapiens
ugugauuucugaacuaaug

SEQ ID NO: 1378814 - RNA, 19 nt, Homo sapiens
gggccagauuguaaauauu

SEQ ID NO: 1378815 - RNA, 19 nt, Homo sapiens
ggcacuuucuuccaauaaa

SEQ ID NO: 1378816 - RNA, 19 nt, Homo sapiens
gaauucaggcacuuucuuc

SEQ ID NO: 1378817 - RNA, 19 nt, Homo sapiens
gcuagaaacacagaauuug

SEQ ID NO: 1378818 - RNA, 19 nt, Homo sapiens
gcaagagucgaaagagaau

SEQ ID NO: 1378819 - RNA, 19 nt, Homo sapiens
ggacauguucccgauuuga

SEQ ID NO: 1378820 - RNA, 19 nt, Homo sapiens
acucaacucuguuucugaa

SEQ ID NO: 1378821 - RNA, 19 nt, Homo sapiens
ggaaagguccacuucuagu

SEQ ID NO: 1378822 - RNA, 19 nt, Homo sapiens
uagaauccaugccaauaca

SEQ ID NO: 1378823 - RNA, 19 nt, Homo sapiens
gcaguacagcaguauagaa

SEQ ID NO: 1378824 - RNA, 19 nt, Homo sapiens
ucacauuccacaccucuuu

SEQ ID NO: 1378825 - RNA, 19 nt, Homo sapiens
gaaagugaaagugagauuc

SEQ ID NO: 1378826 - RNA, 19 nt, Homo sapiens
ugacagaccccguuuauga

SEQ ID NO: 1378827 - RNA, 19 nt, Homo sapiens
gaaauggaaagugaaagug

SEQ ID NO: 1378828 - RNA, 19 nt, Homo sapiens
gaggcuagaagaugaauuc

SEQ ID NO: 1378829 - RNA, 19 nt, Homo sapiens
agaacgaguugaauaccaa

SEQ ID NO: 1378830 - RNA, 19 nt, Homo sapiens
gcuuagaaugccagaauaa

SEQ ID NO: 1378831 - RNA, 19 nt, Homo sapiens
aaagguccacuucuaguuu

SEQ ID NO: 1378832 - RNA, 19 nt, Homo sapiens
uauagaauccaugccaaua

SEQ ID NO: 1378833 - RNA, 19 nt, Homo sapiens
cagccagguugaucuuuga

SEQ ID NO: 1378834 - RNA, 19 nt, Homo sapiens
uaccagaaauggcuguguu

SEQ ID NO: 1378835 - RNA, 19 nt, Homo sapiens
acaaagcgaccagaaauug

SEQ ID NO: 1378836 - RNA, 19 nt, Homo sapiens
gcacuuucuuccaauaaaa

SEQ ID NO: 1378837 - RNA, 19 nt, Homo sapiens
ugucauaacuacucaacuc

SEQ ID NO: 1378838 - RNA, 19 nt, Homo sapiens
aaauaaagguuggcaaacu

SEQ ID NO: 1378839 - RNA, 19 nt, Homo sapiens
cagcacaccucaaccaaaa

SEQ ID NO: 1378840 - RNA, 19 nt, Homo sapiens
ggugucgacuccuaagaau

SEQ ID NO: 1378841 - RNA, 19 nt, Homo sapiens
guacagcaguauagaaucc

SEQ ID NO: 1378842 - RNA, 19 nt, Homo sapiens
gagcacuucaagguaauua

SEQ ID NO: 1378843 - RNA, 19 nt, Homo sapiens
acuggaagcuuucauuagu

SEQ ID NO: 1378844 - RNA, 19 nt, Homo sapiens
ggaaaccguaucacccaaa

SEQ ID NO: 1378845 - RNA, 19 nt, Homo sapiens
caccacagacaguacauaa

SEQ ID NO: 1378846 - RNA, 19 nt, Homo sapiens
ggccuugcuuuauggcuuu

SEQ ID NO: 1378847 - RNA, 19 nt, Homo sapiens
guagucuauuugcuguaua

SEQ ID NO: 1378848 - RNA, 19 nt, Homo sapiens
cgaguugaauaccaagaau

SEQ ID NO: 1378849 - RNA, 19 nt, Homo sapiens
ggaaggauucuaaaaggua

SEQ ID NO: 1378850 - RNA, 19 nt, Homo sapiens
ggucauggcuuguaauuua

SEQ ID NO: 1378851 - RNA, 19 nt, Homo sapiens
ggaaagggcuucaauuaga

SEQ ID NO: 1378852 - RNA, 19 nt, Homo sapiens
gaacacuucucaaccauaa

SEQ ID NO: 1378853 - RNA, 19 nt, Homo sapiens
gagaagaacuguaaaugug

SEQ ID NO: 1378854 - RNA, 19 nt, Homo sapiens
ggaacgaccuuacaaaugu

SEQ ID NO: 1378855 - RNA, 19 nt, Homo sapiens
gaggaaagggcuucaauua

SEQ ID NO: 1378856 - RNA, 19 nt, Homo sapiens
agaaacaacucaagccuua

SEQ ID NO: 1378857 - RNA, 19 nt, Homo sapiens
gaucaaaucucaccaagca

SEQ ID NO: 1378858 - RNA, 19 nt, Homo sapiens
gggaaauccuucaauuaua

SEQ ID NO: 1378859 - RNA, 19 nt, Homo sapiens
ggaagcagcccuauaauug

SEQ ID NO: 1378860 - RNA, 19 nt, Homo sapiens
gaaaguucauguuugguaa

SEQ ID NO: 1378861 - RNA, 19 nt, Homo sapiens
gaacucaaauggaagaaau

SEQ ID NO: 1378862 - RNA, 19 nt, Homo sapiens
gaagugguauucacacauu

SEQ ID NO: 1378863 - RNA, 19 nt, Homo sapiens
gaaagggcuucaauuagaa

SEQ ID NO: 1378864 - RNA, 19 nt, Homo sapiens
ggagaggaaucuuuaaaug

SEQ ID NO: 1378865 - RNA, 19 nt, Homo sapiens
ggaaauccuucaauuauag

SEQ ID NO: 1378866 - RNA, 19 nt, Homo sapiens
gaacacaccgucaacauga

SEQ ID NO: 1378867 - RNA, 19 nt, Homo sapiens
gaacucccauaaugaauga

SEQ ID NO: 1378868 - RNA, 19 nt, Homo sapiens
caagguaguucagcucuua

SEQ ID NO: 1378869 - RNA, 19 nt, Homo sapiens
ugagaaaccuuacgaaugu

SEQ ID NO: 1378870 - RNA, 19 nt, Homo sapiens
cagaugaacucccauaaug

SEQ ID NO: 1378871 - RNA, 19 nt, Homo sapiens
gaugaugacuucugaaaca

SEQ ID NO: 1378872 - RNA, 19 nt, Homo sapiens
gaauagaaaugcugagaag

SEQ ID NO: 1378873 - RNA, 19 nt, Homo sapiens
guucagcucuuacaggaua

SEQ ID NO: 1378874 - RNA, 19 nt, Homo sapiens
ggagaaacccuaugugugu

SEQ ID NO: 1378875 - RNA, 19 nt, Homo sapiens
ggagaaacccuucaagugu

SEQ ID NO: 1378876 - RNA, 19 nt, Homo sapiens
acacaucgcuccuuucuca

SEQ ID NO: 1378877 - RNA, 19 nt, Homo sapiens
gagauaaacccuauaagug

SEQ ID NO: 1378878 - RNA, 19 nt, Homo sapiens
gaaauucagguauagcuuu

SEQ ID NO: 1378879 - RNA, 19 nt, Homo sapiens
ugauauaugugggaaguua

SEQ ID NO: 1378880 - RNA, 19 nt, Homo sapiens
gggagaagcccuacaaaug

SEQ ID NO: 1378881 - RNA, 19 nt, Homo sapiens
gagagaaacccuaugaaug

SEQ ID NO: 1378882 - RNA, 19 nt, Homo sapiens
cuacaaaugugaugugugu

SEQ ID NO: 1378883 - RNA, 19 nt, Homo sapiens
ggagaagcccuacaaaugu

SEQ ID NO: 1378884 - RNA, 19 nt, Homo sapiens
ggagaagcccuaugaaugu

SEQ ID NO: 1378885 - RNA, 19 nt, Homo sapiens
agacauuucuggacauaaa

SEQ ID NO: 1378886 - RNA, 19 nt, Homo sapiens
gauggaaugugaagcaaau

SEQ ID NO: 1378887 - RNA, 19 nt, Homo sapiens
ggagauaaacccuauaagu

SEQ ID NO: 1378888 - RNA, 19 nt, Homo sapiens
ggagaggcccuaugaaugu

SEQ ID NO: 1378889 - RNA, 19 nt, Homo sapiens
gagaagcccuacaaaugug

SEQ ID NO: 1378890 - RNA, 19 nt, Homo sapiens
gaaauaauucuggccuuaa

SEQ ID NO: 1378891 - RNA, 19 nt, Homo sapiens
uggaagaaauaccuuauga

SEQ ID NO: 1378892 - RNA, 19 nt, Homo sapiens
gcauacaucucacacucaa

SEQ ID NO: 1378893 - RNA, 19 nt, Homo sapiens
gaugagggauaaccuggaa

SEQ ID NO: 1378894 - RNA, 19 nt, Homo sapiens
gggagaagcccuuuaagug

SEQ ID NO: 1378895 - RNA, 19 nt, Homo sapiens
gggagaagcccuaugaaug

SEQ ID NO: 1378896 - RNA, 19 nt, Homo sapiens
gggagaagcccuaugaaug

SEQ ID NO: 1378897 - RNA, 19 nt, Homo sapiens
gaagaacuguaaaugugau

SEQ ID NO: 1378898 - RNA, 19 nt, Homo sapiens
ggagaagaacuguaaaugu

SEQ ID NO: 1378899 - RNA, 19 nt, Homo sapiens
uguaggaaauucagguaua

SEQ ID NO: 1378900 - RNA, 19 nt, Homo sapiens
gaaguuacguaaucaccau

SEQ ID NO: 1378901 - RNA, 19 nt, Homo sapiens
guagacauuucuggacaua

SEQ ID NO: 1378902 - RNA, 19 nt, Homo sapiens
guacaagugugaggaaugu

SEQ ID NO: 1378903 - RNA, 19 nt, Homo sapiens
aagaaaggcuccaguguca

SEQ ID NO: 1378904 - RNA, 19 nt, Homo sapiens
ugagaaacccuaugaaugu

SEQ ID NO: 1378905 - RNA, 19 nt, Homo sapiens
ggagaagcccuuuaagugu

SEQ ID NO: 1378906 - RNA, 19 nt, Homo sapiens
gaugaacucccauaaugaa

SEQ ID NO: 1378907 - RNA, 19 nt, Homo sapiens
caucagaaaguucauguuu

SEQ ID NO: 1378908 - RNA, 19 nt, Homo sapiens
ucaagcagaacucuuauaa

SEQ ID NO: 1378909 - RNA, 19 nt, Homo sapiens
cuagagagaaggaaauuaa

SEQ ID NO: 1378910 - RNA, 19 nt, Homo sapiens
gggagaagccguacaagug

SEQ ID NO: 1378911 - RNA, 19 nt, Homo sapiens
ggauagguuucagggaaua

SEQ ID NO: 1378912 - RNA, 19 nt, Homo sapiens
agaggaaucuuuaaaugug

SEQ ID NO: 1378913 - RNA, 19 nt, Homo sapiens
acucaagucuuaucaauca

SEQ ID NO: 1378914 - RNA, 19 nt, Homo sapiens
gaggaaucuuuaaauguga

SEQ ID NO: 1378915 - RNA, 19 nt, Homo sapiens
ucaaaucucaccaagcaua

SEQ ID NO: 1378916 - RNA, 19 nt, Homo sapiens
aguaacagcucuggccuua

SEQ ID NO: 1378917 - RNA, 19 nt, Homo sapiens
ccuguuaaauguuugauug

SEQ ID NO: 1378918 - RNA, 19 nt, Homo sapiens
gcaaauugaugaacguacu

SEQ ID NO: 1378919 - RNA, 19 nt, Homo sapiens
guucauguuugguaaauuc

SEQ ID NO: 1378920 - RNA, 19 nt, Homo sapiens
gaacagcucaggccucaca

SEQ ID NO: 1378921 - RNA, 19 nt, Homo sapiens
gaacgaccuuacaaaugug

SEQ ID NO: 1378922 - RNA, 19 nt, Homo sapiens
uaacagcucuggccuuagg

SEQ ID NO: 1378923 - RNA, 19 nt, Homo sapiens
gggcagugaugaugacuuc

SEQ ID NO: 1378924 - RNA, 19 nt, Homo sapiens
ucagaaaguucauguuugg

SEQ ID NO: 1378925 - RNA, 19 nt, Homo sapiens
gagaggaaucuuuaaaugu

SEQ ID NO: 1378926 - RNA, 19 nt, Homo sapiens
ggaauguguuauuguaaag

SEQ ID NO: 1378927 - RNA, 19 nt, Homo sapiens
gagagaaggaaauuaaugu

SEQ ID NO: 1378928 - RNA, 19 nt, Homo sapiens
cagaagugauucagggauu

SEQ ID NO: 1378929 - RNA, 19 nt, Homo sapiens
caacaugaauucgcaccuu

SEQ ID NO: 1378930 - RNA, 19 nt, Homo sapiens
ugaacguacuauugugaua

SEQ ID NO: 1378931 - RNA, 19 nt, Homo sapiens
gggaagcagcccuauaauu

SEQ ID NO: 1378932 - RNA, 19 nt, Homo sapiens
agagaaacccuaugaaugu

SEQ ID NO: 1378933 - RNA, 19 nt, Homo sapiens
uaaaguaccagucaucuag

SEQ ID NO: 1378934 - RNA, 19 nt, Homo sapiens
ggaagaaauaccuuaugaa

SEQ ID NO: 1378935 - RNA, 19 nt, Homo sapiens
aggcagagcuuaccaaguc

SEQ ID NO: 1378936 - RNA, 19 nt, Homo sapiens
ucucgagccuuauaaauca

SEQ ID NO: 1378937 - RNA, 19 nt, Homo sapiens
gggaaaaccuucaguaaca

SEQ ID NO: 1378938 - RNA, 19 nt, Homo sapiens
gugggaaauccuucaauua

SEQ ID NO: 1378939 - RNA, 19 nt, Homo sapiens
gaagcagcccuauaauugu

SEQ ID NO: 1378940 - RNA, 19 nt, Homo sapiens
gagaaacccuaugaaugug

SEQ ID NO: 1378941 - RNA, 19 nt, Homo sapiens
gggagaaacccuucaagug

SEQ ID NO: 1378942 - RNA, 19 nt, Homo sapiens
gagaaacccuaugaaugug

SEQ ID NO: 1378943 - RNA, 19 nt, Homo sapiens
ccuagaggauuaugaggaa

SEQ ID NO: 1378944 - RNA, 19 nt, Homo sapiens
uaaaugaaaccauccuaga

SEQ ID NO: 1378945 - RNA, 19 nt, Homo sapiens
aagcagaacucuuauaagc

SEQ ID NO: 1378946 - RNA, 19 nt, Homo sapiens
gguccacacuagagagaaa

SEQ ID NO: 1378947 - RNA, 19 nt, Homo sapiens
uuacgaaugugaugagugu

SEQ ID NO: 1378948 - RNA, 19 nt, Homo sapiens
ggaacacaccgucaacaug

SEQ ID NO: 1378949 - RNA, 19 nt, Homo sapiens
gaauuugugaugagggaua

SEQ ID NO: 1378950 - RNA, 19 nt, Homo sapiens
gauagaagcucucaaggau

SEQ ID NO: 1378951 - RNA, 19 nt, Homo sapiens
uagaagcucucaaggauaa

SEQ ID NO: 1378952 - RNA, 19 nt, Homo sapiens
gaaaugaagucugugauag

SEQ ID NO: 1378953 - RNA, 19 nt, Homo sapiens
caaaccagagugaauauua

SEQ ID NO: 1378954 - RNA, 19 nt, Homo sapiens
ugaacaagcugaagaaauc

SEQ ID NO: 1378955 - RNA, 19 nt, Homo sapiens
gaaaguggaaugaaucuga

SEQ ID NO: 1378956 - RNA, 19 nt, Homo sapiens
gaauagaguuggucuggau

SEQ ID NO: 1378957 - RNA, 19 nt, Homo sapiens
gcacuuaauuagccuguau

SEQ ID NO: 1378958 - RNA, 19 nt, Homo sapiens
caagaaagccaaagccaaa

SEQ ID NO: 1378959 - RNA, 19 nt, Homo sapiens
gagaaaugcuggugaaacu

SEQ ID NO: 1378960 - RNA, 19 nt, Homo sapiens
uaucaaggcuauaagagaa

SEQ ID NO: 1378961 - RNA, 19 nt, Homo sapiens
gugaauaaauugcacauag

SEQ ID NO: 1378962 - RNA, 19 nt, Homo sapiens
uaaccuaggacccucauua

SEQ ID NO: 1378963 - RNA, 19 nt, Homo sapiens
gaagaaaugaagucuguga

SEQ ID NO: 1378964 - RNA, 19 nt, Homo sapiens
ugacaagauugcuguggua

SEQ ID NO: 1378965 - RNA, 19 nt, Homo sapiens
uggaagaggugaaugaaga

SEQ ID NO: 1378966 - RNA, 19 nt, Homo sapiens
gaagacagugcaugaaaga

SEQ ID NO: 1378967 - RNA, 19 nt, Homo sapiens
gaauaacaaccacaaagga

SEQ ID NO: 1378968 - RNA, 19 nt, Homo sapiens
caaagaacuccuuggauga

SEQ ID NO: 1378969 - RNA, 19 nt, Homo sapiens
caucaggccuugucuugga

SEQ ID NO: 1378970 - RNA, 19 nt, Homo sapiens
gcagucauauguuguaucg

SEQ ID NO: 1378971 - RNA, 19 nt, Homo sapiens
gaguuggucuggauugaug

SEQ ID NO: 1378972 - RNA, 19 nt, Homo sapiens
ccaaauggccgaugacaca

SEQ ID NO: 1378973 - RNA, 19 nt, Homo sapiens
gaaggaauaacaaccacaa

SEQ ID NO: 1378974 - RNA, 19 nt, Homo sapiens
cacccuaccuuucgcaauu

SEQ ID NO: 1378975 - RNA, 19 nt, Homo sapiens
caacauggccauaggcaau

SEQ ID NO: 1378976 - RNA, 19 nt, Homo sapiens
uaucagacccguuucagaa

SEQ ID NO: 1378977 - RNA, 19 nt, Homo sapiens
aaacagaucagccaaaugg

SEQ ID NO: 1378978 - RNA, 19 nt, Homo sapiens
caacaaggccaaagacucu

SEQ ID NO: 1378979 - RNA, 19 nt, Homo sapiens
guacucaggcauuugcuuu

SEQ ID NO: 1378980 - RNA, 19 nt, Homo sapiens
acagagaaaugcuggugaa

SEQ ID NO: 1378981 - RNA, 19 nt, Homo sapiens
agaaaugaagucugugaua

SEQ ID NO: 1378982 - RNA, 19 nt, Homo sapiens
gaaagacaacauggccaua

SEQ ID NO: 1378983 - RNA, 19 nt, Homo sapiens
gaaguggaagggacgcuaa

SEQ ID NO: 1378984 - RNA, 19 nt, Homo sapiens
ccucagaacuuuguguaau

SEQ ID NO: 1378985 - RNA, 19 nt, Homo sapiens
cuacugcuuuguacgaauu

SEQ ID NO: 1378986 - RNA, 19 nt, Homo sapiens
agaaacagaucagccaaau

SEQ ID NO: 1378987 - RNA, 19 nt, Homo sapiens
ccaaacagaacaccaacaa

SEQ ID NO: 1378988 - RNA, 19 nt, Homo sapiens
aagagaaaguggaaugaau

SEQ ID NO: 1378989 - RNA, 19 nt, Homo sapiens
caagauugcugugguaacu

SEQ ID NO: 1378990 - RNA, 19 nt, Homo sapiens
gacagugcaugaaagacaa

SEQ ID NO: 1378991 - RNA, 19 nt, Homo sapiens
ccaagggacugaggccauu

SEQ ID NO: 1378992 - RNA, 19 nt, Homo sapiens
agaggugaaugaagaaaug

SEQ ID NO: 1378993 - RNA, 19 nt, Homo sapiens
ucacugaggaucuguaugu

SEQ ID NO: 1378994 - RNA, 19 nt, Homo sapiens
caaaggaaagaauagaguu

SEQ ID NO: 1378995 - RNA, 19 nt, Homo sapiens
ggaauaacaaccacaaagg

SEQ ID NO: 1378996 - RNA, 19 nt, Homo sapiens
caaggauugucuucaguca

SEQ ID NO: 1378997 - RNA, 19 nt, Homo sapiens
aaaguggaaugaaucugaa

SEQ ID NO: 1378998 - RNA, 19 nt, Homo sapiens
aaugaagucugugauagaa

SEQ ID NO: 1378999 - RNA, 19 nt, Homo sapiens
ggccuugucuuggauauca

SEQ ID NO: 1379000 - RNA, 19 nt, Homo sapiens
gagaaacagaucagccaaa

SEQ ID NO: 1379001 - RNA, 19 nt, Homo sapiens
gcagcuaucaaggcuauaa

SEQ ID NO: 1379002 - RNA, 19 nt, Homo sapiens
ggaagaggugaaugaagaa

SEQ ID NO: 1379003 - RNA, 19 nt, Homo sapiens
agucauggccuugggauua

SEQ ID NO: 1379004 - RNA, 19 nt, Homo sapiens
ucagacauguucauucucu

SEQ ID NO: 1379005 - RNA, 19 nt, Homo sapiens
gaaacuggccaaacagaac

SEQ ID NO: 1379006 - RNA, 19 nt, Homo sapiens
auaaggaccucaccaggau

SEQ ID NO: 1379007 - RNA, 19 nt, Homo sapiens
ggauauaaucaacuuggaa

SEQ ID NO: 1379008 - RNA, 19 nt, Homo sapiens
uauuaaugcugccuugguu

SEQ ID NO: 1379009 - RNA, 19 nt, Homo sapiens
ugagucgucuucacacaug

SEQ ID NO: 1379010 - RNA, 19 nt, Homo sapiens
gcuaauagagaaacagauc

SEQ ID NO: 1379011 - RNA, 19 nt, Homo sapiens
gucauggccuugggauuaa

SEQ ID NO: 1379012 - RNA, 19 nt, Homo sapiens
gcuauaagagaaaguggaa

SEQ ID NO: 1379013 - RNA, 19 nt, Homo sapiens
ugaagacagugcaugaaag

SEQ ID NO: 1379014 - RNA, 19 nt, Homo sapiens
ggcauuugcuuugacuuga

SEQ ID NO: 1379015 - RNA, 19 nt, Homo sapiens
caaugaacaagcugaagaa

SEQ ID NO: 1379016 - RNA, 19 nt, Homo sapiens
ccaguccuguuuaucauca

SEQ ID NO: 1379017 - RNA, 19 nt, Homo sapiens
ucaaauaauuaggcucugu

SEQ ID NO: 1379018 - RNA, 19 nt, Homo sapiens
gaaacagaucagccaaaug

SEQ ID NO: 1379019 - RNA, 19 nt, Homo sapiens
ccagagagcacagagaaau

SEQ ID NO: 1379020 - RNA, 19 nt, Homo sapiens
gaagaggugaaugaagaaa

SEQ ID NO: 1379021 - RNA, 19 nt, Homo sapiens
uuaauuagccuguauaucc

SEQ ID NO: 1379022 - RNA, 19 nt, Homo sapiens
aggauugucuucagucaug

SEQ ID NO: 1379023 - RNA, 19 nt, Homo sapiens
caaauaauuaggcucuguu

SEQ ID NO: 1379024 - RNA, 19 nt, Homo sapiens
ccaccugcuccucaucuua

SEQ ID NO: 1379025 - RNA, 19 nt, Homo sapiens
gcauuugcuuugacuugau

SEQ ID NO: 1379026 - RNA, 19 nt, Homo sapiens
ucccauggguggcacauug

SEQ ID NO: 1379027 - RNA, 19 nt, Homo sapiens
ucaaugaacaagcugaaga

SEQ ID NO: 1379028 - RNA, 19 nt, Homo sapiens
uguauauccucagaacuuu

SEQ ID NO: 1379029 - RNA, 19 nt, Homo sapiens
ccaaggauacagucucaga

SEQ ID NO: 1379030 - RNA, 19 nt, Homo sapiens
uaaaccagauuagccagau

SEQ ID NO: 1379031 - RNA, 19 nt, Homo sapiens
gaagcucucaaggauaauu

SEQ ID NO: 1379032 - RNA, 19 nt, Homo sapiens
augaagaaaugaagucugu

SEQ ID NO: 1379033 - RNA, 19 nt, Homo sapiens
ccacaaaggaaagaauaga

SEQ ID NO: 1379034 - RNA, 19 nt, Homo sapiens
gaagaccaaagaacuccuu

SEQ ID NO: 1379035 - RNA, 19 nt, Homo sapiens
acaggcaucuggcagugaa

SEQ ID NO: 1379036 - RNA, 19 nt, Homo sapiens
uauaagagaaaguggaaug

SEQ ID NO: 1379037 - RNA, 19 nt, Homo sapiens
ucaccaggaucccuugaca

SEQ ID NO: 1379038 - RNA, 19 nt, Homo sapiens
guauucuuguugcacuuaa

SEQ ID NO: 1379039 - RNA, 19 nt, Homo sapiens
acucagacauguucauucu

SEQ ID NO: 1379040 - RNA, 19 nt, Homo sapiens
gcaccaacucaaugaacaa

SEQ ID NO: 1379041 - RNA, 19 nt, Homo sapiens
aguaggcagucauauguug

SEQ ID NO: 1379042 - RNA, 19 nt, Homo sapiens
gcacccauaacaguaguuu

SEQ ID NO: 1379043 - RNA, 19 nt, Homo sapiens
aaagaacuccuuggaugaa

SEQ ID NO: 1379044 - RNA, 19 nt, Homo sapiens
gaacaccaacaaggccaaa

SEQ ID NO: 1379045 - RNA, 19 nt, Homo sapiens
uaagagaaaguggaaugaa

SEQ ID NO: 1379046 - RNA, 19 nt, Homo sapiens
ugaggcacccauaacagua

SEQ ID NO: 1379047 - RNA, 19 nt, Homo sapiens
agccagaucuccaugaagu

SEQ ID NO: 1379048 - RNA, 19 nt, Homo sapiens
ugauagaagcucucaagga

SEQ ID NO: 1379049 - RNA, 19 nt, Homo sapiens
aauaacaaccacaaaggaa

SEQ ID NO: 1379050 - RNA, 19 nt, Homo sapiens
ggacaccgauuauggauug

SEQ ID NO: 1379051 - RNA, 19 nt, Homo sapiens
ggagcacaaucacauguua

SEQ ID NO: 1379052 - RNA, 19 nt, Homo sapiens
gagaaugcauccauccuuu

SEQ ID NO: 1379053 - RNA, 19 nt, Homo sapiens
cuaauuggcugguugguuu

SEQ ID NO: 1379054 - RNA, 19 nt, Homo sapiens
gcaggaaggacaccgauua

SEQ ID NO: 1379055 - RNA, 19 nt, Homo sapiens
cagaauaaauagcguugua

SEQ ID NO: 1379056 - RNA, 19 nt, Homo sapiens
agaugaugguugugaauua

SEQ ID NO: 1379057 - RNA, 19 nt, Homo sapiens
gauggaagcagaaaccaaa

SEQ ID NO: 1379058 - RNA, 19 nt, Homo sapiens
gaauuacuguagcagcaaa

SEQ ID NO: 1379059 - RNA, 19 nt, Homo sapiens
cagcagcgccuguuuauuc

SEQ ID NO: 1379060 - RNA, 19 nt, Homo sapiens
ccagaaguuuggcaaggua

SEQ ID NO: 1379061 - RNA, 19 nt, Homo sapiens
gaaggacaccgauuaugga

SEQ ID NO: 1379062 - RNA, 19 nt, Homo sapiens
ggaaggacaccgauuaugg

SEQ ID NO: 1379063 - RNA, 19 nt, Homo sapiens
ggacuacuccauauucuag

SEQ ID NO: 1379064 - RNA, 19 nt, Homo sapiens
acaaucacauguuagcauu

SEQ ID NO: 1379065 - RNA, 19 nt, Homo sapiens
aaauuggucuccacaccua

SEQ ID NO: 1379066 - RNA, 19 nt, Homo sapiens
cgaagaugaugguugugaa

SEQ ID NO: 1379067 - RNA, 19 nt, Homo sapiens
caacggagcacaaucacau

SEQ ID NO: 1379068 - RNA, 19 nt, Homo sapiens
gaauaaauagcguuguauc

SEQ ID NO: 1379069 - RNA, 19 nt, Homo sapiens
gcaucauccagaauaaaua

SEQ ID NO: 1379070 - RNA, 19 nt, Homo sapiens
ugagcaucauccagaauaa

SEQ ID NO: 1379071 - RNA, 19 nt, Homo sapiens
ccuaaacuauguauggaau

SEQ ID NO: 1379072 - RNA, 19 nt, Homo sapiens
gaagaugaugguugugaau

SEQ ID NO: 1379073 - RNA, 19 nt, Homo sapiens
gaagcaaaacugaaaauga

SEQ ID NO: 1379074 - RNA, 19 nt, Homo sapiens
uaaaagccauugaagcaaa

SEQ ID NO: 1379075 - RNA, 19 nt, Homo sapiens
ccacaagucaggugcuuug

SEQ ID NO: 1379076 - RNA, 19 nt, Homo sapiens
ucaagcuccuccagaaguu

SEQ ID NO: 1379077 - RNA, 19 nt, Homo sapiens
gaaugcauccauccuuuca

SEQ ID NO: 1379078 - RNA, 19 nt, Homo sapiens
ggagaaugcauccauccuu

SEQ ID NO: 1379079 - RNA, 19 nt, Homo sapiens
ucucgaagaugaugguugu

SEQ ID NO: 1379080 - RNA, 19 nt, Homo sapiens
aaucacauguuagcauuug

SEQ ID NO: 1379081 - RNA, 19 nt, Homo sapiens
gaugaugguugugaauuac

SEQ ID NO: 1379082 - RNA, 19 nt, Homo sapiens
ccacgaguauuucauagac

SEQ ID NO: 1379083 - RNA, 19 nt, Homo sapiens
gggcacaugcucaaguaaa

SEQ ID NO: 1379084 - RNA, 19 nt, Homo sapiens
gcaguuugacuuccucuuc

SEQ ID NO: 1379085 - RNA, 19 nt, Homo sapiens
gcaagguaaagcaguuuga

SEQ ID NO: 1379086 - RNA, 19 nt, Homo sapiens
cagcgccuguuuauuccua

SEQ ID NO: 1379087 - RNA, 19 nt, Homo sapiens
caaguaaagagauaugauc

SEQ ID NO: 1379088 - RNA, 19 nt, Homo sapiens
gagcaucauccagaauaaa

SEQ ID NO: 1379089 - RNA, 19 nt, Homo sapiens
gccgaggccacgaguauuu

SEQ ID NO: 1379090 - RNA, 19 nt, Homo sapiens
ccuacucagucuaaccuaa

SEQ ID NO: 1379091 - RNA, 19 nt, Homo sapiens
ggauuuguaacuccagaaa

SEQ ID NO: 1379092 - RNA, 19 nt, Homo sapiens
gauaaaagccauugaagca

SEQ ID NO: 1379093 - RNA, 19 nt, Homo sapiens
ugaaaaugauggcggaaaa

SEQ ID NO: 1379094 - RNA, 19 nt, Homo sapiens
gcacaugcucaaguaaaga

SEQ ID NO: 1379095 - RNA, 19 nt, Homo sapiens
ggcacaugcucaaguaaag

SEQ ID NO: 1379096 - RNA, 19 nt, Homo sapiens
gguaaagcaguuugacuuc

SEQ ID NO: 1379097 - RNA, 19 nt, Homo sapiens
acccugggaugcucuaauu

SEQ ID NO: 1379098 - RNA, 19 nt, Homo sapiens
uguauggaauugagcauca

SEQ ID NO: 1379099 - RNA, 19 nt, Homo sapiens
aaaggacuacuccauauuc

SEQ ID NO: 1379100 - RNA, 19 nt, Homo sapiens
ccuguuuauuccuacuuua

SEQ ID NO: 1379101 - RNA, 19 nt, Homo sapiens
gcugguugguuuggauuug

SEQ ID NO: 1379102 - RNA, 19 nt, Homo sapiens
cgaggcuacuguuuuguua

SEQ ID NO: 1379103 - RNA, 19 nt, Homo sapiens
uuucuucccuaaacuaugu

SEQ ID NO: 1379104 - RNA, 19 nt, Homo sapiens
uggauguucuuauggaugu

SEQ ID NO: 1379105 - RNA, 19 nt, Homo sapiens
agaugugaaugguacuauu

SEQ ID NO: 1379106 - RNA, 19 nt, Homo sapiens
gccuguuuauuccuacuuu

SEQ ID NO: 1379107 - RNA, 19 nt, Homo sapiens
gcaaaaggcaaauacacaa

SEQ ID NO: 1379108 - RNA, 19 nt, Homo sapiens
augcucaaguaaagagaua

SEQ ID NO: 1379109 - RNA, 19 nt, Homo sapiens
gccauccagugucucaaug

SEQ ID NO: 1379110 - RNA, 19 nt, Homo sapiens
uaaagcaguuugacuuccu

SEQ ID NO: 1379111 - RNA, 19 nt, Homo sapiens
caucauccagaauaaauag

SEQ ID NO: 1379112 - RNA, 19 nt, Homo sapiens
aaaaucgucugccugugua

SEQ ID NO: 1379113 - RNA, 19 nt, Homo sapiens
caggaaggacaccgauuau

SEQ ID NO: 1379114 - RNA, 19 nt, Homo sapiens
ggccacgaguauuucauag

SEQ ID NO: 1379115 - RNA, 19 nt, Homo sapiens
acuuuaagccaccagauaa

SEQ ID NO: 1379116 - RNA, 19 nt, Homo sapiens
gcucaaguaaagagauaug

SEQ ID NO: 1379117 - RNA, 19 nt, Homo sapiens
gcagaaaccaaaacucuuc

SEQ ID NO: 1379118 - RNA, 19 nt, Homo sapiens
uugagcaucauccagaaua

SEQ ID NO: 1379119 - RNA, 19 nt, Homo sapiens
augcauccauccuuucaga

SEQ ID NO: 1379120 - RNA, 19 nt, Homo sapiens
caaccuggaccccaaaauu

SEQ ID NO: 1379121 - RNA, 19 nt, Homo sapiens
gcgaugggcacaugcucaa

SEQ ID NO: 1379122 - RNA, 19 nt, Homo sapiens
guacuuuguagaugugaau

SEQ ID NO: 1379123 - RNA, 19 nt, Homo sapiens
uagaacagcauggaaaucu

SEQ ID NO: 1379124 - RNA, 19 nt, Homo sapiens
uacuuuaagccaccagaua

SEQ ID NO: 1379125 - RNA, 19 nt, Homo sapiens
auuuguaacuccagaaaca

SEQ ID NO: 1379126 - RNA, 19 nt, Homo sapiens
cgaauaccaccuccucaag

SEQ ID NO: 1379127 - RNA, 19 nt, Homo sapiens
gaguauuucauagacauug

SEQ ID NO: 1379128 - RNA, 19 nt, Homo sapiens
gauguucuuauggauguuu

SEQ ID NO: 1379129 - RNA, 19 nt, Homo sapiens
gagcacaaucacauguuag

SEQ ID NO: 1379130 - RNA, 19 nt, Homo sapiens
guagaugugaaugguacua

SEQ ID NO: 1379131 - RNA, 19 nt, Homo sapiens
caagccauccagugucuca

SEQ ID NO: 1379132 - RNA, 19 nt, Homo sapiens
gaaguuuggcaagguaaag

SEQ ID NO: 1379133 - RNA, 19 nt, Homo sapiens
agcguuguaucccaaauug

SEQ ID NO: 1379134 - RNA, 19 nt, Homo sapiens
gauuauggauuggcaaccu

SEQ ID NO: 1379135 - RNA, 19 nt, Homo sapiens
guugugaauuacuguagca

SEQ ID NO: 1379136 - RNA, 19 nt, Homo sapiens
ccgaauaccaccuccucaa

SEQ ID NO: 1379137 - RNA, 19 nt, Homo sapiens
augggcacaugcucaagua

SEQ ID NO: 1379138 - RNA, 19 nt, Homo sapiens
gaugggcacaugcucaagu

SEQ ID NO: 1379139 - RNA, 19 nt, Homo sapiens
aauugagcaucauccagaa

SEQ ID NO: 1379140 - RNA, 19 nt, Homo sapiens
caaucacauguuagcauuu

SEQ ID NO: 1379141 - RNA, 19 nt, Homo sapiens
cagucuaaccuaaguguca

SEQ ID NO: 1379142 - RNA, 19 nt, Homo sapiens
uccucaagcuccuccagaa

SEQ ID NO: 1379143 - RNA, 19 nt, Homo sapiens
uuucauagacauugaugga

SEQ ID NO: 1379144 - RNA, 19 nt, Homo sapiens
acuacuccauauucuagaa

SEQ ID NO: 1379145 - RNA, 19 nt, Homo sapiens
gugucucaauggcaaguug

SEQ ID NO: 1379146 - RNA, 19 nt, Homo sapiens
ccucgaggcuacuguuuug

SEQ ID NO: 1379147 - RNA, 19 nt, Homo sapiens
caaaaggcaaauacacaaa

SEQ ID NO: 1379148 - RNA, 19 nt, Homo sapiens
ugguugguuuggauuugua

SEQ ID NO: 1379149 - RNA, 19 nt, Homo sapiens
gcaaagauaaaagccauug

SEQ ID NO: 1379150 - RNA, 19 nt, Homo sapiens
gaaaugcccuggagugugu

SEQ ID NO: 1379151 - RNA, 19 nt, Homo sapiens
gaacaggaggaauuaaaua

SEQ ID NO: 1379152 - RNA, 19 nt, Homo sapiens
guucagaaguuaacaaaga

SEQ ID NO: 1379153 - RNA, 19 nt, Homo sapiens
gaaagaagagguucgagaa

SEQ ID NO: 1379154 - RNA, 19 nt, Homo sapiens
uggcagaacuugaagaauu

SEQ ID NO: 1379155 - RNA, 19 nt, Homo sapiens
gaagaaacccugucuguac

SEQ ID NO: 1379156 - RNA, 19 nt, Homo sapiens
aaacauggaucugaacaaa

SEQ ID NO: 1379157 - RNA, 19 nt, Homo sapiens
gaauaagcgagcugcauua

SEQ ID NO: 1379158 - RNA, 19 nt, Homo sapiens
gaaacaagaguaccuggaa

SEQ ID NO: 1379159 - RNA, 19 nt, Homo sapiens
agaaacagcucacucagau

SEQ ID NO: 1379160 - RNA, 19 nt, Homo sapiens
gaaacccugucuguacuaa

SEQ ID NO: 1379161 - RNA, 19 nt, Homo sapiens
caggaggaauuaaauaaga

SEQ ID NO: 1379162 - RNA, 19 nt, Homo sapiens
ggauaucgcccaagaaauc

SEQ ID NO: 1379163 - RNA, 19 nt, Homo sapiens
ggcagaacuugaagaauug

SEQ ID NO: 1379164 - RNA, 19 nt, Homo sapiens
caagaaaucucagaagcau

SEQ ID NO: 1379165 - RNA, 19 nt, Homo sapiens
gagaagcccuggagaacuc

SEQ ID NO: 1379166 - RNA, 19 nt, Homo sapiens
gcacuaaagagaaagaaga

SEQ ID NO: 1379167 - RNA, 19 nt, Homo sapiens
uuaccaaguucagaaguua

SEQ ID NO: 1379168 - RNA, 19 nt, Homo sapiens
ccacagcaaugagcaaguu

SEQ ID NO: 1379169 - RNA, 19 nt, Homo sapiens
aaacaagaguaccuggaaa

SEQ ID NO: 1379170 - RNA, 19 nt, Homo sapiens
cagcacagccaaauagaaa

SEQ ID NO: 1379171 - RNA, 19 nt, Homo sapiens
ucacagagcaacaggauau

SEQ ID NO: 1379172 - RNA, 19 nt, Homo sapiens
caaaagcgaugaaaucugu

SEQ ID NO: 1379173 - RNA, 19 nt, Homo sapiens
caaaugugccuuccucuuc

SEQ ID NO: 1379174 - RNA, 19 nt, Homo sapiens
aaacagcucacucagauug

SEQ ID NO: 1379175 - RNA, 19 nt, Homo sapiens
uaagcgagcugcauuacag

SEQ ID NO: 1379176 - RNA, 19 nt, Homo sapiens
gaagaagaggaugaugaua

SEQ ID NO: 1379177 - RNA, 19 nt, Homo sapiens
ggaacaggaggaauuaaau

SEQ ID NO: 1379178 - RNA, 19 nt, Homo sapiens
gagaaacagcucacucaga

SEQ ID NO: 1379179 - RNA, 19 nt, Homo sapiens
agaagaggaugaugauauc

SEQ ID NO: 1379180 - RNA, 19 nt, Homo sapiens
acaaauauccgccuuccaa

SEQ ID NO: 1379181 - RNA, 19 nt, Homo sapiens
uagaugauuugaugcaaga

SEQ ID NO: 1379182 - RNA, 19 nt, Homo sapiens
ccauugaguuccagagaga

SEQ ID NO: 1379183 - RNA, 19 nt, Homo sapiens
cagaagaagaggaugauga

SEQ ID NO: 1379184 - RNA, 19 nt, Homo sapiens
caggauaucgcccaagaaa

SEQ ID NO: 1379185 - RNA, 19 nt, Homo sapiens
caggacgacuuguugauuc

SEQ ID NO: 1379186 - RNA, 19 nt, Homo sapiens
cacgguaucucaugccuau

SEQ ID NO: 1379187 - RNA, 19 nt, Homo sapiens
gugcauacauagaaucagu

SEQ ID NO: 1379188 - RNA, 19 nt, Homo sapiens
ugaagaaacccugucugua

SEQ ID NO: 1379189 - RNA, 19 nt, Homo sapiens
aagaagaggaugaugauau

SEQ ID NO: 1379190 - RNA, 19 nt, Homo sapiens
gauggcagaacuugaagaa

SEQ ID NO: 1379191 - RNA, 19 nt, Homo sapiens
uggcuuuggugaugacuuu

SEQ ID NO: 1379192 - RNA, 19 nt, Homo sapiens
agaagagguucgagaaaca

SEQ ID NO: 1379193 - RNA, 19 nt, Homo sapiens
gaugauaucaaacaauugg

SEQ ID NO: 1379194 - RNA, 19 nt, Homo sapiens
uacaggcacuaaagagaaa

SEQ ID NO: 1379195 - RNA, 19 nt, Homo sapiens
ccuauaaucccagcacuuu

SEQ ID NO: 1379196 - RNA, 19 nt, Homo sapiens
ucagauugauggcacacuu

SEQ ID NO: 1379197 - RNA, 19 nt, Homo sapiens
gaaaucgcccuggccaaga

SEQ ID NO: 1379198 - RNA, 19 nt, Homo sapiens
gaucacagagcaacaggau

SEQ ID NO: 1379199 - RNA, 19 nt, Homo sapiens
caaauauccgccuuccaaa

SEQ ID NO: 1379200 - RNA, 19 nt, Homo sapiens
gaaacagcucacucagauu

SEQ ID NO: 1379201 - RNA, 19 nt, Homo sapiens
ggagaugcugggcaagaaa

SEQ ID NO: 1379202 - RNA, 19 nt, Homo sapiens
gcacacuuucuaccauuga

SEQ ID NO: 1379203 - RNA, 19 nt, Homo sapiens
agaauaagcgagcugcauu

SEQ ID NO: 1379204 - RNA, 19 nt, Homo sapiens
gcauacauagaaucaguga

SEQ ID NO: 1379205 - RNA, 19 nt, Homo sapiens
gggcagaagaagaggauga

SEQ ID NO: 1379206 - RNA, 19 nt, Homo sapiens
caaguugggcaaguucuuu

SEQ ID NO: 1379207 - RNA, 19 nt, Homo sapiens
uaaagagaaagaagagguu

SEQ ID NO: 1379208 - RNA, 19 nt, Homo sapiens
aaaucgcccuggccaagaa

SEQ ID NO: 1379209 - RNA, 19 nt, Homo sapiens
aaucgaauccagagagaaa

SEQ ID NO: 1379210 - RNA, 19 nt, Homo sapiens
ccuccgaacuccacagcaa

SEQ ID NO: 1379211 - RNA, 19 nt, Homo sapiens
guugauggcagaacuugaa

SEQ ID NO: 1379212 - RNA, 19 nt, Homo sapiens
aaagaagagguucgagaaa

SEQ ID NO: 1379213 - RNA, 19 nt, Homo sapiens
aagcacggcacgcagaaua

SEQ ID NO: 1379214 - RNA, 19 nt, Homo sapiens
gcauuacaggcacuaaaga

SEQ ID NO: 1379215 - RNA, 19 nt, Homo sapiens
gagagaagcccuggagaac

SEQ ID NO: 1379216 - RNA, 19 nt, Homo sapiens
cgguaucucaugccuauaa

SEQ ID NO: 1379217 - RNA, 19 nt, Homo sapiens
aacaggauaucgcccaaga

SEQ ID NO: 1379218 - RNA, 19 nt, Homo sapiens
uuacaggcacuaaagagaa

SEQ ID NO: 1379219 - RNA, 19 nt, Homo sapiens
gaggagaugcugggcaaga

SEQ ID NO: 1379220 - RNA, 19 nt, Homo sapiens
ugagcaaguugggcaaguu

SEQ ID NO: 1379221 - RNA, 19 nt, Homo sapiens
gcaaguugggcaaguucuu

SEQ ID NO: 1379222 - RNA, 19 nt, Homo sapiens
aauauccgccuuccaaaug

SEQ ID NO: 1379223 - RNA, 19 nt, Homo sapiens
ccaagaaaucucagaagca

SEQ ID NO: 1379224 - RNA, 19 nt, Homo sapiens
uggcacacuuucuaccauu

SEQ ID NO: 1379225 - RNA, 19 nt, Homo sapiens
gcaguugagaccaggaguu

SEQ ID NO: 1379226 - RNA, 19 nt, Homo sapiens
gguaucucaugccuauaau

SEQ ID NO: 1379227 - RNA, 19 nt, Homo sapiens
ccagagggcagaagaagag

SEQ ID NO: 1379228 - RNA, 19 nt, Homo sapiens
uggaacaggaggaauuaaa

SEQ ID NO: 1379229 - RNA, 19 nt, Homo sapiens
agagagaagcccuggagaa

SEQ ID NO: 1379230 - RNA, 19 nt, Homo sapiens
aagaagagguucgagaaac

SEQ ID NO: 1379231 - RNA, 19 nt, Homo sapiens
gcaagaaacaagaguaccu

SEQ ID NO: 1379232 - RNA, 19 nt, Homo sapiens
ccaaaugugccuuccucuu

SEQ ID NO: 1379233 - RNA, 19 nt, Homo sapiens
gaacucacacaccaacacu

SEQ ID NO: 1379234 - RNA, 19 nt, Homo sapiens
ggcacacuuucuaccauug

SEQ ID NO: 1379235 - RNA, 19 nt, Homo sapiens
ccaggacgacuuguugauu

SEQ ID NO: 1379236 - RNA, 19 nt, Homo sapiens
agaagaagaggaugaugau

SEQ ID NO: 1379237 - RNA, 19 nt, Homo sapiens
cggguuggcuuuggugaug

SEQ ID NO: 1379238 - RNA, 19 nt, Homo sapiens
gagcaaguugggcaaguuc

SEQ ID NO: 1379239 - RNA, 19 nt, Homo sapiens
aagaaacccugucuguacu

SEQ ID NO: 1379240 - RNA, 19 nt, Homo sapiens
ugaugaggaugaguugaug

SEQ ID NO: 1379241 - RNA, 19 nt, Homo sapiens
guuuuaagccuccuaagua

SEQ ID NO: 1379242 - RNA, 19 nt, Homo sapiens
aaaugugccuuccucuucu

SEQ ID NO: 1379243 - RNA, 19 nt, Homo sapiens
gaugauuugaugcaagaga

SEQ ID NO: 1379244 - RNA, 19 nt, Homo sapiens
caaguucagaaguuaacaa

SEQ ID NO: 1379245 - RNA, 19 nt, Homo sapiens
gggaaaugcccuggagugu

SEQ ID NO: 1379246 - RNA, 19 nt, Homo sapiens
gcaagagaucacagagcaa

SEQ ID NO: 1379247 - RNA, 19 nt, Homo sapiens
acauggaucugaacaaaau

SEQ ID NO: 1379248 - RNA, 19 nt, Homo sapiens
ugaccaacaugaagaaacc

SEQ ID NO: 1379249 - RNA, 19 nt, Homo sapiens
ccagcacagccaaauagaa

SEQ ID NO: 1379250 - RNA, 19 nt, Homo sapiens
gguaauagcuucuggcuua

SEQ ID NO: 1379251 - RNA, 19 nt, Homo sapiens
ggaacaugcuuuagaguua

SEQ ID NO: 1379252 - RNA, 19 nt, Homo sapiens
ugaaagcacugaaacauuu

SEQ ID NO: 1379253 - RNA, 19 nt, Homo sapiens
gaagaaauccugaaacaga

SEQ ID NO: 1379254 - RNA, 19 nt, Homo sapiens
ggaagaagauguugcuguu

SEQ ID NO: 1379255 - RNA, 19 nt, Homo sapiens
ggaaaugauugaagugauu

SEQ ID NO: 1379256 - RNA, 19 nt, Homo sapiens
gaucaaaccugcagaugug

SEQ ID NO: 1379257 - RNA, 19 nt, Homo sapiens
gagaagaaauccugaaaca

SEQ ID NO: 1379258 - RNA, 19 nt, Homo sapiens
uaaauacucucguuaccua

SEQ ID NO: 1379259 - RNA, 19 nt, Homo sapiens
cgagaucaaugaaccuuua

SEQ ID NO: 1379260 - RNA, 19 nt, Homo sapiens
agaagaagaugaugaagaa

SEQ ID NO: 1379261 - RNA, 19 nt, Homo sapiens
gaucagaauuguauacuca

SEQ ID NO: 1379262 - RNA, 19 nt, Homo sapiens
caaugaaccuuuagaugaa

SEQ ID NO: 1379263 - RNA, 19 nt, Homo sapiens
gaacaugcuuuagaguuau

SEQ ID NO: 1379264 - RNA, 19 nt, Homo sapiens
gguaaugcauccugaguga

SEQ ID NO: 1379265 - RNA, 19 nt, Homo sapiens
ucgagacccuuucuucuua

SEQ ID NO: 1379266 - RNA, 19 nt, Homo sapiens
gaacaggaaucugaguaug

SEQ ID NO: 1379267 - RNA, 19 nt, Homo sapiens
gaacagaaacgccuaagag

SEQ ID NO: 1379268 - RNA, 19 nt, Homo sapiens
gaaagggagcgacagcaua

SEQ ID NO: 1379269 - RNA, 19 nt, Homo sapiens
agaaucagaugaagaagaa

SEQ ID NO: 1379270 - RNA, 19 nt, Homo sapiens
ucaaugaaccuuuagauga

SEQ ID NO: 1379271 - RNA, 19 nt, Homo sapiens
gauaauacauuugcucauc

SEQ ID NO: 1379272 - RNA, 19 nt, Homo sapiens
gaacuguuguuucucuuuc

SEQ ID NO: 1379273 - RNA, 19 nt, Homo sapiens
gcuguucacugguuauuug

SEQ ID NO: 1379274 - RNA, 19 nt, Homo sapiens
ccaaauagaauauguggaa

SEQ ID NO: 1379275 - RNA, 19 nt, Homo sapiens
gaacugguuuaucacaaau

SEQ ID NO: 1379276 - RNA, 19 nt, Homo sapiens
gaacauuccagaaacuuug

SEQ ID NO: 1379277 - RNA, 19 nt, Homo sapiens
caaagaagaaucagaugaa

SEQ ID NO: 1379278 - RNA, 19 nt, Homo sapiens
gacagaagaccaaauagaa

SEQ ID NO: 1379279 - RNA, 19 nt, Homo sapiens
ggaaagaaggaacaauuau

SEQ ID NO: 1379280 - RNA, 19 nt, Homo sapiens
cagaagaccaaauagaaua

SEQ ID NO: 1379281 - RNA, 19 nt, Homo sapiens
aaaguuaccucuguuauag

SEQ ID NO: 1379282 - RNA, 19 nt, Homo sapiens
gagugaaccuccagggaaa

SEQ ID NO: 1379283 - RNA, 19 nt, Homo sapiens
gcauacaccuggaccuguu

SEQ ID NO: 1379284 - RNA, 19 nt, Homo sapiens
ggacaucaaagaagaauca

SEQ ID NO: 1379285 - RNA, 19 nt, Homo sapiens
gaguuugucugcauaccua

SEQ ID NO: 1379286 - RNA, 19 nt, Homo sapiens
ccacgaagcugaguugaca

SEQ ID NO: 1379287 - RNA, 19 nt, Homo sapiens
gcagagugauaaugaagau

SEQ ID NO: 1379288 - RNA, 19 nt, Homo sapiens
cacaaagccuggcgugaaa

SEQ ID NO: 1379289 - RNA, 19 nt, Homo sapiens
augaagagcuaaaugauga

SEQ ID NO: 1379290 - RNA, 19 nt, Homo sapiens
gcucucagauguaacuaga

SEQ ID NO: 1379291 - RNA, 19 nt, Homo sapiens
gcuuuagaguuaugaguuu

SEQ ID NO: 1379292 - RNA, 19 nt, Homo sapiens
aggaugaacugguuuauca

SEQ ID NO: 1379293 - RNA, 19 nt, Homo sapiens
ggucacgccuguucaagug

SEQ ID NO: 1379294 - RNA, 19 nt, Homo sapiens
aaaccaggaugucaguauu

SEQ ID NO: 1379295 - RNA, 19 nt, Homo sapiens
uaucuaggguguuaaagga

SEQ ID NO: 1379296 - RNA, 19 nt, Homo sapiens
ccaagaacauacacaucaa

SEQ ID NO: 1379297 - RNA, 19 nt, Homo sapiens
gcacaugccuccccagcua

SEQ ID NO: 1379298 - RNA, 19 nt, Homo sapiens
ccacagaccugcgcugcuu

SEQ ID NO: 1379299 - RNA, 19 nt, Homo sapiens
caggagguauggaaacauu

SEQ ID NO: 1379300 - RNA, 19 nt, Homo sapiens
ugaacugguuuaucacaaa

SEQ ID NO: 1379301 - RNA, 19 nt, Homo sapiens
ugacaacacuaacgaccaa

SEQ ID NO: 1379302 - RNA, 19 nt, Homo sapiens
cagcacaagugaaaccuau

SEQ ID NO: 1379303 - RNA, 19 nt, Homo sapiens
cuacagggaacaugcuuua

SEQ ID NO: 1379304 - RNA, 19 nt, Homo sapiens
gagaacaggaaucugagua

SEQ ID NO: 1379305 - RNA, 19 nt, Homo sapiens
gcuuaaagauagaagaaca

SEQ ID NO: 1379306 - RNA, 19 nt, Homo sapiens
ggacaauucaauccuagaa

SEQ ID NO: 1379307 - RNA, 19 nt, Homo sapiens
ccagaaacuuuggagcuuu

SEQ ID NO: 1379308 - RNA, 19 nt, Homo sapiens
aggagcagcuuuacacuga

SEQ ID NO: 1379309 - RNA, 19 nt, Homo sapiens
gagaggaugaacugguuua

SEQ ID NO: 1379310 - RNA, 19 nt, Homo sapiens
gaagaacagaaacgccuaa

SEQ ID NO: 1379311 - RNA, 19 nt, Homo sapiens
gggaaagacggaagugaaa

SEQ ID NO: 1379312 - RNA, 19 nt, Homo sapiens
cccaggcccuccagaauuu

SEQ ID NO: 1379313 - RNA, 19 nt, Homo sapiens
agaagaaucagaugaagaa

SEQ ID NO: 1379314 - RNA, 19 nt, Homo sapiens
guugacagaagaccaaaua

SEQ ID NO: 1379315 - RNA, 19 nt, Homo sapiens
gaagaaggacaguaugaag

SEQ ID NO: 1379316 - RNA, 19 nt, Homo sapiens
cagaggaggagcagcuuua

SEQ ID NO: 1379317 - RNA, 19 nt, Homo sapiens
gaagcugaguugacagaag

SEQ ID NO: 1379318 - RNA, 19 nt, Homo sapiens
aagaaauccugaaacagaa

SEQ ID NO: 1379319 - RNA, 19 nt, Homo sapiens
aaagggagcgacagcauaa

SEQ ID NO: 1379320 - RNA, 19 nt, Homo sapiens
gagcagcuuuacacugaug

SEQ ID NO: 1379321 - RNA, 19 nt, Homo sapiens
caacaugcaguaucaagga

SEQ ID NO: 1379322 - RNA, 19 nt, Homo sapiens
gaaagacggaagugaaagu

SEQ ID NO: 1379323 - RNA, 19 nt, Homo sapiens
aagaagauguugcuguuca

SEQ ID NO: 1379324 - RNA, 19 nt, Homo sapiens
cauuugaacucucugacaa

SEQ ID NO: 1379325 - RNA, 19 nt, Homo sapiens
gaugaagagcuaaaugaug

SEQ ID NO: 1379326 - RNA, 19 nt, Homo sapiens
cagaugaagagcuaaauga

SEQ ID NO: 1379327 - RNA, 19 nt, Homo sapiens
acaggaaucugaguaugaa

SEQ ID NO: 1379328 - RNA, 19 nt, Homo sapiens
ucucaggguguuacaauua

SEQ ID NO: 1379329 - RNA, 19 nt, Homo sapiens
uggcaugguuacaucauuu

SEQ ID NO: 1379330 - RNA, 19 nt, Homo sapiens
gugccaacaugcaguauca

SEQ ID NO: 1379331 - RNA, 19 nt, Homo sapiens
acauagcgaugguaaacuu

SEQ ID NO: 1379332 - RNA, 19 nt, Homo sapiens
acaauuagucugaaugcua

SEQ ID NO: 1379333 - RNA, 19 nt, Homo sapiens
aagcugaguugacagaaga

SEQ ID NO: 1379334 - RNA, 19 nt, Homo sapiens
cgaccaaucuggagaacag

SEQ ID NO: 1379335 - RNA, 19 nt, Homo sapiens
cauaauacaacuucucaga

SEQ ID NO: 1379336 - RNA, 19 nt, Homo sapiens
gcauguguguauacugguu

SEQ ID NO: 1379337 - RNA, 19 nt, Homo sapiens
ucaaagaagaaucagauga

SEQ ID NO: 1379338 - RNA, 19 nt, Homo sapiens
gaaagcacugaaacauuug

SEQ ID NO: 1379339 - RNA, 19 nt, Homo sapiens
cagaaacgccuaagagaag

SEQ ID NO: 1379340 - RNA, 19 nt, Homo sapiens
gggaacaugcuuuagaguu

SEQ ID NO: 1379341 - RNA, 19 nt, Homo sapiens
ggacauguuuugauaauac

SEQ ID NO: 1379342 - RNA, 19 nt, Homo sapiens
caucaacccgcacuucaaa

SEQ ID NO: 1379343 - RNA, 19 nt, Homo sapiens
gcccuaagaugacauaagc

SEQ ID NO: 1379344 - RNA, 19 nt, Homo sapiens
aggaaagaaggaacaauua

SEQ ID NO: 1379345 - RNA, 19 nt, Homo sapiens
ugacagaagaccaaauaga

SEQ ID NO: 1379346 - RNA, 19 nt, Homo sapiens
auaaagugcucccgaucaa

SEQ ID NO: 1379347 - RNA, 19 nt, Homo sapiens
gaugaaagcacugaaacau

SEQ ID NO: 1379348 - RNA, 19 nt, Homo sapiens
gaaaggaaagaaggaacaa

SEQ ID NO: 1379349 - RNA, 19 nt, Homo sapiens
caucaaagaagaaucagau

SEQ ID NO: 1379350 - RNA, 19 nt, Homo sapiens
gaucauagauacaggauua

SEQ ID NO: 1379351 - RNA, 19 nt, Homo sapiens
gaaaguagguagagugauu

SEQ ID NO: 1379352 - RNA, 19 nt, Homo sapiens
gaagaaguauuccucagua

SEQ ID NO: 1379353 - RNA, 19 nt, Homo sapiens
uggaauagaugaagaagua

SEQ ID NO: 1379354 - RNA, 19 nt, Homo sapiens
gagaaacgcgccuuaauuu

SEQ ID NO: 1379355 - RNA, 19 nt, Homo sapiens
ugaaggaucugaacucuga

SEQ ID NO: 1379356 - RNA, 19 nt, Homo sapiens
ggacgauacuuauuuacaa

SEQ ID NO: 1379357 - RNA, 19 nt, Homo sapiens
gaucugaacucugauauag

SEQ ID NO: 1379358 - RNA, 19 nt, Homo sapiens
gcacuugccauguuauaua

SEQ ID NO: 1379359 - RNA, 19 nt, Homo sapiens
gcaacugccuaugagauua

SEQ ID NO: 1379360 - RNA, 19 nt, Homo sapiens
ggagaaacgcgccuuaauu

SEQ ID NO: 1379361 - RNA, 19 nt, Homo sapiens
gcuggacgauacuuauuua

SEQ ID NO: 1379362 - RNA, 19 nt, Homo sapiens
aaacuaccauuccgaaauu

SEQ ID NO: 1379363 - RNA, 19 nt, Homo sapiens
guggauaucuuaacuuaug

SEQ ID NO: 1379364 - RNA, 19 nt, Homo sapiens
caguggauaucuuaacuua

SEQ ID NO: 1379365 - RNA, 19 nt, Homo sapiens
gaaacgcgccuuaauuuag

SEQ ID NO: 1379366 - RNA, 19 nt, Homo sapiens
ggauguagguauuuauugu

SEQ ID NO: 1379367 - RNA, 19 nt, Homo sapiens
uaacuuauguagcuuggaa

SEQ ID NO: 1379368 - RNA, 19 nt, Homo sapiens
gcuaucagcaucuuauuaa

SEQ ID NO: 1379369 - RNA, 19 nt, Homo sapiens
gaaguauuccucaguauuc

SEQ ID NO: 1379370 - RNA, 19 nt, Homo sapiens
aaaguaggauguagguauu

SEQ ID NO: 1379371 - RNA, 19 nt, Homo sapiens
caacauggcagcccuuuca

SEQ ID NO: 1379372 - RNA, 19 nt, Homo sapiens
ugauaaagauccugagcaa

SEQ ID NO: 1379373 - RNA, 19 nt, Homo sapiens
uagcagcacuugccauguu

SEQ ID NO: 1379374 - RNA, 19 nt, Homo sapiens
gaagaagaggcccaucuga

SEQ ID NO: 1379375 - RNA, 19 nt, Homo sapiens
gagaauacauccaguuucc

SEQ ID NO: 1379376 - RNA, 19 nt, Homo sapiens
ccaguuuccaccauaauua

SEQ ID NO: 1379377 - RNA, 19 nt, Homo sapiens
gaaauguggccaucuucaa

SEQ ID NO: 1379378 - RNA, 19 nt, Homo sapiens
gugaugaacuugcccuugu

SEQ ID NO: 1379379 - RNA, 19 nt, Homo sapiens
gacgauggaucuucaacau

SEQ ID NO: 1379380 - RNA, 19 nt, Homo sapiens
agaagaggcccaucugaaa

SEQ ID NO: 1379381 - RNA, 19 nt, Homo sapiens
ucugaaagcugccauggau

SEQ ID NO: 1379382 - RNA, 19 nt, Homo sapiens
agaaacgcgccuuaauuua

SEQ ID NO: 1379383 - RNA, 19 nt, Homo sapiens
ggaaacaggaaaguaggua

SEQ ID NO: 1379384 - RNA, 19 nt, Homo sapiens
gauacaggauuauauaacg

SEQ ID NO: 1379385 - RNA, 19 nt, Homo sapiens
ucugaacucugauauagga

SEQ ID NO: 1379386 - RNA, 19 nt, Homo sapiens
cauggagacucaaguguuc

SEQ ID NO: 1379387 - RNA, 19 nt, Homo sapiens
uuauguagcuuggaaguug

SEQ ID NO: 1379388 - RNA, 19 nt, Homo sapiens
gcuauuucuuucauucuug

SEQ ID NO: 1379389 - RNA, 19 nt, Homo sapiens
auaaagauccugagcaaug

SEQ ID NO: 1379390 - RNA, 19 nt, Homo sapiens
gaagagaucauagauacag

SEQ ID NO: 1379391 - RNA, 19 nt, Homo sapiens
aaacgcgccuuaauuuagu

SEQ ID NO: 1379392 - RNA, 19 nt, Homo sapiens
ucacgaaaaugccaaauau

SEQ ID NO: 1379393 - RNA, 19 nt, Homo sapiens
cuagaaauuccgacucuuu

SEQ ID NO: 1379394 - RNA, 19 nt, Homo sapiens
gauggaaacaggaaaguag

SEQ ID NO: 1379395 - RNA, 19 nt, Homo sapiens
uugaagagaucauagauac

SEQ ID NO: 1379396 - RNA, 19 nt, Homo sapiens
ggaucugaacucugauaua

SEQ ID NO: 1379397 - RNA, 19 nt, Homo sapiens
gcauggagacucaaguguu

SEQ ID NO: 1379398 - RNA, 19 nt, Homo sapiens
cgaaauuauugaagagauc

SEQ ID NO: 1379399 - RNA, 19 nt, Homo sapiens
guggccaucuucaaguuaa

SEQ ID NO: 1379400 - RNA, 19 nt, Homo sapiens
gcaggugcacgccaagaaa

SEQ ID NO: 1379401 - RNA, 19 nt, Homo sapiens
cauccaguuuccaccauaa

SEQ ID NO: 1379402 - RNA, 19 nt, Homo sapiens
ugacugcaacugccuauga

SEQ ID NO: 1379403 - RNA, 19 nt, Homo sapiens
ugagcaagauggcgacugu

SEQ ID NO: 1379404 - RNA, 19 nt, Homo sapiens
aguaaggucuccaucauag

SEQ ID NO: 1379405 - RNA, 19 nt, Homo sapiens
aguaggauguagguauuua

SEQ ID NO: 1379406 - RNA, 19 nt, Homo sapiens
gccuaucuguggccgauuu

SEQ ID NO: 1379407 - RNA, 19 nt, Homo sapiens
gaacucugauauaggaacu

SEQ ID NO: 1379408 - RNA, 19 nt, Homo sapiens
gugagacgauggaucuuca

SEQ ID NO: 1379409 - RNA, 19 nt, Homo sapiens
uuaagggccucuauggaau

SEQ ID NO: 1379410 - RNA, 19 nt, Homo sapiens
uaaagauccugagcaaugg

SEQ ID NO: 1379411 - RNA, 19 nt, Homo sapiens
uuaaaaggcuugagugaug

SEQ ID NO: 1379412 - RNA, 19 nt, Homo sapiens
gagaagcccguucaucaca

SEQ ID NO: 1379413 - RNA, 19 nt, Homo sapiens
ccgagaagcccguucauca

SEQ ID NO: 1379414 - RNA, 19 nt, Homo sapiens
uaagggccucuauggaaua

SEQ ID NO: 1379415 - RNA, 19 nt, Homo sapiens
ucugauauaggaacugaua

SEQ ID NO: 1379416 - RNA, 19 nt, Homo sapiens
gcaagauggcgacugugaa

SEQ ID NO: 1379417 - RNA, 19 nt, Homo sapiens
gugaagagugagcuuauug

SEQ ID NO: 1379418 - RNA, 19 nt, Homo sapiens
ggugggagcgaauuuccua

SEQ ID NO: 1379419 - RNA, 19 nt, Homo sapiens
uagcuggugucccuuugaa

SEQ ID NO: 1379420 - RNA, 19 nt, Homo sapiens
gggagaaacgcgccuuaau

SEQ ID NO: 1379421 - RNA, 19 nt, Homo sapiens
acaguaaggucuccaucau

SEQ ID NO: 1379422 - RNA, 19 nt, Homo sapiens
gaagaggcccaucugaaaa

SEQ ID NO: 1379423 - RNA, 19 nt, Homo sapiens
ggagaauacauccaguuuc

SEQ ID NO: 1379424 - RNA, 19 nt, Homo sapiens
gagcauggagacucaagug

SEQ ID NO: 1379425 - RNA, 19 nt, Homo sapiens
gcaaacuccaaccuaguga

SEQ ID NO: 1379426 - RNA, 19 nt, Homo sapiens
gaagcccguucaucacagu

SEQ ID NO: 1379427 - RNA, 19 nt, Homo sapiens
caguaaggucuccaucaua

SEQ ID NO: 1379428 - RNA, 19 nt, Homo sapiens
cacuugccauguuauauau

SEQ ID NO: 1379429 - RNA, 19 nt, Homo sapiens
ugaaagguuauacuucuug

SEQ ID NO: 1379430 - RNA, 19 nt, Homo sapiens
ggaguggagugaacauagc

SEQ ID NO: 1379431 - RNA, 19 nt, Homo sapiens
uuaauuuaguccagcgaaa

SEQ ID NO: 1379432 - RNA, 19 nt, Homo sapiens
ggcauggccugcgcuauca

SEQ ID NO: 1379433 - RNA, 19 nt, Homo sapiens
uggcgacugugaagaguga

SEQ ID NO: 1379434 - RNA, 19 nt, Homo sapiens
guagagugauuuuccuauu

SEQ ID NO: 1379435 - RNA, 19 nt, Homo sapiens
aagaagaggcccaucugaa

SEQ ID NO: 1379436 - RNA, 19 nt, Homo sapiens
caacugccuaugagauuau

SEQ ID NO: 1379437 - RNA, 19 nt, Homo sapiens
gaagagugagcuuauugag

SEQ ID NO: 1379438 - RNA, 19 nt, Homo sapiens
uaaggucuccaucauagga

SEQ ID NO: 1379439 - RNA, 19 nt, Homo sapiens
ugaagagugagcuuauuga

SEQ ID NO: 1379440 - RNA, 19 nt, Homo sapiens
caagauggcgacugugaag

SEQ ID NO: 1379441 - RNA, 19 nt, Homo sapiens
acuccaaccuagugauuau

SEQ ID NO: 1379442 - RNA, 19 nt, Homo sapiens
aaacuccaaccuagugauu

SEQ ID NO: 1379443 - RNA, 19 nt, Homo sapiens
uuucauucuugcugguuua

SEQ ID NO: 1379444 - RNA, 19 nt, Homo sapiens
caacggcaccuggcucuuc

SEQ ID NO: 1379445 - RNA, 19 nt, Homo sapiens
ccgaaauuauugaagagau

SEQ ID NO: 1379446 - RNA, 19 nt, Homo sapiens
agaaguauuccucaguauu

SEQ ID NO: 1379447 - RNA, 19 nt, Homo sapiens
gauauaggaacugauaaag

SEQ ID NO: 1379448 - RNA, 19 nt, Homo sapiens
acugcaaacugauuauugu

SEQ ID NO: 1379449 - RNA, 19 nt, Homo sapiens
cagcacuugccauguuaua

SEQ ID NO: 1379450 - RNA, 19 nt, Homo sapiens
gcaccgggcugucaaguua

SEQ ID NO: 1379451 - RNA, 19 nt, Homo sapiens
ccaaggagcuuuagaaaug

SEQ ID NO: 1379452 - RNA, 19 nt, Homo sapiens
gcaaugagcucagacaaga

SEQ ID NO: 1379453 - RNA, 19 nt, Homo sapiens
gagcagaagugcacaggua

SEQ ID NO: 1379454 - RNA, 19 nt, Homo sapiens
gaacuggaacggcauaaua

SEQ ID NO: 1379455 - RNA, 19 nt, Homo sapiens
caagaaauguugaaaguag

SEQ ID NO: 1379456 - RNA, 19 nt, Homo sapiens
gaaauuaacaggcuucgaa

SEQ ID NO: 1379457 - RNA, 19 nt, Homo sapiens
ggagauaugugaucaccaa

SEQ ID NO: 1379458 - RNA, 19 nt, Homo sapiens
ccaaugacaucaaguguga

SEQ ID NO: 1379459 - RNA, 19 nt, Homo sapiens
gagaauggaucuuugaagu

SEQ ID NO: 1379460 - RNA, 19 nt, Homo sapiens
gcacagguauucuugaaca

SEQ ID NO: 1379461 - RNA, 19 nt, Homo sapiens
gagagaagcuacucaacau

SEQ ID NO: 1379462 - RNA, 19 nt, Homo sapiens
ccacaaagcccaagcaaga

SEQ ID NO: 1379463 - RNA, 19 nt, Homo sapiens
ggcaaacggugaaauuaaa

SEQ ID NO: 1379464 - RNA, 19 nt, Homo sapiens
ccagugacauugaugagua

SEQ ID NO: 1379465 - RNA, 19 nt, Homo sapiens
agagaaagaucuacuggaa

SEQ ID NO: 1379466 - RNA, 19 nt, Homo sapiens
caacauccauaacucaaga

SEQ ID NO: 1379467 - RNA, 19 nt, Homo sapiens
gcugucaaguuacacaaua

SEQ ID NO: 1379468 - RNA, 19 nt, Homo sapiens
ggaaaugcauuacggacau

SEQ ID NO: 1379469 - RNA, 19 nt, Homo sapiens
ccauagcacugcagaagaa

SEQ ID NO: 1379470 - RNA, 19 nt, Homo sapiens
gagaaauugccucuuuaua

SEQ ID NO: 1379471 - RNA, 19 nt, Homo sapiens
aaacauacauggaaaugca

SEQ ID NO: 1379472 - RNA, 19 nt, Homo sapiens
gaauggaucuuugaagucu

SEQ ID NO: 1379473 - RNA, 19 nt, Homo sapiens
ucagugagcuagaaaguag

SEQ ID NO: 1379474 - RNA, 19 nt, Homo sapiens
gaucaaagacaugaaagaa

SEQ ID NO: 1379475 - RNA, 19 nt, Homo sapiens
gccagaugcuuccgacuuu

SEQ ID NO: 1379476 - RNA, 19 nt, Homo sapiens
auaaucaacucaucaguga

SEQ ID NO: 1379477 - RNA, 19 nt, Homo sapiens
gagaagcugaugaaucuuu

SEQ ID NO: 1379478 - RNA, 19 nt, Homo sapiens
ucaaagacaugaaagaaac

SEQ ID NO: 1379479 - RNA, 19 nt, Homo sapiens
gcucagacaagaauuacua

SEQ ID NO: 1379480 - RNA, 19 nt, Homo sapiens
gaaaugauuaaacgucuga

SEQ ID NO: 1379481 - RNA, 19 nt, Homo sapiens
ggaaaaggauuauucauac

SEQ ID NO: 1379482 - RNA, 19 nt, Homo sapiens
gggcagagcagcuaaguca

SEQ ID NO: 1379483 - RNA, 19 nt, Homo sapiens
ccaaacagcguaagugaau

SEQ ID NO: 1379484 - RNA, 19 nt, Homo sapiens
ggaacugucuugcaaugag

SEQ ID NO: 1379485 - RNA, 19 nt, Homo sapiens
cagcagcaguugaccugua

SEQ ID NO: 1379486 - RNA, 19 nt, Homo sapiens
gaaaccauauuugaauugg

SEQ ID NO: 1379487 - RNA, 19 nt, Homo sapiens
gagcagaaccagccuaaag

SEQ ID NO: 1379488 - RNA, 19 nt, Homo sapiens
uuaaacgucugaaggaaga

SEQ ID NO: 1379489 - RNA, 19 nt, Homo sapiens
gauuaaacgucugaaggaa

SEQ ID NO: 1379490 - RNA, 19 nt, Homo sapiens
gagaaacugaucuaucuug

SEQ ID NO: 1379491 - RNA, 19 nt, Homo sapiens
ggagaaauugccucuuuau

SEQ ID NO: 1379492 - RNA, 19 nt, Homo sapiens
caaggagcuuuagaaauga

SEQ ID NO: 1379493 - RNA, 19 nt, Homo sapiens
gagaagcuacucaacauuc

SEQ ID NO: 1379494 - RNA, 19 nt, Homo sapiens
uaacaggcuucgaagugaa

SEQ ID NO: 1379495 - RNA, 19 nt, Homo sapiens
gggaauguguagaggagaa

SEQ ID NO: 1379496 - RNA, 19 nt, Homo sapiens
ugaagacucugaccaagca

SEQ ID NO: 1379497 - RNA, 19 nt, Homo sapiens
gaucuuugaagucucauuu

SEQ ID NO: 1379498 - RNA, 19 nt, Homo sapiens
gugcacagguauucuugaa

SEQ ID NO: 1379499 - RNA, 19 nt, Homo sapiens
augagaagcugguggauga

SEQ ID NO: 1379500 - RNA, 19 nt, Homo sapiens
acaucaggcuccucaagua

SEQ ID NO: 1379501 - RNA, 19 nt, Homo sapiens
gcagagaucaaagacauga

SEQ ID NO: 1379502 - RNA, 19 nt, Homo sapiens
cagaaaagguuggauaaaa

SEQ ID NO: 1379503 - RNA, 19 nt, Homo sapiens
gagcagcuaagucaagaaa

SEQ ID NO: 1379504 - RNA, 19 nt, Homo sapiens
caacaaaugguacaggaau

SEQ ID NO: 1379505 - RNA, 19 nt, Homo sapiens
gagaagaacaagaacuuuc

SEQ ID NO: 1379506 - RNA, 19 nt, Homo sapiens
agacaagaauuacuaaagg

SEQ ID NO: 1379507 - RNA, 19 nt, Homo sapiens
uuggaagaguguagaguua

SEQ ID NO: 1379508 - RNA, 19 nt, Homo sapiens
uggaacggcauaauaauaa

SEQ ID NO: 1379509 - RNA, 19 nt, Homo sapiens
ggacagacccacgaaguca

SEQ ID NO: 1379510 - RNA, 19 nt, Homo sapiens
aggagaaauugccucuuua

SEQ ID NO: 1379511 - RNA, 19 nt, Homo sapiens
gcuagaaaguagugugauc

SEQ ID NO: 1379512 - RNA, 19 nt, Homo sapiens
ugaaggagauaugugauca

SEQ ID NO: 1379513 - RNA, 19 nt, Homo sapiens
agaaagaucuacuggaacu

SEQ ID NO: 1379514 - RNA, 19 nt, Homo sapiens
gagcugcgaaguucaagaa

SEQ ID NO: 1379515 - RNA, 19 nt, Homo sapiens
gaagugcacagguauucuu

SEQ ID NO: 1379516 - RNA, 19 nt, Homo sapiens
caagagcgaguaaagaaug

SEQ ID NO: 1379517 - RNA, 19 nt, Homo sapiens
gaaugaagguggagaaaag

SEQ ID NO: 1379518 - RNA, 19 nt, Homo sapiens
uuauugaacuggagcagaa

SEQ ID NO: 1379519 - RNA, 19 nt, Homo sapiens
agaaacugaucuaucuuga

SEQ ID NO: 1379520 - RNA, 19 nt, Homo sapiens
ugacacggaaccuaugaua

SEQ ID NO: 1379521 - RNA, 19 nt, Homo sapiens
uuagagacauccuuucauc

SEQ ID NO: 1379522 - RNA, 19 nt, Homo sapiens
ggagaagaacaagaacuuu

SEQ ID NO: 1379523 - RNA, 19 nt, Homo sapiens
cugcgaaguucaagaaaug

SEQ ID NO: 1379524 - RNA, 19 nt, Homo sapiens
aggagaaacugaucuaucu

SEQ ID NO: 1379525 - RNA, 19 nt, Homo sapiens
gcccagcucuugccaugau

SEQ ID NO: 1379526 - RNA, 19 nt, Homo sapiens
aaaccaaggagcuuuagaa

SEQ ID NO: 1379527 - RNA, 19 nt, Homo sapiens
uuaacaggcuucgaaguga

SEQ ID NO: 1379528 - RNA, 19 nt, Homo sapiens
gagcuagaaaguaguguga

SEQ ID NO: 1379529 - RNA, 19 nt, Homo sapiens
gcugcgaaguucaagaaau

SEQ ID NO: 1379530 - RNA, 19 nt, Homo sapiens
gauaaaagauaaggacaga

SEQ ID NO: 1379531 - RNA, 19 nt, Homo sapiens
augagaagcugaugaaucu

SEQ ID NO: 1379532 - RNA, 19 nt, Homo sapiens
ugaucaagcuggaggaaca

SEQ ID NO: 1379533 - RNA, 19 nt, Homo sapiens
agacaugaaagaaaccaua

SEQ ID NO: 1379534 - RNA, 19 nt, Homo sapiens
gccuaaagcugcaagaaaa

SEQ ID NO: 1379535 - RNA, 19 nt, Homo sapiens
gcggaagguugaggaagaa

SEQ ID NO: 1379536 - RNA, 19 nt, Homo sapiens
cgacucagcaggcucaaga

SEQ ID NO: 1379537 - RNA, 19 nt, Homo sapiens
gaaagagagaagcuacuca

SEQ ID NO: 1379538 - RNA, 19 nt, Homo sapiens
uacaagagcgaguaaagaa

SEQ ID NO: 1379539 - RNA, 19 nt, Homo sapiens
cagagcagcuaagucaaga

SEQ ID NO: 1379540 - RNA, 19 nt, Homo sapiens
gacagcaggugcccaacau

SEQ ID NO: 1379541 - RNA, 19 nt, Homo sapiens
ccacgggaauuuucaguaa

SEQ ID NO: 1379542 - RNA, 19 nt, Homo sapiens
ugaccaagcagaugaagga

SEQ ID NO: 1379543 - RNA, 19 nt, Homo sapiens
aaaggcaaacggugaaauu

SEQ ID NO: 1379544 - RNA, 19 nt, Homo sapiens
uaucagaccagcaacaaau

SEQ ID NO: 1379545 - RNA, 19 nt, Homo sapiens
gaacuacaggcuacucuac

SEQ ID NO: 1379546 - RNA, 19 nt, Homo sapiens
caaacagcguaagugaauu

SEQ ID NO: 1379547 - RNA, 19 nt, Homo sapiens
gcacauuacagcagagaca

SEQ ID NO: 1379548 - RNA, 19 nt, Homo sapiens
gaaaugcauuacggacauc

SEQ ID NO: 1379549 - RNA, 19 nt, Homo sapiens
cgaagugaacuaaagaaau

SEQ ID NO: 1379550 - RNA, 19 nt, Homo sapiens
caaggacgcuguacagauu

SEQ ID NO: 1379551 - RNA, 19 nt, Homo sapiens
gcaaagguguccuagaaau

SEQ ID NO: 1379552 - RNA, 19 nt, Homo sapiens
gcacugggcugcagaugga

SEQ ID NO: 1379553 - RNA, 19 nt, Homo sapiens
gaguguagucuccuuauua

SEQ ID NO: 1379554 - RNA, 19 nt, Homo sapiens
cggcaaagguguccuagaa

SEQ ID NO: 1379555 - RNA, 19 nt, Homo sapiens
gcacacuuaugguaucauu

SEQ ID NO: 1379556 - RNA, 19 nt, Homo sapiens
acaccuagauguugugaaa

SEQ ID NO: 1379557 - RNA, 19 nt, Homo sapiens
gaugguugcugcccagaaa

SEQ ID NO: 1379558 - RNA, 19 nt, Homo sapiens
gugauugaguggaugauaa

SEQ ID NO: 1379559 - RNA, 19 nt, Homo sapiens
ugaaauaucuccgaagaca

SEQ ID NO: 1379560 - RNA, 19 nt, Homo sapiens
ccagagagcccauaaguag

SEQ ID NO: 1379561 - RNA, 19 nt, Homo sapiens
guacagauuucgccugaag

SEQ ID NO: 1379562 - RNA, 19 nt, Homo sapiens
ucaguuacuucuugacaaa

SEQ ID NO: 1379563 - RNA, 19 nt, Homo sapiens
gguggccucucuucuaauu

SEQ ID NO: 1379564 - RNA, 19 nt, Homo sapiens
ucacugaucccacuuugaa

SEQ ID NO: 1379565 - RNA, 19 nt, Homo sapiens
ucacagcauugaauuauac

SEQ ID NO: 1379566 - RNA, 19 nt, Homo sapiens
aaccgugacuguuaaacua

SEQ ID NO: 1379567 - RNA, 19 nt, Homo sapiens
gcagugugauugaguggau

SEQ ID NO: 1379568 - RNA, 19 nt, Homo sapiens
ggauacaccaggcuuguga

SEQ ID NO: 1379569 - RNA, 19 nt, Homo sapiens
ugugaaauaucuccgaaga

SEQ ID NO: 1379570 - RNA, 19 nt, Homo sapiens
gggccaaugugaaugugaa

SEQ ID NO: 1379571 - RNA, 19 nt, Homo sapiens
accuagauguugugaaaua

SEQ ID NO: 1379572 - RNA, 19 nt, Homo sapiens
uuaguucaguuacuucuug

SEQ ID NO: 1379573 - RNA, 19 nt, Homo sapiens
uaugguggcuguguuaaau

SEQ ID NO: 1379574 - RNA, 19 nt, Homo sapiens
cuagaaauggccagaguuu

SEQ ID NO: 1379575 - RNA, 19 nt, Homo sapiens
guacagcccacucgucuca

SEQ ID NO: 1379576 - RNA, 19 nt, Homo sapiens
gagcagugguucagguucu

SEQ ID NO: 1379577 - RNA, 19 nt, Homo sapiens
agguugauguucccaauaa

SEQ ID NO: 1379578 - RNA, 19 nt, Homo sapiens
ugugaaugaugaagauuug

SEQ ID NO: 1379579 - RNA, 19 nt, Homo sapiens
caucacagcauugaauuau

SEQ ID NO: 1379580 - RNA, 19 nt, Homo sapiens
caaagugaaccgugacugu

SEQ ID NO: 1379581 - RNA, 19 nt, Homo sapiens
gcaccacucaucugcgaaa

SEQ ID NO: 1379582 - RNA, 19 nt, Homo sapiens
caaagguguccuagaaaug

SEQ ID NO: 1379583 - RNA, 19 nt, Homo sapiens
uggccucucuucuaauuga

SEQ ID NO: 1379584 - RNA, 19 nt, Homo sapiens
uaagguugauguucccaau

SEQ ID NO: 1379585 - RNA, 19 nt, Homo sapiens
gaaccaaggacgcuguaca

SEQ ID NO: 1379586 - RNA, 19 nt, Homo sapiens
gaagcauguuguugaaggu

SEQ ID NO: 1379587 - RNA, 19 nt, Homo sapiens
gaucccacuuugaaauaca

SEQ ID NO: 1379588 - RNA, 19 nt, Homo sapiens
uguagucuccuuauuagaa

SEQ ID NO: 1379589 - RNA, 19 nt, Homo sapiens
agaguuaguucaguuacuu

SEQ ID NO: 1379590 - RNA, 19 nt, Homo sapiens
ugguggcuguguuaaauaa

SEQ ID NO: 1379591 - RNA, 19 nt, Homo sapiens
aggguggccucucuucuaa

SEQ ID NO: 1379592 - RNA, 19 nt, Homo sapiens
aaauaucuccgaagacaug

SEQ ID NO: 1379593 - RNA, 19 nt, Homo sapiens
gaaagccaaacgccaagga

SEQ ID NO: 1379594 - RNA, 19 nt, Homo sapiens
cuucaaggaggccguguua

SEQ ID NO: 1379595 - RNA, 19 nt, Homo sapiens
gaaccgugacuguuaaacu

SEQ ID NO: 1379596 - RNA, 19 nt, Homo sapiens
guagucuccuuauuagaag

SEQ ID NO: 1379597 - RNA, 19 nt, Homo sapiens
gugaaggacagaaauggaa

SEQ ID NO: 1379598 - RNA, 19 nt, Homo sapiens
gaaucaugccacccucaaa

SEQ ID NO: 1379599 - RNA, 19 nt, Homo sapiens
aaacuagggaugggaaauu

SEQ ID NO: 1379600 - RNA, 19 nt, Homo sapiens
aagugaaccgugacuguua

SEQ ID NO: 1379601 - RNA, 19 nt, Homo sapiens
gaaacgcacguaaaacaaa

SEQ ID NO: 1379602 - RNA, 19 nt, Homo sapiens
gaaugugaaggacagaaau

SEQ ID NO: 1379603 - RNA, 19 nt, Homo sapiens
uugaguggaugauaaagga

SEQ ID NO: 1379604 - RNA, 19 nt, Homo sapiens
gggcuguacauuuauuuau

SEQ ID NO: 1379605 - RNA, 19 nt, Homo sapiens
agugaaccgugacuguuaa

SEQ ID NO: 1379606 - RNA, 19 nt, Homo sapiens
ucucugcggugucgggaaa

SEQ ID NO: 1379607 - RNA, 19 nt, Homo sapiens
ucaaggaggccguguuaag

SEQ ID NO: 1379608 - RNA, 19 nt, Homo sapiens
gagagcccauaaguaguga

SEQ ID NO: 1379609 - RNA, 19 nt, Homo sapiens
agaguguagucuccuuauu

SEQ ID NO: 1379610 - RNA, 19 nt, Homo sapiens
gacagaguguagucuccuu

SEQ ID NO: 1379611 - RNA, 19 nt, Homo sapiens
aagauuugcugguccgaau

SEQ ID NO: 1379612 - RNA, 19 nt, Homo sapiens
ccaaggacgcuguacagau

SEQ ID NO: 1379613 - RNA, 19 nt, Homo sapiens
aaaggauggcugugaggua

SEQ ID NO: 1379614 - RNA, 19 nt, Homo sapiens
gauguucccaauaaguuug

SEQ ID NO: 1379615 - RNA, 19 nt, Homo sapiens
gaaggucuggaaccaagga

SEQ ID NO: 1379616 - RNA, 19 nt, Homo sapiens
gguucagguucucgauuga

SEQ ID NO: 1379617 - RNA, 19 nt, Homo sapiens
aagcagaggccaaagaagu

SEQ ID NO: 1379618 - RNA, 19 nt, Homo sapiens
ggcaaagguguccuagaaa

SEQ ID NO: 1379619 - RNA, 19 nt, Homo sapiens
ggaaagacgccccuuaugg

SEQ ID NO: 1379620 - RNA, 19 nt, Homo sapiens
ugaaugugaaggacagaaa

SEQ ID NO: 1379621 - RNA, 19 nt, Homo sapiens
ucaucacagcauugaauua

SEQ ID NO: 1379622 - RNA, 19 nt, Homo sapiens
gucuaaugcuggcgugcua

SEQ ID NO: 1379623 - RNA, 19 nt, Homo sapiens
agacgugaaucugaagaau

SEQ ID NO: 1379624 - RNA, 19 nt, Homo sapiens
gaggccguguuaagguuga

SEQ ID NO: 1379625 - RNA, 19 nt, Homo sapiens
gaagaagaccccaaaaugc

SEQ ID NO: 1379626 - RNA, 19 nt, Homo sapiens
aguguagucuccuuauuag

SEQ ID NO: 1379627 - RNA, 19 nt, Homo sapiens
gaaagacgccccuuauggu

SEQ ID NO: 1379628 - RNA, 19 nt, Homo sapiens
ccuagauguugugaaauau

SEQ ID NO: 1379629 - RNA, 19 nt, Homo sapiens
cagugugaaugaugaagau

SEQ ID NO: 1379630 - RNA, 19 nt, Homo sapiens
gaagaguuaguucaguuac

SEQ ID NO: 1379631 - RNA, 19 nt, Homo sapiens
guggcuguguuaaauaauc

SEQ ID NO: 1379632 - RNA, 19 nt, Homo sapiens
ugaaggacagaaauggaaa

SEQ ID NO: 1379633 - RNA, 19 nt, Homo sapiens
ccaaugugaaugugaagga

SEQ ID NO: 1379634 - RNA, 19 nt, Homo sapiens
ugauugaguggaugauaaa

SEQ ID NO: 1379635 - RNA, 19 nt, Homo sapiens
ugguucagguucucgauug

SEQ ID NO: 1379636 - RNA, 19 nt, Homo sapiens
aacgaagcauguuguugaa

SEQ ID NO: 1379637 - RNA, 19 nt, Homo sapiens
gggcagaugcaaguguaaa

SEQ ID NO: 1379638 - RNA, 19 nt, Homo sapiens
gaaauaucuccgaagacau

SEQ ID NO: 1379639 - RNA, 19 nt, Homo sapiens
gcaaggacagucuaaugcu

SEQ ID NO: 1379640 - RNA, 19 nt, Homo sapiens
gaaguggcaaggacagucu

SEQ ID NO: 1379641 - RNA, 19 nt, Homo sapiens
acgugaaucugaagaaugg

SEQ ID NO: 1379642 - RNA, 19 nt, Homo sapiens
gacgugaaucugaagaaug

SEQ ID NO: 1379643 - RNA, 19 nt, Homo sapiens
acaccaggcuugugaaaau

SEQ ID NO: 1379644 - RNA, 19 nt, Homo sapiens
ugacucaucacagcauuga

SEQ ID NO: 1379645 - RNA, 19 nt, Homo sapiens
gugugaaugaugaagauuu

SEQ ID NO: 1379646 - RNA, 19 nt, Homo sapiens
cugaucccacuuugaaaua

SEQ ID NO: 1379647 - RNA, 19 nt, Homo sapiens
aaagugaaccgugacuguu

SEQ ID NO: 1379648 - RNA, 19 nt, Homo sapiens
ggauggaccccacucauga

SEQ ID NO: 1379649 - RNA, 19 nt, Homo sapiens
ugauaaaggauggcuguga

SEQ ID NO: 1379650 - RNA, 19 nt, Homo sapiens
gcaccagccucaucuauug

SEQ ID NO: 1379651 - RNA, 19 nt, Homo sapiens
gaagauagccugccuugug

SEQ ID NO: 1379652 - RNA, 19 nt, Homo sapiens
ggugcuggcuggccuaaua

SEQ ID NO: 1379653 - RNA, 19 nt, Homo sapiens
ccaauaaagcccuugaaua

SEQ ID NO: 1379654 - RNA, 19 nt, Homo sapiens
caauaaagcccuugaauac

SEQ ID NO: 1379655 - RNA, 19 nt, Homo sapiens
ggaaauggccagaagauag

SEQ ID NO: 1379656 - RNA, 19 nt, Homo sapiens
auaaagcccuugaauacuu

SEQ ID NO: 1379657 - RNA, 19 nt, Homo sapiens
gcagcccucuggcccauaa

SEQ ID NO: 1379658 - RNA, 19 nt, Homo sapiens
gggcacagcugggaaaugg

SEQ ID NO: 1379659 - RNA, 19 nt, Homo sapiens
guccugggcuggcugauga

SEQ ID NO: 1379660 - RNA, 19 nt, Homo sapiens
gaucagccucuucuacauu

SEQ ID NO: 1379661 - RNA, 19 nt, Homo sapiens
gcccuugaauacuuugaaa

SEQ ID NO: 1379662 - RNA, 19 nt, Homo sapiens
ucgcgaaucuucaucuuag

SEQ ID NO: 1379663 - RNA, 19 nt, Homo sapiens
gggaaauggccagaagaua

SEQ ID NO: 1379664 - RNA, 19 nt, Homo sapiens
gaucuuucuugguccauca

SEQ ID NO: 1379665 - RNA, 19 nt, Homo sapiens
gaggagagcgcaggaggaa

SEQ ID NO: 1379666 - RNA, 19 nt, Homo sapiens
cauccacucuuccugacuu

SEQ ID NO: 1379667 - RNA, 19 nt, Homo sapiens
acacugggccuggaucuuu

SEQ ID NO: 1379668 - RNA, 19 nt, Homo sapiens
cagcccagguucaccaguu

SEQ ID NO: 1379669 - RNA, 19 nt, Homo sapiens
ccaugagucugguuacuac

SEQ ID NO: 1379670 - RNA, 19 nt, Homo sapiens
ggccuucucucucccagau

SEQ ID NO: 1379671 - RNA, 19 nt, Homo sapiens
gaaauggccagaagauagc

SEQ ID NO: 1379672 - RNA, 19 nt, Homo sapiens
ggagagcgcaggaggaaac

SEQ ID NO: 1379673 - RNA, 19 nt, Homo sapiens
cauguucagugcccaggaa

SEQ ID NO: 1379674 - RNA, 19 nt, Homo sapiens
ccuucucucucccagauaa

SEQ ID NO: 1379675 - RNA, 19 nt, Homo sapiens
ccaaagagcaaaggcaaca

SEQ ID NO: 1379676 - RNA, 19 nt, Homo sapiens
caaagccaacacucuguga

SEQ ID NO: 1379677 - RNA, 19 nt, Homo sapiens
ugagcggccugaguggaua

SEQ ID NO: 1379678 - RNA, 19 nt, Homo sapiens
gcuuauugcaccuuccuuu

SEQ ID NO: 1379679 - RNA, 19 nt, Homo sapiens
ucuggacacugcaugauca

SEQ ID NO: 1379680 - RNA, 19 nt, Homo sapiens
gcaucgcggugcucuggau

SEQ ID NO: 1379681 - RNA, 19 nt, Homo sapiens
cagaucagccucuucuaca

SEQ ID NO: 1379682 - RNA, 19 nt, Homo sapiens
ucaauuuccucaaguacac

SEQ ID NO: 1379683 - RNA, 19 nt, Homo sapiens
ggcaccagccucaucuauu

SEQ ID NO: 1379684 - RNA, 19 nt, Homo sapiens
ugacugcacuggcccucau

SEQ ID NO: 1379685 - RNA, 19 nt, Homo sapiens
gaccagcggguucuugcaa

SEQ ID NO: 1379686 - RNA, 19 nt, Homo sapiens
ggcucaaccucaucuucaa

SEQ ID NO: 1379687 - RNA, 19 nt, Homo sapiens
ccgaguggcucaaccucau

SEQ ID NO: 1379688 - RNA, 19 nt, Homo sapiens
gagcgcaggaggaaacagu

SEQ ID NO: 1379689 - RNA, 19 nt, Homo sapiens
uaaugacggcccugucuuc

SEQ ID NO: 1379690 - RNA, 19 nt, Homo sapiens
ccagcggguucuugcaaca

SEQ ID NO: 1379691 - RNA, 19 nt, Homo sapiens
gguccucccucugccuuuc

SEQ ID NO: 1379692 - RNA, 19 nt, Homo sapiens
aucagccucuucuacauuu

SEQ ID NO: 1379693 - RNA, 19 nt, Homo sapiens
ccgaggcgcuacagaacca

SEQ ID NO: 1379694 - RNA, 19 nt, Homo sapiens
ccugggcagugcacauguu

SEQ ID NO: 1379695 - RNA, 19 nt, Homo sapiens
gugcuggcuggccuaauaa

SEQ ID NO: 1379696 - RNA, 19 nt, Homo sapiens
gucgcgaaucuucaucuua

SEQ ID NO: 1379697 - RNA, 19 nt, Homo sapiens
cauaaugacggcccugucu

SEQ ID NO: 1379698 - RNA, 19 nt, Homo sapiens
gcaccgcccauccacucuu

SEQ ID NO: 1379699 - RNA, 19 nt, Homo sapiens
gauccucuuucuguucuac

SEQ ID NO: 1379700 - RNA, 19 nt, Homo sapiens
gaguggauacacguggaua

SEQ ID NO: 1379701 - RNA, 19 nt, Homo sapiens
ucagaucagccucuucuac

SEQ ID NO: 1379702 - RNA, 19 nt, Homo sapiens
ucaaccucaucuucaagug

SEQ ID NO: 1379703 - RNA, 19 nt, Homo sapiens
caccacaccuggcugauuu

SEQ ID NO: 1379704 - RNA, 19 nt, Homo sapiens
gacagggucucaccauguu

SEQ ID NO: 1379705 - RNA, 19 nt, Homo sapiens
gcccugagaugcugaaaca

SEQ ID NO: 1379706 - RNA, 19 nt, Homo sapiens
gaccuagucucacucuguu

SEQ ID NO: 1379707 - RNA, 19 nt, Homo sapiens
gaaacacugcgccaacuuc

SEQ ID NO: 1379708 - RNA, 19 nt, Homo sapiens
ccgagcugcugcugcguua

SEQ ID NO: 1379709 - RNA, 19 nt, Homo sapiens
aggcuaaugugcugacuga

SEQ ID NO: 1379710 - RNA, 19 nt, Homo sapiens
agacccagcuguccaccaa

SEQ ID NO: 1379711 - RNA, 19 nt, Homo sapiens
ggagugcaguggcgcuauc

SEQ ID NO: 1379712 - RNA, 19 nt, Homo sapiens
ucccagagcuguggaagga

SEQ ID NO: 1379713 - RNA, 19 nt, Homo sapiens
uccaagcccuguuccaaga

SEQ ID NO: 1379714 - RNA, 19 nt, Homo sapiens
acaccuggcugauuuugua

SEQ ID NO: 1379715 - RNA, 19 nt, Homo sapiens
caccuagguucaagcgauu

SEQ ID NO: 1379716 - RNA, 19 nt, Homo sapiens
caacuucuaccaccuaggu

SEQ ID NO: 1379717 - RNA, 19 nt, Homo sapiens
caacugggagccugaaguc

SEQ ID NO: 1379718 - RNA, 19 nt, Homo sapiens
caacaugauuguggagacu

SEQ ID NO: 1379719 - RNA, 19 nt, Homo sapiens
caagcccuguuccaagaug

SEQ ID NO: 1379720 - RNA, 19 nt, Homo sapiens
ccaggucccaugccaagaa

SEQ ID NO: 1379721 - RNA, 19 nt, Homo sapiens
cuuaaugccuauccuugug

SEQ ID NO: 1379722 - RNA, 19 nt, Homo sapiens
gacaccugcugaccucuag

SEQ ID NO: 1379723 - RNA, 19 nt, Homo sapiens
gcugucccaugguguguuc

SEQ ID NO: 1379724 - RNA, 19 nt, Homo sapiens
uggaaguccugcuuaaugc

SEQ ID NO: 1379725 - RNA, 19 nt, Homo sapiens
gcccuggaaguccugcuua

SEQ ID NO: 1379726 - RNA, 19 nt, Homo sapiens
gguccaagcccuguuccaa

SEQ ID NO: 1379727 - RNA, 19 nt, Homo sapiens
ucgccgcacugcuggacua

SEQ ID NO: 1379728 - RNA, 19 nt, Homo sapiens
agcaacauguggcucugua

SEQ ID NO: 1379729 - RNA, 19 nt, Homo sapiens
cuucuccuccuguguuuaa

SEQ ID NO: 1379730 - RNA, 19 nt, Homo sapiens
gcuuaaugccuauccuugu

SEQ ID NO: 1379731 - RNA, 19 nt, Homo sapiens
cuggaaguccugcuuaaug

SEQ ID NO: 1379732 - RNA, 19 nt, Homo sapiens
gcccgaggcuacacagacu

SEQ ID NO: 1379733 - RNA, 19 nt, Homo sapiens
cccuggaaguccugcuuaa

SEQ ID NO: 1379734 - RNA, 19 nt, Homo sapiens
ccuggaggcuggagcugau

SEQ ID NO: 1379735 - RNA, 19 nt, Homo sapiens
agagagaccuuccccuuca

SEQ ID NO: 1379736 - RNA, 19 nt, Homo sapiens
ucaccacaccuggcugauu

SEQ ID NO: 1379737 - RNA, 19 nt, Homo sapiens
ugaaacacugcgccaacuu

SEQ ID NO: 1379738 - RNA, 19 nt, Homo sapiens
ggacugagguagaggagaa

SEQ ID NO: 1379739 - RNA, 19 nt, Homo sapiens
gagaaaggguggcaagaga

SEQ ID NO: 1379740 - RNA, 19 nt, Homo sapiens
ccaugucucuguccaaaua

SEQ ID NO: 1379741 - RNA, 19 nt, Homo sapiens
gauaugaguuaguagugaa

SEQ ID NO: 1379742 - RNA, 19 nt, Homo sapiens
ccaaauaucugagacuaca

SEQ ID NO: 1379743 - RNA, 19 nt, Homo sapiens
caaauaggccuuuccaucu

SEQ ID NO: 1379744 - RNA, 19 nt, Homo sapiens
agaagaaagggaaguauuu

SEQ ID NO: 1379745 - RNA, 19 nt, Homo sapiens
ggccugcgguugucauauu

SEQ ID NO: 1379746 - RNA, 19 nt, Homo sapiens
gaagucagccguggccaaa

SEQ ID NO: 1379747 - RNA, 19 nt, Homo sapiens
cccaucagccuuccaaaua

SEQ ID NO: 1379748 - RNA, 19 nt, Homo sapiens
ccaucagccuuccaaauau

SEQ ID NO: 1379749 - RNA, 19 nt, Homo sapiens
gaaaggguggcaagagaga

SEQ ID NO: 1379750 - RNA, 19 nt, Homo sapiens
ggacguggccguguacuuc

SEQ ID NO: 1379751 - RNA, 19 nt, Homo sapiens
gagcacgucuacagucaca

SEQ ID NO: 1379752 - RNA, 19 nt, Homo sapiens
uuauaugacuugcugaguu

SEQ ID NO: 1379753 - RNA, 19 nt, Homo sapiens
uaaaguacagcgaagaaga

SEQ ID NO: 1379754 - RNA, 19 nt, Homo sapiens
cgaccuaggcuccgacaaa

SEQ ID NO: 1379755 - RNA, 19 nt, Homo sapiens
gcgguugucauauuuauug

SEQ ID NO: 1379756 - RNA, 19 nt, Homo sapiens
uauaugacuugcugaguuc

SEQ ID NO: 1379757 - RNA, 19 nt, Homo sapiens
ggcauuucccgcucauuua

SEQ ID NO: 1379758 - RNA, 19 nt, Homo sapiens
gaagaagaaagggaaguau

SEQ ID NO: 1379759 - RNA, 19 nt, Homo sapiens
gcagauuccagaaacaaga

SEQ ID NO: 1379760 - RNA, 19 nt, Homo sapiens
agccagaacucacaauuca

SEQ ID NO: 1379761 - RNA, 19 nt, Homo sapiens
caacaagccagcucucauc

SEQ ID NO: 1379762 - RNA, 19 nt, Homo sapiens
cuccagaguucaagcaauu

SEQ ID NO: 1379763 - RNA, 19 nt, Homo sapiens
uaagaggacugagguagag

SEQ ID NO: 1379764 - RNA, 19 nt, Homo sapiens
cgaagaagaaagggaagua

SEQ ID NO: 1379765 - RNA, 19 nt, Homo sapiens
caucauggcuugcuuuuag

SEQ ID NO: 1379766 - RNA, 19 nt, Homo sapiens
ggagugcaauagcgcaauc

SEQ ID NO: 1379767 - RNA, 19 nt, Homo sapiens
gaguuccuauggucauuug

SEQ ID NO: 1379768 - RNA, 19 nt, Homo sapiens
ccugagcgcucucggaauc

SEQ ID NO: 1379769 - RNA, 19 nt, Homo sapiens
gcauuucccgcucauuuau

SEQ ID NO: 1379770 - RNA, 19 nt, Homo sapiens
aaagggaaguauuucuuag

SEQ ID NO: 1379771 - RNA, 19 nt, Homo sapiens
ugauaugaguuaguaguga

SEQ ID NO: 1379772 - RNA, 19 nt, Homo sapiens
gcacccaccaccuccauug

SEQ ID NO: 1379773 - RNA, 19 nt, Homo sapiens
aaauaggccuuuccaucug

SEQ ID NO: 1379774 - RNA, 19 nt, Homo sapiens
ccagaacacaauacucauu

SEQ ID NO: 1379775 - RNA, 19 nt, Homo sapiens
caagagagaaguaaaaguu

SEQ ID NO: 1379776 - RNA, 19 nt, Homo sapiens
ccuauggucauuugaguuu

SEQ ID NO: 1379777 - RNA, 19 nt, Homo sapiens
ggagccagaacucacaauu

SEQ ID NO: 1379778 - RNA, 19 nt, Homo sapiens
aaacggacccagcagauuc

SEQ ID NO: 1379779 - RNA, 19 nt, Homo sapiens
gcaacacuacggccagcua

SEQ ID NO: 1379780 - RNA, 19 nt, Homo sapiens
caucagccuuccaaauauc

SEQ ID NO: 1379781 - RNA, 19 nt, Homo sapiens
ggagugcaguggugugaac

SEQ ID NO: 1379782 - RNA, 19 nt, Homo sapiens
guacagcgaagaagaaagg

SEQ ID NO: 1379783 - RNA, 19 nt, Homo sapiens
caacacuacggccagcuaa

SEQ ID NO: 1379784 - RNA, 19 nt, Homo sapiens
gagccagaacucacaauuc

SEQ ID NO: 1379785 - RNA, 19 nt, Homo sapiens
guagaggagaaccuuguuu

SEQ ID NO: 1379786 - RNA, 19 nt, Homo sapiens
gugacuaucuagacauuac

SEQ ID NO: 1379787 - RNA, 19 nt, Homo sapiens
aaaguacagcgaagaagaa

SEQ ID NO: 1379788 - RNA, 19 nt, Homo sapiens
ccacgugccauucaucaug

SEQ ID NO: 1379789 - RNA, 19 nt, Homo sapiens
ggagauauuccaggagugu

SEQ ID NO: 1379790 - RNA, 19 nt, Homo sapiens
caaacggacccagcagauu

SEQ ID NO: 1379791 - RNA, 19 nt, Homo sapiens
gaucuggccugcgguuguc

SEQ ID NO: 1379792 - RNA, 19 nt, Homo sapiens
gcaacaagccagcucucau

SEQ ID NO: 1379793 - RNA, 19 nt, Homo sapiens
caaacuccuuggcugaagu

SEQ ID NO: 1379794 - RNA, 19 nt, Homo sapiens
gccugcgguugucauauuu

SEQ ID NO: 1379795 - RNA, 19 nt, Homo sapiens
aggcagggcugaguugaga

SEQ ID NO: 1379796 - RNA, 19 nt, Homo sapiens
cugcagugcucaaggaauc

SEQ ID NO: 1379797 - RNA, 19 nt, Homo sapiens
gaaccuuguuuuacccauu

SEQ ID NO: 1379798 - RNA, 19 nt, Homo sapiens
uggcauuucccgcucauuu

SEQ ID NO: 1379799 - RNA, 19 nt, Homo sapiens
aagaagaaagggaaguauu

SEQ ID NO: 1379800 - RNA, 19 nt, Homo sapiens
caccaugccuggcuuccau

SEQ ID NO: 1379801 - RNA, 19 nt, Homo sapiens
gaccuaggcuccgacaaaa

SEQ ID NO: 1379802 - RNA, 19 nt, Homo sapiens
acacuacggccagcuaauu

SEQ ID NO: 1379803 - RNA, 19 nt, Homo sapiens
uggcuuccauugucuuugu

SEQ ID NO: 1379804 - RNA, 19 nt, Homo sapiens
aagugacuaucuagacauu

SEQ ID NO: 1379805 - RNA, 19 nt, Homo sapiens
caccaccuccauugucuuu

SEQ ID NO: 1379806 - RNA, 19 nt, Homo sapiens
cgucucggcuuccgcaagu

SEQ ID NO: 1379807 - RNA, 19 nt, Homo sapiens
cuaagaggacugagguaga

SEQ ID NO: 1379808 - RNA, 19 nt, Homo sapiens
gagagaaaggguggcaaga

SEQ ID NO: 1379809 - RNA, 19 nt, Homo sapiens
aaacaccaguggguucauc

SEQ ID NO: 1379810 - RNA, 19 nt, Homo sapiens
ggauuacaggcgugagcua

SEQ ID NO: 1379811 - RNA, 19 nt, Homo sapiens
uggagcacgucuacaguca

SEQ ID NO: 1379812 - RNA, 19 nt, Homo sapiens
cuccuuggcugaagugauc

SEQ ID NO: 1379813 - RNA, 19 nt, Homo sapiens
ccagcagauuccagaaaca

SEQ ID NO: 1379814 - RNA, 19 nt, Homo sapiens
uuccaaauaucugagacua

SEQ ID NO: 1379815 - RNA, 19 nt, Homo sapiens
cacuacggccagcuaauuu

SEQ ID NO: 1379816 - RNA, 19 nt, Homo sapiens
cagcagauuccagaaacaa

SEQ ID NO: 1379817 - RNA, 19 nt, Homo sapiens
ggaucuggccugcgguugu

SEQ ID NO: 1379818 - RNA, 19 nt, Homo sapiens
guuaaaauccugugacugu

SEQ ID NO: 1379819 - RNA, 19 nt, Homo sapiens
uuccucagccucccaagua

SEQ ID NO: 1379820 - RNA, 19 nt, Homo sapiens
agucagccguggccaaaca

SEQ ID NO: 1379821 - RNA, 19 nt, Homo sapiens
gccuuuccaucuggcauuu

SEQ ID NO: 1379822 - RNA, 19 nt, Homo sapiens
ucccagaacacaauacuca

SEQ ID NO: 1379823 - RNA, 19 nt, Homo sapiens
gguagaggagaaccuuguu

SEQ ID NO: 1379824 - RNA, 19 nt, Homo sapiens
gucuguagcacucagguuu

SEQ ID NO: 1379825 - RNA, 19 nt, Homo sapiens
auccggagguggcgaaaug

SEQ ID NO: 1379826 - RNA, 19 nt, Homo sapiens
cagguuuucuggugucuuu

SEQ ID NO: 1379827 - RNA, 19 nt, Homo sapiens
cugcgguugucauauuuau

SEQ ID NO: 1379828 - RNA, 19 nt, Homo sapiens
cccagaaucuagggcaaga

SEQ ID NO: 1379829 - RNA, 19 nt, Homo sapiens
aaaagugacuaucuagaca

SEQ ID NO: 1379830 - RNA, 19 nt, Homo sapiens
cagauuccagaaacaagaa

SEQ ID NO: 1379831 - RNA, 19 nt, Homo sapiens
ucaaacuccuuggcugaag

SEQ ID NO: 1379832 - RNA, 19 nt, Homo sapiens
ccaaacaccaguggguuca

SEQ ID NO: 1379833 - RNA, 19 nt, Homo sapiens
cauuucccgcucauuuaua

SEQ ID NO: 1379834 - RNA, 19 nt, Homo sapiens
acccaugucucuguccaaa

SEQ ID NO: 1379835 - RNA, 19 nt, Homo sapiens
aaaauccugugacugugua

SEQ ID NO: 1379836 - RNA, 19 nt, Homo sapiens
aaccugcagugcucaagga

SEQ ID NO: 1379837 - RNA, 19 nt, Homo sapiens
gugacggccuuaaaaguga

SEQ ID NO: 1379838 - RNA, 19 nt, Homo sapiens
ggaaauugaucacuucuua

SEQ ID NO: 1379839 - RNA, 19 nt, Homo sapiens
gaacagggcuugaaacaau

SEQ ID NO: 1379840 - RNA, 19 nt, Homo sapiens
gagaugauguggauauuua

SEQ ID NO: 1379841 - RNA, 19 nt, Homo sapiens
gcacuaaucuuguaggaaa

SEQ ID NO: 1379842 - RNA, 19 nt, Homo sapiens
gaagagaguuguccaguga

SEQ ID NO: 1379843 - RNA, 19 nt, Homo sapiens
ccacugaaaugguagaaua

SEQ ID NO: 1379844 - RNA, 19 nt, Homo sapiens
guaaggagauguauauaug

SEQ ID NO: 1379845 - RNA, 19 nt, Homo sapiens
ucacucagaugaacaauuu

SEQ ID NO: 1379846 - RNA, 19 nt, Homo sapiens
gggaagaucucaaugaaug

SEQ ID NO: 1379847 - RNA, 19 nt, Homo sapiens
uaacugcacuguagaugua

SEQ ID NO: 1379848 - RNA, 19 nt, Homo sapiens
gaaagugcuuguugauuga

SEQ ID NO: 1379849 - RNA, 19 nt, Homo sapiens
agucagagcuaguuaauuu

SEQ ID NO: 1379850 - RNA, 19 nt, Homo sapiens
gaaguaaggagauguauau

SEQ ID NO: 1379851 - RNA, 19 nt, Homo sapiens
gacaguuucucucuuauaa

SEQ ID NO: 1379852 - RNA, 19 nt, Homo sapiens
cagcucaacuguaauuuaa

SEQ ID NO: 1379853 - RNA, 19 nt, Homo sapiens
gcaaauuguuccucaaaug

SEQ ID NO: 1379854 - RNA, 19 nt, Homo sapiens
ggacuacucuuaaauaacu

SEQ ID NO: 1379855 - RNA, 19 nt, Homo sapiens
gaaauuaucacuuggaugu

SEQ ID NO: 1379856 - RNA, 19 nt, Homo sapiens
gagcagugauacaauuuaa

SEQ ID NO: 1379857 - RNA, 19 nt, Homo sapiens
ggauaggaauguauauuug

SEQ ID NO: 1379858 - RNA, 19 nt, Homo sapiens
gcaccaaaguauauugauu

SEQ ID NO: 1379859 - RNA, 19 nt, Homo sapiens
caccacaccuggcuaauuu

SEQ ID NO: 1379860 - RNA, 19 nt, Homo sapiens
ggagauguauauaugugua

SEQ ID NO: 1379861 - RNA, 19 nt, Homo sapiens
gaauggagcugauguuugc

SEQ ID NO: 1379862 - RNA, 19 nt, Homo sapiens
guagagcagugauacaauu

SEQ ID NO: 1379863 - RNA, 19 nt, Homo sapiens
agaaagugcuuguugauug

SEQ ID NO: 1379864 - RNA, 19 nt, Homo sapiens
ucucaaagguagauaguaa

SEQ ID NO: 1379865 - RNA, 19 nt, Homo sapiens
caaagaauuucaugucugu

SEQ ID NO: 1379866 - RNA, 19 nt, Homo sapiens
ggaggaagcacaucuaaau

SEQ ID NO: 1379867 - RNA, 19 nt, Homo sapiens
aagcugagauuauuaguga

SEQ ID NO: 1379868 - RNA, 19 nt, Homo sapiens
uugcaggucuucauuguua

SEQ ID NO: 1379869 - RNA, 19 nt, Homo sapiens
cuaauaggcugaucacaga

SEQ ID NO: 1379870 - RNA, 19 nt, Homo sapiens
caguagagcuaucuuaaga

SEQ ID NO: 1379871 - RNA, 19 nt, Homo sapiens
ggaaaucacuguuguucag

SEQ ID NO: 1379872 - RNA, 19 nt, Homo sapiens
gagcauuucuuuaaucaca

SEQ ID NO: 1379873 - RNA, 19 nt, Homo sapiens
gcagauggaacgaacauaa

SEQ ID NO: 1379874 - RNA, 19 nt, Homo sapiens
ugaccuaucuuaaucauca

SEQ ID NO: 1379875 - RNA, 19 nt, Homo sapiens
guaaagguaugcauguaga

SEQ ID NO: 1379876 - RNA, 19 nt, Homo sapiens
ggaagcacaucuaaauaca

SEQ ID NO: 1379877 - RNA, 19 nt, Homo sapiens
gcuaucaccuuaauugugu

SEQ ID NO: 1379878 - RNA, 19 nt, Homo sapiens
gcuuagagcauuucuuuaa

SEQ ID NO: 1379879 - RNA, 19 nt, Homo sapiens
gaagaaaugcuugcucuga

SEQ ID NO: 1379880 - RNA, 19 nt, Homo sapiens
gcagagcugugcaaauugu

SEQ ID NO: 1379881 - RNA, 19 nt, Homo sapiens
uguuagagauucugaagua

SEQ ID NO: 1379882 - RNA, 19 nt, Homo sapiens
cgauaaaucuuucuucagu

SEQ ID NO: 1379883 - RNA, 19 nt, Homo sapiens
aaaggaaugugccaugauu

SEQ ID NO: 1379884 - RNA, 19 nt, Homo sapiens
gcauggagauguucguaug

SEQ ID NO: 1379885 - RNA, 19 nt, Homo sapiens
uacaaacugugccggauua

SEQ ID NO: 1379886 - RNA, 19 nt, Homo sapiens
gauuauucccuuucucuua

SEQ ID NO: 1379887 - RNA, 19 nt, Homo sapiens
ggaaagccuggcagaguua

SEQ ID NO: 1379888 - RNA, 19 nt, Homo sapiens
uauuauagguccaguuuga

SEQ ID NO: 1379889 - RNA, 19 nt, Homo sapiens
gaagcaguguggaguguau

SEQ ID NO: 1379890 - RNA, 19 nt, Homo sapiens
ggaacagugucaugaaauc

SEQ ID NO: 1379891 - RNA, 19 nt, Homo sapiens
ggaaacacuuacuugaugu

SEQ ID NO: 1379892 - RNA, 19 nt, Homo sapiens
ccaaguagcugggauuaca

SEQ ID NO: 1379893 - RNA, 19 nt, Homo sapiens
gguuaaauguugauacgaa

SEQ ID NO: 1379894 - RNA, 19 nt, Homo sapiens
ugagaagagugcauaaaga

SEQ ID NO: 1379895 - RNA, 19 nt, Homo sapiens
gccaaguaauggaagaaua

SEQ ID NO: 1379896 - RNA, 19 nt, Homo sapiens
gggauaggaauguauauuu

SEQ ID NO: 1379897 - RNA, 19 nt, Homo sapiens
gugaaaccauauucuauug

SEQ ID NO: 1379898 - RNA, 19 nt, Homo sapiens
gaugggaugggaaauauuu

SEQ ID NO: 1379899 - RNA, 19 nt, Homo sapiens
gagcuacuaacuuguauuu

SEQ ID NO: 1379900 - RNA, 19 nt, Homo sapiens
gcacagaauuacucagucu

SEQ ID NO: 1379901 - RNA, 19 nt, Homo sapiens
gcaauuauuuaccaaguac

SEQ ID NO: 1379902 - RNA, 19 nt, Homo sapiens
uagaauggcaugaagauuu

SEQ ID NO: 1379903 - RNA, 19 nt, Homo sapiens
guccaggaauucaaccuua

SEQ ID NO: 1379904 - RNA, 19 nt, Homo sapiens
gaggaagcacaucuaaaua

SEQ ID NO: 1379905 - RNA, 19 nt, Homo sapiens
gagaugggguuucaacaua

SEQ ID NO: 1379906 - RNA, 19 nt, Homo sapiens
auaaaugucuguuggauuc

SEQ ID NO: 1379907 - RNA, 19 nt, Homo sapiens
ggaaguaaggagauguaua

SEQ ID NO: 1379908 - RNA, 19 nt, Homo sapiens
gaugagacguuauuuccau

SEQ ID NO: 1379909 - RNA, 19 nt, Homo sapiens
ccaaguaauggaagaauaa

SEQ ID NO: 1379910 - RNA, 19 nt, Homo sapiens
gaaaugguagaauauguga

SEQ ID NO: 1379911 - RNA, 19 nt, Homo sapiens
aaauagagaugauguggau

SEQ ID NO: 1379912 - RNA, 19 nt, Homo sapiens
uaacaaagcauagcaguuc

SEQ ID NO: 1379913 - RNA, 19 nt, Homo sapiens
gguagucgcucuucuaaaa

SEQ ID NO: 1379914 - RNA, 19 nt, Homo sapiens
uuucaagccuuauacagua

SEQ ID NO: 1379915 - RNA, 19 nt, Homo sapiens
gcagugauacaauuuaaug

SEQ ID NO: 1379916 - RNA, 19 nt, Homo sapiens
gaaucaacuuccaugagaa

SEQ ID NO: 1379917 - RNA, 19 nt, Homo sapiens
ccuaguaauugccaaauga

SEQ ID NO: 1379918 - RNA, 19 nt, Homo sapiens
cauguuaacugcacuguag

SEQ ID NO: 1379919 - RNA, 19 nt, Homo sapiens
caaauuguuccucaaauga

SEQ ID NO: 1379920 - RNA, 19 nt, Homo sapiens
gaacgaacauaaagaaacc

SEQ ID NO: 1379921 - RNA, 19 nt, Homo sapiens
ggagaggccuggcauugca

SEQ ID NO: 1379922 - RNA, 19 nt, Homo sapiens
gcucugaaauaguauagau

SEQ ID NO: 1379923 - RNA, 19 nt, Homo sapiens
gaacugaacagggcuugaa

SEQ ID NO: 1379924 - RNA, 19 nt, Homo sapiens
ucacagagaauaauccauu

SEQ ID NO: 1379925 - RNA, 19 nt, Homo sapiens
aagaauaguuuccugaugu

SEQ ID NO: 1379926 - RNA, 19 nt, Homo sapiens
gauggagucuugcucuguu

SEQ ID NO: 1379927 - RNA, 19 nt, Homo sapiens
gaaagugaaagaacugaug

SEQ ID NO: 1379928 - RNA, 19 nt, Homo sapiens
gaccacaguugauucugaa

SEQ ID NO: 1379929 - RNA, 19 nt, Homo sapiens
gcuguucucuggagcuaaa

SEQ ID NO: 1379930 - RNA, 19 nt, Homo sapiens
ggaguacaauggcaugauc

SEQ ID NO: 1379931 - RNA, 19 nt, Homo sapiens
gaagcaauguuuuggaauu

SEQ ID NO: 1379932 - RNA, 19 nt, Homo sapiens
gauaaaagcaucccauaaa

SEQ ID NO: 1379933 - RNA, 19 nt, Homo sapiens
aaauuaaucuugcccuuuc

SEQ ID NO: 1379934 - RNA, 19 nt, Homo sapiens
ggagucaaguucuagaaag

SEQ ID NO: 1379935 - RNA, 19 nt, Homo sapiens
acugugagguuuccuagua

SEQ ID NO: 1379936 - RNA, 19 nt, Homo sapiens
ugagggcacuaaucuugua

SEQ ID NO: 1379937 - RNA, 19 nt, Homo sapiens
agaaacacuuuaaggacua

SEQ ID NO: 1379938 - RNA, 19 nt, Homo sapiens
gaagauggcuuuaaagaau

SEQ ID NO: 1379939 - RNA, 19 nt, Homo sapiens
gaacacaaguagaaguauu

SEQ ID NO: 1379940 - RNA, 19 nt, Homo sapiens
gggaaaagcuuacauuuaa

SEQ ID NO: 1379941 - RNA, 19 nt, Homo sapiens
gcaaauagacuaaagugaa

SEQ ID NO: 1379942 - RNA, 19 nt, Homo sapiens
gggagaagauggcuuuaaa

SEQ ID NO: 1379943 - RNA, 19 nt, Homo sapiens
ggaaucagcugcccuugug

SEQ ID NO: 1379944 - RNA, 19 nt, Homo sapiens
gaaauguguuguuaccaaa

SEQ ID NO: 1379945 - RNA, 19 nt, Homo sapiens
gcucaggaguucaaaguuu

SEQ ID NO: 1379946 - RNA, 19 nt, Homo sapiens
gaaccagaauauucagaaa

SEQ ID NO: 1379947 - RNA, 19 nt, Homo sapiens
gaacccauaugaagaagug

SEQ ID NO: 1379948 - RNA, 19 nt, Homo sapiens
ggagugagucuuagcauuu

SEQ ID NO: 1379949 - RNA, 19 nt, Homo sapiens
gaaaguguccagcauauuc

SEQ ID NO: 1379950 - RNA, 19 nt, Homo sapiens
gagugagucuuagcauuua

SEQ ID NO: 1379951 - RNA, 19 nt, Homo sapiens
caacagaucauguagauag

SEQ ID NO: 1379952 - RNA, 19 nt, Homo sapiens
gaaguuauuucagaccauu

SEQ ID NO: 1379953 - RNA, 19 nt, Homo sapiens
ccucaagucugguuacauu

SEQ ID NO: 1379954 - RNA, 19 nt, Homo sapiens
gaacaucacaauucuaagu

SEQ ID NO: 1379955 - RNA, 19 nt, Homo sapiens
gagaagauggcuuuaaaga

SEQ ID NO: 1379956 - RNA, 19 nt, Homo sapiens
gacaguauauucaccaugu

SEQ ID NO: 1379957 - RNA, 19 nt, Homo sapiens
ggaagaugcuuugcucugu

SEQ ID NO: 1379958 - RNA, 19 nt, Homo sapiens
gagaagugauaaaccaaau

SEQ ID NO: 1379959 - RNA, 19 nt, Homo sapiens
ugaaauguguuguuaccaa

SEQ ID NO: 1379960 - RNA, 19 nt, Homo sapiens
gaaaccagaauauucagaa

SEQ ID NO: 1379961 - RNA, 19 nt, Homo sapiens
gcaggcagcucaggaguuc

SEQ ID NO: 1379962 - RNA, 19 nt, Homo sapiens
ggaaggguuuucugucuua

SEQ ID NO: 1379963 - RNA, 19 nt, Homo sapiens
gcuaugcuaccucuuauuu

SEQ ID NO: 1379964 - RNA, 19 nt, Homo sapiens
ggaaacagcggaugauucu

SEQ ID NO: 1379965 - RNA, 19 nt, Homo sapiens
ggaaugugauaccaagugu

SEQ ID NO: 1379966 - RNA, 19 nt, Homo sapiens
cagcugcccuuguggcuuu

SEQ ID NO: 1379967 - RNA, 19 nt, Homo sapiens
ccaugucgcuggcaauaug

SEQ ID NO: 1379968 - RNA, 19 nt, Homo sapiens
ccagcuaugcuaccucuua

SEQ ID NO: 1379969 - RNA, 19 nt, Homo sapiens
gguucaauguggcuuaauu

SEQ ID NO: 1379970 - RNA, 19 nt, Homo sapiens
gcaaaggaaugugauacca

SEQ ID NO: 1379971 - RNA, 19 nt, Homo sapiens
uuauacaguugcugccuua

SEQ ID NO: 1379972 - RNA, 19 nt, Homo sapiens
ccaaggaauacaaacauaa

SEQ ID NO: 1379973 - RNA, 19 nt, Homo sapiens
cccaaagucuagauauaaa

SEQ ID NO: 1379974 - RNA, 19 nt, Homo sapiens
ggcaagcucugugugauug

SEQ ID NO: 1379975 - RNA, 19 nt, Homo sapiens
gaagaaguggaccaagaaa

SEQ ID NO: 1379976 - RNA, 19 nt, Homo sapiens
gucaacagaucauguagau

SEQ ID NO: 1379977 - RNA, 19 nt, Homo sapiens
cgaaaucccagcuaugcua

SEQ ID NO: 1379978 - RNA, 19 nt, Homo sapiens
caaguggcuucuucgacua

SEQ ID NO: 1379979 - RNA, 19 nt, Homo sapiens
ucagaaaccagaauauuca

SEQ ID NO: 1379980 - RNA, 19 nt, Homo sapiens
gaaccaugauaccaacuac

SEQ ID NO: 1379981 - RNA, 19 nt, Homo sapiens
ggagugcgagcucuugaaa

SEQ ID NO: 1379982 - RNA, 19 nt, Homo sapiens
caagucugguuacauugaa

SEQ ID NO: 1379983 - RNA, 19 nt, Homo sapiens
caacuacagcuuucagguu

SEQ ID NO: 1379984 - RNA, 19 nt, Homo sapiens
gauaccaacuacagcuuuc

SEQ ID NO: 1379985 - RNA, 19 nt, Homo sapiens
caucacaauucuaaguguu

SEQ ID NO: 1379986 - RNA, 19 nt, Homo sapiens
aaaccaaggugaggacaga

SEQ ID NO: 1379987 - RNA, 19 nt, Homo sapiens
cugcuacaaugacuucuuu

SEQ ID NO: 1379988 - RNA, 19 nt, Homo sapiens
ggacacaucagcccacuac

SEQ ID NO: 1379989 - RNA, 19 nt, Homo sapiens
uaucuucaauccagagaga

SEQ ID NO: 1379990 - RNA, 19 nt, Homo sapiens
ucauguagauagagucaau

SEQ ID NO: 1379991 - RNA, 19 nt, Homo sapiens
gauauaaagaccuagacuu

SEQ ID NO: 1379992 - RNA, 19 nt, Homo sapiens
uccaaggaauacaaacaua

SEQ ID NO: 1379993 - RNA, 19 nt, Homo sapiens
gaucugagugcuacacgaa

SEQ ID NO: 1379994 - RNA, 19 nt, Homo sapiens
cuagaagaauauacggaaa

SEQ ID NO: 1379995 - RNA, 19 nt, Homo sapiens
caggaaaccuuaaaagaga

SEQ ID NO: 1379996 - RNA, 19 nt, Homo sapiens
agagagaagugauaaacca

SEQ ID NO: 1379997 - RNA, 19 nt, Homo sapiens
gcaagcauaagcugccaaa

SEQ ID NO: 1379998 - RNA, 19 nt, Homo sapiens
cagcuaugcuaccucuuau

SEQ ID NO: 1379999 - RNA, 19 nt, Homo sapiens
cagaauagggagcaaguug

SEQ ID NO: 1380000 - RNA, 19 nt, Homo sapiens
gcaagugauccuucaguuc

SEQ ID NO: 1380001 - RNA, 19 nt, Homo sapiens
gaggccaguuugaacauca

SEQ ID NO: 1380002 - RNA, 19 nt, Homo sapiens
cagcauauucugaaagaug

SEQ ID NO: 1380003 - RNA, 19 nt, Homo sapiens
ugaagaaguggaccaagaa

SEQ ID NO: 1380004 - RNA, 19 nt, Homo sapiens
aaagugaacccauaugaag

SEQ ID NO: 1380005 - RNA, 19 nt, Homo sapiens
ugagucaacagaucaugua

SEQ ID NO: 1380006 - RNA, 19 nt, Homo sapiens
uaugcuaccucuuauuuac

SEQ ID NO: 1380007 - RNA, 19 nt, Homo sapiens
caacaugaaaccuuaaacu

SEQ ID NO: 1380008 - RNA, 19 nt, Homo sapiens
gaggggaacuauuaaaauc

SEQ ID NO: 1380009 - RNA, 19 nt, Homo sapiens
uaaaccaaaugcaagugau

SEQ ID NO: 1380010 - RNA, 19 nt, Homo sapiens
gaagugauaaaccaaaugc

SEQ ID NO: 1380011 - RNA, 19 nt, Homo sapiens
cgggaucgguggaggaaga

SEQ ID NO: 1380012 - RNA, 19 nt, Homo sapiens
caaaggaaugugauaccaa

SEQ ID NO: 1380013 - RNA, 19 nt, Homo sapiens
gaucauguagauagaguca

SEQ ID NO: 1380014 - RNA, 19 nt, Homo sapiens
uugaaaguguccagcauau

SEQ ID NO: 1380015 - RNA, 19 nt, Homo sapiens
agaagauggcuuuaaagaa

SEQ ID NO: 1380016 - RNA, 19 nt, Homo sapiens
gacagacgagugccacaaa

SEQ ID NO: 1380017 - RNA, 19 nt, Homo sapiens
acuaaacauugcugacuau

SEQ ID NO: 1380018 - RNA, 19 nt, Homo sapiens
aacuaaacauugcugacua

SEQ ID NO: 1380019 - RNA, 19 nt, Homo sapiens
gcugagggugccaagauuu

SEQ ID NO: 1380020 - RNA, 19 nt, Homo sapiens
gaaaagccccaaagucuag

SEQ ID NO: 1380021 - RNA, 19 nt, Homo sapiens
ccacccacauuucauggau

SEQ ID NO: 1380022 - RNA, 19 nt, Homo sapiens
augaagaaguggaccaaga

SEQ ID NO: 1380023 - RNA, 19 nt, Homo sapiens
gaagacaucagagaaacca

SEQ ID NO: 1380024 - RNA, 19 nt, Homo sapiens
gggcaagcucugugugauu

SEQ ID NO: 1380025 - RNA, 19 nt, Homo sapiens
ggacagacgagugccacaa

SEQ ID NO: 1380026 - RNA, 19 nt, Homo sapiens
uggagugagucuuagcauu

SEQ ID NO: 1380027 - RNA, 19 nt, Homo sapiens
ggcugagggugccaagauu

SEQ ID NO: 1380028 - RNA, 19 nt, Homo sapiens
cagguucaauguggcuuaa

SEQ ID NO: 1380029 - RNA, 19 nt, Homo sapiens
uccagcauauucugaaaga

SEQ ID NO: 1380030 - RNA, 19 nt, Homo sapiens
ggagaagauggcuuuaaag

SEQ ID NO: 1380031 - RNA, 19 nt, Homo sapiens
gagagaagugauaaaccaa

SEQ ID NO: 1380032 - RNA, 19 nt, Homo sapiens
ucuuauggagugagucuua

SEQ ID NO: 1380033 - RNA, 19 nt, Homo sapiens
agugcgagcucuugaaagu

SEQ ID NO: 1380034 - RNA, 19 nt, Homo sapiens
cagaucauguagauagagu

SEQ ID NO: 1380035 - RNA, 19 nt, Homo sapiens
caggaugcccagucuuuga

SEQ ID NO: 1380036 - RNA, 19 nt, Homo sapiens
gcaggaugcccagucuuug

SEQ ID NO: 1380037 - RNA, 19 nt, Homo sapiens
gccccaaagucuagauaua

SEQ ID NO: 1380038 - RNA, 19 nt, Homo sapiens
uaucaaagauggcaaguuu

SEQ ID NO: 1380039 - RNA, 19 nt, Homo sapiens
gcagagggcuucuacaaca

SEQ ID NO: 1380040 - RNA, 19 nt, Homo sapiens
gauaauguauugugugaga

SEQ ID NO: 1380041 - RNA, 19 nt, Homo sapiens
ggccggagcuuaucaaaga

SEQ ID NO: 1380042 - RNA, 19 nt, Homo sapiens
gaagaggaagacagaaaua

SEQ ID NO: 1380043 - RNA, 19 nt, Homo sapiens
ggacaaacaguacgagauu

SEQ ID NO: 1380044 - RNA, 19 nt, Homo sapiens
gggaagcacuggucgaaga

SEQ ID NO: 1380045 - RNA, 19 nt, Homo sapiens
gaacacaugguccgaaaga

SEQ ID NO: 1380046 - RNA, 19 nt, Homo sapiens
caagagagcaaucaucaau

SEQ ID NO: 1380047 - RNA, 19 nt, Homo sapiens
gaggaagacagaaauaaga

SEQ ID NO: 1380048 - RNA, 19 nt, Homo sapiens
gaauuugggaaccugaaua

SEQ ID NO: 1380049 - RNA, 19 nt, Homo sapiens
gcagauuagugccauugga

SEQ ID NO: 1380050 - RNA, 19 nt, Homo sapiens
caccuacacuacuuuaaga

SEQ ID NO: 1380051 - RNA, 19 nt, Homo sapiens
cgaagagugugauggacaa

SEQ ID NO: 1380052 - RNA, 19 nt, Homo sapiens
agaaggaacuggaacacau

SEQ ID NO: 1380053 - RNA, 19 nt, Homo sapiens
cuaagcaccuacacuacuu

SEQ ID NO: 1380054 - RNA, 19 nt, Homo sapiens
gaaggaacuggaacacaug

SEQ ID NO: 1380055 - RNA, 19 nt, Homo sapiens
cagcaucauuugucaucaa

SEQ ID NO: 1380056 - RNA, 19 nt, Homo sapiens
gcaccuacacuacuuuaag

SEQ ID NO: 1380057 - RNA, 19 nt, Homo sapiens
agaauucaguguguuauca

SEQ ID NO: 1380058 - RNA, 19 nt, Homo sapiens
acugaaacaugaagaggaa

SEQ ID NO: 1380059 - RNA, 19 nt, Homo sapiens
ggcagaauucaguguguua

SEQ ID NO: 1380060 - RNA, 19 nt, Homo sapiens
gaaucaagcaaggaaagaa

SEQ ID NO: 1380061 - RNA, 19 nt, Homo sapiens
caucauuugucaucaaguc

SEQ ID NO: 1380062 - RNA, 19 nt, Homo sapiens
gcagaacuggauccugaaa

SEQ ID NO: 1380063 - RNA, 19 nt, Homo sapiens
acacaugguccgaaagauu

SEQ ID NO: 1380064 - RNA, 19 nt, Homo sapiens
gugagaccuuugcaucuug

SEQ ID NO: 1380065 - RNA, 19 nt, Homo sapiens
gaggcagaauucagugugu

SEQ ID NO: 1380066 - RNA, 19 nt, Homo sapiens
uggaacacaugguccgaaa

SEQ ID NO: 1380067 - RNA, 19 nt, Homo sapiens
ggaagacagaaauaagaau

SEQ ID NO: 1380068 - RNA, 19 nt, Homo sapiens
gacaaacaguacgagauuc

SEQ ID NO: 1380069 - RNA, 19 nt, Homo sapiens
gaccuuugcaucuuguaaa

SEQ ID NO: 1380070 - RNA, 19 nt, Homo sapiens
caagccugauuuccaccua

SEQ ID NO: 1380071 - RNA, 19 nt, Homo sapiens
ggucgaagagugugaugga

SEQ ID NO: 1380072 - RNA, 19 nt, Homo sapiens
gagcagauuagugccauug

SEQ ID NO: 1380073 - RNA, 19 nt, Homo sapiens
ccacaucuuggcuugcuuu

SEQ ID NO: 1380074 - RNA, 19 nt, Homo sapiens
gucaagagagcaaucauca

SEQ ID NO: 1380075 - RNA, 19 nt, Homo sapiens
auuuggaacugaaacauga

SEQ ID NO: 1380076 - RNA, 19 nt, Homo sapiens
aguacgagauucugugugu

SEQ ID NO: 1380077 - RNA, 19 nt, Homo sapiens
ugugagaccuuugcaucuu

SEQ ID NO: 1380078 - RNA, 19 nt, Homo sapiens
cagauuagugccauuggaa

SEQ ID NO: 1380079 - RNA, 19 nt, Homo sapiens
cagcagcagaggaaagaaa

SEQ ID NO: 1380080 - RNA, 19 nt, Homo sapiens
agagugugauggacaaaca

SEQ ID NO: 1380081 - RNA, 19 nt, Homo sapiens
ugaagaggaagacagaaau

SEQ ID NO: 1380082 - RNA, 19 nt, Homo sapiens
aagaaacacuccccgaaaa

SEQ ID NO: 1380083 - RNA, 19 nt, Homo sapiens
acccaaagcagcugucaaa

SEQ ID NO: 1380084 - RNA, 19 nt, Homo sapiens
ggaggagagcagauuagug

SEQ ID NO: 1380085 - RNA, 19 nt, Homo sapiens
uaaaccugcguguauuuga

SEQ ID NO: 1380086 - RNA, 19 nt, Homo sapiens
uguauugugugagaccuuu

SEQ ID NO: 1380087 - RNA, 19 nt, Homo sapiens
aagaggaagacagaaauaa

SEQ ID NO: 1380088 - RNA, 19 nt, Homo sapiens
gcagaauucaguguguuau

SEQ ID NO: 1380089 - RNA, 19 nt, Homo sapiens
gguauuucccuggaggaua

SEQ ID NO: 1380090 - RNA, 19 nt, Homo sapiens
guuggaggagagcagauua

SEQ ID NO: 1380091 - RNA, 19 nt, Homo sapiens
cauacaggccggagcuuau

SEQ ID NO: 1380092 - RNA, 19 nt, Homo sapiens
ggcccagcaucauuuguca

SEQ ID NO: 1380093 - RNA, 19 nt, Homo sapiens
aaucaagcaaggaaagaaa

SEQ ID NO: 1380094 - RNA, 19 nt, Homo sapiens
aaucucaacaaaccacuuu

SEQ ID NO: 1380095 - RNA, 19 nt, Homo sapiens
cacaugguccgaaagauuc

SEQ ID NO: 1380096 - RNA, 19 nt, Homo sapiens
ucuaaaccugcguguauuu

SEQ ID NO: 1380097 - RNA, 19 nt, Homo sapiens
ggaaggggcauaugugugu

SEQ ID NO: 1380098 - RNA, 19 nt, Homo sapiens
gcuaagcaccuacacuacu

SEQ ID NO: 1380099 - RNA, 19 nt, Homo sapiens
aaaccugcguguauuugag

SEQ ID NO: 1380100 - RNA, 19 nt, Homo sapiens
caucuuggcuugcuuuugg

SEQ ID NO: 1380101 - RNA, 19 nt, Homo sapiens
ugaaacaugaagaggaaga

SEQ ID NO: 1380102 - RNA, 19 nt, Homo sapiens
ggaacugaaacaugaagag

SEQ ID NO: 1380103 - RNA, 19 nt, Homo sapiens
gaauuuggaacugaaacau

SEQ ID NO: 1380104 - RNA, 19 nt, Homo sapiens
uagcucaggaggcagaauu

SEQ ID NO: 1380105 - RNA, 19 nt, Homo sapiens
gaaaagaccagagcuaagg

SEQ ID NO: 1380106 - RNA, 19 nt, Homo sapiens
gcaggcagagggcuucuac

SEQ ID NO: 1380107 - RNA, 19 nt, Homo sapiens
gaagagugugauggacaaa

SEQ ID NO: 1380108 - RNA, 19 nt, Homo sapiens
auucuaaaccugcguguau

SEQ ID NO: 1380109 - RNA, 19 nt, Homo sapiens
aagcaccuacacuacuuua

SEQ ID NO: 1380110 - RNA, 19 nt, Homo sapiens
gaauucaguguguuaucau

SEQ ID NO: 1380111 - RNA, 19 nt, Homo sapiens
ccaaagcagcugucaaagc

SEQ ID NO: 1380112 - RNA, 19 nt, Homo sapiens
gaaacacuccccgaaaaga

SEQ ID NO: 1380113 - RNA, 19 nt, Homo sapiens
acauacaggccggagcuua

SEQ ID NO: 1380114 - RNA, 19 nt, Homo sapiens
ugagaccuuugcaucuugu

SEQ ID NO: 1380115 - RNA, 19 nt, Homo sapiens
ucaggaggcagaauucagu

SEQ ID NO: 1380116 - RNA, 19 nt, Homo sapiens
cagaaugaugggccuguga

SEQ ID NO: 1380117 - RNA, 19 nt, Homo sapiens
agggaaacaagccugauuu

SEQ ID NO: 1380118 - RNA, 19 nt, Homo sapiens
ucucaacaaaccacuuuau

SEQ ID NO: 1380119 - RNA, 19 nt, Homo sapiens
aggaagacagaaauaagaa

SEQ ID NO: 1380120 - RNA, 19 nt, Homo sapiens
gaccauagagcuggaaucg

SEQ ID NO: 1380121 - RNA, 19 nt, Homo sapiens
aggcagagggcuucuacaa

SEQ ID NO: 1380122 - RNA, 19 nt, Homo sapiens
ccaguuuacccuccagugu

SEQ ID NO: 1380123 - RNA, 19 nt, Homo sapiens
acacucacacuguccaugu

SEQ ID NO: 1380124 - RNA, 19 nt, Homo sapiens
acaugaagaggaagacaga

SEQ ID NO: 1380125 - RNA, 19 nt, Homo sapiens
uaagcaccuacacuacuuu

SEQ ID NO: 1380126 - RNA, 19 nt, Homo sapiens
gaagggaaacaagccugau

SEQ ID NO: 1380127 - RNA, 19 nt, Homo sapiens
cucaacaaaccacuuuauu

SEQ ID NO: 1380128 - RNA, 19 nt, Homo sapiens
uggaggauacgcagaagga

SEQ ID NO: 1380129 - RNA, 19 nt, Homo sapiens
uccaauacacucacacugu

SEQ ID NO: 1380130 - RNA, 19 nt, Homo sapiens
uccgaaagauucuaaaccu

SEQ ID NO: 1380131 - RNA, 19 nt, Homo sapiens
agaggaagacagaaauaag

SEQ ID NO: 1380132 - RNA, 19 nt, Homo sapiens
aaacagcagcagaggaaag

SEQ ID NO: 1380133 - RNA, 19 nt, Homo sapiens
gcagagauaugaacaauua

SEQ ID NO: 1380134 - RNA, 19 nt, Homo sapiens
ggagggagaugauuuccua

SEQ ID NO: 1380135 - RNA, 19 nt, Homo sapiens
gaaguucugugauguguga

SEQ ID NO: 1380136 - RNA, 19 nt, Homo sapiens
guacaaagaagccagauuu

SEQ ID NO: 1380137 - RNA, 19 nt, Homo sapiens
gauauuagcaccucacgua

SEQ ID NO: 1380138 - RNA, 19 nt, Homo sapiens
ggacaggagaguacaauuu

SEQ ID NO: 1380139 - RNA, 19 nt, Homo sapiens
gacaggagaguacaauuua

SEQ ID NO: 1380140 - RNA, 19 nt, Homo sapiens
ucacguacuuugcaauuaa

SEQ ID NO: 1380141 - RNA, 19 nt, Homo sapiens
gggaguaugugacuaaaug

SEQ ID NO: 1380142 - RNA, 19 nt, Homo sapiens
gaccaaaccuaaagaguca

SEQ ID NO: 1380143 - RNA, 19 nt, Homo sapiens
gagaugauuuccuagacua

SEQ ID NO: 1380144 - RNA, 19 nt, Homo sapiens
aaacaaguccaacucuuua

SEQ ID NO: 1380145 - RNA, 19 nt, Homo sapiens
gaaguguauuucuuucuug

SEQ ID NO: 1380146 - RNA, 19 nt, Homo sapiens
gaacugcugcgaugaauca

SEQ ID NO: 1380147 - RNA, 19 nt, Homo sapiens
uaagaggucagcagaauuu

SEQ ID NO: 1380148 - RNA, 19 nt, Homo sapiens
caccauacccggcuaauuu

SEQ ID NO: 1380149 - RNA, 19 nt, Homo sapiens
gcacacacccuuccuguuc

SEQ ID NO: 1380150 - RNA, 19 nt, Homo sapiens
ggcacaagaucucguauug

SEQ ID NO: 1380151 - RNA, 19 nt, Homo sapiens
gggacgagguggugauauu

SEQ ID NO: 1380152 - RNA, 19 nt, Homo sapiens
gguaaagauuuguguguau

SEQ ID NO: 1380153 - RNA, 19 nt, Homo sapiens
caaagcaguucacccaaug

SEQ ID NO: 1380154 - RNA, 19 nt, Homo sapiens
caaacaaguccaacucuuu

SEQ ID NO: 1380155 - RNA, 19 nt, Homo sapiens
cagaauccaucaucaucua

SEQ ID NO: 1380156 - RNA, 19 nt, Homo sapiens
agaaagagcugcaggaacu

SEQ ID NO: 1380157 - RNA, 19 nt, Homo sapiens
gaacugaccaaaccuaaag

SEQ ID NO: 1380158 - RNA, 19 nt, Homo sapiens
cagcagaauuuggagauuu

SEQ ID NO: 1380159 - RNA, 19 nt, Homo sapiens
agauuuagcugcauagaau

SEQ ID NO: 1380160 - RNA, 19 nt, Homo sapiens
gaaagagucacgcccagaa

SEQ ID NO: 1380161 - RNA, 19 nt, Homo sapiens
ggugcucuauggugcauua

SEQ ID NO: 1380162 - RNA, 19 nt, Homo sapiens
gauuuagccuucuguuguu

SEQ ID NO: 1380163 - RNA, 19 nt, Homo sapiens
ccacucgauucuucuuaua

SEQ ID NO: 1380164 - RNA, 19 nt, Homo sapiens
gugcugagcuccaccuuca

SEQ ID NO: 1380165 - RNA, 19 nt, Homo sapiens
ccaaacugcuaauaugguu

SEQ ID NO: 1380166 - RNA, 19 nt, Homo sapiens
agacagggauggagugaga

SEQ ID NO: 1380167 - RNA, 19 nt, Homo sapiens
gagauuuggguccuuauaa

SEQ ID NO: 1380168 - RNA, 19 nt, Homo sapiens
ccacagacaugaucuuugc

SEQ ID NO: 1380169 - RNA, 19 nt, Homo sapiens
aaaagaggcuggaaaugua

SEQ ID NO: 1380170 - RNA, 19 nt, Homo sapiens
ggagugagacauuuaggaa

SEQ ID NO: 1380171 - RNA, 19 nt, Homo sapiens
gaaaucagaguccauacug

SEQ ID NO: 1380172 - RNA, 19 nt, Homo sapiens
ggucuaaacucccaacaac

SEQ ID NO: 1380173 - RNA, 19 nt, Homo sapiens
caagcacucucuccaacaa

SEQ ID NO: 1380174 - RNA, 19 nt, Homo sapiens
gaucuuugcugugcugaga

SEQ ID NO: 1380175 - RNA, 19 nt, Homo sapiens
caaguccaacucuuuauaa

SEQ ID NO: 1380176 - RNA, 19 nt, Homo sapiens
uauuuaggccugaaucuua

SEQ ID NO: 1380177 - RNA, 19 nt, Homo sapiens
cgucaggucuggaauggaa

SEQ ID NO: 1380178 - RNA, 19 nt, Homo sapiens
caaauccaccaagauaaua

SEQ ID NO: 1380179 - RNA, 19 nt, Homo sapiens
guaaccaaauccaccaaga

SEQ ID NO: 1380180 - RNA, 19 nt, Homo sapiens
ccaaagcaguucacccaau

SEQ ID NO: 1380181 - RNA, 19 nt, Homo sapiens
caggagaguacaauuuaua

SEQ ID NO: 1380182 - RNA, 19 nt, Homo sapiens
uagcagaagguaaagauuu

SEQ ID NO: 1380183 - RNA, 19 nt, Homo sapiens
ggauggagugagacauuua

SEQ ID NO: 1380184 - RNA, 19 nt, Homo sapiens
gggauggagugagacauuu

SEQ ID NO: 1380185 - RNA, 19 nt, Homo sapiens
uccagcagauuauuucuuu

SEQ ID NO: 1380186 - RNA, 19 nt, Homo sapiens
ggaagagccaacagcagua

SEQ ID NO: 1380187 - RNA, 19 nt, Homo sapiens
ggagauuuggguccuuaua

SEQ ID NO: 1380188 - RNA, 19 nt, Homo sapiens
gacgagguggugauauuua

SEQ ID NO: 1380189 - RNA, 19 nt, Homo sapiens
ucaaggagacuucccagaa

SEQ ID NO: 1380190 - RNA, 19 nt, Homo sapiens
guaaagauuuguguguauc

SEQ ID NO: 1380191 - RNA, 19 nt, Homo sapiens
caauggaacucugcugugu

SEQ ID NO: 1380192 - RNA, 19 nt, Homo sapiens
guauugcccuugccucguu

SEQ ID NO: 1380193 - RNA, 19 nt, Homo sapiens
caacaucuuccucguguau

SEQ ID NO: 1380194 - RNA, 19 nt, Homo sapiens
gagaacugcugcgaugaau

SEQ ID NO: 1380195 - RNA, 19 nt, Homo sapiens
ggugauauuuaaccuagau

SEQ ID NO: 1380196 - RNA, 19 nt, Homo sapiens
ggacgagguggugauauuu

SEQ ID NO: 1380197 - RNA, 19 nt, Homo sapiens
gcuauauucucagcuaaau

SEQ ID NO: 1380198 - RNA, 19 nt, Homo sapiens
caagauagaaguguauuuc

SEQ ID NO: 1380199 - RNA, 19 nt, Homo sapiens
ucaaacaaguccaacucuu

SEQ ID NO: 1380200 - RNA, 19 nt, Homo sapiens
aaaccucacucagagcuuu

SEQ ID NO: 1380201 - RNA, 19 nt, Homo sapiens
ucuguaaugucaugugauu

SEQ ID NO: 1380202 - RNA, 19 nt, Homo sapiens
aaggaagaaugguuauuug

SEQ ID NO: 1380203 - RNA, 19 nt, Homo sapiens
ggaaacgacgccugaagga

SEQ ID NO: 1380204 - RNA, 19 nt, Homo sapiens
uagcagagauaugaacaau

SEQ ID NO: 1380205 - RNA, 19 nt, Homo sapiens
guucaugucucaaaacaaa

SEQ ID NO: 1380206 - RNA, 19 nt, Homo sapiens
ccuaagaggucagcagaau

SEQ ID NO: 1380207 - RNA, 19 nt, Homo sapiens
ggaauugcaucugccaaag

SEQ ID NO: 1380208 - RNA, 19 nt, Homo sapiens
caacaucccagugcugauu

SEQ ID NO: 1380209 - RNA, 19 nt, Homo sapiens
cccaguagccuauauauca

SEQ ID NO: 1380210 - RNA, 19 nt, Homo sapiens
gaaucaaaccagaggaguu

SEQ ID NO: 1380211 - RNA, 19 nt, Homo sapiens
ccaaauccaccaagauaau

SEQ ID NO: 1380212 - RNA, 19 nt, Homo sapiens
aaccaaauccaccaagaua

SEQ ID NO: 1380213 - RNA, 19 nt, Homo sapiens
gcauggagcagacaagcaa

SEQ ID NO: 1380214 - RNA, 19 nt, Homo sapiens
aaagagucaucaagggaaa

SEQ ID NO: 1380215 - RNA, 19 nt, Homo sapiens
ggaacugaccaaaccuaaa

SEQ ID NO: 1380216 - RNA, 19 nt, Homo sapiens
ggagaugauuuccuagacu

SEQ ID NO: 1380217 - RNA, 19 nt, Homo sapiens
ggaguguaaacuagauuaa

SEQ ID NO: 1380218 - RNA, 19 nt, Homo sapiens
gggaguguaaacuagauua

SEQ ID NO: 1380219 - RNA, 19 nt, Homo sapiens
caagaccucagucacauga

SEQ ID NO: 1380220 - RNA, 19 nt, Homo sapiens
ccagaagucccacucgauu

SEQ ID NO: 1380221 - RNA, 19 nt, Homo sapiens
uuaggaagcuggacuacca

SEQ ID NO: 1380222 - RNA, 19 nt, Homo sapiens
ccagcagauuauuucuuua

SEQ ID NO: 1380223 - RNA, 19 nt, Homo sapiens
caaagaagccagauuuagc

SEQ ID NO: 1380224 - RNA, 19 nt, Homo sapiens
gaaacgacgccugaaggaa

SEQ ID NO: 1380225 - RNA, 19 nt, Homo sapiens
acagagagcccaggacauu

SEQ ID NO: 1380226 - RNA, 19 nt, Homo sapiens
cuugggacaucuuugcaua

SEQ ID NO: 1380227 - RNA, 19 nt, Homo sapiens
ugaauaugcuauacaucga

SEQ ID NO: 1380228 - RNA, 19 nt, Homo sapiens
aauacuggguucacgcuaa

SEQ ID NO: 1380229 - RNA, 19 nt, Homo sapiens
ccugggacccugugaagua

SEQ ID NO: 1380230 - RNA, 19 nt, Homo sapiens
cuaaaugugucagggagaa

SEQ ID NO: 1380231 - RNA, 19 nt, Homo sapiens
cuaaacucccaacaacuua

SEQ ID NO: 1380232 - RNA, 19 nt, Homo sapiens
gcucuauggugcauuagca

SEQ ID NO: 1380233 - RNA, 19 nt, Homo sapiens
ggaaugauauuuacucugu

SEQ ID NO: 1380234 - RNA, 19 nt, Homo sapiens
gcacagcguucggcucuuu

SEQ ID NO: 1380235 - RNA, 19 nt, Homo sapiens
gaacagacaggaaccaaug

SEQ ID NO: 1380236 - RNA, 19 nt, Homo sapiens
caaggaaguuucagcauuc

SEQ ID NO: 1380237 - RNA, 19 nt, Homo sapiens
gcucgaaucuccaagaauc

SEQ ID NO: 1380238 - RNA, 19 nt, Homo sapiens
gaaccaaugugggaauuca

SEQ ID NO: 1380239 - RNA, 19 nt, Homo sapiens
gaggaaagcauccaugaga

SEQ ID NO: 1380240 - RNA, 19 nt, Homo sapiens
cugaggacauugugaauuu

SEQ ID NO: 1380241 - RNA, 19 nt, Homo sapiens
gcuauugaguuuguucuuu

SEQ ID NO: 1380242 - RNA, 19 nt, Homo sapiens
cgacagcagugaugagaug

SEQ ID NO: 1380243 - RNA, 19 nt, Homo sapiens
gagugaccguggcggauua

SEQ ID NO: 1380244 - RNA, 19 nt, Homo sapiens
gaggaaagcgacucaaguu

SEQ ID NO: 1380245 - RNA, 19 nt, Homo sapiens
acaaggaaguuucagcauu

SEQ ID NO: 1380246 - RNA, 19 nt, Homo sapiens
caggguggcuggauuguau

SEQ ID NO: 1380247 - RNA, 19 nt, Homo sapiens
caagagacacaaagaagaa

SEQ ID NO: 1380248 - RNA, 19 nt, Homo sapiens
gcaagagacacaaagaaga

SEQ ID NO: 1380249 - RNA, 19 nt, Homo sapiens
cgaguguaguccauuagua

SEQ ID NO: 1380250 - RNA, 19 nt, Homo sapiens
gaacagggugugcaaguca

SEQ ID NO: 1380251 - RNA, 19 nt, Homo sapiens
uuagaggccugaaauuguu

SEQ ID NO: 1380252 - RNA, 19 nt, Homo sapiens
gaguguaguccauuaguaa

SEQ ID NO: 1380253 - RNA, 19 nt, Homo sapiens
gaaguaaaaucucuuugug

SEQ ID NO: 1380254 - RNA, 19 nt, Homo sapiens
ccucgaguguaguccauua

SEQ ID NO: 1380255 - RNA, 19 nt, Homo sapiens
agacugguguuccaagauu

SEQ ID NO: 1380256 - RNA, 19 nt, Homo sapiens
ggaaagcauccaugagaga

SEQ ID NO: 1380257 - RNA, 19 nt, Homo sapiens
gauuguauaucucguuagu

SEQ ID NO: 1380258 - RNA, 19 nt, Homo sapiens
aagaaugccuggacuguca

SEQ ID NO: 1380259 - RNA, 19 nt, Homo sapiens
gaaagcauccaugagagaa

SEQ ID NO: 1380260 - RNA, 19 nt, Homo sapiens
ggacaggguggcuggauug

SEQ ID NO: 1380261 - RNA, 19 nt, Homo sapiens
aauuguugcuuccaguuua

SEQ ID NO: 1380262 - RNA, 19 nt, Homo sapiens
gaaauuguugcuuccaguu

SEQ ID NO: 1380263 - RNA, 19 nt, Homo sapiens
guauaucucguuaguaaug

SEQ ID NO: 1380264 - RNA, 19 nt, Homo sapiens
guacgaagauguucauacc

SEQ ID NO: 1380265 - RNA, 19 nt, Homo sapiens
uggauuguauaucucguua

SEQ ID NO: 1380266 - RNA, 19 nt, Homo sapiens
agggagaaauguugaauca

SEQ ID NO: 1380267 - RNA, 19 nt, Homo sapiens
cacccucaauuucaucuuu

SEQ ID NO: 1380268 - RNA, 19 nt, Homo sapiens
gagaagaguaucccaugga

SEQ ID NO: 1380269 - RNA, 19 nt, Homo sapiens
ccucucagguuccuacaga

SEQ ID NO: 1380270 - RNA, 19 nt, Homo sapiens
acgaagauguucauaccaa

SEQ ID NO: 1380271 - RNA, 19 nt, Homo sapiens
ggugagcccugugacauca

SEQ ID NO: 1380272 - RNA, 19 nt, Homo sapiens
gcacauuaaagaauuccaa

SEQ ID NO: 1380273 - RNA, 19 nt, Homo sapiens
gccauuugcugcucgaauc

SEQ ID NO: 1380274 - RNA, 19 nt, Homo sapiens
gaccagagucaauggagaa

SEQ ID NO: 1380275 - RNA, 19 nt, Homo sapiens
gaucagaggaaccuuagag

SEQ ID NO: 1380276 - RNA, 19 nt, Homo sapiens
gaagauguucauaccaauc

SEQ ID NO: 1380277 - RNA, 19 nt, Homo sapiens
cgaagauguucauaccaau

SEQ ID NO: 1380278 - RNA, 19 nt, Homo sapiens
cccagcacauuaaagaauu

SEQ ID NO: 1380279 - RNA, 19 nt, Homo sapiens
ggucaccacccucaauuuc

SEQ ID NO: 1380280 - RNA, 19 nt, Homo sapiens
ggcuauugcuggccuccua

SEQ ID NO: 1380281 - RNA, 19 nt, Homo sapiens
ccauggauauuuggcuauu

SEQ ID NO: 1380282 - RNA, 19 nt, Homo sapiens
gguucuagggcuccuguua

SEQ ID NO: 1380283 - RNA, 19 nt, Homo sapiens
uccgaucucuguaccauau

SEQ ID NO: 1380284 - RNA, 19 nt, Homo sapiens
ugagacugguguuccaaga

SEQ ID NO: 1380285 - RNA, 19 nt, Homo sapiens
gaaccuuagaggccugaaa

SEQ ID NO: 1380286 - RNA, 19 nt, Homo sapiens
ucaccacccucaauuucau

SEQ ID NO: 1380287 - RNA, 19 nt, Homo sapiens
gcaggucaccacccucaau

SEQ ID NO: 1380288 - RNA, 19 nt, Homo sapiens
caaguguacaggaggauug

SEQ ID NO: 1380289 - RNA, 19 nt, Homo sapiens
ggaacagacaggaaccaau

SEQ ID NO: 1380290 - RNA, 19 nt, Homo sapiens
guaagaaugccuggacugu

SEQ ID NO: 1380291 - RNA, 19 nt, Homo sapiens
ugaucuugcuguagggaaa

SEQ ID NO: 1380292 - RNA, 19 nt, Homo sapiens
gggaaaacaacuacuauga

SEQ ID NO: 1380293 - RNA, 19 nt, Homo sapiens
cacuugcacugcugccuuu

SEQ ID NO: 1380294 - RNA, 19 nt, Homo sapiens
gaaaagcaagagacacaaa

SEQ ID NO: 1380295 - RNA, 19 nt, Homo sapiens
uguacaugcucuucagguu

SEQ ID NO: 1380296 - RNA, 19 nt, Homo sapiens
acccucaauuucaucuuua

SEQ ID NO: 1380297 - RNA, 19 nt, Homo sapiens
gagaggaaagcgacucaag

SEQ ID NO: 1380298 - RNA, 19 nt, Homo sapiens
uaauguacaugcucuucag

SEQ ID NO: 1380299 - RNA, 19 nt, Homo sapiens
gaauuccaaaugcuuacuu

SEQ ID NO: 1380300 - RNA, 19 nt, Homo sapiens
ggucuggacgagucaagaa

SEQ ID NO: 1380301 - RNA, 19 nt, Homo sapiens
ccagcacauuaaagaauuc

SEQ ID NO: 1380302 - RNA, 19 nt, Homo sapiens
guggcuggauuguauaucu

SEQ ID NO: 1380303 - RNA, 19 nt, Homo sapiens
gauugcagccucccguuca

SEQ ID NO: 1380304 - RNA, 19 nt, Homo sapiens
ggagggagaaauguugaau

SEQ ID NO: 1380305 - RNA, 19 nt, Homo sapiens
guaauguacaugcucuuca

SEQ ID NO: 1380306 - RNA, 19 nt, Homo sapiens
gagugagacugguguucca

SEQ ID NO: 1380307 - RNA, 19 nt, Homo sapiens
uggagaagcugcgcugucu

SEQ ID NO: 1380308 - RNA, 19 nt, Homo sapiens
agcauucccuuauggauca

SEQ ID NO: 1380309 - RNA, 19 nt, Homo sapiens
gaaaauuguugaucuugcu

SEQ ID NO: 1380310 - RNA, 19 nt, Homo sapiens
uaaaaggaguggcccuguu

SEQ ID NO: 1380311 - RNA, 19 nt, Homo sapiens
ggaaaacaacuacuaugau

SEQ ID NO: 1380312 - RNA, 19 nt, Homo sapiens
gcaaguguacaggaggauu

SEQ ID NO: 1380313 - RNA, 19 nt, Homo sapiens
gguuaaagagcaaguguac

SEQ ID NO: 1380314 - RNA, 19 nt, Homo sapiens
ggaaguaaaaucucuuugu

SEQ ID NO: 1380315 - RNA, 19 nt, Homo sapiens
ucuccgggcuugugugauc

SEQ ID NO: 1380316 - RNA, 19 nt, Homo sapiens
aaagcaagagacacaaaga

SEQ ID NO: 1380317 - RNA, 19 nt, Homo sapiens
ucccugauuuguaagaaug

SEQ ID NO: 1380318 - RNA, 19 nt, Homo sapiens
cuuagaggccugaaauugu

SEQ ID NO: 1380319 - RNA, 19 nt, Homo sapiens
ccuuagaggccugaaauug

SEQ ID NO: 1380320 - RNA, 19 nt, Homo sapiens
cuuggaagccucucagguu

SEQ ID NO: 1380321 - RNA, 19 nt, Homo sapiens
cagcagugaugagauggau

SEQ ID NO: 1380322 - RNA, 19 nt, Homo sapiens
uuaaagagcaaguguacag

SEQ ID NO: 1380323 - RNA, 19 nt, Homo sapiens
gaucucuguaccauaugua

SEQ ID NO: 1380324 - RNA, 19 nt, Homo sapiens
cagagucaauggagaagcu

SEQ ID NO: 1380325 - RNA, 19 nt, Homo sapiens
aagcaagagacacaaagaa

SEQ ID NO: 1380326 - RNA, 19 nt, Homo sapiens
aauuguugaucuugcugua

SEQ ID NO: 1380327 - RNA, 19 nt, Homo sapiens
cuccaagaauccagccauu

SEQ ID NO: 1380328 - RNA, 19 nt, Homo sapiens
aaauuguugcuuccaguuu

SEQ ID NO: 1380329 - RNA, 19 nt, Homo sapiens
uacaugcucuucagguucu

SEQ ID NO: 1380330 - RNA, 19 nt, Homo sapiens
uggacaggguggcuggauu

SEQ ID NO: 1380331 - RNA, 19 nt, Homo sapiens
ugaacagggugugcaaguc

SEQ ID NO: 1380332 - RNA, 19 nt, Homo sapiens
caggucaccacccucaauu

SEQ ID NO: 1380333 - RNA, 19 nt, Homo sapiens
ccacaucgacuacuacuua

SEQ ID NO: 1380334 - RNA, 19 nt, Homo sapiens
caacaaggcuaaugacaca

SEQ ID NO: 1380335 - RNA, 19 nt, Homo sapiens
agacaacuccuguaaauaa

SEQ ID NO: 1380336 - RNA, 19 nt, Homo sapiens
gaacagcaucccagacauu

SEQ ID NO: 1380337 - RNA, 19 nt, Homo sapiens
gacaacuccuguaaauaaa

SEQ ID NO: 1380338 - RNA, 19 nt, Homo sapiens
agagacaacuccuguaaau

SEQ ID NO: 1380339 - RNA, 19 nt, Homo sapiens
ugcagaaaguguccuauaa

SEQ ID NO: 1380340 - RNA, 19 nt, Homo sapiens
gaggguuacuucaacaguu

SEQ ID NO: 1380341 - RNA, 19 nt, Homo sapiens
ggaggaggguuacuucaac

SEQ ID NO: 1380342 - RNA, 19 nt, Homo sapiens
gagugcagcucuucgagau

SEQ ID NO: 1380343 - RNA, 19 nt, Homo sapiens
ccucgugccuucucucuug

SEQ ID NO: 1380344 - RNA, 19 nt, Homo sapiens
gcugggaccuggagagaca

SEQ ID NO: 1380345 - RNA, 19 nt, Homo sapiens
gagacaacuccuguaaaua

SEQ ID NO: 1380346 - RNA, 19 nt, Homo sapiens
cacccucccuugugcauuu

SEQ ID NO: 1380347 - RNA, 19 nt, Homo sapiens
cagaaaguguccuauaagg

SEQ ID NO: 1380348 - RNA, 19 nt, Homo sapiens
gcagaaaguguccuauaag

SEQ ID NO: 1380349 - RNA, 19 nt, Homo sapiens
gagagacaacuccuguaaa

SEQ ID NO: 1380350 - RNA, 19 nt, Homo sapiens
gcagcugcaugccgacguu

SEQ ID NO: 1380351 - RNA, 19 nt, Homo sapiens
gugcagcucuucgagauca

SEQ ID NO: 1380352 - RNA, 19 nt, Homo sapiens
gaggaggguuacuucaaca

SEQ ID NO: 1380353 - RNA, 19 nt, Homo sapiens
gcagccucguguucuauau

SEQ ID NO: 1380354 - RNA, 19 nt, Homo sapiens
ccuacaagcuggugaagac

SEQ ID NO: 1380355 - RNA, 19 nt, Homo sapiens
caauauugcugugaaccau

SEQ ID NO: 1380356 - RNA, 19 nt, Homo sapiens
ucauccacaucgacuacua

SEQ ID NO: 1380357 - RNA, 19 nt, Homo sapiens
ccacugcacccacguccuu

SEQ ID NO: 1380358 - RNA, 19 nt, Homo sapiens
cugcagaaaguguccuaua

SEQ ID NO: 1380359 - RNA, 19 nt, Homo sapiens
caagugcagccucguguuc

SEQ ID NO: 1380360 - RNA, 19 nt, Homo sapiens
ugacacagcguggguagug

SEQ ID NO: 1380361 - RNA, 19 nt, Homo sapiens
gagcugggaccuggagaga

SEQ ID NO: 1380362 - RNA, 19 nt, Homo sapiens
gcgcuggauccacgacgua

SEQ ID NO: 1380363 - RNA, 19 nt, Homo sapiens
accagcaccuugauucuuc

SEQ ID NO: 1380364 - RNA, 19 nt, Homo sapiens
gaggguccuuucgggaaga

SEQ ID NO: 1380365 - RNA, 19 nt, Homo sapiens
ggguaguggaggaggguua

SEQ ID NO: 1380366 - RNA, 19 nt, Homo sapiens
ccuugaaccugaacagcau

SEQ ID NO: 1380367 - RNA, 19 nt, Homo sapiens
gcugcagccucauccacau

SEQ ID NO: 1380368 - RNA, 19 nt, Homo sapiens
gauucuuccuccagaguac

SEQ ID NO: 1380369 - RNA, 19 nt, Homo sapiens
ccucugccaccaagaaguu

SEQ ID NO: 1380370 - RNA, 19 nt, Homo sapiens
ugaacagcaucccagacau

SEQ ID NO: 1380371 - RNA, 19 nt, Homo sapiens
ggaggguuacuucaacagu

SEQ ID NO: 1380372 - RNA, 19 nt, Homo sapiens
aggguuacuucaacaguuc

SEQ ID NO: 1380373 - RNA, 19 nt, Homo sapiens
acuuacaggucucucugaa

SEQ ID NO: 1380374 - RNA, 19 nt, Homo sapiens
cauccacacgccacgguuu

SEQ ID NO: 1380375 - RNA, 19 nt, Homo sapiens
ucuccaacaaggcuaauga

SEQ ID NO: 1380376 - RNA, 19 nt, Homo sapiens
ccucguguucuauaucuug

SEQ ID NO: 1380377 - RNA, 19 nt, Homo sapiens
gaacugagcuugaaaucau

SEQ ID NO: 1380378 - RNA, 19 nt, Homo sapiens
gaacaaggguggaauggaa

SEQ ID NO: 1380379 - RNA, 19 nt, Homo sapiens
gcuguugacuucucuuaaa

SEQ ID NO: 1380380 - RNA, 19 nt, Homo sapiens
gaccagcccuugaagauca

SEQ ID NO: 1380381 - RNA, 19 nt, Homo sapiens
gaaugaagccacucacaga

SEQ ID NO: 1380382 - RNA, 19 nt, Homo sapiens
ggagggagacugcgaguga

SEQ ID NO: 1380383 - RNA, 19 nt, Homo sapiens
gaaaguggacugggugauu

SEQ ID NO: 1380384 - RNA, 19 nt, Homo sapiens
cagaaaagcuguugacuuc

SEQ ID NO: 1380385 - RNA, 19 nt, Homo sapiens
ccugacaucucacacauug

SEQ ID NO: 1380386 - RNA, 19 nt, Homo sapiens
caggguacccggcaaauuu

SEQ ID NO: 1380387 - RNA, 19 nt, Homo sapiens
gcagauuuguuaaguuucu

SEQ ID NO: 1380388 - RNA, 19 nt, Homo sapiens
ccaacacccugucaugaau

SEQ ID NO: 1380389 - RNA, 19 nt, Homo sapiens
guuuccagcuugcagauuu

SEQ ID NO: 1380390 - RNA, 19 nt, Homo sapiens
gcuuuaagauccucaacug

SEQ ID NO: 1380391 - RNA, 19 nt, Homo sapiens
gcacaguggcuuuaagauc

SEQ ID NO: 1380392 - RNA, 19 nt, Homo sapiens
gggaccaccucaucagaga

SEQ ID NO: 1380393 - RNA, 19 nt, Homo sapiens
cgacgguccugacaucuca

SEQ ID NO: 1380394 - RNA, 19 nt, Homo sapiens
ucacagagggcaugaggaa

SEQ ID NO: 1380395 - RNA, 19 nt, Homo sapiens
gaaaagauacuucugcaau

SEQ ID NO: 1380396 - RNA, 19 nt, Homo sapiens
ccagcuugcagauuuguua

SEQ ID NO: 1380397 - RNA, 19 nt, Homo sapiens
guugacuucucuuaaauca

SEQ ID NO: 1380398 - RNA, 19 nt, Homo sapiens
ucaaugacaacaacucuau

SEQ ID NO: 1380399 - RNA, 19 nt, Homo sapiens
gaagggugcaagcgaguug

SEQ ID NO: 1380400 - RNA, 19 nt, Homo sapiens
gaaucaaguggcacccuuu

SEQ ID NO: 1380401 - RNA, 19 nt, Homo sapiens
aagcagccguuggcagaua

SEQ ID NO: 1380402 - RNA, 19 nt, Homo sapiens
aaaguggacugggugauuc

SEQ ID NO: 1380403 - RNA, 19 nt, Homo sapiens
gccaacacccugucaugaa

SEQ ID NO: 1380404 - RNA, 19 nt, Homo sapiens
ggcccaggcugcagaaagu

SEQ ID NO: 1380405 - RNA, 19 nt, Homo sapiens
ucaggcagauuuugacuuu

SEQ ID NO: 1380406 - RNA, 19 nt, Homo sapiens
gaaaagcuguugacuucuc

SEQ ID NO: 1380407 - RNA, 19 nt, Homo sapiens
cggaaggagucgcgagaga

SEQ ID NO: 1380408 - RNA, 19 nt, Homo sapiens
gcuggaugaugggcuguuu

SEQ ID NO: 1380409 - RNA, 19 nt, Homo sapiens
gggaagcuaugaugaacac

SEQ ID NO: 1380410 - RNA, 19 nt, Homo sapiens
auccagaaauuguguauuc

SEQ ID NO: 1380411 - RNA, 19 nt, Homo sapiens
ggaacugagcuugaaauca

SEQ ID NO: 1380412 - RNA, 19 nt, Homo sapiens
cagagggcaugaggaagaa

SEQ ID NO: 1380413 - RNA, 19 nt, Homo sapiens
ccgacucgcugguguaugg

SEQ ID NO: 1380414 - RNA, 19 nt, Homo sapiens
ccacgggaagcuaugauga

SEQ ID NO: 1380415 - RNA, 19 nt, Homo sapiens
ugaagaucaucagcaguga

SEQ ID NO: 1380416 - RNA, 19 nt, Homo sapiens
gggaccagcccuugaagau

SEQ ID NO: 1380417 - RNA, 19 nt, Homo sapiens
cugcaauccuggacaugaa

SEQ ID NO: 1380418 - RNA, 19 nt, Homo sapiens
ugacuuucagccuuucaua

SEQ ID NO: 1380419 - RNA, 19 nt, Homo sapiens
acagagggcaugaggaaga

SEQ ID NO: 1380420 - RNA, 19 nt, Homo sapiens
ggccgucucuuccuguaca

SEQ ID NO: 1380421 - RNA, 19 nt, Homo sapiens
ggagcagugucuggcuuug

SEQ ID NO: 1380422 - RNA, 19 nt, Homo sapiens
ggcuggacaugcccucuug

SEQ ID NO: 1380423 - RNA, 19 nt, Homo sapiens
uuucagccuuucauacuug

SEQ ID NO: 1380424 - RNA, 19 nt, Homo sapiens
gcuugcagauuuguuaagu

SEQ ID NO: 1380425 - RNA, 19 nt, Homo sapiens
gaagcuaugaugaacacau

SEQ ID NO: 1380426 - RNA, 19 nt, Homo sapiens
gccacgugcuggagccauu

SEQ ID NO: 1380427 - RNA, 19 nt, Homo sapiens
gccaguggauccauacaac

SEQ ID NO: 1380428 - RNA, 19 nt, Homo sapiens
ggacacacgaaacaugaag

SEQ ID NO: 1380429 - RNA, 19 nt, Homo sapiens
ucaauucgaggccuggauu

SEQ ID NO: 1380430 - RNA, 19 nt, Homo sapiens
ccucauggcaggcacauca

SEQ ID NO: 1380431 - RNA, 19 nt, Homo sapiens
caagacggcagaccugaag

SEQ ID NO: 1380432 - RNA, 19 nt, Homo sapiens
ggaauccacaguguaguca

SEQ ID NO: 1380433 - RNA, 19 nt, Homo sapiens
ccaccugcuccuucuauga

SEQ ID NO: 1380434 - RNA, 19 nt, Homo sapiens
uggucgagguccaaagaaa

SEQ ID NO: 1380435 - RNA, 19 nt, Homo sapiens
ccugggcacugauggaauc

SEQ ID NO: 1380436 - RNA, 19 nt, Homo sapiens
aggccuggauugcugcuuu

SEQ ID NO: 1380437 - RNA, 19 nt, Homo sapiens
ugcagaaaguggccucaug

SEQ ID NO: 1380438 - RNA, 19 nt, Homo sapiens
aauccacaguguagucaga

SEQ ID NO: 1380439 - RNA, 19 nt, Homo sapiens
gaggggaacugagcuugaa

SEQ ID NO: 1380440 - RNA, 19 nt, Homo sapiens
aggguggaauggaaguuaa

SEQ ID NO: 1380441 - RNA, 19 nt, Homo sapiens
cagccuuucauacuuguuu

SEQ ID NO: 1380442 - RNA, 19 nt, Homo sapiens
ccagaacaaggguggaaug

SEQ ID NO: 1380443 - RNA, 19 nt, Homo sapiens
caugaaugcagagaggaua

SEQ ID NO: 1380444 - RNA, 19 nt, Homo sapiens
caacacccugucaugaaug

SEQ ID NO: 1380445 - RNA, 19 nt, Homo sapiens
ggaccagcccuugaagauc

SEQ ID NO: 1380446 - RNA, 19 nt, Homo sapiens
agaugccaguggauccaua

SEQ ID NO: 1380447 - RNA, 19 nt, Homo sapiens
guccuuuccuagcaaccua

SEQ ID NO: 1380448 - RNA, 19 nt, Homo sapiens
guccugacaucucacacau

SEQ ID NO: 1380449 - RNA, 19 nt, Homo sapiens
gcaugcacaguggcuuuaa

SEQ ID NO: 1380450 - RNA, 19 nt, Homo sapiens
aaagauacuucugcaaucc

SEQ ID NO: 1380451 - RNA, 19 nt, Homo sapiens
caaugacaacaacucuauu

SEQ ID NO: 1380452 - RNA, 19 nt, Homo sapiens
gcagcuccaccuccugaug

SEQ ID NO: 1380453 - RNA, 19 nt, Homo sapiens
caugaaauggugucacauc

SEQ ID NO: 1380454 - RNA, 19 nt, Homo sapiens
ccaagacggcagaccugaa

SEQ ID NO: 1380455 - RNA, 19 nt, Homo sapiens
cauggcaggcacaucaauu

SEQ ID NO: 1380456 - RNA, 19 nt, Homo sapiens
aagcuguugacuucucuua

SEQ ID NO: 1380457 - RNA, 19 nt, Homo sapiens
gcaauccuggacaugaaau

SEQ ID NO: 1380458 - RNA, 19 nt, Homo sapiens
uaggccgucucuuccugua

SEQ ID NO: 1380459 - RNA, 19 nt, Homo sapiens
gcauccagaaauuguguau

SEQ ID NO: 1380460 - RNA, 19 nt, Homo sapiens
cagcuugcagauuuguuaa

SEQ ID NO: 1380461 - RNA, 19 nt, Homo sapiens
aagacgcgguuuccagcuu

SEQ ID NO: 1380462 - RNA, 19 nt, Homo sapiens
gagggcaugaggaagaaug

SEQ ID NO: 1380463 - RNA, 19 nt, Homo sapiens
aaaagauacuucugcaauc

SEQ ID NO: 1380464 - RNA, 19 nt, Homo sapiens
cuguugacuucucuuaaau

SEQ ID NO: 1380465 - RNA, 19 nt, Homo sapiens
aaugacaacaacucuauuc

SEQ ID NO: 1380466 - RNA, 19 nt, Homo sapiens
ggccuggauugcugcuuuc

SEQ ID NO: 1380467 - RNA, 19 nt, Homo sapiens
gggaacugagcuugaaauc

SEQ ID NO: 1380468 - RNA, 19 nt, Homo sapiens
ugggacacacgaaacauga

SEQ ID NO: 1380469 - RNA, 19 nt, Homo sapiens
ccaggguacccggcaaauu

SEQ ID NO: 1380470 - RNA, 19 nt, Homo sapiens
gaaauugugucucgcauug

SEQ ID NO: 1380471 - RNA, 19 nt, Homo sapiens
gcaugucccuguccgguua

SEQ ID NO: 1380472 - RNA, 19 nt, Homo sapiens
agacggaccucaccaacua

SEQ ID NO: 1380473 - RNA, 19 nt, Homo sapiens
ucacggaccuugccgaaau

SEQ ID NO: 1380474 - RNA, 19 nt, Homo sapiens
ccacgaaagucaagguguu

SEQ ID NO: 1380475 - RNA, 19 nt, Homo sapiens
ggcaugacguccuugauga

SEQ ID NO: 1380476 - RNA, 19 nt, Homo sapiens
ggugguggcugcuguggaa

SEQ ID NO: 1380477 - RNA, 19 nt, Homo sapiens
cgugugauguuucaauaaa

SEQ ID NO: 1380478 - RNA, 19 nt, Homo sapiens
ggacaguguucacgaguac

SEQ ID NO: 1380479 - RNA, 19 nt, Homo sapiens
gccgugugauguuucaaua

SEQ ID NO: 1380480 - RNA, 19 nt, Homo sapiens
gcugacuagugacaacaua

SEQ ID NO: 1380481 - RNA, 19 nt, Homo sapiens
ccaagcugguggagaugua

SEQ ID NO: 1380482 - RNA, 19 nt, Homo sapiens
aaagguggaucucacuguu

SEQ ID NO: 1380483 - RNA, 19 nt, Homo sapiens
ugacucggcugauucaucu

SEQ ID NO: 1380484 - RNA, 19 nt, Homo sapiens
ggaaggaugaugggaagaa

SEQ ID NO: 1380485 - RNA, 19 nt, Homo sapiens
ggaccgacacucagacuuc

SEQ ID NO: 1380486 - RNA, 19 nt, Homo sapiens
gaaggaugaugggaagaag

SEQ ID NO: 1380487 - RNA, 19 nt, Homo sapiens
gcacgguguuugacaucug

SEQ ID NO: 1380488 - RNA, 19 nt, Homo sapiens
gguggugacucggcugauu

SEQ ID NO: 1380489 - RNA, 19 nt, Homo sapiens
caugguggaugacgaaucu

SEQ ID NO: 1380490 - RNA, 19 nt, Homo sapiens
gaacauggcagagauucag

SEQ ID NO: 1380491 - RNA, 19 nt, Homo sapiens
ggaccuugccgaaauugug

SEQ ID NO: 1380492 - RNA, 19 nt, Homo sapiens
ggacggacaccugcugaug

SEQ ID NO: 1380493 - RNA, 19 nt, Homo sapiens
gggcaugacguccuugaug

SEQ ID NO: 1380494 - RNA, 19 nt, Homo sapiens
cgacugcacguacaucaug

SEQ ID NO: 1380495 - RNA, 19 nt, Homo sapiens
ugggugcccuguacucuga

SEQ ID NO: 1380496 - RNA, 19 nt, Homo sapiens
ugacuagugacaacauaaa

SEQ ID NO: 1380497 - RNA, 19 nt, Homo sapiens
ucaacgagaucugcgaagu

SEQ ID NO: 1380498 - RNA, 19 nt, Homo sapiens
gaucgaggaccuguggauu

SEQ ID NO: 1380499 - RNA, 19 nt, Homo sapiens
gcaugacguccuugaugaa

SEQ ID NO: 1380500 - RNA, 19 nt, Homo sapiens
cggcaucccuguggacaug

SEQ ID NO: 1380501 - RNA, 19 nt, Homo sapiens
caacgagaucugcgaagug

SEQ ID NO: 1380502 - RNA, 19 nt, Homo sapiens
uggacaguguucacgagua

SEQ ID NO: 1380503 - RNA, 19 nt, Homo sapiens
cgacccugcugcugacuag

SEQ ID NO: 1380504 - RNA, 19 nt, Homo sapiens
ggaugcauacgcagacuuc

SEQ ID NO: 1380505 - RNA, 19 nt, Homo sapiens
caggagcccucacguccau

SEQ ID NO: 1380506 - RNA, 19 nt, Homo sapiens
accuguggauuccuuauuu

SEQ ID NO: 1380507 - RNA, 19 nt, Homo sapiens
gcucugugauccggaagga

SEQ ID NO: 1380508 - RNA, 19 nt, Homo sapiens
gcggcgugcuggagaagau

SEQ ID NO: 1380509 - RNA, 19 nt, Homo sapiens
ucucugggccucuucuuug

SEQ ID NO: 1380510 - RNA, 19 nt, Homo sapiens
gauguacaagcaugucuuc

SEQ ID NO: 1380511 - RNA, 19 nt, Homo sapiens
cgaaauugugucucgcauu

SEQ ID NO: 1380512 - RNA, 19 nt, Homo sapiens
cacggaccuugccgaaauu

SEQ ID NO: 1380513 - RNA, 19 nt, Homo sapiens
gaccuguggauuccuuauu

SEQ ID NO: 1380514 - RNA, 19 nt, Homo sapiens
uaaagguggaucucacugu

SEQ ID NO: 1380515 - RNA, 19 nt, Homo sapiens
ccagcagggcucagacuug

SEQ ID NO: 1380516 - RNA, 19 nt, Homo sapiens
guucgggacucagaauugg

SEQ ID NO: 1380517 - RNA, 19 nt, Homo sapiens
ucaaggaccagcagaucga

SEQ ID NO: 1380518 - RNA, 19 nt, Homo sapiens
gaccgacacucagacuucu

SEQ ID NO: 1380519 - RNA, 19 nt, Homo sapiens
cuacagcacccuggacuuc

SEQ ID NO: 1380520 - RNA, 19 nt, Homo sapiens
caucaccaccgacaucaca

SEQ ID NO: 1380521 - RNA, 19 nt, Homo sapiens
ugcccaagcugguggagau

SEQ ID NO: 1380522 - RNA, 19 nt, Homo sapiens
ggaugacgaaucugacuac

SEQ ID NO: 1380523 - RNA, 19 nt, Homo sapiens
acggacaccugcugaugga

SEQ ID NO: 1380524 - RNA, 19 nt, Homo sapiens
gugggaggcacguccauug

SEQ ID NO: 1380525 - RNA, 19 nt, Homo sapiens
ugguggagauguacaagca

SEQ ID NO: 1380526 - RNA, 19 nt, Homo sapiens
ucaauaaagguggaucuca

SEQ ID NO: 1380527 - RNA, 19 nt, Homo sapiens
gaugcugccgugugauguu

SEQ ID NO: 1380528 - RNA, 19 nt, Homo sapiens
ccuguggauuccuuauuuc

SEQ ID NO: 1380529 - RNA, 19 nt, Homo sapiens
gaccuugccgaaauugugu

SEQ ID NO: 1380530 - RNA, 19 nt, Homo sapiens
ccgagggcaugacguccuu

SEQ ID NO: 1380531 - RNA, 19 nt, Homo sapiens
ugugauguuucaauaaagg

SEQ ID NO: 1380532 - RNA, 19 nt, Homo sapiens
gcugccgugugauguuuca

SEQ ID NO: 1380533 - RNA, 19 nt, Homo sapiens
ggaccuguggauuccuuau

SEQ ID NO: 1380534 - RNA, 19 nt, Homo sapiens
gagggcaugacguccuuga

SEQ ID NO: 1380535 - RNA, 19 nt, Homo sapiens
gaaauuagccuuugccuua

SEQ ID NO: 1380536 - RNA, 19 nt, Homo sapiens
gcagaaaguuguagaaaug

SEQ ID NO: 1380537 - RNA, 19 nt, Homo sapiens
gaauaaaugugaucaaguc

SEQ ID NO: 1380538 - RNA, 19 nt, Homo sapiens
gaauaagucuaaucaagga

SEQ ID NO: 1380539 - RNA, 19 nt, Homo sapiens
gcuaagagguaguaaaugu

SEQ ID NO: 1380540 - RNA, 19 nt, Homo sapiens
uaacguagcauaugaugua

SEQ ID NO: 1380541 - RNA, 19 nt, Homo sapiens
gcagggaccucguuaaugg

SEQ ID NO: 1380542 - RNA, 19 nt, Homo sapiens
caacagugcucccucauag

SEQ ID NO: 1380543 - RNA, 19 nt, Homo sapiens
gcaaaugacuuggaguguu

SEQ ID NO: 1380544 - RNA, 19 nt, Homo sapiens
aaagaagucugaaauguuc

SEQ ID NO: 1380545 - RNA, 19 nt, Homo sapiens
gaaaugaaaugggaucaag

SEQ ID NO: 1380546 - RNA, 19 nt, Homo sapiens
gaacaccucagucaagauu

SEQ ID NO: 1380547 - RNA, 19 nt, Homo sapiens
caaaugacuuggaguguuc

SEQ ID NO: 1380548 - RNA, 19 nt, Homo sapiens
cguagcauaugauguauaa

SEQ ID NO: 1380549 - RNA, 19 nt, Homo sapiens
gcuagcugcucaagaguuu

SEQ ID NO: 1380550 - RNA, 19 nt, Homo sapiens
gagauacuacacucauuua

SEQ ID NO: 1380551 - RNA, 19 nt, Homo sapiens
cagaauaagucuaaucaag

SEQ ID NO: 1380552 - RNA, 19 nt, Homo sapiens
caacaugcauuuccagucu

SEQ ID NO: 1380553 - RNA, 19 nt, Homo sapiens
agucaaggguucuauauug

SEQ ID NO: 1380554 - RNA, 19 nt, Homo sapiens
gaacaacggcaccugcuau

SEQ ID NO: 1380555 - RNA, 19 nt, Homo sapiens
caaggguucuauauuguga

SEQ ID NO: 1380556 - RNA, 19 nt, Homo sapiens
gauaugugcuucuucugau

SEQ ID NO: 1380557 - RNA, 19 nt, Homo sapiens
gguucuauauugugaguaa

SEQ ID NO: 1380558 - RNA, 19 nt, Homo sapiens
cgaggcaaauucugauuga

SEQ ID NO: 1380559 - RNA, 19 nt, Homo sapiens
cgaaugaaauuagccuuug

SEQ ID NO: 1380560 - RNA, 19 nt, Homo sapiens
uuacaguccugaugacaaa

SEQ ID NO: 1380561 - RNA, 19 nt, Homo sapiens
cuaagucuauuguggcuuu

SEQ ID NO: 1380562 - RNA, 19 nt, Homo sapiens
gauauugccugugggaaug

SEQ ID NO: 1380563 - RNA, 19 nt, Homo sapiens
uaauagaguauacccguua

SEQ ID NO: 1380564 - RNA, 19 nt, Homo sapiens
ccucauagauggacgaagu

SEQ ID NO: 1380565 - RNA, 19 nt, Homo sapiens
ggcagaaaguuguagaaau

SEQ ID NO: 1380566 - RNA, 19 nt, Homo sapiens
gccacugccucacugauuu

SEQ ID NO: 1380567 - RNA, 19 nt, Homo sapiens
gaggugaucccagauauug

SEQ ID NO: 1380568 - RNA, 19 nt, Homo sapiens
gaagauuacaguccugaug

SEQ ID NO: 1380569 - RNA, 19 nt, Homo sapiens
guguuugccuuccugguua

SEQ ID NO: 1380570 - RNA, 19 nt, Homo sapiens
ccacagaacaccucaguca

SEQ ID NO: 1380571 - RNA, 19 nt, Homo sapiens
cagaacaccucagucaaga

SEQ ID NO: 1380572 - RNA, 19 nt, Homo sapiens
cauagugcagcuuuauuua

SEQ ID NO: 1380573 - RNA, 19 nt, Homo sapiens
ggagcaauuucaccugugu

SEQ ID NO: 1380574 - RNA, 19 nt, Homo sapiens
uaacuuauuucugcacugu

SEQ ID NO: 1380575 - RNA, 19 nt, Homo sapiens
ggaccucguuaauggcuau

SEQ ID NO: 1380576 - RNA, 19 nt, Homo sapiens
gcuuaacucugguggugaa

SEQ ID NO: 1380577 - RNA, 19 nt, Homo sapiens
uauuguggcuuugcgcuua

SEQ ID NO: 1380578 - RNA, 19 nt, Homo sapiens
uuauuuaucuccaggaugu

SEQ ID NO: 1380579 - RNA, 19 nt, Homo sapiens
ucauagugcagcuuuauuu

SEQ ID NO: 1380580 - RNA, 19 nt, Homo sapiens
cuacuagugugugcucuuu

SEQ ID NO: 1380581 - RNA, 19 nt, Homo sapiens
gcggagagccucaccaaca

SEQ ID NO: 1380582 - RNA, 19 nt, Homo sapiens
gaggaggaauauaaugagu

SEQ ID NO: 1380583 - RNA, 19 nt, Homo sapiens
gggagagucacgcaaauga

SEQ ID NO: 1380584 - RNA, 19 nt, Homo sapiens
gaacuuuguggaaacauuc

SEQ ID NO: 1380585 - RNA, 19 nt, Homo sapiens
cuucagcucucuaaacugu

SEQ ID NO: 1380586 - RNA, 19 nt, Homo sapiens
caagaugggagcaauuuca

SEQ ID NO: 1380587 - RNA, 19 nt, Homo sapiens
gcuaauuuccaaccauauu

SEQ ID NO: 1380588 - RNA, 19 nt, Homo sapiens
gugcccagcuuauugacuu

SEQ ID NO: 1380589 - RNA, 19 nt, Homo sapiens
cagcaacccuugucaccau

SEQ ID NO: 1380590 - RNA, 19 nt, Homo sapiens
gcaucagccgcauugaaua

SEQ ID NO: 1380591 - RNA, 19 nt, Homo sapiens
gcagaaauggagcaacaug

SEQ ID NO: 1380592 - RNA, 19 nt, Homo sapiens
aaacagggcagaaaguugu

SEQ ID NO: 1380593 - RNA, 19 nt, Homo sapiens
aaacaacgcgagcuguauu

SEQ ID NO: 1380594 - RNA, 19 nt, Homo sapiens
cacgagacccagauuaauu

SEQ ID NO: 1380595 - RNA, 19 nt, Homo sapiens
ccacggcacucccucuaca

SEQ ID NO: 1380596 - RNA, 19 nt, Homo sapiens
ggugaagagugcgacauug

SEQ ID NO: 1380597 - RNA, 19 nt, Homo sapiens
gugaggaggaauauaauga

SEQ ID NO: 1380598 - RNA, 19 nt, Homo sapiens
caacggcaccugcuaugug

SEQ ID NO: 1380599 - RNA, 19 nt, Homo sapiens
cggaucugcuugugaagaa

SEQ ID NO: 1380600 - RNA, 19 nt, Homo sapiens
cuaugaaggucccaacugu

SEQ ID NO: 1380601 - RNA, 19 nt, Homo sapiens
uagugcagcuuuauuuauc

SEQ ID NO: 1380602 - RNA, 19 nt, Homo sapiens
gucaaggguucuauauugu

SEQ ID NO: 1380603 - RNA, 19 nt, Homo sapiens
ugaacuuuguggaaacauu

SEQ ID NO: 1380604 - RNA, 19 nt, Homo sapiens
gaagagugcgacauugaca

SEQ ID NO: 1380605 - RNA, 19 nt, Homo sapiens
cuucggaucugcuugugaa

SEQ ID NO: 1380606 - RNA, 19 nt, Homo sapiens
gccaguccaagauugauua

SEQ ID NO: 1380607 - RNA, 19 nt, Homo sapiens
gagcuguauugaugcaaau

SEQ ID NO: 1380608 - RNA, 19 nt, Homo sapiens
cgagcuguauugaugcaaa

SEQ ID NO: 1380609 - RNA, 19 nt, Homo sapiens
gggaaugccaguucuaaca

SEQ ID NO: 1380610 - RNA, 19 nt, Homo sapiens
uugcuaauuuccaaccaua

SEQ ID NO: 1380611 - RNA, 19 nt, Homo sapiens
acauuugaguuguuuguug

SEQ ID NO: 1380612 - RNA, 19 nt, Homo sapiens
gaaugaaauuagccuuugc

SEQ ID NO: 1380613 - RNA, 19 nt, Homo sapiens
gugcgacauugacauaaau

SEQ ID NO: 1380614 - RNA, 19 nt, Homo sapiens
ggagcaacaugcauuucca

SEQ ID NO: 1380615 - RNA, 19 nt, Homo sapiens
cuagacccaugcagaaaug

SEQ ID NO: 1380616 - RNA, 19 nt, Homo sapiens
gaggaaaccuugccaaaac

SEQ ID NO: 1380617 - RNA, 19 nt, Homo sapiens
ccaacagugcucccucaua

SEQ ID NO: 1380618 - RNA, 19 nt, Homo sapiens
ugaaaccuauagacgaugu

SEQ ID NO: 1380619 - RNA, 19 nt, Homo sapiens
ggccugcaauguaugaugu

SEQ ID NO: 1380620 - RNA, 19 nt, Homo sapiens
gugaagagugcgacauuga

SEQ ID NO: 1380621 - RNA, 19 nt, Homo sapiens
gggcagaaaguuguagaaa

SEQ ID NO: 1380622 - RNA, 19 nt, Homo sapiens
ggaggugaucccagauauu

SEQ ID NO: 1380623 - RNA, 19 nt, Homo sapiens
caaugaaggcuaugaaggu

SEQ ID NO: 1380624 - RNA, 19 nt, Homo sapiens
ugcguggccuucauccuua

SEQ ID NO: 1380625 - RNA, 19 nt, Homo sapiens
gaauggcacgugcaucugu

SEQ ID NO: 1380626 - RNA, 19 nt, Homo sapiens
ggcuguauuugauugauau

SEQ ID NO: 1380627 - RNA, 19 nt, Homo sapiens
ugugaaaccuauagacgau

SEQ ID NO: 1380628 - RNA, 19 nt, Homo sapiens
gacagcgaguucagcaaug

SEQ ID NO: 1380629 - RNA, 19 nt, Homo sapiens
gagcuuugccaguccaaga

SEQ ID NO: 1380630 - RNA, 19 nt, Homo sapiens
cagaggaaaccuugccaaa

SEQ ID NO: 1380631 - RNA, 19 nt, Homo sapiens
cguaacagucgucgaacua

SEQ ID NO: 1380632 - RNA, 19 nt, Homo sapiens
uaagucuaaucaaggagaa

SEQ ID NO: 1380633 - RNA, 19 nt, Homo sapiens
cauccggcaugccagguuu

SEQ ID NO: 1380634 - RNA, 19 nt, Homo sapiens
ugacagcgacggccugaau

SEQ ID NO: 1380635 - RNA, 19 nt, Homo sapiens
uaacauuucuucucaggaa

SEQ ID NO: 1380636 - RNA, 19 nt, Homo sapiens
ccaauugccuguugccuuu

SEQ ID NO: 1380637 - RNA, 19 nt, Homo sapiens
caacuuggcugugcuauag

SEQ ID NO: 1380638 - RNA, 19 nt, Homo sapiens
cgggauaucuuuggaguua

SEQ ID NO: 1380639 - RNA, 19 nt, Homo sapiens
gggaagacaucguuuggaa

SEQ ID NO: 1380640 - RNA, 19 nt, Homo sapiens
aaacagcaauggagaguga

SEQ ID NO: 1380641 - RNA, 19 nt, Homo sapiens
gcucugauccugcuuguuu

SEQ ID NO: 1380642 - RNA, 19 nt, Homo sapiens
gaagacaucguuuggaaug

SEQ ID NO: 1380643 - RNA, 19 nt, Homo sapiens
ggagggaaacgaaauuaaa

SEQ ID NO: 1380644 - RNA, 19 nt, Homo sapiens
ucucaugccugcuuucuuu

SEQ ID NO: 1380645 - RNA, 19 nt, Homo sapiens
gcccagauguucacaguug

SEQ ID NO: 1380646 - RNA, 19 nt, Homo sapiens
agucuaagcuuuauguuug

SEQ ID NO: 1380647 - RNA, 19 nt, Homo sapiens
ggaaaccuccucaucauca

SEQ ID NO: 1380648 - RNA, 19 nt, Homo sapiens
gaaggagggaaacgaaauu

SEQ ID NO: 1380649 - RNA, 19 nt, Homo sapiens
gaagcuguuugucaggauu

SEQ ID NO: 1380650 - RNA, 19 nt, Homo sapiens
ggagcaagccgguccaguu

SEQ ID NO: 1380651 - RNA, 19 nt, Homo sapiens
gcuauaggccacaaugaaa

SEQ ID NO: 1380652 - RNA, 19 nt, Homo sapiens
ccaguuaccuguucaucau

SEQ ID NO: 1380653 - RNA, 19 nt, Homo sapiens
cggagaugcugcacaugua

SEQ ID NO: 1380654 - RNA, 19 nt, Homo sapiens
ucacagcaaccuuuggaua

SEQ ID NO: 1380655 - RNA, 19 nt, Homo sapiens
caucaucgucaguguguua

SEQ ID NO: 1380656 - RNA, 19 nt, Homo sapiens
gaagggaaaccuccucauc

SEQ ID NO: 1380657 - RNA, 19 nt, Homo sapiens
gcaccuuccuguacaugga

SEQ ID NO: 1380658 - RNA, 19 nt, Homo sapiens
gaacugcaggauccaaaga

SEQ ID NO: 1380659 - RNA, 19 nt, Homo sapiens
ggauuacccucgggcuaaa

SEQ ID NO: 1380660 - RNA, 19 nt, Homo sapiens
ggccgucagucuaagcuuu

SEQ ID NO: 1380661 - RNA, 19 nt, Homo sapiens
ugagguggagccuuucuua

SEQ ID NO: 1380662 - RNA, 19 nt, Homo sapiens
uuggauaccucaccuucua

SEQ ID NO: 1380663 - RNA, 19 nt, Homo sapiens
ucucugagcuggugugucu

SEQ ID NO: 1380664 - RNA, 19 nt, Homo sapiens
acaguugacucacagaugu

SEQ ID NO: 1380665 - RNA, 19 nt, Homo sapiens
gcaagccgguccaguucau

SEQ ID NO: 1380666 - RNA, 19 nt, Homo sapiens
gagcaagccgguccaguuc

SEQ ID NO: 1380667 - RNA, 19 nt, Homo sapiens
gaaaccuccucaucaucau

SEQ ID NO: 1380668 - RNA, 19 nt, Homo sapiens
ccaaguggguccagauagg

SEQ ID NO: 1380669 - RNA, 19 nt, Homo sapiens
gaggugcugcccaucuaua

SEQ ID NO: 1380670 - RNA, 19 nt, Homo sapiens
cauuauggcuuuugcuuuu

SEQ ID NO: 1380671 - RNA, 19 nt, Homo sapiens
gaccugugcugguauugca

SEQ ID NO: 1380672 - RNA, 19 nt, Homo sapiens
gggaggaggaggaagaaga

SEQ ID NO: 1380673 - RNA, 19 nt, Homo sapiens
gcugaccugugcugguauu

SEQ ID NO: 1380674 - RNA, 19 nt, Homo sapiens
cugcugaccugugcuggua

SEQ ID NO: 1380675 - RNA, 19 nt, Homo sapiens
caugccugcuuucuuugua

SEQ ID NO: 1380676 - RNA, 19 nt, Homo sapiens
cuacccaccuguuuguuuc

SEQ ID NO: 1380677 - RNA, 19 nt, Homo sapiens
gauguucacaguugacuca

SEQ ID NO: 1380678 - RNA, 19 nt, Homo sapiens
gcugugaggcccagauguu

SEQ ID NO: 1380679 - RNA, 19 nt, Homo sapiens
ucaucugucugcacaaugu

SEQ ID NO: 1380680 - RNA, 19 nt, Homo sapiens
gaaugucaguguucaaccu

SEQ ID NO: 1380681 - RNA, 19 nt, Homo sapiens
caauguccuugucaucugu

SEQ ID NO: 1380682 - RNA, 19 nt, Homo sapiens
ucaauguccuugucaucug

SEQ ID NO: 1380683 - RNA, 19 nt, Homo sapiens
gcacauguacagccagaag

SEQ ID NO: 1380684 - RNA, 19 nt, Homo sapiens
ggucuacacccucaaucuu

SEQ ID NO: 1380685 - RNA, 19 nt, Homo sapiens
gccugugucuccugucuau

SEQ ID NO: 1380686 - RNA, 19 nt, Homo sapiens
ggaagacaucguuuggaau

SEQ ID NO: 1380687 - RNA, 19 nt, Homo sapiens
ccagaaggagggaaacgaa

SEQ ID NO: 1380688 - RNA, 19 nt, Homo sapiens
ccuccuggcugaagcuguu

SEQ ID NO: 1380689 - RNA, 19 nt, Homo sapiens
gcggagaugcugcacaugu

SEQ ID NO: 1380690 - RNA, 19 nt, Homo sapiens
gguggagccuuucuuaucc

SEQ ID NO: 1380691 - RNA, 19 nt, Homo sapiens
gcucacagcaaccuuugga

SEQ ID NO: 1380692 - RNA, 19 nt, Homo sapiens
caucgucaguguguuaauc

SEQ ID NO: 1380693 - RNA, 19 nt, Homo sapiens
gccgucagucuaagcuuua

SEQ ID NO: 1380694 - RNA, 19 nt, Homo sapiens
cugaggugcugcccaucua

SEQ ID NO: 1380695 - RNA, 19 nt, Homo sapiens
cagucuaagcuuuauguuu

SEQ ID NO: 1380696 - RNA, 19 nt, Homo sapiens
gcugcagacuggcccacuu

SEQ ID NO: 1380697 - RNA, 19 nt, Homo sapiens
gagguggagccuuucuuau

SEQ ID NO: 1380698 - RNA, 19 nt, Homo sapiens
ccuacacagugcccauuau

SEQ ID NO: 1380699 - RNA, 19 nt, Homo sapiens
gucuacacccucaaucuuu

SEQ ID NO: 1380700 - RNA, 19 nt, Homo sapiens
ggaggaggaggaagaagag

SEQ ID NO: 1380701 - RNA, 19 nt, Homo sapiens
gcuggugugucugguccua

SEQ ID NO: 1380702 - RNA, 19 nt, Homo sapiens
gagggaaacgaaauuaaaa

SEQ ID NO: 1380703 - RNA, 19 nt, Homo sapiens
gguccuacccucuguuugg

SEQ ID NO: 1380704 - RNA, 19 nt, Homo sapiens
agggaaaccuccucaucau

SEQ ID NO: 1380705 - RNA, 19 nt, Homo sapiens
cauguccaguuaccuguuc

SEQ ID NO: 1380706 - RNA, 19 nt, Homo sapiens
cagaaggagggaaacgaaa

SEQ ID NO: 1380707 - RNA, 19 nt, Homo sapiens
ucuacacccucaaucuuuc

SEQ ID NO: 1380708 - RNA, 19 nt, Homo sapiens
caucuucuaccuccgcauu

SEQ ID NO: 1380709 - RNA, 19 nt, Homo sapiens
gguggcugguucccaugaa

SEQ ID NO: 1380710 - RNA, 19 nt, Homo sapiens
ccacaaugaaacagcaaug

SEQ ID NO: 1380711 - RNA, 19 nt, Homo sapiens
aagggaaaccuccucauca

SEQ ID NO: 1380712 - RNA, 19 nt, Homo sapiens
aaggagggaaacgaaauua

SEQ ID NO: 1380713 - RNA, 19 nt, Homo sapiens
caucaacacacaaacaaac

SEQ ID NO: 1380714 - RNA, 19 nt, Homo sapiens
cuacacagugcccauuaug

SEQ ID NO: 1380715 - RNA, 19 nt, Homo sapiens
ugagcccaauugccuguug

SEQ ID NO: 1380716 - RNA, 19 nt, Homo sapiens
caugggaggaggaggaaga

SEQ ID NO: 1380717 - RNA, 19 nt, Homo sapiens
acaaugaaacagcaaugga

SEQ ID NO: 1380718 - RNA, 19 nt, Homo sapiens
agaaggagggaaacgaaau

SEQ ID NO: 1380719 - RNA, 19 nt, Homo sapiens
ggucaauguccuugucauc

SEQ ID NO: 1380720 - RNA, 19 nt, Homo sapiens
gggaaaccuccucaucauc

SEQ ID NO: 1380721 - RNA, 19 nt, Homo sapiens
gagcugagaggagcaggau

SEQ ID NO: 1380722 - RNA, 19 nt, Homo sapiens
ccuacccaccuguuuguuu

SEQ ID NO: 1380723 - RNA, 19 nt, Homo sapiens
uaaagauguugagcuacca

SEQ ID NO: 1380724 - RNA, 19 nt, Homo sapiens
ggagaugcugcacauguac

SEQ ID NO: 1380725 - RNA, 19 nt, Homo sapiens
gcccugcugcugugcauug

SEQ ID NO: 1380726 - RNA, 19 nt, Homo sapiens
ccaucaacacacaaacaaa

SEQ ID NO: 1380727 - RNA, 19 nt, Homo sapiens
uggcugaagcuguuuguca

SEQ ID NO: 1380728 - RNA, 19 nt, Homo sapiens
aggcggagaugcugcacau

SEQ ID NO: 1380729 - RNA, 19 nt, Homo sapiens
ggucaucuacaagaaguuc

SEQ ID NO: 1380730 - RNA, 19 nt, Homo sapiens
uuucggucaucuacaagaa

SEQ ID NO: 1380731 - RNA, 19 nt, Homo sapiens
gcgcuucugucguccuacu

SEQ ID NO: 1380732 - RNA, 19 nt, Homo sapiens
ccucagcaacgccaucaug

SEQ ID NO: 1380733 - RNA, 19 nt, Homo sapiens
ggaacugcaggauccaaag

SEQ ID NO: 1380734 - RNA, 19 nt, Homo sapiens
ugaagcuguuugucaggau

SEQ ID NO: 1380735 - RNA, 19 nt, Homo sapiens
gaaccagaauggcaaauua

SEQ ID NO: 1380736 - RNA, 19 nt, Homo sapiens
gaucgaggcuuccuucaau

SEQ ID NO: 1380737 - RNA, 19 nt, Homo sapiens
gcaucgggcugaucaauga

SEQ ID NO: 1380738 - RNA, 19 nt, Homo sapiens
gcauccaacugcugcauaa

SEQ ID NO: 1380739 - RNA, 19 nt, Homo sapiens
aauaaacacuugccuguga

SEQ ID NO: 1380740 - RNA, 19 nt, Homo sapiens
caaaggugaccaacuuaua

SEQ ID NO: 1380741 - RNA, 19 nt, Homo sapiens
gaccaucccucucugcaau

SEQ ID NO: 1380742 - RNA, 19 nt, Homo sapiens
ucaagaccaucguggaguu

SEQ ID NO: 1380743 - RNA, 19 nt, Homo sapiens
ugaaggucaucacagcuaa

SEQ ID NO: 1380744 - RNA, 19 nt, Homo sapiens
caucaucacugagaucauc

SEQ ID NO: 1380745 - RNA, 19 nt, Homo sapiens
ggaguuugaccuucuguau

SEQ ID NO: 1380746 - RNA, 19 nt, Homo sapiens
ggauccagcugaugaacuc

SEQ ID NO: 1380747 - RNA, 19 nt, Homo sapiens
ggacaugguggcuggauuc

SEQ ID NO: 1380748 - RNA, 19 nt, Homo sapiens
gugaagcccuccgcccuuu

SEQ ID NO: 1380749 - RNA, 19 nt, Homo sapiens
ccaagugguucaauaacuc

SEQ ID NO: 1380750 - RNA, 19 nt, Homo sapiens
caagguggcccaacugauc

SEQ ID NO: 1380751 - RNA, 19 nt, Homo sapiens
gcauugaccgucuggaguu

SEQ ID NO: 1380752 - RNA, 19 nt, Homo sapiens
uagcuaagcaggucaugaa

SEQ ID NO: 1380753 - RNA, 19 nt, Homo sapiens
ccaaccugauguucugaaa

SEQ ID NO: 1380754 - RNA, 19 nt, Homo sapiens
ccauuucccucagcauuga

SEQ ID NO: 1380755 - RNA, 19 nt, Homo sapiens
cagaauggcaaauuaagau

SEQ ID NO: 1380756 - RNA, 19 nt, Homo sapiens
cugaugaacucugggauug

SEQ ID NO: 1380757 - RNA, 19 nt, Homo sapiens
agggaaaggugaccaagug

SEQ ID NO: 1380758 - RNA, 19 nt, Homo sapiens
gcccaaaagucaucaaaga

SEQ ID NO: 1380759 - RNA, 19 nt, Homo sapiens
ggucuggcauccugcacuu

SEQ ID NO: 1380760 - RNA, 19 nt, Homo sapiens
cuacccagaucgugaagau

SEQ ID NO: 1380761 - RNA, 19 nt, Homo sapiens
gcugugcucucuccagaag

SEQ ID NO: 1380762 - RNA, 19 nt, Homo sapiens
guuccaaccugauguucug

SEQ ID NO: 1380763 - RNA, 19 nt, Homo sapiens
ugaaaaggcugcagauaag

SEQ ID NO: 1380764 - RNA, 19 nt, Homo sapiens
ggucaugaaccuccuagug

SEQ ID NO: 1380765 - RNA, 19 nt, Homo sapiens
ucucugcaaucaauaaaca

SEQ ID NO: 1380766 - RNA, 19 nt, Homo sapiens
gaucgugcuggaaguguuu

SEQ ID NO: 1380767 - RNA, 19 nt, Homo sapiens
caugguggcuggauucaac

SEQ ID NO: 1380768 - RNA, 19 nt, Homo sapiens
gugaagcccucggccaaug

SEQ ID NO: 1380769 - RNA, 19 nt, Homo sapiens
aaacccaccucuccugucu

SEQ ID NO: 1380770 - RNA, 19 nt, Homo sapiens
ccagaauggcaaauuaaga

SEQ ID NO: 1380771 - RNA, 19 nt, Homo sapiens
gaccuucacccuucucugu

SEQ ID NO: 1380772 - RNA, 19 nt, Homo sapiens
gcucggaagcucaguuuua

SEQ ID NO: 1380773 - RNA, 19 nt, Homo sapiens
ggucaucacagcuaacauc

SEQ ID NO: 1380774 - RNA, 19 nt, Homo sapiens
gauccaagccacccucagu

SEQ ID NO: 1380775 - RNA, 19 nt, Homo sapiens
gugaccaacuuauacucaa

SEQ ID NO: 1380776 - RNA, 19 nt, Homo sapiens
ugacacaggagcugaagga

SEQ ID NO: 1380777 - RNA, 19 nt, Homo sapiens
ugcaaucaauaaacacuug

SEQ ID NO: 1380778 - RNA, 19 nt, Homo sapiens
ccaaaggugaccaacuuau

SEQ ID NO: 1380779 - RNA, 19 nt, Homo sapiens
ggugaaggccuugggauuc

SEQ ID NO: 1380780 - RNA, 19 nt, Homo sapiens
gcugaugaacucugggauu

SEQ ID NO: 1380781 - RNA, 19 nt, Homo sapiens
ucgugaagauccuaacuca

SEQ ID NO: 1380782 - RNA, 19 nt, Homo sapiens
ccaaaagucaucaaagaaa

SEQ ID NO: 1380783 - RNA, 19 nt, Homo sapiens
gaccaggagcugcuaguca

SEQ ID NO: 1380784 - RNA, 19 nt, Homo sapiens
auaaacacuugccugugaa

SEQ ID NO: 1380785 - RNA, 19 nt, Homo sapiens
guaugggugugagcucuau

SEQ ID NO: 1380786 - RNA, 19 nt, Homo sapiens
ugugcucucuccagaagaa

SEQ ID NO: 1380787 - RNA, 19 nt, Homo sapiens
gaauggcaaauuaagaucu

SEQ ID NO: 1380788 - RNA, 19 nt, Homo sapiens
gaagcccuccgcccuuugu

SEQ ID NO: 1380789 - RNA, 19 nt, Homo sapiens
ucaagcaucgggcugauca

SEQ ID NO: 1380790 - RNA, 19 nt, Homo sapiens
gugacaccauucagcucua

SEQ ID NO: 1380791 - RNA, 19 nt, Homo sapiens
accaggagcugcuagucaa

SEQ ID NO: 1380792 - RNA, 19 nt, Homo sapiens
cgaaccagaauggcaaauu

SEQ ID NO: 1380793 - RNA, 19 nt, Homo sapiens
ugaacaccguccugaagca

SEQ ID NO: 1380794 - RNA, 19 nt, Homo sapiens
aagaauucaugguccuguu

SEQ ID NO: 1380795 - RNA, 19 nt, Homo sapiens
gcccauuucccucagcauu

SEQ ID NO: 1380796 - RNA, 19 nt, Homo sapiens
uggugaaggugcccauuuc

SEQ ID NO: 1380797 - RNA, 19 nt, Homo sapiens
ugccaucccugcccaaucu

SEQ ID NO: 1380798 - RNA, 19 nt, Homo sapiens
aaccagaauggcaaauuaa

SEQ ID NO: 1380799 - RNA, 19 nt, Homo sapiens
aaaggugaccaacuuauac

SEQ ID NO: 1380800 - RNA, 19 nt, Homo sapiens
cauugaccgucuggaguuu

SEQ ID NO: 1380801 - RNA, 19 nt, Homo sapiens
ggugaccaacuuauacuca

SEQ ID NO: 1380802 - RNA, 19 nt, Homo sapiens
ucugacaccugggaagaug

SEQ ID NO: 1380803 - RNA, 19 nt, Homo sapiens
uaaacacuugccugugaaa

SEQ ID NO: 1380804 - RNA, 19 nt, Homo sapiens
uucaauaacucugcagcuu

SEQ ID NO: 1380805 - RNA, 19 nt, Homo sapiens
gaguuugaccuucuguauc

SEQ ID NO: 1380806 - RNA, 19 nt, Homo sapiens
ucuccugucucccagugaa

SEQ ID NO: 1380807 - RNA, 19 nt, Homo sapiens
gugaaggccuugggauucg

SEQ ID NO: 1380808 - RNA, 19 nt, Homo sapiens
guguuucccuccagugaag

SEQ ID NO: 1380809 - RNA, 19 nt, Homo sapiens
ugaucgugcuggaaguguu

SEQ ID NO: 1380810 - RNA, 19 nt, Homo sapiens
cccaucggcugaagucaag

SEQ ID NO: 1380811 - RNA, 19 nt, Homo sapiens
gcccaucggcugaagucaa

SEQ ID NO: 1380812 - RNA, 19 nt, Homo sapiens
ccagcugugucccgugauc

SEQ ID NO: 1380813 - RNA, 19 nt, Homo sapiens
cugaaggucaucacagcua

SEQ ID NO: 1380814 - RNA, 19 nt, Homo sapiens
ucacccuucucugugguuu

SEQ ID NO: 1380815 - RNA, 19 nt, Homo sapiens
ugcacuugcugcccucuga

SEQ ID NO: 1380816 - RNA, 19 nt, Homo sapiens
aauggcaaauuaagaucug

SEQ ID NO: 1380817 - RNA, 19 nt, Homo sapiens
aaacaucaucacugagauc

SEQ ID NO: 1380818 - RNA, 19 nt, Homo sapiens
gcucucuccagaagaauuc

SEQ ID NO: 1380819 - RNA, 19 nt, Homo sapiens
ccacugcaguucucauccu

SEQ ID NO: 1380820 - RNA, 19 nt, Homo sapiens
gaagaaagcacaguaauua

SEQ ID NO: 1380821 - RNA, 19 nt, Homo sapiens
gaagaaagccgauugaaau

SEQ ID NO: 1380822 - RNA, 19 nt, Homo sapiens
ccaaagagcuggaguaucu

SEQ ID NO: 1380823 - RNA, 19 nt, Homo sapiens
gaaauuagaguacaacuug

SEQ ID NO: 1380824 - RNA, 19 nt, Homo sapiens
gaagagagaugaagaaagc

SEQ ID NO: 1380825 - RNA, 19 nt, Homo sapiens
gaaagcaauuuaucagcua

SEQ ID NO: 1380826 - RNA, 19 nt, Homo sapiens
gaaauuggcuaaacuucug

SEQ ID NO: 1380827 - RNA, 19 nt, Homo sapiens
gaucaacucugaacugcaa

SEQ ID NO: 1380828 - RNA, 19 nt, Homo sapiens
gaucugggauugcgaagaa

SEQ ID NO: 1380829 - RNA, 19 nt, Homo sapiens
gauaaagcgucaaaggauu

SEQ ID NO: 1380830 - RNA, 19 nt, Homo sapiens
gggaagcacuuggagaaua

SEQ ID NO: 1380831 - RNA, 19 nt, Homo sapiens
ggaagcacuuggagaauau

SEQ ID NO: 1380832 - RNA, 19 nt, Homo sapiens
gaggagcucuauaacauug

SEQ ID NO: 1380833 - RNA, 19 nt, Homo sapiens
gaaagccgauugaaauugg

SEQ ID NO: 1380834 - RNA, 19 nt, Homo sapiens
gaaagaagaaagccgauug

SEQ ID NO: 1380835 - RNA, 19 nt, Homo sapiens
gaggaugacuuguauaaac

SEQ ID NO: 1380836 - RNA, 19 nt, Homo sapiens
ccacacagauaguagaaga

SEQ ID NO: 1380837 - RNA, 19 nt, Homo sapiens
aaacaaaggaugaccagua

SEQ ID NO: 1380838 - RNA, 19 nt, Homo sapiens
uugagaagcuggagaauga

SEQ ID NO: 1380839 - RNA, 19 nt, Homo sapiens
gaaguccgccacacagaua

SEQ ID NO: 1380840 - RNA, 19 nt, Homo sapiens
ggacaaauucgaugaaauc

SEQ ID NO: 1380841 - RNA, 19 nt, Homo sapiens
ccaaugauguccucaagau

SEQ ID NO: 1380842 - RNA, 19 nt, Homo sapiens
agauuuggcugaugaauga

SEQ ID NO: 1380843 - RNA, 19 nt, Homo sapiens
gaagaagagagaugaagaa

SEQ ID NO: 1380844 - RNA, 19 nt, Homo sapiens
gugaggagcucuauaacau

SEQ ID NO: 1380845 - RNA, 19 nt, Homo sapiens
uuuauagccugucgaaaua

SEQ ID NO: 1380846 - RNA, 19 nt, Homo sapiens
gaagaucaaucgccugcau

SEQ ID NO: 1380847 - RNA, 19 nt, Homo sapiens
gaauacaacaugaucaaga

SEQ ID NO: 1380848 - RNA, 19 nt, Homo sapiens
cuggugaacuucuuccuua

SEQ ID NO: 1380849 - RNA, 19 nt, Homo sapiens
uguauaaacuggugaacuu

SEQ ID NO: 1380850 - RNA, 19 nt, Homo sapiens
gaaagcauuugagguggaa

SEQ ID NO: 1380851 - RNA, 19 nt, Homo sapiens
gaacaggugaagaauguga

SEQ ID NO: 1380852 - RNA, 19 nt, Homo sapiens
acacagccuuggagaagua

SEQ ID NO: 1380853 - RNA, 19 nt, Homo sapiens
ugaagaaaguagaggacua

SEQ ID NO: 1380854 - RNA, 19 nt, Homo sapiens
aagaacaggugaagaaugu

SEQ ID NO: 1380855 - RNA, 19 nt, Homo sapiens
gaagagggcaagcagaaga

SEQ ID NO: 1380856 - RNA, 19 nt, Homo sapiens
gaauugaaagugaggauga

SEQ ID NO: 1380857 - RNA, 19 nt, Homo sapiens
gcuaaaccaagagaaauua

SEQ ID NO: 1380858 - RNA, 19 nt, Homo sapiens
uuccagggcugucuuuaua

SEQ ID NO: 1380859 - RNA, 19 nt, Homo sapiens
gaaaguagaggacuaugag

SEQ ID NO: 1380860 - RNA, 19 nt, Homo sapiens
ugaaggauuugaagaaaca

SEQ ID NO: 1380861 - RNA, 19 nt, Homo sapiens
ucaaucgccugcaugauau

SEQ ID NO: 1380862 - RNA, 19 nt, Homo sapiens
gaacguggacgagcacuug

SEQ ID NO: 1380863 - RNA, 19 nt, Homo sapiens
gcacuuguccacccagauu

SEQ ID NO: 1380864 - RNA, 19 nt, Homo sapiens
gaagaaaguagaggacuau

SEQ ID NO: 1380865 - RNA, 19 nt, Homo sapiens
ugaagaaacagucagauga

SEQ ID NO: 1380866 - RNA, 19 nt, Homo sapiens
gaugaaaucaccucaaagu

SEQ ID NO: 1380867 - RNA, 19 nt, Homo sapiens
gagauaaagcgucaaagga

SEQ ID NO: 1380868 - RNA, 19 nt, Homo sapiens
uuaccuguguccugcauua

SEQ ID NO: 1380869 - RNA, 19 nt, Homo sapiens
gaagaacaggugaagaaug

SEQ ID NO: 1380870 - RNA, 19 nt, Homo sapiens
auaucgagcucaccguuua

SEQ ID NO: 1380871 - RNA, 19 nt, Homo sapiens
gauaguagaagaaaugcuu

SEQ ID NO: 1380872 - RNA, 19 nt, Homo sapiens
ccuaauagccagagccuuu

SEQ ID NO: 1380873 - RNA, 19 nt, Homo sapiens
caagagaaauuagaguaca

SEQ ID NO: 1380874 - RNA, 19 nt, Homo sapiens
ucgaugaaaucaccucaaa

SEQ ID NO: 1380875 - RNA, 19 nt, Homo sapiens
agaaagccaugaggcauuu

SEQ ID NO: 1380876 - RNA, 19 nt, Homo sapiens
gaugaagaaagcacaguaa

SEQ ID NO: 1380877 - RNA, 19 nt, Homo sapiens
ucaaggagcuacagaaagc

SEQ ID NO: 1380878 - RNA, 19 nt, Homo sapiens
gagcuggaguaucuuaaca

SEQ ID NO: 1380879 - RNA, 19 nt, Homo sapiens
ggugaagaaugugaugaaa

SEQ ID NO: 1380880 - RNA, 19 nt, Homo sapiens
caaaggaugaccaguaugu

SEQ ID NO: 1380881 - RNA, 19 nt, Homo sapiens
ugaagaaagcacaguaauu

SEQ ID NO: 1380882 - RNA, 19 nt, Homo sapiens
gcagaggaaagcaauuuau

SEQ ID NO: 1380883 - RNA, 19 nt, Homo sapiens
ggagcaggaugugcagauu

SEQ ID NO: 1380884 - RNA, 19 nt, Homo sapiens
ccagaggaguuaccugugu

SEQ ID NO: 1380885 - RNA, 19 nt, Homo sapiens
gugaacuucuuccuuaaau

SEQ ID NO: 1380886 - RNA, 19 nt, Homo sapiens
gugaggaugacuuguauaa

SEQ ID NO: 1380887 - RNA, 19 nt, Homo sapiens
ccagguggcuauagauauc

SEQ ID NO: 1380888 - RNA, 19 nt, Homo sapiens
aacaaaggaugaccaguau

SEQ ID NO: 1380889 - RNA, 19 nt, Homo sapiens
gaucaaagcaagagcuaca

SEQ ID NO: 1380890 - RNA, 19 nt, Homo sapiens
gaagaauacaacaugauca

SEQ ID NO: 1380891 - RNA, 19 nt, Homo sapiens
gggaagagggcaagcagaa

SEQ ID NO: 1380892 - RNA, 19 nt, Homo sapiens
caagagcuacaaacagaaa

SEQ ID NO: 1380893 - RNA, 19 nt, Homo sapiens
agcaagagcuacaaacaga

SEQ ID NO: 1380894 - RNA, 19 nt, Homo sapiens
agaagaaagccgauugaaa

SEQ ID NO: 1380895 - RNA, 19 nt, Homo sapiens
ccgaguuggugacaaauau

SEQ ID NO: 1380896 - RNA, 19 nt, Homo sapiens
ggaagaaagccugguggaa

SEQ ID NO: 1380897 - RNA, 19 nt, Homo sapiens
ggaggcgaaggaccuaaua

SEQ ID NO: 1380898 - RNA, 19 nt, Homo sapiens
acuccaagaucaacucuga

SEQ ID NO: 1380899 - RNA, 19 nt, Homo sapiens
gagcucaccguuuaucuuc

SEQ ID NO: 1380900 - RNA, 19 nt, Homo sapiens
gcacuuggagaauauuuag

SEQ ID NO: 1380901 - RNA, 19 nt, Homo sapiens
ccaguaauaagaagaaaug

SEQ ID NO: 1380902 - RNA, 19 nt, Homo sapiens
caggacaaauucgaugaaa

SEQ ID NO: 1380903 - RNA, 19 nt, Homo sapiens
ggauugagaagcuggagaa

SEQ ID NO: 1380904 - RNA, 19 nt, Homo sapiens
cgggagauuuggcugauga

SEQ ID NO: 1380905 - RNA, 19 nt, Homo sapiens
accaguaugugaaggauuu

SEQ ID NO: 1380906 - RNA, 19 nt, Homo sapiens
gaaggagagugaggaggau

SEQ ID NO: 1380907 - RNA, 19 nt, Homo sapiens
ggagauaaagcgucaaagg

SEQ ID NO: 1380908 - RNA, 19 nt, Homo sapiens
uguccugcauuaugauuaa

SEQ ID NO: 1380909 - RNA, 19 nt, Homo sapiens
ccuguguccugcauuauga

SEQ ID NO: 1380910 - RNA, 19 nt, Homo sapiens
cagcagaggaaagcaauuu

SEQ ID NO: 1380911 - RNA, 19 nt, Homo sapiens
gcuacaaacagaaagaaga

SEQ ID NO: 1380912 - RNA, 19 nt, Homo sapiens
gaggagauaaagcgucaaa

SEQ ID NO: 1380913 - RNA, 19 nt, Homo sapiens
uaaggagccagaggaguua

SEQ ID NO: 1380914 - RNA, 19 nt, Homo sapiens
gagauuuggcugaugaaug

SEQ ID NO: 1380915 - RNA, 19 nt, Homo sapiens
uggaagaacaggugaagaa

SEQ ID NO: 1380916 - RNA, 19 nt, Homo sapiens
ugugaaggauuugaagaaa

SEQ ID NO: 1380917 - RNA, 19 nt, Homo sapiens
cuacaaacagaaagaagaa

SEQ ID NO: 1380918 - RNA, 19 nt, Homo sapiens
gcgggaagcacuuggagaa

SEQ ID NO: 1380919 - RNA, 19 nt, Homo sapiens
gaagcuggagaaugaaguu

SEQ ID NO: 1380920 - RNA, 19 nt, Homo sapiens
gagcaaaccugaugaagua

SEQ ID NO: 1380921 - RNA, 19 nt, Homo sapiens
ggagaagaaugcauuaaua

SEQ ID NO: 1380922 - RNA, 19 nt, Homo sapiens
ggacaaggcuauagaaguu

SEQ ID NO: 1380923 - RNA, 19 nt, Homo sapiens
gaagaucuuugaccauuaa

SEQ ID NO: 1380924 - RNA, 19 nt, Homo sapiens
gcaagacugugaucuaauu

SEQ ID NO: 1380925 - RNA, 19 nt, Homo sapiens
cuaaagagauguugaaaga

SEQ ID NO: 1380926 - RNA, 19 nt, Homo sapiens
caagaacuauucacacuuu

SEQ ID NO: 1380927 - RNA, 19 nt, Homo sapiens
uaaaggagguaucaaacua

SEQ ID NO: 1380928 - RNA, 19 nt, Homo sapiens
gaaauguaaugacagcuuu

SEQ ID NO: 1380929 - RNA, 19 nt, Homo sapiens
gagaagaucuuugaccauu

SEQ ID NO: 1380930 - RNA, 19 nt, Homo sapiens
gcacacauauguugaagug

SEQ ID NO: 1380931 - RNA, 19 nt, Homo sapiens
gcaauuaucuucaccugau

SEQ ID NO: 1380932 - RNA, 19 nt, Homo sapiens
caaggaaacuggaaggaaa

SEQ ID NO: 1380933 - RNA, 19 nt, Homo sapiens
gcugaaagauggcaauuau

SEQ ID NO: 1380934 - RNA, 19 nt, Homo sapiens
gaagagcucuggagacagu

SEQ ID NO: 1380935 - RNA, 19 nt, Homo sapiens
gugaaugacuuaacuuuga

SEQ ID NO: 1380936 - RNA, 19 nt, Homo sapiens
caagagacauguaaagugu

SEQ ID NO: 1380937 - RNA, 19 nt, Homo sapiens
gcaaacaguugucuaugug

SEQ ID NO: 1380938 - RNA, 19 nt, Homo sapiens
gaagaauggauuaccuuua

SEQ ID NO: 1380939 - RNA, 19 nt, Homo sapiens
gaucaaggagcuaucaaua

SEQ ID NO: 1380940 - RNA, 19 nt, Homo sapiens
aaaguaagcucuccucuag

SEQ ID NO: 1380941 - RNA, 19 nt, Homo sapiens
gaaaguaacguucgacugu

SEQ ID NO: 1380942 - RNA, 19 nt, Homo sapiens
ggacaaugcuacaagaauc

SEQ ID NO: 1380943 - RNA, 19 nt, Homo sapiens
gcagauauguagagaagau

SEQ ID NO: 1380944 - RNA, 19 nt, Homo sapiens
aaacaaugaugaccacaaa

SEQ ID NO: 1380945 - RNA, 19 nt, Homo sapiens
gggaagaccacaaucguua

SEQ ID NO: 1380946 - RNA, 19 nt, Homo sapiens
gaccauauuuggacuaaug

SEQ ID NO: 1380947 - RNA, 19 nt, Homo sapiens
ugacuuaacuuugacauug

SEQ ID NO: 1380948 - RNA, 19 nt, Homo sapiens
aaagagauguugaaagaga

SEQ ID NO: 1380949 - RNA, 19 nt, Homo sapiens
caaaugauguaacugaugu

SEQ ID NO: 1380950 - RNA, 19 nt, Homo sapiens
gaaaccuccuuggcauuua

SEQ ID NO: 1380951 - RNA, 19 nt, Homo sapiens
gagaagaugggcacacaua

SEQ ID NO: 1380952 - RNA, 19 nt, Homo sapiens
uaauauggcuggccuggaa

SEQ ID NO: 1380953 - RNA, 19 nt, Homo sapiens
gggaaacacuaagaacuuu

SEQ ID NO: 1380954 - RNA, 19 nt, Homo sapiens
ucaaggagcuaucaauauc

SEQ ID NO: 1380955 - RNA, 19 nt, Homo sapiens
ggaaguaacuguggauuuu

SEQ ID NO: 1380956 - RNA, 19 nt, Homo sapiens
gaacaagaccagaaugcuu

SEQ ID NO: 1380957 - RNA, 19 nt, Homo sapiens
ugaaagagauagaagagau

SEQ ID NO: 1380958 - RNA, 19 nt, Homo sapiens
acacauauguugaagugaa

SEQ ID NO: 1380959 - RNA, 19 nt, Homo sapiens
gaaaauaucucuggaaguc

SEQ ID NO: 1380960 - RNA, 19 nt, Homo sapiens
cuauugagcuaaagacaaa

SEQ ID NO: 1380961 - RNA, 19 nt, Homo sapiens
gggaucagguggcugcuuu

SEQ ID NO: 1380962 - RNA, 19 nt, Homo sapiens
ugacugauuuggagaagaa

SEQ ID NO: 1380963 - RNA, 19 nt, Homo sapiens
aaacuaaucaucacucuug

SEQ ID NO: 1380964 - RNA, 19 nt, Homo sapiens
gagcuaaagacaaaccaua

SEQ ID NO: 1380965 - RNA, 19 nt, Homo sapiens
aaacauaucugugcucucu

SEQ ID NO: 1380966 - RNA, 19 nt, Homo sapiens
ucagguggcugcuuuggaa

SEQ ID NO: 1380967 - RNA, 19 nt, Homo sapiens
ggaaacuccugcgauguga

SEQ ID NO: 1380968 - RNA, 19 nt, Homo sapiens
gaagaguuguucccagaca

SEQ ID NO: 1380969 - RNA, 19 nt, Homo sapiens
ggagguaucaaacuacaaa

SEQ ID NO: 1380970 - RNA, 19 nt, Homo sapiens
ccagugaugauguuaauaa

SEQ ID NO: 1380971 - RNA, 19 nt, Homo sapiens
ucaagaaauugugcuauug

SEQ ID NO: 1380972 - RNA, 19 nt, Homo sapiens
gucaagaaauugugcuauu

SEQ ID NO: 1380973 - RNA, 19 nt, Homo sapiens
ugugagcacuccaaacuuu

SEQ ID NO: 1380974 - RNA, 19 nt, Homo sapiens
gaagaugggcacacauaug

SEQ ID NO: 1380975 - RNA, 19 nt, Homo sapiens
acacauccguggaaacuug

SEQ ID NO: 1380976 - RNA, 19 nt, Homo sapiens
aaugacagcuuugcaguuu

SEQ ID NO: 1380977 - RNA, 19 nt, Homo sapiens
gagugaagguacaaguaaa

SEQ ID NO: 1380978 - RNA, 19 nt, Homo sapiens
gaaagagauagaagagauu

SEQ ID NO: 1380979 - RNA, 19 nt, Homo sapiens
gaaccuguggugugaauga

SEQ ID NO: 1380980 - RNA, 19 nt, Homo sapiens
guaaaguguuuggacguuu

SEQ ID NO: 1380981 - RNA, 19 nt, Homo sapiens
caaaguaagcucuccucua

SEQ ID NO: 1380982 - RNA, 19 nt, Homo sapiens
aaacaugcaugggcaagaa

SEQ ID NO: 1380983 - RNA, 19 nt, Homo sapiens
agaagaucuuugaccauua

SEQ ID NO: 1380984 - RNA, 19 nt, Homo sapiens
caucagaguagacuuguuu

SEQ ID NO: 1380985 - RNA, 19 nt, Homo sapiens
uauugaaccugguaacuug

SEQ ID NO: 1380986 - RNA, 19 nt, Homo sapiens
agagacauguaaaguguuu

SEQ ID NO: 1380987 - RNA, 19 nt, Homo sapiens
gaagauaauggaauuccuu

SEQ ID NO: 1380988 - RNA, 19 nt, Homo sapiens
uaagaacuuuccacaagga

SEQ ID NO: 1380989 - RNA, 19 nt, Homo sapiens
ccgauaaucaagaaacuua

SEQ ID NO: 1380990 - RNA, 19 nt, Homo sapiens
ccaaagaccaucagaguag

SEQ ID NO: 1380991 - RNA, 19 nt, Homo sapiens
caacauuacccaucucaau

SEQ ID NO: 1380992 - RNA, 19 nt, Homo sapiens
caagaaauugugcuauuga

SEQ ID NO: 1380993 - RNA, 19 nt, Homo sapiens
caaaccugaugaaguaaga

SEQ ID NO: 1380994 - RNA, 19 nt, Homo sapiens
gagagugaagguacaagua

SEQ ID NO: 1380995 - RNA, 19 nt, Homo sapiens
cuuccagacuucagaauuu

SEQ ID NO: 1380996 - RNA, 19 nt, Homo sapiens
gacaaaccauagagcagaa

SEQ ID NO: 1380997 - RNA, 19 nt, Homo sapiens
gaagggaguuugguaucug

SEQ ID NO: 1380998 - RNA, 19 nt, Homo sapiens
caaacaaaccauggaaauu

SEQ ID NO: 1380999 - RNA, 19 nt, Homo sapiens
ggagcaaacaguugucuau

SEQ ID NO: 1381000 - RNA, 19 nt, Homo sapiens
cugguacgcuuccugauuu

SEQ ID NO: 1381001 - RNA, 19 nt, Homo sapiens
guaacuugcugaaagaucu

SEQ ID NO: 1381002 - RNA, 19 nt, Homo sapiens
gcauuuaugugucgauguc

SEQ ID NO: 1381003 - RNA, 19 nt, Homo sapiens
acauaucugugcucucuuu

SEQ ID NO: 1381004 - RNA, 19 nt, Homo sapiens
ggaggacgacgacuaccua

SEQ ID NO: 1381005 - RNA, 19 nt, Homo sapiens
acacucaccuuugcugaaa

SEQ ID NO: 1381006 - RNA, 19 nt, Homo sapiens
aaauaagcgugacuuugaa

SEQ ID NO: 1381007 - RNA, 19 nt, Homo sapiens
cuaaucaucacucuuguuu

SEQ ID NO: 1381008 - RNA, 19 nt, Homo sapiens
acuaagaacuuuccacaag

SEQ ID NO: 1381009 - RNA, 19 nt, Homo sapiens
gaaaguccaagcaaaauuu

SEQ ID NO: 1381010 - RNA, 19 nt, Homo sapiens
gagaggacacucaccuuug

SEQ ID NO: 1381011 - RNA, 19 nt, Homo sapiens
gaucuucaaaucggucuua

SEQ ID NO: 1381012 - RNA, 19 nt, Homo sapiens
ugaugaaaguccaagcaaa

SEQ ID NO: 1381013 - RNA, 19 nt, Homo sapiens
cggaagagcucuggagaca

SEQ ID NO: 1381014 - RNA, 19 nt, Homo sapiens
ugauguaacugauguaacu

SEQ ID NO: 1381015 - RNA, 19 nt, Homo sapiens
ccaguucucagucaucuaa

SEQ ID NO: 1381016 - RNA, 19 nt, Homo sapiens
aagaauggauuaccuuuac

SEQ ID NO: 1381017 - RNA, 19 nt, Homo sapiens
gcaguuggaagaaagagaa

SEQ ID NO: 1381018 - RNA, 19 nt, Homo sapiens
guucaaggauuuccgucuu

SEQ ID NO: 1381019 - RNA, 19 nt, Homo sapiens
gcccaccgauaaucaagaa

SEQ ID NO: 1381020 - RNA, 19 nt, Homo sapiens
caacgcagcugccaugaug

SEQ ID NO: 1381021 - RNA, 19 nt, Homo sapiens
gcaacaacggcuccauuua

SEQ ID NO: 1381022 - RNA, 19 nt, Homo sapiens
gaaacguccucuucaaugg

SEQ ID NO: 1381023 - RNA, 19 nt, Homo sapiens
ggaaacguccucuucaaug

SEQ ID NO: 1381024 - RNA, 19 nt, Homo sapiens
ucucgacgcugaaagauga

SEQ ID NO: 1381025 - RNA, 19 nt, Homo sapiens
ggaaugccgucaccaagca

SEQ ID NO: 1381026 - RNA, 19 nt, Homo sapiens
gaagucauccaucugaaug

SEQ ID NO: 1381027 - RNA, 19 nt, Homo sapiens
gugcggacauggucuguga

SEQ ID NO: 1381028 - RNA, 19 nt, Homo sapiens
caaugaaacuuccuuuuga

SEQ ID NO: 1381029 - RNA, 19 nt, Homo sapiens
gaaagacaacgaccuccuu

SEQ ID NO: 1381030 - RNA, 19 nt, Homo sapiens
ggaguuggaucgaucuucu

SEQ ID NO: 1381031 - RNA, 19 nt, Homo sapiens
ccucacaccucccaagaug

SEQ ID NO: 1381032 - RNA, 19 nt, Homo sapiens
caacaacggcuccauuuac

SEQ ID NO: 1381033 - RNA, 19 nt, Homo sapiens
gccgaaugcuggaugagaa

SEQ ID NO: 1381034 - RNA, 19 nt, Homo sapiens
ccaccaguguucccaguga

SEQ ID NO: 1381035 - RNA, 19 nt, Homo sapiens
gaaacuuccuuuugaacaa

SEQ ID NO: 1381036 - RNA, 19 nt, Homo sapiens
ggaggcaagagauucagua

SEQ ID NO: 1381037 - RNA, 19 nt, Homo sapiens
agcaagagcugauggaaca

SEQ ID NO: 1381038 - RNA, 19 nt, Homo sapiens
gggugaacaugacaagaug

SEQ ID NO: 1381039 - RNA, 19 nt, Homo sapiens
guggaaacguccucuucaa

SEQ ID NO: 1381040 - RNA, 19 nt, Homo sapiens
guuccagccuccuccauga

SEQ ID NO: 1381041 - RNA, 19 nt, Homo sapiens
agaugaagcucaaugaaac

SEQ ID NO: 1381042 - RNA, 19 nt, Homo sapiens
ggcaagagauucaguaccu

SEQ ID NO: 1381043 - RNA, 19 nt, Homo sapiens
ccacucgcuuccuuuaaga

SEQ ID NO: 1381044 - RNA, 19 nt, Homo sapiens
agaagcaccucaucucagu

SEQ ID NO: 1381045 - RNA, 19 nt, Homo sapiens
gaucgaucuucuuguggaa

SEQ ID NO: 1381046 - RNA, 19 nt, Homo sapiens
caagaugaagcucaaugaa

SEQ ID NO: 1381047 - RNA, 19 nt, Homo sapiens
gugcgucucucaucuacug

SEQ ID NO: 1381048 - RNA, 19 nt, Homo sapiens
gggaagucauccaucugaa

SEQ ID NO: 1381049 - RNA, 19 nt, Homo sapiens
ccaagaugaagcucaauga

SEQ ID NO: 1381050 - RNA, 19 nt, Homo sapiens
ggaagucauccaucugaau

SEQ ID NO: 1381051 - RNA, 19 nt, Homo sapiens
aagaugaagcucaaugaaa

SEQ ID NO: 1381052 - RNA, 19 nt, Homo sapiens
gaaugugggaggcaagaga

SEQ ID NO: 1381053 - RNA, 19 nt, Homo sapiens
ucacaccucccaagaugaa

SEQ ID NO: 1381054 - RNA, 19 nt, Homo sapiens
gaucccagacuccuucuuc

SEQ ID NO: 1381055 - RNA, 19 nt, Homo sapiens
ggacgaccagcuaguguuc

SEQ ID NO: 1381056 - RNA, 19 nt, Homo sapiens
ggacuggcccaucgaacga

SEQ ID NO: 1381057 - RNA, 19 nt, Homo sapiens
ccaugaagcccaguucuau

SEQ ID NO: 1381058 - RNA, 19 nt, Homo sapiens
gcaucucgacgcugaaaga

SEQ ID NO: 1381059 - RNA, 19 nt, Homo sapiens
gggccuccuuggaauaaau

SEQ ID NO: 1381060 - RNA, 19 nt, Homo sapiens
caacggcuccauuuacuac

SEQ ID NO: 1381061 - RNA, 19 nt, Homo sapiens
gccagggccuccuuggaau

SEQ ID NO: 1381062 - RNA, 19 nt, Homo sapiens
gcucaaugaaacuuccuuu

SEQ ID NO: 1381063 - RNA, 19 nt, Homo sapiens
gcagcccugucaccaagau

SEQ ID NO: 1381064 - RNA, 19 nt, Homo sapiens
gggaaccagcucauugcua

SEQ ID NO: 1381065 - RNA, 19 nt, Homo sapiens
ggaucgcuguggccuauac

SEQ ID NO: 1381066 - RNA, 19 nt, Homo sapiens
gaccggagcaaucuucauc

SEQ ID NO: 1381067 - RNA, 19 nt, Homo sapiens
ugcagcccaucaccaguua

SEQ ID NO: 1381068 - RNA, 19 nt, Homo sapiens
gaugagaccggagcaaucu

SEQ ID NO: 1381069 - RNA, 19 nt, Homo sapiens
aaagucagccuccccaaua

SEQ ID NO: 1381070 - RNA, 19 nt, Homo sapiens
ccagggccuccuuggaaua

SEQ ID NO: 1381071 - RNA, 19 nt, Homo sapiens
cagcaacaccuccuugucu

SEQ ID NO: 1381072 - RNA, 19 nt, Homo sapiens
gaaccggcacagccuagug

SEQ ID NO: 1381073 - RNA, 19 nt, Homo sapiens
uaaaguccucacugccuaa

SEQ ID NO: 1381074 - RNA, 19 nt, Homo sapiens
ggagcaagagcugauggaa

SEQ ID NO: 1381075 - RNA, 19 nt, Homo sapiens
cgagaggaguuggaucgau

SEQ ID NO: 1381076 - RNA, 19 nt, Homo sapiens
gggcuuugggugaacauga

SEQ ID NO: 1381077 - RNA, 19 nt, Homo sapiens
ccacgacggccuucacagu

SEQ ID NO: 1381078 - RNA, 19 nt, Homo sapiens
gcaccucaucucagucugu

SEQ ID NO: 1381079 - RNA, 19 nt, Homo sapiens
ucaccgcccucagugucua

SEQ ID NO: 1381080 - RNA, 19 nt, Homo sapiens
cuacguggaugugcagaag

SEQ ID NO: 1381081 - RNA, 19 nt, Homo sapiens
gugcagcccaucaccaguu

SEQ ID NO: 1381082 - RNA, 19 nt, Homo sapiens
ugcaacaacggcuccauuu

SEQ ID NO: 1381083 - RNA, 19 nt, Homo sapiens
caacuuccugcgcaccaaa

SEQ ID NO: 1381084 - RNA, 19 nt, Homo sapiens
cuagucugcuacagguuga

SEQ ID NO: 1381085 - RNA, 19 nt, Homo sapiens
ucaaugaaacuuccuuuug

SEQ ID NO: 1381086 - RNA, 19 nt, Homo sapiens
uuggaucgaucuucuugug

SEQ ID NO: 1381087 - RNA, 19 nt, Homo sapiens
cccacucgcuuccuuuaag

SEQ ID NO: 1381088 - RNA, 19 nt, Homo sapiens
agaucaugcugucggagaa

SEQ ID NO: 1381089 - RNA, 19 nt, Homo sapiens
aacaacggcuccauuuacu

SEQ ID NO: 1381090 - RNA, 19 nt, Homo sapiens
cagggccuccuuggaauaa

SEQ ID NO: 1381091 - RNA, 19 nt, Homo sapiens
gggacgaccagcuaguguu

SEQ ID NO: 1381092 - RNA, 19 nt, Homo sapiens
acguggaugugcagaaguu

SEQ ID NO: 1381093 - RNA, 19 nt, Homo sapiens
caccaguguucccagugaa

SEQ ID NO: 1381094 - RNA, 19 nt, Homo sapiens
ccggagcaaucuucaucga

SEQ ID NO: 1381095 - RNA, 19 nt, Homo sapiens
gccuauacccaguuucuag

SEQ ID NO: 1381096 - RNA, 19 nt, Homo sapiens
ugacggagcaagagcugau

SEQ ID NO: 1381097 - RNA, 19 nt, Homo sapiens
cccaguuucuagucugcua

SEQ ID NO: 1381098 - RNA, 19 nt, Homo sapiens
caugaagcccaguucuaug

SEQ ID NO: 1381099 - RNA, 19 nt, Homo sapiens
uccuuggaauaaaugguua

SEQ ID NO: 1381100 - RNA, 19 nt, Homo sapiens
uuggaucgcuguggccuau

SEQ ID NO: 1381101 - RNA, 19 nt, Homo sapiens
gaaagcagcucccgaaaca

SEQ ID NO: 1381102 - RNA, 19 nt, Homo sapiens
ggaaagcgauuacccuuga

SEQ ID NO: 1381103 - RNA, 19 nt, Homo sapiens
caaagcgaguucacaaaua

SEQ ID NO: 1381104 - RNA, 19 nt, Homo sapiens
gcaaaggccuuagaucuug

SEQ ID NO: 1381105 - RNA, 19 nt, Homo sapiens
gcaucugcaucaacacuua

SEQ ID NO: 1381106 - RNA, 19 nt, Homo sapiens
ugagcgaccuuucugauaa

SEQ ID NO: 1381107 - RNA, 19 nt, Homo sapiens
ggagaaggcugaguuugau

SEQ ID NO: 1381108 - RNA, 19 nt, Homo sapiens
cgaccuuucugauaacuaa

SEQ ID NO: 1381109 - RNA, 19 nt, Homo sapiens
gccagcgccuuuagacuua

SEQ ID NO: 1381110 - RNA, 19 nt, Homo sapiens
ggacauguacauagaaaug

SEQ ID NO: 1381111 - RNA, 19 nt, Homo sapiens
gagccgagaucgcgccauu

SEQ ID NO: 1381112 - RNA, 19 nt, Homo sapiens
caacaaggacauguacaua

SEQ ID NO: 1381113 - RNA, 19 nt, Homo sapiens
gagcaucuuucaugaaugg

SEQ ID NO: 1381114 - RNA, 19 nt, Homo sapiens
gaccagagccagccaaaug

SEQ ID NO: 1381115 - RNA, 19 nt, Homo sapiens
acaaggacauguacauaga

SEQ ID NO: 1381116 - RNA, 19 nt, Homo sapiens
ggaagagaaugcccaaagg

SEQ ID NO: 1381117 - RNA, 19 nt, Homo sapiens
agacgagacuugauuggaa

SEQ ID NO: 1381118 - RNA, 19 nt, Homo sapiens
ccaggagcaucuuucauga

SEQ ID NO: 1381119 - RNA, 19 nt, Homo sapiens
gaagagaaugcccaaagga

SEQ ID NO: 1381120 - RNA, 19 nt, Homo sapiens
gaugagacgagacuugauu

SEQ ID NO: 1381121 - RNA, 19 nt, Homo sapiens
ggagagguuucaugcaagu

SEQ ID NO: 1381122 - RNA, 19 nt, Homo sapiens
aaagcgaguucacaaauag

SEQ ID NO: 1381123 - RNA, 19 nt, Homo sapiens
guacauagaaaugcugaaa

SEQ ID NO: 1381124 - RNA, 19 nt, Homo sapiens
aaggguggcuugugagauu

SEQ ID NO: 1381125 - RNA, 19 nt, Homo sapiens
ccaaaggaacguuuauuuc

SEQ ID NO: 1381126 - RNA, 19 nt, Homo sapiens
ggaaguguuacgacgauuu

SEQ ID NO: 1381127 - RNA, 19 nt, Homo sapiens
ccucaaauuggaaguguua

SEQ ID NO: 1381128 - RNA, 19 nt, Homo sapiens
gaaguguuacgacgauuug

SEQ ID NO: 1381129 - RNA, 19 nt, Homo sapiens
ggcuaaagcaggagaauug

SEQ ID NO: 1381130 - RNA, 19 nt, Homo sapiens
ggccuuagaucuugcuauc

SEQ ID NO: 1381131 - RNA, 19 nt, Homo sapiens
gcaggagaauugcuugaac

SEQ ID NO: 1381132 - RNA, 19 nt, Homo sapiens
gcacugcucauacuagaca

SEQ ID NO: 1381133 - RNA, 19 nt, Homo sapiens
ggacccaggccgcuuguau

SEQ ID NO: 1381134 - RNA, 19 nt, Homo sapiens
gcaacaaggacauguacau

SEQ ID NO: 1381135 - RNA, 19 nt, Homo sapiens
gaaaccccgucucuacuaa

SEQ ID NO: 1381136 - RNA, 19 nt, Homo sapiens
ggcugaguuugaugacuua

SEQ ID NO: 1381137 - RNA, 19 nt, Homo sapiens
cauucgagauaguaaagaa

SEQ ID NO: 1381138 - RNA, 19 nt, Homo sapiens
cccaaaggaacguuuauuu

SEQ ID NO: 1381139 - RNA, 19 nt, Homo sapiens
agacuugauuggaagagaa

SEQ ID NO: 1381140 - RNA, 19 nt, Homo sapiens
gccuuuagacuuaucuuaa

SEQ ID NO: 1381141 - RNA, 19 nt, Homo sapiens
ucaaagcgaguucacaaau

SEQ ID NO: 1381142 - RNA, 19 nt, Homo sapiens
ugucaucccuagugccaaa

SEQ ID NO: 1381143 - RNA, 19 nt, Homo sapiens
gcaacugucaucccuagug

SEQ ID NO: 1381144 - RNA, 19 nt, Homo sapiens
ccaguuugcccgugauuug

SEQ ID NO: 1381145 - RNA, 19 nt, Homo sapiens
ggaaaggcccacagaugca

SEQ ID NO: 1381146 - RNA, 19 nt, Homo sapiens
guagaugagacgagacuug

SEQ ID NO: 1381147 - RNA, 19 nt, Homo sapiens
aaggacauguacauagaaa

SEQ ID NO: 1381148 - RNA, 19 nt, Homo sapiens
gaaaggcccacagaugcaa

SEQ ID NO: 1381149 - RNA, 19 nt, Homo sapiens
aggagcaucuuucaugaau

SEQ ID NO: 1381150 - RNA, 19 nt, Homo sapiens
ggguuuaagucauccaaag

SEQ ID NO: 1381151 - RNA, 19 nt, Homo sapiens
gagacuugauuggaagaga

SEQ ID NO: 1381152 - RNA, 19 nt, Homo sapiens
acggagagguuucaugcaa

SEQ ID NO: 1381153 - RNA, 19 nt, Homo sapiens
caaauagcuacuccucuga

SEQ ID NO: 1381154 - RNA, 19 nt, Homo sapiens
ggaaagcagcucccgaaac

SEQ ID NO: 1381155 - RNA, 19 nt, Homo sapiens
gaccucaaauuggaagugu

SEQ ID NO: 1381156 - RNA, 19 nt, Homo sapiens
ucaugccacucuguaaauu

SEQ ID NO: 1381157 - RNA, 19 nt, Homo sapiens
gcucugaaggguucuugaa

SEQ ID NO: 1381158 - RNA, 19 nt, Homo sapiens
gagccaggguuuaagucau

SEQ ID NO: 1381159 - RNA, 19 nt, Homo sapiens
agaccagccucaacaugga

SEQ ID NO: 1381160 - RNA, 19 nt, Homo sapiens
ggagcaucuuucaugaaug

SEQ ID NO: 1381161 - RNA, 19 nt, Homo sapiens
ucagaucgcaaaggccuua

SEQ ID NO: 1381162 - RNA, 19 nt, Homo sapiens
gagcgaccuuucugauaac

SEQ ID NO: 1381163 - RNA, 19 nt, Homo sapiens
auccaaagaucgcuugaug

SEQ ID NO: 1381164 - RNA, 19 nt, Homo sapiens
ugaaaagcaucaucgaaga

SEQ ID NO: 1381165 - RNA, 19 nt, Homo sapiens
aaucaaagcgaguucacaa

SEQ ID NO: 1381166 - RNA, 19 nt, Homo sapiens
caaggacauguacauagaa

SEQ ID NO: 1381167 - RNA, 19 nt, Homo sapiens
gggauagccagcgccuuua

SEQ ID NO: 1381168 - RNA, 19 nt, Homo sapiens
cagcuacucgggaggcuaa

SEQ ID NO: 1381169 - RNA, 19 nt, Homo sapiens
aaaauacagugcccaaaau

SEQ ID NO: 1381170 - RNA, 19 nt, Homo sapiens
ccaaagaucgcuugaugcu

SEQ ID NO: 1381171 - RNA, 19 nt, Homo sapiens
gaaaagcaucaucgaagaa

SEQ ID NO: 1381172 - RNA, 19 nt, Homo sapiens
aggagaaggcugaguuuga

SEQ ID NO: 1381173 - RNA, 19 nt, Homo sapiens
ccuguaaucccagcacuuu

SEQ ID NO: 1381174 - RNA, 19 nt, Homo sapiens
ucugauaacuaagaguaga

SEQ ID NO: 1381175 - RNA, 19 nt, Homo sapiens
gagacgagacuugauugga

SEQ ID NO: 1381176 - RNA, 19 nt, Homo sapiens
gagguuucaugcaagucaa

SEQ ID NO: 1381177 - RNA, 19 nt, Homo sapiens
aggcugaguuugaugacuu

SEQ ID NO: 1381178 - RNA, 19 nt, Homo sapiens
guggcgaccauucgagaua

SEQ ID NO: 1381179 - RNA, 19 nt, Homo sapiens
caaauuggaaguguuacga

SEQ ID NO: 1381180 - RNA, 19 nt, Homo sapiens
ccucuucgcagccucguuu

SEQ ID NO: 1381181 - RNA, 19 nt, Homo sapiens
ccagcaacaaggacaugua

SEQ ID NO: 1381182 - RNA, 19 nt, Homo sapiens
gcgcagcucccagcaacaa

SEQ ID NO: 1381183 - RNA, 19 nt, Homo sapiens
gaucgcaaaggccuuagau

SEQ ID NO: 1381184 - RNA, 19 nt, Homo sapiens
gcuugagaccgcugugauu

SEQ ID NO: 1381185 - RNA, 19 nt, Homo sapiens
ggacaacaggagugaaacu

SEQ ID NO: 1381186 - RNA, 19 nt, Homo sapiens
gauagccagcgccuuuaga

SEQ ID NO: 1381187 - RNA, 19 nt, Homo sapiens
cgucaugccacucuguaaa

SEQ ID NO: 1381188 - RNA, 19 nt, Homo sapiens
gaaacccgcaaggcucuga

SEQ ID NO: 1381189 - RNA, 19 nt, Homo sapiens
gguuuaagucauccaaaga

SEQ ID NO: 1381190 - RNA, 19 nt, Homo sapiens
uagaugagacgagacuuga

SEQ ID NO: 1381191 - RNA, 19 nt, Homo sapiens
gcgugaacauggcgaaggu

SEQ ID NO: 1381192 - RNA, 19 nt, Homo sapiens
uaucuuaaaucgggcaucu

SEQ ID NO: 1381193 - RNA, 19 nt, Homo sapiens
cgcaaaggccuuagaucuu

SEQ ID NO: 1381194 - RNA, 19 nt, Homo sapiens
ccugaccguucgaggguuu

SEQ ID NO: 1381195 - RNA, 19 nt, Homo sapiens
aagagaaugcccaaaggaa

SEQ ID NO: 1381196 - RNA, 19 nt, Homo sapiens
uggcgaagguucucaaacg

SEQ ID NO: 1381197 - RNA, 19 nt, Homo sapiens
gcugugauuuucugacauu

SEQ ID NO: 1381198 - RNA, 19 nt, Homo sapiens
guaaauuugagcgaccuuu

SEQ ID NO: 1381199 - RNA, 19 nt, Homo sapiens
augccacucuguaaauuug

SEQ ID NO: 1381200 - RNA, 19 nt, Homo sapiens
caucgaagaaggugaguac

SEQ ID NO: 1381201 - RNA, 19 nt, Homo sapiens
guacuugacugccgagauc

SEQ ID NO: 1381202 - RNA, 19 nt, Homo sapiens
gaaauguccggucguggua

SEQ ID NO: 1381203 - RNA, 19 nt, Homo sapiens
guacugcugcccaagaaga

SEQ ID NO: 1381204 - RNA, 19 nt, Homo sapiens
caagaagacgcgcaucauc

SEQ ID NO: 1381205 - RNA, 19 nt, Homo sapiens
ccgcggugcucgaguacuu

SEQ ID NO: 1381206 - RNA, 19 nt, Homo sapiens
caacauccaggccguacug

SEQ ID NO: 1381207 - RNA, 19 nt, Homo sapiens
ccguacugcugcccaagaa

SEQ ID NO: 1381208 - RNA, 19 nt, Homo sapiens
gcaacgacgaggagcucaa

SEQ ID NO: 1381209 - RNA, 19 nt, Homo sapiens
agacggagagccaccacaa

SEQ ID NO: 1381210 - RNA, 19 nt, Homo sapiens
cgacgaggagcucaacaag

SEQ ID NO: 1381211 - RNA, 19 nt, Homo sapiens
caaggccaagggcaaguga

SEQ ID NO: 1381212 - RNA, 19 nt, Homo sapiens
gaaagucucugguaagaag

SEQ ID NO: 1381213 - RNA, 19 nt, Homo sapiens
gaaaggaaagucucuggua

SEQ ID NO: 1381214 - RNA, 19 nt, Homo sapiens
uaagaagagugaaagcaaa

SEQ ID NO: 1381215 - RNA, 19 nt, Homo sapiens
aaaggaaagucucugguaa

SEQ ID NO: 1381216 - RNA, 19 nt, Homo sapiens
ccggacaguucauaaauaa

SEQ ID NO: 1381217 - RNA, 19 nt, Homo sapiens
gaaccaagaauucggaaga

SEQ ID NO: 1381218 - RNA, 19 nt, Homo sapiens
acacagaggugcggaacua

SEQ ID NO: 1381219 - RNA, 19 nt, Homo sapiens
caagaagucugaagaacca

SEQ ID NO: 1381220 - RNA, 19 nt, Homo sapiens
gcaaagaagccaagaaguc

SEQ ID NO: 1381221 - RNA, 19 nt, Homo sapiens
gccggacaguucauaaaua

SEQ ID NO: 1381222 - RNA, 19 nt, Homo sapiens
ggagacgucuugagugaag

SEQ ID NO: 1381223 - RNA, 19 nt, Homo sapiens
ugaagaagcacaucaagga

SEQ ID NO: 1381224 - RNA, 19 nt, Homo sapiens
gagcgugucugguggaucu

SEQ ID NO: 1381225 - RNA, 19 nt, Homo sapiens
agacugagcuggacuuugc

SEQ ID NO: 1381226 - RNA, 19 nt, Homo sapiens
guaagaagagugaaagcaa

SEQ ID NO: 1381227 - RNA, 19 nt, Homo sapiens
gggcaucccucaaguacca

SEQ ID NO: 1381228 - RNA, 19 nt, Homo sapiens
gaagagugaaagcaaagaa

SEQ ID NO: 1381229 - RNA, 19 nt, Homo sapiens
gaacuauaucugugacgaa

SEQ ID NO: 1381230 - RNA, 19 nt, Homo sapiens
gcaacaagguuuucaugau

SEQ ID NO: 1381231 - RNA, 19 nt, Homo sapiens
cuauaucugugacgaaugu

SEQ ID NO: 1381232 - RNA, 19 nt, Homo sapiens
cuaaagcagucgaggagau

SEQ ID NO: 1381233 - RNA, 19 nt, Homo sapiens
ccaagccuuugcaguguga

SEQ ID NO: 1381234 - RNA, 19 nt, Homo sapiens
caaagaagccaagaagucu

SEQ ID NO: 1381235 - RNA, 19 nt, Homo sapiens
caacaagguuuucaugauc

SEQ ID NO: 1381236 - RNA, 19 nt, Homo sapiens
gcaugaagaagcacaucaa

SEQ ID NO: 1381237 - RNA, 19 nt, Homo sapiens
aggaaagucucugguaaga

SEQ ID NO: 1381238 - RNA, 19 nt, Homo sapiens
gaaaaugacaagaagcaaa

SEQ ID NO: 1381239 - RNA, 19 nt, Homo sapiens
agggagacgucuugaguga

SEQ ID NO: 1381240 - RNA, 19 nt, Homo sapiens
ucaaguaccacaugaccaa

SEQ ID NO: 1381241 - RNA, 19 nt, Homo sapiens
ugacacagacccaggacaa

SEQ ID NO: 1381242 - RNA, 19 nt, Homo sapiens
gcgcugacggcaugaagaa

SEQ ID NO: 1381243 - RNA, 19 nt, Homo sapiens
ccacaugaccaaacacaag

SEQ ID NO: 1381244 - RNA, 19 nt, Homo sapiens
gaauguggacaaaccuuca

SEQ ID NO: 1381245 - RNA, 19 nt, Homo sapiens
cagaggugcggaacuauau

SEQ ID NO: 1381246 - RNA, 19 nt, Homo sapiens
acagugcgcuggcagucaa

SEQ ID NO: 1381247 - RNA, 19 nt, Homo sapiens
ggaaagucucugguaagaa

SEQ ID NO: 1381248 - RNA, 19 nt, Homo sapiens
cgaguucagugaccuuucu

SEQ ID NO: 1381249 - RNA, 19 nt, Homo sapiens
acagaggugcggaacuaua

SEQ ID NO: 1381250 - RNA, 19 nt, Homo sapiens
gaagucugaagaaccaaga

SEQ ID NO: 1381251 - RNA, 19 nt, Homo sapiens
acgaguccuuugagccuua

SEQ ID NO: 1381252 - RNA, 19 nt, Homo sapiens
uaaagcagucgaggagauu

SEQ ID NO: 1381253 - RNA, 19 nt, Homo sapiens
ugacgaauguggacaaacc

SEQ ID NO: 1381254 - RNA, 19 nt, Homo sapiens
ccggaagccuugugcaaag

SEQ ID NO: 1381255 - RNA, 19 nt, Homo sapiens
cgcaaacgcugagugacuu

SEQ ID NO: 1381256 - RNA, 19 nt, Homo sapiens
gaaagcaaagaagccaaga

SEQ ID NO: 1381257 - RNA, 19 nt, Homo sapiens
ggacggcagugaggaugag

SEQ ID NO: 1381258 - RNA, 19 nt, Homo sapiens
gccacagccuucucaaguc

SEQ ID NO: 1381259 - RNA, 19 nt, Homo sapiens
uaaaagacgaguucaguga

SEQ ID NO: 1381260 - RNA, 19 nt, Homo sapiens
gcccacaaccucaauguac

SEQ ID NO: 1381261 - RNA, 19 nt, Homo sapiens
gacccaagcccggauggaa

SEQ ID NO: 1381262 - RNA, 19 nt, Homo sapiens
aaccaagaauucggaagaa

SEQ ID NO: 1381263 - RNA, 19 nt, Homo sapiens
gccaagaagucugaagaac

SEQ ID NO: 1381264 - RNA, 19 nt, Homo sapiens
gaagcaaaaugcccagucu

SEQ ID NO: 1381265 - RNA, 19 nt, Homo sapiens
ggccggacaguucauaaau

SEQ ID NO: 1381266 - RNA, 19 nt, Homo sapiens
ugaagcucauccacacaga

SEQ ID NO: 1381267 - RNA, 19 nt, Homo sapiens
ggacuuccagcgccugcuu

SEQ ID NO: 1381268 - RNA, 19 nt, Homo sapiens
ugagggagacgucuugagu

SEQ ID NO: 1381269 - RNA, 19 nt, Homo sapiens
gcaaacgcugagugacuug

SEQ ID NO: 1381270 - RNA, 19 nt, Homo sapiens
cagcgggcaucccucaagu

SEQ ID NO: 1381271 - RNA, 19 nt, Homo sapiens
gccggaagccuugugcaaa

SEQ ID NO: 1381272 - RNA, 19 nt, Homo sapiens
cgagaagccugcgcagcau

SEQ ID NO: 1381273 - RNA, 19 nt, Homo sapiens
cagucgaggagauuuguaa

SEQ ID NO: 1381274 - RNA, 19 nt, Homo sapiens
gcagucgaggagauuugua

SEQ ID NO: 1381275 - RNA, 19 nt, Homo sapiens
gagcuucccaccaucuaca

SEQ ID NO: 1381276 - RNA, 19 nt, Homo sapiens
ccagggcaguugggugaga

SEQ ID NO: 1381277 - RNA, 19 nt, Homo sapiens
caaguggccacgggacaaa

SEQ ID NO: 1381278 - RNA, 19 nt, Homo sapiens
gaaggcccacaaccucaau

SEQ ID NO: 1381279 - RNA, 19 nt, Homo sapiens
aagcaaagaagccaagaag

SEQ ID NO: 1381280 - RNA, 19 nt, Homo sapiens
cccacaaccucaauguaca

SEQ ID NO: 1381281 - RNA, 19 nt, Homo sapiens
ucugaagaaccaagaauuc

SEQ ID NO: 1381282 - RNA, 19 nt, Homo sapiens
aagaagccaagaagucuga

SEQ ID NO: 1381283 - RNA, 19 nt, Homo sapiens
gguaagaagagugaaagca

SEQ ID NO: 1381284 - RNA, 19 nt, Homo sapiens
ccauguuaugcuuguaaua

SEQ ID NO: 1381285 - RNA, 19 nt, Homo sapiens
caagagcuccauguuaugc

SEQ ID NO: 1381286 - RNA, 19 nt, Homo sapiens
agagcuccauguuaugcuu

SEQ ID NO: 1381287 - RNA, 19 nt, Homo sapiens
ggcccacaaccucaaugua

SEQ ID NO: 1381288 - RNA, 19 nt, Homo sapiens
aacacaaggcugagacuga

SEQ ID NO: 1381289 - RNA, 19 nt, Homo sapiens
cuuugagccuuacccagaa

SEQ ID NO: 1381290 - RNA, 19 nt, Homo sapiens
gcuccauguuaugcuugua

SEQ ID NO: 1381291 - RNA, 19 nt, Homo sapiens
aagcccggauggaagaaga

SEQ ID NO: 1381292 - RNA, 19 nt, Homo sapiens
cagcuuccaucuucaaccu

SEQ ID NO: 1381293 - RNA, 19 nt, Homo sapiens
ugaaacaccuggccugcua

SEQ ID NO: 1381294 - RNA, 19 nt, Homo sapiens
gcauaugccucaaucaaag

SEQ ID NO: 1381295 - RNA, 19 nt, Homo sapiens
gagcgucucugcugugcaa

SEQ ID NO: 1381296 - RNA, 19 nt, Homo sapiens
caagugcgccuuccuguug

SEQ ID NO: 1381297 - RNA, 19 nt, Homo sapiens
gcaaggacgacgacacugu

SEQ ID NO: 1381298 - RNA, 19 nt, Homo sapiens
ggaccucucuggaguacac

SEQ ID NO: 1381299 - RNA, 19 nt, Homo sapiens
gcaagugcgccuuccuguu

SEQ ID NO: 1381300 - RNA, 19 nt, Homo sapiens
gaaccuggucaccgaagug

SEQ ID NO: 1381301 - RNA, 19 nt, Homo sapiens
gggcucucaugcuguauca

SEQ ID NO: 1381302 - RNA, 19 nt, Homo sapiens
ggugguguacgcccuguuu

SEQ ID NO: 1381303 - RNA, 19 nt, Homo sapiens
ggaaccuggucaccgaagu

SEQ ID NO: 1381304 - RNA, 19 nt, Homo sapiens
gaauaaccaggaacgucaa

SEQ ID NO: 1381305 - RNA, 19 nt, Homo sapiens
ggccguagacagaaucaug

SEQ ID NO: 1381306 - RNA, 19 nt, Homo sapiens
ccgcauaugccucaaucaa

SEQ ID NO: 1381307 - RNA, 19 nt, Homo sapiens
ucucugcugugcaaucuca

SEQ ID NO: 1381308 - RNA, 19 nt, Homo sapiens
uagacagaaucaugaacga

SEQ ID NO: 1381309 - RNA, 19 nt, Homo sapiens
ggagccgucacucugcuaa

SEQ ID NO: 1381310 - RNA, 19 nt, Homo sapiens
uguuugggcuggccgaguu

SEQ ID NO: 1381311 - RNA, 19 nt, Homo sapiens
cgcauaugccucaaucaaa

SEQ ID NO: 1381312 - RNA, 19 nt, Homo sapiens
ucacucugcuaagccugua

SEQ ID NO: 1381313 - RNA, 19 nt, Homo sapiens
gaggcuccaauaaagcuaa

SEQ ID NO: 1381314 - RNA, 19 nt, Homo sapiens
gccguagacagaaucauga

SEQ ID NO: 1381315 - RNA, 19 nt, Homo sapiens
gugcguccgcuguuccuaa

SEQ ID NO: 1381316 - RNA, 19 nt, Homo sapiens
uguccugguucccuuucua

SEQ ID NO: 1381317 - RNA, 19 nt, Homo sapiens
gagcacuuccuggagcaaa

SEQ ID NO: 1381318 - RNA, 19 nt, Homo sapiens
aaagcuaacccggaccaaa

SEQ ID NO: 1381319 - RNA, 19 nt, Homo sapiens
gcgccuuccuguuguucug

SEQ ID NO: 1381320 - RNA, 19 nt, Homo sapiens
ucccaggccuccacagagu

SEQ ID NO: 1381321 - RNA, 19 nt, Homo sapiens
ccacuggucucggcaacac

SEQ ID NO: 1381322 - RNA, 19 nt, Homo sapiens
cugguucccuuucuacuac

SEQ ID NO: 1381323 - RNA, 19 nt, Homo sapiens
ccugguucccuuucuacua

SEQ ID NO: 1381324 - RNA, 19 nt, Homo sapiens
gaaccgaggucgacaugaa

SEQ ID NO: 1381325 - RNA, 19 nt, Homo sapiens
gaauaaaccgucuguguca

SEQ ID NO: 1381326 - RNA, 19 nt, Homo sapiens
gaacugggauguggaacug

SEQ ID NO: 1381327 - RNA, 19 nt, Homo sapiens
ccacguggaugaugaauac

SEQ ID NO: 1381328 - RNA, 19 nt, Homo sapiens
ggagaggucugaauaaacc

SEQ ID NO: 1381329 - RNA, 19 nt, Homo sapiens
guggagaggucugaauaaa

SEQ ID NO: 1381330 - RNA, 19 nt, Homo sapiens
ucucugacauccuccgaua

SEQ ID NO: 1381331 - RNA, 19 nt, Homo sapiens
gaagaaaaccgccugauuc

SEQ ID NO: 1381332 - RNA, 19 nt, Homo sapiens
aaaccaggacgacuacaua

SEQ ID NO: 1381333 - RNA, 19 nt, Homo sapiens
gacauggacuuggaacuca

SEQ ID NO: 1381334 - RNA, 19 nt, Homo sapiens
gcaagcgggucucugacau

SEQ ID NO: 1381335 - RNA, 19 nt, Homo sapiens
ggacgacuacauaucauuc

SEQ ID NO: 1381336 - RNA, 19 nt, Homo sapiens
agaauggccugcugaacug

SEQ ID NO: 1381337 - RNA, 19 nt, Homo sapiens
ucaagauguuugcaaagga

SEQ ID NO: 1381338 - RNA, 19 nt, Homo sapiens
ggcaccauguguauaagaa

SEQ ID NO: 1381339 - RNA, 19 nt, Homo sapiens
ccaggacgacuacauauca

SEQ ID NO: 1381340 - RNA, 19 nt, Homo sapiens
ggguggagaggucugaaua

SEQ ID NO: 1381341 - RNA, 19 nt, Homo sapiens
caccauguguauaagaaga

SEQ ID NO: 1381342 - RNA, 19 nt, Homo sapiens
ccagccacguggaugauga

SEQ ID NO: 1381343 - RNA, 19 nt, Homo sapiens
ggaagaaaaccgccugauu

SEQ ID NO: 1381344 - RNA, 19 nt, Homo sapiens
gguggagaggucugaauaa

SEQ ID NO: 1381345 - RNA, 19 nt, Homo sapiens
ggacauggacuuggaacuc

SEQ ID NO: 1381346 - RNA, 19 nt, Homo sapiens
gccucaagauguuugcaaa

SEQ ID NO: 1381347 - RNA, 19 nt, Homo sapiens
ccaagguuaugaucacuac

SEQ ID NO: 1381348 - RNA, 19 nt, Homo sapiens
gcucagcccaggagaggaa

SEQ ID NO: 1381349 - RNA, 19 nt, Homo sapiens
caauaccgcacgcaagaga

SEQ ID NO: 1381350 - RNA, 19 nt, Homo sapiens
gaggaucccaagguuauga

SEQ ID NO: 1381351 - RNA, 19 nt, Homo sapiens
ugaugaugcuggaggugaa

SEQ ID NO: 1381352 - RNA, 19 nt, Homo sapiens
cagaauggccugcugaacu

SEQ ID NO: 1381353 - RNA, 19 nt, Homo sapiens
auagacagacccaccagua

SEQ ID NO: 1381354 - RNA, 19 nt, Homo sapiens
gucaggacauggacuugga

SEQ ID NO: 1381355 - RNA, 19 nt, Homo sapiens
ucgcaaaccaggacgacua

SEQ ID NO: 1381356 - RNA, 19 nt, Homo sapiens
ggucaucaccuucgcaaac

SEQ ID NO: 1381357 - RNA, 19 nt, Homo sapiens
ugacauccuccgauaccua

SEQ ID NO: 1381358 - RNA, 19 nt, Homo sapiens
gcaacguggagcucacuga

SEQ ID NO: 1381359 - RNA, 19 nt, Homo sapiens
ccugauucccacugaguua

SEQ ID NO: 1381360 - RNA, 19 nt, Homo sapiens
agucgaggaucccaagguu

SEQ ID NO: 1381361 - RNA, 19 nt, Homo sapiens
caccugcccuuugguccua

SEQ ID NO: 1381362 - RNA, 19 nt, Homo sapiens
cauccuccgauaccuauuu

SEQ ID NO: 1381363 - RNA, 19 nt, Homo sapiens
gacauccuccgauaccuau

SEQ ID NO: 1381364 - RNA, 19 nt, Homo sapiens
gacagacccaccaguagga

SEQ ID NO: 1381365 - RNA, 19 nt, Homo sapiens
ucgaggaucccaagguuau

SEQ ID NO: 1381366 - RNA, 19 nt, Homo sapiens
guucccgccucaagauguu

SEQ ID NO: 1381367 - RNA, 19 nt, Homo sapiens
gcugugcaauguggucaug

SEQ ID NO: 1381368 - RNA, 19 nt, Homo sapiens
uggcacccuuacaccaaua

SEQ ID NO: 1381369 - RNA, 19 nt, Homo sapiens
cugaauaaaccgucugugu

SEQ ID NO: 1381370 - RNA, 19 nt, Homo sapiens
gcuggcacccuuacaccaa

SEQ ID NO: 1381371 - RNA, 19 nt, Homo sapiens
ccaacggcgucaccgaucu

SEQ ID NO: 1381372 - RNA, 19 nt, Homo sapiens
ugaccagccacguggauga

SEQ ID NO: 1381373 - RNA, 19 nt, Homo sapiens
gcugaacugggauguggaa

SEQ ID NO: 1381374 - RNA, 19 nt, Homo sapiens
caaaccaggacgacuacau

SEQ ID NO: 1381375 - RNA, 19 nt, Homo sapiens
ucagccaccugcccuuugg

SEQ ID NO: 1381376 - RNA, 19 nt, Homo sapiens
ccaguucccgccucaagau

SEQ ID NO: 1381377 - RNA, 19 nt, Homo sapiens
caggacgacuacauaucau

SEQ ID NO: 1381378 - RNA, 19 nt, Homo sapiens
ccgaucugcuggucguuca

SEQ ID NO: 1381379 - RNA, 19 nt, Homo sapiens
ggauggggcugucauagac

SEQ ID NO: 1381380 - RNA, 19 nt, Homo sapiens
caauggagcugauauauau

SEQ ID NO: 1381381 - RNA, 19 nt, Homo sapiens
gaacacccuucuucguuua

SEQ ID NO: 1381382 - RNA, 19 nt, Homo sapiens
ggacuacacuaaaccauau

SEQ ID NO: 1381383 - RNA, 19 nt, Homo sapiens
ucacacaccuuaauaaugu

SEQ ID NO: 1381384 - RNA, 19 nt, Homo sapiens
agaaugggcucucgagaua

SEQ ID NO: 1381385 - RNA, 19 nt, Homo sapiens
guacagcacugguagaaau

SEQ ID NO: 1381386 - RNA, 19 nt, Homo sapiens
caccugaacuuguugcuua

SEQ ID NO: 1381387 - RNA, 19 nt, Homo sapiens
aaacauagauagugccaaa

SEQ ID NO: 1381388 - RNA, 19 nt, Homo sapiens
gaaaugggauacaagcaau

SEQ ID NO: 1381389 - RNA, 19 nt, Homo sapiens
gagaagagcauguuagaau

SEQ ID NO: 1381390 - RNA, 19 nt, Homo sapiens
gaagagcauguuagaauuu

SEQ ID NO: 1381391 - RNA, 19 nt, Homo sapiens
ggccaagcaucuaagaaua

SEQ ID NO: 1381392 - RNA, 19 nt, Homo sapiens
aauaaucgcuuuacaagug

SEQ ID NO: 1381393 - RNA, 19 nt, Homo sapiens
ggaaaagacuuaauguuug

SEQ ID NO: 1381394 - RNA, 19 nt, Homo sapiens
agaaaugggugaugaguau

SEQ ID NO: 1381395 - RNA, 19 nt, Homo sapiens
ccaagcaucuaagaauaua

SEQ ID NO: 1381396 - RNA, 19 nt, Homo sapiens
caagagaaaugggauacaa

SEQ ID NO: 1381397 - RNA, 19 nt, Homo sapiens
gggacaauaugcuauguga

SEQ ID NO: 1381398 - RNA, 19 nt, Homo sapiens
ggaaugacaaugacaguug

SEQ ID NO: 1381399 - RNA, 19 nt, Homo sapiens
caacuauucuacaagcaaa

SEQ ID NO: 1381400 - RNA, 19 nt, Homo sapiens
ugaguaugcuguagaaaga

SEQ ID NO: 1381401 - RNA, 19 nt, Homo sapiens
gacauuugcugcagaugaa

SEQ ID NO: 1381402 - RNA, 19 nt, Homo sapiens
ucaaagcuacacuucauua

SEQ ID NO: 1381403 - RNA, 19 nt, Homo sapiens
gcagguggaagucaucaua

SEQ ID NO: 1381404 - RNA, 19 nt, Homo sapiens
uuaagauccuguucuguaa

SEQ ID NO: 1381405 - RNA, 19 nt, Homo sapiens
ggaaauauugagaagguaa

SEQ ID NO: 1381406 - RNA, 19 nt, Homo sapiens
caacucgucuaaauguuau

SEQ ID NO: 1381407 - RNA, 19 nt, Homo sapiens
guacauugcuggucaacag

SEQ ID NO: 1381408 - RNA, 19 nt, Homo sapiens
agaagagcauguuagaauu

SEQ ID NO: 1381409 - RNA, 19 nt, Homo sapiens
gacaggcucuaguggaauu

SEQ ID NO: 1381410 - RNA, 19 nt, Homo sapiens
ccaacucgucuaaauguua

SEQ ID NO: 1381411 - RNA, 19 nt, Homo sapiens
aaagugcaacguauuguua

SEQ ID NO: 1381412 - RNA, 19 nt, Homo sapiens
uuacggcacugaaucacua

SEQ ID NO: 1381413 - RNA, 19 nt, Homo sapiens
gacaauaugcuaugugaug

SEQ ID NO: 1381414 - RNA, 19 nt, Homo sapiens
ggaagcagaccucguggaa

SEQ ID NO: 1381415 - RNA, 19 nt, Homo sapiens
gaagucaucauaaaguuuc

SEQ ID NO: 1381416 - RNA, 19 nt, Homo sapiens
aagauccuguucuguaaua

SEQ ID NO: 1381417 - RNA, 19 nt, Homo sapiens
ugauauauaugcuggaugu

SEQ ID NO: 1381418 - RNA, 19 nt, Homo sapiens
ucaauggagcugauauaua

SEQ ID NO: 1381419 - RNA, 19 nt, Homo sapiens
gcaacguauuguuauauuc

SEQ ID NO: 1381420 - RNA, 19 nt, Homo sapiens
ggaagucaucauaaaguuu

SEQ ID NO: 1381421 - RNA, 19 nt, Homo sapiens
gaagagaagagcauguuag

SEQ ID NO: 1381422 - RNA, 19 nt, Homo sapiens
ccaugaaguucuuacauuc

SEQ ID NO: 1381423 - RNA, 19 nt, Homo sapiens
cagccacccuccuguguuu

SEQ ID NO: 1381424 - RNA, 19 nt, Homo sapiens
caucaucccauuuauaaga

SEQ ID NO: 1381425 - RNA, 19 nt, Homo sapiens
gggaaaagacuuaauguuu

SEQ ID NO: 1381426 - RNA, 19 nt, Homo sapiens
gugaugaugaugccauuua

SEQ ID NO: 1381427 - RNA, 19 nt, Homo sapiens
gaugaacccguguacauug

SEQ ID NO: 1381428 - RNA, 19 nt, Homo sapiens
cauguugccuugcuuacuu

SEQ ID NO: 1381429 - RNA, 19 nt, Homo sapiens
gcacggccaacucgucuaa

SEQ ID NO: 1381430 - RNA, 19 nt, Homo sapiens
aagcaaugguugaguuuga

SEQ ID NO: 1381431 - RNA, 19 nt, Homo sapiens
cuacaucaucccauuuaua

SEQ ID NO: 1381432 - RNA, 19 nt, Homo sapiens
ugaugaugaugccauuuaa

SEQ ID NO: 1381433 - RNA, 19 nt, Homo sapiens
ggaaaucccucugguucag

SEQ ID NO: 1381434 - RNA, 19 nt, Homo sapiens
agauacaccugaacuuguu

SEQ ID NO: 1381435 - RNA, 19 nt, Homo sapiens
gaaagggucgccagagaca

SEQ ID NO: 1381436 - RNA, 19 nt, Homo sapiens
agaauccgcuuuauccaau

SEQ ID NO: 1381437 - RNA, 19 nt, Homo sapiens
uuacaugcauggaggaaau

SEQ ID NO: 1381438 - RNA, 19 nt, Homo sapiens
acuuguugcuuauccauua

SEQ ID NO: 1381439 - RNA, 19 nt, Homo sapiens
gggacuacacuaaaccaua

SEQ ID NO: 1381440 - RNA, 19 nt, Homo sapiens
caaagcuacacuucauuaa

SEQ ID NO: 1381441 - RNA, 19 nt, Homo sapiens
aauguuggcucgguaauug

SEQ ID NO: 1381442 - RNA, 19 nt, Homo sapiens
gcuggauguugcacacuaa

SEQ ID NO: 1381443 - RNA, 19 nt, Homo sapiens
cauagauagugccaaagaa

SEQ ID NO: 1381444 - RNA, 19 nt, Homo sapiens
guuccaaucccuauacauu

SEQ ID NO: 1381445 - RNA, 19 nt, Homo sapiens
gagauacaccugaacuugu

SEQ ID NO: 1381446 - RNA, 19 nt, Homo sapiens
uaaagcagcacucaaugga

SEQ ID NO: 1381447 - RNA, 19 nt, Homo sapiens
guuuagacaugauggcuau

SEQ ID NO: 1381448 - RNA, 19 nt, Homo sapiens
uaaaaugguugaucucaug

SEQ ID NO: 1381449 - RNA, 19 nt, Homo sapiens
ugaugaguaugcuguagaa

SEQ ID NO: 1381450 - RNA, 19 nt, Homo sapiens
acaauaugcuaugugauga

SEQ ID NO: 1381451 - RNA, 19 nt, Homo sapiens
ggaagacgagauagaggaa

SEQ ID NO: 1381452 - RNA, 19 nt, Homo sapiens
ccaauuacaguggauguuu

SEQ ID NO: 1381453 - RNA, 19 nt, Homo sapiens
gaauccgcuuuauccaauu

SEQ ID NO: 1381454 - RNA, 19 nt, Homo sapiens
gaugaugccauuuaaacga

SEQ ID NO: 1381455 - RNA, 19 nt, Homo sapiens
uuuaagauccuguucugua

SEQ ID NO: 1381456 - RNA, 19 nt, Homo sapiens
ccaagucguuacagaaugg

SEQ ID NO: 1381457 - RNA, 19 nt, Homo sapiens
uaaaccauauuugggaaga

SEQ ID NO: 1381458 - RNA, 19 nt, Homo sapiens
uacaagcaaugguugaguu

SEQ ID NO: 1381459 - RNA, 19 nt, Homo sapiens
aauccgcuuuauccaauua

SEQ ID NO: 1381460 - RNA, 19 nt, Homo sapiens
uggaagucaucauaaaguu

SEQ ID NO: 1381461 - RNA, 19 nt, Homo sapiens
gaaguucuuacauucauca

SEQ ID NO: 1381462 - RNA, 19 nt, Homo sapiens
gcugucacacaccuuaaua

SEQ ID NO: 1381463 - RNA, 19 nt, Homo sapiens
gaguuugaaucaguccuuu

SEQ ID NO: 1381464 - RNA, 19 nt, Homo sapiens
ggaggcagguggaagucau

SEQ ID NO: 1381465 - RNA, 19 nt, Homo sapiens
cccuauacauugaagcuuu

SEQ ID NO: 1381466 - RNA, 19 nt, Homo sapiens
cggagacccucgcagaaga

SEQ ID NO: 1381467 - RNA, 19 nt, Homo sapiens
caaccuguucugcuuauau

SEQ ID NO: 1381468 - RNA, 19 nt, Homo sapiens
caaagugcaacguauuguu

SEQ ID NO: 1381469 - RNA, 19 nt, Homo sapiens
gagcauguuagaauuuaug

SEQ ID NO: 1381470 - RNA, 19 nt, Homo sapiens
accaugaaguucuuacauu

SEQ ID NO: 1381471 - RNA, 19 nt, Homo sapiens
uaaugaccaugaaguucuu

SEQ ID NO: 1381472 - RNA, 19 nt, Homo sapiens
guaaugaccaugaaguucu

SEQ ID NO: 1381473 - RNA, 19 nt, Homo sapiens
gaaaagacuuaauguuugc

SEQ ID NO: 1381474 - RNA, 19 nt, Homo sapiens
gaauguuggcucgguaauu

SEQ ID NO: 1381475 - RNA, 19 nt, Homo sapiens
guuaguggauuacaucaac

SEQ ID NO: 1381476 - RNA, 19 nt, Homo sapiens
cgagauacaccugaacuug

SEQ ID NO: 1381477 - RNA, 19 nt, Homo sapiens
gaugaugaugccauuuaaa

SEQ ID NO: 1381478 - RNA, 19 nt, Homo sapiens
uuucaaagcuacacuucau

SEQ ID NO: 1381479 - RNA, 19 nt, Homo sapiens
gauccuguucuguaauaaa

SEQ ID NO: 1381480 - RNA, 19 nt, Homo sapiens
gcucaggaaugucaaguaa

SEQ ID NO: 1381481 - RNA, 19 nt, Homo sapiens
gcagugaacccaguuauuu

SEQ ID NO: 1381482 - RNA, 19 nt, Homo sapiens
ggaaaggaagccuauguuu

SEQ ID NO: 1381483 - RNA, 19 nt, Homo sapiens
ggacugcacugccaauugg

SEQ ID NO: 1381484 - RNA, 19 nt, Homo sapiens
uggaggagcucaagaagga

SEQ ID NO: 1381485 - RNA, 19 nt, Homo sapiens
gcacgaggcugaggugaag

SEQ ID NO: 1381486 - RNA, 19 nt, Homo sapiens
gaacccaguuauuuguaau

SEQ ID NO: 1381487 - RNA, 19 nt, Homo sapiens
aaaggaagccuauguuuua

SEQ ID NO: 1381488 - RNA, 19 nt, Homo sapiens
aguggaagaucaaguauga

SEQ ID NO: 1381489 - RNA, 19 nt, Homo sapiens
ucaaggagcgagaggauaa

SEQ ID NO: 1381490 - RNA, 19 nt, Homo sapiens
uggcagaccugaagcaugu

SEQ ID NO: 1381491 - RNA, 19 nt, Homo sapiens
gcaggaacauugagaagcu

SEQ ID NO: 1381492 - RNA, 19 nt, Homo sapiens
cugaggaccuggaagauga

SEQ ID NO: 1381493 - RNA, 19 nt, Homo sapiens
ugaacccaguuauuuguaa

SEQ ID NO: 1381494 - RNA, 19 nt, Homo sapiens
gaaaggaagccuauguuuu

SEQ ID NO: 1381495 - RNA, 19 nt, Homo sapiens
gauccgcagugcucgcuuu

SEQ ID NO: 1381496 - RNA, 19 nt, Homo sapiens
gcagaacgcuccccucuuc

SEQ ID NO: 1381497 - RNA, 19 nt, Homo sapiens
ccaauuggcgcgagaaaug

SEQ ID NO: 1381498 - RNA, 19 nt, Homo sapiens
cagagaaacugggccuuga

SEQ ID NO: 1381499 - RNA, 19 nt, Homo sapiens
aaccagagcucaggaaugu

SEQ ID NO: 1381500 - RNA, 19 nt, Homo sapiens
ggaagccuauguuuuauau

SEQ ID NO: 1381501 - RNA, 19 nt, Homo sapiens
agaaggugcugcucaagga

SEQ ID NO: 1381502 - RNA, 19 nt, Homo sapiens
guggagagccugcugaaga

SEQ ID NO: 1381503 - RNA, 19 nt, Homo sapiens
gaaccagagcucaggaaug

SEQ ID NO: 1381504 - RNA, 19 nt, Homo sapiens
gagcucagccaguggaaga

SEQ ID NO: 1381505 - RNA, 19 nt, Homo sapiens
ucaggaaugucaaguaacu

SEQ ID NO: 1381506 - RNA, 19 nt, Homo sapiens
ggacccauuugguuuuaua

SEQ ID NO: 1381507 - RNA, 19 nt, Homo sapiens
agaagcaguuccaggagaa

SEQ ID NO: 1381508 - RNA, 19 nt, Homo sapiens
gccaguggaagaucaagua

SEQ ID NO: 1381509 - RNA, 19 nt, Homo sapiens
gcguugagcaggaacauug

SEQ ID NO: 1381510 - RNA, 19 nt, Homo sapiens
ggacgaggaccugcaaauc

SEQ ID NO: 1381511 - RNA, 19 nt, Homo sapiens
gaggauaaacuggcguuga

SEQ ID NO: 1381512 - RNA, 19 nt, Homo sapiens
agaagucuuuggacccauu

SEQ ID NO: 1381513 - RNA, 19 nt, Homo sapiens
caucauacaaugcagugaa

SEQ ID NO: 1381514 - RNA, 19 nt, Homo sapiens
ccagagcucaggaauguca

SEQ ID NO: 1381515 - RNA, 19 nt, Homo sapiens
cugaaaguauggcagaugu

SEQ ID NO: 1381516 - RNA, 19 nt, Homo sapiens
ggagcgagaggauaaacug

SEQ ID NO: 1381517 - RNA, 19 nt, Homo sapiens
ucucuaggcuucgcuguuc

SEQ ID NO: 1381518 - RNA, 19 nt, Homo sapiens
uggacgcgcucaccaagga

SEQ ID NO: 1381519 - RNA, 19 nt, Homo sapiens
caacagucccaccuaccaa

SEQ ID NO: 1381520 - RNA, 19 nt, Homo sapiens
ccaaggcccaguccagaug

SEQ ID NO: 1381521 - RNA, 19 nt, Homo sapiens
gcaagcugaagaagcaguu

SEQ ID NO: 1381522 - RNA, 19 nt, Homo sapiens
gugcauggcaagcugaaga

SEQ ID NO: 1381523 - RNA, 19 nt, Homo sapiens
gcaagaccaagcaggagau

SEQ ID NO: 1381524 - RNA, 19 nt, Homo sapiens
caggaacauugagaagcua

SEQ ID NO: 1381525 - RNA, 19 nt, Homo sapiens
gagcaggaacauugagaag

SEQ ID NO: 1381526 - RNA, 19 nt, Homo sapiens
uaaaugagugaaugugaag

SEQ ID NO: 1381527 - RNA, 19 nt, Homo sapiens
gugaacccaguuauuugua

SEQ ID NO: 1381528 - RNA, 19 nt, Homo sapiens
cagugaacccaguuauuug

SEQ ID NO: 1381529 - RNA, 19 nt, Homo sapiens
gaagucuuuggacccauuu

SEQ ID NO: 1381530 - RNA, 19 nt, Homo sapiens
aggauaaacuggcguugag

SEQ ID NO: 1381531 - RNA, 19 nt, Homo sapiens
cccagaaggugcugcucaa

SEQ ID NO: 1381532 - RNA, 19 nt, Homo sapiens
aggcuucgcuguucaucau

SEQ ID NO: 1381533 - RNA, 19 nt, Homo sapiens
ggguggaggagcucaagaa

SEQ ID NO: 1381534 - RNA, 19 nt, Homo sapiens
guggaaaggaagccuaugu

SEQ ID NO: 1381535 - RNA, 19 nt, Homo sapiens
agacggagcagagcgagaa

SEQ ID NO: 1381536 - RNA, 19 nt, Homo sapiens
uggagagccugcugaagag

SEQ ID NO: 1381537 - RNA, 19 nt, Homo sapiens
ggagcuggcagaccugaag

SEQ ID NO: 1381538 - RNA, 19 nt, Homo sapiens
gaacauugagaagcuagag

SEQ ID NO: 1381539 - RNA, 19 nt, Homo sapiens
ccaacgcccuguggaaagg

SEQ ID NO: 1381540 - RNA, 19 nt, Homo sapiens
acccugggcugccucucua

SEQ ID NO: 1381541 - RNA, 19 nt, Homo sapiens
gcgcacacccagaagucuu

SEQ ID NO: 1381542 - RNA, 19 nt, Homo sapiens
uaaccagccacucaaacug

SEQ ID NO: 1381543 - RNA, 19 nt, Homo sapiens
uggaaaggaagccuauguu

SEQ ID NO: 1381544 - RNA, 19 nt, Homo sapiens
uaccaacgcccuguggaaa

SEQ ID NO: 1381545 - RNA, 19 nt, Homo sapiens
gagcgagaaccugcaagug

SEQ ID NO: 1381546 - RNA, 19 nt, Homo sapiens
aggcugaggugaagaagcu

SEQ ID NO: 1381547 - RNA, 19 nt, Homo sapiens
gccuugagcgggagaacaa

SEQ ID NO: 1381548 - RNA, 19 nt, Homo sapiens
gccugcaccugacgcugaa

SEQ ID NO: 1381549 - RNA, 19 nt, Homo sapiens
cggcgcagauggagaagac

SEQ ID NO: 1381550 - RNA, 19 nt, Homo sapiens
caaggcccaguccagauga

SEQ ID NO: 1381551 - RNA, 19 nt, Homo sapiens
cuaccaacgcccuguggaa

SEQ ID NO: 1381552 - RNA, 19 nt, Homo sapiens
acgaggaccugcaaaucca

SEQ ID NO: 1381553 - RNA, 19 nt, Homo sapiens
uaugaggagcugagcaaga

SEQ ID NO: 1381554 - RNA, 19 nt, Homo sapiens
gcccacaaccaggcacgua

SEQ ID NO: 1381555 - RNA, 19 nt, Homo sapiens
caaggagcgagaggauaaa

SEQ ID NO: 1381556 - RNA, 19 nt, Homo sapiens
aaccagccacucaaacuga

SEQ ID NO: 1381557 - RNA, 19 nt, Homo sapiens
gagcaugccagaggagucu

SEQ ID NO: 1381558 - RNA, 19 nt, Homo sapiens
ugucugaggaccuggaaga

SEQ ID NO: 1381559 - RNA, 19 nt, Homo sapiens
gcucuaaucucacacauuu

SEQ ID NO: 1381560 - RNA, 19 nt, Homo sapiens
guaaggacauucucaaauu

SEQ ID NO: 1381561 - RNA, 19 nt, Homo sapiens
ggaaucaaaugagcacaua

SEQ ID NO: 1381562 - RNA, 19 nt, Homo sapiens
caaauuccaugccaucuau

SEQ ID NO: 1381563 - RNA, 19 nt, Homo sapiens
caggaaaguuauacuagua

SEQ ID NO: 1381564 - RNA, 19 nt, Homo sapiens
ggccaccucucauaucaua

SEQ ID NO: 1381565 - RNA, 19 nt, Homo sapiens
auacacaacuuucagguaa

SEQ ID NO: 1381566 - RNA, 19 nt, Homo sapiens
ggacuuggcuggugaaagc

SEQ ID NO: 1381567 - RNA, 19 nt, Homo sapiens
cauguuggguuuccugaua

SEQ ID NO: 1381568 - RNA, 19 nt, Homo sapiens
gcagguagcagaccacuau

SEQ ID NO: 1381569 - RNA, 19 nt, Homo sapiens
cuaaugcuguuccuucuuu

SEQ ID NO: 1381570 - RNA, 19 nt, Homo sapiens
gcuaauuagugacuccuuu

SEQ ID NO: 1381571 - RNA, 19 nt, Homo sapiens
uagcagaccacuaugauaa

SEQ ID NO: 1381572 - RNA, 19 nt, Homo sapiens
gauccuaggacuugccuua

SEQ ID NO: 1381573 - RNA, 19 nt, Homo sapiens
ugaggcacuugguauguua

SEQ ID NO: 1381574 - RNA, 19 nt, Homo sapiens
gugcauaauuuaccucaug

SEQ ID NO: 1381575 - RNA, 19 nt, Homo sapiens
uaucauagguaaggacauu

SEQ ID NO: 1381576 - RNA, 19 nt, Homo sapiens
agaccacuaugauaacuuu

SEQ ID NO: 1381577 - RNA, 19 nt, Homo sapiens
uaaggacauucucaaauuc

SEQ ID NO: 1381578 - RNA, 19 nt, Homo sapiens
ucaacuaccucacuguaau

SEQ ID NO: 1381579 - RNA, 19 nt, Homo sapiens
uaagagacaguguugcuaa

SEQ ID NO: 1381580 - RNA, 19 nt, Homo sapiens
ggacauccaugcccuuuug

SEQ ID NO: 1381581 - RNA, 19 nt, Homo sapiens
ccucucauaucauagguaa

SEQ ID NO: 1381582 - RNA, 19 nt, Homo sapiens
cgaaccauuucaucacgua

SEQ ID NO: 1381583 - RNA, 19 nt, Homo sapiens
caaucaggaucuuuaauac

SEQ ID NO: 1381584 - RNA, 19 nt, Homo sapiens
gguuacagguaugauuuaa

SEQ ID NO: 1381585 - RNA, 19 nt, Homo sapiens
gauccuacuuuguuacaca

SEQ ID NO: 1381586 - RNA, 19 nt, Homo sapiens
acacaacuuucagguaauu

SEQ ID NO: 1381587 - RNA, 19 nt, Homo sapiens
cuacuucacuacacccauu

SEQ ID NO: 1381588 - RNA, 19 nt, Homo sapiens
uggaugcccuggucaacua

SEQ ID NO: 1381589 - RNA, 19 nt, Homo sapiens
aacauuagguuacagguau

SEQ ID NO: 1381590 - RNA, 19 nt, Homo sapiens
caacuaagucucccugcuu

SEQ ID NO: 1381591 - RNA, 19 nt, Homo sapiens
uuggagagcucuauuucuu

SEQ ID NO: 1381592 - RNA, 19 nt, Homo sapiens
gaaccgaugcacugccaaa

SEQ ID NO: 1381593 - RNA, 19 nt, Homo sapiens
uacuaaagauugaggauuc

SEQ ID NO: 1381594 - RNA, 19 nt, Homo sapiens
auuagugacuccuuucuuu

SEQ ID NO: 1381595 - RNA, 19 nt, Homo sapiens
gguaaggacauucucaaau

SEQ ID NO: 1381596 - RNA, 19 nt, Homo sapiens
ggucaacuaccucacugua

SEQ ID NO: 1381597 - RNA, 19 nt, Homo sapiens
acaguuggguuguguaaca

SEQ ID NO: 1381598 - RNA, 19 nt, Homo sapiens
gggcaauguuuucuuuaua

SEQ ID NO: 1381599 - RNA, 19 nt, Homo sapiens
gaaagauggguaagagaca

SEQ ID NO: 1381600 - RNA, 19 nt, Homo sapiens
guagcagaccacuaugaua

SEQ ID NO: 1381601 - RNA, 19 nt, Homo sapiens
caacuaccucacuguaauu

SEQ ID NO: 1381602 - RNA, 19 nt, Homo sapiens
gagcacgggcugaagauuc

SEQ ID NO: 1381603 - RNA, 19 nt, Homo sapiens
aagucucccugcuuuguua

SEQ ID NO: 1381604 - RNA, 19 nt, Homo sapiens
cugcuucucaggcuaauua

SEQ ID NO: 1381605 - RNA, 19 nt, Homo sapiens
ucaggaaaguuauacuagu

SEQ ID NO: 1381606 - RNA, 19 nt, Homo sapiens
caccggaccuagaaacuca

SEQ ID NO: 1381607 - RNA, 19 nt, Homo sapiens
gugcucaggcagaggauua

SEQ ID NO: 1381608 - RNA, 19 nt, Homo sapiens
gagcaguuccagcagcuuu

SEQ ID NO: 1381609 - RNA, 19 nt, Homo sapiens
cuacaagggcgucuaugaa

SEQ ID NO: 1381610 - RNA, 19 nt, Homo sapiens
gcacaucgggcaccuguac

SEQ ID NO: 1381611 - RNA, 19 nt, Homo sapiens
ggucaaucaggaucuuuaa

SEQ ID NO: 1381612 - RNA, 19 nt, Homo sapiens
gagacaguguugcuaaugc

SEQ ID NO: 1381613 - RNA, 19 nt, Homo sapiens
ggacugugacuacuaugau

SEQ ID NO: 1381614 - RNA, 19 nt, Homo sapiens
caacugggacugugacuac

SEQ ID NO: 1381615 - RNA, 19 nt, Homo sapiens
caaaugcugaguucaaauc

SEQ ID NO: 1381616 - RNA, 19 nt, Homo sapiens
ccauuuaaauuccuacaac

SEQ ID NO: 1381617 - RNA, 19 nt, Homo sapiens
uuucuugccucgauucuau

SEQ ID NO: 1381618 - RNA, 19 nt, Homo sapiens
cagcgcaucuguguccauu

SEQ ID NO: 1381619 - RNA, 19 nt, Homo sapiens
cccaaaugcugaguucaaa

SEQ ID NO: 1381620 - RNA, 19 nt, Homo sapiens
cgaugaugcuugugaugug

SEQ ID NO: 1381621 - RNA, 19 nt, Homo sapiens
ggaauguuugcgagucuuu

SEQ ID NO: 1381622 - RNA, 19 nt, Homo sapiens
gggauucguuuccuguauc

SEQ ID NO: 1381623 - RNA, 19 nt, Homo sapiens
gaaucaaaugagcacauaa

SEQ ID NO: 1381624 - RNA, 19 nt, Homo sapiens
gcagaccacuaugauaacu

SEQ ID NO: 1381625 - RNA, 19 nt, Homo sapiens
ucgcagaccaucuauguau

SEQ ID NO: 1381626 - RNA, 19 nt, Homo sapiens
ggcccacgcuacuacaguu

SEQ ID NO: 1381627 - RNA, 19 nt, Homo sapiens
ucacuguccuuugugcauu

SEQ ID NO: 1381628 - RNA, 19 nt, Homo sapiens
ucuuaaguguggaaucaaa

SEQ ID NO: 1381629 - RNA, 19 nt, Homo sapiens
gacugugacuacuaugaug

SEQ ID NO: 1381630 - RNA, 19 nt, Homo sapiens
ucaaauuccaugccaucua

SEQ ID NO: 1381631 - RNA, 19 nt, Homo sapiens
augcugaguucaaaucuug

SEQ ID NO: 1381632 - RNA, 19 nt, Homo sapiens
uagguuacagguaugauuu

SEQ ID NO: 1381633 - RNA, 19 nt, Homo sapiens
guaagagacaguguugcua

SEQ ID NO: 1381634 - RNA, 19 nt, Homo sapiens
ggauggcuuccgcuacuuu

SEQ ID NO: 1381635 - RNA, 19 nt, Homo sapiens
cuacccaaaugcugaguuc

SEQ ID NO: 1381636 - RNA, 19 nt, Homo sapiens
ucucccugcuuuguuaaua

SEQ ID NO: 1381637 - RNA, 19 nt, Homo sapiens
aacuaagucucccugcuuu

SEQ ID NO: 1381638 - RNA, 19 nt, Homo sapiens
ccauguguauccccauuua

SEQ ID NO: 1381639 - RNA, 19 nt, Homo sapiens
uguuacacauguuggguuu

SEQ ID NO: 1381640 - RNA, 19 nt, Homo sapiens
cauguggccuuggaauguu

SEQ ID NO: 1381641 - RNA, 19 nt, Homo sapiens
uaagcugugucccugugaa

SEQ ID NO: 1381642 - RNA, 19 nt, Homo sapiens
acgcgauucuccacuggua

SEQ ID NO: 1381643 - RNA, 19 nt, Homo sapiens
gguagcagaccacuaugau

SEQ ID NO: 1381644 - RNA, 19 nt, Homo sapiens
aauaagggauagcuuugca

SEQ ID NO: 1381645 - RNA, 19 nt, Homo sapiens
ggauucguuuccuguaucu

SEQ ID NO: 1381646 - RNA, 19 nt, Homo sapiens
cuacuuuguuacacauguu

SEQ ID NO: 1381647 - RNA, 19 nt, Homo sapiens
cauugugugucuaagaugu

SEQ ID NO: 1381648 - RNA, 19 nt, Homo sapiens
uaaguguggaaucaaauga

SEQ ID NO: 1381649 - RNA, 19 nt, Homo sapiens
cuaccugcuucccuaguga

SEQ ID NO: 1381650 - RNA, 19 nt, Homo sapiens
uacccagccuucugcacua

SEQ ID NO: 1381651 - RNA, 19 nt, Homo sapiens
guccuagaccagaugauuu

SEQ ID NO: 1381652 - RNA, 19 nt, Homo sapiens
uuucuuaaguguggaauca

SEQ ID NO: 1381653 - RNA, 19 nt, Homo sapiens
guggauggcuuccgcuacu

SEQ ID NO: 1381654 - RNA, 19 nt, Homo sapiens
gccaaaagauguccaagag

SEQ ID NO: 1381655 - RNA, 19 nt, Homo sapiens
ccggccaccucucauauca

SEQ ID NO: 1381656 - RNA, 19 nt, Homo sapiens
ugcauaauuuaccucauga

SEQ ID NO: 1381657 - RNA, 19 nt, Homo sapiens
ccgagucucugagcaguuc

SEQ ID NO: 1381658 - RNA, 19 nt, Homo sapiens
uaaauccuucugagaccua

SEQ ID NO: 1381659 - RNA, 19 nt, Homo sapiens
gcacuuagcagcuuauuca

SEQ ID NO: 1381660 - RNA, 19 nt, Homo sapiens
acaagcagaucaugccuua

SEQ ID NO: 1381661 - RNA, 19 nt, Homo sapiens
ccagaaauuuccagacaaa

SEQ ID NO: 1381662 - RNA, 19 nt, Homo sapiens
gcucucaaauuaaagauug

SEQ ID NO: 1381663 - RNA, 19 nt, Homo sapiens
agaaggagcugcuguguca

SEQ ID NO: 1381664 - RNA, 19 nt, Homo sapiens
gcaaccaaaucggaugaua

SEQ ID NO: 1381665 - RNA, 19 nt, Homo sapiens
acaaagagauacugagaau

SEQ ID NO: 1381666 - RNA, 19 nt, Homo sapiens
caagagcugugaaggaaga

SEQ ID NO: 1381667 - RNA, 19 nt, Homo sapiens
gcuauaaacccaaagagaa

SEQ ID NO: 1381668 - RNA, 19 nt, Homo sapiens
gcacacugcuccucuuucu

SEQ ID NO: 1381669 - RNA, 19 nt, Homo sapiens
gaacuaaguguaaucaucu

SEQ ID NO: 1381670 - RNA, 19 nt, Homo sapiens
gaagcaccgucaaggaaga

SEQ ID NO: 1381671 - RNA, 19 nt, Homo sapiens
guaaucaucucaccaaagc

SEQ ID NO: 1381672 - RNA, 19 nt, Homo sapiens
caagcaccauggccaguuu

SEQ ID NO: 1381673 - RNA, 19 nt, Homo sapiens
gaugguacgcguugcuaua

SEQ ID NO: 1381674 - RNA, 19 nt, Homo sapiens
aaacaaagccccacauaaa

SEQ ID NO: 1381675 - RNA, 19 nt, Homo sapiens
ggagggagacggauuucuu

SEQ ID NO: 1381676 - RNA, 19 nt, Homo sapiens
gcaaugcucagcucauaau

SEQ ID NO: 1381677 - RNA, 19 nt, Homo sapiens
ugaacuaaguguaaucauc

SEQ ID NO: 1381678 - RNA, 19 nt, Homo sapiens
uacagaacaugcaguaaug

SEQ ID NO: 1381679 - RNA, 19 nt, Homo sapiens
gagggagacggauuucuuu

SEQ ID NO: 1381680 - RNA, 19 nt, Homo sapiens
aaaagguccugaucacuua

SEQ ID NO: 1381681 - RNA, 19 nt, Homo sapiens
ugacaucggcugagugcua

SEQ ID NO: 1381682 - RNA, 19 nt, Homo sapiens
cagcagauuucauugucaa

SEQ ID NO: 1381683 - RNA, 19 nt, Homo sapiens
gaggagcacuuagcagcuu

SEQ ID NO: 1381684 - RNA, 19 nt, Homo sapiens
gggaagcaccgucaaggaa

SEQ ID NO: 1381685 - RNA, 19 nt, Homo sapiens
gacaacccauguucacuca

SEQ ID NO: 1381686 - RNA, 19 nt, Homo sapiens
gaucacuuauaucuggaaa

SEQ ID NO: 1381687 - RNA, 19 nt, Homo sapiens
gaaauuuccagacaaagag

SEQ ID NO: 1381688 - RNA, 19 nt, Homo sapiens
cauauucgccuugucuuaa

SEQ ID NO: 1381689 - RNA, 19 nt, Homo sapiens
aaagagauacugagaaugg

SEQ ID NO: 1381690 - RNA, 19 nt, Homo sapiens
ccaaaucggaugauacugu

SEQ ID NO: 1381691 - RNA, 19 nt, Homo sapiens
gauggagggagacggauuu

SEQ ID NO: 1381692 - RNA, 19 nt, Homo sapiens
gauaugugcaucagugguu

SEQ ID NO: 1381693 - RNA, 19 nt, Homo sapiens
cagaaucuuuggauaugug

SEQ ID NO: 1381694 - RNA, 19 nt, Homo sapiens
uacagaaucuuuggauaug

SEQ ID NO: 1381695 - RNA, 19 nt, Homo sapiens
caacccauguucacucaag

SEQ ID NO: 1381696 - RNA, 19 nt, Homo sapiens
uaaagaaagcagugucuca

SEQ ID NO: 1381697 - RNA, 19 nt, Homo sapiens
cuauaaacccaaagagaaa

SEQ ID NO: 1381698 - RNA, 19 nt, Homo sapiens
gcugagugcuacgaucuga

SEQ ID NO: 1381699 - RNA, 19 nt, Homo sapiens
gaagaaggagcugcugugu

SEQ ID NO: 1381700 - RNA, 19 nt, Homo sapiens
gaguggaaaugcauguaca

SEQ ID NO: 1381701 - RNA, 19 nt, Homo sapiens
gcuacgaucugaggagcaa

SEQ ID NO: 1381702 - RNA, 19 nt, Homo sapiens
cgauacagaacaugcagua

SEQ ID NO: 1381703 - RNA, 19 nt, Homo sapiens
agcaagagcugugaaggaa

SEQ ID NO: 1381704 - RNA, 19 nt, Homo sapiens
agacaaagagauacugaga

SEQ ID NO: 1381705 - RNA, 19 nt, Homo sapiens
gagguuaucagcugacauc

SEQ ID NO: 1381706 - RNA, 19 nt, Homo sapiens
gggcuccgcugacaguaca

SEQ ID NO: 1381707 - RNA, 19 nt, Homo sapiens
cagauuucauugucaagau

SEQ ID NO: 1381708 - RNA, 19 nt, Homo sapiens
acuuauaucuggaaaccaa

SEQ ID NO: 1381709 - RNA, 19 nt, Homo sapiens
guagacauauucgccuugu

SEQ ID NO: 1381710 - RNA, 19 nt, Homo sapiens
gaagaguggaaaugcaugu

SEQ ID NO: 1381711 - RNA, 19 nt, Homo sapiens
gagacggauuucuuuccuu

SEQ ID NO: 1381712 - RNA, 19 nt, Homo sapiens
gacaaagagauacugagaa

SEQ ID NO: 1381713 - RNA, 19 nt, Homo sapiens
ggagacggauuucuuuccu

SEQ ID NO: 1381714 - RNA, 19 nt, Homo sapiens
acucacagcagauuucauu

SEQ ID NO: 1381715 - RNA, 19 nt, Homo sapiens
ggacugcccaccagaagca

SEQ ID NO: 1381716 - RNA, 19 nt, Homo sapiens
agaaauuuccagacaaaga

SEQ ID NO: 1381717 - RNA, 19 nt, Homo sapiens
agucucaacuccacaggaa

SEQ ID NO: 1381718 - RNA, 19 nt, Homo sapiens
ucucacugguuguagcuuu

SEQ ID NO: 1381719 - RNA, 19 nt, Homo sapiens
aagcagaucaugccuuaug

SEQ ID NO: 1381720 - RNA, 19 nt, Homo sapiens
caaguugccaugguucaaa

SEQ ID NO: 1381721 - RNA, 19 nt, Homo sapiens
gcagauuucauugucaaga

SEQ ID NO: 1381722 - RNA, 19 nt, Homo sapiens
gcaccgucaaggaagauaa

SEQ ID NO: 1381723 - RNA, 19 nt, Homo sapiens
ggagcccucguaaguugua

SEQ ID NO: 1381724 - RNA, 19 nt, Homo sapiens
guacaguccaguucaucuu

SEQ ID NO: 1381725 - RNA, 19 nt, Homo sapiens
cacagcagauuucauuguc

SEQ ID NO: 1381726 - RNA, 19 nt, Homo sapiens
gagugcaacuuggauccuu

SEQ ID NO: 1381727 - RNA, 19 nt, Homo sapiens
ggaccacucacagcagauu

SEQ ID NO: 1381728 - RNA, 19 nt, Homo sapiens
acauauucgccuugucuua

SEQ ID NO: 1381729 - RNA, 19 nt, Homo sapiens
ucacagcagauuucauugu

SEQ ID NO: 1381730 - RNA, 19 nt, Homo sapiens
auacagaacaugcaguaau

SEQ ID NO: 1381731 - RNA, 19 nt, Homo sapiens
cuuauucaguguccgauuc

SEQ ID NO: 1381732 - RNA, 19 nt, Homo sapiens
ccagacaaagagauacuga

SEQ ID NO: 1381733 - RNA, 19 nt, Homo sapiens
caacuccacaggaacuuuc

SEQ ID NO: 1381734 - RNA, 19 nt, Homo sapiens
auauucgccuugucuuaaa

SEQ ID NO: 1381735 - RNA, 19 nt, Homo sapiens
guacccacucccugcuaua

SEQ ID NO: 1381736 - RNA, 19 nt, Homo sapiens
gagcugugaaggaagaaau

SEQ ID NO: 1381737 - RNA, 19 nt, Homo sapiens
caaccaaaucggaugauac

SEQ ID NO: 1381738 - RNA, 19 nt, Homo sapiens
ggcuuccugugucuaauga

SEQ ID NO: 1381739 - RNA, 19 nt, Homo sapiens
gagaacaucaaacccaaac

SEQ ID NO: 1381740 - RNA, 19 nt, Homo sapiens
gauacagaacaugcaguaa

SEQ ID NO: 1381741 - RNA, 19 nt, Homo sapiens
caguucaucuucuaucaac

SEQ ID NO: 1381742 - RNA, 19 nt, Homo sapiens
ugacaguacaguccaguuc

SEQ ID NO: 1381743 - RNA, 19 nt, Homo sapiens
ugaauggcuuccugugucu

SEQ ID NO: 1381744 - RNA, 19 nt, Homo sapiens
guguaaucaucucaccaaa

SEQ ID NO: 1381745 - RNA, 19 nt, Homo sapiens
guggaagaguggaaaugca

SEQ ID NO: 1381746 - RNA, 19 nt, Homo sapiens
cgucaaggaagauaacugu

SEQ ID NO: 1381747 - RNA, 19 nt, Homo sapiens
gguuuaugccaaauuguug

SEQ ID NO: 1381748 - RNA, 19 nt, Homo sapiens
guugcuauacagaaucuuu

SEQ ID NO: 1381749 - RNA, 19 nt, Homo sapiens
uuguugaacuagcaccuaa

SEQ ID NO: 1381750 - RNA, 19 nt, Homo sapiens
gacaguacaguccaguuca

SEQ ID NO: 1381751 - RNA, 19 nt, Homo sapiens
uuccagaaauuuccagaca

SEQ ID NO: 1381752 - RNA, 19 nt, Homo sapiens
gacuaaaggugaaaacagu

SEQ ID NO: 1381753 - RNA, 19 nt, Homo sapiens
uaaaagguccugaucacuu

SEQ ID NO: 1381754 - RNA, 19 nt, Homo sapiens
caagugccaagccaaagga

SEQ ID NO: 1381755 - RNA, 19 nt, Homo sapiens
guucaaacaagcucaagag

SEQ ID NO: 1381756 - RNA, 19 nt, Homo sapiens
ucacuuauaucuggaaacc

SEQ ID NO: 1381757 - RNA, 19 nt, Homo sapiens
guccugaucacuuauaucu

SEQ ID NO: 1381758 - RNA, 19 nt, Homo sapiens
ccagcucuccgcaaccaaa

SEQ ID NO: 1381759 - RNA, 19 nt, Homo sapiens
gcacuuagcagcuuauuca

SEQ ID NO: 1381760 - RNA, 19 nt, Homo sapiens
acaagcagaucaugccuua

SEQ ID NO: 1381761 - RNA, 19 nt, Homo sapiens
ccagaaauuuccagacaaa

SEQ ID NO: 1381762 - RNA, 19 nt, Homo sapiens
agaaggagcugcuguguca

SEQ ID NO: 1381763 - RNA, 19 nt, Homo sapiens
caagaggccuggcuucuca

SEQ ID NO: 1381764 - RNA, 19 nt, Homo sapiens
gcaaccaaaucggaugaua

SEQ ID NO: 1381765 - RNA, 19 nt, Homo sapiens
acaaagagauacugagaau

SEQ ID NO: 1381766 - RNA, 19 nt, Homo sapiens
caagagcugugaaggaaga

SEQ ID NO: 1381767 - RNA, 19 nt, Homo sapiens
gcuauaaacccaaagagaa

SEQ ID NO: 1381768 - RNA, 19 nt, Homo sapiens
cgagacagaugggcucuuu

SEQ ID NO: 1381769 - RNA, 19 nt, Homo sapiens
gcacacugcuccucuuucu

SEQ ID NO: 1381770 - RNA, 19 nt, Homo sapiens
gaagcaccgucaaggaaga

SEQ ID NO: 1381771 - RNA, 19 nt, Homo sapiens
cgaggugucugcccuuuau

SEQ ID NO: 1381772 - RNA, 19 nt, Homo sapiens
ccugcaacguucuuuguua

SEQ ID NO: 1381773 - RNA, 19 nt, Homo sapiens
uggcugaccugccuauuga

SEQ ID NO: 1381774 - RNA, 19 nt, Homo sapiens
caagcaccauggccaguuu

SEQ ID NO: 1381775 - RNA, 19 nt, Homo sapiens
gaugguacgcguugcuaua

SEQ ID NO: 1381776 - RNA, 19 nt, Homo sapiens
guggugagcugcuugaaca

SEQ ID NO: 1381777 - RNA, 19 nt, Homo sapiens
aaacaaagccccacauaaa

SEQ ID NO: 1381778 - RNA, 19 nt, Homo sapiens
ggagggagacggauuucuu

SEQ ID NO: 1381779 - RNA, 19 nt, Homo sapiens
gcaaugcucagcucauaau

SEQ ID NO: 1381780 - RNA, 19 nt, Homo sapiens
uacagaacaugcaguaaug

SEQ ID NO: 1381781 - RNA, 19 nt, Homo sapiens
gagggagacggauuucuuu

SEQ ID NO: 1381782 - RNA, 19 nt, Homo sapiens
aaaagguccugaucacuua

SEQ ID NO: 1381783 - RNA, 19 nt, Homo sapiens
ugacaucggcugagugcua

SEQ ID NO: 1381784 - RNA, 19 nt, Homo sapiens
cagcagauuucauugucaa

SEQ ID NO: 1381785 - RNA, 19 nt, Homo sapiens
gaggagcacuuagcagcuu

SEQ ID NO: 1381786 - RNA, 19 nt, Homo sapiens
gggaagcaccgucaaggaa

SEQ ID NO: 1381787 - RNA, 19 nt, Homo sapiens
gacaacccauguucacuca

SEQ ID NO: 1381788 - RNA, 19 nt, Homo sapiens
gucccaugauucuuuauuu

SEQ ID NO: 1381789 - RNA, 19 nt, Homo sapiens
gcaaagugaacugguugua

SEQ ID NO: 1381790 - RNA, 19 nt, Homo sapiens
caucccagcgugccuguua

SEQ ID NO: 1381791 - RNA, 19 nt, Homo sapiens
gaucacuuauaucuggaaa

SEQ ID NO: 1381792 - RNA, 19 nt, Homo sapiens
gaaauuuccagacaaagag

SEQ ID NO: 1381793 - RNA, 19 nt, Homo sapiens
cauauucgccuugucuuaa

SEQ ID NO: 1381794 - RNA, 19 nt, Homo sapiens
cagaagcauuaaacagcua

SEQ ID NO: 1381795 - RNA, 19 nt, Homo sapiens
aaagagauacugagaaugg

SEQ ID NO: 1381796 - RNA, 19 nt, Homo sapiens
ccaaaucggaugauacugu

SEQ ID NO: 1381797 - RNA, 19 nt, Homo sapiens
gauggagggagacggauuu

SEQ ID NO: 1381798 - RNA, 19 nt, Homo sapiens
gauaugugcaucagugguu

SEQ ID NO: 1381799 - RNA, 19 nt, Homo sapiens
cagaaucuuuggauaugug

SEQ ID NO: 1381800 - RNA, 19 nt, Homo sapiens
uacagaaucuuuggauaug

SEQ ID NO: 1381801 - RNA, 19 nt, Homo sapiens
caacccauguucacucaag

SEQ ID NO: 1381802 - RNA, 19 nt, Homo sapiens
gaacugguuguaccugaug

SEQ ID NO: 1381803 - RNA, 19 nt, Homo sapiens
cuauaaacccaaagagaaa

SEQ ID NO: 1381804 - RNA, 19 nt, Homo sapiens
gguuguaccugaugaucug

SEQ ID NO: 1381805 - RNA, 19 nt, Homo sapiens
gcugagugcuacgaucuga

SEQ ID NO: 1381806 - RNA, 19 nt, Homo sapiens
gaagaaggagcugcugugu

SEQ ID NO: 1381807 - RNA, 19 nt, Homo sapiens
gaguggaaaugcauguaca

SEQ ID NO: 1381808 - RNA, 19 nt, Homo sapiens
gcuacgaucugaggagcaa

SEQ ID NO: 1381809 - RNA, 19 nt, Homo sapiens
cgauacagaacaugcagua

SEQ ID NO: 1381810 - RNA, 19 nt, Homo sapiens
ucugagaucccaugacuug

SEQ ID NO: 1381811 - RNA, 19 nt, Homo sapiens
uuccacaucugcaaaguga

SEQ ID NO: 1381812 - RNA, 19 nt, Homo sapiens
agacaaagagauacugaga

SEQ ID NO: 1381813 - RNA, 19 nt, Homo sapiens
agcaagagcugugaaggaa

SEQ ID NO: 1381814 - RNA, 19 nt, Homo sapiens
ggacccaggugcgaauagu

SEQ ID NO: 1381815 - RNA, 19 nt, Homo sapiens
gagguuaucagcugacauc

SEQ ID NO: 1381816 - RNA, 19 nt, Homo sapiens
gggcuccgcugacaguaca

SEQ ID NO: 1381817 - RNA, 19 nt, Homo sapiens
cagauuucauugucaagau

SEQ ID NO: 1381818 - RNA, 19 nt, Homo sapiens
acuuauaucuggaaaccaa

SEQ ID NO: 1381819 - RNA, 19 nt, Homo sapiens
guagacauauucgccuugu

SEQ ID NO: 1381820 - RNA, 19 nt, Homo sapiens
ugucugcccuuuauguuuc

SEQ ID NO: 1381821 - RNA, 19 nt, Homo sapiens
gaagaguggaaaugcaugu

SEQ ID NO: 1381822 - RNA, 19 nt, Homo sapiens
gagacggauuucuuuccuu

SEQ ID NO: 1381823 - RNA, 19 nt, Homo sapiens
gacaaagagauacugagaa

SEQ ID NO: 1381824 - RNA, 19 nt, Homo sapiens
ggacugcccaccagaagca

SEQ ID NO: 1381825 - RNA, 19 nt, Homo sapiens
ggagacggauuucuuuccu

SEQ ID NO: 1381826 - RNA, 19 nt, Homo sapiens
acucacagcagauuucauu

SEQ ID NO: 1381827 - RNA, 19 nt, Homo sapiens
agaaauuuccagacaaaga

SEQ ID NO: 1381828 - RNA, 19 nt, Homo sapiens
agucucaacuccacaggaa

SEQ ID NO: 1381829 - RNA, 19 nt, Homo sapiens
ccugaaguccugcaauuug

SEQ ID NO: 1381830 - RNA, 19 nt, Homo sapiens
aagcagaucaugccuuaug

SEQ ID NO: 1381831 - RNA, 19 nt, Homo sapiens
caaguugccaugguucaaa

SEQ ID NO: 1381832 - RNA, 19 nt, Homo sapiens
gcagauuucauugucaaga

SEQ ID NO: 1381833 - RNA, 19 nt, Homo sapiens
gcaccgucaaggaagauaa

SEQ ID NO: 1381834 - RNA, 19 nt, Homo sapiens
uuuguaggcagaagcauua

SEQ ID NO: 1381835 - RNA, 19 nt, Homo sapiens
guacaguccaguucaucuu

SEQ ID NO: 1381836 - RNA, 19 nt, Homo sapiens
cacagcagauuucauuguc

SEQ ID NO: 1381837 - RNA, 19 nt, Homo sapiens
gcgaggugucugcccuuua

SEQ ID NO: 1381838 - RNA, 19 nt, Homo sapiens
aagaagcaguaucgacuca

SEQ ID NO: 1381839 - RNA, 19 nt, Homo sapiens
cuccugaaguccugcaauu

SEQ ID NO: 1381840 - RNA, 19 nt, Homo sapiens
uugguggccugcaggauuu

SEQ ID NO: 1381841 - RNA, 19 nt, Homo sapiens
gagugcaacuuggauccuu

SEQ ID NO: 1381842 - RNA, 19 nt, Homo sapiens
ggaccacucacagcagauu

SEQ ID NO: 1381843 - RNA, 19 nt, Homo sapiens
ggauuucgacgagcuguau

SEQ ID NO: 1381844 - RNA, 19 nt, Homo sapiens
acauauucgccuugucuua

SEQ ID NO: 1381845 - RNA, 19 nt, Homo sapiens
ucacagcagauuucauugu

SEQ ID NO: 1381846 - RNA, 19 nt, Homo sapiens
auacagaacaugcaguaau

SEQ ID NO: 1381847 - RNA, 19 nt, Homo sapiens
cuuauucaguguccgauuc

SEQ ID NO: 1381848 - RNA, 19 nt, Homo sapiens
ccagacaaagagauacuga

SEQ ID NO: 1381849 - RNA, 19 nt, Homo sapiens
caacuccacaggaacuuuc

SEQ ID NO: 1381850 - RNA, 19 nt, Homo sapiens
auauucgccuugucuuaaa

SEQ ID NO: 1381851 - RNA, 19 nt, Homo sapiens
gagcugugaaggaagaaau

SEQ ID NO: 1381852 - RNA, 19 nt, Homo sapiens
guacccacucccugcuaua

SEQ ID NO: 1381853 - RNA, 19 nt, Homo sapiens
ggcuuccugugucuaauga

SEQ ID NO: 1381854 - RNA, 19 nt, Homo sapiens
caaccaaaucggaugauac

SEQ ID NO: 1381855 - RNA, 19 nt, Homo sapiens
gauacagaacaugcaguaa

SEQ ID NO: 1381856 - RNA, 19 nt, Homo sapiens
ugaauggcuuccugugucu

SEQ ID NO: 1381857 - RNA, 19 nt, Homo sapiens
cugcaacguucuuuguuag

SEQ ID NO: 1381858 - RNA, 19 nt, Homo sapiens
gagaacaucaaacccaaac

SEQ ID NO: 1381859 - RNA, 19 nt, Homo sapiens
gaucagagcugugacauuu

SEQ ID NO: 1381860 - RNA, 19 nt, Homo sapiens
gaaaccugcuguaauuaaa

SEQ ID NO: 1381861 - RNA, 19 nt, Homo sapiens
uaggaaaccugcuguaauu

SEQ ID NO: 1381862 - RNA, 19 nt, Homo sapiens
caagaagccucuauuguuc

SEQ ID NO: 1381863 - RNA, 19 nt, Homo sapiens
gauuaacaaugcugcaaua

SEQ ID NO: 1381864 - RNA, 19 nt, Homo sapiens
ggaagcaacugccuuucaa

SEQ ID NO: 1381865 - RNA, 19 nt, Homo sapiens
gcacuuagcagcuuauuca

SEQ ID NO: 1381866 - RNA, 19 nt, Homo sapiens
gauaauguucccucaaaua

SEQ ID NO: 1381867 - RNA, 19 nt, Homo sapiens
ccagaaauuuccagacaaa

SEQ ID NO: 1381868 - RNA, 19 nt, Homo sapiens
ggaaaccugcuguaauuaa

SEQ ID NO: 1381869 - RNA, 19 nt, Homo sapiens
gaaagggucuaaguggauu

SEQ ID NO: 1381870 - RNA, 19 nt, Homo sapiens
cagauaauguucccucaaa

SEQ ID NO: 1381871 - RNA, 19 nt, Homo sapiens
ggaacgaaguaagauaauu

SEQ ID NO: 1381872 - RNA, 19 nt, Homo sapiens
gcaaccaaaucggaugaua

SEQ ID NO: 1381873 - RNA, 19 nt, Homo sapiens
ucaagaagccucuauuguu

SEQ ID NO: 1381874 - RNA, 19 nt, Homo sapiens
acaaagagauacugagaau

SEQ ID NO: 1381875 - RNA, 19 nt, Homo sapiens
caagagcugugaaggaaga

SEQ ID NO: 1381876 - RNA, 19 nt, Homo sapiens
gggucuaaguggauuaaua

SEQ ID NO: 1381877 - RNA, 19 nt, Homo sapiens
ccagaaguuugauuucauu

SEQ ID NO: 1381878 - RNA, 19 nt, Homo sapiens
gcacacugcuccucuuucu

SEQ ID NO: 1381879 - RNA, 19 nt, Homo sapiens
gaccagaaguuugauuuca

SEQ ID NO: 1381880 - RNA, 19 nt, Homo sapiens
gaagcaccgucaaggaaga

SEQ ID NO: 1381881 - RNA, 19 nt, Homo sapiens
caagcaccauggccaguuu

SEQ ID NO: 1381882 - RNA, 19 nt, Homo sapiens
ggaaacagaaagaugaaau

SEQ ID NO: 1381883 - RNA, 19 nt, Homo sapiens
acagaaagaugaaauaagc

SEQ ID NO: 1381884 - RNA, 19 nt, Homo sapiens
ggucuaaguggauuaauau

SEQ ID NO: 1381885 - RNA, 19 nt, Homo sapiens
gaugguacgcguugcuaua

SEQ ID NO: 1381886 - RNA, 19 nt, Homo sapiens
aaaggaaacagaaagauga

SEQ ID NO: 1381887 - RNA, 19 nt, Homo sapiens
ggagggagacggauuucuu

SEQ ID NO: 1381888 - RNA, 19 nt, Homo sapiens
gcaaugcucagcucauaau

SEQ ID NO: 1381889 - RNA, 19 nt, Homo sapiens
ugaaugaucccgaaucugu

SEQ ID NO: 1381890 - RNA, 19 nt, Homo sapiens
uacagaacaugcaguaaug

SEQ ID NO: 1381891 - RNA, 19 nt, Homo sapiens
gaugauagagcucaguaga

SEQ ID NO: 1381892 - RNA, 19 nt, Homo sapiens
gagggagacggauuucuuu

SEQ ID NO: 1381893 - RNA, 19 nt, Homo sapiens
aaaagguccugaucacuua

SEQ ID NO: 1381894 - RNA, 19 nt, Homo sapiens
gaggagcacuuagcagcuu

SEQ ID NO: 1381895 - RNA, 19 nt, Homo sapiens
gaaugaucccgaaucugua

SEQ ID NO: 1381896 - RNA, 19 nt, Homo sapiens
gguaauugaggcugaauga

SEQ ID NO: 1381897 - RNA, 19 nt, Homo sapiens
ugacaucggcugagugcua

SEQ ID NO: 1381898 - RNA, 19 nt, Homo sapiens
cagcagauuucauugucaa

SEQ ID NO: 1381899 - RNA, 19 nt, Homo sapiens
gggaagcaccgucaaggaa

SEQ ID NO: 1381900 - RNA, 19 nt, Homo sapiens
gacaacccauguucacuca

SEQ ID NO: 1381901 - RNA, 19 nt, Homo sapiens
ggaaguagcggucauuagc

SEQ ID NO: 1381902 - RNA, 19 nt, Homo sapiens
uaaaggaaacagaaagaug

SEQ ID NO: 1381903 - RNA, 19 nt, Homo sapiens
gaucacuuauaucuggaaa

SEQ ID NO: 1381904 - RNA, 19 nt, Homo sapiens
gaaauuuccagacaaagag

SEQ ID NO: 1381905 - RNA, 19 nt, Homo sapiens
cauauucgccuugucuuaa

SEQ ID NO: 1381906 - RNA, 19 nt, Homo sapiens
aaagagauacugagaaugg

SEQ ID NO: 1381907 - RNA, 19 nt, Homo sapiens
ccaaaucggaugauacugu

SEQ ID NO: 1381908 - RNA, 19 nt, Homo sapiens
uaauugaggcugaaugaau

SEQ ID NO: 1381909 - RNA, 19 nt, Homo sapiens
uaacugugccuucuuucuu

SEQ ID NO: 1381910 - RNA, 19 nt, Homo sapiens
gauggagggagacggauuu

SEQ ID NO: 1381911 - RNA, 19 nt, Homo sapiens
gauaugugcaucagugguu

SEQ ID NO: 1381912 - RNA, 19 nt, Homo sapiens
cagaaucuuuggauaugug

SEQ ID NO: 1381913 - RNA, 19 nt, Homo sapiens
uacagaaucuuuggauaug

SEQ ID NO: 1381914 - RNA, 19 nt, Homo sapiens
caacccauguucacucaag

SEQ ID NO: 1381915 - RNA, 19 nt, Homo sapiens
gaugaaauaagccauugug

SEQ ID NO: 1381916 - RNA, 19 nt, Homo sapiens
gcugagugcuacgaucuga

SEQ ID NO: 1381917 - RNA, 19 nt, Homo sapiens
aauugaggcugaaugaaug

SEQ ID NO: 1381918 - RNA, 19 nt, Homo sapiens
cgguaacugugccuucuuu

SEQ ID NO: 1381919 - RNA, 19 nt, Homo sapiens
gaguggaaaugcauguaca

SEQ ID NO: 1381920 - RNA, 19 nt, Homo sapiens
gcuacgaucugaggagcaa

SEQ ID NO: 1381921 - RNA, 19 nt, Homo sapiens
cgauacagaacaugcagua

SEQ ID NO: 1381922 - RNA, 19 nt, Homo sapiens
agacaaagagauacugaga

SEQ ID NO: 1381923 - RNA, 19 nt, Homo sapiens
agcaagagcugugaaggaa

SEQ ID NO: 1381924 - RNA, 19 nt, Homo sapiens
ccucagaaaugacaaaaga

SEQ ID NO: 1381925 - RNA, 19 nt, Homo sapiens
caguagaccagaaguuuga

SEQ ID NO: 1381926 - RNA, 19 nt, Homo sapiens
gaaugaaugaucccgaauc

SEQ ID NO: 1381927 - RNA, 19 nt, Homo sapiens
gagguuaucagcugacauc

SEQ ID NO: 1381928 - RNA, 19 nt, Homo sapiens
gggcuccgcugacaguaca

SEQ ID NO: 1381929 - RNA, 19 nt, Homo sapiens
cagauuucauugucaagau

SEQ ID NO: 1381930 - RNA, 19 nt, Homo sapiens
acuuauaucuggaaaccaa

SEQ ID NO: 1381931 - RNA, 19 nt, Homo sapiens
guagacauauucgccuugu

SEQ ID NO: 1381932 - RNA, 19 nt, Homo sapiens
auacagugcugguagucaa

SEQ ID NO: 1381933 - RNA, 19 nt, Homo sapiens
gaagaguggaaaugcaugu

SEQ ID NO: 1381934 - RNA, 19 nt, Homo sapiens
gagacggauuucuuuccuu

SEQ ID NO: 1381935 - RNA, 19 nt, Homo sapiens
gacaaagagauacugagaa

SEQ ID NO: 1381936 - RNA, 19 nt, Homo sapiens
gggaagcaacugccuuuca

SEQ ID NO: 1381937 - RNA, 19 nt, Homo sapiens
ggagacggauuucuuuccu

SEQ ID NO: 1381938 - RNA, 19 nt, Homo sapiens
acucacagcagauuucauu

SEQ ID NO: 1381939 - RNA, 19 nt, Homo sapiens
agaaauuuccagacaaaga

SEQ ID NO: 1381940 - RNA, 19 nt, Homo sapiens
agucucaacuccacaggaa

SEQ ID NO: 1381941 - RNA, 19 nt, Homo sapiens
ggacugcccaccagaagca

SEQ ID NO: 1381942 - RNA, 19 nt, Homo sapiens
gaaguagcggucauuagca

SEQ ID NO: 1381943 - RNA, 19 nt, Homo sapiens
gcagaaaggaaaaucguaa

SEQ ID NO: 1381944 - RNA, 19 nt, Homo sapiens
guuaggaaaccugcuguaa

SEQ ID NO: 1381945 - RNA, 19 nt, Homo sapiens
aagaugaaauaagccauug

SEQ ID NO: 1381946 - RNA, 19 nt, Homo sapiens
cgaaagggucuaaguggau

SEQ ID NO: 1381947 - RNA, 19 nt, Homo sapiens
gaccaaaaguaaaugaugu

SEQ ID NO: 1381948 - RNA, 19 nt, Homo sapiens
aacugugccuucuuucuuu

SEQ ID NO: 1381949 - RNA, 19 nt, Homo sapiens
gcagauuucauugucaaga

SEQ ID NO: 1381950 - RNA, 19 nt, Homo sapiens
gcaccgucaaggaagauaa

SEQ ID NO: 1381951 - RNA, 19 nt, Homo sapiens
cagggaagcaacugccuuu

SEQ ID NO: 1381952 - RNA, 19 nt, Homo sapiens
aauguucccucaaauagca

SEQ ID NO: 1381953 - RNA, 19 nt, Homo sapiens
gcuccacacucuucuugag

SEQ ID NO: 1381954 - RNA, 19 nt, Homo sapiens
guacaguccaguucaucuu

SEQ ID NO: 1381955 - RNA, 19 nt, Homo sapiens
cacagcagauuucauuguc

SEQ ID NO: 1381956 - RNA, 19 nt, Homo sapiens
aaaggaaaaucguaaagga

SEQ ID NO: 1381957 - RNA, 19 nt, Homo sapiens
gaagaggaaaugaaaauag

SEQ ID NO: 1381958 - RNA, 19 nt, Homo sapiens
gagugcaacuuggauccuu

SEQ ID NO: 1381959 - RNA, 19 nt, Homo sapiens
gaacgggaaucaauuaaac

SEQ ID NO: 1381960 - RNA, 19 nt, Homo sapiens
ggaacgggaaucaauuaaa

SEQ ID NO: 1381961 - RNA, 19 nt, Homo sapiens
ggagcugccuguggugaaa

SEQ ID NO: 1381962 - RNA, 19 nt, Homo sapiens
ccauguuugucuacacuaa

SEQ ID NO: 1381963 - RNA, 19 nt, Homo sapiens
caaaucaagaugaggaaga

SEQ ID NO: 1381964 - RNA, 19 nt, Homo sapiens
ccucaauccucagcaugua

SEQ ID NO: 1381965 - RNA, 19 nt, Homo sapiens
uugaugaccuggccauguu

SEQ ID NO: 1381966 - RNA, 19 nt, Homo sapiens
cgucuuguauccaaaucaa

SEQ ID NO: 1381967 - RNA, 19 nt, Homo sapiens
gcuggcgucuuguauccaa

SEQ ID NO: 1381968 - RNA, 19 nt, Homo sapiens
gaggcgcugucacuucuca

SEQ ID NO: 1381969 - RNA, 19 nt, Homo sapiens
ugucuacacuaagcaauau

SEQ ID NO: 1381970 - RNA, 19 nt, Homo sapiens
gaccaucuugcgacucuuu

SEQ ID NO: 1381971 - RNA, 19 nt, Homo sapiens
gcuggaacgggaaucaauu

SEQ ID NO: 1381972 - RNA, 19 nt, Homo sapiens
cuggaacgggaaucaauua

SEQ ID NO: 1381973 - RNA, 19 nt, Homo sapiens
ccagcugguugguggaguu

SEQ ID NO: 1381974 - RNA, 19 nt, Homo sapiens
cggaggcgcugucacuucu

SEQ ID NO: 1381975 - RNA, 19 nt, Homo sapiens
ggaggaggacgccuuuguc

SEQ ID NO: 1381976 - RNA, 19 nt, Homo sapiens
gguggacgcugaguacaac

SEQ ID NO: 1381977 - RNA, 19 nt, Homo sapiens
ucuugcgacucuuugauga

SEQ ID NO: 1381978 - RNA, 19 nt, Homo sapiens
aaaucaagaugaggaagag

SEQ ID NO: 1381979 - RNA, 19 nt, Homo sapiens
acauuguggugcuggcaaa

SEQ ID NO: 1381980 - RNA, 19 nt, Homo sapiens
ggccugucgugccuugaga

SEQ ID NO: 1381981 - RNA, 19 nt, Homo sapiens
ggccauguuugucuacacu

SEQ ID NO: 1381982 - RNA, 19 nt, Homo sapiens
ugucgugccuugagaaagc

SEQ ID NO: 1381983 - RNA, 19 nt, Homo sapiens
gcugguugguggaguucug

SEQ ID NO: 1381984 - RNA, 19 nt, Homo sapiens
guauccaaaucaagaugag

SEQ ID NO: 1381985 - RNA, 19 nt, Homo sapiens
cagcuggcgucuuguaucc

SEQ ID NO: 1381986 - RNA, 19 nt, Homo sapiens
gaugaccuggccauguuug

SEQ ID NO: 1381987 - RNA, 19 nt, Homo sapiens
uggaugcugcugaaacuga

SEQ ID NO: 1381988 - RNA, 19 nt, Homo sapiens
ccacugcaggaccaucuug

SEQ ID NO: 1381989 - RNA, 19 nt, Homo sapiens
ggaagguccuaaauuauga

SEQ ID NO: 1381990 - RNA, 19 nt, Homo sapiens
gagcagggaucuugaguca

SEQ ID NO: 1381991 - RNA, 19 nt, Homo sapiens
ggacacugaugcacaaaga

SEQ ID NO: 1381992 - RNA, 19 nt, Homo sapiens
aguggaagguccuaaauua

SEQ ID NO: 1381993 - RNA, 19 nt, Homo sapiens
gugauggagucaagauuua

SEQ ID NO: 1381994 - RNA, 19 nt, Homo sapiens
gacaggaucugcucuuuca

SEQ ID NO: 1381995 - RNA, 19 nt, Homo sapiens
ccagauugcugccauaguu

SEQ ID NO: 1381996 - RNA, 19 nt, Homo sapiens
ggaagggcauaaagaauca

SEQ ID NO: 1381997 - RNA, 19 nt, Homo sapiens
gcacagagaagacagaugu

SEQ ID NO: 1381998 - RNA, 19 nt, Homo sapiens
ccucagcgcugcgguuaua

SEQ ID NO: 1381999 - RNA, 19 nt, Homo sapiens
gagggucacuacagucuga

SEQ ID NO: 1382000 - RNA, 19 nt, Homo sapiens
gaugauagcaaauauguag

SEQ ID NO: 1382001 - RNA, 19 nt, Homo sapiens
gaagacagauguugauccu

SEQ ID NO: 1382002 - RNA, 19 nt, Homo sapiens
gagucaagauuuaggauuc

SEQ ID NO: 1382003 - RNA, 19 nt, Homo sapiens
gcaauaagacuaguauaca

SEQ ID NO: 1382004 - RNA, 19 nt, Homo sapiens
gcaaauauguaguguuuuc

SEQ ID NO: 1382005 - RNA, 19 nt, Homo sapiens
gcgcugcgguuauacaauc

SEQ ID NO: 1382006 - RNA, 19 nt, Homo sapiens
ggacauaggaggagaugca

SEQ ID NO: 1382007 - RNA, 19 nt, Homo sapiens
gugccacauucuagauuua

SEQ ID NO: 1382008 - RNA, 19 nt, Homo sapiens
caugaaggcuccucugucu

SEQ ID NO: 1382009 - RNA, 19 nt, Homo sapiens
gcccaauccugccuuucua

SEQ ID NO: 1382010 - RNA, 19 nt, Homo sapiens
ucagagcacuugcccaauc

SEQ ID NO: 1382011 - RNA, 19 nt, Homo sapiens
cgaggacacugaugcacaa

SEQ ID NO: 1382012 - RNA, 19 nt, Homo sapiens
gguccuaaauuaugacaag

SEQ ID NO: 1382013 - RNA, 19 nt, Homo sapiens
ucagacaagugccacauuc

SEQ ID NO: 1382014 - RNA, 19 nt, Homo sapiens
gccucaagcuggagacauu

SEQ ID NO: 1382015 - RNA, 19 nt, Homo sapiens
gguaccagcuggacaaggu

SEQ ID NO: 1382016 - RNA, 19 nt, Homo sapiens
gcauaggccucaucaucca

SEQ ID NO: 1382017 - RNA, 19 nt, Homo sapiens
gggaagggcauaaagaauc

SEQ ID NO: 1382018 - RNA, 19 nt, Homo sapiens
ugguguguauuaacucuua

SEQ ID NO: 1382019 - RNA, 19 nt, Homo sapiens
ggaccaaugccagaagaaa

SEQ ID NO: 1382020 - RNA, 19 nt, Homo sapiens
ugacaagaccaaggacaua

SEQ ID NO: 1382021 - RNA, 19 nt, Homo sapiens
gaucugcuacggcauguau

SEQ ID NO: 1382022 - RNA, 19 nt, Homo sapiens
ggagguaccagcuggacaa

SEQ ID NO: 1382023 - RNA, 19 nt, Homo sapiens
acaccuggaugacauuuca

SEQ ID NO: 1382024 - RNA, 19 nt, Homo sapiens
gauagcaaauauguagugu

SEQ ID NO: 1382025 - RNA, 19 nt, Homo sapiens
gugaugaugauagcaaaua

SEQ ID NO: 1382026 - RNA, 19 nt, Homo sapiens
gguccagauugcugccaua

SEQ ID NO: 1382027 - RNA, 19 nt, Homo sapiens
gguagagacaccuggauga

SEQ ID NO: 1382028 - RNA, 19 nt, Homo sapiens
ggagucaagauuuaggauu

SEQ ID NO: 1382029 - RNA, 19 nt, Homo sapiens
ccacagggcaucuggcaau

SEQ ID NO: 1382030 - RNA, 19 nt, Homo sapiens
cagagaagacagauguuga

SEQ ID NO: 1382031 - RNA, 19 nt, Homo sapiens
gaaaacuuacccaagguua

SEQ ID NO: 1382032 - RNA, 19 nt, Homo sapiens
uuacaaacgaggacacuga

SEQ ID NO: 1382033 - RNA, 19 nt, Homo sapiens
gccgagagguugucaugag

SEQ ID NO: 1382034 - RNA, 19 nt, Homo sapiens
gauccugccugaagguuuu

SEQ ID NO: 1382035 - RNA, 19 nt, Homo sapiens
agacaagugccacauucua

SEQ ID NO: 1382036 - RNA, 19 nt, Homo sapiens
ggagagaaccgucuuuacc

SEQ ID NO: 1382037 - RNA, 19 nt, Homo sapiens
agagacaccuggaugacau

SEQ ID NO: 1382038 - RNA, 19 nt, Homo sapiens
cacagggcaucuggcaaua

SEQ ID NO: 1382039 - RNA, 19 nt, Homo sapiens
acacugaugcacaaagauu

SEQ ID NO: 1382040 - RNA, 19 nt, Homo sapiens
uggaagguccuaaauuaug

SEQ ID NO: 1382041 - RNA, 19 nt, Homo sapiens
ggcaggcagugaaccauca

SEQ ID NO: 1382042 - RNA, 19 nt, Homo sapiens
ggcaauaagacuaguauac

SEQ ID NO: 1382043 - RNA, 19 nt, Homo sapiens
cagggcaucuggcaauaag

SEQ ID NO: 1382044 - RNA, 19 nt, Homo sapiens
gacaagugccacauucuag

SEQ ID NO: 1382045 - RNA, 19 nt, Homo sapiens
caaugcaucagucagagaa

SEQ ID NO: 1382046 - RNA, 19 nt, Homo sapiens
gaugaugauagcaaauaug

SEQ ID NO: 1382047 - RNA, 19 nt, Homo sapiens
gcaucuggcaauaagacua

SEQ ID NO: 1382048 - RNA, 19 nt, Homo sapiens
gaggugaugaugauagcaa

SEQ ID NO: 1382049 - RNA, 19 nt, Homo sapiens
guggaagguccuaaauuau

SEQ ID NO: 1382050 - RNA, 19 nt, Homo sapiens
ucaugagggucacuacagu

SEQ ID NO: 1382051 - RNA, 19 nt, Homo sapiens
ucgagaagguccagauugc

SEQ ID NO: 1382052 - RNA, 19 nt, Homo sapiens
ccaauccugccuuucuaaa

SEQ ID NO: 1382053 - RNA, 19 nt, Homo sapiens
gagagaaccgucuuuaccu

SEQ ID NO: 1382054 - RNA, 19 nt, Homo sapiens
gaccaaugccagaagaaag

SEQ ID NO: 1382055 - RNA, 19 nt, Homo sapiens
caagaccaaggacauagga

SEQ ID NO: 1382056 - RNA, 19 nt, Homo sapiens
ugaaggcuccucugucuac

SEQ ID NO: 1382057 - RNA, 19 nt, Homo sapiens
agugauggagucaagauuu

SEQ ID NO: 1382058 - RNA, 19 nt, Homo sapiens
caguggaagguccuaaauu

SEQ ID NO: 1382059 - RNA, 19 nt, Homo sapiens
caaguuuugguguguauua

SEQ ID NO: 1382060 - RNA, 19 nt, Homo sapiens
cgacaggaucugcucuuuc

SEQ ID NO: 1382061 - RNA, 19 nt, Homo sapiens
gccacauucuagauuuaau

SEQ ID NO: 1382062 - RNA, 19 nt, Homo sapiens
agugccacauucuagauuu

SEQ ID NO: 1382063 - RNA, 19 nt, Homo sapiens
caagugccacauucuagau

SEQ ID NO: 1382064 - RNA, 19 nt, Homo sapiens
gucuuuaccucagcuccua

SEQ ID NO: 1382065 - RNA, 19 nt, Homo sapiens
gacaagaccaaggacauag

SEQ ID NO: 1382066 - RNA, 19 nt, Homo sapiens
cugcauaggccucaucauc

SEQ ID NO: 1382067 - RNA, 19 nt, Homo sapiens
caucgagaagguccagauu

SEQ ID NO: 1382068 - RNA, 19 nt, Homo sapiens
ucauggaugucgucugcau

SEQ ID NO: 1382069 - RNA, 19 nt, Homo sapiens
gagaagacagauguugauc

SEQ ID NO: 1382070 - RNA, 19 nt, Homo sapiens
uaagugauggagucaagau

SEQ ID NO: 1382071 - RNA, 19 nt, Homo sapiens
aguaagugauggagucaag

SEQ ID NO: 1382072 - RNA, 19 nt, Homo sapiens
acgacaggaucugcucuuu

SEQ ID NO: 1382073 - RNA, 19 nt, Homo sapiens
aaucaaggcacagagaaga

SEQ ID NO: 1382074 - RNA, 19 nt, Homo sapiens
acaagugccacauucuaga

SEQ ID NO: 1382075 - RNA, 19 nt, Homo sapiens
cagugaaccaucaguggaa

SEQ ID NO: 1382076 - RNA, 19 nt, Homo sapiens
uguauggcuucauggaugu

SEQ ID NO: 1382077 - RNA, 19 nt, Homo sapiens
gaagaaaggggcuguagac

SEQ ID NO: 1382078 - RNA, 19 nt, Homo sapiens
cuggagagaaccgucuuua

SEQ ID NO: 1382079 - RNA, 19 nt, Homo sapiens
uggcagcuccucccacuca

SEQ ID NO: 1382080 - RNA, 19 nt, Homo sapiens
gagacaccuggaugacauu

SEQ ID NO: 1382081 - RNA, 19 nt, Homo sapiens
agagaagacagauguugau

SEQ ID NO: 1382082 - RNA, 19 nt, Homo sapiens
acagagaagacagauguug

SEQ ID NO: 1382083 - RNA, 19 nt, Homo sapiens
ugauagcaaauauguagug

SEQ ID NO: 1382084 - RNA, 19 nt, Homo sapiens
gcaaugagcgcuuccagua

SEQ ID NO: 1382085 - RNA, 19 nt, Homo sapiens
cagcuacucuggccauaua

SEQ ID NO: 1382086 - RNA, 19 nt, Homo sapiens
ggcaaggacuucaacauga

SEQ ID NO: 1382087 - RNA, 19 nt, Homo sapiens
uaaaggagccugcauguuc

SEQ ID NO: 1382088 - RNA, 19 nt, Homo sapiens
uggcaaagcuuucaagaag

SEQ ID NO: 1382089 - RNA, 19 nt, Homo sapiens
gcugguaccuggagaaaca

SEQ ID NO: 1382090 - RNA, 19 nt, Homo sapiens
gagaagccguucagaugug

SEQ ID NO: 1382091 - RNA, 19 nt, Homo sapiens
gggagaagccguucagaug

SEQ ID NO: 1382092 - RNA, 19 nt, Homo sapiens
cagcugcggucacacauga

SEQ ID NO: 1382093 - RNA, 19 nt, Homo sapiens
gagagaagccguacaucug

SEQ ID NO: 1382094 - RNA, 19 nt, Homo sapiens
guacuucgaugagcacaug

SEQ ID NO: 1382095 - RNA, 19 nt, Homo sapiens
ccauagcacugccgguaaa

SEQ ID NO: 1382096 - RNA, 19 nt, Homo sapiens
gggcagaguccuaggauga

SEQ ID NO: 1382097 - RNA, 19 nt, Homo sapiens
ggaugaacgccaacaacua

SEQ ID NO: 1382098 - RNA, 19 nt, Homo sapiens
cagaagugcccacgaguuu

SEQ ID NO: 1382099 - RNA, 19 nt, Homo sapiens
gaugaacgccaacaacuag

SEQ ID NO: 1382100 - RNA, 19 nt, Homo sapiens
ggagaagccguucagaugu

SEQ ID NO: 1382101 - RNA, 19 nt, Homo sapiens
cuaauuugcuuccucaucu

SEQ ID NO: 1382102 - RNA, 19 nt, Homo sapiens
ggagagaagccguacaucu

SEQ ID NO: 1382103 - RNA, 19 nt, Homo sapiens
gaugugagaacugcaauga

SEQ ID NO: 1382104 - RNA, 19 nt, Homo sapiens
gaggcuagcacuaauagga

SEQ ID NO: 1382105 - RNA, 19 nt, Homo sapiens
aaaggagccugcauguuca

SEQ ID NO: 1382106 - RNA, 19 nt, Homo sapiens
gcacagccuagacccaauu

SEQ ID NO: 1382107 - RNA, 19 nt, Homo sapiens
cacaugagcauccacauug

SEQ ID NO: 1382108 - RNA, 19 nt, Homo sapiens
ccaugagcauaacaagauu

SEQ ID NO: 1382109 - RNA, 19 nt, Homo sapiens
ugacauguggcaaagcuuu

SEQ ID NO: 1382110 - RNA, 19 nt, Homo sapiens
ggcuagcacuaauaggaaa

SEQ ID NO: 1382111 - RNA, 19 nt, Homo sapiens
aaugagcgcuuccaguaca

SEQ ID NO: 1382112 - RNA, 19 nt, Homo sapiens
ccaugaggcuagcacuaau

SEQ ID NO: 1382113 - RNA, 19 nt, Homo sapiens
gguaaaggagccugcaugu

SEQ ID NO: 1382114 - RNA, 19 nt, Homo sapiens
caacauccagugugugaca

SEQ ID NO: 1382115 - RNA, 19 nt, Homo sapiens
ggccuuauccucccucuag

SEQ ID NO: 1382116 - RNA, 19 nt, Homo sapiens
caugaggcuagcacuaaua

SEQ ID NO: 1382117 - RNA, 19 nt, Homo sapiens
aggugaagcuggaggagaa

SEQ ID NO: 1382118 - RNA, 19 nt, Homo sapiens
guaaaggagccugcauguu

SEQ ID NO: 1382119 - RNA, 19 nt, Homo sapiens
caugcgagaucugugagaa

SEQ ID NO: 1382120 - RNA, 19 nt, Homo sapiens
cggcaaggacuucaacaug

SEQ ID NO: 1382121 - RNA, 19 nt, Homo sapiens
gcacggcuacgcagagaag

SEQ ID NO: 1382122 - RNA, 19 nt, Homo sapiens
cgagaucugugagaagaag

SEQ ID NO: 1382123 - RNA, 19 nt, Homo sapiens
caccauccaugccagaagu

SEQ ID NO: 1382124 - RNA, 19 nt, Homo sapiens
ccagaagugcccacgaguu

SEQ ID NO: 1382125 - RNA, 19 nt, Homo sapiens
uaauuugcuuccucaucuu

SEQ ID NO: 1382126 - RNA, 19 nt, Homo sapiens
gcacaugaagacccacaca

SEQ ID NO: 1382127 - RNA, 19 nt, Homo sapiens
acacaugagcauccacauu

SEQ ID NO: 1382128 - RNA, 19 nt, Homo sapiens
gugacuccuugaagccuuu

SEQ ID NO: 1382129 - RNA, 19 nt, Homo sapiens
ucaaggcccacaaggagaa

SEQ ID NO: 1382130 - RNA, 19 nt, Homo sapiens
ggaggaugaacgccaacaa

SEQ ID NO: 1382131 - RNA, 19 nt, Homo sapiens
ugcgagaucugugagaaga

SEQ ID NO: 1382132 - RNA, 19 nt, Homo sapiens
guuucaaggugcuauuagu

SEQ ID NO: 1382133 - RNA, 19 nt, Homo sapiens
gggcaucucacucccaagu

SEQ ID NO: 1382134 - RNA, 19 nt, Homo sapiens
gugcacggcuacgcagaga

SEQ ID NO: 1382135 - RNA, 19 nt, Homo sapiens
ggguuucaaggugcuauua

SEQ ID NO: 1382136 - RNA, 19 nt, Homo sapiens
gguccugaguccuggagau

SEQ ID NO: 1382137 - RNA, 19 nt, Homo sapiens
agaagccguucagauguga

SEQ ID NO: 1382138 - RNA, 19 nt, Homo sapiens
ugcgagaucuguggcaaga

SEQ ID NO: 1382139 - RNA, 19 nt, Homo sapiens
cccaugaggcuagcacuaa

SEQ ID NO: 1382140 - RNA, 19 nt, Homo sapiens
cccaguuccucaccagcua

SEQ ID NO: 1382141 - RNA, 19 nt, Homo sapiens
uccaugagcauaacaagau

SEQ ID NO: 1382142 - RNA, 19 nt, Homo sapiens
guggcaaagcuuucaagaa

SEQ ID NO: 1382143 - RNA, 19 nt, Homo sapiens
uagcacugccgguaaagga

SEQ ID NO: 1382144 - RNA, 19 nt, Homo sapiens
ggaacaaguguggcugugu

SEQ ID NO: 1382145 - RNA, 19 nt, Homo sapiens
gcugguaggguuucaaggu

SEQ ID NO: 1382146 - RNA, 19 nt, Homo sapiens
ucacagagcaccccaguuc

SEQ ID NO: 1382147 - RNA, 19 nt, Homo sapiens
cgcaacauccaguguguga

SEQ ID NO: 1382148 - RNA, 19 nt, Homo sapiens
caggagagaagccguacau

SEQ ID NO: 1382149 - RNA, 19 nt, Homo sapiens
guaccuggagaaacacaug

SEQ ID NO: 1382150 - RNA, 19 nt, Homo sapiens
gaggaugaacgccaacaac

SEQ ID NO: 1382151 - RNA, 19 nt, Homo sapiens
ggucacacaugagcaucca

SEQ ID NO: 1382152 - RNA, 19 nt, Homo sapiens
gcaguucaugugccaaugg

SEQ ID NO: 1382153 - RNA, 19 nt, Homo sapiens
gcuacgcagagaagaaguu

SEQ ID NO: 1382154 - RNA, 19 nt, Homo sapiens
cauauaucccacaccagaa

SEQ ID NO: 1382155 - RNA, 19 nt, Homo sapiens
gaagugcccacgaguuuuc

SEQ ID NO: 1382156 - RNA, 19 nt, Homo sapiens
gagaagcagcaccauccau

SEQ ID NO: 1382157 - RNA, 19 nt, Homo sapiens
gcauccacauuggccacaa

SEQ ID NO: 1382158 - RNA, 19 nt, Homo sapiens
ccauggcccacgugcguaa

SEQ ID NO: 1382159 - RNA, 19 nt, Homo sapiens
ggaaagacaacaaauacua

SEQ ID NO: 1382160 - RNA, 19 nt, Homo sapiens
gcaggaaagacaacaaaua

SEQ ID NO: 1382161 - RNA, 19 nt, Homo sapiens
ccaccaaccugcuagaauu

SEQ ID NO: 1382162 - RNA, 19 nt, Homo sapiens
ucaaguggcuggacaucua

SEQ ID NO: 1382163 - RNA, 19 nt, Homo sapiens
ggaagaacccgaaagaugu

SEQ ID NO: 1382164 - RNA, 19 nt, Homo sapiens
gaacaaggagccgugcuuu

SEQ ID NO: 1382165 - RNA, 19 nt, Homo sapiens
gaaagacaacaaauacuac

SEQ ID NO: 1382166 - RNA, 19 nt, Homo sapiens
ccaugucgcuguggaagaa

SEQ ID NO: 1382167 - RNA, 19 nt, Homo sapiens
cacgagggcuucaagacuu

SEQ ID NO: 1382168 - RNA, 19 nt, Homo sapiens
gaagaacccgaaagaugug

SEQ ID NO: 1382169 - RNA, 19 nt, Homo sapiens
gcaacagccgcaugaacaa

SEQ ID NO: 1382170 - RNA, 19 nt, Homo sapiens
gcgacacccuggagcucua

SEQ ID NO: 1382171 - RNA, 19 nt, Homo sapiens
uggaagaacccgaaagaug

SEQ ID NO: 1382172 - RNA, 19 nt, Homo sapiens
caaauggacagcuggugaa

SEQ ID NO: 1382173 - RNA, 19 nt, Homo sapiens
ggagauccacuuccucaag

SEQ ID NO: 1382174 - RNA, 19 nt, Homo sapiens
caggaaagacaacaaauac

SEQ ID NO: 1382175 - RNA, 19 nt, Homo sapiens
acuaacugcucagccaaua

SEQ ID NO: 1382176 - RNA, 19 nt, Homo sapiens
gcucagccaauaucaacuu

SEQ ID NO: 1382177 - RNA, 19 nt, Homo sapiens
uaacugcucagccaauauc

SEQ ID NO: 1382178 - RNA, 19 nt, Homo sapiens
caccaaccugcuagaauuu

SEQ ID NO: 1382179 - RNA, 19 nt, Homo sapiens
acgagggcuucaagacuuu

SEQ ID NO: 1382180 - RNA, 19 nt, Homo sapiens
cuacgaagaccgccucuac

SEQ ID NO: 1382181 - RNA, 19 nt, Homo sapiens
gggacgugaccaccacuaa

SEQ ID NO: 1382182 - RNA, 19 nt, Homo sapiens
ggccagcuauccgccguau

SEQ ID NO: 1382183 - RNA, 19 nt, Homo sapiens
agacaacaaauacuacauc

SEQ ID NO: 1382184 - RNA, 19 nt, Homo sapiens
ugaaccacccggagaagug

SEQ ID NO: 1382185 - RNA, 19 nt, Homo sapiens
agaaggcccagaagccaaa

SEQ ID NO: 1382186 - RNA, 19 nt, Homo sapiens
guacggcaaggccagcuau

SEQ ID NO: 1382187 - RNA, 19 nt, Homo sapiens
gaccggcagccacaggaaa

SEQ ID NO: 1382188 - RNA, 19 nt, Homo sapiens
cgcaacagccgcaugaaca

SEQ ID NO: 1382189 - RNA, 19 nt, Homo sapiens
aggaggagcgcacgcacua

SEQ ID NO: 1382190 - RNA, 19 nt, Homo sapiens
ggacgugaccaccacuaac

SEQ ID NO: 1382191 - RNA, 19 nt, Homo sapiens
ccacgagggcuucaagacu

SEQ ID NO: 1382192 - RNA, 19 nt, Homo sapiens
ccagcuauccgccguaugc

SEQ ID NO: 1382193 - RNA, 19 nt, Homo sapiens
ucgcaggaaagacaacaaa

SEQ ID NO: 1382194 - RNA, 19 nt, Homo sapiens
ucuggaagaacccgaaaga

SEQ ID NO: 1382195 - RNA, 19 nt, Homo sapiens
ugaacaaggagccgugcuu

SEQ ID NO: 1382196 - RNA, 19 nt, Homo sapiens
ucucaccccuggucaguuu

SEQ ID NO: 1382197 - RNA, 19 nt, Homo sapiens
gacgugaccaccacuaacu

SEQ ID NO: 1382198 - RNA, 19 nt, Homo sapiens
gaacaggacuuauuugaua

SEQ ID NO: 1382199 - RNA, 19 nt, Homo sapiens
gaacaccagugcuaaggua

SEQ ID NO: 1382200 - RNA, 19 nt, Homo sapiens
gaaauaaaguggugauagu

SEQ ID NO: 1382201 - RNA, 19 nt, Homo sapiens
ccacagaguuucauauuug

SEQ ID NO: 1382202 - RNA, 19 nt, Homo sapiens
aaacaucucucaaacagaa

SEQ ID NO: 1382203 - RNA, 19 nt, Homo sapiens
caucgcagcuuauggcuuu

SEQ ID NO: 1382204 - RNA, 19 nt, Homo sapiens
caccaaggcuccauccaua

SEQ ID NO: 1382205 - RNA, 19 nt, Homo sapiens
aaacuuugcuucuuuggaa

SEQ ID NO: 1382206 - RNA, 19 nt, Homo sapiens
ccaaagacauggcuuacug

SEQ ID NO: 1382207 - RNA, 19 nt, Homo sapiens
caagggaagugacaggaaa

SEQ ID NO: 1382208 - RNA, 19 nt, Homo sapiens
gcacuacaguauaucaaug

SEQ ID NO: 1382209 - RNA, 19 nt, Homo sapiens
gaaggaguaugguuaagca

SEQ ID NO: 1382210 - RNA, 19 nt, Homo sapiens
gguagaaggaguaugguua

SEQ ID NO: 1382211 - RNA, 19 nt, Homo sapiens
ugaugacucuuuaggauaa

SEQ ID NO: 1382212 - RNA, 19 nt, Homo sapiens
ucaaggcacuacaguauau

SEQ ID NO: 1382213 - RNA, 19 nt, Homo sapiens
aauagugucuucaaaggua

SEQ ID NO: 1382214 - RNA, 19 nt, Homo sapiens
guagaauagugucuucaaa

SEQ ID NO: 1382215 - RNA, 19 nt, Homo sapiens
gcaagaggcaauacaagaa

SEQ ID NO: 1382216 - RNA, 19 nt, Homo sapiens
caggguacuuucuaagaua

SEQ ID NO: 1382217 - RNA, 19 nt, Homo sapiens
aguaucagcucaccaauga

SEQ ID NO: 1382218 - RNA, 19 nt, Homo sapiens
gcacagagguuagguucca

SEQ ID NO: 1382219 - RNA, 19 nt, Homo sapiens
aggcauaucuuaccaacuu

SEQ ID NO: 1382220 - RNA, 19 nt, Homo sapiens
gaacuaccaauacuguuga

SEQ ID NO: 1382221 - RNA, 19 nt, Homo sapiens
gacaaauucuuccaguaug

SEQ ID NO: 1382222 - RNA, 19 nt, Homo sapiens
uaaacagcgucaaucacua

SEQ ID NO: 1382223 - RNA, 19 nt, Homo sapiens
ucaaacaucucucaaacag

SEQ ID NO: 1382224 - RNA, 19 nt, Homo sapiens
aaagugacaugaaguguag

SEQ ID NO: 1382225 - RNA, 19 nt, Homo sapiens
gaaagguucucugaaaauu

SEQ ID NO: 1382226 - RNA, 19 nt, Homo sapiens
guagaaggaguaugguuaa

SEQ ID NO: 1382227 - RNA, 19 nt, Homo sapiens
gaacgguuacuuuguccua

SEQ ID NO: 1382228 - RNA, 19 nt, Homo sapiens
cgacaaauucuuccaguau

SEQ ID NO: 1382229 - RNA, 19 nt, Homo sapiens
gauauuguacugaugacua

SEQ ID NO: 1382230 - RNA, 19 nt, Homo sapiens
caagaacgccaucaccauu

SEQ ID NO: 1382231 - RNA, 19 nt, Homo sapiens
caucagcauuguagaauag

SEQ ID NO: 1382232 - RNA, 19 nt, Homo sapiens
acaaauucuuccaguauga

SEQ ID NO: 1382233 - RNA, 19 nt, Homo sapiens
aaucagggaucacaagaau

SEQ ID NO: 1382234 - RNA, 19 nt, Homo sapiens
gcuggcacauccauauuug

SEQ ID NO: 1382235 - RNA, 19 nt, Homo sapiens
ccaucagcauuguagaaua

SEQ ID NO: 1382236 - RNA, 19 nt, Homo sapiens
guauauugcugcagauucu

SEQ ID NO: 1382237 - RNA, 19 nt, Homo sapiens
ggagugcggcuuauaaaca

SEQ ID NO: 1382238 - RNA, 19 nt, Homo sapiens
gcagggaggagaaauaaag

SEQ ID NO: 1382239 - RNA, 19 nt, Homo sapiens
cuuaccaacuuguauauug

SEQ ID NO: 1382240 - RNA, 19 nt, Homo sapiens
caagugggagugcggcuua

SEQ ID NO: 1382241 - RNA, 19 nt, Homo sapiens
uaauaaccaugcccaagug

SEQ ID NO: 1382242 - RNA, 19 nt, Homo sapiens
caucaaacuacuucucuuu

SEQ ID NO: 1382243 - RNA, 19 nt, Homo sapiens
uagguuccaucgcagcuua

SEQ ID NO: 1382244 - RNA, 19 nt, Homo sapiens
ggaagugacaggaaaugga

SEQ ID NO: 1382245 - RNA, 19 nt, Homo sapiens
ucacuacggcuuacugauu

SEQ ID NO: 1382246 - RNA, 19 nt, Homo sapiens
agucaauggucuagaauau

SEQ ID NO: 1382247 - RNA, 19 nt, Homo sapiens
gugauagucugguguuaca

SEQ ID NO: 1382248 - RNA, 19 nt, Homo sapiens
agcaugggcucgacaaauu

SEQ ID NO: 1382249 - RNA, 19 nt, Homo sapiens
ccaggguacuuucuaagau

SEQ ID NO: 1382250 - RNA, 19 nt, Homo sapiens
guuaagcacacucuugaaa

SEQ ID NO: 1382251 - RNA, 19 nt, Homo sapiens
gggcagggaggagaaauaa

SEQ ID NO: 1382252 - RNA, 19 nt, Homo sapiens
gacaugaaguguaguaucc

SEQ ID NO: 1382253 - RNA, 19 nt, Homo sapiens
aaaaguacauggaguauca

SEQ ID NO: 1382254 - RNA, 19 nt, Homo sapiens
gcaccaaaaugcaagagaa

SEQ ID NO: 1382255 - RNA, 19 nt, Homo sapiens
gcaggaacaccagugcuaa

SEQ ID NO: 1382256 - RNA, 19 nt, Homo sapiens
aaacuggagcuuuguauuc

SEQ ID NO: 1382257 - RNA, 19 nt, Homo sapiens
gcaaucagggaucacaaga

SEQ ID NO: 1382258 - RNA, 19 nt, Homo sapiens
cacagaguuucauauuuga

SEQ ID NO: 1382259 - RNA, 19 nt, Homo sapiens
aaugaugacucuuuaggau

SEQ ID NO: 1382260 - RNA, 19 nt, Homo sapiens
gcuguccucuucucugaug

SEQ ID NO: 1382261 - RNA, 19 nt, Homo sapiens
cacuacggcuuacugauug

SEQ ID NO: 1382262 - RNA, 19 nt, Homo sapiens
ugaugcugcucauuuagaa

SEQ ID NO: 1382263 - RNA, 19 nt, Homo sapiens
ggagcuuuguauucuguga

SEQ ID NO: 1382264 - RNA, 19 nt, Homo sapiens
gcaagggaagugacaggaa

SEQ ID NO: 1382265 - RNA, 19 nt, Homo sapiens
ucagggaucacaagaauca

SEQ ID NO: 1382266 - RNA, 19 nt, Homo sapiens
ugaugaacaggacuuauuu

SEQ ID NO: 1382267 - RNA, 19 nt, Homo sapiens
ccuccaggguacuuucuaa

SEQ ID NO: 1382268 - RNA, 19 nt, Homo sapiens
aaaggaaucugacaaaaca

SEQ ID NO: 1382269 - RNA, 19 nt, Homo sapiens
gagaaauaaaguggugaua

SEQ ID NO: 1382270 - RNA, 19 nt, Homo sapiens
gguauugccucugcgacaa

SEQ ID NO: 1382271 - RNA, 19 nt, Homo sapiens
cgucaaggcacuacaguau

SEQ ID NO: 1382272 - RNA, 19 nt, Homo sapiens
gggcauccaugaggucguu

SEQ ID NO: 1382273 - RNA, 19 nt, Homo sapiens
guaguauccuggcccuuca

SEQ ID NO: 1382274 - RNA, 19 nt, Homo sapiens
cugcaugaguauaacaauu

SEQ ID NO: 1382275 - RNA, 19 nt, Homo sapiens
ugaucuauauccugaugaa

SEQ ID NO: 1382276 - RNA, 19 nt, Homo sapiens
gagcaagagggucuggaaa

SEQ ID NO: 1382277 - RNA, 19 nt, Homo sapiens
uccacagaguuucauauuu

SEQ ID NO: 1382278 - RNA, 19 nt, Homo sapiens
agaauagugucuucaaagg

SEQ ID NO: 1382279 - RNA, 19 nt, Homo sapiens
gagucaaacaucucucaaa

SEQ ID NO: 1382280 - RNA, 19 nt, Homo sapiens
agacgaagcucuuuuccuu

SEQ ID NO: 1382281 - RNA, 19 nt, Homo sapiens
ucgacaaauucuuccagua

SEQ ID NO: 1382282 - RNA, 19 nt, Homo sapiens
aagaaaggaaucugacaaa

SEQ ID NO: 1382283 - RNA, 19 nt, Homo sapiens
cuacuucucuuugaacuac

SEQ ID NO: 1382284 - RNA, 19 nt, Homo sapiens
uggcacauccauauuugua

SEQ ID NO: 1382285 - RNA, 19 nt, Homo sapiens
gagauagacgaagcucuuu

SEQ ID NO: 1382286 - RNA, 19 nt, Homo sapiens
cugaugagucugaacauuu

SEQ ID NO: 1382287 - RNA, 19 nt, Homo sapiens
ccucuucucugaugagucu

SEQ ID NO: 1382288 - RNA, 19 nt, Homo sapiens
ucaauggucuagaauaucc

SEQ ID NO: 1382289 - RNA, 19 nt, Homo sapiens
ucagaaaauuggaccuuaa

SEQ ID NO: 1382290 - RNA, 19 nt, Homo sapiens
gcaaagcuagacugagcaa

SEQ ID NO: 1382291 - RNA, 19 nt, Homo sapiens
gagugcggcuuauaaacag

SEQ ID NO: 1382292 - RNA, 19 nt, Homo sapiens
gaugaacaggacuuauuug

SEQ ID NO: 1382293 - RNA, 19 nt, Homo sapiens
gaguucgucugagcaauca

SEQ ID NO: 1382294 - RNA, 19 nt, Homo sapiens
uuaaggcacuguuuuagaa

SEQ ID NO: 1382295 - RNA, 19 nt, Homo sapiens
ugaacuaccaauacuguug

SEQ ID NO: 1382296 - RNA, 19 nt, Homo sapiens
cgcagucaauggucuagaa

SEQ ID NO: 1382297 - RNA, 19 nt, Homo sapiens
aaagaaaggaaucugacaa

SEQ ID NO: 1382298 - RNA, 19 nt, Homo sapiens
aaacggaguugucuuugua

SEQ ID NO: 1382299 - RNA, 19 nt, Homo sapiens
ggaaagagaaggcaaagga

SEQ ID NO: 1382300 - RNA, 19 nt, Homo sapiens
gaaaugagaugugcuuagg

SEQ ID NO: 1382301 - RNA, 19 nt, Homo sapiens
gaaacggaguugucuuugu

SEQ ID NO: 1382302 - RNA, 19 nt, Homo sapiens
uaagaagucucugguggua

SEQ ID NO: 1382303 - RNA, 19 nt, Homo sapiens
gaauaaggacuaugugguu

SEQ ID NO: 1382304 - RNA, 19 nt, Homo sapiens
gaaaaguacugaacggaaa

SEQ ID NO: 1382305 - RNA, 19 nt, Homo sapiens
aaaggagucuguguucaua

SEQ ID NO: 1382306 - RNA, 19 nt, Homo sapiens
ccacuucccuacacaauuc

SEQ ID NO: 1382307 - RNA, 19 nt, Homo sapiens
ccauaugccugcagccuuu

SEQ ID NO: 1382308 - RNA, 19 nt, Homo sapiens
ccaggaguaucgugaguuu

SEQ ID NO: 1382309 - RNA, 19 nt, Homo sapiens
cgaauuagaauaaggacua

SEQ ID NO: 1382310 - RNA, 19 nt, Homo sapiens
caaaggauguggaaaugag

SEQ ID NO: 1382311 - RNA, 19 nt, Homo sapiens
gcucagaggucccgaacca

SEQ ID NO: 1382312 - RNA, 19 nt, Homo sapiens
gaaaggagucuguguucau

SEQ ID NO: 1382313 - RNA, 19 nt, Homo sapiens
ggucaaggcuguuuguacu

SEQ ID NO: 1382314 - RNA, 19 nt, Homo sapiens
gaacggaaacggaguuguc

SEQ ID NO: 1382315 - RNA, 19 nt, Homo sapiens
gagacuauuuggcgauuca

SEQ ID NO: 1382316 - RNA, 19 nt, Homo sapiens
ggcaaaggauguggaaaug

SEQ ID NO: 1382317 - RNA, 19 nt, Homo sapiens
gaauguugcugccuuugag

SEQ ID NO: 1382318 - RNA, 19 nt, Homo sapiens
gauaguaacuuuucuaagg

SEQ ID NO: 1382319 - RNA, 19 nt, Homo sapiens
guucuaugcuggcuggaaa

SEQ ID NO: 1382320 - RNA, 19 nt, Homo sapiens
aaugagaugugcuuaggaa

SEQ ID NO: 1382321 - RNA, 19 nt, Homo sapiens
ccguaagggucauuugaaa

SEQ ID NO: 1382322 - RNA, 19 nt, Homo sapiens
gcaaaggauguggaaauga

SEQ ID NO: 1382323 - RNA, 19 nt, Homo sapiens
ucaaggcuguuuguacuga

SEQ ID NO: 1382324 - RNA, 19 nt, Homo sapiens
gagaugugcuuaggaaagg

SEQ ID NO: 1382325 - RNA, 19 nt, Homo sapiens
gaaggcaaaggauguggaa

SEQ ID NO: 1382326 - RNA, 19 nt, Homo sapiens
gaaagagaaggcaaaggau

SEQ ID NO: 1382327 - RNA, 19 nt, Homo sapiens
ggaaaugagaugugcuuag

SEQ ID NO: 1382328 - RNA, 19 nt, Homo sapiens
gaggcuggcuuaccuucga

SEQ ID NO: 1382329 - RNA, 19 nt, Homo sapiens
uguaugaggugguguccaa

SEQ ID NO: 1382330 - RNA, 19 nt, Homo sapiens
caaugcaggagauguauga

SEQ ID NO: 1382331 - RNA, 19 nt, Homo sapiens
gcaaggggcuuucuuacca

SEQ ID NO: 1382332 - RNA, 19 nt, Homo sapiens
uaugcuggcuggaaauguu

SEQ ID NO: 1382333 - RNA, 19 nt, Homo sapiens
ggagucuguguucauaaua

SEQ ID NO: 1382334 - RNA, 19 nt, Homo sapiens
caccagugcugaggagaaa

SEQ ID NO: 1382335 - RNA, 19 nt, Homo sapiens
gguugucucuggaccuuau

SEQ ID NO: 1382336 - RNA, 19 nt, Homo sapiens
ccuacacaauucucuuauu

SEQ ID NO: 1382337 - RNA, 19 nt, Homo sapiens
caccugucauggaacguua

SEQ ID NO: 1382338 - RNA, 19 nt, Homo sapiens
acagaauguugcugccuuu

SEQ ID NO: 1382339 - RNA, 19 nt, Homo sapiens
cggaaacggaguugucuuu

SEQ ID NO: 1382340 - RNA, 19 nt, Homo sapiens
caucguaggagcaccauau

SEQ ID NO: 1382341 - RNA, 19 nt, Homo sapiens
gaaccugcacuguggacuu

SEQ ID NO: 1382342 - RNA, 19 nt, Homo sapiens
agaagucucuggugguauc

SEQ ID NO: 1382343 - RNA, 19 nt, Homo sapiens
cagagguacugagugguaa

SEQ ID NO: 1382344 - RNA, 19 nt, Homo sapiens
uguccaacguccaggagua

SEQ ID NO: 1382345 - RNA, 19 nt, Homo sapiens
cguuacaccucugcaguuu

SEQ ID NO: 1382346 - RNA, 19 nt, Homo sapiens
ggaaacggaguugucuuug

SEQ ID NO: 1382347 - RNA, 19 nt, Homo sapiens
cgaccaaugagguuucuga

SEQ ID NO: 1382348 - RNA, 19 nt, Homo sapiens
ccagcuggccaccauguuu

SEQ ID NO: 1382349 - RNA, 19 nt, Homo sapiens
acagagguacugaguggua

SEQ ID NO: 1382350 - RNA, 19 nt, Homo sapiens
ggucaggcccaucguagga

SEQ ID NO: 1382351 - RNA, 19 nt, Homo sapiens
gagucuguguucauaauac

SEQ ID NO: 1382352 - RNA, 19 nt, Homo sapiens
caagcucuucaaccacuua

SEQ ID NO: 1382353 - RNA, 19 nt, Homo sapiens
gguacucaaugcaggagau

SEQ ID NO: 1382354 - RNA, 19 nt, Homo sapiens
aaccugcacuguggacuuu

SEQ ID NO: 1382355 - RNA, 19 nt, Homo sapiens
gcaagcucuucaaccacuu

SEQ ID NO: 1382356 - RNA, 19 nt, Homo sapiens
gcugcucccuucaccaaca

SEQ ID NO: 1382357 - RNA, 19 nt, Homo sapiens
uagagacuauuuggcgauu

SEQ ID NO: 1382358 - RNA, 19 nt, Homo sapiens
ccacuuagagacuauuugg

SEQ ID NO: 1382359 - RNA, 19 nt, Homo sapiens
caugcugccuggcuacuag

SEQ ID NO: 1382360 - RNA, 19 nt, Homo sapiens
gaccuuaucaagacaccuu

SEQ ID NO: 1382361 - RNA, 19 nt, Homo sapiens
gcgauucagcccugguauu

SEQ ID NO: 1382362 - RNA, 19 nt, Homo sapiens
uuugugcccugguguaaga

SEQ ID NO: 1382363 - RNA, 19 nt, Homo sapiens
ggaguaucgugaguuugug

SEQ ID NO: 1382364 - RNA, 19 nt, Homo sapiens
gaguuguaccuuauucuuc

SEQ ID NO: 1382365 - RNA, 19 nt, Homo sapiens
ucaaccacuuagagacuau

SEQ ID NO: 1382366 - RNA, 19 nt, Homo sapiens
guacugauggcaagcucuu

SEQ ID NO: 1382367 - RNA, 19 nt, Homo sapiens
guaagggucauuugaaagc

SEQ ID NO: 1382368 - RNA, 19 nt, Homo sapiens
guaccuuauucuuccacuu

SEQ ID NO: 1382369 - RNA, 19 nt, Homo sapiens
ccuccagccugaaauacau

SEQ ID NO: 1382370 - RNA, 19 nt, Homo sapiens
aaauugagcuuuucuucug

SEQ ID NO: 1382371 - RNA, 19 nt, Homo sapiens
cuacgaauuagaauaagga

SEQ ID NO: 1382372 - RNA, 19 nt, Homo sapiens
cgauucagcccugguauuc

SEQ ID NO: 1382373 - RNA, 19 nt, Homo sapiens
ucucuggaccuuaucaaga

SEQ ID NO: 1382374 - RNA, 19 nt, Homo sapiens
uggcuccuguuccaauuug

SEQ ID NO: 1382375 - RNA, 19 nt, Homo sapiens
gccguaagggucauuugaa

SEQ ID NO: 1382376 - RNA, 19 nt, Homo sapiens
acucaaugcaggagaugua

SEQ ID NO: 1382377 - RNA, 19 nt, Homo sapiens
cuguuucuccucucaauuu

SEQ ID NO: 1382378 - RNA, 19 nt, Homo sapiens
aggagucuguguucauaau

SEQ ID NO: 1382379 - RNA, 19 nt, Homo sapiens
ucccugaccucccuucuac

SEQ ID NO: 1382380 - RNA, 19 nt, Homo sapiens
gaguuugugcccuggugua

SEQ ID NO: 1382381 - RNA, 19 nt, Homo sapiens
uaccuuauucuuccacuug

SEQ ID NO: 1382382 - RNA, 19 nt, Homo sapiens
uaaggacuaugugguuguc

SEQ ID NO: 1382383 - RNA, 19 nt, Homo sapiens
ucccuacacaauucucuua

SEQ ID NO: 1382384 - RNA, 19 nt, Homo sapiens
ucgauuuccuuugaauuuc

SEQ ID NO: 1382385 - RNA, 19 nt, Homo sapiens
ugaguuguaccuuauucuu

SEQ ID NO: 1382386 - RNA, 19 nt, Homo sapiens
gccguuccuucaugggauu

SEQ ID NO: 1382387 - RNA, 19 nt, Homo sapiens
ugagaugugcuuaggaaag

SEQ ID NO: 1382388 - RNA, 19 nt, Homo sapiens
aggcaaaggauguggaaau

SEQ ID NO: 1382389 - RNA, 19 nt, Homo sapiens
aagagaaggcaaaggaugu

SEQ ID NO: 1382390 - RNA, 19 nt, Homo sapiens
ccaccagugcugaggagaa

SEQ ID NO: 1382391 - RNA, 19 nt, Homo sapiens
agaauguugcugccuuuga

SEQ ID NO: 1382392 - RNA, 19 nt, Homo sapiens
gaaagcccagcuggagguu

SEQ ID NO: 1382393 - RNA, 19 nt, Homo sapiens
gaccaggggacgauaguaa

SEQ ID NO: 1382394 - RNA, 19 nt, Homo sapiens
gugguugucucuggaccuu

SEQ ID NO: 1382395 - RNA, 19 nt, Homo sapiens
gauguggaaaugagaugug

SEQ ID NO: 1382396 - RNA, 19 nt, Homo sapiens
caauuugaaaggagucugu

SEQ ID NO: 1382397 - RNA, 19 nt, Homo sapiens
ccagcuggagguuggcuuu

SEQ ID NO: 1382398 - RNA, 19 nt, Homo sapiens
guaaaggccuuaauauugu

SEQ ID NO: 1382399 - RNA, 19 nt, Homo sapiens
gagcuuaacauauggaaua

SEQ ID NO: 1382400 - RNA, 19 nt, Homo sapiens
gaagguggucuacauauaa

SEQ ID NO: 1382401 - RNA, 19 nt, Homo sapiens
ugaauuaccugaagacauc

SEQ ID NO: 1382402 - RNA, 19 nt, Homo sapiens
gaauuaaggcguauaaauc

SEQ ID NO: 1382403 - RNA, 19 nt, Homo sapiens
aacaagagcuuaacauaug

SEQ ID NO: 1382404 - RNA, 19 nt, Homo sapiens
ugaagguggucuacauaua

SEQ ID NO: 1382405 - RNA, 19 nt, Homo sapiens
uuacugaaauggacaagaa

SEQ ID NO: 1382406 - RNA, 19 nt, Homo sapiens
ccaagaaauuacugaaaug

SEQ ID NO: 1382407 - RNA, 19 nt, Homo sapiens
uguaaaggccuuaauauug

SEQ ID NO: 1382408 - RNA, 19 nt, Homo sapiens
ggagaaaguggcacagaaa

SEQ ID NO: 1382409 - RNA, 19 nt, Homo sapiens
gaagacaucaggagaauac

SEQ ID NO: 1382410 - RNA, 19 nt, Homo sapiens
aaaggacggucgacaaaug

SEQ ID NO: 1382411 - RNA, 19 nt, Homo sapiens
guucuuuaauguucccuua

SEQ ID NO: 1382412 - RNA, 19 nt, Homo sapiens
gcagaugaaaugugugaaa

SEQ ID NO: 1382413 - RNA, 19 nt, Homo sapiens
gaaucuuccucauuugaug

SEQ ID NO: 1382414 - RNA, 19 nt, Homo sapiens
gaaauuaauguccuucaca

SEQ ID NO: 1382415 - RNA, 19 nt, Homo sapiens
ucacuggcaucccaucuug

SEQ ID NO: 1382416 - RNA, 19 nt, Homo sapiens
cuaacaagagcuuaacaua

SEQ ID NO: 1382417 - RNA, 19 nt, Homo sapiens
uaaaagccauguuaucuug

SEQ ID NO: 1382418 - RNA, 19 nt, Homo sapiens
aaaagagccuguacuguuu

SEQ ID NO: 1382419 - RNA, 19 nt, Homo sapiens
ugaaaggacggucgacaaa

SEQ ID NO: 1382420 - RNA, 19 nt, Homo sapiens
cagcauaaacucagagaug

SEQ ID NO: 1382421 - RNA, 19 nt, Homo sapiens
cagaugauggugaugauuu

SEQ ID NO: 1382422 - RNA, 19 nt, Homo sapiens
ugccugagauuuaccugua

SEQ ID NO: 1382423 - RNA, 19 nt, Homo sapiens
caaagcagcagcauaaacu

SEQ ID NO: 1382424 - RNA, 19 nt, Homo sapiens
caucccaucuugcaucuca

SEQ ID NO: 1382425 - RNA, 19 nt, Homo sapiens
guaccuaacaagagcuuaa

SEQ ID NO: 1382426 - RNA, 19 nt, Homo sapiens
uaaaagagccuguacuguu

SEQ ID NO: 1382427 - RNA, 19 nt, Homo sapiens
ggucucauuuguauuucuu

SEQ ID NO: 1382428 - RNA, 19 nt, Homo sapiens
gacaucaggagaauacaaa

SEQ ID NO: 1382429 - RNA, 19 nt, Homo sapiens
gguggucuacauauaauuu

SEQ ID NO: 1382430 - RNA, 19 nt, Homo sapiens
gaaaggacggucgacaaau

SEQ ID NO: 1382431 - RNA, 19 nt, Homo sapiens
gcagcagcauaaacucaga

SEQ ID NO: 1382432 - RNA, 19 nt, Homo sapiens
ucaggagaauacaaacuug

SEQ ID NO: 1382433 - RNA, 19 nt, Homo sapiens
ggagauguccuuugcuucu

SEQ ID NO: 1382434 - RNA, 19 nt, Homo sapiens
gaugaaaugugugaaaaga

SEQ ID NO: 1382435 - RNA, 19 nt, Homo sapiens
uggagaaaguggcacagaa

SEQ ID NO: 1382436 - RNA, 19 nt, Homo sapiens
gccuuaauauuguacauag

SEQ ID NO: 1382437 - RNA, 19 nt, Homo sapiens
cauggagcaucaggagaua

SEQ ID NO: 1382438 - RNA, 19 nt, Homo sapiens
guccuuugcuucucagaug

SEQ ID NO: 1382439 - RNA, 19 nt, Homo sapiens
auacaaacuugcagguguu

SEQ ID NO: 1382440 - RNA, 19 nt, Homo sapiens
acuagaugcuguuuguuug

SEQ ID NO: 1382441 - RNA, 19 nt, Homo sapiens
gcauaaacucagagaugaa

SEQ ID NO: 1382442 - RNA, 19 nt, Homo sapiens
uaaggcguauaaaucaguu

SEQ ID NO: 1382443 - RNA, 19 nt, Homo sapiens
cagcagaugaaauguguga

SEQ ID NO: 1382444 - RNA, 19 nt, Homo sapiens
gaaaguggcacagaaaaug

SEQ ID NO: 1382445 - RNA, 19 nt, Homo sapiens
agcauaaacucagagauga

SEQ ID NO: 1382446 - RNA, 19 nt, Homo sapiens
uauugaagguggucuacau

SEQ ID NO: 1382447 - RNA, 19 nt, Homo sapiens
ugaaauggacaagaaaugu

SEQ ID NO: 1382448 - RNA, 19 nt, Homo sapiens
gauccaagaaauuacugaa

SEQ ID NO: 1382449 - RNA, 19 nt, Homo sapiens
gagcaucaggagauaugaa

SEQ ID NO: 1382450 - RNA, 19 nt, Homo sapiens
ucuugcaucucauggguuu

SEQ ID NO: 1382451 - RNA, 19 nt, Homo sapiens
gcagcugcuucuguaaugu

SEQ ID NO: 1382452 - RNA, 19 nt, Homo sapiens
aaaagaacuuguuggagaa

SEQ ID NO: 1382453 - RNA, 19 nt, Homo sapiens
uacuagaugcuguuuguuu

SEQ ID NO: 1382454 - RNA, 19 nt, Homo sapiens
ucuuggaggucguucaaug

SEQ ID NO: 1382455 - RNA, 19 nt, Homo sapiens
gugaaaggacggucgacaa

SEQ ID NO: 1382456 - RNA, 19 nt, Homo sapiens
auccaaagcagcagcauaa

SEQ ID NO: 1382457 - RNA, 19 nt, Homo sapiens
cuguaaaggccuuaauauu

SEQ ID NO: 1382458 - RNA, 19 nt, Homo sapiens
aagguggucuacauauaau

SEQ ID NO: 1382459 - RNA, 19 nt, Homo sapiens
caagaaauuacugaaaugg

SEQ ID NO: 1382460 - RNA, 19 nt, Homo sapiens
gagccuguacuguuugugu

SEQ ID NO: 1382461 - RNA, 19 nt, Homo sapiens
gccagaugauggugaugau

SEQ ID NO: 1382462 - RNA, 19 nt, Homo sapiens
ggacggucgacaaaugaug

SEQ ID NO: 1382463 - RNA, 19 nt, Homo sapiens
cagaugaaaugugugaaaa

SEQ ID NO: 1382464 - RNA, 19 nt, Homo sapiens
auuacuagaugcuguuugu

SEQ ID NO: 1382465 - RNA, 19 nt, Homo sapiens
cauccaaagcagcagcaua

SEQ ID NO: 1382466 - RNA, 19 nt, Homo sapiens
ggccuuaauauuguacaua

SEQ ID NO: 1382467 - RNA, 19 nt, Homo sapiens
ccuguaaaggccuuaauau

SEQ ID NO: 1382468 - RNA, 19 nt, Homo sapiens
cuucucagauguaaaugca

SEQ ID NO: 1382469 - RNA, 19 nt, Homo sapiens
cagacuaauuugauguucu

SEQ ID NO: 1382470 - RNA, 19 nt, Homo sapiens
acaagagcuuaacauaugg

SEQ ID NO: 1382471 - RNA, 19 nt, Homo sapiens
cucagcagaugaaaugugu

SEQ ID NO: 1382472 - RNA, 19 nt, Homo sapiens
gcucagcagaugaaaugug

SEQ ID NO: 1382473 - RNA, 19 nt, Homo sapiens
gcuguuuguuugguaccua

SEQ ID NO: 1382474 - RNA, 19 nt, Homo sapiens
acacagauuuuguuuugga

SEQ ID NO: 1382475 - RNA, 19 nt, Homo sapiens
ugagucauacagagguuaa

SEQ ID NO: 1382476 - RNA, 19 nt, Homo sapiens
gucauacagagguuaaauu

SEQ ID NO: 1382477 - RNA, 19 nt, Homo sapiens
gcguauaaaucaguuuuga

SEQ ID NO: 1382478 - RNA, 19 nt, Homo sapiens
aaugcaagcuccccauaaa

SEQ ID NO: 1382479 - RNA, 19 nt, Homo sapiens
ccaaagcagcagcauaaac

SEQ ID NO: 1382480 - RNA, 19 nt, Homo sapiens
ucagcauugugagauauau

SEQ ID NO: 1382481 - RNA, 19 nt, Homo sapiens
aggcucagcagaugaaaug

SEQ ID NO: 1382482 - RNA, 19 nt, Homo sapiens
ucuuacacauggagcauca

SEQ ID NO: 1382483 - RNA, 19 nt, Homo sapiens
ugagccagaugauggugau

SEQ ID NO: 1382484 - RNA, 19 nt, Homo sapiens
ggggagauguccuuugcuu

SEQ ID NO: 1382485 - RNA, 19 nt, Homo sapiens
ucagacuaauuugauguuc

SEQ ID NO: 1382486 - RNA, 19 nt, Homo sapiens
aaagccauguuaucuugag

SEQ ID NO: 1382487 - RNA, 19 nt, Homo sapiens
gagaaaguggcacagaaaa

SEQ ID NO: 1382488 - RNA, 19 nt, Homo sapiens
gcauugugagauauauuuc

SEQ ID NO: 1382489 - RNA, 19 nt, Homo sapiens
agaugcuguuuguuuggua

SEQ ID NO: 1382490 - RNA, 19 nt, Homo sapiens
gacggucgacaaaugaugu

SEQ ID NO: 1382491 - RNA, 19 nt, Homo sapiens
agacaucaggagaauacaa

SEQ ID NO: 1382492 - RNA, 19 nt, Homo sapiens
ugaagacaucaggagaaua

SEQ ID NO: 1382493 - RNA, 19 nt, Homo sapiens
gaaaggaggcuucccagua

SEQ ID NO: 1382494 - RNA, 19 nt, Homo sapiens
guaauuuccuugccaguuu

SEQ ID NO: 1382495 - RNA, 19 nt, Homo sapiens
ggagguaucugcaaggaau

SEQ ID NO: 1382496 - RNA, 19 nt, Homo sapiens
ugaagaaccuggacuugaa

SEQ ID NO: 1382497 - RNA, 19 nt, Homo sapiens
cagaaaggcugauuagcaa

SEQ ID NO: 1382498 - RNA, 19 nt, Homo sapiens
gcgcagcccuaccuucuuu

SEQ ID NO: 1382499 - RNA, 19 nt, Homo sapiens
gaggaaggcucaugaaagg

SEQ ID NO: 1382500 - RNA, 19 nt, Homo sapiens
aaaggaggcuucccaguau

SEQ ID NO: 1382501 - RNA, 19 nt, Homo sapiens
caaggaauguauaaaguuc

SEQ ID NO: 1382502 - RNA, 19 nt, Homo sapiens
uagaguggaucuguaguua

SEQ ID NO: 1382503 - RNA, 19 nt, Homo sapiens
acacauacuucugcagaua

SEQ ID NO: 1382504 - RNA, 19 nt, Homo sapiens
gcaaggaauguauaaaguu

SEQ ID NO: 1382505 - RNA, 19 nt, Homo sapiens
gagagaccaugcaucugaa

SEQ ID NO: 1382506 - RNA, 19 nt, Homo sapiens
gaaaggcugauuagcaaga

SEQ ID NO: 1382507 - RNA, 19 nt, Homo sapiens
ccaguagaguggaucugua

SEQ ID NO: 1382508 - RNA, 19 nt, Homo sapiens
acaugaaaguguauuguug

SEQ ID NO: 1382509 - RNA, 19 nt, Homo sapiens
ccacguguauaauggaaau

SEQ ID NO: 1382510 - RNA, 19 nt, Homo sapiens
gaacaagcugcguaacugu

SEQ ID NO: 1382511 - RNA, 19 nt, Homo sapiens
ugaacaagcugcguaacug

SEQ ID NO: 1382512 - RNA, 19 nt, Homo sapiens
guucagguaucuguuguga

SEQ ID NO: 1382513 - RNA, 19 nt, Homo sapiens
uggcgggucuucagcgaua

SEQ ID NO: 1382514 - RNA, 19 nt, Homo sapiens
ucagguaucuguugugacu

SEQ ID NO: 1382515 - RNA, 19 nt, Homo sapiens
ccaacaggauagcaaggaa

SEQ ID NO: 1382516 - RNA, 19 nt, Homo sapiens
agagagaccaugcaucuga

SEQ ID NO: 1382517 - RNA, 19 nt, Homo sapiens
caaguuaggccuaucuaca

SEQ ID NO: 1382518 - RNA, 19 nt, Homo sapiens
ggaguucagguaucuguug

SEQ ID NO: 1382519 - RNA, 19 nt, Homo sapiens
caugggaccucagcaacaa

SEQ ID NO: 1382520 - RNA, 19 nt, Homo sapiens
ccagagagaccaugcaucu

SEQ ID NO: 1382521 - RNA, 19 nt, Homo sapiens
caacaggauagcaaggaaa

SEQ ID NO: 1382522 - RNA, 19 nt, Homo sapiens
ggagaggagugugccaucu

SEQ ID NO: 1382523 - RNA, 19 nt, Homo sapiens
guagaguggaucuguaguu

SEQ ID NO: 1382524 - RNA, 19 nt, Homo sapiens
ggacuugaagcaggaggua

SEQ ID NO: 1382525 - RNA, 19 nt, Homo sapiens
gccaguuucugagauauca

SEQ ID NO: 1382526 - RNA, 19 nt, Homo sapiens
gacacucagcagcaaguua

SEQ ID NO: 1382527 - RNA, 19 nt, Homo sapiens
ucacugugguaauuuccuu

SEQ ID NO: 1382528 - RNA, 19 nt, Homo sapiens
gaguucagguaucuguugu

SEQ ID NO: 1382529 - RNA, 19 nt, Homo sapiens
gggccgugauggacgugua

SEQ ID NO: 1382530 - RNA, 19 nt, Homo sapiens
ugcaaggaauguauaaagu

SEQ ID NO: 1382531 - RNA, 19 nt, Homo sapiens
ccuccuggguauugaagaa

SEQ ID NO: 1382532 - RNA, 19 nt, Homo sapiens
gaagaaccuggacuugaag

SEQ ID NO: 1382533 - RNA, 19 nt, Homo sapiens
gaguggaucuguaguuacc

SEQ ID NO: 1382534 - RNA, 19 nt, Homo sapiens
uaucugcaaggaauguaua

SEQ ID NO: 1382535 - RNA, 19 nt, Homo sapiens
ugagggaguucagguaucu

SEQ ID NO: 1382536 - RNA, 19 nt, Homo sapiens
gguaauuuccuugccaguu

SEQ ID NO: 1382537 - RNA, 19 nt, Homo sapiens
cacgauaccugggccaauc

SEQ ID NO: 1382538 - RNA, 19 nt, Homo sapiens
caggagguaucugcaagga

SEQ ID NO: 1382539 - RNA, 19 nt, Homo sapiens
gagaggcacuucgcuucca

SEQ ID NO: 1382540 - RNA, 19 nt, Homo sapiens
cuugccaguuucugagaua

SEQ ID NO: 1382541 - RNA, 19 nt, Homo sapiens
uaauuuccuugccaguuuc

SEQ ID NO: 1382542 - RNA, 19 nt, Homo sapiens
ggucaugaggucccagaga

SEQ ID NO: 1382543 - RNA, 19 nt, Homo sapiens
aguuaggccuaucuacaaa

SEQ ID NO: 1382544 - RNA, 19 nt, Homo sapiens
uguugucacugugguaauu

SEQ ID NO: 1382545 - RNA, 19 nt, Homo sapiens
caugaaaguguauuguugu

SEQ ID NO: 1382546 - RNA, 19 nt, Homo sapiens
ggugcuuuguuuagagaug

SEQ ID NO: 1382547 - RNA, 19 nt, Homo sapiens
acacucagcagcaaguuag

SEQ ID NO: 1382548 - RNA, 19 nt, Homo sapiens
uuaggccuaucuacaaauc

SEQ ID NO: 1382549 - RNA, 19 nt, Homo sapiens
gagaggagugugccaucug

SEQ ID NO: 1382550 - RNA, 19 nt, Homo sapiens
gagaccaugcaucugaaga

SEQ ID NO: 1382551 - RNA, 19 nt, Homo sapiens
gaguugccaugaggacugu

SEQ ID NO: 1382552 - RNA, 19 nt, Homo sapiens
gcaaguuaggccuaucuac

SEQ ID NO: 1382553 - RNA, 19 nt, Homo sapiens
gcaagaggugcggcagaga

SEQ ID NO: 1382554 - RNA, 19 nt, Homo sapiens
gcagcaaguuaggccuauc

SEQ ID NO: 1382555 - RNA, 19 nt, Homo sapiens
aaguuaggccuaucuacaa

SEQ ID NO: 1382556 - RNA, 19 nt, Homo sapiens
acaauaaacaggaccuuuu

SEQ ID NO: 1382557 - RNA, 19 nt, Homo sapiens
uugaagaaccuggacuuga

SEQ ID NO: 1382558 - RNA, 19 nt, Homo sapiens
uacaauaaacaggaccuuu

SEQ ID NO: 1382559 - RNA, 19 nt, Homo sapiens
ccaccagccucgucacaua

SEQ ID NO: 1382560 - RNA, 19 nt, Homo sapiens
caacugggaugccauaaac

SEQ ID NO: 1382561 - RNA, 19 nt, Homo sapiens
gaacacuccuuuccucaac

SEQ ID NO: 1382562 - RNA, 19 nt, Homo sapiens
gggaggauuucaaacagaa

SEQ ID NO: 1382563 - RNA, 19 nt, Homo sapiens
cggaggaaauggacauaaa

SEQ ID NO: 1382564 - RNA, 19 nt, Homo sapiens
cagcuugucucuccuuguu

SEQ ID NO: 1382565 - RNA, 19 nt, Homo sapiens
gggaugccauaaacaagaa

SEQ ID NO: 1382566 - RNA, 19 nt, Homo sapiens
ucaaacagaacacuccuuu

SEQ ID NO: 1382567 - RNA, 19 nt, Homo sapiens
caacuggaaagcaauuauu

SEQ ID NO: 1382568 - RNA, 19 nt, Homo sapiens
gcgaacaggcaauuucuug

SEQ ID NO: 1382569 - RNA, 19 nt, Homo sapiens
gggaaguacucagucaaga

SEQ ID NO: 1382570 - RNA, 19 nt, Homo sapiens
cuuccaagaacuacaauua

SEQ ID NO: 1382571 - RNA, 19 nt, Homo sapiens
cauaaacccgggugugaaa

SEQ ID NO: 1382572 - RNA, 19 nt, Homo sapiens
gacauaaacccggguguga

SEQ ID NO: 1382573 - RNA, 19 nt, Homo sapiens
ccugggauguuuaacuuug

SEQ ID NO: 1382574 - RNA, 19 nt, Homo sapiens
ggugggaaguacucaguca

SEQ ID NO: 1382575 - RNA, 19 nt, Homo sapiens
acaccagcaucuuucugua

SEQ ID NO: 1382576 - RNA, 19 nt, Homo sapiens
uccaagaacuacaauuaca

SEQ ID NO: 1382577 - RNA, 19 nt, Homo sapiens
gcuugucucuccuuguuuc

SEQ ID NO: 1382578 - RNA, 19 nt, Homo sapiens
ccaagaacuacaauuacaa

SEQ ID NO: 1382579 - RNA, 19 nt, Homo sapiens
gcagcgaccaacaggcuaa

SEQ ID NO: 1382580 - RNA, 19 nt, Homo sapiens
uaacuuccaagaacuacaa

SEQ ID NO: 1382581 - RNA, 19 nt, Homo sapiens
caagcuggguuucaucaac

SEQ ID NO: 1382582 - RNA, 19 nt, Homo sapiens
ugaaucuuguuucccuaaa

SEQ ID NO: 1382583 - RNA, 19 nt, Homo sapiens
ggagguggcagcuguaacu

SEQ ID NO: 1382584 - RNA, 19 nt, Homo sapiens
cgucaucacugcagaaacg

SEQ ID NO: 1382585 - RNA, 19 nt, Homo sapiens
cacauacaccagcaucuuu

SEQ ID NO: 1382586 - RNA, 19 nt, Homo sapiens
ugugacaguucuccaggaa

SEQ ID NO: 1382587 - RNA, 19 nt, Homo sapiens
gaaucuuguuucccuaaaa

SEQ ID NO: 1382588 - RNA, 19 nt, Homo sapiens
gcaggagguggcagcugua

SEQ ID NO: 1382589 - RNA, 19 nt, Homo sapiens
uuaaauccaagcuggguuu

SEQ ID NO: 1382590 - RNA, 19 nt, Homo sapiens
gcuguaacuuccaagaacu

SEQ ID NO: 1382591 - RNA, 19 nt, Homo sapiens
gcgaccaacaggcuaaaga

SEQ ID NO: 1382592 - RNA, 19 nt, Homo sapiens
ucacauacaccagcaucuu

SEQ ID NO: 1382593 - RNA, 19 nt, Homo sapiens
ggaggaaauggacauaaac

SEQ ID NO: 1382594 - RNA, 19 nt, Homo sapiens
aaacagaacacuccuuucc

SEQ ID NO: 1382595 - RNA, 19 nt, Homo sapiens
cccgagcccuccucuacuu

SEQ ID NO: 1382596 - RNA, 19 nt, Homo sapiens
ucaacugggaugccauaaa

SEQ ID NO: 1382597 - RNA, 19 nt, Homo sapiens
gacgucuccugggauguuu

SEQ ID NO: 1382598 - RNA, 19 nt, Homo sapiens
cuccugggauguuuaacuu

SEQ ID NO: 1382599 - RNA, 19 nt, Homo sapiens
caagaacuacaauuacaac

SEQ ID NO: 1382600 - RNA, 19 nt, Homo sapiens
ggaaguacucagucaagac

SEQ ID NO: 1382601 - RNA, 19 nt, Homo sapiens
gcagcuguaacuuccaaga

SEQ ID NO: 1382602 - RNA, 19 nt, Homo sapiens
ugggaggauuucaaacaga

SEQ ID NO: 1382603 - RNA, 19 nt, Homo sapiens
gcggaggaaauggacauaa

SEQ ID NO: 1382604 - RNA, 19 nt, Homo sapiens
cagcuguaacuuccaagaa

SEQ ID NO: 1382605 - RNA, 19 nt, Homo sapiens
guuuaacuuugacacuuuc

SEQ ID NO: 1382606 - RNA, 19 nt, Homo sapiens
aauccaagcuggguuucau

SEQ ID NO: 1382607 - RNA, 19 nt, Homo sapiens
ugucucuccuuguuucuuc

SEQ ID NO: 1382608 - RNA, 19 nt, Homo sapiens
uggcagcuguaacuuccaa

SEQ ID NO: 1382609 - RNA, 19 nt, Homo sapiens
ucaacuggaaagcaauuau

SEQ ID NO: 1382610 - RNA, 19 nt, Homo sapiens
gugaaaagccagggaauga

SEQ ID NO: 1382611 - RNA, 19 nt, Homo sapiens
caaacagaacacuccuuuc

SEQ ID NO: 1382612 - RNA, 19 nt, Homo sapiens
uucuguaccuccucccuuu

SEQ ID NO: 1382613 - RNA, 19 nt, Homo sapiens
gaaaagccagggaaugaag

SEQ ID NO: 1382614 - RNA, 19 nt, Homo sapiens
cugggauguuuaacuuuga

SEQ ID NO: 1382615 - RNA, 19 nt, Homo sapiens
gaggauuucaaacagaaca

SEQ ID NO: 1382616 - RNA, 19 nt, Homo sapiens
ggacaguggugaccugcua

SEQ ID NO: 1382617 - RNA, 19 nt, Homo sapiens
gagguacucugcugaaguu

SEQ ID NO: 1382618 - RNA, 19 nt, Homo sapiens
caacacgaaucacucacuu

SEQ ID NO: 1382619 - RNA, 19 nt, Homo sapiens
gcagugaggugaaugucau

SEQ ID NO: 1382620 - RNA, 19 nt, Homo sapiens
ugacgggucuccacucaug

SEQ ID NO: 1382621 - RNA, 19 nt, Homo sapiens
ggagucaguccucaucgua

SEQ ID NO: 1382622 - RNA, 19 nt, Homo sapiens
gagcacagguguccuugac

SEQ ID NO: 1382623 - RNA, 19 nt, Homo sapiens
ggaaacaacacgaaucacu

SEQ ID NO: 1382624 - RNA, 19 nt, Homo sapiens
ucccaucccuggcagagua

SEQ ID NO: 1382625 - RNA, 19 nt, Homo sapiens
guagucagcaacaacauug

SEQ ID NO: 1382626 - RNA, 19 nt, Homo sapiens
uuucagcggugauacugua

SEQ ID NO: 1382627 - RNA, 19 nt, Homo sapiens
gggcagggaaggacaguga

SEQ ID NO: 1382628 - RNA, 19 nt, Homo sapiens
gaaggacagugagguacuc

SEQ ID NO: 1382629 - RNA, 19 nt, Homo sapiens
ggagggcagugaggugaau

SEQ ID NO: 1382630 - RNA, 19 nt, Homo sapiens
aaacaacacgaaucacuca

SEQ ID NO: 1382631 - RNA, 19 nt, Homo sapiens
uaggagcucccaagcagaa

SEQ ID NO: 1382632 - RNA, 19 nt, Homo sapiens
ggccguggcagggaaguaa

SEQ ID NO: 1382633 - RNA, 19 nt, Homo sapiens
ugacuggaaacaacacgaa

SEQ ID NO: 1382634 - RNA, 19 nt, Homo sapiens
ggaaggacagugagguacu

SEQ ID NO: 1382635 - RNA, 19 nt, Homo sapiens
gcugcagcccagugaguuu

SEQ ID NO: 1382636 - RNA, 19 nt, Homo sapiens
ucugacgggucuccacuca

SEQ ID NO: 1382637 - RNA, 19 nt, Homo sapiens
ggugagcacagguguccuu

SEQ ID NO: 1382638 - RNA, 19 nt, Homo sapiens
ggagauccgcaaggucuuc

SEQ ID NO: 1382639 - RNA, 19 nt, Homo sapiens
gagagaaacuaaacacaua

SEQ ID NO: 1382640 - RNA, 19 nt, Homo sapiens
ucagagaacuugccagaua

SEQ ID NO: 1382641 - RNA, 19 nt, Homo sapiens
gaacaccacucugugcuaa

SEQ ID NO: 1382642 - RNA, 19 nt, Homo sapiens
gaaauaagaaccuagcauu

SEQ ID NO: 1382643 - RNA, 19 nt, Homo sapiens
ccucggagcuccacaguaa

SEQ ID NO: 1382644 - RNA, 19 nt, Homo sapiens
caacagagagagaaacuaa

SEQ ID NO: 1382645 - RNA, 19 nt, Homo sapiens
caacauggguuauauucau

SEQ ID NO: 1382646 - RNA, 19 nt, Homo sapiens
gaaacuaaacacauacgua

SEQ ID NO: 1382647 - RNA, 19 nt, Homo sapiens
gaagugaaauaagaaccua

SEQ ID NO: 1382648 - RNA, 19 nt, Homo sapiens
gaaaaugucuucagaucuu

SEQ ID NO: 1382649 - RNA, 19 nt, Homo sapiens
gagcuugccuuguaaucaa

SEQ ID NO: 1382650 - RNA, 19 nt, Homo sapiens
gauggugcuugcucuauuu

SEQ ID NO: 1382651 - RNA, 19 nt, Homo sapiens
guuuggagcuugccuugua

SEQ ID NO: 1382652 - RNA, 19 nt, Homo sapiens
ccagugaacucaacaugug

SEQ ID NO: 1382653 - RNA, 19 nt, Homo sapiens
uuggaaagcuucaaacaga

SEQ ID NO: 1382654 - RNA, 19 nt, Homo sapiens
ucugagaagugaaauaaga

SEQ ID NO: 1382655 - RNA, 19 nt, Homo sapiens
gacaguaggaucccaguaa

SEQ ID NO: 1382656 - RNA, 19 nt, Homo sapiens
ggucugagaagugaaauaa

SEQ ID NO: 1382657 - RNA, 19 nt, Homo sapiens
uaaaaucccugccuucuug

SEQ ID NO: 1382658 - RNA, 19 nt, Homo sapiens
gcagagaaacagcuggaaa

SEQ ID NO: 1382659 - RNA, 19 nt, Homo sapiens
gagacaagaagacugguaa

SEQ ID NO: 1382660 - RNA, 19 nt, Homo sapiens
acaguaggaucccaguaaa

SEQ ID NO: 1382661 - RNA, 19 nt, Homo sapiens
caguggaccugaagaagga

SEQ ID NO: 1382662 - RNA, 19 nt, Homo sapiens
gaacuugccagauagaaaa

SEQ ID NO: 1382663 - RNA, 19 nt, Homo sapiens
cccaucaucuuaauguuug

SEQ ID NO: 1382664 - RNA, 19 nt, Homo sapiens
ggaaagcuucaaacagaga

SEQ ID NO: 1382665 - RNA, 19 nt, Homo sapiens
gcacagggaggacguacug

SEQ ID NO: 1382666 - RNA, 19 nt, Homo sapiens
agacuuaaauggagaacca

SEQ ID NO: 1382667 - RNA, 19 nt, Homo sapiens
cagagaacuugccagauag

SEQ ID NO: 1382668 - RNA, 19 nt, Homo sapiens
aauaagaaccuagcauuug

SEQ ID NO: 1382669 - RNA, 19 nt, Homo sapiens
gaugggaaacucacagaug

SEQ ID NO: 1382670 - RNA, 19 nt, Homo sapiens
acaguaaggaugccaauga

SEQ ID NO: 1382671 - RNA, 19 nt, Homo sapiens
uauccaacauggguuauau

SEQ ID NO: 1382672 - RNA, 19 nt, Homo sapiens
aguaggaucccaguaaaua

SEQ ID NO: 1382673 - RNA, 19 nt, Homo sapiens
ggaaacuggcucccugaga

SEQ ID NO: 1382674 - RNA, 19 nt, Homo sapiens
gcccaucaucuuaauguuu

SEQ ID NO: 1382675 - RNA, 19 nt, Homo sapiens
cuauuuggcuccuaacagu

SEQ ID NO: 1382676 - RNA, 19 nt, Homo sapiens
auaagaaccuagcauuugg

SEQ ID NO: 1382677 - RNA, 19 nt, Homo sapiens
aggaggagcuggccuacug

SEQ ID NO: 1382678 - RNA, 19 nt, Homo sapiens
uaaaaugugucuuguccaa

SEQ ID NO: 1382679 - RNA, 19 nt, Homo sapiens
guugagaggguuauuggaa

SEQ ID NO: 1382680 - RNA, 19 nt, Homo sapiens
augggaaacucacagauga

SEQ ID NO: 1382681 - RNA, 19 nt, Homo sapiens
ugcggaagcugcugaggaa

SEQ ID NO: 1382682 - RNA, 19 nt, Homo sapiens
caguaaauauggguugaau

SEQ ID NO: 1382683 - RNA, 19 nt, Homo sapiens
guaggaucccaguaaauau

SEQ ID NO: 1382684 - RNA, 19 nt, Homo sapiens
gaaagcuucaaacagagaa

SEQ ID NO: 1382685 - RNA, 19 nt, Homo sapiens
caguaaggaugccaaugau

SEQ ID NO: 1382686 - RNA, 19 nt, Homo sapiens
gccaggaguucuucuucga

SEQ ID NO: 1382687 - RNA, 19 nt, Homo sapiens
caacaggaucagagaacuu

SEQ ID NO: 1382688 - RNA, 19 nt, Homo sapiens
guaaucaacagagagagaa

SEQ ID NO: 1382689 - RNA, 19 nt, Homo sapiens
uugagaggguuauuggaaa

SEQ ID NO: 1382690 - RNA, 19 nt, Homo sapiens
agauggugcuugcucuauu

SEQ ID NO: 1382691 - RNA, 19 nt, Homo sapiens
gauggucugagaagugaaa

SEQ ID NO: 1382692 - RNA, 19 nt, Homo sapiens
uauuaggccaucagucaua

SEQ ID NO: 1382693 - RNA, 19 nt, Homo sapiens
gggcggagaugucuuuuag

SEQ ID NO: 1382694 - RNA, 19 nt, Homo sapiens
gaagaugacaaugccaauc

SEQ ID NO: 1382695 - RNA, 19 nt, Homo sapiens
cuaaacacauacguaagau

SEQ ID NO: 1382696 - RNA, 19 nt, Homo sapiens
uggguaacaucaccucgaa

SEQ ID NO: 1382697 - RNA, 19 nt, Homo sapiens
ggagcuugccuuguaauca

SEQ ID NO: 1382698 - RNA, 19 nt, Homo sapiens
ggaugccaaugaugcaaag

SEQ ID NO: 1382699 - RNA, 19 nt, Homo sapiens
acuaaacacauacguaaga

SEQ ID NO: 1382700 - RNA, 19 nt, Homo sapiens
caaacagagaauuagauug

SEQ ID NO: 1382701 - RNA, 19 nt, Homo sapiens
ugagaggguuauuggaaag

SEQ ID NO: 1382702 - RNA, 19 nt, Homo sapiens
gaugagcugaucuguaagu

SEQ ID NO: 1382703 - RNA, 19 nt, Homo sapiens
guaaacccagcgcuuccua

SEQ ID NO: 1382704 - RNA, 19 nt, Homo sapiens
ggacagccaggaguucuuc

SEQ ID NO: 1382705 - RNA, 19 nt, Homo sapiens
gagagagaaacuaaacaca

SEQ ID NO: 1382706 - RNA, 19 nt, Homo sapiens
uuacugaacaccacucugu

SEQ ID NO: 1382707 - RNA, 19 nt, Homo sapiens
ggccaucagucauaaaaga

SEQ ID NO: 1382708 - RNA, 19 nt, Homo sapiens
gggcaagacaacaggauca

SEQ ID NO: 1382709 - RNA, 19 nt, Homo sapiens
uaagauggugcuugcucua

SEQ ID NO: 1382710 - RNA, 19 nt, Homo sapiens
ccagacaccaccacuaugg

SEQ ID NO: 1382711 - RNA, 19 nt, Homo sapiens
gcaagacaacaggaucaga

SEQ ID NO: 1382712 - RNA, 19 nt, Homo sapiens
guuauuggaaagcuucaaa

SEQ ID NO: 1382713 - RNA, 19 nt, Homo sapiens
gagaaacagcuggaaacug

SEQ ID NO: 1382714 - RNA, 19 nt, Homo sapiens
ccauggagaagaugacaau

SEQ ID NO: 1382715 - RNA, 19 nt, Homo sapiens
gaggguuauuggaaagcuu

SEQ ID NO: 1382716 - RNA, 19 nt, Homo sapiens
cacgccaccuccucucuga

SEQ ID NO: 1382717 - RNA, 19 nt, Homo sapiens
uauuauccaacauggguua

SEQ ID NO: 1382718 - RNA, 19 nt, Homo sapiens
uaggaucccaguaaauaug

SEQ ID NO: 1382719 - RNA, 19 nt, Homo sapiens
cugguggucuucagcaaug

SEQ ID NO: 1382720 - RNA, 19 nt, Homo sapiens
aagaugacaaugccaauca

SEQ ID NO: 1382721 - RNA, 19 nt, Homo sapiens
gcaaugcccaugccuucca

SEQ ID NO: 1382722 - RNA, 19 nt, Homo sapiens
agagagaaacuaaacacau

SEQ ID NO: 1382723 - RNA, 19 nt, Homo sapiens
gccgucagccuguguguca

SEQ ID NO: 1382724 - RNA, 19 nt, Homo sapiens
gagauuuaagagccugaaa

SEQ ID NO: 1382725 - RNA, 19 nt, Homo sapiens
ugagacaagaagacuggua

SEQ ID NO: 1382726 - RNA, 19 nt, Homo sapiens
agaacuugccagauagaaa

SEQ ID NO: 1382727 - RNA, 19 nt, Homo sapiens
gagaacuugccagauagaa

SEQ ID NO: 1382728 - RNA, 19 nt, Homo sapiens
ugaacaccacucugugcua

SEQ ID NO: 1382729 - RNA, 19 nt, Homo sapiens
gacaacaggaucagagaac

SEQ ID NO: 1382730 - RNA, 19 nt, Homo sapiens
cgugaaauggguaacauca

SEQ ID NO: 1382731 - RNA, 19 nt, Homo sapiens
ugacaaugccaaucauagg

SEQ ID NO: 1382732 - RNA, 19 nt, Homo sapiens
cagagaaacagcuggaaac

SEQ ID NO: 1382733 - RNA, 19 nt, Homo sapiens
ggaguccugcaaaggcaaa

SEQ ID NO: 1382734 - RNA, 19 nt, Homo sapiens
cuuccuaccugguggucuu

SEQ ID NO: 1382735 - RNA, 19 nt, Homo sapiens
cagagaauuagauuguuuc

SEQ ID NO: 1382736 - RNA, 19 nt, Homo sapiens
ugaaauaagaaccuagcau

SEQ ID NO: 1382737 - RNA, 19 nt, Homo sapiens
ucccagacaccaccacuau

SEQ ID NO: 1382738 - RNA, 19 nt, Homo sapiens
acagagagagaaacuaaac

SEQ ID NO: 1382739 - RNA, 19 nt, Homo sapiens
cggaagugcuacuauauuu

SEQ ID NO: 1382740 - RNA, 19 nt, Homo sapiens
ucucggaagugcuacuaua

SEQ ID NO: 1382741 - RNA, 19 nt, Homo sapiens
gagacaagaagacugguaa

SEQ ID NO: 1382742 - RNA, 19 nt, Homo sapiens
gcagagaaacagcuggaaa

SEQ ID NO: 1382743 - RNA, 19 nt, Homo sapiens
caguggaccugaagaagga

SEQ ID NO: 1382744 - RNA, 19 nt, Homo sapiens
gcacagggaggacguacug

SEQ ID NO: 1382745 - RNA, 19 nt, Homo sapiens
ggaaacuggcucccugaga

SEQ ID NO: 1382746 - RNA, 19 nt, Homo sapiens
gcucaugaacgaugucaau

SEQ ID NO: 1382747 - RNA, 19 nt, Homo sapiens
ggcccagccuugccuauca

SEQ ID NO: 1382748 - RNA, 19 nt, Homo sapiens
aggaggagcuggccuacug

SEQ ID NO: 1382749 - RNA, 19 nt, Homo sapiens
ugcggaagcugcugaggaa

SEQ ID NO: 1382750 - RNA, 19 nt, Homo sapiens
gccaggaguucuucuucga

SEQ ID NO: 1382751 - RNA, 19 nt, Homo sapiens
ggcgaaugcucucggaagu

SEQ ID NO: 1382752 - RNA, 19 nt, Homo sapiens
ggacagccaggaguucuuc

SEQ ID NO: 1382753 - RNA, 19 nt, Homo sapiens
guaaacccagcgcuuccua

SEQ ID NO: 1382754 - RNA, 19 nt, Homo sapiens
ggaguucugccugcgguuu

SEQ ID NO: 1382755 - RNA, 19 nt, Homo sapiens
gaagugcuacuauauuuuc

SEQ ID NO: 1382756 - RNA, 19 nt, Homo sapiens
ccagacaccaccacuaugg

SEQ ID NO: 1382757 - RNA, 19 nt, Homo sapiens
gagaaacagcuggaaacug

SEQ ID NO: 1382758 - RNA, 19 nt, Homo sapiens
gagcgggauccucaucaug

SEQ ID NO: 1382759 - RNA, 19 nt, Homo sapiens
cugguggucuucagcaaug

SEQ ID NO: 1382760 - RNA, 19 nt, Homo sapiens
gccgucagccuguguguca

SEQ ID NO: 1382761 - RNA, 19 nt, Homo sapiens
gcaaugcccaugccuucca

SEQ ID NO: 1382762 - RNA, 19 nt, Homo sapiens
accuggagcucaagaagga

SEQ ID NO: 1382763 - RNA, 19 nt, Homo sapiens
ggaagugcuacuauauuuu

SEQ ID NO: 1382764 - RNA, 19 nt, Homo sapiens
ugagacaagaagacuggua

SEQ ID NO: 1382765 - RNA, 19 nt, Homo sapiens
ucggaagugcuacuauauu

SEQ ID NO: 1382766 - RNA, 19 nt, Homo sapiens
cagagaaacagcuggaaac

SEQ ID NO: 1382767 - RNA, 19 nt, Homo sapiens
ggugggccaucaucuccau

SEQ ID NO: 1382768 - RNA, 19 nt, Homo sapiens
cuuccuaccugguggucuu

SEQ ID NO: 1382769 - RNA, 19 nt, Homo sapiens
ucccagacaccaccacuau

SEQ ID NO: 1382770 - RNA, 19 nt, Homo sapiens
agacaagaagacugguaaa

SEQ ID NO: 1382771 - RNA, 19 nt, Homo sapiens
ggaaugagcucaccuaaca

SEQ ID NO: 1382772 - RNA, 19 nt, Homo sapiens
uagcaaaugugucugguua

SEQ ID NO: 1382773 - RNA, 19 nt, Homo sapiens
gcacuggaccucgcuauua

SEQ ID NO: 1382774 - RNA, 19 nt, Homo sapiens
gcaaaugugucugguuaga

SEQ ID NO: 1382775 - RNA, 19 nt, Homo sapiens
gaaucaaucugcacugaca

SEQ ID NO: 1382776 - RNA, 19 nt, Homo sapiens
gcacagcaaucccauuugg

SEQ ID NO: 1382777 - RNA, 19 nt, Homo sapiens
gaagaucacaguucacaga

SEQ ID NO: 1382778 - RNA, 19 nt, Homo sapiens
gagacaggccuuaggauuu

SEQ ID NO: 1382779 - RNA, 19 nt, Homo sapiens
ggacagcacaccugaguga

SEQ ID NO: 1382780 - RNA, 19 nt, Homo sapiens
gcaagucacugaggacaau

SEQ ID NO: 1382781 - RNA, 19 nt, Homo sapiens
gaugggagguguucaagca

SEQ ID NO: 1382782 - RNA, 19 nt, Homo sapiens
guaaagauaauccaaagga

SEQ ID NO: 1382783 - RNA, 19 nt, Homo sapiens
gagcucaccuaacagauag

SEQ ID NO: 1382784 - RNA, 19 nt, Homo sapiens
cagcacaccugagugauga

SEQ ID NO: 1382785 - RNA, 19 nt, Homo sapiens
gggaaucaaucugcacuga

SEQ ID NO: 1382786 - RNA, 19 nt, Homo sapiens
uaacagauagcaaaugugu

SEQ ID NO: 1382787 - RNA, 19 nt, Homo sapiens
ccuaacagauagcaaaugu

SEQ ID NO: 1382788 - RNA, 19 nt, Homo sapiens
ccugagugaugaugauuaa

SEQ ID NO: 1382789 - RNA, 19 nt, Homo sapiens
agacaggccuuaggauuug

SEQ ID NO: 1382790 - RNA, 19 nt, Homo sapiens
gaagguaagaggcaugaug

SEQ ID NO: 1382791 - RNA, 19 nt, Homo sapiens
ucacggagcuacgacuuug

SEQ ID NO: 1382792 - RNA, 19 nt, Homo sapiens
gguaagggcgcauggaaug

SEQ ID NO: 1382793 - RNA, 19 nt, Homo sapiens
gaaccucgaaggcagcaaa

SEQ ID NO: 1382794 - RNA, 19 nt, Homo sapiens
gggcuaaggugggagugaa

SEQ ID NO: 1382795 - RNA, 19 nt, Homo sapiens
cuaaaugcaugcagaaggu

SEQ ID NO: 1382796 - RNA, 19 nt, Homo sapiens
uaacgcagcgggaaucaau

SEQ ID NO: 1382797 - RNA, 19 nt, Homo sapiens
aaaugugucugguuagauc

SEQ ID NO: 1382798 - RNA, 19 nt, Homo sapiens
ugagcucaccuaacagaua

SEQ ID NO: 1382799 - RNA, 19 nt, Homo sapiens
gcagugggacccugaagau

SEQ ID NO: 1382800 - RNA, 19 nt, Homo sapiens
ggaccucgcuauuauuuuc

SEQ ID NO: 1382801 - RNA, 19 nt, Homo sapiens
guuaucugcuggaaguuau

SEQ ID NO: 1382802 - RNA, 19 nt, Homo sapiens
gaugagacaggccuuagga

SEQ ID NO: 1382803 - RNA, 19 nt, Homo sapiens
uaacuaaaugcaugcagaa

SEQ ID NO: 1382804 - RNA, 19 nt, Homo sapiens
cacuggaccucgcuauuau

SEQ ID NO: 1382805 - RNA, 19 nt, Homo sapiens
cagcauucguucugaagau

SEQ ID NO: 1382806 - RNA, 19 nt, Homo sapiens
gauaggcccagcauucguu

SEQ ID NO: 1382807 - RNA, 19 nt, Homo sapiens
acacuggggugaauaaauu

SEQ ID NO: 1382808 - RNA, 19 nt, Homo sapiens
caagaugagacaggccuua

SEQ ID NO: 1382809 - RNA, 19 nt, Homo sapiens
caaagaaaauguggagcua

SEQ ID NO: 1382810 - RNA, 19 nt, Homo sapiens
gcagagaaagaggaagaaa

SEQ ID NO: 1382811 - RNA, 19 nt, Homo sapiens
aagcacagcaaucccauuu

SEQ ID NO: 1382812 - RNA, 19 nt, Homo sapiens
ugagacaggccuuaggauu

SEQ ID NO: 1382813 - RNA, 19 nt, Homo sapiens
ucaccuaacagauagcaaa

SEQ ID NO: 1382814 - RNA, 19 nt, Homo sapiens
gaagaaaaccaggagaauu

SEQ ID NO: 1382815 - RNA, 19 nt, Homo sapiens
gguuaucugcuggaaguua

SEQ ID NO: 1382816 - RNA, 19 nt, Homo sapiens
gaggacagcacaccugagu

SEQ ID NO: 1382817 - RNA, 19 nt, Homo sapiens
uucaggaacuaacuaaaug

SEQ ID NO: 1382818 - RNA, 19 nt, Homo sapiens
gaucucagcagagcccauu

SEQ ID NO: 1382819 - RNA, 19 nt, Homo sapiens
uggcugggcuacaucauag

SEQ ID NO: 1382820 - RNA, 19 nt, Homo sapiens
gugaugaagagcaagauga

SEQ ID NO: 1382821 - RNA, 19 nt, Homo sapiens
gacaaugacagcaaucagu

SEQ ID NO: 1382822 - RNA, 19 nt, Homo sapiens
gcuguaugcuucaggaacu

SEQ ID NO: 1382823 - RNA, 19 nt, Homo sapiens
uggguuaucugcuggaagu

SEQ ID NO: 1382824 - RNA, 19 nt, Homo sapiens
ugaggacaaugacagcaau

SEQ ID NO: 1382825 - RNA, 19 nt, Homo sapiens
gcccagcauucguucugaa

SEQ ID NO: 1382826 - RNA, 19 nt, Homo sapiens
cuuaggauuugccaaggaa

SEQ ID NO: 1382827 - RNA, 19 nt, Homo sapiens
gaguguggcugggcuacau

SEQ ID NO: 1382828 - RNA, 19 nt, Homo sapiens
ccucgaaggcagcaaagaa

SEQ ID NO: 1382829 - RNA, 19 nt, Homo sapiens
gugcagagaaagaggaaga

SEQ ID NO: 1382830 - RNA, 19 nt, Homo sapiens
gugggacccugaagaugug

SEQ ID NO: 1382831 - RNA, 19 nt, Homo sapiens
aagaaaaccaggagaauuu

SEQ ID NO: 1382832 - RNA, 19 nt, Homo sapiens
ccaggaaugagcucaccua

SEQ ID NO: 1382833 - RNA, 19 nt, Homo sapiens
gaucucagacccgcucuuc

SEQ ID NO: 1382834 - RNA, 19 nt, Homo sapiens
ugaugaugauuaacaccuu

SEQ ID NO: 1382835 - RNA, 19 nt, Homo sapiens
ugagugaugaugauuaaca

SEQ ID NO: 1382836 - RNA, 19 nt, Homo sapiens
acagauagcaaaugugucu

SEQ ID NO: 1382837 - RNA, 19 nt, Homo sapiens
ucguaaagauaauccaaag

SEQ ID NO: 1382838 - RNA, 19 nt, Homo sapiens
gcuggaaguuaucgauagg

SEQ ID NO: 1382839 - RNA, 19 nt, Homo sapiens
guggcugggcuacaucaua

SEQ ID NO: 1382840 - RNA, 19 nt, Homo sapiens
cuucaggaacuaacuaaau

SEQ ID NO: 1382841 - RNA, 19 nt, Homo sapiens
guucugaagaucacaguuc

SEQ ID NO: 1382842 - RNA, 19 nt, Homo sapiens
acaccugagugaugaugau

SEQ ID NO: 1382843 - RNA, 19 nt, Homo sapiens
ucacacugcaagucacuga

SEQ ID NO: 1382844 - RNA, 19 nt, Homo sapiens
uaaaugcaugcagaaggua

SEQ ID NO: 1382845 - RNA, 19 nt, Homo sapiens
caggaaugagcucaccuaa

SEQ ID NO: 1382846 - RNA, 19 nt, Homo sapiens
ccaggagaauuuggauugg

SEQ ID NO: 1382847 - RNA, 19 nt, Homo sapiens
ucagacccgcucuuccuuu

SEQ ID NO: 1382848 - RNA, 19 nt, Homo sapiens
gagcccagggucaggaguu

SEQ ID NO: 1382849 - RNA, 19 nt, Homo sapiens
gcacaccugagugaugaug

SEQ ID NO: 1382850 - RNA, 19 nt, Homo sapiens
cuggaccucgcuauuauuu

SEQ ID NO: 1382851 - RNA, 19 nt, Homo sapiens
agucagccaugaacggaau

SEQ ID NO: 1382852 - RNA, 19 nt, Homo sapiens
uucauucccuugagaguca

SEQ ID NO: 1382853 - RNA, 19 nt, Homo sapiens
cgucguacccucccguuca

SEQ ID NO: 1382854 - RNA, 19 nt, Homo sapiens
agcaaucagucgcuacaug

SEQ ID NO: 1382855 - RNA, 19 nt, Homo sapiens
ggacaaugacagcaaucag

SEQ ID NO: 1382856 - RNA, 19 nt, Homo sapiens
gaugaagagcaagaugaga

SEQ ID NO: 1382857 - RNA, 19 nt, Homo sapiens
gagugaugaugauuaacac

SEQ ID NO: 1382858 - RNA, 19 nt, Homo sapiens
cgugugugaugaagagcaa

SEQ ID NO: 1382859 - RNA, 19 nt, Homo sapiens
caaaugugucugguuagau

SEQ ID NO: 1382860 - RNA, 19 nt, Homo sapiens
ggcccagcauucguucuga

SEQ ID NO: 1382861 - RNA, 19 nt, Homo sapiens
gaccuggagcagaaguauu

SEQ ID NO: 1382862 - RNA, 19 nt, Homo sapiens
caugaugggagguguucaa

SEQ ID NO: 1382863 - RNA, 19 nt, Homo sapiens
cagaagguaagaggcauga

SEQ ID NO: 1382864 - RNA, 19 nt, Homo sapiens
ggacuguguggccaaccaa

SEQ ID NO: 1382865 - RNA, 19 nt, Homo sapiens
uuugaccugugcagagaaa

SEQ ID NO: 1382866 - RNA, 19 nt, Homo sapiens
aaugagcucaccuaacaga

SEQ ID NO: 1382867 - RNA, 19 nt, Homo sapiens
gcuacgacuuuggguacug

SEQ ID NO: 1382868 - RNA, 19 nt, Homo sapiens
gggauuccuuucuuuauuu

SEQ ID NO: 1382869 - RNA, 19 nt, Homo sapiens
guccuuagcccuugaaaua

SEQ ID NO: 1382870 - RNA, 19 nt, Homo sapiens
auacaaagcucuucugaca

SEQ ID NO: 1382871 - RNA, 19 nt, Homo sapiens
guugaaggaucaugcagua

SEQ ID NO: 1382872 - RNA, 19 nt, Homo sapiens
gaauuuggaugcaccuugu

SEQ ID NO: 1382873 - RNA, 19 nt, Homo sapiens
gaaggaucaugcaguagau

SEQ ID NO: 1382874 - RNA, 19 nt, Homo sapiens
uaaaucguguuucacagaa

SEQ ID NO: 1382875 - RNA, 19 nt, Homo sapiens
caaugaaccuaucuuugga

SEQ ID NO: 1382876 - RNA, 19 nt, Homo sapiens
ggaugcaccuuguuuuaua

SEQ ID NO: 1382877 - RNA, 19 nt, Homo sapiens
ccacauucuugcuuuaguu

SEQ ID NO: 1382878 - RNA, 19 nt, Homo sapiens
ggaacuagaggaacugaau

SEQ ID NO: 1382879 - RNA, 19 nt, Homo sapiens
gaaguuguccugguugguu

SEQ ID NO: 1382880 - RNA, 19 nt, Homo sapiens
gcaccucuuugcacucaug

SEQ ID NO: 1382881 - RNA, 19 nt, Homo sapiens
guagagggauuuggguguu

SEQ ID NO: 1382882 - RNA, 19 nt, Homo sapiens
gcugggauuccuuucuuua

SEQ ID NO: 1382883 - RNA, 19 nt, Homo sapiens
caccacagccucccaggua

SEQ ID NO: 1382884 - RNA, 19 nt, Homo sapiens
acaaagcucuucugacacu

SEQ ID NO: 1382885 - RNA, 19 nt, Homo sapiens
guuccacauucuugcuuua

SEQ ID NO: 1382886 - RNA, 19 nt, Homo sapiens
cuacaaugaaccuaucuuu

SEQ ID NO: 1382887 - RNA, 19 nt, Homo sapiens
ugggauuccuuucuuuauu

SEQ ID NO: 1382888 - RNA, 19 nt, Homo sapiens
gaaauacaaagcucuucug

SEQ ID NO: 1382889 - RNA, 19 nt, Homo sapiens
gugcugggauuccuuucuu

SEQ ID NO: 1382890 - RNA, 19 nt, Homo sapiens
ggauuccuuucuuuauuuc

SEQ ID NO: 1382891 - RNA, 19 nt, Homo sapiens
aggcuggaguguagugaua

SEQ ID NO: 1382892 - RNA, 19 nt, Homo sapiens
ggugaccuguggccacuug

SEQ ID NO: 1382893 - RNA, 19 nt, Homo sapiens
acaaugaaccuaucuuugg

SEQ ID NO: 1382894 - RNA, 19 nt, Homo sapiens
caagacagaccgcuacaag

SEQ ID NO: 1382895 - RNA, 19 nt, Homo sapiens
ugccacacccgacuaauuu

SEQ ID NO: 1382896 - RNA, 19 nt, Homo sapiens
ugaaggaucaugcaguaga

SEQ ID NO: 1382897 - RNA, 19 nt, Homo sapiens
ggccucaguugaaggauca

SEQ ID NO: 1382898 - RNA, 19 nt, Homo sapiens
gcuacaagcaggaacuaga

SEQ ID NO: 1382899 - RNA, 19 nt, Homo sapiens
gaacuagaggaacugaauc

SEQ ID NO: 1382900 - RNA, 19 nt, Homo sapiens
ggucaaguuugugcccauu

SEQ ID NO: 1382901 - RNA, 19 nt, Homo sapiens
gcuaugcaccaaacuuguu

SEQ ID NO: 1382902 - RNA, 19 nt, Homo sapiens
ucagaaggcagccaauugu

SEQ ID NO: 1382903 - RNA, 19 nt, Homo sapiens
gguuccacauucuugcuuu

SEQ ID NO: 1382904 - RNA, 19 nt, Homo sapiens
ccauuuccauuccuauaca

SEQ ID NO: 1382905 - RNA, 19 nt, Homo sapiens
gcucuucugacacugaauu

SEQ ID NO: 1382906 - RNA, 19 nt, Homo sapiens
cauucuugcuuuaguuguu

SEQ ID NO: 1382907 - RNA, 19 nt, Homo sapiens
agacagaccgcuacaagca

SEQ ID NO: 1382908 - RNA, 19 nt, Homo sapiens
ccuuugcccugcauuucua

SEQ ID NO: 1382909 - RNA, 19 nt, Homo sapiens
gcucguguuuguggccuuu

SEQ ID NO: 1382910 - RNA, 19 nt, Homo sapiens
ggagagugaccacgaguac

SEQ ID NO: 1382911 - RNA, 19 nt, Homo sapiens
ccuuagcccuugaaauaca

SEQ ID NO: 1382912 - RNA, 19 nt, Homo sapiens
ggucagaaggcagccaauu

SEQ ID NO: 1382913 - RNA, 19 nt, Homo sapiens
gggcaccuuucucuuccuu

SEQ ID NO: 1382914 - RNA, 19 nt, Homo sapiens
uagagggauuuggguguuu

SEQ ID NO: 1382915 - RNA, 19 nt, Homo sapiens
gucagaaggcagccaauug

SEQ ID NO: 1382916 - RNA, 19 nt, Homo sapiens
guggcuaccucccuuaguc

SEQ ID NO: 1382917 - RNA, 19 nt, Homo sapiens
aaauacaaagcucuucuga

SEQ ID NO: 1382918 - RNA, 19 nt, Homo sapiens
agaaggcagccaauuguug

SEQ ID NO: 1382919 - RNA, 19 nt, Homo sapiens
gggcuggccucaguugaag

SEQ ID NO: 1382920 - RNA, 19 nt, Homo sapiens
gauggguuccacauucuug

SEQ ID NO: 1382921 - RNA, 19 nt, Homo sapiens
caccauuuccauuccuaua

SEQ ID NO: 1382922 - RNA, 19 nt, Homo sapiens
uccacaaccucaacucugu

SEQ ID NO: 1382923 - RNA, 19 nt, Homo sapiens
uagcaaggguuggguaagg

SEQ ID NO: 1382924 - RNA, 19 nt, Homo sapiens
aggugcagcuggagaguga

SEQ ID NO: 1382925 - RNA, 19 nt, Homo sapiens
gccaccauuuccauuccua

SEQ ID NO: 1382926 - RNA, 19 nt, Homo sapiens
caagcaggaacuagaggaa

SEQ ID NO: 1382927 - RNA, 19 nt, Homo sapiens
gcuccuugguggcacacaa

SEQ ID NO: 1382928 - RNA, 19 nt, Homo sapiens
gggcuggggucuuuagaga

SEQ ID NO: 1382929 - RNA, 19 nt, Homo sapiens
uacaaugaaccuaucuuug

SEQ ID NO: 1382930 - RNA, 19 nt, Homo sapiens
ucaaguuugugcccauugg

SEQ ID NO: 1382931 - RNA, 19 nt, Homo sapiens
caacauccacaaccucaac

SEQ ID NO: 1382932 - RNA, 19 nt, Homo sapiens
cagaaggcagccaauuguu

SEQ ID NO: 1382933 - RNA, 19 nt, Homo sapiens
ggaucaugcaguagauaga

SEQ ID NO: 1382934 - RNA, 19 nt, Homo sapiens
gguuuaagcuccccaccuu

SEQ ID NO: 1382935 - RNA, 19 nt, Homo sapiens
ggagcugcaggcuguguga

SEQ ID NO: 1382936 - RNA, 19 nt, Homo sapiens
gcggcuaccuggaccucau

SEQ ID NO: 1382937 - RNA, 19 nt, Homo sapiens
auaaaucguguuucacaga

SEQ ID NO: 1382938 - RNA, 19 nt, Homo sapiens
ucaggcagaguucagauuc

SEQ ID NO: 1382939 - RNA, 19 nt, Homo sapiens
ccaguggcuaccucccuua

SEQ ID NO: 1382940 - RNA, 19 nt, Homo sapiens
gaugcaccuuguuuuauau

SEQ ID NO: 1382941 - RNA, 19 nt, Homo sapiens
ccaaagugcugggauuccu

SEQ ID NO: 1382942 - RNA, 19 nt, Homo sapiens
caaagugcugggauuccuu

SEQ ID NO: 1382943 - RNA, 19 nt, Homo sapiens
gaucaugcaguagauagag

SEQ ID NO: 1382944 - RNA, 19 nt, Homo sapiens
uugguugggucaaguuugu

SEQ ID NO: 1382945 - RNA, 19 nt, Homo sapiens
ugacuuuagccaccauuuc

SEQ ID NO: 1382946 - RNA, 19 nt, Homo sapiens
gcaaugacaccaaagauua

SEQ ID NO: 1382947 - RNA, 19 nt, Homo sapiens
ggaagauccuuuagaaauu

SEQ ID NO: 1382948 - RNA, 19 nt, Homo sapiens
gcacaaaucacucauggua

SEQ ID NO: 1382949 - RNA, 19 nt, Homo sapiens
gaauggagauugccucuau

SEQ ID NO: 1382950 - RNA, 19 nt, Homo sapiens
gacaggcucuggcuuguua

SEQ ID NO: 1382951 - RNA, 19 nt, Homo sapiens
ggcaaugucucuucuagua

SEQ ID NO: 1382952 - RNA, 19 nt, Homo sapiens
ggaaugaaaccauccauaa

SEQ ID NO: 1382953 - RNA, 19 nt, Homo sapiens
ggagagaaguccuuugaau

SEQ ID NO: 1382954 - RNA, 19 nt, Homo sapiens
gcaaauaacccuguacaaa

SEQ ID NO: 1382955 - RNA, 19 nt, Homo sapiens
gagaaacccuucguaugua

SEQ ID NO: 1382956 - RNA, 19 nt, Homo sapiens
caccaaagauuaucagauu

SEQ ID NO: 1382957 - RNA, 19 nt, Homo sapiens
gggaaauccuucacuaauu

SEQ ID NO: 1382958 - RNA, 19 nt, Homo sapiens
caaugucucuucuaguaua

SEQ ID NO: 1382959 - RNA, 19 nt, Homo sapiens
gagagaagccuuaugaaug

SEQ ID NO: 1382960 - RNA, 19 nt, Homo sapiens
ggacacaacugagaaauac

SEQ ID NO: 1382961 - RNA, 19 nt, Homo sapiens
agaaauuccucaugccuua

SEQ ID NO: 1382962 - RNA, 19 nt, Homo sapiens
agacaaagacacagaaaua

SEQ ID NO: 1382963 - RNA, 19 nt, Homo sapiens
caacucaacuuacugaaca

SEQ ID NO: 1382964 - RNA, 19 nt, Homo sapiens
guacagaucuuagugauac

SEQ ID NO: 1382965 - RNA, 19 nt, Homo sapiens
gaagauccuuuagaaauuc

SEQ ID NO: 1382966 - RNA, 19 nt, Homo sapiens
acaaaucacucaugguauu

SEQ ID NO: 1382967 - RNA, 19 nt, Homo sapiens
gaucauagcauuaacaagu

SEQ ID NO: 1382968 - RNA, 19 nt, Homo sapiens
gagaaguccuuugaaugua

SEQ ID NO: 1382969 - RNA, 19 nt, Homo sapiens
caagguggcugauauaguc

SEQ ID NO: 1382970 - RNA, 19 nt, Homo sapiens
aaauaacccuguacaaaga

SEQ ID NO: 1382971 - RNA, 19 nt, Homo sapiens
gggaaagccuucacuagau

SEQ ID NO: 1382972 - RNA, 19 nt, Homo sapiens
ggauaugaguguuaccauu

SEQ ID NO: 1382973 - RNA, 19 nt, Homo sapiens
gauaugaguguuaccauuu

SEQ ID NO: 1382974 - RNA, 19 nt, Homo sapiens
gaaccaaucugcccuuuug

SEQ ID NO: 1382975 - RNA, 19 nt, Homo sapiens
ccacagaccaaauggcuua

SEQ ID NO: 1382976 - RNA, 19 nt, Homo sapiens
gaauguggaagauccuuua

SEQ ID NO: 1382977 - RNA, 19 nt, Homo sapiens
caagacaacccuacaaaug

SEQ ID NO: 1382978 - RNA, 19 nt, Homo sapiens
gaaccuggccucuguggaa

SEQ ID NO: 1382979 - RNA, 19 nt, Homo sapiens
gcaagugguuaucaggauu

SEQ ID NO: 1382980 - RNA, 19 nt, Homo sapiens
gcaaagugcuagaauacag

SEQ ID NO: 1382981 - RNA, 19 nt, Homo sapiens
ggagaaacccuaugaaugc

SEQ ID NO: 1382982 - RNA, 19 nt, Homo sapiens
agagaagccuuaugaaugu

SEQ ID NO: 1382983 - RNA, 19 nt, Homo sapiens
ggaaagccuucacuacauc

SEQ ID NO: 1382984 - RNA, 19 nt, Homo sapiens
ggaaagaaacccuaucagu

SEQ ID NO: 1382985 - RNA, 19 nt, Homo sapiens
ggaaagccuucacuagauc

SEQ ID NO: 1382986 - RNA, 19 nt, Homo sapiens
caaauaacccuguacaaag

SEQ ID NO: 1382987 - RNA, 19 nt, Homo sapiens
cuagaggaauuaagacaaa

SEQ ID NO: 1382988 - RNA, 19 nt, Homo sapiens
cagcagcucuagaggaauu

SEQ ID NO: 1382989 - RNA, 19 nt, Homo sapiens
ggagagaagccuuaugaau

SEQ ID NO: 1382990 - RNA, 19 nt, Homo sapiens
gggaaagccuucacuacau

SEQ ID NO: 1382991 - RNA, 19 nt, Homo sapiens
gaaguccuuugaauguaaa

SEQ ID NO: 1382992 - RNA, 19 nt, Homo sapiens
gaggguaauuguuauggaa

SEQ ID NO: 1382993 - RNA, 19 nt, Homo sapiens
gaguuugacccacauauuu

SEQ ID NO: 1382994 - RNA, 19 nt, Homo sapiens
ggagagaaacccuucguau

SEQ ID NO: 1382995 - RNA, 19 nt, Homo sapiens
ugagaaacucugugaauuu

SEQ ID NO: 1382996 - RNA, 19 nt, Homo sapiens
gagaugugaugcuggagaa

SEQ ID NO: 1382997 - RNA, 19 nt, Homo sapiens
gaacucacacuggaauaaa

SEQ ID NO: 1382998 - RNA, 19 nt, Homo sapiens
ccaagggucucuucugauc

SEQ ID NO: 1382999 - RNA, 19 nt, Homo sapiens
gaacauguaagaacucaca

SEQ ID NO: 1383000 - RNA, 19 nt, Homo sapiens
ucaacuuacugaacaugua

SEQ ID NO: 1383001 - RNA, 19 nt, Homo sapiens
agaaguccuuugaauguaa

SEQ ID NO: 1383002 - RNA, 19 nt, Homo sapiens
uuucacagcugauuauuuc

SEQ ID NO: 1383003 - RNA, 19 nt, Homo sapiens
cgguugccaucuuuaauua

SEQ ID NO: 1383004 - RNA, 19 nt, Homo sapiens
gagagaaacccuucguaug

SEQ ID NO: 1383005 - RNA, 19 nt, Homo sapiens
aaagaaacccuaucagugu

SEQ ID NO: 1383006 - RNA, 19 nt, Homo sapiens
gaucaacucaacuuacuga

SEQ ID NO: 1383007 - RNA, 19 nt, Homo sapiens
agacaaagguagaaaggau

SEQ ID NO: 1383008 - RNA, 19 nt, Homo sapiens
gggagaaacccuaugaaug

SEQ ID NO: 1383009 - RNA, 19 nt, Homo sapiens
cuauauuccucacgccuua

SEQ ID NO: 1383010 - RNA, 19 nt, Homo sapiens
caagauaugugggaaagca

SEQ ID NO: 1383011 - RNA, 19 nt, Homo sapiens
uguggaagauccuuuagaa

SEQ ID NO: 1383012 - RNA, 19 nt, Homo sapiens
gagagaaguccuuugaaug

SEQ ID NO: 1383013 - RNA, 19 nt, Homo sapiens
gaaacucugugacuguaag

SEQ ID NO: 1383014 - RNA, 19 nt, Homo sapiens
ucagugcgguuucgccuuu

SEQ ID NO: 1383015 - RNA, 19 nt, Homo sapiens
ccacauauuuauugacagu

SEQ ID NO: 1383016 - RNA, 19 nt, Homo sapiens
gaugagaaacucugugaau

SEQ ID NO: 1383017 - RNA, 19 nt, Homo sapiens
ggaauacuucugaggguaa

SEQ ID NO: 1383018 - RNA, 19 nt, Homo sapiens
gaagcuuccuguguccuuu

SEQ ID NO: 1383019 - RNA, 19 nt, Homo sapiens
gcaaggauaugaguguuac

SEQ ID NO: 1383020 - RNA, 19 nt, Homo sapiens
ggaauguggccaagccuuu

SEQ ID NO: 1383021 - RNA, 19 nt, Homo sapiens
gaauuaagacaaagacaca

SEQ ID NO: 1383022 - RNA, 19 nt, Homo sapiens
agaaacccuucguauguaa

SEQ ID NO: 1383023 - RNA, 19 nt, Homo sapiens
aagaaacccuaucagugua

SEQ ID NO: 1383024 - RNA, 19 nt, Homo sapiens
gggccuuucuauacacaua

SEQ ID NO: 1383025 - RNA, 19 nt, Homo sapiens
gagcgugucaggaaugaaa

SEQ ID NO: 1383026 - RNA, 19 nt, Homo sapiens
uaaagaaugugggaaagca

SEQ ID NO: 1383027 - RNA, 19 nt, Homo sapiens
agagaaacccuucguaugu

SEQ ID NO: 1383028 - RNA, 19 nt, Homo sapiens
caggagagaagccuuauga

SEQ ID NO: 1383029 - RNA, 19 nt, Homo sapiens
gcaagacaacccuacaaau

SEQ ID NO: 1383030 - RNA, 19 nt, Homo sapiens
gaaauacaaccuagaacca

SEQ ID NO: 1383031 - RNA, 19 nt, Homo sapiens
cugagggucugaaauuaaa

SEQ ID NO: 1383032 - RNA, 19 nt, Homo sapiens
guacucgggccuuucuaua

SEQ ID NO: 1383033 - RNA, 19 nt, Homo sapiens
gccaagccuuugcucagua

SEQ ID NO: 1383034 - RNA, 19 nt, Homo sapiens
gaauaaaacccuaugaaug

SEQ ID NO: 1383035 - RNA, 19 nt, Homo sapiens
ucacagugccgcagagauu

SEQ ID NO: 1383036 - RNA, 19 nt, Homo sapiens
gcuguuuccucacgccuaa

SEQ ID NO: 1383037 - RNA, 19 nt, Homo sapiens
ccaccuagauucauaagcu

SEQ ID NO: 1383038 - RNA, 19 nt, Homo sapiens
cuucugaggguaauuguua

SEQ ID NO: 1383039 - RNA, 19 nt, Homo sapiens
gaacaguuuugccuuaaga

SEQ ID NO: 1383040 - RNA, 19 nt, Homo sapiens
ucaaauauucagugggaua

SEQ ID NO: 1383041 - RNA, 19 nt, Homo sapiens
gaauacaguucugccaagu

SEQ ID NO: 1383042 - RNA, 19 nt, Homo sapiens
gcugagagccuugaacaga

SEQ ID NO: 1383043 - RNA, 19 nt, Homo sapiens
caacugagaaauaccucua

SEQ ID NO: 1383044 - RNA, 19 nt, Homo sapiens
agugauacauaaccaguuu

SEQ ID NO: 1383045 - RNA, 19 nt, Homo sapiens
ccuaagaucauagcauuaa

SEQ ID NO: 1383046 - RNA, 19 nt, Homo sapiens
gcaacgugguggucaaaua

SEQ ID NO: 1383047 - RNA, 19 nt, Homo sapiens
guacauggauggcuauuac

SEQ ID NO: 1383048 - RNA, 19 nt, Homo sapiens
ggaauaaacaggaccuuug

SEQ ID NO: 1383049 - RNA, 19 nt, Homo sapiens
gaauaaacaggaccuuuga

SEQ ID NO: 1383050 - RNA, 19 nt, Homo sapiens
aaacaggaccuuugacauu

SEQ ID NO: 1383051 - RNA, 19 nt, Homo sapiens
gacagacucucuuccagaa

SEQ ID NO: 1383052 - RNA, 19 nt, Homo sapiens
auacaccacuucuuucuuu

SEQ ID NO: 1383053 - RNA, 19 nt, Homo sapiens
gcauggaucuguuucuuuu

SEQ ID NO: 1383054 - RNA, 19 nt, Homo sapiens
ccauggagguccuugaguu

SEQ ID NO: 1383055 - RNA, 19 nt, Homo sapiens
guacaacggcucccuguuc

SEQ ID NO: 1383056 - RNA, 19 nt, Homo sapiens
gcagacacgcggaccauug

SEQ ID NO: 1383057 - RNA, 19 nt, Homo sapiens
aacaggaccuuugacauuu

SEQ ID NO: 1383058 - RNA, 19 nt, Homo sapiens
caaccaguauucccacauc

SEQ ID NO: 1383059 - RNA, 19 nt, Homo sapiens
guucucugccuauguauuu

SEQ ID NO: 1383060 - RNA, 19 nt, Homo sapiens
uuaccaacacguccaguua

SEQ ID NO: 1383061 - RNA, 19 nt, Homo sapiens
gggaggaggugaggaaucu

SEQ ID NO: 1383062 - RNA, 19 nt, Homo sapiens
ucucgaugcuggauuacaa

SEQ ID NO: 1383063 - RNA, 19 nt, Homo sapiens
caacggcucccuguucuau

SEQ ID NO: 1383064 - RNA, 19 nt, Homo sapiens
gugcauggaucuguuucuu

SEQ ID NO: 1383065 - RNA, 19 nt, Homo sapiens
ccucaagggugaucucucu

SEQ ID NO: 1383066 - RNA, 19 nt, Homo sapiens
gaucugcggugugcucuac

SEQ ID NO: 1383067 - RNA, 19 nt, Homo sapiens
uuuguucucugccuaugua

SEQ ID NO: 1383068 - RNA, 19 nt, Homo sapiens
gagcugaaggacaggauga

SEQ ID NO: 1383069 - RNA, 19 nt, Homo sapiens
caggugcucuacaauguca

SEQ ID NO: 1383070 - RNA, 19 nt, Homo sapiens
acggcucccuguucuauaa

SEQ ID NO: 1383071 - RNA, 19 nt, Homo sapiens
caggaccuuugacauuuga

SEQ ID NO: 1383072 - RNA, 19 nt, Homo sapiens
ggacgugcccuuccacaac

SEQ ID NO: 1383073 - RNA, 19 nt, Homo sapiens
ccugggagacuucaucaaa

SEQ ID NO: 1383074 - RNA, 19 nt, Homo sapiens
gccuauguauuucugucua

SEQ ID NO: 1383075 - RNA, 19 nt, Homo sapiens
ggcgaggccuucaugaucu

SEQ ID NO: 1383076 - RNA, 19 nt, Homo sapiens
acaggaccuuugacauuug

SEQ ID NO: 1383077 - RNA, 19 nt, Homo sapiens
ggaccuuugacauuugaaa

SEQ ID NO: 1383078 - RNA, 19 nt, Homo sapiens
caaggucuacuucgccuau

SEQ ID NO: 1383079 - RNA, 19 nt, Homo sapiens
caggaugacggaacuguug

SEQ ID NO: 1383080 - RNA, 19 nt, Homo sapiens
caacgugguggucaaauac

SEQ ID NO: 1383081 - RNA, 19 nt, Homo sapiens
gaugggugccuacggguau

SEQ ID NO: 1383082 - RNA, 19 nt, Homo sapiens
gagcaacgugguggucaaa

SEQ ID NO: 1383083 - RNA, 19 nt, Homo sapiens
gguacauggauggcuauua

SEQ ID NO: 1383084 - RNA, 19 nt, Homo sapiens
cuuuauugaucucugcuuu

SEQ ID NO: 1383085 - RNA, 19 nt, Homo sapiens
gaucucugcuuuuaauaca

SEQ ID NO: 1383086 - RNA, 19 nt, Homo sapiens
cauggauggcuauuacaaa

SEQ ID NO: 1383087 - RNA, 19 nt, Homo sapiens
cuacaaugucacccuguuu

SEQ ID NO: 1383088 - RNA, 19 nt, Homo sapiens
ucuacaaugucacccuguu

SEQ ID NO: 1383089 - RNA, 19 nt, Homo sapiens
acacguccaguuacgagua

SEQ ID NO: 1383090 - RNA, 19 nt, Homo sapiens
uaaacaggaccuuugacau

SEQ ID NO: 1383091 - RNA, 19 nt, Homo sapiens
uaauacaccacuucuuucu

SEQ ID NO: 1383092 - RNA, 19 nt, Homo sapiens
accaggugcucuacaaugu

SEQ ID NO: 1383093 - RNA, 19 nt, Homo sapiens
ccucuucuccuuuauugau

SEQ ID NO: 1383094 - RNA, 19 nt, Homo sapiens
ggcaacugauggagaaggu

SEQ ID NO: 1383095 - RNA, 19 nt, Homo sapiens
uacaacggcucccuguucu

SEQ ID NO: 1383096 - RNA, 19 nt, Homo sapiens
gcgaggccuucaugaucug

SEQ ID NO: 1383097 - RNA, 19 nt, Homo sapiens
cggauagccgggucuggua

SEQ ID NO: 1383098 - RNA, 19 nt, Homo sapiens
cauggagguccuugaguug

SEQ ID NO: 1383099 - RNA, 19 nt, Homo sapiens
cggaauaaacaggaccuuu

SEQ ID NO: 1383100 - RNA, 19 nt, Homo sapiens
caccacuucuuucuuucug

SEQ ID NO: 1383101 - RNA, 19 nt, Homo sapiens
uuaauacaccacuucuuuc

SEQ ID NO: 1383102 - RNA, 19 nt, Homo sapiens
ugcggcaacugauggagaa

SEQ ID NO: 1383103 - RNA, 19 nt, Homo sapiens
ugggagacuucaucaaagg

SEQ ID NO: 1383104 - RNA, 19 nt, Homo sapiens
guaucgcgaccuccaguau

SEQ ID NO: 1383105 - RNA, 19 nt, Homo sapiens
ugagugcauggaucuguuu

SEQ ID NO: 1383106 - RNA, 19 nt, Homo sapiens
aggucuacuucgccuauuu

SEQ ID NO: 1383107 - RNA, 19 nt, Homo sapiens
guacaccaccaaccagaac

SEQ ID NO: 1383108 - RNA, 19 nt, Homo sapiens
cugggagacuucaucaaag

SEQ ID NO: 1383109 - RNA, 19 nt, Homo sapiens
auggauggcuauuacaaag

SEQ ID NO: 1383110 - RNA, 19 nt, Homo sapiens
uuacaaugcuucugucuua

SEQ ID NO: 1383111 - RNA, 19 nt, Homo sapiens
gaagagagcuuugggacau

SEQ ID NO: 1383112 - RNA, 19 nt, Homo sapiens
ggauauccgucacaacuuu

SEQ ID NO: 1383113 - RNA, 19 nt, Homo sapiens
ccucaccgcuuuccucuua

SEQ ID NO: 1383114 - RNA, 19 nt, Homo sapiens
gcgaauggcuccugaacuu

SEQ ID NO: 1383115 - RNA, 19 nt, Homo sapiens
gaagauauauccagugacu

SEQ ID NO: 1383116 - RNA, 19 nt, Homo sapiens
gaagggaagguuagaagua

SEQ ID NO: 1383117 - RNA, 19 nt, Homo sapiens
gaauauaguuagagacauc

SEQ ID NO: 1383118 - RNA, 19 nt, Homo sapiens
ugacagagagaaucaaaua

SEQ ID NO: 1383119 - RNA, 19 nt, Homo sapiens
cagagagaaucaaauauga

SEQ ID NO: 1383120 - RNA, 19 nt, Homo sapiens
gaaaagagcuguaguucuc

SEQ ID NO: 1383121 - RNA, 19 nt, Homo sapiens
gguuuguucuuucuucuua

SEQ ID NO: 1383122 - RNA, 19 nt, Homo sapiens
caacagaacuuaaaagcaa

SEQ ID NO: 1383123 - RNA, 19 nt, Homo sapiens
ucagcgagcucuuuggaaa

SEQ ID NO: 1383124 - RNA, 19 nt, Homo sapiens
gaaaggcugaugaaacuau

SEQ ID NO: 1383125 - RNA, 19 nt, Homo sapiens
gcagagagcaaguggaguu

SEQ ID NO: 1383126 - RNA, 19 nt, Homo sapiens
agauauauccagugacuua

SEQ ID NO: 1383127 - RNA, 19 nt, Homo sapiens
uuagagacaucagguuuaa

SEQ ID NO: 1383128 - RNA, 19 nt, Homo sapiens
gaacacaccuacuuuuauc

SEQ ID NO: 1383129 - RNA, 19 nt, Homo sapiens
gcagcuguauucuaugguu

SEQ ID NO: 1383130 - RNA, 19 nt, Homo sapiens
ccacagcucaucuugcuuu

SEQ ID NO: 1383131 - RNA, 19 nt, Homo sapiens
gaauggcuccugaacuuga

SEQ ID NO: 1383132 - RNA, 19 nt, Homo sapiens
gggaauaaaggucacauau

SEQ ID NO: 1383133 - RNA, 19 nt, Homo sapiens
gugauagucugcagucguu

SEQ ID NO: 1383134 - RNA, 19 nt, Homo sapiens
cuccuaauguuaugguuua

SEQ ID NO: 1383135 - RNA, 19 nt, Homo sapiens
gaaauccuaggacucguuu

SEQ ID NO: 1383136 - RNA, 19 nt, Homo sapiens
gaaguacgaaggcaguuug

SEQ ID NO: 1383137 - RNA, 19 nt, Homo sapiens
gggcugugcugcuguuugu

SEQ ID NO: 1383138 - RNA, 19 nt, Homo sapiens
gugugcagcuguauucuau

SEQ ID NO: 1383139 - RNA, 19 nt, Homo sapiens
uggaaaggcugaugaaacu

SEQ ID NO: 1383140 - RNA, 19 nt, Homo sapiens
guucuagaguuucaaggaa

SEQ ID NO: 1383141 - RNA, 19 nt, Homo sapiens
guaguucuccuaauguuau

SEQ ID NO: 1383142 - RNA, 19 nt, Homo sapiens
ucaccgcuuuccucuuaua

SEQ ID NO: 1383143 - RNA, 19 nt, Homo sapiens
guuagagacaucagguuua

SEQ ID NO: 1383144 - RNA, 19 nt, Homo sapiens
ggacauggugggaauaaag

SEQ ID NO: 1383145 - RNA, 19 nt, Homo sapiens
gcccuugccuguagucuca

SEQ ID NO: 1383146 - RNA, 19 nt, Homo sapiens
uaacacccaucuuuucuuu

SEQ ID NO: 1383147 - RNA, 19 nt, Homo sapiens
uccuaggacucguuuauuu

SEQ ID NO: 1383148 - RNA, 19 nt, Homo sapiens
gagaaucaaauaugacuag

SEQ ID NO: 1383149 - RNA, 19 nt, Homo sapiens
acaccuuucuguuuauuug

SEQ ID NO: 1383150 - RNA, 19 nt, Homo sapiens
ucuaagcauucuagugaaa

SEQ ID NO: 1383151 - RNA, 19 nt, Homo sapiens
gcgcucgccuuaccugaga

SEQ ID NO: 1383152 - RNA, 19 nt, Homo sapiens
agaggaauauaguuagaga

SEQ ID NO: 1383153 - RNA, 19 nt, Homo sapiens
uugguuagcugguuuguuc

SEQ ID NO: 1383154 - RNA, 19 nt, Homo sapiens
gaugguccucuacuugaua

SEQ ID NO: 1383155 - RNA, 19 nt, Homo sapiens
ugagagccacguaccguua

SEQ ID NO: 1383156 - RNA, 19 nt, Homo sapiens
gagggucgcuugaguucag

SEQ ID NO: 1383157 - RNA, 19 nt, Homo sapiens
cccaguacuuucuuuggua

SEQ ID NO: 1383158 - RNA, 19 nt, Homo sapiens
ggaaauccuaggacucguu

SEQ ID NO: 1383159 - RNA, 19 nt, Homo sapiens
acagagagaaucaaauaug

SEQ ID NO: 1383160 - RNA, 19 nt, Homo sapiens
gagcuguaguucuccuaau

SEQ ID NO: 1383161 - RNA, 19 nt, Homo sapiens
gcuccucacucccaacauc

SEQ ID NO: 1383162 - RNA, 19 nt, Homo sapiens
ccuguagucucagcacuuu

SEQ ID NO: 1383163 - RNA, 19 nt, Homo sapiens
gccaguauuuguuccuguu

SEQ ID NO: 1383164 - RNA, 19 nt, Homo sapiens
gaacauucuaagcauucua

SEQ ID NO: 1383165 - RNA, 19 nt, Homo sapiens
guaaugcggacucuauugu

SEQ ID NO: 1383166 - RNA, 19 nt, Homo sapiens
gaagaaccccugacagaga

SEQ ID NO: 1383167 - RNA, 19 nt, Homo sapiens
augaagauauauccaguga

SEQ ID NO: 1383168 - RNA, 19 nt, Homo sapiens
gguuuaagccaguauuugu

SEQ ID NO: 1383169 - RNA, 19 nt, Homo sapiens
agugaaaguucccauguuc

SEQ ID NO: 1383170 - RNA, 19 nt, Homo sapiens
uguguuacauucugauugu

SEQ ID NO: 1383171 - RNA, 19 nt, Homo sapiens
cagcuguauucuaugguuu

SEQ ID NO: 1383172 - RNA, 19 nt, Homo sapiens
gguauacggacaucgacua

SEQ ID NO: 1383173 - RNA, 19 nt, Homo sapiens
ggaauauaguuagagacau

SEQ ID NO: 1383174 - RNA, 19 nt, Homo sapiens
cuacuguguuacauucuga

SEQ ID NO: 1383175 - RNA, 19 nt, Homo sapiens
gugcagcuguauucuaugg

SEQ ID NO: 1383176 - RNA, 19 nt, Homo sapiens
gguaaugcggacucuauug

SEQ ID NO: 1383177 - RNA, 19 nt, Homo sapiens
cuucaugccggaugugaua

SEQ ID NO: 1383178 - RNA, 19 nt, Homo sapiens
aaaggucacauauuggaaa

SEQ ID NO: 1383179 - RNA, 19 nt, Homo sapiens
uagugaaaguucccauguu

SEQ ID NO: 1383180 - RNA, 19 nt, Homo sapiens
agagagcuuugggacauuu

SEQ ID NO: 1383181 - RNA, 19 nt, Homo sapiens
gcugguuuguucuuucuuc

SEQ ID NO: 1383182 - RNA, 19 nt, Homo sapiens
ugaguacggcugggaauuu

SEQ ID NO: 1383183 - RNA, 19 nt, Homo sapiens
gacaaaagccuccgucaau

SEQ ID NO: 1383184 - RNA, 19 nt, Homo sapiens
gcgguaaugcggacucuau

SEQ ID NO: 1383185 - RNA, 19 nt, Homo sapiens
ggcaagauggugagaccua

SEQ ID NO: 1383186 - RNA, 19 nt, Homo sapiens
caucagguuuaagccagua

SEQ ID NO: 1383187 - RNA, 19 nt, Homo sapiens
ugucuuguauggaccagaa

SEQ ID NO: 1383188 - RNA, 19 nt, Homo sapiens
gagagaaucaaauaugacu

SEQ ID NO: 1383189 - RNA, 19 nt, Homo sapiens
guuagcugguuuguucuuu

SEQ ID NO: 1383190 - RNA, 19 nt, Homo sapiens
gcuuucagcugugucuuuc

SEQ ID NO: 1383191 - RNA, 19 nt, Homo sapiens
guccucuacuugauaaaga

SEQ ID NO: 1383192 - RNA, 19 nt, Homo sapiens
uaagcauucuagugaaagu

SEQ ID NO: 1383193 - RNA, 19 nt, Homo sapiens
auucuaagcauucuaguga

SEQ ID NO: 1383194 - RNA, 19 nt, Homo sapiens
ggacccugcacgugaggua

SEQ ID NO: 1383195 - RNA, 19 nt, Homo sapiens
gaaucaaauaugacuagug

SEQ ID NO: 1383196 - RNA, 19 nt, Homo sapiens
guuccauccugauucaaau

SEQ ID NO: 1383197 - RNA, 19 nt, Homo sapiens
cugugucuuucgccuauua

SEQ ID NO: 1383198 - RNA, 19 nt, Homo sapiens
cagcucaucuugcuuucag

SEQ ID NO: 1383199 - RNA, 19 nt, Homo sapiens
ggaaaggcugaugaaacua

SEQ ID NO: 1383200 - RNA, 19 nt, Homo sapiens
gggacauggugggaauaaa

SEQ ID NO: 1383201 - RNA, 19 nt, Homo sapiens
gaaaguucccauguuccaa

SEQ ID NO: 1383202 - RNA, 19 nt, Homo sapiens
gcuacuguguuacauucug

SEQ ID NO: 1383203 - RNA, 19 nt, Homo sapiens
guggcuggcuccugccuau

SEQ ID NO: 1383204 - RNA, 19 nt, Homo sapiens
ucgcuugaguucaggaguu

SEQ ID NO: 1383205 - RNA, 19 nt, Homo sapiens
ucugaacauucuaagcauu

SEQ ID NO: 1383206 - RNA, 19 nt, Homo sapiens
acauucugauugucuugua

SEQ ID NO: 1383207 - RNA, 19 nt, Homo sapiens
gacagagagaaucaaauau

SEQ ID NO: 1383208 - RNA, 19 nt, Homo sapiens
ccuauguucuagaguuuca

SEQ ID NO: 1383209 - RNA, 19 nt, Homo sapiens
cagaaugccuuggaaaaga

SEQ ID NO: 1383210 - RNA, 19 nt, Homo sapiens
gaacugcugugcaaugugu

SEQ ID NO: 1383211 - RNA, 19 nt, Homo sapiens
cgaaaacggugaucccuua

SEQ ID NO: 1383212 - RNA, 19 nt, Homo sapiens
ggucaacucugcaggaagu

SEQ ID NO: 1383213 - RNA, 19 nt, Homo sapiens
ccacucuuccuuuaauuua

SEQ ID NO: 1383214 - RNA, 19 nt, Homo sapiens
gcugagaguucuuccagau

SEQ ID NO: 1383215 - RNA, 19 nt, Homo sapiens
gaagguggcauccagaaca

SEQ ID NO: 1383216 - RNA, 19 nt, Homo sapiens
gcacagcugucuccaucuc

SEQ ID NO: 1383217 - RNA, 19 nt, Homo sapiens
gcacacagaagcacacaca

SEQ ID NO: 1383218 - RNA, 19 nt, Homo sapiens
ugagaguucuuccagaugu

SEQ ID NO: 1383219 - RNA, 19 nt, Homo sapiens
gggcccagauugcagagaa

SEQ ID NO: 1383220 - RNA, 19 nt, Homo sapiens
gcaaugugaccggcuauga

SEQ ID NO: 1383221 - RNA, 19 nt, Homo sapiens
ucuguccacucuuccuuua

SEQ ID NO: 1383222 - RNA, 19 nt, Homo sapiens
uaugagggccgacacauug

SEQ ID NO: 1383223 - RNA, 19 nt, Homo sapiens
uagcccagcuggacacaga

SEQ ID NO: 1383224 - RNA, 19 nt, Homo sapiens
guaccaaggauacccaguu

SEQ ID NO: 1383225 - RNA, 19 nt, Homo sapiens
gagaagguggcauccagaa

SEQ ID NO: 1383226 - RNA, 19 nt, Homo sapiens
ggacaagcacacagaagca

SEQ ID NO: 1383227 - RNA, 19 nt, Homo sapiens
ccucuggccuucuguucuu

SEQ ID NO: 1383228 - RNA, 19 nt, Homo sapiens
gcggucaacucugcaggaa

SEQ ID NO: 1383229 - RNA, 19 nt, Homo sapiens
uaccaaggauacccaguuc

SEQ ID NO: 1383230 - RNA, 19 nt, Homo sapiens
gggaauccggucagacuug

SEQ ID NO: 1383231 - RNA, 19 nt, Homo sapiens
uccaagcccuccucugguu

SEQ ID NO: 1383232 - RNA, 19 nt, Homo sapiens
aaacggugaucccuuacuc

SEQ ID NO: 1383233 - RNA, 19 nt, Homo sapiens
gauacccaguucuccuaug

SEQ ID NO: 1383234 - RNA, 19 nt, Homo sapiens
ucgagugguuccuguauag

SEQ ID NO: 1383235 - RNA, 19 nt, Homo sapiens
uguccacucuuccuuuaau

SEQ ID NO: 1383236 - RNA, 19 nt, Homo sapiens
ccuuggaacugcugugcaa

SEQ ID NO: 1383237 - RNA, 19 nt, Homo sapiens
guucuccuaugcugucuuc

SEQ ID NO: 1383238 - RNA, 19 nt, Homo sapiens
ggccuucuguucuugaucu

SEQ ID NO: 1383239 - RNA, 19 nt, Homo sapiens
cgccaaagccuauguucga

SEQ ID NO: 1383240 - RNA, 19 nt, Homo sapiens
gccgacacauugccaugga

SEQ ID NO: 1383241 - RNA, 19 nt, Homo sapiens
ccuaugcugucuucaaguc

SEQ ID NO: 1383242 - RNA, 19 nt, Homo sapiens
gcgaggacaagcacacaga

SEQ ID NO: 1383243 - RNA, 19 nt, Homo sapiens
ggacacccucucccucugu

SEQ ID NO: 1383244 - RNA, 19 nt, Homo sapiens
ggcccagauugcagagaaa

SEQ ID NO: 1383245 - RNA, 19 nt, Homo sapiens
guccacucuuccuuuaauu

SEQ ID NO: 1383246 - RNA, 19 nt, Homo sapiens
gcaggugcagcgccuacaa

SEQ ID NO: 1383247 - RNA, 19 nt, Homo sapiens
gcccuggacacccuauuug

SEQ ID NO: 1383248 - RNA, 19 nt, Homo sapiens
uggaacugcugugcaaugu

SEQ ID NO: 1383249 - RNA, 19 nt, Homo sapiens
gagaguucuuccagauguc

SEQ ID NO: 1383250 - RNA, 19 nt, Homo sapiens
auacugcacugggcauugu

SEQ ID NO: 1383251 - RNA, 19 nt, Homo sapiens
gcaagguggagcugagagu

SEQ ID NO: 1383252 - RNA, 19 nt, Homo sapiens
gugaugccguggugcucaa

SEQ ID NO: 1383253 - RNA, 19 nt, Homo sapiens
ccaaggauacccaguucuc

SEQ ID NO: 1383254 - RNA, 19 nt, Homo sapiens
gauacugcacugggcauug

SEQ ID NO: 1383255 - RNA, 19 nt, Homo sapiens
gggugcagcaugccgacua

SEQ ID NO: 1383256 - RNA, 19 nt, Homo sapiens
ccacuguccuugguaccau

SEQ ID NO: 1383257 - RNA, 19 nt, Homo sapiens
uagcaggaggcacagugua

SEQ ID NO: 1383258 - RNA, 19 nt, Homo sapiens
caagguggagcugagaguu

SEQ ID NO: 1383259 - RNA, 19 nt, Homo sapiens
ggauacccaguucuccuau

SEQ ID NO: 1383260 - RNA, 19 nt, Homo sapiens
uucgagugguuccuguaua

SEQ ID NO: 1383261 - RNA, 19 nt, Homo sapiens
cuaugagggccgacacauu

SEQ ID NO: 1383262 - RNA, 19 nt, Homo sapiens
gcugcauacucuguagguu

SEQ ID NO: 1383263 - RNA, 19 nt, Homo sapiens
ggcuggagcucccuaugcu

SEQ ID NO: 1383264 - RNA, 19 nt, Homo sapiens
ggagaaaguucaccagaga

SEQ ID NO: 1383265 - RNA, 19 nt, Homo sapiens
gcaaauccuuaacauguuu

SEQ ID NO: 1383266 - RNA, 19 nt, Homo sapiens
gcagagcacuuauacuuca

SEQ ID NO: 1383267 - RNA, 19 nt, Homo sapiens
gcacuuauacuucauccua

SEQ ID NO: 1383268 - RNA, 19 nt, Homo sapiens
gaucaacucucccuaaagg

SEQ ID NO: 1383269 - RNA, 19 nt, Homo sapiens
ccacaucgcuaccugauca

SEQ ID NO: 1383270 - RNA, 19 nt, Homo sapiens
gcaccuaugacgaccauua

SEQ ID NO: 1383271 - RNA, 19 nt, Homo sapiens
gaccaaguauucaacgaaa

SEQ ID NO: 1383272 - RNA, 19 nt, Homo sapiens
caaaggugcucucagaauc

SEQ ID NO: 1383273 - RNA, 19 nt, Homo sapiens
gaagagaggagaaaguuca

SEQ ID NO: 1383274 - RNA, 19 nt, Homo sapiens
cgucaaaggugcucucaga

SEQ ID NO: 1383275 - RNA, 19 nt, Homo sapiens
gggcaaauccuuaacaugu

SEQ ID NO: 1383276 - RNA, 19 nt, Homo sapiens
uaaacugcaucaagucaaa

SEQ ID NO: 1383277 - RNA, 19 nt, Homo sapiens
ccuaaaggcugacagugaa

SEQ ID NO: 1383278 - RNA, 19 nt, Homo sapiens
caacaaguggcgcagauaa

SEQ ID NO: 1383279 - RNA, 19 nt, Homo sapiens
uagaucaacucucccuaaa

SEQ ID NO: 1383280 - RNA, 19 nt, Homo sapiens
aaacucagcaacuucauaa

SEQ ID NO: 1383281 - RNA, 19 nt, Homo sapiens
ggcaaauccuuaacauguu

SEQ ID NO: 1383282 - RNA, 19 nt, Homo sapiens
uacaaacuauggacucuau

SEQ ID NO: 1383283 - RNA, 19 nt, Homo sapiens
cccaauccauuuacagaaa

SEQ ID NO: 1383284 - RNA, 19 nt, Homo sapiens
cagagacacugacaagaca

SEQ ID NO: 1383285 - RNA, 19 nt, Homo sapiens
gcaaggagucaucuacuag

SEQ ID NO: 1383286 - RNA, 19 nt, Homo sapiens
agaaucaucaucugcauuu

SEQ ID NO: 1383287 - RNA, 19 nt, Homo sapiens
aagcagagcacuuauacuu

SEQ ID NO: 1383288 - RNA, 19 nt, Homo sapiens
caaacucagcaacuucaua

SEQ ID NO: 1383289 - RNA, 19 nt, Homo sapiens
caaacuauggacucuauga

SEQ ID NO: 1383290 - RNA, 19 nt, Homo sapiens
gacaacaaguggcgcagau

SEQ ID NO: 1383291 - RNA, 19 nt, Homo sapiens
gcuggcagauugagaccaa

SEQ ID NO: 1383292 - RNA, 19 nt, Homo sapiens
ccacagaccagaccagauc

SEQ ID NO: 1383293 - RNA, 19 nt, Homo sapiens
gcacuuggaauggacagaa

SEQ ID NO: 1383294 - RNA, 19 nt, Homo sapiens
gccuuaaacugcaucaagu

SEQ ID NO: 1383295 - RNA, 19 nt, Homo sapiens
ggaaauuggauggaagaga

SEQ ID NO: 1383296 - RNA, 19 nt, Homo sapiens
gagaccaaguauucaacga

SEQ ID NO: 1383297 - RNA, 19 nt, Homo sapiens
gaaucaucaucugcauuug

SEQ ID NO: 1383298 - RNA, 19 nt, Homo sapiens
ucaaaggugcucucagaau

SEQ ID NO: 1383299 - RNA, 19 nt, Homo sapiens
gaucuggcccgucaaaggu

SEQ ID NO: 1383300 - RNA, 19 nt, Homo sapiens
agauugagaccaaguauuc

SEQ ID NO: 1383301 - RNA, 19 nt, Homo sapiens
gcagauugagaccaaguau

SEQ ID NO: 1383302 - RNA, 19 nt, Homo sapiens
ucucugagguuagcaagga

SEQ ID NO: 1383303 - RNA, 19 nt, Homo sapiens
agcaaggagucaucuacua

SEQ ID NO: 1383304 - RNA, 19 nt, Homo sapiens
gccugaagcagagcacuua

SEQ ID NO: 1383305 - RNA, 19 nt, Homo sapiens
ggaagagaggagaaaguuc

SEQ ID NO: 1383306 - RNA, 19 nt, Homo sapiens
ccacuccgcacuuggaaug

SEQ ID NO: 1383307 - RNA, 19 nt, Homo sapiens
gaggccagcugggaagaca

SEQ ID NO: 1383308 - RNA, 19 nt, Homo sapiens
cccacagguuccuuucuuu

SEQ ID NO: 1383309 - RNA, 19 nt, Homo sapiens
uggcgcagauaaacucaga

SEQ ID NO: 1383310 - RNA, 19 nt, Homo sapiens
cgagaucuggcccgucaaa

SEQ ID NO: 1383311 - RNA, 19 nt, Homo sapiens
ugaagcagagcacuuauac

SEQ ID NO: 1383312 - RNA, 19 nt, Homo sapiens
ccaaguauucaacgaaagu

SEQ ID NO: 1383313 - RNA, 19 nt, Homo sapiens
ggcugacagugaacucuug

SEQ ID NO: 1383314 - RNA, 19 nt, Homo sapiens
ggaauggacagaaguugcu

SEQ ID NO: 1383315 - RNA, 19 nt, Homo sapiens
ggauggaagagaggagaaa

SEQ ID NO: 1383316 - RNA, 19 nt, Homo sapiens
ccagagacacugacaagac

SEQ ID NO: 1383317 - RNA, 19 nt, Homo sapiens
auagaucaacucucccuaa

SEQ ID NO: 1383318 - RNA, 19 nt, Homo sapiens
guaaauccacagccacucu

SEQ ID NO: 1383319 - RNA, 19 nt, Homo sapiens
aaagaaaccuggggcaaau

SEQ ID NO: 1383320 - RNA, 19 nt, Homo sapiens
gaccaccguugugcgcuau

SEQ ID NO: 1383321 - RNA, 19 nt, Homo sapiens
cugaagcagagcacuuaua

SEQ ID NO: 1383322 - RNA, 19 nt, Homo sapiens
ggugguaugggaagaggaa

SEQ ID NO: 1383323 - RNA, 19 nt, Homo sapiens
caagacaccccaauccauu

SEQ ID NO: 1383324 - RNA, 19 nt, Homo sapiens
uggaagagaggagaaaguu

SEQ ID NO: 1383325 - RNA, 19 nt, Homo sapiens
gcucucagaaucaucaucu

SEQ ID NO: 1383326 - RNA, 19 nt, Homo sapiens
ccacagccacucucuacuc

SEQ ID NO: 1383327 - RNA, 19 nt, Homo sapiens
ggccagcugggaagacaaa

SEQ ID NO: 1383328 - RNA, 19 nt, Homo sapiens
acccacagguuccuuucuu

SEQ ID NO: 1383329 - RNA, 19 nt, Homo sapiens
cagcaccuaugacgaccau

SEQ ID NO: 1383330 - RNA, 19 nt, Homo sapiens
aaaggugcucucagaauca

SEQ ID NO: 1383331 - RNA, 19 nt, Homo sapiens
ccuaugacgaccauuacaa

SEQ ID NO: 1383332 - RNA, 19 nt, Homo sapiens
cccuaaaggcugacaguga

SEQ ID NO: 1383333 - RNA, 19 nt, Homo sapiens
uaugggaagaggaaaguug

SEQ ID NO: 1383334 - RNA, 19 nt, Homo sapiens
ccaauccauuuacagaaaa

SEQ ID NO: 1383335 - RNA, 19 nt, Homo sapiens
cagcugggaagacaaaaua

SEQ ID NO: 1383336 - RNA, 19 nt, Homo sapiens
cagauugagaccaaguauu

SEQ ID NO: 1383337 - RNA, 19 nt, Homo sapiens
caaagaaaccuggggcaaa

SEQ ID NO: 1383338 - RNA, 19 nt, Homo sapiens
agaccaaguauucaacgaa

SEQ ID NO: 1383339 - RNA, 19 nt, Homo sapiens
caccagagacacugacaag

SEQ ID NO: 1383340 - RNA, 19 nt, Homo sapiens
cugcaucaagucaaagaaa

SEQ ID NO: 1383341 - RNA, 19 nt, Homo sapiens
cauccaacaauuaaagauc

SEQ ID NO: 1383342 - RNA, 19 nt, Homo sapiens
ggcagauugagaccaagua

SEQ ID NO: 1383343 - RNA, 19 nt, Homo sapiens
ggaccaagcugcugggauu

SEQ ID NO: 1383344 - RNA, 19 nt, Homo sapiens
acacugaccuacagagaaa

SEQ ID NO: 1383345 - RNA, 19 nt, Homo sapiens
ccaggaaggucacaaagug

SEQ ID NO: 1383346 - RNA, 19 nt, Homo sapiens
ggccugcgcuagcuucuuu

SEQ ID NO: 1383347 - RNA, 19 nt, Homo sapiens
cagcagcccuggcauguuc

SEQ ID NO: 1383348 - RNA, 19 nt, Homo sapiens
ggaauccugucaccaucaa

SEQ ID NO: 1383349 - RNA, 19 nt, Homo sapiens
gcuggaugcuuguucuuug

SEQ ID NO: 1383350 - RNA, 19 nt, Homo sapiens
ggaaucagaggacaaguuc

SEQ ID NO: 1383351 - RNA, 19 nt, Homo sapiens
gggccaggcugagugcaua

SEQ ID NO: 1383352 - RNA, 19 nt, Homo sapiens
gaaaauggacuacuucugu

SEQ ID NO: 1383353 - RNA, 19 nt, Homo sapiens
gcacccagcuguggucaag

SEQ ID NO: 1383354 - RNA, 19 nt, Homo sapiens
caccaucaauaaucacuug

SEQ ID NO: 1383355 - RNA, 19 nt, Homo sapiens
caacagugcccuccagaag

SEQ ID NO: 1383356 - RNA, 19 nt, Homo sapiens
ccacaggccuuagggauac

SEQ ID NO: 1383357 - RNA, 19 nt, Homo sapiens
ggacacugaccuacagaga

SEQ ID NO: 1383358 - RNA, 19 nt, Homo sapiens
caaagugccucaguuccau

SEQ ID NO: 1383359 - RNA, 19 nt, Homo sapiens
ggacugaacugggguggaa

SEQ ID NO: 1383360 - RNA, 19 nt, Homo sapiens
ggaugugggcccagaauca

SEQ ID NO: 1383361 - RNA, 19 nt, Homo sapiens
gccuguaccugcugaagga

SEQ ID NO: 1383362 - RNA, 19 nt, Homo sapiens
ucagcuuucuggaagauga

SEQ ID NO: 1383363 - RNA, 19 nt, Homo sapiens
gaaggaaucagaggacaag

SEQ ID NO: 1383364 - RNA, 19 nt, Homo sapiens
ucacaaagugccucaguuc

SEQ ID NO: 1383365 - RNA, 19 nt, Homo sapiens
gagaaggggagaaagcuua

SEQ ID NO: 1383366 - RNA, 19 nt, Homo sapiens
gggcaugugagaugaguga

SEQ ID NO: 1383367 - RNA, 19 nt, Homo sapiens
gaacuuggacaugaaggau

SEQ ID NO: 1383368 - RNA, 19 nt, Homo sapiens
gguugaagcagacuggauu

SEQ ID NO: 1383369 - RNA, 19 nt, Homo sapiens
gccguggccucguuucuca

SEQ ID NO: 1383370 - RNA, 19 nt, Homo sapiens
gagggaauccugucaccau

SEQ ID NO: 1383371 - RNA, 19 nt, Homo sapiens
ggagcaggaugagggaauc

SEQ ID NO: 1383372 - RNA, 19 nt, Homo sapiens
gcgcuagcuucuuuugaua

SEQ ID NO: 1383373 - RNA, 19 nt, Homo sapiens
ccagagggucuuacuguuc

SEQ ID NO: 1383374 - RNA, 19 nt, Homo sapiens
gacacugaccuacagagaa

SEQ ID NO: 1383375 - RNA, 19 nt, Homo sapiens
acagugcccuccagaagca

SEQ ID NO: 1383376 - RNA, 19 nt, Homo sapiens
ggauugggaaggaguuuca

SEQ ID NO: 1383377 - RNA, 19 nt, Homo sapiens
ggguggaacugaguguguu

SEQ ID NO: 1383378 - RNA, 19 nt, Homo sapiens
gucacaaagugccucaguu

SEQ ID NO: 1383379 - RNA, 19 nt, Homo sapiens
gggacgacuguaaguauga

SEQ ID NO: 1383380 - RNA, 19 nt, Homo sapiens
caggaggccucaccauacu

SEQ ID NO: 1383381 - RNA, 19 nt, Homo sapiens
aaucagaggacaaguucaa

SEQ ID NO: 1383382 - RNA, 19 nt, Homo sapiens
cagagaaaauggacuacuu

SEQ ID NO: 1383383 - RNA, 19 nt, Homo sapiens
ggcugggucugguuucuuc

SEQ ID NO: 1383384 - RNA, 19 nt, Homo sapiens
ggacgacuguaaguaugag

SEQ ID NO: 1383385 - RNA, 19 nt, Homo sapiens
ccaggaggccucaccauac

SEQ ID NO: 1383386 - RNA, 19 nt, Homo sapiens
cccaggaggccucaccaua

SEQ ID NO: 1383387 - RNA, 19 nt, Homo sapiens
aauccugucaccaucaaua

SEQ ID NO: 1383388 - RNA, 19 nt, Homo sapiens
cgggacgacuguaaguaug

SEQ ID NO: 1383389 - RNA, 19 nt, Homo sapiens
caggguaccacaggccuua

SEQ ID NO: 1383390 - RNA, 19 nt, Homo sapiens
gacuguaaguaugagugua

SEQ ID NO: 1383391 - RNA, 19 nt, Homo sapiens
gagguguggcuucaaagug

SEQ ID NO: 1383392 - RNA, 19 nt, Homo sapiens
aguucaagcuggacugaga

SEQ ID NO: 1383393 - RNA, 19 nt, Homo sapiens
uggcaagggaugugcuuaa

SEQ ID NO: 1383394 - RNA, 19 nt, Homo sapiens
gcagcagggccacacuaug

SEQ ID NO: 1383395 - RNA, 19 nt, Homo sapiens
guaaguaugaguguaugug

SEQ ID NO: 1383396 - RNA, 19 nt, Homo sapiens
cccagagggucuuacuguu

SEQ ID NO: 1383397 - RNA, 19 nt, Homo sapiens
gaaggaugugggcccagaa

SEQ ID NO: 1383398 - RNA, 19 nt, Homo sapiens
ccucauccgcuucgacuau

SEQ ID NO: 1383399 - RNA, 19 nt, Homo sapiens
cagcagggccacacuaugc

SEQ ID NO: 1383400 - RNA, 19 nt, Homo sapiens
caccagccuuggagucugu

SEQ ID NO: 1383401 - RNA, 19 nt, Homo sapiens
caagcuggacugagaccuu

SEQ ID NO: 1383402 - RNA, 19 nt, Homo sapiens
cagggacacugaccuacag

SEQ ID NO: 1383403 - RNA, 19 nt, Homo sapiens
gaggggagcuaugcuagga

SEQ ID NO: 1383404 - RNA, 19 nt, Homo sapiens
agguguggcuucaaagugu

SEQ ID NO: 1383405 - RNA, 19 nt, Homo sapiens
caaguucaagcuggacuga

SEQ ID NO: 1383406 - RNA, 19 nt, Homo sapiens
ggugcuggaugcuuguucu

SEQ ID NO: 1383407 - RNA, 19 nt, Homo sapiens
ggaaggccucccagcaucu

SEQ ID NO: 1383408 - RNA, 19 nt, Homo sapiens
caccagggacacugaccua

SEQ ID NO: 1383409 - RNA, 19 nt, Homo sapiens
guugaagcagacuggauuu

SEQ ID NO: 1383410 - RNA, 19 nt, Homo sapiens
aaaggcagucuccgugguu

SEQ ID NO: 1383411 - RNA, 19 nt, Homo sapiens
gggaauccugucaccauca

SEQ ID NO: 1383412 - RNA, 19 nt, Homo sapiens
uguccacaguugagagguu

SEQ ID NO: 1383413 - RNA, 19 nt, Homo sapiens
gguguguuagcguggguua

SEQ ID NO: 1383414 - RNA, 19 nt, Homo sapiens
ggucacaaagugccucagu

SEQ ID NO: 1383415 - RNA, 19 nt, Homo sapiens
guucugguccacagucuuc

SEQ ID NO: 1383416 - RNA, 19 nt, Homo sapiens
agggagcuccagaaacuuu

SEQ ID NO: 1383417 - RNA, 19 nt, Homo sapiens
ucuugaacuuggacaugaa

SEQ ID NO: 1383418 - RNA, 19 nt, Homo sapiens
gcaaggaugaccagcauuu

SEQ ID NO: 1383419 - RNA, 19 nt, Homo sapiens
aaaugggacuguggaaaua

SEQ ID NO: 1383420 - RNA, 19 nt, Homo sapiens
gugcaggccuuccuacaug

SEQ ID NO: 1383421 - RNA, 19 nt, Homo sapiens
gagugacccugaccuguug

SEQ ID NO: 1383422 - RNA, 19 nt, Homo sapiens
ggacuguggaaauaaagua

SEQ ID NO: 1383423 - RNA, 19 nt, Homo sapiens
gaucgaggagcgcaacuuu

SEQ ID NO: 1383424 - RNA, 19 nt, Homo sapiens
caugaucgaugaccuccuu

SEQ ID NO: 1383425 - RNA, 19 nt, Homo sapiens
gagaagcucaaggcugaua

SEQ ID NO: 1383426 - RNA, 19 nt, Homo sapiens
aggaagagaucaaggagau

SEQ ID NO: 1383427 - RNA, 19 nt, Homo sapiens
cagcaaggaugaccagcau

SEQ ID NO: 1383428 - RNA, 19 nt, Homo sapiens
aggagaggcuggugcuuug

SEQ ID NO: 1383429 - RNA, 19 nt, Homo sapiens
uggagcagcugcaccacuu

SEQ ID NO: 1383430 - RNA, 19 nt, Homo sapiens
cgaggacgcccugaauaaa

SEQ ID NO: 1383431 - RNA, 19 nt, Homo sapiens
ggaggcacagcgucugauu

SEQ ID NO: 1383432 - RNA, 19 nt, Homo sapiens
cgucuugucuccauaucug

SEQ ID NO: 1383433 - RNA, 19 nt, Homo sapiens
ucaacgagcagaacuugga

SEQ ID NO: 1383434 - RNA, 19 nt, Homo sapiens
acagcagcaugaucgauga

SEQ ID NO: 1383435 - RNA, 19 nt, Homo sapiens
acgaggacgcccugaauaa

SEQ ID NO: 1383436 - RNA, 19 nt, Homo sapiens
caggagaggcuggugcuuu

SEQ ID NO: 1383437 - RNA, 19 nt, Homo sapiens
guggcaggccucugucuuu

SEQ ID NO: 1383438 - RNA, 19 nt, Homo sapiens
acuuggagcuggagcaugu

SEQ ID NO: 1383439 - RNA, 19 nt, Homo sapiens
uggagcaugugcaggaaga

SEQ ID NO: 1383440 - RNA, 19 nt, Homo sapiens
caucaacgagcagaacuug

SEQ ID NO: 1383441 - RNA, 19 nt, Homo sapiens
gaggacgcccugaauaaac

SEQ ID NO: 1383442 - RNA, 19 nt, Homo sapiens
gaaaaugggacuguggaaa

SEQ ID NO: 1383443 - RNA, 19 nt, Homo sapiens
ugguggagcuccugacagu

SEQ ID NO: 1383444 - RNA, 19 nt, Homo sapiens
gaacuuggagcuggagcau

SEQ ID NO: 1383445 - RNA, 19 nt, Homo sapiens
agagugacccugaccuguu

SEQ ID NO: 1383446 - RNA, 19 nt, Homo sapiens
uacgaggacgcccugaaua

SEQ ID NO: 1383447 - RNA, 19 nt, Homo sapiens
gucagugucuguccgucuu

SEQ ID NO: 1383448 - RNA, 19 nt, Homo sapiens
gaagcucaaggcugauauc

SEQ ID NO: 1383449 - RNA, 19 nt, Homo sapiens
caaggaugaccagcauuug

SEQ ID NO: 1383450 - RNA, 19 nt, Homo sapiens
gcuggagcaugugcaggaa

SEQ ID NO: 1383451 - RNA, 19 nt, Homo sapiens
uccucaagcucaagaacaa

SEQ ID NO: 1383452 - RNA, 19 nt, Homo sapiens
cuacgaggacgcccugaau

SEQ ID NO: 1383453 - RNA, 19 nt, Homo sapiens
uaaacugucccagcugaug

SEQ ID NO: 1383454 - RNA, 19 nt, Homo sapiens
cuacaugcccagagcuuca

SEQ ID NO: 1383455 - RNA, 19 nt, Homo sapiens
gauauccagcuccucuuca

SEQ ID NO: 1383456 - RNA, 19 nt, Homo sapiens
ggagaugcaggaggcuuug

SEQ ID NO: 1383457 - RNA, 19 nt, Homo sapiens
gagcaugugcaggaagaga

SEQ ID NO: 1383458 - RNA, 19 nt, Homo sapiens
agaggcuggugcuuugcua

SEQ ID NO: 1383459 - RNA, 19 nt, Homo sapiens
gcugacaggugugggaaaa

SEQ ID NO: 1383460 - RNA, 19 nt, Homo sapiens
gcauuugcccagccacauc

SEQ ID NO: 1383461 - RNA, 19 nt, Homo sapiens
gacagugcaggccuuccua

SEQ ID NO: 1383462 - RNA, 19 nt, Homo sapiens
cugugucccugucucugua

SEQ ID NO: 1383463 - RNA, 19 nt, Homo sapiens
caaagaaaguccuuagaua

SEQ ID NO: 1383464 - RNA, 19 nt, Homo sapiens
gaaaguugauuugaaguga

SEQ ID NO: 1383465 - RNA, 19 nt, Homo sapiens
ugauagaccugucauugua

SEQ ID NO: 1383466 - RNA, 19 nt, Homo sapiens
gaaaguccuuagauaaaga

SEQ ID NO: 1383467 - RNA, 19 nt, Homo sapiens
agaaagggaucaugaacua

SEQ ID NO: 1383468 - RNA, 19 nt, Homo sapiens
gaaagaggaaaguugauuu

SEQ ID NO: 1383469 - RNA, 19 nt, Homo sapiens
gugcagaacuaccaccuuu

SEQ ID NO: 1383470 - RNA, 19 nt, Homo sapiens
gaucuaauguaccugauuc

SEQ ID NO: 1383471 - RNA, 19 nt, Homo sapiens
gaggaaaguugauuugaag

SEQ ID NO: 1383472 - RNA, 19 nt, Homo sapiens
auacggagauguuaauuug

SEQ ID NO: 1383473 - RNA, 19 nt, Homo sapiens
ccaaacuacugcuuuaaug

SEQ ID NO: 1383474 - RNA, 19 nt, Homo sapiens
gaagugaggauuagaagug

SEQ ID NO: 1383475 - RNA, 19 nt, Homo sapiens
gcaagcaacuggauugaac

SEQ ID NO: 1383476 - RNA, 19 nt, Homo sapiens
gauuagaagugaaugacaa

SEQ ID NO: 1383477 - RNA, 19 nt, Homo sapiens
gcaaagaaaguccuuagau

SEQ ID NO: 1383478 - RNA, 19 nt, Homo sapiens
uacaagaugugauucauga

SEQ ID NO: 1383479 - RNA, 19 nt, Homo sapiens
guaaaguguucugucauuu

SEQ ID NO: 1383480 - RNA, 19 nt, Homo sapiens
cagaagccguucauuagaa

SEQ ID NO: 1383481 - RNA, 19 nt, Homo sapiens
caagaaagaggaaaguuga

SEQ ID NO: 1383482 - RNA, 19 nt, Homo sapiens
gcaccaaucccaacaugaa

SEQ ID NO: 1383483 - RNA, 19 nt, Homo sapiens
ucacauggugcuuauaaua

SEQ ID NO: 1383484 - RNA, 19 nt, Homo sapiens
ccacaagaccuauuaacaa

SEQ ID NO: 1383485 - RNA, 19 nt, Homo sapiens
gcacuaucauuaaucuuuc

SEQ ID NO: 1383486 - RNA, 19 nt, Homo sapiens
ucacaaauaugagccaaga

SEQ ID NO: 1383487 - RNA, 19 nt, Homo sapiens
ugaaccaucuaauccuaua

SEQ ID NO: 1383488 - RNA, 19 nt, Homo sapiens
ggucaacccuaccuuagug

SEQ ID NO: 1383489 - RNA, 19 nt, Homo sapiens
caccagaagccguucauua

SEQ ID NO: 1383490 - RNA, 19 nt, Homo sapiens
gaaccaagacuggcacuau

SEQ ID NO: 1383491 - RNA, 19 nt, Homo sapiens
uuacuacccuuccaaaugu

SEQ ID NO: 1383492 - RNA, 19 nt, Homo sapiens
ggagacaucagaaagaaug

SEQ ID NO: 1383493 - RNA, 19 nt, Homo sapiens
ggauugaacacccuaagaa

SEQ ID NO: 1383494 - RNA, 19 nt, Homo sapiens
uaacacaagcucuucugua

SEQ ID NO: 1383495 - RNA, 19 nt, Homo sapiens
acugcaagguugacauuua

SEQ ID NO: 1383496 - RNA, 19 nt, Homo sapiens
ugacaaaacccuuuagaua

SEQ ID NO: 1383497 - RNA, 19 nt, Homo sapiens
cuacagagauagccuacug

SEQ ID NO: 1383498 - RNA, 19 nt, Homo sapiens
ggucugggguucaaaauaa

SEQ ID NO: 1383499 - RNA, 19 nt, Homo sapiens
agaggaaaguugauuugaa

SEQ ID NO: 1383500 - RNA, 19 nt, Homo sapiens
gacaaaacccuuuagauaa

SEQ ID NO: 1383501 - RNA, 19 nt, Homo sapiens
uguaaaguguucugucauu

SEQ ID NO: 1383502 - RNA, 19 nt, Homo sapiens
caacccaaauuccaucugu

SEQ ID NO: 1383503 - RNA, 19 nt, Homo sapiens
ugaagaaucuacuaaacag

SEQ ID NO: 1383504 - RNA, 19 nt, Homo sapiens
caggagacaucagaaagaa

SEQ ID NO: 1383505 - RNA, 19 nt, Homo sapiens
cacaagaccuauuaacaag

SEQ ID NO: 1383506 - RNA, 19 nt, Homo sapiens
gcaccugacacuucugaaa

SEQ ID NO: 1383507 - RNA, 19 nt, Homo sapiens
gcaagguugacauuuauug

SEQ ID NO: 1383508 - RNA, 19 nt, Homo sapiens
ugucaaguuugcagaauug

SEQ ID NO: 1383509 - RNA, 19 nt, Homo sapiens
guucacauggugcuuauaa

SEQ ID NO: 1383510 - RNA, 19 nt, Homo sapiens
acaaauaugagccaagaaa

SEQ ID NO: 1383511 - RNA, 19 nt, Homo sapiens
guuguaaaguguucuguca

SEQ ID NO: 1383512 - RNA, 19 nt, Homo sapiens
uuacuucggucacuacuca

SEQ ID NO: 1383513 - RNA, 19 nt, Homo sapiens
gaccacagcugccccaauu

SEQ ID NO: 1383514 - RNA, 19 nt, Homo sapiens
caaauuccaucugugacuu

SEQ ID NO: 1383515 - RNA, 19 nt, Homo sapiens
caccuaaacauccagauaa

SEQ ID NO: 1383516 - RNA, 19 nt, Homo sapiens
gauguuaauuugggauaug

SEQ ID NO: 1383517 - RNA, 19 nt, Homo sapiens
ccaagaaagaggaaaguug

SEQ ID NO: 1383518 - RNA, 19 nt, Homo sapiens
guccuuagauaaagagaga

SEQ ID NO: 1383519 - RNA, 19 nt, Homo sapiens
gagaaaauguuaacacaag

SEQ ID NO: 1383520 - RNA, 19 nt, Homo sapiens
cagaaggcaucaucaccaa

SEQ ID NO: 1383521 - RNA, 19 nt, Homo sapiens
uuuaaaccaugccaaacua

SEQ ID NO: 1383522 - RNA, 19 nt, Homo sapiens
ugacauuuauuguguugug

SEQ ID NO: 1383523 - RNA, 19 nt, Homo sapiens
ccaccuaaacauccagaua

SEQ ID NO: 1383524 - RNA, 19 nt, Homo sapiens
cuauaaaugucugcacaaa

SEQ ID NO: 1383525 - RNA, 19 nt, Homo sapiens
gaaggcaucaucaccaauc

SEQ ID NO: 1383526 - RNA, 19 nt, Homo sapiens
cccaucagcuuccaccaaa

SEQ ID NO: 1383527 - RNA, 19 nt, Homo sapiens
agaagccguucauuagaaa

SEQ ID NO: 1383528 - RNA, 19 nt, Homo sapiens
ggaaaguugauuugaagug

SEQ ID NO: 1383529 - RNA, 19 nt, Homo sapiens
ccugaaccaucuaauccua

SEQ ID NO: 1383530 - RNA, 19 nt, Homo sapiens
gaucaugaacuacgucaca

SEQ ID NO: 1383531 - RNA, 19 nt, Homo sapiens
aaccaagacuggcacuauu

SEQ ID NO: 1383532 - RNA, 19 nt, Homo sapiens
gccaucaaccauuuacuuu

SEQ ID NO: 1383533 - RNA, 19 nt, Homo sapiens
cugcaagguugacauuuau

SEQ ID NO: 1383534 - RNA, 19 nt, Homo sapiens
gaacucuccagaugaacaa

SEQ ID NO: 1383535 - RNA, 19 nt, Homo sapiens
caagaccuauuaacaagac

SEQ ID NO: 1383536 - RNA, 19 nt, Homo sapiens
aacacaagcucuucuguag

SEQ ID NO: 1383537 - RNA, 19 nt, Homo sapiens
ccagaaugccaccaccaua

SEQ ID NO: 1383538 - RNA, 19 nt, Homo sapiens
caucaccaaucacccaaau

SEQ ID NO: 1383539 - RNA, 19 nt, Homo sapiens
gaacuaccaccuuucuuuu

SEQ ID NO: 1383540 - RNA, 19 nt, Homo sapiens
gagauguuaauuugggaua

SEQ ID NO: 1383541 - RNA, 19 nt, Homo sapiens
gauuugaagugaggauuag

SEQ ID NO: 1383542 - RNA, 19 nt, Homo sapiens
agaaaguccuuagauaaag

SEQ ID NO: 1383543 - RNA, 19 nt, Homo sapiens
aacccugacuuuaguugua

SEQ ID NO: 1383544 - RNA, 19 nt, Homo sapiens
caaacuacugcuuuaaugu

SEQ ID NO: 1383545 - RNA, 19 nt, Homo sapiens
gaagugaaugacaauaaag

SEQ ID NO: 1383546 - RNA, 19 nt, Homo sapiens
aaaguguucugucauuuac

SEQ ID NO: 1383547 - RNA, 19 nt, Homo sapiens
gaagaaucuacuaaacaga

SEQ ID NO: 1383548 - RNA, 19 nt, Homo sapiens
cagaaugccaccaccauau

SEQ ID NO: 1383549 - RNA, 19 nt, Homo sapiens
ccagaagccguucauuaga

SEQ ID NO: 1383550 - RNA, 19 nt, Homo sapiens
uguguugugucuaaguuaa

SEQ ID NO: 1383551 - RNA, 19 nt, Homo sapiens
guugacauuuauuguguug

SEQ ID NO: 1383552 - RNA, 19 nt, Homo sapiens
gaaccaucuaauccuauaa

SEQ ID NO: 1383553 - RNA, 19 nt, Homo sapiens
cagaauuauugacgacaug

SEQ ID NO: 1383554 - RNA, 19 nt, Homo sapiens
ugaacacccuaagaagaaa

SEQ ID NO: 1383555 - RNA, 19 nt, Homo sapiens
gaaaguccuauaaaugucu

SEQ ID NO: 1383556 - RNA, 19 nt, Homo sapiens
augccaaacuacugcuuua

SEQ ID NO: 1383557 - RNA, 19 nt, Homo sapiens
ccaggagacaucagaaaga

SEQ ID NO: 1383558 - RNA, 19 nt, Homo sapiens
aaagaggaaaguugauuug

SEQ ID NO: 1383559 - RNA, 19 nt, Homo sapiens
aaauaugagccaagaaaga

SEQ ID NO: 1383560 - RNA, 19 nt, Homo sapiens
auucaugagugcagaacua

SEQ ID NO: 1383561 - RNA, 19 nt, Homo sapiens
gacaucagaaagaaugaaa

SEQ ID NO: 1383562 - RNA, 19 nt, Homo sapiens
auaaaugucugcacaaacg

SEQ ID NO: 1383563 - RNA, 19 nt, Homo sapiens
ccaagacagugccuggaua

SEQ ID NO: 1383564 - RNA, 19 nt, Homo sapiens
gcaagagcuucgcgcagaa

SEQ ID NO: 1383565 - RNA, 19 nt, Homo sapiens
gacagaagccagugccuuu

SEQ ID NO: 1383566 - RNA, 19 nt, Homo sapiens
gcagccagccagccaagua

SEQ ID NO: 1383567 - RNA, 19 nt, Homo sapiens
gacagugccuggauaccuu

SEQ ID NO: 1383568 - RNA, 19 nt, Homo sapiens
ccagugccuuuaagucauu

SEQ ID NO: 1383569 - RNA, 19 nt, Homo sapiens
ggaaugacuccaucuacga

SEQ ID NO: 1383570 - RNA, 19 nt, Homo sapiens
gcaugugugugaagcuguu

SEQ ID NO: 1383571 - RNA, 19 nt, Homo sapiens
aagaaacgcauguguguga

SEQ ID NO: 1383572 - RNA, 19 nt, Homo sapiens
acauugaggaggaguauaa

SEQ ID NO: 1383573 - RNA, 19 nt, Homo sapiens
cagaagccagugccuuuaa

SEQ ID NO: 1383574 - RNA, 19 nt, Homo sapiens
ucaagucucuggcggacau

SEQ ID NO: 1383575 - RNA, 19 nt, Homo sapiens
uagagaacccgcaggagaa

SEQ ID NO: 1383576 - RNA, 19 nt, Homo sapiens
gccuuuaagucauuugugu

SEQ ID NO: 1383577 - RNA, 19 nt, Homo sapiens
ggacauugaggaggaguau

SEQ ID NO: 1383578 - RNA, 19 nt, Homo sapiens
gaacgugguggccgauauc

SEQ ID NO: 1383579 - RNA, 19 nt, Homo sapiens
caaggcguuugcuaucuuc

SEQ ID NO: 1383580 - RNA, 19 nt, Homo sapiens
agaagaaacgcaugugugu

SEQ ID NO: 1383581 - RNA, 19 nt, Homo sapiens
ggcuggagcuggacagaag

SEQ ID NO: 1383582 - RNA, 19 nt, Homo sapiens
caagaagaaacgcaugugu

SEQ ID NO: 1383583 - RNA, 19 nt, Homo sapiens
gccuggauaccuucgaaua

SEQ ID NO: 1383584 - RNA, 19 nt, Homo sapiens
cagccucuauggcaucuca

SEQ ID NO: 1383585 - RNA, 19 nt, Homo sapiens
gagcuucgcgcagaaaucu

SEQ ID NO: 1383586 - RNA, 19 nt, Homo sapiens
ggacaugcagggccucucu

SEQ ID NO: 1383587 - RNA, 19 nt, Homo sapiens
gguguccuccuggcaauaa

SEQ ID NO: 1383588 - RNA, 19 nt, Homo sapiens
gccagugccuuuaagucau

SEQ ID NO: 1383589 - RNA, 19 nt, Homo sapiens
gaagccagugccuuuaagu

SEQ ID NO: 1383590 - RNA, 19 nt, Homo sapiens
agaacgugguggccgauau

SEQ ID NO: 1383591 - RNA, 19 nt, Homo sapiens
acagaagccagugccuuua

SEQ ID NO: 1383592 - RNA, 19 nt, Homo sapiens
gaggaaugacuccaucuac

SEQ ID NO: 1383593 - RNA, 19 nt, Homo sapiens
gugccuggauaccuucgaa

SEQ ID NO: 1383594 - RNA, 19 nt, Homo sapiens
ggaccugaccaucaagucu

SEQ ID NO: 1383595 - RNA, 19 nt, Homo sapiens
acacuccacccacgauuug

SEQ ID NO: 1383596 - RNA, 19 nt, Homo sapiens
cauccacucugcggaggaa

SEQ ID NO: 1383597 - RNA, 19 nt, Homo sapiens
uugaggaggaguauaacua

SEQ ID NO: 1383598 - RNA, 19 nt, Homo sapiens
cagccagccagccaaguaa

SEQ ID NO: 1383599 - RNA, 19 nt, Homo sapiens
caagagcuucgcgcagaaa

SEQ ID NO: 1383600 - RNA, 19 nt, Homo sapiens
caagacagugccuggauac

SEQ ID NO: 1383601 - RNA, 19 nt, Homo sapiens
agaaacgcaugugugugaa

SEQ ID NO: 1383602 - RNA, 19 nt, Homo sapiens
gagaacgugguggccgaua

SEQ ID NO: 1383603 - RNA, 19 nt, Homo sapiens
gaaacgcaugugugugaag

SEQ ID NO: 1383604 - RNA, 19 nt, Homo sapiens
agaagccagugccuuuaag

SEQ ID NO: 1383605 - RNA, 19 nt, Homo sapiens
gguggccgauauccagauc

SEQ ID NO: 1383606 - RNA, 19 nt, Homo sapiens
ccacucugcggaggaauga

SEQ ID NO: 1383607 - RNA, 19 nt, Homo sapiens
gugggaagaccaagacagu

SEQ ID NO: 1383608 - RNA, 19 nt, Homo sapiens
ugacagagcuccacagaaa

SEQ ID NO: 1383609 - RNA, 19 nt, Homo sapiens
gaacuccugugcaaacaua

SEQ ID NO: 1383610 - RNA, 19 nt, Homo sapiens
ggaaggaucucuaccuaau

SEQ ID NO: 1383611 - RNA, 19 nt, Homo sapiens
caagaaagcacaaagauga

SEQ ID NO: 1383612 - RNA, 19 nt, Homo sapiens
gaggaaggaucucuaccua

SEQ ID NO: 1383613 - RNA, 19 nt, Homo sapiens
gggcauggcuggagcagaa

SEQ ID NO: 1383614 - RNA, 19 nt, Homo sapiens
gaaggaaagugaccaagca

SEQ ID NO: 1383615 - RNA, 19 nt, Homo sapiens
ugagagcacuugggaaaua

SEQ ID NO: 1383616 - RNA, 19 nt, Homo sapiens
ggagguaaaugcucucugu

SEQ ID NO: 1383617 - RNA, 19 nt, Homo sapiens
caaaguguauacagacuga

SEQ ID NO: 1383618 - RNA, 19 nt, Homo sapiens
uagagaaacuugaggaaga

SEQ ID NO: 1383619 - RNA, 19 nt, Homo sapiens
gaaagucuauugcuguucu

SEQ ID NO: 1383620 - RNA, 19 nt, Homo sapiens
ccaagaaucucaucaacca

SEQ ID NO: 1383621 - RNA, 19 nt, Homo sapiens
ugagaaggauuucaaggaa

SEQ ID NO: 1383622 - RNA, 19 nt, Homo sapiens
ccaagauuccauacuauua

SEQ ID NO: 1383623 - RNA, 19 nt, Homo sapiens
gcaccucucuuucauccuu

SEQ ID NO: 1383624 - RNA, 19 nt, Homo sapiens
ccaaguagcugggauuaca

SEQ ID NO: 1383625 - RNA, 19 nt, Homo sapiens
ccaagagccacacauguua

SEQ ID NO: 1383626 - RNA, 19 nt, Homo sapiens
gaucaagagcuucaagaaa

SEQ ID NO: 1383627 - RNA, 19 nt, Homo sapiens
ggaacccacuuuacucaga

SEQ ID NO: 1383628 - RNA, 19 nt, Homo sapiens
ucaaggaaguguuugcuau

SEQ ID NO: 1383629 - RNA, 19 nt, Homo sapiens
caaaggaggcuacgcaaga

SEQ ID NO: 1383630 - RNA, 19 nt, Homo sapiens
gaacaugaaucugaaagac

SEQ ID NO: 1383631 - RNA, 19 nt, Homo sapiens
cagcuggucucgagugaaa

SEQ ID NO: 1383632 - RNA, 19 nt, Homo sapiens
gacagacucucaccucuuc

SEQ ID NO: 1383633 - RNA, 19 nt, Homo sapiens
gagcccaugugguuggaua

SEQ ID NO: 1383634 - RNA, 19 nt, Homo sapiens
ggaaacaaaugggaacagu

SEQ ID NO: 1383635 - RNA, 19 nt, Homo sapiens
ugaaggagcccaugugguu

SEQ ID NO: 1383636 - RNA, 19 nt, Homo sapiens
ugacgucccuggaguugaa

SEQ ID NO: 1383637 - RNA, 19 nt, Homo sapiens
ggacaccuccucugauaug

SEQ ID NO: 1383638 - RNA, 19 nt, Homo sapiens
aaacaaaugggaacaguug

SEQ ID NO: 1383639 - RNA, 19 nt, Homo sapiens
gaacaguugguaaaucaga

SEQ ID NO: 1383640 - RNA, 19 nt, Homo sapiens
gaaagugagaaguaaguga

SEQ ID NO: 1383641 - RNA, 19 nt, Homo sapiens
gaggggagcuguucuguug

SEQ ID NO: 1383642 - RNA, 19 nt, Homo sapiens
ggaaagugaccaagcaugu

SEQ ID NO: 1383643 - RNA, 19 nt, Homo sapiens
gcaggcaccucucuuucau

SEQ ID NO: 1383644 - RNA, 19 nt, Homo sapiens
gccacugacuucaaacuga

SEQ ID NO: 1383645 - RNA, 19 nt, Homo sapiens
caauggcacugauagaaca

SEQ ID NO: 1383646 - RNA, 19 nt, Homo sapiens
caugugcaguucuuggaua

SEQ ID NO: 1383647 - RNA, 19 nt, Homo sapiens
gaaaagaguccgaucaaga

SEQ ID NO: 1383648 - RNA, 19 nt, Homo sapiens
gaaaagaaggcgaacauga

SEQ ID NO: 1383649 - RNA, 19 nt, Homo sapiens
agggacaccuccucugaua

SEQ ID NO: 1383650 - RNA, 19 nt, Homo sapiens
ucaguugacccuuguauga

SEQ ID NO: 1383651 - RNA, 19 nt, Homo sapiens
gaaacaaaugggaacaguu

SEQ ID NO: 1383652 - RNA, 19 nt, Homo sapiens
ccacagggccucuuacaag

SEQ ID NO: 1383653 - RNA, 19 nt, Homo sapiens
gaggaacaguugguaaauc

SEQ ID NO: 1383654 - RNA, 19 nt, Homo sapiens
gguauuguccuuuccuuga

SEQ ID NO: 1383655 - RNA, 19 nt, Homo sapiens
gaaacuuggaugaguguga

SEQ ID NO: 1383656 - RNA, 19 nt, Homo sapiens
ggagaaauuggaacaagga

SEQ ID NO: 1383657 - RNA, 19 nt, Homo sapiens
gaaaaccagccaagcuuua

SEQ ID NO: 1383658 - RNA, 19 nt, Homo sapiens
gaacgguggccauuuccaa

SEQ ID NO: 1383659 - RNA, 19 nt, Homo sapiens
caggaacgguggccauuuc

SEQ ID NO: 1383660 - RNA, 19 nt, Homo sapiens
ggaguugaaagcccaguuu

SEQ ID NO: 1383661 - RNA, 19 nt, Homo sapiens
guauuguccuuuccuugaa

SEQ ID NO: 1383662 - RNA, 19 nt, Homo sapiens
cugcagaacucccaaacug

SEQ ID NO: 1383663 - RNA, 19 nt, Homo sapiens
ugucucagccucccaagua

SEQ ID NO: 1383664 - RNA, 19 nt, Homo sapiens
cuccagacaacauuuauua

SEQ ID NO: 1383665 - RNA, 19 nt, Homo sapiens
aagaugaaacuguggauuu

SEQ ID NO: 1383666 - RNA, 19 nt, Homo sapiens
caccaugcccagcuaauuu

SEQ ID NO: 1383667 - RNA, 19 nt, Homo sapiens
gaaggagauuggaggugau

SEQ ID NO: 1383668 - RNA, 19 nt, Homo sapiens
ggauuucaaggaaguguuu

SEQ ID NO: 1383669 - RNA, 19 nt, Homo sapiens
uugccaagauuccauacua

SEQ ID NO: 1383670 - RNA, 19 nt, Homo sapiens
ucaaucaucugacccuucu

SEQ ID NO: 1383671 - RNA, 19 nt, Homo sapiens
caaggaaguguuugcuauu

SEQ ID NO: 1383672 - RNA, 19 nt, Homo sapiens
aggaacaguugguaaauca

SEQ ID NO: 1383673 - RNA, 19 nt, Homo sapiens
gguugccacugacuucaaa

SEQ ID NO: 1383674 - RNA, 19 nt, Homo sapiens
agagaaacuugaggaagaa

SEQ ID NO: 1383675 - RNA, 19 nt, Homo sapiens
gaaccuuggcaaaguguau

SEQ ID NO: 1383676 - RNA, 19 nt, Homo sapiens
ugaccaagcauguggcaaa

SEQ ID NO: 1383677 - RNA, 19 nt, Homo sapiens
cagggccucuuacaaguau

SEQ ID NO: 1383678 - RNA, 19 nt, Homo sapiens
gcucacccauguccaaucu

SEQ ID NO: 1383679 - RNA, 19 nt, Homo sapiens
aaaccuggaacccacuuua

SEQ ID NO: 1383680 - RNA, 19 nt, Homo sapiens
ccugugcaaacauauauua

SEQ ID NO: 1383681 - RNA, 19 nt, Homo sapiens
cagacaacauuuauuacuc

SEQ ID NO: 1383682 - RNA, 19 nt, Homo sapiens
gagagcacuugggaaauag

SEQ ID NO: 1383683 - RNA, 19 nt, Homo sapiens
ggaaguguuugcuauucag

SEQ ID NO: 1383684 - RNA, 19 nt, Homo sapiens
gugaguuccuccucuugaa

SEQ ID NO: 1383685 - RNA, 19 nt, Homo sapiens
ccagaaagcccggaagcaa

SEQ ID NO: 1383686 - RNA, 19 nt, Homo sapiens
agaaggauuucaaggaagu

SEQ ID NO: 1383687 - RNA, 19 nt, Homo sapiens
gacuggaggcugaauuuga

SEQ ID NO: 1383688 - RNA, 19 nt, Homo sapiens
gcaggggaauguacugaaa

SEQ ID NO: 1383689 - RNA, 19 nt, Homo sapiens
gaagggaauuuuacauaag

SEQ ID NO: 1383690 - RNA, 19 nt, Homo sapiens
gaaagugaccaagcaugug

SEQ ID NO: 1383691 - RNA, 19 nt, Homo sapiens
gacaggaagcacggucuua

SEQ ID NO: 1383692 - RNA, 19 nt, Homo sapiens
uguggaaagugagaaguaa

SEQ ID NO: 1383693 - RNA, 19 nt, Homo sapiens
cgcaagaccuuuuaucuga

SEQ ID NO: 1383694 - RNA, 19 nt, Homo sapiens
gccaagauuccauacuauu

SEQ ID NO: 1383695 - RNA, 19 nt, Homo sapiens
aucaagagcuucaagaaag

SEQ ID NO: 1383696 - RNA, 19 nt, Homo sapiens
ggaagaggaacugagauca

SEQ ID NO: 1383697 - RNA, 19 nt, Homo sapiens
caaaauggauacuguggau

SEQ ID NO: 1383698 - RNA, 19 nt, Homo sapiens
caaggagaagugccagaaa

SEQ ID NO: 1383699 - RNA, 19 nt, Homo sapiens
ccacacauguuagagaaac

SEQ ID NO: 1383700 - RNA, 19 nt, Homo sapiens
ucaagaaagcacaaagaug

SEQ ID NO: 1383701 - RNA, 19 nt, Homo sapiens
aaagaaggcgaacaugaau

SEQ ID NO: 1383702 - RNA, 19 nt, Homo sapiens
aaauggauacuguggauau

SEQ ID NO: 1383703 - RNA, 19 nt, Homo sapiens
ggugauaccagcacagaca

SEQ ID NO: 1383704 - RNA, 19 nt, Homo sapiens
aagaggaacugagaucaca

SEQ ID NO: 1383705 - RNA, 19 nt, Homo sapiens
gagccacacauguuagaga

SEQ ID NO: 1383706 - RNA, 19 nt, Homo sapiens
aaaggaggcuacgcaagau

SEQ ID NO: 1383707 - RNA, 19 nt, Homo sapiens
cacagggccucuuacaagu

SEQ ID NO: 1383708 - RNA, 19 nt, Homo sapiens
gaaaggagcuuaccaaagg

SEQ ID NO: 1383709 - RNA, 19 nt, Homo sapiens
gcugguggcuuuacuauuu

SEQ ID NO: 1383710 - RNA, 19 nt, Homo sapiens
gaacuuauguuggaaugaa

SEQ ID NO: 1383711 - RNA, 19 nt, Homo sapiens
cuagaaagguucagcauuu

SEQ ID NO: 1383712 - RNA, 19 nt, Homo sapiens
ggaaauauuugccucaugu

SEQ ID NO: 1383713 - RNA, 19 nt, Homo sapiens
ucucagaucuugugcuuua

SEQ ID NO: 1383714 - RNA, 19 nt, Homo sapiens
gaaauaugcaugugacuaa

SEQ ID NO: 1383715 - RNA, 19 nt, Homo sapiens
ggagacacaucauucauug

SEQ ID NO: 1383716 - RNA, 19 nt, Homo sapiens
gauggcaguuccucaaaua

SEQ ID NO: 1383717 - RNA, 19 nt, Homo sapiens
gaaagacacaagccaauaa

SEQ ID NO: 1383718 - RNA, 19 nt, Homo sapiens
gcaccuggcucaaucaugu

SEQ ID NO: 1383719 - RNA, 19 nt, Homo sapiens
ggaaugaagugaaaaguaa

SEQ ID NO: 1383720 - RNA, 19 nt, Homo sapiens
ccauauugcuugccugaua

SEQ ID NO: 1383721 - RNA, 19 nt, Homo sapiens
gggcugauuugucucuuua

SEQ ID NO: 1383722 - RNA, 19 nt, Homo sapiens
ccacacagauauccuagaa

SEQ ID NO: 1383723 - RNA, 19 nt, Homo sapiens
ccauguagcuauaaaguga

SEQ ID NO: 1383724 - RNA, 19 nt, Homo sapiens
aaacagacauucccaguca

SEQ ID NO: 1383725 - RNA, 19 nt, Homo sapiens
gaaagcagccugaaaagua

SEQ ID NO: 1383726 - RNA, 19 nt, Homo sapiens
ggaagcaccuggcucaauc

SEQ ID NO: 1383727 - RNA, 19 nt, Homo sapiens
ggacaggcuuucacuuuca

SEQ ID NO: 1383728 - RNA, 19 nt, Homo sapiens
ggagaucacccacacauga

SEQ ID NO: 1383729 - RNA, 19 nt, Homo sapiens
ugacagaccaugugaaauu

SEQ ID NO: 1383730 - RNA, 19 nt, Homo sapiens
caauaaagccagugagaaa

SEQ ID NO: 1383731 - RNA, 19 nt, Homo sapiens
ccacacaccuggccuagga

SEQ ID NO: 1383732 - RNA, 19 nt, Homo sapiens
gcaguuaauuguuucugaa

SEQ ID NO: 1383733 - RNA, 19 nt, Homo sapiens
ggaaagcuguuuggcagaa

SEQ ID NO: 1383734 - RNA, 19 nt, Homo sapiens
cacaagaacuuauguugga

SEQ ID NO: 1383735 - RNA, 19 nt, Homo sapiens
caaaggcaguguacgaaga

SEQ ID NO: 1383736 - RNA, 19 nt, Homo sapiens
gaccuuggauuuacugaga

SEQ ID NO: 1383737 - RNA, 19 nt, Homo sapiens
gaaaugagggcuguaucua

SEQ ID NO: 1383738 - RNA, 19 nt, Homo sapiens
ccuaugauccaaauuguua

SEQ ID NO: 1383739 - RNA, 19 nt, Homo sapiens
ccacacaagggaacauuua

SEQ ID NO: 1383740 - RNA, 19 nt, Homo sapiens
gacagaccaugugaaauuu

SEQ ID NO: 1383741 - RNA, 19 nt, Homo sapiens
gcauuucugucauuuacuu

SEQ ID NO: 1383742 - RNA, 19 nt, Homo sapiens
gcuauaaagugagggauga

SEQ ID NO: 1383743 - RNA, 19 nt, Homo sapiens
acacagggcuucugauuac

SEQ ID NO: 1383744 - RNA, 19 nt, Homo sapiens
ggaagcaguuaauuguuuc

SEQ ID NO: 1383745 - RNA, 19 nt, Homo sapiens
cacaagaggcccacauaua

SEQ ID NO: 1383746 - RNA, 19 nt, Homo sapiens
uaacuguuccuacaaauga

SEQ ID NO: 1383747 - RNA, 19 nt, Homo sapiens
ccucaguucuguacuugua

SEQ ID NO: 1383748 - RNA, 19 nt, Homo sapiens
acaagcagauuuagccauu

SEQ ID NO: 1383749 - RNA, 19 nt, Homo sapiens
gagaggaagcaguuaauug

SEQ ID NO: 1383750 - RNA, 19 nt, Homo sapiens
gggauacaaaugaaacuua

SEQ ID NO: 1383751 - RNA, 19 nt, Homo sapiens
gucaauaccugcucuucaa

SEQ ID NO: 1383752 - RNA, 19 nt, Homo sapiens
cauauugcuugccugauaa

SEQ ID NO: 1383753 - RNA, 19 nt, Homo sapiens
ccuccuaccucuucccaua

SEQ ID NO: 1383754 - RNA, 19 nt, Homo sapiens
caaguugggauacaaauga

SEQ ID NO: 1383755 - RNA, 19 nt, Homo sapiens
gcgaggaaccugugcauga

SEQ ID NO: 1383756 - RNA, 19 nt, Homo sapiens
gaucguguccucauaugaa

SEQ ID NO: 1383757 - RNA, 19 nt, Homo sapiens
gaacauuuaggacaaacuu

SEQ ID NO: 1383758 - RNA, 19 nt, Homo sapiens
gaaauaaagggaagugucu

SEQ ID NO: 1383759 - RNA, 19 nt, Homo sapiens
acaagaggcccacauauau

SEQ ID NO: 1383760 - RNA, 19 nt, Homo sapiens
gguuaacuguuccuacaaa

SEQ ID NO: 1383761 - RNA, 19 nt, Homo sapiens
cagcuaaucaccagcauuu

SEQ ID NO: 1383762 - RNA, 19 nt, Homo sapiens
aggaagcaguuaauuguuu

SEQ ID NO: 1383763 - RNA, 19 nt, Homo sapiens
gaaagugacagaccaugug

SEQ ID NO: 1383764 - RNA, 19 nt, Homo sapiens
gagaaaggagcuuaccaaa

SEQ ID NO: 1383765 - RNA, 19 nt, Homo sapiens
guacuucuccuacauguca

SEQ ID NO: 1383766 - RNA, 19 nt, Homo sapiens
ccaaggaggccaaauggaa

SEQ ID NO: 1383767 - RNA, 19 nt, Homo sapiens
ggaauuugcuuuucuuugu

SEQ ID NO: 1383768 - RNA, 19 nt, Homo sapiens
ugaugacaaucccaagaua

SEQ ID NO: 1383769 - RNA, 19 nt, Homo sapiens
cgaagaagaagcagcauug

SEQ ID NO: 1383770 - RNA, 19 nt, Homo sapiens
guucagcauuucugucauu

SEQ ID NO: 1383771 - RNA, 19 nt, Homo sapiens
gggacaggcuuucacuuuc

SEQ ID NO: 1383772 - RNA, 19 nt, Homo sapiens
gaaagcuguuuggcagaaa

SEQ ID NO: 1383773 - RNA, 19 nt, Homo sapiens
uuacagcucuggaacacuu

SEQ ID NO: 1383774 - RNA, 19 nt, Homo sapiens
gggagacugucagaaauga

SEQ ID NO: 1383775 - RNA, 19 nt, Homo sapiens
guaaggcuggauugaaaua

SEQ ID NO: 1383776 - RNA, 19 nt, Homo sapiens
gcacaagaggcccacauau

SEQ ID NO: 1383777 - RNA, 19 nt, Homo sapiens
uugcugagauggagguaua

SEQ ID NO: 1383778 - RNA, 19 nt, Homo sapiens
auauuugccucaugucaua

SEQ ID NO: 1383779 - RNA, 19 nt, Homo sapiens
gagccucaguucuguacuu

SEQ ID NO: 1383780 - RNA, 19 nt, Homo sapiens
gggauaguuguuaaaguua

SEQ ID NO: 1383781 - RNA, 19 nt, Homo sapiens
agggauaguuguuaaaguu

SEQ ID NO: 1383782 - RNA, 19 nt, Homo sapiens
aaaguaagaaggacagaaa

SEQ ID NO: 1383783 - RNA, 19 nt, Homo sapiens
acacagcaguggaaagaau

SEQ ID NO: 1383784 - RNA, 19 nt, Homo sapiens
acuaagccauguagcuaua

SEQ ID NO: 1383785 - RNA, 19 nt, Homo sapiens
caaguccucuggaucuaau

SEQ ID NO: 1383786 - RNA, 19 nt, Homo sapiens
gaauaaccaagaacauguu

SEQ ID NO: 1383787 - RNA, 19 nt, Homo sapiens
cagcauuucugucauuuac

SEQ ID NO: 1383788 - RNA, 19 nt, Homo sapiens
ccacggcuuagaauauuua

SEQ ID NO: 1383789 - RNA, 19 nt, Homo sapiens
ggccuuggcuuugauacuu

SEQ ID NO: 1383790 - RNA, 19 nt, Homo sapiens
caaggaggccaaauggaaa

SEQ ID NO: 1383791 - RNA, 19 nt, Homo sapiens
gaagaagaagcagcauuga

SEQ ID NO: 1383792 - RNA, 19 nt, Homo sapiens
acacagauauccuagaaaa

SEQ ID NO: 1383793 - RNA, 19 nt, Homo sapiens
ggagacaggaccacaggaa

SEQ ID NO: 1383794 - RNA, 19 nt, Homo sapiens
gacauuaugauaccucuga

SEQ ID NO: 1383795 - RNA, 19 nt, Homo sapiens
uaaaggaggggaaauauuu

SEQ ID NO: 1383796 - RNA, 19 nt, Homo sapiens
gggcuugguuucugagugu

SEQ ID NO: 1383797 - RNA, 19 nt, Homo sapiens
ugaaagacacaagccaaua

SEQ ID NO: 1383798 - RNA, 19 nt, Homo sapiens
caagaaagcagccugaaaa

SEQ ID NO: 1383799 - RNA, 19 nt, Homo sapiens
uaacuccucuucccauuuu

SEQ ID NO: 1383800 - RNA, 19 nt, Homo sapiens
gacuggugguguuacauuu

SEQ ID NO: 1383801 - RNA, 19 nt, Homo sapiens
ccacugagcagcuguacga

SEQ ID NO: 1383802 - RNA, 19 nt, Homo sapiens
ucacacagggcuucugauu

SEQ ID NO: 1383803 - RNA, 19 nt, Homo sapiens
caacgugccugccauucag

SEQ ID NO: 1383804 - RNA, 19 nt, Homo sapiens
ggcaguuucuuacaaguuc

SEQ ID NO: 1383805 - RNA, 19 nt, Homo sapiens
cuacuuaguugccagucaa

SEQ ID NO: 1383806 - RNA, 19 nt, Homo sapiens
ccucaugucauaauugaaa

SEQ ID NO: 1383807 - RNA, 19 nt, Homo sapiens
caagaggcccacauauaug

SEQ ID NO: 1383808 - RNA, 19 nt, Homo sapiens
acacagagcuggaauauug

SEQ ID NO: 1383809 - RNA, 19 nt, Homo sapiens
caaaugacuuggcaaauaa

SEQ ID NO: 1383810 - RNA, 19 nt, Homo sapiens
gaaauuggcuagcucuuug

SEQ ID NO: 1383811 - RNA, 19 nt, Homo sapiens
gcaaauaauugacaaagug

SEQ ID NO: 1383812 - RNA, 19 nt, Homo sapiens
gaaagggagugguugguaa

SEQ ID NO: 1383813 - RNA, 19 nt, Homo sapiens
aaaggaaacucgucauuaa

SEQ ID NO: 1383814 - RNA, 19 nt, Homo sapiens
ucacauaccuuacaauuca

SEQ ID NO: 1383815 - RNA, 19 nt, Homo sapiens
guaggaagcucaacauuuc

SEQ ID NO: 1383816 - RNA, 19 nt, Homo sapiens
gaacaaaguuagaaaucug

SEQ ID NO: 1383817 - RNA, 19 nt, Homo sapiens
gaaaugagucuuugguauu

SEQ ID NO: 1383818 - RNA, 19 nt, Homo sapiens
caaauggacuucccugaug

SEQ ID NO: 1383819 - RNA, 19 nt, Homo sapiens
ggauauguuuccaaucuuu

SEQ ID NO: 1383820 - RNA, 19 nt, Homo sapiens
cggaacgacucacuuaaua

SEQ ID NO: 1383821 - RNA, 19 nt, Homo sapiens
gaauggauguugaaaucuu

SEQ ID NO: 1383822 - RNA, 19 nt, Homo sapiens
ggacuggcuucccaaauau

SEQ ID NO: 1383823 - RNA, 19 nt, Homo sapiens
gacaucagcucuucucuuc

SEQ ID NO: 1383824 - RNA, 19 nt, Homo sapiens
cagaaguacuugccaguuu

SEQ ID NO: 1383825 - RNA, 19 nt, Homo sapiens
ggcaaccacuaaucuauuu

SEQ ID NO: 1383826 - RNA, 19 nt, Homo sapiens
gaaaucggguuaaagugau

SEQ ID NO: 1383827 - RNA, 19 nt, Homo sapiens
gucauaagaugccauugua

SEQ ID NO: 1383828 - RNA, 19 nt, Homo sapiens
caacauuucuuuguagaga

SEQ ID NO: 1383829 - RNA, 19 nt, Homo sapiens
uaaaggaaacucgucauua

SEQ ID NO: 1383830 - RNA, 19 nt, Homo sapiens
gaaaucugccgauaaccua

SEQ ID NO: 1383831 - RNA, 19 nt, Homo sapiens
uagaauggauguugaaauc

SEQ ID NO: 1383832 - RNA, 19 nt, Homo sapiens
ugacucugcucucuaauga

SEQ ID NO: 1383833 - RNA, 19 nt, Homo sapiens
caagaugcauuguccucua

SEQ ID NO: 1383834 - RNA, 19 nt, Homo sapiens
ugaaaugagucuuugguau

SEQ ID NO: 1383835 - RNA, 19 nt, Homo sapiens
gguaugucuucguuucuua

SEQ ID NO: 1383836 - RNA, 19 nt, Homo sapiens
ggucuucaauucuuaacaa

SEQ ID NO: 1383837 - RNA, 19 nt, Homo sapiens
ccauggcccuuguuuauau

SEQ ID NO: 1383838 - RNA, 19 nt, Homo sapiens
gccaauagauauaguucuu

SEQ ID NO: 1383839 - RNA, 19 nt, Homo sapiens
ggacuucagugacgucauc

SEQ ID NO: 1383840 - RNA, 19 nt, Homo sapiens
ccagggaaccagccaaaua

SEQ ID NO: 1383841 - RNA, 19 nt, Homo sapiens
ggaacgacucacuuaauaa

SEQ ID NO: 1383842 - RNA, 19 nt, Homo sapiens
ggaaauuggcuagcucuuu

SEQ ID NO: 1383843 - RNA, 19 nt, Homo sapiens
ggaugaggauacagaguug

SEQ ID NO: 1383844 - RNA, 19 nt, Homo sapiens
gguuguauguggccuguuu

SEQ ID NO: 1383845 - RNA, 19 nt, Homo sapiens
gcaggagaguuuaaagaca

SEQ ID NO: 1383846 - RNA, 19 nt, Homo sapiens
gaccuugcccuguccaaua

SEQ ID NO: 1383847 - RNA, 19 nt, Homo sapiens
ucagugauauucagaagug

SEQ ID NO: 1383848 - RNA, 19 nt, Homo sapiens
guuguaacacugcuaaaua

SEQ ID NO: 1383849 - RNA, 19 nt, Homo sapiens
gugaguuucugcugucuuu

SEQ ID NO: 1383850 - RNA, 19 nt, Homo sapiens
gaacucuuauugcugugaa

SEQ ID NO: 1383851 - RNA, 19 nt, Homo sapiens
ggauacagaguugauauuu

SEQ ID NO: 1383852 - RNA, 19 nt, Homo sapiens
agacagaguucaaaggaau

SEQ ID NO: 1383853 - RNA, 19 nt, Homo sapiens
ggaaacucgucauuaaucu

SEQ ID NO: 1383854 - RNA, 19 nt, Homo sapiens
caagagggccagauaccua

SEQ ID NO: 1383855 - RNA, 19 nt, Homo sapiens
ggacacagagcuggaauau

SEQ ID NO: 1383856 - RNA, 19 nt, Homo sapiens
gcucaacauuucuuuguag

SEQ ID NO: 1383857 - RNA, 19 nt, Homo sapiens
gagauucugugugcaguga

SEQ ID NO: 1383858 - RNA, 19 nt, Homo sapiens
caucagcugucuuguuuca

SEQ ID NO: 1383859 - RNA, 19 nt, Homo sapiens
caguguaaguuauauguga

SEQ ID NO: 1383860 - RNA, 19 nt, Homo sapiens
gaaucacugccaauagaua

SEQ ID NO: 1383861 - RNA, 19 nt, Homo sapiens
gagcuggaauauuggaguu

SEQ ID NO: 1383862 - RNA, 19 nt, Homo sapiens
ucgaaucacugcgucguua

SEQ ID NO: 1383863 - RNA, 19 nt, Homo sapiens
guaacucccuaaugauugu

SEQ ID NO: 1383864 - RNA, 19 nt, Homo sapiens
ccucauaaccaagcauuua

SEQ ID NO: 1383865 - RNA, 19 nt, Homo sapiens
ugaaaucggguuaaaguga

SEQ ID NO: 1383866 - RNA, 19 nt, Homo sapiens
gcuuucgccucuucguuua

SEQ ID NO: 1383867 - RNA, 19 nt, Homo sapiens
ucacgugugucuaucuuug

SEQ ID NO: 1383868 - RNA, 19 nt, Homo sapiens
gaaaauucuucucaucuug

SEQ ID NO: 1383869 - RNA, 19 nt, Homo sapiens
caucagacuuggcuacugu

SEQ ID NO: 1383870 - RNA, 19 nt, Homo sapiens
gaaacucgucauuaaucua

SEQ ID NO: 1383871 - RNA, 19 nt, Homo sapiens
agacauggaugccacuuca

SEQ ID NO: 1383872 - RNA, 19 nt, Homo sapiens
gagcagucaccucucauuu

SEQ ID NO: 1383873 - RNA, 19 nt, Homo sapiens
caucagcucuucucuucug

SEQ ID NO: 1383874 - RNA, 19 nt, Homo sapiens
gaaauggacaucagcucuu

SEQ ID NO: 1383875 - RNA, 19 nt, Homo sapiens
gaauaacuguaugcagguu

SEQ ID NO: 1383876 - RNA, 19 nt, Homo sapiens
accaucagcugucuuguuu

SEQ ID NO: 1383877 - RNA, 19 nt, Homo sapiens
gaacgacucacuuaauaac

SEQ ID NO: 1383878 - RNA, 19 nt, Homo sapiens
gagaacaaaguuagaaauc

SEQ ID NO: 1383879 - RNA, 19 nt, Homo sapiens
guugaagacuaguugaaga

SEQ ID NO: 1383880 - RNA, 19 nt, Homo sapiens
guaaaauggucuucaauuc

SEQ ID NO: 1383881 - RNA, 19 nt, Homo sapiens
ggaaccagccaaauacugu

SEQ ID NO: 1383882 - RNA, 19 nt, Homo sapiens
ggaaucacccauccuuuua

SEQ ID NO: 1383883 - RNA, 19 nt, Homo sapiens
gcgcagcaucguucuuaua

SEQ ID NO: 1383884 - RNA, 19 nt, Homo sapiens
caauagauuucaggcaaga

SEQ ID NO: 1383885 - RNA, 19 nt, Homo sapiens
gguacgauuugguuuggaa

SEQ ID NO: 1383886 - RNA, 19 nt, Homo sapiens
cuucuggccuuugcaguua

SEQ ID NO: 1383887 - RNA, 19 nt, Homo sapiens
caggugagcuccccaaauu

SEQ ID NO: 1383888 - RNA, 19 nt, Homo sapiens
gcuagcagcuuguauaccu

SEQ ID NO: 1383889 - RNA, 19 nt, Homo sapiens
ugacuuggcaaauaauuga

SEQ ID NO: 1383890 - RNA, 19 nt, Homo sapiens
uuagaaaucugccgauaac

SEQ ID NO: 1383891 - RNA, 19 nt, Homo sapiens
ggccaaauauauucucagu

SEQ ID NO: 1383892 - RNA, 19 nt, Homo sapiens
ccuuugcaguuaccuguua

SEQ ID NO: 1383893 - RNA, 19 nt, Homo sapiens
ugauuuggaugcguuguaa

SEQ ID NO: 1383894 - RNA, 19 nt, Homo sapiens
ccaaagcaugagauuauuu

SEQ ID NO: 1383895 - RNA, 19 nt, Homo sapiens
ggacaucagcucuucucuu

SEQ ID NO: 1383896 - RNA, 19 nt, Homo sapiens
ucaaugaguuggaggugau

SEQ ID NO: 1383897 - RNA, 19 nt, Homo sapiens
ucagaaguguguaccaauc

SEQ ID NO: 1383898 - RNA, 19 nt, Homo sapiens
ucucuucauuugucuguaa

SEQ ID NO: 1383899 - RNA, 19 nt, Homo sapiens
aaauggacuucccugauga

SEQ ID NO: 1383900 - RNA, 19 nt, Homo sapiens
gcagcaugaauuauaguaa

SEQ ID NO: 1383901 - RNA, 19 nt, Homo sapiens
caggagaguuuaaagacau

SEQ ID NO: 1383902 - RNA, 19 nt, Homo sapiens
ggaggugauuauucucugu

SEQ ID NO: 1383903 - RNA, 19 nt, Homo sapiens
aauaugaugugagcuaguu

SEQ ID NO: 1383904 - RNA, 19 nt, Homo sapiens
ggcaaauaauugacaaagu

SEQ ID NO: 1383905 - RNA, 19 nt, Homo sapiens
guuagaaaucugccgauaa

SEQ ID NO: 1383906 - RNA, 19 nt, Homo sapiens
gcuggaauauuggaguuug

SEQ ID NO: 1383907 - RNA, 19 nt, Homo sapiens
aagaugcauuguccucuaa

SEQ ID NO: 1383908 - RNA, 19 nt, Homo sapiens
ggacaaagcaagaauaaau

SEQ ID NO: 1383909 - RNA, 19 nt, Homo sapiens
gcagauguuugcagcguuu

SEQ ID NO: 1383910 - RNA, 19 nt, Homo sapiens
gagaagagcucggaaaaga

SEQ ID NO: 1383911 - RNA, 19 nt, Homo sapiens
cacuaugccugacuaauuu

SEQ ID NO: 1383912 - RNA, 19 nt, Homo sapiens
ccacuaugccugacuaauu

SEQ ID NO: 1383913 - RNA, 19 nt, Homo sapiens
guucgacacugaagggaaa

SEQ ID NO: 1383914 - RNA, 19 nt, Homo sapiens
caacgucuucuccauguuu

SEQ ID NO: 1383915 - RNA, 19 nt, Homo sapiens
gcaucaaugucaagaacga

SEQ ID NO: 1383916 - RNA, 19 nt, Homo sapiens
ccaaagugcugggauuaca

SEQ ID NO: 1383917 - RNA, 19 nt, Homo sapiens
ggacuugagggacaccuuu

SEQ ID NO: 1383918 - RNA, 19 nt, Homo sapiens
ucaccacuaugccugacua

SEQ ID NO: 1383919 - RNA, 19 nt, Homo sapiens
ggccauagccugccugucu

SEQ ID NO: 1383920 - RNA, 19 nt, Homo sapiens
ggagcgcaauggcaugauc

SEQ ID NO: 1383921 - RNA, 19 nt, Homo sapiens
acacugaagggaaagguuu

SEQ ID NO: 1383922 - RNA, 19 nt, Homo sapiens
ggaggucaagcagauguuu

SEQ ID NO: 1383923 - RNA, 19 nt, Homo sapiens
gccagaggcugcaggaaaa

SEQ ID NO: 1383924 - RNA, 19 nt, Homo sapiens
gcuccaacgucuucuccau

SEQ ID NO: 1383925 - RNA, 19 nt, Homo sapiens
ucaaacuccuggccucaag

SEQ ID NO: 1383926 - RNA, 19 nt, Homo sapiens
ccucacggguucaagcaau

SEQ ID NO: 1383927 - RNA, 19 nt, Homo sapiens
aggaggaggucaagcagau

SEQ ID NO: 1383928 - RNA, 19 nt, Homo sapiens
gcggcaaccuggacuacag

SEQ ID NO: 1383929 - RNA, 19 nt, Homo sapiens
ugcuuaggcuggucucaaa

SEQ ID NO: 1383930 - RNA, 19 nt, Homo sapiens
aggcagaccgcuucaguga

SEQ ID NO: 1383931 - RNA, 19 nt, Homo sapiens
ccgcaucaaugucaagaac

SEQ ID NO: 1383932 - RNA, 19 nt, Homo sapiens
gaggaggucaagcagaugu

SEQ ID NO: 1383933 - RNA, 19 nt, Homo sapiens
caaccuggacuacagaaac

SEQ ID NO: 1383934 - RNA, 19 nt, Homo sapiens
gcaaccuggacuacagaaa

SEQ ID NO: 1383935 - RNA, 19 nt, Homo sapiens
uccaacgucuucuccaugu

SEQ ID NO: 1383936 - RNA, 19 nt, Homo sapiens
acggugaagagaaggauua

SEQ ID NO: 1383937 - RNA, 19 nt, Homo sapiens
uggaggccauggugaagga

SEQ ID NO: 1383938 - RNA, 19 nt, Homo sapiens
gauccaggaguuuaaagag

SEQ ID NO: 1383939 - RNA, 19 nt, Homo sapiens
cccaucgcaugcccuauga

SEQ ID NO: 1383940 - RNA, 19 nt, Homo sapiens
ggcaugaucucggcucacu

SEQ ID NO: 1383941 - RNA, 19 nt, Homo sapiens
gaggucaagcagauguuug

SEQ ID NO: 1383942 - RNA, 19 nt, Homo sapiens
ccagauccaggaguuuaaa

SEQ ID NO: 1383943 - RNA, 19 nt, Homo sapiens
ucccagauccaggaguuua

SEQ ID NO: 1383944 - RNA, 19 nt, Homo sapiens
ccaacgucuucuccauguu

SEQ ID NO: 1383945 - RNA, 19 nt, Homo sapiens
ggauuacaggcaccgagaa

SEQ ID NO: 1383946 - RNA, 19 nt, Homo sapiens
ggacccagaggagaccauu

SEQ ID NO: 1383947 - RNA, 19 nt, Homo sapiens
gggacaaagcaagaauaaa

SEQ ID NO: 1383948 - RNA, 19 nt, Homo sapiens
ugugcuacgucaucacuca

SEQ ID NO: 1383949 - RNA, 19 nt, Homo sapiens
ccaucaacuucacgguguu

SEQ ID NO: 1383950 - RNA, 19 nt, Homo sapiens
ccaggaguuuaaagagagu

SEQ ID NO: 1383951 - RNA, 19 nt, Homo sapiens
agucccagauccaggaguu

SEQ ID NO: 1383952 - RNA, 19 nt, Homo sapiens
gcagcugggcauggaagaa

SEQ ID NO: 1383953 - RNA, 19 nt, Homo sapiens
cuccacgccuucaaagugu

SEQ ID NO: 1383954 - RNA, 19 nt, Homo sapiens
gaguugagguccugauuaa

SEQ ID NO: 1383955 - RNA, 19 nt, Homo sapiens
ggacagacgaguucucuaa

SEQ ID NO: 1383956 - RNA, 19 nt, Homo sapiens
gaaagccaauaaagaccua

SEQ ID NO: 1383957 - RNA, 19 nt, Homo sapiens
ucaguuaagcccacaauua

SEQ ID NO: 1383958 - RNA, 19 nt, Homo sapiens
gcccugaacuugcagauug

SEQ ID NO: 1383959 - RNA, 19 nt, Homo sapiens
ugacacaguucaccuauuc

SEQ ID NO: 1383960 - RNA, 19 nt, Homo sapiens
ugaaggagaucuugagcaa

SEQ ID NO: 1383961 - RNA, 19 nt, Homo sapiens
gaaggaacuuuagcuuuua

SEQ ID NO: 1383962 - RNA, 19 nt, Homo sapiens
aaucauaccugucuuaaac

SEQ ID NO: 1383963 - RNA, 19 nt, Homo sapiens
ggcagaggcugaaggaaga

SEQ ID NO: 1383964 - RNA, 19 nt, Homo sapiens
gaagagaagaacaaacaga

SEQ ID NO: 1383965 - RNA, 19 nt, Homo sapiens
gagagaaaguacaccugaa

SEQ ID NO: 1383966 - RNA, 19 nt, Homo sapiens
auagucagcuucccuuaaa

SEQ ID NO: 1383967 - RNA, 19 nt, Homo sapiens
uaaaucaaguggaaguuag

SEQ ID NO: 1383968 - RNA, 19 nt, Homo sapiens
ccagugacaugguggaguu

SEQ ID NO: 1383969 - RNA, 19 nt, Homo sapiens
gaacuugcagauugaagaa

SEQ ID NO: 1383970 - RNA, 19 nt, Homo sapiens
ucucuaagaugcaguuaau

SEQ ID NO: 1383971 - RNA, 19 nt, Homo sapiens
gaacugaguggcaaugaag

SEQ ID NO: 1383972 - RNA, 19 nt, Homo sapiens
agaaggaacuuuagcuuuu

SEQ ID NO: 1383973 - RNA, 19 nt, Homo sapiens
ggcaauauacuaucaaaca

SEQ ID NO: 1383974 - RNA, 19 nt, Homo sapiens
caaacuggcaauauacuau

SEQ ID NO: 1383975 - RNA, 19 nt, Homo sapiens
uggaagacgugaagcauca

SEQ ID NO: 1383976 - RNA, 19 nt, Homo sapiens
cagagcggcuggcaaagga

SEQ ID NO: 1383977 - RNA, 19 nt, Homo sapiens
gaagacaccacauuuuaaa

SEQ ID NO: 1383978 - RNA, 19 nt, Homo sapiens
guuaagcccacaauuagaa

SEQ ID NO: 1383979 - RNA, 19 nt, Homo sapiens
guuaaucauaccugucuua

SEQ ID NO: 1383980 - RNA, 19 nt, Homo sapiens
cagacgaguucucuaagau

SEQ ID NO: 1383981 - RNA, 19 nt, Homo sapiens
gugaggcccugcagaagga

SEQ ID NO: 1383982 - RNA, 19 nt, Homo sapiens
cgaguugagguccugauua

SEQ ID NO: 1383983 - RNA, 19 nt, Homo sapiens
uagaaggaacuuuagcuuu

SEQ ID NO: 1383984 - RNA, 19 nt, Homo sapiens
cagcagaagugccaacaac

SEQ ID NO: 1383985 - RNA, 19 nt, Homo sapiens
gaacagcuggaagaucuga

SEQ ID NO: 1383986 - RNA, 19 nt, Homo sapiens
gaauuucugcccugaacuu

SEQ ID NO: 1383987 - RNA, 19 nt, Homo sapiens
aaagaaagccaauaaagac

SEQ ID NO: 1383988 - RNA, 19 nt, Homo sapiens
acagacgaguucucuaaga

SEQ ID NO: 1383989 - RNA, 19 nt, Homo sapiens
gagguuggcauucgaggaa

SEQ ID NO: 1383990 - RNA, 19 nt, Homo sapiens
ugaacugaguggcaaugaa

SEQ ID NO: 1383991 - RNA, 19 nt, Homo sapiens
aggaacagcuggaagaucu

SEQ ID NO: 1383992 - RNA, 19 nt, Homo sapiens
acaaggaccucugggacuu

SEQ ID NO: 1383993 - RNA, 19 nt, Homo sapiens
ggucaaggcgacacuggaa

SEQ ID NO: 1383994 - RNA, 19 nt, Homo sapiens
aagaagagaagaacaaaca

SEQ ID NO: 1383995 - RNA, 19 nt, Homo sapiens
caguuaagcccacaauuag

SEQ ID NO: 1383996 - RNA, 19 nt, Homo sapiens
aaacaaacuggcaauauac

SEQ ID NO: 1383997 - RNA, 19 nt, Homo sapiens
ucauaccugucuuaaacaa

SEQ ID NO: 1383998 - RNA, 19 nt, Homo sapiens
aauggaacauggcaaagug

SEQ ID NO: 1383999 - RNA, 19 nt, Homo sapiens
gaaagugggaagccuagag

SEQ ID NO: 1384000 - RNA, 19 nt, Homo sapiens
ccagagcacacaagaggaa

SEQ ID NO: 1384001 - RNA, 19 nt, Homo sapiens
aaggagaucuugagcaaaa

SEQ ID NO: 1384002 - RNA, 19 nt, Homo sapiens
acaggaagcacaccauguu

SEQ ID NO: 1384003 - RNA, 19 nt, Homo sapiens
auugaagacuugauggaaa

SEQ ID NO: 1384004 - RNA, 19 nt, Homo sapiens
gaaaauugaagacuugaug

SEQ ID NO: 1384005 - RNA, 19 nt, Homo sapiens
uugaagacuugauggaaau

SEQ ID NO: 1384006 - RNA, 19 nt, Homo sapiens
ucuaagaugcaguuaauca

SEQ ID NO: 1384007 - RNA, 19 nt, Homo sapiens
ucacugcagagcacuguuu

SEQ ID NO: 1384008 - RNA, 19 nt, Homo sapiens
ggaagcacaccauguugca

SEQ ID NO: 1384009 - RNA, 19 nt, Homo sapiens
aaagugaggcacacaggaa

SEQ ID NO: 1384010 - RNA, 19 nt, Homo sapiens
ugaagaagagaagaacaaa

SEQ ID NO: 1384011 - RNA, 19 nt, Homo sapiens
gcagauugaagaagagaag

SEQ ID NO: 1384012 - RNA, 19 nt, Homo sapiens
gaaggagaucuugagcaaa

SEQ ID NO: 1384013 - RNA, 19 nt, Homo sapiens
aagaugcaguuaaucauac

SEQ ID NO: 1384014 - RNA, 19 nt, Homo sapiens
gccaacaacagcagcagaa

SEQ ID NO: 1384015 - RNA, 19 nt, Homo sapiens
gcagaagugccaacaacag

SEQ ID NO: 1384016 - RNA, 19 nt, Homo sapiens
acaguucaccuauucaugu

SEQ ID NO: 1384017 - RNA, 19 nt, Homo sapiens
acagaaaauugaagacuug

SEQ ID NO: 1384018 - RNA, 19 nt, Homo sapiens
gaagaagagaagaacaaac

SEQ ID NO: 1384019 - RNA, 19 nt, Homo sapiens
gugacaugguggaguugaa

SEQ ID NO: 1384020 - RNA, 19 nt, Homo sapiens
acaaacuggcaauauacua

SEQ ID NO: 1384021 - RNA, 19 nt, Homo sapiens
gagugcaaggagagaauuu

SEQ ID NO: 1384022 - RNA, 19 nt, Homo sapiens
ggagugcaaggagagaauu

SEQ ID NO: 1384023 - RNA, 19 nt, Homo sapiens
aauagucagcuucccuuaa

SEQ ID NO: 1384024 - RNA, 19 nt, Homo sapiens
ucaaggcgacacuggaaga

SEQ ID NO: 1384025 - RNA, 19 nt, Homo sapiens
aaguacaccugaaggagau

SEQ ID NO: 1384026 - RNA, 19 nt, Homo sapiens
aaauagucagcuucccuua

SEQ ID NO: 1384027 - RNA, 19 nt, Homo sapiens
cagcugagguuggcauucg

SEQ ID NO: 1384028 - RNA, 19 nt, Homo sapiens
ugaacuugcagauugaaga

SEQ ID NO: 1384029 - RNA, 19 nt, Homo sapiens
agaaaguacaccugaagga

SEQ ID NO: 1384030 - RNA, 19 nt, Homo sapiens
caguucaccuauucaugug

SEQ ID NO: 1384031 - RNA, 19 nt, Homo sapiens
cuggcaauauacuaucaaa

SEQ ID NO: 1384032 - RNA, 19 nt, Homo sapiens
auaccugucuuaaacaaac

SEQ ID NO: 1384033 - RNA, 19 nt, Homo sapiens
aggaagagcuggaaaagca

SEQ ID NO: 1384034 - RNA, 19 nt, Homo sapiens
caauuagaaggaacuuuag

SEQ ID NO: 1384035 - RNA, 19 nt, Homo sapiens
auggcaaagugcagaaauu

SEQ ID NO: 1384036 - RNA, 19 nt, Homo sapiens
ugguggaguugaagagaga

SEQ ID NO: 1384037 - RNA, 19 nt, Homo sapiens
ugauggaaauggugcaaaa

SEQ ID NO: 1384038 - RNA, 19 nt, Homo sapiens
cggcugcauugccaggaaa

SEQ ID NO: 1384039 - RNA, 19 nt, Homo sapiens
gguccugauuaaccggauu

SEQ ID NO: 1384040 - RNA, 19 nt, Homo sapiens
ugaagacaccacauuuuaa

SEQ ID NO: 1384041 - RNA, 19 nt, Homo sapiens
gcagcagaagugccaacaa

SEQ ID NO: 1384042 - RNA, 19 nt, Homo sapiens
acuugcagauugaagaaga

SEQ ID NO: 1384043 - RNA, 19 nt, Homo sapiens
ccucugggacuuccacaug

SEQ ID NO: 1384044 - RNA, 19 nt, Homo sapiens
ucgaggaacagcuggaaga

SEQ ID NO: 1384045 - RNA, 19 nt, Homo sapiens
guccugauuaaccggauua

SEQ ID NO: 1384046 - RNA, 19 nt, Homo sapiens
uuagaaggaacuuuagcuu

SEQ ID NO: 1384047 - RNA, 19 nt, Homo sapiens
aacaagagacccugaggau

SEQ ID NO: 1384048 - RNA, 19 nt, Homo sapiens
agagaagaacaaacagaga

SEQ ID NO: 1384049 - RNA, 19 nt, Homo sapiens
caggaagcacaccauguug

SEQ ID NO: 1384050 - RNA, 19 nt, Homo sapiens
ccaaagcguuccuggauaa

SEQ ID NO: 1384051 - RNA, 19 nt, Homo sapiens
gaucugagcaacauuguaa

SEQ ID NO: 1384052 - RNA, 19 nt, Homo sapiens
ccacaaccaugccaagaug

SEQ ID NO: 1384053 - RNA, 19 nt, Homo sapiens
gcgagaacaucgaggaguu

SEQ ID NO: 1384054 - RNA, 19 nt, Homo sapiens
ucacugcccugucugaaau

SEQ ID NO: 1384055 - RNA, 19 nt, Homo sapiens
cccaggaggugucagcaua

SEQ ID NO: 1384056 - RNA, 19 nt, Homo sapiens
cgacauccgugugcccuuu

SEQ ID NO: 1384057 - RNA, 19 nt, Homo sapiens
ggaccuggguugucauguc

SEQ ID NO: 1384058 - RNA, 19 nt, Homo sapiens
gcuaugacccagcaucuga

SEQ ID NO: 1384059 - RNA, 19 nt, Homo sapiens
ccugaaacaugaacagaau

SEQ ID NO: 1384060 - RNA, 19 nt, Homo sapiens
ggcaagaccuggugaaagc

SEQ ID NO: 1384061 - RNA, 19 nt, Homo sapiens
gcaacgacgacgugaaaga

SEQ ID NO: 1384062 - RNA, 19 nt, Homo sapiens
guaaagacggcaccuaaag

SEQ ID NO: 1384063 - RNA, 19 nt, Homo sapiens
cgugaaagaugcuauuguc

SEQ ID NO: 1384064 - RNA, 19 nt, Homo sapiens
gcaaugaccaccagaugag

SEQ ID NO: 1384065 - RNA, 19 nt, Homo sapiens
acgcuugccugaaacauga

SEQ ID NO: 1384066 - RNA, 19 nt, Homo sapiens
caacacaggcgaagauggu

SEQ ID NO: 1384067 - RNA, 19 nt, Homo sapiens
gcucaucgaagccaccaaa

SEQ ID NO: 1384068 - RNA, 19 nt, Homo sapiens
cagaggaggcagugaaaga

SEQ ID NO: 1384069 - RNA, 19 nt, Homo sapiens
gccagcagcacggauguua

SEQ ID NO: 1384070 - RNA, 19 nt, Homo sapiens
caaagggcacgucccauca

SEQ ID NO: 1384071 - RNA, 19 nt, Homo sapiens
ggaggccucuacacagaag

SEQ ID NO: 1384072 - RNA, 19 nt, Homo sapiens
gcuugaaggugcucaucga

SEQ ID NO: 1384073 - RNA, 19 nt, Homo sapiens
cccaggagcccacacauga

SEQ ID NO: 1384074 - RNA, 19 nt, Homo sapiens
caacgacgacgugaaagau

SEQ ID NO: 1384075 - RNA, 19 nt, Homo sapiens
gcucugggauccgcugugu

SEQ ID NO: 1384076 - RNA, 19 nt, Homo sapiens
cacaugacauccugcagau

SEQ ID NO: 1384077 - RNA, 19 nt, Homo sapiens
uaaagacggcaccuaaagu

SEQ ID NO: 1384078 - RNA, 19 nt, Homo sapiens
aggcgaagauggucuccaa

SEQ ID NO: 1384079 - RNA, 19 nt, Homo sapiens
accaaagcguuccuggaua

SEQ ID NO: 1384080 - RNA, 19 nt, Homo sapiens
caccaaagcguuccuggau

SEQ ID NO: 1384081 - RNA, 19 nt, Homo sapiens
gggcacgucccaucacuca

SEQ ID NO: 1384082 - RNA, 19 nt, Homo sapiens
ggagaacaaaggcuugaag

SEQ ID NO: 1384083 - RNA, 19 nt, Homo sapiens
uggccacgcugacccagaa

SEQ ID NO: 1384084 - RNA, 19 nt, Homo sapiens
caucaacacaggcgaagau

SEQ ID NO: 1384085 - RNA, 19 nt, Homo sapiens
cgacaacagccgcaucauc

SEQ ID NO: 1384086 - RNA, 19 nt, Homo sapiens
agggaggccucuacacaga

SEQ ID NO: 1384087 - RNA, 19 nt, Homo sapiens
ucgcggucguccuugguua

SEQ ID NO: 1384088 - RNA, 19 nt, Homo sapiens
cgacgugaaagaugcuauu

SEQ ID NO: 1384089 - RNA, 19 nt, Homo sapiens
ugagcaacauuguaaagac

SEQ ID NO: 1384090 - RNA, 19 nt, Homo sapiens
gcacgucccaucacucacu

SEQ ID NO: 1384091 - RNA, 19 nt, Homo sapiens
gacggcaccuaaagucucu

SEQ ID NO: 1384092 - RNA, 19 nt, Homo sapiens
gagaacaucgaggaguuug

SEQ ID NO: 1384093 - RNA, 19 nt, Homo sapiens
gcagcacggauguuacugu

SEQ ID NO: 1384094 - RNA, 19 nt, Homo sapiens
caaccaugccaagaugauu

SEQ ID NO: 1384095 - RNA, 19 nt, Homo sapiens
ugacccagaaugcugauga

SEQ ID NO: 1384096 - RNA, 19 nt, Homo sapiens
ugaaggcacacccgcagaa

SEQ ID NO: 1384097 - RNA, 19 nt, Homo sapiens
aggcaacgacgacgugaaa

SEQ ID NO: 1384098 - RNA, 19 nt, Homo sapiens
aagaggccguggagcaguu

SEQ ID NO: 1384099 - RNA, 19 nt, Homo sapiens
cgagaacaucgaggaguuu

SEQ ID NO: 1384100 - RNA, 19 nt, Homo sapiens
ggccagaggaggcagugaa

SEQ ID NO: 1384101 - RNA, 19 nt, Homo sapiens
aaagacggcaccuaaaguc

SEQ ID NO: 1384102 - RNA, 19 nt, Homo sapiens
uguaaagacggcaccuaaa

SEQ ID NO: 1384103 - RNA, 19 nt, Homo sapiens
gccagaggaggcagugaaa

SEQ ID NO: 1384104 - RNA, 19 nt, Homo sapiens
gcauugcccaggagaccuu

SEQ ID NO: 1384105 - RNA, 19 nt, Homo sapiens
ccaggagaccuuugaugca

SEQ ID NO: 1384106 - RNA, 19 nt, Homo sapiens
gccugaaacaugaacagaa

SEQ ID NO: 1384107 - RNA, 19 nt, Homo sapiens
ggccucugcuccuugucuu

SEQ ID NO: 1384108 - RNA, 19 nt, Homo sapiens
gcacgccaacaucaacaca

SEQ ID NO: 1384109 - RNA, 19 nt, Homo sapiens
gacccagaaugcugaugag

SEQ ID NO: 1384110 - RNA, 19 nt, Homo sapiens
uuguaaagacggcaccuaa

SEQ ID NO: 1384111 - RNA, 19 nt, Homo sapiens
gggaggccucuacacagaa

SEQ ID NO: 1384112 - RNA, 19 nt, Homo sapiens
ggaaauggauucaguguca

SEQ ID NO: 1384113 - RNA, 19 nt, Homo sapiens
gaaccuggcuucuguagga

SEQ ID NO: 1384114 - RNA, 19 nt, Homo sapiens
gguaaagccuucaaauauu

SEQ ID NO: 1384115 - RNA, 19 nt, Homo sapiens
gagagacuguuugaaauua

SEQ ID NO: 1384116 - RNA, 19 nt, Homo sapiens
ccagagaaguuauaucauu

SEQ ID NO: 1384117 - RNA, 19 nt, Homo sapiens
gcugagaauuucacagaua

SEQ ID NO: 1384118 - RNA, 19 nt, Homo sapiens
uaucagugguucauuguua

SEQ ID NO: 1384119 - RNA, 19 nt, Homo sapiens
gaaggugucuauacuuuag

SEQ ID NO: 1384120 - RNA, 19 nt, Homo sapiens
gguaaagccuucaguuguu

SEQ ID NO: 1384121 - RNA, 19 nt, Homo sapiens
guaaagccuucaaauauuc

SEQ ID NO: 1384122 - RNA, 19 nt, Homo sapiens
guagagagacuguuugaaa

SEQ ID NO: 1384123 - RNA, 19 nt, Homo sapiens
gagaaacccuaugaaugua

SEQ ID NO: 1384124 - RNA, 19 nt, Homo sapiens
gugauaaagccuucaauua

SEQ ID NO: 1384125 - RNA, 19 nt, Homo sapiens
ggagaaaucuaagcaguca

SEQ ID NO: 1384126 - RNA, 19 nt, Homo sapiens
gagaaacccuaugcaugua

SEQ ID NO: 1384127 - RNA, 19 nt, Homo sapiens
gagagaaacccuaugaaug

SEQ ID NO: 1384128 - RNA, 19 nt, Homo sapiens
uaaagaaggugucuauacu

SEQ ID NO: 1384129 - RNA, 19 nt, Homo sapiens
uaaagaaggcagucaauau

SEQ ID NO: 1384130 - RNA, 19 nt, Homo sapiens
uauccaagaugacuucaaa

SEQ ID NO: 1384131 - RNA, 19 nt, Homo sapiens
aagaaggugucuauacuuu

SEQ ID NO: 1384132 - RNA, 19 nt, Homo sapiens
gagagaaacccaacacaug

SEQ ID NO: 1384133 - RNA, 19 nt, Homo sapiens
gaauguaaacaauguggua

SEQ ID NO: 1384134 - RNA, 19 nt, Homo sapiens
cagagaaguuauaucauug

SEQ ID NO: 1384135 - RNA, 19 nt, Homo sapiens
ggagagaaacccuaugaau

SEQ ID NO: 1384136 - RNA, 19 nt, Homo sapiens
caaguuaucuucgugaaca

SEQ ID NO: 1384137 - RNA, 19 nt, Homo sapiens
gaaaagcccuaugaaugua

SEQ ID NO: 1384138 - RNA, 19 nt, Homo sapiens
gagaugugaugcaagaaau

SEQ ID NO: 1384139 - RNA, 19 nt, Homo sapiens
agaaguguguuaaagcuuu

SEQ ID NO: 1384140 - RNA, 19 nt, Homo sapiens
ggcaaagccuucagucguu

SEQ ID NO: 1384141 - RNA, 19 nt, Homo sapiens
acagagaugugaugcaaga

SEQ ID NO: 1384142 - RNA, 19 nt, Homo sapiens
gagcugagaauuucacaga

SEQ ID NO: 1384143 - RNA, 19 nt, Homo sapiens
acacauguaaggaagauua

SEQ ID NO: 1384144 - RNA, 19 nt, Homo sapiens
gagaaacccaacacaugua

SEQ ID NO: 1384145 - RNA, 19 nt, Homo sapiens
ggaauguccagagaaguua

SEQ ID NO: 1384146 - RNA, 19 nt, Homo sapiens
uagagagacuguuugaaau

SEQ ID NO: 1384147 - RNA, 19 nt, Homo sapiens
cuacagagaugugaugcaa

SEQ ID NO: 1384148 - RNA, 19 nt, Homo sapiens
uauaagccauaguacauga

SEQ ID NO: 1384149 - RNA, 19 nt, Homo sapiens
ggaaagaacgucauaaaau

SEQ ID NO: 1384150 - RNA, 19 nt, Homo sapiens
guaaggaagauuagaaugu

SEQ ID NO: 1384151 - RNA, 19 nt, Homo sapiens
ggaaugugguaagucguuu

SEQ ID NO: 1384152 - RNA, 19 nt, Homo sapiens
gugguaaagccuucaaaua

SEQ ID NO: 1384153 - RNA, 19 nt, Homo sapiens
agagaaacccuaugaaugu

SEQ ID NO: 1384154 - RNA, 19 nt, Homo sapiens
cagccaggauucaaauuug

SEQ ID NO: 1384155 - RNA, 19 nt, Homo sapiens
gaauguaagaaauguggua

SEQ ID NO: 1384156 - RNA, 19 nt, Homo sapiens
gagaaaagcccuaugaaug

SEQ ID NO: 1384157 - RNA, 19 nt, Homo sapiens
ggagugggcuuugcuggau

SEQ ID NO: 1384158 - RNA, 19 nt, Homo sapiens
ggaguaaagccaugugaau

SEQ ID NO: 1384159 - RNA, 19 nt, Homo sapiens
ucuaagcagucauguggua

SEQ ID NO: 1384160 - RNA, 19 nt, Homo sapiens
ggaaaagucuucauauguc

SEQ ID NO: 1384161 - RNA, 19 nt, Homo sapiens
caauguaagaaguguguua

SEQ ID NO: 1384162 - RNA, 19 nt, Homo sapiens
ugagaagccuuuugauuuu

SEQ ID NO: 1384163 - RNA, 19 nt, Homo sapiens
caacacauguaaggaagau

SEQ ID NO: 1384164 - RNA, 19 nt, Homo sapiens
caugaaagagcuuauaugu

SEQ ID NO: 1384165 - RNA, 19 nt, Homo sapiens
ugguaaagccuucaaauau

SEQ ID NO: 1384166 - RNA, 19 nt, Homo sapiens
gaacucauacuggagagaa

SEQ ID NO: 1384167 - RNA, 19 nt, Homo sapiens
ucauggagcugagaauuuc

SEQ ID NO: 1384168 - RNA, 19 nt, Homo sapiens
gagcuuauaugugguaaaa

SEQ ID NO: 1384169 - RNA, 19 nt, Homo sapiens
agugaaaccuuauggaugu

SEQ ID NO: 1384170 - RNA, 19 nt, Homo sapiens
uaaccuaugugagcaugaa

SEQ ID NO: 1384171 - RNA, 19 nt, Homo sapiens
gcacuuacacuggagagaa

SEQ ID NO: 1384172 - RNA, 19 nt, Homo sapiens
gcacauccugucucacauu

SEQ ID NO: 1384173 - RNA, 19 nt, Homo sapiens
guguuaaagcuuucaguua

SEQ ID NO: 1384174 - RNA, 19 nt, Homo sapiens
gaaguguguuaaagcuuuc

SEQ ID NO: 1384175 - RNA, 19 nt, Homo sapiens
guaaagccuucaguuguuc

SEQ ID NO: 1384176 - RNA, 19 nt, Homo sapiens
gaaacccuaugaauguaag

SEQ ID NO: 1384177 - RNA, 19 nt, Homo sapiens
aaagaaggcagucaauaug

SEQ ID NO: 1384178 - RNA, 19 nt, Homo sapiens
cccagccgcuuucaaauau

SEQ ID NO: 1384179 - RNA, 19 nt, Homo sapiens
uaagaaguguguuaaagcu

SEQ ID NO: 1384180 - RNA, 19 nt, Homo sapiens
ggagugaaaccuuauggau

SEQ ID NO: 1384181 - RNA, 19 nt, Homo sapiens
gaauauccaagaugacuuc

SEQ ID NO: 1384182 - RNA, 19 nt, Homo sapiens
caaaucagaagaccagaau

SEQ ID NO: 1384183 - RNA, 19 nt, Homo sapiens
cauaguacaugagcuuaau

SEQ ID NO: 1384184 - RNA, 19 nt, Homo sapiens
gaaugugguaagucguuua

SEQ ID NO: 1384185 - RNA, 19 nt, Homo sapiens
uuauaaggguccaguguau

SEQ ID NO: 1384186 - RNA, 19 nt, Homo sapiens
cuaguaaugggccuuauaa

SEQ ID NO: 1384187 - RNA, 19 nt, Homo sapiens
gaaacccuaugcauguaag

SEQ ID NO: 1384188 - RNA, 19 nt, Homo sapiens
agagaaacccuaugcaugu

SEQ ID NO: 1384189 - RNA, 19 nt, Homo sapiens
ggagagaaacccuaugcau

SEQ ID NO: 1384190 - RNA, 19 nt, Homo sapiens
guaacacacacuaguaaug

SEQ ID NO: 1384191 - RNA, 19 nt, Homo sapiens
uggauucagugucauuuga

SEQ ID NO: 1384192 - RNA, 19 nt, Homo sapiens
gaaaagucuucauauguca

SEQ ID NO: 1384193 - RNA, 19 nt, Homo sapiens
cuaauuaauggaccaauga

SEQ ID NO: 1384194 - RNA, 19 nt, Homo sapiens
cagccgcuuucaaauauau

SEQ ID NO: 1384195 - RNA, 19 nt, Homo sapiens
gcauguaagaaauguggua

SEQ ID NO: 1384196 - RNA, 19 nt, Homo sapiens
guccagagaaguuauauca

SEQ ID NO: 1384197 - RNA, 19 nt, Homo sapiens
guaaagccaugugaaugca

SEQ ID NO: 1384198 - RNA, 19 nt, Homo sapiens
gugguucauuguuaaagaa

SEQ ID NO: 1384199 - RNA, 19 nt, Homo sapiens
gccuucaaauauucuagua

SEQ ID NO: 1384200 - RNA, 19 nt, Homo sapiens
aaucagaagaccagaauau

SEQ ID NO: 1384201 - RNA, 19 nt, Homo sapiens
gagaaguuauaucauugca

SEQ ID NO: 1384202 - RNA, 19 nt, Homo sapiens
ugaggaauguccagagaag

SEQ ID NO: 1384203 - RNA, 19 nt, Homo sapiens
cauccugucucacauugga

SEQ ID NO: 1384204 - RNA, 19 nt, Homo sapiens
gaguaaagccaugugaaug

SEQ ID NO: 1384205 - RNA, 19 nt, Homo sapiens
uuaaagaaggcagucaaua

SEQ ID NO: 1384206 - RNA, 19 nt, Homo sapiens
ucacagauacuuuauaagc

SEQ ID NO: 1384207 - RNA, 19 nt, Homo sapiens
uuuccuaguucccuucuaa

SEQ ID NO: 1384208 - RNA, 19 nt, Homo sapiens
gcuuucaguuauucuaguu

SEQ ID NO: 1384209 - RNA, 19 nt, Homo sapiens
uguaagaaguguguuaaag

SEQ ID NO: 1384210 - RNA, 19 nt, Homo sapiens
gcaugaaagagcuuauaug

SEQ ID NO: 1384211 - RNA, 19 nt, Homo sapiens
uguaagaaaugugguaaag

SEQ ID NO: 1384212 - RNA, 19 nt, Homo sapiens
gcacaugaaugcauauaua

SEQ ID NO: 1384213 - RNA, 19 nt, Homo sapiens
gaccugaccuuguuauuua

SEQ ID NO: 1384214 - RNA, 19 nt, Homo sapiens
ggaaauaauucucuccuuu

SEQ ID NO: 1384215 - RNA, 19 nt, Homo sapiens
caacuucauuggcaaauua

SEQ ID NO: 1384216 - RNA, 19 nt, Homo sapiens
gcacuaaagucugcuauuu

SEQ ID NO: 1384217 - RNA, 19 nt, Homo sapiens
guaaagugcuuauggcuaa

SEQ ID NO: 1384218 - RNA, 19 nt, Homo sapiens
gaacuugacuucuuaugug

SEQ ID NO: 1384219 - RNA, 19 nt, Homo sapiens
gcacacacaucccuugauu

SEQ ID NO: 1384220 - RNA, 19 nt, Homo sapiens
agacaugacuguucucuuu

SEQ ID NO: 1384221 - RNA, 19 nt, Homo sapiens
ggaguugagugccaucuuu

SEQ ID NO: 1384222 - RNA, 19 nt, Homo sapiens
gagaauaacccaucauaau

SEQ ID NO: 1384223 - RNA, 19 nt, Homo sapiens
gaguagaccugaccuuguu

SEQ ID NO: 1384224 - RNA, 19 nt, Homo sapiens
ucuaagauguggauuauug

SEQ ID NO: 1384225 - RNA, 19 nt, Homo sapiens
cuaugaaacuacacacuua

SEQ ID NO: 1384226 - RNA, 19 nt, Homo sapiens
gaaauaauucucuccuuug

SEQ ID NO: 1384227 - RNA, 19 nt, Homo sapiens
gcauagaaguaaaucauuc

SEQ ID NO: 1384228 - RNA, 19 nt, Homo sapiens
ugacuguguugcuuaaaua

SEQ ID NO: 1384229 - RNA, 19 nt, Homo sapiens
guaaauaaguggaguugag

SEQ ID NO: 1384230 - RNA, 19 nt, Homo sapiens
gagauuugauuaugagaug

SEQ ID NO: 1384231 - RNA, 19 nt, Homo sapiens
gacaaauguugcuuuaaga

SEQ ID NO: 1384232 - RNA, 19 nt, Homo sapiens
caucauauguauaccauca

SEQ ID NO: 1384233 - RNA, 19 nt, Homo sapiens
guuagaaucugcaacuuca

SEQ ID NO: 1384234 - RNA, 19 nt, Homo sapiens
agacaaauguugcuuuaag

SEQ ID NO: 1384235 - RNA, 19 nt, Homo sapiens
gcauauugcuuugggaaga

SEQ ID NO: 1384236 - RNA, 19 nt, Homo sapiens
guaaaucauucggauguga

SEQ ID NO: 1384237 - RNA, 19 nt, Homo sapiens
gcaaucaguuugagauacu

SEQ ID NO: 1384238 - RNA, 19 nt, Homo sapiens
guagaucucugcaacuaag

SEQ ID NO: 1384239 - RNA, 19 nt, Homo sapiens
guucaguucuguauuuguu

SEQ ID NO: 1384240 - RNA, 19 nt, Homo sapiens
uagauaaacccuaggaauu

SEQ ID NO: 1384241 - RNA, 19 nt, Homo sapiens
gaaccucaaacuagauaaa

SEQ ID NO: 1384242 - RNA, 19 nt, Homo sapiens
uaagcuaugucauugucua

SEQ ID NO: 1384243 - RNA, 19 nt, Homo sapiens
uagggaaccuuaagucaug

SEQ ID NO: 1384244 - RNA, 19 nt, Homo sapiens
guacaagugugaaucaaaa

SEQ ID NO: 1384245 - RNA, 19 nt, Homo sapiens
gagaugugcauauugcuuu

SEQ ID NO: 1384246 - RNA, 19 nt, Homo sapiens
aaauaaaccugguccucuu

SEQ ID NO: 1384247 - RNA, 19 nt, Homo sapiens
cuacugcggucucggauau

SEQ ID NO: 1384248 - RNA, 19 nt, Homo sapiens
ggccauauccuacaccaaa

SEQ ID NO: 1384249 - RNA, 19 nt, Homo sapiens
gcaacuucauuggcaaauu

SEQ ID NO: 1384250 - RNA, 19 nt, Homo sapiens
ugaaguacauguauaugca

SEQ ID NO: 1384251 - RNA, 19 nt, Homo sapiens
acgaagagaugacgcuuug

SEQ ID NO: 1384252 - RNA, 19 nt, Homo sapiens
gcccagagcguucccugua

SEQ ID NO: 1384253 - RNA, 19 nt, Homo sapiens
gcuuauggcuaacaguuca

SEQ ID NO: 1384254 - RNA, 19 nt, Homo sapiens
cagcagauacugacuuguu

SEQ ID NO: 1384255 - RNA, 19 nt, Homo sapiens
aaauuacccucuagcucua

SEQ ID NO: 1384256 - RNA, 19 nt, Homo sapiens
guugacagguaaauaagug

SEQ ID NO: 1384257 - RNA, 19 nt, Homo sapiens
gauuaucucuuuguacuac

SEQ ID NO: 1384258 - RNA, 19 nt, Homo sapiens
uaugugugcucuaugaguu

SEQ ID NO: 1384259 - RNA, 19 nt, Homo sapiens
uuuggcaccuuauguuuaa

SEQ ID NO: 1384260 - RNA, 19 nt, Homo sapiens
ugucagauguggaguucaa

SEQ ID NO: 1384261 - RNA, 19 nt, Homo sapiens
cgagaauaacccaucauaa

SEQ ID NO: 1384262 - RNA, 19 nt, Homo sapiens
gggcauucaugaaagaaca

SEQ ID NO: 1384263 - RNA, 19 nt, Homo sapiens
gcucuaacacugaaaauaa

SEQ ID NO: 1384264 - RNA, 19 nt, Homo sapiens
ggucauacagcacuaaagu

SEQ ID NO: 1384265 - RNA, 19 nt, Homo sapiens
agaauaacccaucauaauc

SEQ ID NO: 1384266 - RNA, 19 nt, Homo sapiens
gauguggauuauuguuaga

SEQ ID NO: 1384267 - RNA, 19 nt, Homo sapiens
uuagagggcauucaugaaa

SEQ ID NO: 1384268 - RNA, 19 nt, Homo sapiens
ccaguaauccuuuccaagu

SEQ ID NO: 1384269 - RNA, 19 nt, Homo sapiens
ggaguagaccugaccuugu

SEQ ID NO: 1384270 - RNA, 19 nt, Homo sapiens
guuaagcuaugucauuguc

SEQ ID NO: 1384271 - RNA, 19 nt, Homo sapiens
gauaaacccuaggaauugc

SEQ ID NO: 1384272 - RNA, 19 nt, Homo sapiens
ucuuaugugugcucuauga

SEQ ID NO: 1384273 - RNA, 19 nt, Homo sapiens
ucaguucuguauuuguuga

SEQ ID NO: 1384274 - RNA, 19 nt, Homo sapiens
gugacuguguugcuuaaau

SEQ ID NO: 1384275 - RNA, 19 nt, Homo sapiens
caugacuguucucuuugua

SEQ ID NO: 1384276 - RNA, 19 nt, Homo sapiens
agauaaacccuaggaauug

SEQ ID NO: 1384277 - RNA, 19 nt, Homo sapiens
uaacccaucauaauccaaa

SEQ ID NO: 1384278 - RNA, 19 nt, Homo sapiens
cauggaaaguuaaagugau

SEQ ID NO: 1384279 - RNA, 19 nt, Homo sapiens
gagcuacccagaccauaug

SEQ ID NO: 1384280 - RNA, 19 nt, Homo sapiens
gcucuaugaguuuguugua

SEQ ID NO: 1384281 - RNA, 19 nt, Homo sapiens
auacugacuuguugccauu

SEQ ID NO: 1384282 - RNA, 19 nt, Homo sapiens
ugacuguucucuuuguaca

SEQ ID NO: 1384283 - RNA, 19 nt, Homo sapiens
gaauaacccaucauaaucc

SEQ ID NO: 1384284 - RNA, 19 nt, Homo sapiens
ucauauguauaccaucaga

SEQ ID NO: 1384285 - RNA, 19 nt, Homo sapiens
cagaugcacuaccugaaca

SEQ ID NO: 1384286 - RNA, 19 nt, Homo sapiens
uuuaucaccugcugcugua

SEQ ID NO: 1384287 - RNA, 19 nt, Homo sapiens
gagcacacacaucccuuga

SEQ ID NO: 1384288 - RNA, 19 nt, Homo sapiens
auaacugccucuuguacuu

SEQ ID NO: 1384289 - RNA, 19 nt, Homo sapiens
caguaauccuuuccaagug

SEQ ID NO: 1384290 - RNA, 19 nt, Homo sapiens
ccauauccuacaccaaaua

SEQ ID NO: 1384291 - RNA, 19 nt, Homo sapiens
guauguaauugucuaugca

SEQ ID NO: 1384292 - RNA, 19 nt, Homo sapiens
guaguuuauuucugcucua

SEQ ID NO: 1384293 - RNA, 19 nt, Homo sapiens
gcuaugucauugucuacug

SEQ ID NO: 1384294 - RNA, 19 nt, Homo sapiens
ggaccagcaccaacaggaa

SEQ ID NO: 1384295 - RNA, 19 nt, Homo sapiens
gaagagcucgaggaaggaa

SEQ ID NO: 1384296 - RNA, 19 nt, Homo sapiens
agagaugacgcuuugcuuu

SEQ ID NO: 1384297 - RNA, 19 nt, Homo sapiens
gcacuuucacugccuguca

SEQ ID NO: 1384298 - RNA, 19 nt, Homo sapiens
agaccugaccuuguuauuu

SEQ ID NO: 1384299 - RNA, 19 nt, Homo sapiens
uguauuuguugacagguaa

SEQ ID NO: 1384300 - RNA, 19 nt, Homo sapiens
ccaggggucuaaaacauaa

SEQ ID NO: 1384301 - RNA, 19 nt, Homo sapiens
ccagcacccuuuccuccuu

SEQ ID NO: 1384302 - RNA, 19 nt, Homo sapiens
guaauuauugucagaugug

SEQ ID NO: 1384303 - RNA, 19 nt, Homo sapiens
ucgagaauaacccaucaua

SEQ ID NO: 1384304 - RNA, 19 nt, Homo sapiens
agagggcauucaugaaaga

SEQ ID NO: 1384305 - RNA, 19 nt, Homo sapiens
uaaacugccuaaaauguga

SEQ ID NO: 1384306 - RNA, 19 nt, Homo sapiens
ccuaggaauugcuuaacug

SEQ ID NO: 1384307 - RNA, 19 nt, Homo sapiens
agucugcuauuuauggaaa

SEQ ID NO: 1384308 - RNA, 19 nt, Homo sapiens
ucagauguggaguucaaua

SEQ ID NO: 1384309 - RNA, 19 nt, Homo sapiens
uauuagagggcauucauga

SEQ ID NO: 1384310 - RNA, 19 nt, Homo sapiens
auugcugguuucacuauua

SEQ ID NO: 1384311 - RNA, 19 nt, Homo sapiens
gaagagaugacgcuuugcu

SEQ ID NO: 1384312 - RNA, 19 nt, Homo sapiens
ggagaaaggcgaaccaaua

SEQ ID NO: 1384313 - RNA, 19 nt, Homo sapiens
gaggaaagccuauauuauu

SEQ ID NO: 1384314 - RNA, 19 nt, Homo sapiens
ccuaagcacuuccauaaua

SEQ ID NO: 1384315 - RNA, 19 nt, Homo sapiens
ggaaggcagucuuucuaua

SEQ ID NO: 1384316 - RNA, 19 nt, Homo sapiens
cuucgaaucuuccuaaaua

SEQ ID NO: 1384317 - RNA, 19 nt, Homo sapiens
gaaaugacuuccaaugaca

SEQ ID NO: 1384318 - RNA, 19 nt, Homo sapiens
guagaaggauggacacauu

SEQ ID NO: 1384319 - RNA, 19 nt, Homo sapiens
gagaaaggcgaaccaauaa

SEQ ID NO: 1384320 - RNA, 19 nt, Homo sapiens
cgacuucuacgacuuauua

SEQ ID NO: 1384321 - RNA, 19 nt, Homo sapiens
gauauugcaugacauugaa

SEQ ID NO: 1384322 - RNA, 19 nt, Homo sapiens
ugagaaggcugguuucaga

SEQ ID NO: 1384323 - RNA, 19 nt, Homo sapiens
gaaacaacgcugagugaaa

SEQ ID NO: 1384324 - RNA, 19 nt, Homo sapiens
ugaaacaucucuacaacug

SEQ ID NO: 1384325 - RNA, 19 nt, Homo sapiens
gaaugaaaguccacagaca

SEQ ID NO: 1384326 - RNA, 19 nt, Homo sapiens
gaucgaagcaguacaaauc

SEQ ID NO: 1384327 - RNA, 19 nt, Homo sapiens
gaaauccaauugaggaagu

SEQ ID NO: 1384328 - RNA, 19 nt, Homo sapiens
agacggauacucuuuauaa

SEQ ID NO: 1384329 - RNA, 19 nt, Homo sapiens
guugugcgguuucuagaua

SEQ ID NO: 1384330 - RNA, 19 nt, Homo sapiens
cuggagaacugauaauaaa

SEQ ID NO: 1384331 - RNA, 19 nt, Homo sapiens
gaaagaaagcccacacaca

SEQ ID NO: 1384332 - RNA, 19 nt, Homo sapiens
caucaucacaggcaaauuu

SEQ ID NO: 1384333 - RNA, 19 nt, Homo sapiens
caauaaauuucagggagua

SEQ ID NO: 1384334 - RNA, 19 nt, Homo sapiens
ggaggcaccugcgaaagaa

SEQ ID NO: 1384335 - RNA, 19 nt, Homo sapiens
agaauuugcuguggagaua

SEQ ID NO: 1384336 - RNA, 19 nt, Homo sapiens
ugaaagagcuuaugauccu

SEQ ID NO: 1384337 - RNA, 19 nt, Homo sapiens
ggugauguaugugaucuaa

SEQ ID NO: 1384338 - RNA, 19 nt, Homo sapiens
cauaauagggucaguagaa

SEQ ID NO: 1384339 - RNA, 19 nt, Homo sapiens
aaagaaagcccacacacaa

SEQ ID NO: 1384340 - RNA, 19 nt, Homo sapiens
ggcaagaaaugacuuccaa

SEQ ID NO: 1384341 - RNA, 19 nt, Homo sapiens
gaaggcagucuuucuauag

SEQ ID NO: 1384342 - RNA, 19 nt, Homo sapiens
gacggauacucuuuauaaa

SEQ ID NO: 1384343 - RNA, 19 nt, Homo sapiens
ggaaauuguucgauauugc

SEQ ID NO: 1384344 - RNA, 19 nt, Homo sapiens
ggaagaaccgggacuaugg

SEQ ID NO: 1384345 - RNA, 19 nt, Homo sapiens
gaaagagcuuaugauccua

SEQ ID NO: 1384346 - RNA, 19 nt, Homo sapiens
gaaaauuuauccaccagaa

SEQ ID NO: 1384347 - RNA, 19 nt, Homo sapiens
ucacugacagcaaacuuua

SEQ ID NO: 1384348 - RNA, 19 nt, Homo sapiens
ccgaggaaagccuauauua

SEQ ID NO: 1384349 - RNA, 19 nt, Homo sapiens
guggauggcucaagaucuu

SEQ ID NO: 1384350 - RNA, 19 nt, Homo sapiens
ggaugucacucuccuccuu

SEQ ID NO: 1384351 - RNA, 19 nt, Homo sapiens
gcagugaaagagcuuauga

SEQ ID NO: 1384352 - RNA, 19 nt, Homo sapiens
uacaaucuaugcagugaaa

SEQ ID NO: 1384353 - RNA, 19 nt, Homo sapiens
caagaaaugacuuccaaug

SEQ ID NO: 1384354 - RNA, 19 nt, Homo sapiens
uaucgagucuacaaucuau

SEQ ID NO: 1384355 - RNA, 19 nt, Homo sapiens
uaaaggaggcaaaggaaga

SEQ ID NO: 1384356 - RNA, 19 nt, Homo sapiens
ccacacacaagugaauuua

SEQ ID NO: 1384357 - RNA, 19 nt, Homo sapiens
ccacagacaaacgaauuua

SEQ ID NO: 1384358 - RNA, 19 nt, Homo sapiens
gaacguauuauugcuaugu

SEQ ID NO: 1384359 - RNA, 19 nt, Homo sapiens
cagaacguauuauugcuau

SEQ ID NO: 1384360 - RNA, 19 nt, Homo sapiens
gacaaacgaauuuaaagga

SEQ ID NO: 1384361 - RNA, 19 nt, Homo sapiens
guccaccucuguaugauga

SEQ ID NO: 1384362 - RNA, 19 nt, Homo sapiens
guacuucauuaggaaauug

SEQ ID NO: 1384363 - RNA, 19 nt, Homo sapiens
gaaaggcgaaccaauaaaa

SEQ ID NO: 1384364 - RNA, 19 nt, Homo sapiens
gaaguugugcgguuucuag

SEQ ID NO: 1384365 - RNA, 19 nt, Homo sapiens
cagaauagauauguuggau

SEQ ID NO: 1384366 - RNA, 19 nt, Homo sapiens
aaacaacgcugagugaaaa

SEQ ID NO: 1384367 - RNA, 19 nt, Homo sapiens
cauugaaacagacaaagua

SEQ ID NO: 1384368 - RNA, 19 nt, Homo sapiens
cgaggaaagccuauauuau

SEQ ID NO: 1384369 - RNA, 19 nt, Homo sapiens
ucguagcgauucacuguaa

SEQ ID NO: 1384370 - RNA, 19 nt, Homo sapiens
acauuuaguucgacuucua

SEQ ID NO: 1384371 - RNA, 19 nt, Homo sapiens
gacagcaaacuuuauauuc

SEQ ID NO: 1384372 - RNA, 19 nt, Homo sapiens
gauccuaagcacuuccaua

SEQ ID NO: 1384373 - RNA, 19 nt, Homo sapiens
ggauguucuucuucgagua

SEQ ID NO: 1384374 - RNA, 19 nt, Homo sapiens
ucucauggauguucuucuu

SEQ ID NO: 1384375 - RNA, 19 nt, Homo sapiens
caacacgucuuuuauucaa

SEQ ID NO: 1384376 - RNA, 19 nt, Homo sapiens
cgaaucuuccuaaauacua

SEQ ID NO: 1384377 - RNA, 19 nt, Homo sapiens
gaaauuguucgauauugca

SEQ ID NO: 1384378 - RNA, 19 nt, Homo sapiens
cuaagcacuuccauaauag

SEQ ID NO: 1384379 - RNA, 19 nt, Homo sapiens
agaaggauggacacauuua

SEQ ID NO: 1384380 - RNA, 19 nt, Homo sapiens
agaaaugacuuccaaugac

SEQ ID NO: 1384381 - RNA, 19 nt, Homo sapiens
uaacaggcuuugucuacca

SEQ ID NO: 1384382 - RNA, 19 nt, Homo sapiens
cccaagaccuggagaacug

SEQ ID NO: 1384383 - RNA, 19 nt, Homo sapiens
ugaggaaguugugcgguuu

SEQ ID NO: 1384384 - RNA, 19 nt, Homo sapiens
ggaguaucguucuauuucu

SEQ ID NO: 1384385 - RNA, 19 nt, Homo sapiens
cagaggcacguaugaauga

SEQ ID NO: 1384386 - RNA, 19 nt, Homo sapiens
cagaaacaacgcugaguga

SEQ ID NO: 1384387 - RNA, 19 nt, Homo sapiens
cgaaaccacuaucgagucu

SEQ ID NO: 1384388 - RNA, 19 nt, Homo sapiens
aagaaaugacuuccaauga

SEQ ID NO: 1384389 - RNA, 19 nt, Homo sapiens
gcaauggaacacuauaugg

SEQ ID NO: 1384390 - RNA, 19 nt, Homo sapiens
guucgacuucuacgacuua

SEQ ID NO: 1384391 - RNA, 19 nt, Homo sapiens
ucaccaaggaaguaaauga

SEQ ID NO: 1384392 - RNA, 19 nt, Homo sapiens
cgauauugcaugacauuga

SEQ ID NO: 1384393 - RNA, 19 nt, Homo sapiens
caauggaacacuauaugga

SEQ ID NO: 1384394 - RNA, 19 nt, Homo sapiens
gcuaugucauuuccaucuu

SEQ ID NO: 1384395 - RNA, 19 nt, Homo sapiens
cuagaccucacuuacguua

SEQ ID NO: 1384396 - RNA, 19 nt, Homo sapiens
gaaggauggacacauuuag

SEQ ID NO: 1384397 - RNA, 19 nt, Homo sapiens
ucgaguauuuguagaagga

SEQ ID NO: 1384398 - RNA, 19 nt, Homo sapiens
ugcaugacauugaaacaga

SEQ ID NO: 1384399 - RNA, 19 nt, Homo sapiens
gaacccagaggcacguaug

SEQ ID NO: 1384400 - RNA, 19 nt, Homo sapiens
agaccucacuuacguuaca

SEQ ID NO: 1384401 - RNA, 19 nt, Homo sapiens
gggauggauuugaccuaga

SEQ ID NO: 1384402 - RNA, 19 nt, Homo sapiens
acccacaaaugaauuauca

SEQ ID NO: 1384403 - RNA, 19 nt, Homo sapiens
cuauagaaauccaauugag

SEQ ID NO: 1384404 - RNA, 19 nt, Homo sapiens
ggauggauuugaccuagac

SEQ ID NO: 1384405 - RNA, 19 nt, Homo sapiens
gggagaacgugcccaagac

SEQ ID NO: 1384406 - RNA, 19 nt, Homo sapiens
ggauggacacauuuaguuc

SEQ ID NO: 1384407 - RNA, 19 nt, Homo sapiens
gaaagcccacacacaagug

SEQ ID NO: 1384408 - RNA, 19 nt, Homo sapiens
ccuggagaacugauaauaa

SEQ ID NO: 1384409 - RNA, 19 nt, Homo sapiens
ggcuuugucuaccaagaaa

SEQ ID NO: 1384410 - RNA, 19 nt, Homo sapiens
ucuguaugaugaugugaaa

SEQ ID NO: 1384411 - RNA, 19 nt, Homo sapiens
gauucguggugauguaugu

SEQ ID NO: 1384412 - RNA, 19 nt, Homo sapiens
agaaagagcuagguuauaa

SEQ ID NO: 1384413 - RNA, 19 nt, Homo sapiens
uaacagagaugguucacuu

SEQ ID NO: 1384414 - RNA, 19 nt, Homo sapiens
caaaagaucucaaaaggaa

SEQ ID NO: 1384415 - RNA, 19 nt, Homo sapiens
ggagaagggugcccagguu

SEQ ID NO: 1384416 - RNA, 19 nt, Homo sapiens
ggaaucaaguuuauacaag

SEQ ID NO: 1384417 - RNA, 19 nt, Homo sapiens
gaggucaaguuaucagaaa

SEQ ID NO: 1384418 - RNA, 19 nt, Homo sapiens
gggagcaacucaaucgaaa

SEQ ID NO: 1384419 - RNA, 19 nt, Homo sapiens
cagaaggaaucaaguuuau

SEQ ID NO: 1384420 - RNA, 19 nt, Homo sapiens
agaagggucuguucaaguu

SEQ ID NO: 1384421 - RNA, 19 nt, Homo sapiens
gcaguggaaugguuuaaag

SEQ ID NO: 1384422 - RNA, 19 nt, Homo sapiens
ccagaaggaaucaaguuua

SEQ ID NO: 1384423 - RNA, 19 nt, Homo sapiens
uagcaguucucaugugaaa

SEQ ID NO: 1384424 - RNA, 19 nt, Homo sapiens
gauuauagcaguucucaug

SEQ ID NO: 1384425 - RNA, 19 nt, Homo sapiens
ccaagaaagagcuagguua

SEQ ID NO: 1384426 - RNA, 19 nt, Homo sapiens
gaaggaaucaaguuuauac

SEQ ID NO: 1384427 - RNA, 19 nt, Homo sapiens
caagaaagagcuagguuau

SEQ ID NO: 1384428 - RNA, 19 nt, Homo sapiens
gacaacauccuccagguuu

SEQ ID NO: 1384429 - RNA, 19 nt, Homo sapiens
ucacuuguguguuccauau

SEQ ID NO: 1384430 - RNA, 19 nt, Homo sapiens
gcagacccgugaacaacuu

SEQ ID NO: 1384431 - RNA, 19 nt, Homo sapiens
gaaaguguccucauuacag

SEQ ID NO: 1384432 - RNA, 19 nt, Homo sapiens
agagaugguucacuucauu

SEQ ID NO: 1384433 - RNA, 19 nt, Homo sapiens
cagaggcgacggugucuua

SEQ ID NO: 1384434 - RNA, 19 nt, Homo sapiens
gagaagggugcccagguua

SEQ ID NO: 1384435 - RNA, 19 nt, Homo sapiens
agacgucacuuguguguuc

SEQ ID NO: 1384436 - RNA, 19 nt, Homo sapiens
ggaaguggcuauuuugguu

SEQ ID NO: 1384437 - RNA, 19 nt, Homo sapiens
uauagcaguucucauguga

SEQ ID NO: 1384438 - RNA, 19 nt, Homo sapiens
uuaagaaccugcgcucuga

SEQ ID NO: 1384439 - RNA, 19 nt, Homo sapiens
aaagacaccuucccaggau

SEQ ID NO: 1384440 - RNA, 19 nt, Homo sapiens
gaucacuacucucggacaa

SEQ ID NO: 1384441 - RNA, 19 nt, Homo sapiens
gaaaccugaucaaagaagu

SEQ ID NO: 1384442 - RNA, 19 nt, Homo sapiens
ggaagcaguggaaugguuu

SEQ ID NO: 1384443 - RNA, 19 nt, Homo sapiens
gggaugggcuauuggucuu

SEQ ID NO: 1384444 - RNA, 19 nt, Homo sapiens
gaagcaguggaaugguuua

SEQ ID NO: 1384445 - RNA, 19 nt, Homo sapiens
uccugcagcuguccaguua

SEQ ID NO: 1384446 - RNA, 19 nt, Homo sapiens
agagaaagccuuccaggau

SEQ ID NO: 1384447 - RNA, 19 nt, Homo sapiens
gcucaaaccauuccagaag

SEQ ID NO: 1384448 - RNA, 19 nt, Homo sapiens
uagagaaagccaagaaaga

SEQ ID NO: 1384449 - RNA, 19 nt, Homo sapiens
gagaugguucacuucauuu

SEQ ID NO: 1384450 - RNA, 19 nt, Homo sapiens
ucaaaccauuccagaagga

SEQ ID NO: 1384451 - RNA, 19 nt, Homo sapiens
ggaaaguguccucauuaca

SEQ ID NO: 1384452 - RNA, 19 nt, Homo sapiens
caccagcacuuucaauguc

SEQ ID NO: 1384453 - RNA, 19 nt, Homo sapiens
ccaccugucugacguagag

SEQ ID NO: 1384454 - RNA, 19 nt, Homo sapiens
ucacucgcacugaaguuua

SEQ ID NO: 1384455 - RNA, 19 nt, Homo sapiens
gagaagggucuguucaagu

SEQ ID NO: 1384456 - RNA, 19 nt, Homo sapiens
ggaggucaaguuaucagaa

SEQ ID NO: 1384457 - RNA, 19 nt, Homo sapiens
cacuuucaaugucaucuuu

SEQ ID NO: 1384458 - RNA, 19 nt, Homo sapiens
gaaagccaagaaagagcua

SEQ ID NO: 1384459 - RNA, 19 nt, Homo sapiens
gaagggucuguucaaguuu

SEQ ID NO: 1384460 - RNA, 19 nt, Homo sapiens
cgagaagggucuguucaag

SEQ ID NO: 1384461 - RNA, 19 nt, Homo sapiens
aggcgacggugucuuaaga

SEQ ID NO: 1384462 - RNA, 19 nt, Homo sapiens
aucgaaaccugaucaaaga

SEQ ID NO: 1384463 - RNA, 19 nt, Homo sapiens
gcagacgucacuugugugu

SEQ ID NO: 1384464 - RNA, 19 nt, Homo sapiens
gaaagagcuagguuauaag

SEQ ID NO: 1384465 - RNA, 19 nt, Homo sapiens
gcugacaagggccauauug

SEQ ID NO: 1384466 - RNA, 19 nt, Homo sapiens
ucacuacucucggacaaag

SEQ ID NO: 1384467 - RNA, 19 nt, Homo sapiens
ggucaaguuaucagaaaug

SEQ ID NO: 1384468 - RNA, 19 nt, Homo sapiens
uuacaaaacuggugucaca

SEQ ID NO: 1384469 - RNA, 19 nt, Homo sapiens
ggugcaggcucacauucug

SEQ ID NO: 1384470 - RNA, 19 nt, Homo sapiens
cuaugggccuggagaacaa

SEQ ID NO: 1384471 - RNA, 19 nt, Homo sapiens
aggaagcaguggaaugguu

SEQ ID NO: 1384472 - RNA, 19 nt, Homo sapiens
aagaaagagcuagguuaua

SEQ ID NO: 1384473 - RNA, 19 nt, Homo sapiens
ggagccugguugaguuugu

SEQ ID NO: 1384474 - RNA, 19 nt, Homo sapiens
cagcuguccaguuaucuuu

SEQ ID NO: 1384475 - RNA, 19 nt, Homo sapiens
uguuccauauugccucuua

SEQ ID NO: 1384476 - RNA, 19 nt, Homo sapiens
acaacauccuccagguuug

SEQ ID NO: 1384477 - RNA, 19 nt, Homo sapiens
aaucgaaaccugaucaaag

SEQ ID NO: 1384478 - RNA, 19 nt, Homo sapiens
uccaugugauucuguuuga

SEQ ID NO: 1384479 - RNA, 19 nt, Homo sapiens
cagcccugcucaaaccauu

SEQ ID NO: 1384480 - RNA, 19 nt, Homo sapiens
ggucuuccuccugauuaua

SEQ ID NO: 1384481 - RNA, 19 nt, Homo sapiens
gcugugcccugaaccaaaa

SEQ ID NO: 1384482 - RNA, 19 nt, Homo sapiens
ggaugcagacgucacuugu

SEQ ID NO: 1384483 - RNA, 19 nt, Homo sapiens
gagcugacaagggccauau

SEQ ID NO: 1384484 - RNA, 19 nt, Homo sapiens
gaguccaugugauucuguu

SEQ ID NO: 1384485 - RNA, 19 nt, Homo sapiens
gcacuuucaaugucaucuu

SEQ ID NO: 1384486 - RNA, 19 nt, Homo sapiens
gaagggugcccagguuagu

SEQ ID NO: 1384487 - RNA, 19 nt, Homo sapiens
augcagacgucacuugugu

SEQ ID NO: 1384488 - RNA, 19 nt, Homo sapiens
cagagaugguucacuucau

SEQ ID NO: 1384489 - RNA, 19 nt, Homo sapiens
aagggucuguucaaguuug

SEQ ID NO: 1384490 - RNA, 19 nt, Homo sapiens
gacggugucuuaagaaccu

SEQ ID NO: 1384491 - RNA, 19 nt, Homo sapiens
uuauagcaguucucaugug

SEQ ID NO: 1384492 - RNA, 19 nt, Homo sapiens
ccaggaagcaguggaaugg

SEQ ID NO: 1384493 - RNA, 19 nt, Homo sapiens
ggcuacacauucccgucua

SEQ ID NO: 1384494 - RNA, 19 nt, Homo sapiens
gcagcuguccaguuaucuu

SEQ ID NO: 1384495 - RNA, 19 nt, Homo sapiens
caaucgaaaccugaucaaa

SEQ ID NO: 1384496 - RNA, 19 nt, Homo sapiens
acuuguguguuccauauug

SEQ ID NO: 1384497 - RNA, 19 nt, Homo sapiens
aagacaccuucccaggaua

SEQ ID NO: 1384498 - RNA, 19 nt, Homo sapiens
gccaagaaagagcuagguu

SEQ ID NO: 1384499 - RNA, 19 nt, Homo sapiens
gggccugggcuacacauuc

SEQ ID NO: 1384500 - RNA, 19 nt, Homo sapiens
cugcagcuguccaguuauc

SEQ ID NO: 1384501 - RNA, 19 nt, Homo sapiens
caucuuuggaggucaaguu

SEQ ID NO: 1384502 - RNA, 19 nt, Homo sapiens
caggaggaaguggcuauuu

SEQ ID NO: 1384503 - RNA, 19 nt, Homo sapiens
agagaaagccaagaaagag

SEQ ID NO: 1384504 - RNA, 19 nt, Homo sapiens
gcgacggugucuuaagaac

SEQ ID NO: 1384505 - RNA, 19 nt, Homo sapiens
ccuccacccugaucacuac

SEQ ID NO: 1384506 - RNA, 19 nt, Homo sapiens
cuuuggaggucaaguuauc

SEQ ID NO: 1384507 - RNA, 19 nt, Homo sapiens
agacaacauccuccagguu

SEQ ID NO: 1384508 - RNA, 19 nt, Homo sapiens
guuuaaagcccauggucau

SEQ ID NO: 1384509 - RNA, 19 nt, Homo sapiens
ggaggaaguggcuauuuug

SEQ ID NO: 1384510 - RNA, 19 nt, Homo sapiens
uguuugggaugggcuauug

SEQ ID NO: 1384511 - RNA, 19 nt, Homo sapiens
uccagaaggaaucaaguuu

SEQ ID NO: 1384512 - RNA, 19 nt, Homo sapiens
uaagaaagcugucaagaua

SEQ ID NO: 1384513 - RNA, 19 nt, Homo sapiens
gauaauagcugggagaaua

SEQ ID NO: 1384514 - RNA, 19 nt, Homo sapiens
gaacugggcugucuacaaa

SEQ ID NO: 1384515 - RNA, 19 nt, Homo sapiens
gaacaagaaugcuacugua

SEQ ID NO: 1384516 - RNA, 19 nt, Homo sapiens
caaacuaccuccucagaua

SEQ ID NO: 1384517 - RNA, 19 nt, Homo sapiens
gaacaugaaucucagcaaa

SEQ ID NO: 1384518 - RNA, 19 nt, Homo sapiens
ggaauggaauuucaaguuu

SEQ ID NO: 1384519 - RNA, 19 nt, Homo sapiens
caagaaugcuacuguauuu

SEQ ID NO: 1384520 - RNA, 19 nt, Homo sapiens
cuacaaaccuccagcauuu

SEQ ID NO: 1384521 - RNA, 19 nt, Homo sapiens
ggaauaacauggaacuuga

SEQ ID NO: 1384522 - RNA, 19 nt, Homo sapiens
gaaaaguucuccccaguua

SEQ ID NO: 1384523 - RNA, 19 nt, Homo sapiens
gaagaaauguuguuuagac

SEQ ID NO: 1384524 - RNA, 19 nt, Homo sapiens
uaacaaggcuuccaaagag

SEQ ID NO: 1384525 - RNA, 19 nt, Homo sapiens
guagagacuucaguucuua

SEQ ID NO: 1384526 - RNA, 19 nt, Homo sapiens
ggaaacaacuucugugcau

SEQ ID NO: 1384527 - RNA, 19 nt, Homo sapiens
ucacagaaaugacuaacaa

SEQ ID NO: 1384528 - RNA, 19 nt, Homo sapiens
gaaggugcgugcaaaguga

SEQ ID NO: 1384529 - RNA, 19 nt, Homo sapiens
cgacaacacuuaauuugga

SEQ ID NO: 1384530 - RNA, 19 nt, Homo sapiens
ccauggagcucuucauuga

SEQ ID NO: 1384531 - RNA, 19 nt, Homo sapiens
uaaccaggcuuccacauug

SEQ ID NO: 1384532 - RNA, 19 nt, Homo sapiens
gaucugauguuauuuccaa

SEQ ID NO: 1384533 - RNA, 19 nt, Homo sapiens
ggaauuaaguccucacaag

SEQ ID NO: 1384534 - RNA, 19 nt, Homo sapiens
gaauggcucuacucagauu

SEQ ID NO: 1384535 - RNA, 19 nt, Homo sapiens
gaauggaauuucaaguuug

SEQ ID NO: 1384536 - RNA, 19 nt, Homo sapiens
ggaaugauuuagcuuuguu

SEQ ID NO: 1384537 - RNA, 19 nt, Homo sapiens
gauguuauuuccaaaguug

SEQ ID NO: 1384538 - RNA, 19 nt, Homo sapiens
cagaagaaauguuguuuag

SEQ ID NO: 1384539 - RNA, 19 nt, Homo sapiens
gaauuucuuuccugcagua

SEQ ID NO: 1384540 - RNA, 19 nt, Homo sapiens
gaaacuugccaucuaguaa

SEQ ID NO: 1384541 - RNA, 19 nt, Homo sapiens
guacaaaacucaaaacaug

SEQ ID NO: 1384542 - RNA, 19 nt, Homo sapiens
aaacaggacuggcuaguag

SEQ ID NO: 1384543 - RNA, 19 nt, Homo sapiens
agaaggagaucaauugaau

SEQ ID NO: 1384544 - RNA, 19 nt, Homo sapiens
gggaaaagaucugauguua

SEQ ID NO: 1384545 - RNA, 19 nt, Homo sapiens
gaacaaucacuucuaccua

SEQ ID NO: 1384546 - RNA, 19 nt, Homo sapiens
agaaagcugucaagauaaa

SEQ ID NO: 1384547 - RNA, 19 nt, Homo sapiens
caaagagccuguugguugu

SEQ ID NO: 1384548 - RNA, 19 nt, Homo sapiens
aaacugagccuucuucuuc

SEQ ID NO: 1384549 - RNA, 19 nt, Homo sapiens
ccacuugccauuaaauaua

SEQ ID NO: 1384550 - RNA, 19 nt, Homo sapiens
gaagauggcagaguacuug

SEQ ID NO: 1384551 - RNA, 19 nt, Homo sapiens
cuacucagauugaccauau

SEQ ID NO: 1384552 - RNA, 19 nt, Homo sapiens
gagagacaguccaaauguu

SEQ ID NO: 1384553 - RNA, 19 nt, Homo sapiens
uuaggaagauggcagagua

SEQ ID NO: 1384554 - RNA, 19 nt, Homo sapiens
ggaaugaauggaaauaaug

SEQ ID NO: 1384555 - RNA, 19 nt, Homo sapiens
caaagugaaucuggaguug

SEQ ID NO: 1384556 - RNA, 19 nt, Homo sapiens
uuaggaaacuugccaucua

SEQ ID NO: 1384557 - RNA, 19 nt, Homo sapiens
agacuucauuucugugaua

SEQ ID NO: 1384558 - RNA, 19 nt, Homo sapiens
gaauuaaguccucacaaga

SEQ ID NO: 1384559 - RNA, 19 nt, Homo sapiens
gaacagagcagcggcuuag

SEQ ID NO: 1384560 - RNA, 19 nt, Homo sapiens
agaaggaaaugcugaugaa

SEQ ID NO: 1384561 - RNA, 19 nt, Homo sapiens
aacaaucacuucuaccuaa

SEQ ID NO: 1384562 - RNA, 19 nt, Homo sapiens
gaagaccuccugcagcaaa

SEQ ID NO: 1384563 - RNA, 19 nt, Homo sapiens
ggaaacuugccaucuagua

SEQ ID NO: 1384564 - RNA, 19 nt, Homo sapiens
cagcaaacaaguuacauuu

SEQ ID NO: 1384565 - RNA, 19 nt, Homo sapiens
gaaugcagauguggaaaca

SEQ ID NO: 1384566 - RNA, 19 nt, Homo sapiens
uaacaacuuuacacuggaa

SEQ ID NO: 1384567 - RNA, 19 nt, Homo sapiens
gagaauguacuacucauca

SEQ ID NO: 1384568 - RNA, 19 nt, Homo sapiens
ugaagcugcugaaggcuaa

SEQ ID NO: 1384569 - RNA, 19 nt, Homo sapiens
cagauuagauucggacaug

SEQ ID NO: 1384570 - RNA, 19 nt, Homo sapiens
uauugcaugucuuguguua

SEQ ID NO: 1384571 - RNA, 19 nt, Homo sapiens
gcacaagcagaaauagauu

SEQ ID NO: 1384572 - RNA, 19 nt, Homo sapiens
gaacauugucuuaccuuca

SEQ ID NO: 1384573 - RNA, 19 nt, Homo sapiens
ugucuuguguuaaguguuu

SEQ ID NO: 1384574 - RNA, 19 nt, Homo sapiens
aauagaagaugucccacuu

SEQ ID NO: 1384575 - RNA, 19 nt, Homo sapiens
gggaaucaguagagacuuc

SEQ ID NO: 1384576 - RNA, 19 nt, Homo sapiens
gcaaagugaaucuggaguu

SEQ ID NO: 1384577 - RNA, 19 nt, Homo sapiens
ggagcuugcugacucuguu

SEQ ID NO: 1384578 - RNA, 19 nt, Homo sapiens
aaaucuaacucuuccucua

SEQ ID NO: 1384579 - RNA, 19 nt, Homo sapiens
gacaacacuuaauuuggaa

SEQ ID NO: 1384580 - RNA, 19 nt, Homo sapiens
ccaggagaaauacaaauaa

SEQ ID NO: 1384581 - RNA, 19 nt, Homo sapiens
gugguucuauguauaauuc

SEQ ID NO: 1384582 - RNA, 19 nt, Homo sapiens
cuagaagaguuccuacaga

SEQ ID NO: 1384583 - RNA, 19 nt, Homo sapiens
ggaccuauaaauacuagaa

SEQ ID NO: 1384584 - RNA, 19 nt, Homo sapiens
auacauuucuuccacauuc

SEQ ID NO: 1384585 - RNA, 19 nt, Homo sapiens
gggauucguauuauaauga

SEQ ID NO: 1384586 - RNA, 19 nt, Homo sapiens
guuagaacauacaggaguu

SEQ ID NO: 1384587 - RNA, 19 nt, Homo sapiens
ggaacugggcugucuacaa

SEQ ID NO: 1384588 - RNA, 19 nt, Homo sapiens
gggagcacaagcagaaaua

SEQ ID NO: 1384589 - RNA, 19 nt, Homo sapiens
caaaguaauggauaacaga

SEQ ID NO: 1384590 - RNA, 19 nt, Homo sapiens
gcagcaaacaaguuacauu

SEQ ID NO: 1384591 - RNA, 19 nt, Homo sapiens
caaauccugugguuaaugc

SEQ ID NO: 1384592 - RNA, 19 nt, Homo sapiens
gcuaagaugaagaacauga

SEQ ID NO: 1384593 - RNA, 19 nt, Homo sapiens
gagaaggagaucaauugaa

SEQ ID NO: 1384594 - RNA, 19 nt, Homo sapiens
augaauggcucuacucaga

SEQ ID NO: 1384595 - RNA, 19 nt, Homo sapiens
acucauggcuguaccuaug

SEQ ID NO: 1384596 - RNA, 19 nt, Homo sapiens
guucuuaacuaccgggaau

SEQ ID NO: 1384597 - RNA, 19 nt, Homo sapiens
cccgaaaucuccaggaaug

SEQ ID NO: 1384598 - RNA, 19 nt, Homo sapiens
gggcaacagauaauugaaa

SEQ ID NO: 1384599 - RNA, 19 nt, Homo sapiens
gaguggugguucuauguau

SEQ ID NO: 1384600 - RNA, 19 nt, Homo sapiens
gaguugaggucugggagaa

SEQ ID NO: 1384601 - RNA, 19 nt, Homo sapiens
gagcugagaguuucaccuu

SEQ ID NO: 1384602 - RNA, 19 nt, Homo sapiens
guuauugcaugucuugugu

SEQ ID NO: 1384603 - RNA, 19 nt, Homo sapiens
aggcaaauccugugguuaa

SEQ ID NO: 1384604 - RNA, 19 nt, Homo sapiens
cgaggcaaauccugugguu

SEQ ID NO: 1384605 - RNA, 19 nt, Homo sapiens
ccuguugguuguguaaaua

SEQ ID NO: 1384606 - RNA, 19 nt, Homo sapiens
cuaacaaggcuuccaaaga

SEQ ID NO: 1384607 - RNA, 19 nt, Homo sapiens
gaaacugagccuucuucuu

SEQ ID NO: 1384608 - RNA, 19 nt, Homo sapiens
gggcucaccggcuucauuu

SEQ ID NO: 1384609 - RNA, 19 nt, Homo sapiens
caacuucugugcaucucau

SEQ ID NO: 1384610 - RNA, 19 nt, Homo sapiens
gagcacaagcagaaauaga

SEQ ID NO: 1384611 - RNA, 19 nt, Homo sapiens
cauaacugauucuucuuuc

SEQ ID NO: 1384612 - RNA, 19 nt, Homo sapiens
gaagagauguuguucauag

SEQ ID NO: 1384613 - RNA, 19 nt, Homo sapiens
ggaauuagaugaaucaaag

SEQ ID NO: 1384614 - RNA, 19 nt, Homo sapiens
gcaagaaggugaagauuac

SEQ ID NO: 1384615 - RNA, 19 nt, Homo sapiens
gcauaucuguuccuucuuu

SEQ ID NO: 1384616 - RNA, 19 nt, Homo sapiens
acaagggacucacauauaa

SEQ ID NO: 1384617 - RNA, 19 nt, Homo sapiens
gcccauaucuuaucuagga

SEQ ID NO: 1384618 - RNA, 19 nt, Homo sapiens
uaacuauccucaucaugua

SEQ ID NO: 1384619 - RNA, 19 nt, Homo sapiens
auagggcacuguuuaauua

SEQ ID NO: 1384620 - RNA, 19 nt, Homo sapiens
gaaagugaggugcuauaua

SEQ ID NO: 1384621 - RNA, 19 nt, Homo sapiens
gaacuagauucaccacaug

SEQ ID NO: 1384622 - RNA, 19 nt, Homo sapiens
caaacuggguggcuuuaaa

SEQ ID NO: 1384623 - RNA, 19 nt, Homo sapiens
ugggaaaucuguacucuaa

SEQ ID NO: 1384624 - RNA, 19 nt, Homo sapiens
aaagugaggugcuauauag

SEQ ID NO: 1384625 - RNA, 19 nt, Homo sapiens
ggaaaucuguacucuaaag

SEQ ID NO: 1384626 - RNA, 19 nt, Homo sapiens
ggcaagauauguaaguaaa

SEQ ID NO: 1384627 - RNA, 19 nt, Homo sapiens
ugaagggugugaaccaaua

SEQ ID NO: 1384628 - RNA, 19 nt, Homo sapiens
aaagugaguuugcaaagaa

SEQ ID NO: 1384629 - RNA, 19 nt, Homo sapiens
guacugauauuuacugucu

SEQ ID NO: 1384630 - RNA, 19 nt, Homo sapiens
gcucucaguucuuaauuga

SEQ ID NO: 1384631 - RNA, 19 nt, Homo sapiens
guauggcucucaguucuua

SEQ ID NO: 1384632 - RNA, 19 nt, Homo sapiens
ggaagaaguaucaguuuga

SEQ ID NO: 1384633 - RNA, 19 nt, Homo sapiens
gcacagcucccacuuggaa

SEQ ID NO: 1384634 - RNA, 19 nt, Homo sapiens
gaaugugccuucugaccuu

SEQ ID NO: 1384635 - RNA, 19 nt, Homo sapiens
ggaggaauauagcagaaau

SEQ ID NO: 1384636 - RNA, 19 nt, Homo sapiens
gaaagugcuucucaugaca

SEQ ID NO: 1384637 - RNA, 19 nt, Homo sapiens
gaagaccugauuuaccuua

SEQ ID NO: 1384638 - RNA, 19 nt, Homo sapiens
agaaagaagaccugauuua

SEQ ID NO: 1384639 - RNA, 19 nt, Homo sapiens
ggauuagaguucaccauga

SEQ ID NO: 1384640 - RNA, 19 nt, Homo sapiens
gaauugccauauaucugua

SEQ ID NO: 1384641 - RNA, 19 nt, Homo sapiens
gcgcauaucuguuccuucu

SEQ ID NO: 1384642 - RNA, 19 nt, Homo sapiens
gaauauagcagaaaugaac

SEQ ID NO: 1384643 - RNA, 19 nt, Homo sapiens
uagcagaaaugaacuagau

SEQ ID NO: 1384644 - RNA, 19 nt, Homo sapiens
ggcaagaaggugaagauua

SEQ ID NO: 1384645 - RNA, 19 nt, Homo sapiens
agacaaagccugugaaagu

SEQ ID NO: 1384646 - RNA, 19 nt, Homo sapiens
uaaacaagcgucagauuau

SEQ ID NO: 1384647 - RNA, 19 nt, Homo sapiens
gaaagaagaccugauuuac

SEQ ID NO: 1384648 - RNA, 19 nt, Homo sapiens
gggcacuguuuaauuauga

SEQ ID NO: 1384649 - RNA, 19 nt, Homo sapiens
gacaagcccuacaauuuua

SEQ ID NO: 1384650 - RNA, 19 nt, Homo sapiens
aagacaagcccuacaauuu

SEQ ID NO: 1384651 - RNA, 19 nt, Homo sapiens
acacuaauguuaccugguu

SEQ ID NO: 1384652 - RNA, 19 nt, Homo sapiens
ugauuuaccuuacgucaga

SEQ ID NO: 1384653 - RNA, 19 nt, Homo sapiens
caacagaaaguuuauugga

SEQ ID NO: 1384654 - RNA, 19 nt, Homo sapiens
gaaagaauagugugaaagg

SEQ ID NO: 1384655 - RNA, 19 nt, Homo sapiens
gaaggaauuagaugaauca

SEQ ID NO: 1384656 - RNA, 19 nt, Homo sapiens
gcagaggcaccaaauaaug

SEQ ID NO: 1384657 - RNA, 19 nt, Homo sapiens
gcaagaaagaauaguguga

SEQ ID NO: 1384658 - RNA, 19 nt, Homo sapiens
ccucaguaguuucuagaua

SEQ ID NO: 1384659 - RNA, 19 nt, Homo sapiens
ggacucacauauaaacaag

SEQ ID NO: 1384660 - RNA, 19 nt, Homo sapiens
aaagaaagaagaccugauu

SEQ ID NO: 1384661 - RNA, 19 nt, Homo sapiens
ggugugaaccaauaucuaa

SEQ ID NO: 1384662 - RNA, 19 nt, Homo sapiens
ucaccaugauccaauauga

SEQ ID NO: 1384663 - RNA, 19 nt, Homo sapiens
gauuagaguucaccaugau

SEQ ID NO: 1384664 - RNA, 19 nt, Homo sapiens
uauaguggcuugacuccaa

SEQ ID NO: 1384665 - RNA, 19 nt, Homo sapiens
gaacaaauuaccacaaacu

SEQ ID NO: 1384666 - RNA, 19 nt, Homo sapiens
uuauaaggcuguugcuauu

SEQ ID NO: 1384667 - RNA, 19 nt, Homo sapiens
gacaaagccugugaaagug

SEQ ID NO: 1384668 - RNA, 19 nt, Homo sapiens
gcugaacucucugaaaugu

SEQ ID NO: 1384669 - RNA, 19 nt, Homo sapiens
gugccaugcuuccuccuua

SEQ ID NO: 1384670 - RNA, 19 nt, Homo sapiens
uaacaguuccagagacuaa

SEQ ID NO: 1384671 - RNA, 19 nt, Homo sapiens
gaugugcuagaacaaauua

SEQ ID NO: 1384672 - RNA, 19 nt, Homo sapiens
gagggcacauauucauaaa

SEQ ID NO: 1384673 - RNA, 19 nt, Homo sapiens
gcaaagaaucagugggaaa

SEQ ID NO: 1384674 - RNA, 19 nt, Homo sapiens
gaggaggaauauagcagaa

SEQ ID NO: 1384675 - RNA, 19 nt, Homo sapiens
gaagaugaauagucgaaaa

SEQ ID NO: 1384676 - RNA, 19 nt, Homo sapiens
gaccucaucuugacuacau

SEQ ID NO: 1384677 - RNA, 19 nt, Homo sapiens
gaacauuggcaagaaagaa

SEQ ID NO: 1384678 - RNA, 19 nt, Homo sapiens
gagaaagugaggugcuaua

SEQ ID NO: 1384679 - RNA, 19 nt, Homo sapiens
ugaacucucugccacacua

SEQ ID NO: 1384680 - RNA, 19 nt, Homo sapiens
auaaacaagcgucagauua

SEQ ID NO: 1384681 - RNA, 19 nt, Homo sapiens
ucaaaggccuaugugauug

SEQ ID NO: 1384682 - RNA, 19 nt, Homo sapiens
ugacgucgcugaacucucu

SEQ ID NO: 1384683 - RNA, 19 nt, Homo sapiens
gacuaaauguccagacuca

SEQ ID NO: 1384684 - RNA, 19 nt, Homo sapiens
guaaagacaagcccuacaa

SEQ ID NO: 1384685 - RNA, 19 nt, Homo sapiens
auacauaacuauccucauc

SEQ ID NO: 1384686 - RNA, 19 nt, Homo sapiens
uggaauaccuggaaacaag

SEQ ID NO: 1384687 - RNA, 19 nt, Homo sapiens
aaagcugccuuaccucauu

SEQ ID NO: 1384688 - RNA, 19 nt, Homo sapiens
cacaagggacucacauaua

SEQ ID NO: 1384689 - RNA, 19 nt, Homo sapiens
ucaacgauguuacgcagaa

SEQ ID NO: 1384690 - RNA, 19 nt, Homo sapiens
cauagcacccuucgccuua

SEQ ID NO: 1384691 - RNA, 19 nt, Homo sapiens
ugaacucucugaaauguag

SEQ ID NO: 1384692 - RNA, 19 nt, Homo sapiens
auaacuaguuucugaggua

SEQ ID NO: 1384693 - RNA, 19 nt, Homo sapiens
uaucuuaucuaggauguug

SEQ ID NO: 1384694 - RNA, 19 nt, Homo sapiens
gcucuuagcagcugugguu

SEQ ID NO: 1384695 - RNA, 19 nt, Homo sapiens
aaugucaucugaaauguug

SEQ ID NO: 1384696 - RNA, 19 nt, Homo sapiens
ucgcugaacucucugaaau

SEQ ID NO: 1384697 - RNA, 19 nt, Homo sapiens
cagcauuuauugaaacuuc

SEQ ID NO: 1384698 - RNA, 19 nt, Homo sapiens
uguauuaguuuccuagaug

SEQ ID NO: 1384699 - RNA, 19 nt, Homo sapiens
guaauuguacaugcaguua

SEQ ID NO: 1384700 - RNA, 19 nt, Homo sapiens
cauaucuguuccuucuuua

SEQ ID NO: 1384701 - RNA, 19 nt, Homo sapiens
cucaguaguuucuagauaa

SEQ ID NO: 1384702 - RNA, 19 nt, Homo sapiens
ggcaguuaaucauguguuu

SEQ ID NO: 1384703 - RNA, 19 nt, Homo sapiens
aaacaagcgucagauuaug

SEQ ID NO: 1384704 - RNA, 19 nt, Homo sapiens
uacccugucuucuauguuu

SEQ ID NO: 1384705 - RNA, 19 nt, Homo sapiens
gcagaaaugaacuagauuc

SEQ ID NO: 1384706 - RNA, 19 nt, Homo sapiens
gaaacaaugggaagagcaa

SEQ ID NO: 1384707 - RNA, 19 nt, Homo sapiens
cuaugugauuggaggauua

SEQ ID NO: 1384708 - RNA, 19 nt, Homo sapiens
gaacauggaugaaaaugac

SEQ ID NO: 1384709 - RNA, 19 nt, Homo sapiens
gaaacuucauaagcagauu

SEQ ID NO: 1384710 - RNA, 19 nt, Homo sapiens
gagccagaagccaagauua

SEQ ID NO: 1384711 - RNA, 19 nt, Homo sapiens
ucucaguucuuaauugaug

SEQ ID NO: 1384712 - RNA, 19 nt, Homo sapiens
cgacagaagucaaauauaa

SEQ ID NO: 1384713 - RNA, 19 nt, Homo sapiens
gagaaugacuucguuaaua

SEQ ID NO: 1384714 - RNA, 19 nt, Homo sapiens
gaacagccaugaucaauag

SEQ ID NO: 1384715 - RNA, 19 nt, Homo sapiens
ggaaauugauguacauuca

SEQ ID NO: 1384716 - RNA, 19 nt, Homo sapiens
caacaaagacccagauauu

SEQ ID NO: 1384717 - RNA, 19 nt, Homo sapiens
gaacacgucuguggaagaa

SEQ ID NO: 1384718 - RNA, 19 nt, Homo sapiens
gaacggggcugccucuuua

SEQ ID NO: 1384719 - RNA, 19 nt, Homo sapiens
gaaauccauucaggaaaua

SEQ ID NO: 1384720 - RNA, 19 nt, Homo sapiens
ggaaccagcugcaguugug

SEQ ID NO: 1384721 - RNA, 19 nt, Homo sapiens
gagcauacuucugaccuaa

SEQ ID NO: 1384722 - RNA, 19 nt, Homo sapiens
ggacagaggccuacaugga

SEQ ID NO: 1384723 - RNA, 19 nt, Homo sapiens
ccaaacugcugcuauugaa

SEQ ID NO: 1384724 - RNA, 19 nt, Homo sapiens
uuacaaagcccuaaaggaa

SEQ ID NO: 1384725 - RNA, 19 nt, Homo sapiens
ggaguggucucugguagaa

SEQ ID NO: 1384726 - RNA, 19 nt, Homo sapiens
ggccaacgcuccucucaau

SEQ ID NO: 1384727 - RNA, 19 nt, Homo sapiens
gcuuggagcuggugaggaa

SEQ ID NO: 1384728 - RNA, 19 nt, Homo sapiens
ggucaagacugagaaagga

SEQ ID NO: 1384729 - RNA, 19 nt, Homo sapiens
caagaaagggucaguuguu

SEQ ID NO: 1384730 - RNA, 19 nt, Homo sapiens
gaagaaggccugcaugacu

SEQ ID NO: 1384731 - RNA, 19 nt, Homo sapiens
ccaccaacguguacaacaa

SEQ ID NO: 1384732 - RNA, 19 nt, Homo sapiens
aaggaaaguuugcaucuau

SEQ ID NO: 1384733 - RNA, 19 nt, Homo sapiens
aagaaagggucaguuguuu

SEQ ID NO: 1384734 - RNA, 19 nt, Homo sapiens
aggagaacgugauggaaua

SEQ ID NO: 1384735 - RNA, 19 nt, Homo sapiens
gcauggaaauugauguaca

SEQ ID NO: 1384736 - RNA, 19 nt, Homo sapiens
ggauacgccuuucugaaca

SEQ ID NO: 1384737 - RNA, 19 nt, Homo sapiens
gggcugaggaugacuauug

SEQ ID NO: 1384738 - RNA, 19 nt, Homo sapiens
gacgugagcggcaguauga

SEQ ID NO: 1384739 - RNA, 19 nt, Homo sapiens
auaacacugugaccaaaua

SEQ ID NO: 1384740 - RNA, 19 nt, Homo sapiens
guauaacacugugaccaaa

SEQ ID NO: 1384741 - RNA, 19 nt, Homo sapiens
ggaccaagcccugagagaa

SEQ ID NO: 1384742 - RNA, 19 nt, Homo sapiens
ggaaaguuugcaucuauga

SEQ ID NO: 1384743 - RNA, 19 nt, Homo sapiens
aaaggaaaguuugcaucua

SEQ ID NO: 1384744 - RNA, 19 nt, Homo sapiens
cgacagggcuacacgugau

SEQ ID NO: 1384745 - RNA, 19 nt, Homo sapiens
gagacaaucgagagcauuu

SEQ ID NO: 1384746 - RNA, 19 nt, Homo sapiens
gauuaaaggguuucauguu

SEQ ID NO: 1384747 - RNA, 19 nt, Homo sapiens
ggagaaugacuucguuaau

SEQ ID NO: 1384748 - RNA, 19 nt, Homo sapiens
ggaguccaaugcucacuuc

SEQ ID NO: 1384749 - RNA, 19 nt, Homo sapiens
agaagcagcagcagaauga

SEQ ID NO: 1384750 - RNA, 19 nt, Homo sapiens
uaaugccucugucaaaugu

SEQ ID NO: 1384751 - RNA, 19 nt, Homo sapiens
uauaaugccucugucaaau

SEQ ID NO: 1384752 - RNA, 19 nt, Homo sapiens
ugacacugcucaccacugu

SEQ ID NO: 1384753 - RNA, 19 nt, Homo sapiens
uaaauggagucuacauguc

SEQ ID NO: 1384754 - RNA, 19 nt, Homo sapiens
caaagacccagauauuuua

SEQ ID NO: 1384755 - RNA, 19 nt, Homo sapiens
caacuggauucuucaggau

SEQ ID NO: 1384756 - RNA, 19 nt, Homo sapiens
gaaaguuugcaucuaugaa

SEQ ID NO: 1384757 - RNA, 19 nt, Homo sapiens
ggagaggccagcggauuaa

SEQ ID NO: 1384758 - RNA, 19 nt, Homo sapiens
gcagaggggugcacuauag

SEQ ID NO: 1384759 - RNA, 19 nt, Homo sapiens
cagcagauucccaacagua

SEQ ID NO: 1384760 - RNA, 19 nt, Homo sapiens
auuaaaggguuucauguug

SEQ ID NO: 1384761 - RNA, 19 nt, Homo sapiens
ugacaugggaugcagcuaa

SEQ ID NO: 1384762 - RNA, 19 nt, Homo sapiens
gccaagugacuauguauga

SEQ ID NO: 1384763 - RNA, 19 nt, Homo sapiens
ugaagguuccgauggauaa

SEQ ID NO: 1384764 - RNA, 19 nt, Homo sapiens
ggacuacgagccgguguuu

SEQ ID NO: 1384765 - RNA, 19 nt, Homo sapiens
acaaagcccuaaaggaaag

SEQ ID NO: 1384766 - RNA, 19 nt, Homo sapiens
ggaauggucaagacugaga

SEQ ID NO: 1384767 - RNA, 19 nt, Homo sapiens
ucaaauauaaugccucugu

SEQ ID NO: 1384768 - RNA, 19 nt, Homo sapiens
aagaaggccugcaugacuu

SEQ ID NO: 1384769 - RNA, 19 nt, Homo sapiens
gagaacagccaugaucaau

SEQ ID NO: 1384770 - RNA, 19 nt, Homo sapiens
gggagaaugacuucguuaa

SEQ ID NO: 1384771 - RNA, 19 nt, Homo sapiens
ggaugacuauugccaagca

SEQ ID NO: 1384772 - RNA, 19 nt, Homo sapiens
caacguugaccuggcaaua

SEQ ID NO: 1384773 - RNA, 19 nt, Homo sapiens
cagaggacauggagaacau

SEQ ID NO: 1384774 - RNA, 19 nt, Homo sapiens
ucagccaagugacuaugua

SEQ ID NO: 1384775 - RNA, 19 nt, Homo sapiens
ccaaggcacggaagacaaa

SEQ ID NO: 1384776 - RNA, 19 nt, Homo sapiens
gcagaaggaccagaaagug

SEQ ID NO: 1384777 - RNA, 19 nt, Homo sapiens
ccaaggacauagugauuuu

SEQ ID NO: 1384778 - RNA, 19 nt, Homo sapiens
agaaaggaaugaaauccau

SEQ ID NO: 1384779 - RNA, 19 nt, Homo sapiens
guaagggaauggucaagac

SEQ ID NO: 1384780 - RNA, 19 nt, Homo sapiens
uccaagaggucccgagaga

SEQ ID NO: 1384781 - RNA, 19 nt, Homo sapiens
gacaacaacggguucauuc

SEQ ID NO: 1384782 - RNA, 19 nt, Homo sapiens
gacuggaucuacugcauca

SEQ ID NO: 1384783 - RNA, 19 nt, Homo sapiens
ggacuucuggguacugaga

SEQ ID NO: 1384784 - RNA, 19 nt, Homo sapiens
ggaccaagacaaaauaauu

SEQ ID NO: 1384785 - RNA, 19 nt, Homo sapiens
cccaauuucugccuucuug

SEQ ID NO: 1384786 - RNA, 19 nt, Homo sapiens
gcacggauacgccuuucug

SEQ ID NO: 1384787 - RNA, 19 nt, Homo sapiens
gccaauaggcugagacauc

SEQ ID NO: 1384788 - RNA, 19 nt, Homo sapiens
aacaacggguucauucuga

SEQ ID NO: 1384789 - RNA, 19 nt, Homo sapiens
gggaagaccaggcugaauc

SEQ ID NO: 1384790 - RNA, 19 nt, Homo sapiens
caaucgagagcauuucaaa

SEQ ID NO: 1384791 - RNA, 19 nt, Homo sapiens
gaggccaaaugcagagaug

SEQ ID NO: 1384792 - RNA, 19 nt, Homo sapiens
gagggaaccagcugcaguu

SEQ ID NO: 1384793 - RNA, 19 nt, Homo sapiens
uggcaccacuuucaagaug

SEQ ID NO: 1384794 - RNA, 19 nt, Homo sapiens
ggauggaacaggaaaccaa

SEQ ID NO: 1384795 - RNA, 19 nt, Homo sapiens
ggaggcgacagaagucaaa

SEQ ID NO: 1384796 - RNA, 19 nt, Homo sapiens
caacaacggguucauucug

SEQ ID NO: 1384797 - RNA, 19 nt, Homo sapiens
gacaagaggacagccauug

SEQ ID NO: 1384798 - RNA, 19 nt, Homo sapiens
ggaacacgucuguggaaga

SEQ ID NO: 1384799 - RNA, 19 nt, Homo sapiens
ccacggagaauacauccuu

SEQ ID NO: 1384800 - RNA, 19 nt, Homo sapiens
gaccaaugacuacuucuuc

SEQ ID NO: 1384801 - RNA, 19 nt, Homo sapiens
gauaaagggaagcgaguuc

SEQ ID NO: 1384802 - RNA, 19 nt, Homo sapiens
cagguacucucucgaugga

SEQ ID NO: 1384803 - RNA, 19 nt, Homo sapiens
ucagcaaccugccggugaa

SEQ ID NO: 1384804 - RNA, 19 nt, Homo sapiens
gaaguucucagaggacaug

SEQ ID NO: 1384805 - RNA, 19 nt, Homo sapiens
aaacugcugcuauugaaga

SEQ ID NO: 1384806 - RNA, 19 nt, Homo sapiens
aacaugagcauacuucuga

SEQ ID NO: 1384807 - RNA, 19 nt, Homo sapiens
ggauuaaaggguuucaugu

SEQ ID NO: 1384808 - RNA, 19 nt, Homo sapiens
ggacaagaggacagccauu

SEQ ID NO: 1384809 - RNA, 19 nt, Homo sapiens
agaacagccaugaucaaua

SEQ ID NO: 1384810 - RNA, 19 nt, Homo sapiens
caucgagccuuguuuuaaa

SEQ ID NO: 1384811 - RNA, 19 nt, Homo sapiens
gaggcuaaggcaagaauau

SEQ ID NO: 1384812 - RNA, 19 nt, Homo sapiens
gaacaagcaugccuaaaua

SEQ ID NO: 1384813 - RNA, 19 nt, Homo sapiens
ggaauaaccuggauauaaa

SEQ ID NO: 1384814 - RNA, 19 nt, Homo sapiens
gcacagcucuggccuuuaa

SEQ ID NO: 1384815 - RNA, 19 nt, Homo sapiens
ggaauuagcucaucagcaa

SEQ ID NO: 1384816 - RNA, 19 nt, Homo sapiens
ggaaacagguucaaucuug

SEQ ID NO: 1384817 - RNA, 19 nt, Homo sapiens
gaaaugcacuuacaagaug

SEQ ID NO: 1384818 - RNA, 19 nt, Homo sapiens
gcaaagaguugaagaugaa

SEQ ID NO: 1384819 - RNA, 19 nt, Homo sapiens
aaagagagcugaaaguaaa

SEQ ID NO: 1384820 - RNA, 19 nt, Homo sapiens
ccugaaagcucuaguauau

SEQ ID NO: 1384821 - RNA, 19 nt, Homo sapiens
uaagaagacuggaugauga

SEQ ID NO: 1384822 - RNA, 19 nt, Homo sapiens
gauauaaccucccagcuau

SEQ ID NO: 1384823 - RNA, 19 nt, Homo sapiens
gaaggaagcugaaggaaaa

SEQ ID NO: 1384824 - RNA, 19 nt, Homo sapiens
gaagauuugcccaauaaua

SEQ ID NO: 1384825 - RNA, 19 nt, Homo sapiens
aggcagcucuuuagaauua

SEQ ID NO: 1384826 - RNA, 19 nt, Homo sapiens
uaugagagaucgagaaauu

SEQ ID NO: 1384827 - RNA, 19 nt, Homo sapiens
ccuagaaccucacaauuaa

SEQ ID NO: 1384828 - RNA, 19 nt, Homo sapiens
gaggcuagcugcugugaaa

SEQ ID NO: 1384829 - RNA, 19 nt, Homo sapiens
gaagaaacaagaagagaaa

SEQ ID NO: 1384830 - RNA, 19 nt, Homo sapiens
ggaaugaugaauuggauua

SEQ ID NO: 1384831 - RNA, 19 nt, Homo sapiens
guaaauggcuucuugaacu

SEQ ID NO: 1384832 - RNA, 19 nt, Homo sapiens
ugaauuaccagauggauua

SEQ ID NO: 1384833 - RNA, 19 nt, Homo sapiens
cugcucagcuguaaucuua

SEQ ID NO: 1384834 - RNA, 19 nt, Homo sapiens
gcagaugccuauagacgaa

SEQ ID NO: 1384835 - RNA, 19 nt, Homo sapiens
gcagacaguugaagauaug

SEQ ID NO: 1384836 - RNA, 19 nt, Homo sapiens
cagauucagucuuuacaua

SEQ ID NO: 1384837 - RNA, 19 nt, Homo sapiens
aaagaaagcugaauauucg

SEQ ID NO: 1384838 - RNA, 19 nt, Homo sapiens
gaaagaauaaggaaugaug

SEQ ID NO: 1384839 - RNA, 19 nt, Homo sapiens
ggagaaagguauauaugag

SEQ ID NO: 1384840 - RNA, 19 nt, Homo sapiens
gccuagaaccucacaauua

SEQ ID NO: 1384841 - RNA, 19 nt, Homo sapiens
gagaaagaauaaggaauga

SEQ ID NO: 1384842 - RNA, 19 nt, Homo sapiens
gaucagcccuuuguacaga

SEQ ID NO: 1384843 - RNA, 19 nt, Homo sapiens
uaaaggaaaugcacuuaca

SEQ ID NO: 1384844 - RNA, 19 nt, Homo sapiens
gagccucgaugaaggaauu

SEQ ID NO: 1384845 - RNA, 19 nt, Homo sapiens
ggcauuagcugauuauucu

SEQ ID NO: 1384846 - RNA, 19 nt, Homo sapiens
gaaccucacaauuaaauga

SEQ ID NO: 1384847 - RNA, 19 nt, Homo sapiens
gaaguagccaaacuccuua

SEQ ID NO: 1384848 - RNA, 19 nt, Homo sapiens
ggaaguagccaaacuccuu

SEQ ID NO: 1384849 - RNA, 19 nt, Homo sapiens
ggaaauggagcuaagaaga

SEQ ID NO: 1384850 - RNA, 19 nt, Homo sapiens
gcacugaccuaggcaacaa

SEQ ID NO: 1384851 - RNA, 19 nt, Homo sapiens
caaaguuuauuguggacua

SEQ ID NO: 1384852 - RNA, 19 nt, Homo sapiens
gaaacagguucaaucuugu

SEQ ID NO: 1384853 - RNA, 19 nt, Homo sapiens
uuaguacccucauagauaa

SEQ ID NO: 1384854 - RNA, 19 nt, Homo sapiens
gcucuggccuuuaaucuuc

SEQ ID NO: 1384855 - RNA, 19 nt, Homo sapiens
ggaaggaagcugaaggaaa

SEQ ID NO: 1384856 - RNA, 19 nt, Homo sapiens
gaaauugggagaaagguau

SEQ ID NO: 1384857 - RNA, 19 nt, Homo sapiens
gcucagcuguaaucuuaaa

SEQ ID NO: 1384858 - RNA, 19 nt, Homo sapiens
cagaagugcugacaagaga

SEQ ID NO: 1384859 - RNA, 19 nt, Homo sapiens
acaaccaacucaucuguuu

SEQ ID NO: 1384860 - RNA, 19 nt, Homo sapiens
gaaaauccaugucauaaag

SEQ ID NO: 1384861 - RNA, 19 nt, Homo sapiens
ggaaaugcacuuacaagau

SEQ ID NO: 1384862 - RNA, 19 nt, Homo sapiens
ugaaauggaucccucaaca

SEQ ID NO: 1384863 - RNA, 19 nt, Homo sapiens
aacaggagcugcuucguaa

SEQ ID NO: 1384864 - RNA, 19 nt, Homo sapiens
gauaaaugcggcuguagaa

SEQ ID NO: 1384865 - RNA, 19 nt, Homo sapiens
gugaugaucuacaacgaaa

SEQ ID NO: 1384866 - RNA, 19 nt, Homo sapiens
ggcaaaggcugaacaagca

SEQ ID NO: 1384867 - RNA, 19 nt, Homo sapiens
ucacaacacuuccgauuac

SEQ ID NO: 1384868 - RNA, 19 nt, Homo sapiens
cggaauaaccuggauauaa

SEQ ID NO: 1384869 - RNA, 19 nt, Homo sapiens
gaugagaggacaugaauca

SEQ ID NO: 1384870 - RNA, 19 nt, Homo sapiens
aaaugacucuucugaaaug

SEQ ID NO: 1384871 - RNA, 19 nt, Homo sapiens
caacacugguuugaauauu

SEQ ID NO: 1384872 - RNA, 19 nt, Homo sapiens
gaacaaccaacucaucugu

SEQ ID NO: 1384873 - RNA, 19 nt, Homo sapiens
gacgguacauugcaucuau

SEQ ID NO: 1384874 - RNA, 19 nt, Homo sapiens
gaaaagagagcugaaagua

SEQ ID NO: 1384875 - RNA, 19 nt, Homo sapiens
gaacgagaaagaauaagga

SEQ ID NO: 1384876 - RNA, 19 nt, Homo sapiens
uggcugaaauuguucgaua

SEQ ID NO: 1384877 - RNA, 19 nt, Homo sapiens
uugaagauuugcccaauaa

SEQ ID NO: 1384878 - RNA, 19 nt, Homo sapiens
ccacauggacgguacauug

SEQ ID NO: 1384879 - RNA, 19 nt, Homo sapiens
uaaauggcuucuugaacuu

SEQ ID NO: 1384880 - RNA, 19 nt, Homo sapiens
gaacauuauucacaacacu

SEQ ID NO: 1384881 - RNA, 19 nt, Homo sapiens
gggagaaagguauauauga

SEQ ID NO: 1384882 - RNA, 19 nt, Homo sapiens
gagaggaguggcugaaauu

SEQ ID NO: 1384883 - RNA, 19 nt, Homo sapiens
acaaggaacugcugcaaca

SEQ ID NO: 1384884 - RNA, 19 nt, Homo sapiens
guacauugcaucuauuaug

SEQ ID NO: 1384885 - RNA, 19 nt, Homo sapiens
cuuguaaacuucucuuuga

SEQ ID NO: 1384886 - RNA, 19 nt, Homo sapiens
cuaggcagcucuuuagaau

SEQ ID NO: 1384887 - RNA, 19 nt, Homo sapiens
ggaggcaagucaaaucauc

SEQ ID NO: 1384888 - RNA, 19 nt, Homo sapiens
ggaaauaugccaucacaac

SEQ ID NO: 1384889 - RNA, 19 nt, Homo sapiens
ugaauuccuuguggcauua

SEQ ID NO: 1384890 - RNA, 19 nt, Homo sapiens
gcuuguaaauggcuucuug

SEQ ID NO: 1384891 - RNA, 19 nt, Homo sapiens
ucguaaagcugaagaaaca

SEQ ID NO: 1384892 - RNA, 19 nt, Homo sapiens
uugaagauaugcaagcuaa

SEQ ID NO: 1384893 - RNA, 19 nt, Homo sapiens
ggacucauguggcguuucu

SEQ ID NO: 1384894 - RNA, 19 nt, Homo sapiens
uauauucaguucaggcuuu

SEQ ID NO: 1384895 - RNA, 19 nt, Homo sapiens
gaaaacagaaggaaagaaa

SEQ ID NO: 1384896 - RNA, 19 nt, Homo sapiens
aaacucagaaggugauuaa

SEQ ID NO: 1384897 - RNA, 19 nt, Homo sapiens
ucagcaagaucaacaggaa

SEQ ID NO: 1384898 - RNA, 19 nt, Homo sapiens
ggcaguauccaguauuuaa

SEQ ID NO: 1384899 - RNA, 19 nt, Homo sapiens
ccagacagcaugcuuaaug

SEQ ID NO: 1384900 - RNA, 19 nt, Homo sapiens
caccauaucuuccacucuu

SEQ ID NO: 1384901 - RNA, 19 nt, Homo sapiens
aagacuggaugaugaaauu

SEQ ID NO: 1384902 - RNA, 19 nt, Homo sapiens
cgagaaagaauaaggaaug

SEQ ID NO: 1384903 - RNA, 19 nt, Homo sapiens
gaccacgccuacugacauu

SEQ ID NO: 1384904 - RNA, 19 nt, Homo sapiens
gaagaaauaccccaucaaa

SEQ ID NO: 1384905 - RNA, 19 nt, Homo sapiens
gaacucgaaucacaaaaga

SEQ ID NO: 1384906 - RNA, 19 nt, Homo sapiens
gagaaccuuaucugcauua

SEQ ID NO: 1384907 - RNA, 19 nt, Homo sapiens
ucaauaugcagacuuguaa

SEQ ID NO: 1384908 - RNA, 19 nt, Homo sapiens
caaggagagcggcaagaua

SEQ ID NO: 1384909 - RNA, 19 nt, Homo sapiens
gagaaagguauauaugaga

SEQ ID NO: 1384910 - RNA, 19 nt, Homo sapiens
gagcugaaaguaaaggaaa

SEQ ID NO: 1384911 - RNA, 19 nt, Homo sapiens
aaacaggagcugcuucgua

SEQ ID NO: 1384912 - RNA, 19 nt, Homo sapiens
gcagggaggugaccaugua

SEQ ID NO: 1384913 - RNA, 19 nt, Homo sapiens
guaaacaacugcugucaga

SEQ ID NO: 1384914 - RNA, 19 nt, Homo sapiens
gcugaacccugacugguaa

SEQ ID NO: 1384915 - RNA, 19 nt, Homo sapiens
caagacaacuggcaagcuu

SEQ ID NO: 1384916 - RNA, 19 nt, Homo sapiens
caugagcccuggaugagua

SEQ ID NO: 1384917 - RNA, 19 nt, Homo sapiens
ucaacgagcugcccgagaa

SEQ ID NO: 1384918 - RNA, 19 nt, Homo sapiens
gcaguguucuccugacuuc

SEQ ID NO: 1384919 - RNA, 19 nt, Homo sapiens
gaacugccauucccaagac

SEQ ID NO: 1384920 - RNA, 19 nt, Homo sapiens
gagagggcuucaucacuga

SEQ ID NO: 1384921 - RNA, 19 nt, Homo sapiens
caaccacccuuggaacuug

SEQ ID NO: 1384922 - RNA, 19 nt, Homo sapiens
ggacugagggaauccugua

SEQ ID NO: 1384923 - RNA, 19 nt, Homo sapiens
aaacaacugcugucagaaa

SEQ ID NO: 1384924 - RNA, 19 nt, Homo sapiens
ucugacagcuggacacaug

SEQ ID NO: 1384925 - RNA, 19 nt, Homo sapiens
gcucagaagagguggcuuu

SEQ ID NO: 1384926 - RNA, 19 nt, Homo sapiens
gcuugcagcugcccugaug

SEQ ID NO: 1384927 - RNA, 19 nt, Homo sapiens
ccuuggaacuugccucuug

SEQ ID NO: 1384928 - RNA, 19 nt, Homo sapiens
cauucuaccuguguucuuu

SEQ ID NO: 1384929 - RNA, 19 nt, Homo sapiens
ggaccauucuaccuguguu

SEQ ID NO: 1384930 - RNA, 19 nt, Homo sapiens
ccagaggacugagggaauc

SEQ ID NO: 1384931 - RNA, 19 nt, Homo sapiens
agacggagcaccugagaug

SEQ ID NO: 1384932 - RNA, 19 nt, Homo sapiens
gagaccagaggaaggaauu

SEQ ID NO: 1384933 - RNA, 19 nt, Homo sapiens
aaaggugugcccagucuaa

SEQ ID NO: 1384934 - RNA, 19 nt, Homo sapiens
ccauguaacucugaccaau

SEQ ID NO: 1384935 - RNA, 19 nt, Homo sapiens
gaagguggaggaucucucu

SEQ ID NO: 1384936 - RNA, 19 nt, Homo sapiens
acacaugagcccuggauga

SEQ ID NO: 1384937 - RNA, 19 nt, Homo sapiens
gagccuggaugugaaugga

SEQ ID NO: 1384938 - RNA, 19 nt, Homo sapiens
ccuagcagccucuucuuug

SEQ ID NO: 1384939 - RNA, 19 nt, Homo sapiens
ggacacaugagcccuggau

SEQ ID NO: 1384940 - RNA, 19 nt, Homo sapiens
gaggugaccauguaacucu

SEQ ID NO: 1384941 - RNA, 19 nt, Homo sapiens
gcagggacaggcaagacaa

SEQ ID NO: 1384942 - RNA, 19 nt, Homo sapiens
cuagcagccucuucuuugu

SEQ ID NO: 1384943 - RNA, 19 nt, Homo sapiens
ugugggaggugcagcaugu

SEQ ID NO: 1384944 - RNA, 19 nt, Homo sapiens
cagauugcggguccaagua

SEQ ID NO: 1384945 - RNA, 19 nt, Homo sapiens
ggaaagauagcaguguucu

SEQ ID NO: 1384946 - RNA, 19 nt, Homo sapiens
cuggaaagauagcaguguu

SEQ ID NO: 1384947 - RNA, 19 nt, Homo sapiens
ggauugggaccugcucuga

SEQ ID NO: 1384948 - RNA, 19 nt, Homo sapiens
ugacuucgcccuacugcau

SEQ ID NO: 1384949 - RNA, 19 nt, Homo sapiens
cggcgaccauccagcagaa

SEQ ID NO: 1384950 - RNA, 19 nt, Homo sapiens
ccucuuguccugcuggaaa

SEQ ID NO: 1384951 - RNA, 19 nt, Homo sapiens
acaggaggguguccagaag

SEQ ID NO: 1384952 - RNA, 19 nt, Homo sapiens
aacccugacugguaaacaa

SEQ ID NO: 1384953 - RNA, 19 nt, Homo sapiens
ccacacauucuccaacuac

SEQ ID NO: 1384954 - RNA, 19 nt, Homo sapiens
ccucgugacccucuggaaa

SEQ ID NO: 1384955 - RNA, 19 nt, Homo sapiens
ucuggagccuggaugugaa

SEQ ID NO: 1384956 - RNA, 19 nt, Homo sapiens
uaaaaggugugcccagucu

SEQ ID NO: 1384957 - RNA, 19 nt, Homo sapiens
gcggcguggacacucauua

SEQ ID NO: 1384958 - RNA, 19 nt, Homo sapiens
gaagagggguucgaguucu

SEQ ID NO: 1384959 - RNA, 19 nt, Homo sapiens
gaacccugacugguaaaca

SEQ ID NO: 1384960 - RNA, 19 nt, Homo sapiens
ccagauugcggguccaagu

SEQ ID NO: 1384961 - RNA, 19 nt, Homo sapiens
aguggaagguggaggaucu

SEQ ID NO: 1384962 - RNA, 19 nt, Homo sapiens
gaaagauagcaguguucuc

SEQ ID NO: 1384963 - RNA, 19 nt, Homo sapiens
ucagaaagucgagcuugga

SEQ ID NO: 1384964 - RNA, 19 nt, Homo sapiens
cagaagagcgaugccaagu

SEQ ID NO: 1384965 - RNA, 19 nt, Homo sapiens
gcgaccauccagcagaaga

SEQ ID NO: 1384966 - RNA, 19 nt, Homo sapiens
ugaaggagcugcauuaauu

SEQ ID NO: 1384967 - RNA, 19 nt, Homo sapiens
gagaagagcuggagaaugg

SEQ ID NO: 1384968 - RNA, 19 nt, Homo sapiens
guaauacccugaugcguuu

SEQ ID NO: 1384969 - RNA, 19 nt, Homo sapiens
ucagaacccuaccauguua

SEQ ID NO: 1384970 - RNA, 19 nt, Homo sapiens
uagcagaccuaacaaauau

SEQ ID NO: 1384971 - RNA, 19 nt, Homo sapiens
uaaccugucuggugaguuu

SEQ ID NO: 1384972 - RNA, 19 nt, Homo sapiens
ccaaggagauugcgaagau

SEQ ID NO: 1384973 - RNA, 19 nt, Homo sapiens
caaccuaacucagcuuuau

SEQ ID NO: 1384974 - RNA, 19 nt, Homo sapiens
guauggaacugucugcauu

SEQ ID NO: 1384975 - RNA, 19 nt, Homo sapiens
caacagacaucgcuauugc

SEQ ID NO: 1384976 - RNA, 19 nt, Homo sapiens
guagcagaccuaacaaaua

SEQ ID NO: 1384977 - RNA, 19 nt, Homo sapiens
uaacucagcuuuauuugac

SEQ ID NO: 1384978 - RNA, 19 nt, Homo sapiens
gcagaccuaacaaauauuu

SEQ ID NO: 1384979 - RNA, 19 nt, Homo sapiens
gauauucuguacaaguuga

SEQ ID NO: 1384980 - RNA, 19 nt, Homo sapiens
gagaauggauaguauuguc

SEQ ID NO: 1384981 - RNA, 19 nt, Homo sapiens
ggucagaacccuaccaugu

SEQ ID NO: 1384982 - RNA, 19 nt, Homo sapiens
gaaaggaccagacuucaac

SEQ ID NO: 1384983 - RNA, 19 nt, Homo sapiens
ggagagauguguuuuguuc

SEQ ID NO: 1384984 - RNA, 19 nt, Homo sapiens
ugugggagauggacaauau

SEQ ID NO: 1384985 - RNA, 19 nt, Homo sapiens
ggagcaagcugugggagau

SEQ ID NO: 1384986 - RNA, 19 nt, Homo sapiens
gcucucacauacaggaauu

SEQ ID NO: 1384987 - RNA, 19 nt, Homo sapiens
gcuguaaguucauuugagu

SEQ ID NO: 1384988 - RNA, 19 nt, Homo sapiens
gacuuuaauuucuguguga

SEQ ID NO: 1384989 - RNA, 19 nt, Homo sapiens
gcuggagaauggauaguau

SEQ ID NO: 1384990 - RNA, 19 nt, Homo sapiens
ggagaaggccaaggagauu

SEQ ID NO: 1384991 - RNA, 19 nt, Homo sapiens
gggcuuuggugguuauuuc

SEQ ID NO: 1384992 - RNA, 19 nt, Homo sapiens
uauuugacauggaaccuaa

SEQ ID NO: 1384993 - RNA, 19 nt, Homo sapiens
ggauaguauugucuguauu

SEQ ID NO: 1384994 - RNA, 19 nt, Homo sapiens
uuagaggacuuggcauaaa

SEQ ID NO: 1384995 - RNA, 19 nt, Homo sapiens
gaccaaaggaggagagaug

SEQ ID NO: 1384996 - RNA, 19 nt, Homo sapiens
gcauagcgagugucgguuu

SEQ ID NO: 1384997 - RNA, 19 nt, Homo sapiens
gccaauggauucuggucaa

SEQ ID NO: 1384998 - RNA, 19 nt, Homo sapiens
acccuaaacuggacuagaa

SEQ ID NO: 1384999 - RNA, 19 nt, Homo sapiens
gaacuuugggucugugugu

SEQ ID NO: 1385000 - RNA, 19 nt, Homo sapiens
ccagagagccuuuuguuuu

SEQ ID NO: 1385001 - RNA, 19 nt, Homo sapiens
gcgagaaggccgaggagaa

SEQ ID NO: 1385002 - RNA, 19 nt, Homo sapiens
gugguacacuaucuuaugu

SEQ ID NO: 1385003 - RNA, 19 nt, Homo sapiens
gaaggagcugcauuaauuc

SEQ ID NO: 1385004 - RNA, 19 nt, Homo sapiens
uggauaguauugucuguau

SEQ ID NO: 1385005 - RNA, 19 nt, Homo sapiens
uuucuugugugaccugaua

SEQ ID NO: 1385006 - RNA, 19 nt, Homo sapiens
uauggucugugguugauga

SEQ ID NO: 1385007 - RNA, 19 nt, Homo sapiens
uaaguucauuugaguagca

SEQ ID NO: 1385008 - RNA, 19 nt, Homo sapiens
gaguuucgauuguuaacgu

SEQ ID NO: 1385009 - RNA, 19 nt, Homo sapiens
ugacauggaaccuaaaaua

SEQ ID NO: 1385010 - RNA, 19 nt, Homo sapiens
ggaauauucgggcucucua

SEQ ID NO: 1385011 - RNA, 19 nt, Homo sapiens
ggcauaaaaugaaagauug

SEQ ID NO: 1385012 - RNA, 19 nt, Homo sapiens
ggacuuggcauaaaaugaa

SEQ ID NO: 1385013 - RNA, 19 nt, Homo sapiens
aguauugucuguauuugga

SEQ ID NO: 1385014 - RNA, 19 nt, Homo sapiens
uugaggugcuuugcuauuu

SEQ ID NO: 1385015 - RNA, 19 nt, Homo sapiens
gcuauggucugugguugau

SEQ ID NO: 1385016 - RNA, 19 nt, Homo sapiens
caaaggaggagagaugugu

SEQ ID NO: 1385017 - RNA, 19 nt, Homo sapiens
gcuuugcuauuucuugugu

SEQ ID NO: 1385018 - RNA, 19 nt, Homo sapiens
ucuaugcucugucucacuu

SEQ ID NO: 1385019 - RNA, 19 nt, Homo sapiens
uaucuuauguaaccugucu

SEQ ID NO: 1385020 - RNA, 19 nt, Homo sapiens
gugcuuugcuauuucuugu

SEQ ID NO: 1385021 - RNA, 19 nt, Homo sapiens
gcagcagucacauuuguuc

SEQ ID NO: 1385022 - RNA, 19 nt, Homo sapiens
gaauauucgggcucucuau

SEQ ID NO: 1385023 - RNA, 19 nt, Homo sapiens
cauggaaccuaaaauagaa

SEQ ID NO: 1385024 - RNA, 19 nt, Homo sapiens
guugugguacacuaucuua

SEQ ID NO: 1385025 - RNA, 19 nt, Homo sapiens
gaggagagauguguuuugu

SEQ ID NO: 1385026 - RNA, 19 nt, Homo sapiens
ggagaagagcuggagaaug

SEQ ID NO: 1385027 - RNA, 19 nt, Homo sapiens
gggaaguaauuuuguuuga

SEQ ID NO: 1385028 - RNA, 19 nt, Homo sapiens
aaugaaagauuggcaaagg

SEQ ID NO: 1385029 - RNA, 19 nt, Homo sapiens
gcugaaggagcugcauuaa

SEQ ID NO: 1385030 - RNA, 19 nt, Homo sapiens
gaggugcuuugcuauuucu

SEQ ID NO: 1385031 - RNA, 19 nt, Homo sapiens
ugaggugcuuugcuauuuc

SEQ ID NO: 1385032 - RNA, 19 nt, Homo sapiens
uaugcucugucucacuuaa

SEQ ID NO: 1385033 - RNA, 19 nt, Homo sapiens
gucagaacccuaccauguu

SEQ ID NO: 1385034 - RNA, 19 nt, Homo sapiens
gaguagcagaccuaacaaa

SEQ ID NO: 1385035 - RNA, 19 nt, Homo sapiens
caaggagauugcgaagaug

SEQ ID NO: 1385036 - RNA, 19 nt, Homo sapiens
gagaaggccaaggagauug

SEQ ID NO: 1385037 - RNA, 19 nt, Homo sapiens
cuaacucagcuuuauuuga

SEQ ID NO: 1385038 - RNA, 19 nt, Homo sapiens
gaagagcuggagaauggau

SEQ ID NO: 1385039 - RNA, 19 nt, Homo sapiens
ugcagcaacuacugaagaa

SEQ ID NO: 1385040 - RNA, 19 nt, Homo sapiens
gacaaccuaacucagcuuu

SEQ ID NO: 1385041 - RNA, 19 nt, Homo sapiens
ugaaaaugcucucacauac

SEQ ID NO: 1385042 - RNA, 19 nt, Homo sapiens
ugucugcauuggacccuaa

SEQ ID NO: 1385043 - RNA, 19 nt, Homo sapiens
cugcauuaauucuggaaga

SEQ ID NO: 1385044 - RNA, 19 nt, Homo sapiens
gauagcucccuggaacuuu

SEQ ID NO: 1385045 - RNA, 19 nt, Homo sapiens
uagaggacuuggcauaaaa

SEQ ID NO: 1385046 - RNA, 19 nt, Homo sapiens
uugcgaagauggcagagau

SEQ ID NO: 1385047 - RNA, 19 nt, Homo sapiens
agaaaggaccagacuucaa

SEQ ID NO: 1385048 - RNA, 19 nt, Homo sapiens
cuuuggugguuauuucuaa

SEQ ID NO: 1385049 - RNA, 19 nt, Homo sapiens
cagagagccuuuuguuuuc

SEQ ID NO: 1385050 - RNA, 19 nt, Homo sapiens
gagaagccgaaaccagaga

SEQ ID NO: 1385051 - RNA, 19 nt, Homo sapiens
cauacguuguccagcugua

SEQ ID NO: 1385052 - RNA, 19 nt, Homo sapiens
ucuucaagguucauacguu

SEQ ID NO: 1385053 - RNA, 19 nt, Homo sapiens
ccaacagacaucgcuauug

SEQ ID NO: 1385054 - RNA, 19 nt, Homo sapiens
ggagaauggauaguauugu

SEQ ID NO: 1385055 - RNA, 19 nt, Homo sapiens
cagcaacuacugaagaaag

SEQ ID NO: 1385056 - RNA, 19 nt, Homo sapiens
uugcagcagucacauuugu

SEQ ID NO: 1385057 - RNA, 19 nt, Homo sapiens
ucacuuaacacuacguuuu

SEQ ID NO: 1385058 - RNA, 19 nt, Homo sapiens
gaaaaugcucucacauaca

SEQ ID NO: 1385059 - RNA, 19 nt, Homo sapiens
aggaggauuucgagcaguu

SEQ ID NO: 1385060 - RNA, 19 nt, Homo sapiens
guccagcuguaaguucauu

SEQ ID NO: 1385061 - RNA, 19 nt, Homo sapiens
cagcuuuauuugacaugga

SEQ ID NO: 1385062 - RNA, 19 nt, Homo sapiens
ggacaaccuaacucagcuu

SEQ ID NO: 1385063 - RNA, 19 nt, Homo sapiens
auagcucccuggaacuuug

SEQ ID NO: 1385064 - RNA, 19 nt, Homo sapiens
ucgugaaucuggagaagag

SEQ ID NO: 1385065 - RNA, 19 nt, Homo sapiens
ggcugggacucgugaaucu

SEQ ID NO: 1385066 - RNA, 19 nt, Homo sapiens
gcggaugacuucagcauua

SEQ ID NO: 1385067 - RNA, 19 nt, Homo sapiens
gaauauggccuauacagua

SEQ ID NO: 1385068 - RNA, 19 nt, Homo sapiens
ggaguugguuucauucuuu

SEQ ID NO: 1385069 - RNA, 19 nt, Homo sapiens
gaaagccaguguuuagaau

SEQ ID NO: 1385070 - RNA, 19 nt, Homo sapiens
gaaguauacucgugugcuu

SEQ ID NO: 1385071 - RNA, 19 nt, Homo sapiens
gagaagacacuacaugguu

SEQ ID NO: 1385072 - RNA, 19 nt, Homo sapiens
gcagaugaccaaagcaauu

SEQ ID NO: 1385073 - RNA, 19 nt, Homo sapiens
cacauuagccacucaauuu

SEQ ID NO: 1385074 - RNA, 19 nt, Homo sapiens
ggaaacgugugaauguugu

SEQ ID NO: 1385075 - RNA, 19 nt, Homo sapiens
gaccaaagcaauugacuug

SEQ ID NO: 1385076 - RNA, 19 nt, Homo sapiens
ccugugaucuuauuguauu

SEQ ID NO: 1385077 - RNA, 19 nt, Homo sapiens
gguugcagcugccacauga

SEQ ID NO: 1385078 - RNA, 19 nt, Homo sapiens
gcucugucuuguuaugaua

SEQ ID NO: 1385079 - RNA, 19 nt, Homo sapiens
aaaggaauauggccuauac

SEQ ID NO: 1385080 - RNA, 19 nt, Homo sapiens
ucauuaaugucccacguaa

SEQ ID NO: 1385081 - RNA, 19 nt, Homo sapiens
caagagagccuuucguuuu

SEQ ID NO: 1385082 - RNA, 19 nt, Homo sapiens
caugagagacuugagguua

SEQ ID NO: 1385083 - RNA, 19 nt, Homo sapiens
ggagguacaugcuggaaac

SEQ ID NO: 1385084 - RNA, 19 nt, Homo sapiens
ugaauguuguuacgagauu

SEQ ID NO: 1385085 - RNA, 19 nt, Homo sapiens
ccaagcuccugucaaaguu

SEQ ID NO: 1385086 - RNA, 19 nt, Homo sapiens
ccgcggaguugguuucauu

SEQ ID NO: 1385087 - RNA, 19 nt, Homo sapiens
gcugaaagccaguguuuag

SEQ ID NO: 1385088 - RNA, 19 nt, Homo sapiens
ugaaugcgacuuuggauga

SEQ ID NO: 1385089 - RNA, 19 nt, Homo sapiens
aacccaagcuccugucaaa

SEQ ID NO: 1385090 - RNA, 19 nt, Homo sapiens
caugaccacuggaaguauu

SEQ ID NO: 1385091 - RNA, 19 nt, Homo sapiens
gggaugaguucuagguaca

SEQ ID NO: 1385092 - RNA, 19 nt, Homo sapiens
gauauguuguuguaaagag

SEQ ID NO: 1385093 - RNA, 19 nt, Homo sapiens
uuacgagauuggagcauuu

SEQ ID NO: 1385094 - RNA, 19 nt, Homo sapiens
cagaguggcugaggaagga

SEQ ID NO: 1385095 - RNA, 19 nt, Homo sapiens
ggugagcaaccuacaauug

SEQ ID NO: 1385096 - RNA, 19 nt, Homo sapiens
guaaaggaauauggccuau

SEQ ID NO: 1385097 - RNA, 19 nt, Homo sapiens
uagauggucagguguauuu

SEQ ID NO: 1385098 - RNA, 19 nt, Homo sapiens
gaauuucucccacuuguac

SEQ ID NO: 1385099 - RNA, 19 nt, Homo sapiens
aggcuuagaugaugacuag

SEQ ID NO: 1385100 - RNA, 19 nt, Homo sapiens
cgacuuuggaugagauuaa

SEQ ID NO: 1385101 - RNA, 19 nt, Homo sapiens
ccaagagagccuuucguuu

SEQ ID NO: 1385102 - RNA, 19 nt, Homo sapiens
gccaguguuuagaaucuuu

SEQ ID NO: 1385103 - RNA, 19 nt, Homo sapiens
ugaaagccaguguuuagaa

SEQ ID NO: 1385104 - RNA, 19 nt, Homo sapiens
ggaauauggccuauacagu

SEQ ID NO: 1385105 - RNA, 19 nt, Homo sapiens
ccacauuagccacucaauu

SEQ ID NO: 1385106 - RNA, 19 nt, Homo sapiens
gcuggaaacgugugaaugu

SEQ ID NO: 1385107 - RNA, 19 nt, Homo sapiens
caauugggaugaguucuag

SEQ ID NO: 1385108 - RNA, 19 nt, Homo sapiens
gcagcugccacaugaagaa

SEQ ID NO: 1385109 - RNA, 19 nt, Homo sapiens
guuacgagauuggagcauu

SEQ ID NO: 1385110 - RNA, 19 nt, Homo sapiens
gaugaguucuagguacaug

SEQ ID NO: 1385111 - RNA, 19 nt, Homo sapiens
gguuagaguucugcaagug

SEQ ID NO: 1385112 - RNA, 19 nt, Homo sapiens
ugagagacuugagguuaga

SEQ ID NO: 1385113 - RNA, 19 nt, Homo sapiens
ggacaggcucaaaccaaga

SEQ ID NO: 1385114 - RNA, 19 nt, Homo sapiens
guacauguguuugcugacu

SEQ ID NO: 1385115 - RNA, 19 nt, Homo sapiens
gaauguaauuuuccuaugg

SEQ ID NO: 1385116 - RNA, 19 nt, Homo sapiens
gagaauaucaagcucaaaa

SEQ ID NO: 1385117 - RNA, 19 nt, Homo sapiens
gaauguuguuacgagauug

SEQ ID NO: 1385118 - RNA, 19 nt, Homo sapiens
gcugcugcguggucauauu

SEQ ID NO: 1385119 - RNA, 19 nt, Homo sapiens
uaauaggcgcauucaguuu

SEQ ID NO: 1385120 - RNA, 19 nt, Homo sapiens
uuaauaggcgcauucaguu

SEQ ID NO: 1385121 - RNA, 19 nt, Homo sapiens
caaaggagggagagcuguu

SEQ ID NO: 1385122 - RNA, 19 nt, Homo sapiens
aacagucauuccaggcuua

SEQ ID NO: 1385123 - RNA, 19 nt, Homo sapiens
acauguguuugcugacuuu

SEQ ID NO: 1385124 - RNA, 19 nt, Homo sapiens
uaaaggaauauggccuaua

SEQ ID NO: 1385125 - RNA, 19 nt, Homo sapiens
gaacccaagcuccugucaa

SEQ ID NO: 1385126 - RNA, 19 nt, Homo sapiens
gcucaaaauuuauguugug

SEQ ID NO: 1385127 - RNA, 19 nt, Homo sapiens
guucuagguacauguguuu

SEQ ID NO: 1385128 - RNA, 19 nt, Homo sapiens
acaauugggaugaguucua

SEQ ID NO: 1385129 - RNA, 19 nt, Homo sapiens
caaccuacaauugggauga

SEQ ID NO: 1385130 - RNA, 19 nt, Homo sapiens
cauauuuguuccugugauc

SEQ ID NO: 1385131 - RNA, 19 nt, Homo sapiens
aaacgugugaauguuguua

SEQ ID NO: 1385132 - RNA, 19 nt, Homo sapiens
gcacaggugguuggguuug

SEQ ID NO: 1385133 - RNA, 19 nt, Homo sapiens
cagaugaccaaagcaauug

SEQ ID NO: 1385134 - RNA, 19 nt, Homo sapiens
gaaugcgacuuuggaugag

SEQ ID NO: 1385135 - RNA, 19 nt, Homo sapiens
ugucccacguaaaggaaua

SEQ ID NO: 1385136 - RNA, 19 nt, Homo sapiens
gaugaauuucucccacuug

SEQ ID NO: 1385137 - RNA, 19 nt, Homo sapiens
ugaugaauuucucccacuu

SEQ ID NO: 1385138 - RNA, 19 nt, Homo sapiens
gagcauuugcgaugaccuu

SEQ ID NO: 1385139 - RNA, 19 nt, Homo sapiens
ggacucaugagagacuuga

SEQ ID NO: 1385140 - RNA, 19 nt, Homo sapiens
aauauggccuauacaguac

SEQ ID NO: 1385141 - RNA, 19 nt, Homo sapiens
cggaguugguuucauucuu

SEQ ID NO: 1385142 - RNA, 19 nt, Homo sapiens
guggacgguuggucuugaa

SEQ ID NO: 1385143 - RNA, 19 nt, Homo sapiens
gcucgacgccaucaagagu

SEQ ID NO: 1385144 - RNA, 19 nt, Homo sapiens
gucaugaccacuggaagua

SEQ ID NO: 1385145 - RNA, 19 nt, Homo sapiens
gcugcguggucauauuugu

SEQ ID NO: 1385146 - RNA, 19 nt, Homo sapiens
aauaggcgcauucaguuug

SEQ ID NO: 1385147 - RNA, 19 nt, Homo sapiens
agagcucugucuuguuaug

SEQ ID NO: 1385148 - RNA, 19 nt, Homo sapiens
agacagcuuuucauuaaug

SEQ ID NO: 1385149 - RNA, 19 nt, Homo sapiens
caagaaaagguaagguaaa

SEQ ID NO: 1385150 - RNA, 19 nt, Homo sapiens
gugcagaugaccaaagcaa

SEQ ID NO: 1385151 - RNA, 19 nt, Homo sapiens
gcccagaguggcugaggaa

SEQ ID NO: 1385152 - RNA, 19 nt, Homo sapiens
gaguggcaguguguggauu

SEQ ID NO: 1385153 - RNA, 19 nt, Homo sapiens
ucgacgccaucaagaguga

SEQ ID NO: 1385154 - RNA, 19 nt, Homo sapiens
uuccugugaucuuauugua

SEQ ID NO: 1385155 - RNA, 19 nt, Homo sapiens
uaaugucccacguaaagga

SEQ ID NO: 1385156 - RNA, 19 nt, Homo sapiens
cauuagauggucaggugua

SEQ ID NO: 1385157 - RNA, 19 nt, Homo sapiens
agaugcaugugaccucuuc

SEQ ID NO: 1385158 - RNA, 19 nt, Homo sapiens
cuggaaacgugugaauguu

SEQ ID NO: 1385159 - RNA, 19 nt, Homo sapiens
ggaccucugcagaccauca

SEQ ID NO: 1385160 - RNA, 19 nt, Homo sapiens
guuagaguucugcaaguga

SEQ ID NO: 1385161 - RNA, 19 nt, Homo sapiens
gaaacgugugaauguuguu

SEQ ID NO: 1385162 - RNA, 19 nt, Homo sapiens
ugaauuucucccacuugua

SEQ ID NO: 1385163 - RNA, 19 nt, Homo sapiens
gugagcaaccuacaauugg

SEQ ID NO: 1385164 - RNA, 19 nt, Homo sapiens
gagacuugagguuagaguu

SEQ ID NO: 1385165 - RNA, 19 nt, Homo sapiens
gaugacuucagcauuagau

SEQ ID NO: 1385166 - RNA, 19 nt, Homo sapiens
ucagacaauuucaaccuua

SEQ ID NO: 1385167 - RNA, 19 nt, Homo sapiens
ggucagggcagcuacauuu

SEQ ID NO: 1385168 - RNA, 19 nt, Homo sapiens
ccacaccacuucugucuca

SEQ ID NO: 1385169 - RNA, 19 nt, Homo sapiens
cagacaauuucaaccuuaa

SEQ ID NO: 1385170 - RNA, 19 nt, Homo sapiens
ggacccagugauacuugua

SEQ ID NO: 1385171 - RNA, 19 nt, Homo sapiens
aaucucaccugccaacgau

SEQ ID NO: 1385172 - RNA, 19 nt, Homo sapiens
gaaucucaccugccaacga

SEQ ID NO: 1385173 - RNA, 19 nt, Homo sapiens
gcacugaggcaccgagacu

SEQ ID NO: 1385174 - RNA, 19 nt, Homo sapiens
gaacgaggggacuguguuu

SEQ ID NO: 1385175 - RNA, 19 nt, Homo sapiens
cuacauuucuggugaucag

SEQ ID NO: 1385176 - RNA, 19 nt, Homo sapiens
cagggcagcuacauuucug

SEQ ID NO: 1385177 - RNA, 19 nt, Homo sapiens
ggacgggacccagugauac

SEQ ID NO: 1385178 - RNA, 19 nt, Homo sapiens
ccugaaaugaacucuguuu

SEQ ID NO: 1385179 - RNA, 19 nt, Homo sapiens
cgacagaugacaaaagaaa

SEQ ID NO: 1385180 - RNA, 19 nt, Homo sapiens
gacaauuucaaccuuaauc

SEQ ID NO: 1385181 - RNA, 19 nt, Homo sapiens
cuccugaaaugaacucugu

SEQ ID NO: 1385182 - RNA, 19 nt, Homo sapiens
aaaagaaacagccccaaaa

SEQ ID NO: 1385183 - RNA, 19 nt, Homo sapiens
caaaagaaacagccccaaa

SEQ ID NO: 1385184 - RNA, 19 nt, Homo sapiens
gaacucuguuuuaaauugg

SEQ ID NO: 1385185 - RNA, 19 nt, Homo sapiens
cggacgggacccagugaua

SEQ ID NO: 1385186 - RNA, 19 nt, Homo sapiens
uauuacacaguccugauuu

SEQ ID NO: 1385187 - RNA, 19 nt, Homo sapiens
ucucaccugccaacgauuu

SEQ ID NO: 1385188 - RNA, 19 nt, Homo sapiens
cagcuacauuucuggugau

SEQ ID NO: 1385189 - RNA, 19 nt, Homo sapiens
caaaauacgaccacuccaa

SEQ ID NO: 1385190 - RNA, 19 nt, Homo sapiens
agaaacagccccaaaauac

SEQ ID NO: 1385191 - RNA, 19 nt, Homo sapiens
aagaaacagccccaaaaua

SEQ ID NO: 1385192 - RNA, 19 nt, Homo sapiens
gggacccagugauacuugu

SEQ ID NO: 1385193 - RNA, 19 nt, Homo sapiens
ggccucgacagaugacaaa

SEQ ID NO: 1385194 - RNA, 19 nt, Homo sapiens
gugcuuguggcaucucuga

SEQ ID NO: 1385195 - RNA, 19 nt, Homo sapiens
gcuaaaggcuuauccauau

SEQ ID NO: 1385196 - RNA, 19 nt, Homo sapiens
gcagaaagaucuauugaag

SEQ ID NO: 1385197 - RNA, 19 nt, Homo sapiens
aaagacaacucacauguaa

SEQ ID NO: 1385198 - RNA, 19 nt, Homo sapiens
gaagaaguguauuaccuuu

SEQ ID NO: 1385199 - RNA, 19 nt, Homo sapiens
aaacuugacucuacaugua

SEQ ID NO: 1385200 - RNA, 19 nt, Homo sapiens
gagaauccaucccauuaaa

SEQ ID NO: 1385201 - RNA, 19 nt, Homo sapiens
gaagaugaccagucuaauu

SEQ ID NO: 1385202 - RNA, 19 nt, Homo sapiens
gcuaauggcuuuaaugagu

SEQ ID NO: 1385203 - RNA, 19 nt, Homo sapiens
ggaaaucauucgauccaaa

SEQ ID NO: 1385204 - RNA, 19 nt, Homo sapiens
cacaaugcauuccuuauaa

SEQ ID NO: 1385205 - RNA, 19 nt, Homo sapiens
caucccaucuccucaaaua

SEQ ID NO: 1385206 - RNA, 19 nt, Homo sapiens
gaugaaauauccaagaauc

SEQ ID NO: 1385207 - RNA, 19 nt, Homo sapiens
gaaguucggcaccuuauuu

SEQ ID NO: 1385208 - RNA, 19 nt, Homo sapiens
uuucagagcuuggauauuu

SEQ ID NO: 1385209 - RNA, 19 nt, Homo sapiens
gaaagauguugguggagaa

SEQ ID NO: 1385210 - RNA, 19 nt, Homo sapiens
ucugagaugugcugauuua

SEQ ID NO: 1385211 - RNA, 19 nt, Homo sapiens
gagaaucuaucaaccuguu

SEQ ID NO: 1385212 - RNA, 19 nt, Homo sapiens
agacaacucacauguaaua

SEQ ID NO: 1385213 - RNA, 19 nt, Homo sapiens
gagagaaggauacagagua

SEQ ID NO: 1385214 - RNA, 19 nt, Homo sapiens
ggucguggcugaacauugu

SEQ ID NO: 1385215 - RNA, 19 nt, Homo sapiens
gagaaacuauucacaaugc

SEQ ID NO: 1385216 - RNA, 19 nt, Homo sapiens
acauaaagcccaagaaauu

SEQ ID NO: 1385217 - RNA, 19 nt, Homo sapiens
aaacagcaauaaugaguug

SEQ ID NO: 1385218 - RNA, 19 nt, Homo sapiens
gggaaagcaugaacgacua

SEQ ID NO: 1385219 - RNA, 19 nt, Homo sapiens
gauaaagacacuccaauuc

SEQ ID NO: 1385220 - RNA, 19 nt, Homo sapiens
uaccagaaauugacauuga

SEQ ID NO: 1385221 - RNA, 19 nt, Homo sapiens
ucacaaugcauuccuuaua

SEQ ID NO: 1385222 - RNA, 19 nt, Homo sapiens
ugggauaccuuacuacuug

SEQ ID NO: 1385223 - RNA, 19 nt, Homo sapiens
gagaugugcugauuuaacu

SEQ ID NO: 1385224 - RNA, 19 nt, Homo sapiens
gaagaugaaauauccaaga

SEQ ID NO: 1385225 - RNA, 19 nt, Homo sapiens
gauacagaguaccaacuaa

SEQ ID NO: 1385226 - RNA, 19 nt, Homo sapiens
gaggugacuuggagaaaga

SEQ ID NO: 1385227 - RNA, 19 nt, Homo sapiens
gaugacacuuuaauaguuc

SEQ ID NO: 1385228 - RNA, 19 nt, Homo sapiens
caacaggccuccucaccau

SEQ ID NO: 1385229 - RNA, 19 nt, Homo sapiens
cagaggaccugauugacuu

SEQ ID NO: 1385230 - RNA, 19 nt, Homo sapiens
caaguacgaugcaauugau

SEQ ID NO: 1385231 - RNA, 19 nt, Homo sapiens
uguauuaccuuugguguuu

SEQ ID NO: 1385232 - RNA, 19 nt, Homo sapiens
gagcuuggauauuucugaa

SEQ ID NO: 1385233 - RNA, 19 nt, Homo sapiens
gcacaguucuucauaucca

SEQ ID NO: 1385234 - RNA, 19 nt, Homo sapiens
cuaaaggcuuauccauaua

SEQ ID NO: 1385235 - RNA, 19 nt, Homo sapiens
ggugaaagcuuuggacaag

SEQ ID NO: 1385236 - RNA, 19 nt, Homo sapiens
ucagauguauggucucuug

SEQ ID NO: 1385237 - RNA, 19 nt, Homo sapiens
gggcugaaaucaucaucuu

SEQ ID NO: 1385238 - RNA, 19 nt, Homo sapiens
gcagaaguucggcaccuua

SEQ ID NO: 1385239 - RNA, 19 nt, Homo sapiens
ugacauuccuccucuuaug

SEQ ID NO: 1385240 - RNA, 19 nt, Homo sapiens
ccacauaaagcccaagaaa

SEQ ID NO: 1385241 - RNA, 19 nt, Homo sapiens
acagugaaaucugaucaua

SEQ ID NO: 1385242 - RNA, 19 nt, Homo sapiens
ggucuugacucacuuugug

SEQ ID NO: 1385243 - RNA, 19 nt, Homo sapiens
uuaccacacugccacauaa

SEQ ID NO: 1385244 - RNA, 19 nt, Homo sapiens
gaaguaucaccacggauuu

SEQ ID NO: 1385245 - RNA, 19 nt, Homo sapiens
ccaaagccaucuucugaca

SEQ ID NO: 1385246 - RNA, 19 nt, Homo sapiens
ggauacagaguaccaacua

SEQ ID NO: 1385247 - RNA, 19 nt, Homo sapiens
aagagaauccaucccauua

SEQ ID NO: 1385248 - RNA, 19 nt, Homo sapiens
guagaugacacuuuaauag

SEQ ID NO: 1385249 - RNA, 19 nt, Homo sapiens
gccaguauguggauauuuc

SEQ ID NO: 1385250 - RNA, 19 nt, Homo sapiens
aagaugaccagucuaauuu

SEQ ID NO: 1385251 - RNA, 19 nt, Homo sapiens
gauguauggucucuuggaa

SEQ ID NO: 1385252 - RNA, 19 nt, Homo sapiens
ggacaaggucgagauagaa

SEQ ID NO: 1385253 - RNA, 19 nt, Homo sapiens
caaaguauucagugaggua

SEQ ID NO: 1385254 - RNA, 19 nt, Homo sapiens
uaauaguucuggcugaaga

SEQ ID NO: 1385255 - RNA, 19 nt, Homo sapiens
gagcuauucaugccaagua

SEQ ID NO: 1385256 - RNA, 19 nt, Homo sapiens
ugaagagcaugguuguuug

SEQ ID NO: 1385257 - RNA, 19 nt, Homo sapiens
aaauucagcugacaagaca

SEQ ID NO: 1385258 - RNA, 19 nt, Homo sapiens
caaagcuccuggugguuga

SEQ ID NO: 1385259 - RNA, 19 nt, Homo sapiens
gaaacuugacucuacaugu

SEQ ID NO: 1385260 - RNA, 19 nt, Homo sapiens
gaaagaagcaagaguugac

SEQ ID NO: 1385261 - RNA, 19 nt, Homo sapiens
ggaaagaagcaagaguuga

SEQ ID NO: 1385262 - RNA, 19 nt, Homo sapiens
cuacauguauugcugaaag

SEQ ID NO: 1385263 - RNA, 19 nt, Homo sapiens
cagcacaguucuucauauc

SEQ ID NO: 1385264 - RNA, 19 nt, Homo sapiens
ggaccugauugacuugugu

SEQ ID NO: 1385265 - RNA, 19 nt, Homo sapiens
cagcagaggaccugauuga

SEQ ID NO: 1385266 - RNA, 19 nt, Homo sapiens
caagagaauccaucccauu

SEQ ID NO: 1385267 - RNA, 19 nt, Homo sapiens
gaaacugugauagaucuuu

SEQ ID NO: 1385268 - RNA, 19 nt, Homo sapiens
guaacucauuucacccaaa

SEQ ID NO: 1385269 - RNA, 19 nt, Homo sapiens
ccucggcucugccacauga

SEQ ID NO: 1385270 - RNA, 19 nt, Homo sapiens
gccaucccuugguuucuua

SEQ ID NO: 1385271 - RNA, 19 nt, Homo sapiens
gcauguaugucugcuuuua

SEQ ID NO: 1385272 - RNA, 19 nt, Homo sapiens
ccaaguacgaugcaauuga

SEQ ID NO: 1385273 - RNA, 19 nt, Homo sapiens
aaccaaaucuggaaagaag

SEQ ID NO: 1385274 - RNA, 19 nt, Homo sapiens
ugaggauggugaaagcuuu

SEQ ID NO: 1385275 - RNA, 19 nt, Homo sapiens
ccucaaauaugaagaacca

SEQ ID NO: 1385276 - RNA, 19 nt, Homo sapiens
cuagaugguggcauuaaua

SEQ ID NO: 1385277 - RNA, 19 nt, Homo sapiens
ccucugggauaccuuacua

SEQ ID NO: 1385278 - RNA, 19 nt, Homo sapiens
gguagugucucauccugau

SEQ ID NO: 1385279 - RNA, 19 nt, Homo sapiens
ggaggugacuuggagaaag

SEQ ID NO: 1385280 - RNA, 19 nt, Homo sapiens
agucaguuguguaaagaua

SEQ ID NO: 1385281 - RNA, 19 nt, Homo sapiens
ggauaucagucaguugugu

SEQ ID NO: 1385282 - RNA, 19 nt, Homo sapiens
gaggauaucagucaguugu

SEQ ID NO: 1385283 - RNA, 19 nt, Homo sapiens
cagaugaauuaaugaagga

SEQ ID NO: 1385284 - RNA, 19 nt, Homo sapiens
gaaauucagcugacaagac

SEQ ID NO: 1385285 - RNA, 19 nt, Homo sapiens
gaaauauccaagaaucugu

SEQ ID NO: 1385286 - RNA, 19 nt, Homo sapiens
ucaggaagcaucaacauuc

SEQ ID NO: 1385287 - RNA, 19 nt, Homo sapiens
ucucucagaugauugcauu

SEQ ID NO: 1385288 - RNA, 19 nt, Homo sapiens
gaugaccagucuaauuuac

SEQ ID NO: 1385289 - RNA, 19 nt, Homo sapiens
ggagaaagagcuugucaac

SEQ ID NO: 1385290 - RNA, 19 nt, Homo sapiens
caaaaccacugaucacaug

SEQ ID NO: 1385291 - RNA, 19 nt, Homo sapiens
gcauuuccguaaaguuugu

SEQ ID NO: 1385292 - RNA, 19 nt, Homo sapiens
aaaacuagauguccagauu

SEQ ID NO: 1385293 - RNA, 19 nt, Homo sapiens
ccacgccacucucagacaa

SEQ ID NO: 1385294 - RNA, 19 nt, Homo sapiens
guacgaugcaauugauaaa

SEQ ID NO: 1385295 - RNA, 19 nt, Homo sapiens
gcgaggagcuggacaaauu

SEQ ID NO: 1385296 - RNA, 19 nt, Homo sapiens
agagagagcugccgacaaa

SEQ ID NO: 1385297 - RNA, 19 nt, Homo sapiens
caucuuccauccuuucaua

SEQ ID NO: 1385298 - RNA, 19 nt, Homo sapiens
gaaauuacagugccuacuu

SEQ ID NO: 1385299 - RNA, 19 nt, Homo sapiens
gagcugaaccugccuauca

SEQ ID NO: 1385300 - RNA, 19 nt, Homo sapiens
caagaaggcugagauggau

SEQ ID NO: 1385301 - RNA, 19 nt, Homo sapiens
aagaagagauagcgacuug

SEQ ID NO: 1385302 - RNA, 19 nt, Homo sapiens
gaacgugagcuggaaauug

SEQ ID NO: 1385303 - RNA, 19 nt, Homo sapiens
cuaagaaacccuaccguaa

SEQ ID NO: 1385304 - RNA, 19 nt, Homo sapiens
ggugaugguguaauuguua

SEQ ID NO: 1385305 - RNA, 19 nt, Homo sapiens
gaaccugacucuggcuuuc

SEQ ID NO: 1385306 - RNA, 19 nt, Homo sapiens
ggaggagaaugaagagcuu

SEQ ID NO: 1385307 - RNA, 19 nt, Homo sapiens
ggacaugguucggaaacau

SEQ ID NO: 1385308 - RNA, 19 nt, Homo sapiens
ggacaaauuuaaggauaag

SEQ ID NO: 1385309 - RNA, 19 nt, Homo sapiens
gcucuagacuguuacucuu

SEQ ID NO: 1385310 - RNA, 19 nt, Homo sapiens
gagcugcguuuggaaauuc

SEQ ID NO: 1385311 - RNA, 19 nt, Homo sapiens
guauucaucuuccauccuu

SEQ ID NO: 1385312 - RNA, 19 nt, Homo sapiens
cagaaaggaugaagcucuu

SEQ ID NO: 1385313 - RNA, 19 nt, Homo sapiens
ggagcugcguuuggaaauu

SEQ ID NO: 1385314 - RNA, 19 nt, Homo sapiens
ccaagaacaccaucaacaa

SEQ ID NO: 1385315 - RNA, 19 nt, Homo sapiens
gaggagcuggacaaauuua

SEQ ID NO: 1385316 - RNA, 19 nt, Homo sapiens
gugaugguguaauuguuaa

SEQ ID NO: 1385317 - RNA, 19 nt, Homo sapiens
ucuagacuguuacucuuaa

SEQ ID NO: 1385318 - RNA, 19 nt, Homo sapiens
cuggacaaauuuaaggaua

SEQ ID NO: 1385319 - RNA, 19 nt, Homo sapiens
gcagcuugccucaugguuu

SEQ ID NO: 1385320 - RNA, 19 nt, Homo sapiens
agucauugcccgaguguua

SEQ ID NO: 1385321 - RNA, 19 nt, Homo sapiens
aaauuacagugccuacuug

SEQ ID NO: 1385322 - RNA, 19 nt, Homo sapiens
ccuuggcucuagacuguua

SEQ ID NO: 1385323 - RNA, 19 nt, Homo sapiens
aggcugagauggauaggaa

SEQ ID NO: 1385324 - RNA, 19 nt, Homo sapiens
uaagaaacccuaccguaag

SEQ ID NO: 1385325 - RNA, 19 nt, Homo sapiens
ggacagcggaacagagaga

SEQ ID NO: 1385326 - RNA, 19 nt, Homo sapiens
gugccuaccucagucauug

SEQ ID NO: 1385327 - RNA, 19 nt, Homo sapiens
ucaagaaggcugagaugga

SEQ ID NO: 1385328 - RNA, 19 nt, Homo sapiens
gaucaagaaggcugagaug

SEQ ID NO: 1385329 - RNA, 19 nt, Homo sapiens
gagcgggagcuguggcuaa

SEQ ID NO: 1385330 - RNA, 19 nt, Homo sapiens
aaccuuggcucuagacugu

SEQ ID NO: 1385331 - RNA, 19 nt, Homo sapiens
cucaagaccuuuccuccaa

SEQ ID NO: 1385332 - RNA, 19 nt, Homo sapiens
caagaacaccaucaacaag

SEQ ID NO: 1385333 - RNA, 19 nt, Homo sapiens
uuacagugccuacuuggaa

SEQ ID NO: 1385334 - RNA, 19 nt, Homo sapiens
caagcugggcucuguguga

SEQ ID NO: 1385335 - RNA, 19 nt, Homo sapiens
gaguuuaucaguauucauc

SEQ ID NO: 1385336 - RNA, 19 nt, Homo sapiens
caagaccuuuccuccaauc

SEQ ID NO: 1385337 - RNA, 19 nt, Homo sapiens
ccacaaguuugccgaucug

SEQ ID NO: 1385338 - RNA, 19 nt, Homo sapiens
gguaccggcuggacugcaa

SEQ ID NO: 1385339 - RNA, 19 nt, Homo sapiens
ggacgagggagaggacuga

SEQ ID NO: 1385340 - RNA, 19 nt, Homo sapiens
uuggaaagaagaagagaua

SEQ ID NO: 1385341 - RNA, 19 nt, Homo sapiens
gaaaggaugaagcucuuac

SEQ ID NO: 1385342 - RNA, 19 nt, Homo sapiens
gccgucaccucccagaaug

SEQ ID NO: 1385343 - RNA, 19 nt, Homo sapiens
guuaaccucauuuccguuu

SEQ ID NO: 1385344 - RNA, 19 nt, Homo sapiens
gccaagaacaccaucaaca

SEQ ID NO: 1385345 - RNA, 19 nt, Homo sapiens
ugcagcagcuugccucaug

SEQ ID NO: 1385346 - RNA, 19 nt, Homo sapiens
agggcaaccugcucaacua

SEQ ID NO: 1385347 - RNA, 19 nt, Homo sapiens
cagagccugcugcccauua

SEQ ID NO: 1385348 - RNA, 19 nt, Homo sapiens
gacaagcugcacacacuga

SEQ ID NO: 1385349 - RNA, 19 nt, Homo sapiens
aacgugagcuggaaauugg

SEQ ID NO: 1385350 - RNA, 19 nt, Homo sapiens
cgagggagaggacugauuc

SEQ ID NO: 1385351 - RNA, 19 nt, Homo sapiens
uacagugccuacuuggaaa

SEQ ID NO: 1385352 - RNA, 19 nt, Homo sapiens
gggugaugguguaauuguu

SEQ ID NO: 1385353 - RNA, 19 nt, Homo sapiens
aagcuuagaucagccuuuc

SEQ ID NO: 1385354 - RNA, 19 nt, Homo sapiens
cuguacagcuccucaagug

SEQ ID NO: 1385355 - RNA, 19 nt, Homo sapiens
ucaagaccuuuccuccaau

SEQ ID NO: 1385356 - RNA, 19 nt, Homo sapiens
gaagaagagauagcgacuu

SEQ ID NO: 1385357 - RNA, 19 nt, Homo sapiens
cagcuugccucaugguuuu

SEQ ID NO: 1385358 - RNA, 19 nt, Homo sapiens
agagccugcugcccauuaa

SEQ ID NO: 1385359 - RNA, 19 nt, Homo sapiens
uugccgaucugcccuguga

SEQ ID NO: 1385360 - RNA, 19 nt, Homo sapiens
ggacugcaacccggcugua

SEQ ID NO: 1385361 - RNA, 19 nt, Homo sapiens
acucuuaagcuuugagaaa

SEQ ID NO: 1385362 - RNA, 19 nt, Homo sapiens
gacaugguucggaaacauu

SEQ ID NO: 1385363 - RNA, 19 nt, Homo sapiens
ugcacacacugaucaagaa

SEQ ID NO: 1385364 - RNA, 19 nt, Homo sapiens
aagaaacccuaccguaagg

SEQ ID NO: 1385365 - RNA, 19 nt, Homo sapiens
gacuguuacucuuaagcuu

SEQ ID NO: 1385366 - RNA, 19 nt, Homo sapiens
acaaacagacguccagagu

SEQ ID NO: 1385367 - RNA, 19 nt, Homo sapiens
cccuugaccucuccucuau

SEQ ID NO: 1385368 - RNA, 19 nt, Homo sapiens
cgaggagcuggacaaauuu

SEQ ID NO: 1385369 - RNA, 19 nt, Homo sapiens
ggaaagaagaagagauagc

SEQ ID NO: 1385370 - RNA, 19 nt, Homo sapiens
ugaggaguuuaucaguauu

SEQ ID NO: 1385371 - RNA, 19 nt, Homo sapiens
ucucugagccugccuccuu

SEQ ID NO: 1385372 - RNA, 19 nt, Homo sapiens
ggaacgugagcuggaaauu

SEQ ID NO: 1385373 - RNA, 19 nt, Homo sapiens
gcucaauucagcccaguca

SEQ ID NO: 1385374 - RNA, 19 nt, Homo sapiens
gcugagauggauaggaaga

SEQ ID NO: 1385375 - RNA, 19 nt, Homo sapiens
gagcuggacaaauuuaagg

SEQ ID NO: 1385376 - RNA, 19 nt, Homo sapiens
cuguuacucuuaagcuuug

SEQ ID NO: 1385377 - RNA, 19 nt, Homo sapiens
gcccuugaccucuccucua

SEQ ID NO: 1385378 - RNA, 19 nt, Homo sapiens
ucaccucccagaaugacua

SEQ ID NO: 1385379 - RNA, 19 nt, Homo sapiens
ccucaugguuuucccuuuu

SEQ ID NO: 1385380 - RNA, 19 nt, Homo sapiens
ggagcuggacaaauuuaag

SEQ ID NO: 1385381 - RNA, 19 nt, Homo sapiens
gaggaguuuaucaguauuc

SEQ ID NO: 1385382 - RNA, 19 nt, Homo sapiens
ucagagguaacaugcaguu

SEQ ID NO: 1385383 - RNA, 19 nt, Homo sapiens
ggcugaggaugucuuugug

SEQ ID NO: 1385384 - RNA, 19 nt, Homo sapiens
ggagcuguggcuaaaggaa

SEQ ID NO: 1385385 - RNA, 19 nt, Homo sapiens
uacaggaggagaaugaaga

SEQ ID NO: 1385386 - RNA, 19 nt, Homo sapiens
ccggacagcggaacagaga

SEQ ID NO: 1385387 - RNA, 19 nt, Homo sapiens
cuacuuggaaagaagaaga

SEQ ID NO: 1385388 - RNA, 19 nt, Homo sapiens
agucucuacugcucaauuc

SEQ ID NO: 1385389 - RNA, 19 nt, Homo sapiens
gagucucuacugcucaauu

SEQ ID NO: 1385390 - RNA, 19 nt, Homo sapiens
cggagucucuacugcucaa

SEQ ID NO: 1385391 - RNA, 19 nt, Homo sapiens
gugccuacuuggaaagaag

SEQ ID NO: 1385392 - RNA, 19 nt, Homo sapiens
acgcuggacugggagauug

SEQ ID NO: 1385393 - RNA, 19 nt, Homo sapiens
gcacacacugaucaagaag

SEQ ID NO: 1385394 - RNA, 19 nt, Homo sapiens
aggacaagcugcacacacu

SEQ ID NO: 1385395 - RNA, 19 nt, Homo sapiens
gaaggucucugaauuaaga

SEQ ID NO: 1385396 - RNA, 19 nt, Homo sapiens
ccaacacgcugcccaauua

SEQ ID NO: 1385397 - RNA, 19 nt, Homo sapiens
gcagagagguccauuccaa

SEQ ID NO: 1385398 - RNA, 19 nt, Homo sapiens
gcaaugggcugcaguuaag

SEQ ID NO: 1385399 - RNA, 19 nt, Homo sapiens
gcgaagagccucacuuuga

SEQ ID NO: 1385400 - RNA, 19 nt, Homo sapiens
caacaucgauuuccuggau

SEQ ID NO: 1385401 - RNA, 19 nt, Homo sapiens
ucaaugaacucaccuggaa

SEQ ID NO: 1385402 - RNA, 19 nt, Homo sapiens
gauaauggauggauucucu

SEQ ID NO: 1385403 - RNA, 19 nt, Homo sapiens
gaggaucacucaugucuuc

SEQ ID NO: 1385404 - RNA, 19 nt, Homo sapiens
gaacagauggucagaaauc

SEQ ID NO: 1385405 - RNA, 19 nt, Homo sapiens
uaacacagccuccauccua

SEQ ID NO: 1385406 - RNA, 19 nt, Homo sapiens
aaacuggugucucuucuuu

SEQ ID NO: 1385407 - RNA, 19 nt, Homo sapiens
gguuuacacucuucugaua

SEQ ID NO: 1385408 - RNA, 19 nt, Homo sapiens
caacaacccucacuuucug

SEQ ID NO: 1385409 - RNA, 19 nt, Homo sapiens
guuaagacuucaacaaaga

SEQ ID NO: 1385410 - RNA, 19 nt, Homo sapiens
gaauaacuguucagagaag

SEQ ID NO: 1385411 - RNA, 19 nt, Homo sapiens
gaaaacauuuggauaguga

SEQ ID NO: 1385412 - RNA, 19 nt, Homo sapiens
uaagucaaguucagcaauu

SEQ ID NO: 1385413 - RNA, 19 nt, Homo sapiens
ggaaccaaaugaacagaug

SEQ ID NO: 1385414 - RNA, 19 nt, Homo sapiens
ggaugucacugaucucaau

SEQ ID NO: 1385415 - RNA, 19 nt, Homo sapiens
gagcgaagagccucacuuu

SEQ ID NO: 1385416 - RNA, 19 nt, Homo sapiens
ggucagaaauccaaacucu

SEQ ID NO: 1385417 - RNA, 19 nt, Homo sapiens
aggaauaacuguucagaga

SEQ ID NO: 1385418 - RNA, 19 nt, Homo sapiens
gaucacucaugucuucaaa

SEQ ID NO: 1385419 - RNA, 19 nt, Homo sapiens
ggagucagcagauggauga

SEQ ID NO: 1385420 - RNA, 19 nt, Homo sapiens
gaucaaaccaauguacuuu

SEQ ID NO: 1385421 - RNA, 19 nt, Homo sapiens
cauaauaccaccacugaaa

SEQ ID NO: 1385422 - RNA, 19 nt, Homo sapiens
agaagaagccgcugccuuu

SEQ ID NO: 1385423 - RNA, 19 nt, Homo sapiens
caacagugccgacuugguu

SEQ ID NO: 1385424 - RNA, 19 nt, Homo sapiens
cgaagagccucacuuugau

SEQ ID NO: 1385425 - RNA, 19 nt, Homo sapiens
caacugcuguccucaccaa

SEQ ID NO: 1385426 - RNA, 19 nt, Homo sapiens
gcccacagcacaucaguuu

SEQ ID NO: 1385427 - RNA, 19 nt, Homo sapiens
ggaauaacuguucagagaa

SEQ ID NO: 1385428 - RNA, 19 nt, Homo sapiens
acaagaugcugguggagaa

SEQ ID NO: 1385429 - RNA, 19 nt, Homo sapiens
gcaucuugaagucuuauua

SEQ ID NO: 1385430 - RNA, 19 nt, Homo sapiens
agcagaaggugaucaauga

SEQ ID NO: 1385431 - RNA, 19 nt, Homo sapiens
cugaaggucucugaauuaa

SEQ ID NO: 1385432 - RNA, 19 nt, Homo sapiens
gugcaacagugccgacuug

SEQ ID NO: 1385433 - RNA, 19 nt, Homo sapiens
aaaccaauguacuuucuuc

SEQ ID NO: 1385434 - RNA, 19 nt, Homo sapiens
ggaaagaugagugauguca

SEQ ID NO: 1385435 - RNA, 19 nt, Homo sapiens
cagaucaguuuuacaguua

SEQ ID NO: 1385436 - RNA, 19 nt, Homo sapiens
caacggcuucuaccacuuu

SEQ ID NO: 1385437 - RNA, 19 nt, Homo sapiens
uaaccuggaugaucugaag

SEQ ID NO: 1385438 - RNA, 19 nt, Homo sapiens
gcuuaaauaucaccaguac

SEQ ID NO: 1385439 - RNA, 19 nt, Homo sapiens
ccaggugaguuucuccaaa

SEQ ID NO: 1385440 - RNA, 19 nt, Homo sapiens
ggaccucacuccgccaaau

SEQ ID NO: 1385441 - RNA, 19 nt, Homo sapiens
uagagaggaucacucaugu

SEQ ID NO: 1385442 - RNA, 19 nt, Homo sapiens
cugcacagauggcugguuu

SEQ ID NO: 1385443 - RNA, 19 nt, Homo sapiens
gaaaaggaauaacuguuca

SEQ ID NO: 1385444 - RNA, 19 nt, Homo sapiens
ucugaaggucucugaauua

SEQ ID NO: 1385445 - RNA, 19 nt, Homo sapiens
ggaucagacucgaagugaa

SEQ ID NO: 1385446 - RNA, 19 nt, Homo sapiens
ugaauuccaugagcaaaga

SEQ ID NO: 1385447 - RNA, 19 nt, Homo sapiens
uaggaaagaugagugaugu

SEQ ID NO: 1385448 - RNA, 19 nt, Homo sapiens
gcccucggcuuccuuugaa

SEQ ID NO: 1385449 - RNA, 19 nt, Homo sapiens
gaaauccaaacucuucuuc

SEQ ID NO: 1385450 - RNA, 19 nt, Homo sapiens
ucagaaauccaaacucuuc

SEQ ID NO: 1385451 - RNA, 19 nt, Homo sapiens
ccaaaggugaagaagcuua

SEQ ID NO: 1385452 - RNA, 19 nt, Homo sapiens
caggugaguuucuccaaau

SEQ ID NO: 1385453 - RNA, 19 nt, Homo sapiens
ccggacaccuucaaugaug

SEQ ID NO: 1385454 - RNA, 19 nt, Homo sapiens
gacaacagcuucgaauucg

SEQ ID NO: 1385455 - RNA, 19 nt, Homo sapiens
aauccaaacucuucuucaa

SEQ ID NO: 1385456 - RNA, 19 nt, Homo sapiens
caaaggugaagaagcuuaa

SEQ ID NO: 1385457 - RNA, 19 nt, Homo sapiens
gaaacguccagcugaauuc

SEQ ID NO: 1385458 - RNA, 19 nt, Homo sapiens
cuaugaagaugccguaaag

SEQ ID NO: 1385459 - RNA, 19 nt, Homo sapiens
caccuaaccuggaugaucu

SEQ ID NO: 1385460 - RNA, 19 nt, Homo sapiens
gugccgacuugguuaauau

SEQ ID NO: 1385461 - RNA, 19 nt, Homo sapiens
ucacuuugaugggauaaug

SEQ ID NO: 1385462 - RNA, 19 nt, Homo sapiens
guacuuucuuccacauuuc

SEQ ID NO: 1385463 - RNA, 19 nt, Homo sapiens
gcucaacuccagccucuug

SEQ ID NO: 1385464 - RNA, 19 nt, Homo sapiens
caguuaagacuucaacaaa

SEQ ID NO: 1385465 - RNA, 19 nt, Homo sapiens
gcaacccagugccgaacuu

SEQ ID NO: 1385466 - RNA, 19 nt, Homo sapiens
caacgccacugagcaauac

SEQ ID NO: 1385467 - RNA, 19 nt, Homo sapiens
augaacagauggucagaaa

SEQ ID NO: 1385468 - RNA, 19 nt, Homo sapiens
ggugaagaagcuuaaauau

SEQ ID NO: 1385469 - RNA, 19 nt, Homo sapiens
ucaaaccaauguacuuucu

SEQ ID NO: 1385470 - RNA, 19 nt, Homo sapiens
caaagcagcagcucagagu

SEQ ID NO: 1385471 - RNA, 19 nt, Homo sapiens
ccaaguaccugugaaaaga

SEQ ID NO: 1385472 - RNA, 19 nt, Homo sapiens
gaucugaaggucucugaau

SEQ ID NO: 1385473 - RNA, 19 nt, Homo sapiens
gaaaugacucagccucaca

SEQ ID NO: 1385474 - RNA, 19 nt, Homo sapiens
gggcugcaguuaagcuuca

SEQ ID NO: 1385475 - RNA, 19 nt, Homo sapiens
caaugcacaugagaucuug

SEQ ID NO: 1385476 - RNA, 19 nt, Homo sapiens
ggcauaauaccaccacuga

SEQ ID NO: 1385477 - RNA, 19 nt, Homo sapiens
gagaggaucacucaugucu

SEQ ID NO: 1385478 - RNA, 19 nt, Homo sapiens
uguacuuucuuccacauuu

SEQ ID NO: 1385479 - RNA, 19 nt, Homo sapiens
gugaagaagcuuaaauauc

SEQ ID NO: 1385480 - RNA, 19 nt, Homo sapiens
ccgaugaucucaaugaaaa

SEQ ID NO: 1385481 - RNA, 19 nt, Homo sapiens
ccauggaccuucacuugca

SEQ ID NO: 1385482 - RNA, 19 nt, Homo sapiens
gaagagccucacuuugaug

SEQ ID NO: 1385483 - RNA, 19 nt, Homo sapiens
agacaacagcuucgaauuc

SEQ ID NO: 1385484 - RNA, 19 nt, Homo sapiens
gaucagacucgaagugaag

SEQ ID NO: 1385485 - RNA, 19 nt, Homo sapiens
ugagcaucuugaagucuua

SEQ ID NO: 1385486 - RNA, 19 nt, Homo sapiens
acagauggcugguuuacac

SEQ ID NO: 1385487 - RNA, 19 nt, Homo sapiens
ggagcaaguucagaucagu

SEQ ID NO: 1385488 - RNA, 19 nt, Homo sapiens
ugucacugaucucaauuug

SEQ ID NO: 1385489 - RNA, 19 nt, Homo sapiens
ugaaacguccagcugaauu

SEQ ID NO: 1385490 - RNA, 19 nt, Homo sapiens
gaagaagcuuaaauaucac

SEQ ID NO: 1385491 - RNA, 19 nt, Homo sapiens
gcagaaggugaucaaugaa

SEQ ID NO: 1385492 - RNA, 19 nt, Homo sapiens
uggugucucuucuuucaaa

SEQ ID NO: 1385493 - RNA, 19 nt, Homo sapiens
ucaacgccacugagcaaua

SEQ ID NO: 1385494 - RNA, 19 nt, Homo sapiens
cuagagaggaucacucaug

SEQ ID NO: 1385495 - RNA, 19 nt, Homo sapiens
caacauguaugcucaguag

SEQ ID NO: 1385496 - RNA, 19 nt, Homo sapiens
gaucucggcuuuggauauu

SEQ ID NO: 1385497 - RNA, 19 nt, Homo sapiens
ugaaugcuauccuugcaaa

SEQ ID NO: 1385498 - RNA, 19 nt, Homo sapiens
aggauaagcugcugagguu

SEQ ID NO: 1385499 - RNA, 19 nt, Homo sapiens
guucguggcucugguauuc

SEQ ID NO: 1385500 - RNA, 19 nt, Homo sapiens
cgccaaagauggagggaau

SEQ ID NO: 1385501 - RNA, 19 nt, Homo sapiens
gcccagaucucggcuuugg

SEQ ID NO: 1385502 - RNA, 19 nt, Homo sapiens
ggauccugcugaaugcuau

SEQ ID NO: 1385503 - RNA, 19 nt, Homo sapiens
ugagucgccuggagaacuu

SEQ ID NO: 1385504 - RNA, 19 nt, Homo sapiens
gcugaaugcuauccuugca

SEQ ID NO: 1385505 - RNA, 19 nt, Homo sapiens
aaagauggagggaauguca

SEQ ID NO: 1385506 - RNA, 19 nt, Homo sapiens
ucaagauggucauguacuc

SEQ ID NO: 1385507 - RNA, 19 nt, Homo sapiens
gcgcagggcauggaagguu

SEQ ID NO: 1385508 - RNA, 19 nt, Homo sapiens
cuacgaggccuuccugagu

SEQ ID NO: 1385509 - RNA, 19 nt, Homo sapiens
cccucaagauggucaugua

SEQ ID NO: 1385510 - RNA, 19 nt, Homo sapiens
gcccguggcugaggauaag

SEQ ID NO: 1385511 - RNA, 19 nt, Homo sapiens
ccagaucucggcuuuggau

SEQ ID NO: 1385512 - RNA, 19 nt, Homo sapiens
ccaaagauggagggaaugu

SEQ ID NO: 1385513 - RNA, 19 nt, Homo sapiens
ccagcaagcccacggucuu

SEQ ID NO: 1385514 - RNA, 19 nt, Homo sapiens
gggauccugcugaaugcua

SEQ ID NO: 1385515 - RNA, 19 nt, Homo sapiens
ccauggacccacacaagga

SEQ ID NO: 1385516 - RNA, 19 nt, Homo sapiens
gaaucccgccaaagaugga

SEQ ID NO: 1385517 - RNA, 19 nt, Homo sapiens
caagauggucauguacuca

SEQ ID NO: 1385518 - RNA, 19 nt, Homo sapiens
uugcccagaucucggcuuu

SEQ ID NO: 1385519 - RNA, 19 nt, Homo sapiens
gguguucguggcucuggua

SEQ ID NO: 1385520 - RNA, 19 nt, Homo sapiens
ccaacauguaugcucagua

SEQ ID NO: 1385521 - RNA, 19 nt, Homo sapiens
caacauguaugcucaguag

SEQ ID NO: 1385522 - RNA, 19 nt, Homo sapiens
gaucucggcuuuggauauu

SEQ ID NO: 1385523 - RNA, 19 nt, Homo sapiens
ugaaugcuauccuugcaaa

SEQ ID NO: 1385524 - RNA, 19 nt, Homo sapiens
aggauaagcugcugagguu

SEQ ID NO: 1385525 - RNA, 19 nt, Homo sapiens
cgccaaagauggagggaau

SEQ ID NO: 1385526 - RNA, 19 nt, Homo sapiens
gcccagaucucggcuuugg

SEQ ID NO: 1385527 - RNA, 19 nt, Homo sapiens
ggauccugcugaaugcuau

SEQ ID NO: 1385528 - RNA, 19 nt, Homo sapiens
ugagucgccuggagaacuu

SEQ ID NO: 1385529 - RNA, 19 nt, Homo sapiens
gcugaaugcuauccuugca

SEQ ID NO: 1385530 - RNA, 19 nt, Homo sapiens
aaagauggagggaauguca

SEQ ID NO: 1385531 - RNA, 19 nt, Homo sapiens
ucaagauggucauguacuc

SEQ ID NO: 1385532 - RNA, 19 nt, Homo sapiens
cuacgaggccuuccugagu

SEQ ID NO: 1385533 - RNA, 19 nt, Homo sapiens
gcgcagggcauggaagguu

SEQ ID NO: 1385534 - RNA, 19 nt, Homo sapiens
cccucaagauggucaugua

SEQ ID NO: 1385535 - RNA, 19 nt, Homo sapiens
gcccguggcugaggauaag

SEQ ID NO: 1385536 - RNA, 19 nt, Homo sapiens
ccagaucucggcuuuggau

SEQ ID NO: 1385537 - RNA, 19 nt, Homo sapiens
ccaaagauggagggaaugu

SEQ ID NO: 1385538 - RNA, 19 nt, Homo sapiens
ccagcaagcccacggucuu

SEQ ID NO: 1385539 - RNA, 19 nt, Homo sapiens
gggauccugcugaaugcua

SEQ ID NO: 1385540 - RNA, 19 nt, Homo sapiens
ccauggacccacacaagga

SEQ ID NO: 1385541 - RNA, 19 nt, Homo sapiens
gaaucccgccaaagaugga

SEQ ID NO: 1385542 - RNA, 19 nt, Homo sapiens
caagauggucauguacuca

SEQ ID NO: 1385543 - RNA, 19 nt, Homo sapiens
uugcccagaucucggcuuu

SEQ ID NO: 1385544 - RNA, 19 nt, Homo sapiens
ccaacauguaugcucagua

SEQ ID NO: 1385545 - RNA, 19 nt, Homo sapiens
caacauguaugcucaguag

SEQ ID NO: 1385546 - RNA, 19 nt, Homo sapiens
ugaaugcuauccuugcaaa

SEQ ID NO: 1385547 - RNA, 19 nt, Homo sapiens
aggauaagcugcugagguu

SEQ ID NO: 1385548 - RNA, 19 nt, Homo sapiens
cgccaaagauggagggaau

SEQ ID NO: 1385549 - RNA, 19 nt, Homo sapiens
ggauccugcugaaugcuau

SEQ ID NO: 1385550 - RNA, 19 nt, Homo sapiens
ugagucgccuggagaacuu

SEQ ID NO: 1385551 - RNA, 19 nt, Homo sapiens
gcugaaugcuauccuugca

SEQ ID NO: 1385552 - RNA, 19 nt, Homo sapiens
aaagauggagggaauguca

SEQ ID NO: 1385553 - RNA, 19 nt, Homo sapiens
ucaagauggucauguacuc

SEQ ID NO: 1385554 - RNA, 19 nt, Homo sapiens
cuacgaggccuuccugagu

SEQ ID NO: 1385555 - RNA, 19 nt, Homo sapiens
gcgcagggcauggaagguu

SEQ ID NO: 1385556 - RNA, 19 nt, Homo sapiens
cccucaagauggucaugua

SEQ ID NO: 1385557 - RNA, 19 nt, Homo sapiens
gcccguggcugaggauaag

SEQ ID NO: 1385558 - RNA, 19 nt, Homo sapiens
ccaaagauggagggaaugu

SEQ ID NO: 1385559 - RNA, 19 nt, Homo sapiens
ccauggacccacacaagga

SEQ ID NO: 1385560 - RNA, 19 nt, Homo sapiens
gggauccugcugaaugcua

SEQ ID NO: 1385561 - RNA, 19 nt, Homo sapiens
gaaucccgccaaagaugga

SEQ ID NO: 1385562 - RNA, 19 nt, Homo sapiens
caagauggucauguacuca

SEQ ID NO: 1385563 - RNA, 19 nt, Homo sapiens
ccaacauguaugcucagua

SEQ ID NO: 1385564 - RNA, 19 nt, Homo sapiens
caacauguaugcucaguag

SEQ ID NO: 1385565 - RNA, 19 nt, Homo sapiens
gaucucggcuuuggauauu

SEQ ID NO: 1385566 - RNA, 19 nt, Homo sapiens
ugaaugcuauccuugcaaa

SEQ ID NO: 1385567 - RNA, 19 nt, Homo sapiens
guucguggcucugguauuc

SEQ ID NO: 1385568 - RNA, 19 nt, Homo sapiens
cgccaaagauggagggaau

SEQ ID NO: 1385569 - RNA, 19 nt, Homo sapiens
gcccagaucucggcuuugg

SEQ ID NO: 1385570 - RNA, 19 nt, Homo sapiens
ggauccugcugaaugcuau

SEQ ID NO: 1385571 - RNA, 19 nt, Homo sapiens
ugagucgccuggagaacuu

SEQ ID NO: 1385572 - RNA, 19 nt, Homo sapiens
gcugaaugcuauccuugca

SEQ ID NO: 1385573 - RNA, 19 nt, Homo sapiens
aaagauggagggaauguca

SEQ ID NO: 1385574 - RNA, 19 nt, Homo sapiens
ucaagauggucauguacuc

SEQ ID NO: 1385575 - RNA, 19 nt, Homo sapiens
gcgcagggcauggaagguu

SEQ ID NO: 1385576 - RNA, 19 nt, Homo sapiens
cccucaagauggucaugua

SEQ ID NO: 1385577 - RNA, 19 nt, Homo sapiens
ccagaucucggcuuuggau

SEQ ID NO: 1385578 - RNA, 19 nt, Homo sapiens
ccaaagauggagggaaugu

SEQ ID NO: 1385579 - RNA, 19 nt, Homo sapiens
ccagcaagcccacggucuu

SEQ ID NO: 1385580 - RNA, 19 nt, Homo sapiens
ccauggacccacacaagga

SEQ ID NO: 1385581 - RNA, 19 nt, Homo sapiens
gggauccugcugaaugcua

SEQ ID NO: 1385582 - RNA, 19 nt, Homo sapiens
gaaucccgccaaagaugga

SEQ ID NO: 1385583 - RNA, 19 nt, Homo sapiens
caagauggucauguacuca

SEQ ID NO: 1385584 - RNA, 19 nt, Homo sapiens
gguguucguggcucuggua

SEQ ID NO: 1385585 - RNA, 19 nt, Homo sapiens
uugcccagaucucggcuuu

SEQ ID NO: 1385586 - RNA, 19 nt, Homo sapiens
ccaacauguaugcucagua

SEQ ID NO: 1385587 - RNA, 19 nt, Homo sapiens
gcucucagcugucaaugug

SEQ ID NO: 1385588 - RNA, 19 nt, Homo sapiens
caauaaaggcuucucaauc

SEQ ID NO: 1385589 - RNA, 19 nt, Homo sapiens
aauaaaggcuucucaaucc

SEQ ID NO: 1385590 - RNA, 19 nt, Homo sapiens
acaauaaaggcuucucaau

SEQ ID NO: 1385591 - RNA, 19 nt, Homo sapiens
ccacaauaaaggcuucuca

SEQ ID NO: 1385592 - RNA, 19 nt, Homo sapiens
ccgauccucccacaauaaa

SEQ ID NO: 1385593 - RNA, 19 nt, Homo sapiens
gauccucccacaauaaagg

SEQ ID NO: 1385594 - RNA, 19 nt, Homo sapiens
cgucaacaccaccaucugu

SEQ ID NO: 1385595 - RNA, 19 nt, Homo sapiens
cacaauaaaggcuucucaa

SEQ ID NO: 1385596 - RNA, 19 nt, Homo sapiens
gaugaucucugucugcuua

SEQ ID NO: 1385597 - RNA, 19 nt, Homo sapiens
ggugauguauccuaaauua

SEQ ID NO: 1385598 - RNA, 19 nt, Homo sapiens
gaaagaaagcuuggaaaua

SEQ ID NO: 1385599 - RNA, 19 nt, Homo sapiens
caaguuaacccauuucuaa

SEQ ID NO: 1385600 - RNA, 19 nt, Homo sapiens
gaacacuccucauuucaga

SEQ ID NO: 1385601 - RNA, 19 nt, Homo sapiens
aaagaaagcuuggaaauag

SEQ ID NO: 1385602 - RNA, 19 nt, Homo sapiens
caaccaaacaugacacuua

SEQ ID NO: 1385603 - RNA, 19 nt, Homo sapiens
ugaaagacauccaaaguca

SEQ ID NO: 1385604 - RNA, 19 nt, Homo sapiens
ccaaguaacgggaagaaua

SEQ ID NO: 1385605 - RNA, 19 nt, Homo sapiens
gaagaucacaacuaugaaa

SEQ ID NO: 1385606 - RNA, 19 nt, Homo sapiens
ggacaaggaaagaguaauu

SEQ ID NO: 1385607 - RNA, 19 nt, Homo sapiens
ccaaggaccugaaagaaag

SEQ ID NO: 1385608 - RNA, 19 nt, Homo sapiens
ggaaauaguuaaccaagcu

SEQ ID NO: 1385609 - RNA, 19 nt, Homo sapiens
gcaacuggauaauauaaag

SEQ ID NO: 1385610 - RNA, 19 nt, Homo sapiens
gauacucucugacuugaau

SEQ ID NO: 1385611 - RNA, 19 nt, Homo sapiens
ccaaagucaugguaucauu

SEQ ID NO: 1385612 - RNA, 19 nt, Homo sapiens
guaaaugccuuugaugauc

SEQ ID NO: 1385613 - RNA, 19 nt, Homo sapiens
gaacggacuuuggaaaucu

SEQ ID NO: 1385614 - RNA, 19 nt, Homo sapiens
cuugauagcuugcauugaa

SEQ ID NO: 1385615 - RNA, 19 nt, Homo sapiens
aaagguggcucauggaaug

SEQ ID NO: 1385616 - RNA, 19 nt, Homo sapiens
caagaaguguguugugcaa

SEQ ID NO: 1385617 - RNA, 19 nt, Homo sapiens
ggaagaauuacaggaguua

SEQ ID NO: 1385618 - RNA, 19 nt, Homo sapiens
cauugaagaucacaacuau

SEQ ID NO: 1385619 - RNA, 19 nt, Homo sapiens
gcagaauaccugagaguug

SEQ ID NO: 1385620 - RNA, 19 nt, Homo sapiens
gaaggacaaggaaagagua

SEQ ID NO: 1385621 - RNA, 19 nt, Homo sapiens
ggaacggacuuuggaaauc

SEQ ID NO: 1385622 - RNA, 19 nt, Homo sapiens
gcucagaccuugccagacu

SEQ ID NO: 1385623 - RNA, 19 nt, Homo sapiens
ccaaugaagcccugagaaa

SEQ ID NO: 1385624 - RNA, 19 nt, Homo sapiens
caaguaacgggaagaauau

SEQ ID NO: 1385625 - RNA, 19 nt, Homo sapiens
cagaauaccugagaguugu

SEQ ID NO: 1385626 - RNA, 19 nt, Homo sapiens
guaauucgcagacuguuau

SEQ ID NO: 1385627 - RNA, 19 nt, Homo sapiens
gaaagcuuggaaauaguua

SEQ ID NO: 1385628 - RNA, 19 nt, Homo sapiens
gaauugcuccugguaacua

SEQ ID NO: 1385629 - RNA, 19 nt, Homo sapiens
uuacaggaguuauccaaug

SEQ ID NO: 1385630 - RNA, 19 nt, Homo sapiens
gcauugaagaucacaacua

SEQ ID NO: 1385631 - RNA, 19 nt, Homo sapiens
guaugugaaugaccacuau

SEQ ID NO: 1385632 - RNA, 19 nt, Homo sapiens
ggaaagguggcucauggaa

SEQ ID NO: 1385633 - RNA, 19 nt, Homo sapiens
uacaggaguuauccaauga

SEQ ID NO: 1385634 - RNA, 19 nt, Homo sapiens
ugaaugaccacuauccaaa

SEQ ID NO: 1385635 - RNA, 19 nt, Homo sapiens
aaauaugaccugcuucaaa

SEQ ID NO: 1385636 - RNA, 19 nt, Homo sapiens
uaaagaauugcuccuggua

SEQ ID NO: 1385637 - RNA, 19 nt, Homo sapiens
gaaauccaguacucuuguc

SEQ ID NO: 1385638 - RNA, 19 nt, Homo sapiens
gaaagguggcucauggaau

SEQ ID NO: 1385639 - RNA, 19 nt, Homo sapiens
caagagaacaaauuucaag

SEQ ID NO: 1385640 - RNA, 19 nt, Homo sapiens
ugaaagaaagcuuggaaau

SEQ ID NO: 1385641 - RNA, 19 nt, Homo sapiens
gaucacaacuaugaaacag

SEQ ID NO: 1385642 - RNA, 19 nt, Homo sapiens
ggaaauccaguacucuugu

SEQ ID NO: 1385643 - RNA, 19 nt, Homo sapiens
uaaaugccuuugaugaucu

SEQ ID NO: 1385644 - RNA, 19 nt, Homo sapiens
acuugaaucuggugaugua

SEQ ID NO: 1385645 - RNA, 19 nt, Homo sapiens
gcaagagaacaaauuucaa

SEQ ID NO: 1385646 - RNA, 19 nt, Homo sapiens
gaagagcaagagaacaaau

SEQ ID NO: 1385647 - RNA, 19 nt, Homo sapiens
uugaagaucacaacuauga

SEQ ID NO: 1385648 - RNA, 19 nt, Homo sapiens
uagcuugcauugaagauca

SEQ ID NO: 1385649 - RNA, 19 nt, Homo sapiens
gcuugaauguuaacaccuu

SEQ ID NO: 1385650 - RNA, 19 nt, Homo sapiens
cagacugccugcuuucaug

SEQ ID NO: 1385651 - RNA, 19 nt, Homo sapiens
ugugcaagcucacuucuuc

SEQ ID NO: 1385652 - RNA, 19 nt, Homo sapiens
guaacgggaagaauauuug

SEQ ID NO: 1385653 - RNA, 19 nt, Homo sapiens
ggaaggacaaggaaagagu

SEQ ID NO: 1385654 - RNA, 19 nt, Homo sapiens
gugcaacuggauaauauaa

SEQ ID NO: 1385655 - RNA, 19 nt, Homo sapiens
gcugaaagacauccaaagu

SEQ ID NO: 1385656 - RNA, 19 nt, Homo sapiens
ggacuuuggaaaucuaaau

SEQ ID NO: 1385657 - RNA, 19 nt, Homo sapiens
gcaggaaggacaaggaaag

SEQ ID NO: 1385658 - RNA, 19 nt, Homo sapiens
aaaaggaaauugcaacaug

SEQ ID NO: 1385659 - RNA, 19 nt, Homo sapiens
aauaugaccugcuucaaaa

SEQ ID NO: 1385660 - RNA, 19 nt, Homo sapiens
uuucaaauaugaccugcuu

SEQ ID NO: 1385661 - RNA, 19 nt, Homo sapiens
gagcaggaaggacaaggaa

SEQ ID NO: 1385662 - RNA, 19 nt, Homo sapiens
ggaagagcaagagaacaaa

SEQ ID NO: 1385663 - RNA, 19 nt, Homo sapiens
gucaugguaucauucagaa

SEQ ID NO: 1385664 - RNA, 19 nt, Homo sapiens
aaagacauccaaagucaug

SEQ ID NO: 1385665 - RNA, 19 nt, Homo sapiens
ugacuugaaucuggugaug

SEQ ID NO: 1385666 - RNA, 19 nt, Homo sapiens
ggcacaggauacucucuga

SEQ ID NO: 1385667 - RNA, 19 nt, Homo sapiens
ucaaauaugaccugcuuca

SEQ ID NO: 1385668 - RNA, 19 nt, Homo sapiens
aaccaaacaugacacuuag

SEQ ID NO: 1385669 - RNA, 19 nt, Homo sapiens
gguggcucauggaauguuu

SEQ ID NO: 1385670 - RNA, 19 nt, Homo sapiens
uuugaacacuccucauuuc

SEQ ID NO: 1385671 - RNA, 19 nt, Homo sapiens
uggaagaauuacaggaguu

SEQ ID NO: 1385672 - RNA, 19 nt, Homo sapiens
gagcaagagaacaaauuuc

SEQ ID NO: 1385673 - RNA, 19 nt, Homo sapiens
caggauacucucugacuug

SEQ ID NO: 1385674 - RNA, 19 nt, Homo sapiens
agagcaagagaacaaauuu

SEQ ID NO: 1385675 - RNA, 19 nt, Homo sapiens
guucuucugugcgccuuaa

SEQ ID NO: 1385676 - RNA, 19 nt, Homo sapiens
cauccaaagucaugguauc

SEQ ID NO: 1385677 - RNA, 19 nt, Homo sapiens
aaagaauugcuccugguaa

SEQ ID NO: 1385678 - RNA, 19 nt, Homo sapiens
uggaagagcaagagaacaa

SEQ ID NO: 1385679 - RNA, 19 nt, Homo sapiens
ugugucaaccuucauauug

SEQ ID NO: 1385680 - RNA, 19 nt, Homo sapiens
gggaagaauauuugugcaa

SEQ ID NO: 1385681 - RNA, 19 nt, Homo sapiens
ccaaguuaacccauuucua

SEQ ID NO: 1385682 - RNA, 19 nt, Homo sapiens
ccugagaguuguucuucug

SEQ ID NO: 1385683 - RNA, 19 nt, Homo sapiens
caaagucaugguaucauuc

SEQ ID NO: 1385684 - RNA, 19 nt, Homo sapiens
gaaagacauccaaagucau

SEQ ID NO: 1385685 - RNA, 19 nt, Homo sapiens
aaaaucagcugaaagacau

SEQ ID NO: 1385686 - RNA, 19 nt, Homo sapiens
uuuccaaguuaacccauuu

SEQ ID NO: 1385687 - RNA, 19 nt, Homo sapiens
uugugcaacuggauaauau

SEQ ID NO: 1385688 - RNA, 19 nt, Homo sapiens
uccaaggaccugaaagaaa

SEQ ID NO: 1385689 - RNA, 19 nt, Homo sapiens
aaggaguacuugauagcuu

SEQ ID NO: 1385690 - RNA, 19 nt, Homo sapiens
acaggauacucucugacuu

SEQ ID NO: 1385691 - RNA, 19 nt, Homo sapiens
agaaagcuuggaaauaguu

SEQ ID NO: 1385692 - RNA, 19 nt, Homo sapiens
aagaaagcuuggaaauagu

SEQ ID NO: 1385693 - RNA, 19 nt, Homo sapiens
uauccaaggaccugaaaga

SEQ ID NO: 1385694 - RNA, 19 nt, Homo sapiens
ccauuucuaacccaaguaa

SEQ ID NO: 1385695 - RNA, 19 nt, Homo sapiens
gaagaauuacaggaguuau

SEQ ID NO: 1385696 - RNA, 19 nt, Homo sapiens
gaagaaaguuugccauuua

SEQ ID NO: 1385697 - RNA, 19 nt, Homo sapiens
gaaaugaaguagagaaaug

SEQ ID NO: 1385698 - RNA, 19 nt, Homo sapiens
ggaaacagaaggccucuua

SEQ ID NO: 1385699 - RNA, 19 nt, Homo sapiens
gaaauuggaggaaauauug

SEQ ID NO: 1385700 - RNA, 19 nt, Homo sapiens
gaguaaagaggcuuaauua

SEQ ID NO: 1385701 - RNA, 19 nt, Homo sapiens
ggacucauauuauucaguu

SEQ ID NO: 1385702 - RNA, 19 nt, Homo sapiens
gaacagcgagaauuuguaa

SEQ ID NO: 1385703 - RNA, 19 nt, Homo sapiens
ggaaugcuguuaaugagaa

SEQ ID NO: 1385704 - RNA, 19 nt, Homo sapiens
gaagaagaguggcuuaaag

SEQ ID NO: 1385705 - RNA, 19 nt, Homo sapiens
gaauaagucuacuggaaga

SEQ ID NO: 1385706 - RNA, 19 nt, Homo sapiens
acacuuacaugaaggauuu

SEQ ID NO: 1385707 - RNA, 19 nt, Homo sapiens
gaagagagagguuuggaaa

SEQ ID NO: 1385708 - RNA, 19 nt, Homo sapiens
gcaaauaccaugcacuuau

SEQ ID NO: 1385709 - RNA, 19 nt, Homo sapiens
aaacugauuucucgaauug

SEQ ID NO: 1385710 - RNA, 19 nt, Homo sapiens
aaagagccaugaagaaauu

SEQ ID NO: 1385711 - RNA, 19 nt, Homo sapiens
caauacagcuaacugaaga

SEQ ID NO: 1385712 - RNA, 19 nt, Homo sapiens
gcacaaacgguguucauga

SEQ ID NO: 1385713 - RNA, 19 nt, Homo sapiens
guauugagcugaaacaaca

SEQ ID NO: 1385714 - RNA, 19 nt, Homo sapiens
cauguggacuucugucaua

SEQ ID NO: 1385715 - RNA, 19 nt, Homo sapiens
uauaucagcuuaacccaaa

SEQ ID NO: 1385716 - RNA, 19 nt, Homo sapiens
guaaaugaaugcugcacaa

SEQ ID NO: 1385717 - RNA, 19 nt, Homo sapiens
ggaaagcaccaccaucaaa

SEQ ID NO: 1385718 - RNA, 19 nt, Homo sapiens
ggacaauucccaaguuuau

SEQ ID NO: 1385719 - RNA, 19 nt, Homo sapiens
ugaagaaaguuugccauuu

SEQ ID NO: 1385720 - RNA, 19 nt, Homo sapiens
guaaagaggcuuaauuagu

SEQ ID NO: 1385721 - RNA, 19 nt, Homo sapiens
ugaagaaauugcugaagaa

SEQ ID NO: 1385722 - RNA, 19 nt, Homo sapiens
gaauuucuccaaagaguaa

SEQ ID NO: 1385723 - RNA, 19 nt, Homo sapiens
gccaagaacuagaagcaaa

SEQ ID NO: 1385724 - RNA, 19 nt, Homo sapiens
gcgaauacccuugaucuuu

SEQ ID NO: 1385725 - RNA, 19 nt, Homo sapiens
ggacuucugucauaauucu

SEQ ID NO: 1385726 - RNA, 19 nt, Homo sapiens
ucaaagccauuguagaaga

SEQ ID NO: 1385727 - RNA, 19 nt, Homo sapiens
agaaauggcaggacucaua

SEQ ID NO: 1385728 - RNA, 19 nt, Homo sapiens
aaacuucuguggacaauuc

SEQ ID NO: 1385729 - RNA, 19 nt, Homo sapiens
cgaauacccuugaucuuuc

SEQ ID NO: 1385730 - RNA, 19 nt, Homo sapiens
gagaugagccucuguacug

SEQ ID NO: 1385731 - RNA, 19 nt, Homo sapiens
acagcuaacugaagaacua

SEQ ID NO: 1385732 - RNA, 19 nt, Homo sapiens
ugacagcgcuauuagaaca

SEQ ID NO: 1385733 - RNA, 19 nt, Homo sapiens
uggcaggacucauauuauu

SEQ ID NO: 1385734 - RNA, 19 nt, Homo sapiens
caagauaagaguacaaaug

SEQ ID NO: 1385735 - RNA, 19 nt, Homo sapiens
gaaucgcagucacuuagaa

SEQ ID NO: 1385736 - RNA, 19 nt, Homo sapiens
cauauuugcucaacagaga

SEQ ID NO: 1385737 - RNA, 19 nt, Homo sapiens
gauaagaguacaaaugaug

SEQ ID NO: 1385738 - RNA, 19 nt, Homo sapiens
gcaccaccaucaaaguuau

SEQ ID NO: 1385739 - RNA, 19 nt, Homo sapiens
aaacaaauaccaaggaaga

SEQ ID NO: 1385740 - RNA, 19 nt, Homo sapiens
accaugcacuuauugauua

SEQ ID NO: 1385741 - RNA, 19 nt, Homo sapiens
gucagaagcugccaguuau

SEQ ID NO: 1385742 - RNA, 19 nt, Homo sapiens
gaaauggcaggacucauau

SEQ ID NO: 1385743 - RNA, 19 nt, Homo sapiens
guagaagacuuaacaagcu

SEQ ID NO: 1385744 - RNA, 19 nt, Homo sapiens
gaugaugacacuuacauga

SEQ ID NO: 1385745 - RNA, 19 nt, Homo sapiens
ggaagaagaguggcuuaaa

SEQ ID NO: 1385746 - RNA, 19 nt, Homo sapiens
caucuacccuuucccaguu

SEQ ID NO: 1385747 - RNA, 19 nt, Homo sapiens
uguaauauaugcucucuca

SEQ ID NO: 1385748 - RNA, 19 nt, Homo sapiens
ugacugcccucuaugaugu

SEQ ID NO: 1385749 - RNA, 19 nt, Homo sapiens
gaaaacaaauaccaaggaa

SEQ ID NO: 1385750 - RNA, 19 nt, Homo sapiens
aaacaaacaguaccagauu

SEQ ID NO: 1385751 - RNA, 19 nt, Homo sapiens
gcaaacagggacacacuga

SEQ ID NO: 1385752 - RNA, 19 nt, Homo sapiens
cuacuguacucuucuaaau

SEQ ID NO: 1385753 - RNA, 19 nt, Homo sapiens
guggaaaugucuucucuuc

SEQ ID NO: 1385754 - RNA, 19 nt, Homo sapiens
gaagaaauugcugaagaaa

SEQ ID NO: 1385755 - RNA, 19 nt, Homo sapiens
cagaagcugccaguuauua

SEQ ID NO: 1385756 - RNA, 19 nt, Homo sapiens
ugucagaagcugccaguua

SEQ ID NO: 1385757 - RNA, 19 nt, Homo sapiens
gagucaagaguguaaauaa

SEQ ID NO: 1385758 - RNA, 19 nt, Homo sapiens
gaauacccuugaucuuuca

SEQ ID NO: 1385759 - RNA, 19 nt, Homo sapiens
cacauuaccuaguuucaga

SEQ ID NO: 1385760 - RNA, 19 nt, Homo sapiens
uaagucuacuggaagaauu

SEQ ID NO: 1385761 - RNA, 19 nt, Homo sapiens
ugaaauguguccagaugug

SEQ ID NO: 1385762 - RNA, 19 nt, Homo sapiens
ggaaugcgaauacccuuga

SEQ ID NO: 1385763 - RNA, 19 nt, Homo sapiens
cugaauaagucuacuggaa

SEQ ID NO: 1385764 - RNA, 19 nt, Homo sapiens
cauaugcucugugaaaugu

SEQ ID NO: 1385765 - RNA, 19 nt, Homo sapiens
gaaagcaccaccaucaaag

SEQ ID NO: 1385766 - RNA, 19 nt, Homo sapiens
ugaagaaaauggcuuauga

SEQ ID NO: 1385767 - RNA, 19 nt, Homo sapiens
gaugccacauuaccuaguu

SEQ ID NO: 1385768 - RNA, 19 nt, Homo sapiens
uauggaagacuauuggaua

SEQ ID NO: 1385769 - RNA, 19 nt, Homo sapiens
gaugaugccacauuaccua

SEQ ID NO: 1385770 - RNA, 19 nt, Homo sapiens
gagcaagcacucaaucaga

SEQ ID NO: 1385771 - RNA, 19 nt, Homo sapiens
gcaggacucauauuauuca

SEQ ID NO: 1385772 - RNA, 19 nt, Homo sapiens
gauauggccaguacacuau

SEQ ID NO: 1385773 - RNA, 19 nt, Homo sapiens
cuguggauaugaucacuua

SEQ ID NO: 1385774 - RNA, 19 nt, Homo sapiens
guggacuucugucauaauu

SEQ ID NO: 1385775 - RNA, 19 nt, Homo sapiens
guggacaauucccaaguuu

SEQ ID NO: 1385776 - RNA, 19 nt, Homo sapiens
caguucaucugacuuaugu

SEQ ID NO: 1385777 - RNA, 19 nt, Homo sapiens
ucuauuaccuccucacauc

SEQ ID NO: 1385778 - RNA, 19 nt, Homo sapiens
uaaagucaaagccauugua

SEQ ID NO: 1385779 - RNA, 19 nt, Homo sapiens
guaugaaauuggaggaaau

SEQ ID NO: 1385780 - RNA, 19 nt, Homo sapiens
caauuucccaggauucuuu

SEQ ID NO: 1385781 - RNA, 19 nt, Homo sapiens
cgaggcaucuaaccuuguu

SEQ ID NO: 1385782 - RNA, 19 nt, Homo sapiens
caaacgguguucaugauac

SEQ ID NO: 1385783 - RNA, 19 nt, Homo sapiens
gacagcacauuaaaacaua

SEQ ID NO: 1385784 - RNA, 19 nt, Homo sapiens
agucaaagccauuguagaa

SEQ ID NO: 1385785 - RNA, 19 nt, Homo sapiens
uaugauguauuggguauug

SEQ ID NO: 1385786 - RNA, 19 nt, Homo sapiens
gagccucuguacuguaaau

SEQ ID NO: 1385787 - RNA, 19 nt, Homo sapiens
uuaacaagcugcagauaac

SEQ ID NO: 1385788 - RNA, 19 nt, Homo sapiens
ggauugaaguccagugaac

SEQ ID NO: 1385789 - RNA, 19 nt, Homo sapiens
aggcgaugaugccacauua

SEQ ID NO: 1385790 - RNA, 19 nt, Homo sapiens
gcagucacuuagaacaaau

SEQ ID NO: 1385791 - RNA, 19 nt, Homo sapiens
ugacgucagagacauauuu

SEQ ID NO: 1385792 - RNA, 19 nt, Homo sapiens
cacaaacgguguucaugau

SEQ ID NO: 1385793 - RNA, 19 nt, Homo sapiens
aguaaugguugaagaaugu

SEQ ID NO: 1385794 - RNA, 19 nt, Homo sapiens
gugaagacagcacauuaaa

SEQ ID NO: 1385795 - RNA, 19 nt, Homo sapiens
gaaauguguccagauguga

SEQ ID NO: 1385796 - RNA, 19 nt, Homo sapiens
gaagaaagcuaaguuauug

SEQ ID NO: 1385797 - RNA, 19 nt, Homo sapiens
agagaaagcugccaacuga

SEQ ID NO: 1385798 - RNA, 19 nt, Homo sapiens
ggaaagaggacaaguuuga

SEQ ID NO: 1385799 - RNA, 19 nt, Homo sapiens
gaaacuaucugagccaugu

SEQ ID NO: 1385800 - RNA, 19 nt, Homo sapiens
caacagugaugauucagaa

SEQ ID NO: 1385801 - RNA, 19 nt, Homo sapiens
ccaggaaccuccaauaguu

SEQ ID NO: 1385802 - RNA, 19 nt, Homo sapiens
ggaucuaccuugggucuua

SEQ ID NO: 1385803 - RNA, 19 nt, Homo sapiens
gcagaagauuuguguaaug

SEQ ID NO: 1385804 - RNA, 19 nt, Homo sapiens
ggacgaggauuguuacauc

SEQ ID NO: 1385805 - RNA, 19 nt, Homo sapiens
uaacgaugauugaccuuaa

SEQ ID NO: 1385806 - RNA, 19 nt, Homo sapiens
gcuauauccuuuacuggua

SEQ ID NO: 1385807 - RNA, 19 nt, Homo sapiens
gaauuuagguacuguuaag

SEQ ID NO: 1385808 - RNA, 19 nt, Homo sapiens
caaagucccuggauguuuc

SEQ ID NO: 1385809 - RNA, 19 nt, Homo sapiens
ugacaacgguaaugauuug

SEQ ID NO: 1385810 - RNA, 19 nt, Homo sapiens
cagaagagcuccgaagaga

SEQ ID NO: 1385811 - RNA, 19 nt, Homo sapiens
cagaagagcuccgaagaga

SEQ ID NO: 1385812 - RNA, 19 nt, Homo sapiens
ucaaagaaauacucuggaa

SEQ ID NO: 1385813 - RNA, 19 nt, Homo sapiens
gugcagaaguauuauagaa

SEQ ID NO: 1385814 - RNA, 19 nt, Homo sapiens
gaaguauuaugccaggaaa

SEQ ID NO: 1385815 - RNA, 19 nt, Homo sapiens
gagaaucuacgaccuguuu

SEQ ID NO: 1385816 - RNA, 19 nt, Homo sapiens
caagugauccugaggcuaa

SEQ ID NO: 1385817 - RNA, 19 nt, Homo sapiens
gaagauuuguguaaugaag

SEQ ID NO: 1385818 - RNA, 19 nt, Homo sapiens
cgacaacagugaugauuca

SEQ ID NO: 1385819 - RNA, 19 nt, Homo sapiens
cgacaacagugaugauuca

SEQ ID NO: 1385820 - RNA, 19 nt, Homo sapiens
cgacaacagugaugauuca

SEQ ID NO: 1385821 - RNA, 19 nt, Homo sapiens
cagaagauuuguguaauga

SEQ ID NO: 1385822 - RNA, 19 nt, Homo sapiens
ggugaaaacugcuggcuua

SEQ ID NO: 1385823 - RNA, 19 nt, Homo sapiens
gaaauaaggaugaauuggu

SEQ ID NO: 1385824 - RNA, 19 nt, Homo sapiens
aaugugagcuauauccuuu

SEQ ID NO: 1385825 - RNA, 19 nt, Homo sapiens
caauagugaugauuuggaa

SEQ ID NO: 1385826 - RNA, 19 nt, Homo sapiens
ugacaauagugaugauuug

SEQ ID NO: 1385827 - RNA, 19 nt, Homo sapiens
gaagagcuccgaagagaca

SEQ ID NO: 1385828 - RNA, 19 nt, Homo sapiens
gaagagcuccgaagagaca

SEQ ID NO: 1385829 - RNA, 19 nt, Homo sapiens
ggaauuacaaggcaaugaa

SEQ ID NO: 1385830 - RNA, 19 nt, Homo sapiens
caacgguaaugauuuggaa

SEQ ID NO: 1385831 - RNA, 19 nt, Homo sapiens
gcaaagucccuggauguuu

SEQ ID NO: 1385832 - RNA, 19 nt, Homo sapiens
cagauuggcuugaaagucu

SEQ ID NO: 1385833 - RNA, 19 nt, Homo sapiens
gaugacaacgguaaugauu

SEQ ID NO: 1385834 - RNA, 19 nt, Homo sapiens
gagaagaaagcuaaguuau

SEQ ID NO: 1385835 - RNA, 19 nt, Homo sapiens
cagcagaagauuuguguaa

SEQ ID NO: 1385836 - RNA, 19 nt, Homo sapiens
acaaggcaaugaagaauuc

SEQ ID NO: 1385837 - RNA, 19 nt, Homo sapiens
ugaauguacuggaugcaaa

SEQ ID NO: 1385838 - RNA, 19 nt, Homo sapiens
aggcaacacuuaaacacua

SEQ ID NO: 1385839 - RNA, 19 nt, Homo sapiens
acuacaagguccauuauga

SEQ ID NO: 1385840 - RNA, 19 nt, Homo sapiens
cgaguugcauccuuaaugu

SEQ ID NO: 1385841 - RNA, 19 nt, Homo sapiens
gggcuacuguggcaucuau

SEQ ID NO: 1385842 - RNA, 19 nt, Homo sapiens
gagaggagaaugcuggaaa

SEQ ID NO: 1385843 - RNA, 19 nt, Homo sapiens
caggagauggcuaggauua

SEQ ID NO: 1385844 - RNA, 19 nt, Homo sapiens
ggaauaacaagauggugaa

SEQ ID NO: 1385845 - RNA, 19 nt, Homo sapiens
ggaaauaaacagcgacgau

SEQ ID NO: 1385846 - RNA, 19 nt, Homo sapiens
caggcgaguugcauccuua

SEQ ID NO: 1385847 - RNA, 19 nt, Homo sapiens
gccauuaacucagaaagau

SEQ ID NO: 1385848 - RNA, 19 nt, Homo sapiens
gauccagauuggcuugaaa

SEQ ID NO: 1385849 - RNA, 19 nt, Homo sapiens
gaaucuacgaccuguuuaa

SEQ ID NO: 1385850 - RNA, 19 nt, Homo sapiens
gaugauugaccuuaaauag

SEQ ID NO: 1385851 - RNA, 19 nt, Homo sapiens
gcacuggugagauguggua

SEQ ID NO: 1385852 - RNA, 19 nt, Homo sapiens
uguaugugcagaaguauua

SEQ ID NO: 1385853 - RNA, 19 nt, Homo sapiens
aaacgaggauuggcugcua

SEQ ID NO: 1385854 - RNA, 19 nt, Homo sapiens
gaagacaagagugaugauu

SEQ ID NO: 1385855 - RNA, 19 nt, Homo sapiens
ggaaguauuaugccaggaa

SEQ ID NO: 1385856 - RNA, 19 nt, Homo sapiens
agagaagaaagcuaaguua

SEQ ID NO: 1385857 - RNA, 19 nt, Homo sapiens
caaagaaauacucuggaaa

SEQ ID NO: 1385858 - RNA, 19 nt, Homo sapiens
agacauggaugggugcaaa

SEQ ID NO: 1385859 - RNA, 19 nt, Homo sapiens
cgcauaggcuggaauaaca

SEQ ID NO: 1385860 - RNA, 19 nt, Homo sapiens
aaagaugggacccguauug

SEQ ID NO: 1385861 - RNA, 19 nt, Homo sapiens
gaaaacugcuggcuuaugc

SEQ ID NO: 1385862 - RNA, 19 nt, Homo sapiens
cgacaagagugaugauucg

SEQ ID NO: 1385863 - RNA, 19 nt, Homo sapiens
cgacaagagugaugauucg

SEQ ID NO: 1385864 - RNA, 19 nt, Homo sapiens
cgacaacagugaugauucg

SEQ ID NO: 1385865 - RNA, 19 nt, Homo sapiens
cgacaacagugaugauucg

SEQ ID NO: 1385866 - RNA, 19 nt, Homo sapiens
cgacaacagugaugauucg

SEQ ID NO: 1385867 - RNA, 19 nt, Homo sapiens
cgacaacagugaugauucg

SEQ ID NO: 1385868 - RNA, 19 nt, Homo sapiens
caggaaccuccaauaguua

SEQ ID NO: 1385869 - RNA, 19 nt, Homo sapiens
ucugagccauguaaucaaa

SEQ ID NO: 1385870 - RNA, 19 nt, Homo sapiens
gagaugugguacccaaagu

SEQ ID NO: 1385871 - RNA, 19 nt, Homo sapiens
ccagagaaacuacgcauag

SEQ ID NO: 1385872 - RNA, 19 nt, Homo sapiens
gaggcuaacccugaaguuu

SEQ ID NO: 1385873 - RNA, 19 nt, Homo sapiens
gguaaugauuuggaaguuc

SEQ ID NO: 1385874 - RNA, 19 nt, Homo sapiens
uuaacuacaagguccauua

SEQ ID NO: 1385875 - RNA, 19 nt, Homo sapiens
gauugacucugauucugau

SEQ ID NO: 1385876 - RNA, 19 nt, Homo sapiens
uaccuugggucuuacuuga

SEQ ID NO: 1385877 - RNA, 19 nt, Homo sapiens
ggugacgcauggaaguauu

SEQ ID NO: 1385878 - RNA, 19 nt, Homo sapiens
gaaacccggugcagcaaaa

SEQ ID NO: 1385879 - RNA, 19 nt, Homo sapiens
gagagaaagcugccaacug

SEQ ID NO: 1385880 - RNA, 19 nt, Homo sapiens
cgacagcagugaugauucg

SEQ ID NO: 1385881 - RNA, 19 nt, Homo sapiens
cgacagcagugaugauucg

SEQ ID NO: 1385882 - RNA, 19 nt, Homo sapiens
cgacagcagugaugauucg

SEQ ID NO: 1385883 - RNA, 19 nt, Homo sapiens
cgacagcagugaugauucg

SEQ ID NO: 1385884 - RNA, 19 nt, Homo sapiens
cgacagcagugaugauucg

SEQ ID NO: 1385885 - RNA, 19 nt, Homo sapiens
cgacagcagugaugauucg

SEQ ID NO: 1385886 - RNA, 19 nt, Homo sapiens
cgacagcagugaugauucg

SEQ ID NO: 1385887 - RNA, 19 nt, Homo sapiens
gcagugaugauucggaugu

SEQ ID NO: 1385888 - RNA, 19 nt, Homo sapiens
cgacagcagugaugauucg

SEQ ID NO: 1385889 - RNA, 19 nt, Homo sapiens
gaaaacacuuggcaggaau

SEQ ID NO: 1385890 - RNA, 19 nt, Homo sapiens
uaacuacaagguccauuau

SEQ ID NO: 1385891 - RNA, 19 nt, Homo sapiens
gcgaaauaaggaugaauug

SEQ ID NO: 1385892 - RNA, 19 nt, Homo sapiens
ggaguguugucaugugaag

SEQ ID NO: 1385893 - RNA, 19 nt, Homo sapiens
gguaagaaguuuuagaaag

SEQ ID NO: 1385894 - RNA, 19 nt, Homo sapiens
ugagcuauauccuuuacug

SEQ ID NO: 1385895 - RNA, 19 nt, Homo sapiens
cgaagagacaggcgaguug

SEQ ID NO: 1385896 - RNA, 19 nt, Homo sapiens
gcacagaauucucaacaaa

SEQ ID NO: 1385897 - RNA, 19 nt, Homo sapiens
guacagauauggugacuga

SEQ ID NO: 1385898 - RNA, 19 nt, Homo sapiens
gaagaguccaccaguauua

SEQ ID NO: 1385899 - RNA, 19 nt, Homo sapiens
gaaugccaguuaacaaaua

SEQ ID NO: 1385900 - RNA, 19 nt, Homo sapiens
gcacuuaugugacucaugu

SEQ ID NO: 1385901 - RNA, 19 nt, Homo sapiens
gcacugauguccaggaaga

SEQ ID NO: 1385902 - RNA, 19 nt, Homo sapiens
ugacucauguguccucuua

SEQ ID NO: 1385903 - RNA, 19 nt, Homo sapiens
ccauguccaucuucuauua

SEQ ID NO: 1385904 - RNA, 19 nt, Homo sapiens
uaaguuggcuugaaucuca

SEQ ID NO: 1385905 - RNA, 19 nt, Homo sapiens
uaagaguccuuguguugua

SEQ ID NO: 1385906 - RNA, 19 nt, Homo sapiens
gaaaucagaagggaauaua

SEQ ID NO: 1385907 - RNA, 19 nt, Homo sapiens
ggagaacuguccacucaug

SEQ ID NO: 1385908 - RNA, 19 nt, Homo sapiens
uuauugaucuggaugcuua

SEQ ID NO: 1385909 - RNA, 19 nt, Homo sapiens
gaucuaaaguugucugagu

SEQ ID NO: 1385910 - RNA, 19 nt, Homo sapiens
uuacagagaaugccaguua

SEQ ID NO: 1385911 - RNA, 19 nt, Homo sapiens
gauaaagccauccuccaua

SEQ ID NO: 1385912 - RNA, 19 nt, Homo sapiens
gcauauugcucuuauaacu

SEQ ID NO: 1385913 - RNA, 19 nt, Homo sapiens
gagaaugccaguuaacaaa

SEQ ID NO: 1385914 - RNA, 19 nt, Homo sapiens
guagagcuguuucaaagga

SEQ ID NO: 1385915 - RNA, 19 nt, Homo sapiens
gagcuuagaggaagaaaga

SEQ ID NO: 1385916 - RNA, 19 nt, Homo sapiens
gaccaugaguuucagauuc

SEQ ID NO: 1385917 - RNA, 19 nt, Homo sapiens
gcacuuacaagcacuguga

SEQ ID NO: 1385918 - RNA, 19 nt, Homo sapiens
gaaaacugaucaugacaaa

SEQ ID NO: 1385919 - RNA, 19 nt, Homo sapiens
ccugaaggauuaagugaaa

SEQ ID NO: 1385920 - RNA, 19 nt, Homo sapiens
uuaaacaguucuucaccua

SEQ ID NO: 1385921 - RNA, 19 nt, Homo sapiens
gaacagauaagggauggaa

SEQ ID NO: 1385922 - RNA, 19 nt, Homo sapiens
ugaguuaaaugcacuuaug

SEQ ID NO: 1385923 - RNA, 19 nt, Homo sapiens
gggcaguguuggcuuguuu

SEQ ID NO: 1385924 - RNA, 19 nt, Homo sapiens
ccucuuagaaucccaaaua

SEQ ID NO: 1385925 - RNA, 19 nt, Homo sapiens
uaaaugcacuuaugugacu

SEQ ID NO: 1385926 - RNA, 19 nt, Homo sapiens
ucagggcauuugagaauaa

SEQ ID NO: 1385927 - RNA, 19 nt, Homo sapiens
ggacaugacauugguuuga

SEQ ID NO: 1385928 - RNA, 19 nt, Homo sapiens
ggugggaggugguuugaug

SEQ ID NO: 1385929 - RNA, 19 nt, Homo sapiens
ccgaaagucugcauccaaa

SEQ ID NO: 1385930 - RNA, 19 nt, Homo sapiens
gauaagggauggaaaucag

SEQ ID NO: 1385931 - RNA, 19 nt, Homo sapiens
ggaugugugccuucaauuu

SEQ ID NO: 1385932 - RNA, 19 nt, Homo sapiens
cucaguagguuacaaauga

SEQ ID NO: 1385933 - RNA, 19 nt, Homo sapiens
caugagggauaguauguga

SEQ ID NO: 1385934 - RNA, 19 nt, Homo sapiens
ggaggugguuugauguuuc

SEQ ID NO: 1385935 - RNA, 19 nt, Homo sapiens
gaacaaaugcugaaaagga

SEQ ID NO: 1385936 - RNA, 19 nt, Homo sapiens
aauaggaacuuucucuuca

SEQ ID NO: 1385937 - RNA, 19 nt, Homo sapiens
cggaggaucugauguguca

SEQ ID NO: 1385938 - RNA, 19 nt, Homo sapiens
agaaagaacucuggaugug

SEQ ID NO: 1385939 - RNA, 19 nt, Homo sapiens
uauggugacugauguaguu

SEQ ID NO: 1385940 - RNA, 19 nt, Homo sapiens
gugguuugauguuucauaa

SEQ ID NO: 1385941 - RNA, 19 nt, Homo sapiens
gacaugacauugguuugaa

SEQ ID NO: 1385942 - RNA, 19 nt, Homo sapiens
ggaggaagagaaagcauug

SEQ ID NO: 1385943 - RNA, 19 nt, Homo sapiens
gauguaaacguugcuauug

SEQ ID NO: 1385944 - RNA, 19 nt, Homo sapiens
gaugugugccuucaauuug

SEQ ID NO: 1385945 - RNA, 19 nt, Homo sapiens
aggauuaagugaaagcuuu

SEQ ID NO: 1385946 - RNA, 19 nt, Homo sapiens
ggugacugauguaguuauu

SEQ ID NO: 1385947 - RNA, 19 nt, Homo sapiens
ggaguacccucuguaacug

SEQ ID NO: 1385948 - RNA, 19 nt, Homo sapiens
gguuugauguuucauaaag

SEQ ID NO: 1385949 - RNA, 19 nt, Homo sapiens
gacagaaaaugacgacuuu

SEQ ID NO: 1385950 - RNA, 19 nt, Homo sapiens
caaaggaaguugguuucug

SEQ ID NO: 1385951 - RNA, 19 nt, Homo sapiens
agaagggaauauagaaaga

SEQ ID NO: 1385952 - RNA, 19 nt, Homo sapiens
gggaggugguuugauguuu

SEQ ID NO: 1385953 - RNA, 19 nt, Homo sapiens
uggaucagcugccuguuug

SEQ ID NO: 1385954 - RNA, 19 nt, Homo sapiens
uguaaacguugcuauugaa

SEQ ID NO: 1385955 - RNA, 19 nt, Homo sapiens
aaugaagaguccaccagua

SEQ ID NO: 1385956 - RNA, 19 nt, Homo sapiens
gaccagaagacaaguguau

SEQ ID NO: 1385957 - RNA, 19 nt, Homo sapiens
guuaaaugcacuuauguga

SEQ ID NO: 1385958 - RNA, 19 nt, Homo sapiens
guacagcuccauccuagug

SEQ ID NO: 1385959 - RNA, 19 nt, Homo sapiens
ccacacagagcaaacaaga

SEQ ID NO: 1385960 - RNA, 19 nt, Homo sapiens
gaagggaauauagaaagaa

SEQ ID NO: 1385961 - RNA, 19 nt, Homo sapiens
uuaagcagcacguguauug

SEQ ID NO: 1385962 - RNA, 19 nt, Homo sapiens
ccauucaggucucgauuuc

SEQ ID NO: 1385963 - RNA, 19 nt, Homo sapiens
ggacaucucugggcuucag

SEQ ID NO: 1385964 - RNA, 19 nt, Homo sapiens
aaacagaacaaaugcugaa

SEQ ID NO: 1385965 - RNA, 19 nt, Homo sapiens
aaacguugcuauugaaggu

SEQ ID NO: 1385966 - RNA, 19 nt, Homo sapiens
gaggugguuugauguuuca

SEQ ID NO: 1385967 - RNA, 19 nt, Homo sapiens
ugguagagcuguuucaaag

SEQ ID NO: 1385968 - RNA, 19 nt, Homo sapiens
ucagcugccuguuugcaaa

SEQ ID NO: 1385969 - RNA, 19 nt, Homo sapiens
caauuuaaacuugccagua

SEQ ID NO: 1385970 - RNA, 19 nt, Homo sapiens
ggaauacucggcuuugucu

SEQ ID NO: 1385971 - RNA, 19 nt, Homo sapiens
cagauauggugacugaugu

SEQ ID NO: 1385972 - RNA, 19 nt, Homo sapiens
cuaaaguugucugaguuaa

SEQ ID NO: 1385973 - RNA, 19 nt, Homo sapiens
cauuuaaguuggcuugaau

SEQ ID NO: 1385974 - RNA, 19 nt, Homo sapiens
gaggacaugacauugguuu

SEQ ID NO: 1385975 - RNA, 19 nt, Homo sapiens
cauggacaguaaaugaauu

SEQ ID NO: 1385976 - RNA, 19 nt, Homo sapiens
ggaaaucagaagggaauau

SEQ ID NO: 1385977 - RNA, 19 nt, Homo sapiens
agggagaacuguccacuca

SEQ ID NO: 1385978 - RNA, 19 nt, Homo sapiens
gaaaggaggggcaguguug

SEQ ID NO: 1385979 - RNA, 19 nt, Homo sapiens
gagcaaacaagaacagucu

SEQ ID NO: 1385980 - RNA, 19 nt, Homo sapiens
uacagagaaugccaguuaa

SEQ ID NO: 1385981 - RNA, 19 nt, Homo sapiens
ccuaaaccauguccaucuu

SEQ ID NO: 1385982 - RNA, 19 nt, Homo sapiens
caggaacuguggauuuauc

SEQ ID NO: 1385983 - RNA, 19 nt, Homo sapiens
ucacaaggccuaaggacau

SEQ ID NO: 1385984 - RNA, 19 nt, Homo sapiens
aaacaguucuucaccuaac

SEQ ID NO: 1385985 - RNA, 19 nt, Homo sapiens
ucaguagguuacaaaugaa

SEQ ID NO: 1385986 - RNA, 19 nt, Homo sapiens
auaaagccauccuccauag

SEQ ID NO: 1385987 - RNA, 19 nt, Homo sapiens
uggaauuguuggacagaaa

SEQ ID NO: 1385988 - RNA, 19 nt, Homo sapiens
ggaccaugaguuucagauu

SEQ ID NO: 1385989 - RNA, 19 nt, Homo sapiens
cugcaacaccuuaaagaaa

SEQ ID NO: 1385990 - RNA, 19 nt, Homo sapiens
gggaguacccucuguaacu

SEQ ID NO: 1385991 - RNA, 19 nt, Homo sapiens
gaacucuggauguggagaa

SEQ ID NO: 1385992 - RNA, 19 nt, Homo sapiens
ucucuugucuaguauuuca

SEQ ID NO: 1385993 - RNA, 19 nt, Homo sapiens
uauugaagguucucaugug

SEQ ID NO: 1385994 - RNA, 19 nt, Homo sapiens
ccaccaguauuagaaacaa

SEQ ID NO: 1385995 - RNA, 19 nt, Homo sapiens
gucagggcauuugagaaua

SEQ ID NO: 1385996 - RNA, 19 nt, Homo sapiens
gaagaaaucguucaucaua

SEQ ID NO: 1385997 - RNA, 19 nt, Homo sapiens
gagaacaacuggcagcuuu

SEQ ID NO: 1385998 - RNA, 19 nt, Homo sapiens
aagaagaaaucguucauca

SEQ ID NO: 1385999 - RNA, 19 nt, Homo sapiens
gguucugguuuaacuaaua

SEQ ID NO: 1386000 - RNA, 19 nt, Homo sapiens
agacaugguucugguuuaa

SEQ ID NO: 1386001 - RNA, 19 nt, Homo sapiens
ccacuucuguguagacaug

SEQ ID NO: 1386002 - RNA, 19 nt, Homo sapiens
gaacaacuggcagcuuuga

SEQ ID NO: 1386003 - RNA, 19 nt, Homo sapiens
uagacaugguucugguuua

SEQ ID NO: 1386004 - RNA, 19 nt, Homo sapiens
agaaaucguucaucauaag

SEQ ID NO: 1386005 - RNA, 19 nt, Homo sapiens
gaaaucguucaucauaaga

SEQ ID NO: 1386006 - RNA, 19 nt, Homo sapiens
guagacaugguucugguuu

SEQ ID NO: 1386007 - RNA, 19 nt, Homo sapiens
gaaauugagcgccauaagc

SEQ ID NO: 1386008 - RNA, 19 nt, Homo sapiens
agagcaggcugaagaggaa

SEQ ID NO: 1386009 - RNA, 19 nt, Homo sapiens
agagagagcaggcugaaga

SEQ ID NO: 1386010 - RNA, 19 nt, Homo sapiens
gccauaagcagaagaucaa

SEQ ID NO: 1386011 - RNA, 19 nt, Homo sapiens
gagcgucugcagaaagaaa

SEQ ID NO: 1386012 - RNA, 19 nt, Homo sapiens
gauugagcgucugcagaaa

SEQ ID NO: 1386013 - RNA, 19 nt, Homo sapiens
gaagaagaaaucguucauc

SEQ ID NO: 1386014 - RNA, 19 nt, Homo sapiens
ccaugaagaagaaaucguu

SEQ ID NO: 1386015 - RNA, 19 nt, Homo sapiens
acaacuggcagcuuugaaa

SEQ ID NO: 1386016 - RNA, 19 nt, Homo sapiens
ugaagaggaacgauauuuc

SEQ ID NO: 1386017 - RNA, 19 nt, Homo sapiens
gugugcuacuaacagauua

SEQ ID NO: 1386018 - RNA, 19 nt, Homo sapiens
aaagaaauugagcgccaua

SEQ ID NO: 1386019 - RNA, 19 nt, Homo sapiens
cauagaauggcacauguca

SEQ ID NO: 1386020 - RNA, 19 nt, Homo sapiens
aaauugagcgccauaagca

SEQ ID NO: 1386021 - RNA, 19 nt, Homo sapiens
gcacagaguagagaacaac

SEQ ID NO: 1386022 - RNA, 19 nt, Homo sapiens
agauugagcgucugcagaa

SEQ ID NO: 1386023 - RNA, 19 nt, Homo sapiens
gagcacagaguagagaaca

SEQ ID NO: 1386024 - RNA, 19 nt, Homo sapiens
uugagcgucugcagaaaga

SEQ ID NO: 1386025 - RNA, 19 nt, Homo sapiens
aaaacaccaugaagaagaa

SEQ ID NO: 1386026 - RNA, 19 nt, Homo sapiens
cugaagaggaacgauauuu

SEQ ID NO: 1386027 - RNA, 19 nt, Homo sapiens
gugcuacuaacagauuaua

SEQ ID NO: 1386028 - RNA, 19 nt, Homo sapiens
ugucauugcccacuucugu

SEQ ID NO: 1386029 - RNA, 19 nt, Homo sapiens
caucauaagaaggagauug

SEQ ID NO: 1386030 - RNA, 19 nt, Homo sapiens
gcugaagaggaacgauauu

SEQ ID NO: 1386031 - RNA, 19 nt, Homo sapiens
cagaagaucaaaaugcuaa

SEQ ID NO: 1386032 - RNA, 19 nt, Homo sapiens
aaagagagagcaggcugaa

SEQ ID NO: 1386033 - RNA, 19 nt, Homo sapiens
ggcugaagaggaacgauau

SEQ ID NO: 1386034 - RNA, 19 nt, Homo sapiens
aaucguucaucauaagaag

SEQ ID NO: 1386035 - RNA, 19 nt, Homo sapiens
ugaaagacaucaaagcuua

SEQ ID NO: 1386036 - RNA, 19 nt, Homo sapiens
uaaacgagcucccuucuuu

SEQ ID NO: 1386037 - RNA, 19 nt, Homo sapiens
ggauucagcuucugccuua

SEQ ID NO: 1386038 - RNA, 19 nt, Homo sapiens
caacaugacugcuuugugu

SEQ ID NO: 1386039 - RNA, 19 nt, Homo sapiens
ucauagagcucgucacaaa

SEQ ID NO: 1386040 - RNA, 19 nt, Homo sapiens
guugagaacucuaauaaug

SEQ ID NO: 1386041 - RNA, 19 nt, Homo sapiens
ggagauauauagcuggauu

SEQ ID NO: 1386042 - RNA, 19 nt, Homo sapiens
caucagaccuggaaucuuc

SEQ ID NO: 1386043 - RNA, 19 nt, Homo sapiens
caaguugucucaucuauac

SEQ ID NO: 1386044 - RNA, 19 nt, Homo sapiens
cagcugaacuacgaaauaa

SEQ ID NO: 1386045 - RNA, 19 nt, Homo sapiens
gcaccaacagcuucaguua

SEQ ID NO: 1386046 - RNA, 19 nt, Homo sapiens
gaaauugacucugcugucu

SEQ ID NO: 1386047 - RNA, 19 nt, Homo sapiens
cuacugaagcugaauguua

SEQ ID NO: 1386048 - RNA, 19 nt, Homo sapiens
caaguacgccuucagcuuu

SEQ ID NO: 1386049 - RNA, 19 nt, Homo sapiens
cagcaggacugagaaauug

SEQ ID NO: 1386050 - RNA, 19 nt, Homo sapiens
caaaugcagcugugacuaa

SEQ ID NO: 1386051 - RNA, 19 nt, Homo sapiens
acaguuaaguggccuauug

SEQ ID NO: 1386052 - RNA, 19 nt, Homo sapiens
ggauaguugucucaucauu

SEQ ID NO: 1386053 - RNA, 19 nt, Homo sapiens
gcggugaccuucaugucua

SEQ ID NO: 1386054 - RNA, 19 nt, Homo sapiens
caaaucagagggaguugua

SEQ ID NO: 1386055 - RNA, 19 nt, Homo sapiens
gaaaaccaguccauucuug

SEQ ID NO: 1386056 - RNA, 19 nt, Homo sapiens
gaagaacaaguccaucaga

SEQ ID NO: 1386057 - RNA, 19 nt, Homo sapiens
aagcuuaucuggagucuca

SEQ ID NO: 1386058 - RNA, 19 nt, Homo sapiens
ccaauucacucaaguuguc

SEQ ID NO: 1386059 - RNA, 19 nt, Homo sapiens
gcuuacagcaucaugauaa

SEQ ID NO: 1386060 - RNA, 19 nt, Homo sapiens
gcguggaucucaacaggaa

SEQ ID NO: 1386061 - RNA, 19 nt, Homo sapiens
gcagggcguucugucgaua

SEQ ID NO: 1386062 - RNA, 19 nt, Homo sapiens
gcaucuggacugccaauaa

SEQ ID NO: 1386063 - RNA, 19 nt, Homo sapiens
auauauagcuggauugaca

SEQ ID NO: 1386064 - RNA, 19 nt, Homo sapiens
aaucgggcauucugagaua

SEQ ID NO: 1386065 - RNA, 19 nt, Homo sapiens
gaacagcugaacuacgaaa

SEQ ID NO: 1386066 - RNA, 19 nt, Homo sapiens
uuaaauuccugagcuauug

SEQ ID NO: 1386067 - RNA, 19 nt, Homo sapiens
gaaaugguucuaacagcaa

SEQ ID NO: 1386068 - RNA, 19 nt, Homo sapiens
ccauggacaucuucauaga

SEQ ID NO: 1386069 - RNA, 19 nt, Homo sapiens
gauugaauuccuucucaua

SEQ ID NO: 1386070 - RNA, 19 nt, Homo sapiens
ucucaucauugguggcuua

SEQ ID NO: 1386071 - RNA, 19 nt, Homo sapiens
acucucagaugcuuaugua

SEQ ID NO: 1386072 - RNA, 19 nt, Homo sapiens
ugacagacauacugaaugc

SEQ ID NO: 1386073 - RNA, 19 nt, Homo sapiens
ggcaucaucuuucacuuuc

SEQ ID NO: 1386074 - RNA, 19 nt, Homo sapiens
gcacacauagccaguuaau

SEQ ID NO: 1386075 - RNA, 19 nt, Homo sapiens
gaauguuacuuggguggaa

SEQ ID NO: 1386076 - RNA, 19 nt, Homo sapiens
uagcuggauugacaacuuu

SEQ ID NO: 1386077 - RNA, 19 nt, Homo sapiens
ugaauuccuucucauacaa

SEQ ID NO: 1386078 - RNA, 19 nt, Homo sapiens
cugaacagcugaacuacga

SEQ ID NO: 1386079 - RNA, 19 nt, Homo sapiens
cagcuucaguuacucauca

SEQ ID NO: 1386080 - RNA, 19 nt, Homo sapiens
gaacugaaagacaucaaag

SEQ ID NO: 1386081 - RNA, 19 nt, Homo sapiens
ugacucugcugucuguuga

SEQ ID NO: 1386082 - RNA, 19 nt, Homo sapiens
gaaucgccagugacaguua

SEQ ID NO: 1386083 - RNA, 19 nt, Homo sapiens
gagaaucgccagugacagu

SEQ ID NO: 1386084 - RNA, 19 nt, Homo sapiens
cuuaaacccuuugauaaug

SEQ ID NO: 1386085 - RNA, 19 nt, Homo sapiens
ggaacuggaagucggguuu

SEQ ID NO: 1386086 - RNA, 19 nt, Homo sapiens
caucuggacugccaauaag

SEQ ID NO: 1386087 - RNA, 19 nt, Homo sapiens
gaaagacaucaaagcuuau

SEQ ID NO: 1386088 - RNA, 19 nt, Homo sapiens
gauaugagaguuccuuucu

SEQ ID NO: 1386089 - RNA, 19 nt, Homo sapiens
ccaaguacagggauaguug

SEQ ID NO: 1386090 - RNA, 19 nt, Homo sapiens
uuaaguggccuauuguuga

SEQ ID NO: 1386091 - RNA, 19 nt, Homo sapiens
gcugaacuacgaaauaaug

SEQ ID NO: 1386092 - RNA, 19 nt, Homo sapiens
guccuuaaacccuuugaua

SEQ ID NO: 1386093 - RNA, 19 nt, Homo sapiens
cuccuggucuucagcuuua

SEQ ID NO: 1386094 - RNA, 19 nt, Homo sapiens
ucacucaaguugucucauc

SEQ ID NO: 1386095 - RNA, 19 nt, Homo sapiens
aaaugcagcugugacuaaa

SEQ ID NO: 1386096 - RNA, 19 nt, Homo sapiens
cuggaggacugaucucaaa

SEQ ID NO: 1386097 - RNA, 19 nt, Homo sapiens
uugcacacauagccaguua

SEQ ID NO: 1386098 - RNA, 19 nt, Homo sapiens
ugaaugccauggacaucuu

SEQ ID NO: 1386099 - RNA, 19 nt, Homo sapiens
gcauuccgauauugucuca

SEQ ID NO: 1386100 - RNA, 19 nt, Homo sapiens
gacaggccauggcgaaauc

SEQ ID NO: 1386101 - RNA, 19 nt, Homo sapiens
uaagccaaguacagggaua

SEQ ID NO: 1386102 - RNA, 19 nt, Homo sapiens
ucaaggcucugaucuccau

SEQ ID NO: 1386103 - RNA, 19 nt, Homo sapiens
gauaguugucucaucauug

SEQ ID NO: 1386104 - RNA, 19 nt, Homo sapiens
ugucagugauuauggcaaa

SEQ ID NO: 1386105 - RNA, 19 nt, Homo sapiens
ggacugagaaauugacucu

SEQ ID NO: 1386106 - RNA, 19 nt, Homo sapiens
gaacgacuugguuggauuc

SEQ ID NO: 1386107 - RNA, 19 nt, Homo sapiens
ugaacgacuugguuggauu

SEQ ID NO: 1386108 - RNA, 19 nt, Homo sapiens
acacauagccaguuaaucg

SEQ ID NO: 1386109 - RNA, 19 nt, Homo sapiens
ccacagcuacucucagaug

SEQ ID NO: 1386110 - RNA, 19 nt, Homo sapiens
agaagagucuggcuugucu

SEQ ID NO: 1386111 - RNA, 19 nt, Homo sapiens
ucucugaacugaaagacau

SEQ ID NO: 1386112 - RNA, 19 nt, Homo sapiens
ggaggacugaucucaaaug

SEQ ID NO: 1386113 - RNA, 19 nt, Homo sapiens
gcuauucccaaacuauaaa

SEQ ID NO: 1386114 - RNA, 19 nt, Homo sapiens
caucauugguggcuuaaaa

SEQ ID NO: 1386115 - RNA, 19 nt, Homo sapiens
guucagcacuggagguucu

SEQ ID NO: 1386116 - RNA, 19 nt, Homo sapiens
caugggaucgaguacauuu

SEQ ID NO: 1386117 - RNA, 19 nt, Homo sapiens
ggaggaaaugguucuaaca

SEQ ID NO: 1386118 - RNA, 19 nt, Homo sapiens
gacuagcacuaucucuguu

SEQ ID NO: 1386119 - RNA, 19 nt, Homo sapiens
ggacacuccuggucuucag

SEQ ID NO: 1386120 - RNA, 19 nt, Homo sapiens
gaggacugaucucaaaugc

SEQ ID NO: 1386121 - RNA, 19 nt, Homo sapiens
guuaaguggccuauuguug

SEQ ID NO: 1386122 - RNA, 19 nt, Homo sapiens
cgguggaggccuuguauaa

SEQ ID NO: 1386123 - RNA, 19 nt, Homo sapiens
ucaaguugucucaucuaua

SEQ ID NO: 1386124 - RNA, 19 nt, Homo sapiens
ugacugcggugaccuucau

SEQ ID NO: 1386125 - RNA, 19 nt, Homo sapiens
cuuccaacaugacugcuuu

SEQ ID NO: 1386126 - RNA, 19 nt, Homo sapiens
agggauaguugucucauca

SEQ ID NO: 1386127 - RNA, 19 nt, Homo sapiens
ugucugaacagcugaacua

SEQ ID NO: 1386128 - RNA, 19 nt, Homo sapiens
caucagcaccacccucuau

SEQ ID NO: 1386129 - RNA, 19 nt, Homo sapiens
gaucccguuucaaaucaga

SEQ ID NO: 1386130 - RNA, 19 nt, Homo sapiens
cagcuacucucagaugcuu

SEQ ID NO: 1386131 - RNA, 19 nt, Homo sapiens
gcuuauggcggaagaacaa

SEQ ID NO: 1386132 - RNA, 19 nt, Homo sapiens
caacagcuucaguuacuca

SEQ ID NO: 1386133 - RNA, 19 nt, Homo sapiens
ccaagccaauucacucaag

SEQ ID NO: 1386134 - RNA, 19 nt, Homo sapiens
ugagaacucuaauaaugac

SEQ ID NO: 1386135 - RNA, 19 nt, Homo sapiens
ccacagagcuuaccucaaa

SEQ ID NO: 1386136 - RNA, 19 nt, Homo sapiens
gaaguuugcucuaacauuu

SEQ ID NO: 1386137 - RNA, 19 nt, Homo sapiens
gcaaacaaguggauugaaa

SEQ ID NO: 1386138 - RNA, 19 nt, Homo sapiens
uaaagcaccuuaacaauga

SEQ ID NO: 1386139 - RNA, 19 nt, Homo sapiens
gacaggcaguuaacacuua

SEQ ID NO: 1386140 - RNA, 19 nt, Homo sapiens
ugagcuagcuucugaguuu

SEQ ID NO: 1386141 - RNA, 19 nt, Homo sapiens
ccacaaccaugaauauuug

SEQ ID NO: 1386142 - RNA, 19 nt, Homo sapiens
gaaauuuacagcugguuua

SEQ ID NO: 1386143 - RNA, 19 nt, Homo sapiens
gaugaagacugcccaaugu

SEQ ID NO: 1386144 - RNA, 19 nt, Homo sapiens
gagaagguauuaagucaug

SEQ ID NO: 1386145 - RNA, 19 nt, Homo sapiens
cagcagagauggaagauca

SEQ ID NO: 1386146 - RNA, 19 nt, Homo sapiens
gaaagcauuugugaagauu

SEQ ID NO: 1386147 - RNA, 19 nt, Homo sapiens
ggagacagcccuaaaggaa

SEQ ID NO: 1386148 - RNA, 19 nt, Homo sapiens
acagagagauugaagaaga

SEQ ID NO: 1386149 - RNA, 19 nt, Homo sapiens
gaugucagaccuccauuua

SEQ ID NO: 1386150 - RNA, 19 nt, Homo sapiens
gcaguuacaucuucagcuu

SEQ ID NO: 1386151 - RNA, 19 nt, Homo sapiens
aaugagaacugacuuguga

SEQ ID NO: 1386152 - RNA, 19 nt, Homo sapiens
ggcuagaccucacuacuaa

SEQ ID NO: 1386153 - RNA, 19 nt, Homo sapiens
caaagcaucaccaccaaua

SEQ ID NO: 1386154 - RNA, 19 nt, Homo sapiens
aagaagagccuuuaucuga

SEQ ID NO: 1386155 - RNA, 19 nt, Homo sapiens
gcagagagcaguuuaccuu

SEQ ID NO: 1386156 - RNA, 19 nt, Homo sapiens
ggaaugagcacucuaagca

SEQ ID NO: 1386157 - RNA, 19 nt, Homo sapiens
gcaguacgucauaaucuua

SEQ ID NO: 1386158 - RNA, 19 nt, Homo sapiens
gaagagccuuuaucugaag

SEQ ID NO: 1386159 - RNA, 19 nt, Homo sapiens
gacaacagcuaaucacagu

SEQ ID NO: 1386160 - RNA, 19 nt, Homo sapiens
ggacagucuucaguucuaa

SEQ ID NO: 1386161 - RNA, 19 nt, Homo sapiens
gacaccagcucugaaguaa

SEQ ID NO: 1386162 - RNA, 19 nt, Homo sapiens
cugaagaucuggaaugaga

SEQ ID NO: 1386163 - RNA, 19 nt, Homo sapiens
ggaaguccaaccuuaguaa

SEQ ID NO: 1386164 - RNA, 19 nt, Homo sapiens
gagcagugauaaacagaga

SEQ ID NO: 1386165 - RNA, 19 nt, Homo sapiens
cagagaagguauuaaguca

SEQ ID NO: 1386166 - RNA, 19 nt, Homo sapiens
ucacugaccuucauaacca

SEQ ID NO: 1386167 - RNA, 19 nt, Homo sapiens
gaucuggaaugagaacuga

SEQ ID NO: 1386168 - RNA, 19 nt, Homo sapiens
gcaaauggccaggcuguga

SEQ ID NO: 1386169 - RNA, 19 nt, Homo sapiens
gcagguggugcaacaguua

SEQ ID NO: 1386170 - RNA, 19 nt, Homo sapiens
cgacagagagauugaagaa

SEQ ID NO: 1386171 - RNA, 19 nt, Homo sapiens
gaaagaagugacuggaguu

SEQ ID NO: 1386172 - RNA, 19 nt, Homo sapiens
agaagagccuuuaucugaa

SEQ ID NO: 1386173 - RNA, 19 nt, Homo sapiens
caaggaagagccagugauu

SEQ ID NO: 1386174 - RNA, 19 nt, Homo sapiens
aacaggaaguccaaccuua

SEQ ID NO: 1386175 - RNA, 19 nt, Homo sapiens
gcagcaacuuggaagaaug

SEQ ID NO: 1386176 - RNA, 19 nt, Homo sapiens
gaaacagcaagagcaguua

SEQ ID NO: 1386177 - RNA, 19 nt, Homo sapiens
gguauuaagucaugaugca

SEQ ID NO: 1386178 - RNA, 19 nt, Homo sapiens
ugaaagcauuugugaagau

SEQ ID NO: 1386179 - RNA, 19 nt, Homo sapiens
gacuguggaugaaguagaa

SEQ ID NO: 1386180 - RNA, 19 nt, Homo sapiens
gcgaacgucuucaagcaau

SEQ ID NO: 1386181 - RNA, 19 nt, Homo sapiens
gggcuagaccucacuacua

SEQ ID NO: 1386182 - RNA, 19 nt, Homo sapiens
ggaaguuugcucuaacauu

SEQ ID NO: 1386183 - RNA, 19 nt, Homo sapiens
ucagaccuccauuuacuua

SEQ ID NO: 1386184 - RNA, 19 nt, Homo sapiens
cgacagagacaauaagcaa

SEQ ID NO: 1386185 - RNA, 19 nt, Homo sapiens
uaaaggagacagcccuaaa

SEQ ID NO: 1386186 - RNA, 19 nt, Homo sapiens
ggaugaagacugcccaaug

SEQ ID NO: 1386187 - RNA, 19 nt, Homo sapiens
ugacagcaauggaaacagu

SEQ ID NO: 1386188 - RNA, 19 nt, Homo sapiens
gaagaagagccuuuaucug

SEQ ID NO: 1386189 - RNA, 19 nt, Homo sapiens
gaaguccaaccuuaguaaa

SEQ ID NO: 1386190 - RNA, 19 nt, Homo sapiens
ucagacaaauacaacauuc

SEQ ID NO: 1386191 - RNA, 19 nt, Homo sapiens
gcaacagcauccuggaaag

SEQ ID NO: 1386192 - RNA, 19 nt, Homo sapiens
uuaacaaacuccuaugaag

SEQ ID NO: 1386193 - RNA, 19 nt, Homo sapiens
gcagauccuucagcaacaa

SEQ ID NO: 1386194 - RNA, 19 nt, Homo sapiens
uaaaucuggugucuagugu

SEQ ID NO: 1386195 - RNA, 19 nt, Homo sapiens
ggugcaacaguuagaaaua

SEQ ID NO: 1386196 - RNA, 19 nt, Homo sapiens
gaauggacagucuucaguu

SEQ ID NO: 1386197 - RNA, 19 nt, Homo sapiens
uaacaaacuccuaugaagu

SEQ ID NO: 1386198 - RNA, 19 nt, Homo sapiens
agagagcaguuuaccuuug

SEQ ID NO: 1386199 - RNA, 19 nt, Homo sapiens
uaagagcagugauaaacag

SEQ ID NO: 1386200 - RNA, 19 nt, Homo sapiens
gaagacgacagagagauug

SEQ ID NO: 1386201 - RNA, 19 nt, Homo sapiens
aauccuggacugauaaaua

SEQ ID NO: 1386202 - RNA, 19 nt, Homo sapiens
aaguaauccuggacugaua

SEQ ID NO: 1386203 - RNA, 19 nt, Homo sapiens
gcuacaagcccuucuccaa

SEQ ID NO: 1386204 - RNA, 19 nt, Homo sapiens
gaaguaagcacaguagaac

SEQ ID NO: 1386205 - RNA, 19 nt, Homo sapiens
ugacaccagcucugaagua

SEQ ID NO: 1386206 - RNA, 19 nt, Homo sapiens
auccuggacugauaaauaa

SEQ ID NO: 1386207 - RNA, 19 nt, Homo sapiens
gagagcaguuuaccuuugc

SEQ ID NO: 1386208 - RNA, 19 nt, Homo sapiens
gaacgucuucaagcaauga

SEQ ID NO: 1386209 - RNA, 19 nt, Homo sapiens
ugaagggacauaucacuga

SEQ ID NO: 1386210 - RNA, 19 nt, Homo sapiens
gaacugacuugugaaaccu

SEQ ID NO: 1386211 - RNA, 19 nt, Homo sapiens
gauugaagaagagccuuua

SEQ ID NO: 1386212 - RNA, 19 nt, Homo sapiens
gcuaaucacaguccagaau

SEQ ID NO: 1386213 - RNA, 19 nt, Homo sapiens
ugucagaccuccauuuacu

SEQ ID NO: 1386214 - RNA, 19 nt, Homo sapiens
gugaaagcauuugugaaga

SEQ ID NO: 1386215 - RNA, 19 nt, Homo sapiens
cuuaaguccugcugagauu

SEQ ID NO: 1386216 - RNA, 19 nt, Homo sapiens
gcagcaaacaaguggauug

SEQ ID NO: 1386217 - RNA, 19 nt, Homo sapiens
ugaaguaagcacaguagaa

SEQ ID NO: 1386218 - RNA, 19 nt, Homo sapiens
cagaagcgaaggucacaaa

SEQ ID NO: 1386219 - RNA, 19 nt, Homo sapiens
gucaccaugucgaagaaua

SEQ ID NO: 1386220 - RNA, 19 nt, Homo sapiens
gcccaaaccaucucccaaa

SEQ ID NO: 1386221 - RNA, 19 nt, Homo sapiens
caaacaaguggauugaaau

SEQ ID NO: 1386222 - RNA, 19 nt, Homo sapiens
ggaaugagaacugacuugu

SEQ ID NO: 1386223 - RNA, 19 nt, Homo sapiens
ugaagaagagccuuuaucu

SEQ ID NO: 1386224 - RNA, 19 nt, Homo sapiens
agaauuagaagacgacaga

SEQ ID NO: 1386225 - RNA, 19 nt, Homo sapiens
ucacaguccagaauuagaa

SEQ ID NO: 1386226 - RNA, 19 nt, Homo sapiens
cauaaccacuccacaacca

SEQ ID NO: 1386227 - RNA, 19 nt, Homo sapiens
uuacacggacauuugcuua

SEQ ID NO: 1386228 - RNA, 19 nt, Homo sapiens
gccaggcugugaaagcauu

SEQ ID NO: 1386229 - RNA, 19 nt, Homo sapiens
ccaccaauaacucaucauu

SEQ ID NO: 1386230 - RNA, 19 nt, Homo sapiens
uacaagcccuucuccaaca

SEQ ID NO: 1386231 - RNA, 19 nt, Homo sapiens
uuacuaagccagcccuuug

SEQ ID NO: 1386232 - RNA, 19 nt, Homo sapiens
agaaugcaguacgucauaa

SEQ ID NO: 1386233 - RNA, 19 nt, Homo sapiens
ucccaaaccucuaaaucug

SEQ ID NO: 1386234 - RNA, 19 nt, Homo sapiens
caaaccaucucccaaaccu

SEQ ID NO: 1386235 - RNA, 19 nt, Homo sapiens
ccacagagcuuaccucaaa

SEQ ID NO: 1386236 - RNA, 19 nt, Homo sapiens
gaaguuugcucuaacauuu

SEQ ID NO: 1386237 - RNA, 19 nt, Homo sapiens
gcaaacaaguggauugaaa

SEQ ID NO: 1386238 - RNA, 19 nt, Homo sapiens
uaaagcaccuuaacaauga

SEQ ID NO: 1386239 - RNA, 19 nt, Homo sapiens
gacaggcaguuaacacuua

SEQ ID NO: 1386240 - RNA, 19 nt, Homo sapiens
ugagcuagcuucugaguuu

SEQ ID NO: 1386241 - RNA, 19 nt, Homo sapiens
ccacaaccaugaauauuug

SEQ ID NO: 1386242 - RNA, 19 nt, Homo sapiens
gaaauuuacagcugguuua

SEQ ID NO: 1386243 - RNA, 19 nt, Homo sapiens
gaugaagacugcccaaugu

SEQ ID NO: 1386244 - RNA, 19 nt, Homo sapiens
gagaagguauuaagucaug

SEQ ID NO: 1386245 - RNA, 19 nt, Homo sapiens
cagcagagauggaagauca

SEQ ID NO: 1386246 - RNA, 19 nt, Homo sapiens
gaaagcauuugugaagauu

SEQ ID NO: 1386247 - RNA, 19 nt, Homo sapiens
ggagacagcccuaaaggaa

SEQ ID NO: 1386248 - RNA, 19 nt, Homo sapiens
acagagagauugaagaaga

SEQ ID NO: 1386249 - RNA, 19 nt, Homo sapiens
gaugucagaccuccauuua

SEQ ID NO: 1386250 - RNA, 19 nt, Homo sapiens
gcaguuacaucuucagcuu

SEQ ID NO: 1386251 - RNA, 19 nt, Homo sapiens
aaugagaacugacuuguga

SEQ ID NO: 1386252 - RNA, 19 nt, Homo sapiens
ggcuagaccucacuacuaa

SEQ ID NO: 1386253 - RNA, 19 nt, Homo sapiens
caaagcaucaccaccaaua

SEQ ID NO: 1386254 - RNA, 19 nt, Homo sapiens
aagaagagccuuuaucuga

SEQ ID NO: 1386255 - RNA, 19 nt, Homo sapiens
gcagagagcaguuuaccuu

SEQ ID NO: 1386256 - RNA, 19 nt, Homo sapiens
ggaaugagcacucuaagca

SEQ ID NO: 1386257 - RNA, 19 nt, Homo sapiens
gcaguacgucauaaucuua

SEQ ID NO: 1386258 - RNA, 19 nt, Homo sapiens
gaagagccuuuaucugaag

SEQ ID NO: 1386259 - RNA, 19 nt, Homo sapiens
gacaacagcuaaucacagu

SEQ ID NO: 1386260 - RNA, 19 nt, Homo sapiens
ggacagucuucaguucuaa

SEQ ID NO: 1386261 - RNA, 19 nt, Homo sapiens
gacaccagcucugaaguaa

SEQ ID NO: 1386262 - RNA, 19 nt, Homo sapiens
cugaagaucuggaaugaga

SEQ ID NO: 1386263 - RNA, 19 nt, Homo sapiens
ggaaguccaaccuuaguaa

SEQ ID NO: 1386264 - RNA, 19 nt, Homo sapiens
gagcagugauaaacagaga

SEQ ID NO: 1386265 - RNA, 19 nt, Homo sapiens
cagagaagguauuaaguca

SEQ ID NO: 1386266 - RNA, 19 nt, Homo sapiens
ucacugaccuucauaacca

SEQ ID NO: 1386267 - RNA, 19 nt, Homo sapiens
gaucuggaaugagaacuga

SEQ ID NO: 1386268 - RNA, 19 nt, Homo sapiens
gcaaauggccaggcuguga

SEQ ID NO: 1386269 - RNA, 19 nt, Homo sapiens
gcagguggugcaacaguua

SEQ ID NO: 1386270 - RNA, 19 nt, Homo sapiens
cgacagagagauugaagaa

SEQ ID NO: 1386271 - RNA, 19 nt, Homo sapiens
gaaagaagugacuggaguu

SEQ ID NO: 1386272 - RNA, 19 nt, Homo sapiens
agaagagccuuuaucugaa

SEQ ID NO: 1386273 - RNA, 19 nt, Homo sapiens
caaggaagagccagugauu

SEQ ID NO: 1386274 - RNA, 19 nt, Homo sapiens
aacaggaaguccaaccuua

SEQ ID NO: 1386275 - RNA, 19 nt, Homo sapiens
gcagcaacuuggaagaaug

SEQ ID NO: 1386276 - RNA, 19 nt, Homo sapiens
gaaacagcaagagcaguua

SEQ ID NO: 1386277 - RNA, 19 nt, Homo sapiens
gguauuaagucaugaugca

SEQ ID NO: 1386278 - RNA, 19 nt, Homo sapiens
ugaaagcauuugugaagau

SEQ ID NO: 1386279 - RNA, 19 nt, Homo sapiens
gacuguggaugaaguagaa

SEQ ID NO: 1386280 - RNA, 19 nt, Homo sapiens
gcgaacgucuucaagcaau

SEQ ID NO: 1386281 - RNA, 19 nt, Homo sapiens
gggcuagaccucacuacua

SEQ ID NO: 1386282 - RNA, 19 nt, Homo sapiens
ggaaguuugcucuaacauu

SEQ ID NO: 1386283 - RNA, 19 nt, Homo sapiens
ucagaccuccauuuacuua

SEQ ID NO: 1386284 - RNA, 19 nt, Homo sapiens
cgacagagacaauaagcaa

SEQ ID NO: 1386285 - RNA, 19 nt, Homo sapiens
uaaaggagacagcccuaaa

SEQ ID NO: 1386286 - RNA, 19 nt, Homo sapiens
ggaugaagacugcccaaug

SEQ ID NO: 1386287 - RNA, 19 nt, Homo sapiens
ugacagcaauggaaacagu

SEQ ID NO: 1386288 - RNA, 19 nt, Homo sapiens
agagaccacugcaggaauu

SEQ ID NO: 1386289 - RNA, 19 nt, Homo sapiens
gaagaagagccuuuaucug

SEQ ID NO: 1386290 - RNA, 19 nt, Homo sapiens
gaaguccaaccuuaguaaa

SEQ ID NO: 1386291 - RNA, 19 nt, Homo sapiens
ucagacaaauacaacauuc

SEQ ID NO: 1386292 - RNA, 19 nt, Homo sapiens
gcaacagcauccuggaaag

SEQ ID NO: 1386293 - RNA, 19 nt, Homo sapiens
uuaacaaacuccuaugaag

SEQ ID NO: 1386294 - RNA, 19 nt, Homo sapiens
gcagauccuucagcaacaa

SEQ ID NO: 1386295 - RNA, 19 nt, Homo sapiens
uaaaucuggugucuagugu

SEQ ID NO: 1386296 - RNA, 19 nt, Homo sapiens
ggugcaacaguuagaaaua

SEQ ID NO: 1386297 - RNA, 19 nt, Homo sapiens
gaauggacagucuucaguu

SEQ ID NO: 1386298 - RNA, 19 nt, Homo sapiens
uaacaaacuccuaugaagu

SEQ ID NO: 1386299 - RNA, 19 nt, Homo sapiens
agagagcaguuuaccuuug

SEQ ID NO: 1386300 - RNA, 19 nt, Homo sapiens
uaagagcagugauaaacag

SEQ ID NO: 1386301 - RNA, 19 nt, Homo sapiens
gaagacgacagagagauug

SEQ ID NO: 1386302 - RNA, 19 nt, Homo sapiens
aauccuggacugauaaaua

SEQ ID NO: 1386303 - RNA, 19 nt, Homo sapiens
aaguaauccuggacugaua

SEQ ID NO: 1386304 - RNA, 19 nt, Homo sapiens
gcuacaagcccuucuccaa

SEQ ID NO: 1386305 - RNA, 19 nt, Homo sapiens
gaaguaagcacaguagaac

SEQ ID NO: 1386306 - RNA, 19 nt, Homo sapiens
ugacaccagcucugaagua

SEQ ID NO: 1386307 - RNA, 19 nt, Homo sapiens
auccuggacugauaaauaa

SEQ ID NO: 1386308 - RNA, 19 nt, Homo sapiens
gagagcaguuuaccuuugc

SEQ ID NO: 1386309 - RNA, 19 nt, Homo sapiens
guaaaucuggugucuagug

SEQ ID NO: 1386310 - RNA, 19 nt, Homo sapiens
gaacgucuucaagcaauga

SEQ ID NO: 1386311 - RNA, 19 nt, Homo sapiens
ugaagggacauaucacuga

SEQ ID NO: 1386312 - RNA, 19 nt, Homo sapiens
gaacugacuugugaaaccu

SEQ ID NO: 1386313 - RNA, 19 nt, Homo sapiens
gauugaagaagagccuuua

SEQ ID NO: 1386314 - RNA, 19 nt, Homo sapiens
gcuaaucacaguccagaau

SEQ ID NO: 1386315 - RNA, 19 nt, Homo sapiens
ugucagaccuccauuuacu

SEQ ID NO: 1386316 - RNA, 19 nt, Homo sapiens
gugaaagcauuugugaaga

SEQ ID NO: 1386317 - RNA, 19 nt, Homo sapiens
cuuaaguccugcugagauu

SEQ ID NO: 1386318 - RNA, 19 nt, Homo sapiens
gcagcaaacaaguggauug

SEQ ID NO: 1386319 - RNA, 19 nt, Homo sapiens
ugaaguaagcacaguagaa

SEQ ID NO: 1386320 - RNA, 19 nt, Homo sapiens
cagaagcgaaggucacaaa

SEQ ID NO: 1386321 - RNA, 19 nt, Homo sapiens
gucaccaugucgaagaaua

SEQ ID NO: 1386322 - RNA, 19 nt, Homo sapiens
gcccaaaccaucucccaaa

SEQ ID NO: 1386323 - RNA, 19 nt, Homo sapiens
caaacaaguggauugaaau

SEQ ID NO: 1386324 - RNA, 19 nt, Homo sapiens
ggaaugagaacugacuugu

SEQ ID NO: 1386325 - RNA, 19 nt, Homo sapiens
ugaagaagagccuuuaucu

SEQ ID NO: 1386326 - RNA, 19 nt, Homo sapiens
agaauuagaagacgacaga

SEQ ID NO: 1386327 - RNA, 19 nt, Homo sapiens
ucacaguccagaauuagaa

SEQ ID NO: 1386328 - RNA, 19 nt, Homo sapiens
cauaaccacuccacaacca

SEQ ID NO: 1386329 - RNA, 19 nt, Homo sapiens
uuacacggacauuugcuua

SEQ ID NO: 1386330 - RNA, 19 nt, Homo sapiens
gccaggcugugaaagcauu

SEQ ID NO: 1386331 - RNA, 19 nt, Homo sapiens
ccaccaauaacucaucauu

SEQ ID NO: 1386332 - RNA, 19 nt, Homo sapiens
uacaagcccuucuccaaca

SEQ ID NO: 1386333 - RNA, 19 nt, Homo sapiens
uuacuaagccagcccuuug

SEQ ID NO: 1386334 - RNA, 19 nt, Homo sapiens
agaaugcaguacgucauaa

SEQ ID NO: 1386335 - RNA, 19 nt, Homo sapiens
ccacagagcuuaccucaaa

SEQ ID NO: 1386336 - RNA, 19 nt, Homo sapiens
gaaguuugcucuaacauuu

SEQ ID NO: 1386337 - RNA, 19 nt, Homo sapiens
gagcagagacguaaauuua

SEQ ID NO: 1386338 - RNA, 19 nt, Homo sapiens
gcaaacaaguggauugaaa

SEQ ID NO: 1386339 - RNA, 19 nt, Homo sapiens
uaaagcaccuuaacaauga

SEQ ID NO: 1386340 - RNA, 19 nt, Homo sapiens
gacaggcaguuaacacuua

SEQ ID NO: 1386341 - RNA, 19 nt, Homo sapiens
ugagcuagcuucugaguuu

SEQ ID NO: 1386342 - RNA, 19 nt, Homo sapiens
ccacaaccaugaauauuug

SEQ ID NO: 1386343 - RNA, 19 nt, Homo sapiens
gaaauuuacagcugguuua

SEQ ID NO: 1386344 - RNA, 19 nt, Homo sapiens
gaugaagacugcccaaugu

SEQ ID NO: 1386345 - RNA, 19 nt, Homo sapiens
gagaagguauuaagucaug

SEQ ID NO: 1386346 - RNA, 19 nt, Homo sapiens
cagcagagauggaagauca

SEQ ID NO: 1386347 - RNA, 19 nt, Homo sapiens
gaaagcauuugugaagauu

SEQ ID NO: 1386348 - RNA, 19 nt, Homo sapiens
ggagacagcccuaaaggaa

SEQ ID NO: 1386349 - RNA, 19 nt, Homo sapiens
acagagagauugaagaaga

SEQ ID NO: 1386350 - RNA, 19 nt, Homo sapiens
gaugucagaccuccauuua

SEQ ID NO: 1386351 - RNA, 19 nt, Homo sapiens
gcaguuacaucuucagcuu

SEQ ID NO: 1386352 - RNA, 19 nt, Homo sapiens
aaugagaacugacuuguga

SEQ ID NO: 1386353 - RNA, 19 nt, Homo sapiens
ggcuagaccucacuacuaa

SEQ ID NO: 1386354 - RNA, 19 nt, Homo sapiens
caaagcaucaccaccaaua

SEQ ID NO: 1386355 - RNA, 19 nt, Homo sapiens
aagaagagccuuuaucuga

SEQ ID NO: 1386356 - RNA, 19 nt, Homo sapiens
gcagagagcaguuuaccuu

SEQ ID NO: 1386357 - RNA, 19 nt, Homo sapiens
gcagagacguaaauuuaag

SEQ ID NO: 1386358 - RNA, 19 nt, Homo sapiens
ggaaugagcacucuaagca

SEQ ID NO: 1386359 - RNA, 19 nt, Homo sapiens
gcaguacgucauaaucuua

SEQ ID NO: 1386360 - RNA, 19 nt, Homo sapiens
gaagagccuuuaucugaag

SEQ ID NO: 1386361 - RNA, 19 nt, Homo sapiens
gacaacagcuaaucacagu

SEQ ID NO: 1386362 - RNA, 19 nt, Homo sapiens
ggacagucuucaguucuaa

SEQ ID NO: 1386363 - RNA, 19 nt, Homo sapiens
gacaccagcucugaaguaa

SEQ ID NO: 1386364 - RNA, 19 nt, Homo sapiens
cugaagaucuggaaugaga

SEQ ID NO: 1386365 - RNA, 19 nt, Homo sapiens
ggaaguccaaccuuaguaa

SEQ ID NO: 1386366 - RNA, 19 nt, Homo sapiens
gagcagugauaaacagaga

SEQ ID NO: 1386367 - RNA, 19 nt, Homo sapiens
cagagaagguauuaaguca

SEQ ID NO: 1386368 - RNA, 19 nt, Homo sapiens
ucacugaccuucauaacca

SEQ ID NO: 1386369 - RNA, 19 nt, Homo sapiens
gaucuggaaugagaacuga

SEQ ID NO: 1386370 - RNA, 19 nt, Homo sapiens
gcaaauggccaggcuguga

SEQ ID NO: 1386371 - RNA, 19 nt, Homo sapiens
gcagguggugcaacaguua

SEQ ID NO: 1386372 - RNA, 19 nt, Homo sapiens
cgacagagagauugaagaa

SEQ ID NO: 1386373 - RNA, 19 nt, Homo sapiens
gaaagaagugacuggaguu

SEQ ID NO: 1386374 - RNA, 19 nt, Homo sapiens
agaagagccuuuaucugaa

SEQ ID NO: 1386375 - RNA, 19 nt, Homo sapiens
caaggaagagccagugauu

SEQ ID NO: 1386376 - RNA, 19 nt, Homo sapiens
aacaggaaguccaaccuua

SEQ ID NO: 1386377 - RNA, 19 nt, Homo sapiens
gcagcaacuuggaagaaug

SEQ ID NO: 1386378 - RNA, 19 nt, Homo sapiens
gaaacagcaagagcaguua

SEQ ID NO: 1386379 - RNA, 19 nt, Homo sapiens
gguauuaagucaugaugca

SEQ ID NO: 1386380 - RNA, 19 nt, Homo sapiens
ugaaagcauuugugaagau

SEQ ID NO: 1386381 - RNA, 19 nt, Homo sapiens
ggaaguuugcucuaacauu

SEQ ID NO: 1386382 - RNA, 19 nt, Homo sapiens
gacuguggaugaaguagaa

SEQ ID NO: 1386383 - RNA, 19 nt, Homo sapiens
gcgaacgucuucaagcaau

SEQ ID NO: 1386384 - RNA, 19 nt, Homo sapiens
gggcuagaccucacuacua

SEQ ID NO: 1386385 - RNA, 19 nt, Homo sapiens
ucagaccuccauuuacuua

SEQ ID NO: 1386386 - RNA, 19 nt, Homo sapiens
cgacagagacaauaagcaa

SEQ ID NO: 1386387 - RNA, 19 nt, Homo sapiens
uaaaggagacagcccuaaa

SEQ ID NO: 1386388 - RNA, 19 nt, Homo sapiens
ggaugaagacugcccaaug

SEQ ID NO: 1386389 - RNA, 19 nt, Homo sapiens
ugacagcaauggaaacagu

SEQ ID NO: 1386390 - RNA, 19 nt, Homo sapiens
gaagaagagccuuuaucug

SEQ ID NO: 1386391 - RNA, 19 nt, Homo sapiens
gaaguccaaccuuaguaaa

SEQ ID NO: 1386392 - RNA, 19 nt, Homo sapiens
uuaacaaacuccuaugaag

SEQ ID NO: 1386393 - RNA, 19 nt, Homo sapiens
ucagacaaauacaacauuc

SEQ ID NO: 1386394 - RNA, 19 nt, Homo sapiens
gcaacagcauccuggaaag

SEQ ID NO: 1386395 - RNA, 19 nt, Homo sapiens
gcagauccuucagcaacaa

SEQ ID NO: 1386396 - RNA, 19 nt, Homo sapiens
uaaaucuggugucuagugu

SEQ ID NO: 1386397 - RNA, 19 nt, Homo sapiens
ggugcaacaguuagaaaua

SEQ ID NO: 1386398 - RNA, 19 nt, Homo sapiens
gaauggacagucuucaguu

SEQ ID NO: 1386399 - RNA, 19 nt, Homo sapiens
agagagcaguuuaccuuug

SEQ ID NO: 1386400 - RNA, 19 nt, Homo sapiens
uaacaaacuccuaugaagu

SEQ ID NO: 1386401 - RNA, 19 nt, Homo sapiens
uaagagcagugauaaacag

SEQ ID NO: 1386402 - RNA, 19 nt, Homo sapiens
gaagacgacagagagauug

SEQ ID NO: 1386403 - RNA, 19 nt, Homo sapiens
aauccuggacugauaaaua

SEQ ID NO: 1386404 - RNA, 19 nt, Homo sapiens
aaguaauccuggacugaua

SEQ ID NO: 1386405 - RNA, 19 nt, Homo sapiens
gcuacaagcccuucuccaa

SEQ ID NO: 1386406 - RNA, 19 nt, Homo sapiens
gcagagcagagacguaaau

SEQ ID NO: 1386407 - RNA, 19 nt, Homo sapiens
gaaguaagcacaguagaac

SEQ ID NO: 1386408 - RNA, 19 nt, Homo sapiens
ugacaccagcucugaagua

SEQ ID NO: 1386409 - RNA, 19 nt, Homo sapiens
auccuggacugauaaauaa

SEQ ID NO: 1386410 - RNA, 19 nt, Homo sapiens
gagagcaguuuaccuuugc

SEQ ID NO: 1386411 - RNA, 19 nt, Homo sapiens
gaacgucuucaagcaauga

SEQ ID NO: 1386412 - RNA, 19 nt, Homo sapiens
ugaagggacauaucacuga

SEQ ID NO: 1386413 - RNA, 19 nt, Homo sapiens
gaacugacuugugaaaccu

SEQ ID NO: 1386414 - RNA, 19 nt, Homo sapiens
gauugaagaagagccuuua

SEQ ID NO: 1386415 - RNA, 19 nt, Homo sapiens
gcuaaucacaguccagaau

SEQ ID NO: 1386416 - RNA, 19 nt, Homo sapiens
ugucagaccuccauuuacu

SEQ ID NO: 1386417 - RNA, 19 nt, Homo sapiens
gugaaagcauuugugaaga

SEQ ID NO: 1386418 - RNA, 19 nt, Homo sapiens
cuuaaguccugcugagauu

SEQ ID NO: 1386419 - RNA, 19 nt, Homo sapiens
gugcagagcagagacguaa

SEQ ID NO: 1386420 - RNA, 19 nt, Homo sapiens
gagacagacuugugguucu

SEQ ID NO: 1386421 - RNA, 19 nt, Homo sapiens
gcagcaaacaaguggauug

SEQ ID NO: 1386422 - RNA, 19 nt, Homo sapiens
ugaaguaagcacaguagaa

SEQ ID NO: 1386423 - RNA, 19 nt, Homo sapiens
cagaagcgaaggucacaaa

SEQ ID NO: 1386424 - RNA, 19 nt, Homo sapiens
gucaccaugucgaagaaua

SEQ ID NO: 1386425 - RNA, 19 nt, Homo sapiens
gcccaaaccaucucccaaa

SEQ ID NO: 1386426 - RNA, 19 nt, Homo sapiens
caaacaaguggauugaaau

SEQ ID NO: 1386427 - RNA, 19 nt, Homo sapiens
ggaaugagaacugacuugu

SEQ ID NO: 1386428 - RNA, 19 nt, Homo sapiens
ugaagaagagccuuuaucu

SEQ ID NO: 1386429 - RNA, 19 nt, Homo sapiens
agaauuagaagacgacaga

SEQ ID NO: 1386430 - RNA, 19 nt, Homo sapiens
ucacaguccagaauuagaa

SEQ ID NO: 1386431 - RNA, 19 nt, Homo sapiens
cauaaccacuccacaacca

SEQ ID NO: 1386432 - RNA, 19 nt, Homo sapiens
uuacacggacauuugcuua

SEQ ID NO: 1386433 - RNA, 19 nt, Homo sapiens
gccaggcugugaaagcauu

SEQ ID NO: 1386434 - RNA, 19 nt, Homo sapiens
ccaccaauaacucaucauu

SEQ ID NO: 1386435 - RNA, 19 nt, Homo sapiens
ccacagagcuuaccucaaa

SEQ ID NO: 1386436 - RNA, 19 nt, Homo sapiens
gaaguuugcucuaacauuu

SEQ ID NO: 1386437 - RNA, 19 nt, Homo sapiens
gagcagagacguaaauuua

SEQ ID NO: 1386438 - RNA, 19 nt, Homo sapiens
gcaaacaaguggauugaaa

SEQ ID NO: 1386439 - RNA, 19 nt, Homo sapiens
uaaagcaccuuaacaauga

SEQ ID NO: 1386440 - RNA, 19 nt, Homo sapiens
gacaggcaguuaacacuua

SEQ ID NO: 1386441 - RNA, 19 nt, Homo sapiens
ugagcuagcuucugaguuu

SEQ ID NO: 1386442 - RNA, 19 nt, Homo sapiens
ccacaaccaugaauauuug

SEQ ID NO: 1386443 - RNA, 19 nt, Homo sapiens
gaaauuuacagcugguuua

SEQ ID NO: 1386444 - RNA, 19 nt, Homo sapiens
gaugaagacugcccaaugu

SEQ ID NO: 1386445 - RNA, 19 nt, Homo sapiens
gagaagguauuaagucaug

SEQ ID NO: 1386446 - RNA, 19 nt, Homo sapiens
cagcagagauggaagauca

SEQ ID NO: 1386447 - RNA, 19 nt, Homo sapiens
gaaagcauuugugaagauu

SEQ ID NO: 1386448 - RNA, 19 nt, Homo sapiens
ggagacagcccuaaaggaa

SEQ ID NO: 1386449 - RNA, 19 nt, Homo sapiens
acagagagauugaagaaga

SEQ ID NO: 1386450 - RNA, 19 nt, Homo sapiens
gaugucagaccuccauuua

SEQ ID NO: 1386451 - RNA, 19 nt, Homo sapiens
gcaguuacaucuucagcuu

SEQ ID NO: 1386452 - RNA, 19 nt, Homo sapiens
aaugagaacugacuuguga

SEQ ID NO: 1386453 - RNA, 19 nt, Homo sapiens
ggcuagaccucacuacuaa

SEQ ID NO: 1386454 - RNA, 19 nt, Homo sapiens
caaagcaucaccaccaaua

SEQ ID NO: 1386455 - RNA, 19 nt, Homo sapiens
aagaagagccuuuaucuga

SEQ ID NO: 1386456 - RNA, 19 nt, Homo sapiens
gcagagagcaguuuaccuu

SEQ ID NO: 1386457 - RNA, 19 nt, Homo sapiens
gcagagacguaaauuuaag

SEQ ID NO: 1386458 - RNA, 19 nt, Homo sapiens
ggaaugagcacucuaagca

SEQ ID NO: 1386459 - RNA, 19 nt, Homo sapiens
gcaguacgucauaaucuua

SEQ ID NO: 1386460 - RNA, 19 nt, Homo sapiens
gaagagccuuuaucugaag

SEQ ID NO: 1386461 - RNA, 19 nt, Homo sapiens
gacaacagcuaaucacagu

SEQ ID NO: 1386462 - RNA, 19 nt, Homo sapiens
ggacagucuucaguucuaa

SEQ ID NO: 1386463 - RNA, 19 nt, Homo sapiens
gacaccagcucugaaguaa

SEQ ID NO: 1386464 - RNA, 19 nt, Homo sapiens
cugaagaucuggaaugaga

SEQ ID NO: 1386465 - RNA, 19 nt, Homo sapiens
ggaaguccaaccuuaguaa

SEQ ID NO: 1386466 - RNA, 19 nt, Homo sapiens
gagcagugauaaacagaga

SEQ ID NO: 1386467 - RNA, 19 nt, Homo sapiens
cagagaagguauuaaguca

SEQ ID NO: 1386468 - RNA, 19 nt, Homo sapiens
ucacugaccuucauaacca

SEQ ID NO: 1386469 - RNA, 19 nt, Homo sapiens
gaucuggaaugagaacuga

SEQ ID NO: 1386470 - RNA, 19 nt, Homo sapiens
gcaaauggccaggcuguga

SEQ ID NO: 1386471 - RNA, 19 nt, Homo sapiens
gcagguggugcaacaguua

SEQ ID NO: 1386472 - RNA, 19 nt, Homo sapiens
cgacagagagauugaagaa

SEQ ID NO: 1386473 - RNA, 19 nt, Homo sapiens
gaaagaagugacuggaguu

SEQ ID NO: 1386474 - RNA, 19 nt, Homo sapiens
guaauugcuuccagaaaca

SEQ ID NO: 1386475 - RNA, 19 nt, Homo sapiens
gguaauugcuuccagaaac

SEQ ID NO: 1386476 - RNA, 19 nt, Homo sapiens
agaagagccuuuaucugaa

SEQ ID NO: 1386477 - RNA, 19 nt, Homo sapiens
caaggaagagccagugauu

SEQ ID NO: 1386478 - RNA, 19 nt, Homo sapiens
aacaggaaguccaaccuua

SEQ ID NO: 1386479 - RNA, 19 nt, Homo sapiens
gcagcaacuuggaagaaug

SEQ ID NO: 1386480 - RNA, 19 nt, Homo sapiens
gaaacagcaagagcaguua

SEQ ID NO: 1386481 - RNA, 19 nt, Homo sapiens
gguauuaagucaugaugca

SEQ ID NO: 1386482 - RNA, 19 nt, Homo sapiens
ugaaagcauuugugaagau

SEQ ID NO: 1386483 - RNA, 19 nt, Homo sapiens
ggaaguuugcucuaacauu

SEQ ID NO: 1386484 - RNA, 19 nt, Homo sapiens
gacuguggaugaaguagaa

SEQ ID NO: 1386485 - RNA, 19 nt, Homo sapiens
gcgaacgucuucaagcaau

SEQ ID NO: 1386486 - RNA, 19 nt, Homo sapiens
gggcuagaccucacuacua

SEQ ID NO: 1386487 - RNA, 19 nt, Homo sapiens
ucagaccuccauuuacuua

SEQ ID NO: 1386488 - RNA, 19 nt, Homo sapiens
cgacagagacaauaagcaa

SEQ ID NO: 1386489 - RNA, 19 nt, Homo sapiens
uaaaggagacagcccuaaa

SEQ ID NO: 1386490 - RNA, 19 nt, Homo sapiens
ggaugaagacugcccaaug

SEQ ID NO: 1386491 - RNA, 19 nt, Homo sapiens
ugacagcaauggaaacagu

SEQ ID NO: 1386492 - RNA, 19 nt, Homo sapiens
gaagaagagccuuuaucug

SEQ ID NO: 1386493 - RNA, 19 nt, Homo sapiens
gaaguccaaccuuaguaaa

SEQ ID NO: 1386494 - RNA, 19 nt, Homo sapiens
uuaacaaacuccuaugaag

SEQ ID NO: 1386495 - RNA, 19 nt, Homo sapiens
ucagacaaauacaacauuc

SEQ ID NO: 1386496 - RNA, 19 nt, Homo sapiens
gcaacagcauccuggaaag

SEQ ID NO: 1386497 - RNA, 19 nt, Homo sapiens
gcagauccuucagcaacaa

SEQ ID NO: 1386498 - RNA, 19 nt, Homo sapiens
uaaaucuggugucuagugu

SEQ ID NO: 1386499 - RNA, 19 nt, Homo sapiens
ggugcaacaguuagaaaua

SEQ ID NO: 1386500 - RNA, 19 nt, Homo sapiens
gaauggacagucuucaguu

SEQ ID NO: 1386501 - RNA, 19 nt, Homo sapiens
agagagcaguuuaccuuug

SEQ ID NO: 1386502 - RNA, 19 nt, Homo sapiens
uaacaaacuccuaugaagu

SEQ ID NO: 1386503 - RNA, 19 nt, Homo sapiens
uaagagcagugauaaacag

SEQ ID NO: 1386504 - RNA, 19 nt, Homo sapiens
gaagacgacagagagauug

SEQ ID NO: 1386505 - RNA, 19 nt, Homo sapiens
aauccuggacugauaaaua

SEQ ID NO: 1386506 - RNA, 19 nt, Homo sapiens
aaguaauccuggacugaua

SEQ ID NO: 1386507 - RNA, 19 nt, Homo sapiens
gcuacaagcccuucuccaa

SEQ ID NO: 1386508 - RNA, 19 nt, Homo sapiens
gcagagcagagacguaaau

SEQ ID NO: 1386509 - RNA, 19 nt, Homo sapiens
gaaguaagcacaguagaac

SEQ ID NO: 1386510 - RNA, 19 nt, Homo sapiens
ugacaccagcucugaagua

SEQ ID NO: 1386511 - RNA, 19 nt, Homo sapiens
auccuggacugauaaauaa

SEQ ID NO: 1386512 - RNA, 19 nt, Homo sapiens
gagagcaguuuaccuuugc

SEQ ID NO: 1386513 - RNA, 19 nt, Homo sapiens
gaacgucuucaagcaauga

SEQ ID NO: 1386514 - RNA, 19 nt, Homo sapiens
ugaagggacauaucacuga

SEQ ID NO: 1386515 - RNA, 19 nt, Homo sapiens
gaacugacuugugaaaccu

SEQ ID NO: 1386516 - RNA, 19 nt, Homo sapiens
gauugaagaagagccuuua

SEQ ID NO: 1386517 - RNA, 19 nt, Homo sapiens
gcuaaucacaguccagaau

SEQ ID NO: 1386518 - RNA, 19 nt, Homo sapiens
ugucagaccuccauuuacu

SEQ ID NO: 1386519 - RNA, 19 nt, Homo sapiens
gugaaagcauuugugaaga

SEQ ID NO: 1386520 - RNA, 19 nt, Homo sapiens
cuuaaguccugcugagauu

SEQ ID NO: 1386521 - RNA, 19 nt, Homo sapiens
gugcagagcagagacguaa

SEQ ID NO: 1386522 - RNA, 19 nt, Homo sapiens
gagacagacuugugguucu

SEQ ID NO: 1386523 - RNA, 19 nt, Homo sapiens
gcagcaaacaaguggauug

SEQ ID NO: 1386524 - RNA, 19 nt, Homo sapiens
ugaaguaagcacaguagaa

SEQ ID NO: 1386525 - RNA, 19 nt, Homo sapiens
cagaagcgaaggucacaaa

SEQ ID NO: 1386526 - RNA, 19 nt, Homo sapiens
gucaccaugucgaagaaua

SEQ ID NO: 1386527 - RNA, 19 nt, Homo sapiens
gcccaaaccaucucccaaa

SEQ ID NO: 1386528 - RNA, 19 nt, Homo sapiens
caaacaaguggauugaaau

SEQ ID NO: 1386529 - RNA, 19 nt, Homo sapiens
ggaaugagaacugacuugu

SEQ ID NO: 1386530 - RNA, 19 nt, Homo sapiens
ugaagaagagccuuuaucu

SEQ ID NO: 1386531 - RNA, 19 nt, Homo sapiens
agaauuagaagacgacaga

SEQ ID NO: 1386532 - RNA, 19 nt, Homo sapiens
ucacaguccagaauuagaa

SEQ ID NO: 1386533 - RNA, 19 nt, Homo sapiens
cauaaccacuccacaacca

SEQ ID NO: 1386534 - RNA, 19 nt, Homo sapiens
uuacacggacauuugcuua

SEQ ID NO: 1386535 - RNA, 19 nt, Homo sapiens
guaguaggcucuuaauaaa

SEQ ID NO: 1386536 - RNA, 19 nt, Homo sapiens
aauaaacacuggcugaaua

SEQ ID NO: 1386537 - RNA, 19 nt, Homo sapiens
gaacacuccucacuucuuc

SEQ ID NO: 1386538 - RNA, 19 nt, Homo sapiens
gaugaugucucccuuacaa

SEQ ID NO: 1386539 - RNA, 19 nt, Homo sapiens
ccagaaaguuccagauuug

SEQ ID NO: 1386540 - RNA, 19 nt, Homo sapiens
aaacaguccugaauucaaa

SEQ ID NO: 1386541 - RNA, 19 nt, Homo sapiens
gauaagguauugaaucucu

SEQ ID NO: 1386542 - RNA, 19 nt, Homo sapiens
uaaagugucuggcguguag

SEQ ID NO: 1386543 - RNA, 19 nt, Homo sapiens
cagaagccauguuagauga

SEQ ID NO: 1386544 - RNA, 19 nt, Homo sapiens
gagaucaccuucaguuuac

SEQ ID NO: 1386545 - RNA, 19 nt, Homo sapiens
ugagaucaccuucaguuua

SEQ ID NO: 1386546 - RNA, 19 nt, Homo sapiens
ucagcaacauugucauuaa

SEQ ID NO: 1386547 - RNA, 19 nt, Homo sapiens
ggagaaagccugagaagac

SEQ ID NO: 1386548 - RNA, 19 nt, Homo sapiens
caaggacuguuuguucuuu

SEQ ID NO: 1386549 - RNA, 19 nt, Homo sapiens
uguaguaggcucuuaauaa

SEQ ID NO: 1386550 - RNA, 19 nt, Homo sapiens
uaaaugugaucagcaugua

SEQ ID NO: 1386551 - RNA, 19 nt, Homo sapiens
gagaaagccugagaagaca

SEQ ID NO: 1386552 - RNA, 19 nt, Homo sapiens
ccucugagcuugccuucuu

SEQ ID NO: 1386553 - RNA, 19 nt, Homo sapiens
gaagucggcagaagaguug

SEQ ID NO: 1386554 - RNA, 19 nt, Homo sapiens
gcaacauugucauuaagga

SEQ ID NO: 1386555 - RNA, 19 nt, Homo sapiens
ggagggcuuuggaccauga

SEQ ID NO: 1386556 - RNA, 19 nt, Homo sapiens
ggugggcgguguuagauug

SEQ ID NO: 1386557 - RNA, 19 nt, Homo sapiens
gcagaagccauguuagaug

SEQ ID NO: 1386558 - RNA, 19 nt, Homo sapiens
caaaugccguuuccagaag

SEQ ID NO: 1386559 - RNA, 19 nt, Homo sapiens
acucucagauucuuuacua

SEQ ID NO: 1386560 - RNA, 19 nt, Homo sapiens
ggagagcuuuggauaaggu

SEQ ID NO: 1386561 - RNA, 19 nt, Homo sapiens
gaucagcaacauugucauu

SEQ ID NO: 1386562 - RNA, 19 nt, Homo sapiens
ggcaagaucagcaacauug

SEQ ID NO: 1386563 - RNA, 19 nt, Homo sapiens
gaguaaaugugaucagcau

SEQ ID NO: 1386564 - RNA, 19 nt, Homo sapiens
ggaagaccacggagaccua

SEQ ID NO: 1386565 - RNA, 19 nt, Homo sapiens
uccagaaaguuccagauuu

SEQ ID NO: 1386566 - RNA, 19 nt, Homo sapiens
ggcagcaccuccauaggaa

SEQ ID NO: 1386567 - RNA, 19 nt, Homo sapiens
caacuucucuguggacucu

SEQ ID NO: 1386568 - RNA, 19 nt, Homo sapiens
ugucagagguuccagaaag

SEQ ID NO: 1386569 - RNA, 19 nt, Homo sapiens
gcuaugagaucaccuucag

SEQ ID NO: 1386570 - RNA, 19 nt, Homo sapiens
aaacacuggcugaauauga

SEQ ID NO: 1386571 - RNA, 19 nt, Homo sapiens
gaaucaaacaguccugaau

SEQ ID NO: 1386572 - RNA, 19 nt, Homo sapiens
gccugucacugucguguuu

SEQ ID NO: 1386573 - RNA, 19 nt, Homo sapiens
gaaguuugccaucuacauc

SEQ ID NO: 1386574 - RNA, 19 nt, Homo sapiens
ggacauggugcgagugaug

SEQ ID NO: 1386575 - RNA, 19 nt, Homo sapiens
caaauggcacugaugaugu

SEQ ID NO: 1386576 - RNA, 19 nt, Homo sapiens
caaacaguccugaauucaa

SEQ ID NO: 1386577 - RNA, 19 nt, Homo sapiens
gggcagcaccuccauagga

SEQ ID NO: 1386578 - RNA, 19 nt, Homo sapiens
gcucaacuuucuacucuac

SEQ ID NO: 1386579 - RNA, 19 nt, Homo sapiens
cgggaggccuuuaacauca

SEQ ID NO: 1386580 - RNA, 19 nt, Homo sapiens
ucaaaugccguuuccagaa

SEQ ID NO: 1386581 - RNA, 19 nt, Homo sapiens
guucaaauggcacugauga

SEQ ID NO: 1386582 - RNA, 19 nt, Homo sapiens
gugcucaacuuucuacucu

SEQ ID NO: 1386583 - RNA, 19 nt, Homo sapiens
aguaggcucuuaauaaaca

SEQ ID NO: 1386584 - RNA, 19 nt, Homo sapiens
guaaaugugaucagcaugu

SEQ ID NO: 1386585 - RNA, 19 nt, Homo sapiens
uggauaagguauugaaucu

SEQ ID NO: 1386586 - RNA, 19 nt, Homo sapiens
ggcaaggacuguuuguucu

SEQ ID NO: 1386587 - RNA, 19 nt, Homo sapiens
gaccagaaguuugccaucu

SEQ ID NO: 1386588 - RNA, 19 nt, Homo sapiens
ggaggccuuuaacaucauu

SEQ ID NO: 1386589 - RNA, 19 nt, Homo sapiens
gacaugaugagcuacauug

SEQ ID NO: 1386590 - RNA, 19 nt, Homo sapiens
ggcugaauaugaauuggaa

SEQ ID NO: 1386591 - RNA, 19 nt, Homo sapiens
caucauccgggucuccuua

SEQ ID NO: 1386592 - RNA, 19 nt, Homo sapiens
gaaagccugagaagacaga

SEQ ID NO: 1386593 - RNA, 19 nt, Homo sapiens
ggacaugaugagcuacauu

SEQ ID NO: 1386594 - RNA, 19 nt, Homo sapiens
ucugaacacuccucacuuc

SEQ ID NO: 1386595 - RNA, 19 nt, Homo sapiens
cuaccgcucugguggaaga

SEQ ID NO: 1386596 - RNA, 19 nt, Homo sapiens
acucaccgcuguacauuca

SEQ ID NO: 1386597 - RNA, 19 nt, Homo sapiens
gugcaaccuuuccugaaug

SEQ ID NO: 1386598 - RNA, 19 nt, Homo sapiens
ggcagcagcucaggacaug

SEQ ID NO: 1386599 - RNA, 19 nt, Homo sapiens
gcaaggacuguuuguucuu

SEQ ID NO: 1386600 - RNA, 19 nt, Homo sapiens
caaggugggcgguguuaga

SEQ ID NO: 1386601 - RNA, 19 nt, Homo sapiens
cagcaacauugucauuaag

SEQ ID NO: 1386602 - RNA, 19 nt, Homo sapiens
gcuaaugaccugggagcua

SEQ ID NO: 1386603 - RNA, 19 nt, Homo sapiens
agaggcagaagccauguua

SEQ ID NO: 1386604 - RNA, 19 nt, Homo sapiens
aacacuggcugaauaugaa

SEQ ID NO: 1386605 - RNA, 19 nt, Homo sapiens
aaucaaacaguccugaauu

SEQ ID NO: 1386606 - RNA, 19 nt, Homo sapiens
ggaaucaaacaguccugaa

SEQ ID NO: 1386607 - RNA, 19 nt, Homo sapiens
ccauucaccuggcucaauc

SEQ ID NO: 1386608 - RNA, 19 nt, Homo sapiens
ggcgcuaugugcaaccuuu

SEQ ID NO: 1386609 - RNA, 19 nt, Homo sapiens
cccaggacaugaugagcua

SEQ ID NO: 1386610 - RNA, 19 nt, Homo sapiens
ucaaauggcacugaugaug

SEQ ID NO: 1386611 - RNA, 19 nt, Homo sapiens
uaugagaucaccuucaguu

SEQ ID NO: 1386612 - RNA, 19 nt, Homo sapiens
gugaucagcauguaaagug

SEQ ID NO: 1386613 - RNA, 19 nt, Homo sapiens
ccagaaguuugccaucuac

SEQ ID NO: 1386614 - RNA, 19 nt, Homo sapiens
gggcgguguuagauuguga

SEQ ID NO: 1386615 - RNA, 19 nt, Homo sapiens
gcagggcagcaccuccaua

SEQ ID NO: 1386616 - RNA, 19 nt, Homo sapiens
caagucccaugaugucuac

SEQ ID NO: 1386617 - RNA, 19 nt, Homo sapiens
ccaagucccaugaugucua

SEQ ID NO: 1386618 - RNA, 19 nt, Homo sapiens
gagcuuuggauaagguauu

SEQ ID NO: 1386619 - RNA, 19 nt, Homo sapiens
agauuccucugaaauacaa

SEQ ID NO: 1386620 - RNA, 19 nt, Homo sapiens
cagcuacuauuuggacaug

SEQ ID NO: 1386621 - RNA, 19 nt, Homo sapiens
gcccaggccaugucuuuga

SEQ ID NO: 1386622 - RNA, 19 nt, Homo sapiens
cuuauugucuggagagcuu

SEQ ID NO: 1386623 - RNA, 19 nt, Homo sapiens
uuucagggccuacgaguga

SEQ ID NO: 1386624 - RNA, 19 nt, Homo sapiens
caguugcgguugcucuuug

SEQ ID NO: 1386625 - RNA, 19 nt, Homo sapiens
aaauggcacugaugauguc

SEQ ID NO: 1386626 - RNA, 19 nt, Homo sapiens
ccagugcugccuccuugua

SEQ ID NO: 1386627 - RNA, 19 nt, Homo sapiens
ugugcaaccuuuccugaau

SEQ ID NO: 1386628 - RNA, 19 nt, Homo sapiens
cuggagagcuuuggauaag

SEQ ID NO: 1386629 - RNA, 19 nt, Homo sapiens
guccugaauucaaauccuu

SEQ ID NO: 1386630 - RNA, 19 nt, Homo sapiens
gccggaaugacuuaaauau

SEQ ID NO: 1386631 - RNA, 19 nt, Homo sapiens
gcuacuauuuggacaugca

SEQ ID NO: 1386632 - RNA, 19 nt, Homo sapiens
ccucugaaauacaaaauga

SEQ ID NO: 1386633 - RNA, 19 nt, Homo sapiens
accagaaguuugccaucua

SEQ ID NO: 1386634 - RNA, 19 nt, Homo sapiens
gcaagaucagcaacauugu

SEQ ID NO: 1386635 - RNA, 19 nt, Homo sapiens
cauauuaccuccagacuuu

SEQ ID NO: 1386636 - RNA, 19 nt, Homo sapiens
gcccaggugucccauauua

SEQ ID NO: 1386637 - RNA, 19 nt, Homo sapiens
ggacaggccucacuagucu

SEQ ID NO: 1386638 - RNA, 19 nt, Homo sapiens
ggagcgagauuccaacuuc

SEQ ID NO: 1386639 - RNA, 19 nt, Homo sapiens
ucaaagcaguccacggaua

SEQ ID NO: 1386640 - RNA, 19 nt, Homo sapiens
caacaucugugaccucaag

SEQ ID NO: 1386641 - RNA, 19 nt, Homo sapiens
caacucagcuggccuagac

SEQ ID NO: 1386642 - RNA, 19 nt, Homo sapiens
cagaugaaauggagaacuu

SEQ ID NO: 1386643 - RNA, 19 nt, Homo sapiens
cgagagcgauggcugagaa

SEQ ID NO: 1386644 - RNA, 19 nt, Homo sapiens
uaucaucagcuccuucuua

SEQ ID NO: 1386645 - RNA, 19 nt, Homo sapiens
gcugucuccuggcuaauaa

SEQ ID NO: 1386646 - RNA, 19 nt, Homo sapiens
gagaugguggauaaacuua

SEQ ID NO: 1386647 - RNA, 19 nt, Homo sapiens
ccuaagcgguuccaguuug

SEQ ID NO: 1386648 - RNA, 19 nt, Homo sapiens
caugauagacacaaugaaa

SEQ ID NO: 1386649 - RNA, 19 nt, Homo sapiens
ccaacuggauggaaaauaa

SEQ ID NO: 1386650 - RNA, 19 nt, Homo sapiens
gaaauccacccucaaagag

SEQ ID NO: 1386651 - RNA, 19 nt, Homo sapiens
gcacguggccaguaucauc

SEQ ID NO: 1386652 - RNA, 19 nt, Homo sapiens
gcugcugucuccuggcuaa

SEQ ID NO: 1386653 - RNA, 19 nt, Homo sapiens
ugaaauccacccucaaaga

SEQ ID NO: 1386654 - RNA, 19 nt, Homo sapiens
caaagcaguccacggauau

SEQ ID NO: 1386655 - RNA, 19 nt, Homo sapiens
gcagagaacagcauugacu

SEQ ID NO: 1386656 - RNA, 19 nt, Homo sapiens
gagcgagauuccaacuuca

SEQ ID NO: 1386657 - RNA, 19 nt, Homo sapiens
agaacuugcugaccuacaa

SEQ ID NO: 1386658 - RNA, 19 nt, Homo sapiens
ggacuacuucggauacaau

SEQ ID NO: 1386659 - RNA, 19 nt, Homo sapiens
cagcccaggugucccauau

SEQ ID NO: 1386660 - RNA, 19 nt, Homo sapiens
gcaagacuuuuauuacguu

SEQ ID NO: 1386661 - RNA, 19 nt, Homo sapiens
gcccauguccuguugauca

SEQ ID NO: 1386662 - RNA, 19 nt, Homo sapiens
gauuccaacuucaacaucu

SEQ ID NO: 1386663 - RNA, 19 nt, Homo sapiens
aaugaaauccacccucaaa

SEQ ID NO: 1386664 - RNA, 19 nt, Homo sapiens
gcucugggccuggaacuau

SEQ ID NO: 1386665 - RNA, 19 nt, Homo sapiens
uggagaacuugcugaccua

SEQ ID NO: 1386666 - RNA, 19 nt, Homo sapiens
ugagugagauccgaagagu

SEQ ID NO: 1386667 - RNA, 19 nt, Homo sapiens
ccaugcaacuucacaacuc

SEQ ID NO: 1386668 - RNA, 19 nt, Homo sapiens
cgucgugggcggaauguuu

SEQ ID NO: 1386669 - RNA, 19 nt, Homo sapiens
cuggaacuaugaagaccua

SEQ ID NO: 1386670 - RNA, 19 nt, Homo sapiens
agugagauccgaagaguug

SEQ ID NO: 1386671 - RNA, 19 nt, Homo sapiens
agaauuacucugacaagga

SEQ ID NO: 1386672 - RNA, 19 nt, Homo sapiens
ccuggaaucagaugaaaug

SEQ ID NO: 1386673 - RNA, 19 nt, Homo sapiens
cuaagcgguuccaguuugu

SEQ ID NO: 1386674 - RNA, 19 nt, Homo sapiens
caugcaacuucacaacuca

SEQ ID NO: 1386675 - RNA, 19 nt, Homo sapiens
gacagacucaucccucuuc

SEQ ID NO: 1386676 - RNA, 19 nt, Homo sapiens
acaaggagucccugucguu

SEQ ID NO: 1386677 - RNA, 19 nt, Homo sapiens
cgagaugguggauaaacuu

SEQ ID NO: 1386678 - RNA, 19 nt, Homo sapiens
uggcagccuugaaauggaa

SEQ ID NO: 1386679 - RNA, 19 nt, Homo sapiens
aaagguucuuguauucuca

SEQ ID NO: 1386680 - RNA, 19 nt, Homo sapiens
uuuauuacguugccaugga

SEQ ID NO: 1386681 - RNA, 19 nt, Homo sapiens
caucagcuccuucuuacag

SEQ ID NO: 1386682 - RNA, 19 nt, Homo sapiens
ggaagcugcaggcccaugu

SEQ ID NO: 1386683 - RNA, 19 nt, Homo sapiens
gagauuccaacuucaacau

SEQ ID NO: 1386684 - RNA, 19 nt, Homo sapiens
gggacaggccucacuaguc

SEQ ID NO: 1386685 - RNA, 19 nt, Homo sapiens
ugauagacacaaugaaauc

SEQ ID NO: 1386686 - RNA, 19 nt, Homo sapiens
gagucccugucguucauga

SEQ ID NO: 1386687 - RNA, 19 nt, Homo sapiens
gccuugaaauggaaucgau

SEQ ID NO: 1386688 - RNA, 19 nt, Homo sapiens
gaggacuacuucggauaca

SEQ ID NO: 1386689 - RNA, 19 nt, Homo sapiens
cugcccaacuggauggaaa

SEQ ID NO: 1386690 - RNA, 19 nt, Homo sapiens
caacaaggccagggauggu

SEQ ID NO: 1386691 - RNA, 19 nt, Homo sapiens
guggcagccuugaaaugga

SEQ ID NO: 1386692 - RNA, 19 nt, Homo sapiens
cagagaacagcauugacuu

SEQ ID NO: 1386693 - RNA, 19 nt, Homo sapiens
cuacaagcggagagccaua

SEQ ID NO: 1386694 - RNA, 19 nt, Homo sapiens
gucccugucguucaugaua

SEQ ID NO: 1386695 - RNA, 19 nt, Homo sapiens
aaucagaugaaauggagaa

SEQ ID NO: 1386696 - RNA, 19 nt, Homo sapiens
ggacacgccgcucuuucuc

SEQ ID NO: 1386697 - RNA, 19 nt, Homo sapiens
ggcccagccuaggauggua

SEQ ID NO: 1386698 - RNA, 19 nt, Homo sapiens
gggccuggaacuaugaaga

SEQ ID NO: 1386699 - RNA, 19 nt, Homo sapiens
cccagcacguggccaguau

SEQ ID NO: 1386700 - RNA, 19 nt, Homo sapiens
ccauauuaccuccagacuu

SEQ ID NO: 1386701 - RNA, 19 nt, Homo sapiens
ccgagaugguggauaaacu

SEQ ID NO: 1386702 - RNA, 19 nt, Homo sapiens
ucccuaagcgguuccaguu

SEQ ID NO: 1386703 - RNA, 19 nt, Homo sapiens
cauguccuguugaucaaag

SEQ ID NO: 1386704 - RNA, 19 nt, Homo sapiens
aagaggacuacuucggaua

SEQ ID NO: 1386705 - RNA, 19 nt, Homo sapiens
aagcaguccacggauauuu

SEQ ID NO: 1386706 - RNA, 19 nt, Homo sapiens
cccauguccuguugaucaa

SEQ ID NO: 1386707 - RNA, 19 nt, Homo sapiens
gggaaggagucgauucuua

SEQ ID NO: 1386708 - RNA, 19 nt, Homo sapiens
gaagagaaauaaaccacuu

SEQ ID NO: 1386709 - RNA, 19 nt, Homo sapiens
caaguaaguuugccagaaa

SEQ ID NO: 1386710 - RNA, 19 nt, Homo sapiens
cuacaacugugucuuuaua

SEQ ID NO: 1386711 - RNA, 19 nt, Homo sapiens
gaaacgacuuuaggucuuu

SEQ ID NO: 1386712 - RNA, 19 nt, Homo sapiens
ggagucgauucuuaaauaa

SEQ ID NO: 1386713 - RNA, 19 nt, Homo sapiens
ggaaggagucgauucuuaa

SEQ ID NO: 1386714 - RNA, 19 nt, Homo sapiens
gcaaauacaagcugcguuu

SEQ ID NO: 1386715 - RNA, 19 nt, Homo sapiens
gucaaaguguugcuucuua

SEQ ID NO: 1386716 - RNA, 19 nt, Homo sapiens
gaaccaagccaugcucuuu

SEQ ID NO: 1386717 - RNA, 19 nt, Homo sapiens
ggugaaagccugccacauu

SEQ ID NO: 1386718 - RNA, 19 nt, Homo sapiens
ggagggaggucaccaugga

SEQ ID NO: 1386719 - RNA, 19 nt, Homo sapiens
aggagucgauucuuaaaua

SEQ ID NO: 1386720 - RNA, 19 nt, Homo sapiens
aagcugcguuucuuuaaua

SEQ ID NO: 1386721 - RNA, 19 nt, Homo sapiens
gaacuacccagaagaugaa

SEQ ID NO: 1386722 - RNA, 19 nt, Homo sapiens
cauggaaacuaaacagauu

SEQ ID NO: 1386723 - RNA, 19 nt, Homo sapiens
gaacagacacuuugaaacg

SEQ ID NO: 1386724 - RNA, 19 nt, Homo sapiens
ucaaaguguugcuucuuaa

SEQ ID NO: 1386725 - RNA, 19 nt, Homo sapiens
gaucaggagaugcucuuua

SEQ ID NO: 1386726 - RNA, 19 nt, Homo sapiens
caagagagcuguguguucu

SEQ ID NO: 1386727 - RNA, 19 nt, Homo sapiens
ggaacuacccagaagauga

SEQ ID NO: 1386728 - RNA, 19 nt, Homo sapiens
aaucaaugcugcagaaugu

SEQ ID NO: 1386729 - RNA, 19 nt, Homo sapiens
cagaaucaaugcugcagaa

SEQ ID NO: 1386730 - RNA, 19 nt, Homo sapiens
gugaaagccugccacauuc

SEQ ID NO: 1386731 - RNA, 19 nt, Homo sapiens
gaaggagucgauucuuaaa

SEQ ID NO: 1386732 - RNA, 19 nt, Homo sapiens
ccaaguaaguuugccagaa

SEQ ID NO: 1386733 - RNA, 19 nt, Homo sapiens
gcacuacgggaaucaguuu

SEQ ID NO: 1386734 - RNA, 19 nt, Homo sapiens
gaaauaaaccacuuguacu

SEQ ID NO: 1386735 - RNA, 19 nt, Homo sapiens
agaaccaccugucaucaaa

SEQ ID NO: 1386736 - RNA, 19 nt, Homo sapiens
ggaagaaccaccugucauc

SEQ ID NO: 1386737 - RNA, 19 nt, Homo sapiens
cugguuaggucacuacuuu

SEQ ID NO: 1386738 - RNA, 19 nt, Homo sapiens
gaacaagccaaaucagagu

SEQ ID NO: 1386739 - RNA, 19 nt, Homo sapiens
gaaucaguuuccagccuaa

SEQ ID NO: 1386740 - RNA, 19 nt, Homo sapiens
caacagauuugcagcucau

SEQ ID NO: 1386741 - RNA, 19 nt, Homo sapiens
gaaacagagacuacgauga

SEQ ID NO: 1386742 - RNA, 19 nt, Homo sapiens
ggcauggucucagguauga

SEQ ID NO: 1386743 - RNA, 19 nt, Homo sapiens
gccauaaacucacuuuggu

SEQ ID NO: 1386744 - RNA, 19 nt, Homo sapiens
ugaaacgacuuuaggucuu

SEQ ID NO: 1386745 - RNA, 19 nt, Homo sapiens
gcaguggccugggaaguca

SEQ ID NO: 1386746 - RNA, 19 nt, Homo sapiens
gggcguaccagcugaugua

SEQ ID NO: 1386747 - RNA, 19 nt, Homo sapiens
ggccucaccuggaagagaa

SEQ ID NO: 1386748 - RNA, 19 nt, Homo sapiens
gguaugaacagacacuuug

SEQ ID NO: 1386749 - RNA, 19 nt, Homo sapiens
acgaugacauugaugauga

SEQ ID NO: 1386750 - RNA, 19 nt, Homo sapiens
gagaaauaaaccacuugua

SEQ ID NO: 1386751 - RNA, 19 nt, Homo sapiens
caagcugcguuucuuuaau

SEQ ID NO: 1386752 - RNA, 19 nt, Homo sapiens
agacuacgaugacauugau

SEQ ID NO: 1386753 - RNA, 19 nt, Homo sapiens
ggaacucugcgacgucaaa

SEQ ID NO: 1386754 - RNA, 19 nt, Homo sapiens
gaagaaccaccugucauca

SEQ ID NO: 1386755 - RNA, 19 nt, Homo sapiens
ggugggcguugguuucuau

SEQ ID NO: 1386756 - RNA, 19 nt, Homo sapiens
gaaucaaugcugcagaaug

SEQ ID NO: 1386757 - RNA, 19 nt, Homo sapiens
gagggcugcacaaggauua

SEQ ID NO: 1386758 - RNA, 19 nt, Homo sapiens
aggaagaccugcuugcaau

SEQ ID NO: 1386759 - RNA, 19 nt, Homo sapiens
gaggaagaccugcuugcaa

SEQ ID NO: 1386760 - RNA, 19 nt, Homo sapiens
caaaguguugcuucuuaaa

SEQ ID NO: 1386761 - RNA, 19 nt, Homo sapiens
cauaaacucacuuugguau

SEQ ID NO: 1386762 - RNA, 19 nt, Homo sapiens
cagcgaagccuccacaaca

SEQ ID NO: 1386763 - RNA, 19 nt, Homo sapiens
gcagauaggcauggucuca

SEQ ID NO: 1386764 - RNA, 19 nt, Homo sapiens
gagacuacgaugacauuga

SEQ ID NO: 1386765 - RNA, 19 nt, Homo sapiens
ccacagagggaggaucuuu

SEQ ID NO: 1386766 - RNA, 19 nt, Homo sapiens
aucaggagaugcucuuuaa

SEQ ID NO: 1386767 - RNA, 19 nt, Homo sapiens
cagaggagcagcugggauu

SEQ ID NO: 1386768 - RNA, 19 nt, Homo sapiens
agaaauaaaccacuuguac

SEQ ID NO: 1386769 - RNA, 19 nt, Homo sapiens
acagagggaggaucuuuaa

SEQ ID NO: 1386770 - RNA, 19 nt, Homo sapiens
gggcguugguuucuaugga

SEQ ID NO: 1386771 - RNA, 19 nt, Homo sapiens
caaagaauugaaacuccua

SEQ ID NO: 1386772 - RNA, 19 nt, Homo sapiens
ucaucuuccuuguggcuua

SEQ ID NO: 1386773 - RNA, 19 nt, Homo sapiens
uacaagcugcguuucuuua

SEQ ID NO: 1386774 - RNA, 19 nt, Homo sapiens
gcauggaaacuaaacagau

SEQ ID NO: 1386775 - RNA, 19 nt, Homo sapiens
caacugugucuuuauagga

SEQ ID NO: 1386776 - RNA, 19 nt, Homo sapiens
auuugcagcucauuccuua

SEQ ID NO: 1386777 - RNA, 19 nt, Homo sapiens
cuacauuaacccaugcaua

SEQ ID NO: 1386778 - RNA, 19 nt, Homo sapiens
gugcuacaacugugucuuu

SEQ ID NO: 1386779 - RNA, 19 nt, Homo sapiens
ggucucagguaugaacaga

SEQ ID NO: 1386780 - RNA, 19 nt, Homo sapiens
cagaacaagccaaaucaga

SEQ ID NO: 1386781 - RNA, 19 nt, Homo sapiens
gccaugcucuuugguagga

SEQ ID NO: 1386782 - RNA, 19 nt, Homo sapiens
caagccaugcucuuuggua

SEQ ID NO: 1386783 - RNA, 19 nt, Homo sapiens
aaacagagacuacgaugac

SEQ ID NO: 1386784 - RNA, 19 nt, Homo sapiens
ugggaucgaugcucugguu

SEQ ID NO: 1386785 - RNA, 19 nt, Homo sapiens
gcucugguuuccggaacua

SEQ ID NO: 1386786 - RNA, 19 nt, Homo sapiens
gacuuuaggucuuucuuuu

SEQ ID NO: 1386787 - RNA, 19 nt, Homo sapiens
aauacaagcugcguuucuu

SEQ ID NO: 1386788 - RNA, 19 nt, Homo sapiens
uacgagaacgugccacuaa

SEQ ID NO: 1386789 - RNA, 19 nt, Homo sapiens
cgacuuuaggucuuucuuu

SEQ ID NO: 1386790 - RNA, 19 nt, Homo sapiens
uguguuagcugcagauagg

SEQ ID NO: 1386791 - RNA, 19 nt, Homo sapiens
cgaugacucugccucuugu

SEQ ID NO: 1386792 - RNA, 19 nt, Homo sapiens
ugacauugaugaugaugac

SEQ ID NO: 1386793 - RNA, 19 nt, Homo sapiens
cagagacuacgaugacauu

SEQ ID NO: 1386794 - RNA, 19 nt, Homo sapiens
ggcguugguuucuauggaa

SEQ ID NO: 1386795 - RNA, 19 nt, Homo sapiens
ccauaaacucacuuuggua

SEQ ID NO: 1386796 - RNA, 19 nt, Homo sapiens
cauguugauuauccaaaga

SEQ ID NO: 1386797 - RNA, 19 nt, Homo sapiens
gaaccucaucuuccuugug

SEQ ID NO: 1386798 - RNA, 19 nt, Homo sapiens
cacagagggaggaucuuua

SEQ ID NO: 1386799 - RNA, 19 nt, Homo sapiens
ucucagguaugaacagaca

SEQ ID NO: 1386800 - RNA, 19 nt, Homo sapiens
cuggucaucugccucauug

SEQ ID NO: 1386801 - RNA, 19 nt, Homo sapiens
acaagcugcguuucuuuaa

SEQ ID NO: 1386802 - RNA, 19 nt, Homo sapiens
gcacuucaccaccagaaac

SEQ ID NO: 1386803 - RNA, 19 nt, Homo sapiens
agaggugacucgcuacuac

SEQ ID NO: 1386804 - RNA, 19 nt, Homo sapiens
ucaccuggaagagaaauaa

SEQ ID NO: 1386805 - RNA, 19 nt, Homo sapiens
gaaacagcgagaccaacga

SEQ ID NO: 1386806 - RNA, 19 nt, Homo sapiens
ucacuacuuuugcagauuu

SEQ ID NO: 1386807 - RNA, 19 nt, Homo sapiens
gagcaagucuuucuagaua

SEQ ID NO: 1386808 - RNA, 19 nt, Homo sapiens
gaaauggagucaucaguuu

SEQ ID NO: 1386809 - RNA, 19 nt, Homo sapiens
caacagaaaugagcccuua

SEQ ID NO: 1386810 - RNA, 19 nt, Homo sapiens
ccagauaaauuuccacauu

SEQ ID NO: 1386811 - RNA, 19 nt, Homo sapiens
gaagaacggugcugagaca

SEQ ID NO: 1386812 - RNA, 19 nt, Homo sapiens
gcacuaaggucugugaaga

SEQ ID NO: 1386813 - RNA, 19 nt, Homo sapiens
gagagcagcuguauuugga

SEQ ID NO: 1386814 - RNA, 19 nt, Homo sapiens
aaagacagccucuaccuua

SEQ ID NO: 1386815 - RNA, 19 nt, Homo sapiens
ggacagggauagccucuuc

SEQ ID NO: 1386816 - RNA, 19 nt, Homo sapiens
acaauuaacuucaccauca

SEQ ID NO: 1386817 - RNA, 19 nt, Homo sapiens
gcgaguaccagauaaauuu

SEQ ID NO: 1386818 - RNA, 19 nt, Homo sapiens
gggcagaaauaaaccauau

SEQ ID NO: 1386819 - RNA, 19 nt, Homo sapiens
ucacuaaccugcgguauga

SEQ ID NO: 1386820 - RNA, 19 nt, Homo sapiens
ucacuaaccugcgguauga

SEQ ID NO: 1386821 - RNA, 19 nt, Homo sapiens
ggacaacgacagccucuuu

SEQ ID NO: 1386822 - RNA, 19 nt, Homo sapiens
agacagaguugccaucuau

SEQ ID NO: 1386823 - RNA, 19 nt, Homo sapiens
gcuauucacucucaacuuc

SEQ ID NO: 1386824 - RNA, 19 nt, Homo sapiens
guacccagcugcagaacuu

SEQ ID NO: 1386825 - RNA, 19 nt, Homo sapiens
caaugaaccuggucuagau

SEQ ID NO: 1386826 - RNA, 19 nt, Homo sapiens
ucaagcagguguuccauga

SEQ ID NO: 1386827 - RNA, 19 nt, Homo sapiens
gaggagccauucacacuga

SEQ ID NO: 1386828 - RNA, 19 nt, Homo sapiens
gagagcggcuguacuggaa

SEQ ID NO: 1386829 - RNA, 19 nt, Homo sapiens
gauagccucuucaucaaug

SEQ ID NO: 1386830 - RNA, 19 nt, Homo sapiens
cagauaaauuuccacauug

SEQ ID NO: 1386831 - RNA, 19 nt, Homo sapiens
ucacugagcugggccacua

SEQ ID NO: 1386832 - RNA, 19 nt, Homo sapiens
gaagaaggaaggagaauac

SEQ ID NO: 1386833 - RNA, 19 nt, Homo sapiens
ucaccaaccuaccauauuc

SEQ ID NO: 1386834 - RNA, 19 nt, Homo sapiens
ggacagggacagucucuau

SEQ ID NO: 1386835 - RNA, 19 nt, Homo sapiens
ggacagggacagucucuau

SEQ ID NO: 1386836 - RNA, 19 nt, Homo sapiens
ggaagaaggaaggagaaua

SEQ ID NO: 1386837 - RNA, 19 nt, Homo sapiens
cgaaacagcagcaucaaga

SEQ ID NO: 1386838 - RNA, 19 nt, Homo sapiens
gcaagucuuucuagauaag

SEQ ID NO: 1386839 - RNA, 19 nt, Homo sapiens
gggauagccucuucaucaa

SEQ ID NO: 1386840 - RNA, 19 nt, Homo sapiens
ucaccaaccugcgguauga

SEQ ID NO: 1386841 - RNA, 19 nt, Homo sapiens
caaaggcagucaacuacau

SEQ ID NO: 1386842 - RNA, 19 nt, Homo sapiens
cuacaaaggcagucaacua

SEQ ID NO: 1386843 - RNA, 19 nt, Homo sapiens
ggacaaagacagccucuac

SEQ ID NO: 1386844 - RNA, 19 nt, Homo sapiens
ucaacuacaugacacauuc

SEQ ID NO: 1386845 - RNA, 19 nt, Homo sapiens
gcccuaggcuggacagaga

SEQ ID NO: 1386846 - RNA, 19 nt, Homo sapiens
cuggugcuauucacaauua

SEQ ID NO: 1386847 - RNA, 19 nt, Homo sapiens
ucaaccaacucuuccgaaa

SEQ ID NO: 1386848 - RNA, 19 nt, Homo sapiens
acagcagcaucaagaguua

SEQ ID NO: 1386849 - RNA, 19 nt, Homo sapiens
ucuccaaucuccaguauuc

SEQ ID NO: 1386850 - RNA, 19 nt, Homo sapiens
ggacaggcacagucucuau

SEQ ID NO: 1386851 - RNA, 19 nt, Homo sapiens
ggacagagagcagcuauac

SEQ ID NO: 1386852 - RNA, 19 nt, Homo sapiens
gcccaggucugccuaucaa

SEQ ID NO: 1386853 - RNA, 19 nt, Homo sapiens
gaaggaaggagaauacaac

SEQ ID NO: 1386854 - RNA, 19 nt, Homo sapiens
ccaggaaguucaacacuac

SEQ ID NO: 1386855 - RNA, 19 nt, Homo sapiens
ugaagacccucacacucaa

SEQ ID NO: 1386856 - RNA, 19 nt, Homo sapiens
gaacuucaccaucaacaac

SEQ ID NO: 1386857 - RNA, 19 nt, Homo sapiens
ccuacucucuggacaaaga

SEQ ID NO: 1386858 - RNA, 19 nt, Homo sapiens
gcccuggacuggacagaga

SEQ ID NO: 1386859 - RNA, 19 nt, Homo sapiens
gcccuggacuggacagaga

SEQ ID NO: 1386860 - RNA, 19 nt, Homo sapiens
ccugauaccuccacaaugc

SEQ ID NO: 1386861 - RNA, 19 nt, Homo sapiens
cggaugacccggaauggua

SEQ ID NO: 1386862 - RNA, 19 nt, Homo sapiens
ggagucaucaguuuaucaa

SEQ ID NO: 1386863 - RNA, 19 nt, Homo sapiens
acacucaacuucaccaucu

SEQ ID NO: 1386864 - RNA, 19 nt, Homo sapiens
caacccggcucccucaagu

SEQ ID NO: 1386865 - RNA, 19 nt, Homo sapiens
cuucugggcugucaucuuc

SEQ ID NO: 1386866 - RNA, 19 nt, Homo sapiens
aagacagccucuaccuuaa

SEQ ID NO: 1386867 - RNA, 19 nt, Homo sapiens
aaccaacucuuccgaaaca

SEQ ID NO: 1386868 - RNA, 19 nt, Homo sapiens
ggagcaagucuuucuagau

SEQ ID NO: 1386869 - RNA, 19 nt, Homo sapiens
gggcucagcuacauucaac

SEQ ID NO: 1386870 - RNA, 19 nt, Homo sapiens
ugccagccaucuccugaua

SEQ ID NO: 1386871 - RNA, 19 nt, Homo sapiens
cagcugacccacaauauca

SEQ ID NO: 1386872 - RNA, 19 nt, Homo sapiens
gacgauggacuccguguug

SEQ ID NO: 1386873 - RNA, 19 nt, Homo sapiens
ugagggacauccaggacaa

SEQ ID NO: 1386874 - RNA, 19 nt, Homo sapiens
caucuccaaucuccaguau

SEQ ID NO: 1386875 - RNA, 19 nt, Homo sapiens
ucacagacaacgucaugaa

SEQ ID NO: 1386876 - RNA, 19 nt, Homo sapiens
gcucaggccuguguucaag

SEQ ID NO: 1386877 - RNA, 19 nt, Homo sapiens
gcaucacccuggcucuaga

SEQ ID NO: 1386878 - RNA, 19 nt, Homo sapiens
ggucaccacacucuacaaa

SEQ ID NO: 1386879 - RNA, 19 nt, Homo sapiens
cuaccgcccugaucccaaa

SEQ ID NO: 1386880 - RNA, 19 nt, Homo sapiens
ugccaucuaugaggaauuu

SEQ ID NO: 1386881 - RNA, 19 nt, Homo sapiens
aaauggagucaucaguuua

SEQ ID NO: 1386882 - RNA, 19 nt, Homo sapiens
ucaccacacucuacaaagg

SEQ ID NO: 1386883 - RNA, 19 nt, Homo sapiens
ggcaagggcucagcuacau

SEQ ID NO: 1386884 - RNA, 19 nt, Homo sapiens
cagcacuucuacccgaauu

SEQ ID NO: 1386885 - RNA, 19 nt, Homo sapiens
agaaauggagucaucaguu

SEQ ID NO: 1386886 - RNA, 19 nt, Homo sapiens
caacuucaccaucuccaau

SEQ ID NO: 1386887 - RNA, 19 nt, Homo sapiens
ugagccagcugacccacaa

SEQ ID NO: 1386888 - RNA, 19 nt, Homo sapiens
cacccuggcucuagaaagu

SEQ ID NO: 1386889 - RNA, 19 nt, Homo sapiens
ccaauuaccagaggaacaa

SEQ ID NO: 1386890 - RNA, 19 nt, Homo sapiens
gcacagucucuaugucaau

SEQ ID NO: 1386891 - RNA, 19 nt, Homo sapiens
caaagacagccucuaccuu

SEQ ID NO: 1386892 - RNA, 19 nt, Homo sapiens
cagacaacgucaugaagca

SEQ ID NO: 1386893 - RNA, 19 nt, Homo sapiens
uccaggaaguucaacacua

SEQ ID NO: 1386894 - RNA, 19 nt, Homo sapiens
acucucaacuucaccauca

SEQ ID NO: 1386895 - RNA, 19 nt, Homo sapiens
acagagagcagcuauacug

SEQ ID NO: 1386896 - RNA, 19 nt, Homo sapiens
ucaggccuguguucaagaa

SEQ ID NO: 1386897 - RNA, 19 nt, Homo sapiens
gcccuuaacugggaauucu

SEQ ID NO: 1386898 - RNA, 19 nt, Homo sapiens
ugucaaguuucaacauuca

SEQ ID NO: 1386899 - RNA, 19 nt, Homo sapiens
gcacuucuacccgaauuuc

SEQ ID NO: 1386900 - RNA, 19 nt, Homo sapiens
ggacauacagcagcuuuac

SEQ ID NO: 1386901 - RNA, 19 nt, Homo sapiens
gguaugaggagaacaugug

SEQ ID NO: 1386902 - RNA, 19 nt, Homo sapiens
ccuggaggaucugcaauga

SEQ ID NO: 1386903 - RNA, 19 nt, Homo sapiens
caagggcucagcuacauuc

SEQ ID NO: 1386904 - RNA, 19 nt, Homo sapiens
gcaagggcucagcuacauu

SEQ ID NO: 1386905 - RNA, 19 nt, Homo sapiens
gucaaugguuucacucauc

SEQ ID NO: 1386906 - RNA, 19 nt, Homo sapiens
agggauagccucuucauca

SEQ ID NO: 1386907 - RNA, 19 nt, Homo sapiens
ccacaaacccgagguauaa

SEQ ID NO: 1386908 - RNA, 19 nt, Homo sapiens
gcucucagcugucaaugug

SEQ ID NO: 1386909 - RNA, 19 nt, Homo sapiens
caauaaaggcuucucaauc

SEQ ID NO: 1386910 - RNA, 19 nt, Homo sapiens
caccaaggauggagauguu

SEQ ID NO: 1386911 - RNA, 19 nt, Homo sapiens
aauaaaggcuucucaaucc

SEQ ID NO: 1386912 - RNA, 19 nt, Homo sapiens
acaauaaaggcuucucaau

SEQ ID NO: 1386913 - RNA, 19 nt, Homo sapiens
cgagguauaaagccaggua

SEQ ID NO: 1386914 - RNA, 19 nt, Homo sapiens
ucccuggccuugucuacuu

SEQ ID NO: 1386915 - RNA, 19 nt, Homo sapiens
cccacaaacccgagguaua

SEQ ID NO: 1386916 - RNA, 19 nt, Homo sapiens
ccacaauaaaggcuucuca

SEQ ID NO: 1386917 - RNA, 19 nt, Homo sapiens
ccgauccucccacaauaaa

SEQ ID NO: 1386918 - RNA, 19 nt, Homo sapiens
ccucauccuuggcgcuaga

SEQ ID NO: 1386919 - RNA, 19 nt, Homo sapiens
gauccucccacaauaaagg

SEQ ID NO: 1386920 - RNA, 19 nt, Homo sapiens
ccuacacccuacucucugu

SEQ ID NO: 1386921 - RNA, 19 nt, Homo sapiens
cgucaacaccaccaucugu

SEQ ID NO: 1386922 - RNA, 19 nt, Homo sapiens
cacaauaaaggcuucucaa

SEQ ID NO: 1386923 - RNA, 19 nt, Homo sapiens
ucaaagacaucgacaagaa

SEQ ID NO: 1386924 - RNA, 19 nt, Homo sapiens
ggucacaucugaucccuuu

SEQ ID NO: 1386925 - RNA, 19 nt, Homo sapiens
guaaauggauucccagugu

SEQ ID NO: 1386926 - RNA, 19 nt, Homo sapiens
gaggacaggucacaucuga

SEQ ID NO: 1386927 - RNA, 19 nt, Homo sapiens
caagauccaucccaagaaa

SEQ ID NO: 1386928 - RNA, 19 nt, Homo sapiens
gagcuuugcuguaaaugga

SEQ ID NO: 1386929 - RNA, 19 nt, Homo sapiens
gaacacccaucugcaguau

SEQ ID NO: 1386930 - RNA, 19 nt, Homo sapiens
ggucagcaguggaauuuau

SEQ ID NO: 1386931 - RNA, 19 nt, Homo sapiens
ucacagaguuccaagacaa

SEQ ID NO: 1386932 - RNA, 19 nt, Homo sapiens
gaacgacgaccuccucuuc

SEQ ID NO: 1386933 - RNA, 19 nt, Homo sapiens
gacaagaagucggacauug

SEQ ID NO: 1386934 - RNA, 19 nt, Homo sapiens
gaccgagucuccucuccua

SEQ ID NO: 1386935 - RNA, 19 nt, Homo sapiens
ggucugggcugccaagcuu

SEQ ID NO: 1386936 - RNA, 19 nt, Homo sapiens
caacgggcguccucuagug

SEQ ID NO: 1386937 - RNA, 19 nt, Homo sapiens
gggagcacguggaaaguug

SEQ ID NO: 1386938 - RNA, 19 nt, Homo sapiens
guauguuucucuacuguau

SEQ ID NO: 1386939 - RNA, 19 nt, Homo sapiens
ggacaggucacaucugauc

SEQ ID NO: 1386940 - RNA, 19 nt, Homo sapiens
cagaugauccugaaaguca

SEQ ID NO: 1386941 - RNA, 19 nt, Homo sapiens
gaggucagcaguggaauuu

SEQ ID NO: 1386942 - RNA, 19 nt, Homo sapiens
caaguucuccggauauuca

SEQ ID NO: 1386943 - RNA, 19 nt, Homo sapiens
uuugugagcuuugcuguaa

SEQ ID NO: 1386944 - RNA, 19 nt, Homo sapiens
gaucaaagacuggaagaag

SEQ ID NO: 1386945 - RNA, 19 nt, Homo sapiens
uaaauggauucccaguguu

SEQ ID NO: 1386946 - RNA, 19 nt, Homo sapiens
cgucagagccugcagacaa

SEQ ID NO: 1386947 - RNA, 19 nt, Homo sapiens
ucacacgguuccucacaga

SEQ ID NO: 1386948 - RNA, 19 nt, Homo sapiens
ggacauugccaccaucaag

SEQ ID NO: 1386949 - RNA, 19 nt, Homo sapiens
guacagaugauccugaaag

SEQ ID NO: 1386950 - RNA, 19 nt, Homo sapiens
gguucuggcuucaucaugu

SEQ ID NO: 1386951 - RNA, 19 nt, Homo sapiens
cuuccaaguucuccggaua

SEQ ID NO: 1386952 - RNA, 19 nt, Homo sapiens
aagacaagcagaucaaaga

SEQ ID NO: 1386953 - RNA, 19 nt, Homo sapiens
ucagagaggcggcauccaa

SEQ ID NO: 1386954 - RNA, 19 nt, Homo sapiens
aaagcucccuguguuguug

SEQ ID NO: 1386955 - RNA, 19 nt, Homo sapiens
caucaaagacaucgacaag

SEQ ID NO: 1386956 - RNA, 19 nt, Homo sapiens
gcaggcagcagcucaaggu

SEQ ID NO: 1386957 - RNA, 19 nt, Homo sapiens
gacauugccaccaucaaga

SEQ ID NO: 1386958 - RNA, 19 nt, Homo sapiens
ucacaaaacugccuuccau

SEQ ID NO: 1386959 - RNA, 19 nt, Homo sapiens
ccagaggucagcaguggaa

SEQ ID NO: 1386960 - RNA, 19 nt, Homo sapiens
ugaacacccaucugcagua

SEQ ID NO: 1386961 - RNA, 19 nt, Homo sapiens
cagcgguucuggcuucauc

SEQ ID NO: 1386962 - RNA, 19 nt, Homo sapiens
gcuuugcuguaaauggauu

SEQ ID NO: 1386963 - RNA, 19 nt, Homo sapiens
ggaacgagugugucucaag

SEQ ID NO: 1386964 - RNA, 19 nt, Homo sapiens
ggucaacgggcguccucua

SEQ ID NO: 1386965 - RNA, 19 nt, Homo sapiens
gagaggcggcauccaagau

SEQ ID NO: 1386966 - RNA, 19 nt, Homo sapiens
caagagguugcgccgaauu

SEQ ID NO: 1386967 - RNA, 19 nt, Homo sapiens
ugugagcuuugcuguaaau

SEQ ID NO: 1386968 - RNA, 19 nt, Homo sapiens
ucaaggugcagcuacagaa

SEQ ID NO: 1386969 - RNA, 19 nt, Homo sapiens
ucaagauccaucccaagaa

SEQ ID NO: 1386970 - RNA, 19 nt, Homo sapiens
caguggaauuuaugugcaa

SEQ ID NO: 1386971 - RNA, 19 nt, Homo sapiens
cuacagaacacagugacaa

SEQ ID NO: 1386972 - RNA, 19 nt, Homo sapiens
caaagacaucgacaagaag

SEQ ID NO: 1386973 - RNA, 19 nt, Homo sapiens
uugcugacgugguggagaa

SEQ ID NO: 1386974 - RNA, 19 nt, Homo sapiens
uacagaugauccugaaagu

SEQ ID NO: 1386975 - RNA, 19 nt, Homo sapiens
caagacaagcagaucaaag

SEQ ID NO: 1386976 - RNA, 19 nt, Homo sapiens
ccuaugaggccaccaucaa

SEQ ID NO: 1386977 - RNA, 19 nt, Homo sapiens
uguacuguauguuucucua

SEQ ID NO: 1386978 - RNA, 19 nt, Homo sapiens
aaauggauucccaguguug

SEQ ID NO: 1386979 - RNA, 19 nt, Homo sapiens
cuaugaggccaccaucaaa

SEQ ID NO: 1386980 - RNA, 19 nt, Homo sapiens
ugagacacccgcuguuugg

SEQ ID NO: 1386981 - RNA, 19 nt, Homo sapiens
caaggugcagcuacagaau

SEQ ID NO: 1386982 - RNA, 19 nt, Homo sapiens
ccaagacaagcagaucaaa

SEQ ID NO: 1386983 - RNA, 19 nt, Homo sapiens
cgagucuccucuccuacug

SEQ ID NO: 1386984 - RNA, 19 nt, Homo sapiens
cacgguuccucacagaguu

SEQ ID NO: 1386985 - RNA, 19 nt, Homo sapiens
uugcuuguacuguauguuu

SEQ ID NO: 1386986 - RNA, 19 nt, Homo sapiens
ggaacgacgaccuccucuu

SEQ ID NO: 1386987 - RNA, 19 nt, Homo sapiens
ccugagacacccgcuguuu

SEQ ID NO: 1386988 - RNA, 19 nt, Homo sapiens
acacccaucugcaguaucc

SEQ ID NO: 1386989 - RNA, 19 nt, Homo sapiens
uccaaguucuccggauauu

SEQ ID NO: 1386990 - RNA, 19 nt, Homo sapiens
gggaacgagugugucucaa

SEQ ID NO: 1386991 - RNA, 19 nt, Homo sapiens
caacauccccuuguacaga

SEQ ID NO: 1386992 - RNA, 19 nt, Homo sapiens
aaagacaucgacaagaagu

SEQ ID NO: 1386993 - RNA, 19 nt, Homo sapiens
gcaucaacacgcucaaggu

SEQ ID NO: 1386994 - RNA, 19 nt, Homo sapiens
gucagagccugcagacaac

SEQ ID NO: 1386995 - RNA, 19 nt, Homo sapiens
gcagucccuucgcccuaca

SEQ ID NO: 1386996 - RNA, 19 nt, Homo sapiens
gaucgaggaugaccggaua

SEQ ID NO: 1386997 - RNA, 19 nt, Homo sapiens
ggacaccaacuccuucuuc

SEQ ID NO: 1386998 - RNA, 19 nt, Homo sapiens
gaguggugaucgaggauga

SEQ ID NO: 1386999 - RNA, 19 nt, Homo sapiens
ggauagacgacgugcugaa

SEQ ID NO: 1387000 - RNA, 19 nt, Homo sapiens
cuacagcgaagacaagaug

SEQ ID NO: 1387001 - RNA, 19 nt, Homo sapiens
gcuccgaccucuccuucag

SEQ ID NO: 1387002 - RNA, 19 nt, Homo sapiens
ccaagcgaguggugaucga

SEQ ID NO: 1387003 - RNA, 19 nt, Homo sapiens
gauagacgacgugcugaag

SEQ ID NO: 1387004 - RNA, 19 nt, Homo sapiens
gagccaagcgaguggugau

SEQ ID NO: 1387005 - RNA, 19 nt, Homo sapiens
ggaaagagguccuauaaau

SEQ ID NO: 1387006 - RNA, 19 nt, Homo sapiens
agaaagaccuuaugaaugu

SEQ ID NO: 1387007 - RNA, 19 nt, Homo sapiens
ggaaagaccaggacauuga

SEQ ID NO: 1387008 - RNA, 19 nt, Homo sapiens
gaaagagaccuuaugaaug

SEQ ID NO: 1387009 - RNA, 19 nt, Homo sapiens
ggagaaaucccaccaaugu

SEQ ID NO: 1387010 - RNA, 19 nt, Homo sapiens
ggagaaagaccuuaugaau

SEQ ID NO: 1387011 - RNA, 19 nt, Homo sapiens
caaauuaccuuagacuuca

SEQ ID NO: 1387012 - RNA, 19 nt, Homo sapiens
gaaagagguccuauaaaug

SEQ ID NO: 1387013 - RNA, 19 nt, Homo sapiens
gaauguaaauacuguggaa

SEQ ID NO: 1387014 - RNA, 19 nt, Homo sapiens
aaagagaccuuaugaaugc

SEQ ID NO: 1387015 - RNA, 19 nt, Homo sapiens
gagaaagaccuuaugaaug

SEQ ID NO: 1387016 - RNA, 19 nt, Homo sapiens
cgaaagagaccuuaugaau

SEQ ID NO: 1387017 - RNA, 19 nt, Homo sapiens
gaaagaccuuaugaaugua

SEQ ID NO: 1387018 - RNA, 19 nt, Homo sapiens
ccagaagaaucucuacaga

SEQ ID NO: 1387019 - RNA, 19 nt, Homo sapiens
ucaauuaucccaguuguuu

SEQ ID NO: 1387020 - RNA, 19 nt, Homo sapiens
gaauguacaagguguggua

SEQ ID NO: 1387021 - RNA, 19 nt, Homo sapiens
ggauguggcugugaacuuc

SEQ ID NO: 1387022 - RNA, 19 nt, Homo sapiens
gaggaaaacucuacgaaug

SEQ ID NO: 1387023 - RNA, 19 nt, Homo sapiens
aaagagguccuauaaaugu

SEQ ID NO: 1387024 - RNA, 19 nt, Homo sapiens
ucacagacaugaaagaacu

SEQ ID NO: 1387025 - RNA, 19 nt, Homo sapiens
gguaaaaccuucaauuauc

SEQ ID NO: 1387026 - RNA, 19 nt, Homo sapiens
uaucgauuaucccaguuua

SEQ ID NO: 1387027 - RNA, 19 nt, Homo sapiens
ggagugaaaccaugcaaau

SEQ ID NO: 1387028 - RNA, 19 nt, Homo sapiens
ggauuaagcuaagaagucu

SEQ ID NO: 1387029 - RNA, 19 nt, Homo sapiens
ggagugggcuuugcugagu

SEQ ID NO: 1387030 - RNA, 19 nt, Homo sapiens
gaaaagccauaugaaugua

SEQ ID NO: 1387031 - RNA, 19 nt, Homo sapiens
gagacucuguggacguaaa

SEQ ID NO: 1387032 - RNA, 19 nt, Homo sapiens
ggacacaaacgaucugagu

SEQ ID NO: 1387033 - RNA, 19 nt, Homo sapiens
guaaagaagggaaugaaca

SEQ ID NO: 1387034 - RNA, 19 nt, Homo sapiens
ccaguucccuucacagaca

SEQ ID NO: 1387035 - RNA, 19 nt, Homo sapiens
ucaaauccaucaaagaacu

SEQ ID NO: 1387036 - RNA, 19 nt, Homo sapiens
agaagggaaugaacacaga

SEQ ID NO: 1387037 - RNA, 19 nt, Homo sapiens
ucaaauuaccuuagacuuc

SEQ ID NO: 1387038 - RNA, 19 nt, Homo sapiens
uaaacagugugguaaaguc

SEQ ID NO: 1387039 - RNA, 19 nt, Homo sapiens
gaagacaugaaaugacuca

SEQ ID NO: 1387040 - RNA, 19 nt, Homo sapiens
gcaguucccuccgaagaca

SEQ ID NO: 1387041 - RNA, 19 nt, Homo sapiens
gagaaaagccauaugaaug

SEQ ID NO: 1387042 - RNA, 19 nt, Homo sapiens
gggcguagccagugcuuug

SEQ ID NO: 1387043 - RNA, 19 nt, Homo sapiens
uaccuuagacuucaugaaa

SEQ ID NO: 1387044 - RNA, 19 nt, Homo sapiens
ccaccaaugucaggaaugu

SEQ ID NO: 1387045 - RNA, 19 nt, Homo sapiens
guggaaaaccuaucgauua

SEQ ID NO: 1387046 - RNA, 19 nt, Homo sapiens
ccuuagacuucaugaaaga

SEQ ID NO: 1387047 - RNA, 19 nt, Homo sapiens
ccauaugaauguacaaggu

SEQ ID NO: 1387048 - RNA, 19 nt, Homo sapiens
gaacucauaguggaggaaa

SEQ ID NO: 1387049 - RNA, 19 nt, Homo sapiens
gauuaucccaguuuauuuc

SEQ ID NO: 1387050 - RNA, 19 nt, Homo sapiens
cuggaaagagguccuauaa

SEQ ID NO: 1387051 - RNA, 19 nt, Homo sapiens
gggaaugaacacagagaaa

SEQ ID NO: 1387052 - RNA, 19 nt, Homo sapiens
gauuguaaacaguguggua

SEQ ID NO: 1387053 - RNA, 19 nt, Homo sapiens
aagagguccuauaaaugua

SEQ ID NO: 1387054 - RNA, 19 nt, Homo sapiens
aaagaacucacacuggaaa

SEQ ID NO: 1387055 - RNA, 19 nt, Homo sapiens
ccgaagacaugaaaugacu

SEQ ID NO: 1387056 - RNA, 19 nt, Homo sapiens
caaagaacucacacuggaa

SEQ ID NO: 1387057 - RNA, 19 nt, Homo sapiens
gggauuaagcuaagaaguc

SEQ ID NO: 1387058 - RNA, 19 nt, Homo sapiens
aagucaaacuggagugaaa

SEQ ID NO: 1387059 - RNA, 19 nt, Homo sapiens
cacaugaaaucagaucuca

SEQ ID NO: 1387060 - RNA, 19 nt, Homo sapiens
ggacacaugaaaucagauc

SEQ ID NO: 1387061 - RNA, 19 nt, Homo sapiens
agaaaucccaccaauguca

SEQ ID NO: 1387062 - RNA, 19 nt, Homo sapiens
cgauuaucccaguuuauuu

SEQ ID NO: 1387063 - RNA, 19 nt, Homo sapiens
gaacucacacuggaaagag

SEQ ID NO: 1387064 - RNA, 19 nt, Homo sapiens
ggaaugaacacagagaaac

SEQ ID NO: 1387065 - RNA, 19 nt, Homo sapiens
ucggacacaugaaaucaga

SEQ ID NO: 1387066 - RNA, 19 nt, Homo sapiens
gaaugaacacagagaaacu

SEQ ID NO: 1387067 - RNA, 19 nt, Homo sapiens
gaaagaccaggacauugag

SEQ ID NO: 1387068 - RNA, 19 nt, Homo sapiens
ggagaaaagccauaugaau

SEQ ID NO: 1387069 - RNA, 19 nt, Homo sapiens
gugguaaaaccuucaauua

SEQ ID NO: 1387070 - RNA, 19 nt, Homo sapiens
gaaaaccuaucgauuaucc

SEQ ID NO: 1387071 - RNA, 19 nt, Homo sapiens
ucgauuaucccaguuuauu

SEQ ID NO: 1387072 - RNA, 19 nt, Homo sapiens
ugagagccuucacaguuuc

SEQ ID NO: 1387073 - RNA, 19 nt, Homo sapiens
caacucgaaagagaccuua

SEQ ID NO: 1387074 - RNA, 19 nt, Homo sapiens
gaaauagugagagccuuca

SEQ ID NO: 1387075 - RNA, 19 nt, Homo sapiens
aaauguagggaaauaguga

SEQ ID NO: 1387076 - RNA, 19 nt, Homo sapiens
guaacaccaacucgaaaga

SEQ ID NO: 1387077 - RNA, 19 nt, Homo sapiens
acagaaacaacaugggaaa

SEQ ID NO: 1387078 - RNA, 19 nt, Homo sapiens
ggacauugagaaucuguac

SEQ ID NO: 1387079 - RNA, 19 nt, Homo sapiens
uggaaaaccuaucgauuau

SEQ ID NO: 1387080 - RNA, 19 nt, Homo sapiens
cuucacaguuuccaguuuc

SEQ ID NO: 1387081 - RNA, 19 nt, Homo sapiens
uguaaacaaugugguaaag

SEQ ID NO: 1387082 - RNA, 19 nt, Homo sapiens
acaguaacaccaacucgaa

SEQ ID NO: 1387083 - RNA, 19 nt, Homo sapiens
gagugaaaccaugcaaaug

SEQ ID NO: 1387084 - RNA, 19 nt, Homo sapiens
ggacguaaagaagggaaug

SEQ ID NO: 1387085 - RNA, 19 nt, Homo sapiens
guaaacagugugguaaagu

SEQ ID NO: 1387086 - RNA, 19 nt, Homo sapiens
gcacaugaaagagcucaca

SEQ ID NO: 1387087 - RNA, 19 nt, Homo sapiens
gcuaugaauguaaauacug

SEQ ID NO: 1387088 - RNA, 19 nt, Homo sapiens
gccuuuggguggugcaguu

SEQ ID NO: 1387089 - RNA, 19 nt, Homo sapiens
aacaccaacucgaaagaga

SEQ ID NO: 1387090 - RNA, 19 nt, Homo sapiens
uguaaacagugugguaaag

SEQ ID NO: 1387091 - RNA, 19 nt, Homo sapiens
aaagccauaugaauguaca

SEQ ID NO: 1387092 - RNA, 19 nt, Homo sapiens
ggauacggcugauuuuguc

SEQ ID NO: 1387093 - RNA, 19 nt, Homo sapiens
cuggagaaaucccaccaau

SEQ ID NO: 1387094 - RNA, 19 nt, Homo sapiens
gugguaaagccuucauuuc

SEQ ID NO: 1387095 - RNA, 19 nt, Homo sapiens
uugagaaucuguaccaaaa

SEQ ID NO: 1387096 - RNA, 19 nt, Homo sapiens
uaaauguagggaaauagug

SEQ ID NO: 1387097 - RNA, 19 nt, Homo sapiens
gaaagucuuccuccgucau

SEQ ID NO: 1387098 - RNA, 19 nt, Homo sapiens
gaacucacacuggagaaaa

SEQ ID NO: 1387099 - RNA, 19 nt, Homo sapiens
ccuucacaguuuccaguuu

SEQ ID NO: 1387100 - RNA, 19 nt, Homo sapiens
gugcaguucccuccgaaga

SEQ ID NO: 1387101 - RNA, 19 nt, Homo sapiens
uguacaaggugugguaaag

SEQ ID NO: 1387102 - RNA, 19 nt, Homo sapiens
ggaaaacucuacgaauguc

SEQ ID NO: 1387103 - RNA, 19 nt, Homo sapiens
gagaaaucccaccaauguc

SEQ ID NO: 1387104 - RNA, 19 nt, Homo sapiens
uggacucaguggccuuuga

SEQ ID NO: 1387105 - RNA, 19 nt, Homo sapiens
ccaaagaacuuaagaggaa

SEQ ID NO: 1387106 - RNA, 19 nt, Homo sapiens
guaaucaaaucucagcuua

SEQ ID NO: 1387107 - RNA, 19 nt, Homo sapiens
gaaacccugucuuuacuaa

SEQ ID NO: 1387108 - RNA, 19 nt, Homo sapiens
gcaggaacuucaagaauau

SEQ ID NO: 1387109 - RNA, 19 nt, Homo sapiens
ggaagcacuuucagaacua

SEQ ID NO: 1387110 - RNA, 19 nt, Homo sapiens
ugaaacagcacaaacaaua

SEQ ID NO: 1387111 - RNA, 19 nt, Homo sapiens
ggaaagaaauggagcaacu

SEQ ID NO: 1387112 - RNA, 19 nt, Homo sapiens
ggaagaggauucugcagau

SEQ ID NO: 1387113 - RNA, 19 nt, Homo sapiens
aaagaaauccguagaagaa

SEQ ID NO: 1387114 - RNA, 19 nt, Homo sapiens
gaaacagcacaaacaauaa

SEQ ID NO: 1387115 - RNA, 19 nt, Homo sapiens
gauauaagcaucacacaau

SEQ ID NO: 1387116 - RNA, 19 nt, Homo sapiens
cagaaggcaugaaagagua

SEQ ID NO: 1387117 - RNA, 19 nt, Homo sapiens
aaacugggauaaggaaaua

SEQ ID NO: 1387118 - RNA, 19 nt, Homo sapiens
aaacuugccucuucuacuu

SEQ ID NO: 1387119 - RNA, 19 nt, Homo sapiens
ggagacagccguacuggaa

SEQ ID NO: 1387120 - RNA, 19 nt, Homo sapiens
gaagaucuaaggaaagaaa

SEQ ID NO: 1387121 - RNA, 19 nt, Homo sapiens
ucaggaagaucuaaggaaa

SEQ ID NO: 1387122 - RNA, 19 nt, Homo sapiens
gaauaauccuuaacagucu

SEQ ID NO: 1387123 - RNA, 19 nt, Homo sapiens
gaagaggauucugcagauu

SEQ ID NO: 1387124 - RNA, 19 nt, Homo sapiens
gaccagccuugccaacaua

SEQ ID NO: 1387125 - RNA, 19 nt, Homo sapiens
gaagagcaacauacaaaga

SEQ ID NO: 1387126 - RNA, 19 nt, Homo sapiens
gauuugcccucguuccuaa

SEQ ID NO: 1387127 - RNA, 19 nt, Homo sapiens
gaugagauuugcccucguu

SEQ ID NO: 1387128 - RNA, 19 nt, Homo sapiens
ccaaagacuucggcaacua

SEQ ID NO: 1387129 - RNA, 19 nt, Homo sapiens
aguuagagaugucuucaua

SEQ ID NO: 1387130 - RNA, 19 nt, Homo sapiens
gaagaauaauccuuaacag

SEQ ID NO: 1387131 - RNA, 19 nt, Homo sapiens
agcaggaacuucaagaaua

SEQ ID NO: 1387132 - RNA, 19 nt, Homo sapiens
uuucagaacuauucacuug

SEQ ID NO: 1387133 - RNA, 19 nt, Homo sapiens
gauaugaggguguuaaagu

SEQ ID NO: 1387134 - RNA, 19 nt, Homo sapiens
gaaaaugcuucaagaggaa

SEQ ID NO: 1387135 - RNA, 19 nt, Homo sapiens
gaaagaaauggagcaacua

SEQ ID NO: 1387136 - RNA, 19 nt, Homo sapiens
ccacagaaacauaaguaaa

SEQ ID NO: 1387137 - RNA, 19 nt, Homo sapiens
aaaauuagcuguuccugaa

SEQ ID NO: 1387138 - RNA, 19 nt, Homo sapiens
gcaacuagugcuugacaaa

SEQ ID NO: 1387139 - RNA, 19 nt, Homo sapiens
ucaagaggaugaggaagaa

SEQ ID NO: 1387140 - RNA, 19 nt, Homo sapiens
ggaaggaggagaagagcaa

SEQ ID NO: 1387141 - RNA, 19 nt, Homo sapiens
gaagaaacaauucaacaac

SEQ ID NO: 1387142 - RNA, 19 nt, Homo sapiens
gcaaacugacauuaaauuc

SEQ ID NO: 1387143 - RNA, 19 nt, Homo sapiens
agacuucggcaacuauuua

SEQ ID NO: 1387144 - RNA, 19 nt, Homo sapiens
uaccgcgucucccugauua

SEQ ID NO: 1387145 - RNA, 19 nt, Homo sapiens
acuauucacuugccaggua

SEQ ID NO: 1387146 - RNA, 19 nt, Homo sapiens
aauaugaaguggugacaga

SEQ ID NO: 1387147 - RNA, 19 nt, Homo sapiens
auaugaggguguuaaagua

SEQ ID NO: 1387148 - RNA, 19 nt, Homo sapiens
ucugcaaacugacauuaaa

SEQ ID NO: 1387149 - RNA, 19 nt, Homo sapiens
uaaagaaauccguagaaga

SEQ ID NO: 1387150 - RNA, 19 nt, Homo sapiens
gaccaaauuauaccaaaga

SEQ ID NO: 1387151 - RNA, 19 nt, Homo sapiens
ggauaaggaaauagagaaa

SEQ ID NO: 1387152 - RNA, 19 nt, Homo sapiens
uaaccuaaaucaggaagau

SEQ ID NO: 1387153 - RNA, 19 nt, Homo sapiens
gcccagguguuucugaguu

SEQ ID NO: 1387154 - RNA, 19 nt, Homo sapiens
cggcuggcgugcaauuuaa

SEQ ID NO: 1387155 - RNA, 19 nt, Homo sapiens
gaagcacuuucagaacuau

SEQ ID NO: 1387156 - RNA, 19 nt, Homo sapiens
ggugauagagugagauuca

SEQ ID NO: 1387157 - RNA, 19 nt, Homo sapiens
gaaauccguagaagaagga

SEQ ID NO: 1387158 - RNA, 19 nt, Homo sapiens
gugaaacccugucuuuacu

SEQ ID NO: 1387159 - RNA, 19 nt, Homo sapiens
caagacaauuauaggagau

SEQ ID NO: 1387160 - RNA, 19 nt, Homo sapiens
ugaaucagaaggcaugaaa

SEQ ID NO: 1387161 - RNA, 19 nt, Homo sapiens
aggaagaucuaaggaaaga

SEQ ID NO: 1387162 - RNA, 19 nt, Homo sapiens
caaagacuucggcaacuau

SEQ ID NO: 1387163 - RNA, 19 nt, Homo sapiens
agaggaagcacuuucagaa

SEQ ID NO: 1387164 - RNA, 19 nt, Homo sapiens
cagcacaaacaauaaagaa

SEQ ID NO: 1387165 - RNA, 19 nt, Homo sapiens
gggauaaggaaauagagaa

SEQ ID NO: 1387166 - RNA, 19 nt, Homo sapiens
gcagcaggaacuucaagaa

SEQ ID NO: 1387167 - RNA, 19 nt, Homo sapiens
ccaggaggaugagcugcua

SEQ ID NO: 1387168 - RNA, 19 nt, Homo sapiens
ugacaagacaauuauagga

SEQ ID NO: 1387169 - RNA, 19 nt, Homo sapiens
agacagccguacuggaaga

SEQ ID NO: 1387170 - RNA, 19 nt, Homo sapiens
cacuaacgaugaagaaaca

SEQ ID NO: 1387171 - RNA, 19 nt, Homo sapiens
gguugacacuaacgaugaa

SEQ ID NO: 1387172 - RNA, 19 nt, Homo sapiens
caauaaagaaauccguaga

SEQ ID NO: 1387173 - RNA, 19 nt, Homo sapiens
cuaaacuugugaaggaaga

SEQ ID NO: 1387174 - RNA, 19 nt, Homo sapiens
uaauugauaugaggguguu

SEQ ID NO: 1387175 - RNA, 19 nt, Homo sapiens
uuagagaugucuucauagg

SEQ ID NO: 1387176 - RNA, 19 nt, Homo sapiens
ggcaugaaagaguauaauu

SEQ ID NO: 1387177 - RNA, 19 nt, Homo sapiens
aaucagaaggcaugaaaga

SEQ ID NO: 1387178 - RNA, 19 nt, Homo sapiens
guugacaauuacugaauca

SEQ ID NO: 1387179 - RNA, 19 nt, Homo sapiens
cggcaacuauuuauuuaac

SEQ ID NO: 1387180 - RNA, 19 nt, Homo sapiens
uggcagagagcaagauuug

SEQ ID NO: 1387181 - RNA, 19 nt, Homo sapiens
cuucggcaacuauuuauuu

SEQ ID NO: 1387182 - RNA, 19 nt, Homo sapiens
uugaagagcaacauacaaa

SEQ ID NO: 1387183 - RNA, 19 nt, Homo sapiens
agaaauggagcaacuagug

SEQ ID NO: 1387184 - RNA, 19 nt, Homo sapiens
cagcugacaagaggaauuu

SEQ ID NO: 1387185 - RNA, 19 nt, Homo sapiens
auaaagaaauccguagaag

SEQ ID NO: 1387186 - RNA, 19 nt, Homo sapiens
gaaacuugccucuucuacu

SEQ ID NO: 1387187 - RNA, 19 nt, Homo sapiens
gaaggcaugaaagaguaua

SEQ ID NO: 1387188 - RNA, 19 nt, Homo sapiens
gaggaugaggaagaaauuu

SEQ ID NO: 1387189 - RNA, 19 nt, Homo sapiens
auagugaaacccugucuuu

SEQ ID NO: 1387190 - RNA, 19 nt, Homo sapiens
ucagaaggcaugaaagagu

SEQ ID NO: 1387191 - RNA, 19 nt, Homo sapiens
cagcaggaacuucaagaau

SEQ ID NO: 1387192 - RNA, 19 nt, Homo sapiens
ggguugacacuaacgauga

SEQ ID NO: 1387193 - RNA, 19 nt, Homo sapiens
ggaaauagagaaaaugcuu

SEQ ID NO: 1387194 - RNA, 19 nt, Homo sapiens
uagugaaacccugucuuua

SEQ ID NO: 1387195 - RNA, 19 nt, Homo sapiens
caccggaggucaggaguuc

SEQ ID NO: 1387196 - RNA, 19 nt, Homo sapiens
aagagcaacauacaaagaa

SEQ ID NO: 1387197 - RNA, 19 nt, Homo sapiens
uucgaugccuguaaccuaa

SEQ ID NO: 1387198 - RNA, 19 nt, Homo sapiens
gcaauggcagagagcaaga

SEQ ID NO: 1387199 - RNA, 19 nt, Homo sapiens
cgacuuugaucagauguac

SEQ ID NO: 1387200 - RNA, 19 nt, Homo sapiens
ccaccaggccaaagacuuc

SEQ ID NO: 1387201 - RNA, 19 nt, Homo sapiens
ccuguaaucccagcacuuu

SEQ ID NO: 1387202 - RNA, 19 nt, Homo sapiens
acuugccucuucuacuuua

SEQ ID NO: 1387203 - RNA, 19 nt, Homo sapiens
gaugaaaacugggauaagg

SEQ ID NO: 1387204 - RNA, 19 nt, Homo sapiens
gaucuaaggaaagaaaugg

SEQ ID NO: 1387205 - RNA, 19 nt, Homo sapiens
gaacuaccaccaaacauua

SEQ ID NO: 1387206 - RNA, 19 nt, Homo sapiens
caaaguacaucuaugauuc

SEQ ID NO: 1387207 - RNA, 19 nt, Homo sapiens
ucaaugccgucgucaauua

SEQ ID NO: 1387208 - RNA, 19 nt, Homo sapiens
ucaacuggaugaaauguua

SEQ ID NO: 1387209 - RNA, 19 nt, Homo sapiens
gaccaugucuggagaacua

SEQ ID NO: 1387210 - RNA, 19 nt, Homo sapiens
uagaauaggugcucaguau

SEQ ID NO: 1387211 - RNA, 19 nt, Homo sapiens
gagcaaaguacaucuauga

SEQ ID NO: 1387212 - RNA, 19 nt, Homo sapiens
gaaccucgaugggaucaaa

SEQ ID NO: 1387213 - RNA, 19 nt, Homo sapiens
caaaggaugaugauuguaa

SEQ ID NO: 1387214 - RNA, 19 nt, Homo sapiens
gggaacagcuuacguuucu

SEQ ID NO: 1387215 - RNA, 19 nt, Homo sapiens
guauguugaucacaguuua

SEQ ID NO: 1387216 - RNA, 19 nt, Homo sapiens
gaauaggugcucaguauau

SEQ ID NO: 1387217 - RNA, 19 nt, Homo sapiens
ggccaucccuccauucauu

SEQ ID NO: 1387218 - RNA, 19 nt, Homo sapiens
gcaaaguacaucuaugauu

SEQ ID NO: 1387219 - RNA, 19 nt, Homo sapiens
gucaguaaauguucuauug

SEQ ID NO: 1387220 - RNA, 19 nt, Homo sapiens
caagagagccauccugaau

SEQ ID NO: 1387221 - RNA, 19 nt, Homo sapiens
aagcaugucucaccacuga

SEQ ID NO: 1387222 - RNA, 19 nt, Homo sapiens
gauacucccuuacacugaa

SEQ ID NO: 1387223 - RNA, 19 nt, Homo sapiens
uggaggccauguauuauuu

SEQ ID NO: 1387224 - RNA, 19 nt, Homo sapiens
agagagccauccugaauug

SEQ ID NO: 1387225 - RNA, 19 nt, Homo sapiens
caccaaacauuaacaucaa

SEQ ID NO: 1387226 - RNA, 19 nt, Homo sapiens
gaugaugauuguaaguguu

SEQ ID NO: 1387227 - RNA, 19 nt, Homo sapiens
ggaugaugauuguaagugu

SEQ ID NO: 1387228 - RNA, 19 nt, Homo sapiens
ggaaaccucugcagcucau

SEQ ID NO: 1387229 - RNA, 19 nt, Homo sapiens
cgacgcguguacuucaaua

SEQ ID NO: 1387230 - RNA, 19 nt, Homo sapiens
gcaugucucaccacugaua

SEQ ID NO: 1387231 - RNA, 19 nt, Homo sapiens
aauaagggauuguaaagca

SEQ ID NO: 1387232 - RNA, 19 nt, Homo sapiens
ggagaacuaccaccaaaca

SEQ ID NO: 1387233 - RNA, 19 nt, Homo sapiens
ccaaucauuucuucacugu

SEQ ID NO: 1387234 - RNA, 19 nt, Homo sapiens
ggagagcaaaguacaucua

SEQ ID NO: 1387235 - RNA, 19 nt, Homo sapiens
ggccauguauuauuucagu

SEQ ID NO: 1387236 - RNA, 19 nt, Homo sapiens
auacaaaggaugaugauug

SEQ ID NO: 1387237 - RNA, 19 nt, Homo sapiens
gaacauggagcugcaucuu

SEQ ID NO: 1387238 - RNA, 19 nt, Homo sapiens
cucaguauauggucaguaa

SEQ ID NO: 1387239 - RNA, 19 nt, Homo sapiens
uguuggaggccauguauua

SEQ ID NO: 1387240 - RNA, 19 nt, Homo sapiens
caacagcucuaggacucaa

SEQ ID NO: 1387241 - RNA, 19 nt, Homo sapiens
ccaccaaacauuaacauca

SEQ ID NO: 1387242 - RNA, 19 nt, Homo sapiens
uagccaugcuggugagaaa

SEQ ID NO: 1387243 - RNA, 19 nt, Homo sapiens
uuaguuggcuucuguuugg

SEQ ID NO: 1387244 - RNA, 19 nt, Homo sapiens
ggcgaacgcugcgaaacaa

SEQ ID NO: 1387245 - RNA, 19 nt, Homo sapiens
gagagcaaaguacaucuau

SEQ ID NO: 1387246 - RNA, 19 nt, Homo sapiens
uaaaagggaugaugaacau

SEQ ID NO: 1387247 - RNA, 19 nt, Homo sapiens
ggauuaaccaguccuucaa

SEQ ID NO: 1387248 - RNA, 19 nt, Homo sapiens
uugaagagguucccaugga

SEQ ID NO: 1387249 - RNA, 19 nt, Homo sapiens
cagguuguaugaugacguu

SEQ ID NO: 1387250 - RNA, 19 nt, Homo sapiens
gcacugguaggcauagaau

SEQ ID NO: 1387251 - RNA, 19 nt, Homo sapiens
cuggagaacuaccaccaaa

SEQ ID NO: 1387252 - RNA, 19 nt, Homo sapiens
ugaagagguucccauggau

SEQ ID NO: 1387253 - RNA, 19 nt, Homo sapiens
cagcccagguucccaugaa

SEQ ID NO: 1387254 - RNA, 19 nt, Homo sapiens
agaacuaccaccaaacauu

SEQ ID NO: 1387255 - RNA, 19 nt, Homo sapiens
gaggccauguauuauuuca

SEQ ID NO: 1387256 - RNA, 19 nt, Homo sapiens
ucaauuacaccaacagaag

SEQ ID NO: 1387257 - RNA, 19 nt, Homo sapiens
gaagaugauuuugauagga

SEQ ID NO: 1387258 - RNA, 19 nt, Homo sapiens
gaccaucacagguuguaug

SEQ ID NO: 1387259 - RNA, 19 nt, Homo sapiens
caacuggaugaaauguuaa

SEQ ID NO: 1387260 - RNA, 19 nt, Homo sapiens
acauggagcugcaucuuuu

SEQ ID NO: 1387261 - RNA, 19 nt, Homo sapiens
gaugagugcacccauucaa

SEQ ID NO: 1387262 - RNA, 19 nt, Homo sapiens
guauauggucaguaaaugu

SEQ ID NO: 1387263 - RNA, 19 nt, Homo sapiens
uggcuucuguuugguguuu

SEQ ID NO: 1387264 - RNA, 19 nt, Homo sapiens
caagccaucacgcaaguug

SEQ ID NO: 1387265 - RNA, 19 nt, Homo sapiens
gauuacaggcaaggaauug

SEQ ID NO: 1387266 - RNA, 19 nt, Homo sapiens
gaggcaaagggaacucaaa

SEQ ID NO: 1387267 - RNA, 19 nt, Homo sapiens
guuguaugaugacguuuua

SEQ ID NO: 1387268 - RNA, 19 nt, Homo sapiens
aaaggaugaugauuguaag

SEQ ID NO: 1387269 - RNA, 19 nt, Homo sapiens
cacaugaagugcaauaagc

SEQ ID NO: 1387270 - RNA, 19 nt, Homo sapiens
aauaggugcucaguauaug

SEQ ID NO: 1387271 - RNA, 19 nt, Homo sapiens
agaauaggugcucaguaua

SEQ ID NO: 1387272 - RNA, 19 nt, Homo sapiens
caagcuaagauccaagaga

SEQ ID NO: 1387273 - RNA, 19 nt, Homo sapiens
uuuacugacuggcagcuuu

SEQ ID NO: 1387274 - RNA, 19 nt, Homo sapiens
ggacgagccaaucauuucu

SEQ ID NO: 1387275 - RNA, 19 nt, Homo sapiens
gauccacauuagccuuuua

SEQ ID NO: 1387276 - RNA, 19 nt, Homo sapiens
gaggccgaguugcaagcua

SEQ ID NO: 1387277 - RNA, 19 nt, Homo sapiens
gagugcacccauucaaguu

SEQ ID NO: 1387278 - RNA, 19 nt, Homo sapiens
caguauauggucaguaaau

SEQ ID NO: 1387279 - RNA, 19 nt, Homo sapiens
aggccgaguugcaagcuaa

SEQ ID NO: 1387280 - RNA, 19 nt, Homo sapiens
uggguuaguuggcuucugu

SEQ ID NO: 1387281 - RNA, 19 nt, Homo sapiens
ugacacuggugagaagaug

SEQ ID NO: 1387282 - RNA, 19 nt, Homo sapiens
ccacaugaagugcaauaag

SEQ ID NO: 1387283 - RNA, 19 nt, Homo sapiens
ggucaguaaauguucuauu

SEQ ID NO: 1387284 - RNA, 19 nt, Homo sapiens
ccacugcaaagcuggugua

SEQ ID NO: 1387285 - RNA, 19 nt, Homo sapiens
gccaucccuccauucauua

SEQ ID NO: 1387286 - RNA, 19 nt, Homo sapiens
gugagaagaugauuuugau

SEQ ID NO: 1387287 - RNA, 19 nt, Homo sapiens
cacagcgucuugccagugu

SEQ ID NO: 1387288 - RNA, 19 nt, Homo sapiens
aaagcuaucaacuguaugu

SEQ ID NO: 1387289 - RNA, 19 nt, Homo sapiens
ccaagagagccauccugaa

SEQ ID NO: 1387290 - RNA, 19 nt, Homo sapiens
ccuguguugugcccuguuu

SEQ ID NO: 1387291 - RNA, 19 nt, Homo sapiens
caucuaugauucagcuuuu

SEQ ID NO: 1387292 - RNA, 19 nt, Homo sapiens
uacacugaaucauguuaug

SEQ ID NO: 1387293 - RNA, 19 nt, Homo sapiens
guugcaagcuaagauccaa

SEQ ID NO: 1387294 - RNA, 19 nt, Homo sapiens
guugggaacagcuuacguu

SEQ ID NO: 1387295 - RNA, 19 nt, Homo sapiens
gagaagaugauuuugauag

SEQ ID NO: 1387296 - RNA, 19 nt, Homo sapiens
cauucaaguuggguuaguu

SEQ ID NO: 1387297 - RNA, 19 nt, Homo sapiens
gcucuaggacucaaugcau

SEQ ID NO: 1387298 - RNA, 19 nt, Homo sapiens
gauuaaccaguccuucaau

SEQ ID NO: 1387299 - RNA, 19 nt, Homo sapiens
gauacaaaggaugaugauu

SEQ ID NO: 1387300 - RNA, 19 nt, Homo sapiens
aagagagccauccugaauu

SEQ ID NO: 1387301 - RNA, 19 nt, Homo sapiens
caaacauuaacaucaagga

SEQ ID NO: 1387302 - RNA, 19 nt, Homo sapiens
uagaauaaagcugcuacuu

SEQ ID NO: 1387303 - RNA, 19 nt, Homo sapiens
gcauugaccaagcaugucu

SEQ ID NO: 1387304 - RNA, 19 nt, Homo sapiens
uuacguuucugcaacaacu

SEQ ID NO: 1387305 - RNA, 19 nt, Homo sapiens
cagagacgguuuccaaaug

SEQ ID NO: 1387306 - RNA, 19 nt, Homo sapiens
gcagguggauggccaaugg

SEQ ID NO: 1387307 - RNA, 19 nt, Homo sapiens
agagacgguuuccaaauga

SEQ ID NO: 1387308 - RNA, 19 nt, Homo sapiens
ggaaaaugcucccguccaa

SEQ ID NO: 1387309 - RNA, 19 nt, Homo sapiens
gagacgguuuccaaaugaa

SEQ ID NO: 1387310 - RNA, 19 nt, Homo sapiens
acaaugaccaugccagaga

SEQ ID NO: 1387311 - RNA, 19 nt, Homo sapiens
guaacaccuucuccaacga

SEQ ID NO: 1387312 - RNA, 19 nt, Homo sapiens
ccagagacgguuuccaaau

SEQ ID NO: 1387313 - RNA, 19 nt, Homo sapiens
ucaguuaccgcaugucaca

SEQ ID NO: 1387314 - RNA, 19 nt, Homo sapiens
cggcucaggaggacaauga

SEQ ID NO: 1387315 - RNA, 19 nt, Homo sapiens
ggucaguuaccgcauguca

SEQ ID NO: 1387316 - RNA, 19 nt, Homo sapiens
gccagagacgguuuccaaa

SEQ ID NO: 1387317 - RNA, 19 nt, Homo sapiens
gcucuaaggcuuccaaccu

SEQ ID NO: 1387318 - RNA, 19 nt, Homo sapiens
guuaccgcaugucacagaa

SEQ ID NO: 1387319 - RNA, 19 nt, Homo sapiens
ugccagagacgguuuccaa

SEQ ID NO: 1387320 - RNA, 19 nt, Homo sapiens
ggacagugguguacaacaa

SEQ ID NO: 1387321 - RNA, 19 nt, Homo sapiens
guuaugagccgacuucuuu

SEQ ID NO: 1387322 - RNA, 19 nt, Homo sapiens
gaggaguucuaacacauuu

SEQ ID NO: 1387323 - RNA, 19 nt, Homo sapiens
gaaggaagagcaagcugua

SEQ ID NO: 1387324 - RNA, 19 nt, Homo sapiens
gcugguaaauuuaggauau

SEQ ID NO: 1387325 - RNA, 19 nt, Homo sapiens
gcagcuggcucugaaugua

SEQ ID NO: 1387326 - RNA, 19 nt, Homo sapiens
gccaaacacuuuacaguuc

SEQ ID NO: 1387327 - RNA, 19 nt, Homo sapiens
ucucauaacucauuugcuu

SEQ ID NO: 1387328 - RNA, 19 nt, Homo sapiens
gcugcaggguggcaucuua

SEQ ID NO: 1387329 - RNA, 19 nt, Homo sapiens
gggaugcccuucuuccauu

SEQ ID NO: 1387330 - RNA, 19 nt, Homo sapiens
ggagagugcucaaccuaca

SEQ ID NO: 1387331 - RNA, 19 nt, Homo sapiens
gcaaaugucagagaugaaa

SEQ ID NO: 1387332 - RNA, 19 nt, Homo sapiens
gagcuuugggcaauaaaua

SEQ ID NO: 1387333 - RNA, 19 nt, Homo sapiens
gcaguuggccucagcagaa

SEQ ID NO: 1387334 - RNA, 19 nt, Homo sapiens
caagaggaguucuaacaca

SEQ ID NO: 1387335 - RNA, 19 nt, Homo sapiens
ggaggccucugcaagauuc

SEQ ID NO: 1387336 - RNA, 19 nt, Homo sapiens
gagggagacugacccauuc

SEQ ID NO: 1387337 - RNA, 19 nt, Homo sapiens
gaaucaaaucugagccuua

SEQ ID NO: 1387338 - RNA, 19 nt, Homo sapiens
ggagggagacugacccauu

SEQ ID NO: 1387339 - RNA, 19 nt, Homo sapiens
gcacacucuuugucacuga

SEQ ID NO: 1387340 - RNA, 19 nt, Homo sapiens
cuaaugagcuuugggcaau

SEQ ID NO: 1387341 - RNA, 19 nt, Homo sapiens
ccacucagcacaauuaugu

SEQ ID NO: 1387342 - RNA, 19 nt, Homo sapiens
cagcagacguccuucuaug

SEQ ID NO: 1387343 - RNA, 19 nt, Homo sapiens
agacaagccuggaggacaa

SEQ ID NO: 1387344 - RNA, 19 nt, Homo sapiens
gaauggugcuuggcaggaa

SEQ ID NO: 1387345 - RNA, 19 nt, Homo sapiens
ucagaaagccaacaaguuc

SEQ ID NO: 1387346 - RNA, 19 nt, Homo sapiens
ccaauuagagccggagaua

SEQ ID NO: 1387347 - RNA, 19 nt, Homo sapiens
ccgcaaaugucagagauga

SEQ ID NO: 1387348 - RNA, 19 nt, Homo sapiens
cagcaucucauaacucauu

SEQ ID NO: 1387349 - RNA, 19 nt, Homo sapiens
gcgcugugcuggucucuag

SEQ ID NO: 1387350 - RNA, 19 nt, Homo sapiens
caaauucauucccuucucu

SEQ ID NO: 1387351 - RNA, 19 nt, Homo sapiens
caucagcgccgucuccauu

SEQ ID NO: 1387352 - RNA, 19 nt, Homo sapiens
gagccaaucccaccauaau

SEQ ID NO: 1387353 - RNA, 19 nt, Homo sapiens
gaagagcaagcuguacaaa

SEQ ID NO: 1387354 - RNA, 19 nt, Homo sapiens
ggccuugccuuguguagug

SEQ ID NO: 1387355 - RNA, 19 nt, Homo sapiens
aaucugagccuuaguuuca

SEQ ID NO: 1387356 - RNA, 19 nt, Homo sapiens
gguagaaguagaauccuuu

SEQ ID NO: 1387357 - RNA, 19 nt, Homo sapiens
ucuaacacauuucguacaa

SEQ ID NO: 1387358 - RNA, 19 nt, Homo sapiens
ggacaccaaugagaagauc

SEQ ID NO: 1387359 - RNA, 19 nt, Homo sapiens
caagcaggcuauucuacau

SEQ ID NO: 1387360 - RNA, 19 nt, Homo sapiens
uguagucggucuucucuug

SEQ ID NO: 1387361 - RNA, 19 nt, Homo sapiens
uuagacaccuaucagagaa

SEQ ID NO: 1387362 - RNA, 19 nt, Homo sapiens
uaacucauuugcuuugucu

SEQ ID NO: 1387363 - RNA, 19 nt, Homo sapiens
agagcaagcuguacaaagg

SEQ ID NO: 1387364 - RNA, 19 nt, Homo sapiens
ugaaacaucccaauuagag

SEQ ID NO: 1387365 - RNA, 19 nt, Homo sapiens
gcuccuaccuaucauaagg

SEQ ID NO: 1387366 - RNA, 19 nt, Homo sapiens
gagaagcagcaucaaccua

SEQ ID NO: 1387367 - RNA, 19 nt, Homo sapiens
aaucaaaucugagccuuag

SEQ ID NO: 1387368 - RNA, 19 nt, Homo sapiens
agacugacccauucacauu

SEQ ID NO: 1387369 - RNA, 19 nt, Homo sapiens
uuaauguccugguucagaa

SEQ ID NO: 1387370 - RNA, 19 nt, Homo sapiens
ggaagagcaagcuguacaa

SEQ ID NO: 1387371 - RNA, 19 nt, Homo sapiens
guggagcucuaacugauuc

SEQ ID NO: 1387372 - RNA, 19 nt, Homo sapiens
caaaucugagccuuaguuu

SEQ ID NO: 1387373 - RNA, 19 nt, Homo sapiens
ccaaacacuuuacaguucu

SEQ ID NO: 1387374 - RNA, 19 nt, Homo sapiens
caaugccugugucaacuau

SEQ ID NO: 1387375 - RNA, 19 nt, Homo sapiens
guaauacuaaugagcuuug

SEQ ID NO: 1387376 - RNA, 19 nt, Homo sapiens
gaugaacuagccaugacua

SEQ ID NO: 1387377 - RNA, 19 nt, Homo sapiens
ucaaaucugagccuuaguu

SEQ ID NO: 1387378 - RNA, 19 nt, Homo sapiens
uaucagagaagcagcauca

SEQ ID NO: 1387379 - RNA, 19 nt, Homo sapiens
ggcaagaggaguucuaaca

SEQ ID NO: 1387380 - RNA, 19 nt, Homo sapiens
cgaugcaccuccuuuccaa

SEQ ID NO: 1387381 - RNA, 19 nt, Homo sapiens
uaaugagcuuugggcaaua

SEQ ID NO: 1387382 - RNA, 19 nt, Homo sapiens
gcccuggucuggcuuugga

SEQ ID NO: 1387383 - RNA, 19 nt, Homo sapiens
ggaggaggagguaacauag

SEQ ID NO: 1387384 - RNA, 19 nt, Homo sapiens
uggaggaggagguaacaua

SEQ ID NO: 1387385 - RNA, 19 nt, Homo sapiens
gugggcagcuggcucugaa

SEQ ID NO: 1387386 - RNA, 19 nt, Homo sapiens
ggguagaaguagaauccuu

SEQ ID NO: 1387387 - RNA, 19 nt, Homo sapiens
ucaggcacuucuuggauau

SEQ ID NO: 1387388 - RNA, 19 nt, Homo sapiens
ucuggucacuucaaacaug

SEQ ID NO: 1387389 - RNA, 19 nt, Homo sapiens
gcggugcaguggcaaagga

SEQ ID NO: 1387390 - RNA, 19 nt, Homo sapiens
gccaaucccaccauaaugu

SEQ ID NO: 1387391 - RNA, 19 nt, Homo sapiens
aaacuccacucagcacaau

SEQ ID NO: 1387392 - RNA, 19 nt, Homo sapiens
aaugagcuuugggcaauaa

SEQ ID NO: 1387393 - RNA, 19 nt, Homo sapiens
gcaugucugggucgucuuu

SEQ ID NO: 1387394 - RNA, 19 nt, Homo sapiens
cagauuaggccuggaguug

SEQ ID NO: 1387395 - RNA, 19 nt, Homo sapiens
ggagggacauuuuaaaagg

SEQ ID NO: 1387396 - RNA, 19 nt, Homo sapiens
gcccuccucuggucacuuc

SEQ ID NO: 1387397 - RNA, 19 nt, Homo sapiens
uucaggcacuucuuggaua

SEQ ID NO: 1387398 - RNA, 19 nt, Homo sapiens
gaggaggagguaacauaga

SEQ ID NO: 1387399 - RNA, 19 nt, Homo sapiens
ggcccuggcucugucacua

SEQ ID NO: 1387400 - RNA, 19 nt, Homo sapiens
gugccaauaucugcaaugu

SEQ ID NO: 1387401 - RNA, 19 nt, Homo sapiens
cgacuucuuugguguucug

SEQ ID NO: 1387402 - RNA, 19 nt, Homo sapiens
ggcaaaggauccagauagc

SEQ ID NO: 1387403 - RNA, 19 nt, Homo sapiens
aggaggagguaacauagau

SEQ ID NO: 1387404 - RNA, 19 nt, Homo sapiens
gcucccaaaugcagcuuca

SEQ ID NO: 1387405 - RNA, 19 nt, Homo sapiens
gaacuaggugcuggcaugu

SEQ ID NO: 1387406 - RNA, 19 nt, Homo sapiens
gggagaaggguuagacaag

SEQ ID NO: 1387407 - RNA, 19 nt, Homo sapiens
gcauggccguugccucucu

SEQ ID NO: 1387408 - RNA, 19 nt, Homo sapiens
cgggagcaguugaccuuug

SEQ ID NO: 1387409 - RNA, 19 nt, Homo sapiens
ucccaucccuuucuaagca

SEQ ID NO: 1387410 - RNA, 19 nt, Homo sapiens
guggaggcgagccagauua

SEQ ID NO: 1387411 - RNA, 19 nt, Homo sapiens
aagaggaguucuaacacau

SEQ ID NO: 1387412 - RNA, 19 nt, Homo sapiens
gacugacccauucacauuu

SEQ ID NO: 1387413 - RNA, 19 nt, Homo sapiens
ggaugcccuucuuccauuc

SEQ ID NO: 1387414 - RNA, 19 nt, Homo sapiens
ucauaacucauuugcuuug

SEQ ID NO: 1387415 - RNA, 19 nt, Homo sapiens
ucacccugcuccuaccuau

SEQ ID NO: 1387416 - RNA, 19 nt, Homo sapiens
ucccaucucccucccauuu

SEQ ID NO: 1387417 - RNA, 19 nt, Homo sapiens
cuaaauggcagugagaugu

SEQ ID NO: 1387418 - RNA, 19 nt, Homo sapiens
gagcuucuccagccaccaa

SEQ ID NO: 1387419 - RNA, 19 nt, Homo sapiens
acuccacucagcacaauua

SEQ ID NO: 1387420 - RNA, 19 nt, Homo sapiens
gaacauggaccacgcaguu

SEQ ID NO: 1387421 - RNA, 19 nt, Homo sapiens
auagggaacuuucaccuua

SEQ ID NO: 1387422 - RNA, 19 nt, Homo sapiens
gcagaggacugguguaagg

SEQ ID NO: 1387423 - RNA, 19 nt, Homo sapiens
gaguguagauggcuugguu

SEQ ID NO: 1387424 - RNA, 19 nt, Homo sapiens
gacagaagcuagacccaau

SEQ ID NO: 1387425 - RNA, 19 nt, Homo sapiens
guagggagcugucuaaucc

SEQ ID NO: 1387426 - RNA, 19 nt, Homo sapiens
ggaggcugcuguggguuua

SEQ ID NO: 1387427 - RNA, 19 nt, Homo sapiens
ucaccaaccucauucacaa

SEQ ID NO: 1387428 - RNA, 19 nt, Homo sapiens
gggagcagauggauuaugg

SEQ ID NO: 1387429 - RNA, 19 nt, Homo sapiens
gaagaagccucuggacacu

SEQ ID NO: 1387430 - RNA, 19 nt, Homo sapiens
ggcaagacguggccuguag

SEQ ID NO: 1387431 - RNA, 19 nt, Homo sapiens
caaagugugaauaggauuu

SEQ ID NO: 1387432 - RNA, 19 nt, Homo sapiens
ucacacccaucgugcugua

SEQ ID NO: 1387433 - RNA, 19 nt, Homo sapiens
caaccucauucacaacaug

SEQ ID NO: 1387434 - RNA, 19 nt, Homo sapiens
cugcaacacugaagacaga

SEQ ID NO: 1387435 - RNA, 19 nt, Homo sapiens
ucaccagcuucuacacuaa

SEQ ID NO: 1387436 - RNA, 19 nt, Homo sapiens
uagggaacuuucaccuuaa

SEQ ID NO: 1387437 - RNA, 19 nt, Homo sapiens
caacuuggaguagcuugua

SEQ ID NO: 1387438 - RNA, 19 nt, Homo sapiens
ggagcugucuaauccaagu

SEQ ID NO: 1387439 - RNA, 19 nt, Homo sapiens
cggaaguucuugaccauca

SEQ ID NO: 1387440 - RNA, 19 nt, Homo sapiens
ggaaaaggcccgugaguca

SEQ ID NO: 1387441 - RNA, 19 nt, Homo sapiens
uaauuuacccacagaaugu

SEQ ID NO: 1387442 - RNA, 19 nt, Homo sapiens
gcucugaccuuuucugaau

SEQ ID NO: 1387443 - RNA, 19 nt, Homo sapiens
gaaucaauaaguacugaga

SEQ ID NO: 1387444 - RNA, 19 nt, Homo sapiens
acugggagcagauggauua

SEQ ID NO: 1387445 - RNA, 19 nt, Homo sapiens
cagcagaggacugguguaa

SEQ ID NO: 1387446 - RNA, 19 nt, Homo sapiens
gcaucuggcucuccuacgu

SEQ ID NO: 1387447 - RNA, 19 nt, Homo sapiens
gagcaucccguuugugagu

SEQ ID NO: 1387448 - RNA, 19 nt, Homo sapiens
ggaugggucuuugccuuuc

SEQ ID NO: 1387449 - RNA, 19 nt, Homo sapiens
cgguacggcuucuggauug

SEQ ID NO: 1387450 - RNA, 19 nt, Homo sapiens
gggaugggucuuugccuuu

SEQ ID NO: 1387451 - RNA, 19 nt, Homo sapiens
gcaaagugugaauaggauu

SEQ ID NO: 1387452 - RNA, 19 nt, Homo sapiens
aaaggcaugugcugcaaca

SEQ ID NO: 1387453 - RNA, 19 nt, Homo sapiens
gguugagccucuggccuaa

SEQ ID NO: 1387454 - RNA, 19 nt, Homo sapiens
gcuagacccaaucuccuuu

SEQ ID NO: 1387455 - RNA, 19 nt, Homo sapiens
gccaugcagugugugcuuu

SEQ ID NO: 1387456 - RNA, 19 nt, Homo sapiens
uugagccucuggccuaauu

SEQ ID NO: 1387457 - RNA, 19 nt, Homo sapiens
gcaacacugaagacagaaa

SEQ ID NO: 1387458 - RNA, 19 nt, Homo sapiens
ccaacacgcgggugaugaa

SEQ ID NO: 1387459 - RNA, 19 nt, Homo sapiens
guaagcacagguccaacuu

SEQ ID NO: 1387460 - RNA, 19 nt, Homo sapiens
gggaggcugcuguggguuu

SEQ ID NO: 1387461 - RNA, 19 nt, Homo sapiens
uggaaucaauaaguacuga

SEQ ID NO: 1387462 - RNA, 19 nt, Homo sapiens
aagcaaagugugaauagga

SEQ ID NO: 1387463 - RNA, 19 nt, Homo sapiens
cucaccagcuucuacacua

SEQ ID NO: 1387464 - RNA, 19 nt, Homo sapiens
gguagggagcugucuaauc

SEQ ID NO: 1387465 - RNA, 19 nt, Homo sapiens
aggcuuggaggguuaauuu

SEQ ID NO: 1387466 - RNA, 19 nt, Homo sapiens
gcgguacggcuucuggauu

SEQ ID NO: 1387467 - RNA, 19 nt, Homo sapiens
agggaacuuucaccuuaaa

SEQ ID NO: 1387468 - RNA, 19 nt, Homo sapiens
uggaguuggucauggaaug

SEQ ID NO: 1387469 - RNA, 19 nt, Homo sapiens
gcaucccguuugugagugu

SEQ ID NO: 1387470 - RNA, 19 nt, Homo sapiens
uuaauuuacccacagaaug

SEQ ID NO: 1387471 - RNA, 19 nt, Homo sapiens
gguagggacagaagcuaga

SEQ ID NO: 1387472 - RNA, 19 nt, Homo sapiens
gacccucaccaaccucauu

SEQ ID NO: 1387473 - RNA, 19 nt, Homo sapiens
gaacuuucaccuuaaaauc

SEQ ID NO: 1387474 - RNA, 19 nt, Homo sapiens
gggcaagacguggccugua

SEQ ID NO: 1387475 - RNA, 19 nt, Homo sapiens
gucgagacuuagaagaaug

SEQ ID NO: 1387476 - RNA, 19 nt, Homo sapiens
uacggcuucuggauuguuu

SEQ ID NO: 1387477 - RNA, 19 nt, Homo sapiens
ucgaugccaugcagugugu

SEQ ID NO: 1387478 - RNA, 19 nt, Homo sapiens
cuccugggcugaacaugga

SEQ ID NO: 1387479 - RNA, 19 nt, Homo sapiens
uaagcaaagugugaauagg

SEQ ID NO: 1387480 - RNA, 19 nt, Homo sapiens
gaggucacugggccuguuu

SEQ ID NO: 1387481 - RNA, 19 nt, Homo sapiens
cagaaugugauaguaauag

SEQ ID NO: 1387482 - RNA, 19 nt, Homo sapiens
guuaauuuacccacagaau

SEQ ID NO: 1387483 - RNA, 19 nt, Homo sapiens
ggcuuggaggguuaauuua

SEQ ID NO: 1387484 - RNA, 19 nt, Homo sapiens
cugagcaucccguuuguga

SEQ ID NO: 1387485 - RNA, 19 nt, Homo sapiens
acacugaagacagaaagaa

SEQ ID NO: 1387486 - RNA, 19 nt, Homo sapiens
caacacugaagacagaaag

SEQ ID NO: 1387487 - RNA, 19 nt, Homo sapiens
aguacgaccagauccauuu

SEQ ID NO: 1387488 - RNA, 19 nt, Homo sapiens
caaauaaaagggcaacaug

SEQ ID NO: 1387489 - RNA, 19 nt, Homo sapiens
cauagggaacuuucaccuu

SEQ ID NO: 1387490 - RNA, 19 nt, Homo sapiens
gcccgugagucauuguaag

SEQ ID NO: 1387491 - RNA, 19 nt, Homo sapiens
aaaggcccgugagucauug

SEQ ID NO: 1387492 - RNA, 19 nt, Homo sapiens
agaaugugauaguaauagg

SEQ ID NO: 1387493 - RNA, 19 nt, Homo sapiens
gagaggggcagcaggauga

SEQ ID NO: 1387494 - RNA, 19 nt, Homo sapiens
gcuguaggagagcuaguga

SEQ ID NO: 1387495 - RNA, 19 nt, Homo sapiens
ucaggcagccaaagcacuu

SEQ ID NO: 1387496 - RNA, 19 nt, Homo sapiens
gcaugugcugcaacacuga

SEQ ID NO: 1387497 - RNA, 19 nt, Homo sapiens
ggcaaggcgaggcugcuaa

SEQ ID NO: 1387498 - RNA, 19 nt, Homo sapiens
aauccaagucccaggcuuu

SEQ ID NO: 1387499 - RNA, 19 nt, Homo sapiens
gcacuuuaaccccugcaua

SEQ ID NO: 1387500 - RNA, 19 nt, Homo sapiens
cugaagacagaaagaagaa

SEQ ID NO: 1387501 - RNA, 19 nt, Homo sapiens
gcaaggcgaggcugcuaac

SEQ ID NO: 1387502 - RNA, 19 nt, Homo sapiens
gagccucuggccuaauuuc

SEQ ID NO: 1387503 - RNA, 19 nt, Homo sapiens
gaaguucuugaccaucaca

SEQ ID NO: 1387504 - RNA, 19 nt, Homo sapiens
gagaagaacuuuagaugau

SEQ ID NO: 1387505 - RNA, 19 nt, Homo sapiens
cuacaaagaugcuuacauu

SEQ ID NO: 1387506 - RNA, 19 nt, Homo sapiens
gaagaacuuuagaugauga

SEQ ID NO: 1387507 - RNA, 19 nt, Homo sapiens
ccaaauggcccgagaauug

SEQ ID NO: 1387508 - RNA, 19 nt, Homo sapiens
caauggauauccuucagua

SEQ ID NO: 1387509 - RNA, 19 nt, Homo sapiens
gaacgacuccgaagaggaa

SEQ ID NO: 1387510 - RNA, 19 nt, Homo sapiens
gaagauguccuugaaaguu

SEQ ID NO: 1387511 - RNA, 19 nt, Homo sapiens
ccgcagaagugaauaugua

SEQ ID NO: 1387512 - RNA, 19 nt, Homo sapiens
agacagaacucaacucauc

SEQ ID NO: 1387513 - RNA, 19 nt, Homo sapiens
gaacuugaaucagcaauac

SEQ ID NO: 1387514 - RNA, 19 nt, Homo sapiens
ucaagaagauggaguuauc

SEQ ID NO: 1387515 - RNA, 19 nt, Homo sapiens
ggauacaaaucaagaagau

SEQ ID NO: 1387516 - RNA, 19 nt, Homo sapiens
ggaagaaaaugaagaaguu

SEQ ID NO: 1387517 - RNA, 19 nt, Homo sapiens
gaaaaggugccacugauua

SEQ ID NO: 1387518 - RNA, 19 nt, Homo sapiens
caacacagacuucaagaau

SEQ ID NO: 1387519 - RNA, 19 nt, Homo sapiens
aaagaaugcugcucagaga

SEQ ID NO: 1387520 - RNA, 19 nt, Homo sapiens
gagaauaugcugugguuug

SEQ ID NO: 1387521 - RNA, 19 nt, Homo sapiens
gagugaugaugaugcuuua

SEQ ID NO: 1387522 - RNA, 19 nt, Homo sapiens
gauggcagaucaccuugaa

SEQ ID NO: 1387523 - RNA, 19 nt, Homo sapiens
gaagaacgagagcaagaaa

SEQ ID NO: 1387524 - RNA, 19 nt, Homo sapiens
caccaaaucuugacuccuu

SEQ ID NO: 1387525 - RNA, 19 nt, Homo sapiens
aaauggauauggaaaguga

SEQ ID NO: 1387526 - RNA, 19 nt, Homo sapiens
ccagaacacuuaccagaca

SEQ ID NO: 1387527 - RNA, 19 nt, Homo sapiens
gaacaggagcagauaagga

SEQ ID NO: 1387528 - RNA, 19 nt, Homo sapiens
gagaaugagaagaacuuua

SEQ ID NO: 1387529 - RNA, 19 nt, Homo sapiens
gacuucagcuccucacuug

SEQ ID NO: 1387530 - RNA, 19 nt, Homo sapiens
ccagggcuauugaaagauu

SEQ ID NO: 1387531 - RNA, 19 nt, Homo sapiens
uaccagggcuauugaaaga

SEQ ID NO: 1387532 - RNA, 19 nt, Homo sapiens
gaagaaguuuucaaaguga

SEQ ID NO: 1387533 - RNA, 19 nt, Homo sapiens
ucagagaggccaagaagaa

SEQ ID NO: 1387534 - RNA, 19 nt, Homo sapiens
gaggguauguccaagacuu

SEQ ID NO: 1387535 - RNA, 19 nt, Homo sapiens
gauaauacagucccuuuca

SEQ ID NO: 1387536 - RNA, 19 nt, Homo sapiens
gcagauaaggaaaggaauu

SEQ ID NO: 1387537 - RNA, 19 nt, Homo sapiens
gagcagauaaggaaaggaa

SEQ ID NO: 1387538 - RNA, 19 nt, Homo sapiens
ggagugaugaugaugcuuu

SEQ ID NO: 1387539 - RNA, 19 nt, Homo sapiens
ucaagaauggugggaauua

SEQ ID NO: 1387540 - RNA, 19 nt, Homo sapiens
aagauguccuugaaaguuu

SEQ ID NO: 1387541 - RNA, 19 nt, Homo sapiens
guaaagaaacagcuuaaag

SEQ ID NO: 1387542 - RNA, 19 nt, Homo sapiens
ugaugaugaugcuuuagua

SEQ ID NO: 1387543 - RNA, 19 nt, Homo sapiens
guuugaaucuuugcuguuu

SEQ ID NO: 1387544 - RNA, 19 nt, Homo sapiens
uaaaauugcucaagaagga

SEQ ID NO: 1387545 - RNA, 19 nt, Homo sapiens
caaagacgacaagaugaua

SEQ ID NO: 1387546 - RNA, 19 nt, Homo sapiens
gcacuuuuauugagaauga

SEQ ID NO: 1387547 - RNA, 19 nt, Homo sapiens
acacagacuucaagaaugg

SEQ ID NO: 1387548 - RNA, 19 nt, Homo sapiens
cagauaaggaaaggaauua

SEQ ID NO: 1387549 - RNA, 19 nt, Homo sapiens
ugucgugacuuugagaaua

SEQ ID NO: 1387550 - RNA, 19 nt, Homo sapiens
agaauaugcugugguuuga

SEQ ID NO: 1387551 - RNA, 19 nt, Homo sapiens
aagacuugcuugaguguuu

SEQ ID NO: 1387552 - RNA, 19 nt, Homo sapiens
gcaagaggccucgcgagaa

SEQ ID NO: 1387553 - RNA, 19 nt, Homo sapiens
ggauauccuucaguaguga

SEQ ID NO: 1387554 - RNA, 19 nt, Homo sapiens
gcucaagaaggaauauaaa

SEQ ID NO: 1387555 - RNA, 19 nt, Homo sapiens
gauguugcccuacuaccua

SEQ ID NO: 1387556 - RNA, 19 nt, Homo sapiens
gaaggccuuuccagugaug

SEQ ID NO: 1387557 - RNA, 19 nt, Homo sapiens
ugacucccguuacuauuga

SEQ ID NO: 1387558 - RNA, 19 nt, Homo sapiens
gaacauggugaagaugaaa

SEQ ID NO: 1387559 - RNA, 19 nt, Homo sapiens
caagaggccucgcgagaac

SEQ ID NO: 1387560 - RNA, 19 nt, Homo sapiens
ggugauucuuccuaaacua

SEQ ID NO: 1387561 - RNA, 19 nt, Homo sapiens
gaugaugaugcuuuaguaa

SEQ ID NO: 1387562 - RNA, 19 nt, Homo sapiens
gaaagaaaagucacaaaga

SEQ ID NO: 1387563 - RNA, 19 nt, Homo sapiens
ugagaagaacuuuagauga

SEQ ID NO: 1387564 - RNA, 19 nt, Homo sapiens
ggcaaaaugucgugacuuu

SEQ ID NO: 1387565 - RNA, 19 nt, Homo sapiens
cuacacauccuacaaagau

SEQ ID NO: 1387566 - RNA, 19 nt, Homo sapiens
uugaaggccuuuccaguga

SEQ ID NO: 1387567 - RNA, 19 nt, Homo sapiens
ccagagaacaaaccgguaa

SEQ ID NO: 1387568 - RNA, 19 nt, Homo sapiens
gaagaaaucaaguuauagc

SEQ ID NO: 1387569 - RNA, 19 nt, Homo sapiens
ugaaauggauauggaaagu

SEQ ID NO: 1387570 - RNA, 19 nt, Homo sapiens
caacucaucagcugaaagu

SEQ ID NO: 1387571 - RNA, 19 nt, Homo sapiens
gaugagaaacgccggauag

SEQ ID NO: 1387572 - RNA, 19 nt, Homo sapiens
aagaugaaauggauaugga

SEQ ID NO: 1387573 - RNA, 19 nt, Homo sapiens
gaacuuuagaugaugaugu

SEQ ID NO: 1387574 - RNA, 19 nt, Homo sapiens
uaagauggcagaucaccuu

SEQ ID NO: 1387575 - RNA, 19 nt, Homo sapiens
ccgguaagauggcagauca

SEQ ID NO: 1387576 - RNA, 19 nt, Homo sapiens
caggaggacucgucguaga

SEQ ID NO: 1387577 - RNA, 19 nt, Homo sapiens
gacgacaagaugauauuaa

SEQ ID NO: 1387578 - RNA, 19 nt, Homo sapiens
caaaucgacagcagcauga

SEQ ID NO: 1387579 - RNA, 19 nt, Homo sapiens
uaauacagucccuuucaaa

SEQ ID NO: 1387580 - RNA, 19 nt, Homo sapiens
uguacuaccagaacacuua

SEQ ID NO: 1387581 - RNA, 19 nt, Homo sapiens
uauacaugcugcaaggaaa

SEQ ID NO: 1387582 - RNA, 19 nt, Homo sapiens
gaugaaauggauauggaaa

SEQ ID NO: 1387583 - RNA, 19 nt, Homo sapiens
aaaggugauucuuccuaaa

SEQ ID NO: 1387584 - RNA, 19 nt, Homo sapiens
ggugaacgguauaaauuuu

SEQ ID NO: 1387585 - RNA, 19 nt, Homo sapiens
uggcauuccuuauaguuau

SEQ ID NO: 1387586 - RNA, 19 nt, Homo sapiens
uaauaucccucagguucaa

SEQ ID NO: 1387587 - RNA, 19 nt, Homo sapiens
uuagagaagaugagaauga

SEQ ID NO: 1387588 - RNA, 19 nt, Homo sapiens
uaagacagaacucaacuca

SEQ ID NO: 1387589 - RNA, 19 nt, Homo sapiens
ggacggacaggccuugugu

SEQ ID NO: 1387590 - RNA, 19 nt, Homo sapiens
aaagaauccggcaaaguuu

SEQ ID NO: 1387591 - RNA, 19 nt, Homo sapiens
gcaagaaaugcgaggguau

SEQ ID NO: 1387592 - RNA, 19 nt, Homo sapiens
cagaagugaauauguacua

SEQ ID NO: 1387593 - RNA, 19 nt, Homo sapiens
uagagaagaugagaaugau

SEQ ID NO: 1387594 - RNA, 19 nt, Homo sapiens
ugaacauggugaagaugaa

SEQ ID NO: 1387595 - RNA, 19 nt, Homo sapiens
ggaguuaucaucagugaac

SEQ ID NO: 1387596 - RNA, 19 nt, Homo sapiens
gacagcagcaugagaaaca

SEQ ID NO: 1387597 - RNA, 19 nt, Homo sapiens
ccagugaugaugaagauga

SEQ ID NO: 1387598 - RNA, 19 nt, Homo sapiens
gagauuucacuccucauga

SEQ ID NO: 1387599 - RNA, 19 nt, Homo sapiens
ggaaagaaugcugcucaga

SEQ ID NO: 1387600 - RNA, 19 nt, Homo sapiens
gucgugacuuugagaauau

SEQ ID NO: 1387601 - RNA, 19 nt, Homo sapiens
ucacuuggacuccucuuga

SEQ ID NO: 1387602 - RNA, 19 nt, Homo sapiens
guccaaagacgacaagaug

SEQ ID NO: 1387603 - RNA, 19 nt, Homo sapiens
ugagaugacucccguuacu

SEQ ID NO: 1387604 - RNA, 19 nt, Homo sapiens
gagaagaacuuuagaugau

SEQ ID NO: 1387605 - RNA, 19 nt, Homo sapiens
cuacaaagaugcuuacauu

SEQ ID NO: 1387606 - RNA, 19 nt, Homo sapiens
gaagaacuuuagaugauga

SEQ ID NO: 1387607 - RNA, 19 nt, Homo sapiens
gauauauucucauggcuuu

SEQ ID NO: 1387608 - RNA, 19 nt, Homo sapiens
ccaaauggcccgagaauug

SEQ ID NO: 1387609 - RNA, 19 nt, Homo sapiens
caauggauauccuucagua

SEQ ID NO: 1387610 - RNA, 19 nt, Homo sapiens
gaacgacuccgaagaggaa

SEQ ID NO: 1387611 - RNA, 19 nt, Homo sapiens
gaagauguccuugaaaguu

SEQ ID NO: 1387612 - RNA, 19 nt, Homo sapiens
ccgcagaagugaauaugua

SEQ ID NO: 1387613 - RNA, 19 nt, Homo sapiens
gaaauaguaucggguguuc

SEQ ID NO: 1387614 - RNA, 19 nt, Homo sapiens
agacagaacucaacucauc

SEQ ID NO: 1387615 - RNA, 19 nt, Homo sapiens
gaacuugaaucagcaauac

SEQ ID NO: 1387616 - RNA, 19 nt, Homo sapiens
ucaagaagauggaguuauc

SEQ ID NO: 1387617 - RNA, 19 nt, Homo sapiens
ggauacaaaucaagaagau

SEQ ID NO: 1387618 - RNA, 19 nt, Homo sapiens
ggaagaaaaugaagaaguu

SEQ ID NO: 1387619 - RNA, 19 nt, Homo sapiens
gaaaaggugccacugauua

SEQ ID NO: 1387620 - RNA, 19 nt, Homo sapiens
caacacagacuucaagaau

SEQ ID NO: 1387621 - RNA, 19 nt, Homo sapiens
gagaauaugcugugguuug

SEQ ID NO: 1387622 - RNA, 19 nt, Homo sapiens
gagugaugaugaugcuuua

SEQ ID NO: 1387623 - RNA, 19 nt, Homo sapiens
gauggcagaucaccuugaa

SEQ ID NO: 1387624 - RNA, 19 nt, Homo sapiens
caagaguuaucaauagaug

SEQ ID NO: 1387625 - RNA, 19 nt, Homo sapiens
gaagaacgagagcaagaaa

SEQ ID NO: 1387626 - RNA, 19 nt, Homo sapiens
caccaaaucuugacuccuu

SEQ ID NO: 1387627 - RNA, 19 nt, Homo sapiens
aaauggauauggaaaguga

SEQ ID NO: 1387628 - RNA, 19 nt, Homo sapiens
ccagaacacuuaccagaca

SEQ ID NO: 1387629 - RNA, 19 nt, Homo sapiens
gaacaggagcagauaagga

SEQ ID NO: 1387630 - RNA, 19 nt, Homo sapiens
acacuuagcggauacaauu

SEQ ID NO: 1387631 - RNA, 19 nt, Homo sapiens
aaacaaugguucaugaauc

SEQ ID NO: 1387632 - RNA, 19 nt, Homo sapiens
gccgauaccuuguacacuu

SEQ ID NO: 1387633 - RNA, 19 nt, Homo sapiens
gcaauuuucuucaguggua

SEQ ID NO: 1387634 - RNA, 19 nt, Homo sapiens
gagaaugagaagaacuuua

SEQ ID NO: 1387635 - RNA, 19 nt, Homo sapiens
gaagaaguuuucaaaguga

SEQ ID NO: 1387636 - RNA, 19 nt, Homo sapiens
gacuucagcuccucacuug

SEQ ID NO: 1387637 - RNA, 19 nt, Homo sapiens
ccagggcuauugaaagauu

SEQ ID NO: 1387638 - RNA, 19 nt, Homo sapiens
uaccagggcuauugaaaga

SEQ ID NO: 1387639 - RNA, 19 nt, Homo sapiens
ccgauaccuuguacacuua

SEQ ID NO: 1387640 - RNA, 19 nt, Homo sapiens
gaggguauguccaagacuu

SEQ ID NO: 1387641 - RNA, 19 nt, Homo sapiens
gauaauacagucccuuuca

SEQ ID NO: 1387642 - RNA, 19 nt, Homo sapiens
gcagauaaggaaaggaauu

SEQ ID NO: 1387643 - RNA, 19 nt, Homo sapiens
gagcagauaaggaaaggaa

SEQ ID NO: 1387644 - RNA, 19 nt, Homo sapiens
ggagugaugaugaugcuuu

SEQ ID NO: 1387645 - RNA, 19 nt, Homo sapiens
ucaagaauggugggaauua

SEQ ID NO: 1387646 - RNA, 19 nt, Homo sapiens
aagauguccuugaaaguuu

SEQ ID NO: 1387647 - RNA, 19 nt, Homo sapiens
guaaagaaacagcuuaaag

SEQ ID NO: 1387648 - RNA, 19 nt, Homo sapiens
ugaugaugaugcuuuagua

SEQ ID NO: 1387649 - RNA, 19 nt, Homo sapiens
guuugaaucuuugcuguuu

SEQ ID NO: 1387650 - RNA, 19 nt, Homo sapiens
caaagacgacaagaugaua

SEQ ID NO: 1387651 - RNA, 19 nt, Homo sapiens
uaaaauugcucaagaagga

SEQ ID NO: 1387652 - RNA, 19 nt, Homo sapiens
aaaggacuauuucucaguu

SEQ ID NO: 1387653 - RNA, 19 nt, Homo sapiens
gcacuuuuauugagaauga

SEQ ID NO: 1387654 - RNA, 19 nt, Homo sapiens
acacagacuucaagaaugg

SEQ ID NO: 1387655 - RNA, 19 nt, Homo sapiens
cagauaaggaaaggaauua

SEQ ID NO: 1387656 - RNA, 19 nt, Homo sapiens
gcggauacaauuuauagaa

SEQ ID NO: 1387657 - RNA, 19 nt, Homo sapiens
gaaaggagaaaggacuauu

SEQ ID NO: 1387658 - RNA, 19 nt, Homo sapiens
ugucgugacuuugagaaua

SEQ ID NO: 1387659 - RNA, 19 nt, Homo sapiens
agaauaugcugugguuuga

SEQ ID NO: 1387660 - RNA, 19 nt, Homo sapiens
gcaagaggccucgcgagaa

SEQ ID NO: 1387661 - RNA, 19 nt, Homo sapiens
aagacuugcuugaguguuu

SEQ ID NO: 1387662 - RNA, 19 nt, Homo sapiens
ggucuucaguuaagcuguu

SEQ ID NO: 1387663 - RNA, 19 nt, Homo sapiens
ggauauccuucaguaguga

SEQ ID NO: 1387664 - RNA, 19 nt, Homo sapiens
gauguugcccuacuaccua

SEQ ID NO: 1387665 - RNA, 19 nt, Homo sapiens
gaaggccuuuccagugaug

SEQ ID NO: 1387666 - RNA, 19 nt, Homo sapiens
gcucaagaaggaauauaaa

SEQ ID NO: 1387667 - RNA, 19 nt, Homo sapiens
ugacucccguuacuauuga

SEQ ID NO: 1387668 - RNA, 19 nt, Homo sapiens
caagaggccucgcgagaac

SEQ ID NO: 1387669 - RNA, 19 nt, Homo sapiens
gaacauggugaagaugaaa

SEQ ID NO: 1387670 - RNA, 19 nt, Homo sapiens
guuaagcuguuaggcaauu

SEQ ID NO: 1387671 - RNA, 19 nt, Homo sapiens
ggugauucuuccuaaacua

SEQ ID NO: 1387672 - RNA, 19 nt, Homo sapiens
gaugaugaugcuuuaguaa

SEQ ID NO: 1387673 - RNA, 19 nt, Homo sapiens
gaaagaaaagucacaaaga

SEQ ID NO: 1387674 - RNA, 19 nt, Homo sapiens
cccaaacaaugguucauga

SEQ ID NO: 1387675 - RNA, 19 nt, Homo sapiens
ugagaagaacuuuagauga

SEQ ID NO: 1387676 - RNA, 19 nt, Homo sapiens
ggcaaaaugucgugacuuu

SEQ ID NO: 1387677 - RNA, 19 nt, Homo sapiens
cuacacauccuacaaagau

SEQ ID NO: 1387678 - RNA, 19 nt, Homo sapiens
uugaaggccuuuccaguga

SEQ ID NO: 1387679 - RNA, 19 nt, Homo sapiens
ccagagaacaaaccgguaa

SEQ ID NO: 1387680 - RNA, 19 nt, Homo sapiens
gaagaaaucaaguuauagc

SEQ ID NO: 1387681 - RNA, 19 nt, Homo sapiens
ugaaauggauauggaaagu

SEQ ID NO: 1387682 - RNA, 19 nt, Homo sapiens
caacucaucagcugaaagu

SEQ ID NO: 1387683 - RNA, 19 nt, Homo sapiens
gaugagaaacgccggauag

SEQ ID NO: 1387684 - RNA, 19 nt, Homo sapiens
aagaugaaauggauaugga

SEQ ID NO: 1387685 - RNA, 19 nt, Homo sapiens
gaacuuuagaugaugaugu

SEQ ID NO: 1387686 - RNA, 19 nt, Homo sapiens
uaagauggcagaucaccuu

SEQ ID NO: 1387687 - RNA, 19 nt, Homo sapiens
ccgguaagauggcagauca

SEQ ID NO: 1387688 - RNA, 19 nt, Homo sapiens
caggaggacucgucguaga

SEQ ID NO: 1387689 - RNA, 19 nt, Homo sapiens
gacgacaagaugauauuaa

SEQ ID NO: 1387690 - RNA, 19 nt, Homo sapiens
caaaucgacagcagcauga

SEQ ID NO: 1387691 - RNA, 19 nt, Homo sapiens
cugcaagaguuaucaauag

SEQ ID NO: 1387692 - RNA, 19 nt, Homo sapiens
uaauacagucccuuucaaa

SEQ ID NO: 1387693 - RNA, 19 nt, Homo sapiens
uguacuaccagaacacuua

SEQ ID NO: 1387694 - RNA, 19 nt, Homo sapiens
uauacaugcugcaaggaaa

SEQ ID NO: 1387695 - RNA, 19 nt, Homo sapiens
gaugaaauggauauggaaa

SEQ ID NO: 1387696 - RNA, 19 nt, Homo sapiens
aaaggagaaaggacuauuu

SEQ ID NO: 1387697 - RNA, 19 nt, Homo sapiens
aaaggugauucuuccuaaa

SEQ ID NO: 1387698 - RNA, 19 nt, Homo sapiens
uaagacagaacucaacuca

SEQ ID NO: 1387699 - RNA, 19 nt, Homo sapiens
ggugaacgguauaaauuuu

SEQ ID NO: 1387700 - RNA, 19 nt, Homo sapiens
uggcauuccuuauaguuau

SEQ ID NO: 1387701 - RNA, 19 nt, Homo sapiens
uaauaucccucagguucaa

SEQ ID NO: 1387702 - RNA, 19 nt, Homo sapiens
uuagagaagaugagaauga

SEQ ID NO: 1387703 - RNA, 19 nt, Homo sapiens
gaucaugcuaugucuguug

SEQ ID NO: 1387704 - RNA, 19 nt, Homo sapiens
ccaaauggcccgagaauug

SEQ ID NO: 1387705 - RNA, 19 nt, Homo sapiens
ccgcagaagugaauaugua

SEQ ID NO: 1387706 - RNA, 19 nt, Homo sapiens
gaacgacuccgaagaggaa

SEQ ID NO: 1387707 - RNA, 19 nt, Homo sapiens
agacagaacucaacucauc

SEQ ID NO: 1387708 - RNA, 19 nt, Homo sapiens
ucaagaagauggaguuauc

SEQ ID NO: 1387709 - RNA, 19 nt, Homo sapiens
ggauacaaaucaagaagau

SEQ ID NO: 1387710 - RNA, 19 nt, Homo sapiens
ggaagaaaaugaagaaguu

SEQ ID NO: 1387711 - RNA, 19 nt, Homo sapiens
gagugaugaugaugcuuua

SEQ ID NO: 1387712 - RNA, 19 nt, Homo sapiens
aaauggauauggaaaguga

SEQ ID NO: 1387713 - RNA, 19 nt, Homo sapiens
ccagaacacuuaccagaca

SEQ ID NO: 1387714 - RNA, 19 nt, Homo sapiens
gaacaggagcagauaagga

SEQ ID NO: 1387715 - RNA, 19 nt, Homo sapiens
ccagggcuauugaaagauu

SEQ ID NO: 1387716 - RNA, 19 nt, Homo sapiens
uaccagggcuauugaaaga

SEQ ID NO: 1387717 - RNA, 19 nt, Homo sapiens
gaagaaguuuucaaaguga

SEQ ID NO: 1387718 - RNA, 19 nt, Homo sapiens
gaggguauguccaagacuu

SEQ ID NO: 1387719 - RNA, 19 nt, Homo sapiens
gauaauacagucccuuuca

SEQ ID NO: 1387720 - RNA, 19 nt, Homo sapiens
gcagauaaggaaaggaauu

SEQ ID NO: 1387721 - RNA, 19 nt, Homo sapiens
gagcagauaaggaaaggaa

SEQ ID NO: 1387722 - RNA, 19 nt, Homo sapiens
ggagugaugaugaugcuuu

SEQ ID NO: 1387723 - RNA, 19 nt, Homo sapiens
guaaagaaacagcuuaaag

SEQ ID NO: 1387724 - RNA, 19 nt, Homo sapiens
ugaugaugaugcuuuagua

SEQ ID NO: 1387725 - RNA, 19 nt, Homo sapiens
uaaaauugcucaagaagga

SEQ ID NO: 1387726 - RNA, 19 nt, Homo sapiens
cagauaaggaaaggaauua

SEQ ID NO: 1387727 - RNA, 19 nt, Homo sapiens
aagacuugcuugaguguuu

SEQ ID NO: 1387728 - RNA, 19 nt, Homo sapiens
gcaagaggccucgcgagaa

SEQ ID NO: 1387729 - RNA, 19 nt, Homo sapiens
ugacucccguuacuauuga

SEQ ID NO: 1387730 - RNA, 19 nt, Homo sapiens
caagaggccucgcgagaac

SEQ ID NO: 1387731 - RNA, 19 nt, Homo sapiens
gaacauggugaagaugaaa

SEQ ID NO: 1387732 - RNA, 19 nt, Homo sapiens
gcucaagaaggaauauaaa

SEQ ID NO: 1387733 - RNA, 19 nt, Homo sapiens
gaugaugaugcuuuaguaa

SEQ ID NO: 1387734 - RNA, 19 nt, Homo sapiens
gaaagaaaagucacaaaga

SEQ ID NO: 1387735 - RNA, 19 nt, Homo sapiens
ugaaauggauauggaaagu

SEQ ID NO: 1387736 - RNA, 19 nt, Homo sapiens
gaagaaaucaaguuauagc

SEQ ID NO: 1387737 - RNA, 19 nt, Homo sapiens
gaugagaaacgccggauag

SEQ ID NO: 1387738 - RNA, 19 nt, Homo sapiens
aagaugaaauggauaugga

SEQ ID NO: 1387739 - RNA, 19 nt, Homo sapiens
caacucaucagcugaaagu

SEQ ID NO: 1387740 - RNA, 19 nt, Homo sapiens
caaaucgacagcagcauga

SEQ ID NO: 1387741 - RNA, 19 nt, Homo sapiens
uaauacagucccuuucaaa

SEQ ID NO: 1387742 - RNA, 19 nt, Homo sapiens
uguacuaccagaacacuua

SEQ ID NO: 1387743 - RNA, 19 nt, Homo sapiens
uauacaugcugcaaggaaa

SEQ ID NO: 1387744 - RNA, 19 nt, Homo sapiens
gaugaaauggauauggaaa

SEQ ID NO: 1387745 - RNA, 19 nt, Homo sapiens
ggugaacgguauaaauuuu

SEQ ID NO: 1387746 - RNA, 19 nt, Homo sapiens
uggcauuccuuauaguuau

SEQ ID NO: 1387747 - RNA, 19 nt, Homo sapiens
uaauaucccucagguucaa

SEQ ID NO: 1387748 - RNA, 19 nt, Homo sapiens
uuagagaagaugagaauga

SEQ ID NO: 1387749 - RNA, 19 nt, Homo sapiens
uaagacagaacucaacuca

SEQ ID NO: 1387750 - RNA, 19 nt, Homo sapiens
gcaagaaaugcgaggguau

SEQ ID NO: 1387751 - RNA, 19 nt, Homo sapiens
cagaagugaauauguacua

SEQ ID NO: 1387752 - RNA, 19 nt, Homo sapiens
uagagaagaugagaaugau

SEQ ID NO: 1387753 - RNA, 19 nt, Homo sapiens
ugaacauggugaagaugaa

SEQ ID NO: 1387754 - RNA, 19 nt, Homo sapiens
ggaguuaucaucagugaac

SEQ ID NO: 1387755 - RNA, 19 nt, Homo sapiens
gacagcagcaugagaaaca

SEQ ID NO: 1387756 - RNA, 19 nt, Homo sapiens
ccagugaugaugaagauga

SEQ ID NO: 1387757 - RNA, 19 nt, Homo sapiens
gagauuucacuccucauga

SEQ ID NO: 1387758 - RNA, 19 nt, Homo sapiens
ugagaugacucccguuacu

SEQ ID NO: 1387759 - RNA, 19 nt, Homo sapiens
cagauaauacagucccuuu

SEQ ID NO: 1387760 - RNA, 19 nt, Homo sapiens
cauccuauggcauuccuua

SEQ ID NO: 1387761 - RNA, 19 nt, Homo sapiens
ugaagaugacgaugagaaa

SEQ ID NO: 1387762 - RNA, 19 nt, Homo sapiens
gaagaugaaauggauaugg

SEQ ID NO: 1387763 - RNA, 19 nt, Homo sapiens
caugaaagaauugcacaaa

SEQ ID NO: 1387764 - RNA, 19 nt, Homo sapiens
gagaugacucccguuacua

SEQ ID NO: 1387765 - RNA, 19 nt, Homo sapiens
gaauauguacuaccagaac

SEQ ID NO: 1387766 - RNA, 19 nt, Homo sapiens
caggacauguuaaggauac

SEQ ID NO: 1387767 - RNA, 19 nt, Homo sapiens
gugaacaaccuuuggacaa

SEQ ID NO: 1387768 - RNA, 19 nt, Homo sapiens
gauuucacuccucaugaua

SEQ ID NO: 1387769 - RNA, 19 nt, Homo sapiens
ggguauuggugaacgguau

SEQ ID NO: 1387770 - RNA, 19 nt, Homo sapiens
cagggcuauugaaagauua

SEQ ID NO: 1387771 - RNA, 19 nt, Homo sapiens
gaugaugcuuuaguaacug

SEQ ID NO: 1387772 - RNA, 19 nt, Homo sapiens
cagugaacauggugaagau

SEQ ID NO: 1387773 - RNA, 19 nt, Homo sapiens
aaugagaugacucccguua

SEQ ID NO: 1387774 - RNA, 19 nt, Homo sapiens
ugaugaagaugacgaugag

SEQ ID NO: 1387775 - RNA, 19 nt, Homo sapiens
uaucaucagugaacauggu

SEQ ID NO: 1387776 - RNA, 19 nt, Homo sapiens
gaacacuuaccagacaaug

SEQ ID NO: 1387777 - RNA, 19 nt, Homo sapiens
ugaugaugcuuuaguaacu

SEQ ID NO: 1387778 - RNA, 19 nt, Homo sapiens
gauaaugagccugguaaag

SEQ ID NO: 1387779 - RNA, 19 nt, Homo sapiens
caagaaaugcgaggguaug

SEQ ID NO: 1387780 - RNA, 19 nt, Homo sapiens
cucaucagcugaaagugaa

SEQ ID NO: 1387781 - RNA, 19 nt, Homo sapiens
caugagaaacaucugcaaa

SEQ ID NO: 1387782 - RNA, 19 nt, Homo sapiens
gguaaagaaacagcuuaaa

SEQ ID NO: 1387783 - RNA, 19 nt, Homo sapiens
auaauacagucccuuucaa

SEQ ID NO: 1387784 - RNA, 19 nt, Homo sapiens
gaaauggauauggaaagug

SEQ ID NO: 1387785 - RNA, 19 nt, Homo sapiens
gugaagaugaaauggauau

SEQ ID NO: 1387786 - RNA, 19 nt, Homo sapiens
gugaacauggugaagauga

SEQ ID NO: 1387787 - RNA, 19 nt, Homo sapiens
gaugacucccguuacuauu

SEQ ID NO: 1387788 - RNA, 19 nt, Homo sapiens
gaugggaacaggagcagau

SEQ ID NO: 1387789 - RNA, 19 nt, Homo sapiens
gagaaugaugccagugaug

SEQ ID NO: 1387790 - RNA, 19 nt, Homo sapiens
guucaggaagcugcuauaa

SEQ ID NO: 1387791 - RNA, 19 nt, Homo sapiens
cagaacacuuaccagacaa

SEQ ID NO: 1387792 - RNA, 19 nt, Homo sapiens
gaaaagucacaaagacaaa

SEQ ID NO: 1387793 - RNA, 19 nt, Homo sapiens
ugagaaacgccggauaguu

SEQ ID NO: 1387794 - RNA, 19 nt, Homo sapiens
gaaugaugccagugaugau

SEQ ID NO: 1387795 - RNA, 19 nt, Homo sapiens
ugagaaugaugccagugau

SEQ ID NO: 1387796 - RNA, 19 nt, Homo sapiens
gcccgagaauugggagauu

SEQ ID NO: 1387797 - RNA, 19 nt, Homo sapiens
ugagaaacaucugcaaagc

SEQ ID NO: 1387798 - RNA, 19 nt, Homo sapiens
ggacuccaugaaagaauug

SEQ ID NO: 1387799 - RNA, 19 nt, Homo sapiens
agaaugaugccagugauga

SEQ ID NO: 1387800 - RNA, 19 nt, Homo sapiens
agauuucacuccucaugau

SEQ ID NO: 1387801 - RNA, 19 nt, Homo sapiens
gcgaggguauguccaagac

SEQ ID NO: 1387802 - RNA, 19 nt, Homo sapiens
gaaagaauugcacaaaaca

SEQ ID NO: 1387803 - RNA, 19 nt, Homo sapiens
uaacuggagaacaggauga

SEQ ID NO: 1387804 - RNA, 19 nt, Homo sapiens
gagaagaacuuuagaugau

SEQ ID NO: 1387805 - RNA, 19 nt, Homo sapiens
cuacaaagaugcuuacauu

SEQ ID NO: 1387806 - RNA, 19 nt, Homo sapiens
gaagaacuuuagaugauga

SEQ ID NO: 1387807 - RNA, 19 nt, Homo sapiens
gauauauucucauggcuuu

SEQ ID NO: 1387808 - RNA, 19 nt, Homo sapiens
ccaaauggcccgagaauug

SEQ ID NO: 1387809 - RNA, 19 nt, Homo sapiens
caauggauauccuucagua

SEQ ID NO: 1387810 - RNA, 19 nt, Homo sapiens
gaacgacuccgaagaggaa

SEQ ID NO: 1387811 - RNA, 19 nt, Homo sapiens
gaagauguccuugaaaguu

SEQ ID NO: 1387812 - RNA, 19 nt, Homo sapiens
ccgcagaagugaauaugua

SEQ ID NO: 1387813 - RNA, 19 nt, Homo sapiens
gaaauaguaucggguguuc

SEQ ID NO: 1387814 - RNA, 19 nt, Homo sapiens
agacagaacucaacucauc

SEQ ID NO: 1387815 - RNA, 19 nt, Homo sapiens
gaacuugaaucagcaauac

SEQ ID NO: 1387816 - RNA, 19 nt, Homo sapiens
ucaagaagauggaguuauc

SEQ ID NO: 1387817 - RNA, 19 nt, Homo sapiens
ggauacaaaucaagaagau

SEQ ID NO: 1387818 - RNA, 19 nt, Homo sapiens
ggaagaaaaugaagaaguu

SEQ ID NO: 1387819 - RNA, 19 nt, Homo sapiens
gaaaaggugccacugauua

SEQ ID NO: 1387820 - RNA, 19 nt, Homo sapiens
caacacagacuucaagaau

SEQ ID NO: 1387821 - RNA, 19 nt, Homo sapiens
gagaauaugcugugguuug

SEQ ID NO: 1387822 - RNA, 19 nt, Homo sapiens
gagugaugaugaugcuuua

SEQ ID NO: 1387823 - RNA, 19 nt, Homo sapiens
gauggcagaucaccuugaa

SEQ ID NO: 1387824 - RNA, 19 nt, Homo sapiens
caagaguuaucaauagaug

SEQ ID NO: 1387825 - RNA, 19 nt, Homo sapiens
gaagaacgagagcaagaaa

SEQ ID NO: 1387826 - RNA, 19 nt, Homo sapiens
caccaaaucuugacuccuu

SEQ ID NO: 1387827 - RNA, 19 nt, Homo sapiens
aaauggauauggaaaguga

SEQ ID NO: 1387828 - RNA, 19 nt, Homo sapiens
ccagaacacuuaccagaca

SEQ ID NO: 1387829 - RNA, 19 nt, Homo sapiens
gaacaggagcagauaagga

SEQ ID NO: 1387830 - RNA, 19 nt, Homo sapiens
acacuuagcggauacaauu

SEQ ID NO: 1387831 - RNA, 19 nt, Homo sapiens
aaacaaugguucaugaauc

SEQ ID NO: 1387832 - RNA, 19 nt, Homo sapiens
gccgauaccuuguacacuu

SEQ ID NO: 1387833 - RNA, 19 nt, Homo sapiens
gcaauuuucuucaguggua

SEQ ID NO: 1387834 - RNA, 19 nt, Homo sapiens
gagaaugagaagaacuuua

SEQ ID NO: 1387835 - RNA, 19 nt, Homo sapiens
gaagaaguuuucaaaguga

SEQ ID NO: 1387836 - RNA, 19 nt, Homo sapiens
gacuucagcuccucacuug

SEQ ID NO: 1387837 - RNA, 19 nt, Homo sapiens
ccagggcuauugaaagauu

SEQ ID NO: 1387838 - RNA, 19 nt, Homo sapiens
uaccagggcuauugaaaga

SEQ ID NO: 1387839 - RNA, 19 nt, Homo sapiens
ccgauaccuuguacacuua

SEQ ID NO: 1387840 - RNA, 19 nt, Homo sapiens
gaggguauguccaagacuu

SEQ ID NO: 1387841 - RNA, 19 nt, Homo sapiens
gauaauacagucccuuuca

SEQ ID NO: 1387842 - RNA, 19 nt, Homo sapiens
gcagauaaggaaaggaauu

SEQ ID NO: 1387843 - RNA, 19 nt, Homo sapiens
gagcagauaaggaaaggaa

SEQ ID NO: 1387844 - RNA, 19 nt, Homo sapiens
ggagugaugaugaugcuuu

SEQ ID NO: 1387845 - RNA, 19 nt, Homo sapiens
ucaagaauggugggaauua

SEQ ID NO: 1387846 - RNA, 19 nt, Homo sapiens
aagauguccuugaaaguuu

SEQ ID NO: 1387847 - RNA, 19 nt, Homo sapiens
guaaagaaacagcuuaaag

SEQ ID NO: 1387848 - RNA, 19 nt, Homo sapiens
ugaugaugaugcuuuagua

SEQ ID NO: 1387849 - RNA, 19 nt, Homo sapiens
guuugaaucuuugcuguuu

SEQ ID NO: 1387850 - RNA, 19 nt, Homo sapiens
caaagacgacaagaugaua

SEQ ID NO: 1387851 - RNA, 19 nt, Homo sapiens
uaaaauugcucaagaagga

SEQ ID NO: 1387852 - RNA, 19 nt, Homo sapiens
aaaggacuauuucucaguu

SEQ ID NO: 1387853 - RNA, 19 nt, Homo sapiens
gcacuuuuauugagaauga

SEQ ID NO: 1387854 - RNA, 19 nt, Homo sapiens
acacagacuucaagaaugg

SEQ ID NO: 1387855 - RNA, 19 nt, Homo sapiens
cagauaaggaaaggaauua

SEQ ID NO: 1387856 - RNA, 19 nt, Homo sapiens
gcggauacaauuuauagaa

SEQ ID NO: 1387857 - RNA, 19 nt, Homo sapiens
gaaaggagaaaggacuauu

SEQ ID NO: 1387858 - RNA, 19 nt, Homo sapiens
ugucgugacuuugagaaua

SEQ ID NO: 1387859 - RNA, 19 nt, Homo sapiens
agaauaugcugugguuuga

SEQ ID NO: 1387860 - RNA, 19 nt, Homo sapiens
gcaagaggccucgcgagaa

SEQ ID NO: 1387861 - RNA, 19 nt, Homo sapiens
aagacuugcuugaguguuu

SEQ ID NO: 1387862 - RNA, 19 nt, Homo sapiens
ggucuucaguuaagcuguu

SEQ ID NO: 1387863 - RNA, 19 nt, Homo sapiens
ggauauccuucaguaguga

SEQ ID NO: 1387864 - RNA, 19 nt, Homo sapiens
gauguugcccuacuaccua

SEQ ID NO: 1387865 - RNA, 19 nt, Homo sapiens
gaaggccuuuccagugaug

SEQ ID NO: 1387866 - RNA, 19 nt, Homo sapiens
gcucaagaaggaauauaaa

SEQ ID NO: 1387867 - RNA, 19 nt, Homo sapiens
ugacucccguuacuauuga

SEQ ID NO: 1387868 - RNA, 19 nt, Homo sapiens
caagaggccucgcgagaac

SEQ ID NO: 1387869 - RNA, 19 nt, Homo sapiens
gaacauggugaagaugaaa

SEQ ID NO: 1387870 - RNA, 19 nt, Homo sapiens
guuaagcuguuaggcaauu

SEQ ID NO: 1387871 - RNA, 19 nt, Homo sapiens
ggugauucuuccuaaacua

SEQ ID NO: 1387872 - RNA, 19 nt, Homo sapiens
gaugaugaugcuuuaguaa

SEQ ID NO: 1387873 - RNA, 19 nt, Homo sapiens
gaaagaaaagucacaaaga

SEQ ID NO: 1387874 - RNA, 19 nt, Homo sapiens
cccaaacaaugguucauga

SEQ ID NO: 1387875 - RNA, 19 nt, Homo sapiens
ugagaagaacuuuagauga

SEQ ID NO: 1387876 - RNA, 19 nt, Homo sapiens
ggcaaaaugucgugacuuu

SEQ ID NO: 1387877 - RNA, 19 nt, Homo sapiens
cuacacauccuacaaagau

SEQ ID NO: 1387878 - RNA, 19 nt, Homo sapiens
uugaaggccuuuccaguga

SEQ ID NO: 1387879 - RNA, 19 nt, Homo sapiens
ccagagaacaaaccgguaa

SEQ ID NO: 1387880 - RNA, 19 nt, Homo sapiens
gaagaaaucaaguuauagc

SEQ ID NO: 1387881 - RNA, 19 nt, Homo sapiens
ugaaauggauauggaaagu

SEQ ID NO: 1387882 - RNA, 19 nt, Homo sapiens
caacucaucagcugaaagu

SEQ ID NO: 1387883 - RNA, 19 nt, Homo sapiens
gaugagaaacgccggauag

SEQ ID NO: 1387884 - RNA, 19 nt, Homo sapiens
aagaugaaauggauaugga

SEQ ID NO: 1387885 - RNA, 19 nt, Homo sapiens
gaacuuuagaugaugaugu

SEQ ID NO: 1387886 - RNA, 19 nt, Homo sapiens
uaagauggcagaucaccuu

SEQ ID NO: 1387887 - RNA, 19 nt, Homo sapiens
ccgguaagauggcagauca

SEQ ID NO: 1387888 - RNA, 19 nt, Homo sapiens
caggaggacucgucguaga

SEQ ID NO: 1387889 - RNA, 19 nt, Homo sapiens
gacgacaagaugauauuaa

SEQ ID NO: 1387890 - RNA, 19 nt, Homo sapiens
caaaucgacagcagcauga

SEQ ID NO: 1387891 - RNA, 19 nt, Homo sapiens
cugcaagaguuaucaauag

SEQ ID NO: 1387892 - RNA, 19 nt, Homo sapiens
uaauacagucccuuucaaa

SEQ ID NO: 1387893 - RNA, 19 nt, Homo sapiens
uguacuaccagaacacuua

SEQ ID NO: 1387894 - RNA, 19 nt, Homo sapiens
uauacaugcugcaaggaaa

SEQ ID NO: 1387895 - RNA, 19 nt, Homo sapiens
gaugaaauggauauggaaa

SEQ ID NO: 1387896 - RNA, 19 nt, Homo sapiens
aaaggagaaaggacuauuu

SEQ ID NO: 1387897 - RNA, 19 nt, Homo sapiens
aaaggugauucuuccuaaa

SEQ ID NO: 1387898 - RNA, 19 nt, Homo sapiens
uaagacagaacucaacuca

SEQ ID NO: 1387899 - RNA, 19 nt, Homo sapiens
ggugaacgguauaaauuuu

SEQ ID NO: 1387900 - RNA, 19 nt, Homo sapiens
uggcauuccuuauaguuau

SEQ ID NO: 1387901 - RNA, 19 nt, Homo sapiens
uaauaucccucagguucaa

SEQ ID NO: 1387902 - RNA, 19 nt, Homo sapiens
uuagagaagaugagaauga

SEQ ID NO: 1387903 - RNA, 19 nt, Homo sapiens
gaucaugcuaugucuguug

SEQ ID NO: 1387904 - RNA, 19 nt, Homo sapiens
gagacaaacuggucaagug

SEQ ID NO: 1387905 - RNA, 19 nt, Homo sapiens
gaaccaacuucaccagcaa

SEQ ID NO: 1387906 - RNA, 19 nt, Homo sapiens
agaaggagguaaaggauga

SEQ ID NO: 1387907 - RNA, 19 nt, Homo sapiens
gcaguucacccauccagua

SEQ ID NO: 1387908 - RNA, 19 nt, Homo sapiens
gcuucugucugguuuauuu

SEQ ID NO: 1387909 - RNA, 19 nt, Homo sapiens
ggacacuucucaggaaaug

SEQ ID NO: 1387910 - RNA, 19 nt, Homo sapiens
gcacaccucuggcugucuu

SEQ ID NO: 1387911 - RNA, 19 nt, Homo sapiens
gaagagggaagccaggauu

SEQ ID NO: 1387912 - RNA, 19 nt, Homo sapiens
gcaaauacaacaugaaggu

SEQ ID NO: 1387913 - RNA, 19 nt, Homo sapiens
caugaagguccucuacuua

SEQ ID NO: 1387914 - RNA, 19 nt, Homo sapiens
caaagaaaacugcacaaua

SEQ ID NO: 1387915 - RNA, 19 nt, Homo sapiens
gugcagagauccuacuucu

SEQ ID NO: 1387916 - RNA, 19 nt, Homo sapiens
acaaacuggucaaguguga

SEQ ID NO: 1387917 - RNA, 19 nt, Homo sapiens
gguaaaggaugaggguuca

SEQ ID NO: 1387918 - RNA, 19 nt, Homo sapiens
cagugaagaugcagguuug

SEQ ID NO: 1387919 - RNA, 19 nt, Homo sapiens
ggcaagccauggagugaga

SEQ ID NO: 1387920 - RNA, 19 nt, Homo sapiens
gaacgucacagugcucaga

SEQ ID NO: 1387921 - RNA, 19 nt, Homo sapiens
acaugaagguccucuacuu

SEQ ID NO: 1387922 - RNA, 19 nt, Homo sapiens
gcuuauggcaucucauuga

SEQ ID NO: 1387923 - RNA, 19 nt, Homo sapiens
ucacagugcucagagacaa

SEQ ID NO: 1387924 - RNA, 19 nt, Homo sapiens
caacuucaccagcaaauac

SEQ ID NO: 1387925 - RNA, 19 nt, Homo sapiens
ggagaaggagguaaaggau

SEQ ID NO: 1387926 - RNA, 19 nt, Homo sapiens
ugaagguccucuacuuauc

SEQ ID NO: 1387927 - RNA, 19 nt, Homo sapiens
ggacugccgccaugagaau

SEQ ID NO: 1387928 - RNA, 19 nt, Homo sapiens
gccggacacuucucaggaa

SEQ ID NO: 1387929 - RNA, 19 nt, Homo sapiens
ugagaucccagaaccauga

SEQ ID NO: 1387930 - RNA, 19 nt, Homo sapiens
gagggcaccaccaagaauu

SEQ ID NO: 1387931 - RNA, 19 nt, Homo sapiens
gacaggaagccucaaguuc

SEQ ID NO: 1387932 - RNA, 19 nt, Homo sapiens
guggaggguuggagaagga

SEQ ID NO: 1387933 - RNA, 19 nt, Homo sapiens
ccagugaagaugcagguuu

SEQ ID NO: 1387934 - RNA, 19 nt, Homo sapiens
ggagagugagagcauguga

SEQ ID NO: 1387935 - RNA, 19 nt, Homo sapiens
aaccaaagccucuggaauc

SEQ ID NO: 1387936 - RNA, 19 nt, Homo sapiens
cugagcaucuccagcauuc

SEQ ID NO: 1387937 - RNA, 19 nt, Homo sapiens
caacaugaagguccucuac

SEQ ID NO: 1387938 - RNA, 19 nt, Homo sapiens
ccuguucugugacugugua

SEQ ID NO: 1387939 - RNA, 19 nt, Homo sapiens
gggcaugacccagugaaga

SEQ ID NO: 1387940 - RNA, 19 nt, Homo sapiens
gcaaggacgagggcaccua

SEQ ID NO: 1387941 - RNA, 19 nt, Homo sapiens
gaugugagggcaccaccaa

SEQ ID NO: 1387942 - RNA, 19 nt, Homo sapiens
gguucuuccuguucuguga

SEQ ID NO: 1387943 - RNA, 19 nt, Homo sapiens
gaggcaagccauggaguga

SEQ ID NO: 1387944 - RNA, 19 nt, Homo sapiens
gggaccugauggagaguga

SEQ ID NO: 1387945 - RNA, 19 nt, Homo sapiens
cagaaggugaccagccuaa

SEQ ID NO: 1387946 - RNA, 19 nt, Homo sapiens
cagcaaauacaacaugaag

SEQ ID NO: 1387947 - RNA, 19 nt, Homo sapiens
guucacccauccaguacga

SEQ ID NO: 1387948 - RNA, 19 nt, Homo sapiens
gagaauaccagcaguucac

SEQ ID NO: 1387949 - RNA, 19 nt, Homo sapiens
gagcugcuucugucugguu

SEQ ID NO: 1387950 - RNA, 19 nt, Homo sapiens
agacaggaagccucaaguu

SEQ ID NO: 1387951 - RNA, 19 nt, Homo sapiens
ccaugaaccuggccaucag

SEQ ID NO: 1387952 - RNA, 19 nt, Homo sapiens
aagcuuauggcaucucauu

SEQ ID NO: 1387953 - RNA, 19 nt, Homo sapiens
ccagagcugcacaggguuu

SEQ ID NO: 1387954 - RNA, 19 nt, Homo sapiens
gaaggugaccagccuaacg

SEQ ID NO: 1387955 - RNA, 19 nt, Homo sapiens
caggaaagcagcgcuagug

SEQ ID NO: 1387956 - RNA, 19 nt, Homo sapiens
ggcaugacccagugaagau

SEQ ID NO: 1387957 - RNA, 19 nt, Homo sapiens
ccuaacggccugccuagug

SEQ ID NO: 1387958 - RNA, 19 nt, Homo sapiens
cuacuuauccgccuucacu

SEQ ID NO: 1387959 - RNA, 19 nt, Homo sapiens
ccggacacuucucaggaaa

SEQ ID NO: 1387960 - RNA, 19 nt, Homo sapiens
cuacaaaggaggacaagac

SEQ ID NO: 1387961 - RNA, 19 nt, Homo sapiens
gagcaucuccagcauucuc

SEQ ID NO: 1387962 - RNA, 19 nt, Homo sapiens
ccaacuucaccagcaaaua

SEQ ID NO: 1387963 - RNA, 19 nt, Homo sapiens
guucugugacuguguauag

SEQ ID NO: 1387964 - RNA, 19 nt, Homo sapiens
gguuggagaaggagguaaa

SEQ ID NO: 1387965 - RNA, 19 nt, Homo sapiens
gcaccaccaagaauuugug

SEQ ID NO: 1387966 - RNA, 19 nt, Homo sapiens
ccagugcugcaugcgauua

SEQ ID NO: 1387967 - RNA, 19 nt, Homo sapiens
ggagacaggaagccucaag

SEQ ID NO: 1387968 - RNA, 19 nt, Homo sapiens
aaaccaaagccucuggaau

SEQ ID NO: 1387969 - RNA, 19 nt, Homo sapiens
gaaaacugcacaauaaaac

SEQ ID NO: 1387970 - RNA, 19 nt, Homo sapiens
ggauuucaugucccuguga

SEQ ID NO: 1387971 - RNA, 19 nt, Homo sapiens
agacaaacuggucaagugu

SEQ ID NO: 1387972 - RNA, 19 nt, Homo sapiens
caguggagagggcuacaaa

SEQ ID NO: 1387973 - RNA, 19 nt, Homo sapiens
gugagggcaccaccaagaa

SEQ ID NO: 1387974 - RNA, 19 nt, Homo sapiens
gcaucgcucuccugcuaac

SEQ ID NO: 1387975 - RNA, 19 nt, Homo sapiens
gaagguccucuacuuaucc

SEQ ID NO: 1387976 - RNA, 19 nt, Homo sapiens
uggagaaggagguaaagga

SEQ ID NO: 1387977 - RNA, 19 nt, Homo sapiens
gaaaccugggagagacuug

SEQ ID NO: 1387978 - RNA, 19 nt, Homo sapiens
uuugagaguucgugaagag

SEQ ID NO: 1387979 - RNA, 19 nt, Homo sapiens
acauaccgcucccgaacca

SEQ ID NO: 1387980 - RNA, 19 nt, Homo sapiens
gggcaccaccaagaauuug

SEQ ID NO: 1387981 - RNA, 19 nt, Homo sapiens
caugagaauaccagcaguu

SEQ ID NO: 1387982 - RNA, 19 nt, Homo sapiens
gaccugauggagagugaga

SEQ ID NO: 1387983 - RNA, 19 nt, Homo sapiens
ccaccacucuggccauucc

SEQ ID NO: 1387984 - RNA, 19 nt, Homo sapiens
uuuguggccuaccuuguga

SEQ ID NO: 1387985 - RNA, 19 nt, Homo sapiens
ugucugguuuauuuagguu

SEQ ID NO: 1387986 - RNA, 19 nt, Homo sapiens
cauggcuggugccugaaga

SEQ ID NO: 1387987 - RNA, 19 nt, Homo sapiens
gcacugagaucuacaaaug

SEQ ID NO: 1387988 - RNA, 19 nt, Homo sapiens
ggaaaguacuguugcacaa

SEQ ID NO: 1387989 - RNA, 19 nt, Homo sapiens
gacagaagaauguugaaua

SEQ ID NO: 1387990 - RNA, 19 nt, Homo sapiens
gaagaauguugaauaagag

SEQ ID NO: 1387991 - RNA, 19 nt, Homo sapiens
gauuuaagccucccuaaga

SEQ ID NO: 1387992 - RNA, 19 nt, Homo sapiens
ccagucaggugccacauga

SEQ ID NO: 1387993 - RNA, 19 nt, Homo sapiens
gaacaggugucagauacuc

SEQ ID NO: 1387994 - RNA, 19 nt, Homo sapiens
guagaugccuuuguuagau

SEQ ID NO: 1387995 - RNA, 19 nt, Homo sapiens
uuagaguccugucugguua

SEQ ID NO: 1387996 - RNA, 19 nt, Homo sapiens
gcacaaaggcugcaaagcu

SEQ ID NO: 1387997 - RNA, 19 nt, Homo sapiens
gcacaccugagacagauuu

SEQ ID NO: 1387998 - RNA, 19 nt, Homo sapiens
gagaggaacaggugucaga

SEQ ID NO: 1387999 - RNA, 19 nt, Homo sapiens
gaaaguacuguugcacaaa

SEQ ID NO: 1388000 - RNA, 19 nt, Homo sapiens
gaggaacaggugucagaua

SEQ ID NO: 1388001 - RNA, 19 nt, Homo sapiens
gagaaccuuugcugagaug

SEQ ID NO: 1388002 - RNA, 19 nt, Homo sapiens
agggagcgcuggacaacua

SEQ ID NO: 1388003 - RNA, 19 nt, Homo sapiens
gaguagauaauccugaauu

SEQ ID NO: 1388004 - RNA, 19 nt, Homo sapiens
ccuacgaacuuugguuuga

SEQ ID NO: 1388005 - RNA, 19 nt, Homo sapiens
gguagaugccuuuguuaga

SEQ ID NO: 1388006 - RNA, 19 nt, Homo sapiens
gguuaucuguugcccaaga

SEQ ID NO: 1388007 - RNA, 19 nt, Homo sapiens
guagauaauccugaauuga

SEQ ID NO: 1388008 - RNA, 19 nt, Homo sapiens
ugaauaagagcacgauuag

SEQ ID NO: 1388009 - RNA, 19 nt, Homo sapiens
uugaauaagagcacgauua

SEQ ID NO: 1388010 - RNA, 19 nt, Homo sapiens
gaccagacuucgguagaug

SEQ ID NO: 1388011 - RNA, 19 nt, Homo sapiens
gcaccuacuucaccaccau

SEQ ID NO: 1388012 - RNA, 19 nt, Homo sapiens
gcaaagcuggacucaggaa

SEQ ID NO: 1388013 - RNA, 19 nt, Homo sapiens
aauaagagcacgauuagag

SEQ ID NO: 1388014 - RNA, 19 nt, Homo sapiens
aaaguacuguugcacaaag

SEQ ID NO: 1388015 - RNA, 19 nt, Homo sapiens
gcacugcuuggcuuacuau

SEQ ID NO: 1388016 - RNA, 19 nt, Homo sapiens
uguuagaucuaucacaugu

SEQ ID NO: 1388017 - RNA, 19 nt, Homo sapiens
cuuggaaacugaauauaag

SEQ ID NO: 1388018 - RNA, 19 nt, Homo sapiens
caaguucgucuucgagaug

SEQ ID NO: 1388019 - RNA, 19 nt, Homo sapiens
gcugagaugcaaauaaagu

SEQ ID NO: 1388020 - RNA, 19 nt, Homo sapiens
gugaguggcccaucuuugu

SEQ ID NO: 1388021 - RNA, 19 nt, Homo sapiens
cgagcugagugccggguuu

SEQ ID NO: 1388022 - RNA, 19 nt, Homo sapiens
aguagauaauccugaauug

SEQ ID NO: 1388023 - RNA, 19 nt, Homo sapiens
uagcacaccugagacagau

SEQ ID NO: 1388024 - RNA, 19 nt, Homo sapiens
ugagaaccuuugcugagau

SEQ ID NO: 1388025 - RNA, 19 nt, Homo sapiens
cauaggcacugagaucuac

SEQ ID NO: 1388026 - RNA, 19 nt, Homo sapiens
cagcaaagacugcaguuuu

SEQ ID NO: 1388027 - RNA, 19 nt, Homo sapiens
aagcuggacucaggaaugu

SEQ ID NO: 1388028 - RNA, 19 nt, Homo sapiens
ucugacacuuggaaacuga

SEQ ID NO: 1388029 - RNA, 19 nt, Homo sapiens
uagauaauccugaauugag

SEQ ID NO: 1388030 - RNA, 19 nt, Homo sapiens
uaaaagagcagccuucauc

SEQ ID NO: 1388031 - RNA, 19 nt, Homo sapiens
aggaacaggugucagauac

SEQ ID NO: 1388032 - RNA, 19 nt, Homo sapiens
gaauaagagcacgauuaga

SEQ ID NO: 1388033 - RNA, 19 nt, Homo sapiens
gcagagacagaagaauguu

SEQ ID NO: 1388034 - RNA, 19 nt, Homo sapiens
acacuuggaaacugaauau

SEQ ID NO: 1388035 - RNA, 19 nt, Homo sapiens
uugaguagauaauccugaa

SEQ ID NO: 1388036 - RNA, 19 nt, Homo sapiens
ccaauccuguuugaaaugg

SEQ ID NO: 1388037 - RNA, 19 nt, Homo sapiens
gugccggguuucccuauuc

SEQ ID NO: 1388038 - RNA, 19 nt, Homo sapiens
ggccuacgaacuuugguuu

SEQ ID NO: 1388039 - RNA, 19 nt, Homo sapiens
ggcacugcuuggcuuacua

SEQ ID NO: 1388040 - RNA, 19 nt, Homo sapiens
agagacagaagaauguuga

SEQ ID NO: 1388041 - RNA, 19 nt, Homo sapiens
cauguaaacgagcuuguau

SEQ ID NO: 1388042 - RNA, 19 nt, Homo sapiens
gggcucagcaccuacuuca

SEQ ID NO: 1388043 - RNA, 19 nt, Homo sapiens
gaggcucucuagucugaag

SEQ ID NO: 1388044 - RNA, 19 nt, Homo sapiens
gaguggcccaucuuuguug

SEQ ID NO: 1388045 - RNA, 19 nt, Homo sapiens
gcaguuuuguggacuuuug

SEQ ID NO: 1388046 - RNA, 19 nt, Homo sapiens
guuaucuguugcccaagaa

SEQ ID NO: 1388047 - RNA, 19 nt, Homo sapiens
ucaaguucgucuucgagau

SEQ ID NO: 1388048 - RNA, 19 nt, Homo sapiens
cuauuccaauccuguuuga

SEQ ID NO: 1388049 - RNA, 19 nt, Homo sapiens
ggcagagacagaagaaugu

SEQ ID NO: 1388050 - RNA, 19 nt, Homo sapiens
uagaugccuuuguuagauc

SEQ ID NO: 1388051 - RNA, 19 nt, Homo sapiens
guuuaaugcuuugaguaga

SEQ ID NO: 1388052 - RNA, 19 nt, Homo sapiens
ggguuucccuauuccaauc

SEQ ID NO: 1388053 - RNA, 19 nt, Homo sapiens
caucuuuguuggccuacga

SEQ ID NO: 1388054 - RNA, 19 nt, Homo sapiens
acucuuagcacaccugaga

SEQ ID NO: 1388055 - RNA, 19 nt, Homo sapiens
gcgccugucgggucaacua

SEQ ID NO: 1388056 - RNA, 19 nt, Homo sapiens
cuacgaacuuugguuugau

SEQ ID NO: 1388057 - RNA, 19 nt, Homo sapiens
ggugucagauacucauagg

SEQ ID NO: 1388058 - RNA, 19 nt, Homo sapiens
gagagggagcgcuggacaa

SEQ ID NO: 1388059 - RNA, 19 nt, Homo sapiens
uacgaacuuugguuugaug

SEQ ID NO: 1388060 - RNA, 19 nt, Homo sapiens
ucauaggcacugagaucua

SEQ ID NO: 1388061 - RNA, 19 nt, Homo sapiens
ggcuuacuaucccagcaaa

SEQ ID NO: 1388062 - RNA, 19 nt, Homo sapiens
agaccagacuucgguagau

SEQ ID NO: 1388063 - RNA, 19 nt, Homo sapiens
gagaugcaaauaaaguaag

SEQ ID NO: 1388064 - RNA, 19 nt, Homo sapiens
augagaaccuuugcugaga

SEQ ID NO: 1388065 - RNA, 19 nt, Homo sapiens
cacgagagagauuggcuuu

SEQ ID NO: 1388066 - RNA, 19 nt, Homo sapiens
gcucugguucggccucauu

SEQ ID NO: 1388067 - RNA, 19 nt, Homo sapiens
uguggauccugggaaagua

SEQ ID NO: 1388068 - RNA, 19 nt, Homo sapiens
ccaggcacugcuuggcuua

SEQ ID NO: 1388069 - RNA, 19 nt, Homo sapiens
gagcgcuggacaacuagaa

SEQ ID NO: 1388070 - RNA, 19 nt, Homo sapiens
ccugucugguuaucuguug

SEQ ID NO: 1388071 - RNA, 19 nt, Homo sapiens
cugagaugcaaauaaagua

SEQ ID NO: 1388072 - RNA, 19 nt, Homo sapiens
gaaccuuugcugagaugca

SEQ ID NO: 1388073 - RNA, 19 nt, Homo sapiens
gcgcuggacaacuagaaug

SEQ ID NO: 1388074 - RNA, 19 nt, Homo sapiens
aggcagagacagaagaaug

SEQ ID NO: 1388075 - RNA, 19 nt, Homo sapiens
uucgguagaugccuuuguu

SEQ ID NO: 1388076 - RNA, 19 nt, Homo sapiens
aaagcuggacucaggaaug

SEQ ID NO: 1388077 - RNA, 19 nt, Homo sapiens
gacacuuggaaacugaaua

SEQ ID NO: 1388078 - RNA, 19 nt, Homo sapiens
aauccuguuugaaaugguu

SEQ ID NO: 1388079 - RNA, 19 nt, Homo sapiens
ugaguggcccaucuuuguu

SEQ ID NO: 1388080 - RNA, 19 nt, Homo sapiens
uuccaauccuguuugaaau

SEQ ID NO: 1388081 - RNA, 19 nt, Homo sapiens
auuccaauccuguuugaaa

SEQ ID NO: 1388082 - RNA, 19 nt, Homo sapiens
uguaaacgagcuuguaucu

SEQ ID NO: 1388083 - RNA, 19 nt, Homo sapiens
cugaguauuuccuguggau

SEQ ID NO: 1388084 - RNA, 19 nt, Homo sapiens
gagacagaagaauguugaa

SEQ ID NO: 1388085 - RNA, 19 nt, Homo sapiens
gcucucagcugucaaugug

SEQ ID NO: 1388086 - RNA, 19 nt, Homo sapiens
caauaaaggcuucucaauc

SEQ ID NO: 1388087 - RNA, 19 nt, Homo sapiens
aauaaaggcuucucaaucc

SEQ ID NO: 1388088 - RNA, 19 nt, Homo sapiens
acaauaaaggcuucucaau

SEQ ID NO: 1388089 - RNA, 19 nt, Homo sapiens
ccacaauaaaggcuucuca

SEQ ID NO: 1388090 - RNA, 19 nt, Homo sapiens
ccgauccucccacaauaaa

SEQ ID NO: 1388091 - RNA, 19 nt, Homo sapiens
gauccucccacaauaaagg

SEQ ID NO: 1388092 - RNA, 19 nt, Homo sapiens
cgucaacaccaccaucugu

SEQ ID NO: 1388093 - RNA, 19 nt, Homo sapiens
cacaauaaaggcuucucaa

SEQ ID NO: 1388094 - RNA, 19 nt, Homo sapiens
ggauaaaucuggccucuuu

SEQ ID NO: 1388095 - RNA, 19 nt, Homo sapiens
gaagaugucugcucccaaa

SEQ ID NO: 1388096 - RNA, 19 nt, Homo sapiens
caaaguggcuccuccauga

SEQ ID NO: 1388097 - RNA, 19 nt, Homo sapiens
gaaauagaguugaagaaag

SEQ ID NO: 1388098 - RNA, 19 nt, Homo sapiens
gcuaacugauuuccuauaa

SEQ ID NO: 1388099 - RNA, 19 nt, Homo sapiens
gaagcaggguugguuagua

SEQ ID NO: 1388100 - RNA, 19 nt, Homo sapiens
aaagcagucucaagaauaa

SEQ ID NO: 1388101 - RNA, 19 nt, Homo sapiens
ggaaauagaguugaagaaa

SEQ ID NO: 1388102 - RNA, 19 nt, Homo sapiens
gaaagaagaguagaagaaa

SEQ ID NO: 1388103 - RNA, 19 nt, Homo sapiens
agagagagcuccucauuuc

SEQ ID NO: 1388104 - RNA, 19 nt, Homo sapiens
ccacaaaccugcagugagu

SEQ ID NO: 1388105 - RNA, 19 nt, Homo sapiens
gaaguuacaucgccagaag

SEQ ID NO: 1388106 - RNA, 19 nt, Homo sapiens
ccuggaagcuugauaagaa

SEQ ID NO: 1388107 - RNA, 19 nt, Homo sapiens
auaagaaacuggaucauug

SEQ ID NO: 1388108 - RNA, 19 nt, Homo sapiens
gaaagaggcguguugucua

SEQ ID NO: 1388109 - RNA, 19 nt, Homo sapiens
aaacugaccuuucuauucu

SEQ ID NO: 1388110 - RNA, 19 nt, Homo sapiens
uaacagaauucccaagcuu

SEQ ID NO: 1388111 - RNA, 19 nt, Homo sapiens
gguaugagaucccagaauc

SEQ ID NO: 1388112 - RNA, 19 nt, Homo sapiens
gaagcgcucuaacccauau

SEQ ID NO: 1388113 - RNA, 19 nt, Homo sapiens
ggaugagggugagaugaua

SEQ ID NO: 1388114 - RNA, 19 nt, Homo sapiens
uaaagcagucucaagaaua

SEQ ID NO: 1388115 - RNA, 19 nt, Homo sapiens
gcugcuaacugauuuccua

SEQ ID NO: 1388116 - RNA, 19 nt, Homo sapiens
acccauaugugaagacuua

SEQ ID NO: 1388117 - RNA, 19 nt, Homo sapiens
ucccaaaucucaaguagaa

SEQ ID NO: 1388118 - RNA, 19 nt, Homo sapiens
ggaagaggaagaagaagaa

SEQ ID NO: 1388119 - RNA, 19 nt, Homo sapiens
ccaaggaaauagaguugaa

SEQ ID NO: 1388120 - RNA, 19 nt, Homo sapiens
caacagagucagcugcuaa

SEQ ID NO: 1388121 - RNA, 19 nt, Homo sapiens
ccagaagagccaaguguua

SEQ ID NO: 1388122 - RNA, 19 nt, Homo sapiens
gaacaaggccaguaaacgu

SEQ ID NO: 1388123 - RNA, 19 nt, Homo sapiens
gaacuugacggcugccaaa

SEQ ID NO: 1388124 - RNA, 19 nt, Homo sapiens
gauaagaaacuggaucauu

SEQ ID NO: 1388125 - RNA, 19 nt, Homo sapiens
ccacaucugucuuaguguu

SEQ ID NO: 1388126 - RNA, 19 nt, Homo sapiens
gugaagaaaucaagagcaa

SEQ ID NO: 1388127 - RNA, 19 nt, Homo sapiens
gcagagaggaaaucccuuu

SEQ ID NO: 1388128 - RNA, 19 nt, Homo sapiens
gaagaucuacagcauaugu

SEQ ID NO: 1388129 - RNA, 19 nt, Homo sapiens
uggaagaucuacagcauau

SEQ ID NO: 1388130 - RNA, 19 nt, Homo sapiens
ggugacaucuggccaggaa

SEQ ID NO: 1388131 - RNA, 19 nt, Homo sapiens
ccgcacagguagugagaua

SEQ ID NO: 1388132 - RNA, 19 nt, Homo sapiens
caaacugaccuuucuauuc

SEQ ID NO: 1388133 - RNA, 19 nt, Homo sapiens
gagcuaaguuucaucuucu

SEQ ID NO: 1388134 - RNA, 19 nt, Homo sapiens
aagcaggguugguuaguaa

SEQ ID NO: 1388135 - RNA, 19 nt, Homo sapiens
gaagaaaucaagagcaaag

SEQ ID NO: 1388136 - RNA, 19 nt, Homo sapiens
cagaggaagugaagaaauc

SEQ ID NO: 1388137 - RNA, 19 nt, Homo sapiens
agggugagaugauauuuaa

SEQ ID NO: 1388138 - RNA, 19 nt, Homo sapiens
gacagucccuccuucauca

SEQ ID NO: 1388139 - RNA, 19 nt, Homo sapiens
uaaguuucaucuucuggua

SEQ ID NO: 1388140 - RNA, 19 nt, Homo sapiens
cagugaagcuggugauuuc

SEQ ID NO: 1388141 - RNA, 19 nt, Homo sapiens
guagugagauaaucaggau

SEQ ID NO: 1388142 - RNA, 19 nt, Homo sapiens
ggaggaauguuuucaaaga

SEQ ID NO: 1388143 - RNA, 19 nt, Homo sapiens
ggcagaagaugcgacagua

SEQ ID NO: 1388144 - RNA, 19 nt, Homo sapiens
gcgaguuggugguuucauu

SEQ ID NO: 1388145 - RNA, 19 nt, Homo sapiens
gaaaaggauuugauucuca

SEQ ID NO: 1388146 - RNA, 19 nt, Homo sapiens
gagagagagcuccucauuu

SEQ ID NO: 1388147 - RNA, 19 nt, Homo sapiens
ugaccuuucuauucucaua

SEQ ID NO: 1388148 - RNA, 19 nt, Homo sapiens
ccaccuugcuuuggucuaa

SEQ ID NO: 1388149 - RNA, 19 nt, Homo sapiens
cuggcuaccuuucgcauua

SEQ ID NO: 1388150 - RNA, 19 nt, Homo sapiens
aaacuccugugaugaagaa

SEQ ID NO: 1388151 - RNA, 19 nt, Homo sapiens
ggacacuguuaauccacua

SEQ ID NO: 1388152 - RNA, 19 nt, Homo sapiens
gagggugagaugauauuua

SEQ ID NO: 1388153 - RNA, 19 nt, Homo sapiens
ggauugcaauuguaaugga

SEQ ID NO: 1388154 - RNA, 19 nt, Homo sapiens
ggauaaacuucuggaacuu

SEQ ID NO: 1388155 - RNA, 19 nt, Homo sapiens
ucaaagaagccaagaacuu

SEQ ID NO: 1388156 - RNA, 19 nt, Homo sapiens
ucacuacaaccauacauuu

SEQ ID NO: 1388157 - RNA, 19 nt, Homo sapiens
gaagaaagaagaguagaag

SEQ ID NO: 1388158 - RNA, 19 nt, Homo sapiens
ucaaagaagggucuaguga

SEQ ID NO: 1388159 - RNA, 19 nt, Homo sapiens
uaccacaucugucuuagug

SEQ ID NO: 1388160 - RNA, 19 nt, Homo sapiens
uuaaagcagucucaagaau

SEQ ID NO: 1388161 - RNA, 19 nt, Homo sapiens
ggugagaugauauuuaaga

SEQ ID NO: 1388162 - RNA, 19 nt, Homo sapiens
gaaggagcccagugugcua

SEQ ID NO: 1388163 - RNA, 19 nt, Homo sapiens
guaacuugcucuuuuguuu

SEQ ID NO: 1388164 - RNA, 19 nt, Homo sapiens
uaacugauuuccuauaagc

SEQ ID NO: 1388165 - RNA, 19 nt, Homo sapiens
gcacagguagugagauaau

SEQ ID NO: 1388166 - RNA, 19 nt, Homo sapiens
gguguggauugcaauugua

SEQ ID NO: 1388167 - RNA, 19 nt, Homo sapiens
cuaagggaauguagacaga

SEQ ID NO: 1388168 - RNA, 19 nt, Homo sapiens
cuagagugaugcagacuug

SEQ ID NO: 1388169 - RNA, 19 nt, Homo sapiens
ggucagaggaagugaagaa

SEQ ID NO: 1388170 - RNA, 19 nt, Homo sapiens
gcagaagcuggguuuauga

SEQ ID NO: 1388171 - RNA, 19 nt, Homo sapiens
ccaaagugcugggauuaca

SEQ ID NO: 1388172 - RNA, 19 nt, Homo sapiens
agaagaagaagaagacauu

SEQ ID NO: 1388173 - RNA, 19 nt, Homo sapiens
agaaagaagaguagaagaa

SEQ ID NO: 1388174 - RNA, 19 nt, Homo sapiens
aauaaagcuuucucacuug

SEQ ID NO: 1388175 - RNA, 19 nt, Homo sapiens
agaagggucuagugagcua

SEQ ID NO: 1388176 - RNA, 19 nt, Homo sapiens
ggauaccuccuucccauga

SEQ ID NO: 1388177 - RNA, 19 nt, Homo sapiens
ggaagaagaagaagaagac

SEQ ID NO: 1388178 - RNA, 19 nt, Homo sapiens
aaagaggcguguugucuag

SEQ ID NO: 1388179 - RNA, 19 nt, Homo sapiens
guaaaucaugucggaguua

SEQ ID NO: 1388180 - RNA, 19 nt, Homo sapiens
ugagcuaaguuucaucuuc

SEQ ID NO: 1388181 - RNA, 19 nt, Homo sapiens
gaguaguuccuuccucuuu

SEQ ID NO: 1388182 - RNA, 19 nt, Homo sapiens
gcagcuccguuccucaaug

SEQ ID NO: 1388183 - RNA, 19 nt, Homo sapiens
gaucauugccucccuuuac

SEQ ID NO: 1388184 - RNA, 19 nt, Homo sapiens
gccagaagcuagccagaag

SEQ ID NO: 1388185 - RNA, 19 nt, Homo sapiens
ccggaaagcagaugagaaa

SEQ ID NO: 1388186 - RNA, 19 nt, Homo sapiens
gaucaaagaagccaagaac

SEQ ID NO: 1388187 - RNA, 19 nt, Homo sapiens
gugagagucuggauagcuu

SEQ ID NO: 1388188 - RNA, 19 nt, Homo sapiens
gcgacuaaagaaugaguua

SEQ ID NO: 1388189 - RNA, 19 nt, Homo sapiens
uaauggagcugcuuuugaa

SEQ ID NO: 1388190 - RNA, 19 nt, Homo sapiens
uuaagaagaacaccagaaa

SEQ ID NO: 1388191 - RNA, 19 nt, Homo sapiens
gaugucugcucccaaaucu

SEQ ID NO: 1388192 - RNA, 19 nt, Homo sapiens
ggagcccagugugcuauuu

SEQ ID NO: 1388193 - RNA, 19 nt, Homo sapiens
gauugcaauuguaauggaa

SEQ ID NO: 1388194 - RNA, 19 nt, Homo sapiens
gcacaaaacucugguaaua

SEQ ID NO: 1388195 - RNA, 19 nt, Homo sapiens
gaacaacuccaaggaaaua

SEQ ID NO: 1388196 - RNA, 19 nt, Homo sapiens
gcaaguggccuaucaacua

SEQ ID NO: 1388197 - RNA, 19 nt, Homo sapiens
gaaagucaguggugaaauc

SEQ ID NO: 1388198 - RNA, 19 nt, Homo sapiens
gaaccucucucuccucaga

SEQ ID NO: 1388199 - RNA, 19 nt, Homo sapiens
ggauuuggcugcuauugaa

SEQ ID NO: 1388200 - RNA, 19 nt, Homo sapiens
ucaaagaggcaaagaauuu

SEQ ID NO: 1388201 - RNA, 19 nt, Homo sapiens
uguaaucucuggaggaaua

SEQ ID NO: 1388202 - RNA, 19 nt, Homo sapiens
ggaagaacguggauuggau

SEQ ID NO: 1388203 - RNA, 19 nt, Homo sapiens
cagaacaacuccaaggaaa

SEQ ID NO: 1388204 - RNA, 19 nt, Homo sapiens
ggugaaauccuucuccaua

SEQ ID NO: 1388205 - RNA, 19 nt, Homo sapiens
uccaggagcugaagaagua

SEQ ID NO: 1388206 - RNA, 19 nt, Homo sapiens
gaagaaggagucaccugua

SEQ ID NO: 1388207 - RNA, 19 nt, Homo sapiens
gcacuaugaucgauuugga

SEQ ID NO: 1388208 - RNA, 19 nt, Homo sapiens
ggaagagacugaagaaagc

SEQ ID NO: 1388209 - RNA, 19 nt, Homo sapiens
gggaagcacuggcucauca

SEQ ID NO: 1388210 - RNA, 19 nt, Homo sapiens
ggagucaccuguaaucucu

SEQ ID NO: 1388211 - RNA, 19 nt, Homo sapiens
gcaguuaucuacaaacacu

SEQ ID NO: 1388212 - RNA, 19 nt, Homo sapiens
ggacuuagacggucaacau

SEQ ID NO: 1388213 - RNA, 19 nt, Homo sapiens
ggcagaagauggccaacaa

SEQ ID NO: 1388214 - RNA, 19 nt, Homo sapiens
gggaggaguucguuugaau

SEQ ID NO: 1388215 - RNA, 19 nt, Homo sapiens
ggaagaaggccagccauga

SEQ ID NO: 1388216 - RNA, 19 nt, Homo sapiens
aagaaggagucaccuguaa

SEQ ID NO: 1388217 - RNA, 19 nt, Homo sapiens
gugaaauccuucuccauau

SEQ ID NO: 1388218 - RNA, 19 nt, Homo sapiens
guucaucaaucugucauuu

SEQ ID NO: 1388219 - RNA, 19 nt, Homo sapiens
gaugagcguuuacagugaa

SEQ ID NO: 1388220 - RNA, 19 nt, Homo sapiens
acacuaaaguacacuauca

SEQ ID NO: 1388221 - RNA, 19 nt, Homo sapiens
ggaagugcacugucuguga

SEQ ID NO: 1388222 - RNA, 19 nt, Homo sapiens
caagaggccagcagaguuu

SEQ ID NO: 1388223 - RNA, 19 nt, Homo sapiens
uaaagaauguuugccuaga

SEQ ID NO: 1388224 - RNA, 19 nt, Homo sapiens
gaagaaggccagccaugau

SEQ ID NO: 1388225 - RNA, 19 nt, Homo sapiens
guacagagccaagagcaaa

SEQ ID NO: 1388226 - RNA, 19 nt, Homo sapiens
gcgcagcuaaggauuauaa

SEQ ID NO: 1388227 - RNA, 19 nt, Homo sapiens
aaagaauguuugccuagaa

SEQ ID NO: 1388228 - RNA, 19 nt, Homo sapiens
gaggauacuguaagcauaa

SEQ ID NO: 1388229 - RNA, 19 nt, Homo sapiens
acagaagacucagaggaua

SEQ ID NO: 1388230 - RNA, 19 nt, Homo sapiens
gaaggagucaccuguaauc

SEQ ID NO: 1388231 - RNA, 19 nt, Homo sapiens
aaggagagcugacaguugu

SEQ ID NO: 1388232 - RNA, 19 nt, Homo sapiens
ggaguucguuugaauucug

SEQ ID NO: 1388233 - RNA, 19 nt, Homo sapiens
caacaagcguaagaccaaa

SEQ ID NO: 1388234 - RNA, 19 nt, Homo sapiens
gaaauccuucuccauauca

SEQ ID NO: 1388235 - RNA, 19 nt, Homo sapiens
gaagagcagucggagcaau

SEQ ID NO: 1388236 - RNA, 19 nt, Homo sapiens
gcaaagccaccaagcacaa

SEQ ID NO: 1388237 - RNA, 19 nt, Homo sapiens
uagaaguguucaucaaaga

SEQ ID NO: 1388238 - RNA, 19 nt, Homo sapiens
uaugaucgauuuggacgua

SEQ ID NO: 1388239 - RNA, 19 nt, Homo sapiens
cauaggagaugaaaagaaa

SEQ ID NO: 1388240 - RNA, 19 nt, Homo sapiens
agaggauacuguaagcaua

SEQ ID NO: 1388241 - RNA, 19 nt, Homo sapiens
gaggaauacuagaaguguu

SEQ ID NO: 1388242 - RNA, 19 nt, Homo sapiens
gcaccaauccagaauucaa

SEQ ID NO: 1388243 - RNA, 19 nt, Homo sapiens
caucaaagaggcaaagaau

SEQ ID NO: 1388244 - RNA, 19 nt, Homo sapiens
gauuugagugagucauuua

SEQ ID NO: 1388245 - RNA, 19 nt, Homo sapiens
caaguggccuaucaacuac

SEQ ID NO: 1388246 - RNA, 19 nt, Homo sapiens
gcuauagcuuggacuuaga

SEQ ID NO: 1388247 - RNA, 19 nt, Homo sapiens
ucagacacuucaccuguug

SEQ ID NO: 1388248 - RNA, 19 nt, Homo sapiens
aaaccugggccuaaucuuu

SEQ ID NO: 1388249 - RNA, 19 nt, Homo sapiens
gucaagaauugcagaaauc

SEQ ID NO: 1388250 - RNA, 19 nt, Homo sapiens
ugaaauccuucuccauauc

SEQ ID NO: 1388251 - RNA, 19 nt, Homo sapiens
aaccagaggagaaaucaua

SEQ ID NO: 1388252 - RNA, 19 nt, Homo sapiens
gaguuuguguucacuguca

SEQ ID NO: 1388253 - RNA, 19 nt, Homo sapiens
ggaggaguucguuugaauu

SEQ ID NO: 1388254 - RNA, 19 nt, Homo sapiens
gaaacacuaaaguacacua

SEQ ID NO: 1388255 - RNA, 19 nt, Homo sapiens
ugucaagaauugcagaaau

SEQ ID NO: 1388256 - RNA, 19 nt, Homo sapiens
cauaucagcuacugcuaca

SEQ ID NO: 1388257 - RNA, 19 nt, Homo sapiens
gccuagaacuuacuaucug

SEQ ID NO: 1388258 - RNA, 19 nt, Homo sapiens
gcuaccugcucccugauga

SEQ ID NO: 1388259 - RNA, 19 nt, Homo sapiens
gaggaguucguuugaauuc

SEQ ID NO: 1388260 - RNA, 19 nt, Homo sapiens
ugacaguuguuuuacguua

SEQ ID NO: 1388261 - RNA, 19 nt, Homo sapiens
ggagagcugacaguuguuu

SEQ ID NO: 1388262 - RNA, 19 nt, Homo sapiens
caaaggagagcugacaguu

SEQ ID NO: 1388263 - RNA, 19 nt, Homo sapiens
gaucgauuuggacguaaua

SEQ ID NO: 1388264 - RNA, 19 nt, Homo sapiens
ugaugagcguuuacaguga

SEQ ID NO: 1388265 - RNA, 19 nt, Homo sapiens
ucaauguucucggcacuga

SEQ ID NO: 1388266 - RNA, 19 nt, Homo sapiens
cuagaaguguucaucaaag

SEQ ID NO: 1388267 - RNA, 19 nt, Homo sapiens
uaucagcuacugcuacaaa

SEQ ID NO: 1388268 - RNA, 19 nt, Homo sapiens
gagaauaaggaagcugaaa

SEQ ID NO: 1388269 - RNA, 19 nt, Homo sapiens
gggaagagcagcgccuuug

SEQ ID NO: 1388270 - RNA, 19 nt, Homo sapiens
ggaggaauacuagaagugu

SEQ ID NO: 1388271 - RNA, 19 nt, Homo sapiens
caacuccaaggaaauaaga

SEQ ID NO: 1388272 - RNA, 19 nt, Homo sapiens
gugagucauuuacagaaga

SEQ ID NO: 1388273 - RNA, 19 nt, Homo sapiens
caaagagucaccgcagaaa

SEQ ID NO: 1388274 - RNA, 19 nt, Homo sapiens
uggauuggauggacucuca

SEQ ID NO: 1388275 - RNA, 19 nt, Homo sapiens
gauacuguaagcauaagaa

SEQ ID NO: 1388276 - RNA, 19 nt, Homo sapiens
acagaaaccugggccuaau

SEQ ID NO: 1388277 - RNA, 19 nt, Homo sapiens
uggcacaccuuccauagca

SEQ ID NO: 1388278 - RNA, 19 nt, Homo sapiens
guggaggacaagagaauaa

SEQ ID NO: 1388279 - RNA, 19 nt, Homo sapiens
ccuguaaucucuggaggaa

SEQ ID NO: 1388280 - RNA, 19 nt, Homo sapiens
ccagaacaacuccaaggaa

SEQ ID NO: 1388281 - RNA, 19 nt, Homo sapiens
caaugaaacacuaaaguac

SEQ ID NO: 1388282 - RNA, 19 nt, Homo sapiens
ccucgcaguuaucuacaaa

SEQ ID NO: 1388283 - RNA, 19 nt, Homo sapiens
gaagaaaaggcaaaacguu

SEQ ID NO: 1388284 - RNA, 19 nt, Homo sapiens
cccaggauauaaagaaugu

SEQ ID NO: 1388285 - RNA, 19 nt, Homo sapiens
gaauuugacagcagugaag

SEQ ID NO: 1388286 - RNA, 19 nt, Homo sapiens
gaaaucauaacucccaaaa

SEQ ID NO: 1388287 - RNA, 19 nt, Homo sapiens
gaggacaagagaauaagga

SEQ ID NO: 1388288 - RNA, 19 nt, Homo sapiens
gaacucugcagcucucagu

SEQ ID NO: 1388289 - RNA, 19 nt, Homo sapiens
ccuaaagagagaugaauau

SEQ ID NO: 1388290 - RNA, 19 nt, Homo sapiens
ccauggauuuggcugcuau

SEQ ID NO: 1388291 - RNA, 19 nt, Homo sapiens
gucagacacuucaccuguu

SEQ ID NO: 1388292 - RNA, 19 nt, Homo sapiens
ucaagcaagucaauguucu

SEQ ID NO: 1388293 - RNA, 19 nt, Homo sapiens
cagcuaaggauuauaacug

SEQ ID NO: 1388294 - RNA, 19 nt, Homo sapiens
gaacagaacugcuaauuca

SEQ ID NO: 1388295 - RNA, 19 nt, Homo sapiens
gcaaaucacuguaaugaga

SEQ ID NO: 1388296 - RNA, 19 nt, Homo sapiens
gaacaugguuuggauauug

SEQ ID NO: 1388297 - RNA, 19 nt, Homo sapiens
gaagacaaccuguggaaua

SEQ ID NO: 1388298 - RNA, 19 nt, Homo sapiens
ggagaaggcucugaaagaa

SEQ ID NO: 1388299 - RNA, 19 nt, Homo sapiens
cgaaugaccuaucagagua

SEQ ID NO: 1388300 - RNA, 19 nt, Homo sapiens
ggacguugauucuuacuga

SEQ ID NO: 1388301 - RNA, 19 nt, Homo sapiens
caaaggaucaagagaaaua

SEQ ID NO: 1388302 - RNA, 19 nt, Homo sapiens
gggcagcacacuaauauua

SEQ ID NO: 1388303 - RNA, 19 nt, Homo sapiens
ggacuugaaugacaguaaa

SEQ ID NO: 1388304 - RNA, 19 nt, Homo sapiens
agaaggcucugaaagaaua

SEQ ID NO: 1388305 - RNA, 19 nt, Homo sapiens
ugaauagacuugcuaaaug

SEQ ID NO: 1388306 - RNA, 19 nt, Homo sapiens
ggacagaaagauugugaua

SEQ ID NO: 1388307 - RNA, 19 nt, Homo sapiens
caaaggcucuugggcauuu

SEQ ID NO: 1388308 - RNA, 19 nt, Homo sapiens
cgacaucucagaagaguua

SEQ ID NO: 1388309 - RNA, 19 nt, Homo sapiens
ggaaacccaucuguaaauu

SEQ ID NO: 1388310 - RNA, 19 nt, Homo sapiens
gaauagacuugcuaaaugg

SEQ ID NO: 1388311 - RNA, 19 nt, Homo sapiens
gaugggauauacagaguaa

SEQ ID NO: 1388312 - RNA, 19 nt, Homo sapiens
uagcuggucugccaaauaa

SEQ ID NO: 1388313 - RNA, 19 nt, Homo sapiens
gcagugauccagaaacuaa

SEQ ID NO: 1388314 - RNA, 19 nt, Homo sapiens
gagagagaauggcacagua

SEQ ID NO: 1388315 - RNA, 19 nt, Homo sapiens
gcaaaggacagaaagauug

SEQ ID NO: 1388316 - RNA, 19 nt, Homo sapiens
gaaacccaucuguaaauua

SEQ ID NO: 1388317 - RNA, 19 nt, Homo sapiens
gacaguaaaugggaagaua

SEQ ID NO: 1388318 - RNA, 19 nt, Homo sapiens
gggcauaccuuauauacca

SEQ ID NO: 1388319 - RNA, 19 nt, Homo sapiens
gaaaauggcugacagaagu

SEQ ID NO: 1388320 - RNA, 19 nt, Homo sapiens
gauccaaucucgcuaaucu

SEQ ID NO: 1388321 - RNA, 19 nt, Homo sapiens
gaauaggacacgcucauuu

SEQ ID NO: 1388322 - RNA, 19 nt, Homo sapiens
ccaaauaacuccacgaaaa

SEQ ID NO: 1388323 - RNA, 19 nt, Homo sapiens
cauauuugcugcuuuguug

SEQ ID NO: 1388324 - RNA, 19 nt, Homo sapiens
gacaaugacacuguuauua

SEQ ID NO: 1388325 - RNA, 19 nt, Homo sapiens
gcucagggcguugcuauua

SEQ ID NO: 1388326 - RNA, 19 nt, Homo sapiens
ugccugagcuuucaaguuu

SEQ ID NO: 1388327 - RNA, 19 nt, Homo sapiens
cuucagagaucaacagaaa

SEQ ID NO: 1388328 - RNA, 19 nt, Homo sapiens
gagauggcuucaaaggaua

SEQ ID NO: 1388329 - RNA, 19 nt, Homo sapiens
gggaauugccaaaguauaa

SEQ ID NO: 1388330 - RNA, 19 nt, Homo sapiens
ggaagauauucaugucauu

SEQ ID NO: 1388331 - RNA, 19 nt, Homo sapiens
gauaaggaaucuccaacug

SEQ ID NO: 1388332 - RNA, 19 nt, Homo sapiens
cuucggacguugauucuua

SEQ ID NO: 1388333 - RNA, 19 nt, Homo sapiens
gaugagaaauuggacuuga

SEQ ID NO: 1388334 - RNA, 19 nt, Homo sapiens
gaauguauuugagcugaaa

SEQ ID NO: 1388335 - RNA, 19 nt, Homo sapiens
ggacacuaaugauaaggaa

SEQ ID NO: 1388336 - RNA, 19 nt, Homo sapiens
uuaacaaaguggagacaua

SEQ ID NO: 1388337 - RNA, 19 nt, Homo sapiens
gggcguugcuauuacuaua

SEQ ID NO: 1388338 - RNA, 19 nt, Homo sapiens
guucuaagcuauauucauc

SEQ ID NO: 1388339 - RNA, 19 nt, Homo sapiens
cagcuccacugaacagaua

SEQ ID NO: 1388340 - RNA, 19 nt, Homo sapiens
gguggaauaugauuaugaa

SEQ ID NO: 1388341 - RNA, 19 nt, Homo sapiens
ggaaagaacuuggaaaccu

SEQ ID NO: 1388342 - RNA, 19 nt, Homo sapiens
ugagauggcuucaaaggau

SEQ ID NO: 1388343 - RNA, 19 nt, Homo sapiens
agacauagcaccauuguau

SEQ ID NO: 1388344 - RNA, 19 nt, Homo sapiens
ggaaagccaucgucaucug

SEQ ID NO: 1388345 - RNA, 19 nt, Homo sapiens
caaauugccugagcuuuca

SEQ ID NO: 1388346 - RNA, 19 nt, Homo sapiens
ugacagaagugggaagauu

SEQ ID NO: 1388347 - RNA, 19 nt, Homo sapiens
gacagaagugggaagauua

SEQ ID NO: 1388348 - RNA, 19 nt, Homo sapiens
gaagaacaugguuuggaua

SEQ ID NO: 1388349 - RNA, 19 nt, Homo sapiens
uaacuuacccucccucaga

SEQ ID NO: 1388350 - RNA, 19 nt, Homo sapiens
gaaugggaauugccaaagu

SEQ ID NO: 1388351 - RNA, 19 nt, Homo sapiens
gagaaugggaaacucauaa

SEQ ID NO: 1388352 - RNA, 19 nt, Homo sapiens
gacaaccuguggaauagaa

SEQ ID NO: 1388353 - RNA, 19 nt, Homo sapiens
caaguugguuuggcaguaa

SEQ ID NO: 1388354 - RNA, 19 nt, Homo sapiens
caggacaaguguauauuga

SEQ ID NO: 1388355 - RNA, 19 nt, Homo sapiens
uaucuuaguugcuuguuug

SEQ ID NO: 1388356 - RNA, 19 nt, Homo sapiens
acggaaaguuuaacaauga

SEQ ID NO: 1388357 - RNA, 19 nt, Homo sapiens
gaagauuauuccaggacaa

SEQ ID NO: 1388358 - RNA, 19 nt, Homo sapiens
cauggucuguugaagauuu

SEQ ID NO: 1388359 - RNA, 19 nt, Homo sapiens
gccauaaugugguauaaca

SEQ ID NO: 1388360 - RNA, 19 nt, Homo sapiens
aaacccaucuguaaauuag

SEQ ID NO: 1388361 - RNA, 19 nt, Homo sapiens
uaaaugugauacuggugua

SEQ ID NO: 1388362 - RNA, 19 nt, Homo sapiens
gaagucaguucagggcauu

SEQ ID NO: 1388363 - RNA, 19 nt, Homo sapiens
gaacaaauugccugagcuu

SEQ ID NO: 1388364 - RNA, 19 nt, Homo sapiens
ggugaaggcuugcugucuu

SEQ ID NO: 1388365 - RNA, 19 nt, Homo sapiens
gauauaacugcguguaauu

SEQ ID NO: 1388366 - RNA, 19 nt, Homo sapiens
gguaauauagcaguucaua

SEQ ID NO: 1388367 - RNA, 19 nt, Homo sapiens
ggaaguagcacaaguuggu

SEQ ID NO: 1388368 - RNA, 19 nt, Homo sapiens
gcagcaaagagaaauaauu

SEQ ID NO: 1388369 - RNA, 19 nt, Homo sapiens
ugaagaacaugguuuggau

SEQ ID NO: 1388370 - RNA, 19 nt, Homo sapiens
gaucaagguagacaauauu

SEQ ID NO: 1388371 - RNA, 19 nt, Homo sapiens
gaacgugggcauaccuuau

SEQ ID NO: 1388372 - RNA, 19 nt, Homo sapiens
ugacucacauucuccuaaa

SEQ ID NO: 1388373 - RNA, 19 nt, Homo sapiens
gcucucaugccaccuguua

SEQ ID NO: 1388374 - RNA, 19 nt, Homo sapiens
guaccauacugaguuauug

SEQ ID NO: 1388375 - RNA, 19 nt, Homo sapiens
gugaaggcuugcugucuuu

SEQ ID NO: 1388376 - RNA, 19 nt, Homo sapiens
gccuggaccugacccauaa

SEQ ID NO: 1388377 - RNA, 19 nt, Homo sapiens
uaacugcguguaauuauga

SEQ ID NO: 1388378 - RNA, 19 nt, Homo sapiens
gggaagauauucaugucau

SEQ ID NO: 1388379 - RNA, 19 nt, Homo sapiens
agaaacugaugaaggaauu

SEQ ID NO: 1388380 - RNA, 19 nt, Homo sapiens
aguagaaacugaugaagga

SEQ ID NO: 1388381 - RNA, 19 nt, Homo sapiens
guugcaggguucaucuuua

SEQ ID NO: 1388382 - RNA, 19 nt, Homo sapiens
ucaaggaacaggucuuauu

SEQ ID NO: 1388383 - RNA, 19 nt, Homo sapiens
gauguuggauggaaaauga

SEQ ID NO: 1388384 - RNA, 19 nt, Homo sapiens
cuaaauggcacaugcacua

SEQ ID NO: 1388385 - RNA, 19 nt, Homo sapiens
gagcauggucuguugaaga

SEQ ID NO: 1388386 - RNA, 19 nt, Homo sapiens
uccuuuagcuuguguauau

SEQ ID NO: 1388387 - RNA, 19 nt, Homo sapiens
guggaaacacacauuauuu

SEQ ID NO: 1388388 - RNA, 19 nt, Homo sapiens
cagaguauagcaauuguuu

SEQ ID NO: 1388389 - RNA, 19 nt, Homo sapiens
gaagaggagauaccggauu

SEQ ID NO: 1388390 - RNA, 19 nt, Homo sapiens
gguuuaaaguucuuaguag

SEQ ID NO: 1388391 - RNA, 19 nt, Homo sapiens
ggaacagaacugcuaauuc

SEQ ID NO: 1388392 - RNA, 19 nt, Homo sapiens
uccaaaggaucaagagaaa

SEQ ID NO: 1388393 - RNA, 19 nt, Homo sapiens
guauuggacacuaaugaua

SEQ ID NO: 1388394 - RNA, 19 nt, Homo sapiens
gaucuuggcugcuguguuu

SEQ ID NO: 1388395 - RNA, 19 nt, Homo sapiens
gaacugaucuggguaaagu

SEQ ID NO: 1388396 - RNA, 19 nt, Homo sapiens
gaaacaggcucagaauuug

SEQ ID NO: 1388397 - RNA, 19 nt, Homo sapiens
gaaccaagcugacugugau

SEQ ID NO: 1388398 - RNA, 19 nt, Homo sapiens
gacaagggcucacggauga

SEQ ID NO: 1388399 - RNA, 19 nt, Homo sapiens
ggaagaugcugguauaauc

SEQ ID NO: 1388400 - RNA, 19 nt, Homo sapiens
gggaagaucuugggaauau

SEQ ID NO: 1388401 - RNA, 19 nt, Homo sapiens
ggaaggugauugaguuuga

SEQ ID NO: 1388402 - RNA, 19 nt, Homo sapiens
gagaauggauguccucaug

SEQ ID NO: 1388403 - RNA, 19 nt, Homo sapiens
ucaauaaccuuugccauuu

SEQ ID NO: 1388404 - RNA, 19 nt, Homo sapiens
gaauggauguccucaugaa

SEQ ID NO: 1388405 - RNA, 19 nt, Homo sapiens
ucaagaagguggagaaugu

SEQ ID NO: 1388406 - RNA, 19 nt, Homo sapiens
ggagagcccugcugagaga

SEQ ID NO: 1388407 - RNA, 19 nt, Homo sapiens
gaaauuacccugaaauguc

SEQ ID NO: 1388408 - RNA, 19 nt, Homo sapiens
gcgaaugucucucuaagga

SEQ ID NO: 1388409 - RNA, 19 nt, Homo sapiens
ugaaacaggcucagaauuu

SEQ ID NO: 1388410 - RNA, 19 nt, Homo sapiens
ggaaagucaucguuaggaa

SEQ ID NO: 1388411 - RNA, 19 nt, Homo sapiens
guuugaagcugccuuguuu

SEQ ID NO: 1388412 - RNA, 19 nt, Homo sapiens
gggcagaggcagaggauua

SEQ ID NO: 1388413 - RNA, 19 nt, Homo sapiens
ggagagaacauucaugaga

SEQ ID NO: 1388414 - RNA, 19 nt, Homo sapiens
agaggaagaugcugguaua

SEQ ID NO: 1388415 - RNA, 19 nt, Homo sapiens
gaaaucagccacaauaaac

SEQ ID NO: 1388416 - RNA, 19 nt, Homo sapiens
guggauaucugcauucuca

SEQ ID NO: 1388417 - RNA, 19 nt, Homo sapiens
gcuguaggcuucuucauuc

SEQ ID NO: 1388418 - RNA, 19 nt, Homo sapiens
ucaauauacugucaaguga

SEQ ID NO: 1388419 - RNA, 19 nt, Homo sapiens
ccaaugaguuucuuugaca

SEQ ID NO: 1388420 - RNA, 19 nt, Homo sapiens
ggauggaguuugcaagguu

SEQ ID NO: 1388421 - RNA, 19 nt, Homo sapiens
cagcagaagucagauugua

SEQ ID NO: 1388422 - RNA, 19 nt, Homo sapiens
uuaaagagcccaaugaguu

SEQ ID NO: 1388423 - RNA, 19 nt, Homo sapiens
gacccuaccuuaucucaga

SEQ ID NO: 1388424 - RNA, 19 nt, Homo sapiens
ggaauuaaaugguccuacu

SEQ ID NO: 1388425 - RNA, 19 nt, Homo sapiens
ugacaagccugaaguccuu

SEQ ID NO: 1388426 - RNA, 19 nt, Homo sapiens
caagugauagcuauucuuu

SEQ ID NO: 1388427 - RNA, 19 nt, Homo sapiens
guaaugacacagauuugua

SEQ ID NO: 1388428 - RNA, 19 nt, Homo sapiens
caucaguacuucauccaaa

SEQ ID NO: 1388429 - RNA, 19 nt, Homo sapiens
caaagaucauucuccuuga

SEQ ID NO: 1388430 - RNA, 19 nt, Homo sapiens
gauauaagaaggagggaaa

SEQ ID NO: 1388431 - RNA, 19 nt, Homo sapiens
ggcaaaggcugaccguaga

SEQ ID NO: 1388432 - RNA, 19 nt, Homo sapiens
ccaaaggccugucauuguc

SEQ ID NO: 1388433 - RNA, 19 nt, Homo sapiens
uaaagagcccaaugaguuu

SEQ ID NO: 1388434 - RNA, 19 nt, Homo sapiens
gugaaaggcuaccggcaaa

SEQ ID NO: 1388435 - RNA, 19 nt, Homo sapiens
ggaaagcucauuggugaaa

SEQ ID NO: 1388436 - RNA, 19 nt, Homo sapiens
gaaaugucgccuugcaauu

SEQ ID NO: 1388437 - RNA, 19 nt, Homo sapiens
uuagaaaucagccacaaua

SEQ ID NO: 1388438 - RNA, 19 nt, Homo sapiens
aaaugucgccuugcaauua

SEQ ID NO: 1388439 - RNA, 19 nt, Homo sapiens
guaggaaauuacccugaaa

SEQ ID NO: 1388440 - RNA, 19 nt, Homo sapiens
caacuuggaucccuuugag

SEQ ID NO: 1388441 - RNA, 19 nt, Homo sapiens
gcaacaggaccauguguga

SEQ ID NO: 1388442 - RNA, 19 nt, Homo sapiens
ggucagaggcauacaguga

SEQ ID NO: 1388443 - RNA, 19 nt, Homo sapiens
caaagaaauugcagaacca

SEQ ID NO: 1388444 - RNA, 19 nt, Homo sapiens
gaaauugcagaaccagaaa

SEQ ID NO: 1388445 - RNA, 19 nt, Homo sapiens
ggaaauuacccugaaaugu

SEQ ID NO: 1388446 - RNA, 19 nt, Homo sapiens
gauggaguuugcaagguuu

SEQ ID NO: 1388447 - RNA, 19 nt, Homo sapiens
gaauuaaaugguccuacua

SEQ ID NO: 1388448 - RNA, 19 nt, Homo sapiens
ugagaaagaugaaggaaaa

SEQ ID NO: 1388449 - RNA, 19 nt, Homo sapiens
gcaaagugacagccucaaa

SEQ ID NO: 1388450 - RNA, 19 nt, Homo sapiens
cugaagauauuccaauuuc

SEQ ID NO: 1388451 - RNA, 19 nt, Homo sapiens
gagaucaccuucagagacu

SEQ ID NO: 1388452 - RNA, 19 nt, Homo sapiens
ggacguagcaggucuucug

SEQ ID NO: 1388453 - RNA, 19 nt, Homo sapiens
ugacucaucugacaccaau

SEQ ID NO: 1388454 - RNA, 19 nt, Homo sapiens
gcggagauccuuugcagaa

SEQ ID NO: 1388455 - RNA, 19 nt, Homo sapiens
gaacauccuuaccuucacu

SEQ ID NO: 1388456 - RNA, 19 nt, Homo sapiens
uaucaccuccucuacuuua

SEQ ID NO: 1388457 - RNA, 19 nt, Homo sapiens
gaagaucuugggaauaugu

SEQ ID NO: 1388458 - RNA, 19 nt, Homo sapiens
gcaugaagccagcaggaaa

SEQ ID NO: 1388459 - RNA, 19 nt, Homo sapiens
gaagcgaaugucucucuaa

SEQ ID NO: 1388460 - RNA, 19 nt, Homo sapiens
uaagaaggagggaaagaaa

SEQ ID NO: 1388461 - RNA, 19 nt, Homo sapiens
ccaccgaguuuaccaaagu

SEQ ID NO: 1388462 - RNA, 19 nt, Homo sapiens
gaaagucuggguuggcauu

SEQ ID NO: 1388463 - RNA, 19 nt, Homo sapiens
gaaaaugccuuaggaugga

SEQ ID NO: 1388464 - RNA, 19 nt, Homo sapiens
gcagaagucagauuguaga

SEQ ID NO: 1388465 - RNA, 19 nt, Homo sapiens
aaacauacucuuuggagaa

SEQ ID NO: 1388466 - RNA, 19 nt, Homo sapiens
gcaagaaacagaggucaga

SEQ ID NO: 1388467 - RNA, 19 nt, Homo sapiens
cauccucaccucucaauaa

SEQ ID NO: 1388468 - RNA, 19 nt, Homo sapiens
gaacgucagcugcuuugug

SEQ ID NO: 1388469 - RNA, 19 nt, Homo sapiens
gagagacacaauaaugaaa

SEQ ID NO: 1388470 - RNA, 19 nt, Homo sapiens
cagaugagauacagagaca

SEQ ID NO: 1388471 - RNA, 19 nt, Homo sapiens
aaacauaucacacguacau

SEQ ID NO: 1388472 - RNA, 19 nt, Homo sapiens
gaacuuuggccuacguuuc

SEQ ID NO: 1388473 - RNA, 19 nt, Homo sapiens
gggaauaugugggaaugug

SEQ ID NO: 1388474 - RNA, 19 nt, Homo sapiens
gaaaaguaccccaaagaaa

SEQ ID NO: 1388475 - RNA, 19 nt, Homo sapiens
agugauagcuauucuuugu

SEQ ID NO: 1388476 - RNA, 19 nt, Homo sapiens
caauaaccuuugccauuuc

SEQ ID NO: 1388477 - RNA, 19 nt, Homo sapiens
cauaucacacguacauuaa

SEQ ID NO: 1388478 - RNA, 19 nt, Homo sapiens
acauaucacacguacauua

SEQ ID NO: 1388479 - RNA, 19 nt, Homo sapiens
gaagauauuccaauuucca

SEQ ID NO: 1388480 - RNA, 19 nt, Homo sapiens
gcuggaguuucucuauaaa

SEQ ID NO: 1388481 - RNA, 19 nt, Homo sapiens
ccacucacuuccaucuuga

SEQ ID NO: 1388482 - RNA, 19 nt, Homo sapiens
caugagagacacaauaaug

SEQ ID NO: 1388483 - RNA, 19 nt, Homo sapiens
ccuaucaccuccucuacuu

SEQ ID NO: 1388484 - RNA, 19 nt, Homo sapiens
gcaggcuaaugaaccguuu

SEQ ID NO: 1388485 - RNA, 19 nt, Homo sapiens
auuagaagauggagagauu

SEQ ID NO: 1388486 - RNA, 19 nt, Homo sapiens
gcacggccauccgguugaa

SEQ ID NO: 1388487 - RNA, 19 nt, Homo sapiens
agaaaucagccacaauaaa

SEQ ID NO: 1388488 - RNA, 19 nt, Homo sapiens
gaaagucaucguuaggaau

SEQ ID NO: 1388489 - RNA, 19 nt, Homo sapiens
gaagauggagagauuugug

SEQ ID NO: 1388490 - RNA, 19 nt, Homo sapiens
ggaguuucucuauaaauga

SEQ ID NO: 1388491 - RNA, 19 nt, Homo sapiens
caauaaacaacaugggaaa

SEQ ID NO: 1388492 - RNA, 19 nt, Homo sapiens
gcgaucacguccugguuau

SEQ ID NO: 1388493 - RNA, 19 nt, Homo sapiens
uaaugaaacucccagaaaa

SEQ ID NO: 1388494 - RNA, 19 nt, Homo sapiens
gaucuuggcugcuguguuu

SEQ ID NO: 1388495 - RNA, 19 nt, Homo sapiens
gaacugaucuggguaaagu

SEQ ID NO: 1388496 - RNA, 19 nt, Homo sapiens
gaaacaggcucagaauuug

SEQ ID NO: 1388497 - RNA, 19 nt, Homo sapiens
gaaccaagcugacugugau

SEQ ID NO: 1388498 - RNA, 19 nt, Homo sapiens
gacaagggcucacggauga

SEQ ID NO: 1388499 - RNA, 19 nt, Homo sapiens
gggaagaucuugggaauau

SEQ ID NO: 1388500 - RNA, 19 nt, Homo sapiens
ggaaggugauugaguuuga

SEQ ID NO: 1388501 - RNA, 19 nt, Homo sapiens
gagaauggauguccucaug

SEQ ID NO: 1388502 - RNA, 19 nt, Homo sapiens
ucaauaaccuuugccauuu

SEQ ID NO: 1388503 - RNA, 19 nt, Homo sapiens
gaauggauguccucaugaa

SEQ ID NO: 1388504 - RNA, 19 nt, Homo sapiens
ucaagaagguggagaaugu

SEQ ID NO: 1388505 - RNA, 19 nt, Homo sapiens
ggagagcccugcugagaga

SEQ ID NO: 1388506 - RNA, 19 nt, Homo sapiens
gaaauuacccugaaauguc

SEQ ID NO: 1388507 - RNA, 19 nt, Homo sapiens
gcgaaugucucucuaagga

SEQ ID NO: 1388508 - RNA, 19 nt, Homo sapiens
ugaaacaggcucagaauuu

SEQ ID NO: 1388509 - RNA, 19 nt, Homo sapiens
ggaaagucaucguuaggaa

SEQ ID NO: 1388510 - RNA, 19 nt, Homo sapiens
guuugaagcugccuuguuu

SEQ ID NO: 1388511 - RNA, 19 nt, Homo sapiens
gauccuguccuguuuauaa

SEQ ID NO: 1388512 - RNA, 19 nt, Homo sapiens
gggcagaggcagaggauua

SEQ ID NO: 1388513 - RNA, 19 nt, Homo sapiens
gaaaucagccacaauaaac

SEQ ID NO: 1388514 - RNA, 19 nt, Homo sapiens
guggauaucugcauucuca

SEQ ID NO: 1388515 - RNA, 19 nt, Homo sapiens
gcuguaggcuucuucauuc

SEQ ID NO: 1388516 - RNA, 19 nt, Homo sapiens
ucaauauacugucaaguga

SEQ ID NO: 1388517 - RNA, 19 nt, Homo sapiens
ccaaugaguuucuuugaca

SEQ ID NO: 1388518 - RNA, 19 nt, Homo sapiens
ggauggaguuugcaagguu

SEQ ID NO: 1388519 - RNA, 19 nt, Homo sapiens
cagcagaagucagauugua

SEQ ID NO: 1388520 - RNA, 19 nt, Homo sapiens
uuaaagagcccaaugaguu

SEQ ID NO: 1388521 - RNA, 19 nt, Homo sapiens
gacccuaccuuaucucaga

SEQ ID NO: 1388522 - RNA, 19 nt, Homo sapiens
ugacaagccugaaguccuu

SEQ ID NO: 1388523 - RNA, 19 nt, Homo sapiens
caagugauagcuauucuuu

SEQ ID NO: 1388524 - RNA, 19 nt, Homo sapiens
ggaauuaaaugguccuacu

SEQ ID NO: 1388525 - RNA, 19 nt, Homo sapiens
guaaugacacagauuugua

SEQ ID NO: 1388526 - RNA, 19 nt, Homo sapiens
caucaguacuucauccaaa

SEQ ID NO: 1388527 - RNA, 19 nt, Homo sapiens
caaagaucauucuccuuga

SEQ ID NO: 1388528 - RNA, 19 nt, Homo sapiens
gauauaagaaggagggaaa

SEQ ID NO: 1388529 - RNA, 19 nt, Homo sapiens
ggcaaaggcugaccguaga

SEQ ID NO: 1388530 - RNA, 19 nt, Homo sapiens
ccaaaggccugucauuguc

SEQ ID NO: 1388531 - RNA, 19 nt, Homo sapiens
uaaagagcccaaugaguuu

SEQ ID NO: 1388532 - RNA, 19 nt, Homo sapiens
gugaaaggcuaccggcaaa

SEQ ID NO: 1388533 - RNA, 19 nt, Homo sapiens
ggaaagcucauuggugaaa

SEQ ID NO: 1388534 - RNA, 19 nt, Homo sapiens
gaaaugucgccuugcaauu

SEQ ID NO: 1388535 - RNA, 19 nt, Homo sapiens
uuagaaaucagccacaaua

SEQ ID NO: 1388536 - RNA, 19 nt, Homo sapiens
aaaugucgccuugcaauua

SEQ ID NO: 1388537 - RNA, 19 nt, Homo sapiens
guaggaaauuacccugaaa

SEQ ID NO: 1388538 - RNA, 19 nt, Homo sapiens
gcaacaggaccauguguga

SEQ ID NO: 1388539 - RNA, 19 nt, Homo sapiens
ggucagaggcauacaguga

SEQ ID NO: 1388540 - RNA, 19 nt, Homo sapiens
caaagaaauugcagaacca

SEQ ID NO: 1388541 - RNA, 19 nt, Homo sapiens
ccagucaccuccucuacuu

SEQ ID NO: 1388542 - RNA, 19 nt, Homo sapiens
gaaauugcagaaccagaaa

SEQ ID NO: 1388543 - RNA, 19 nt, Homo sapiens
ggaaauuacccugaaaugu

SEQ ID NO: 1388544 - RNA, 19 nt, Homo sapiens
gauggaguuugcaagguuu

SEQ ID NO: 1388545 - RNA, 19 nt, Homo sapiens
gaauuaaaugguccuacua

SEQ ID NO: 1388546 - RNA, 19 nt, Homo sapiens
ugagaaagaugaaggaaaa

SEQ ID NO: 1388547 - RNA, 19 nt, Homo sapiens
gcaaagugacagccucaaa

SEQ ID NO: 1388548 - RNA, 19 nt, Homo sapiens
cugaagauauuccaauuuc

SEQ ID NO: 1388549 - RNA, 19 nt, Homo sapiens
gagaucaccuucagagacu

SEQ ID NO: 1388550 - RNA, 19 nt, Homo sapiens
ggacguagcaggucuucug

SEQ ID NO: 1388551 - RNA, 19 nt, Homo sapiens
ugacucaucugacaccaau

SEQ ID NO: 1388552 - RNA, 19 nt, Homo sapiens
gcggagauccuuugcagaa

SEQ ID NO: 1388553 - RNA, 19 nt, Homo sapiens
gaacauccuuaccuucacu

SEQ ID NO: 1388554 - RNA, 19 nt, Homo sapiens
gaagaucuugggaauaugu

SEQ ID NO: 1388555 - RNA, 19 nt, Homo sapiens
gcaugaagccagcaggaaa

SEQ ID NO: 1388556 - RNA, 19 nt, Homo sapiens
gaagcgaaugucucucuaa

SEQ ID NO: 1388557 - RNA, 19 nt, Homo sapiens
uaagaaggagggaaagaaa

SEQ ID NO: 1388558 - RNA, 19 nt, Homo sapiens
ccaccgaguuuaccaaagu

SEQ ID NO: 1388559 - RNA, 19 nt, Homo sapiens
gaaagucuggguuggcauu

SEQ ID NO: 1388560 - RNA, 19 nt, Homo sapiens
gaaaaugccuuaggaugga

SEQ ID NO: 1388561 - RNA, 19 nt, Homo sapiens
gcagaagucagauuguaga

SEQ ID NO: 1388562 - RNA, 19 nt, Homo sapiens
aaacauacucuuuggagaa

SEQ ID NO: 1388563 - RNA, 19 nt, Homo sapiens
gcaagaaacagaggucaga

SEQ ID NO: 1388564 - RNA, 19 nt, Homo sapiens
cauccucaccucucaauaa

SEQ ID NO: 1388565 - RNA, 19 nt, Homo sapiens
gaacgucagcugcuuugug

SEQ ID NO: 1388566 - RNA, 19 nt, Homo sapiens
cagaugagauacagagaca

SEQ ID NO: 1388567 - RNA, 19 nt, Homo sapiens
aaacauaucacacguacau

SEQ ID NO: 1388568 - RNA, 19 nt, Homo sapiens
gaacuuuggccuacguuuc

SEQ ID NO: 1388569 - RNA, 19 nt, Homo sapiens
gggaauaugugggaaugug

SEQ ID NO: 1388570 - RNA, 19 nt, Homo sapiens
gaaaaguaccccaaagaaa

SEQ ID NO: 1388571 - RNA, 19 nt, Homo sapiens
agugauagcuauucuuugu

SEQ ID NO: 1388572 - RNA, 19 nt, Homo sapiens
caauaaccuuugccauuuc

SEQ ID NO: 1388573 - RNA, 19 nt, Homo sapiens
cauaucacacguacauuaa

SEQ ID NO: 1388574 - RNA, 19 nt, Homo sapiens
acauaucacacguacauua

SEQ ID NO: 1388575 - RNA, 19 nt, Homo sapiens
gaagauauuccaauuucca

SEQ ID NO: 1388576 - RNA, 19 nt, Homo sapiens
gcuggaguuucucuauaaa

SEQ ID NO: 1388577 - RNA, 19 nt, Homo sapiens
ccacucacuuccaucuuga

SEQ ID NO: 1388578 - RNA, 19 nt, Homo sapiens
gcaggcuaaugaaccguuu

SEQ ID NO: 1388579 - RNA, 19 nt, Homo sapiens
auuagaagauggagagauu

SEQ ID NO: 1388580 - RNA, 19 nt, Homo sapiens
gcacggccauccgguugaa

SEQ ID NO: 1388581 - RNA, 19 nt, Homo sapiens
agaaaucagccacaauaaa

SEQ ID NO: 1388582 - RNA, 19 nt, Homo sapiens
gaaagucaucguuaggaau

SEQ ID NO: 1388583 - RNA, 19 nt, Homo sapiens
gaagauggagagauuugug

SEQ ID NO: 1388584 - RNA, 19 nt, Homo sapiens
ggaguuucucuauaaauga

SEQ ID NO: 1388585 - RNA, 19 nt, Homo sapiens
caauaaacaacaugggaaa

SEQ ID NO: 1388586 - RNA, 19 nt, Homo sapiens
gcgaucacguccugguuau

SEQ ID NO: 1388587 - RNA, 19 nt, Homo sapiens
uaaugaaacucccagaaaa

SEQ ID NO: 1388588 - RNA, 19 nt, Homo sapiens
gggcaucauucacgccuau

SEQ ID NO: 1388589 - RNA, 19 nt, Homo sapiens
caaagugacagccucaaau

SEQ ID NO: 1388590 - RNA, 19 nt, Homo sapiens
gacauuauccugccacauc

SEQ ID NO: 1388591 - RNA, 19 nt, Homo sapiens
uggaguuucucuauaaaug

SEQ ID NO: 1388592 - RNA, 19 nt, Homo sapiens
gaggagugcauuaagaaga

SEQ ID NO: 1388593 - RNA, 19 nt, Homo sapiens
caaaugccaccuugacaug

SEQ ID NO: 1388594 - RNA, 19 nt, Homo sapiens
gaacugaucuggguaaagu

SEQ ID NO: 1388595 - RNA, 19 nt, Homo sapiens
gaaacaggcucagaauuug

SEQ ID NO: 1388596 - RNA, 19 nt, Homo sapiens
gaaccaagcugacugugau

SEQ ID NO: 1388597 - RNA, 19 nt, Homo sapiens
gacaagggcucacggauga

SEQ ID NO: 1388598 - RNA, 19 nt, Homo sapiens
gggaagaucuugggaauau

SEQ ID NO: 1388599 - RNA, 19 nt, Homo sapiens
ggaaggugauugaguuuga

SEQ ID NO: 1388600 - RNA, 19 nt, Homo sapiens
gagaauggauguccucaug

SEQ ID NO: 1388601 - RNA, 19 nt, Homo sapiens
ucaauaaccuuugccauuu

SEQ ID NO: 1388602 - RNA, 19 nt, Homo sapiens
gaauggauguccucaugaa

SEQ ID NO: 1388603 - RNA, 19 nt, Homo sapiens
ucaagaagguggagaaugu

SEQ ID NO: 1388604 - RNA, 19 nt, Homo sapiens
ggagagcccugcugagaga

SEQ ID NO: 1388605 - RNA, 19 nt, Homo sapiens
gaaauuacccugaaauguc

SEQ ID NO: 1388606 - RNA, 19 nt, Homo sapiens
gcgaaugucucucuaagga

SEQ ID NO: 1388607 - RNA, 19 nt, Homo sapiens
ugaaacaggcucagaauuu

SEQ ID NO: 1388608 - RNA, 19 nt, Homo sapiens
ggaaagucaucguuaggaa

SEQ ID NO: 1388609 - RNA, 19 nt, Homo sapiens
guuugaagcugccuuguuu

SEQ ID NO: 1388610 - RNA, 19 nt, Homo sapiens
gggcagaggcagaggauua

SEQ ID NO: 1388611 - RNA, 19 nt, Homo sapiens
ggagagaacauucaugaga

SEQ ID NO: 1388612 - RNA, 19 nt, Homo sapiens
gaaaucagccacaauaaac

SEQ ID NO: 1388613 - RNA, 19 nt, Homo sapiens
guggauaucugcauucuca

SEQ ID NO: 1388614 - RNA, 19 nt, Homo sapiens
ucaauauacugucaaguga

SEQ ID NO: 1388615 - RNA, 19 nt, Homo sapiens
ggauggaguuugcaagguu

SEQ ID NO: 1388616 - RNA, 19 nt, Homo sapiens
cagcagaagucagauugua

SEQ ID NO: 1388617 - RNA, 19 nt, Homo sapiens
gacccuaccuuaucucaga

SEQ ID NO: 1388618 - RNA, 19 nt, Homo sapiens
ugacaagccugaaguccuu

SEQ ID NO: 1388619 - RNA, 19 nt, Homo sapiens
caagugauagcuauucuuu

SEQ ID NO: 1388620 - RNA, 19 nt, Homo sapiens
ggaauuaaaugguccuacu

SEQ ID NO: 1388621 - RNA, 19 nt, Homo sapiens
guaaugacacagauuugua

SEQ ID NO: 1388622 - RNA, 19 nt, Homo sapiens
caucaguacuucauccaaa

SEQ ID NO: 1388623 - RNA, 19 nt, Homo sapiens
caaagaucauucuccuuga

SEQ ID NO: 1388624 - RNA, 19 nt, Homo sapiens
gauauaagaaggagggaaa

SEQ ID NO: 1388625 - RNA, 19 nt, Homo sapiens
ggcaaaggcugaccguaga

SEQ ID NO: 1388626 - RNA, 19 nt, Homo sapiens
ccaaaggccugucauuguc

SEQ ID NO: 1388627 - RNA, 19 nt, Homo sapiens
gugaaaggcuaccggcaaa

SEQ ID NO: 1388628 - RNA, 19 nt, Homo sapiens
ggaaagcucauuggugaaa

SEQ ID NO: 1388629 - RNA, 19 nt, Homo sapiens
gaaaugucgccuugcaauu

SEQ ID NO: 1388630 - RNA, 19 nt, Homo sapiens
uuagaaaucagccacaaua

SEQ ID NO: 1388631 - RNA, 19 nt, Homo sapiens
aaaugucgccuugcaauua

SEQ ID NO: 1388632 - RNA, 19 nt, Homo sapiens
guaggaaauuacccugaaa

SEQ ID NO: 1388633 - RNA, 19 nt, Homo sapiens
caacuuggaucccuuugag

SEQ ID NO: 1388634 - RNA, 19 nt, Homo sapiens
gcaacaggaccauguguga

SEQ ID NO: 1388635 - RNA, 19 nt, Homo sapiens
ggucagaggcauacaguga

SEQ ID NO: 1388636 - RNA, 19 nt, Homo sapiens
caaagaaauugcagaacca

SEQ ID NO: 1388637 - RNA, 19 nt, Homo sapiens
ccagucaccuccucuacuu

SEQ ID NO: 1388638 - RNA, 19 nt, Homo sapiens
gaaauugcagaaccagaaa

SEQ ID NO: 1388639 - RNA, 19 nt, Homo sapiens
ggaaauuacccugaaaugu

SEQ ID NO: 1388640 - RNA, 19 nt, Homo sapiens
gauggaguuugcaagguuu

SEQ ID NO: 1388641 - RNA, 19 nt, Homo sapiens
gaauuaaaugguccuacua

SEQ ID NO: 1388642 - RNA, 19 nt, Homo sapiens
ugagaaagaugaaggaaaa

SEQ ID NO: 1388643 - RNA, 19 nt, Homo sapiens
gcaaagugacagccucaaa

SEQ ID NO: 1388644 - RNA, 19 nt, Homo sapiens
cugaagauauuccaauuuc

SEQ ID NO: 1388645 - RNA, 19 nt, Homo sapiens
gagaucaccuucagagacu

SEQ ID NO: 1388646 - RNA, 19 nt, Homo sapiens
ggacguagcaggucuucug

SEQ ID NO: 1388647 - RNA, 19 nt, Homo sapiens
ugacucaucugacaccaau

SEQ ID NO: 1388648 - RNA, 19 nt, Homo sapiens
gcggagauccuuugcagaa

SEQ ID NO: 1388649 - RNA, 19 nt, Homo sapiens
gaacauccuuaccuucacu

SEQ ID NO: 1388650 - RNA, 19 nt, Homo sapiens
gaagaucuugggaauaugu

SEQ ID NO: 1388651 - RNA, 19 nt, Homo sapiens
gcaugaagccagcaggaaa

SEQ ID NO: 1388652 - RNA, 19 nt, Homo sapiens
gaagcgaaugucucucuaa

SEQ ID NO: 1388653 - RNA, 19 nt, Homo sapiens
uaagaaggagggaaagaaa

SEQ ID NO: 1388654 - RNA, 19 nt, Homo sapiens
ccaccgaguuuaccaaagu

SEQ ID NO: 1388655 - RNA, 19 nt, Homo sapiens
gaaagucuggguuggcauu

SEQ ID NO: 1388656 - RNA, 19 nt, Homo sapiens
gaaaaugccuuaggaugga

SEQ ID NO: 1388657 - RNA, 19 nt, Homo sapiens
gcagaagucagauuguaga

SEQ ID NO: 1388658 - RNA, 19 nt, Homo sapiens
aaacauacucuuuggagaa

SEQ ID NO: 1388659 - RNA, 19 nt, Homo sapiens
gcaagaaacagaggucaga

SEQ ID NO: 1388660 - RNA, 19 nt, Homo sapiens
cauccucaccucucaauaa

SEQ ID NO: 1388661 - RNA, 19 nt, Homo sapiens
gaacgucagcugcuuugug

SEQ ID NO: 1388662 - RNA, 19 nt, Homo sapiens
gagagacacaauaaugaaa

SEQ ID NO: 1388663 - RNA, 19 nt, Homo sapiens
cagaugagauacagagaca

SEQ ID NO: 1388664 - RNA, 19 nt, Homo sapiens
aaacauaucacacguacau

SEQ ID NO: 1388665 - RNA, 19 nt, Homo sapiens
gaacuuuggccuacguuuc

SEQ ID NO: 1388666 - RNA, 19 nt, Homo sapiens
gggaauaugugggaaugug

SEQ ID NO: 1388667 - RNA, 19 nt, Homo sapiens
gaaaaguaccccaaagaaa

SEQ ID NO: 1388668 - RNA, 19 nt, Homo sapiens
agugauagcuauucuuugu

SEQ ID NO: 1388669 - RNA, 19 nt, Homo sapiens
caauaaccuuugccauuuc

SEQ ID NO: 1388670 - RNA, 19 nt, Homo sapiens
cauaucacacguacauuaa

SEQ ID NO: 1388671 - RNA, 19 nt, Homo sapiens
acauaucacacguacauua

SEQ ID NO: 1388672 - RNA, 19 nt, Homo sapiens
gaagauauuccaauuucca

SEQ ID NO: 1388673 - RNA, 19 nt, Homo sapiens
gcuggaguuucucuauaaa

SEQ ID NO: 1388674 - RNA, 19 nt, Homo sapiens
ccacucacuuccaucuuga

SEQ ID NO: 1388675 - RNA, 19 nt, Homo sapiens
caugagagacacaauaaug

SEQ ID NO: 1388676 - RNA, 19 nt, Homo sapiens
auuagaagauggagagauu

SEQ ID NO: 1388677 - RNA, 19 nt, Homo sapiens
gcacggccauccgguugaa

SEQ ID NO: 1388678 - RNA, 19 nt, Homo sapiens
agaaaucagccacaauaaa

SEQ ID NO: 1388679 - RNA, 19 nt, Homo sapiens
gaaagucaucguuaggaau

SEQ ID NO: 1388680 - RNA, 19 nt, Homo sapiens
gaagauggagagauuugug

SEQ ID NO: 1388681 - RNA, 19 nt, Homo sapiens
ggaguuucucuauaaauga

SEQ ID NO: 1388682 - RNA, 19 nt, Homo sapiens
caauaaacaacaugggaaa

SEQ ID NO: 1388683 - RNA, 19 nt, Homo sapiens
gcgaucacguccugguuau

SEQ ID NO: 1388684 - RNA, 19 nt, Homo sapiens
uaaugaaacucccagaaaa

SEQ ID NO: 1388685 - RNA, 19 nt, Homo sapiens
gggcaucauucacgccuau

SEQ ID NO: 1388686 - RNA, 19 nt, Homo sapiens
caaagugacagccucaaau

SEQ ID NO: 1388687 - RNA, 19 nt, Homo sapiens
gacauuauccugccacauc

SEQ ID NO: 1388688 - RNA, 19 nt, Homo sapiens
uggaguuucucuauaaaug

SEQ ID NO: 1388689 - RNA, 19 nt, Homo sapiens
gaggagugcauuaagaaga

SEQ ID NO: 1388690 - RNA, 19 nt, Homo sapiens
caaaugccaccuugacaug

SEQ ID NO: 1388691 - RNA, 19 nt, Homo sapiens
gcaaaugccaccuugacau

SEQ ID NO: 1388692 - RNA, 19 nt, Homo sapiens
gcgacccugugcaagguua

SEQ ID NO: 1388693 - RNA, 19 nt, Homo sapiens
gaaaagaggaauuaaaugg

SEQ ID NO: 1388694 - RNA, 19 nt, Homo sapiens
gaucuuggcugcuguguuu

SEQ ID NO: 1388695 - RNA, 19 nt, Homo sapiens
gaacugaucuggguaaagu

SEQ ID NO: 1388696 - RNA, 19 nt, Homo sapiens
gaaacaggcucagaauuug

SEQ ID NO: 1388697 - RNA, 19 nt, Homo sapiens
gaaccaagcugacugugau

SEQ ID NO: 1388698 - RNA, 19 nt, Homo sapiens
gacaagggcucacggauga

SEQ ID NO: 1388699 - RNA, 19 nt, Homo sapiens
gggaagaucuugggaauau

SEQ ID NO: 1388700 - RNA, 19 nt, Homo sapiens
ggaaggugauugaguuuga

SEQ ID NO: 1388701 - RNA, 19 nt, Homo sapiens
gagaauggauguccucaug

SEQ ID NO: 1388702 - RNA, 19 nt, Homo sapiens
ucaauaaccuuugccauuu

SEQ ID NO: 1388703 - RNA, 19 nt, Homo sapiens
gaauggauguccucaugaa

SEQ ID NO: 1388704 - RNA, 19 nt, Homo sapiens
ucaagaagguggagaaugu

SEQ ID NO: 1388705 - RNA, 19 nt, Homo sapiens
ggagagcccugcugagaga

SEQ ID NO: 1388706 - RNA, 19 nt, Homo sapiens
gaaauuacccugaaauguc

SEQ ID NO: 1388707 - RNA, 19 nt, Homo sapiens
gcgaaugucucucuaagga

SEQ ID NO: 1388708 - RNA, 19 nt, Homo sapiens
ugaaacaggcucagaauuu

SEQ ID NO: 1388709 - RNA, 19 nt, Homo sapiens
ggaaagucaucguuaggaa

SEQ ID NO: 1388710 - RNA, 19 nt, Homo sapiens
guuugaagcugccuuguuu

SEQ ID NO: 1388711 - RNA, 19 nt, Homo sapiens
gggcagaggcagaggauua

SEQ ID NO: 1388712 - RNA, 19 nt, Homo sapiens
ggagagaacauucaugaga

SEQ ID NO: 1388713 - RNA, 19 nt, Homo sapiens
gaaaucagccacaauaaac

SEQ ID NO: 1388714 - RNA, 19 nt, Homo sapiens
guggauaucugcauucuca

SEQ ID NO: 1388715 - RNA, 19 nt, Homo sapiens
gcuguaggcuucuucauuc

SEQ ID NO: 1388716 - RNA, 19 nt, Homo sapiens
ucaauauacugucaaguga

SEQ ID NO: 1388717 - RNA, 19 nt, Homo sapiens
ccaaugaguuucuuugaca

SEQ ID NO: 1388718 - RNA, 19 nt, Homo sapiens
ggauggaguuugcaagguu

SEQ ID NO: 1388719 - RNA, 19 nt, Homo sapiens
cagcagaagucagauugua

SEQ ID NO: 1388720 - RNA, 19 nt, Homo sapiens
uuaaagagcccaaugaguu

SEQ ID NO: 1388721 - RNA, 19 nt, Homo sapiens
gacccuaccuuaucucaga

SEQ ID NO: 1388722 - RNA, 19 nt, Homo sapiens
ugacaagccugaaguccuu

SEQ ID NO: 1388723 - RNA, 19 nt, Homo sapiens
caagugauagcuauucuuu

SEQ ID NO: 1388724 - RNA, 19 nt, Homo sapiens
ggaauuaaaugguccuacu

SEQ ID NO: 1388725 - RNA, 19 nt, Homo sapiens
guaaugacacagauuugua

SEQ ID NO: 1388726 - RNA, 19 nt, Homo sapiens
caucaguacuucauccaaa

SEQ ID NO: 1388727 - RNA, 19 nt, Homo sapiens
caaagaucauucuccuuga

SEQ ID NO: 1388728 - RNA, 19 nt, Homo sapiens
gauauaagaaggagggaaa

SEQ ID NO: 1388729 - RNA, 19 nt, Homo sapiens
ggcaaaggcugaccguaga

SEQ ID NO: 1388730 - RNA, 19 nt, Homo sapiens
ccaaaggccugucauuguc

SEQ ID NO: 1388731 - RNA, 19 nt, Homo sapiens
uaaagagcccaaugaguuu

SEQ ID NO: 1388732 - RNA, 19 nt, Homo sapiens
gugaaaggcuaccggcaaa

SEQ ID NO: 1388733 - RNA, 19 nt, Homo sapiens
ggaaagcucauuggugaaa

SEQ ID NO: 1388734 - RNA, 19 nt, Homo sapiens
gaaaugucgccuugcaauu

SEQ ID NO: 1388735 - RNA, 19 nt, Homo sapiens
uuagaaaucagccacaaua

SEQ ID NO: 1388736 - RNA, 19 nt, Homo sapiens
aaaugucgccuugcaauua

SEQ ID NO: 1388737 - RNA, 19 nt, Homo sapiens
guaggaaauuacccugaaa

SEQ ID NO: 1388738 - RNA, 19 nt, Homo sapiens
caacuuggaucccuuugag

SEQ ID NO: 1388739 - RNA, 19 nt, Homo sapiens
gcaacaggaccauguguga

SEQ ID NO: 1388740 - RNA, 19 nt, Homo sapiens
ggucagaggcauacaguga

SEQ ID NO: 1388741 - RNA, 19 nt, Homo sapiens
caaagaaauugcagaacca

SEQ ID NO: 1388742 - RNA, 19 nt, Homo sapiens
ccagucaccuccucuacuu

SEQ ID NO: 1388743 - RNA, 19 nt, Homo sapiens
gaaauugcagaaccagaaa

SEQ ID NO: 1388744 - RNA, 19 nt, Homo sapiens
ggaaauuacccugaaaugu

SEQ ID NO: 1388745 - RNA, 19 nt, Homo sapiens
gauggaguuugcaagguuu

SEQ ID NO: 1388746 - RNA, 19 nt, Homo sapiens
gaauuaaaugguccuacua

SEQ ID NO: 1388747 - RNA, 19 nt, Homo sapiens
ugagaaagaugaaggaaaa

SEQ ID NO: 1388748 - RNA, 19 nt, Homo sapiens
gcaaagugacagccucaaa

SEQ ID NO: 1388749 - RNA, 19 nt, Homo sapiens
cugaagauauuccaauuuc

SEQ ID NO: 1388750 - RNA, 19 nt, Homo sapiens
gagaucaccuucagagacu

SEQ ID NO: 1388751 - RNA, 19 nt, Homo sapiens
ggacguagcaggucuucug

SEQ ID NO: 1388752 - RNA, 19 nt, Homo sapiens
ugacucaucugacaccaau

SEQ ID NO: 1388753 - RNA, 19 nt, Homo sapiens
gcggagauccuuugcagaa

SEQ ID NO: 1388754 - RNA, 19 nt, Homo sapiens
gaacauccuuaccuucacu

SEQ ID NO: 1388755 - RNA, 19 nt, Homo sapiens
gaagaucuugggaauaugu

SEQ ID NO: 1388756 - RNA, 19 nt, Homo sapiens
gcaugaagccagcaggaaa

SEQ ID NO: 1388757 - RNA, 19 nt, Homo sapiens
gaagcgaaugucucucuaa

SEQ ID NO: 1388758 - RNA, 19 nt, Homo sapiens
uaagaaggagggaaagaaa

SEQ ID NO: 1388759 - RNA, 19 nt, Homo sapiens
ccaccgaguuuaccaaagu

SEQ ID NO: 1388760 - RNA, 19 nt, Homo sapiens
gaaagucuggguuggcauu

SEQ ID NO: 1388761 - RNA, 19 nt, Homo sapiens
gaaaaugccuuaggaugga

SEQ ID NO: 1388762 - RNA, 19 nt, Homo sapiens
gcagaagucagauuguaga

SEQ ID NO: 1388763 - RNA, 19 nt, Homo sapiens
aaacauacucuuuggagaa

SEQ ID NO: 1388764 - RNA, 19 nt, Homo sapiens
gcaagaaacagaggucaga

SEQ ID NO: 1388765 - RNA, 19 nt, Homo sapiens
cauccucaccucucaauaa

SEQ ID NO: 1388766 - RNA, 19 nt, Homo sapiens
gaacgucagcugcuuugug

SEQ ID NO: 1388767 - RNA, 19 nt, Homo sapiens
gagagacacaauaaugaaa

SEQ ID NO: 1388768 - RNA, 19 nt, Homo sapiens
cagaugagauacagagaca

SEQ ID NO: 1388769 - RNA, 19 nt, Homo sapiens
aaacauaucacacguacau

SEQ ID NO: 1388770 - RNA, 19 nt, Homo sapiens
gaacuuuggccuacguuuc

SEQ ID NO: 1388771 - RNA, 19 nt, Homo sapiens
gggaauaugugggaaugug

SEQ ID NO: 1388772 - RNA, 19 nt, Homo sapiens
gaaaaguaccccaaagaaa

SEQ ID NO: 1388773 - RNA, 19 nt, Homo sapiens
agugauagcuauucuuugu

SEQ ID NO: 1388774 - RNA, 19 nt, Homo sapiens
caauaaccuuugccauuuc

SEQ ID NO: 1388775 - RNA, 19 nt, Homo sapiens
cauaucacacguacauuaa

SEQ ID NO: 1388776 - RNA, 19 nt, Homo sapiens
acauaucacacguacauua

SEQ ID NO: 1388777 - RNA, 19 nt, Homo sapiens
gaagauauuccaauuucca

SEQ ID NO: 1388778 - RNA, 19 nt, Homo sapiens
gcuggaguuucucuauaaa

SEQ ID NO: 1388779 - RNA, 19 nt, Homo sapiens
ccacucacuuccaucuuga

SEQ ID NO: 1388780 - RNA, 19 nt, Homo sapiens
caugagagacacaauaaug

SEQ ID NO: 1388781 - RNA, 19 nt, Homo sapiens
gcaggcuaaugaaccguuu

SEQ ID NO: 1388782 - RNA, 19 nt, Homo sapiens
auuagaagauggagagauu

SEQ ID NO: 1388783 - RNA, 19 nt, Homo sapiens
gcacggccauccgguugaa

SEQ ID NO: 1388784 - RNA, 19 nt, Homo sapiens
agaaaucagccacaauaaa

SEQ ID NO: 1388785 - RNA, 19 nt, Homo sapiens
gaaagucaucguuaggaau

SEQ ID NO: 1388786 - RNA, 19 nt, Homo sapiens
gaagauggagagauuugug

SEQ ID NO: 1388787 - RNA, 19 nt, Homo sapiens
ggaguuucucuauaaauga

SEQ ID NO: 1388788 - RNA, 19 nt, Homo sapiens
caauaaacaacaugggaaa

SEQ ID NO: 1388789 - RNA, 19 nt, Homo sapiens
gcgaucacguccugguuau

SEQ ID NO: 1388790 - RNA, 19 nt, Homo sapiens
uaaugaaacucccagaaaa

SEQ ID NO: 1388791 - RNA, 19 nt, Homo sapiens
gggcaucauucacgccuau

SEQ ID NO: 1388792 - RNA, 19 nt, Homo sapiens
caaagugacagccucaaau

SEQ ID NO: 1388793 - RNA, 19 nt, Homo sapiens
gacauuauccugccacauc

SEQ ID NO: 1388794 - RNA, 19 nt, Homo sapiens
gaucuuggcugcuguguuu

SEQ ID NO: 1388795 - RNA, 19 nt, Homo sapiens
gaacugaucuggguaaagu

SEQ ID NO: 1388796 - RNA, 19 nt, Homo sapiens
gaaacaggcucagaauuug

SEQ ID NO: 1388797 - RNA, 19 nt, Homo sapiens
gaaccaagcugacugugau

SEQ ID NO: 1388798 - RNA, 19 nt, Homo sapiens
gacaagggcucacggauga

SEQ ID NO: 1388799 - RNA, 19 nt, Homo sapiens
gggaagaucuugggaauau

SEQ ID NO: 1388800 - RNA, 19 nt, Homo sapiens
ggaaggugauugaguuuga

SEQ ID NO: 1388801 - RNA, 19 nt, Homo sapiens
gagaauggauguccucaug

SEQ ID NO: 1388802 - RNA, 19 nt, Homo sapiens
ucaauaaccuuugccauuu

SEQ ID NO: 1388803 - RNA, 19 nt, Homo sapiens
gaauggauguccucaugaa

SEQ ID NO: 1388804 - RNA, 19 nt, Homo sapiens
ucaagaagguggagaaugu

SEQ ID NO: 1388805 - RNA, 19 nt, Homo sapiens
ggagagcccugcugagaga

SEQ ID NO: 1388806 - RNA, 19 nt, Homo sapiens
gaaauuacccugaaauguc

SEQ ID NO: 1388807 - RNA, 19 nt, Homo sapiens
gcgaaugucucucuaagga

SEQ ID NO: 1388808 - RNA, 19 nt, Homo sapiens
ugaaacaggcucagaauuu

SEQ ID NO: 1388809 - RNA, 19 nt, Homo sapiens
ggaaagucaucguuaggaa

SEQ ID NO: 1388810 - RNA, 19 nt, Homo sapiens
guuugaagcugccuuguuu

SEQ ID NO: 1388811 - RNA, 19 nt, Homo sapiens
gggcagaggcagaggauua

SEQ ID NO: 1388812 - RNA, 19 nt, Homo sapiens
gaaaucagccacaauaaac

SEQ ID NO: 1388813 - RNA, 19 nt, Homo sapiens
guggauaucugcauucuca

SEQ ID NO: 1388814 - RNA, 19 nt, Homo sapiens
gcuguaggcuucuucauuc

SEQ ID NO: 1388815 - RNA, 19 nt, Homo sapiens
ucaauauacugucaaguga

SEQ ID NO: 1388816 - RNA, 19 nt, Homo sapiens
ccaaugaguuucuuugaca

SEQ ID NO: 1388817 - RNA, 19 nt, Homo sapiens
ggauggaguuugcaagguu

SEQ ID NO: 1388818 - RNA, 19 nt, Homo sapiens
cagcagaagucagauugua

SEQ ID NO: 1388819 - RNA, 19 nt, Homo sapiens
uuaaagagcccaaugaguu

SEQ ID NO: 1388820 - RNA, 19 nt, Homo sapiens
gacccuaccuuaucucaga

SEQ ID NO: 1388821 - RNA, 19 nt, Homo sapiens
ugacaagccugaaguccuu

SEQ ID NO: 1388822 - RNA, 19 nt, Homo sapiens
ggaauuaaaugguccuacu

SEQ ID NO: 1388823 - RNA, 19 nt, Homo sapiens
caagugauagcuauucuuu

SEQ ID NO: 1388824 - RNA, 19 nt, Homo sapiens
guaaugacacagauuugua

SEQ ID NO: 1388825 - RNA, 19 nt, Homo sapiens
caucaguacuucauccaaa

SEQ ID NO: 1388826 - RNA, 19 nt, Homo sapiens
caaagaucauucuccuuga

SEQ ID NO: 1388827 - RNA, 19 nt, Homo sapiens
gauauaagaaggagggaaa

SEQ ID NO: 1388828 - RNA, 19 nt, Homo sapiens
ggcaaaggcugaccguaga

SEQ ID NO: 1388829 - RNA, 19 nt, Homo sapiens
ccaaaggccugucauuguc

SEQ ID NO: 1388830 - RNA, 19 nt, Homo sapiens
uaaagagcccaaugaguuu

SEQ ID NO: 1388831 - RNA, 19 nt, Homo sapiens
gugaaaggcuaccggcaaa

SEQ ID NO: 1388832 - RNA, 19 nt, Homo sapiens
ggaaagcucauuggugaaa

SEQ ID NO: 1388833 - RNA, 19 nt, Homo sapiens
gaaaugucgccuugcaauu

SEQ ID NO: 1388834 - RNA, 19 nt, Homo sapiens
uuagaaaucagccacaaua

SEQ ID NO: 1388835 - RNA, 19 nt, Homo sapiens
aaaugucgccuugcaauua

SEQ ID NO: 1388836 - RNA, 19 nt, Homo sapiens
guaggaaauuacccugaaa

SEQ ID NO: 1388837 - RNA, 19 nt, Homo sapiens
gcaacaggaccauguguga

SEQ ID NO: 1388838 - RNA, 19 nt, Homo sapiens
ggucagaggcauacaguga

SEQ ID NO: 1388839 - RNA, 19 nt, Homo sapiens
caaagaaauugcagaacca

SEQ ID NO: 1388840 - RNA, 19 nt, Homo sapiens
ccagucaccuccucuacuu

SEQ ID NO: 1388841 - RNA, 19 nt, Homo sapiens
gaaauugcagaaccagaaa

SEQ ID NO: 1388842 - RNA, 19 nt, Homo sapiens
ggaaauuacccugaaaugu

SEQ ID NO: 1388843 - RNA, 19 nt, Homo sapiens
gauggaguuugcaagguuu

SEQ ID NO: 1388844 - RNA, 19 nt, Homo sapiens
gaauuaaaugguccuacua

SEQ ID NO: 1388845 - RNA, 19 nt, Homo sapiens
ugagaaagaugaaggaaaa

SEQ ID NO: 1388846 - RNA, 19 nt, Homo sapiens
gcaaagugacagccucaaa

SEQ ID NO: 1388847 - RNA, 19 nt, Homo sapiens
cugaagauauuccaauuuc

SEQ ID NO: 1388848 - RNA, 19 nt, Homo sapiens
gagaucaccuucagagacu

SEQ ID NO: 1388849 - RNA, 19 nt, Homo sapiens
ggacguagcaggucuucug

SEQ ID NO: 1388850 - RNA, 19 nt, Homo sapiens
ugacucaucugacaccaau

SEQ ID NO: 1388851 - RNA, 19 nt, Homo sapiens
gcggagauccuuugcagaa

SEQ ID NO: 1388852 - RNA, 19 nt, Homo sapiens
gaacauccuuaccuucacu

SEQ ID NO: 1388853 - RNA, 19 nt, Homo sapiens
gaagaucuugggaauaugu

SEQ ID NO: 1388854 - RNA, 19 nt, Homo sapiens
gcaugaagccagcaggaaa

SEQ ID NO: 1388855 - RNA, 19 nt, Homo sapiens
gaagcgaaugucucucuaa

SEQ ID NO: 1388856 - RNA, 19 nt, Homo sapiens
uaagaaggagggaaagaaa

SEQ ID NO: 1388857 - RNA, 19 nt, Homo sapiens
ccaccgaguuuaccaaagu

SEQ ID NO: 1388858 - RNA, 19 nt, Homo sapiens
gaaagucuggguuggcauu

SEQ ID NO: 1388859 - RNA, 19 nt, Homo sapiens
gaaaaugccuuaggaugga

SEQ ID NO: 1388860 - RNA, 19 nt, Homo sapiens
gcagaagucagauuguaga

SEQ ID NO: 1388861 - RNA, 19 nt, Homo sapiens
aaacauacucuuuggagaa

SEQ ID NO: 1388862 - RNA, 19 nt, Homo sapiens
gcaagaaacagaggucaga

SEQ ID NO: 1388863 - RNA, 19 nt, Homo sapiens
cauccucaccucucaauaa

SEQ ID NO: 1388864 - RNA, 19 nt, Homo sapiens
gaacgucagcugcuuugug

SEQ ID NO: 1388865 - RNA, 19 nt, Homo sapiens
cagaugagauacagagaca

SEQ ID NO: 1388866 - RNA, 19 nt, Homo sapiens
aaacauaucacacguacau

SEQ ID NO: 1388867 - RNA, 19 nt, Homo sapiens
gaacuuuggccuacguuuc

SEQ ID NO: 1388868 - RNA, 19 nt, Homo sapiens
gggaauaugugggaaugug

SEQ ID NO: 1388869 - RNA, 19 nt, Homo sapiens
gaaaaguaccccaaagaaa

SEQ ID NO: 1388870 - RNA, 19 nt, Homo sapiens
agugauagcuauucuuugu

SEQ ID NO: 1388871 - RNA, 19 nt, Homo sapiens
caauaaccuuugccauuuc

SEQ ID NO: 1388872 - RNA, 19 nt, Homo sapiens
cauaucacacguacauuaa

SEQ ID NO: 1388873 - RNA, 19 nt, Homo sapiens
acauaucacacguacauua

SEQ ID NO: 1388874 - RNA, 19 nt, Homo sapiens
gaagauauuccaauuucca

SEQ ID NO: 1388875 - RNA, 19 nt, Homo sapiens
gcuggaguuucucuauaaa

SEQ ID NO: 1388876 - RNA, 19 nt, Homo sapiens
ccacucacuuccaucuuga

SEQ ID NO: 1388877 - RNA, 19 nt, Homo sapiens
gauaaugaaacucccagaa

SEQ ID NO: 1388878 - RNA, 19 nt, Homo sapiens
gcaggcuaaugaaccguuu

SEQ ID NO: 1388879 - RNA, 19 nt, Homo sapiens
auuagaagauggagagauu

SEQ ID NO: 1388880 - RNA, 19 nt, Homo sapiens
gcacggccauccgguugaa

SEQ ID NO: 1388881 - RNA, 19 nt, Homo sapiens
agaaaucagccacaauaaa

SEQ ID NO: 1388882 - RNA, 19 nt, Homo sapiens
gaaagucaucguuaggaau

SEQ ID NO: 1388883 - RNA, 19 nt, Homo sapiens
gaagauggagagauuugug

SEQ ID NO: 1388884 - RNA, 19 nt, Homo sapiens
ggaguuucucuauaaauga

SEQ ID NO: 1388885 - RNA, 19 nt, Homo sapiens
caauaaacaacaugggaaa

SEQ ID NO: 1388886 - RNA, 19 nt, Homo sapiens
gcgaucacguccugguuau

SEQ ID NO: 1388887 - RNA, 19 nt, Homo sapiens
uaaugaaacucccagaaaa

SEQ ID NO: 1388888 - RNA, 19 nt, Homo sapiens
gggcaucauucacgccuau

SEQ ID NO: 1388889 - RNA, 19 nt, Homo sapiens
caaagugacagccucaaau

SEQ ID NO: 1388890 - RNA, 19 nt, Homo sapiens
gacauuauccugccacauc

SEQ ID NO: 1388891 - RNA, 19 nt, Homo sapiens
uggaguuucucuauaaaug

SEQ ID NO: 1388892 - RNA, 19 nt, Homo sapiens
gaggagugcauuaagaaga

SEQ ID NO: 1388893 - RNA, 19 nt, Homo sapiens
caaaugccaccuugacaug

SEQ ID NO: 1388894 - RNA, 19 nt, Homo sapiens
gcacagaccucccuuugca

SEQ ID NO: 1388895 - RNA, 19 nt, Homo sapiens
gaacacaccagcuauuuau

SEQ ID NO: 1388896 - RNA, 19 nt, Homo sapiens
guaguuaccuaucugaaug

SEQ ID NO: 1388897 - RNA, 19 nt, Homo sapiens
ggagcucucuuuggcauuu

SEQ ID NO: 1388898 - RNA, 19 nt, Homo sapiens
gccaacauguucauuauca

SEQ ID NO: 1388899 - RNA, 19 nt, Homo sapiens
gagaacacaccagcuauuu

SEQ ID NO: 1388900 - RNA, 19 nt, Homo sapiens
auacacagacccaggauua

SEQ ID NO: 1388901 - RNA, 19 nt, Homo sapiens
caagaggcgugcggcauuu

SEQ ID NO: 1388902 - RNA, 19 nt, Homo sapiens
gaggugggcuggacacaca

SEQ ID NO: 1388903 - RNA, 19 nt, Homo sapiens
gagcacagaccucccuuug

SEQ ID NO: 1388904 - RNA, 19 nt, Homo sapiens
ggagacaggcugcgaguuc

SEQ ID NO: 1388905 - RNA, 19 nt, Homo sapiens
caaggaccaucccaacuca

SEQ ID NO: 1388906 - RNA, 19 nt, Homo sapiens
ccaguagccucuauaagca

SEQ ID NO: 1388907 - RNA, 19 nt, Homo sapiens
ccagagaacacaccagcua

SEQ ID NO: 1388908 - RNA, 19 nt, Homo sapiens
ggugauggcuccagagaac

SEQ ID NO: 1388909 - RNA, 19 nt, Homo sapiens
uauaagcaguggcucuuug

SEQ ID NO: 1388910 - RNA, 19 nt, Homo sapiens
caaaugggcggucccucua

SEQ ID NO: 1388911 - RNA, 19 nt, Homo sapiens
gcagagcgagugcaagaug

SEQ ID NO: 1388912 - RNA, 19 nt, Homo sapiens
ggacaccugccaacauguu

SEQ ID NO: 1388913 - RNA, 19 nt, Homo sapiens
gaucugacaggguauagga

SEQ ID NO: 1388914 - RNA, 19 nt, Homo sapiens
caaaacuccugccccauaa

SEQ ID NO: 1388915 - RNA, 19 nt, Homo sapiens
cgaguucuaugccuucugu

SEQ ID NO: 1388916 - RNA, 19 nt, Homo sapiens
ggucagcgacuuccucaug

SEQ ID NO: 1388917 - RNA, 19 nt, Homo sapiens
agaacacaccagcuauuua

SEQ ID NO: 1388918 - RNA, 19 nt, Homo sapiens
gcaauuguccaggcgauga

SEQ ID NO: 1388919 - RNA, 19 nt, Homo sapiens
gcaaggaccaucccaacuc

SEQ ID NO: 1388920 - RNA, 19 nt, Homo sapiens
caaaugcugugugcugcaa

SEQ ID NO: 1388921 - RNA, 19 nt, Homo sapiens
cugcgucugugauucauuu

SEQ ID NO: 1388922 - RNA, 19 nt, Homo sapiens
acacaccagcuauuuauga

SEQ ID NO: 1388923 - RNA, 19 nt, Homo sapiens
ccacgucucccucauauac

SEQ ID NO: 1388924 - RNA, 19 nt, Homo sapiens
caagauggccaagaucaug

SEQ ID NO: 1388925 - RNA, 19 nt, Homo sapiens
ggcauuuccuccaugauca

SEQ ID NO: 1388926 - RNA, 19 nt, Homo sapiens
ccacagcaccugggacuug

SEQ ID NO: 1388927 - RNA, 19 nt, Homo sapiens
ccaagaggcgugcggcauu

SEQ ID NO: 1388928 - RNA, 19 nt, Homo sapiens
ccggacaccugccaacaug

SEQ ID NO: 1388929 - RNA, 19 nt, Homo sapiens
gacgggcucuccagaccuu

SEQ ID NO: 1388930 - RNA, 19 nt, Homo sapiens
gcugugugcugcaauuguc

SEQ ID NO: 1388931 - RNA, 19 nt, Homo sapiens
ccaacauguucauuaucaa

SEQ ID NO: 1388932 - RNA, 19 nt, Homo sapiens
ucaccaguagccucuauaa

SEQ ID NO: 1388933 - RNA, 19 nt, Homo sapiens
cugccaacauguucauuau

SEQ ID NO: 1388934 - RNA, 19 nt, Homo sapiens
gcucucgcguaguuaccua

SEQ ID NO: 1388935 - RNA, 19 nt, Homo sapiens
gcagagacuccagggaaga

SEQ ID NO: 1388936 - RNA, 19 nt, Homo sapiens
gagacaggcugcgaguucu

SEQ ID NO: 1388937 - RNA, 19 nt, Homo sapiens
gcgacuuccucauguccuu

SEQ ID NO: 1388938 - RNA, 19 nt, Homo sapiens
ugauucauuucauguagug

SEQ ID NO: 1388939 - RNA, 19 nt, Homo sapiens
gccugucacuggcauagga

SEQ ID NO: 1388940 - RNA, 19 nt, Homo sapiens
ggcucucccuuucuucuga

SEQ ID NO: 1388941 - RNA, 19 nt, Homo sapiens
gcaagauggccaagaucau

SEQ ID NO: 1388942 - RNA, 19 nt, Homo sapiens
caucaucuacugcuacauc

SEQ ID NO: 1388943 - RNA, 19 nt, Homo sapiens
ucaaaacuccugccccaua

SEQ ID NO: 1388944 - RNA, 19 nt, Homo sapiens
gucagggucuggaggacuu

SEQ ID NO: 1388945 - RNA, 19 nt, Homo sapiens
caucuacugcuacaucuuc

SEQ ID NO: 1388946 - RNA, 19 nt, Homo sapiens
ccugucuucuucaccagua

SEQ ID NO: 1388947 - RNA, 19 nt, Homo sapiens
ccugccaacauguucauua

SEQ ID NO: 1388948 - RNA, 19 nt, Homo sapiens
agagaacacaccagcuauu

SEQ ID NO: 1388949 - RNA, 19 nt, Homo sapiens
acacagacccaggauuaug

SEQ ID NO: 1388950 - RNA, 19 nt, Homo sapiens
guccugacacccuacauga

SEQ ID NO: 1388951 - RNA, 19 nt, Homo sapiens
gcugggcguuuggcucuau

SEQ ID NO: 1388952 - RNA, 19 nt, Homo sapiens
guacgcacacguccugaca

SEQ ID NO: 1388953 - RNA, 19 nt, Homo sapiens
gucagcgacuuccucaugu

SEQ ID NO: 1388954 - RNA, 19 nt, Homo sapiens
gacaggguauaggaaaaua

SEQ ID NO: 1388955 - RNA, 19 nt, Homo sapiens
caacauguucauuaucaac

SEQ ID NO: 1388956 - RNA, 19 nt, Homo sapiens
gugauucauuucauguagu

SEQ ID NO: 1388957 - RNA, 19 nt, Homo sapiens
ugugauucauuucauguag

SEQ ID NO: 1388958 - RNA, 19 nt, Homo sapiens
gaaugcacaccaagcacau

SEQ ID NO: 1388959 - RNA, 19 nt, Homo sapiens
cagagaacacaccagcuau

SEQ ID NO: 1388960 - RNA, 19 nt, Homo sapiens
aaugcugugugcugcaauu

SEQ ID NO: 1388961 - RNA, 19 nt, Homo sapiens
cgucugugauucauuucau

SEQ ID NO: 1388962 - RNA, 19 nt, Homo sapiens
uuugcacgcuggaacaguu

SEQ ID NO: 1388963 - RNA, 19 nt, Homo sapiens
cacaccagcuauuuaugag

SEQ ID NO: 1388964 - RNA, 19 nt, Homo sapiens
cccacuggcucucccuuuc

SEQ ID NO: 1388965 - RNA, 19 nt, Homo sapiens
agugcaagauggccaagau

SEQ ID NO: 1388966 - RNA, 19 nt, Homo sapiens
cauuucauguaguggucua

SEQ ID NO: 1388967 - RNA, 19 nt, Homo sapiens
uccagaccaugcccacuau

SEQ ID NO: 1388968 - RNA, 19 nt, Homo sapiens
cgccaaggccucugcaauc

SEQ ID NO: 1388969 - RNA, 19 nt, Homo sapiens
acacucugcgucugugauu

SEQ ID NO: 1388970 - RNA, 19 nt, Homo sapiens
cguaguuaccuaucugaau

SEQ ID NO: 1388971 - RNA, 19 nt, Homo sapiens
acucaccuguggcuucuuc

SEQ ID NO: 1388972 - RNA, 19 nt, Homo sapiens
ccugcaggcuuuggaagug

SEQ ID NO: 1388973 - RNA, 19 nt, Homo sapiens
gccaaggccucugcaaucc

SEQ ID NO: 1388974 - RNA, 19 nt, Homo sapiens
ugcuacaucuucaucuuca

SEQ ID NO: 1388975 - RNA, 19 nt, Homo sapiens
gcacgcagcaagccauaua

SEQ ID NO: 1388976 - RNA, 19 nt, Homo sapiens
uggcggagaucaacgagua

SEQ ID NO: 1388977 - RNA, 19 nt, Homo sapiens
gaucaacgaguaccucaug

SEQ ID NO: 1388978 - RNA, 19 nt, Homo sapiens
gcaaggacaacuacuggau

SEQ ID NO: 1388979 - RNA, 19 nt, Homo sapiens
gccacaaccuuucgcucaa

SEQ ID NO: 1388980 - RNA, 19 nt, Homo sapiens
gcuugacgcuggcggagau

SEQ ID NO: 1388981 - RNA, 19 nt, Homo sapiens
gcaacuccgugcgccacaa

SEQ ID NO: 1388982 - RNA, 19 nt, Homo sapiens
gggacaagcagggcaguga

SEQ ID NO: 1388983 - RNA, 19 nt, Homo sapiens
ccacaaccuuucgcucaac

SEQ ID NO: 1388984 - RNA, 19 nt, Homo sapiens
cagcggaacuccuggcuuu

SEQ ID NO: 1388985 - RNA, 19 nt, Homo sapiens
gaacaucgaccgcaugaag

SEQ ID NO: 1388986 - RNA, 19 nt, Homo sapiens
ccaacaacauggccaagau

SEQ ID NO: 1388987 - RNA, 19 nt, Homo sapiens
gcgagacgcaugccaaaga

SEQ ID NO: 1388988 - RNA, 19 nt, Homo sapiens
caacaacauggccaagauu

SEQ ID NO: 1388989 - RNA, 19 nt, Homo sapiens
cgagacgcaugccaaagau

SEQ ID NO: 1388990 - RNA, 19 nt, Homo sapiens
agacgcaugccaaagauga

SEQ ID NO: 1388991 - RNA, 19 nt, Homo sapiens
gugaacaucgaccgcauga

SEQ ID NO: 1388992 - RNA, 19 nt, Homo sapiens
gaacauggcuggaggcaaa

SEQ ID NO: 1388993 - RNA, 19 nt, Homo sapiens
ggaaaagcauagacaauua

SEQ ID NO: 1388994 - RNA, 19 nt, Homo sapiens
cuaaggaucucaaaguaaa

SEQ ID NO: 1388995 - RNA, 19 nt, Homo sapiens
gugcugcgauucuggagua

SEQ ID NO: 1388996 - RNA, 19 nt, Homo sapiens
ggccaaggcuaaggcagua

SEQ ID NO: 1388997 - RNA, 19 nt, Homo sapiens
guucuuagacucgaaguuu

SEQ ID NO: 1388998 - RNA, 19 nt, Homo sapiens
gaguuggauucucuuauca

SEQ ID NO: 1388999 - RNA, 19 nt, Homo sapiens
guacagugcugcgauucug

SEQ ID NO: 1389000 - RNA, 19 nt, Homo sapiens
ugacaguuguguguugauu

SEQ ID NO: 1389001 - RNA, 19 nt, Homo sapiens
ggugacaguuguguguuga

SEQ ID NO: 1389002 - RNA, 19 nt, Homo sapiens
uaacugggacagaagaaau

SEQ ID NO: 1389003 - RNA, 19 nt, Homo sapiens
gagcugggcuacaguuucc

SEQ ID NO: 1389004 - RNA, 19 nt, Homo sapiens
acagagagcugggcuacag

SEQ ID NO: 1389005 - RNA, 19 nt, Homo sapiens
gugggaaggccaaggcuaa

SEQ ID NO: 1389006 - RNA, 19 nt, Homo sapiens
uucuaaggaucucaaagua

SEQ ID NO: 1389007 - RNA, 19 nt, Homo sapiens
ugcuggagcuggcagguaa

SEQ ID NO: 1389008 - RNA, 19 nt, Homo sapiens
caaaguaaagcguaucacu

SEQ ID NO: 1389009 - RNA, 19 nt, Homo sapiens
ucuaaggaucucaaaguaa

SEQ ID NO: 1389010 - RNA, 19 nt, Homo sapiens
uagacucgaaguuugauaa

SEQ ID NO: 1389011 - RNA, 19 nt, Homo sapiens
cagguaaugcuucuaagga

SEQ ID NO: 1389012 - RNA, 19 nt, Homo sapiens
gaaauaauggggauaugug

SEQ ID NO: 1389013 - RNA, 19 nt, Homo sapiens
gcaagacaagcgggcauug

SEQ ID NO: 1389014 - RNA, 19 nt, Homo sapiens
gagagcugggcuacaguuu

SEQ ID NO: 1389015 - RNA, 19 nt, Homo sapiens
cuagguuucucccgugugu

SEQ ID NO: 1389016 - RNA, 19 nt, Homo sapiens
guucgaaccagcaagacaa

SEQ ID NO: 1389017 - RNA, 19 nt, Homo sapiens
gaagaaauaauggggauau

SEQ ID NO: 1389018 - RNA, 19 nt, Homo sapiens
guuggauucucuuaucaag

SEQ ID NO: 1389019 - RNA, 19 nt, Homo sapiens
gaugaagaguuggauucuc

SEQ ID NO: 1389020 - RNA, 19 nt, Homo sapiens
ugcaauccguggugaugaa

SEQ ID NO: 1389021 - RNA, 19 nt, Homo sapiens
acaguuguguguugauugg

SEQ ID NO: 1389022 - RNA, 19 nt, Homo sapiens
uggcagguaaugcuucuaa

SEQ ID NO: 1389023 - RNA, 19 nt, Homo sapiens
guaacugggacagaagaaa

SEQ ID NO: 1389024 - RNA, 19 nt, Homo sapiens
gcuuagagggaugcuuuaa

SEQ ID NO: 1389025 - RNA, 19 nt, Homo sapiens
gugaugaagaguuggauuc

SEQ ID NO: 1389026 - RNA, 19 nt, Homo sapiens
gcagguaaugcuucuaagg

SEQ ID NO: 1389027 - RNA, 19 nt, Homo sapiens
cguguacagugcugcgauu

SEQ ID NO: 1389028 - RNA, 19 nt, Homo sapiens
cugcuuagagggaugcuuu

SEQ ID NO: 1389029 - RNA, 19 nt, Homo sapiens
guaaugcuucuaaggaucu

SEQ ID NO: 1389030 - RNA, 19 nt, Homo sapiens
ugggacagaagaaauaaug

SEQ ID NO: 1389031 - RNA, 19 nt, Homo sapiens
uuagagggaugcuuuaacc

SEQ ID NO: 1389032 - RNA, 19 nt, Homo sapiens
gagcuggcagguaaugcuu

SEQ ID NO: 1389033 - RNA, 19 nt, Homo sapiens
agagggaugcuuuaaccaa

SEQ ID NO: 1389034 - RNA, 19 nt, Homo sapiens
gacaguuguguguugauug

SEQ ID NO: 1389035 - RNA, 19 nt, Homo sapiens
ccacagacacuugaagacu

SEQ ID NO: 1389036 - RNA, 19 nt, Homo sapiens
gcuggcagguaaugcuucu

SEQ ID NO: 1389037 - RNA, 19 nt, Homo sapiens
agacucgaaguuugauaaa

SEQ ID NO: 1389038 - RNA, 19 nt, Homo sapiens
gcaguaucucgcucacaga

SEQ ID NO: 1389039 - RNA, 19 nt, Homo sapiens
ccguggugaugaagaguug

SEQ ID NO: 1389040 - RNA, 19 nt, Homo sapiens
uggugacaguuguguguug

SEQ ID NO: 1389041 - RNA, 19 nt, Homo sapiens
ugaagacucgcaccacaag

SEQ ID NO: 1389042 - RNA, 19 nt, Homo sapiens
ucccucacauccacaaauc

SEQ ID NO: 1389043 - RNA, 19 nt, Homo sapiens
cuucuaaggaucucaaagu

SEQ ID NO: 1389044 - RNA, 19 nt, Homo sapiens
gaacauggcuggaggcaaa

SEQ ID NO: 1389045 - RNA, 19 nt, Homo sapiens
guaauuacaugaacccuua

SEQ ID NO: 1389046 - RNA, 19 nt, Homo sapiens
gacauuugcuucucagaua

SEQ ID NO: 1389047 - RNA, 19 nt, Homo sapiens
gagcuaaccuccacagaug

SEQ ID NO: 1389048 - RNA, 19 nt, Homo sapiens
guaccaaggucguuaagaa

SEQ ID NO: 1389049 - RNA, 19 nt, Homo sapiens
gguaauaugugaacuaaca

SEQ ID NO: 1389050 - RNA, 19 nt, Homo sapiens
gaaaucagaaugaacguuu

SEQ ID NO: 1389051 - RNA, 19 nt, Homo sapiens
ggagucagauucaaaggaa

SEQ ID NO: 1389052 - RNA, 19 nt, Homo sapiens
aaacagcucucuauacuca

SEQ ID NO: 1389053 - RNA, 19 nt, Homo sapiens
acaauuagcucuauucauc

SEQ ID NO: 1389054 - RNA, 19 nt, Homo sapiens
gaaguagaccuuugacauu

SEQ ID NO: 1389055 - RNA, 19 nt, Homo sapiens
cuaaggaucucaaaguaaa

SEQ ID NO: 1389056 - RNA, 19 nt, Homo sapiens
cagagcagcuuugauuuaa

SEQ ID NO: 1389057 - RNA, 19 nt, Homo sapiens
ccaaggaacugcccgaaug

SEQ ID NO: 1389058 - RNA, 19 nt, Homo sapiens
cgaaugugcugaacaagga

SEQ ID NO: 1389059 - RNA, 19 nt, Homo sapiens
ugaauaucaucucugguua

SEQ ID NO: 1389060 - RNA, 19 nt, Homo sapiens
ucagauacgugaauucaau

SEQ ID NO: 1389061 - RNA, 19 nt, Homo sapiens
ugaaugagaacacauguaa

SEQ ID NO: 1389062 - RNA, 19 nt, Homo sapiens
ccaaguagcugggauuaca

SEQ ID NO: 1389063 - RNA, 19 nt, Homo sapiens
gauuaguucuuuggcaaua

SEQ ID NO: 1389064 - RNA, 19 nt, Homo sapiens
ggugauaguuggagaguca

SEQ ID NO: 1389065 - RNA, 19 nt, Homo sapiens
gaacacauguaagacacuu

SEQ ID NO: 1389066 - RNA, 19 nt, Homo sapiens
ccagugagcuuggaagaga

SEQ ID NO: 1389067 - RNA, 19 nt, Homo sapiens
gaagcccaguuaagacaaa

SEQ ID NO: 1389068 - RNA, 19 nt, Homo sapiens
caaauuaugcaccuagaaa

SEQ ID NO: 1389069 - RNA, 19 nt, Homo sapiens
uaggagugccugacaauua

SEQ ID NO: 1389070 - RNA, 19 nt, Homo sapiens
agaagaugccauuguauua

SEQ ID NO: 1389071 - RNA, 19 nt, Homo sapiens
ucagagcagcuuugauuua

SEQ ID NO: 1389072 - RNA, 19 nt, Homo sapiens
gugcugcgauucuggagua

SEQ ID NO: 1389073 - RNA, 19 nt, Homo sapiens
uuacuuugcugagaagaua

SEQ ID NO: 1389074 - RNA, 19 nt, Homo sapiens
acagccauauguauuguua

SEQ ID NO: 1389075 - RNA, 19 nt, Homo sapiens
ggaaguaccaaggucguua

SEQ ID NO: 1389076 - RNA, 19 nt, Homo sapiens
gaguugggcuuuguaauuc

SEQ ID NO: 1389077 - RNA, 19 nt, Homo sapiens
gaagaucaucccauuccua

SEQ ID NO: 1389078 - RNA, 19 nt, Homo sapiens
ucucuauacucaauccuua

SEQ ID NO: 1389079 - RNA, 19 nt, Homo sapiens
acaaacagcucucuauacu

SEQ ID NO: 1389080 - RNA, 19 nt, Homo sapiens
gaauaucaucucugguuaa

SEQ ID NO: 1389081 - RNA, 19 nt, Homo sapiens
uaccagagguucagugaga

SEQ ID NO: 1389082 - RNA, 19 nt, Homo sapiens
aaaugaggcugguuucuuc

SEQ ID NO: 1389083 - RNA, 19 nt, Homo sapiens
cacccuagauucaaauuau

SEQ ID NO: 1389084 - RNA, 19 nt, Homo sapiens
gaugagaagcuuggccuua

SEQ ID NO: 1389085 - RNA, 19 nt, Homo sapiens
guuauaggccuuugaaaug

SEQ ID NO: 1389086 - RNA, 19 nt, Homo sapiens
guuuaaagccacuaaguuu

SEQ ID NO: 1389087 - RNA, 19 nt, Homo sapiens
gugaaaggguuauaguuag

SEQ ID NO: 1389088 - RNA, 19 nt, Homo sapiens
guaccuaccucacucugau

SEQ ID NO: 1389089 - RNA, 19 nt, Homo sapiens
uaauagagucucauucuug

SEQ ID NO: 1389090 - RNA, 19 nt, Homo sapiens
aaauaggccuuuccacaau

SEQ ID NO: 1389091 - RNA, 19 nt, Homo sapiens
uaagcacccuagauucaaa

SEQ ID NO: 1389092 - RNA, 19 nt, Homo sapiens
gcuguaagcacccuagauu

SEQ ID NO: 1389093 - RNA, 19 nt, Homo sapiens
gaaguaccaaggucguuaa

SEQ ID NO: 1389094 - RNA, 19 nt, Homo sapiens
ccagaccagucacuuagaa

SEQ ID NO: 1389095 - RNA, 19 nt, Homo sapiens
cagcauuucuuaaggugaa

SEQ ID NO: 1389096 - RNA, 19 nt, Homo sapiens
aaguagaccuuugacauuu

SEQ ID NO: 1389097 - RNA, 19 nt, Homo sapiens
ccaaggucguuaagaauca

SEQ ID NO: 1389098 - RNA, 19 nt, Homo sapiens
ggccaaggcuaaggcagua

SEQ ID NO: 1389099 - RNA, 19 nt, Homo sapiens
gggguaaccugaaauguuu

SEQ ID NO: 1389100 - RNA, 19 nt, Homo sapiens
agacaaacagcucucuaua

SEQ ID NO: 1389101 - RNA, 19 nt, Homo sapiens
agugaaaggguuauaguua

SEQ ID NO: 1389102 - RNA, 19 nt, Homo sapiens
gcccgaaugugcugaacaa

SEQ ID NO: 1389103 - RNA, 19 nt, Homo sapiens
gaagaugccauuguauuag

SEQ ID NO: 1389104 - RNA, 19 nt, Homo sapiens
cagaagaugccauuguauu

SEQ ID NO: 1389105 - RNA, 19 nt, Homo sapiens
gaucagaagaugccauugu

SEQ ID NO: 1389106 - RNA, 19 nt, Homo sapiens
gugaauaucaucucugguu

SEQ ID NO: 1389107 - RNA, 19 nt, Homo sapiens
gaacguuucgccugccaaa

SEQ ID NO: 1389108 - RNA, 19 nt, Homo sapiens
acuaauugcugguaauaug

SEQ ID NO: 1389109 - RNA, 19 nt, Homo sapiens
uaaaguggcgaugauagua

SEQ ID NO: 1389110 - RNA, 19 nt, Homo sapiens
caaggacauuugcuucuca

SEQ ID NO: 1389111 - RNA, 19 nt, Homo sapiens
cuauucaucuugucuccua

SEQ ID NO: 1389112 - RNA, 19 nt, Homo sapiens
gugguaauuuguuggcuuu

SEQ ID NO: 1389113 - RNA, 19 nt, Homo sapiens
cuaaguuugugguaauuug

SEQ ID NO: 1389114 - RNA, 19 nt, Homo sapiens
gcacccuagauucaaauua

SEQ ID NO: 1389115 - RNA, 19 nt, Homo sapiens
agacacagccauauguauu

SEQ ID NO: 1389116 - RNA, 19 nt, Homo sapiens
gagaacaugggcaggguaa

SEQ ID NO: 1389117 - RNA, 19 nt, Homo sapiens
agagagcaguggagaguug

SEQ ID NO: 1389118 - RNA, 19 nt, Homo sapiens
uaaauuugcugugcuaugc

SEQ ID NO: 1389119 - RNA, 19 nt, Homo sapiens
gaaaucaagagaaggaagu

SEQ ID NO: 1389120 - RNA, 19 nt, Homo sapiens
caaccagcauuucuuaagg

SEQ ID NO: 1389121 - RNA, 19 nt, Homo sapiens
ggagaguugggcuuuguaa

SEQ ID NO: 1389122 - RNA, 19 nt, Homo sapiens
cacaaucuucuaccaguua

SEQ ID NO: 1389123 - RNA, 19 nt, Homo sapiens
ccacaaucuucuaccaguu

SEQ ID NO: 1389124 - RNA, 19 nt, Homo sapiens
cuucagagcagcuuugauu

SEQ ID NO: 1389125 - RNA, 19 nt, Homo sapiens
uaacaucucaacacuggaa

SEQ ID NO: 1389126 - RNA, 19 nt, Homo sapiens
guagaccuuugacauuuca

SEQ ID NO: 1389127 - RNA, 19 nt, Homo sapiens
guugagaaguagaccuuug

SEQ ID NO: 1389128 - RNA, 19 nt, Homo sapiens
guacagugcugcgauucug

SEQ ID NO: 1389129 - RNA, 19 nt, Homo sapiens
cgucuaagccuuccaaagu

SEQ ID NO: 1389130 - RNA, 19 nt, Homo sapiens
caccaugcccagcuaauuu

SEQ ID NO: 1389131 - RNA, 19 nt, Homo sapiens
ugaaaggguuauaguuagu

SEQ ID NO: 1389132 - RNA, 19 nt, Homo sapiens
gguccacacuaccauccua

SEQ ID NO: 1389133 - RNA, 19 nt, Homo sapiens
gaguuggauucucuuauca

SEQ ID NO: 1389134 - RNA, 19 nt, Homo sapiens
gccucugucuucauccuua

SEQ ID NO: 1389135 - RNA, 19 nt, Homo sapiens
gaggacagaguacugcaaa

SEQ ID NO: 1389136 - RNA, 19 nt, Homo sapiens
agucaggaauaccauguaa

SEQ ID NO: 1389137 - RNA, 19 nt, Homo sapiens
ccacagaugcugauagucu

SEQ ID NO: 1389138 - RNA, 19 nt, Homo sapiens
agaguugggcuuuguaauu

SEQ ID NO: 1389139 - RNA, 19 nt, Homo sapiens
aauagagucucauucuugu

SEQ ID NO: 1389140 - RNA, 19 nt, Homo sapiens
uguaacauguugaaguaga

SEQ ID NO: 1389141 - RNA, 19 nt, Homo sapiens
aaugagaacacauguaaga

SEQ ID NO: 1389142 - RNA, 19 nt, Homo sapiens
agauuuauggcuuguguua

SEQ ID NO: 1389143 - RNA, 19 nt, Homo sapiens
ggacuuugcagauguaacu

SEQ ID NO: 1389144 - RNA, 19 nt, Homo sapiens
gcaauaaacuggaggagaa

SEQ ID NO: 1389145 - RNA, 19 nt, Homo sapiens
gaacacaggaggguaaaua

SEQ ID NO: 1389146 - RNA, 19 nt, Homo sapiens
ugaagaagcugaacuccaa

SEQ ID NO: 1389147 - RNA, 19 nt, Homo sapiens
gcugauuccugaacucaua

SEQ ID NO: 1389148 - RNA, 19 nt, Homo sapiens
gggagucacuugaugcuuu

SEQ ID NO: 1389149 - RNA, 19 nt, Homo sapiens
ggaaguauaauuagaguga

SEQ ID NO: 1389150 - RNA, 19 nt, Homo sapiens
gaagagaagcauuuagaga

SEQ ID NO: 1389151 - RNA, 19 nt, Homo sapiens
agaagaaucuguaagaauc

SEQ ID NO: 1389152 - RNA, 19 nt, Homo sapiens
gaugaaggaugaacaacau

SEQ ID NO: 1389153 - RNA, 19 nt, Homo sapiens
uuagagagcaucagcaaua

SEQ ID NO: 1389154 - RNA, 19 nt, Homo sapiens
gagaaaauauugacuccua

SEQ ID NO: 1389155 - RNA, 19 nt, Homo sapiens
ucuggaggcuguuggaaua

SEQ ID NO: 1389156 - RNA, 19 nt, Homo sapiens
ugagcaaacugaacacaga

SEQ ID NO: 1389157 - RNA, 19 nt, Homo sapiens
gagaagaaucuguaagaau

SEQ ID NO: 1389158 - RNA, 19 nt, Homo sapiens
ggaggcuguuggaauauga

SEQ ID NO: 1389159 - RNA, 19 nt, Homo sapiens
caagaaggaagcugaagaa

SEQ ID NO: 1389160 - RNA, 19 nt, Homo sapiens
agaagugccugucaaagug

SEQ ID NO: 1389161 - RNA, 19 nt, Homo sapiens
cuugauagcaccaaauaua

SEQ ID NO: 1389162 - RNA, 19 nt, Homo sapiens
gaugcaaucuaaauacaag

SEQ ID NO: 1389163 - RNA, 19 nt, Homo sapiens
gcagcaagagcaagaaaga

SEQ ID NO: 1389164 - RNA, 19 nt, Homo sapiens
cuacaggcuugucuuucua

SEQ ID NO: 1389165 - RNA, 19 nt, Homo sapiens
gcuacaggcuugucuuucu

SEQ ID NO: 1389166 - RNA, 19 nt, Homo sapiens
gguggaagccagucagaaa

SEQ ID NO: 1389167 - RNA, 19 nt, Homo sapiens
aauauaaaccggagaaaug

SEQ ID NO: 1389168 - RNA, 19 nt, Homo sapiens
gugaauuacuggaacugaa

SEQ ID NO: 1389169 - RNA, 19 nt, Homo sapiens
ggagaaaugagauacaaag

SEQ ID NO: 1389170 - RNA, 19 nt, Homo sapiens
ggagucacuugaugcuuuc

SEQ ID NO: 1389171 - RNA, 19 nt, Homo sapiens
gagagcaucagcaauacaa

SEQ ID NO: 1389172 - RNA, 19 nt, Homo sapiens
uagaagagaagcauuuaga

SEQ ID NO: 1389173 - RNA, 19 nt, Homo sapiens
gguaacagcugggguauau

SEQ ID NO: 1389174 - RNA, 19 nt, Homo sapiens
gagagaagagcaauaaacu

SEQ ID NO: 1389175 - RNA, 19 nt, Homo sapiens
agagagagaagagcaauaa

SEQ ID NO: 1389176 - RNA, 19 nt, Homo sapiens
caacugcccacacacuuga

SEQ ID NO: 1389177 - RNA, 19 nt, Homo sapiens
cgaaaagccucaugagaug

SEQ ID NO: 1389178 - RNA, 19 nt, Homo sapiens
caaaaccgcugaguucuug

SEQ ID NO: 1389179 - RNA, 19 nt, Homo sapiens
gaagaaucuguaagaauca

SEQ ID NO: 1389180 - RNA, 19 nt, Homo sapiens
agagaagaaucuguaagaa

SEQ ID NO: 1389181 - RNA, 19 nt, Homo sapiens
gagaaaugagauacaaaga

SEQ ID NO: 1389182 - RNA, 19 nt, Homo sapiens
ccaaauauaaaccggagaa

SEQ ID NO: 1389183 - RNA, 19 nt, Homo sapiens
ccucauuuaugcauguuug

SEQ ID NO: 1389184 - RNA, 19 nt, Homo sapiens
aagagaagaaucuguaaga

SEQ ID NO: 1389185 - RNA, 19 nt, Homo sapiens
aggcuugucuuucuaagug

SEQ ID NO: 1389186 - RNA, 19 nt, Homo sapiens
acuugaugcuuucagguua

SEQ ID NO: 1389187 - RNA, 19 nt, Homo sapiens
gugacuggcuucuccuugu

SEQ ID NO: 1389188 - RNA, 19 nt, Homo sapiens
ugaauuacuggaacugaaa

SEQ ID NO: 1389189 - RNA, 19 nt, Homo sapiens
cagaagugccugucaaagu

SEQ ID NO: 1389190 - RNA, 19 nt, Homo sapiens
ccgcugaguucuugagcaa

SEQ ID NO: 1389191 - RNA, 19 nt, Homo sapiens
ggaccgacuccaaggcaaa

SEQ ID NO: 1389192 - RNA, 19 nt, Homo sapiens
gaggguaaauaaugcuuuu

SEQ ID NO: 1389193 - RNA, 19 nt, Homo sapiens
caugaacacccgcaauaga

SEQ ID NO: 1389194 - RNA, 19 nt, Homo sapiens
ccggagaaaugagauacaa

SEQ ID NO: 1389195 - RNA, 19 nt, Homo sapiens
cacaggaggguaaauaaug

SEQ ID NO: 1389196 - RNA, 19 nt, Homo sapiens
ugaaacggcagcagcaaga

SEQ ID NO: 1389197 - RNA, 19 nt, Homo sapiens
gagcaaacugaacacagaa

SEQ ID NO: 1389198 - RNA, 19 nt, Homo sapiens
gaagaagcugaacuccaaa

SEQ ID NO: 1389199 - RNA, 19 nt, Homo sapiens
gaagucagacagaaacaac

SEQ ID NO: 1389200 - RNA, 19 nt, Homo sapiens
gagcagaacagagcuaaac

SEQ ID NO: 1389201 - RNA, 19 nt, Homo sapiens
ggaggguaaauaaugcuuu

SEQ ID NO: 1389202 - RNA, 19 nt, Homo sapiens
gagagagaagagcaauaaa

SEQ ID NO: 1389203 - RNA, 19 nt, Homo sapiens
uggccaaccuggagaagug

SEQ ID NO: 1389204 - RNA, 19 nt, Homo sapiens
gcuguuggaauaugaauag

SEQ ID NO: 1389205 - RNA, 19 nt, Homo sapiens
gcugaguucuugagcaaac

SEQ ID NO: 1389206 - RNA, 19 nt, Homo sapiens
cagcugaugcaaucuaaau

SEQ ID NO: 1389207 - RNA, 19 nt, Homo sapiens
cuaauucucagaucagguu

SEQ ID NO: 1389208 - RNA, 19 nt, Homo sapiens
uaucuggccuucaucaacu

SEQ ID NO: 1389209 - RNA, 19 nt, Homo sapiens
gaagaaaacagaaaauugc

SEQ ID NO: 1389210 - RNA, 19 nt, Homo sapiens
gcaaacugaacacagaauc

SEQ ID NO: 1389211 - RNA, 19 nt, Homo sapiens
ucaagaaggaagcugaaga

SEQ ID NO: 1389212 - RNA, 19 nt, Homo sapiens
aagagggagucacuugaug

SEQ ID NO: 1389213 - RNA, 19 nt, Homo sapiens
cagguggccucgagcaauc

SEQ ID NO: 1389214 - RNA, 19 nt, Homo sapiens
aaagaugaaggaugaacaa

SEQ ID NO: 1389215 - RNA, 19 nt, Homo sapiens
gcaauucagagagagaaga

SEQ ID NO: 1389216 - RNA, 19 nt, Homo sapiens
gaaucuguaagaaucaaga

SEQ ID NO: 1389217 - RNA, 19 nt, Homo sapiens
ugcaaaagaugaaggauga

SEQ ID NO: 1389218 - RNA, 19 nt, Homo sapiens
cagaaucgccagacagaag

SEQ ID NO: 1389219 - RNA, 19 nt, Homo sapiens
caagaaaaccuuagaagag

SEQ ID NO: 1389220 - RNA, 19 nt, Homo sapiens
gauagcaccaaauauaaac

SEQ ID NO: 1389221 - RNA, 19 nt, Homo sapiens
cuugaugcuuucagguuaa

SEQ ID NO: 1389222 - RNA, 19 nt, Homo sapiens
uaauuagagugauguuggu

SEQ ID NO: 1389223 - RNA, 19 nt, Homo sapiens
aaagagugaauuacuggaa

SEQ ID NO: 1389224 - RNA, 19 nt, Homo sapiens
gaucagguuuugaaagcuu

SEQ ID NO: 1389225 - RNA, 19 nt, Homo sapiens
ucaaaagagugaauuacug

SEQ ID NO: 1389226 - RNA, 19 nt, Homo sapiens
ccuuagaagagaagcauuu

SEQ ID NO: 1389227 - RNA, 19 nt, Homo sapiens
gugcuacaggcuugucuuu

SEQ ID NO: 1389228 - RNA, 19 nt, Homo sapiens
gagcugauuccugaacuca

SEQ ID NO: 1389229 - RNA, 19 nt, Homo sapiens
cacagaaucgccagacaga

SEQ ID NO: 1389230 - RNA, 19 nt, Homo sapiens
aacaacaacuccagcugau

SEQ ID NO: 1389231 - RNA, 19 nt, Homo sapiens
aagaaaaccuuagaagaga

SEQ ID NO: 1389232 - RNA, 19 nt, Homo sapiens
cagagagagaagagcaaua

SEQ ID NO: 1389233 - RNA, 19 nt, Homo sapiens
ggagcugauuccugaacuc

SEQ ID NO: 1389234 - RNA, 19 nt, Homo sapiens
acaggaggguaaauaaugc

SEQ ID NO: 1389235 - RNA, 19 nt, Homo sapiens
cuuagaagagaagcauuua

SEQ ID NO: 1389236 - RNA, 19 nt, Homo sapiens
caauaaacuggaggagaaa

SEQ ID NO: 1389237 - RNA, 19 nt, Homo sapiens
cugaugcaaucuaaauaca

SEQ ID NO: 1389238 - RNA, 19 nt, Homo sapiens
gcugaugcaaucuaaauac

SEQ ID NO: 1389239 - RNA, 19 nt, Homo sapiens
caaauauaaaccggagaaa

SEQ ID NO: 1389240 - RNA, 19 nt, Homo sapiens
aaaccggagaaaugagaua

SEQ ID NO: 1389241 - RNA, 19 nt, Homo sapiens
gaugcuuucagguuaauca

SEQ ID NO: 1389242 - RNA, 19 nt, Homo sapiens
aaagagggagucacuugau

SEQ ID NO: 1389243 - RNA, 19 nt, Homo sapiens
uccagcugaugcaaucuaa

SEQ ID NO: 1389244 - RNA, 19 nt, Homo sapiens
gcagaaagaugcaaaguga

SEQ ID NO: 1389245 - RNA, 19 nt, Homo sapiens
gaaagaagaugaugaaugg

SEQ ID NO: 1389246 - RNA, 19 nt, Homo sapiens
gcucuaaacuguuaacaua

SEQ ID NO: 1389247 - RNA, 19 nt, Homo sapiens
gaggagagcugguuuauca

SEQ ID NO: 1389248 - RNA, 19 nt, Homo sapiens
gaacgauguugaccuguua

SEQ ID NO: 1389249 - RNA, 19 nt, Homo sapiens
gaauaggcaucuuucauuu

SEQ ID NO: 1389250 - RNA, 19 nt, Homo sapiens
gagauaggcuuuauauuuc

SEQ ID NO: 1389251 - RNA, 19 nt, Homo sapiens
guucauagauggucaguuu

SEQ ID NO: 1389252 - RNA, 19 nt, Homo sapiens
guacaucaaucuaugcaua

SEQ ID NO: 1389253 - RNA, 19 nt, Homo sapiens
acaaugcgcuuuagacaua

SEQ ID NO: 1389254 - RNA, 19 nt, Homo sapiens
gcagagggauuaaauuaga

SEQ ID NO: 1389255 - RNA, 19 nt, Homo sapiens
gaaauggcaucccuaucua

SEQ ID NO: 1389256 - RNA, 19 nt, Homo sapiens
cauaaugccuugccuuuaa

SEQ ID NO: 1389257 - RNA, 19 nt, Homo sapiens
ggaaacaaguccuauggaa

SEQ ID NO: 1389258 - RNA, 19 nt, Homo sapiens
guacacagacugaacaaua

SEQ ID NO: 1389259 - RNA, 19 nt, Homo sapiens
gaaugucucuuuagaacaa

SEQ ID NO: 1389260 - RNA, 19 nt, Homo sapiens
uuacauaccuucucuguug

SEQ ID NO: 1389261 - RNA, 19 nt, Homo sapiens
gcauuuauaugguugauug

SEQ ID NO: 1389262 - RNA, 19 nt, Homo sapiens
gaaauaagaccucucugaa

SEQ ID NO: 1389263 - RNA, 19 nt, Homo sapiens
ggccaagucuguaaaguuu

SEQ ID NO: 1389264 - RNA, 19 nt, Homo sapiens
ggacaucagugaagaguca

SEQ ID NO: 1389265 - RNA, 19 nt, Homo sapiens
aauaagaccucucugaauu

SEQ ID NO: 1389266 - RNA, 19 nt, Homo sapiens
ucagguacauuaagcuuua

SEQ ID NO: 1389267 - RNA, 19 nt, Homo sapiens
gaaccagaauucaaugaga

SEQ ID NO: 1389268 - RNA, 19 nt, Homo sapiens
gauaaucucucuguauaug

SEQ ID NO: 1389269 - RNA, 19 nt, Homo sapiens
gauaaccaaucacauaguu

SEQ ID NO: 1389270 - RNA, 19 nt, Homo sapiens
gcagggagcuuuuaagaaa

SEQ ID NO: 1389271 - RNA, 19 nt, Homo sapiens
agacauuucuucccaagua

SEQ ID NO: 1389272 - RNA, 19 nt, Homo sapiens
ggcagcauauucauuguua

SEQ ID NO: 1389273 - RNA, 19 nt, Homo sapiens
gcaaugcauuuauaugguu

SEQ ID NO: 1389274 - RNA, 19 nt, Homo sapiens
gaacugaaccuuguaggaa

SEQ ID NO: 1389275 - RNA, 19 nt, Homo sapiens
guuaguaccucacaagcua

SEQ ID NO: 1389276 - RNA, 19 nt, Homo sapiens
caaugacucuucuugcuuu

SEQ ID NO: 1389277 - RNA, 19 nt, Homo sapiens
gauaagauaguuuccauga

SEQ ID NO: 1389278 - RNA, 19 nt, Homo sapiens
gaaugaguuucuuagcuuu

SEQ ID NO: 1389279 - RNA, 19 nt, Homo sapiens
gauguugaccuguuaagua

SEQ ID NO: 1389280 - RNA, 19 nt, Homo sapiens
gugcagagggauuaaauua

SEQ ID NO: 1389281 - RNA, 19 nt, Homo sapiens
uggcaucccuaucuacuua

SEQ ID NO: 1389282 - RNA, 19 nt, Homo sapiens
agaccucucugaauuagua

SEQ ID NO: 1389283 - RNA, 19 nt, Homo sapiens
gaaacaaguccuauggaaa

SEQ ID NO: 1389284 - RNA, 19 nt, Homo sapiens
cauagaauguuacuuggaa

SEQ ID NO: 1389285 - RNA, 19 nt, Homo sapiens
uaagauaguuuccaugaag

SEQ ID NO: 1389286 - RNA, 19 nt, Homo sapiens
gaacagauuuguguauaac

SEQ ID NO: 1389287 - RNA, 19 nt, Homo sapiens
ggagaaagagguacuggaa

SEQ ID NO: 1389288 - RNA, 19 nt, Homo sapiens
gcccauaaauacugguuaa

SEQ ID NO: 1389289 - RNA, 19 nt, Homo sapiens
uaguagcucuaaacuguua

SEQ ID NO: 1389290 - RNA, 19 nt, Homo sapiens
caaagugaguuagaaguug

SEQ ID NO: 1389291 - RNA, 19 nt, Homo sapiens
cauccacucugacugauuu

SEQ ID NO: 1389292 - RNA, 19 nt, Homo sapiens
aauuagaccugugagauua

SEQ ID NO: 1389293 - RNA, 19 nt, Homo sapiens
cagcuuaaguggacaaugu

SEQ ID NO: 1389294 - RNA, 19 nt, Homo sapiens
gagauaagauaguuuccau

SEQ ID NO: 1389295 - RNA, 19 nt, Homo sapiens
gacagccucuuaacagaaa

SEQ ID NO: 1389296 - RNA, 19 nt, Homo sapiens
gaagaguauuguagacugu

SEQ ID NO: 1389297 - RNA, 19 nt, Homo sapiens
ugaaugaguuucuuagcuu

SEQ ID NO: 1389298 - RNA, 19 nt, Homo sapiens
gaaguucagccaugagauu

SEQ ID NO: 1389299 - RNA, 19 nt, Homo sapiens
ccgugggacugaugaauua

SEQ ID NO: 1389300 - RNA, 19 nt, Homo sapiens
gugagaagacaguuuauuu

SEQ ID NO: 1389301 - RNA, 19 nt, Homo sapiens
cgucaaauguguagugaga

SEQ ID NO: 1389302 - RNA, 19 nt, Homo sapiens
gaaaauuagccauccauua

SEQ ID NO: 1389303 - RNA, 19 nt, Homo sapiens
gcauguaaguuguuaguac

SEQ ID NO: 1389304 - RNA, 19 nt, Homo sapiens
gaccaguacuugauaaucu

SEQ ID NO: 1389305 - RNA, 19 nt, Homo sapiens
gccagaaugucucuuuaga

SEQ ID NO: 1389306 - RNA, 19 nt, Homo sapiens
cagcauauccuuaagugaa

SEQ ID NO: 1389307 - RNA, 19 nt, Homo sapiens
ggaauuauggcuggacuuu

SEQ ID NO: 1389308 - RNA, 19 nt, Homo sapiens
ggucagcuguacacuuuau

SEQ ID NO: 1389309 - RNA, 19 nt, Homo sapiens
cuuguugacuucauagaua

SEQ ID NO: 1389310 - RNA, 19 nt, Homo sapiens
gcugauauauuagaaaugg

SEQ ID NO: 1389311 - RNA, 19 nt, Homo sapiens
ugagugagaagacaguuua

SEQ ID NO: 1389312 - RNA, 19 nt, Homo sapiens
ggaauaucauacugugguu

SEQ ID NO: 1389313 - RNA, 19 nt, Homo sapiens
gcugagccauccacucuga

SEQ ID NO: 1389314 - RNA, 19 nt, Homo sapiens
gucuguaacuaacccauua

SEQ ID NO: 1389315 - RNA, 19 nt, Homo sapiens
ugagcacccuucagucuuu

SEQ ID NO: 1389316 - RNA, 19 nt, Homo sapiens
gagguuagauguguguuuc

SEQ ID NO: 1389317 - RNA, 19 nt, Homo sapiens
ucucugaguuggaaacaaa

SEQ ID NO: 1389318 - RNA, 19 nt, Homo sapiens
cagaaugucucuuuagaac

SEQ ID NO: 1389319 - RNA, 19 nt, Homo sapiens
acauuaagcuuuagugaag

SEQ ID NO: 1389320 - RNA, 19 nt, Homo sapiens
caaccaagaaccagaauuc

SEQ ID NO: 1389321 - RNA, 19 nt, Homo sapiens
ccagagauuuugaacuuua

SEQ ID NO: 1389322 - RNA, 19 nt, Homo sapiens
ucaaauguguagugagaug

SEQ ID NO: 1389323 - RNA, 19 nt, Homo sapiens
caaagcaauucuacugaca

SEQ ID NO: 1389324 - RNA, 19 nt, Homo sapiens
gaaguggagcuguucagaa

SEQ ID NO: 1389325 - RNA, 19 nt, Homo sapiens
ggugauaguugccauggau

SEQ ID NO: 1389326 - RNA, 19 nt, Homo sapiens
gaacaacccaagagcuuuc

SEQ ID NO: 1389327 - RNA, 19 nt, Homo sapiens
uuacauagcccaaguaguc

SEQ ID NO: 1389328 - RNA, 19 nt, Homo sapiens
uaaaagacauccagccaaa

SEQ ID NO: 1389329 - RNA, 19 nt, Homo sapiens
gugccagaaugucucuuua

SEQ ID NO: 1389330 - RNA, 19 nt, Homo sapiens
gugaugaagugccagaaug

SEQ ID NO: 1389331 - RNA, 19 nt, Homo sapiens
gaaaagcagcauauccuua

SEQ ID NO: 1389332 - RNA, 19 nt, Homo sapiens
ccucugaaguaaacauauu

SEQ ID NO: 1389333 - RNA, 19 nt, Homo sapiens
uaaccacucuggccucugu

SEQ ID NO: 1389334 - RNA, 19 nt, Homo sapiens
gugaaaauguugucucuuu

SEQ ID NO: 1389335 - RNA, 19 nt, Homo sapiens
gguuugugcuuacauguau

SEQ ID NO: 1389336 - RNA, 19 nt, Homo sapiens
ucugaaaucuguauaguac

SEQ ID NO: 1389337 - RNA, 19 nt, Homo sapiens
uaccuucucuguuguauca

SEQ ID NO: 1389338 - RNA, 19 nt, Homo sapiens
aagagugcaugcaguaauu

SEQ ID NO: 1389339 - RNA, 19 nt, Homo sapiens
gaagagugcaugcaguaau

SEQ ID NO: 1389340 - RNA, 19 nt, Homo sapiens
ugccuugccuuuaacauuu

SEQ ID NO: 1389341 - RNA, 19 nt, Homo sapiens
ccaagaaccagaauucaau

SEQ ID NO: 1389342 - RNA, 19 nt, Homo sapiens
guacaugugccuucuuaau

SEQ ID NO: 1389343 - RNA, 19 nt, Homo sapiens
uaccagaguugggagauaa

SEQ ID NO: 1389344 - RNA, 19 nt, Homo sapiens
ccagcuugcuuguguauaa

SEQ ID NO: 1389345 - RNA, 19 nt, Homo sapiens
ggaaaccugucgaggacuu

SEQ ID NO: 1389346 - RNA, 19 nt, Homo sapiens
gcgcgucaccgucaaguau

SEQ ID NO: 1389347 - RNA, 19 nt, Homo sapiens
ccgcccagcuugcuugugu

SEQ ID NO: 1389348 - RNA, 19 nt, Homo sapiens
gcgucaccgucaaguauga

SEQ ID NO: 1389349 - RNA, 19 nt, Homo sapiens
ggaguuagagagugaagag

SEQ ID NO: 1389350 - RNA, 19 nt, Homo sapiens
agacaugcccgaugagauc

SEQ ID NO: 1389351 - RNA, 19 nt, Homo sapiens
gcagacaugcccgaugaga

SEQ ID NO: 1389352 - RNA, 19 nt, Homo sapiens
gaagucaugugggaaaccu

SEQ ID NO: 1389353 - RNA, 19 nt, Homo sapiens
gaugaauuguuggaguuag

SEQ ID NO: 1389354 - RNA, 19 nt, Homo sapiens
uugaugaauuguuggaguu

SEQ ID NO: 1389355 - RNA, 19 nt, Homo sapiens
gaggagagaagccggaaaa

SEQ ID NO: 1389356 - RNA, 19 nt, Homo sapiens
ggcuggacguggagaagug

SEQ ID NO: 1389357 - RNA, 19 nt, Homo sapiens
gcuugcuuguguauaaguu

SEQ ID NO: 1389358 - RNA, 19 nt, Homo sapiens
uguuggaguuagagaguga

SEQ ID NO: 1389359 - RNA, 19 nt, Homo sapiens
ugaugaauuguuggaguua

SEQ ID NO: 1389360 - RNA, 19 nt, Homo sapiens
gcuuguguauaaguuguau

SEQ ID NO: 1389361 - RNA, 19 nt, Homo sapiens
ccugaagucaugugggaaa

SEQ ID NO: 1389362 - RNA, 19 nt, Homo sapiens
gagagaagccggaaaaucc

SEQ ID NO: 1389363 - RNA, 19 nt, Homo sapiens
gaaagaagguuugcaguau

SEQ ID NO: 1389364 - RNA, 19 nt, Homo sapiens
ucacaaagaugaagacuug

SEQ ID NO: 1389365 - RNA, 19 nt, Homo sapiens
ggcaagagcuaaauuuauu

SEQ ID NO: 1389366 - RNA, 19 nt, Homo sapiens
guaauggacuuguauaugu

SEQ ID NO: 1389367 - RNA, 19 nt, Homo sapiens
ucaaaugucugucaacuga

SEQ ID NO: 1389368 - RNA, 19 nt, Homo sapiens
gaugaagacuuguggauau

SEQ ID NO: 1389369 - RNA, 19 nt, Homo sapiens
gaaauucuggagcuuauua

SEQ ID NO: 1389370 - RNA, 19 nt, Homo sapiens
gcaaauagcccaacugaag

SEQ ID NO: 1389371 - RNA, 19 nt, Homo sapiens
caacaugauugaaccuuaa

SEQ ID NO: 1389372 - RNA, 19 nt, Homo sapiens
gaagaaacagcaaaucaaa

SEQ ID NO: 1389373 - RNA, 19 nt, Homo sapiens
caacaugauugaacccuaa

SEQ ID NO: 1389374 - RNA, 19 nt, Homo sapiens
gaauauuacucagcaauga

SEQ ID NO: 1389375 - RNA, 19 nt, Homo sapiens
gaaaauauauguccacaga

SEQ ID NO: 1389376 - RNA, 19 nt, Homo sapiens
gaauaggcauuucugcaaa

SEQ ID NO: 1389377 - RNA, 19 nt, Homo sapiens
gaaacuaaaggucauguaa

SEQ ID NO: 1389378 - RNA, 19 nt, Homo sapiens
ggaaaggaaugguuuacau

SEQ ID NO: 1389379 - RNA, 19 nt, Homo sapiens
caacaugauuggacccuaa

SEQ ID NO: 1389380 - RNA, 19 nt, Homo sapiens
ccacaaggauggcuauaau

SEQ ID NO: 1389381 - RNA, 19 nt, Homo sapiens
uuaacuggcugcacauaua

SEQ ID NO: 1389382 - RNA, 19 nt, Homo sapiens
gaaaaugucucccuaaaag

SEQ ID NO: 1389383 - RNA, 19 nt, Homo sapiens
ucaaagaggcagauucaua

SEQ ID NO: 1389384 - RNA, 19 nt, Homo sapiens
acggaaggauuguuuaaua

SEQ ID NO: 1389385 - RNA, 19 nt, Homo sapiens
aggaaugguuuacauguua

SEQ ID NO: 1389386 - RNA, 19 nt, Homo sapiens
gauaugagaggaaugguuu

SEQ ID NO: 1389387 - RNA, 19 nt, Homo sapiens
guguaugacuccauugaua

SEQ ID NO: 1389388 - RNA, 19 nt, Homo sapiens
aggaaugguuuacauguua

SEQ ID NO: 1389389 - RNA, 19 nt, Homo sapiens
gaaggauuguuuaauaugg

SEQ ID NO: 1389390 - RNA, 19 nt, Homo sapiens
cauaauagccucaaguaga

SEQ ID NO: 1389391 - RNA, 19 nt, Homo sapiens
acaaggauauggagaaaug

SEQ ID NO: 1389392 - RNA, 19 nt, Homo sapiens
acuaauggauguaggauuu

SEQ ID NO: 1389393 - RNA, 19 nt, Homo sapiens
ggaaauucauacccaacaa

SEQ ID NO: 1389394 - RNA, 19 nt, Homo sapiens
gaggaaugguuuacauguu

SEQ ID NO: 1389395 - RNA, 19 nt, Homo sapiens
ggacuuguauauguaaaga

SEQ ID NO: 1389396 - RNA, 19 nt, Homo sapiens
uggcauuucuucaagguua

SEQ ID NO: 1389397 - RNA, 19 nt, Homo sapiens
gcacauauaccuuaauaac

SEQ ID NO: 1389398 - RNA, 19 nt, Homo sapiens
ugaagaugcugaagaaaca

SEQ ID NO: 1389399 - RNA, 19 nt, Homo sapiens
ggaguuuccuugccugguu

SEQ ID NO: 1389400 - RNA, 19 nt, Homo sapiens
gaaaggaaugguuuacaug

SEQ ID NO: 1389401 - RNA, 19 nt, Homo sapiens
auaauagccucaaguagaa

SEQ ID NO: 1389402 - RNA, 19 nt, Homo sapiens
gaacguuggaacugucaua

SEQ ID NO: 1389403 - RNA, 19 nt, Homo sapiens
ugaaagaagguuugcagua

SEQ ID NO: 1389404 - RNA, 19 nt, Homo sapiens
cugcacauauaccuuaaua

SEQ ID NO: 1389405 - RNA, 19 nt, Homo sapiens
agaggcagauucauagaaa

SEQ ID NO: 1389406 - RNA, 19 nt, Homo sapiens
acaacaugauugaaccuua

SEQ ID NO: 1389407 - RNA, 19 nt, Homo sapiens
gauaggaaaggaaugguuu

SEQ ID NO: 1389408 - RNA, 19 nt, Homo sapiens
caacucaaaugucugucaa

SEQ ID NO: 1389409 - RNA, 19 nt, Homo sapiens
ugacucagcaguuccauuu

SEQ ID NO: 1389410 - RNA, 19 nt, Homo sapiens
uauugaagaugcugaagaa

SEQ ID NO: 1389411 - RNA, 19 nt, Homo sapiens
caaagaggcagauucauag

SEQ ID NO: 1389412 - RNA, 19 nt, Homo sapiens
cggaaggauuguuuaauau

SEQ ID NO: 1389413 - RNA, 19 nt, Homo sapiens
gggcaaaggaucugaauag

SEQ ID NO: 1389414 - RNA, 19 nt, Homo sapiens
ucacaaggauauggagaaa

SEQ ID NO: 1389415 - RNA, 19 nt, Homo sapiens
gagaagacaguaacaagug

SEQ ID NO: 1389416 - RNA, 19 nt, Homo sapiens
uaaccaccauaaaugcuaa

SEQ ID NO: 1389417 - RNA, 19 nt, Homo sapiens
ugguuaagaugguaaguuu

SEQ ID NO: 1389418 - RNA, 19 nt, Homo sapiens
gaagacuuguggauaugga

SEQ ID NO: 1389419 - RNA, 19 nt, Homo sapiens
gccaaaaggcuguguauua

SEQ ID NO: 1389420 - RNA, 19 nt, Homo sapiens
cagaaagcuucauuauaug

SEQ ID NO: 1389421 - RNA, 19 nt, Homo sapiens
ggauauggaugguggugau

SEQ ID NO: 1389422 - RNA, 19 nt, Homo sapiens
ggaaggauuguuuaauaug

SEQ ID NO: 1389423 - RNA, 19 nt, Homo sapiens
gaaaagaagcucaacauca

SEQ ID NO: 1389424 - RNA, 19 nt, Homo sapiens
gaaaugauuauaccgaaca

SEQ ID NO: 1389425 - RNA, 19 nt, Homo sapiens
gcuauaaucagaacgagaa

SEQ ID NO: 1389426 - RNA, 19 nt, Homo sapiens
cuaaaggucauguaauuga

SEQ ID NO: 1389427 - RNA, 19 nt, Homo sapiens
gaggaggaaggauugcuua

SEQ ID NO: 1389428 - RNA, 19 nt, Homo sapiens
gugggaagauccaggaguu

SEQ ID NO: 1389429 - RNA, 19 nt, Homo sapiens
caaauagcccaacugaaga

SEQ ID NO: 1389430 - RNA, 19 nt, Homo sapiens
aaggauggcuauaaucaga

SEQ ID NO: 1389431 - RNA, 19 nt, Homo sapiens
gaugguaaguuuuauguug

SEQ ID NO: 1389432 - RNA, 19 nt, Homo sapiens
ggcaccagcuggaaauuca

SEQ ID NO: 1389433 - RNA, 19 nt, Homo sapiens
uaugaaaugucucaaagag

SEQ ID NO: 1389434 - RNA, 19 nt, Homo sapiens
ccaaaaggcuguguauuau

SEQ ID NO: 1389435 - RNA, 19 nt, Homo sapiens
agaagcaacucaaaugucu

SEQ ID NO: 1389436 - RNA, 19 nt, Homo sapiens
gcaaaacacaugaaaagaa

SEQ ID NO: 1389437 - RNA, 19 nt, Homo sapiens
aaacagcaaaucaaacuug

SEQ ID NO: 1389438 - RNA, 19 nt, Homo sapiens
cguuggaacugucauaugu

SEQ ID NO: 1389439 - RNA, 19 nt, Homo sapiens
aagaagcucaacaucauua

SEQ ID NO: 1389440 - RNA, 19 nt, Homo sapiens
gcuggaaauuauauuggaa

SEQ ID NO: 1389441 - RNA, 19 nt, Homo sapiens
ggaauauuacucagcaaug

SEQ ID NO: 1389442 - RNA, 19 nt, Homo sapiens
gagcggaaaccugaaagaa

SEQ ID NO: 1389443 - RNA, 19 nt, Homo sapiens
ccacggaaggauuguuuaa

SEQ ID NO: 1389444 - RNA, 19 nt, Homo sapiens
gacaaaacaugguacaaug

SEQ ID NO: 1389445 - RNA, 19 nt, Homo sapiens
gaacagaugacaaaacaug

SEQ ID NO: 1389446 - RNA, 19 nt, Homo sapiens
cauaaaugcuaagggaguu

SEQ ID NO: 1389447 - RNA, 19 nt, Homo sapiens
ugaagaaacagcaaaucaa

SEQ ID NO: 1389448 - RNA, 19 nt, Homo sapiens
ggucacauaacugaauaua

SEQ ID NO: 1389449 - RNA, 19 nt, Homo sapiens
ugagaggaaugguuuacau

SEQ ID NO: 1389450 - RNA, 19 nt, Homo sapiens
ggaaugcuuuauauguuac

SEQ ID NO: 1389451 - RNA, 19 nt, Homo sapiens
gauaugggacugcuaacau

SEQ ID NO: 1389452 - RNA, 19 nt, Homo sapiens
aaagaagguuugcaguauc

SEQ ID NO: 1389453 - RNA, 19 nt, Homo sapiens
caaguaauccugccaucau

SEQ ID NO: 1389454 - RNA, 19 nt, Homo sapiens
gaacgagaagacaguaaca

SEQ ID NO: 1389455 - RNA, 19 nt, Homo sapiens
ccacaucugggcaagcuaa

SEQ ID NO: 1389456 - RNA, 19 nt, Homo sapiens
gugaugagccagcuaaauc

SEQ ID NO: 1389457 - RNA, 19 nt, Homo sapiens
aaaagaagcucaacaucau

SEQ ID NO: 1389458 - RNA, 19 nt, Homo sapiens
gguaauggacuuguauaug

SEQ ID NO: 1389459 - RNA, 19 nt, Homo sapiens
ggaagauccaggaguugaa

SEQ ID NO: 1389460 - RNA, 19 nt, Homo sapiens
caaguagaagcaacucaaa

SEQ ID NO: 1389461 - RNA, 19 nt, Homo sapiens
gaguuuccuugccugguuu

SEQ ID NO: 1389462 - RNA, 19 nt, Homo sapiens
ugaauaggcauuucugcaa

SEQ ID NO: 1389463 - RNA, 19 nt, Homo sapiens
gaaaguagcuguacacuca

SEQ ID NO: 1389464 - RNA, 19 nt, Homo sapiens
gcaauuuccugcuuacuuu

SEQ ID NO: 1389465 - RNA, 19 nt, Homo sapiens
gaaagaccaugacauaugu

SEQ ID NO: 1389466 - RNA, 19 nt, Homo sapiens
agacaacuuuggaguauua

SEQ ID NO: 1389467 - RNA, 19 nt, Homo sapiens
gaggaaagaccaugacaua

SEQ ID NO: 1389468 - RNA, 19 nt, Homo sapiens
ggaauaaauugugcucuuu

SEQ ID NO: 1389469 - RNA, 19 nt, Homo sapiens
ggaacuggaucuagacaaa

SEQ ID NO: 1389470 - RNA, 19 nt, Homo sapiens
gauaagggacugaggaaua

SEQ ID NO: 1389471 - RNA, 19 nt, Homo sapiens
caaaagagcuguucuaauc

SEQ ID NO: 1389472 - RNA, 19 nt, Homo sapiens
ucacugaaauugaagauga

SEQ ID NO: 1389473 - RNA, 19 nt, Homo sapiens
ggaaagaccaugacauaug

SEQ ID NO: 1389474 - RNA, 19 nt, Homo sapiens
gaaaaccucuucaugcuuu

SEQ ID NO: 1389475 - RNA, 19 nt, Homo sapiens
cauguuagauggacagaaa

SEQ ID NO: 1389476 - RNA, 19 nt, Homo sapiens
gcaagaucaucauucugua

SEQ ID NO: 1389477 - RNA, 19 nt, Homo sapiens
cuagaacaaugaacccuua

SEQ ID NO: 1389478 - RNA, 19 nt, Homo sapiens
caacguacacauagcuuua

SEQ ID NO: 1389479 - RNA, 19 nt, Homo sapiens
gaaauuauggccaguugaa

SEQ ID NO: 1389480 - RNA, 19 nt, Homo sapiens
gaacaaugaacccuuauuc

SEQ ID NO: 1389481 - RNA, 19 nt, Homo sapiens
gaucguagcugugauaagg

SEQ ID NO: 1389482 - RNA, 19 nt, Homo sapiens
ugaggagccugucauguuu

SEQ ID NO: 1389483 - RNA, 19 nt, Homo sapiens
gcaaauaaauguucuuccu

SEQ ID NO: 1389484 - RNA, 19 nt, Homo sapiens
uaaauggucuucccuccuu

SEQ ID NO: 1389485 - RNA, 19 nt, Homo sapiens
guacacauagcuuuaauga

SEQ ID NO: 1389486 - RNA, 19 nt, Homo sapiens
gaaaagagcgguguuaauu

SEQ ID NO: 1389487 - RNA, 19 nt, Homo sapiens
gcaacucugucuagaacaa

SEQ ID NO: 1389488 - RNA, 19 nt, Homo sapiens
ggcaaacccuggaaguaaa

SEQ ID NO: 1389489 - RNA, 19 nt, Homo sapiens
ucucaugacugaacuguga

SEQ ID NO: 1389490 - RNA, 19 nt, Homo sapiens
agaaaccacuguauauaug

SEQ ID NO: 1389491 - RNA, 19 nt, Homo sapiens
gucaagccaugcccaauuu

SEQ ID NO: 1389492 - RNA, 19 nt, Homo sapiens
ggaagccagugccugugua

SEQ ID NO: 1389493 - RNA, 19 nt, Homo sapiens
gcaagggccugcagaucau

SEQ ID NO: 1389494 - RNA, 19 nt, Homo sapiens
gcuguacacucacugaaug

SEQ ID NO: 1389495 - RNA, 19 nt, Homo sapiens
gagaagcucgaagagauua

SEQ ID NO: 1389496 - RNA, 19 nt, Homo sapiens
gugaugcuuugugcaauua

SEQ ID NO: 1389497 - RNA, 19 nt, Homo sapiens
ucagacaacuuuggaguau

SEQ ID NO: 1389498 - RNA, 19 nt, Homo sapiens
auaagggacugaggaauaa

SEQ ID NO: 1389499 - RNA, 19 nt, Homo sapiens
ggacugaggaauaaauugu

SEQ ID NO: 1389500 - RNA, 19 nt, Homo sapiens
gaaaucagauggaaaagag

SEQ ID NO: 1389501 - RNA, 19 nt, Homo sapiens
ucacuuaggcaaauaaaug

SEQ ID NO: 1389502 - RNA, 19 nt, Homo sapiens
agccagaccuguuagaauu

SEQ ID NO: 1389503 - RNA, 19 nt, Homo sapiens
uuaauaagguccagcuugu

SEQ ID NO: 1389504 - RNA, 19 nt, Homo sapiens
agucuuagcucagaaauuc

SEQ ID NO: 1389505 - RNA, 19 nt, Homo sapiens
gaauaaauugugcucuuug

SEQ ID NO: 1389506 - RNA, 19 nt, Homo sapiens
cagaaauuauggccaguug

SEQ ID NO: 1389507 - RNA, 19 nt, Homo sapiens
aaagagcgguguuaauuuu

SEQ ID NO: 1389508 - RNA, 19 nt, Homo sapiens
gaacaaaaggccucaggua

SEQ ID NO: 1389509 - RNA, 19 nt, Homo sapiens
gucaguauaucaguuauga

SEQ ID NO: 1389510 - RNA, 19 nt, Homo sapiens
gcccugagcaguucauaaa

SEQ ID NO: 1389511 - RNA, 19 nt, Homo sapiens
uuuauugccugagaacuua

SEQ ID NO: 1389512 - RNA, 19 nt, Homo sapiens
caacuuuggaguauuagaa

SEQ ID NO: 1389513 - RNA, 19 nt, Homo sapiens
gcuuacaguuacccaauug

SEQ ID NO: 1389514 - RNA, 19 nt, Homo sapiens
acaaagggccagugaagaa

SEQ ID NO: 1389515 - RNA, 19 nt, Homo sapiens
ccaaguugcuucccucucu

SEQ ID NO: 1389516 - RNA, 19 nt, Homo sapiens
gugcaauuaugaauguuga

SEQ ID NO: 1389517 - RNA, 19 nt, Homo sapiens
agacuucccugccggauuc

SEQ ID NO: 1389518 - RNA, 19 nt, Homo sapiens
aaaaugcucuggcuuugua

SEQ ID NO: 1389519 - RNA, 19 nt, Homo sapiens
ccagggacauuguucagau

SEQ ID NO: 1389520 - RNA, 19 nt, Homo sapiens
aaacaaaccagggacauug

SEQ ID NO: 1389521 - RNA, 19 nt, Homo sapiens
uagaguguguuuauucuuc

SEQ ID NO: 1389522 - RNA, 19 nt, Homo sapiens
ugacugacauucauuccau

SEQ ID NO: 1389523 - RNA, 19 nt, Homo sapiens
gcucgaagagauuaagaaa

SEQ ID NO: 1389524 - RNA, 19 nt, Homo sapiens
gcaaccagcuucugaaaag

SEQ ID NO: 1389525 - RNA, 19 nt, Homo sapiens
guaaauacuucagucacau

SEQ ID NO: 1389526 - RNA, 19 nt, Homo sapiens
cugagaagcucgaagagau

SEQ ID NO: 1389527 - RNA, 19 nt, Homo sapiens
uaaauugugcucuuuguca

SEQ ID NO: 1389528 - RNA, 19 nt, Homo sapiens
gaaggacugauuacugguu

SEQ ID NO: 1389529 - RNA, 19 nt, Homo sapiens
cagcugaucauccaaguug

SEQ ID NO: 1389530 - RNA, 19 nt, Homo sapiens
cagguuggauauauuuaug

SEQ ID NO: 1389531 - RNA, 19 nt, Homo sapiens
gaaaccacuguauauaugu

SEQ ID NO: 1389532 - RNA, 19 nt, Homo sapiens
gaacccuuauucaaaugau

SEQ ID NO: 1389533 - RNA, 19 nt, Homo sapiens
ggaccaaugggaaaggaaa

SEQ ID NO: 1389534 - RNA, 19 nt, Homo sapiens
gccaguuucuucauuagau

SEQ ID NO: 1389535 - RNA, 19 nt, Homo sapiens
gguaacaguaugacuaaau

SEQ ID NO: 1389536 - RNA, 19 nt, Homo sapiens
gaaaagcccacugaaaauu

SEQ ID NO: 1389537 - RNA, 19 nt, Homo sapiens
gaugaggaacucugaaauc

SEQ ID NO: 1389538 - RNA, 19 nt, Homo sapiens
ccagaaagguaugcaugug

SEQ ID NO: 1389539 - RNA, 19 nt, Homo sapiens
guaugacgaugaugaaagg

SEQ ID NO: 1389540 - RNA, 19 nt, Homo sapiens
ggcaagaucaucauucugu

SEQ ID NO: 1389541 - RNA, 19 nt, Homo sapiens
aaagagcuguucuaaucug

SEQ ID NO: 1389542 - RNA, 19 nt, Homo sapiens
gcagguuggauauauuuau

SEQ ID NO: 1389543 - RNA, 19 nt, Homo sapiens
gauuaggaaguugugauua

SEQ ID NO: 1389544 - RNA, 19 nt, Homo sapiens
ccuaccagcugagaauaaa

SEQ ID NO: 1389545 - RNA, 19 nt, Homo sapiens
ccaguuucuucauuagauu

SEQ ID NO: 1389546 - RNA, 19 nt, Homo sapiens
uuuccaaagugcaacauuu

SEQ ID NO: 1389547 - RNA, 19 nt, Homo sapiens
gggcuguguuuguaugaga

SEQ ID NO: 1389548 - RNA, 19 nt, Homo sapiens
ugccuuaacaguacuauuu

SEQ ID NO: 1389549 - RNA, 19 nt, Homo sapiens
aagauuugccuuaacagua

SEQ ID NO: 1389550 - RNA, 19 nt, Homo sapiens
ugacugaacugugauuagg

SEQ ID NO: 1389551 - RNA, 19 nt, Homo sapiens
caaacaaaccagggacauu

SEQ ID NO: 1389552 - RNA, 19 nt, Homo sapiens
uguacucacugaaauugaa

SEQ ID NO: 1389553 - RNA, 19 nt, Homo sapiens
uuugacaggugaccauaaa

SEQ ID NO: 1389554 - RNA, 19 nt, Homo sapiens
uaccagcagugccacauug

SEQ ID NO: 1389555 - RNA, 19 nt, Homo sapiens
gacuaaauauacugagaag

SEQ ID NO: 1389556 - RNA, 19 nt, Homo sapiens
gaugaggaaaguagcugua

SEQ ID NO: 1389557 - RNA, 19 nt, Homo sapiens
uaagucuugugaaacugua

SEQ ID NO: 1389558 - RNA, 19 nt, Homo sapiens
caaagggccagugaagaaa

SEQ ID NO: 1389559 - RNA, 19 nt, Homo sapiens
caaugauucugcagcuuca

SEQ ID NO: 1389560 - RNA, 19 nt, Homo sapiens
ugucaggaguugagacuuc

SEQ ID NO: 1389561 - RNA, 19 nt, Homo sapiens
uguaaauacuucagucaca

SEQ ID NO: 1389562 - RNA, 19 nt, Homo sapiens
gugcgagcguggauuugaa

SEQ ID NO: 1389563 - RNA, 19 nt, Homo sapiens
aaagaaagcuuggaaacuu

SEQ ID NO: 1389564 - RNA, 19 nt, Homo sapiens
cgagagggcuguuuccaaa

SEQ ID NO: 1389565 - RNA, 19 nt, Homo sapiens
gagcagcccuuaacacugu

SEQ ID NO: 1389566 - RNA, 19 nt, Homo sapiens
aagaaagcuuggaaacuua

SEQ ID NO: 1389567 - RNA, 19 nt, Homo sapiens
gugcuucagucuuuguaua

SEQ ID NO: 1389568 - RNA, 19 nt, Homo sapiens
gagacgaucgugaacagua

SEQ ID NO: 1389569 - RNA, 19 nt, Homo sapiens
gaacgugaugguuaagcua

SEQ ID NO: 1389570 - RNA, 19 nt, Homo sapiens
uaagcuaccuucauuaagc

SEQ ID NO: 1389571 - RNA, 19 nt, Homo sapiens
ucacacuggacuauaaaua

SEQ ID NO: 1389572 - RNA, 19 nt, Homo sapiens
agacgaucgugaacaguaa

SEQ ID NO: 1389573 - RNA, 19 nt, Homo sapiens
gcgaugaaucccagaacua

SEQ ID NO: 1389574 - RNA, 19 nt, Homo sapiens
ugguuaagcuaccuucauu

SEQ ID NO: 1389575 - RNA, 19 nt, Homo sapiens
acagugacgugaaagucua

SEQ ID NO: 1389576 - RNA, 19 nt, Homo sapiens
caaggaguucugugacuuu

SEQ ID NO: 1389577 - RNA, 19 nt, Homo sapiens
ccaguuugccuuccauuug

SEQ ID NO: 1389578 - RNA, 19 nt, Homo sapiens
gcucagaacagccuugaca

SEQ ID NO: 1389579 - RNA, 19 nt, Homo sapiens
ccacuggugcugagucaaa

SEQ ID NO: 1389580 - RNA, 19 nt, Homo sapiens
ggaguucugugacuuuuau

SEQ ID NO: 1389581 - RNA, 19 nt, Homo sapiens
gaaagucuacaaggaguuc

SEQ ID NO: 1389582 - RNA, 19 nt, Homo sapiens
cugaggaagauuacuauuu

SEQ ID NO: 1389583 - RNA, 19 nt, Homo sapiens
gguuaagcuaccuucauua

SEQ ID NO: 1389584 - RNA, 19 nt, Homo sapiens
acaaggaguucugugacuu

SEQ ID NO: 1389585 - RNA, 19 nt, Homo sapiens
caucuucgccccuauaaaa

SEQ ID NO: 1389586 - RNA, 19 nt, Homo sapiens
gcacagugacgugaaaguc

SEQ ID NO: 1389587 - RNA, 19 nt, Homo sapiens
ucccagaacuaggcuauuc

SEQ ID NO: 1389588 - RNA, 19 nt, Homo sapiens
aagaauaaagcaugacuca

SEQ ID NO: 1389589 - RNA, 19 nt, Homo sapiens
caggcacagugacgugaaa

SEQ ID NO: 1389590 - RNA, 19 nt, Homo sapiens
accugcaucuggagaauaa

SEQ ID NO: 1389591 - RNA, 19 nt, Homo sapiens
cccucacacuggacuauaa

SEQ ID NO: 1389592 - RNA, 19 nt, Homo sapiens
ugugugcuguuauuccaaa

SEQ ID NO: 1389593 - RNA, 19 nt, Homo sapiens
gggucugugugcuguuauu

SEQ ID NO: 1389594 - RNA, 19 nt, Homo sapiens
caguuugccuuccauuugg

SEQ ID NO: 1389595 - RNA, 19 nt, Homo sapiens
gaaaagaaagcuuggaaac

SEQ ID NO: 1389596 - RNA, 19 nt, Homo sapiens
gcuaacaaauaaucuucac

SEQ ID NO: 1389597 - RNA, 19 nt, Homo sapiens
ggccacuggugcugaguca

SEQ ID NO: 1389598 - RNA, 19 nt, Homo sapiens
ccauuugggacaugacuga

SEQ ID NO: 1389599 - RNA, 19 nt, Homo sapiens
gaggaagauuacuauuuug

SEQ ID NO: 1389600 - RNA, 19 nt, Homo sapiens
gcuucagucuuuguauaau

SEQ ID NO: 1389601 - RNA, 19 nt, Homo sapiens
aaaccugcaucuggagaau

SEQ ID NO: 1389602 - RNA, 19 nt, Homo sapiens
uuggcuacauuguuuauca

SEQ ID NO: 1389603 - RNA, 19 nt, Homo sapiens
cugggucugugugcuguua

SEQ ID NO: 1389604 - RNA, 19 nt, Homo sapiens
ccgcugagacgaucgugaa

SEQ ID NO: 1389605 - RNA, 19 nt, Homo sapiens
gccuugacagcgaagaaua

SEQ ID NO: 1389606 - RNA, 19 nt, Homo sapiens
gcuguaccaugagcagugu

SEQ ID NO: 1389607 - RNA, 19 nt, Homo sapiens
gcaggcacagugacgugaa

SEQ ID NO: 1389608 - RNA, 19 nt, Homo sapiens
ugacagcgaagaauaaagc

SEQ ID NO: 1389609 - RNA, 19 nt, Homo sapiens
ccuugacagcgaagaauaa

SEQ ID NO: 1389610 - RNA, 19 nt, Homo sapiens
gugcugagucaaagggaaa

SEQ ID NO: 1389611 - RNA, 19 nt, Homo sapiens
cgaugaaucccagaacuag

SEQ ID NO: 1389612 - RNA, 19 nt, Homo sapiens
ucuacaaggaguucuguga

SEQ ID NO: 1389613 - RNA, 19 nt, Homo sapiens
gagcuccugcugccgcauu

SEQ ID NO: 1389614 - RNA, 19 nt, Homo sapiens
aagcuaccuucauuaagca

SEQ ID NO: 1389615 - RNA, 19 nt, Homo sapiens
ucuggagaauaagacauuu

SEQ ID NO: 1389616 - RNA, 19 nt, Homo sapiens
uaaaccugcaucuggagaa

SEQ ID NO: 1389617 - RNA, 19 nt, Homo sapiens
uacaaggaguucugugacu

SEQ ID NO: 1389618 - RNA, 19 nt, Homo sapiens
acgugaaagucuacaagga

SEQ ID NO: 1389619 - RNA, 19 nt, Homo sapiens
gaacagaacuuccuuaaca

SEQ ID NO: 1389620 - RNA, 19 nt, Homo sapiens
gcagagaccuuugacauua

SEQ ID NO: 1389621 - RNA, 19 nt, Homo sapiens
gaagauugcugaacacauu

SEQ ID NO: 1389622 - RNA, 19 nt, Homo sapiens
cguaugaaauggaaacuua

SEQ ID NO: 1389623 - RNA, 19 nt, Homo sapiens
gcaauaaugcagaaguuua

SEQ ID NO: 1389624 - RNA, 19 nt, Homo sapiens
ggaaauaccauucaguuug

SEQ ID NO: 1389625 - RNA, 19 nt, Homo sapiens
aaacccagcuucagacuuu

SEQ ID NO: 1389626 - RNA, 19 nt, Homo sapiens
gaacuuccuuaacaacaaa

SEQ ID NO: 1389627 - RNA, 19 nt, Homo sapiens
gcacgacgcuuccacaagu

SEQ ID NO: 1389628 - RNA, 19 nt, Homo sapiens
ggacuuaaauaucagugaa

SEQ ID NO: 1389629 - RNA, 19 nt, Homo sapiens
ggacagagagggcugguuu

SEQ ID NO: 1389630 - RNA, 19 nt, Homo sapiens
gaagaagcaucacaggaau

SEQ ID NO: 1389631 - RNA, 19 nt, Homo sapiens
caagaaaugcugauauuga

SEQ ID NO: 1389632 - RNA, 19 nt, Homo sapiens
gccaugaacuggacauuga

SEQ ID NO: 1389633 - RNA, 19 nt, Homo sapiens
gcgggaggauuguaagaua

SEQ ID NO: 1389634 - RNA, 19 nt, Homo sapiens
gcagacaaauaaagaugaa

SEQ ID NO: 1389635 - RNA, 19 nt, Homo sapiens
ccugauggcuuugaaauuu

SEQ ID NO: 1389636 - RNA, 19 nt, Homo sapiens
agaagaaugugaagcuuaa

SEQ ID NO: 1389637 - RNA, 19 nt, Homo sapiens
gaaauaccauucaguuugc

SEQ ID NO: 1389638 - RNA, 19 nt, Homo sapiens
ggacuauuguggcaaaguu

SEQ ID NO: 1389639 - RNA, 19 nt, Homo sapiens
ggauuaaguuggacagaga

SEQ ID NO: 1389640 - RNA, 19 nt, Homo sapiens
gagaagaaugugaagcuua

SEQ ID NO: 1389641 - RNA, 19 nt, Homo sapiens
cacauuaucuccaaagcua

SEQ ID NO: 1389642 - RNA, 19 nt, Homo sapiens
ugaagacaaucacugcaua

SEQ ID NO: 1389643 - RNA, 19 nt, Homo sapiens
gacaugcgcagacaaauaa

SEQ ID NO: 1389644 - RNA, 19 nt, Homo sapiens
ccaauuagauuccuguaca

SEQ ID NO: 1389645 - RNA, 19 nt, Homo sapiens
aaacacaucuucuuuacca

SEQ ID NO: 1389646 - RNA, 19 nt, Homo sapiens
acacagagccaauuagauu

SEQ ID NO: 1389647 - RNA, 19 nt, Homo sapiens
ggaggacuauuguggcaaa

SEQ ID NO: 1389648 - RNA, 19 nt, Homo sapiens
ggaaauagaacagaacuuc

SEQ ID NO: 1389649 - RNA, 19 nt, Homo sapiens
uaacugcacauaaggauuu

SEQ ID NO: 1389650 - RNA, 19 nt, Homo sapiens
uggcaugucuuccuuuauu

SEQ ID NO: 1389651 - RNA, 19 nt, Homo sapiens
gacaaucacugcauauuuu

SEQ ID NO: 1389652 - RNA, 19 nt, Homo sapiens
gaacuggacauugaugaaa

SEQ ID NO: 1389653 - RNA, 19 nt, Homo sapiens
caacagcuaagugaaguua

SEQ ID NO: 1389654 - RNA, 19 nt, Homo sapiens
gcuagaaauuacagagaaa

SEQ ID NO: 1389655 - RNA, 19 nt, Homo sapiens
gaaaacacauuaucuccaa

SEQ ID NO: 1389656 - RNA, 19 nt, Homo sapiens
ggucuuauaucaccguaug

SEQ ID NO: 1389657 - RNA, 19 nt, Homo sapiens
uggcaaaguuggcaagaaa

SEQ ID NO: 1389658 - RNA, 19 nt, Homo sapiens
uagaugaaauugugcaaga

SEQ ID NO: 1389659 - RNA, 19 nt, Homo sapiens
gcauaggccuggaugaaag

SEQ ID NO: 1389660 - RNA, 19 nt, Homo sapiens
gaggaaauaccauucaguu

SEQ ID NO: 1389661 - RNA, 19 nt, Homo sapiens
ggcagaaacugaagcugaa

SEQ ID NO: 1389662 - RNA, 19 nt, Homo sapiens
uagcaacuguuccagauga

SEQ ID NO: 1389663 - RNA, 19 nt, Homo sapiens
gaucauagugaaauacuug

SEQ ID NO: 1389664 - RNA, 19 nt, Homo sapiens
ugaaauagcugcuguuccu

SEQ ID NO: 1389665 - RNA, 19 nt, Homo sapiens
ugacagugguucccuucua

SEQ ID NO: 1389666 - RNA, 19 nt, Homo sapiens
acaaugaugucuccugaug

SEQ ID NO: 1389667 - RNA, 19 nt, Homo sapiens
ugggauagcagauaagaua

SEQ ID NO: 1389668 - RNA, 19 nt, Homo sapiens
ugagagugauugccauuga

SEQ ID NO: 1389669 - RNA, 19 nt, Homo sapiens
agaagaagaccaagaagaa

SEQ ID NO: 1389670 - RNA, 19 nt, Homo sapiens
ggagcaacauuauagucaa

SEQ ID NO: 1389671 - RNA, 19 nt, Homo sapiens
gcugaacucaugagaagua

SEQ ID NO: 1389672 - RNA, 19 nt, Homo sapiens
gaaacuuacaggacuuaaa

SEQ ID NO: 1389673 - RNA, 19 nt, Homo sapiens
ugaagaagcaucacaggaa

SEQ ID NO: 1389674 - RNA, 19 nt, Homo sapiens
aaugauagcucugguacaa

SEQ ID NO: 1389675 - RNA, 19 nt, Homo sapiens
uaggauaacugcacauaag

SEQ ID NO: 1389676 - RNA, 19 nt, Homo sapiens
gaacuuuccuguuuucaug

SEQ ID NO: 1389677 - RNA, 19 nt, Homo sapiens
caagugugacguuguagua

SEQ ID NO: 1389678 - RNA, 19 nt, Homo sapiens
gcuagcaacuguuccagau

SEQ ID NO: 1389679 - RNA, 19 nt, Homo sapiens
ugaaagagacagcuugcua

SEQ ID NO: 1389680 - RNA, 19 nt, Homo sapiens
ggucagguauuuagagaag

SEQ ID NO: 1389681 - RNA, 19 nt, Homo sapiens
caaagugaaccacguaaug

SEQ ID NO: 1389682 - RNA, 19 nt, Homo sapiens
gagaacaccagaacauaug

SEQ ID NO: 1389683 - RNA, 19 nt, Homo sapiens
gagggcaaguggaaauaga

SEQ ID NO: 1389684 - RNA, 19 nt, Homo sapiens
uccaagaaaugcugauauu

SEQ ID NO: 1389685 - RNA, 19 nt, Homo sapiens
uaucgauccuguuaagauu

SEQ ID NO: 1389686 - RNA, 19 nt, Homo sapiens
uaacacagagccaauuaga

SEQ ID NO: 1389687 - RNA, 19 nt, Homo sapiens
cgaagcaacccgugugaaa

SEQ ID NO: 1389688 - RNA, 19 nt, Homo sapiens
gucaagcacuaucuucuga

SEQ ID NO: 1389689 - RNA, 19 nt, Homo sapiens
ugacaucaauacgcaauau

SEQ ID NO: 1389690 - RNA, 19 nt, Homo sapiens
gaugagcaggauuguguua

SEQ ID NO: 1389691 - RNA, 19 nt, Homo sapiens
gaacucaugagaaguaugg

SEQ ID NO: 1389692 - RNA, 19 nt, Homo sapiens
ggagugcagugccaugauc

SEQ ID NO: 1389693 - RNA, 19 nt, Homo sapiens
gaagacaaucacugcauau

SEQ ID NO: 1389694 - RNA, 19 nt, Homo sapiens
gaagaggagccaugaacug

SEQ ID NO: 1389695 - RNA, 19 nt, Homo sapiens
aaacagaagcugaugacaa

SEQ ID NO: 1389696 - RNA, 19 nt, Homo sapiens
agaaucacaugacagcaaa

SEQ ID NO: 1389697 - RNA, 19 nt, Homo sapiens
gaugucuccugauggcuuu

SEQ ID NO: 1389698 - RNA, 19 nt, Homo sapiens
aaauguuucucuucacuga

SEQ ID NO: 1389699 - RNA, 19 nt, Homo sapiens
ccgagaagauugcugaaca

SEQ ID NO: 1389700 - RNA, 19 nt, Homo sapiens
acaaacacaucuucuuuac

SEQ ID NO: 1389701 - RNA, 19 nt, Homo sapiens
augugaagcuuaagucuaa

SEQ ID NO: 1389702 - RNA, 19 nt, Homo sapiens
gauaaugauagcucuggua

SEQ ID NO: 1389703 - RNA, 19 nt, Homo sapiens
caauugaacaguaugagaa

SEQ ID NO: 1389704 - RNA, 19 nt, Homo sapiens
agacaaucacugcauauuu

SEQ ID NO: 1389705 - RNA, 19 nt, Homo sapiens
guaagauacugugccuuug

SEQ ID NO: 1389706 - RNA, 19 nt, Homo sapiens
ugcagaaguuuaugggaua

SEQ ID NO: 1389707 - RNA, 19 nt, Homo sapiens
cuucaagugugacguugua

SEQ ID NO: 1389708 - RNA, 19 nt, Homo sapiens
aacugaagcugaagugaaa

SEQ ID NO: 1389709 - RNA, 19 nt, Homo sapiens
agacaugcgcagacaaaua

SEQ ID NO: 1389710 - RNA, 19 nt, Homo sapiens
ucagguauuuagagaagaa

SEQ ID NO: 1389711 - RNA, 19 nt, Homo sapiens
gguggaaucccaaauuuca

SEQ ID NO: 1389712 - RNA, 19 nt, Homo sapiens
gagaugaaagugaggaaga

SEQ ID NO: 1389713 - RNA, 19 nt, Homo sapiens
gaaccaaugaggaaagcaa

SEQ ID NO: 1389714 - RNA, 19 nt, Homo sapiens
uaagugaaguuaguagcaa

SEQ ID NO: 1389715 - RNA, 19 nt, Homo sapiens
gugaaauacuugauggaau

SEQ ID NO: 1389716 - RNA, 19 nt, Homo sapiens
uuuaaaggcugauguugug

SEQ ID NO: 1389717 - RNA, 19 nt, Homo sapiens
gaauucagaggaaguaaca

SEQ ID NO: 1389718 - RNA, 19 nt, Homo sapiens
gauaaggaucauagugaaa

SEQ ID NO: 1389719 - RNA, 19 nt, Homo sapiens
ccacuuagcacuuguauaa

SEQ ID NO: 1389720 - RNA, 19 nt, Homo sapiens
gcacagauccugaagaugu

SEQ ID NO: 1389721 - RNA, 19 nt, Homo sapiens
gaaguuaaauggcacagau

SEQ ID NO: 1389722 - RNA, 19 nt, Homo sapiens
ucaggaagauuaccuaaga

SEQ ID NO: 1389723 - RNA, 19 nt, Homo sapiens
aaagaggccuucaacauga

SEQ ID NO: 1389724 - RNA, 19 nt, Homo sapiens
uaagagagcugcugacaac

SEQ ID NO: 1389725 - RNA, 19 nt, Homo sapiens
agacaaagaugacugaaag

SEQ ID NO: 1389726 - RNA, 19 nt, Homo sapiens
caaagaggccuucaacaug

SEQ ID NO: 1389727 - RNA, 19 nt, Homo sapiens
ggaugaggguguaaauugu

SEQ ID NO: 1389728 - RNA, 19 nt, Homo sapiens
guacagagaagcaccuauu

SEQ ID NO: 1389729 - RNA, 19 nt, Homo sapiens
gggaugaggguguaaauug

SEQ ID NO: 1389730 - RNA, 19 nt, Homo sapiens
gagaagcaccuauugacaa

SEQ ID NO: 1389731 - RNA, 19 nt, Homo sapiens
agaagcaccuauugacaaa

SEQ ID NO: 1389732 - RNA, 19 nt, Homo sapiens
caaggaagauuugcaugau

SEQ ID NO: 1389733 - RNA, 19 nt, Homo sapiens
caauguguuugccauguuu

SEQ ID NO: 1389734 - RNA, 19 nt, Homo sapiens
ggguguaaauuguauugaa

SEQ ID NO: 1389735 - RNA, 19 nt, Homo sapiens
gaaacgccuuugcuugcuu

SEQ ID NO: 1389736 - RNA, 19 nt, Homo sapiens
aaagaugacugaaagaacu

SEQ ID NO: 1389737 - RNA, 19 nt, Homo sapiens
gggaucgguuuacagauga

SEQ ID NO: 1389738 - RNA, 19 nt, Homo sapiens
guaccauucaggaagauua

SEQ ID NO: 1389739 - RNA, 19 nt, Homo sapiens
cauguuuggugagaaguua

SEQ ID NO: 1389740 - RNA, 19 nt, Homo sapiens
gaugaggguguaaauugua

SEQ ID NO: 1389741 - RNA, 19 nt, Homo sapiens
caaagacaaagaugacuga

SEQ ID NO: 1389742 - RNA, 19 nt, Homo sapiens
gcucuucgcugucguuugc

SEQ ID NO: 1389743 - RNA, 19 nt, Homo sapiens
aaggaagauuugcaugaua

SEQ ID NO: 1389744 - RNA, 19 nt, Homo sapiens
ccugaaacauggagccaaa

SEQ ID NO: 1389745 - RNA, 19 nt, Homo sapiens
ucaaagaggccuucaacau

SEQ ID NO: 1389746 - RNA, 19 nt, Homo sapiens
gcacuuguauaaucagacu

SEQ ID NO: 1389747 - RNA, 19 nt, Homo sapiens
gaugaagaagcaacaggua

SEQ ID NO: 1389748 - RNA, 19 nt, Homo sapiens
aggaagauuugcaugauau

SEQ ID NO: 1389749 - RNA, 19 nt, Homo sapiens
ccaauguguuugccauguu

SEQ ID NO: 1389750 - RNA, 19 nt, Homo sapiens
ucacacgcauccugaaaca

SEQ ID NO: 1389751 - RNA, 19 nt, Homo sapiens
caaccaccaugucgagcaa

SEQ ID NO: 1389752 - RNA, 19 nt, Homo sapiens
agucacagauucaggaguu

SEQ ID NO: 1389753 - RNA, 19 nt, Homo sapiens
ccaguuacauugucuuacu

SEQ ID NO: 1389754 - RNA, 19 nt, Homo sapiens
gagccaaagacaaagauga

SEQ ID NO: 1389755 - RNA, 19 nt, Homo sapiens
gaagcaacagguaccauuc

SEQ ID NO: 1389756 - RNA, 19 nt, Homo sapiens
uggcacagauccugaagau

SEQ ID NO: 1389757 - RNA, 19 nt, Homo sapiens
aaacgccuuugcuugcuuu

SEQ ID NO: 1389758 - RNA, 19 nt, Homo sapiens
gcuaaaaucuuccaguuac

SEQ ID NO: 1389759 - RNA, 19 nt, Homo sapiens
ggaauuaaacaaccaccau

SEQ ID NO: 1389760 - RNA, 19 nt, Homo sapiens
uugaugccaugaugaauga

SEQ ID NO: 1389761 - RNA, 19 nt, Homo sapiens
gagagcugcugacaaccau

SEQ ID NO: 1389762 - RNA, 19 nt, Homo sapiens
cagguaccauucaggaaga

SEQ ID NO: 1389763 - RNA, 19 nt, Homo sapiens
acaaggaagauuugcauga

SEQ ID NO: 1389764 - RNA, 19 nt, Homo sapiens
acauggagccaaagacaaa

SEQ ID NO: 1389765 - RNA, 19 nt, Homo sapiens
aaacauggagccaaagaca

SEQ ID NO: 1389766 - RNA, 19 nt, Homo sapiens
uacauugucuuacucucuu

SEQ ID NO: 1389767 - RNA, 19 nt, Homo sapiens
acaaagaugacugaaagaa

SEQ ID NO: 1389768 - RNA, 19 nt, Homo sapiens
acacgcauccugaaacaug

SEQ ID NO: 1389769 - RNA, 19 nt, Homo sapiens
gaggguguaaauuguauug

SEQ ID NO: 1389770 - RNA, 19 nt, Homo sapiens
uguauaaucagacuggaaa

SEQ ID NO: 1389771 - RNA, 19 nt, Homo sapiens
acuuagcacuuguauaauc

SEQ ID NO: 1389772 - RNA, 19 nt, Homo sapiens
ucaauuacaucgaguucac

SEQ ID NO: 1389773 - RNA, 19 nt, Homo sapiens
acagagaagcaccuauuga

SEQ ID NO: 1389774 - RNA, 19 nt, Homo sapiens
gaagaaucccacugaugca

SEQ ID NO: 1389775 - RNA, 19 nt, Homo sapiens
guguuuggcgucggaauua

SEQ ID NO: 1389776 - RNA, 19 nt, Homo sapiens
ugauaugcuugcuucucua

SEQ ID NO: 1389777 - RNA, 19 nt, Homo sapiens
cuuagcacuuguauaauca

SEQ ID NO: 1389778 - RNA, 19 nt, Homo sapiens
caaagaugacugaaagaac

SEQ ID NO: 1389779 - RNA, 19 nt, Homo sapiens
cgacaaggaagauuugcau

SEQ ID NO: 1389780 - RNA, 19 nt, Homo sapiens
ugaaacauggagccaaaga

SEQ ID NO: 1389781 - RNA, 19 nt, Homo sapiens
guuuacagaugaggaagug

SEQ ID NO: 1389782 - RNA, 19 nt, Homo sapiens
caaagaccaagaccaccaa

SEQ ID NO: 1389783 - RNA, 19 nt, Homo sapiens
ucacagcuuugccucuucu

SEQ ID NO: 1389784 - RNA, 19 nt, Homo sapiens
ggggaucgguuuacagaug

SEQ ID NO: 1389785 - RNA, 19 nt, Homo sapiens
agaagcaacagguaccauu

SEQ ID NO: 1389786 - RNA, 19 nt, Homo sapiens
uagcuaaaaucuuccaguu

SEQ ID NO: 1389787 - RNA, 19 nt, Homo sapiens
caucgacaaggaagauuug

SEQ ID NO: 1389788 - RNA, 19 nt, Homo sapiens
agaaucccacugaugcaua

SEQ ID NO: 1389789 - RNA, 19 nt, Homo sapiens
ggaagauuugcaugauaug

SEQ ID NO: 1389790 - RNA, 19 nt, Homo sapiens
gguguuuggcgucggaauu

SEQ ID NO: 1389791 - RNA, 19 nt, Homo sapiens
guauuuauuccagaccuuu

SEQ ID NO: 1389792 - RNA, 19 nt, Homo sapiens
gacaaagaugacugaaaga

SEQ ID NO: 1389793 - RNA, 19 nt, Homo sapiens
uagcacuuguauaaucaga

SEQ ID NO: 1389794 - RNA, 19 nt, Homo sapiens
guucaaagaggccuucaac

SEQ ID NO: 1389795 - RNA, 19 nt, Homo sapiens
gauaugcuugcuucucuag

SEQ ID NO: 1389796 - RNA, 19 nt, Homo sapiens
cgccuuugcuugcuuugau

SEQ ID NO: 1389797 - RNA, 19 nt, Homo sapiens
cagagaagcaccuauugac

SEQ ID NO: 1389798 - RNA, 19 nt, Homo sapiens
uuucacagcuuugccucuu

SEQ ID NO: 1389799 - RNA, 19 nt, Homo sapiens
agaccuuucugccacuuag

SEQ ID NO: 1389800 - RNA, 19 nt, Homo sapiens
ccucauagaaccuguugca

SEQ ID NO: 1389801 - RNA, 19 nt, Homo sapiens
ucaucgacaaggaagauuu

SEQ ID NO: 1389802 - RNA, 19 nt, Homo sapiens
gaagaagcaacagguacca

SEQ ID NO: 1389803 - RNA, 19 nt, Homo sapiens
aagacaaagaugacugaaa

SEQ ID NO: 1389804 - RNA, 19 nt, Homo sapiens
gaaacauggagccaaagac

SEQ ID NO: 1389805 - RNA, 19 nt, Homo sapiens
cacagauccugaagauguc

SEQ ID NO: 1389806 - RNA, 19 nt, Homo sapiens
uauaaucagacuggaaaug

SEQ ID NO: 1389807 - RNA, 19 nt, Homo sapiens
gcccucagcgugcaacauc

SEQ ID NO: 1389808 - RNA, 19 nt, Homo sapiens
cuaagagagcugcugacaa

SEQ ID NO: 1389809 - RNA, 19 nt, Homo sapiens
caggaagauuaccuaagag

SEQ ID NO: 1389810 - RNA, 19 nt, Homo sapiens
ggaauuaggucuuucuauu

SEQ ID NO: 1389811 - RNA, 19 nt, Homo sapiens
gcagagaggucaagacaga

SEQ ID NO: 1389812 - RNA, 19 nt, Homo sapiens
acagaaagguguccaagua

SEQ ID NO: 1389813 - RNA, 19 nt, Homo sapiens
ucagagagauuaauugcua

SEQ ID NO: 1389814 - RNA, 19 nt, Homo sapiens
gaacugggacguuaaggua

SEQ ID NO: 1389815 - RNA, 19 nt, Homo sapiens
gagcugagguuucugauag

SEQ ID NO: 1389816 - RNA, 19 nt, Homo sapiens
caaacucuguuacuaauug

SEQ ID NO: 1389817 - RNA, 19 nt, Homo sapiens
gcagacagcuuaaaugacu

SEQ ID NO: 1389818 - RNA, 19 nt, Homo sapiens
gagagaagguugucagcuu

SEQ ID NO: 1389819 - RNA, 19 nt, Homo sapiens
aaucagaacugggacguua

SEQ ID NO: 1389820 - RNA, 19 nt, Homo sapiens
caacaucgagccacucuuu

SEQ ID NO: 1389821 - RNA, 19 nt, Homo sapiens
uccagaaccucccaaguua

SEQ ID NO: 1389822 - RNA, 19 nt, Homo sapiens
gcccaucucuagucaguaa

SEQ ID NO: 1389823 - RNA, 19 nt, Homo sapiens
caaauuauccuuggaguug

SEQ ID NO: 1389824 - RNA, 19 nt, Homo sapiens
ggcaaggucugguggauga

SEQ ID NO: 1389825 - RNA, 19 nt, Homo sapiens
gguaagaauuccuggucua

SEQ ID NO: 1389826 - RNA, 19 nt, Homo sapiens
gaucgugaauguuuaucuu

SEQ ID NO: 1389827 - RNA, 19 nt, Homo sapiens
caaagagggucagaaggaa

SEQ ID NO: 1389828 - RNA, 19 nt, Homo sapiens
ggaaagaacccuguagaca

SEQ ID NO: 1389829 - RNA, 19 nt, Homo sapiens
gauguuugaucgugaaugu

SEQ ID NO: 1389830 - RNA, 19 nt, Homo sapiens
gaggaggcauugucacuuc

SEQ ID NO: 1389831 - RNA, 19 nt, Homo sapiens
cugggaagcuuuaccaauu

SEQ ID NO: 1389832 - RNA, 19 nt, Homo sapiens
ggaagucaccugccugaug

SEQ ID NO: 1389833 - RNA, 19 nt, Homo sapiens
ccagacacuuguuaucuug

SEQ ID NO: 1389834 - RNA, 19 nt, Homo sapiens
gaccauggcccaauucuuc

SEQ ID NO: 1389835 - RNA, 19 nt, Homo sapiens
gcgaugagcucagccuguu

SEQ ID NO: 1389836 - RNA, 19 nt, Homo sapiens
ggacagggaccuuuuaaaa

SEQ ID NO: 1389837 - RNA, 19 nt, Homo sapiens
ggagugagcagugcaaaga

SEQ ID NO: 1389838 - RNA, 19 nt, Homo sapiens
cugauuggauuccuaauug

SEQ ID NO: 1389839 - RNA, 19 nt, Homo sapiens
cagcuagccucauccuuug

SEQ ID NO: 1389840 - RNA, 19 nt, Homo sapiens
ccagcuagccucauccuuu

SEQ ID NO: 1389841 - RNA, 19 nt, Homo sapiens
ccagcucccugaugacaaa

SEQ ID NO: 1389842 - RNA, 19 nt, Homo sapiens
gcacuccagucugcaggua

SEQ ID NO: 1389843 - RNA, 19 nt, Homo sapiens
ggcagcaguucuuaacauu

SEQ ID NO: 1389844 - RNA, 19 nt, Homo sapiens
guacacaucaggcaguuga

SEQ ID NO: 1389845 - RNA, 19 nt, Homo sapiens
aaaccaagcccugcaauga

SEQ ID NO: 1389846 - RNA, 19 nt, Homo sapiens
gagcauggguguggaaguc

SEQ ID NO: 1389847 - RNA, 19 nt, Homo sapiens
gggaggcgcugugugagaa

SEQ ID NO: 1389848 - RNA, 19 nt, Homo sapiens
ccgcauggcagacagcuua

SEQ ID NO: 1389849 - RNA, 19 nt, Homo sapiens
gggcagcaguucuuaacau

SEQ ID NO: 1389850 - RNA, 19 nt, Homo sapiens
ggugagcccugggauaaug

SEQ ID NO: 1389851 - RNA, 19 nt, Homo sapiens
gaugaggugcacaugguua

SEQ ID NO: 1389852 - RNA, 19 nt, Homo sapiens
guaacucacuguuucuaag

SEQ ID NO: 1389853 - RNA, 19 nt, Homo sapiens
ccacgugcaucaucagugu

SEQ ID NO: 1389854 - RNA, 19 nt, Homo sapiens
uaacaaagagggucagaag

SEQ ID NO: 1389855 - RNA, 19 nt, Homo sapiens
acaacaaccugugaaauag

SEQ ID NO: 1389856 - RNA, 19 nt, Homo sapiens
gaguuggaauuaggucuuu

SEQ ID NO: 1389857 - RNA, 19 nt, Homo sapiens
caucaucaguguaaucucu

SEQ ID NO: 1389858 - RNA, 19 nt, Homo sapiens
caaagacaaguaucagcua

SEQ ID NO: 1389859 - RNA, 19 nt, Homo sapiens
gaaacaaaucaaacucugu

SEQ ID NO: 1389860 - RNA, 19 nt, Homo sapiens
ugggaagcuuuaccaauuu

SEQ ID NO: 1389861 - RNA, 19 nt, Homo sapiens
gcaaugaguccuguuagau

SEQ ID NO: 1389862 - RNA, 19 nt, Homo sapiens
gaaaccaagcccugcaaug

SEQ ID NO: 1389863 - RNA, 19 nt, Homo sapiens
ggaauugugucugcagaag

SEQ ID NO: 1389864 - RNA, 19 nt, Homo sapiens
acagggaccuuuuaaaauu

SEQ ID NO: 1389865 - RNA, 19 nt, Homo sapiens
agaauuaccugggaagcuu

SEQ ID NO: 1389866 - RNA, 19 nt, Homo sapiens
gaggaaagaacccuguaga

SEQ ID NO: 1389867 - RNA, 19 nt, Homo sapiens
gcccugggauaauguguug

SEQ ID NO: 1389868 - RNA, 19 nt, Homo sapiens
ggaguggaacggacaauca

SEQ ID NO: 1389869 - RNA, 19 nt, Homo sapiens
gaaguccugucagccaaga

SEQ ID NO: 1389870 - RNA, 19 nt, Homo sapiens
gcaaauuauccuuggaguu

SEQ ID NO: 1389871 - RNA, 19 nt, Homo sapiens
gggaagcuuuaccaauuuc

SEQ ID NO: 1389872 - RNA, 19 nt, Homo sapiens
gaaccucccaaguuauguu

SEQ ID NO: 1389873 - RNA, 19 nt, Homo sapiens
cagagcagcuuaacaucca

SEQ ID NO: 1389874 - RNA, 19 nt, Homo sapiens
acaaagagggucagaagga

SEQ ID NO: 1389875 - RNA, 19 nt, Homo sapiens
gcuagcaucaggacagaaa

SEQ ID NO: 1389876 - RNA, 19 nt, Homo sapiens
ccagggcaguacuagguaa

SEQ ID NO: 1389877 - RNA, 19 nt, Homo sapiens
gcaucaccuguaucuauua

SEQ ID NO: 1389878 - RNA, 19 nt, Homo sapiens
cauggcugcuucucuaaga

SEQ ID NO: 1389879 - RNA, 19 nt, Homo sapiens
ggagcugagguuucugaua

SEQ ID NO: 1389880 - RNA, 19 nt, Homo sapiens
ggugagucauggccucuug

SEQ ID NO: 1389881 - RNA, 19 nt, Homo sapiens
ccaccaggaugcaggacuu

SEQ ID NO: 1389882 - RNA, 19 nt, Homo sapiens
auucauggcugcuucucua

SEQ ID NO: 1389883 - RNA, 19 nt, Homo sapiens
cuaugggacagauaauuua

SEQ ID NO: 1389884 - RNA, 19 nt, Homo sapiens
cuuguuaucuuguucacuu

SEQ ID NO: 1389885 - RNA, 19 nt, Homo sapiens
gaugagcucagccuguuga

SEQ ID NO: 1389886 - RNA, 19 nt, Homo sapiens
ggccauggcaggcaccuuu

SEQ ID NO: 1389887 - RNA, 19 nt, Homo sapiens
cgccaucacugucugguau

SEQ ID NO: 1389888 - RNA, 19 nt, Homo sapiens
gggaugaauugugggaaga

SEQ ID NO: 1389889 - RNA, 19 nt, Homo sapiens
uggcagacagcuuaaauga

SEQ ID NO: 1389890 - RNA, 19 nt, Homo sapiens
ugagguuucugauagacuu

SEQ ID NO: 1389891 - RNA, 19 nt, Homo sapiens
cagcaguucuuaacauugc

SEQ ID NO: 1389892 - RNA, 19 nt, Homo sapiens
ucuaugggacagauaauuu

SEQ ID NO: 1389893 - RNA, 19 nt, Homo sapiens
ucugaauccugaauaacaa

SEQ ID NO: 1389894 - RNA, 19 nt, Homo sapiens
gggcagagaggucaagaca

SEQ ID NO: 1389895 - RNA, 19 nt, Homo sapiens
ggccuucucacuaauugua

SEQ ID NO: 1389896 - RNA, 19 nt, Homo sapiens
gggagaggcacaugagguu

SEQ ID NO: 1389897 - RNA, 19 nt, Homo sapiens
ggagggagugggcucuuga

SEQ ID NO: 1389898 - RNA, 19 nt, Homo sapiens
guuugaucgugaauguuua

SEQ ID NO: 1389899 - RNA, 19 nt, Homo sapiens
ugcaucaccuguaucuauu

SEQ ID NO: 1389900 - RNA, 19 nt, Homo sapiens
agacacuuguuaucuuguu

SEQ ID NO: 1389901 - RNA, 19 nt, Homo sapiens
guacagggcaggaggaaac

SEQ ID NO: 1389902 - RNA, 19 nt, Homo sapiens
ggaccaaggaggagaagag

SEQ ID NO: 1389903 - RNA, 19 nt, Homo sapiens
ccaucacugucugguauuu

SEQ ID NO: 1389904 - RNA, 19 nt, Homo sapiens
ugggacagauaauuuagug

SEQ ID NO: 1389905 - RNA, 19 nt, Homo sapiens
ggaggucuaugggacagau

SEQ ID NO: 1389906 - RNA, 19 nt, Homo sapiens
ggacgccagcagaguugua

SEQ ID NO: 1389907 - RNA, 19 nt, Homo sapiens
ccaauucuucucccaguga

SEQ ID NO: 1389908 - RNA, 19 nt, Homo sapiens
guggagggcucugucuguu

SEQ ID NO: 1389909 - RNA, 19 nt, Homo sapiens
uuugaccgguugcucauuu

SEQ ID NO: 1389910 - RNA, 19 nt, Homo sapiens
acagaaagguguccaagua

SEQ ID NO: 1389911 - RNA, 19 nt, Homo sapiens
gcagacagcuuaaaugacu

SEQ ID NO: 1389912 - RNA, 19 nt, Homo sapiens
gaaccaggcugucgaagca

SEQ ID NO: 1389913 - RNA, 19 nt, Homo sapiens
ggaugggaguggagaguua

SEQ ID NO: 1389914 - RNA, 19 nt, Homo sapiens
aaucagaacugggacguua

SEQ ID NO: 1389915 - RNA, 19 nt, Homo sapiens
caacaucgagccacucuuu

SEQ ID NO: 1389916 - RNA, 19 nt, Homo sapiens
gaggaggcauugucacuuc

SEQ ID NO: 1389917 - RNA, 19 nt, Homo sapiens
gagcauggguguggaaguc

SEQ ID NO: 1389918 - RNA, 19 nt, Homo sapiens
ccgcauggcagacagcuua

SEQ ID NO: 1389919 - RNA, 19 nt, Homo sapiens
caaagacaaguaucagcua

SEQ ID NO: 1389920 - RNA, 19 nt, Homo sapiens
gaaguccugucagccaaga

SEQ ID NO: 1389921 - RNA, 19 nt, Homo sapiens
gcuagcaucaggacagaaa

SEQ ID NO: 1389922 - RNA, 19 nt, Homo sapiens
gcaucaccuguaucuauua

SEQ ID NO: 1389923 - RNA, 19 nt, Homo sapiens
gaaaugggccgaggauggu

SEQ ID NO: 1389924 - RNA, 19 nt, Homo sapiens
ggugagucauggccucuug

SEQ ID NO: 1389925 - RNA, 19 nt, Homo sapiens
ccaccaggaugcaggacuu

SEQ ID NO: 1389926 - RNA, 19 nt, Homo sapiens
guccaggagugccuaguga

SEQ ID NO: 1389927 - RNA, 19 nt, Homo sapiens
ggccauggcaggcaccuuu

SEQ ID NO: 1389928 - RNA, 19 nt, Homo sapiens
cgccaucacugucugguau

SEQ ID NO: 1389929 - RNA, 19 nt, Homo sapiens
gggcagcuaugucaucaac

SEQ ID NO: 1389930 - RNA, 19 nt, Homo sapiens
uggcagacagcuuaaauga

SEQ ID NO: 1389931 - RNA, 19 nt, Homo sapiens
gccuggcccuggacuauau

SEQ ID NO: 1389932 - RNA, 19 nt, Homo sapiens
ugcaucaccuguaucuauu

SEQ ID NO: 1389933 - RNA, 19 nt, Homo sapiens
gucaggcucucccucaguu

SEQ ID NO: 1389934 - RNA, 19 nt, Homo sapiens
ggaccaaggaggagaagag

SEQ ID NO: 1389935 - RNA, 19 nt, Homo sapiens
ccaucacugucugguauuu

SEQ ID NO: 1389936 - RNA, 19 nt, Homo sapiens
guggagggcucugucuguu

SEQ ID NO: 1389937 - RNA, 19 nt, Homo sapiens
uuugaccgguugcucauuu

SEQ ID NO: 1389938 - RNA, 19 nt, Homo sapiens
aagcauuggugcccucaug

SEQ ID NO: 1389939 - RNA, 19 nt, Homo sapiens
ggccaccguuaccaacuga

SEQ ID NO: 1389940 - RNA, 19 nt, Homo sapiens
cagcagccaaagacaagua

SEQ ID NO: 1389941 - RNA, 19 nt, Homo sapiens
cugcaucaccuguaucuau

SEQ ID NO: 1389942 - RNA, 19 nt, Homo sapiens
agacaaguaucagcuagca

SEQ ID NO: 1389943 - RNA, 19 nt, Homo sapiens
cagccuaugccaccaggua

SEQ ID NO: 1389944 - RNA, 19 nt, Homo sapiens
ggaggaggcauugucacuu

SEQ ID NO: 1389945 - RNA, 19 nt, Homo sapiens
ccugucagccaagaaauaa

SEQ ID NO: 1389946 - RNA, 19 nt, Homo sapiens
cagcuagcaucaggacaga

SEQ ID NO: 1389947 - RNA, 19 nt, Homo sapiens
gggcagcagccaaagacaa

SEQ ID NO: 1389948 - RNA, 19 nt, Homo sapiens
ccagguacgccaucacugu

SEQ ID NO: 1389949 - RNA, 19 nt, Homo sapiens
uaaggcacguugacaaucc

SEQ ID NO: 1389950 - RNA, 19 nt, Homo sapiens
caucaccuguaucuauuac

SEQ ID NO: 1389951 - RNA, 19 nt, Homo sapiens
gagcugggaggaggcauug

SEQ ID NO: 1389952 - RNA, 19 nt, Homo sapiens
ccaccgcugcugcuucuga

SEQ ID NO: 1389953 - RNA, 19 nt, Homo sapiens
cagccaaagacaaguauca

SEQ ID NO: 1389954 - RNA, 19 nt, Homo sapiens
gaccaaggaggagaagaga

SEQ ID NO: 1389955 - RNA, 19 nt, Homo sapiens
cuucugacuuugccucugu

SEQ ID NO: 1389956 - RNA, 19 nt, Homo sapiens
gccugccugucucuaguuu

SEQ ID NO: 1389957 - RNA, 19 nt, Homo sapiens
cgagacgggcagcuaguga

SEQ ID NO: 1389958 - RNA, 19 nt, Homo sapiens
caacgggcucggguacgua

SEQ ID NO: 1389959 - RNA, 19 nt, Homo sapiens
gguggaaggccaugaacca

SEQ ID NO: 1389960 - RNA, 19 nt, Homo sapiens
gaggagaagagaccuuugc

SEQ ID NO: 1389961 - RNA, 19 nt, Homo sapiens
ggaggagaagagaccuuug

SEQ ID NO: 1389962 - RNA, 19 nt, Homo sapiens
cauggcagacagcuuaaau

SEQ ID NO: 1389963 - RNA, 19 nt, Homo sapiens
acaucgagccacucuuuga

SEQ ID NO: 1389964 - RNA, 19 nt, Homo sapiens
guaaggcacguugacaauc

SEQ ID NO: 1389965 - RNA, 19 nt, Homo sapiens
cguaaggcacguugacaau

SEQ ID NO: 1389966 - RNA, 19 nt, Homo sapiens
gaccuuugcugccccauca

SEQ ID NO: 1389967 - RNA, 19 nt, Homo sapiens
cuguaucuauuaccugaau

SEQ ID NO: 1389968 - RNA, 19 nt, Homo sapiens
ggcgcugcaucaccuguau

SEQ ID NO: 1389969 - RNA, 19 nt, Homo sapiens
ccuggaaugugaagugacu

SEQ ID NO: 1389970 - RNA, 19 nt, Homo sapiens
gaggagcauggguguggaa

SEQ ID NO: 1389971 - RNA, 19 nt, Homo sapiens
acagaaagguguccaagua

SEQ ID NO: 1389972 - RNA, 19 nt, Homo sapiens
gcagacagcuuaaaugacu

SEQ ID NO: 1389973 - RNA, 19 nt, Homo sapiens
gaaccaggcugucgaagca

SEQ ID NO: 1389974 - RNA, 19 nt, Homo sapiens
ggaugggaguggagaguua

SEQ ID NO: 1389975 - RNA, 19 nt, Homo sapiens
aaucagaacugggacguua

SEQ ID NO: 1389976 - RNA, 19 nt, Homo sapiens
caacaucgagccacucuuu

SEQ ID NO: 1389977 - RNA, 19 nt, Homo sapiens
gaggaggcauugucacuuc

SEQ ID NO: 1389978 - RNA, 19 nt, Homo sapiens
gagcauggguguggaaguc

SEQ ID NO: 1389979 - RNA, 19 nt, Homo sapiens
ccgcauggcagacagcuua

SEQ ID NO: 1389980 - RNA, 19 nt, Homo sapiens
caaagacaaguaucagcua

SEQ ID NO: 1389981 - RNA, 19 nt, Homo sapiens
gaaguccugucagccaaga

SEQ ID NO: 1389982 - RNA, 19 nt, Homo sapiens
gcuagcaucaggacagaaa

SEQ ID NO: 1389983 - RNA, 19 nt, Homo sapiens
gcaucaccuguaucuauua

SEQ ID NO: 1389984 - RNA, 19 nt, Homo sapiens
gaaaugggccgaggauggu

SEQ ID NO: 1389985 - RNA, 19 nt, Homo sapiens
ggugagucauggccucuug

SEQ ID NO: 1389986 - RNA, 19 nt, Homo sapiens
ccaccaggaugcaggacuu

SEQ ID NO: 1389987 - RNA, 19 nt, Homo sapiens
guccaggagugccuaguga

SEQ ID NO: 1389988 - RNA, 19 nt, Homo sapiens
ggccauggcaggcaccuuu

SEQ ID NO: 1389989 - RNA, 19 nt, Homo sapiens
cgccaucacugucugguau

SEQ ID NO: 1389990 - RNA, 19 nt, Homo sapiens
gggcagcuaugucaucaac

SEQ ID NO: 1389991 - RNA, 19 nt, Homo sapiens
uggcagacagcuuaaauga

SEQ ID NO: 1389992 - RNA, 19 nt, Homo sapiens
gccuggcccuggacuauau

SEQ ID NO: 1389993 - RNA, 19 nt, Homo sapiens
gucaggcucucccucaguu

SEQ ID NO: 1389994 - RNA, 19 nt, Homo sapiens
ugcaucaccuguaucuauu

SEQ ID NO: 1389995 - RNA, 19 nt, Homo sapiens
ggaccaaggaggagaagag

SEQ ID NO: 1389996 - RNA, 19 nt, Homo sapiens
ccaucacugucugguauuu

SEQ ID NO: 1389997 - RNA, 19 nt, Homo sapiens
guggagggcucugucuguu

SEQ ID NO: 1389998 - RNA, 19 nt, Homo sapiens
uuugaccgguugcucauuu

SEQ ID NO: 1389999 - RNA, 19 nt, Homo sapiens
aagcauuggugcccucaug

SEQ ID NO: 1390000 - RNA, 19 nt, Homo sapiens
ggccaccguuaccaacuga

SEQ ID NO: 1390001 - RNA, 19 nt, Homo sapiens
cagcagccaaagacaagua

SEQ ID NO: 1390002 - RNA, 19 nt, Homo sapiens
cugcaucaccuguaucuau

SEQ ID NO: 1390003 - RNA, 19 nt, Homo sapiens
agacaaguaucagcuagca

SEQ ID NO: 1390004 - RNA, 19 nt, Homo sapiens
cagccuaugccaccaggua

SEQ ID NO: 1390005 - RNA, 19 nt, Homo sapiens
ggaggaggcauugucacuu

SEQ ID NO: 1390006 - RNA, 19 nt, Homo sapiens
ccugucagccaagaaauaa

SEQ ID NO: 1390007 - RNA, 19 nt, Homo sapiens
cagcuagcaucaggacaga

SEQ ID NO: 1390008 - RNA, 19 nt, Homo sapiens
gggcagcagccaaagacaa

SEQ ID NO: 1390009 - RNA, 19 nt, Homo sapiens
ccagguacgccaucacugu

SEQ ID NO: 1390010 - RNA, 19 nt, Homo sapiens
uaaggcacguugacaaucc

SEQ ID NO: 1390011 - RNA, 19 nt, Homo sapiens
caucaccuguaucuauuac

SEQ ID NO: 1390012 - RNA, 19 nt, Homo sapiens
gagcugggaggaggcauug

SEQ ID NO: 1390013 - RNA, 19 nt, Homo sapiens
ccaccgcugcugcuucuga

SEQ ID NO: 1390014 - RNA, 19 nt, Homo sapiens
cagccaaagacaaguauca

SEQ ID NO: 1390015 - RNA, 19 nt, Homo sapiens
gaccaaggaggagaagaga

SEQ ID NO: 1390016 - RNA, 19 nt, Homo sapiens
cuucugacuuugccucugu

SEQ ID NO: 1390017 - RNA, 19 nt, Homo sapiens
cgagacgggcagcuaguga

SEQ ID NO: 1390018 - RNA, 19 nt, Homo sapiens
caacgggcucggguacgua

SEQ ID NO: 1390019 - RNA, 19 nt, Homo sapiens
gguggaaggccaugaacca

SEQ ID NO: 1390020 - RNA, 19 nt, Homo sapiens
gaggagaagagaccuuugc

SEQ ID NO: 1390021 - RNA, 19 nt, Homo sapiens
ggaggagaagagaccuuug

SEQ ID NO: 1390022 - RNA, 19 nt, Homo sapiens
cauggcagacagcuuaaau

SEQ ID NO: 1390023 - RNA, 19 nt, Homo sapiens
acaucgagccacucuuuga

SEQ ID NO: 1390024 - RNA, 19 nt, Homo sapiens
guaaggcacguugacaauc

SEQ ID NO: 1390025 - RNA, 19 nt, Homo sapiens
cguaaggcacguugacaau

SEQ ID NO: 1390026 - RNA, 19 nt, Homo sapiens
gaccuuugcugccccauca

SEQ ID NO: 1390027 - RNA, 19 nt, Homo sapiens
cuguaucuauuaccugaau

SEQ ID NO: 1390028 - RNA, 19 nt, Homo sapiens
ggcgcugcaucaccuguau

SEQ ID NO: 1390029 - RNA, 19 nt, Homo sapiens
ccuggaaugugaagugacu

SEQ ID NO: 1390030 - RNA, 19 nt, Homo sapiens
gaggagcauggguguggaa

SEQ ID NO: 1390031 - RNA, 19 nt, Homo sapiens
uuaaugagcucacccuuua

SEQ ID NO: 1390032 - RNA, 19 nt, Homo sapiens
gaaccuuacuugcacuuua

SEQ ID NO: 1390033 - RNA, 19 nt, Homo sapiens
agaaagggcugcugucaua

SEQ ID NO: 1390034 - RNA, 19 nt, Homo sapiens
gaauaaagauggcaacaca

SEQ ID NO: 1390035 - RNA, 19 nt, Homo sapiens
gauaagacaugucaccauu

SEQ ID NO: 1390036 - RNA, 19 nt, Homo sapiens
gaaaggaggagguuugaaa

SEQ ID NO: 1390037 - RNA, 19 nt, Homo sapiens
uaagacaugucaccauuaa

SEQ ID NO: 1390038 - RNA, 19 nt, Homo sapiens
gaaaucugcuggccuuguu

SEQ ID NO: 1390039 - RNA, 19 nt, Homo sapiens
gaaaaucccaugaacauua

SEQ ID NO: 1390040 - RNA, 19 nt, Homo sapiens
ccugauagauucgguaaua

SEQ ID NO: 1390041 - RNA, 19 nt, Homo sapiens
guacuuugaugcugaagaa

SEQ ID NO: 1390042 - RNA, 19 nt, Homo sapiens
ggagaauuaucacaaccua

SEQ ID NO: 1390043 - RNA, 19 nt, Homo sapiens
aguaagggcucaguaaaua

SEQ ID NO: 1390044 - RNA, 19 nt, Homo sapiens
aaagcagggugauguauuu

SEQ ID NO: 1390045 - RNA, 19 nt, Homo sapiens
gcaggaaacagagaaauuu

SEQ ID NO: 1390046 - RNA, 19 nt, Homo sapiens
aaacaugugugcaucuuga

SEQ ID NO: 1390047 - RNA, 19 nt, Homo sapiens
agagcuaggucuacugaua

SEQ ID NO: 1390048 - RNA, 19 nt, Homo sapiens
gcaaccagauaugcuauga

SEQ ID NO: 1390049 - RNA, 19 nt, Homo sapiens
ggagccggcugggcaaaua

SEQ ID NO: 1390050 - RNA, 19 nt, Homo sapiens
ucacuuggcucucuagauc

SEQ ID NO: 1390051 - RNA, 19 nt, Homo sapiens
ugugucaucugaacaauuu

SEQ ID NO: 1390052 - RNA, 19 nt, Homo sapiens
aaagauggcaacacaauuu

SEQ ID NO: 1390053 - RNA, 19 nt, Homo sapiens
ggaaugaaccuuacuugca

SEQ ID NO: 1390054 - RNA, 19 nt, Homo sapiens
cauuaaagagccagaaaua

SEQ ID NO: 1390055 - RNA, 19 nt, Homo sapiens
ggaaagagcuaggucuacu

SEQ ID NO: 1390056 - RNA, 19 nt, Homo sapiens
guaauacuaucaagagaag

SEQ ID NO: 1390057 - RNA, 19 nt, Homo sapiens
ucuacuaucugaacaagaa

SEQ ID NO: 1390058 - RNA, 19 nt, Homo sapiens
agaaauuugugucaucuga

SEQ ID NO: 1390059 - RNA, 19 nt, Homo sapiens
gcaaauacuacgucaagga

SEQ ID NO: 1390060 - RNA, 19 nt, Homo sapiens
agacaugucaccauuaauu

SEQ ID NO: 1390061 - RNA, 19 nt, Homo sapiens
ggagaggucuaaggcaaug

SEQ ID NO: 1390062 - RNA, 19 nt, Homo sapiens
gcucacccuuuaacacaaa

SEQ ID NO: 1390063 - RNA, 19 nt, Homo sapiens
gauagauucgguaauacua

SEQ ID NO: 1390064 - RNA, 19 nt, Homo sapiens
gaauaaacucagucuccua

SEQ ID NO: 1390065 - RNA, 19 nt, Homo sapiens
ugaccagaaucauggaauu

SEQ ID NO: 1390066 - RNA, 19 nt, Homo sapiens
ggucuacugauauacaaua

SEQ ID NO: 1390067 - RNA, 19 nt, Homo sapiens
cugcuggccuuguucauuu

SEQ ID NO: 1390068 - RNA, 19 nt, Homo sapiens
ggaaacagagaaauuugug

SEQ ID NO: 1390069 - RNA, 19 nt, Homo sapiens
uaguaacgguuccugaauu

SEQ ID NO: 1390070 - RNA, 19 nt, Homo sapiens
gcagggugauguauuuuaa

SEQ ID NO: 1390071 - RNA, 19 nt, Homo sapiens
cucaacgacugcucuauuu

SEQ ID NO: 1390072 - RNA, 19 nt, Homo sapiens
gagcuaggucuacugauau

SEQ ID NO: 1390073 - RNA, 19 nt, Homo sapiens
cuugcuaacuccagaaauu

SEQ ID NO: 1390074 - RNA, 19 nt, Homo sapiens
ggaaauggaacagguuaug

SEQ ID NO: 1390075 - RNA, 19 nt, Homo sapiens
gugugcaucuugaacaauu

SEQ ID NO: 1390076 - RNA, 19 nt, Homo sapiens
gccagcgguuuaccugaua

SEQ ID NO: 1390077 - RNA, 19 nt, Homo sapiens
guuccugaauucucuuaaa

SEQ ID NO: 1390078 - RNA, 19 nt, Homo sapiens
ccagauaugcuaugacugu

SEQ ID NO: 1390079 - RNA, 19 nt, Homo sapiens
cauaguaagggcucaguaa

SEQ ID NO: 1390080 - RNA, 19 nt, Homo sapiens
cagagaaauuugugucauc

SEQ ID NO: 1390081 - RNA, 19 nt, Homo sapiens
gagcacagcgagggaauga

SEQ ID NO: 1390082 - RNA, 19 nt, Homo sapiens
agaaauuccugcagacauc

SEQ ID NO: 1390083 - RNA, 19 nt, Homo sapiens
gaucgcacugccucaauaa

SEQ ID NO: 1390084 - RNA, 19 nt, Homo sapiens
gagcucacccuuuaacaca

SEQ ID NO: 1390085 - RNA, 19 nt, Homo sapiens
acugauaacuguggaaaga

SEQ ID NO: 1390086 - RNA, 19 nt, Homo sapiens
aaucugcccucacugaaga

SEQ ID NO: 1390087 - RNA, 19 nt, Homo sapiens
gaaauggaacagguuaugu

SEQ ID NO: 1390088 - RNA, 19 nt, Homo sapiens
aaacucagucuccuacauu

SEQ ID NO: 1390089 - RNA, 19 nt, Homo sapiens
aaauauaucccugguaguu

SEQ ID NO: 1390090 - RNA, 19 nt, Homo sapiens
gggcugcugucauagugaa

SEQ ID NO: 1390091 - RNA, 19 nt, Homo sapiens
gguaauacuaucaagagaa

SEQ ID NO: 1390092 - RNA, 19 nt, Homo sapiens
cgguuuaccugauagauuc

SEQ ID NO: 1390093 - RNA, 19 nt, Homo sapiens
agaaagggcagaagccaaa

SEQ ID NO: 1390094 - RNA, 19 nt, Homo sapiens
gcagauguggagcccauuu

SEQ ID NO: 1390095 - RNA, 19 nt, Homo sapiens
agaucgcacugccucaaua

SEQ ID NO: 1390096 - RNA, 19 nt, Homo sapiens
gaaauuugugucaucugaa

SEQ ID NO: 1390097 - RNA, 19 nt, Homo sapiens
ggaggagguuugaaaagaa

SEQ ID NO: 1390098 - RNA, 19 nt, Homo sapiens
gauggccucuucagugaca

SEQ ID NO: 1390099 - RNA, 19 nt, Homo sapiens
uaaacucagucuccuacau

SEQ ID NO: 1390100 - RNA, 19 nt, Homo sapiens
gaccagaaucauggaauuu

SEQ ID NO: 1390101 - RNA, 19 nt, Homo sapiens
gagguggaguuggaaaugu

SEQ ID NO: 1390102 - RNA, 19 nt, Homo sapiens
auuaauaccucuagaaagg

SEQ ID NO: 1390103 - RNA, 19 nt, Homo sapiens
ucaggaauuuaacuaggaa

SEQ ID NO: 1390104 - RNA, 19 nt, Homo sapiens
gggcaaauacuacgucaag

SEQ ID NO: 1390105 - RNA, 19 nt, Homo sapiens
gcacaaugaagacaggaau

SEQ ID NO: 1390106 - RNA, 19 nt, Homo sapiens
gauacucucuuugccagau

SEQ ID NO: 1390107 - RNA, 19 nt, Homo sapiens
gaacauuaaagagccagaa

SEQ ID NO: 1390108 - RNA, 19 nt, Homo sapiens
gcacugccucaauaacuug

SEQ ID NO: 1390109 - RNA, 19 nt, Homo sapiens
gacauuaguuguuuugguu

SEQ ID NO: 1390110 - RNA, 19 nt, Homo sapiens
uaaagauggcaacacaauu

SEQ ID NO: 1390111 - RNA, 19 nt, Homo sapiens
gacauuaauaccucuagaa

SEQ ID NO: 1390112 - RNA, 19 nt, Homo sapiens
gaaaucauucauagcagau

SEQ ID NO: 1390113 - RNA, 19 nt, Homo sapiens
acaaugaagacaggaauuu

SEQ ID NO: 1390114 - RNA, 19 nt, Homo sapiens
guuguacgguaauaguuau

SEQ ID NO: 1390115 - RNA, 19 nt, Homo sapiens
aaauguggguguuccuguu

SEQ ID NO: 1390116 - RNA, 19 nt, Homo sapiens
gaucguucccucucugguu

SEQ ID NO: 1390117 - RNA, 19 nt, Homo sapiens
ugacauuaauaccucuaga

SEQ ID NO: 1390118 - RNA, 19 nt, Homo sapiens
gcacagcgagggaaugaac

SEQ ID NO: 1390119 - RNA, 19 nt, Homo sapiens
cgacugcucuauuuuguug

SEQ ID NO: 1390120 - RNA, 19 nt, Homo sapiens
gaaacagagaaauuugugu

SEQ ID NO: 1390121 - RNA, 19 nt, Homo sapiens
ggccagcgguuuaccugau

SEQ ID NO: 1390122 - RNA, 19 nt, Homo sapiens
cuacucggccagcgguuua

SEQ ID NO: 1390123 - RNA, 19 nt, Homo sapiens
ccucuucagugacaacaau

SEQ ID NO: 1390124 - RNA, 19 nt, Homo sapiens
gacugaccgugcucugaaa

SEQ ID NO: 1390125 - RNA, 19 nt, Homo sapiens
aacucagucuccuacauua

SEQ ID NO: 1390126 - RNA, 19 nt, Homo sapiens
aaauagugccgggaacaua

SEQ ID NO: 1390127 - RNA, 19 nt, Homo sapiens
aaauugcccuggaguacau

SEQ ID NO: 1390128 - RNA, 19 nt, Homo sapiens
gcgaccagaucacguggau

SEQ ID NO: 1390129 - RNA, 19 nt, Homo sapiens
gagaauuaucacaaccuaa

SEQ ID NO: 1390130 - RNA, 19 nt, Homo sapiens
ccucuuacgcaaccagaua

SEQ ID NO: 1390131 - RNA, 19 nt, Homo sapiens
gaaccuuacuugcacuuua

SEQ ID NO: 1390132 - RNA, 19 nt, Homo sapiens
agaaagggcugcugucaua

SEQ ID NO: 1390133 - RNA, 19 nt, Homo sapiens
gaauaaagauggcaacaca

SEQ ID NO: 1390134 - RNA, 19 nt, Homo sapiens
gaaaggaggagguuugaaa

SEQ ID NO: 1390135 - RNA, 19 nt, Homo sapiens
gaaaucugcuggccuuguu

SEQ ID NO: 1390136 - RNA, 19 nt, Homo sapiens
ccugauagauucgguaaua

SEQ ID NO: 1390137 - RNA, 19 nt, Homo sapiens
guacuuugaugcugaagaa

SEQ ID NO: 1390138 - RNA, 19 nt, Homo sapiens
ggagaauuaucacaaccua

SEQ ID NO: 1390139 - RNA, 19 nt, Homo sapiens
gcaggaaacagagaaauuu

SEQ ID NO: 1390140 - RNA, 19 nt, Homo sapiens
gcaaccagauaugcuauga

SEQ ID NO: 1390141 - RNA, 19 nt, Homo sapiens
ggagccggcugggcaaaua

SEQ ID NO: 1390142 - RNA, 19 nt, Homo sapiens
ugugucaucugaacaauuu

SEQ ID NO: 1390143 - RNA, 19 nt, Homo sapiens
ggaaugaaccuuacuugca

SEQ ID NO: 1390144 - RNA, 19 nt, Homo sapiens
guaauacuaucaagagaag

SEQ ID NO: 1390145 - RNA, 19 nt, Homo sapiens
ucuacuaucugaacaagaa

SEQ ID NO: 1390146 - RNA, 19 nt, Homo sapiens
agaaauuugugucaucuga

SEQ ID NO: 1390147 - RNA, 19 nt, Homo sapiens
gcaaauacuacgucaagga

SEQ ID NO: 1390148 - RNA, 19 nt, Homo sapiens
ggagaggucuaaggcaaug

SEQ ID NO: 1390149 - RNA, 19 nt, Homo sapiens
gauagauucgguaauacua

SEQ ID NO: 1390150 - RNA, 19 nt, Homo sapiens
cugcuggccuuguucauuu

SEQ ID NO: 1390151 - RNA, 19 nt, Homo sapiens
ggaaacagagaaauuugug

SEQ ID NO: 1390152 - RNA, 19 nt, Homo sapiens
uaguaacgguuccugaauu

SEQ ID NO: 1390153 - RNA, 19 nt, Homo sapiens
ggaaauggaacagguuaug

SEQ ID NO: 1390154 - RNA, 19 nt, Homo sapiens
gccagcgguuuaccugaua

SEQ ID NO: 1390155 - RNA, 19 nt, Homo sapiens
guuccugaauucucuuaaa

SEQ ID NO: 1390156 - RNA, 19 nt, Homo sapiens
ccagauaugcuaugacugu

SEQ ID NO: 1390157 - RNA, 19 nt, Homo sapiens
cagagaaauuugugucauc

SEQ ID NO: 1390158 - RNA, 19 nt, Homo sapiens
gagcacagcgagggaauga

SEQ ID NO: 1390159 - RNA, 19 nt, Homo sapiens
agaaauuccugcagacauc

SEQ ID NO: 1390160 - RNA, 19 nt, Homo sapiens
aaucugcccucacugaaga

SEQ ID NO: 1390161 - RNA, 19 nt, Homo sapiens
gaaauggaacagguuaugu

SEQ ID NO: 1390162 - RNA, 19 nt, Homo sapiens
gggcugcugucauagugaa

SEQ ID NO: 1390163 - RNA, 19 nt, Homo sapiens
gguaauacuaucaagagaa

SEQ ID NO: 1390164 - RNA, 19 nt, Homo sapiens
cgguuuaccugauagauuc

SEQ ID NO: 1390165 - RNA, 19 nt, Homo sapiens
agaaagggcagaagccaaa

SEQ ID NO: 1390166 - RNA, 19 nt, Homo sapiens
gcagauguggagcccauuu

SEQ ID NO: 1390167 - RNA, 19 nt, Homo sapiens
gaaauuugugucaucugaa

SEQ ID NO: 1390168 - RNA, 19 nt, Homo sapiens
ggaggagguuugaaaagaa

SEQ ID NO: 1390169 - RNA, 19 nt, Homo sapiens
gauggccucuucagugaca

SEQ ID NO: 1390170 - RNA, 19 nt, Homo sapiens
auuaauaccucuagaaagg

SEQ ID NO: 1390171 - RNA, 19 nt, Homo sapiens
ucaggaauuuaacuaggaa

SEQ ID NO: 1390172 - RNA, 19 nt, Homo sapiens
gggcaaauacuacgucaag

SEQ ID NO: 1390173 - RNA, 19 nt, Homo sapiens
gauacucucuuugccagau

SEQ ID NO: 1390174 - RNA, 19 nt, Homo sapiens
gacauuaauaccucuagaa

SEQ ID NO: 1390175 - RNA, 19 nt, Homo sapiens
gaaaucauucauagcagau

SEQ ID NO: 1390176 - RNA, 19 nt, Homo sapiens
auaaagauggcaacacaaa

SEQ ID NO: 1390177 - RNA, 19 nt, Homo sapiens
ugacauuaauaccucuaga

SEQ ID NO: 1390178 - RNA, 19 nt, Homo sapiens
gcacagcgagggaaugaac

SEQ ID NO: 1390179 - RNA, 19 nt, Homo sapiens
gaucguucccucucugguu

SEQ ID NO: 1390180 - RNA, 19 nt, Homo sapiens
gaaacagagaaauuugugu

SEQ ID NO: 1390181 - RNA, 19 nt, Homo sapiens
ggccagcgguuuaccugau

SEQ ID NO: 1390182 - RNA, 19 nt, Homo sapiens
cuacucggccagcgguuua

SEQ ID NO: 1390183 - RNA, 19 nt, Homo sapiens
ccucuucagugacaacaau

SEQ ID NO: 1390184 - RNA, 19 nt, Homo sapiens
gacugaccgugcucugaaa

SEQ ID NO: 1390185 - RNA, 19 nt, Homo sapiens
gagaauuaucacaaccuaa

SEQ ID NO: 1390186 - RNA, 19 nt, Homo sapiens
gcgaccagaucacguggau

SEQ ID NO: 1390187 - RNA, 19 nt, Homo sapiens
aaauugcccuggaguacau

SEQ ID NO: 1390188 - RNA, 19 nt, Homo sapiens
ccucuuacgcaaccagaua

SEQ ID NO: 1390189 - RNA, 19 nt, Homo sapiens
ucaccugcaucuacuaucu

SEQ ID NO: 1390190 - RNA, 19 nt, Homo sapiens
gaggagguuugaaaagaaa

SEQ ID NO: 1390191 - RNA, 19 nt, Homo sapiens
aaccuuacuugcacuuuau

SEQ ID NO: 1390192 - RNA, 19 nt, Homo sapiens
gcuucgcgcucguguagau

SEQ ID NO: 1390193 - RNA, 19 nt, Homo sapiens
gacaacaaucucccugcua

SEQ ID NO: 1390194 - RNA, 19 nt, Homo sapiens
gcgguuuaccugauagauu

SEQ ID NO: 1390195 - RNA, 19 nt, Homo sapiens
acgaagugcagcccucuua

SEQ ID NO: 1390196 - RNA, 19 nt, Homo sapiens
gcgagggaaugaaccuuac

SEQ ID NO: 1390197 - RNA, 19 nt, Homo sapiens
uagauucgguaauacuauc

SEQ ID NO: 1390198 - RNA, 19 nt, Homo sapiens
ucugcuaccuggacaacuu

SEQ ID NO: 1390199 - RNA, 19 nt, Homo sapiens
gaggggaaaucauucauag

SEQ ID NO: 1390200 - RNA, 19 nt, Homo sapiens
uaacagcaggaaacagaga

SEQ ID NO: 1390201 - RNA, 19 nt, Homo sapiens
ucgacaggcugguccucua

SEQ ID NO: 1390202 - RNA, 19 nt, Homo sapiens
aguaacgguuccugaauuc

SEQ ID NO: 1390203 - RNA, 19 nt, Homo sapiens
uaucacaaccuaaugacau

SEQ ID NO: 1390204 - RNA, 19 nt, Homo sapiens
caggaaacagagaaauuug

SEQ ID NO: 1390205 - RNA, 19 nt, Homo sapiens
cuuaacagcaggaaacaga

SEQ ID NO: 1390206 - RNA, 19 nt, Homo sapiens
guaggaacccacacgaagu

SEQ ID NO: 1390207 - RNA, 19 nt, Homo sapiens
gcugucauagugaacaauu

SEQ ID NO: 1390208 - RNA, 19 nt, Homo sapiens
gaaucugcccucacugaag

SEQ ID NO: 1390209 - RNA, 19 nt, Homo sapiens
cugaacaauuuccagaugu

SEQ ID NO: 1390210 - RNA, 19 nt, Homo sapiens
guauacuuccugauuugaa

SEQ ID NO: 1390211 - RNA, 19 nt, Homo sapiens
cgggaaauggaacagguua

SEQ ID NO: 1390212 - RNA, 19 nt, Homo sapiens
caauuuccagauguucuua

SEQ ID NO: 1390213 - RNA, 19 nt, Homo sapiens
caaucucccugcuacuucu

SEQ ID NO: 1390214 - RNA, 19 nt, Homo sapiens
agacugaccgugcucugaa

SEQ ID NO: 1390215 - RNA, 19 nt, Homo sapiens
aaccagauaugcuaugacu

SEQ ID NO: 1390216 - RNA, 19 nt, Homo sapiens
caucuacuaucugaacaag

SEQ ID NO: 1390217 - RNA, 19 nt, Homo sapiens
agagaaauuugugucaucu

SEQ ID NO: 1390218 - RNA, 19 nt, Homo sapiens
gagggaaugaaccuuacuu

SEQ ID NO: 1390219 - RNA, 19 nt, Homo sapiens
ugaccgugcucugaaaucu

SEQ ID NO: 1390220 - RNA, 19 nt, Homo sapiens
ugcccucacugaagacuga

SEQ ID NO: 1390221 - RNA, 19 nt, Homo sapiens
aaauuugugucaucugaac

SEQ ID NO: 1390222 - RNA, 19 nt, Homo sapiens
ucccgagaguugcgagaaa

SEQ ID NO: 1390223 - RNA, 19 nt, Homo sapiens
aaucauucauagcagaugu

SEQ ID NO: 1390224 - RNA, 19 nt, Homo sapiens
ggcagccgcagguuucuga

SEQ ID NO: 1390225 - RNA, 19 nt, Homo sapiens
acagagaaauuugugucau

SEQ ID NO: 1390226 - RNA, 19 nt, Homo sapiens
cgguaauacuaucaagaga

SEQ ID NO: 1390227 - RNA, 19 nt, Homo sapiens
gaaagggcugcugucauag

SEQ ID NO: 1390228 - RNA, 19 nt, Homo sapiens
caucacggaagccuuaaca

SEQ ID NO: 1390229 - RNA, 19 nt, Homo sapiens
ugugugguacuucauguuu

SEQ ID NO: 1390230 - RNA, 19 nt, Homo sapiens
gaaaauugcccuggaguac

SEQ ID NO: 1390231 - RNA, 19 nt, Homo sapiens
gcaaauaucugcuagaaga

SEQ ID NO: 1390232 - RNA, 19 nt, Homo sapiens
gaagggacaugaauauaua

SEQ ID NO: 1390233 - RNA, 19 nt, Homo sapiens
gaagauaacuuugaacagu

SEQ ID NO: 1390234 - RNA, 19 nt, Homo sapiens
ggaaagaauucaaacaucu

SEQ ID NO: 1390235 - RNA, 19 nt, Homo sapiens
gcagcgcgguuauugauuu

SEQ ID NO: 1390236 - RNA, 19 nt, Homo sapiens
gcacuaauacucagccuuu

SEQ ID NO: 1390237 - RNA, 19 nt, Homo sapiens
acaagaagcuauacgaaug

SEQ ID NO: 1390238 - RNA, 19 nt, Homo sapiens
ggauagaucagacuccaua

SEQ ID NO: 1390239 - RNA, 19 nt, Homo sapiens
gauuaaaugugugauguga

SEQ ID NO: 1390240 - RNA, 19 nt, Homo sapiens
gauaccaucuucccuaauc

SEQ ID NO: 1390241 - RNA, 19 nt, Homo sapiens
ggacaucuggucacuugua

SEQ ID NO: 1390242 - RNA, 19 nt, Homo sapiens
caagagaagauaacuuuga

SEQ ID NO: 1390243 - RNA, 19 nt, Homo sapiens
gaaagacacuacagaaaau

SEQ ID NO: 1390244 - RNA, 19 nt, Homo sapiens
gaagagaagggacaugaau

SEQ ID NO: 1390245 - RNA, 19 nt, Homo sapiens
gggaacagcaugcuaaaug

SEQ ID NO: 1390246 - RNA, 19 nt, Homo sapiens
gcucaggaguugacaaaca

SEQ ID NO: 1390247 - RNA, 19 nt, Homo sapiens
ggaacagcaugcuaaaugg

SEQ ID NO: 1390248 - RNA, 19 nt, Homo sapiens
ugaagaagcuagauaacag

SEQ ID NO: 1390249 - RNA, 19 nt, Homo sapiens
gcgccgaauugcagguuua

SEQ ID NO: 1390250 - RNA, 19 nt, Homo sapiens
agauggagcuggacgauau

SEQ ID NO: 1390251 - RNA, 19 nt, Homo sapiens
guggacaucuggucacuug

SEQ ID NO: 1390252 - RNA, 19 nt, Homo sapiens
gagaagggacaugaauaua

SEQ ID NO: 1390253 - RNA, 19 nt, Homo sapiens
ggugugcuauguucuuauu

SEQ ID NO: 1390254 - RNA, 19 nt, Homo sapiens
guauccagguugcaaauau

SEQ ID NO: 1390255 - RNA, 19 nt, Homo sapiens
gacaucuggucacuuguaa

SEQ ID NO: 1390256 - RNA, 19 nt, Homo sapiens
cgaaugggauuugauuuca

SEQ ID NO: 1390257 - RNA, 19 nt, Homo sapiens
gaggagggcuagccaacug

SEQ ID NO: 1390258 - RNA, 19 nt, Homo sapiens
gauguacuccgucaacaaa

SEQ ID NO: 1390259 - RNA, 19 nt, Homo sapiens
ugagggagcucugguacaa

SEQ ID NO: 1390260 - RNA, 19 nt, Homo sapiens
ggccuuagcugcccugaag

SEQ ID NO: 1390261 - RNA, 19 nt, Homo sapiens
gugauaccaucuucccuaa

SEQ ID NO: 1390262 - RNA, 19 nt, Homo sapiens
ucaacaaguucuccaagga

SEQ ID NO: 1390263 - RNA, 19 nt, Homo sapiens
gagaagauaacuuugaaca

SEQ ID NO: 1390264 - RNA, 19 nt, Homo sapiens
caucugggagcaacuauaa

SEQ ID NO: 1390265 - RNA, 19 nt, Homo sapiens
gcuaaaugguauccagguu

SEQ ID NO: 1390266 - RNA, 19 nt, Homo sapiens
ggagacauuuuccuaauug

SEQ ID NO: 1390267 - RNA, 19 nt, Homo sapiens
cagaaagacacuacagaaa

SEQ ID NO: 1390268 - RNA, 19 nt, Homo sapiens
gaggaaagaauucaaacau

SEQ ID NO: 1390269 - RNA, 19 nt, Homo sapiens
gauaacagucguuucacaa

SEQ ID NO: 1390270 - RNA, 19 nt, Homo sapiens
ugaagacagugccacgaaa

SEQ ID NO: 1390271 - RNA, 19 nt, Homo sapiens
ugaagcaguugacagaugu

SEQ ID NO: 1390272 - RNA, 19 nt, Homo sapiens
gaucgugccuggucagaac

SEQ ID NO: 1390273 - RNA, 19 nt, Homo sapiens
caagugcagugcuucuguu

SEQ ID NO: 1390274 - RNA, 19 nt, Homo sapiens
ggaugaagaauuaguaaag

SEQ ID NO: 1390275 - RNA, 19 nt, Homo sapiens
guucuuauuacccugauua

SEQ ID NO: 1390276 - RNA, 19 nt, Homo sapiens
gcuggacgauaucaugcua

SEQ ID NO: 1390277 - RNA, 19 nt, Homo sapiens
caacaaguucuccaaggaa

SEQ ID NO: 1390278 - RNA, 19 nt, Homo sapiens
gugcagugcuucuguugug

SEQ ID NO: 1390279 - RNA, 19 nt, Homo sapiens
ccacaacguuaauauucga

SEQ ID NO: 1390280 - RNA, 19 nt, Homo sapiens
ucagaaagacacuacagaa

SEQ ID NO: 1390281 - RNA, 19 nt, Homo sapiens
gaaagaauucaaacaucug

SEQ ID NO: 1390282 - RNA, 19 nt, Homo sapiens
ccaaggaauccauccauga

SEQ ID NO: 1390283 - RNA, 19 nt, Homo sapiens
aaucugauguugcgaguuc

SEQ ID NO: 1390284 - RNA, 19 nt, Homo sapiens
gcgagacgguggacaaguc

SEQ ID NO: 1390285 - RNA, 19 nt, Homo sapiens
gauguugcgaguucugaua

SEQ ID NO: 1390286 - RNA, 19 nt, Homo sapiens
aagaggagaagcuuuguaa

SEQ ID NO: 1390287 - RNA, 19 nt, Homo sapiens
agaagggacaugaauauau

SEQ ID NO: 1390288 - RNA, 19 nt, Homo sapiens
ggccacaacguuaauauuc

SEQ ID NO: 1390289 - RNA, 19 nt, Homo sapiens
gacaaguccuauauucaag

SEQ ID NO: 1390290 - RNA, 19 nt, Homo sapiens
cuaauacucagccuuuaaa

SEQ ID NO: 1390291 - RNA, 19 nt, Homo sapiens
aaaacacagugcacuaaua

SEQ ID NO: 1390292 - RNA, 19 nt, Homo sapiens
caucuucccuaauccuaug

SEQ ID NO: 1390293 - RNA, 19 nt, Homo sapiens
cuaauccuaugcuacaaga

SEQ ID NO: 1390294 - RNA, 19 nt, Homo sapiens
cuagauaacagucguuuca

SEQ ID NO: 1390295 - RNA, 19 nt, Homo sapiens
agaaagcagcgccgaauug

SEQ ID NO: 1390296 - RNA, 19 nt, Homo sapiens
gaggagaagcuuuguaaaa

SEQ ID NO: 1390297 - RNA, 19 nt, Homo sapiens
cgaggugaaucugauguug

SEQ ID NO: 1390298 - RNA, 19 nt, Homo sapiens
ucagaacacaggagacauu

SEQ ID NO: 1390299 - RNA, 19 nt, Homo sapiens
gggcaggguuuggcauuuc

SEQ ID NO: 1390300 - RNA, 19 nt, Homo sapiens
ucaaggacguuaagaaaau

SEQ ID NO: 1390301 - RNA, 19 nt, Homo sapiens
cauuuaacccguucacuug

SEQ ID NO: 1390302 - RNA, 19 nt, Homo sapiens
uugcaaauaucugcuagaa

SEQ ID NO: 1390303 - RNA, 19 nt, Homo sapiens
ggagcuggacgauaucaug

SEQ ID NO: 1390304 - RNA, 19 nt, Homo sapiens
gaacacaggagacauuuuc

SEQ ID NO: 1390305 - RNA, 19 nt, Homo sapiens
uaacagucguuucacaacu

SEQ ID NO: 1390306 - RNA, 19 nt, Homo sapiens
ggaguugacaaacacaaga

SEQ ID NO: 1390307 - RNA, 19 nt, Homo sapiens
cgaaggaucuaaaacguau

SEQ ID NO: 1390308 - RNA, 19 nt, Homo sapiens
caagaggagaagcuuugua

SEQ ID NO: 1390309 - RNA, 19 nt, Homo sapiens
ggaggaaagaauucaaaca

SEQ ID NO: 1390310 - RNA, 19 nt, Homo sapiens
agagaagggacaugaauau

SEQ ID NO: 1390311 - RNA, 19 nt, Homo sapiens
aauagucaauaccaaguug

SEQ ID NO: 1390312 - RNA, 19 nt, Homo sapiens
caagaaagcagcgccgaau

SEQ ID NO: 1390313 - RNA, 19 nt, Homo sapiens
agacuucauugcagagaga

SEQ ID NO: 1390314 - RNA, 19 nt, Homo sapiens
aagagaagggacaugaaua

SEQ ID NO: 1390315 - RNA, 19 nt, Homo sapiens
caaagagcagcuugcaaga

SEQ ID NO: 1390316 - RNA, 19 nt, Homo sapiens
cacaggcacugaugaccaa

SEQ ID NO: 1390317 - RNA, 19 nt, Homo sapiens
gaagaagcuagauaacagu

SEQ ID NO: 1390318 - RNA, 19 nt, Homo sapiens
gacaggugguggauagauc

SEQ ID NO: 1390319 - RNA, 19 nt, Homo sapiens
gaacaguuucgaaggaucu

SEQ ID NO: 1390320 - RNA, 19 nt, Homo sapiens
gggcucaggaguugacaaa

SEQ ID NO: 1390321 - RNA, 19 nt, Homo sapiens
cugcagacaucaauaggau

SEQ ID NO: 1390322 - RNA, 19 nt, Homo sapiens
ggagaagcuuuguaaaauc

SEQ ID NO: 1390323 - RNA, 19 nt, Homo sapiens
caagaaaacaccaucacua

SEQ ID NO: 1390324 - RNA, 19 nt, Homo sapiens
gaacagcaugcuaaauggu

SEQ ID NO: 1390325 - RNA, 19 nt, Homo sapiens
ucaagaggauaaaguacag

SEQ ID NO: 1390326 - RNA, 19 nt, Homo sapiens
ugcaagagcuggauuuuau

SEQ ID NO: 1390327 - RNA, 19 nt, Homo sapiens
uggacgauaucaugcuaaa

SEQ ID NO: 1390328 - RNA, 19 nt, Homo sapiens
uuaaaugugugaugugacu

SEQ ID NO: 1390329 - RNA, 19 nt, Homo sapiens
gauuucaagcaaagaguuu

SEQ ID NO: 1390330 - RNA, 19 nt, Homo sapiens
ugugugcgcguguguauaa

SEQ ID NO: 1390331 - RNA, 19 nt, Homo sapiens
cgaagaagcucugcuccaa

SEQ ID NO: 1390332 - RNA, 19 nt, Homo sapiens
gcagagcggucagggauca

SEQ ID NO: 1390333 - RNA, 19 nt, Homo sapiens
gaagaagcucugcuccaaa

SEQ ID NO: 1390334 - RNA, 19 nt, Homo sapiens
aagaagcucugcuccaaau

SEQ ID NO: 1390335 - RNA, 19 nt, Homo sapiens
gcgggaagcuccacguucu

SEQ ID NO: 1390336 - RNA, 19 nt, Homo sapiens
gcuugugccuugucccaaa

SEQ ID NO: 1390337 - RNA, 19 nt, Homo sapiens
ccaguccuguguccucuga

SEQ ID NO: 1390338 - RNA, 19 nt, Homo sapiens
gcacucacgcccuaauaag

SEQ ID NO: 1390339 - RNA, 19 nt, Homo sapiens
gaagcucugcuccaaaugg

SEQ ID NO: 1390340 - RNA, 19 nt, Homo sapiens
gcaccggauugcagaaggu

SEQ ID NO: 1390341 - RNA, 19 nt, Homo sapiens
gcagcuggaggccgaaguu

SEQ ID NO: 1390342 - RNA, 19 nt, Homo sapiens
gcaggacaccgaggaagau

SEQ ID NO: 1390343 - RNA, 19 nt, Homo sapiens
gcuggaggccgaaguugga

SEQ ID NO: 1390344 - RNA, 19 nt, Homo sapiens
uagcacucacgcccuaaua

SEQ ID NO: 1390345 - RNA, 19 nt, Homo sapiens
agccagcgcuuuccagaag

SEQ ID NO: 1390346 - RNA, 19 nt, Homo sapiens
caaggaggagggugaaguc

SEQ ID NO: 1390347 - RNA, 19 nt, Homo sapiens
gagcggucagggaucauga

SEQ ID NO: 1390348 - RNA, 19 nt, Homo sapiens
gcuccacguucugcucuuc

SEQ ID NO: 1390349 - RNA, 19 nt, Homo sapiens
gcgcucaccaucaauaaaa

SEQ ID NO: 1390350 - RNA, 19 nt, Homo sapiens
aguccuguguccucugaaa

SEQ ID NO: 1390351 - RNA, 19 nt, Homo sapiens
ugagggagagugcguugga

SEQ ID NO: 1390352 - RNA, 19 nt, Homo sapiens
gaagacccaugccaagaaa

SEQ ID NO: 1390353 - RNA, 19 nt, Homo sapiens
caaccucccugcacuaaug

SEQ ID NO: 1390354 - RNA, 19 nt, Homo sapiens
ccacagaccucagcuuaag

SEQ ID NO: 1390355 - RNA, 19 nt, Homo sapiens
ggccacagaccucagcuua

SEQ ID NO: 1390356 - RNA, 19 nt, Homo sapiens
ccucaucccugcacugguu

SEQ ID NO: 1390357 - RNA, 19 nt, Homo sapiens
ugaggaggaucgaaugaga

SEQ ID NO: 1390358 - RNA, 19 nt, Homo sapiens
ccagaaaccucgggacuac

SEQ ID NO: 1390359 - RNA, 19 nt, Homo sapiens
gcgaguuucuuucuugaag

SEQ ID NO: 1390360 - RNA, 19 nt, Homo sapiens
uagccaagcucuuaagcau

SEQ ID NO: 1390361 - RNA, 19 nt, Homo sapiens
ucacgugcuucguaaugaa

SEQ ID NO: 1390362 - RNA, 19 nt, Homo sapiens
cgaagacccaugccaagaa

SEQ ID NO: 1390363 - RNA, 19 nt, Homo sapiens
ucauucacgugcuucguaa

SEQ ID NO: 1390364 - RNA, 19 nt, Homo sapiens
caucguggccuucgcuuau

SEQ ID NO: 1390365 - RNA, 19 nt, Homo sapiens
caaccucccgucaccguuu

SEQ ID NO: 1390366 - RNA, 19 nt, Homo sapiens
ccaagaaacaguguccaaa

SEQ ID NO: 1390367 - RNA, 19 nt, Homo sapiens
ucucuuccuucccuucuuu

SEQ ID NO: 1390368 - RNA, 19 nt, Homo sapiens
gccgcugucucugcuauuu

SEQ ID NO: 1390369 - RNA, 19 nt, Homo sapiens
ugaggagagucccaagguu

SEQ ID NO: 1390370 - RNA, 19 nt, Homo sapiens
cuggaaaccucccugaaca

SEQ ID NO: 1390371 - RNA, 19 nt, Homo sapiens
gauucugucugagagugua

SEQ ID NO: 1390372 - RNA, 19 nt, Homo sapiens
aaccagaagugagcaaaga

SEQ ID NO: 1390373 - RNA, 19 nt, Homo sapiens
aaacagcccaggccacaga

SEQ ID NO: 1390374 - RNA, 19 nt, Homo sapiens
gcagccagcagcucugaga

SEQ ID NO: 1390375 - RNA, 19 nt, Homo sapiens
cagcagcucugagaucucu

SEQ ID NO: 1390376 - RNA, 19 nt, Homo sapiens
uaagcauccucuucuccaa

SEQ ID NO: 1390377 - RNA, 19 nt, Homo sapiens
ccucaguccucucuuccuu

SEQ ID NO: 1390378 - RNA, 19 nt, Homo sapiens
ccggguagccaagcucuua

SEQ ID NO: 1390379 - RNA, 19 nt, Homo sapiens
gaggaggaucgaaugagaa

SEQ ID NO: 1390380 - RNA, 19 nt, Homo sapiens
caagaaacaguguccaaac

SEQ ID NO: 1390381 - RNA, 19 nt, Homo sapiens
uuccuucccuucuuuauca

SEQ ID NO: 1390382 - RNA, 19 nt, Homo sapiens
ccaguccgcgaguuucuuu

SEQ ID NO: 1390383 - RNA, 19 nt, Homo sapiens
gccagcagcucugagaucu

SEQ ID NO: 1390384 - RNA, 19 nt, Homo sapiens
gcugucaugucccggaaca

SEQ ID NO: 1390385 - RNA, 19 nt, Homo sapiens
gaguuucuuucuugaaggu

SEQ ID NO: 1390386 - RNA, 19 nt, Homo sapiens
gcagcucugagaucucuga

SEQ ID NO: 1390387 - RNA, 19 nt, Homo sapiens
ccgcgaguuucuuucuuga

SEQ ID NO: 1390388 - RNA, 19 nt, Homo sapiens
uagauucauucacgugcuu

SEQ ID NO: 1390389 - RNA, 19 nt, Homo sapiens
ggaaaccucccugcacucu

SEQ ID NO: 1390390 - RNA, 19 nt, Homo sapiens
gccacagaccucagcuuaa

SEQ ID NO: 1390391 - RNA, 19 nt, Homo sapiens
gcucucagccucccugcau

SEQ ID NO: 1390392 - RNA, 19 nt, Homo sapiens
cgugcuucguaaugaaaua

SEQ ID NO: 1390393 - RNA, 19 nt, Homo sapiens
aaccucccgucaccguuua

SEQ ID NO: 1390394 - RNA, 19 nt, Homo sapiens
ucaacuuaggcguguauaa

SEQ ID NO: 1390395 - RNA, 19 nt, Homo sapiens
caagccagcccuucaacca

SEQ ID NO: 1390396 - RNA, 19 nt, Homo sapiens
gccaagaaacaguguccaa

SEQ ID NO: 1390397 - RNA, 19 nt, Homo sapiens
ccucccaacuuucauuguc

SEQ ID NO: 1390398 - RNA, 19 nt, Homo sapiens
guccugcuccugcaucuug

SEQ ID NO: 1390399 - RNA, 19 nt, Homo sapiens
agccugagcggccuuguuu

SEQ ID NO: 1390400 - RNA, 19 nt, Homo sapiens
caaaccagaagugagcaaa

SEQ ID NO: 1390401 - RNA, 19 nt, Homo sapiens
ccuccugcgucaucaacuu

SEQ ID NO: 1390402 - RNA, 19 nt, Homo sapiens
caucaacuuaggcguguau

SEQ ID NO: 1390403 - RNA, 19 nt, Homo sapiens
gcagcugguugaggaggau

SEQ ID NO: 1390404 - RNA, 19 nt, Homo sapiens
gggaaucaaaggccaacug

SEQ ID NO: 1390405 - RNA, 19 nt, Homo sapiens
ugagcggccuuguuuacag

SEQ ID NO: 1390406 - RNA, 19 nt, Homo sapiens
gagccugagcggccuuguu

SEQ ID NO: 1390407 - RNA, 19 nt, Homo sapiens
cgaaugagaagggcacaca

SEQ ID NO: 1390408 - RNA, 19 nt, Homo sapiens
ccccugagauucugucuga

SEQ ID NO: 1390409 - RNA, 19 nt, Homo sapiens
gcuucguaaugaaauaauc

SEQ ID NO: 1390410 - RNA, 19 nt, Homo sapiens
ccucaucucccuuaagcau

SEQ ID NO: 1390411 - RNA, 19 nt, Homo sapiens
ccugagauucugucugaga

SEQ ID NO: 1390412 - RNA, 19 nt, Homo sapiens
uccgcgaguuucuuucuug

SEQ ID NO: 1390413 - RNA, 19 nt, Homo sapiens
gggaaaagcaagagaaugg

SEQ ID NO: 1390414 - RNA, 19 nt, Homo sapiens
gaucagagaugguugugua

SEQ ID NO: 1390415 - RNA, 19 nt, Homo sapiens
uauaauagcugcuuuccua

SEQ ID NO: 1390416 - RNA, 19 nt, Homo sapiens
gcaguuguuugacuacuua

SEQ ID NO: 1390417 - RNA, 19 nt, Homo sapiens
caaaggcccauuuauaaua

SEQ ID NO: 1390418 - RNA, 19 nt, Homo sapiens
caucaaaggcccauuuaua

SEQ ID NO: 1390419 - RNA, 19 nt, Homo sapiens
aaagaaggauugaagcauu

SEQ ID NO: 1390420 - RNA, 19 nt, Homo sapiens
uacaaugacugcauguuaa

SEQ ID NO: 1390421 - RNA, 19 nt, Homo sapiens
ccaagcaguuguuugacua

SEQ ID NO: 1390422 - RNA, 19 nt, Homo sapiens
cagcuuggauuaauuagga

SEQ ID NO: 1390423 - RNA, 19 nt, Homo sapiens
cuacaaugacugcauguua

SEQ ID NO: 1390424 - RNA, 19 nt, Homo sapiens
gaaggagucccucugaaga

SEQ ID NO: 1390425 - RNA, 19 nt, Homo sapiens
gaaucgacaugcuggaaug

SEQ ID NO: 1390426 - RNA, 19 nt, Homo sapiens
uggcuuagcuugaauuaca

SEQ ID NO: 1390427 - RNA, 19 nt, Homo sapiens
uacagaaccuuacuucaga

SEQ ID NO: 1390428 - RNA, 19 nt, Homo sapiens
ggguuugccuggaguauga

SEQ ID NO: 1390429 - RNA, 19 nt, Homo sapiens
cacaucaacuggacagauu

SEQ ID NO: 1390430 - RNA, 19 nt, Homo sapiens
gcaggaaguaggaauagaa

SEQ ID NO: 1390431 - RNA, 19 nt, Homo sapiens
ggaaaucucggaagaagca

SEQ ID NO: 1390432 - RNA, 19 nt, Homo sapiens
aagaaggauugaagcauuu

SEQ ID NO: 1390433 - RNA, 19 nt, Homo sapiens
caauaugaguaaacaggaa

SEQ ID NO: 1390434 - RNA, 19 nt, Homo sapiens
caccauagccaggaaauaa

SEQ ID NO: 1390435 - RNA, 19 nt, Homo sapiens
cagagcaacuuacaagcuu

SEQ ID NO: 1390436 - RNA, 19 nt, Homo sapiens
gcauaaagcaggcucaagu

SEQ ID NO: 1390437 - RNA, 19 nt, Homo sapiens
ggaauugacaggcauaaag

SEQ ID NO: 1390438 - RNA, 19 nt, Homo sapiens
gcaaauccaagcaguuguu

SEQ ID NO: 1390439 - RNA, 19 nt, Homo sapiens
cagagaugguuguguaaug

SEQ ID NO: 1390440 - RNA, 19 nt, Homo sapiens
uggcaugucugcaaaggaa

SEQ ID NO: 1390441 - RNA, 19 nt, Homo sapiens
ugacuugccucuuguuucu

SEQ ID NO: 1390442 - RNA, 19 nt, Homo sapiens
gaucuugcaaucauggaua

SEQ ID NO: 1390443 - RNA, 19 nt, Homo sapiens
ucacuggcaugucugcaaa

SEQ ID NO: 1390444 - RNA, 19 nt, Homo sapiens
aaauggaaaucucggaaga

SEQ ID NO: 1390445 - RNA, 19 nt, Homo sapiens
agagaugguuguguaauga

SEQ ID NO: 1390446 - RNA, 19 nt, Homo sapiens
ucaggaacauccaauucuu

SEQ ID NO: 1390447 - RNA, 19 nt, Homo sapiens
gccaggaaauaauugaguu

SEQ ID NO: 1390448 - RNA, 19 nt, Homo sapiens
gaugaaggagucccucuga

SEQ ID NO: 1390449 - RNA, 19 nt, Homo sapiens
guuccaggcuuauguucaa

SEQ ID NO: 1390450 - RNA, 19 nt, Homo sapiens
ccucuuguuucuguaaaua

SEQ ID NO: 1390451 - RNA, 19 nt, Homo sapiens
aauauucucugguugacaa

SEQ ID NO: 1390452 - RNA, 19 nt, Homo sapiens
gggaauauucucugguuga

SEQ ID NO: 1390453 - RNA, 19 nt, Homo sapiens
cagcaacagaagaacauua

SEQ ID NO: 1390454 - RNA, 19 nt, Homo sapiens
gcuuaucucaguucuguaa

SEQ ID NO: 1390455 - RNA, 19 nt, Homo sapiens
gcaccaccauagccaggaa

SEQ ID NO: 1390456 - RNA, 19 nt, Homo sapiens
gaagcaaauccaagcaguu

SEQ ID NO: 1390457 - RNA, 19 nt, Homo sapiens
aaaggcccauuuauaauag

SEQ ID NO: 1390458 - RNA, 19 nt, Homo sapiens
aaaucugacuugccucuug

SEQ ID NO: 1390459 - RNA, 19 nt, Homo sapiens
guaaggagucugugugauc

SEQ ID NO: 1390460 - RNA, 19 nt, Homo sapiens
ucaaaggcccauuuauaau

SEQ ID NO: 1390461 - RNA, 19 nt, Homo sapiens
cggcagcuuggauuaauua

SEQ ID NO: 1390462 - RNA, 19 nt, Homo sapiens
aaucauggauaaggaagaa

SEQ ID NO: 1390463 - RNA, 19 nt, Homo sapiens
aucaaaggcccauuuauaa

SEQ ID NO: 1390464 - RNA, 19 nt, Homo sapiens
gaguaaggagucuguguga

SEQ ID NO: 1390465 - RNA, 19 nt, Homo sapiens
cagaagcccaauaugagua

SEQ ID NO: 1390466 - RNA, 19 nt, Homo sapiens
gaauuuggcuguggaaccu

SEQ ID NO: 1390467 - RNA, 19 nt, Homo sapiens
gaacauccaauucuuucag

SEQ ID NO: 1390468 - RNA, 19 nt, Homo sapiens
ucaguucuguaaauggauu

SEQ ID NO: 1390469 - RNA, 19 nt, Homo sapiens
uaucucaguucuguaaaug

SEQ ID NO: 1390470 - RNA, 19 nt, Homo sapiens
gagucccucugaagauuug

SEQ ID NO: 1390471 - RNA, 19 nt, Homo sapiens
aauccaagcaguuguuuga

SEQ ID NO: 1390472 - RNA, 19 nt, Homo sapiens
uaugugcauuuguuacuug

SEQ ID NO: 1390473 - RNA, 19 nt, Homo sapiens
gcaacagaagaacauuauu

SEQ ID NO: 1390474 - RNA, 19 nt, Homo sapiens
ucucaguucuguaaaugga

SEQ ID NO: 1390475 - RNA, 19 nt, Homo sapiens
ggagucccucugaagauuu

SEQ ID NO: 1390476 - RNA, 19 nt, Homo sapiens
gcggcagcuuggauuaauu

SEQ ID NO: 1390477 - RNA, 19 nt, Homo sapiens
uaaggagucugugugaucu

SEQ ID NO: 1390478 - RNA, 19 nt, Homo sapiens
ggugcuuucuagaaucaaa

SEQ ID NO: 1390479 - RNA, 19 nt, Homo sapiens
gaucucagagcaacuuaca

SEQ ID NO: 1390480 - RNA, 19 nt, Homo sapiens
gaguaugaguguaaaagaa

SEQ ID NO: 1390481 - RNA, 19 nt, Homo sapiens
caggaacauccaauucuuu

SEQ ID NO: 1390482 - RNA, 19 nt, Homo sapiens
ccauagccaggaaauaauu

SEQ ID NO: 1390483 - RNA, 19 nt, Homo sapiens
cauaaagcaggcucaaguu

SEQ ID NO: 1390484 - RNA, 19 nt, Homo sapiens
gaagaagcaaauccaagca

SEQ ID NO: 1390485 - RNA, 19 nt, Homo sapiens
aaacacagcaucacagacu

SEQ ID NO: 1390486 - RNA, 19 nt, Homo sapiens
ggaauauucucugguugac

SEQ ID NO: 1390487 - RNA, 19 nt, Homo sapiens
gcaaggagugucgggaaug

SEQ ID NO: 1390488 - RNA, 19 nt, Homo sapiens
cuacagaaccuuacuucag

SEQ ID NO: 1390489 - RNA, 19 nt, Homo sapiens
uaggugcuuucuagaauca

SEQ ID NO: 1390490 - RNA, 19 nt, Homo sapiens
uuuaggugcuuucuagaau

SEQ ID NO: 1390491 - RNA, 19 nt, Homo sapiens
gaagcccaauaugaguaaa

SEQ ID NO: 1390492 - RNA, 19 nt, Homo sapiens
caaggagugucgggaaugg

SEQ ID NO: 1390493 - RNA, 19 nt, Homo sapiens
uuacaaggucguugaacaa

SEQ ID NO: 1390494 - RNA, 19 nt, Homo sapiens
ccaggaaauaauugaguuu

SEQ ID NO: 1390495 - RNA, 19 nt, Homo sapiens
cauaagauucagcaacaga

SEQ ID NO: 1390496 - RNA, 19 nt, Homo sapiens
guacugaugggccaacaca

SEQ ID NO: 1390497 - RNA, 19 nt, Homo sapiens
uaaaagccauggguacuga

SEQ ID NO: 1390498 - RNA, 19 nt, Homo sapiens
caaauccaagcaguuguuu

SEQ ID NO: 1390499 - RNA, 19 nt, Homo sapiens
acaaugacugcauguuaaa

SEQ ID NO: 1390500 - RNA, 19 nt, Homo sapiens
gagaaaaccaaaaggacua

SEQ ID NO: 1390501 - RNA, 19 nt, Homo sapiens
gucaucaaaggcccauuua

SEQ ID NO: 1390502 - RNA, 19 nt, Homo sapiens
acagaaccuuacuucagaa

SEQ ID NO: 1390503 - RNA, 19 nt, Homo sapiens
gagaugguuguguaaugaa

SEQ ID NO: 1390504 - RNA, 19 nt, Homo sapiens
ggauuaauuaggagaaagu

SEQ ID NO: 1390505 - RNA, 19 nt, Homo sapiens
uucauaagauucagcaaca

SEQ ID NO: 1390506 - RNA, 19 nt, Homo sapiens
uugcuuaucucaguucugu

SEQ ID NO: 1390507 - RNA, 19 nt, Homo sapiens
gaauugacaggcauaaagc

SEQ ID NO: 1390508 - RNA, 19 nt, Homo sapiens
ugauaaagaaggauugaag

SEQ ID NO: 1390509 - RNA, 19 nt, Homo sapiens
aagcaaauccaagcaguug

SEQ ID NO: 1390510 - RNA, 19 nt, Homo sapiens
ucgacaugcuggaaugaug

SEQ ID NO: 1390511 - RNA, 19 nt, Homo sapiens
agaugguuguguaaugaaa

SEQ ID NO: 1390512 - RNA, 19 nt, Homo sapiens
cuuacaagcuuuucuauag

SEQ ID NO: 1390513 - RNA, 19 nt, Homo sapiens
agagcaacuuacaagcuuu

SEQ ID NO: 1390514 - RNA, 19 nt, Homo sapiens
ggagagaccuuucuuccuu

SEQ ID NO: 1390515 - RNA, 19 nt, Homo sapiens
gcuaugggauauacuauuu

SEQ ID NO: 1390516 - RNA, 19 nt, Homo sapiens
gauaagggcugcucccaau

SEQ ID NO: 1390517 - RNA, 19 nt, Homo sapiens
ggaagggacgcaccauuua

SEQ ID NO: 1390518 - RNA, 19 nt, Homo sapiens
cgagaaaguuggcaggaaa

SEQ ID NO: 1390519 - RNA, 19 nt, Homo sapiens
gcagauggcuuuggagaca

SEQ ID NO: 1390520 - RNA, 19 nt, Homo sapiens
gagacaauccuuucuauca

SEQ ID NO: 1390521 - RNA, 19 nt, Homo sapiens
gagggagacuguggagaua

SEQ ID NO: 1390522 - RNA, 19 nt, Homo sapiens
gaggaucucugucuugagu

SEQ ID NO: 1390523 - RNA, 19 nt, Homo sapiens
ggagcuagccgaauucgaa

SEQ ID NO: 1390524 - RNA, 19 nt, Homo sapiens
gagagcagauggcuuugga

SEQ ID NO: 1390525 - RNA, 19 nt, Homo sapiens
ggaucucugucuugaguuu

SEQ ID NO: 1390526 - RNA, 19 nt, Homo sapiens
ggaaucccagcuccacuua

SEQ ID NO: 1390527 - RNA, 19 nt, Homo sapiens
gaagggacgcaccauuuau

SEQ ID NO: 1390528 - RNA, 19 nt, Homo sapiens
gagacuacguccacagaca

SEQ ID NO: 1390529 - RNA, 19 nt, Homo sapiens
ggagggagacuguggagau

SEQ ID NO: 1390530 - RNA, 19 nt, Homo sapiens
aaaguuggcaggaaaguga

SEQ ID NO: 1390531 - RNA, 19 nt, Homo sapiens
gcugagggcuggcacuucu

SEQ ID NO: 1390532 - RNA, 19 nt, Homo sapiens
ccugagagcagauggcuuu

SEQ ID NO: 1390533 - RNA, 19 nt, Homo sapiens
agaccuuucuuccuuguug

SEQ ID NO: 1390534 - RNA, 19 nt, Homo sapiens
agagggccauggacuugua

SEQ ID NO: 1390535 - RNA, 19 nt, Homo sapiens
gggagacuguggagauauc

SEQ ID NO: 1390536 - RNA, 19 nt, Homo sapiens
uggagacaauccuuucuau

SEQ ID NO: 1390537 - RNA, 19 nt, Homo sapiens
gggugccuauccucaagua

SEQ ID NO: 1390538 - RNA, 19 nt, Homo sapiens
gcacuucuucugcuuucaa

SEQ ID NO: 1390539 - RNA, 19 nt, Homo sapiens
uggaagggacgcaccauuu

SEQ ID NO: 1390540 - RNA, 19 nt, Homo sapiens
gggauauacuauuucaucu

SEQ ID NO: 1390541 - RNA, 19 nt, Homo sapiens
gacaauccuuucuaucacu

SEQ ID NO: 1390542 - RNA, 19 nt, Homo sapiens
gaauugagggagagaccuu

SEQ ID NO: 1390543 - RNA, 19 nt, Homo sapiens
ugccuauccucaaguauug

SEQ ID NO: 1390544 - RNA, 19 nt, Homo sapiens
gugccuauccucaaguauu

SEQ ID NO: 1390545 - RNA, 19 nt, Homo sapiens
ggagaggcaacgagaaagu

SEQ ID NO: 1390546 - RNA, 19 nt, Homo sapiens
gagcuagccgaauucgaaa

SEQ ID NO: 1390547 - RNA, 19 nt, Homo sapiens
uggcugagguggccuugga

SEQ ID NO: 1390548 - RNA, 19 nt, Homo sapiens
gaccuuucuuccuuguuga

SEQ ID NO: 1390549 - RNA, 19 nt, Homo sapiens
gagaggcaacgagaaaguu

SEQ ID NO: 1390550 - RNA, 19 nt, Homo sapiens
aggaggaucucugucuuga

SEQ ID NO: 1390551 - RNA, 19 nt, Homo sapiens
ccaaguccguaggcccuuu

SEQ ID NO: 1390552 - RNA, 19 nt, Homo sapiens
gaaaguuggcaggaaagug

SEQ ID NO: 1390553 - RNA, 19 nt, Homo sapiens
uaagggcugcucccaauuc

SEQ ID NO: 1390554 - RNA, 19 nt, Homo sapiens
cuaggaggaucucugucuu

SEQ ID NO: 1390555 - RNA, 19 nt, Homo sapiens
caaguccguaggcccuuua

SEQ ID NO: 1390556 - RNA, 19 nt, Homo sapiens
ggagacaauccuuucuauc

SEQ ID NO: 1390557 - RNA, 19 nt, Homo sapiens
ccagagggccauggacuug

SEQ ID NO: 1390558 - RNA, 19 nt, Homo sapiens
gcugagguggccuuggaua

SEQ ID NO: 1390559 - RNA, 19 nt, Homo sapiens
aaggagaggcaacgagaaa

SEQ ID NO: 1390560 - RNA, 19 nt, Homo sapiens
uggaggauaucuaugugau

SEQ ID NO: 1390561 - RNA, 19 nt, Homo sapiens
guggugggcuaugggauau

SEQ ID NO: 1390562 - RNA, 19 nt, Homo sapiens
gagauauccugaggcugau

SEQ ID NO: 1390563 - RNA, 19 nt, Homo sapiens
ccuaggagcccaagaucug

SEQ ID NO: 1390564 - RNA, 19 nt, Homo sapiens
ggaaccagagggccaugga

SEQ ID NO: 1390565 - RNA, 19 nt, Homo sapiens
caaggagaggcaacgagaa

SEQ ID NO: 1390566 - RNA, 19 nt, Homo sapiens
gcuggcacuucuucugcuu

SEQ ID NO: 1390567 - RNA, 19 nt, Homo sapiens
ggaggauaucuaugugaug

SEQ ID NO: 1390568 - RNA, 19 nt, Homo sapiens
cagagacuacguccacaga

SEQ ID NO: 1390569 - RNA, 19 nt, Homo sapiens
ggugaagaucagugaagaa

SEQ ID NO: 1390570 - RNA, 19 nt, Homo sapiens
cguggugggcuaugggaua

SEQ ID NO: 1390571 - RNA, 19 nt, Homo sapiens
agacaauccuuucuaucac

SEQ ID NO: 1390572 - RNA, 19 nt, Homo sapiens
ugggauauacuauuucauc

SEQ ID NO: 1390573 - RNA, 19 nt, Homo sapiens
ggugggcuaugggauauac

SEQ ID NO: 1390574 - RNA, 19 nt, Homo sapiens
ccuggaggaaggaggguua

SEQ ID NO: 1390575 - RNA, 19 nt, Homo sapiens
gauauccugaggcugauuc

SEQ ID NO: 1390576 - RNA, 19 nt, Homo sapiens
gagaaaguuggcaggaaag

SEQ ID NO: 1390577 - RNA, 19 nt, Homo sapiens
gagggagagaccuuucuuc

SEQ ID NO: 1390578 - RNA, 19 nt, Homo sapiens
uauuggaagagcagaauug

SEQ ID NO: 1390579 - RNA, 19 nt, Homo sapiens
gugaagaucagugaagaag

SEQ ID NO: 1390580 - RNA, 19 nt, Homo sapiens
acgagaaaguuggcaggaa

SEQ ID NO: 1390581 - RNA, 19 nt, Homo sapiens
ggccaaggagggagacugu

SEQ ID NO: 1390582 - RNA, 19 nt, Homo sapiens
cuacguccacagacacuga

SEQ ID NO: 1390583 - RNA, 19 nt, Homo sapiens
uggcacuucuucugcuuuc

SEQ ID NO: 1390584 - RNA, 19 nt, Homo sapiens
ucucggaucaggugaagau

SEQ ID NO: 1390585 - RNA, 19 nt, Homo sapiens
gaagaaacaugcaauauca

SEQ ID NO: 1390586 - RNA, 19 nt, Homo sapiens
caagggagcugauaaagaa

SEQ ID NO: 1390587 - RNA, 19 nt, Homo sapiens
gaacuuuacucucaauuug

SEQ ID NO: 1390588 - RNA, 19 nt, Homo sapiens
gaagaaggguuugaacuuu

SEQ ID NO: 1390589 - RNA, 19 nt, Homo sapiens
gaaggguuauuguguguua

SEQ ID NO: 1390590 - RNA, 19 nt, Homo sapiens
gaacaaaguauaaggguuu

SEQ ID NO: 1390591 - RNA, 19 nt, Homo sapiens
gaaauuaagugagacagaa

SEQ ID NO: 1390592 - RNA, 19 nt, Homo sapiens
gcaagcaugucucuauauu

SEQ ID NO: 1390593 - RNA, 19 nt, Homo sapiens
ggaucuaccuggcaacauu

SEQ ID NO: 1390594 - RNA, 19 nt, Homo sapiens
gguaugaaaugaucuaaag

SEQ ID NO: 1390595 - RNA, 19 nt, Homo sapiens
aaagaggacuggugaucua

SEQ ID NO: 1390596 - RNA, 19 nt, Homo sapiens
aagaaggguuugaacuuua

SEQ ID NO: 1390597 - RNA, 19 nt, Homo sapiens
ggaagaaacaugcaauauc

SEQ ID NO: 1390598 - RNA, 19 nt, Homo sapiens
gguuugaacuuuacucuca

SEQ ID NO: 1390599 - RNA, 19 nt, Homo sapiens
gacccagucucuaacauau

SEQ ID NO: 1390600 - RNA, 19 nt, Homo sapiens
gaaauucaugcaaacaaga

SEQ ID NO: 1390601 - RNA, 19 nt, Homo sapiens
uggcaagcaugucucuaua

SEQ ID NO: 1390602 - RNA, 19 nt, Homo sapiens
uagguaaacuucagcacuu

SEQ ID NO: 1390603 - RNA, 19 nt, Homo sapiens
ccucuacccuucuacuuga

SEQ ID NO: 1390604 - RNA, 19 nt, Homo sapiens
gcaugucucuauauuggau

SEQ ID NO: 1390605 - RNA, 19 nt, Homo sapiens
ccuggcaacauucuuauua

SEQ ID NO: 1390606 - RNA, 19 nt, Homo sapiens
uguuaaagcuggacaccaa

SEQ ID NO: 1390607 - RNA, 19 nt, Homo sapiens
aagcaugucucuauauugg

SEQ ID NO: 1390608 - RNA, 19 nt, Homo sapiens
ggagugcaguggcgcaauc

SEQ ID NO: 1390609 - RNA, 19 nt, Homo sapiens
ucacacacuuaauugaguu

SEQ ID NO: 1390610 - RNA, 19 nt, Homo sapiens
ggacaccaacggaccauuc

SEQ ID NO: 1390611 - RNA, 19 nt, Homo sapiens
cuaccuggcaacauucuua

SEQ ID NO: 1390612 - RNA, 19 nt, Homo sapiens
ggaccauucacacacuuaa

SEQ ID NO: 1390613 - RNA, 19 nt, Homo sapiens
uagaaggguuauugugugu

SEQ ID NO: 1390614 - RNA, 19 nt, Homo sapiens
ucaagggagcugauaaaga

SEQ ID NO: 1390615 - RNA, 19 nt, Homo sapiens
agaagaaggguuugaacuu

SEQ ID NO: 1390616 - RNA, 19 nt, Homo sapiens
cuuauuaucccucaagcua

SEQ ID NO: 1390617 - RNA, 19 nt, Homo sapiens
agaaauucaugcaaacaag

SEQ ID NO: 1390618 - RNA, 19 nt, Homo sapiens
uauagaaggguuauugugu

SEQ ID NO: 1390619 - RNA, 19 nt, Homo sapiens
gcugucuauucacuucaua

SEQ ID NO: 1390620 - RNA, 19 nt, Homo sapiens
ggaggaagacuaaaaggaa

SEQ ID NO: 1390621 - RNA, 19 nt, Homo sapiens
gaggugggaggaucacuug

SEQ ID NO: 1390622 - RNA, 19 nt, Homo sapiens
cccuuaaucuugaauauac

SEQ ID NO: 1390623 - RNA, 19 nt, Homo sapiens
gcaauaucacucuaacucu

SEQ ID NO: 1390624 - RNA, 19 nt, Homo sapiens
caagcaugucucuauauug

SEQ ID NO: 1390625 - RNA, 19 nt, Homo sapiens
ugccucagccucccaagua

SEQ ID NO: 1390626 - RNA, 19 nt, Homo sapiens
gggagcugauaaagaacuu

SEQ ID NO: 1390627 - RNA, 19 nt, Homo sapiens
ccaaagaggacuggugauc

SEQ ID NO: 1390628 - RNA, 19 nt, Homo sapiens
aaggaagaaacaugcaaua

SEQ ID NO: 1390629 - RNA, 19 nt, Homo sapiens
uggcaacauucuuauuauc

SEQ ID NO: 1390630 - RNA, 19 nt, Homo sapiens
acucugcaccugcuaauug

SEQ ID NO: 1390631 - RNA, 19 nt, Homo sapiens
cuggcaacauucuuauuau

SEQ ID NO: 1390632 - RNA, 19 nt, Homo sapiens
gaaaauggcaagcaugucu

SEQ ID NO: 1390633 - RNA, 19 nt, Homo sapiens
ucagucaccuuuuguccua

SEQ ID NO: 1390634 - RNA, 19 nt, Homo sapiens
agaaggguuugaacuuuac

SEQ ID NO: 1390635 - RNA, 19 nt, Homo sapiens
caaagaggacuggugaucu

SEQ ID NO: 1390636 - RNA, 19 nt, Homo sapiens
ugaaauuaagugagacaga

SEQ ID NO: 1390637 - RNA, 19 nt, Homo sapiens
cccagucucuaacauauac

SEQ ID NO: 1390638 - RNA, 19 nt, Homo sapiens
uaugcugucuauucacuuc

SEQ ID NO: 1390639 - RNA, 19 nt, Homo sapiens
acaggaaaaucuuggguuu

SEQ ID NO: 1390640 - RNA, 19 nt, Homo sapiens
ccauucacacacuuaauug

SEQ ID NO: 1390641 - RNA, 19 nt, Homo sapiens
gaaaagaagaaggguuuga

SEQ ID NO: 1390642 - RNA, 19 nt, Homo sapiens
aaacaugcaauaucacucu

SEQ ID NO: 1390643 - RNA, 19 nt, Homo sapiens
gaggacuggugaucuacgu

SEQ ID NO: 1390644 - RNA, 19 nt, Homo sapiens
ggguuauuguguguuauau

SEQ ID NO: 1390645 - RNA, 19 nt, Homo sapiens
ucacuugagcccaggaguu

SEQ ID NO: 1390646 - RNA, 19 nt, Homo sapiens
ggugaucuacgugugcuuu

SEQ ID NO: 1390647 - RNA, 19 nt, Homo sapiens
ggcaagcaugucucuauau

SEQ ID NO: 1390648 - RNA, 19 nt, Homo sapiens
gguaaacuucagcacuuug

SEQ ID NO: 1390649 - RNA, 19 nt, Homo sapiens
cuucauagucauuaaggaa

SEQ ID NO: 1390650 - RNA, 19 nt, Homo sapiens
gaucuaccuggcaacauuc

SEQ ID NO: 1390651 - RNA, 19 nt, Homo sapiens
cacuugagcccaggaguuu

SEQ ID NO: 1390652 - RNA, 19 nt, Homo sapiens
acaggcagguguuaaagcu

SEQ ID NO: 1390653 - RNA, 19 nt, Homo sapiens
uagauuuucuuccccuuaa

SEQ ID NO: 1390654 - RNA, 19 nt, Homo sapiens
aaaggaagaaacaugcaau

SEQ ID NO: 1390655 - RNA, 19 nt, Homo sapiens
guaaacuucagcacuuugg

SEQ ID NO: 1390656 - RNA, 19 nt, Homo sapiens
acauuccucuacccuucua

SEQ ID NO: 1390657 - RNA, 19 nt, Homo sapiens
caccuaaacucuggaucuc

SEQ ID NO: 1390658 - RNA, 19 nt, Homo sapiens
gcaccugcuaauuggauga

SEQ ID NO: 1390659 - RNA, 19 nt, Homo sapiens
cuauagcuguuuucuggua

SEQ ID NO: 1390660 - RNA, 19 nt, Homo sapiens
agguaaacuucagcacuuu

SEQ ID NO: 1390661 - RNA, 19 nt, Homo sapiens
ccaaaaugguuaauacacu

SEQ ID NO: 1390662 - RNA, 19 nt, Homo sapiens
ucaccuaaacucuggaucu

SEQ ID NO: 1390663 - RNA, 19 nt, Homo sapiens
gaacuucuucccaaaaugg

SEQ ID NO: 1390664 - RNA, 19 nt, Homo sapiens
uuucaagggagcugauaaa

SEQ ID NO: 1390665 - RNA, 19 nt, Homo sapiens
cugcuaauuggaugacuuu

SEQ ID NO: 1390666 - RNA, 19 nt, Homo sapiens
gacaccaacggaccauuca

SEQ ID NO: 1390667 - RNA, 19 nt, Homo sapiens
acuuuacucucaauuugug

SEQ ID NO: 1390668 - RNA, 19 nt, Homo sapiens
caugcaauaucacucuaac

SEQ ID NO: 1390669 - RNA, 19 nt, Homo sapiens
agaaaucacuccuagauga

SEQ ID NO: 1390670 - RNA, 19 nt, Homo sapiens
caagaacucuccugacaga

SEQ ID NO: 1390671 - RNA, 19 nt, Homo sapiens
aaacucaaaugcugccuua

SEQ ID NO: 1390672 - RNA, 19 nt, Homo sapiens
ggaccuguguuauauuuga

SEQ ID NO: 1390673 - RNA, 19 nt, Homo sapiens
gacaagaacucuccugaca

SEQ ID NO: 1390674 - RNA, 19 nt, Homo sapiens
gacccaacaugauuuguaa

SEQ ID NO: 1390675 - RNA, 19 nt, Homo sapiens
uggaauggcugcaaauaaa

SEQ ID NO: 1390676 - RNA, 19 nt, Homo sapiens
gaagaaggaaggagaagaa

SEQ ID NO: 1390677 - RNA, 19 nt, Homo sapiens
guucaaaccugaguuguga

SEQ ID NO: 1390678 - RNA, 19 nt, Homo sapiens
ggauaaugauuucuccuau

SEQ ID NO: 1390679 - RNA, 19 nt, Homo sapiens
ugauauaccuucugagaca

SEQ ID NO: 1390680 - RNA, 19 nt, Homo sapiens
gaaaucacuccuagaugaa

SEQ ID NO: 1390681 - RNA, 19 nt, Homo sapiens
ggacggagaagacgaggaa

SEQ ID NO: 1390682 - RNA, 19 nt, Homo sapiens
acuccuagaugaaauguuu

SEQ ID NO: 1390683 - RNA, 19 nt, Homo sapiens
gauacagaaggcaauaaua

SEQ ID NO: 1390684 - RNA, 19 nt, Homo sapiens
cuagggaccuguguuauau

SEQ ID NO: 1390685 - RNA, 19 nt, Homo sapiens
gaagaggaagagauucaaa

SEQ ID NO: 1390686 - RNA, 19 nt, Homo sapiens
ggaaggagaagaaaacaua

SEQ ID NO: 1390687 - RNA, 19 nt, Homo sapiens
ugaacaugcugauacagaa

SEQ ID NO: 1390688 - RNA, 19 nt, Homo sapiens
gaggaagagauucaaauga

SEQ ID NO: 1390689 - RNA, 19 nt, Homo sapiens
gcaguugguucugguggaa

SEQ ID NO: 1390690 - RNA, 19 nt, Homo sapiens
caaaugcugccuuagaaau

SEQ ID NO: 1390691 - RNA, 19 nt, Homo sapiens
ggagaaaccaaugcacuug

SEQ ID NO: 1390692 - RNA, 19 nt, Homo sapiens
uaaaugccauacaaugaag

SEQ ID NO: 1390693 - RNA, 19 nt, Homo sapiens
gcacuuggaaauagaagau

SEQ ID NO: 1390694 - RNA, 19 nt, Homo sapiens
ugaagacgaagaaguggua

SEQ ID NO: 1390695 - RNA, 19 nt, Homo sapiens
cucaaaugcugccuuagaa

SEQ ID NO: 1390696 - RNA, 19 nt, Homo sapiens
caaugcacuuggaaauaga

SEQ ID NO: 1390697 - RNA, 19 nt, Homo sapiens
guggaauggcugcaaauaa

SEQ ID NO: 1390698 - RNA, 19 nt, Homo sapiens
cgacccaacaugauuugua

SEQ ID NO: 1390699 - RNA, 19 nt, Homo sapiens
ucuagggaccuguguuaua

SEQ ID NO: 1390700 - RNA, 19 nt, Homo sapiens
ugaagaagcucagcaugac

SEQ ID NO: 1390701 - RNA, 19 nt, Homo sapiens
ggaagaggaggagcaguug

SEQ ID NO: 1390702 - RNA, 19 nt, Homo sapiens
agggaccuguguuauauuu

SEQ ID NO: 1390703 - RNA, 19 nt, Homo sapiens
gaacaggagaaaccaaugc

SEQ ID NO: 1390704 - RNA, 19 nt, Homo sapiens
aaaugaagacgaagaagug

SEQ ID NO: 1390705 - RNA, 19 nt, Homo sapiens
gaccuguguuauauuugaa

SEQ ID NO: 1390706 - RNA, 19 nt, Homo sapiens
ccaacaugauuuguaacuu

SEQ ID NO: 1390707 - RNA, 19 nt, Homo sapiens
gguggaauggcugcaaaua

SEQ ID NO: 1390708 - RNA, 19 nt, Homo sapiens
uuagaaaucacuccuagau

SEQ ID NO: 1390709 - RNA, 19 nt, Homo sapiens
auucagacuuccucucaaa

SEQ ID NO: 1390710 - RNA, 19 nt, Homo sapiens
ggcugcaaauaaaggauaa

SEQ ID NO: 1390711 - RNA, 19 nt, Homo sapiens
aaacauaggugggguggaa

SEQ ID NO: 1390712 - RNA, 19 nt, Homo sapiens
aagcucagcaugacaagaa

SEQ ID NO: 1390713 - RNA, 19 nt, Homo sapiens
ucaaaugcugccuuagaaa

SEQ ID NO: 1390714 - RNA, 19 nt, Homo sapiens
ggaagaggaagagauucaa

SEQ ID NO: 1390715 - RNA, 19 nt, Homo sapiens
gauucagacuuccucucaa

SEQ ID NO: 1390716 - RNA, 19 nt, Homo sapiens
ggaauggcugcaaauaaag

SEQ ID NO: 1390717 - RNA, 19 nt, Homo sapiens
gaacaugcugauacagaag

SEQ ID NO: 1390718 - RNA, 19 nt, Homo sapiens
gauaaaucuuuggaauugg

SEQ ID NO: 1390719 - RNA, 19 nt, Homo sapiens
gaagaagcucagcaugaca

SEQ ID NO: 1390720 - RNA, 19 nt, Homo sapiens
gcugauacagaaggcaaua

SEQ ID NO: 1390721 - RNA, 19 nt, Homo sapiens
uaucgacccaacaugauuu

SEQ ID NO: 1390722 - RNA, 19 nt, Homo sapiens
gauucugguccucuuauug

SEQ ID NO: 1390723 - RNA, 19 nt, Homo sapiens
auaaugauuucuccuaucg

SEQ ID NO: 1390724 - RNA, 19 nt, Homo sapiens
acucuagggaccuguguua

SEQ ID NO: 1390725 - RNA, 19 nt, Homo sapiens
cugguccucuuauugauau

SEQ ID NO: 1390726 - RNA, 19 nt, Homo sapiens
agaggaagagauucaaaug

SEQ ID NO: 1390727 - RNA, 19 nt, Homo sapiens
ggaauuggaagaggaagag

SEQ ID NO: 1390728 - RNA, 19 nt, Homo sapiens
acucaaaugcugccuuaga

SEQ ID NO: 1390729 - RNA, 19 nt, Homo sapiens
aaaccugaguugugaacag

SEQ ID NO: 1390730 - RNA, 19 nt, Homo sapiens
gccauacaaugaagaagcu

SEQ ID NO: 1390731 - RNA, 19 nt, Homo sapiens
aaucacuccuagaugaaau

SEQ ID NO: 1390732 - RNA, 19 nt, Homo sapiens
gaauggcugcaaauaaagg

SEQ ID NO: 1390733 - RNA, 19 nt, Homo sapiens
gugaacaggagaaaccaau

SEQ ID NO: 1390734 - RNA, 19 nt, Homo sapiens
gaaggaaggagaagaaaac

SEQ ID NO: 1390735 - RNA, 19 nt, Homo sapiens
augaagaagcucagcauga

SEQ ID NO: 1390736 - RNA, 19 nt, Homo sapiens
ugauacagaaggcaauaau

SEQ ID NO: 1390737 - RNA, 19 nt, Homo sapiens
aaugcugccuuagaaauca

SEQ ID NO: 1390738 - RNA, 19 nt, Homo sapiens
cugguggaauuaucaggaa

SEQ ID NO: 1390739 - RNA, 19 nt, Homo sapiens
agauucugguccucuuauu

SEQ ID NO: 1390740 - RNA, 19 nt, Homo sapiens
ugauucagacuuccucuca

SEQ ID NO: 1390741 - RNA, 19 nt, Homo sapiens
caaugaagaagcucagcau

SEQ ID NO: 1390742 - RNA, 19 nt, Homo sapiens
uagaaaucacuccuagaug

SEQ ID NO: 1390743 - RNA, 19 nt, Homo sapiens
ugagaggcccauucugcaa

SEQ ID NO: 1390744 - RNA, 19 nt, Homo sapiens
uggaagaggaagagauuca

SEQ ID NO: 1390745 - RNA, 19 nt, Homo sapiens
aggaagaggaggagcaguu

SEQ ID NO: 1390746 - RNA, 19 nt, Homo sapiens
aagaagcucagcaugacaa

SEQ ID NO: 1390747 - RNA, 19 nt, Homo sapiens
aagaggaagagauucaaau

SEQ ID NO: 1390748 - RNA, 19 nt, Homo sapiens
uggcugcaaauaaaggaua

SEQ ID NO: 1390749 - RNA, 19 nt, Homo sapiens
agagaagaaggaaggagaa

SEQ ID NO: 1390750 - RNA, 19 nt, Homo sapiens
gaggaggacuucaucucua

SEQ ID NO: 1390751 - RNA, 19 nt, Homo sapiens
ggccugaucugguggauga

SEQ ID NO: 1390752 - RNA, 19 nt, Homo sapiens
ccucgaguaucuugcauua

SEQ ID NO: 1390753 - RNA, 19 nt, Homo sapiens
ggaccuggaucccgucaug

SEQ ID NO: 1390754 - RNA, 19 nt, Homo sapiens
ugacagugcuaucauuuua

SEQ ID NO: 1390755 - RNA, 19 nt, Homo sapiens
gcagcuuccuccucgagua

SEQ ID NO: 1390756 - RNA, 19 nt, Homo sapiens
gguaaagccuggcccuuag

SEQ ID NO: 1390757 - RNA, 19 nt, Homo sapiens
gcaggugaccggcuucaaa

SEQ ID NO: 1390758 - RNA, 19 nt, Homo sapiens
caggugauauggaguguau

SEQ ID NO: 1390759 - RNA, 19 nt, Homo sapiens
caagauagacggcuucaag

SEQ ID NO: 1390760 - RNA, 19 nt, Homo sapiens
ucaagggcaugaagagcua

SEQ ID NO: 1390761 - RNA, 19 nt, Homo sapiens
ccaccaagcagaccaaguu

SEQ ID NO: 1390762 - RNA, 19 nt, Homo sapiens
ucaagugcuucaccaagaa

SEQ ID NO: 1390763 - RNA, 19 nt, Homo sapiens
ggagguggagagcaagaua

SEQ ID NO: 1390764 - RNA, 19 nt, Homo sapiens
ggaagcagggcaagaggaa

SEQ ID NO: 1390765 - RNA, 19 nt, Homo sapiens
gcaagaggaaggccgagaa

SEQ ID NO: 1390766 - RNA, 19 nt, Homo sapiens
cagcagcaccgacgagaaa

SEQ ID NO: 1390767 - RNA, 19 nt, Homo sapiens
caucauccacguucagaaa

SEQ ID NO: 1390768 - RNA, 19 nt, Homo sapiens
ucucgaagguucaaagagu

SEQ ID NO: 1390769 - RNA, 19 nt, Homo sapiens
aggaggacuucaucucuaa

SEQ ID NO: 1390770 - RNA, 19 nt, Homo sapiens
ggugauauggaguguauug

SEQ ID NO: 1390771 - RNA, 19 nt, Homo sapiens
gggaaugaguacucuuucu

SEQ ID NO: 1390772 - RNA, 19 nt, Homo sapiens
ggagaacccaggagagauc

SEQ ID NO: 1390773 - RNA, 19 nt, Homo sapiens
ccaagcagaccaaguucaa

SEQ ID NO: 1390774 - RNA, 19 nt, Homo sapiens
aagaguaccuuugaugaca

SEQ ID NO: 1390775 - RNA, 19 nt, Homo sapiens
ucgaguaucuugcauuagg

SEQ ID NO: 1390776 - RNA, 19 nt, Homo sapiens
agagcuacaucuccuacaa

SEQ ID NO: 1390777 - RNA, 19 nt, Homo sapiens
guuucagacucauauucua

SEQ ID NO: 1390778 - RNA, 19 nt, Homo sapiens
ccacacggccaacgaguuc

SEQ ID NO: 1390779 - RNA, 19 nt, Homo sapiens
ggaaugaguacucuuucuc

SEQ ID NO: 1390780 - RNA, 19 nt, Homo sapiens
gcccuuagagcaggugaua

SEQ ID NO: 1390781 - RNA, 19 nt, Homo sapiens
uaacuucccggacaucauc

SEQ ID NO: 1390782 - RNA, 19 nt, Homo sapiens
gcagcgagcaggacaucga

SEQ ID NO: 1390783 - RNA, 19 nt, Homo sapiens
uagggaaugaguacucuuu

SEQ ID NO: 1390784 - RNA, 19 nt, Homo sapiens
cucgaagguucaaagagua

SEQ ID NO: 1390785 - RNA, 19 nt, Homo sapiens
gcacuucgacuggcuguac

SEQ ID NO: 1390786 - RNA, 19 nt, Homo sapiens
uucaagugcuucaccaaga

SEQ ID NO: 1390787 - RNA, 19 nt, Homo sapiens
agaggaaggccgagaagga

SEQ ID NO: 1390788 - RNA, 19 nt, Homo sapiens
ccuuagagcaggugauaug

SEQ ID NO: 1390789 - RNA, 19 nt, Homo sapiens
guaaagccuggcccuuaga

SEQ ID NO: 1390790 - RNA, 19 nt, Homo sapiens
ugcaggagguggagagcaa

SEQ ID NO: 1390791 - RNA, 19 nt, Homo sapiens
agguaaagccuggcccuua

SEQ ID NO: 1390792 - RNA, 19 nt, Homo sapiens
gccaaggcagcgaugauga

SEQ ID NO: 1390793 - RNA, 19 nt, Homo sapiens
gaguaccuuugaugacagu

SEQ ID NO: 1390794 - RNA, 19 nt, Homo sapiens
caccggagaugccuaugac

SEQ ID NO: 1390795 - RNA, 19 nt, Homo sapiens
uagaguguaaguuggauug

SEQ ID NO: 1390796 - RNA, 19 nt, Homo sapiens
ggacaucauccacguucag

SEQ ID NO: 1390797 - RNA, 19 nt, Homo sapiens
gcaugaagagcuacaucuc

SEQ ID NO: 1390798 - RNA, 19 nt, Homo sapiens
ggaccuauuagcgcuguau

SEQ ID NO: 1390799 - RNA, 19 nt, Homo sapiens
ucaaucgcuucuccaccuu

SEQ ID NO: 1390800 - RNA, 19 nt, Homo sapiens
cgaggaggacuucaucucu

SEQ ID NO: 1390801 - RNA, 19 nt, Homo sapiens
gagcuacaucuccuacaag

SEQ ID NO: 1390802 - RNA, 19 nt, Homo sapiens
ucaccggagaugccuauga

SEQ ID NO: 1390803 - RNA, 19 nt, Homo sapiens
cguggacgccugggucuuu

SEQ ID NO: 1390804 - RNA, 19 nt, Homo sapiens
caagaggaaggccgagaag

SEQ ID NO: 1390805 - RNA, 19 nt, Homo sapiens
ugauauggaguguauugug

SEQ ID NO: 1390806 - RNA, 19 nt, Homo sapiens
gacaucauccacguucaga

SEQ ID NO: 1390807 - RNA, 19 nt, Homo sapiens
gagaaguucccggucaucu

SEQ ID NO: 1390808 - RNA, 19 nt, Homo sapiens
gaaugaaucucaagaggaa

SEQ ID NO: 1390809 - RNA, 19 nt, Homo sapiens
ccacagggaucucucauug

SEQ ID NO: 1390810 - RNA, 19 nt, Homo sapiens
cagaauaacugggagauga

SEQ ID NO: 1390811 - RNA, 19 nt, Homo sapiens
ugacacacuugaucgaaua

SEQ ID NO: 1390812 - RNA, 19 nt, Homo sapiens
ggaaauagcggguagucuu

SEQ ID NO: 1390813 - RNA, 19 nt, Homo sapiens
gaauauggcuggaaauagc

SEQ ID NO: 1390814 - RNA, 19 nt, Homo sapiens
gaaacaggaagcucuauga

SEQ ID NO: 1390815 - RNA, 19 nt, Homo sapiens
gggcuggucuggucgguuu

SEQ ID NO: 1390816 - RNA, 19 nt, Homo sapiens
ggaaugcagcugaaagauu

SEQ ID NO: 1390817 - RNA, 19 nt, Homo sapiens
uaacagaaucacagucuuu

SEQ ID NO: 1390818 - RNA, 19 nt, Homo sapiens
gaaauagcggguagucuug

SEQ ID NO: 1390819 - RNA, 19 nt, Homo sapiens
gaagcucuaugacacacuu

SEQ ID NO: 1390820 - RNA, 19 nt, Homo sapiens
guagagccaucccuucuuc

SEQ ID NO: 1390821 - RNA, 19 nt, Homo sapiens
ccagguguauugugauuau

SEQ ID NO: 1390822 - RNA, 19 nt, Homo sapiens
gcagcagauuuaagcauga

SEQ ID NO: 1390823 - RNA, 19 nt, Homo sapiens
uacuguaucuugugaauga

SEQ ID NO: 1390824 - RNA, 19 nt, Homo sapiens
uugauucucuggcuuauug

SEQ ID NO: 1390825 - RNA, 19 nt, Homo sapiens
gaacugaggguugcaucuu

SEQ ID NO: 1390826 - RNA, 19 nt, Homo sapiens
gaggaaggaugaagcuuuu

SEQ ID NO: 1390827 - RNA, 19 nt, Homo sapiens
gguguauugugauuauuug

SEQ ID NO: 1390828 - RNA, 19 nt, Homo sapiens
gugaauauggcuggaaaua

SEQ ID NO: 1390829 - RNA, 19 nt, Homo sapiens
gcauucaugauaugucuuu

SEQ ID NO: 1390830 - RNA, 19 nt, Homo sapiens
guuuguugcuugccaauau

SEQ ID NO: 1390831 - RNA, 19 nt, Homo sapiens
gcccagguguauugugauu

SEQ ID NO: 1390832 - RNA, 19 nt, Homo sapiens
ucacaugccuucaucucau

SEQ ID NO: 1390833 - RNA, 19 nt, Homo sapiens
ucuggucgguuucccauuu

SEQ ID NO: 1390834 - RNA, 19 nt, Homo sapiens
uaacuucucuggguauuuu

SEQ ID NO: 1390835 - RNA, 19 nt, Homo sapiens
gcuacuguaucuugugaau

SEQ ID NO: 1390836 - RNA, 19 nt, Homo sapiens
ugaccucccucccauggaa

SEQ ID NO: 1390837 - RNA, 19 nt, Homo sapiens
gaugaaacaggaagcucua

SEQ ID NO: 1390838 - RNA, 19 nt, Homo sapiens
cacacuugaucgaauauga

SEQ ID NO: 1390839 - RNA, 19 nt, Homo sapiens
gcuaggcccagguguauug

SEQ ID NO: 1390840 - RNA, 19 nt, Homo sapiens
gugcuacuguaucuuguga

SEQ ID NO: 1390841 - RNA, 19 nt, Homo sapiens
gggcuacaguauggacuuu

SEQ ID NO: 1390842 - RNA, 19 nt, Homo sapiens
cuuaaucccuuguccuuca

SEQ ID NO: 1390843 - RNA, 19 nt, Homo sapiens
gaauaacugggagaugaaa

SEQ ID NO: 1390844 - RNA, 19 nt, Homo sapiens
gggagacugagaaugauuu

SEQ ID NO: 1390845 - RNA, 19 nt, Homo sapiens
ggacagguugcauguggaa

SEQ ID NO: 1390846 - RNA, 19 nt, Homo sapiens
gggaacaucugccuuuuca

SEQ ID NO: 1390847 - RNA, 19 nt, Homo sapiens
uauuguggcauucaugaua

SEQ ID NO: 1390848 - RNA, 19 nt, Homo sapiens
caucccuucuucauccaua

SEQ ID NO: 1390849 - RNA, 19 nt, Homo sapiens
ucaagcggcagagcaguua

SEQ ID NO: 1390850 - RNA, 19 nt, Homo sapiens
uagugaauauggcuggaaa

SEQ ID NO: 1390851 - RNA, 19 nt, Homo sapiens
gcugauaaauuugauucuc

SEQ ID NO: 1390852 - RNA, 19 nt, Homo sapiens
cagcagauuuaagcaugaa

SEQ ID NO: 1390853 - RNA, 19 nt, Homo sapiens
agaggaaggaugaagcuuu

SEQ ID NO: 1390854 - RNA, 19 nt, Homo sapiens
cacaugccuucaucucauu

SEQ ID NO: 1390855 - RNA, 19 nt, Homo sapiens
ugauaugucuuucccuuuu

SEQ ID NO: 1390856 - RNA, 19 nt, Homo sapiens
ccauuugucuggccagucu

SEQ ID NO: 1390857 - RNA, 19 nt, Homo sapiens
ccaucuguauuucugauuc

SEQ ID NO: 1390858 - RNA, 19 nt, Homo sapiens
cggguagucuuggauuuga

SEQ ID NO: 1390859 - RNA, 19 nt, Homo sapiens
ggaccucauugggcuggaa

SEQ ID NO: 1390860 - RNA, 19 nt, Homo sapiens
gcuacaguauggacuuugg

SEQ ID NO: 1390861 - RNA, 19 nt, Homo sapiens
ucugaauucuguuuaugug

SEQ ID NO: 1390862 - RNA, 19 nt, Homo sapiens
ggugccaucuguauuucug

SEQ ID NO: 1390863 - RNA, 19 nt, Homo sapiens
aaucccuuguccuucauua

SEQ ID NO: 1390864 - RNA, 19 nt, Homo sapiens
ucugaggccucugcauuug

SEQ ID NO: 1390865 - RNA, 19 nt, Homo sapiens
gaacaucugccuuuucagu

SEQ ID NO: 1390866 - RNA, 19 nt, Homo sapiens
gcugcuaggcccaggugua

SEQ ID NO: 1390867 - RNA, 19 nt, Homo sapiens
ucagugugguuggcaguga

SEQ ID NO: 1390868 - RNA, 19 nt, Homo sapiens
ccuguaaguccuuguguga

SEQ ID NO: 1390869 - RNA, 19 nt, Homo sapiens
aggcccagguguauuguga

SEQ ID NO: 1390870 - RNA, 19 nt, Homo sapiens
uuugggagacugagaauga

SEQ ID NO: 1390871 - RNA, 19 nt, Homo sapiens
gcaugaaguugguuuugug

SEQ ID NO: 1390872 - RNA, 19 nt, Homo sapiens
acagcaggguucccaagga

SEQ ID NO: 1390873 - RNA, 19 nt, Homo sapiens
aguauccuuucacuuguuu

SEQ ID NO: 1390874 - RNA, 19 nt, Homo sapiens
guauggacuuugggaagau

SEQ ID NO: 1390875 - RNA, 19 nt, Homo sapiens
uauccacccuucccucuac

SEQ ID NO: 1390876 - RNA, 19 nt, Homo sapiens
gcagauuuaagcaugaagu

SEQ ID NO: 1390877 - RNA, 19 nt, Homo sapiens
ugccuaauguuaaccaaag

SEQ ID NO: 1390878 - RNA, 19 nt, Homo sapiens
gagcagcagauuuaagcau

SEQ ID NO: 1390879 - RNA, 19 nt, Homo sapiens
ugacagacaccgaaaauca

SEQ ID NO: 1390880 - RNA, 19 nt, Homo sapiens
gguuggcagugaccugugu

SEQ ID NO: 1390881 - RNA, 19 nt, Homo sapiens
caccugugccauccuguaa

SEQ ID NO: 1390882 - RNA, 19 nt, Homo sapiens
gugauuauuugauguaccu

SEQ ID NO: 1390883 - RNA, 19 nt, Homo sapiens
aguauggacuuugggaaga

SEQ ID NO: 1390884 - RNA, 19 nt, Homo sapiens
ucccuuguccuucauuaaa

SEQ ID NO: 1390885 - RNA, 19 nt, Homo sapiens
gcggguagucuuggauuug

SEQ ID NO: 1390886 - RNA, 19 nt, Homo sapiens
gguagagccaucccuucuu

SEQ ID NO: 1390887 - RNA, 19 nt, Homo sapiens
ugaaacaggaagcucuaug

SEQ ID NO: 1390888 - RNA, 19 nt, Homo sapiens
aauuugauucucuggcuua

SEQ ID NO: 1390889 - RNA, 19 nt, Homo sapiens
guccuugugugacucuuca

SEQ ID NO: 1390890 - RNA, 19 nt, Homo sapiens
agaauaacugggagaugaa

SEQ ID NO: 1390891 - RNA, 19 nt, Homo sapiens
ccugugccauccuguaagu

SEQ ID NO: 1390892 - RNA, 19 nt, Homo sapiens
uuaacagaaucacagucuu

SEQ ID NO: 1390893 - RNA, 19 nt, Homo sapiens
uggucugccugugauauuu

SEQ ID NO: 1390894 - RNA, 19 nt, Homo sapiens
acucugaggccucugcauu

SEQ ID NO: 1390895 - RNA, 19 nt, Homo sapiens
ccggaaugcagcugaaaga

SEQ ID NO: 1390896 - RNA, 19 nt, Homo sapiens
uccagcaccucuaccuguu

SEQ ID NO: 1390897 - RNA, 19 nt, Homo sapiens
cuucugaauucuguuuaug

SEQ ID NO: 1390898 - RNA, 19 nt, Homo sapiens
gaccaggaagucagaacug

SEQ ID NO: 1390899 - RNA, 19 nt, Homo sapiens
cagauuuaagcaugaaguu

SEQ ID NO: 1390900 - RNA, 19 nt, Homo sapiens
ugaauauggcuggaaauag

SEQ ID NO: 1390901 - RNA, 19 nt, Homo sapiens
caguuuccauguacuagag

SEQ ID NO: 1390902 - RNA, 19 nt, Homo sapiens
uggcauucaugauaugucu

SEQ ID NO: 1390903 - RNA, 19 nt, Homo sapiens
aacugaggguugcaucuug

SEQ ID NO: 1390904 - RNA, 19 nt, Homo sapiens
gauucuaccgucccucugu

SEQ ID NO: 1390905 - RNA, 19 nt, Homo sapiens
caucuguauuucugauucu

SEQ ID NO: 1390906 - RNA, 19 nt, Homo sapiens
gagccaucccuucuucauc

SEQ ID NO: 1390907 - RNA, 19 nt, Homo sapiens
aaaaucacaugccuucauc

SEQ ID NO: 1390908 - RNA, 19 nt, Homo sapiens
caacacagcuuuaauuuca

SEQ ID NO: 1390909 - RNA, 19 nt, Homo sapiens
ugaaacagcucuucugaga

SEQ ID NO: 1390910 - RNA, 19 nt, Homo sapiens
ggacaccucugauuuauac

SEQ ID NO: 1390911 - RNA, 19 nt, Homo sapiens
ugagaaacaugcucuguaa

SEQ ID NO: 1390912 - RNA, 19 nt, Homo sapiens
ccacagcccuugacaguga

SEQ ID NO: 1390913 - RNA, 19 nt, Homo sapiens
ggagccagauaaaguauuu

SEQ ID NO: 1390914 - RNA, 19 nt, Homo sapiens
gcucauaaauauuccauug

SEQ ID NO: 1390915 - RNA, 19 nt, Homo sapiens
gcccagagguuaauuucua

SEQ ID NO: 1390916 - RNA, 19 nt, Homo sapiens
caucccaccucuaauauuu

SEQ ID NO: 1390917 - RNA, 19 nt, Homo sapiens
gaauguggcccaauacaaa

SEQ ID NO: 1390918 - RNA, 19 nt, Homo sapiens
gagcaacacagcuuuaauu

SEQ ID NO: 1390919 - RNA, 19 nt, Homo sapiens
gauguggauucuaucuuua

SEQ ID NO: 1390920 - RNA, 19 nt, Homo sapiens
ggaggaugaucuucugauu

SEQ ID NO: 1390921 - RNA, 19 nt, Homo sapiens
ugaacaggcucaugaaguu

SEQ ID NO: 1390922 - RNA, 19 nt, Homo sapiens
ggacagagccaaagcuugu

SEQ ID NO: 1390923 - RNA, 19 nt, Homo sapiens
ggaggugccuucuggguau

SEQ ID NO: 1390924 - RNA, 19 nt, Homo sapiens
acugaaggcucauaaauau

SEQ ID NO: 1390925 - RNA, 19 nt, Homo sapiens
gacugaaggcucauaaaua

SEQ ID NO: 1390926 - RNA, 19 nt, Homo sapiens
uaacagaaccucccagcaa

SEQ ID NO: 1390927 - RNA, 19 nt, Homo sapiens
gcuauuaccuuggcagaug

SEQ ID NO: 1390928 - RNA, 19 nt, Homo sapiens
ugauuaagcugagugguuu

SEQ ID NO: 1390929 - RNA, 19 nt, Homo sapiens
guugacaggucuagaguga

SEQ ID NO: 1390930 - RNA, 19 nt, Homo sapiens
ggacugaaggcucauaaau

SEQ ID NO: 1390931 - RNA, 19 nt, Homo sapiens
aggcugagcuauacauaaa

SEQ ID NO: 1390932 - RNA, 19 nt, Homo sapiens
cagaugaggcugagcuaua

SEQ ID NO: 1390933 - RNA, 19 nt, Homo sapiens
cuacuaugcucuaccuuug

SEQ ID NO: 1390934 - RNA, 19 nt, Homo sapiens
agagagagacauagagaua

SEQ ID NO: 1390935 - RNA, 19 nt, Homo sapiens
gaaacaugcucuguaaagg

SEQ ID NO: 1390936 - RNA, 19 nt, Homo sapiens
gcugcacacugguauuaaa

SEQ ID NO: 1390937 - RNA, 19 nt, Homo sapiens
ucagcuaucguuaguguua

SEQ ID NO: 1390938 - RNA, 19 nt, Homo sapiens
ggauuagccuaccauguuc

SEQ ID NO: 1390939 - RNA, 19 nt, Homo sapiens
ggagagagagacauagaga

SEQ ID NO: 1390940 - RNA, 19 nt, Homo sapiens
cugaagauguggauucuau

SEQ ID NO: 1390941 - RNA, 19 nt, Homo sapiens
gcagaguccucagagaaga

SEQ ID NO: 1390942 - RNA, 19 nt, Homo sapiens
gauggucaguggguuguaa

SEQ ID NO: 1390943 - RNA, 19 nt, Homo sapiens
gaacacagaccagaacuac

SEQ ID NO: 1390944 - RNA, 19 nt, Homo sapiens
gaggaugaucuucugauuu

SEQ ID NO: 1390945 - RNA, 19 nt, Homo sapiens
ugacaggucuagagugauc

SEQ ID NO: 1390946 - RNA, 19 nt, Homo sapiens
aggaugaucuucugauuuc

SEQ ID NO: 1390947 - RNA, 19 nt, Homo sapiens
gaacaggcucaugaaguuu

SEQ ID NO: 1390948 - RNA, 19 nt, Homo sapiens
ugaguuauguaaacaagug

SEQ ID NO: 1390949 - RNA, 19 nt, Homo sapiens
gucaguggguuguaaauuc

SEQ ID NO: 1390950 - RNA, 19 nt, Homo sapiens
gauuggacaccucugauuu

SEQ ID NO: 1390951 - RNA, 19 nt, Homo sapiens
gauuacaccugggaauaug

SEQ ID NO: 1390952 - RNA, 19 nt, Homo sapiens
cuaauugagccaagcuuua

SEQ ID NO: 1390953 - RNA, 19 nt, Homo sapiens
ugacuuugccuucagauga

SEQ ID NO: 1390954 - RNA, 19 nt, Homo sapiens
acauagagauagagacaga

SEQ ID NO: 1390955 - RNA, 19 nt, Homo sapiens
agagagacauagagauaga

SEQ ID NO: 1390956 - RNA, 19 nt, Homo sapiens
cuauuguucuggaaacuaa

SEQ ID NO: 1390957 - RNA, 19 nt, Homo sapiens
gauuuauacuagcucguuu

SEQ ID NO: 1390958 - RNA, 19 nt, Homo sapiens
gcaacacagcuuuaauuuc

SEQ ID NO: 1390959 - RNA, 19 nt, Homo sapiens
caagaaauguuaggaagcu

SEQ ID NO: 1390960 - RNA, 19 nt, Homo sapiens
uaauacauuuggagcuuug

SEQ ID NO: 1390961 - RNA, 19 nt, Homo sapiens
gaaaucuacauccaccaaa

SEQ ID NO: 1390962 - RNA, 19 nt, Homo sapiens
ugaaggcucauaaauauuc

SEQ ID NO: 1390963 - RNA, 19 nt, Homo sapiens
ucaggagacucaucuuaca

SEQ ID NO: 1390964 - RNA, 19 nt, Homo sapiens
gauuggaccaguuuccuuu

SEQ ID NO: 1390965 - RNA, 19 nt, Homo sapiens
acacagaccagaacuacuu

SEQ ID NO: 1390966 - RNA, 19 nt, Homo sapiens
ucucaaaucucuguaccuu

SEQ ID NO: 1390967 - RNA, 19 nt, Homo sapiens
caggacagcuuugaaugug

SEQ ID NO: 1390968 - RNA, 19 nt, Homo sapiens
uguaaagggucuuccugaa

SEQ ID NO: 1390969 - RNA, 19 nt, Homo sapiens
gcagauguguaggugauag

SEQ ID NO: 1390970 - RNA, 19 nt, Homo sapiens
ccacuuaacccuaauugag

SEQ ID NO: 1390971 - RNA, 19 nt, Homo sapiens
gaccacagcccuugacagu

SEQ ID NO: 1390972 - RNA, 19 nt, Homo sapiens
gcaaucggcaucuaauucu

SEQ ID NO: 1390973 - RNA, 19 nt, Homo sapiens
cgucagcuaucguuagugu

SEQ ID NO: 1390974 - RNA, 19 nt, Homo sapiens
agaccuggauugagaaaca

SEQ ID NO: 1390975 - RNA, 19 nt, Homo sapiens
cuacaucaaugagguggaa

SEQ ID NO: 1390976 - RNA, 19 nt, Homo sapiens
gauguccgcccagagguua

SEQ ID NO: 1390977 - RNA, 19 nt, Homo sapiens
ggaccaguuuccuuugaag

SEQ ID NO: 1390978 - RNA, 19 nt, Homo sapiens
caccaccugucuugcuuaa

SEQ ID NO: 1390979 - RNA, 19 nt, Homo sapiens
acacagcuuuaauuucaug

SEQ ID NO: 1390980 - RNA, 19 nt, Homo sapiens
caagugagcaacacagcuu

SEQ ID NO: 1390981 - RNA, 19 nt, Homo sapiens
gaggcugagcuauacauaa

SEQ ID NO: 1390982 - RNA, 19 nt, Homo sapiens
gaagagaccccuuuagaag

SEQ ID NO: 1390983 - RNA, 19 nt, Homo sapiens
uaucguuaguguuagugua

SEQ ID NO: 1390984 - RNA, 19 nt, Homo sapiens
ucaaagcugcacacuggua

SEQ ID NO: 1390985 - RNA, 19 nt, Homo sapiens
guaucucuguguuggugua

SEQ ID NO: 1390986 - RNA, 19 nt, Homo sapiens
uguaggcucucucaaaucu

SEQ ID NO: 1390987 - RNA, 19 nt, Homo sapiens
gguacugccucguaucucu

SEQ ID NO: 1390988 - RNA, 19 nt, Homo sapiens
cuuugaauguggcccaaua

SEQ ID NO: 1390989 - RNA, 19 nt, Homo sapiens
gagaagagaccccuuuaga

SEQ ID NO: 1390990 - RNA, 19 nt, Homo sapiens
gagaaacaugcucuguaaa

SEQ ID NO: 1390991 - RNA, 19 nt, Homo sapiens
agaaugaacagcuuugugu

SEQ ID NO: 1390992 - RNA, 19 nt, Homo sapiens
ugucaggagacucaucuua

SEQ ID NO: 1390993 - RNA, 19 nt, Homo sapiens
ucucuguaccuuccacuua

SEQ ID NO: 1390994 - RNA, 19 nt, Homo sapiens
cuuguaggcucucucaaau

SEQ ID NO: 1390995 - RNA, 19 nt, Homo sapiens
aggauuagccuaccauguu

SEQ ID NO: 1390996 - RNA, 19 nt, Homo sapiens
cagggaagcuaaaagauug

SEQ ID NO: 1390997 - RNA, 19 nt, Homo sapiens
cccagagguuaauuucuaa

SEQ ID NO: 1390998 - RNA, 19 nt, Homo sapiens
ucagagaagagauucagaa

SEQ ID NO: 1390999 - RNA, 19 nt, Homo sapiens
ccaccugucuugcuuaagc

SEQ ID NO: 1391000 - RNA, 19 nt, Homo sapiens
gcacagggaagcuaaaaga

SEQ ID NO: 1391001 - RNA, 19 nt, Homo sapiens
gaaggacugaaggcucaua

SEQ ID NO: 1391002 - RNA, 19 nt, Homo sapiens
gaaauguuaggaagcuugu

SEQ ID NO: 1391003 - RNA, 19 nt, Homo sapiens
cagaaugucaggagacuca

SEQ ID NO: 1391004 - RNA, 19 nt, Homo sapiens
ggaguccaggucucucuuu

SEQ ID NO: 1391005 - RNA, 19 nt, Homo sapiens
aagcugcacacugguauua

SEQ ID NO: 1391006 - RNA, 19 nt, Homo sapiens
gugauagucaucuggcuuu

SEQ ID NO: 1391007 - RNA, 19 nt, Homo sapiens
aacagaaccucccagcaau

SEQ ID NO: 1391008 - RNA, 19 nt, Homo sapiens
gaauaggccuuuaaacuuu

SEQ ID NO: 1391009 - RNA, 19 nt, Homo sapiens
acagaaagcuuguauauga

SEQ ID NO: 1391010 - RNA, 19 nt, Homo sapiens
acaaaggucucacuucuua

SEQ ID NO: 1391011 - RNA, 19 nt, Homo sapiens
gaacagaaagcuuguauau

SEQ ID NO: 1391012 - RNA, 19 nt, Homo sapiens
aaacccagcuccagaauuu

SEQ ID NO: 1391013 - RNA, 19 nt, Homo sapiens
gaucuacagucaccauaua

SEQ ID NO: 1391014 - RNA, 19 nt, Homo sapiens
uaaaugcccugacgaauau

SEQ ID NO: 1391015 - RNA, 19 nt, Homo sapiens
guaaaugcccugacgaaua

SEQ ID NO: 1391016 - RNA, 19 nt, Homo sapiens
ggacaacagugcaucuuau

SEQ ID NO: 1391017 - RNA, 19 nt, Homo sapiens
gcaaagcguuccugcagaa

SEQ ID NO: 1391018 - RNA, 19 nt, Homo sapiens
caacaaaggucucacuucu

SEQ ID NO: 1391019 - RNA, 19 nt, Homo sapiens
gaaaugaauaggccuuuaa

SEQ ID NO: 1391020 - RNA, 19 nt, Homo sapiens
gaaaggcucucggugcaaa

SEQ ID NO: 1391021 - RNA, 19 nt, Homo sapiens
cagaauugcuuccacguaa

SEQ ID NO: 1391022 - RNA, 19 nt, Homo sapiens
gaauguggaucuacaguca

SEQ ID NO: 1391023 - RNA, 19 nt, Homo sapiens
ugacgaauauaaagaggua

SEQ ID NO: 1391024 - RNA, 19 nt, Homo sapiens
gaaugacuaucacaugaau

SEQ ID NO: 1391025 - RNA, 19 nt, Homo sapiens
uaauuacacuccagauuga

SEQ ID NO: 1391026 - RNA, 19 nt, Homo sapiens
gguaacgaauuucaacuga

SEQ ID NO: 1391027 - RNA, 19 nt, Homo sapiens
gcagcuacuucucaacaaa

SEQ ID NO: 1391028 - RNA, 19 nt, Homo sapiens
guaauuacacuccagauug

SEQ ID NO: 1391029 - RNA, 19 nt, Homo sapiens
gauguuaucucuagguuuu

SEQ ID NO: 1391030 - RNA, 19 nt, Homo sapiens
ugaaaugaauaggccuuua

SEQ ID NO: 1391031 - RNA, 19 nt, Homo sapiens
uaacgaauuucaacugaca

SEQ ID NO: 1391032 - RNA, 19 nt, Homo sapiens
ugaauaggccuuuaaacuu

SEQ ID NO: 1391033 - RNA, 19 nt, Homo sapiens
caacagugcaucuuauuuc

SEQ ID NO: 1391034 - RNA, 19 nt, Homo sapiens
ugacagacaucagcagcua

SEQ ID NO: 1391035 - RNA, 19 nt, Homo sapiens
gacuauggauuaaggaaug

SEQ ID NO: 1391036 - RNA, 19 nt, Homo sapiens
gguuagaugugacuggauu

SEQ ID NO: 1391037 - RNA, 19 nt, Homo sapiens
cagaaagcuuguauaugaa

SEQ ID NO: 1391038 - RNA, 19 nt, Homo sapiens
aagcaaagccagucaagaa

SEQ ID NO: 1391039 - RNA, 19 nt, Homo sapiens
gaggaguucuggcacacaa

SEQ ID NO: 1391040 - RNA, 19 nt, Homo sapiens
gcagaauugcuuccacgua

SEQ ID NO: 1391041 - RNA, 19 nt, Homo sapiens
ggaaugacuaucacaugaa

SEQ ID NO: 1391042 - RNA, 19 nt, Homo sapiens
cgggaaauuucgcuggaua

SEQ ID NO: 1391043 - RNA, 19 nt, Homo sapiens
ggacggucaucugaacuug

SEQ ID NO: 1391044 - RNA, 19 nt, Homo sapiens
aggaaugacuaucacauga

SEQ ID NO: 1391045 - RNA, 19 nt, Homo sapiens
gcacaaaagugagcauguu

SEQ ID NO: 1391046 - RNA, 19 nt, Homo sapiens
gggaaaagguuagauguga

SEQ ID NO: 1391047 - RNA, 19 nt, Homo sapiens
gauuaaggaaugacuauca

SEQ ID NO: 1391048 - RNA, 19 nt, Homo sapiens
aggaaagccugguauaauc

SEQ ID NO: 1391049 - RNA, 19 nt, Homo sapiens
gccuaugccuguaauuuca

SEQ ID NO: 1391050 - RNA, 19 nt, Homo sapiens
gcacauuuccuguaagcau

SEQ ID NO: 1391051 - RNA, 19 nt, Homo sapiens
aagcguuccugcagaauug

SEQ ID NO: 1391052 - RNA, 19 nt, Homo sapiens
uaacauugcaauugugaug

SEQ ID NO: 1391053 - RNA, 19 nt, Homo sapiens
cauggugacuauggauuaa

SEQ ID NO: 1391054 - RNA, 19 nt, Homo sapiens
gcaaagccagucaagaaca

SEQ ID NO: 1391055 - RNA, 19 nt, Homo sapiens
caggugagcucuguguaug

SEQ ID NO: 1391056 - RNA, 19 nt, Homo sapiens
ggucucacuucuuacauag

SEQ ID NO: 1391057 - RNA, 19 nt, Homo sapiens
ggagauggaaaugcuguuu

SEQ ID NO: 1391058 - RNA, 19 nt, Homo sapiens
ggugaggaccugcgccuuu

SEQ ID NO: 1391059 - RNA, 19 nt, Homo sapiens
gacaacagugcaucuuauu

SEQ ID NO: 1391060 - RNA, 19 nt, Homo sapiens
ggaguucuggcacacaauu

SEQ ID NO: 1391061 - RNA, 19 nt, Homo sapiens
acaugaaucugggccaauu

SEQ ID NO: 1391062 - RNA, 19 nt, Homo sapiens
agaauugcuuccacguaaa

SEQ ID NO: 1391063 - RNA, 19 nt, Homo sapiens
caauugugauguuaucucu

SEQ ID NO: 1391064 - RNA, 19 nt, Homo sapiens
ggaaagccugguauaaucu

SEQ ID NO: 1391065 - RNA, 19 nt, Homo sapiens
cuacagucaccauauauau

SEQ ID NO: 1391066 - RNA, 19 nt, Homo sapiens
ggugagcucuguguaugug

SEQ ID NO: 1391067 - RNA, 19 nt, Homo sapiens
ucauggugacuauggauua

SEQ ID NO: 1391068 - RNA, 19 nt, Homo sapiens
ccaauuggaagcacauuuc

SEQ ID NO: 1391069 - RNA, 19 nt, Homo sapiens
uaaucuguguggaggguuu

SEQ ID NO: 1391070 - RNA, 19 nt, Homo sapiens
gcuuguauaugaaccaucu

SEQ ID NO: 1391071 - RNA, 19 nt, Homo sapiens
cauugcaauugugauguua

SEQ ID NO: 1391072 - RNA, 19 nt, Homo sapiens
gaagcacauuuccuguaag

SEQ ID NO: 1391073 - RNA, 19 nt, Homo sapiens
cuaagucaguauuucuguu

SEQ ID NO: 1391074 - RNA, 19 nt, Homo sapiens
gugauguuaucucuagguu

SEQ ID NO: 1391075 - RNA, 19 nt, Homo sapiens
caaaaguucagacucauaa

SEQ ID NO: 1391076 - RNA, 19 nt, Homo sapiens
caucuuauuuccugaacag

SEQ ID NO: 1391077 - RNA, 19 nt, Homo sapiens
ucaagaagcacaaaaguga

SEQ ID NO: 1391078 - RNA, 19 nt, Homo sapiens
ggagacagaaggaaauggu

SEQ ID NO: 1391079 - RNA, 19 nt, Homo sapiens
ugaaccaucuacacaagca

SEQ ID NO: 1391080 - RNA, 19 nt, Homo sapiens
uaugaaccaucuacacaag

SEQ ID NO: 1391081 - RNA, 19 nt, Homo sapiens
gcaaaaguucagacucaua

SEQ ID NO: 1391082 - RNA, 19 nt, Homo sapiens
gaguucuggcacacaauua

SEQ ID NO: 1391083 - RNA, 19 nt, Homo sapiens
caucagcagcuacuucuca

SEQ ID NO: 1391084 - RNA, 19 nt, Homo sapiens
ucacagcuaccccuauuua

SEQ ID NO: 1391085 - RNA, 19 nt, Homo sapiens
cugaaagcguggagacaga

SEQ ID NO: 1391086 - RNA, 19 nt, Homo sapiens
uugaagagcccaaggugaa

SEQ ID NO: 1391087 - RNA, 19 nt, Homo sapiens
gaauugcuuccacguaaag

SEQ ID NO: 1391088 - RNA, 19 nt, Homo sapiens
acagucaccauauauauca

SEQ ID NO: 1391089 - RNA, 19 nt, Homo sapiens
ggaucuacagucaccauau

SEQ ID NO: 1391090 - RNA, 19 nt, Homo sapiens
uauaugaaccaucuacaca

SEQ ID NO: 1391091 - RNA, 19 nt, Homo sapiens
acaacagugcaucuuauuu

SEQ ID NO: 1391092 - RNA, 19 nt, Homo sapiens
cuucuuacauagggacuuu

SEQ ID NO: 1391093 - RNA, 19 nt, Homo sapiens
ggccuaugccuguaauuuc

SEQ ID NO: 1391094 - RNA, 19 nt, Homo sapiens
gaaagccugguauaaucug

SEQ ID NO: 1391095 - RNA, 19 nt, Homo sapiens
gauaccggcuggcauugac

SEQ ID NO: 1391096 - RNA, 19 nt, Homo sapiens
aggucucacuucuuacaua

SEQ ID NO: 1391097 - RNA, 19 nt, Homo sapiens
gcaaaacccagcuccagaa

SEQ ID NO: 1391098 - RNA, 19 nt, Homo sapiens
ccuguaauuucacuaaguc

SEQ ID NO: 1391099 - RNA, 19 nt, Homo sapiens
uaaccaaggagaaguaaaa

SEQ ID NO: 1391100 - RNA, 19 nt, Homo sapiens
caaagccagucaagaacac

SEQ ID NO: 1391101 - RNA, 19 nt, Homo sapiens
ugaacagaaagcuuguaua

SEQ ID NO: 1391102 - RNA, 19 nt, Homo sapiens
caugucugcuucggugaaa

SEQ ID NO: 1391103 - RNA, 19 nt, Homo sapiens
gauuuuggauguugggaaa

SEQ ID NO: 1391104 - RNA, 19 nt, Homo sapiens
ucuacagucaccauauaua

SEQ ID NO: 1391105 - RNA, 19 nt, Homo sapiens
ccaggugagcucuguguau

SEQ ID NO: 1391106 - RNA, 19 nt, Homo sapiens
ugaccaugccucacagcua

SEQ ID NO: 1391107 - RNA, 19 nt, Homo sapiens
gcaauugugauguuaucuc

SEQ ID NO: 1391108 - RNA, 19 nt, Homo sapiens
gcauauggcuguccuauaa

SEQ ID NO: 1391109 - RNA, 19 nt, Homo sapiens
uauaagaucucguguguaa

SEQ ID NO: 1391110 - RNA, 19 nt, Homo sapiens
gaacaucccucccauucug

SEQ ID NO: 1391111 - RNA, 19 nt, Homo sapiens
ggagugaagugccuuaaga

SEQ ID NO: 1391112 - RNA, 19 nt, Homo sapiens
acaaagcccuguccuaauu

SEQ ID NO: 1391113 - RNA, 19 nt, Homo sapiens
gaacuucugcacuauuuaa

SEQ ID NO: 1391114 - RNA, 19 nt, Homo sapiens
aaacaaagcccuguccuaa

SEQ ID NO: 1391115 - RNA, 19 nt, Homo sapiens
gaaacaaagcccuguccua

SEQ ID NO: 1391116 - RNA, 19 nt, Homo sapiens
ugaagugccuuaagaaaca

SEQ ID NO: 1391117 - RNA, 19 nt, Homo sapiens
cuaaaucccuucuacuuca

SEQ ID NO: 1391118 - RNA, 19 nt, Homo sapiens
gcagagaggaggacgugua

SEQ ID NO: 1391119 - RNA, 19 nt, Homo sapiens
gagaacaucccucccauuc

SEQ ID NO: 1391120 - RNA, 19 nt, Homo sapiens
ggagcgaucuuugguuuca

SEQ ID NO: 1391121 - RNA, 19 nt, Homo sapiens
ccuauaagaucucgugugu

SEQ ID NO: 1391122 - RNA, 19 nt, Homo sapiens
cggaacuucugcacuauuu

SEQ ID NO: 1391123 - RNA, 19 nt, Homo sapiens
ugucggaacuucugcacua

SEQ ID NO: 1391124 - RNA, 19 nt, Homo sapiens
aaagcccuguccuaauuua

SEQ ID NO: 1391125 - RNA, 19 nt, Homo sapiens
ccggagcgaucuuugguuu

SEQ ID NO: 1391126 - RNA, 19 nt, Homo sapiens
gauaaugauccucgccuuu

SEQ ID NO: 1391127 - RNA, 19 nt, Homo sapiens
ugaauacucccgccuaaau

SEQ ID NO: 1391128 - RNA, 19 nt, Homo sapiens
ggucaccauuugcgacuug

SEQ ID NO: 1391129 - RNA, 19 nt, Homo sapiens
gaagugccuuaagaaacaa

SEQ ID NO: 1391130 - RNA, 19 nt, Homo sapiens
gauacccucuuuccugaag

SEQ ID NO: 1391131 - RNA, 19 nt, Homo sapiens
gcuugucaguccggucuua

SEQ ID NO: 1391132 - RNA, 19 nt, Homo sapiens
aaagcagccuccagggaaa

SEQ ID NO: 1391133 - RNA, 19 nt, Homo sapiens
ggaacuucugcacuauuua

SEQ ID NO: 1391134 - RNA, 19 nt, Homo sapiens
caaagcccuguccuaauuu

SEQ ID NO: 1391135 - RNA, 19 nt, Homo sapiens
gcugauugccuucaucugu

SEQ ID NO: 1391136 - RNA, 19 nt, Homo sapiens
gaauacucccgccuaaauc

SEQ ID NO: 1391137 - RNA, 19 nt, Homo sapiens
ugugaauacucccgccuaa

SEQ ID NO: 1391138 - RNA, 19 nt, Homo sapiens
gccuaaaucccuucuacuu

SEQ ID NO: 1391139 - RNA, 19 nt, Homo sapiens
guaacccaguccacagaug

SEQ ID NO: 1391140 - RNA, 19 nt, Homo sapiens
uaaugauccucgccuuuua

SEQ ID NO: 1391141 - RNA, 19 nt, Homo sapiens
gagugaagugccuuaagaa

SEQ ID NO: 1391142 - RNA, 19 nt, Homo sapiens
cuccaucucugccuuuguu

SEQ ID NO: 1391143 - RNA, 19 nt, Homo sapiens
ggagcucccuguggaccaa

SEQ ID NO: 1391144 - RNA, 19 nt, Homo sapiens
uggcagcuuccaagaguua

SEQ ID NO: 1391145 - RNA, 19 nt, Homo sapiens
ccucaucgccuccauugug

SEQ ID NO: 1391146 - RNA, 19 nt, Homo sapiens
aauauugacucggccaguu

SEQ ID NO: 1391147 - RNA, 19 nt, Homo sapiens
gccuacagcuacuuugaag

SEQ ID NO: 1391148 - RNA, 19 nt, Homo sapiens
ccuaauuuaucuagcuugu

SEQ ID NO: 1391149 - RNA, 19 nt, Homo sapiens
ggacugccgcuaccuuucu

SEQ ID NO: 1391150 - RNA, 19 nt, Homo sapiens
caccauuugcgacuugaua

SEQ ID NO: 1391151 - RNA, 19 nt, Homo sapiens
gugcauguguuuguguguu

SEQ ID NO: 1391152 - RNA, 19 nt, Homo sapiens
gagaggaggacguguacuc

SEQ ID NO: 1391153 - RNA, 19 nt, Homo sapiens
ccacuuagcacagcugaag

SEQ ID NO: 1391154 - RNA, 19 nt, Homo sapiens
cucaggagcuuugcagaga

SEQ ID NO: 1391155 - RNA, 19 nt, Homo sapiens
agaugcagccgucugauga

SEQ ID NO: 1391156 - RNA, 19 nt, Homo sapiens
ucaguccggucuuagagau

SEQ ID NO: 1391157 - RNA, 19 nt, Homo sapiens
gcgccuacagcuacuuuga

SEQ ID NO: 1391158 - RNA, 19 nt, Homo sapiens
uguggcagcuuccaagagu

SEQ ID NO: 1391159 - RNA, 19 nt, Homo sapiens
gcccuguccuaauuuaucu

SEQ ID NO: 1391160 - RNA, 19 nt, Homo sapiens
ccuaaaucccuucuacuuc

SEQ ID NO: 1391161 - RNA, 19 nt, Homo sapiens
ugcauguguuuguguguuu

SEQ ID NO: 1391162 - RNA, 19 nt, Homo sapiens
auauggcuguccuauaaga

SEQ ID NO: 1391163 - RNA, 19 nt, Homo sapiens
guccuaauuuaucuagcuu

SEQ ID NO: 1391164 - RNA, 19 nt, Homo sapiens
gugaagugccuuaagaaac

SEQ ID NO: 1391165 - RNA, 19 nt, Homo sapiens
ccgccuaaaucccuucuac

SEQ ID NO: 1391166 - RNA, 19 nt, Homo sapiens
gcugaaaguggcgcaaaug

SEQ ID NO: 1391167 - RNA, 19 nt, Homo sapiens
ccagugugcauguguuugu

SEQ ID NO: 1391168 - RNA, 19 nt, Homo sapiens
uuaccagugugcauguguu

SEQ ID NO: 1391169 - RNA, 19 nt, Homo sapiens
auauugacucggccaguua

SEQ ID NO: 1391170 - RNA, 19 nt, Homo sapiens
gaaaggccugcacccucuu

SEQ ID NO: 1391171 - RNA, 19 nt, Homo sapiens
ugauugccuucaucugugu

SEQ ID NO: 1391172 - RNA, 19 nt, Homo sapiens
cuucugcacuauuuaaucg

SEQ ID NO: 1391173 - RNA, 19 nt, Homo sapiens
cugaagggguuugugaaua

SEQ ID NO: 1391174 - RNA, 19 nt, Homo sapiens
auuugcgacuugauaauga

SEQ ID NO: 1391175 - RNA, 19 nt, Homo sapiens
cagcaaagaucauugaaga

SEQ ID NO: 1391176 - RNA, 19 nt, Homo sapiens
guacuucgauggacucaaa

SEQ ID NO: 1391177 - RNA, 19 nt, Homo sapiens
ggacagagcugggcagaca

SEQ ID NO: 1391178 - RNA, 19 nt, Homo sapiens
ucucaaacuugcucauuua

SEQ ID NO: 1391179 - RNA, 19 nt, Homo sapiens
uaacugcugucucccauga

SEQ ID NO: 1391180 - RNA, 19 nt, Homo sapiens
gagaugcaguuuggcguua

SEQ ID NO: 1391181 - RNA, 19 nt, Homo sapiens
caacaacgcgggugugaug

SEQ ID NO: 1391182 - RNA, 19 nt, Homo sapiens
acaggcagcucuaagugua

SEQ ID NO: 1391183 - RNA, 19 nt, Homo sapiens
gaggaaguauaacaccaaa

SEQ ID NO: 1391184 - RNA, 19 nt, Homo sapiens
gcaaggcucuggugugacu

SEQ ID NO: 1391185 - RNA, 19 nt, Homo sapiens
caaacuugcugcuggacaa

SEQ ID NO: 1391186 - RNA, 19 nt, Homo sapiens
gaguggacauucuaaucaa

SEQ ID NO: 1391187 - RNA, 19 nt, Homo sapiens
agagguggccgaaugcuua

SEQ ID NO: 1391188 - RNA, 19 nt, Homo sapiens
gaagcagaccgccuuggaa

SEQ ID NO: 1391189 - RNA, 19 nt, Homo sapiens
ggccgaaugcuuacucuaa

SEQ ID NO: 1391190 - RNA, 19 nt, Homo sapiens
gaagagcaugggcaaguug

SEQ ID NO: 1391191 - RNA, 19 nt, Homo sapiens
cggaggaacuggcggaugu

SEQ ID NO: 1391192 - RNA, 19 nt, Homo sapiens
cauagacuuugacgacuug

SEQ ID NO: 1391193 - RNA, 19 nt, Homo sapiens
gccgagacauggagaagug

SEQ ID NO: 1391194 - RNA, 19 nt, Homo sapiens
ccuaucaauucucauggua

SEQ ID NO: 1391195 - RNA, 19 nt, Homo sapiens
ucgauggacucaaacagaa

SEQ ID NO: 1391196 - RNA, 19 nt, Homo sapiens
ggaagcagaccgccuugga

SEQ ID NO: 1391197 - RNA, 19 nt, Homo sapiens
gacacuugguggauucuug

SEQ ID NO: 1391198 - RNA, 19 nt, Homo sapiens
ccaaggugcuccgugaaga

SEQ ID NO: 1391199 - RNA, 19 nt, Homo sapiens
ggcagacgaggaaguauaa

SEQ ID NO: 1391200 - RNA, 19 nt, Homo sapiens
uggcuucccucaagucuau

SEQ ID NO: 1391201 - RNA, 19 nt, Homo sapiens
ugaaagggguucggaauuu

SEQ ID NO: 1391202 - RNA, 19 nt, Homo sapiens
cugcaaggcucugguguga

SEQ ID NO: 1391203 - RNA, 19 nt, Homo sapiens
gccgaaugcuuacucuaau

SEQ ID NO: 1391204 - RNA, 19 nt, Homo sapiens
gccuagagguggccgaaug

SEQ ID NO: 1391205 - RNA, 19 nt, Homo sapiens
guucggaauuucacucugu

SEQ ID NO: 1391206 - RNA, 19 nt, Homo sapiens
ugaagagcaugggcaaguu

SEQ ID NO: 1391207 - RNA, 19 nt, Homo sapiens
gagaggaggcaacaucauc

SEQ ID NO: 1391208 - RNA, 19 nt, Homo sapiens
gcagaccgccuuggaacuu

SEQ ID NO: 1391209 - RNA, 19 nt, Homo sapiens
gagaugcucagaauaacug

SEQ ID NO: 1391210 - RNA, 19 nt, Homo sapiens
gggaauggccgaggaggaa

SEQ ID NO: 1391211 - RNA, 19 nt, Homo sapiens
gcccaucccugagugucua

SEQ ID NO: 1391212 - RNA, 19 nt, Homo sapiens
ggaaguauaacaccaaagc

SEQ ID NO: 1391213 - RNA, 19 nt, Homo sapiens
cgaguggacauucuaauca

SEQ ID NO: 1391214 - RNA, 19 nt, Homo sapiens
uaucaauucucaugguagu

SEQ ID NO: 1391215 - RNA, 19 nt, Homo sapiens
gagcgaguggacauucuaa

SEQ ID NO: 1391216 - RNA, 19 nt, Homo sapiens
ucaagucuauccgagaguu

SEQ ID NO: 1391217 - RNA, 19 nt, Homo sapiens
ggaaugcaguagggcaauc

SEQ ID NO: 1391218 - RNA, 19 nt, Homo sapiens
ggagcgaguggacauucua

SEQ ID NO: 1391219 - RNA, 19 nt, Homo sapiens
ccgaaugcuuacucuaaug

SEQ ID NO: 1391220 - RNA, 19 nt, Homo sapiens
acauagacuuugacgacuu

SEQ ID NO: 1391221 - RNA, 19 nt, Homo sapiens
gcgaguggacauucuaauc

SEQ ID NO: 1391222 - RNA, 19 nt, Homo sapiens
uggcagacgaggaaguaua

SEQ ID NO: 1391223 - RNA, 19 nt, Homo sapiens
cugggucacuuucucuuga

SEQ ID NO: 1391224 - RNA, 19 nt, Homo sapiens
gcuucgagaugcaguuugg

SEQ ID NO: 1391225 - RNA, 19 nt, Homo sapiens
caugcaugguccucucuga

SEQ ID NO: 1391226 - RNA, 19 nt, Homo sapiens
gcaugggcaaguugucuga

SEQ ID NO: 1391227 - RNA, 19 nt, Homo sapiens
gaggaacuggcggauguuu

SEQ ID NO: 1391228 - RNA, 19 nt, Homo sapiens
ucucgucccuggcccaugu

SEQ ID NO: 1391229 - RNA, 19 nt, Homo sapiens
agaguucccagcccgcuua

SEQ ID NO: 1391230 - RNA, 19 nt, Homo sapiens
cucucaaacuugcucauuu

SEQ ID NO: 1391231 - RNA, 19 nt, Homo sapiens
ugaacuggcagacgaggaa

SEQ ID NO: 1391232 - RNA, 19 nt, Homo sapiens
cgaggacggcuucgagaug

SEQ ID NO: 1391233 - RNA, 19 nt, Homo sapiens
gcuuaaggaaggaaggaaa

SEQ ID NO: 1391234 - RNA, 19 nt, Homo sapiens
gaaucuaaacugggaaugg

SEQ ID NO: 1391235 - RNA, 19 nt, Homo sapiens
ccaccugggucacuuucuc

SEQ ID NO: 1391236 - RNA, 19 nt, Homo sapiens
gcagcaaagaucauugaag

SEQ ID NO: 1391237 - RNA, 19 nt, Homo sapiens
gagacauggagaaguguga

SEQ ID NO: 1391238 - RNA, 19 nt, Homo sapiens
caaacugcagacucucaaa

SEQ ID NO: 1391239 - RNA, 19 nt, Homo sapiens
cgaggaaguauaacaccaa

SEQ ID NO: 1391240 - RNA, 19 nt, Homo sapiens
gaaaacacaggcagcucua

SEQ ID NO: 1391241 - RNA, 19 nt, Homo sapiens
ggacuacagggacuauguc

SEQ ID NO: 1391242 - RNA, 19 nt, Homo sapiens
gggacuacagggacuaugu

SEQ ID NO: 1391243 - RNA, 19 nt, Homo sapiens
ccaccuuccuaucaauucu

SEQ ID NO: 1391244 - RNA, 19 nt, Homo sapiens
gagcuguugucuggcuaug

SEQ ID NO: 1391245 - RNA, 19 nt, Homo sapiens
gugaagagcaugggcaagu

SEQ ID NO: 1391246 - RNA, 19 nt, Homo sapiens
cugcagacucucaaacuug

SEQ ID NO: 1391247 - RNA, 19 nt, Homo sapiens
uaaccaccugggucacuuu

SEQ ID NO: 1391248 - RNA, 19 nt, Homo sapiens
gacccucaaucaccauguc

SEQ ID NO: 1391249 - RNA, 19 nt, Homo sapiens
caggagaggaggcaacauc

SEQ ID NO: 1391250 - RNA, 19 nt, Homo sapiens
cagaccgccuuggaacuug

SEQ ID NO: 1391251 - RNA, 19 nt, Homo sapiens
gcuucggccuccugaguag

SEQ ID NO: 1391252 - RNA, 19 nt, Homo sapiens
gaggagcgaguggacauuc

SEQ ID NO: 1391253 - RNA, 19 nt, Homo sapiens
ggagaggaggcaacaucau

SEQ ID NO: 1391254 - RNA, 19 nt, Homo sapiens
acacaggcaucgggaagca

SEQ ID NO: 1391255 - RNA, 19 nt, Homo sapiens
ggacucccaccuuccuauc

SEQ ID NO: 1391256 - RNA, 19 nt, Homo sapiens
ucugagccuugguuucuuc

SEQ ID NO: 1391257 - RNA, 19 nt, Homo sapiens
ucugacacuugguggauuc

SEQ ID NO: 1391258 - RNA, 19 nt, Homo sapiens
aaacacaggcagcucuaag

SEQ ID NO: 1391259 - RNA, 19 nt, Homo sapiens
cacuuucucuugacaaacu

SEQ ID NO: 1391260 - RNA, 19 nt, Homo sapiens
caagucuauccgagaguuu

SEQ ID NO: 1391261 - RNA, 19 nt, Homo sapiens
ccaaacugcagacucucaa

SEQ ID NO: 1391262 - RNA, 19 nt, Homo sapiens
cggaaaguacuucgaugga

SEQ ID NO: 1391263 - RNA, 19 nt, Homo sapiens
cgacgagggaggucucauc

SEQ ID NO: 1391264 - RNA, 19 nt, Homo sapiens
agaugcaguuuggcguuaa

SEQ ID NO: 1391265 - RNA, 19 nt, Homo sapiens
acacaggcagcucuaagug

SEQ ID NO: 1391266 - RNA, 19 nt, Homo sapiens
ggaggagcgaguggacauu

SEQ ID NO: 1391267 - RNA, 19 nt, Homo sapiens
acugcagacucucaaacuu

SEQ ID NO: 1391268 - RNA, 19 nt, Homo sapiens
gagcaugggcaaguugucu

SEQ ID NO: 1391269 - RNA, 19 nt, Homo sapiens
gaagacaucuccaugaauu

SEQ ID NO: 1391270 - RNA, 19 nt, Homo sapiens
ugaagaagcuguagaaaug

SEQ ID NO: 1391271 - RNA, 19 nt, Homo sapiens
caccaaggcugcucuguuu

SEQ ID NO: 1391272 - RNA, 19 nt, Homo sapiens
guagaaaugccacuccuua

SEQ ID NO: 1391273 - RNA, 19 nt, Homo sapiens
ggaauuacacugucacuug

SEQ ID NO: 1391274 - RNA, 19 nt, Homo sapiens
gaacuugggcugcaucaau

SEQ ID NO: 1391275 - RNA, 19 nt, Homo sapiens
guaugaagcuugacauugg

SEQ ID NO: 1391276 - RNA, 19 nt, Homo sapiens
ccacuucacaggacucuua

SEQ ID NO: 1391277 - RNA, 19 nt, Homo sapiens
gcccagccauggucaagua

SEQ ID NO: 1391278 - RNA, 19 nt, Homo sapiens
caauguauguguguaugua

SEQ ID NO: 1391279 - RNA, 19 nt, Homo sapiens
gagguaguaugaagcuuga

SEQ ID NO: 1391280 - RNA, 19 nt, Homo sapiens
caucaaugcucaaggaaag

SEQ ID NO: 1391281 - RNA, 19 nt, Homo sapiens
gcacggauggaaacagaaa

SEQ ID NO: 1391282 - RNA, 19 nt, Homo sapiens
gcaccaaggcugcucuguu

SEQ ID NO: 1391283 - RNA, 19 nt, Homo sapiens
gaaaggaagacaucuccau

SEQ ID NO: 1391284 - RNA, 19 nt, Homo sapiens
ccagugcucugcaacaagu

SEQ ID NO: 1391285 - RNA, 19 nt, Homo sapiens
aggaagacaucuccaugaa

SEQ ID NO: 1391286 - RNA, 19 nt, Homo sapiens
cuucacaggacucuuaaua

SEQ ID NO: 1391287 - RNA, 19 nt, Homo sapiens
agaaggugcuggugacugu

SEQ ID NO: 1391288 - RNA, 19 nt, Homo sapiens
gcguuuccaugucacguaa

SEQ ID NO: 1391289 - RNA, 19 nt, Homo sapiens
gaaaauccccaaaguagga

SEQ ID NO: 1391290 - RNA, 19 nt, Homo sapiens
ggaagacaucuccaugaau

SEQ ID NO: 1391291 - RNA, 19 nt, Homo sapiens
gccaggagguaguaugaag

SEQ ID NO: 1391292 - RNA, 19 nt, Homo sapiens
ugcaacaaguccugucuga

SEQ ID NO: 1391293 - RNA, 19 nt, Homo sapiens
gcauauccacucagcugaa

SEQ ID NO: 1391294 - RNA, 19 nt, Homo sapiens
cauccaccaugugcaguaa

SEQ ID NO: 1391295 - RNA, 19 nt, Homo sapiens
ccaauucccuccacuucac

SEQ ID NO: 1391296 - RNA, 19 nt, Homo sapiens
aguaagaggugcauaucca

SEQ ID NO: 1391297 - RNA, 19 nt, Homo sapiens
gcaguaagaggugcauauc

SEQ ID NO: 1391298 - RNA, 19 nt, Homo sapiens
cugcacggauggaaacaga

SEQ ID NO: 1391299 - RNA, 19 nt, Homo sapiens
caaggcugcucuguuucuu

SEQ ID NO: 1391300 - RNA, 19 nt, Homo sapiens
cagccauggucaaguacuu

SEQ ID NO: 1391301 - RNA, 19 nt, Homo sapiens
ccagcgcguuuccauguca

SEQ ID NO: 1391302 - RNA, 19 nt, Homo sapiens
aggcugcucuguuucuuuc

SEQ ID NO: 1391303 - RNA, 19 nt, Homo sapiens
cugaagaagcuguagaaau

SEQ ID NO: 1391304 - RNA, 19 nt, Homo sapiens
ucaaggaaaggaagacauc

SEQ ID NO: 1391305 - RNA, 19 nt, Homo sapiens
ugaauuccguucccaucca

SEQ ID NO: 1391306 - RNA, 19 nt, Homo sapiens
aaggaagacaucuccauga

SEQ ID NO: 1391307 - RNA, 19 nt, Homo sapiens
aacuugggcugcaucaaug

SEQ ID NO: 1391308 - RNA, 19 nt, Homo sapiens
gugccaggagguaguauga

SEQ ID NO: 1391309 - RNA, 19 nt, Homo sapiens
agaggugcauauccacuca

SEQ ID NO: 1391310 - RNA, 19 nt, Homo sapiens
cauauccacucagcugaag

SEQ ID NO: 1391311 - RNA, 19 nt, Homo sapiens
ggauggaaacagaaaauau

SEQ ID NO: 1391312 - RNA, 19 nt, Homo sapiens
gaagaagcuguagaaaugc

SEQ ID NO: 1391313 - RNA, 19 nt, Homo sapiens
gcugaagaagcuguagaaa

SEQ ID NO: 1391314 - RNA, 19 nt, Homo sapiens
uauccacucagcugaagaa

SEQ ID NO: 1391315 - RNA, 19 nt, Homo sapiens
guacuugcugcugucgaua

SEQ ID NO: 1391316 - RNA, 19 nt, Homo sapiens
ggcuugccuuucugaguga

SEQ ID NO: 1391317 - RNA, 19 nt, Homo sapiens
ccaaggcugcucuguuucu

SEQ ID NO: 1391318 - RNA, 19 nt, Homo sapiens
gauauuggggcuugccuuu

SEQ ID NO: 1391319 - RNA, 19 nt, Homo sapiens
gguaguaugaagcuugaca

SEQ ID NO: 1391320 - RNA, 19 nt, Homo sapiens
gaagacaucuccaugaauu

SEQ ID NO: 1391321 - RNA, 19 nt, Homo sapiens
gaacugaggugcaaagaga

SEQ ID NO: 1391322 - RNA, 19 nt, Homo sapiens
ugaagaagcuguagaaaug

SEQ ID NO: 1391323 - RNA, 19 nt, Homo sapiens
gagaagcccugaucccaua

SEQ ID NO: 1391324 - RNA, 19 nt, Homo sapiens
ggacaggaaugcugaguuc

SEQ ID NO: 1391325 - RNA, 19 nt, Homo sapiens
caccaaggcugcucuguuu

SEQ ID NO: 1391326 - RNA, 19 nt, Homo sapiens
guagaaaugccacuccuua

SEQ ID NO: 1391327 - RNA, 19 nt, Homo sapiens
ggaauuacacugucacuug

SEQ ID NO: 1391328 - RNA, 19 nt, Homo sapiens
gaacuugggcugcaucaau

SEQ ID NO: 1391329 - RNA, 19 nt, Homo sapiens
guaugaagcuugacauugg

SEQ ID NO: 1391330 - RNA, 19 nt, Homo sapiens
ccacuucacaggacucuua

SEQ ID NO: 1391331 - RNA, 19 nt, Homo sapiens
gaccaugcaucucuugcua

SEQ ID NO: 1391332 - RNA, 19 nt, Homo sapiens
caauguauguguguaugua

SEQ ID NO: 1391333 - RNA, 19 nt, Homo sapiens
gcgagucucuaacugauug

SEQ ID NO: 1391334 - RNA, 19 nt, Homo sapiens
gcaaagagaagcccugauc

SEQ ID NO: 1391335 - RNA, 19 nt, Homo sapiens
gaguuuaguucucaguuug

SEQ ID NO: 1391336 - RNA, 19 nt, Homo sapiens
gagguaguaugaagcuuga

SEQ ID NO: 1391337 - RNA, 19 nt, Homo sapiens
caucaaugcucaaggaaag

SEQ ID NO: 1391338 - RNA, 19 nt, Homo sapiens
gcacggauggaaacagaaa

SEQ ID NO: 1391339 - RNA, 19 nt, Homo sapiens
gcaccaaggcugcucuguu

SEQ ID NO: 1391340 - RNA, 19 nt, Homo sapiens
gaaaggaagacaucuccau

SEQ ID NO: 1391341 - RNA, 19 nt, Homo sapiens
ccagugcucugcaacaagu

SEQ ID NO: 1391342 - RNA, 19 nt, Homo sapiens
aggaagacaucuccaugaa

SEQ ID NO: 1391343 - RNA, 19 nt, Homo sapiens
cuucacaggacucuuaaua

SEQ ID NO: 1391344 - RNA, 19 nt, Homo sapiens
agaaggugcuggugacugu

SEQ ID NO: 1391345 - RNA, 19 nt, Homo sapiens
gcguuuccaugucacguaa

SEQ ID NO: 1391346 - RNA, 19 nt, Homo sapiens
gaaaauccccaaaguagga

SEQ ID NO: 1391347 - RNA, 19 nt, Homo sapiens
ggaagacaucuccaugaau

SEQ ID NO: 1391348 - RNA, 19 nt, Homo sapiens
ggugugaguguucccauuu

SEQ ID NO: 1391349 - RNA, 19 nt, Homo sapiens
gugaggaacugaggugcaa

SEQ ID NO: 1391350 - RNA, 19 nt, Homo sapiens
gccaggagguaguaugaag

SEQ ID NO: 1391351 - RNA, 19 nt, Homo sapiens
gaggcgagucucuaacuga

SEQ ID NO: 1391352 - RNA, 19 nt, Homo sapiens
gauugcagcgucuucuauu

SEQ ID NO: 1391353 - RNA, 19 nt, Homo sapiens
ugcaacaaguccugucuga

SEQ ID NO: 1391354 - RNA, 19 nt, Homo sapiens
gcauauccacucagcugaa

SEQ ID NO: 1391355 - RNA, 19 nt, Homo sapiens
cauccaccaugugcaguaa

SEQ ID NO: 1391356 - RNA, 19 nt, Homo sapiens
ccaauucccuccacuucac

SEQ ID NO: 1391357 - RNA, 19 nt, Homo sapiens
aguaagaggugcauaucca

SEQ ID NO: 1391358 - RNA, 19 nt, Homo sapiens
gcaguaagaggugcauauc

SEQ ID NO: 1391359 - RNA, 19 nt, Homo sapiens
augcaucucuugcuaguag

SEQ ID NO: 1391360 - RNA, 19 nt, Homo sapiens
cugcacggauggaaacaga

SEQ ID NO: 1391361 - RNA, 19 nt, Homo sapiens
caaggcugcucuguuucuu

SEQ ID NO: 1391362 - RNA, 19 nt, Homo sapiens
ccaugcaucucuugcuagu

SEQ ID NO: 1391363 - RNA, 19 nt, Homo sapiens
gcaccuugauaccuuuagg

SEQ ID NO: 1391364 - RNA, 19 nt, Homo sapiens
ccagcgcguuuccauguca

SEQ ID NO: 1391365 - RNA, 19 nt, Homo sapiens
gcuaggcuacugaguuuag

SEQ ID NO: 1391366 - RNA, 19 nt, Homo sapiens
ucaguuuggcaccuugaua

SEQ ID NO: 1391367 - RNA, 19 nt, Homo sapiens
aggcugcucuguuucuuuc

SEQ ID NO: 1391368 - RNA, 19 nt, Homo sapiens
gaagcccugaucccauaaa

SEQ ID NO: 1391369 - RNA, 19 nt, Homo sapiens
cugaagaagcuguagaaau

SEQ ID NO: 1391370 - RNA, 19 nt, Homo sapiens
ucaaggaaaggaagacauc

SEQ ID NO: 1391371 - RNA, 19 nt, Homo sapiens
ugaauuccguucccaucca

SEQ ID NO: 1391372 - RNA, 19 nt, Homo sapiens
aaggaagacaucuccauga

SEQ ID NO: 1391373 - RNA, 19 nt, Homo sapiens
gccagaccaugcaucucuu

SEQ ID NO: 1391374 - RNA, 19 nt, Homo sapiens
gcuacugaguuuaguucuc

SEQ ID NO: 1391375 - RNA, 19 nt, Homo sapiens
aacuugggcugcaucaaug

SEQ ID NO: 1391376 - RNA, 19 nt, Homo sapiens
gugccaggagguaguauga

SEQ ID NO: 1391377 - RNA, 19 nt, Homo sapiens
agaggugcauauccacuca

SEQ ID NO: 1391378 - RNA, 19 nt, Homo sapiens
cauauccacucagcugaag

SEQ ID NO: 1391379 - RNA, 19 nt, Homo sapiens
gugugaguguucccauuuc

SEQ ID NO: 1391380 - RNA, 19 nt, Homo sapiens
ggauggaaacagaaaauau

SEQ ID NO: 1391381 - RNA, 19 nt, Homo sapiens
gaagaagcuguagaaaugc

SEQ ID NO: 1391382 - RNA, 19 nt, Homo sapiens
gcugaagaagcuguagaaa

SEQ ID NO: 1391383 - RNA, 19 nt, Homo sapiens
uauccacucagcugaagaa

SEQ ID NO: 1391384 - RNA, 19 nt, Homo sapiens
ccaaggcugcucuguuucu

SEQ ID NO: 1391385 - RNA, 19 nt, Homo sapiens
guucucaguuuggcaccuu

SEQ ID NO: 1391386 - RNA, 19 nt, Homo sapiens
ggcuugccuuucugaguga

SEQ ID NO: 1391387 - RNA, 19 nt, Homo sapiens
guacuugcugcugucgaua

SEQ ID NO: 1391388 - RNA, 19 nt, Homo sapiens
auugcagcgucuucuauuu

SEQ ID NO: 1391389 - RNA, 19 nt, Homo sapiens
ggaacugaggugcaaagag

SEQ ID NO: 1391390 - RNA, 19 nt, Homo sapiens
ugaggcgagucucuaacug

SEQ ID NO: 1391391 - RNA, 19 nt, Homo sapiens
gaggaacugaggugcaaag

SEQ ID NO: 1391392 - RNA, 19 nt, Homo sapiens
gguaguaugaagcuugaca

SEQ ID NO: 1391393 - RNA, 19 nt, Homo sapiens
gauauuggggcuugccuuu

SEQ ID NO: 1391394 - RNA, 19 nt, Homo sapiens
gaaaugcaaugagcuuaaa

SEQ ID NO: 1391395 - RNA, 19 nt, Homo sapiens
gaacgcaugcuaucacaaa

SEQ ID NO: 1391396 - RNA, 19 nt, Homo sapiens
gacuuccucugcuaaauua

SEQ ID NO: 1391397 - RNA, 19 nt, Homo sapiens
uaaagcgggugaugaccua

SEQ ID NO: 1391398 - RNA, 19 nt, Homo sapiens
gaagaaaugcaaugagcuu

SEQ ID NO: 1391399 - RNA, 19 nt, Homo sapiens
gggaccaucuguucacuga

SEQ ID NO: 1391400 - RNA, 19 nt, Homo sapiens
caaccacauuggauaauuc

SEQ ID NO: 1391401 - RNA, 19 nt, Homo sapiens
ggacugggaccaucuguuc

SEQ ID NO: 1391402 - RNA, 19 nt, Homo sapiens
ggaagaagacuuuguuuug

SEQ ID NO: 1391403 - RNA, 19 nt, Homo sapiens
guaagcagcuccgaauuuu

SEQ ID NO: 1391404 - RNA, 19 nt, Homo sapiens
gcaaacaacagcuggaucu

SEQ ID NO: 1391405 - RNA, 19 nt, Homo sapiens
gaagaggcagauauuccua

SEQ ID NO: 1391406 - RNA, 19 nt, Homo sapiens
aaacgcaucacagaaauuu

SEQ ID NO: 1391407 - RNA, 19 nt, Homo sapiens
aacaacagcuggaucugaa

SEQ ID NO: 1391408 - RNA, 19 nt, Homo sapiens
ucaaccacauuggauaauu

SEQ ID NO: 1391409 - RNA, 19 nt, Homo sapiens
ugaaacuccucaccaaagu

SEQ ID NO: 1391410 - RNA, 19 nt, Homo sapiens
guacucagccauucagaca

SEQ ID NO: 1391411 - RNA, 19 nt, Homo sapiens
uguaagcagcuccgaauuu

SEQ ID NO: 1391412 - RNA, 19 nt, Homo sapiens
gaucugaacgcaugcuauc

SEQ ID NO: 1391413 - RNA, 19 nt, Homo sapiens
gagacuuccucugcuaaau

SEQ ID NO: 1391414 - RNA, 19 nt, Homo sapiens
agaaaugcaaugagcuuaa

SEQ ID NO: 1391415 - RNA, 19 nt, Homo sapiens
accgugaccuggacaauga

SEQ ID NO: 1391416 - RNA, 19 nt, Homo sapiens
gcucuagacaugaagaaau

SEQ ID NO: 1391417 - RNA, 19 nt, Homo sapiens
ggaggaaguacaggaagaa

SEQ ID NO: 1391418 - RNA, 19 nt, Homo sapiens
ucaccucaauggcaagaau

SEQ ID NO: 1391419 - RNA, 19 nt, Homo sapiens
ggaaguacaggaagaagac

SEQ ID NO: 1391420 - RNA, 19 nt, Homo sapiens
aaacaacagcuggaucuga

SEQ ID NO: 1391421 - RNA, 19 nt, Homo sapiens
ggccgagaaucaccucaau

SEQ ID NO: 1391422 - RNA, 19 nt, Homo sapiens
gaagaagacuuuguuuugc

SEQ ID NO: 1391423 - RNA, 19 nt, Homo sapiens
caaaacgcaucacagaaau

SEQ ID NO: 1391424 - RNA, 19 nt, Homo sapiens
agacuuccucugcuaaauu

SEQ ID NO: 1391425 - RNA, 19 nt, Homo sapiens
cagcgcaggccgagaauca

SEQ ID NO: 1391426 - RNA, 19 nt, Homo sapiens
uggaggaaguacaggaaga

SEQ ID NO: 1391427 - RNA, 19 nt, Homo sapiens
uauauucagucaaccacau

SEQ ID NO: 1391428 - RNA, 19 nt, Homo sapiens
gaaacuccucaccaaagug

SEQ ID NO: 1391429 - RNA, 19 nt, Homo sapiens
cagauaaagcgggugauga

SEQ ID NO: 1391430 - RNA, 19 nt, Homo sapiens
ccucccagcauccagauaa

SEQ ID NO: 1391431 - RNA, 19 nt, Homo sapiens
acaggaagaagacuuuguu

SEQ ID NO: 1391432 - RNA, 19 nt, Homo sapiens
ggagaucgaccugaaacuc

SEQ ID NO: 1391433 - RNA, 19 nt, Homo sapiens
gaaguacucagccauucag

SEQ ID NO: 1391434 - RNA, 19 nt, Homo sapiens
caugaaguacucagccauu

SEQ ID NO: 1391435 - RNA, 19 nt, Homo sapiens
cuuauucugugccaucuca

SEQ ID NO: 1391436 - RNA, 19 nt, Homo sapiens
gacaugaagaaaugcaaug

SEQ ID NO: 1391437 - RNA, 19 nt, Homo sapiens
cucuagacaugaagaaaug

SEQ ID NO: 1391438 - RNA, 19 nt, Homo sapiens
gcacgaaguccgggaggau

SEQ ID NO: 1391439 - RNA, 19 nt, Homo sapiens
caggaagaagacuuuguuu

SEQ ID NO: 1391440 - RNA, 19 nt, Homo sapiens
aggauuugcucgacuugga

SEQ ID NO: 1391441 - RNA, 19 nt, Homo sapiens
ccaaacaggcaaacaacag

SEQ ID NO: 1391442 - RNA, 19 nt, Homo sapiens
acaaaacgcaucacagaaa

SEQ ID NO: 1391443 - RNA, 19 nt, Homo sapiens
cagucaaccacauuggaua

SEQ ID NO: 1391444 - RNA, 19 nt, Homo sapiens
uggaggauuugcucgacuu

SEQ ID NO: 1391445 - RNA, 19 nt, Homo sapiens
ccgagaaucaccucaaugg

SEQ ID NO: 1391446 - RNA, 19 nt, Homo sapiens
ucacaaaacgcaucacaga

SEQ ID NO: 1391447 - RNA, 19 nt, Homo sapiens
agucaaccacauuggauaa

SEQ ID NO: 1391448 - RNA, 19 nt, Homo sapiens
aagaaaugcaaugagcuua

SEQ ID NO: 1391449 - RNA, 19 nt, Homo sapiens
ggcaggugauuccgugaag

SEQ ID NO: 1391450 - RNA, 19 nt, Homo sapiens
gcccgucacccaugcucua

SEQ ID NO: 1391451 - RNA, 19 nt, Homo sapiens
ccagauaaagcgggugaug

SEQ ID NO: 1391452 - RNA, 19 nt, Homo sapiens
gggcaggugauuccgugaa

SEQ ID NO: 1391453 - RNA, 19 nt, Homo sapiens
ccugaaacuccucaccaaa

SEQ ID NO: 1391454 - RNA, 19 nt, Homo sapiens
ggaucugaacgcaugcuau

SEQ ID NO: 1391455 - RNA, 19 nt, Homo sapiens
guacaggaagaagacuuug

SEQ ID NO: 1391456 - RNA, 19 nt, Homo sapiens
ggggcuggcuucauuggaa

SEQ ID NO: 1391457 - RNA, 19 nt, Homo sapiens
gaaagacagugaugaugaa

SEQ ID NO: 1391458 - RNA, 19 nt, Homo sapiens
ggaugugccugaaguauug

SEQ ID NO: 1391459 - RNA, 19 nt, Homo sapiens
ugauaggucuucucagaua

SEQ ID NO: 1391460 - RNA, 19 nt, Homo sapiens
caagaaagcagugaaauau

SEQ ID NO: 1391461 - RNA, 19 nt, Homo sapiens
ccaagaaagcagugaaaua

SEQ ID NO: 1391462 - RNA, 19 nt, Homo sapiens
agaaagcagugaaauauca

SEQ ID NO: 1391463 - RNA, 19 nt, Homo sapiens
caacaagguucgguccaaa

SEQ ID NO: 1391464 - RNA, 19 nt, Homo sapiens
gcgggaagcuggccaucuu

SEQ ID NO: 1391465 - RNA, 19 nt, Homo sapiens
cgaaagacagugaugauga

SEQ ID NO: 1391466 - RNA, 19 nt, Homo sapiens
gaagacggccaacaagguu

SEQ ID NO: 1391467 - RNA, 19 nt, Homo sapiens
ugaaagcgaucgagcaaag

SEQ ID NO: 1391468 - RNA, 19 nt, Homo sapiens
cgaagcaggcgcugaauga

SEQ ID NO: 1391469 - RNA, 19 nt, Homo sapiens
gaucgcagcaggcgugauu

SEQ ID NO: 1391470 - RNA, 19 nt, Homo sapiens
ucaagaagacggccaacaa

SEQ ID NO: 1391471 - RNA, 19 nt, Homo sapiens
gauuacacaugcacaccaa

SEQ ID NO: 1391472 - RNA, 19 nt, Homo sapiens
ggaaguucguggagguaau

SEQ ID NO: 1391473 - RNA, 19 nt, Homo sapiens
aaaauggacucacagauga

SEQ ID NO: 1391474 - RNA, 19 nt, Homo sapiens
ccaggcagguggugugugu

SEQ ID NO: 1391475 - RNA, 19 nt, Homo sapiens
ugaaggaucggacucaaga

SEQ ID NO: 1391476 - RNA, 19 nt, Homo sapiens
aagguucgguccaaauuga

SEQ ID NO: 1391477 - RNA, 19 nt, Homo sapiens
ggaucucacugcagacauc

SEQ ID NO: 1391478 - RNA, 19 nt, Homo sapiens
cagcaggcgugauuacaca

SEQ ID NO: 1391479 - RNA, 19 nt, Homo sapiens
ggucuuggcgucauccauu

SEQ ID NO: 1391480 - RNA, 19 nt, Homo sapiens
gagguaaugaccgaauaua

SEQ ID NO: 1391481 - RNA, 19 nt, Homo sapiens
gaugaaggaucggacucaa

SEQ ID NO: 1391482 - RNA, 19 nt, Homo sapiens
gcaacaaagccacugauac

SEQ ID NO: 1391483 - RNA, 19 nt, Homo sapiens
caccacaucgggagcaaua

SEQ ID NO: 1391484 - RNA, 19 nt, Homo sapiens
ggaagaaaaucaugaucau

SEQ ID NO: 1391485 - RNA, 19 nt, Homo sapiens
guagagagccagggagaga

SEQ ID NO: 1391486 - RNA, 19 nt, Homo sapiens
ccaacaagguucgguccaa

SEQ ID NO: 1391487 - RNA, 19 nt, Homo sapiens
gguaaugaccgaauauaac

SEQ ID NO: 1391488 - RNA, 19 nt, Homo sapiens
agacagugaugaugaagag

SEQ ID NO: 1391489 - RNA, 19 nt, Homo sapiens
gauaggucuucucagauag

SEQ ID NO: 1391490 - RNA, 19 nt, Homo sapiens
auugauaggucuucucaga

SEQ ID NO: 1391491 - RNA, 19 nt, Homo sapiens
caacaaagccacugauacc

SEQ ID NO: 1391492 - RNA, 19 nt, Homo sapiens
gaaccuaaugcaacagcaa

SEQ ID NO: 1391493 - RNA, 19 nt, Homo sapiens
acgaagaacuggaagacau

SEQ ID NO: 1391494 - RNA, 19 nt, Homo sapiens
gaaggaccaccaccaacga

SEQ ID NO: 1391495 - RNA, 19 nt, Homo sapiens
ggacucacacucacauucu

SEQ ID NO: 1391496 - RNA, 19 nt, Homo sapiens
acugauaccugagcccuuu

SEQ ID NO: 1391497 - RNA, 19 nt, Homo sapiens
gagacgaggcacaaugaga

SEQ ID NO: 1391498 - RNA, 19 nt, Homo sapiens
ugacgaagcaggcgcugaa

SEQ ID NO: 1391499 - RNA, 19 nt, Homo sapiens
ggagguaaugaccgaauau

SEQ ID NO: 1391500 - RNA, 19 nt, Homo sapiens
uggagguaaugaccgaaua

SEQ ID NO: 1391501 - RNA, 19 nt, Homo sapiens
ggagugcgaaagacaguga

SEQ ID NO: 1391502 - RNA, 19 nt, Homo sapiens
agacugcagccaaguguaa

SEQ ID NO: 1391503 - RNA, 19 nt, Homo sapiens
aacaggagcuggaggaucu

SEQ ID NO: 1391504 - RNA, 19 nt, Homo sapiens
cagaugagaagaccaaaca

SEQ ID NO: 1391505 - RNA, 19 nt, Homo sapiens
ggaccaccaccaacgaaga

SEQ ID NO: 1391506 - RNA, 19 nt, Homo sapiens
caacuggagaucacuggaa

SEQ ID NO: 1391507 - RNA, 19 nt, Homo sapiens
ggaacauucuguggacuac

SEQ ID NO: 1391508 - RNA, 19 nt, Homo sapiens
ugauugaccgcaucgagua

SEQ ID NO: 1391509 - RNA, 19 nt, Homo sapiens
gaaguucguggagguaaug

SEQ ID NO: 1391510 - RNA, 19 nt, Homo sapiens
gagcugcacgauauguuug

SEQ ID NO: 1391511 - RNA, 19 nt, Homo sapiens
caaaauggacucacagaug

SEQ ID NO: 1391512 - RNA, 19 nt, Homo sapiens
gaccaccaccaacgaagaa

SEQ ID NO: 1391513 - RNA, 19 nt, Homo sapiens
caagaagacggccaacaag

SEQ ID NO: 1391514 - RNA, 19 nt, Homo sapiens
acucacagaugacgaagca

SEQ ID NO: 1391515 - RNA, 19 nt, Homo sapiens
gcacccaacccagaugaga

SEQ ID NO: 1391516 - RNA, 19 nt, Homo sapiens
guuugaaccuaaugcaaca

SEQ ID NO: 1391517 - RNA, 19 nt, Homo sapiens
cgagcugcacgauauguuu

SEQ ID NO: 1391518 - RNA, 19 nt, Homo sapiens
guacaacguggaacauucu

SEQ ID NO: 1391519 - RNA, 19 nt, Homo sapiens
guaaugaccgaauauaacg

SEQ ID NO: 1391520 - RNA, 19 nt, Homo sapiens
ucacugcagacaucaagaa

SEQ ID NO: 1391521 - RNA, 19 nt, Homo sapiens
guauugauaggucuucuca

SEQ ID NO: 1391522 - RNA, 19 nt, Homo sapiens
gaguacaacguggaacauu

SEQ ID NO: 1391523 - RNA, 19 nt, Homo sapiens
uccgcgagcugcacgauau

SEQ ID NO: 1391524 - RNA, 19 nt, Homo sapiens
cgaagaacuggaagacaug

SEQ ID NO: 1391525 - RNA, 19 nt, Homo sapiens
uugaacagguggaagagau

SEQ ID NO: 1391526 - RNA, 19 nt, Homo sapiens
caagguucgguccaaauug

SEQ ID NO: 1391527 - RNA, 19 nt, Homo sapiens
acaagguucgguccaaauu

SEQ ID NO: 1391528 - RNA, 19 nt, Homo sapiens
gcgaaagacagugaugaug

SEQ ID NO: 1391529 - RNA, 19 nt, Homo sapiens
cuaaugcaacagcaacaaa

SEQ ID NO: 1391530 - RNA, 19 nt, Homo sapiens
gaaacugucggaggaugug

SEQ ID NO: 1391531 - RNA, 19 nt, Homo sapiens
aguacaacguggaacauuc

SEQ ID NO: 1391532 - RNA, 19 nt, Homo sapiens
cugcagacaucaagaagac

SEQ ID NO: 1391533 - RNA, 19 nt, Homo sapiens
ccaggagggugugcaugug

SEQ ID NO: 1391534 - RNA, 19 nt, Homo sapiens
ggaucgggaccacuucaug

SEQ ID NO: 1391535 - RNA, 19 nt, Homo sapiens
ggaugaaggaucggacuca

SEQ ID NO: 1391536 - RNA, 19 nt, Homo sapiens
uaacacagcaguccaucac

SEQ ID NO: 1391537 - RNA, 19 nt, Homo sapiens
caccaagaaagcagugaaa

SEQ ID NO: 1391538 - RNA, 19 nt, Homo sapiens
caccaacgaagaacuggaa

SEQ ID NO: 1391539 - RNA, 19 nt, Homo sapiens
gaucgagcaaagcauugaa

SEQ ID NO: 1391540 - RNA, 19 nt, Homo sapiens
ggauguggagcaggugaaa

SEQ ID NO: 1391541 - RNA, 19 nt, Homo sapiens
agacgaggcacaaugagau

SEQ ID NO: 1391542 - RNA, 19 nt, Homo sapiens
acccagcacuccacacugu

SEQ ID NO: 1391543 - RNA, 19 nt, Homo sapiens
ggugguguguguggacuca

SEQ ID NO: 1391544 - RNA, 19 nt, Homo sapiens
guagacugcagccaagugu

SEQ ID NO: 1391545 - RNA, 19 nt, Homo sapiens
gaaagcagugaaauaucag

SEQ ID NO: 1391546 - RNA, 19 nt, Homo sapiens
caacgaagaacuggaagac

SEQ ID NO: 1391547 - RNA, 19 nt, Homo sapiens
gcaggcgugauuacacaug

SEQ ID NO: 1391548 - RNA, 19 nt, Homo sapiens
agcaggcgcugaaugagau

SEQ ID NO: 1391549 - RNA, 19 nt, Homo sapiens
agguaaugaccgaauauaa

SEQ ID NO: 1391550 - RNA, 19 nt, Homo sapiens
gagccagggagagaugauu

SEQ ID NO: 1391551 - RNA, 19 nt, Homo sapiens
guaacacagcaguccauca

SEQ ID NO: 1391552 - RNA, 19 nt, Homo sapiens
aagcaggcgcugaaugaga

SEQ ID NO: 1391553 - RNA, 19 nt, Homo sapiens
gggcugcauugagaaacug

SEQ ID NO: 1391554 - RNA, 19 nt, Homo sapiens
agaagacggccaacaaggu

SEQ ID NO: 1391555 - RNA, 19 nt, Homo sapiens
ggacagggcuauugauaag

SEQ ID NO: 1391556 - RNA, 19 nt, Homo sapiens
gaguaccaguccauaaauu

SEQ ID NO: 1391557 - RNA, 19 nt, Homo sapiens
uaacuucugugccuucaau

SEQ ID NO: 1391558 - RNA, 19 nt, Homo sapiens
gcaccaacguguccgauac

SEQ ID NO: 1391559 - RNA, 19 nt, Homo sapiens
guaccaguccauaaauuaa

SEQ ID NO: 1391560 - RNA, 19 nt, Homo sapiens
gagggaaggacauuacuga

SEQ ID NO: 1391561 - RNA, 19 nt, Homo sapiens
ccaggcugcuugaguuuga

SEQ ID NO: 1391562 - RNA, 19 nt, Homo sapiens
cagaguaccaguccauaaa

SEQ ID NO: 1391563 - RNA, 19 nt, Homo sapiens
uuaccaggcugcuugaguu

SEQ ID NO: 1391564 - RNA, 19 nt, Homo sapiens
ggacuugcaggccuaaaug

SEQ ID NO: 1391565 - RNA, 19 nt, Homo sapiens
gggacagggcuauugauaa

SEQ ID NO: 1391566 - RNA, 19 nt, Homo sapiens
gaccauauccuccauacuc

SEQ ID NO: 1391567 - RNA, 19 nt, Homo sapiens
gaagaccauauccuccaua

SEQ ID NO: 1391568 - RNA, 19 nt, Homo sapiens
ccacacauuucccuuggau

SEQ ID NO: 1391569 - RNA, 19 nt, Homo sapiens
gggcuuccuucauacuuug

SEQ ID NO: 1391570 - RNA, 19 nt, Homo sapiens
ggaagaccauauccuccau

SEQ ID NO: 1391571 - RNA, 19 nt, Homo sapiens
ggacucuacuucuguuugc

SEQ ID NO: 1391572 - RNA, 19 nt, Homo sapiens
gagguuggagcaucaaguu

SEQ ID NO: 1391573 - RNA, 19 nt, Homo sapiens
cauacuccuuggccgauuu

SEQ ID NO: 1391574 - RNA, 19 nt, Homo sapiens
uaaggacagcauucaguuu

SEQ ID NO: 1391575 - RNA, 19 nt, Homo sapiens
ugauggugcucccuaagga

SEQ ID NO: 1391576 - RNA, 19 nt, Homo sapiens
ucagaguaccaguccauaa

SEQ ID NO: 1391577 - RNA, 19 nt, Homo sapiens
cacccugagugccacauuu

SEQ ID NO: 1391578 - RNA, 19 nt, Homo sapiens
aguaccaguccauaaauua

SEQ ID NO: 1391579 - RNA, 19 nt, Homo sapiens
gccgauuucucuuggaaca

SEQ ID NO: 1391580 - RNA, 19 nt, Homo sapiens
ucuugcaucuccacacauu

SEQ ID NO: 1391581 - RNA, 19 nt, Homo sapiens
cugguuggcugcccuggaa

SEQ ID NO: 1391582 - RNA, 19 nt, Homo sapiens
cuaaggacagcauucaguu

SEQ ID NO: 1391583 - RNA, 19 nt, Homo sapiens
ccaauuccacacugcacua

SEQ ID NO: 1391584 - RNA, 19 nt, Homo sapiens
gaaggacauuacugaaccu

SEQ ID NO: 1391585 - RNA, 19 nt, Homo sapiens
acagggcuauugauaaggu

SEQ ID NO: 1391586 - RNA, 19 nt, Homo sapiens
gggcagugggcaccaauuc

SEQ ID NO: 1391587 - RNA, 19 nt, Homo sapiens
gcagugggcaccaauucca

SEQ ID NO: 1391588 - RNA, 19 nt, Homo sapiens
gggaaggacauuacugaac

SEQ ID NO: 1391589 - RNA, 19 nt, Homo sapiens
ccacuaguccugggcauca

SEQ ID NO: 1391590 - RNA, 19 nt, Homo sapiens
ggagggaaggacauuacug

SEQ ID NO: 1391591 - RNA, 19 nt, Homo sapiens
gcuagagguggcccugauu

SEQ ID NO: 1391592 - RNA, 19 nt, Homo sapiens
cagaaccugcuucauauac

SEQ ID NO: 1391593 - RNA, 19 nt, Homo sapiens
gccugauggugcucccuaa

SEQ ID NO: 1391594 - RNA, 19 nt, Homo sapiens
uggccgauuucucuuggaa

SEQ ID NO: 1391595 - RNA, 19 nt, Homo sapiens
cucuggaggucaucccuaa

SEQ ID NO: 1391596 - RNA, 19 nt, Homo sapiens
gggacuugcaggccuaaau

SEQ ID NO: 1391597 - RNA, 19 nt, Homo sapiens
ccaucaggcuuugcacagu

SEQ ID NO: 1391598 - RNA, 19 nt, Homo sapiens
auuccacacugcacuaugu

SEQ ID NO: 1391599 - RNA, 19 nt, Homo sapiens
cgauuucucuuggaacaac

SEQ ID NO: 1391600 - RNA, 19 nt, Homo sapiens
gacuugcaggccuaaauga

SEQ ID NO: 1391601 - RNA, 19 nt, Homo sapiens
gagauugccuugaagagua

SEQ ID NO: 1391602 - RNA, 19 nt, Homo sapiens
gaagagguaugaggaggaa

SEQ ID NO: 1391603 - RNA, 19 nt, Homo sapiens
ucaaggcucugaacaacaa

SEQ ID NO: 1391604 - RNA, 19 nt, Homo sapiens
gcucagagaucgagaacgu

SEQ ID NO: 1391605 - RNA, 19 nt, Homo sapiens
gaucaaggcucugaacaac

SEQ ID NO: 1391606 - RNA, 19 nt, Homo sapiens
ggaggcauccaccagguua

SEQ ID NO: 1391607 - RNA, 19 nt, Homo sapiens
gaguggaggcuauggauuu

SEQ ID NO: 1391608 - RNA, 19 nt, Homo sapiens
caacaugagccgccaauuc

SEQ ID NO: 1391609 - RNA, 19 nt, Homo sapiens
ggucagcgguggcuaugug

SEQ ID NO: 1391610 - RNA, 19 nt, Homo sapiens
caggaugucaggagaauuu

SEQ ID NO: 1391611 - RNA, 19 nt, Homo sapiens
guugcaaccucaauaaaca

SEQ ID NO: 1391612 - RNA, 19 nt, Homo sapiens
guacacacccuauuaacuc

SEQ ID NO: 1391613 - RNA, 19 nt, Homo sapiens
gaaggacaaacaaccaaga

SEQ ID NO: 1391614 - RNA, 19 nt, Homo sapiens
ggacaacaaccggaaccua

SEQ ID NO: 1391615 - RNA, 19 nt, Homo sapiens
caaguucgccuccuucauc

SEQ ID NO: 1391616 - RNA, 19 nt, Homo sapiens
gcacccagaagcagagaaa

SEQ ID NO: 1391617 - RNA, 19 nt, Homo sapiens
cagagaauccgcucagaga

SEQ ID NO: 1391618 - RNA, 19 nt, Homo sapiens
ucaauaaacagcacaaucu

SEQ ID NO: 1391619 - RNA, 19 nt, Homo sapiens
uuaauggccuuccucuguu

SEQ ID NO: 1391620 - RNA, 19 nt, Homo sapiens
acauggagaucgccaccua

SEQ ID NO: 1391621 - RNA, 19 nt, Homo sapiens
ugaaauuccucccuguaca

SEQ ID NO: 1391622 - RNA, 19 nt, Homo sapiens
guggaggacuacaagaaga

SEQ ID NO: 1391623 - RNA, 19 nt, Homo sapiens
gucagcaucuccaucauca

SEQ ID NO: 1391624 - RNA, 19 nt, Homo sapiens
ggacagcaucauugacgaa

SEQ ID NO: 1391625 - RNA, 19 nt, Homo sapiens
ggauguggaugcugcuuac

SEQ ID NO: 1391626 - RNA, 19 nt, Homo sapiens
cagcagagaacgaguuugu

SEQ ID NO: 1391627 - RNA, 19 nt, Homo sapiens
acucggagcugaggaaugu

SEQ ID NO: 1391628 - RNA, 19 nt, Homo sapiens
cugaacaacugcaagaaca

SEQ ID NO: 1391629 - RNA, 19 nt, Homo sapiens
gagaauccgcucagagauc

SEQ ID NO: 1391630 - RNA, 19 nt, Homo sapiens
gaaguccgcacccaguaug

SEQ ID NO: 1391631 - RNA, 19 nt, Homo sapiens
gguaugaggaggaaaucaa

SEQ ID NO: 1391632 - RNA, 19 nt, Homo sapiens
agcaggcacuguucacuuu

SEQ ID NO: 1391633 - RNA, 19 nt, Homo sapiens
ggugaaauuccucccugua

SEQ ID NO: 1391634 - RNA, 19 nt, Homo sapiens
gagugcacccuccaagaaa

SEQ ID NO: 1391635 - RNA, 19 nt, Homo sapiens
gaagcuggcccuggacaug

SEQ ID NO: 1391636 - RNA, 19 nt, Homo sapiens
gaagaguggaggcuaugga

SEQ ID NO: 1391637 - RNA, 19 nt, Homo sapiens
aaggaggacugaaggacaa

SEQ ID NO: 1391638 - RNA, 19 nt, Homo sapiens
gaauuucccuccccuguca

SEQ ID NO: 1391639 - RNA, 19 nt, Homo sapiens
cagcaucauugacgaaguc

SEQ ID NO: 1391640 - RNA, 19 nt, Homo sapiens
gaccuggacagcaucauug

SEQ ID NO: 1391641 - RNA, 19 nt, Homo sapiens
ggaugcugcuuacgccaau

SEQ ID NO: 1391642 - RNA, 19 nt, Homo sapiens
ggacagcagcagagaacga

SEQ ID NO: 1391643 - RNA, 19 nt, Homo sapiens
uaauggccuuccucuguug

SEQ ID NO: 1391644 - RNA, 19 nt, Homo sapiens
ugagugcacccuccaagaa

SEQ ID NO: 1391645 - RNA, 19 nt, Homo sapiens
gagacaacgcccugaagga

SEQ ID NO: 1391646 - RNA, 19 nt, Homo sapiens
agauugccuugaagaguaa

SEQ ID NO: 1391647 - RNA, 19 nt, Homo sapiens
ggagauugccuugaagagu

SEQ ID NO: 1391648 - RNA, 19 nt, Homo sapiens
gaggagauugccuugaaga

SEQ ID NO: 1391649 - RNA, 19 nt, Homo sapiens
augaggagauugccuugaa

SEQ ID NO: 1391650 - RNA, 19 nt, Homo sapiens
acaacaaguucgccuccuu

SEQ ID NO: 1391651 - RNA, 19 nt, Homo sapiens
gcagugccaacgauuacaa

SEQ ID NO: 1391652 - RNA, 19 nt, Homo sapiens
gaccugaacaacugcaaga

SEQ ID NO: 1391653 - RNA, 19 nt, Homo sapiens
uaaacagcacaaucucaaa

SEQ ID NO: 1391654 - RNA, 19 nt, Homo sapiens
gagaaaagcaggcacuguu

SEQ ID NO: 1391655 - RNA, 19 nt, Homo sapiens
acugggaccuagcauaguu

SEQ ID NO: 1391656 - RNA, 19 nt, Homo sapiens
gaaaaccagucgguagaga

SEQ ID NO: 1391657 - RNA, 19 nt, Homo sapiens
cuuaauggccuuccucugu

SEQ ID NO: 1391658 - RNA, 19 nt, Homo sapiens
cagguuaccgucaaugaga

SEQ ID NO: 1391659 - RNA, 19 nt, Homo sapiens
ucgagaacgugaagaagca

SEQ ID NO: 1391660 - RNA, 19 nt, Homo sapiens
caagaaggauguggaugcu

SEQ ID NO: 1391661 - RNA, 19 nt, Homo sapiens
aacaugagccgccaauuca

SEQ ID NO: 1391662 - RNA, 19 nt, Homo sapiens
cagauccagucccacauca

SEQ ID NO: 1391663 - RNA, 19 nt, Homo sapiens
aagccgagaucacucagau

SEQ ID NO: 1391664 - RNA, 19 nt, Homo sapiens
gaagcauguuuggcagugu

SEQ ID NO: 1391665 - RNA, 19 nt, Homo sapiens
guucuucaggugucucuuu

SEQ ID NO: 1391666 - RNA, 19 nt, Homo sapiens
gauccagucccacaucagu

SEQ ID NO: 1391667 - RNA, 19 nt, Homo sapiens
ggaccaggagaucaaguuc

SEQ ID NO: 1391668 - RNA, 19 nt, Homo sapiens
gaacaacugcaagaacaac

SEQ ID NO: 1391669 - RNA, 19 nt, Homo sapiens
ccuguacacacccuauuaa

SEQ ID NO: 1391670 - RNA, 19 nt, Homo sapiens
cgggaagaguggaggcuau

SEQ ID NO: 1391671 - RNA, 19 nt, Homo sapiens
accaggagaucaaguucuu

SEQ ID NO: 1391672 - RNA, 19 nt, Homo sapiens
ggaaugugcgggacguagu

SEQ ID NO: 1391673 - RNA, 19 nt, Homo sapiens
ccaccagguuaccgucaau

SEQ ID NO: 1391674 - RNA, 19 nt, Homo sapiens
auaaacagcacaaucucaa

SEQ ID NO: 1391675 - RNA, 19 nt, Homo sapiens
gaaugugcgggacguagug

SEQ ID NO: 1391676 - RNA, 19 nt, Homo sapiens
ggacugaaggacaaacaac

SEQ ID NO: 1391677 - RNA, 19 nt, Homo sapiens
acacugggaccuagcauag

SEQ ID NO: 1391678 - RNA, 19 nt, Homo sapiens
gaaauuccucccuguacac

SEQ ID NO: 1391679 - RNA, 19 nt, Homo sapiens
gaugcugcuuacgccaaua

SEQ ID NO: 1391680 - RNA, 19 nt, Homo sapiens
cugcucagcugugcucuca

SEQ ID NO: 1391681 - RNA, 19 nt, Homo sapiens
gaaggguuccagccugagu

SEQ ID NO: 1391682 - RNA, 19 nt, Homo sapiens
agacaacgcccugaaggau

SEQ ID NO: 1391683 - RNA, 19 nt, Homo sapiens
aguuugugcugcucaagaa

SEQ ID NO: 1391684 - RNA, 19 nt, Homo sapiens
gaguuugugcugcucaaga

SEQ ID NO: 1391685 - RNA, 19 nt, Homo sapiens
acuguucacuuuuccuuua

SEQ ID NO: 1391686 - RNA, 19 nt, Homo sapiens
cuagcucagucucaaaucu

SEQ ID NO: 1391687 - RNA, 19 nt, Homo sapiens
ugccaacgauuacaaagac

SEQ ID NO: 1391688 - RNA, 19 nt, Homo sapiens
gugccaacgauuacaaaga

SEQ ID NO: 1391689 - RNA, 19 nt, Homo sapiens
cgccaccuaucgcaagcua

SEQ ID NO: 1391690 - RNA, 19 nt, Homo sapiens
gaccaaguuccaagagcuu

SEQ ID NO: 1391691 - RNA, 19 nt, Homo sapiens
cgaaguccgcacccaguau

SEQ ID NO: 1391692 - RNA, 19 nt, Homo sapiens
caggagaucaaguucuuca

SEQ ID NO: 1391693 - RNA, 19 nt, Homo sapiens
gcucaagaaggauguggau

SEQ ID NO: 1391694 - RNA, 19 nt, Homo sapiens
ucagcaaccugcggaagca

SEQ ID NO: 1391695 - RNA, 19 nt, Homo sapiens
cgcagucgcuaacuacucu

SEQ ID NO: 1391696 - RNA, 19 nt, Homo sapiens
ggaaggccuggaugaccaa

SEQ ID NO: 1391697 - RNA, 19 nt, Homo sapiens
cagcagcagagaacgaguu

SEQ ID NO: 1391698 - RNA, 19 nt, Homo sapiens
caauaaacagcacaaucuc

SEQ ID NO: 1391699 - RNA, 19 nt, Homo sapiens
gaaaagcaggcacuguuca

SEQ ID NO: 1391700 - RNA, 19 nt, Homo sapiens
ugagugggaccaagugcaa

SEQ ID NO: 1391701 - RNA, 19 nt, Homo sapiens
gagcugcaauaaaucgaua

SEQ ID NO: 1391702 - RNA, 19 nt, Homo sapiens
gagaaucaggguuugagua

SEQ ID NO: 1391703 - RNA, 19 nt, Homo sapiens
gcaauaaaucgauaacaca

SEQ ID NO: 1391704 - RNA, 19 nt, Homo sapiens
gagggaagacgacaugcua

SEQ ID NO: 1391705 - RNA, 19 nt, Homo sapiens
ggagagggaagacgacaug

SEQ ID NO: 1391706 - RNA, 19 nt, Homo sapiens
gaacgugguguuucguaga

SEQ ID NO: 1391707 - RNA, 19 nt, Homo sapiens
aaucaggguuugaguagga

SEQ ID NO: 1391708 - RNA, 19 nt, Homo sapiens
gaagacgacaugcuagaca

SEQ ID NO: 1391709 - RNA, 19 nt, Homo sapiens
gggcccagauugagggaau

SEQ ID NO: 1391710 - RNA, 19 nt, Homo sapiens
cuacguggauggccauguc

SEQ ID NO: 1391711 - RNA, 19 nt, Homo sapiens
gggaagacgacaugcuaga

SEQ ID NO: 1391712 - RNA, 19 nt, Homo sapiens
augaacaccuggaccauuc

SEQ ID NO: 1391713 - RNA, 19 nt, Homo sapiens
caagaucaccaggaacuuc

SEQ ID NO: 1391714 - RNA, 19 nt, Homo sapiens
gagugaagaccaccuggau

SEQ ID NO: 1391715 - RNA, 19 nt, Homo sapiens
ccaccugccauguguaugu

SEQ ID NO: 1391716 - RNA, 19 nt, Homo sapiens
gugaagaccaccuggaucu

SEQ ID NO: 1391717 - RNA, 19 nt, Homo sapiens
agaaucaggguuugaguag

SEQ ID NO: 1391718 - RNA, 19 nt, Homo sapiens
ugcaauaaaucgauaacac

SEQ ID NO: 1391719 - RNA, 19 nt, Homo sapiens
ggcccagauugagggaaua

SEQ ID NO: 1391720 - RNA, 19 nt, Homo sapiens
caugaacaccuggaccauu

SEQ ID NO: 1391721 - RNA, 19 nt, Homo sapiens
gugaacgugguguuucgua

SEQ ID NO: 1391722 - RNA, 19 nt, Homo sapiens
gcuggaaggagcggaauuc

SEQ ID NO: 1391723 - RNA, 19 nt, Homo sapiens
ccauguguaugugagugaa

SEQ ID NO: 1391724 - RNA, 19 nt, Homo sapiens
ggaaguaucagcuuaagaa

SEQ ID NO: 1391725 - RNA, 19 nt, Homo sapiens
ggacagcgguggugaugug

SEQ ID NO: 1391726 - RNA, 19 nt, Homo sapiens
ggaagaagguggacauugc

SEQ ID NO: 1391727 - RNA, 19 nt, Homo sapiens
uaagaaacuugaucaggaa

SEQ ID NO: 1391728 - RNA, 19 nt, Homo sapiens
ccagggaaguaucagcuua

SEQ ID NO: 1391729 - RNA, 19 nt, Homo sapiens
ggacugguuuggcuacuau

SEQ ID NO: 1391730 - RNA, 19 nt, Homo sapiens
ggauugggcugauuguuca

SEQ ID NO: 1391731 - RNA, 19 nt, Homo sapiens
cgaaggagauacucuuuag

SEQ ID NO: 1391732 - RNA, 19 nt, Homo sapiens
ccagaaaccaguccuauau

SEQ ID NO: 1391733 - RNA, 19 nt, Homo sapiens
ggagauaccgaaggagaua

SEQ ID NO: 1391734 - RNA, 19 nt, Homo sapiens
ucagggaggccgcaaauuu

SEQ ID NO: 1391735 - RNA, 19 nt, Homo sapiens
ggaggagaaucugcacaaa

SEQ ID NO: 1391736 - RNA, 19 nt, Homo sapiens
augcauaucuccuauucua

SEQ ID NO: 1391737 - RNA, 19 nt, Homo sapiens
gcacucugcuuuuauuauu

SEQ ID NO: 1391738 - RNA, 19 nt, Homo sapiens
ggagugcaauggcaugauc

SEQ ID NO: 1391739 - RNA, 19 nt, Homo sapiens
ggaaggagcaauuucucaa

SEQ ID NO: 1391740 - RNA, 19 nt, Homo sapiens
caagguugcugaucucucu

SEQ ID NO: 1391741 - RNA, 19 nt, Homo sapiens
gaaacacuaaggagacuug

SEQ ID NO: 1391742 - RNA, 19 nt, Homo sapiens
cccaguggcuugucagauu

SEQ ID NO: 1391743 - RNA, 19 nt, Homo sapiens
caagucuggucuucuguga

SEQ ID NO: 1391744 - RNA, 19 nt, Homo sapiens
gggcuccaauggcgaguuu

SEQ ID NO: 1391745 - RNA, 19 nt, Homo sapiens
ccacaacgcccuuuucuaa

SEQ ID NO: 1391746 - RNA, 19 nt, Homo sapiens
ccaaagugcugggauuaca

SEQ ID NO: 1391747 - RNA, 19 nt, Homo sapiens
gcaggagcuuguccaggaa

SEQ ID NO: 1391748 - RNA, 19 nt, Homo sapiens
gccuaggucugaaacacua

SEQ ID NO: 1391749 - RNA, 19 nt, Homo sapiens
gaaguaucagcuuaagaaa

SEQ ID NO: 1391750 - RNA, 19 nt, Homo sapiens
gcaaguaggcacaguaagg

SEQ ID NO: 1391751 - RNA, 19 nt, Homo sapiens
gcauggauuucaccagcaa

SEQ ID NO: 1391752 - RNA, 19 nt, Homo sapiens
ccaugcauaucuccuauuc

SEQ ID NO: 1391753 - RNA, 19 nt, Homo sapiens
ggacauugcggguaucuac

SEQ ID NO: 1391754 - RNA, 19 nt, Homo sapiens
cuugucagauugguaaaua

SEQ ID NO: 1391755 - RNA, 19 nt, Homo sapiens
gggcaaguaggcacaguaa

SEQ ID NO: 1391756 - RNA, 19 nt, Homo sapiens
gaaggagcaauuucucaau

SEQ ID NO: 1391757 - RNA, 19 nt, Homo sapiens
cugcagagguggacuaugg

SEQ ID NO: 1391758 - RNA, 19 nt, Homo sapiens
gcacugcgcauggauuuca

SEQ ID NO: 1391759 - RNA, 19 nt, Homo sapiens
ccaguggcuugucagauug

SEQ ID NO: 1391760 - RNA, 19 nt, Homo sapiens
cuacaaacccaaguucuga

SEQ ID NO: 1391761 - RNA, 19 nt, Homo sapiens
ccgaguagcugggauuaca

SEQ ID NO: 1391762 - RNA, 19 nt, Homo sapiens
gcacaugaagucagaaagg

SEQ ID NO: 1391763 - RNA, 19 nt, Homo sapiens
ugaggcacaugaagucaga

SEQ ID NO: 1391764 - RNA, 19 nt, Homo sapiens
gcugaucucucuccaaucc

SEQ ID NO: 1391765 - RNA, 19 nt, Homo sapiens
gagauagggccauccacuu

SEQ ID NO: 1391766 - RNA, 19 nt, Homo sapiens
aguaucagcuuaagaaacu

SEQ ID NO: 1391767 - RNA, 19 nt, Homo sapiens
gccaggccaugcccaagaa

SEQ ID NO: 1391768 - RNA, 19 nt, Homo sapiens
agaaaccaguccuauaucu

SEQ ID NO: 1391769 - RNA, 19 nt, Homo sapiens
acaccaagguugcugaucu

SEQ ID NO: 1391770 - RNA, 19 nt, Homo sapiens
ccaccacgcccagcuaauu

SEQ ID NO: 1391771 - RNA, 19 nt, Homo sapiens
gaccaggauugggcugauu

SEQ ID NO: 1391772 - RNA, 19 nt, Homo sapiens
gaaaccaguccuauaucug

SEQ ID NO: 1391773 - RNA, 19 nt, Homo sapiens
aaaccugagucuagcacaa

SEQ ID NO: 1391774 - RNA, 19 nt, Homo sapiens
guaagggaauuuucuuuuc

SEQ ID NO: 1391775 - RNA, 19 nt, Homo sapiens
gcccaugcauaucuccuau

SEQ ID NO: 1391776 - RNA, 19 nt, Homo sapiens
ccgaaggagauacucuuua

SEQ ID NO: 1391777 - RNA, 19 nt, Homo sapiens
ggccagggcuacuccuaca

SEQ ID NO: 1391778 - RNA, 19 nt, Homo sapiens
ggagacuuggccugagaua

SEQ ID NO: 1391779 - RNA, 19 nt, Homo sapiens
cacaugaagucagaaagga

SEQ ID NO: 1391780 - RNA, 19 nt, Homo sapiens
ggaagaugcccagaaacug

SEQ ID NO: 1391781 - RNA, 19 nt, Homo sapiens
gggaagaugcccagaaacu

SEQ ID NO: 1391782 - RNA, 19 nt, Homo sapiens
aggagaaucugcacaaacu

SEQ ID NO: 1391783 - RNA, 19 nt, Homo sapiens
gcauaucuccuauucuaac

SEQ ID NO: 1391784 - RNA, 19 nt, Homo sapiens
ccaauggcgaguuuccuuu

SEQ ID NO: 1391785 - RNA, 19 nt, Homo sapiens
guuacauucuagaagacua

SEQ ID NO: 1391786 - RNA, 19 nt, Homo sapiens
ucauucaucuccuauucug

SEQ ID NO: 1391787 - RNA, 19 nt, Homo sapiens
gcacgcccaugcauaucuc

SEQ ID NO: 1391788 - RNA, 19 nt, Homo sapiens
gaaaaucauggacugguuu

SEQ ID NO: 1391789 - RNA, 19 nt, Homo sapiens
ggaccugccuguggaugca

SEQ ID NO: 1391790 - RNA, 19 nt, Homo sapiens
uugcugaucucucuccaau

SEQ ID NO: 1391791 - RNA, 19 nt, Homo sapiens
gggaagaagguggacauug

SEQ ID NO: 1391792 - RNA, 19 nt, Homo sapiens
ccagggcuacuccuacaaa

SEQ ID NO: 1391793 - RNA, 19 nt, Homo sapiens
uuucuacuguggaugcuuu

SEQ ID NO: 1391794 - RNA, 19 nt, Homo sapiens
gauccuaaacugugucucu

SEQ ID NO: 1391795 - RNA, 19 nt, Homo sapiens
cgaauauugugggcaugaa

SEQ ID NO: 1391796 - RNA, 19 nt, Homo sapiens
aaggagacuuggccugaga

SEQ ID NO: 1391797 - RNA, 19 nt, Homo sapiens
caccacgcccagcuaauuu

SEQ ID NO: 1391798 - RNA, 19 nt, Homo sapiens
ucugggacauagaccaauu

SEQ ID NO: 1391799 - RNA, 19 nt, Homo sapiens
ggaaacuggaggagaaucu

SEQ ID NO: 1391800 - RNA, 19 nt, Homo sapiens
ucuguagccuugauuccaa

SEQ ID NO: 1391801 - RNA, 19 nt, Homo sapiens
uuucauucaucuccuauuc

SEQ ID NO: 1391802 - RNA, 19 nt, Homo sapiens
gggaaggagcaauuucuca

SEQ ID NO: 1391803 - RNA, 19 nt, Homo sapiens
ucccagcacccgaauauug

SEQ ID NO: 1391804 - RNA, 19 nt, Homo sapiens
cagggaaguaucagcuuaa

SEQ ID NO: 1391805 - RNA, 19 nt, Homo sapiens
agacugggaaggagcaauu

SEQ ID NO: 1391806 - RNA, 19 nt, Homo sapiens
cccagaaaccaguccuaua

SEQ ID NO: 1391807 - RNA, 19 nt, Homo sapiens
gaaggagauacucuuuagu

SEQ ID NO: 1391808 - RNA, 19 nt, Homo sapiens
gccgauagaggcuccuuug

SEQ ID NO: 1391809 - RNA, 19 nt, Homo sapiens
ggugaugugaccaggauug

SEQ ID NO: 1391810 - RNA, 19 nt, Homo sapiens
gaaggacagcgguggugau

SEQ ID NO: 1391811 - RNA, 19 nt, Homo sapiens
agauagggccauccacuug

SEQ ID NO: 1391812 - RNA, 19 nt, Homo sapiens
augggaaacuggaggagaa

SEQ ID NO: 1391813 - RNA, 19 nt, Homo sapiens
uacuguggaugcuuuccua

SEQ ID NO: 1391814 - RNA, 19 nt, Homo sapiens
agaccaggaagcaggauuu

SEQ ID NO: 1391815 - RNA, 19 nt, Homo sapiens
caaucccuguggugcugua

SEQ ID NO: 1391816 - RNA, 19 nt, Homo sapiens
gccgggaauuuaucaaagg

SEQ ID NO: 1391817 - RNA, 19 nt, Homo sapiens
agagguggacuaugggaaa

SEQ ID NO: 1391818 - RNA, 19 nt, Homo sapiens
caggcacgcccaugcauau

SEQ ID NO: 1391819 - RNA, 19 nt, Homo sapiens
gaggagaaucugcacaaac

SEQ ID NO: 1391820 - RNA, 19 nt, Homo sapiens
uggcuugucagauugguaa

SEQ ID NO: 1391821 - RNA, 19 nt, Homo sapiens
cacuggagauaccgaagga

SEQ ID NO: 1391822 - RNA, 19 nt, Homo sapiens
cugcagcaccgccucauug

SEQ ID NO: 1391823 - RNA, 19 nt, Homo sapiens
ccuacaggcacucugcuuu

SEQ ID NO: 1391824 - RNA, 19 nt, Homo sapiens
gaacccaucuguuaaugua

SEQ ID NO: 1391825 - RNA, 19 nt, Homo sapiens
ggagaaaucgcauucauaa

SEQ ID NO: 1391826 - RNA, 19 nt, Homo sapiens
uaacauaaauggcugguau

SEQ ID NO: 1391827 - RNA, 19 nt, Homo sapiens
uuaaagaacccaucuguua

SEQ ID NO: 1391828 - RNA, 19 nt, Homo sapiens
aaagauaucuggagaaauc

SEQ ID NO: 1391829 - RNA, 19 nt, Homo sapiens
gaaaggaaguuaucuuggu

SEQ ID NO: 1391830 - RNA, 19 nt, Homo sapiens
guauuaugcuggaguauuu

SEQ ID NO: 1391831 - RNA, 19 nt, Homo sapiens
caaauaguccuucuuguuu

SEQ ID NO: 1391832 - RNA, 19 nt, Homo sapiens
ucaguaagcuguauugguu

SEQ ID NO: 1391833 - RNA, 19 nt, Homo sapiens
gaaccaaagagcccacuua

SEQ ID NO: 1391834 - RNA, 19 nt, Homo sapiens
ugaaagauaucuggagaaa

SEQ ID NO: 1391835 - RNA, 19 nt, Homo sapiens
aaacagauuuacugcauga

SEQ ID NO: 1391836 - RNA, 19 nt, Homo sapiens
auaaauggcugguaugguu

SEQ ID NO: 1391837 - RNA, 19 nt, Homo sapiens
gagaaguaguuaacaugaa

SEQ ID NO: 1391838 - RNA, 19 nt, Homo sapiens
gaacugaaagagacaaaga

SEQ ID NO: 1391839 - RNA, 19 nt, Homo sapiens
uaaagaacccaucuguuaa

SEQ ID NO: 1391840 - RNA, 19 nt, Homo sapiens
ugaagaaggugcuuugcuu

SEQ ID NO: 1391841 - RNA, 19 nt, Homo sapiens
gaaagccacagaagauaaa

SEQ ID NO: 1391842 - RNA, 19 nt, Homo sapiens
gcuggaguauuuaaaugua

SEQ ID NO: 1391843 - RNA, 19 nt, Homo sapiens
gcacaguuguuacuuugga

SEQ ID NO: 1391844 - RNA, 19 nt, Homo sapiens
ugaaagagacaaagagaaa

SEQ ID NO: 1391845 - RNA, 19 nt, Homo sapiens
aaaggaaguuaucuuggua

SEQ ID NO: 1391846 - RNA, 19 nt, Homo sapiens
uuaaucaucuggacacuga

SEQ ID NO: 1391847 - RNA, 19 nt, Homo sapiens
gaacucuucagucaauuaa

SEQ ID NO: 1391848 - RNA, 19 nt, Homo sapiens
ggcaguggguuauuagaaa

SEQ ID NO: 1391849 - RNA, 19 nt, Homo sapiens
guagacauguuuaaagcuu

SEQ ID NO: 1391850 - RNA, 19 nt, Homo sapiens
gaugcacaguuguuacuuu

SEQ ID NO: 1391851 - RNA, 19 nt, Homo sapiens
gcuaaucugcacauuguua

SEQ ID NO: 1391852 - RNA, 19 nt, Homo sapiens
ugucauuucucuugaguaa

SEQ ID NO: 1391853 - RNA, 19 nt, Homo sapiens
gaugaaagccacagaagau

SEQ ID NO: 1391854 - RNA, 19 nt, Homo sapiens
uaauuccggucuucacaua

SEQ ID NO: 1391855 - RNA, 19 nt, Homo sapiens
gaguacgaguucauaguaa

SEQ ID NO: 1391856 - RNA, 19 nt, Homo sapiens
gaagaugcuuuggacuauu

SEQ ID NO: 1391857 - RNA, 19 nt, Homo sapiens
agacagugcuaucuaguga

SEQ ID NO: 1391858 - RNA, 19 nt, Homo sapiens
cuagagaagacuuucauua

SEQ ID NO: 1391859 - RNA, 19 nt, Homo sapiens
agaaggaaauacuugguaa

SEQ ID NO: 1391860 - RNA, 19 nt, Homo sapiens
agaaauagcuccgauaagg

SEQ ID NO: 1391861 - RNA, 19 nt, Homo sapiens
ucagugaguugaaaguaaa

SEQ ID NO: 1391862 - RNA, 19 nt, Homo sapiens
ucucuaaucugcuucaguu

SEQ ID NO: 1391863 - RNA, 19 nt, Homo sapiens
gggaaagguuauaaacaga

SEQ ID NO: 1391864 - RNA, 19 nt, Homo sapiens
ucuaauggaucaaucagaa

SEQ ID NO: 1391865 - RNA, 19 nt, Homo sapiens
aaagaaauagcuccgauaa

SEQ ID NO: 1391866 - RNA, 19 nt, Homo sapiens
uguaguaaauguuggcuuu

SEQ ID NO: 1391867 - RNA, 19 nt, Homo sapiens
ggugggaucuuaaucaucu

SEQ ID NO: 1391868 - RNA, 19 nt, Homo sapiens
gacacaugaugaaggauuu

SEQ ID NO: 1391869 - RNA, 19 nt, Homo sapiens
ccugaagccuugugaagaa

SEQ ID NO: 1391870 - RNA, 19 nt, Homo sapiens
ucaaauaguccuucuuguu

SEQ ID NO: 1391871 - RNA, 19 nt, Homo sapiens
gcaguggguuauuagaaau

SEQ ID NO: 1391872 - RNA, 19 nt, Homo sapiens
uaauaggacucgacuugga

SEQ ID NO: 1391873 - RNA, 19 nt, Homo sapiens
gaaauagcuccgauaagga

SEQ ID NO: 1391874 - RNA, 19 nt, Homo sapiens
uagagaagaccuuuacaaa

SEQ ID NO: 1391875 - RNA, 19 nt, Homo sapiens
guuggaaugugcaagauga

SEQ ID NO: 1391876 - RNA, 19 nt, Homo sapiens
ggacucgacuuggagaaau

SEQ ID NO: 1391877 - RNA, 19 nt, Homo sapiens
gauaaugcauuuggcacuu

SEQ ID NO: 1391878 - RNA, 19 nt, Homo sapiens
uuggaaaccuggagcuaua

SEQ ID NO: 1391879 - RNA, 19 nt, Homo sapiens
ggaacaauuugcuaaucug

SEQ ID NO: 1391880 - RNA, 19 nt, Homo sapiens
cuacgauguucuccugaua

SEQ ID NO: 1391881 - RNA, 19 nt, Homo sapiens
gaaggaaauacuugguaaa

SEQ ID NO: 1391882 - RNA, 19 nt, Homo sapiens
cauauuauuugugcuggua

SEQ ID NO: 1391883 - RNA, 19 nt, Homo sapiens
gaaaguagaacugaaagag

SEQ ID NO: 1391884 - RNA, 19 nt, Homo sapiens
aggagcaucuauauguuua

SEQ ID NO: 1391885 - RNA, 19 nt, Homo sapiens
gaggagcaucuauauguuu

SEQ ID NO: 1391886 - RNA, 19 nt, Homo sapiens
gagaagaugcacaguuguu

SEQ ID NO: 1391887 - RNA, 19 nt, Homo sapiens
aagaugcuuuggacuauuu

SEQ ID NO: 1391888 - RNA, 19 nt, Homo sapiens
ggauauccuggacuucuua

SEQ ID NO: 1391889 - RNA, 19 nt, Homo sapiens
gaggaacaauuugcuaauc

SEQ ID NO: 1391890 - RNA, 19 nt, Homo sapiens
uauaauaggacucgacuug

SEQ ID NO: 1391891 - RNA, 19 nt, Homo sapiens
caacgaguacgaguucaua

SEQ ID NO: 1391892 - RNA, 19 nt, Homo sapiens
aggagaagaugcacaguug

SEQ ID NO: 1391893 - RNA, 19 nt, Homo sapiens
gcaucuauguaaagugaga

SEQ ID NO: 1391894 - RNA, 19 nt, Homo sapiens
caucugaggagcaucuaua

SEQ ID NO: 1391895 - RNA, 19 nt, Homo sapiens
uaaagaaauagcuccgaua

SEQ ID NO: 1391896 - RNA, 19 nt, Homo sapiens
aagcagugauaaugcauuu

SEQ ID NO: 1391897 - RNA, 19 nt, Homo sapiens
cgaguacgaguucauagua

SEQ ID NO: 1391898 - RNA, 19 nt, Homo sapiens
ggacugacccaugugacua

SEQ ID NO: 1391899 - RNA, 19 nt, Homo sapiens
aaaggaaggauucauuuga

SEQ ID NO: 1391900 - RNA, 19 nt, Homo sapiens
cuaagguauuuggcuauua

SEQ ID NO: 1391901 - RNA, 19 nt, Homo sapiens
gccuuuaccucaccacuau

SEQ ID NO: 1391902 - RNA, 19 nt, Homo sapiens
aaacaagccaguuagcaaa

SEQ ID NO: 1391903 - RNA, 19 nt, Homo sapiens
gcuuuggacuauuugauug

SEQ ID NO: 1391904 - RNA, 19 nt, Homo sapiens
guaacucaauuucaucagu

SEQ ID NO: 1391905 - RNA, 19 nt, Homo sapiens
gguuacccuuccaauauuu

SEQ ID NO: 1391906 - RNA, 19 nt, Homo sapiens
gguauagacacaucaaaga

SEQ ID NO: 1391907 - RNA, 19 nt, Homo sapiens
ugaaagccacagaagauaa

SEQ ID NO: 1391908 - RNA, 19 nt, Homo sapiens
gagaaaauauuccugaaag

SEQ ID NO: 1391909 - RNA, 19 nt, Homo sapiens
ggaugcugcuguugacaug

SEQ ID NO: 1391910 - RNA, 19 nt, Homo sapiens
uaaguugucauuucucuug

SEQ ID NO: 1391911 - RNA, 19 nt, Homo sapiens
gcacuuuguuugguagguu

SEQ ID NO: 1391912 - RNA, 19 nt, Homo sapiens
gcauuuggcacuuuguuug

SEQ ID NO: 1391913 - RNA, 19 nt, Homo sapiens
cacaagaucugaugguuuu

SEQ ID NO: 1391914 - RNA, 19 nt, Homo sapiens
agugcuaucuagugaauaa

SEQ ID NO: 1391915 - RNA, 19 nt, Homo sapiens
aaccauaaaucugaggaua

SEQ ID NO: 1391916 - RNA, 19 nt, Homo sapiens
guccaaaccauaaaucuga

SEQ ID NO: 1391917 - RNA, 19 nt, Homo sapiens
aggcaucuauguaaaguga

SEQ ID NO: 1391918 - RNA, 19 nt, Homo sapiens
acaaagaaagagaguauga

SEQ ID NO: 1391919 - RNA, 19 nt, Homo sapiens
ucagagaaguaguuaacau

SEQ ID NO: 1391920 - RNA, 19 nt, Homo sapiens
ugaggaggaugcacugguu

SEQ ID NO: 1391921 - RNA, 19 nt, Homo sapiens
gcaaggaugaauucucaga

SEQ ID NO: 1391922 - RNA, 19 nt, Homo sapiens
ugaggagcaucuauauguu

SEQ ID NO: 1391923 - RNA, 19 nt, Homo sapiens
ggaaauacuugguaaaacu

SEQ ID NO: 1391924 - RNA, 19 nt, Homo sapiens
ggaacuauauuaacagaug

SEQ ID NO: 1391925 - RNA, 19 nt, Homo sapiens
gaaccaaccaccaacauuu

SEQ ID NO: 1391926 - RNA, 19 nt, Homo sapiens
gaagcgaaauguggugauu

SEQ ID NO: 1391927 - RNA, 19 nt, Homo sapiens
gcagugaaagcucaguuua

SEQ ID NO: 1391928 - RNA, 19 nt, Homo sapiens
gaagaugacgacccauuga

SEQ ID NO: 1391929 - RNA, 19 nt, Homo sapiens
gaaaggugaugguggacau

SEQ ID NO: 1391930 - RNA, 19 nt, Homo sapiens
cgaauugccuuacaguauc

SEQ ID NO: 1391931 - RNA, 19 nt, Homo sapiens
agugaaagcucaguuuaaa

SEQ ID NO: 1391932 - RNA, 19 nt, Homo sapiens
gaauugccuuacaguauca

SEQ ID NO: 1391933 - RNA, 19 nt, Homo sapiens
ggagugacagcccgaauug

SEQ ID NO: 1391934 - RNA, 19 nt, Homo sapiens
acaaagggcuucuggaacu

SEQ ID NO: 1391935 - RNA, 19 nt, Homo sapiens
gaaaagaugcuuauaccaa

SEQ ID NO: 1391936 - RNA, 19 nt, Homo sapiens
ucacaaagggcuucuggaa

SEQ ID NO: 1391937 - RNA, 19 nt, Homo sapiens
ggaaccaaccaccaacauu

SEQ ID NO: 1391938 - RNA, 19 nt, Homo sapiens
aaaguuaggacuagacauu

SEQ ID NO: 1391939 - RNA, 19 nt, Homo sapiens
ccagaaauucagagucuuu

SEQ ID NO: 1391940 - RNA, 19 nt, Homo sapiens
ggauggauuucuucucaag

SEQ ID NO: 1391941 - RNA, 19 nt, Homo sapiens
ccucguauuugcaacugua

SEQ ID NO: 1391942 - RNA, 19 nt, Homo sapiens
ggguacagcaagcuuuaua

SEQ ID NO: 1391943 - RNA, 19 nt, Homo sapiens
ggacuagacauuuguucug

SEQ ID NO: 1391944 - RNA, 19 nt, Homo sapiens
uaaggacuguuuucucuaa

SEQ ID NO: 1391945 - RNA, 19 nt, Homo sapiens
ggacuguuuucucuaaauu

SEQ ID NO: 1391946 - RNA, 19 nt, Homo sapiens
ccgaauugccuuacaguau

SEQ ID NO: 1391947 - RNA, 19 nt, Homo sapiens
ccaaggaaccaaccaccaa

SEQ ID NO: 1391948 - RNA, 19 nt, Homo sapiens
gaugguggacauugcauau

SEQ ID NO: 1391949 - RNA, 19 nt, Homo sapiens
ccgcuucgcuuuggacuuc

SEQ ID NO: 1391950 - RNA, 19 nt, Homo sapiens
gagggcaccgggacaugua

SEQ ID NO: 1391951 - RNA, 19 nt, Homo sapiens
cagugaaagcucaguuuaa

SEQ ID NO: 1391952 - RNA, 19 nt, Homo sapiens
cuaacucucauucuuugua

SEQ ID NO: 1391953 - RNA, 19 nt, Homo sapiens
cguauuugcaacuguauuu

SEQ ID NO: 1391954 - RNA, 19 nt, Homo sapiens
aauacuacccuguggcuaa

SEQ ID NO: 1391955 - RNA, 19 nt, Homo sapiens
agggauggauuucuucuca

SEQ ID NO: 1391956 - RNA, 19 nt, Homo sapiens
cuagacauuuguucugcaa

SEQ ID NO: 1391957 - RNA, 19 nt, Homo sapiens
uaaagcuguuauaguggaa

SEQ ID NO: 1391958 - RNA, 19 nt, Homo sapiens
ccagaugagagccuucaaa

SEQ ID NO: 1391959 - RNA, 19 nt, Homo sapiens
gggauggauuucuucucaa

SEQ ID NO: 1391960 - RNA, 19 nt, Homo sapiens
gaacagguugacagaaguc

SEQ ID NO: 1391961 - RNA, 19 nt, Homo sapiens
aacuaacucucauucuuug

SEQ ID NO: 1391962 - RNA, 19 nt, Homo sapiens
gaccagggaccuuguggau

SEQ ID NO: 1391963 - RNA, 19 nt, Homo sapiens
gauuaacguaucagguaaa

SEQ ID NO: 1391964 - RNA, 19 nt, Homo sapiens
guggcuaaauauaaaguca

SEQ ID NO: 1391965 - RNA, 19 nt, Homo sapiens
cccuguggcuaaauauaaa

SEQ ID NO: 1391966 - RNA, 19 nt, Homo sapiens
auacuacccuguggcuaaa

SEQ ID NO: 1391967 - RNA, 19 nt, Homo sapiens
uagaagaugacgacccauu

SEQ ID NO: 1391968 - RNA, 19 nt, Homo sapiens
ugaacagguugacagaagu

SEQ ID NO: 1391969 - RNA, 19 nt, Homo sapiens
ggcgacggcucauguucga

SEQ ID NO: 1391970 - RNA, 19 nt, Homo sapiens
acuacccuguggcuaaaua

SEQ ID NO: 1391971 - RNA, 19 nt, Homo sapiens
caaagggcuucuggaacug

SEQ ID NO: 1391972 - RNA, 19 nt, Homo sapiens
ugccagaaauucagagucu

SEQ ID NO: 1391973 - RNA, 19 nt, Homo sapiens
gugacuucuuccaugauuu

SEQ ID NO: 1391974 - RNA, 19 nt, Homo sapiens
ggaacugaaccagaugaga

SEQ ID NO: 1391975 - RNA, 19 nt, Homo sapiens
agaagaugacgacccauug

SEQ ID NO: 1391976 - RNA, 19 nt, Homo sapiens
ggcagugaaagcucaguuu

SEQ ID NO: 1391977 - RNA, 19 nt, Homo sapiens
aguuaggacuagacauuug

SEQ ID NO: 1391978 - RNA, 19 nt, Homo sapiens
aaagucauuauaccucgua

SEQ ID NO: 1391979 - RNA, 19 nt, Homo sapiens
agugacuucuuccaugauu

SEQ ID NO: 1391980 - RNA, 19 nt, Homo sapiens
caaccaccaacauuugugu

SEQ ID NO: 1391981 - RNA, 19 nt, Homo sapiens
gaugagagccuucaaaagc

SEQ ID NO: 1391982 - RNA, 19 nt, Homo sapiens
uggauuucuucucaaguga

SEQ ID NO: 1391983 - RNA, 19 nt, Homo sapiens
gcaucugggcguccuguuc

SEQ ID NO: 1391984 - RNA, 19 nt, Homo sapiens
augaacagguugacagaag

SEQ ID NO: 1391985 - RNA, 19 nt, Homo sapiens
gaugaacagguugacagaa

SEQ ID NO: 1391986 - RNA, 19 nt, Homo sapiens
caaagaccagggaccuugu

SEQ ID NO: 1391987 - RNA, 19 nt, Homo sapiens
gcuguuauaguggaaguau

SEQ ID NO: 1391988 - RNA, 19 nt, Homo sapiens
gcauauggcggugcauuuu

SEQ ID NO: 1391989 - RNA, 19 nt, Homo sapiens
uguuacugcugaaaaguua

SEQ ID NO: 1391990 - RNA, 19 nt, Homo sapiens
cauacaaaaugccagaaau

SEQ ID NO: 1391991 - RNA, 19 nt, Homo sapiens
auugagggauggauuucuu

SEQ ID NO: 1391992 - RNA, 19 nt, Homo sapiens
cagaucucaugguggaugu

SEQ ID NO: 1391993 - RNA, 19 nt, Homo sapiens
aaccaaccaccaacauuug

SEQ ID NO: 1391994 - RNA, 19 nt, Homo sapiens
ugguggacauugcauaugg

SEQ ID NO: 1391995 - RNA, 19 nt, Homo sapiens
gaucucaugguggauguuc

SEQ ID NO: 1391996 - RNA, 19 nt, Homo sapiens
gcagaugaacagguugaca

SEQ ID NO: 1391997 - RNA, 19 nt, Homo sapiens
gaagaaaugcuacaaguau

SEQ ID NO: 1391998 - RNA, 19 nt, Homo sapiens
gcacuucacucaagagcuu

SEQ ID NO: 1391999 - RNA, 19 nt, Homo sapiens
gaagugcgccugagaggaa

SEQ ID NO: 1392000 - RNA, 19 nt, Homo sapiens
gaugaagucugguuuaagg

SEQ ID NO: 1392001 - RNA, 19 nt, Homo sapiens
gacaagugauugaucuaaa

SEQ ID NO: 1392002 - RNA, 19 nt, Homo sapiens
gguagaagaauguguauga

SEQ ID NO: 1392003 - RNA, 19 nt, Homo sapiens
caacuuagccaagacaauu

SEQ ID NO: 1392004 - RNA, 19 nt, Homo sapiens
gaaauugaaggcucaguga

SEQ ID NO: 1392005 - RNA, 19 nt, Homo sapiens
aaggauaugugcugaguuu

SEQ ID NO: 1392006 - RNA, 19 nt, Homo sapiens
gggaagagagggauaagaa

SEQ ID NO: 1392007 - RNA, 19 nt, Homo sapiens
cgaagaagucccaggauuu

SEQ ID NO: 1392008 - RNA, 19 nt, Homo sapiens
gguaugugaucgugucauu

SEQ ID NO: 1392009 - RNA, 19 nt, Homo sapiens
uggaacagcugaacauugu

SEQ ID NO: 1392010 - RNA, 19 nt, Homo sapiens
gcuuccaacugcuuauaua

SEQ ID NO: 1392011 - RNA, 19 nt, Homo sapiens
agaagaauguguaugacaa

SEQ ID NO: 1392012 - RNA, 19 nt, Homo sapiens
gaagaagucccaggauuuc

SEQ ID NO: 1392013 - RNA, 19 nt, Homo sapiens
ugugaagacugaaguuuga

SEQ ID NO: 1392014 - RNA, 19 nt, Homo sapiens
ggaagagagggauaagaaa

SEQ ID NO: 1392015 - RNA, 19 nt, Homo sapiens
uaagacaagugauugaucu

SEQ ID NO: 1392016 - RNA, 19 nt, Homo sapiens
ggacaggcuucucccagau

SEQ ID NO: 1392017 - RNA, 19 nt, Homo sapiens
gagcuuacuaugugucuaa

SEQ ID NO: 1392018 - RNA, 19 nt, Homo sapiens
gaugagaucuaaguaaagg

SEQ ID NO: 1392019 - RNA, 19 nt, Homo sapiens
gaagaaagagguccauggu

SEQ ID NO: 1392020 - RNA, 19 nt, Homo sapiens
gaagggaagagagggauaa

SEQ ID NO: 1392021 - RNA, 19 nt, Homo sapiens
ccgaagaagucccaggauu

SEQ ID NO: 1392022 - RNA, 19 nt, Homo sapiens
gaacggagcagccgcuucu

SEQ ID NO: 1392023 - RNA, 19 nt, Homo sapiens
ccgaagaagucccaggauu

SEQ ID NO: 1392024 - RNA, 19 nt, Homo sapiens
gaagacugaaguuugauga

SEQ ID NO: 1392025 - RNA, 19 nt, Homo sapiens
guaaguagguagagcaaaa

SEQ ID NO: 1392026 - RNA, 19 nt, Homo sapiens
gaucuaaguaaagguguua

SEQ ID NO: 1392027 - RNA, 19 nt, Homo sapiens
cgaagaagucccaggauug

SEQ ID NO: 1392028 - RNA, 19 nt, Homo sapiens
cucaagagcuuacuaugug

SEQ ID NO: 1392029 - RNA, 19 nt, Homo sapiens
gugguuaccuucuaagaca

SEQ ID NO: 1392030 - RNA, 19 nt, Homo sapiens
gcugaacauugugcucaua

SEQ ID NO: 1392031 - RNA, 19 nt, Homo sapiens
cgaagcaucgcgacaguuu

SEQ ID NO: 1392032 - RNA, 19 nt, Homo sapiens
ggagcuagcuuuuaaccuu

SEQ ID NO: 1392033 - RNA, 19 nt, Homo sapiens
gaauacagcauggaaaaua

SEQ ID NO: 1392034 - RNA, 19 nt, Homo sapiens
aggcagaauuggguauuua

SEQ ID NO: 1392035 - RNA, 19 nt, Homo sapiens
ugaagaaaugcuacaagua

SEQ ID NO: 1392036 - RNA, 19 nt, Homo sapiens
aaacuccaaucaacaaaca

SEQ ID NO: 1392037 - RNA, 19 nt, Homo sapiens
gcagaauuggguauuuaaa

SEQ ID NO: 1392038 - RNA, 19 nt, Homo sapiens
caucugcacuucacucaag

SEQ ID NO: 1392039 - RNA, 19 nt, Homo sapiens
guacccaucccaacacuga

SEQ ID NO: 1392040 - RNA, 19 nt, Homo sapiens
gagcuuacuggcccucuaa

SEQ ID NO: 1392041 - RNA, 19 nt, Homo sapiens
cuacaaguaugagaugaga

SEQ ID NO: 1392042 - RNA, 19 nt, Homo sapiens
auaccuuucuuccuuguaa

SEQ ID NO: 1392043 - RNA, 19 nt, Homo sapiens
gaagagagggauaagaaaa

SEQ ID NO: 1392044 - RNA, 19 nt, Homo sapiens
ggaagggaagagagggaua

SEQ ID NO: 1392045 - RNA, 19 nt, Homo sapiens
gaguguggaugcaaaagua

SEQ ID NO: 1392046 - RNA, 19 nt, Homo sapiens
ccaaggauaugugcugagu

SEQ ID NO: 1392047 - RNA, 19 nt, Homo sapiens
ggauacaaccagcauuuua

SEQ ID NO: 1392048 - RNA, 19 nt, Homo sapiens
auacauggguguggcauug

SEQ ID NO: 1392049 - RNA, 19 nt, Homo sapiens
ugggaggcguaaccacuua

SEQ ID NO: 1392050 - RNA, 19 nt, Homo sapiens
uauauucaguccacuaugg

SEQ ID NO: 1392051 - RNA, 19 nt, Homo sapiens
cugcuuaacuccaauuucu

SEQ ID NO: 1392052 - RNA, 19 nt, Homo sapiens
aaagucugcuuaacuccaa

SEQ ID NO: 1392053 - RNA, 19 nt, Homo sapiens
aagaaaugcuacaaguaug

SEQ ID NO: 1392054 - RNA, 19 nt, Homo sapiens
caagacaauugggcagguu

SEQ ID NO: 1392055 - RNA, 19 nt, Homo sapiens
cuuagaagaagcuauguuu

SEQ ID NO: 1392056 - RNA, 19 nt, Homo sapiens
gaaccucaggcuucagaga

SEQ ID NO: 1392057 - RNA, 19 nt, Homo sapiens
gacugaaguuugaugaagu

SEQ ID NO: 1392058 - RNA, 19 nt, Homo sapiens
acaagugauugaucuaaag

SEQ ID NO: 1392059 - RNA, 19 nt, Homo sapiens
gcacagguaaacugagugu

SEQ ID NO: 1392060 - RNA, 19 nt, Homo sapiens
uugaugaagucugguuuaa

SEQ ID NO: 1392061 - RNA, 19 nt, Homo sapiens
gauaugugcugaguuuuga

SEQ ID NO: 1392062 - RNA, 19 nt, Homo sapiens
gaucgugucauuaucaucu

SEQ ID NO: 1392063 - RNA, 19 nt, Homo sapiens
gccuggagcuggugaagca

SEQ ID NO: 1392064 - RNA, 19 nt, Homo sapiens
uuugaagccuuucugaaga

SEQ ID NO: 1392065 - RNA, 19 nt, Homo sapiens
gaagaagucccaggauugc

SEQ ID NO: 1392066 - RNA, 19 nt, Homo sapiens
ucagagagccgaaaaguug

SEQ ID NO: 1392067 - RNA, 19 nt, Homo sapiens
gauacucgcugagcuuacu

SEQ ID NO: 1392068 - RNA, 19 nt, Homo sapiens
agaaaugcuacaaguauga

SEQ ID NO: 1392069 - RNA, 19 nt, Homo sapiens
uugaagaaaugcuacaagu

SEQ ID NO: 1392070 - RNA, 19 nt, Homo sapiens
caacugcuuauauauggaa

SEQ ID NO: 1392071 - RNA, 19 nt, Homo sapiens
gauacaaccagcauuuuaa

SEQ ID NO: 1392072 - RNA, 19 nt, Homo sapiens
cagauugugacauguauau

SEQ ID NO: 1392073 - RNA, 19 nt, Homo sapiens
ggcagaauuggguauuuaa

SEQ ID NO: 1392074 - RNA, 19 nt, Homo sapiens
uaugugaucgugucauuau

SEQ ID NO: 1392075 - RNA, 19 nt, Homo sapiens
ugacaaccacacacaguga

SEQ ID NO: 1392076 - RNA, 19 nt, Homo sapiens
cagggucucuccaacuuag

SEQ ID NO: 1392077 - RNA, 19 nt, Homo sapiens
gauuauauucaguccacua

SEQ ID NO: 1392078 - RNA, 19 nt, Homo sapiens
guaaacuccaaucaacaaa

SEQ ID NO: 1392079 - RNA, 19 nt, Homo sapiens
agacugaaguuugaugaag

SEQ ID NO: 1392080 - RNA, 19 nt, Homo sapiens
uagaagaagcuauguuugg

SEQ ID NO: 1392081 - RNA, 19 nt, Homo sapiens
gaacauugugcucauagac

SEQ ID NO: 1392082 - RNA, 19 nt, Homo sapiens
uaaggcacagguaaacuga

SEQ ID NO: 1392083 - RNA, 19 nt, Homo sapiens
gugucuaagucauguucua

SEQ ID NO: 1392084 - RNA, 19 nt, Homo sapiens
ucaagagcuuacuaugugu

SEQ ID NO: 1392085 - RNA, 19 nt, Homo sapiens
gaguuucauuucagcacuu

SEQ ID NO: 1392086 - RNA, 19 nt, Homo sapiens
ugaacauugugcucauaga

SEQ ID NO: 1392087 - RNA, 19 nt, Homo sapiens
gaucucaccaccuccaaca

SEQ ID NO: 1392088 - RNA, 19 nt, Homo sapiens
agacaagugauugaucuaa

SEQ ID NO: 1392089 - RNA, 19 nt, Homo sapiens
uaggcagaauuggguauuu

SEQ ID NO: 1392090 - RNA, 19 nt, Homo sapiens
acauugugcucauagacuu

SEQ ID NO: 1392091 - RNA, 19 nt, Homo sapiens
cccagggucucuccaacuu

SEQ ID NO: 1392092 - RNA, 19 nt, Homo sapiens
agugauugaucuaaaguuc

SEQ ID NO: 1392093 - RNA, 19 nt, Homo sapiens
cggagcagccgcuucuuga

SEQ ID NO: 1392094 - RNA, 19 nt, Homo sapiens
cagggaaccucaggcuuca

SEQ ID NO: 1392095 - RNA, 19 nt, Homo sapiens
uguaaacuccaaucaacaa

SEQ ID NO: 1392096 - RNA, 19 nt, Homo sapiens
agagagggauaagaaaaua

SEQ ID NO: 1392097 - RNA, 19 nt, Homo sapiens
ggaaagcucuggacaagau

SEQ ID NO: 1392098 - RNA, 19 nt, Homo sapiens
gaacacaacuuagugaaca

SEQ ID NO: 1392099 - RNA, 19 nt, Homo sapiens
gaacaagauuucucccuau

SEQ ID NO: 1392100 - RNA, 19 nt, Homo sapiens
gaacgcaggucugugauca

SEQ ID NO: 1392101 - RNA, 19 nt, Homo sapiens
ucaagucucuguuggaaga

SEQ ID NO: 1392102 - RNA, 19 nt, Homo sapiens
gauacgugguggcuuguaa

SEQ ID NO: 1392103 - RNA, 19 nt, Homo sapiens
ggaaaucaagucucuguug

SEQ ID NO: 1392104 - RNA, 19 nt, Homo sapiens
caacaaguaugagguagau

SEQ ID NO: 1392105 - RNA, 19 nt, Homo sapiens
uggccgagguggucaguua

SEQ ID NO: 1392106 - RNA, 19 nt, Homo sapiens
caagauuucucccuauuac

SEQ ID NO: 1392107 - RNA, 19 nt, Homo sapiens
gcggagcgaacacaacuua

SEQ ID NO: 1392108 - RNA, 19 nt, Homo sapiens
gcagacagagaacaagauu

SEQ ID NO: 1392109 - RNA, 19 nt, Homo sapiens
cagaggacgugcugggauu

SEQ ID NO: 1392110 - RNA, 19 nt, Homo sapiens
cgugguggcuuguaaggaa

SEQ ID NO: 1392111 - RNA, 19 nt, Homo sapiens
ucaauguggcucagagaua

SEQ ID NO: 1392112 - RNA, 19 nt, Homo sapiens
caagaucgcggaaaucaag

SEQ ID NO: 1392113 - RNA, 19 nt, Homo sapiens
agacagagaacaagauuuc

SEQ ID NO: 1392114 - RNA, 19 nt, Homo sapiens
ugacuacucgguccuguuu

SEQ ID NO: 1392115 - RNA, 19 nt, Homo sapiens
aaucaagucucuguuggaa

SEQ ID NO: 1392116 - RNA, 19 nt, Homo sapiens
gaucaaacaaacccaggaa

SEQ ID NO: 1392117 - RNA, 19 nt, Homo sapiens
gacaagaucgcggaaauca

SEQ ID NO: 1392118 - RNA, 19 nt, Homo sapiens
ugaagaaggcaaagagaga

SEQ ID NO: 1392119 - RNA, 19 nt, Homo sapiens
caauguggcucagagauac

SEQ ID NO: 1392120 - RNA, 19 nt, Homo sapiens
acaagauuucucccuauua

SEQ ID NO: 1392121 - RNA, 19 nt, Homo sapiens
gagcgaacacaacuuagug

SEQ ID NO: 1392122 - RNA, 19 nt, Homo sapiens
ucaaacaaacccaggaaga

SEQ ID NO: 1392123 - RNA, 19 nt, Homo sapiens
caagauugccggucucuac

SEQ ID NO: 1392124 - RNA, 19 nt, Homo sapiens
aacaagauuucucccuauu

SEQ ID NO: 1392125 - RNA, 19 nt, Homo sapiens
acaaguaugagguagauga

SEQ ID NO: 1392126 - RNA, 19 nt, Homo sapiens
gaugaagaaggcaaagaga

SEQ ID NO: 1392127 - RNA, 19 nt, Homo sapiens
gccaugccaccaacaagua

SEQ ID NO: 1392128 - RNA, 19 nt, Homo sapiens
gugcugggauuaaacacau

SEQ ID NO: 1392129 - RNA, 19 nt, Homo sapiens
gagcggaugcagacagaga

SEQ ID NO: 1392130 - RNA, 19 nt, Homo sapiens
uggacaagaucgcggaaau

SEQ ID NO: 1392131 - RNA, 19 nt, Homo sapiens
uugccggucucuacaauga

SEQ ID NO: 1392132 - RNA, 19 nt, Homo sapiens
ggagcgaacacaacuuagu

SEQ ID NO: 1392133 - RNA, 19 nt, Homo sapiens
gcggauugcggccaagauu

SEQ ID NO: 1392134 - RNA, 19 nt, Homo sapiens
ucggaaagcucuggacaag

SEQ ID NO: 1392135 - RNA, 19 nt, Homo sapiens
gcggaaaucaagucucugu

SEQ ID NO: 1392136 - RNA, 19 nt, Homo sapiens
ggacaagaucgcggaaauc

SEQ ID NO: 1392137 - RNA, 19 nt, Homo sapiens
ggaugcagacagagaacaa

SEQ ID NO: 1392138 - RNA, 19 nt, Homo sapiens
caaacaaacccaggaagag

SEQ ID NO: 1392139 - RNA, 19 nt, Homo sapiens
cgacgugccgccaaucuuc

SEQ ID NO: 1392140 - RNA, 19 nt, Homo sapiens
acuacucgguccuguuuga

SEQ ID NO: 1392141 - RNA, 19 nt, Homo sapiens
caccaacaaguaugaggua

SEQ ID NO: 1392142 - RNA, 19 nt, Homo sapiens
cgggaagccuggugacaag

SEQ ID NO: 1392143 - RNA, 19 nt, Homo sapiens
caacauccuucggaaagcu

SEQ ID NO: 1392144 - RNA, 19 nt, Homo sapiens
uuagugaacauccagaaga

SEQ ID NO: 1392145 - RNA, 19 nt, Homo sapiens
gcgaacacaacuuagugaa

SEQ ID NO: 1392146 - RNA, 19 nt, Homo sapiens
ucgcggaaaucaagucucu

SEQ ID NO: 1392147 - RNA, 19 nt, Homo sapiens
gaggacgugcugggauuaa

SEQ ID NO: 1392148 - RNA, 19 nt, Homo sapiens
ugaagacaccuccuaugca

SEQ ID NO: 1392149 - RNA, 19 nt, Homo sapiens
gaaggcaaagagagacaca

SEQ ID NO: 1392150 - RNA, 19 nt, Homo sapiens
gcaacauccuucggaaagc

SEQ ID NO: 1392151 - RNA, 19 nt, Homo sapiens
acucgguccuguuugaaga

SEQ ID NO: 1392152 - RNA, 19 nt, Homo sapiens
ccaacaaguaugagguaga

SEQ ID NO: 1392153 - RNA, 19 nt, Homo sapiens
agacaccuccuaugcagau

SEQ ID NO: 1392154 - RNA, 19 nt, Homo sapiens
aguaugagguagaugacau

SEQ ID NO: 1392155 - RNA, 19 nt, Homo sapiens
gugcaacauccuucggaaa

SEQ ID NO: 1392156 - RNA, 19 nt, Homo sapiens
ggacgugcugggauuaaac

SEQ ID NO: 1392157 - RNA, 19 nt, Homo sapiens
acgcaggucugugaucauc

SEQ ID NO: 1392158 - RNA, 19 nt, Homo sapiens
ggauugcggccaagauugc

SEQ ID NO: 1392159 - RNA, 19 nt, Homo sapiens
gcacacgucuucuauauug

SEQ ID NO: 1392160 - RNA, 19 nt, Homo sapiens
gcaaagugcugcccaaguu

SEQ ID NO: 1392161 - RNA, 19 nt, Homo sapiens
gagaaacugugcuguauga

SEQ ID NO: 1392162 - RNA, 19 nt, Homo sapiens
gcagaaggccuuaaagaaa

SEQ ID NO: 1392163 - RNA, 19 nt, Homo sapiens
uaaacucgaucgaugauuu

SEQ ID NO: 1392164 - RNA, 19 nt, Homo sapiens
ggaaacggcuggccuccaa

SEQ ID NO: 1392165 - RNA, 19 nt, Homo sapiens
gaaacugugcuguaugaua

SEQ ID NO: 1392166 - RNA, 19 nt, Homo sapiens
gaaaaucgccuucauggua

SEQ ID NO: 1392167 - RNA, 19 nt, Homo sapiens
ggacucaguuugccguuga

SEQ ID NO: 1392168 - RNA, 19 nt, Homo sapiens
gcaaggagcggcagugcua

SEQ ID NO: 1392169 - RNA, 19 nt, Homo sapiens
agaaaugccuggaguugaa

SEQ ID NO: 1392170 - RNA, 19 nt, Homo sapiens
uaaauacgccaauguaguu

SEQ ID NO: 1392171 - RNA, 19 nt, Homo sapiens
gggagaaacugugcuguau

SEQ ID NO: 1392172 - RNA, 19 nt, Homo sapiens
gaagagccgauaaguauuc

SEQ ID NO: 1392173 - RNA, 19 nt, Homo sapiens
cagaaggccuuaaagaaag

SEQ ID NO: 1392174 - RNA, 19 nt, Homo sapiens
ccacaagacagucaaagaa

SEQ ID NO: 1392175 - RNA, 19 nt, Homo sapiens
uggaagagccgauaaguau

SEQ ID NO: 1392176 - RNA, 19 nt, Homo sapiens
cgagggaccagucuucaua

SEQ ID NO: 1392177 - RNA, 19 nt, Homo sapiens
uggauugaguuacauguuu

SEQ ID NO: 1392178 - RNA, 19 nt, Homo sapiens
gcggauggauugaguuaca

SEQ ID NO: 1392179 - RNA, 19 nt, Homo sapiens
gaacggcgaccucaagaag

SEQ ID NO: 1392180 - RNA, 19 nt, Homo sapiens
guaaugggaggaucugaaa

SEQ ID NO: 1392181 - RNA, 19 nt, Homo sapiens
gcagaaaugccuggaguug

SEQ ID NO: 1392182 - RNA, 19 nt, Homo sapiens
cgacugaagcccuuucuug

SEQ ID NO: 1392183 - RNA, 19 nt, Homo sapiens
uuauuaggguuacgaauug

SEQ ID NO: 1392184 - RNA, 19 nt, Homo sapiens
ggacucagcacaacaggau

SEQ ID NO: 1392185 - RNA, 19 nt, Homo sapiens
guauuccacuccucccuuu

SEQ ID NO: 1392186 - RNA, 19 nt, Homo sapiens
agaagcagcuccacgaaag

SEQ ID NO: 1392187 - RNA, 19 nt, Homo sapiens
gagaacacauggacuagcu

SEQ ID NO: 1392188 - RNA, 19 nt, Homo sapiens
gcugagaacacauggacua

SEQ ID NO: 1392189 - RNA, 19 nt, Homo sapiens
acaagacagucaaagaaga

SEQ ID NO: 1392190 - RNA, 19 nt, Homo sapiens
ccacggaacauuuggaaga

SEQ ID NO: 1392191 - RNA, 19 nt, Homo sapiens
gccgaugugucuugagauu

SEQ ID NO: 1392192 - RNA, 19 nt, Homo sapiens
cgucagcagugcagaaaug

SEQ ID NO: 1392193 - RNA, 19 nt, Homo sapiens
cgaugugucuugagauugu

SEQ ID NO: 1392194 - RNA, 19 nt, Homo sapiens
ccacagaggagccaucuca

SEQ ID NO: 1392195 - RNA, 19 nt, Homo sapiens
ggaagagccgauaaguauu

SEQ ID NO: 1392196 - RNA, 19 nt, Homo sapiens
gcagcuguuuaacuugaaa

SEQ ID NO: 1392197 - RNA, 19 nt, Homo sapiens
aggcacacgucuucuauau

SEQ ID NO: 1392198 - RNA, 19 nt, Homo sapiens
uggaagauccggcagguuu

SEQ ID NO: 1392199 - RNA, 19 nt, Homo sapiens
gguaguggaucuagguagu

SEQ ID NO: 1392200 - RNA, 19 nt, Homo sapiens
cagcagaaggccuuaaaga

SEQ ID NO: 1392201 - RNA, 19 nt, Homo sapiens
aauugcagcuguuuaacuu

SEQ ID NO: 1392202 - RNA, 19 nt, Homo sapiens
gugcagacacuaugccaaa

SEQ ID NO: 1392203 - RNA, 19 nt, Homo sapiens
guuauugggacccugcuua

SEQ ID NO: 1392204 - RNA, 19 nt, Homo sapiens
ucacagcgagagccaauga

SEQ ID NO: 1392205 - RNA, 19 nt, Homo sapiens
cgacaggagcggaagagaa

SEQ ID NO: 1392206 - RNA, 19 nt, Homo sapiens
cucgaucgaugauuucaaa

SEQ ID NO: 1392207 - RNA, 19 nt, Homo sapiens
gucuugagauuguuagguu

SEQ ID NO: 1392208 - RNA, 19 nt, Homo sapiens
cacggucccuccugucauu

SEQ ID NO: 1392209 - RNA, 19 nt, Homo sapiens
ggauugaguuacauguuuu

SEQ ID NO: 1392210 - RNA, 19 nt, Homo sapiens
ggagaaacugugcuguaug

SEQ ID NO: 1392211 - RNA, 19 nt, Homo sapiens
uuucuugucuccuuuggaa

SEQ ID NO: 1392212 - RNA, 19 nt, Homo sapiens
ggcagcauuuggcagguuu

SEQ ID NO: 1392213 - RNA, 19 nt, Homo sapiens
gcccugugcccuccaaauu

SEQ ID NO: 1392214 - RNA, 19 nt, Homo sapiens
gacaggagcggaagagaag

SEQ ID NO: 1392215 - RNA, 19 nt, Homo sapiens
gaggcacacgucuucuaua

SEQ ID NO: 1392216 - RNA, 19 nt, Homo sapiens
cuagguaguuccucaaugc

SEQ ID NO: 1392217 - RNA, 19 nt, Homo sapiens
ucauacccacggaaaguua

SEQ ID NO: 1392218 - RNA, 19 nt, Homo sapiens
agaaggccuuaaagaaaga

SEQ ID NO: 1392219 - RNA, 19 nt, Homo sapiens
ccugugcccuccaaauuca

SEQ ID NO: 1392220 - RNA, 19 nt, Homo sapiens
aagaagaggagaagcagaa

SEQ ID NO: 1392221 - RNA, 19 nt, Homo sapiens
uugcagcuguuuaacuuga

SEQ ID NO: 1392222 - RNA, 19 nt, Homo sapiens
gaauugcagcuguuuaacu

SEQ ID NO: 1392223 - RNA, 19 nt, Homo sapiens
caagaagcagcuccacgaa

SEQ ID NO: 1392224 - RNA, 19 nt, Homo sapiens
gggccaaagugagcgcaaa

SEQ ID NO: 1392225 - RNA, 19 nt, Homo sapiens
cugaagcccuuucuugucu

SEQ ID NO: 1392226 - RNA, 19 nt, Homo sapiens
gacugaagcccuuucuugu

SEQ ID NO: 1392227 - RNA, 19 nt, Homo sapiens
ucaaagaagaggagaagca

SEQ ID NO: 1392228 - RNA, 19 nt, Homo sapiens
cacggaacauuuggaagaa

SEQ ID NO: 1392229 - RNA, 19 nt, Homo sapiens
aaacaagcuuugggaacga

SEQ ID NO: 1392230 - RNA, 19 nt, Homo sapiens
gacucuggcugacuuccuu

SEQ ID NO: 1392231 - RNA, 19 nt, Homo sapiens
caaagugcugcccaaguug

SEQ ID NO: 1392232 - RNA, 19 nt, Homo sapiens
gggcagcauuuggcagguu

SEQ ID NO: 1392233 - RNA, 19 nt, Homo sapiens
acgaauugcagcuguuuaa

SEQ ID NO: 1392234 - RNA, 19 nt, Homo sapiens
gucaguauuauuaggguua

SEQ ID NO: 1392235 - RNA, 19 nt, Homo sapiens
ugucggccuuaauucauaa

SEQ ID NO: 1392236 - RNA, 19 nt, Homo sapiens
acucuuaugucacccacaa

SEQ ID NO: 1392237 - RNA, 19 nt, Homo sapiens
gagcggaagagaagaagca

SEQ ID NO: 1392238 - RNA, 19 nt, Homo sapiens
ucuuaaauacgccaaugua

SEQ ID NO: 1392239 - RNA, 19 nt, Homo sapiens
cuguuuaacuugaaagaca

SEQ ID NO: 1392240 - RNA, 19 nt, Homo sapiens
ccaaagugagcgcaaagug

SEQ ID NO: 1392241 - RNA, 19 nt, Homo sapiens
cgggagaaacugugcugua

SEQ ID NO: 1392242 - RNA, 19 nt, Homo sapiens
cuaguagucucugcuucaa

SEQ ID NO: 1392243 - RNA, 19 nt, Homo sapiens
cugucggccuuaauucaua

SEQ ID NO: 1392244 - RNA, 19 nt, Homo sapiens
cagaaaugccuggaguuga

SEQ ID NO: 1392245 - RNA, 19 nt, Homo sapiens
uggccaucgugcacucuua

SEQ ID NO: 1392246 - RNA, 19 nt, Homo sapiens
uuaaauacgccaauguagu

SEQ ID NO: 1392247 - RNA, 19 nt, Homo sapiens
uaucacauggugccgaauu

SEQ ID NO: 1392248 - RNA, 19 nt, Homo sapiens
gcccuuucuugucuccuuu

SEQ ID NO: 1392249 - RNA, 19 nt, Homo sapiens
guuacgaauugcagcuguu

SEQ ID NO: 1392250 - RNA, 19 nt, Homo sapiens
uauuaaacucgaucgauga

SEQ ID NO: 1392251 - RNA, 19 nt, Homo sapiens
ucgcggauggauugaguua

SEQ ID NO: 1392252 - RNA, 19 nt, Homo sapiens
caagacagucaaagaagag

SEQ ID NO: 1392253 - RNA, 19 nt, Homo sapiens
gaacgagaucacccacgau

SEQ ID NO: 1392254 - RNA, 19 nt, Homo sapiens
caauguaguuuuccuucuu

SEQ ID NO: 1392255 - RNA, 19 nt, Homo sapiens
ccagaacggcgaccucaag

SEQ ID NO: 1392256 - RNA, 19 nt, Homo sapiens
gccagcagaaggccuuaaa

SEQ ID NO: 1392257 - RNA, 19 nt, Homo sapiens
guagcgcuaggccugguua

SEQ ID NO: 1392258 - RNA, 19 nt, Homo sapiens
gguagugaggauagagaaa

SEQ ID NO: 1392259 - RNA, 19 nt, Homo sapiens
ggaagaaggagaaauauuu

SEQ ID NO: 1392260 - RNA, 19 nt, Homo sapiens
gagcugaacucuuccauca

SEQ ID NO: 1392261 - RNA, 19 nt, Homo sapiens
ucaaagagauggacauugu

SEQ ID NO: 1392262 - RNA, 19 nt, Homo sapiens
ucaaugauguugucaaaga

SEQ ID NO: 1392263 - RNA, 19 nt, Homo sapiens
ccaaauaccacuugaaaga

SEQ ID NO: 1392264 - RNA, 19 nt, Homo sapiens
gcggaagggugacaucgua

SEQ ID NO: 1392265 - RNA, 19 nt, Homo sapiens
gaaguucucugugcgcuau

SEQ ID NO: 1392266 - RNA, 19 nt, Homo sapiens
cuugaaagaugucauugua

SEQ ID NO: 1392267 - RNA, 19 nt, Homo sapiens
gcacauacccagagcugaa

SEQ ID NO: 1392268 - RNA, 19 nt, Homo sapiens
ccucaaugauguugucaaa

SEQ ID NO: 1392269 - RNA, 19 nt, Homo sapiens
ggagauagacaucaucaag

SEQ ID NO: 1392270 - RNA, 19 nt, Homo sapiens
gcugaacucuuccaucaag

SEQ ID NO: 1392271 - RNA, 19 nt, Homo sapiens
ccaugagaaugacacgaua

SEQ ID NO: 1392272 - RNA, 19 nt, Homo sapiens
ucaagcacauggagauaga

SEQ ID NO: 1392273 - RNA, 19 nt, Homo sapiens
aaauaccacuugaaagaug

SEQ ID NO: 1392274 - RNA, 19 nt, Homo sapiens
ggaaauccuucugaacgau

SEQ ID NO: 1392275 - RNA, 19 nt, Homo sapiens
gaagcuacgcuauuuccuu

SEQ ID NO: 1392276 - RNA, 19 nt, Homo sapiens
gaaccaccaugaguuugug

SEQ ID NO: 1392277 - RNA, 19 nt, Homo sapiens
gcaucaagaucgaguucau

SEQ ID NO: 1392278 - RNA, 19 nt, Homo sapiens
caagauggagguugggauu

SEQ ID NO: 1392279 - RNA, 19 nt, Homo sapiens
ggccuucgacuuugaguuu

SEQ ID NO: 1392280 - RNA, 19 nt, Homo sapiens
gggaagaaggagaaauauu

SEQ ID NO: 1392281 - RNA, 19 nt, Homo sapiens
caacguguaccaugagaau

SEQ ID NO: 1392282 - RNA, 19 nt, Homo sapiens
gcacauggagauagacauc

SEQ ID NO: 1392283 - RNA, 19 nt, Homo sapiens
gcacauugaauuugaguac

SEQ ID NO: 1392284 - RNA, 19 nt, Homo sapiens
caaagagauggacauugua

SEQ ID NO: 1392285 - RNA, 19 nt, Homo sapiens
gcagaucgaacucuacuac

SEQ ID NO: 1392286 - RNA, 19 nt, Homo sapiens
ucaguugacccguuacuug

SEQ ID NO: 1392287 - RNA, 19 nt, Homo sapiens
aggcucaguugacccguua

SEQ ID NO: 1392288 - RNA, 19 nt, Homo sapiens
ccacuugaaagaugucauu

SEQ ID NO: 1392289 - RNA, 19 nt, Homo sapiens
ggaaccaccaugaguuugu

SEQ ID NO: 1392290 - RNA, 19 nt, Homo sapiens
ggacaucaacaagaaguuc

SEQ ID NO: 1392291 - RNA, 19 nt, Homo sapiens
agauggagguugggauuga

SEQ ID NO: 1392292 - RNA, 19 nt, Homo sapiens
caaauaccacuugaaagau

SEQ ID NO: 1392293 - RNA, 19 nt, Homo sapiens
ggugacaucguacggaaga

SEQ ID NO: 1392294 - RNA, 19 nt, Homo sapiens
uaaauccaaauaccacuug

SEQ ID NO: 1392295 - RNA, 19 nt, Homo sapiens
uggaaauccuucugaacga

SEQ ID NO: 1392296 - RNA, 19 nt, Homo sapiens
agagauggacauuguaguu

SEQ ID NO: 1392297 - RNA, 19 nt, Homo sapiens
aauauuuccucuucuacga

SEQ ID NO: 1392298 - RNA, 19 nt, Homo sapiens
gacaucaucaagcgagaaa

SEQ ID NO: 1392299 - RNA, 19 nt, Homo sapiens
ggacauuguaguucacaca

SEQ ID NO: 1392300 - RNA, 19 nt, Homo sapiens
gaaugugaagcuacgcuau

SEQ ID NO: 1392301 - RNA, 19 nt, Homo sapiens
acgggaagaaggagaaaua

SEQ ID NO: 1392302 - RNA, 19 nt, Homo sapiens
aggacugucugcacauuga

SEQ ID NO: 1392303 - RNA, 19 nt, Homo sapiens
ugaggacugucugcacauu

SEQ ID NO: 1392304 - RNA, 19 nt, Homo sapiens
gagguggaaauccuucuga

SEQ ID NO: 1392305 - RNA, 19 nt, Homo sapiens
agauggacauuguaguuca

SEQ ID NO: 1392306 - RNA, 19 nt, Homo sapiens
gagauggacauuguaguuc

SEQ ID NO: 1392307 - RNA, 19 nt, Homo sapiens
agaucgaacucuacuacga

SEQ ID NO: 1392308 - RNA, 19 nt, Homo sapiens
ccaaguacgagaucaugga

SEQ ID NO: 1392309 - RNA, 19 nt, Homo sapiens
gccuucgacuuugaguuua

SEQ ID NO: 1392310 - RNA, 19 nt, Homo sapiens
gcgggaaccaccaugaguu

SEQ ID NO: 1392311 - RNA, 19 nt, Homo sapiens
ugcgggacaucaacaagaa

SEQ ID NO: 1392312 - RNA, 19 nt, Homo sapiens
caaugauguugucaaagag

SEQ ID NO: 1392313 - RNA, 19 nt, Homo sapiens
ucgcaggccuucgacuuug

SEQ ID NO: 1392314 - RNA, 19 nt, Homo sapiens
cgggaaccaccaugaguuu

SEQ ID NO: 1392315 - RNA, 19 nt, Homo sapiens
gcaccagggcaucaagauc

SEQ ID NO: 1392316 - RNA, 19 nt, Homo sapiens
gucugcacauugaauuuga

SEQ ID NO: 1392317 - RNA, 19 nt, Homo sapiens
aaagagauggacauuguag

SEQ ID NO: 1392318 - RNA, 19 nt, Homo sapiens
augugaagcuacgcuauuu

SEQ ID NO: 1392319 - RNA, 19 nt, Homo sapiens
gagcaccagggcaucaaga

SEQ ID NO: 1392320 - RNA, 19 nt, Homo sapiens
guugacccguuacuugcaa

SEQ ID NO: 1392321 - RNA, 19 nt, Homo sapiens
ucaaccuggugcugauaga

SEQ ID NO: 1392322 - RNA, 19 nt, Homo sapiens
gcggugcgaugagcuucuu

SEQ ID NO: 1392323 - RNA, 19 nt, Homo sapiens
ucgggcagaucgaacucua

SEQ ID NO: 1392324 - RNA, 19 nt, Homo sapiens
ggacgggaagaaggagaaa

SEQ ID NO: 1392325 - RNA, 19 nt, Homo sapiens
gaggacugucugcacauug

SEQ ID NO: 1392326 - RNA, 19 nt, Homo sapiens
augacacgauagccaagua

SEQ ID NO: 1392327 - RNA, 19 nt, Homo sapiens
gaaucaaaaucaagcacau

SEQ ID NO: 1392328 - RNA, 19 nt, Homo sapiens
aaauccaaauaccacuuga

SEQ ID NO: 1392329 - RNA, 19 nt, Homo sapiens
ggacugucugcacauugaa

SEQ ID NO: 1392330 - RNA, 19 nt, Homo sapiens
gcagagcguggagguggaa

SEQ ID NO: 1392331 - RNA, 19 nt, Homo sapiens
acauggagauagacaucau

SEQ ID NO: 1392332 - RNA, 19 nt, Homo sapiens
gagcguggagguggaaauc

SEQ ID NO: 1392333 - RNA, 19 nt, Homo sapiens
gcagcaggaagugguguug

SEQ ID NO: 1392334 - RNA, 19 nt, Homo sapiens
aaucaagcacauggagaua

SEQ ID NO: 1392335 - RNA, 19 nt, Homo sapiens
aaaucaagcacauggagau

SEQ ID NO: 1392336 - RNA, 19 nt, Homo sapiens
agacggaggacgggaagaa

SEQ ID NO: 1392337 - RNA, 19 nt, Homo sapiens
gggcaucaagaucgaguuc

SEQ ID NO: 1392338 - RNA, 19 nt, Homo sapiens
aaugugaagcuacgcuauu

SEQ ID NO: 1392339 - RNA, 19 nt, Homo sapiens
ccucuggccuucuuuaccu

SEQ ID NO: 1392340 - RNA, 19 nt, Homo sapiens
aauaccacuugaaagaugu

SEQ ID NO: 1392341 - RNA, 19 nt, Homo sapiens
guggagaagccguaugagu

SEQ ID NO: 1392342 - RNA, 19 nt, Homo sapiens
cgcaggccuucgacuuuga

SEQ ID NO: 1392343 - RNA, 19 nt, Homo sapiens
gaacuuaucaaccagauug

SEQ ID NO: 1392344 - RNA, 19 nt, Homo sapiens
acacacaccugccaucuug

SEQ ID NO: 1392345 - RNA, 19 nt, Homo sapiens
gggcgcagcugaugaacug

SEQ ID NO: 1392346 - RNA, 19 nt, Homo sapiens
ggaacacgcuggccaacag

SEQ ID NO: 1392347 - RNA, 19 nt, Homo sapiens
gcaccgaguucuuccucaa

SEQ ID NO: 1392348 - RNA, 19 nt, Homo sapiens
gcuccuggccuccuucuuu

SEQ ID NO: 1392349 - RNA, 19 nt, Homo sapiens
gucaugagcuacugucugu

SEQ ID NO: 1392350 - RNA, 19 nt, Homo sapiens
gcuccacgcugucaaguac

SEQ ID NO: 1392351 - RNA, 19 nt, Homo sapiens
cggcugaacuuaucaacca

SEQ ID NO: 1392352 - RNA, 19 nt, Homo sapiens
gcgaggagggcauggauga

SEQ ID NO: 1392353 - RNA, 19 nt, Homo sapiens
gccgcaagauggccaaguu

SEQ ID NO: 1392354 - RNA, 19 nt, Homo sapiens
agauggagaucccgaacuu

SEQ ID NO: 1392355 - RNA, 19 nt, Homo sapiens
caagggcgcagcugaugaa

SEQ ID NO: 1392356 - RNA, 19 nt, Homo sapiens
ggagaagggcaccgaguuc

SEQ ID NO: 1392357 - RNA, 19 nt, Homo sapiens
ucaaggagagcgagaugaa

SEQ ID NO: 1392358 - RNA, 19 nt, Homo sapiens
gggcauggaugagcaguac

SEQ ID NO: 1392359 - RNA, 19 nt, Homo sapiens
gaucgagccggacaugaug

SEQ ID NO: 1392360 - RNA, 19 nt, Homo sapiens
ugacaggcaccaacgugua

SEQ ID NO: 1392361 - RNA, 19 nt, Homo sapiens
gcaccaacguguacaucac

SEQ ID NO: 1392362 - RNA, 19 nt, Homo sapiens
ggcaauggcagccgcaaga

SEQ ID NO: 1392363 - RNA, 19 nt, Homo sapiens
uggagugccucaaugaaca

SEQ ID NO: 1392364 - RNA, 19 nt, Homo sapiens
cagcagauccucagcuucu

SEQ ID NO: 1392365 - RNA, 19 nt, Homo sapiens
gaccaguuccugcucaugu

SEQ ID NO: 1392366 - RNA, 19 nt, Homo sapiens
acaccaccuucaucaguga

SEQ ID NO: 1392367 - RNA, 19 nt, Homo sapiens
ggcauccgcucuucuacca

SEQ ID NO: 1392368 - RNA, 19 nt, Homo sapiens
gagcaguaccggcagaucu

SEQ ID NO: 1392369 - RNA, 19 nt, Homo sapiens
ccaucuuggucaugagcua

SEQ ID NO: 1392370 - RNA, 19 nt, Homo sapiens
gaugaacgucggccagaca

SEQ ID NO: 1392371 - RNA, 19 nt, Homo sapiens
guacuacugccagaacuuc

SEQ ID NO: 1392372 - RNA, 19 nt, Homo sapiens
cccagacacugcagaugga

SEQ ID NO: 1392373 - RNA, 19 nt, Homo sapiens
caagaucgagccggacaug

SEQ ID NO: 1392374 - RNA, 19 nt, Homo sapiens
aaggagagcgagaugaaug

SEQ ID NO: 1392375 - RNA, 19 nt, Homo sapiens
cuacaccaccuucaucagu

SEQ ID NO: 1392376 - RNA, 19 nt, Homo sapiens
gcaagauggccaaguucuc

SEQ ID NO: 1392377 - RNA, 19 nt, Homo sapiens
ucacaagggcgcagcugau

SEQ ID NO: 1392378 - RNA, 19 nt, Homo sapiens
accaguuccugcucaugua

SEQ ID NO: 1392379 - RNA, 19 nt, Homo sapiens
ccugccaucuuggucauga

SEQ ID NO: 1392380 - RNA, 19 nt, Homo sapiens
cuccuggccuccuucuuug

SEQ ID NO: 1392381 - RNA, 19 nt, Homo sapiens
caugauggguguggagcau

SEQ ID NO: 1392382 - RNA, 19 nt, Homo sapiens
uccacgcugucaaguacua

SEQ ID NO: 1392383 - RNA, 19 nt, Homo sapiens
caauggcagccgcaagaug

SEQ ID NO: 1392384 - RNA, 19 nt, Homo sapiens
ucucccggcugaacuuauc

SEQ ID NO: 1392385 - RNA, 19 nt, Homo sapiens
gcauccggguucggcaaga

SEQ ID NO: 1392386 - RNA, 19 nt, Homo sapiens
uccagcagauccucagcuu

SEQ ID NO: 1392387 - RNA, 19 nt, Homo sapiens
gcaauggcagccgcaagau

SEQ ID NO: 1392388 - RNA, 19 nt, Homo sapiens
gaacagaaaugugaaguuu

SEQ ID NO: 1392389 - RNA, 19 nt, Homo sapiens
gaaagcaaauugaccuaua

SEQ ID NO: 1392390 - RNA, 19 nt, Homo sapiens
gaaaggauaugaggacuaa

SEQ ID NO: 1392391 - RNA, 19 nt, Homo sapiens
agagagaaaugguguauua

SEQ ID NO: 1392392 - RNA, 19 nt, Homo sapiens
ggagauugcuugcagagaa

SEQ ID NO: 1392393 - RNA, 19 nt, Homo sapiens
gaagagagauaaguugaug

SEQ ID NO: 1392394 - RNA, 19 nt, Homo sapiens
gaagaucaauuucaagaag

SEQ ID NO: 1392395 - RNA, 19 nt, Homo sapiens
uguauuaccugacugcuua

SEQ ID NO: 1392396 - RNA, 19 nt, Homo sapiens
cagagaaacucaaagaaga

SEQ ID NO: 1392397 - RNA, 19 nt, Homo sapiens
gcaagccauucgaauaauu

SEQ ID NO: 1392398 - RNA, 19 nt, Homo sapiens
cagugaagcugcaauaaug

SEQ ID NO: 1392399 - RNA, 19 nt, Homo sapiens
gaagaagaaagcaaauuga

SEQ ID NO: 1392400 - RNA, 19 nt, Homo sapiens
uaugaggacuaaacagaua

SEQ ID NO: 1392401 - RNA, 19 nt, Homo sapiens
gagaagcaaacauuacuaa

SEQ ID NO: 1392402 - RNA, 19 nt, Homo sapiens
gcacuucuccucuugcaaa

SEQ ID NO: 1392403 - RNA, 19 nt, Homo sapiens
gcaaauugaccuauacaga

SEQ ID NO: 1392404 - RNA, 19 nt, Homo sapiens
gagauugcuugcagagaaa

SEQ ID NO: 1392405 - RNA, 19 nt, Homo sapiens
gagauaaguugauguccau

SEQ ID NO: 1392406 - RNA, 19 nt, Homo sapiens
gaagcaaacauuacuaaag

SEQ ID NO: 1392407 - RNA, 19 nt, Homo sapiens
gauaugaggacuaaacaga

SEQ ID NO: 1392408 - RNA, 19 nt, Homo sapiens
gaagcugcaauaaugaaua

SEQ ID NO: 1392409 - RNA, 19 nt, Homo sapiens
ggaauacaaagaacuaguu

SEQ ID NO: 1392410 - RNA, 19 nt, Homo sapiens
uagaggaaaugacagagaa

SEQ ID NO: 1392411 - RNA, 19 nt, Homo sapiens
gcaaacuuaucaguacuug

SEQ ID NO: 1392412 - RNA, 19 nt, Homo sapiens
gcagagaaacucaaagaag

SEQ ID NO: 1392413 - RNA, 19 nt, Homo sapiens
ggaaguucaaauugucuua

SEQ ID NO: 1392414 - RNA, 19 nt, Homo sapiens
aaauugaccuauacagaga

SEQ ID NO: 1392415 - RNA, 19 nt, Homo sapiens
gcagaagagagauaaguug

SEQ ID NO: 1392416 - RNA, 19 nt, Homo sapiens
gcugcaagccauucgaaua

SEQ ID NO: 1392417 - RNA, 19 nt, Homo sapiens
ugaagaagaaagcaaauug

SEQ ID NO: 1392418 - RNA, 19 nt, Homo sapiens
ggacuaaacagauacaaaa

SEQ ID NO: 1392419 - RNA, 19 nt, Homo sapiens
gcuaaucagucaauagaac

SEQ ID NO: 1392420 - RNA, 19 nt, Homo sapiens
ggagaagcaaacauuacua

SEQ ID NO: 1392421 - RNA, 19 nt, Homo sapiens
guggaaaggucugaaacuu

SEQ ID NO: 1392422 - RNA, 19 nt, Homo sapiens
ccacagugcauuccaguga

SEQ ID NO: 1392423 - RNA, 19 nt, Homo sapiens
agaggaauaugaccaggaa

SEQ ID NO: 1392424 - RNA, 19 nt, Homo sapiens
gaaaagcuguuagaagguu

SEQ ID NO: 1392425 - RNA, 19 nt, Homo sapiens
gcaugcacuucuccucuug

SEQ ID NO: 1392426 - RNA, 19 nt, Homo sapiens
gaauacaaagaacuaguug

SEQ ID NO: 1392427 - RNA, 19 nt, Homo sapiens
ggagguagaggaaaugaca

SEQ ID NO: 1392428 - RNA, 19 nt, Homo sapiens
aaacuuaucaguacuugga

SEQ ID NO: 1392429 - RNA, 19 nt, Homo sapiens
aauagaaccuuugggaaga

SEQ ID NO: 1392430 - RNA, 19 nt, Homo sapiens
cagaggagaagcaaacauu

SEQ ID NO: 1392431 - RNA, 19 nt, Homo sapiens
ggaccaauagcaaacuuau

SEQ ID NO: 1392432 - RNA, 19 nt, Homo sapiens
gagaaaugguguauuaccu

SEQ ID NO: 1392433 - RNA, 19 nt, Homo sapiens
gaagagcccacagugcauu

SEQ ID NO: 1392434 - RNA, 19 nt, Homo sapiens
ggaauaugaccaggaagaa

SEQ ID NO: 1392435 - RNA, 19 nt, Homo sapiens
ggaacagaaaugugaaguu

SEQ ID NO: 1392436 - RNA, 19 nt, Homo sapiens
cacccacccucagaaguua

SEQ ID NO: 1392437 - RNA, 19 nt, Homo sapiens
gauaaguugauguccauga

SEQ ID NO: 1392438 - RNA, 19 nt, Homo sapiens
cagaagagagauaaguuga

SEQ ID NO: 1392439 - RNA, 19 nt, Homo sapiens
gaagaaaggaagaggaaaa

SEQ ID NO: 1392440 - RNA, 19 nt, Homo sapiens
cgggauggcugcggaagaa

SEQ ID NO: 1392441 - RNA, 19 nt, Homo sapiens
aagcaaugaugguccagaa

SEQ ID NO: 1392442 - RNA, 19 nt, Homo sapiens
caaagacccauacaucaca

SEQ ID NO: 1392443 - RNA, 19 nt, Homo sapiens
ggacuuuguggaacagaaa

SEQ ID NO: 1392444 - RNA, 19 nt, Homo sapiens
aacacuaucucaagcagaa

SEQ ID NO: 1392445 - RNA, 19 nt, Homo sapiens
cugcaagccauucgaauaa

SEQ ID NO: 1392446 - RNA, 19 nt, Homo sapiens
ucaggaauacaaagaacua

SEQ ID NO: 1392447 - RNA, 19 nt, Homo sapiens
caucuuggacuuuguggaa

SEQ ID NO: 1392448 - RNA, 19 nt, Homo sapiens
acagagaaaccagaaauga

SEQ ID NO: 1392449 - RNA, 19 nt, Homo sapiens
ugacagagaaaccagaaau

SEQ ID NO: 1392450 - RNA, 19 nt, Homo sapiens
caagagagaaaugguguau

SEQ ID NO: 1392451 - RNA, 19 nt, Homo sapiens
gcaaagacccauacaucac

SEQ ID NO: 1392452 - RNA, 19 nt, Homo sapiens
aaagcaaauugaccuauac

SEQ ID NO: 1392453 - RNA, 19 nt, Homo sapiens
gaacuucggcaacgagaac

SEQ ID NO: 1392454 - RNA, 19 nt, Homo sapiens
uaucaguacuuggaacaga

SEQ ID NO: 1392455 - RNA, 19 nt, Homo sapiens
agaggagaagcaaacauua

SEQ ID NO: 1392456 - RNA, 19 nt, Homo sapiens
ccagugaagcugcaauaau

SEQ ID NO: 1392457 - RNA, 19 nt, Homo sapiens
ggaaaugacagagaaacca

SEQ ID NO: 1392458 - RNA, 19 nt, Homo sapiens
guagaggaaaugacagaga

SEQ ID NO: 1392459 - RNA, 19 nt, Homo sapiens
ucaagcagaagagagauaa

SEQ ID NO: 1392460 - RNA, 19 nt, Homo sapiens
gaggagaagcaaacauuac

SEQ ID NO: 1392461 - RNA, 19 nt, Homo sapiens
agagaaaccagaaaugaca

SEQ ID NO: 1392462 - RNA, 19 nt, Homo sapiens
auagcaaacuuaucaguac

SEQ ID NO: 1392463 - RNA, 19 nt, Homo sapiens
gcaaugaugguccagaaaa

SEQ ID NO: 1392464 - RNA, 19 nt, Homo sapiens
aauaugaccaggaagaaga

SEQ ID NO: 1392465 - RNA, 19 nt, Homo sapiens
caucaggaauacaaagaac

SEQ ID NO: 1392466 - RNA, 19 nt, Homo sapiens
ugaugaagaagaaagcaaa

SEQ ID NO: 1392467 - RNA, 19 nt, Homo sapiens
gacagagaaaccagaaaug

SEQ ID NO: 1392468 - RNA, 19 nt, Homo sapiens
aaguugauguccaugagaa

SEQ ID NO: 1392469 - RNA, 19 nt, Homo sapiens
agagaaacucaaagaagaa

SEQ ID NO: 1392470 - RNA, 19 nt, Homo sapiens
gcacacccacccucagaag

SEQ ID NO: 1392471 - RNA, 19 nt, Homo sapiens
aaacagaagagcccacagu

SEQ ID NO: 1392472 - RNA, 19 nt, Homo sapiens
aagaagaaaggaagaggaa

SEQ ID NO: 1392473 - RNA, 19 nt, Homo sapiens
uauuuaguccuuacacuga

SEQ ID NO: 1392474 - RNA, 19 nt, Homo sapiens
aauggaaguucaaauuguc

SEQ ID NO: 1392475 - RNA, 19 nt, Homo sapiens
cacagugcauuccagugaa

SEQ ID NO: 1392476 - RNA, 19 nt, Homo sapiens
gaauaugaccaggaagaag

SEQ ID NO: 1392477 - RNA, 19 nt, Homo sapiens
accaauagcaaacuuauca

SEQ ID NO: 1392478 - RNA, 19 nt, Homo sapiens
gaugaagaagaaagcaaau

SEQ ID NO: 1392479 - RNA, 19 nt, Homo sapiens
ggauggcugcggaagaaga

SEQ ID NO: 1392480 - RNA, 19 nt, Homo sapiens
gauggcugcggaagaagaa

SEQ ID NO: 1392481 - RNA, 19 nt, Homo sapiens
aaaguggaaaggucugaaa

SEQ ID NO: 1392482 - RNA, 19 nt, Homo sapiens
acacccacccucagaaguu

SEQ ID NO: 1392483 - RNA, 19 nt, Homo sapiens
uacagagauucaucaggaa

SEQ ID NO: 1392484 - RNA, 19 nt, Homo sapiens
uacaaaauauggagcagaa

SEQ ID NO: 1392485 - RNA, 19 nt, Homo sapiens
uagaaccuuugggaagaaa

SEQ ID NO: 1392486 - RNA, 19 nt, Homo sapiens
gugaagcugcaauaaugaa

SEQ ID NO: 1392487 - RNA, 19 nt, Homo sapiens
uaaccgauggcucugaugu

SEQ ID NO: 1392488 - RNA, 19 nt, Homo sapiens
ggaaaggacuaucuaauug

SEQ ID NO: 1392489 - RNA, 19 nt, Homo sapiens
uaaccugccuuucuuagua

SEQ ID NO: 1392490 - RNA, 19 nt, Homo sapiens
gggaaaggacuaucuaauu

SEQ ID NO: 1392491 - RNA, 19 nt, Homo sapiens
ggguuuaguugaccucaua

SEQ ID NO: 1392492 - RNA, 19 nt, Homo sapiens
aaacgacuuuccuucauuu

SEQ ID NO: 1392493 - RNA, 19 nt, Homo sapiens
cgaacaagcagaccuuuaa

SEQ ID NO: 1392494 - RNA, 19 nt, Homo sapiens
gaaggacgggugccuguuu

SEQ ID NO: 1392495 - RNA, 19 nt, Homo sapiens
ggacagcuuugccuugcuu

SEQ ID NO: 1392496 - RNA, 19 nt, Homo sapiens
ucaaguggcugaucugaag

SEQ ID NO: 1392497 - RNA, 19 nt, Homo sapiens
gaacaggagaagcaacuga

SEQ ID NO: 1392498 - RNA, 19 nt, Homo sapiens
gcaggaaccucaggauuac

SEQ ID NO: 1392499 - RNA, 19 nt, Homo sapiens
agaagcaacugacgacaga

SEQ ID NO: 1392500 - RNA, 19 nt, Homo sapiens
gaaguggaccaaaggauuc

SEQ ID NO: 1392501 - RNA, 19 nt, Homo sapiens
gaaaaugccaaguggaaua

SEQ ID NO: 1392502 - RNA, 19 nt, Homo sapiens
ucauaauggugcccacuuu

SEQ ID NO: 1392503 - RNA, 19 nt, Homo sapiens
cagcagaaguggaccaaag

SEQ ID NO: 1392504 - RNA, 19 nt, Homo sapiens
gcaaguuggagaacgagua

SEQ ID NO: 1392505 - RNA, 19 nt, Homo sapiens
uagaugcacugcugaguca

SEQ ID NO: 1392506 - RNA, 19 nt, Homo sapiens
ggaguuucauuugcaaguu

SEQ ID NO: 1392507 - RNA, 19 nt, Homo sapiens
gaaaggacuaucuaauugg

SEQ ID NO: 1392508 - RNA, 19 nt, Homo sapiens
gcagcuugaggcaucauua

SEQ ID NO: 1392509 - RNA, 19 nt, Homo sapiens
ugcaggaaccucaggauua

SEQ ID NO: 1392510 - RNA, 19 nt, Homo sapiens
gaguuucauuugcaaguug

SEQ ID NO: 1392511 - RNA, 19 nt, Homo sapiens
acacugccaucaggguuua

SEQ ID NO: 1392512 - RNA, 19 nt, Homo sapiens
caagucggcuuccaugcau

SEQ ID NO: 1392513 - RNA, 19 nt, Homo sapiens
aaaggacuaucuaauugga

SEQ ID NO: 1392514 - RNA, 19 nt, Homo sapiens
caucauuccucugguguug

SEQ ID NO: 1392515 - RNA, 19 nt, Homo sapiens
ggacagcugaacacucuga

SEQ ID NO: 1392516 - RNA, 19 nt, Homo sapiens
gguagucccugaccaucug

SEQ ID NO: 1392517 - RNA, 19 nt, Homo sapiens
ugaacacucugaacaaggu

SEQ ID NO: 1392518 - RNA, 19 nt, Homo sapiens
gcugaacacucugaacaag

SEQ ID NO: 1392519 - RNA, 19 nt, Homo sapiens
uggcugaucugaagaacuc

SEQ ID NO: 1392520 - RNA, 19 nt, Homo sapiens
agaaguggaccaaaggauu

SEQ ID NO: 1392521 - RNA, 19 nt, Homo sapiens
gcacuucacacugccauca

SEQ ID NO: 1392522 - RNA, 19 nt, Homo sapiens
gcaggacuaugugggaaag

SEQ ID NO: 1392523 - RNA, 19 nt, Homo sapiens
ggagaagggaauugcacuu

SEQ ID NO: 1392524 - RNA, 19 nt, Homo sapiens
ccugucaaauagucauaaa

SEQ ID NO: 1392525 - RNA, 19 nt, Homo sapiens
gcuuuuaccugucaaauag

SEQ ID NO: 1392526 - RNA, 19 nt, Homo sapiens
gaacaagcagaccuuuaac

SEQ ID NO: 1392527 - RNA, 19 nt, Homo sapiens
caguagcuuugccugcuuu

SEQ ID NO: 1392528 - RNA, 19 nt, Homo sapiens
caaguuggagaacgaguau

SEQ ID NO: 1392529 - RNA, 19 nt, Homo sapiens
ccgaacaagcagaccuuua

SEQ ID NO: 1392530 - RNA, 19 nt, Homo sapiens
auccagagcuugaauaaaa

SEQ ID NO: 1392531 - RNA, 19 nt, Homo sapiens
ggaagaacaggagaagcaa

SEQ ID NO: 1392532 - RNA, 19 nt, Homo sapiens
ucuuaguacuccuuuguug

SEQ ID NO: 1392533 - RNA, 19 nt, Homo sapiens
ccucuaaggagccaacuug

SEQ ID NO: 1392534 - RNA, 19 nt, Homo sapiens
gauuacagcaggugcagau

SEQ ID NO: 1392535 - RNA, 19 nt, Homo sapiens
aaccaagccugacccugaa

SEQ ID NO: 1392536 - RNA, 19 nt, Homo sapiens
guaaccaggucaucauucc

SEQ ID NO: 1392537 - RNA, 19 nt, Homo sapiens
gcagaaguggaccaaagga

SEQ ID NO: 1392538 - RNA, 19 nt, Homo sapiens
cuggacagcugaacacucu

SEQ ID NO: 1392539 - RNA, 19 nt, Homo sapiens
uaguugaccucauaauggu

SEQ ID NO: 1392540 - RNA, 19 nt, Homo sapiens
ccuggauucauguuucuua

SEQ ID NO: 1392541 - RNA, 19 nt, Homo sapiens
ggccugcucuccuuuccau

SEQ ID NO: 1392542 - RNA, 19 nt, Homo sapiens
ggagcgagaaucagagagu

SEQ ID NO: 1392543 - RNA, 19 nt, Homo sapiens
gaggagcgagaaucagaga

SEQ ID NO: 1392544 - RNA, 19 nt, Homo sapiens
gccugacccugaaguggaa

SEQ ID NO: 1392545 - RNA, 19 nt, Homo sapiens
cagcugaacacucugaaca

SEQ ID NO: 1392546 - RNA, 19 nt, Homo sapiens
gucaaauagucauaaaguc

SEQ ID NO: 1392547 - RNA, 19 nt, Homo sapiens
gcuugggccugcucuccuu

SEQ ID NO: 1392548 - RNA, 19 nt, Homo sapiens
gauccagagcuugaauaaa

SEQ ID NO: 1392549 - RNA, 19 nt, Homo sapiens
gcagauccagagcuugaau

SEQ ID NO: 1392550 - RNA, 19 nt, Homo sapiens
ugagucaaguggcugaucu

SEQ ID NO: 1392551 - RNA, 19 nt, Homo sapiens
ccaguagcuuugccugcuu

SEQ ID NO: 1392552 - RNA, 19 nt, Homo sapiens
cuaagccuguggcccaaau

SEQ ID NO: 1392553 - RNA, 19 nt, Homo sapiens
cagauccagagcuugaaua

SEQ ID NO: 1392554 - RNA, 19 nt, Homo sapiens
aaaacgacuuuccuucauu

SEQ ID NO: 1392555 - RNA, 19 nt, Homo sapiens
gcagaccuuuaacccuaca

SEQ ID NO: 1392556 - RNA, 19 nt, Homo sapiens
gagcuugaauaaaaugugu

SEQ ID NO: 1392557 - RNA, 19 nt, Homo sapiens
gcuugaggcaucauuagau

SEQ ID NO: 1392558 - RNA, 19 nt, Homo sapiens
gccaucaggguuuaguuga

SEQ ID NO: 1392559 - RNA, 19 nt, Homo sapiens
uuaguugaccucauaaugg

SEQ ID NO: 1392560 - RNA, 19 nt, Homo sapiens
gaggcuuucucaggaagug

SEQ ID NO: 1392561 - RNA, 19 nt, Homo sapiens
cacgaggcuuucucaggaa

SEQ ID NO: 1392562 - RNA, 19 nt, Homo sapiens
cauucuggcuaucccucua

SEQ ID NO: 1392563 - RNA, 19 nt, Homo sapiens
uggaagaacaggagaagca

SEQ ID NO: 1392564 - RNA, 19 nt, Homo sapiens
gggaaaaugccaaguggaa

SEQ ID NO: 1392565 - RNA, 19 nt, Homo sapiens
agauccagagcuugaauaa

SEQ ID NO: 1392566 - RNA, 19 nt, Homo sapiens
gggaauugcacuucacacu

SEQ ID NO: 1392567 - RNA, 19 nt, Homo sapiens
caagccagcagcagccaau

SEQ ID NO: 1392568 - RNA, 19 nt, Homo sapiens
ggcuaaccugccuuucuua

SEQ ID NO: 1392569 - RNA, 19 nt, Homo sapiens
ucaagucggcuuccaugca

SEQ ID NO: 1392570 - RNA, 19 nt, Homo sapiens
cauaauggugcccacuuuc

SEQ ID NO: 1392571 - RNA, 19 nt, Homo sapiens
cuggauucauguuucuuau

SEQ ID NO: 1392572 - RNA, 19 nt, Homo sapiens
cuuauacacacgaggcuuu

SEQ ID NO: 1392573 - RNA, 19 nt, Homo sapiens
ggaccgaguucacagauaa

SEQ ID NO: 1392574 - RNA, 19 nt, Homo sapiens
cagcauaaguucagacuaa

SEQ ID NO: 1392575 - RNA, 19 nt, Homo sapiens
uaaagagaauggagaacua

SEQ ID NO: 1392576 - RNA, 19 nt, Homo sapiens
caacauguuucuucaguau

SEQ ID NO: 1392577 - RNA, 19 nt, Homo sapiens
acagagcacuugcgguuua

SEQ ID NO: 1392578 - RNA, 19 nt, Homo sapiens
gauccgcucugcccuguuu

SEQ ID NO: 1392579 - RNA, 19 nt, Homo sapiens
gaucuccacuccacuuuau

SEQ ID NO: 1392580 - RNA, 19 nt, Homo sapiens
ggauagaugagaauuguuu

SEQ ID NO: 1392581 - RNA, 19 nt, Homo sapiens
gcaacuggccaacauguuu

SEQ ID NO: 1392582 - RNA, 19 nt, Homo sapiens
acagauaaauccauugguu

SEQ ID NO: 1392583 - RNA, 19 nt, Homo sapiens
gcucugcccuguuugagaa

SEQ ID NO: 1392584 - RNA, 19 nt, Homo sapiens
ggaauuggagcgagaagaa

SEQ ID NO: 1392585 - RNA, 19 nt, Homo sapiens
caucaaagguuuccguuac

SEQ ID NO: 1392586 - RNA, 19 nt, Homo sapiens
guucacagauaaauccauu

SEQ ID NO: 1392587 - RNA, 19 nt, Homo sapiens
cuagagcuguugugacuga

SEQ ID NO: 1392588 - RNA, 19 nt, Homo sapiens
agagaaaucugcaaagcau

SEQ ID NO: 1392589 - RNA, 19 nt, Homo sapiens
gagcagacuggauagauga

SEQ ID NO: 1392590 - RNA, 19 nt, Homo sapiens
acucaaacuuuccugcaua

SEQ ID NO: 1392591 - RNA, 19 nt, Homo sapiens
ccaacauguuucuucagua

SEQ ID NO: 1392592 - RNA, 19 nt, Homo sapiens
ggaccggccuuuauucacu

SEQ ID NO: 1392593 - RNA, 19 nt, Homo sapiens
gagcuguugugacugauuc

SEQ ID NO: 1392594 - RNA, 19 nt, Homo sapiens
ucacagagcauugaccauu

SEQ ID NO: 1392595 - RNA, 19 nt, Homo sapiens
gggaccgaguucacagaua

SEQ ID NO: 1392596 - RNA, 19 nt, Homo sapiens
ggaugccgcucgugguguu

SEQ ID NO: 1392597 - RNA, 19 nt, Homo sapiens
ugaagaugguacaguucua

SEQ ID NO: 1392598 - RNA, 19 nt, Homo sapiens
gcaggucuccagagcauau

SEQ ID NO: 1392599 - RNA, 19 nt, Homo sapiens
aaaugcaucccaacaauga

SEQ ID NO: 1392600 - RNA, 19 nt, Homo sapiens
cagauaaauccauugguuu

SEQ ID NO: 1392601 - RNA, 19 nt, Homo sapiens
gccaacauguuucuucagu

SEQ ID NO: 1392602 - RNA, 19 nt, Homo sapiens
cgacguacccaaggaauug

SEQ ID NO: 1392603 - RNA, 19 nt, Homo sapiens
cacagagcauugaccauug

SEQ ID NO: 1392604 - RNA, 19 nt, Homo sapiens
gauccuacuugggcuauca

SEQ ID NO: 1392605 - RNA, 19 nt, Homo sapiens
uuaccuagauuggauccua

SEQ ID NO: 1392606 - RNA, 19 nt, Homo sapiens
gagaauggagaacuauugu

SEQ ID NO: 1392607 - RNA, 19 nt, Homo sapiens
gcauggguccggugccuuu

SEQ ID NO: 1392608 - RNA, 19 nt, Homo sapiens
caguuuauuucguacacua

SEQ ID NO: 1392609 - RNA, 19 nt, Homo sapiens
ugggagagcagacuggaua

SEQ ID NO: 1392610 - RNA, 19 nt, Homo sapiens
cauaaguucagacuaaaga

SEQ ID NO: 1392611 - RNA, 19 nt, Homo sapiens
ggucacgagucaaguacug

SEQ ID NO: 1392612 - RNA, 19 nt, Homo sapiens
uaaaaugcaucccaacaau

SEQ ID NO: 1392613 - RNA, 19 nt, Homo sapiens
cuucgucgccaguuuauuu

SEQ ID NO: 1392614 - RNA, 19 nt, Homo sapiens
cagacuggauagaugagaa

SEQ ID NO: 1392615 - RNA, 19 nt, Homo sapiens
ccacuccacuuuauuucuc

SEQ ID NO: 1392616 - RNA, 19 nt, Homo sapiens
ucgcuuaacuacaucaaag

SEQ ID NO: 1392617 - RNA, 19 nt, Homo sapiens
gaccauggcagaacugagu

SEQ ID NO: 1392618 - RNA, 19 nt, Homo sapiens
gcugggaccggccuuuauu

SEQ ID NO: 1392619 - RNA, 19 nt, Homo sapiens
cugauucacucaaacuuuc

SEQ ID NO: 1392620 - RNA, 19 nt, Homo sapiens
agagcagacuggauagaug

SEQ ID NO: 1392621 - RNA, 19 nt, Homo sapiens
cuacuugggcuaucacaga

SEQ ID NO: 1392622 - RNA, 19 nt, Homo sapiens
ggccggaacgucaguguga

SEQ ID NO: 1392623 - RNA, 19 nt, Homo sapiens
gccuuggguuuacagcaua

SEQ ID NO: 1392624 - RNA, 19 nt, Homo sapiens
gucaaguacuggccggauu

SEQ ID NO: 1392625 - RNA, 19 nt, Homo sapiens
ccaggucacgagucaagua

SEQ ID NO: 1392626 - RNA, 19 nt, Homo sapiens
ggacucgcuuaacuacauc

SEQ ID NO: 1392627 - RNA, 19 nt, Homo sapiens
gaccggccuuuauucacuu

SEQ ID NO: 1392628 - RNA, 19 nt, Homo sapiens
agauaaauccauugguuug

SEQ ID NO: 1392629 - RNA, 19 nt, Homo sapiens
cuggauagaugagaauugu

SEQ ID NO: 1392630 - RNA, 19 nt, Homo sapiens
cagaggacccagcggugua

SEQ ID NO: 1392631 - RNA, 19 nt, Homo sapiens
aacagaaacugaagauggu

SEQ ID NO: 1392632 - RNA, 19 nt, Homo sapiens
gagagcagacuggauagau

SEQ ID NO: 1392633 - RNA, 19 nt, Homo sapiens
uacuagagcuguugugacu

SEQ ID NO: 1392634 - RNA, 19 nt, Homo sapiens
uggacucgcuuaacuacau

SEQ ID NO: 1392635 - RNA, 19 nt, Homo sapiens
gcauacugcggacucugua

SEQ ID NO: 1392636 - RNA, 19 nt, Homo sapiens
ggaaguaagaaaguuaucu

SEQ ID NO: 1392637 - RNA, 19 nt, Homo sapiens
ggccuuggguuuacagcau

SEQ ID NO: 1392638 - RNA, 19 nt, Homo sapiens
gauaaauccauugguuugu

SEQ ID NO: 1392639 - RNA, 19 nt, Homo sapiens
ggugcaaccuggcaaaucc

SEQ ID NO: 1392640 - RNA, 19 nt, Homo sapiens
agagaauggagaacuauug

SEQ ID NO: 1392641 - RNA, 19 nt, Homo sapiens
uaaguucagacuaaagaga

SEQ ID NO: 1392642 - RNA, 19 nt, Homo sapiens
ucaaagguuuccguuacga

SEQ ID NO: 1392643 - RNA, 19 nt, Homo sapiens
gaagaugguacaguucuac

SEQ ID NO: 1392644 - RNA, 19 nt, Homo sapiens
gacuaaagagaauggagaa

SEQ ID NO: 1392645 - RNA, 19 nt, Homo sapiens
gugccaggccuuggguuua

SEQ ID NO: 1392646 - RNA, 19 nt, Homo sapiens
caacuggccaacauguuuc

SEQ ID NO: 1392647 - RNA, 19 nt, Homo sapiens
ugcggacucuguaguaaau

SEQ ID NO: 1392648 - RNA, 19 nt, Homo sapiens
gcuuugaggcucccgauuc

SEQ ID NO: 1392649 - RNA, 19 nt, Homo sapiens
uguggaaguaagaaaguua

SEQ ID NO: 1392650 - RNA, 19 nt, Homo sapiens
ucuccacuccacuuuauuu

SEQ ID NO: 1392651 - RNA, 19 nt, Homo sapiens
gucgccaguuuauuucgua

SEQ ID NO: 1392652 - RNA, 19 nt, Homo sapiens
ucaaguacuggccggauug

SEQ ID NO: 1392653 - RNA, 19 nt, Homo sapiens
gaauuggagcgagaagaau

SEQ ID NO: 1392654 - RNA, 19 nt, Homo sapiens
ggagagcagacuggauaga

SEQ ID NO: 1392655 - RNA, 19 nt, Homo sapiens
uggccaacauguuucuuca

SEQ ID NO: 1392656 - RNA, 19 nt, Homo sapiens
ccggcgugcugaagaguug

SEQ ID NO: 1392657 - RNA, 19 nt, Homo sapiens
ggaacgucagugugaguug

SEQ ID NO: 1392658 - RNA, 19 nt, Homo sapiens
ucacagauaaauccauugg

SEQ ID NO: 1392659 - RNA, 19 nt, Homo sapiens
accauuggcuucccucauc

SEQ ID NO: 1392660 - RNA, 19 nt, Homo sapiens
gcauaaguucagacuaaag

SEQ ID NO: 1392661 - RNA, 19 nt, Homo sapiens
ucccaacaaugagaacuug

SEQ ID NO: 1392662 - RNA, 19 nt, Homo sapiens
cccuaacgcugcgcuuuga

SEQ ID NO: 1392663 - RNA, 19 nt, Homo sapiens
gcccuaacgcugcgcuuug

SEQ ID NO: 1392664 - RNA, 19 nt, Homo sapiens
acagagcauugaccauugg

SEQ ID NO: 1392665 - RNA, 19 nt, Homo sapiens
cuagauuggauccuacuug

SEQ ID NO: 1392666 - RNA, 19 nt, Homo sapiens
gugaacagaaacugaagau

SEQ ID NO: 1392667 - RNA, 19 nt, Homo sapiens
aaagagaauggagaacuau

SEQ ID NO: 1392668 - RNA, 19 nt, Homo sapiens
cugcaggucuccagagcau

SEQ ID NO: 1392669 - RNA, 19 nt, Homo sapiens
ucacuuuggugggccuaga

SEQ ID NO: 1392670 - RNA, 19 nt, Homo sapiens
gaccgaguucacagauaaa

SEQ ID NO: 1392671 - RNA, 19 nt, Homo sapiens
acaucaaagguuuccguua

SEQ ID NO: 1392672 - RNA, 19 nt, Homo sapiens
ugaucuccacuccacuuua

SEQ ID NO: 1392673 - RNA, 19 nt, Homo sapiens
ccaaauaaauguucaguga

SEQ ID NO: 1392674 - RNA, 19 nt, Homo sapiens
gaaugaugcugcacgcuuu

SEQ ID NO: 1392675 - RNA, 19 nt, Homo sapiens
ucacagaucucgugguucu

SEQ ID NO: 1392676 - RNA, 19 nt, Homo sapiens
gcacugggacguucgcauu

SEQ ID NO: 1392677 - RNA, 19 nt, Homo sapiens
ccucacagaucucgugguu

SEQ ID NO: 1392678 - RNA, 19 nt, Homo sapiens
acacagccaugcauuguca

SEQ ID NO: 1392679 - RNA, 19 nt, Homo sapiens
gcuccagggacuccaaaua

SEQ ID NO: 1392680 - RNA, 19 nt, Homo sapiens
gaagaggcagggccagguu

SEQ ID NO: 1392681 - RNA, 19 nt, Homo sapiens
gcacgcccaucccucagau

SEQ ID NO: 1392682 - RNA, 19 nt, Homo sapiens
uccagggacuccaaauaaa

SEQ ID NO: 1392683 - RNA, 19 nt, Homo sapiens
ggacuccaaauaaauguuc

SEQ ID NO: 1392684 - RNA, 19 nt, Homo sapiens
gaacagcuuccggcucuca

SEQ ID NO: 1392685 - RNA, 19 nt, Homo sapiens
gaaccuguccaucguguac

SEQ ID NO: 1392686 - RNA, 19 nt, Homo sapiens
gcgauccugucuccaaagu

SEQ ID NO: 1392687 - RNA, 19 nt, Homo sapiens
caacaagcacugggacguu

SEQ ID NO: 1392688 - RNA, 19 nt, Homo sapiens
ccagggacuccaaauaaau

SEQ ID NO: 1392689 - RNA, 19 nt, Homo sapiens
cuccagggacuccaaauaa

SEQ ID NO: 1392690 - RNA, 19 nt, Homo sapiens
ucccucagauccacuguga

SEQ ID NO: 1392691 - RNA, 19 nt, Homo sapiens
ccacacagccaugcauugu

SEQ ID NO: 1392692 - RNA, 19 nt, Homo sapiens
cgaccugaccuacggagaa

SEQ ID NO: 1392693 - RNA, 19 nt, Homo sapiens
gaccugaccuacggagaag

SEQ ID NO: 1392694 - RNA, 19 nt, Homo sapiens
ugagcucagugugguguuu

SEQ ID NO: 1392695 - RNA, 19 nt, Homo sapiens
cagggacuccaaauaaaug

SEQ ID NO: 1392696 - RNA, 19 nt, Homo sapiens
ggcucuuucuccaggcuua

SEQ ID NO: 1392697 - RNA, 19 nt, Homo sapiens
gauccacugugagcaccaa

SEQ ID NO: 1392698 - RNA, 19 nt, Homo sapiens
gugcguggcccuaaacaag

SEQ ID NO: 1392699 - RNA, 19 nt, Homo sapiens
ugacuggcuccaaggauga

SEQ ID NO: 1392700 - RNA, 19 nt, Homo sapiens
gagagccggguaaccauca

SEQ ID NO: 1392701 - RNA, 19 nt, Homo sapiens
gccaccagcuggauuucuc

SEQ ID NO: 1392702 - RNA, 19 nt, Homo sapiens
ucuccaaagugcugcugaa

SEQ ID NO: 1392703 - RNA, 19 nt, Homo sapiens
caaagccaagccucacaga

SEQ ID NO: 1392704 - RNA, 19 nt, Homo sapiens
aagccaagccucacagauc

SEQ ID NO: 1392705 - RNA, 19 nt, Homo sapiens
gcgggacucuagggagaug

SEQ ID NO: 1392706 - RNA, 19 nt, Homo sapiens
gcgacuuccugguggucaa

SEQ ID NO: 1392707 - RNA, 19 nt, Homo sapiens
aggcgauccugucuccaaa

SEQ ID NO: 1392708 - RNA, 19 nt, Homo sapiens
gcggguaccucuguaugcu

SEQ ID NO: 1392709 - RNA, 19 nt, Homo sapiens
uaaagaagcacguugauuu

SEQ ID NO: 1392710 - RNA, 19 nt, Homo sapiens
gaggagaucuuccaucagu

SEQ ID NO: 1392711 - RNA, 19 nt, Homo sapiens
ggagaagacaguagaauga

SEQ ID NO: 1392712 - RNA, 19 nt, Homo sapiens
gaagagcccuggagaagac

SEQ ID NO: 1392713 - RNA, 19 nt, Homo sapiens
gggcugagaucgaggaguu

SEQ ID NO: 1392714 - RNA, 19 nt, Homo sapiens
gcaaggguaccgccacaua

SEQ ID NO: 1392715 - RNA, 19 nt, Homo sapiens
acaccuggcuaauguuuaa

SEQ ID NO: 1392716 - RNA, 19 nt, Homo sapiens
caaccugacucgaccuuug

SEQ ID NO: 1392717 - RNA, 19 nt, Homo sapiens
gaacucagccaacuacagu

SEQ ID NO: 1392718 - RNA, 19 nt, Homo sapiens
gguuugugguggaagauua

SEQ ID NO: 1392719 - RNA, 19 nt, Homo sapiens
ucaagagccugcugagaau

SEQ ID NO: 1392720 - RNA, 19 nt, Homo sapiens
caccacaccuggcuaaugu

SEQ ID NO: 1392721 - RNA, 19 nt, Homo sapiens
gcagggaacagcuuuguca

SEQ ID NO: 1392722 - RNA, 19 nt, Homo sapiens
guaacuguuucauagaaga

SEQ ID NO: 1392723 - RNA, 19 nt, Homo sapiens
guuuguaacuguuucauag

SEQ ID NO: 1392724 - RNA, 19 nt, Homo sapiens
ccaaagugcugggauuaca

SEQ ID NO: 1392725 - RNA, 19 nt, Homo sapiens
caacaacgaccgucuagag

SEQ ID NO: 1392726 - RNA, 19 nt, Homo sapiens
gacacuggauggcuucaug

SEQ ID NO: 1392727 - RNA, 19 nt, Homo sapiens
gcuacgagauggaccucaa

SEQ ID NO: 1392728 - RNA, 19 nt, Homo sapiens
gcaccgaggccuauguuag

SEQ ID NO: 1392729 - RNA, 19 nt, Homo sapiens
gcucaacaauggcuucaac

SEQ ID NO: 1392730 - RNA, 19 nt, Homo sapiens
gagaagccacacuccauug

SEQ ID NO: 1392731 - RNA, 19 nt, Homo sapiens
cuggauggcuucaugaugu

SEQ ID NO: 1392732 - RNA, 19 nt, Homo sapiens
aaauaaagaagcacguuga

SEQ ID NO: 1392733 - RNA, 19 nt, Homo sapiens
gacaguagaaugagccuau

SEQ ID NO: 1392734 - RNA, 19 nt, Homo sapiens
gccacgcucuucauccaaa

SEQ ID NO: 1392735 - RNA, 19 nt, Homo sapiens
gccauacccucaccuccaa

SEQ ID NO: 1392736 - RNA, 19 nt, Homo sapiens
gggagcccgucaucuauca

SEQ ID NO: 1392737 - RNA, 19 nt, Homo sapiens
gcaagaugagcuucaagga

SEQ ID NO: 1392738 - RNA, 19 nt, Homo sapiens
acauacaccugcuuuccaa

SEQ ID NO: 1392739 - RNA, 19 nt, Homo sapiens
gaaccacucucagcaucca

SEQ ID NO: 1392740 - RNA, 19 nt, Homo sapiens
ccacaccuggcuaauguuu

SEQ ID NO: 1392741 - RNA, 19 nt, Homo sapiens
gcaguguggcuacguccua

SEQ ID NO: 1392742 - RNA, 19 nt, Homo sapiens
ggccguagguuuguaacug

SEQ ID NO: 1392743 - RNA, 19 nt, Homo sapiens
aaagaagcacguugauuuc

SEQ ID NO: 1392744 - RNA, 19 nt, Homo sapiens
ugucggcccuggcugugua

SEQ ID NO: 1392745 - RNA, 19 nt, Homo sapiens
gggacaugcuggugacaca

SEQ ID NO: 1392746 - RNA, 19 nt, Homo sapiens
ccacaacaccuaucugacu

SEQ ID NO: 1392747 - RNA, 19 nt, Homo sapiens
cgagaagccacacuccauu

SEQ ID NO: 1392748 - RNA, 19 nt, Homo sapiens
ggaggcagggaacagcuuu

SEQ ID NO: 1392749 - RNA, 19 nt, Homo sapiens
ggaugaacucagccaacua

SEQ ID NO: 1392750 - RNA, 19 nt, Homo sapiens
uggauggcuucaugaugua

SEQ ID NO: 1392751 - RNA, 19 nt, Homo sapiens
gaugaacucagccaacuac

SEQ ID NO: 1392752 - RNA, 19 nt, Homo sapiens
gaucaagagccugcugaga

SEQ ID NO: 1392753 - RNA, 19 nt, Homo sapiens
caagcugaaugccgagaag

SEQ ID NO: 1392754 - RNA, 19 nt, Homo sapiens
ggagaucuuccaucaguac

SEQ ID NO: 1392755 - RNA, 19 nt, Homo sapiens
gccguagguuuguaacugu

SEQ ID NO: 1392756 - RNA, 19 nt, Homo sapiens
uagaagagcccuggagaag

SEQ ID NO: 1392757 - RNA, 19 nt, Homo sapiens
gcgcaaagccaagaaacuc

SEQ ID NO: 1392758 - RNA, 19 nt, Homo sapiens
caaccaggacagcaagaug

SEQ ID NO: 1392759 - RNA, 19 nt, Homo sapiens
gguuuguaacuguuucaua

SEQ ID NO: 1392760 - RNA, 19 nt, Homo sapiens
caucgcagcacaucuucuu

SEQ ID NO: 1392761 - RNA, 19 nt, Homo sapiens
gcaaagccaagaaacucau

SEQ ID NO: 1392762 - RNA, 19 nt, Homo sapiens
guagguuuguaacuguuuc

SEQ ID NO: 1392763 - RNA, 19 nt, Homo sapiens
ccuggcuaauguuuaaauu

SEQ ID NO: 1392764 - RNA, 19 nt, Homo sapiens
caguguggcuacguccuaa

SEQ ID NO: 1392765 - RNA, 19 nt, Homo sapiens
caaagccaagaaacucauu

SEQ ID NO: 1392766 - RNA, 19 nt, Homo sapiens
gcacaaggagcggcuguac

SEQ ID NO: 1392767 - RNA, 19 nt, Homo sapiens
cuccugaccucaagugauc

SEQ ID NO: 1392768 - RNA, 19 nt, Homo sapiens
cagccacgcucuucaucca

SEQ ID NO: 1392769 - RNA, 19 nt, Homo sapiens
gaggggagcccgucaucua

SEQ ID NO: 1392770 - RNA, 19 nt, Homo sapiens
agacagccaagcagcauga

SEQ ID NO: 1392771 - RNA, 19 nt, Homo sapiens
cugacuacgugcucaacaa

SEQ ID NO: 1392772 - RNA, 19 nt, Homo sapiens
gcagcucauucagaccuau

SEQ ID NO: 1392773 - RNA, 19 nt, Homo sapiens
gcccagcagcucauucaga

SEQ ID NO: 1392774 - RNA, 19 nt, Homo sapiens
acagcaagaugagcuucaa

SEQ ID NO: 1392775 - RNA, 19 nt, Homo sapiens
gcugguggccuugaacuuc

SEQ ID NO: 1392776 - RNA, 19 nt, Homo sapiens
gcccacuacuucaucucuu

SEQ ID NO: 1392777 - RNA, 19 nt, Homo sapiens
agcaugagcugaugacacu

SEQ ID NO: 1392778 - RNA, 19 nt, Homo sapiens
acgccuaccuccucuucaa

SEQ ID NO: 1392779 - RNA, 19 nt, Homo sapiens
ggaugacgaggaggaagaa

SEQ ID NO: 1392780 - RNA, 19 nt, Homo sapiens
guacgccuaccuccucuuc

SEQ ID NO: 1392781 - RNA, 19 nt, Homo sapiens
gagaagacaguagaaugag

SEQ ID NO: 1392782 - RNA, 19 nt, Homo sapiens
uggagaagacaguagaaug

SEQ ID NO: 1392783 - RNA, 19 nt, Homo sapiens
ccaccacaccuggcuaaug

SEQ ID NO: 1392784 - RNA, 19 nt, Homo sapiens
aucaagagccugcugagaa

SEQ ID NO: 1392785 - RNA, 19 nt, Homo sapiens
gcgcuggacuccccaaauc

SEQ ID NO: 1392786 - RNA, 19 nt, Homo sapiens
gcgcccagcagcucauuca

SEQ ID NO: 1392787 - RNA, 19 nt, Homo sapiens
auccagcgcuccugaguag

SEQ ID NO: 1392788 - RNA, 19 nt, Homo sapiens
gacuuugugggccaguuua

SEQ ID NO: 1392789 - RNA, 19 nt, Homo sapiens
ugacuuugugggccaguuu

SEQ ID NO: 1392790 - RNA, 19 nt, Homo sapiens
cggaugaacucagccaacu

SEQ ID NO: 1392791 - RNA, 19 nt, Homo sapiens
acccucaccuccaagauuc

SEQ ID NO: 1392792 - RNA, 19 nt, Homo sapiens
auaaagaagcacguugauu

SEQ ID NO: 1392793 - RNA, 19 nt, Homo sapiens
cauccagcgcuccugagua

SEQ ID NO: 1392794 - RNA, 19 nt, Homo sapiens
aaccaggacagcaagauga

SEQ ID NO: 1392795 - RNA, 19 nt, Homo sapiens
ccacuggauccacuccuau

SEQ ID NO: 1392796 - RNA, 19 nt, Homo sapiens
ggaggaugacgaggaggaa

SEQ ID NO: 1392797 - RNA, 19 nt, Homo sapiens
cccuuacccugucauccua

SEQ ID NO: 1392798 - RNA, 19 nt, Homo sapiens
ccacgcucuucauccaaau

SEQ ID NO: 1392799 - RNA, 19 nt, Homo sapiens
ugacuacgugcucaacaau

SEQ ID NO: 1392800 - RNA, 19 nt, Homo sapiens
gagcccgucaucuaucaug

SEQ ID NO: 1392801 - RNA, 19 nt, Homo sapiens
caaggguaccgccacauac

SEQ ID NO: 1392802 - RNA, 19 nt, Homo sapiens
acuacgugcucaacaaugg

SEQ ID NO: 1392803 - RNA, 19 nt, Homo sapiens
ggcaggagacugacuacgu

SEQ ID NO: 1392804 - RNA, 19 nt, Homo sapiens
cagcagcaccgaggccuau

SEQ ID NO: 1392805 - RNA, 19 nt, Homo sapiens
ucccacaacaccuaucuga

SEQ ID NO: 1392806 - RNA, 19 nt, Homo sapiens
caaccaggaucuaauaaua

SEQ ID NO: 1392807 - RNA, 19 nt, Homo sapiens
aaacugauuuggacuguua

SEQ ID NO: 1392808 - RNA, 19 nt, Homo sapiens
gagaauagaucuugggaau

SEQ ID NO: 1392809 - RNA, 19 nt, Homo sapiens
gaagagaaaguggaaauuu

SEQ ID NO: 1392810 - RNA, 19 nt, Homo sapiens
ggauccaguuucuuuaaua

SEQ ID NO: 1392811 - RNA, 19 nt, Homo sapiens
aaaugaagcugcaauuaga

SEQ ID NO: 1392812 - RNA, 19 nt, Homo sapiens
cuucuaaacucaaggauuu

SEQ ID NO: 1392813 - RNA, 19 nt, Homo sapiens
guacaaccaggaucuaaua

SEQ ID NO: 1392814 - RNA, 19 nt, Homo sapiens
gcacuuaaacagaaauuug

SEQ ID NO: 1392815 - RNA, 19 nt, Homo sapiens
guaaaugaagcugcaauua

SEQ ID NO: 1392816 - RNA, 19 nt, Homo sapiens
cuuccuggaugauaaauua

SEQ ID NO: 1392817 - RNA, 19 nt, Homo sapiens
gaacccggcugcuaauaag

SEQ ID NO: 1392818 - RNA, 19 nt, Homo sapiens
gaagaagccaguuaucuca

SEQ ID NO: 1392819 - RNA, 19 nt, Homo sapiens
caacugaaaugagcaaaca

SEQ ID NO: 1392820 - RNA, 19 nt, Homo sapiens
gaagaaauggucaacacaa

SEQ ID NO: 1392821 - RNA, 19 nt, Homo sapiens
ggaaaugcaggaacugaaa

SEQ ID NO: 1392822 - RNA, 19 nt, Homo sapiens
ggacaucacauuucacagu

SEQ ID NO: 1392823 - RNA, 19 nt, Homo sapiens
gauaauccagcaacugaaa

SEQ ID NO: 1392824 - RNA, 19 nt, Homo sapiens
aagaaauggucaacacaaa

SEQ ID NO: 1392825 - RNA, 19 nt, Homo sapiens
uaaaugaagcugcaauuag

SEQ ID NO: 1392826 - RNA, 19 nt, Homo sapiens
ugaccugccuguaaaugaa

SEQ ID NO: 1392827 - RNA, 19 nt, Homo sapiens
acacaagccuucuaaacuc

SEQ ID NO: 1392828 - RNA, 19 nt, Homo sapiens
gcgguagacccauucauaa

SEQ ID NO: 1392829 - RNA, 19 nt, Homo sapiens
aacuuaagguugagcuuua

SEQ ID NO: 1392830 - RNA, 19 nt, Homo sapiens
acucaaggauuuaaacuca

SEQ ID NO: 1392831 - RNA, 19 nt, Homo sapiens
ggacagcgaacuaaagaag

SEQ ID NO: 1392832 - RNA, 19 nt, Homo sapiens
uuucuucgcucucagauug

SEQ ID NO: 1392833 - RNA, 19 nt, Homo sapiens
acagcgaacuaaagaagaa

SEQ ID NO: 1392834 - RNA, 19 nt, Homo sapiens
ggcgguagacccauucaua

SEQ ID NO: 1392835 - RNA, 19 nt, Homo sapiens
cagauaauccagcaacuga

SEQ ID NO: 1392836 - RNA, 19 nt, Homo sapiens
gaaggacagcgaacuaaag

SEQ ID NO: 1392837 - RNA, 19 nt, Homo sapiens
aaaaugaccugccuguaaa

SEQ ID NO: 1392838 - RNA, 19 nt, Homo sapiens
aaagacagaauucacauug

SEQ ID NO: 1392839 - RNA, 19 nt, Homo sapiens
ccaauuauagucaucauuc

SEQ ID NO: 1392840 - RNA, 19 nt, Homo sapiens
aaacagaacccggcugcua

SEQ ID NO: 1392841 - RNA, 19 nt, Homo sapiens
gugacgagcgcauuaguuu

SEQ ID NO: 1392842 - RNA, 19 nt, Homo sapiens
caagguaucagcaacacaa

SEQ ID NO: 1392843 - RNA, 19 nt, Homo sapiens
gguagacccauucauaaga

SEQ ID NO: 1392844 - RNA, 19 nt, Homo sapiens
gaaacugauuuggacuguu

SEQ ID NO: 1392845 - RNA, 19 nt, Homo sapiens
caacacaagccuucuaaac

SEQ ID NO: 1392846 - RNA, 19 nt, Homo sapiens
agacucuucuugacacauu

SEQ ID NO: 1392847 - RNA, 19 nt, Homo sapiens
gggauccaguuucuuuaau

SEQ ID NO: 1392848 - RNA, 19 nt, Homo sapiens
agguugagcuuuaaacuuc

SEQ ID NO: 1392849 - RNA, 19 nt, Homo sapiens
gaacuaaagaagaaauggu

SEQ ID NO: 1392850 - RNA, 19 nt, Homo sapiens
guagacccauucauaagag

SEQ ID NO: 1392851 - RNA, 19 nt, Homo sapiens
gguuaagcuucgugcaauu

SEQ ID NO: 1392852 - RNA, 19 nt, Homo sapiens
uauacucuguucuucugua

SEQ ID NO: 1392853 - RNA, 19 nt, Homo sapiens
gugaugaagaagccaguua

SEQ ID NO: 1392854 - RNA, 19 nt, Homo sapiens
cacaaaagcuguugaccaa

SEQ ID NO: 1392855 - RNA, 19 nt, Homo sapiens
ucagaaggacagcgaacua

SEQ ID NO: 1392856 - RNA, 19 nt, Homo sapiens
ugaagaagagaaaguggaa

SEQ ID NO: 1392857 - RNA, 19 nt, Homo sapiens
guuuggacaucacauuuca

SEQ ID NO: 1392858 - RNA, 19 nt, Homo sapiens
guacaaauucuaguuccuu

SEQ ID NO: 1392859 - RNA, 19 nt, Homo sapiens
uagcugcccuugaaaauga

SEQ ID NO: 1392860 - RNA, 19 nt, Homo sapiens
cacaagccuucuaaacuca

SEQ ID NO: 1392861 - RNA, 19 nt, Homo sapiens
gcaacacaagccuucuaaa

SEQ ID NO: 1392862 - RNA, 19 nt, Homo sapiens
cagaaggacagcgaacuaa

SEQ ID NO: 1392863 - RNA, 19 nt, Homo sapiens
agaagccaguuaucucaga

SEQ ID NO: 1392864 - RNA, 19 nt, Homo sapiens
acugucaccugcuguaaga

SEQ ID NO: 1392865 - RNA, 19 nt, Homo sapiens
cucaugcacuuaaacagaa

SEQ ID NO: 1392866 - RNA, 19 nt, Homo sapiens
ggauaugaauaagguuaag

SEQ ID NO: 1392867 - RNA, 19 nt, Homo sapiens
gaagaagagaaaguggaaa

SEQ ID NO: 1392868 - RNA, 19 nt, Homo sapiens
guccagaaacuucaagguu

SEQ ID NO: 1392869 - RNA, 19 nt, Homo sapiens
ccagaucagcuuccagguu

SEQ ID NO: 1392870 - RNA, 19 nt, Homo sapiens
guuaaaggcuaaaaguaga

SEQ ID NO: 1392871 - RNA, 19 nt, Homo sapiens
aagaagaaauggucaacac

SEQ ID NO: 1392872 - RNA, 19 nt, Homo sapiens
ucacauugggauccaguuu

SEQ ID NO: 1392873 - RNA, 19 nt, Homo sapiens
agaacccggcugcuaauaa

SEQ ID NO: 1392874 - RNA, 19 nt, Homo sapiens
ugggucagcugucaucauc

SEQ ID NO: 1392875 - RNA, 19 nt, Homo sapiens
ugaagaagccaguuaucuc

SEQ ID NO: 1392876 - RNA, 19 nt, Homo sapiens
ucaaggauuuaaacucaac

SEQ ID NO: 1392877 - RNA, 19 nt, Homo sapiens
aaacauguuggacguucua

SEQ ID NO: 1392878 - RNA, 19 nt, Homo sapiens
cagcaacacaagccuucua

SEQ ID NO: 1392879 - RNA, 19 nt, Homo sapiens
cagcaauuguggaaaugca

SEQ ID NO: 1392880 - RNA, 19 nt, Homo sapiens
ggaaaagacagaauucaca

SEQ ID NO: 1392881 - RNA, 19 nt, Homo sapiens
agccagagaaauaaagaua

SEQ ID NO: 1392882 - RNA, 19 nt, Homo sapiens
aacagaacccggcugcuaa

SEQ ID NO: 1392883 - RNA, 19 nt, Homo sapiens
gacgagcgcauuaguuugg

SEQ ID NO: 1392884 - RNA, 19 nt, Homo sapiens
agaaggacagcgaacuaaa

SEQ ID NO: 1392885 - RNA, 19 nt, Homo sapiens
gaugaagaagccaguuauc

SEQ ID NO: 1392886 - RNA, 19 nt, Homo sapiens
ugagaaagagaauagaucu

SEQ ID NO: 1392887 - RNA, 19 nt, Homo sapiens
ucaugcacuuaaacagaaa

SEQ ID NO: 1392888 - RNA, 19 nt, Homo sapiens
gaauucacauugggaucca

SEQ ID NO: 1392889 - RNA, 19 nt, Homo sapiens
gaccaauuauagucaucau

SEQ ID NO: 1392890 - RNA, 19 nt, Homo sapiens
ggacccagaucagcuucca

SEQ ID NO: 1392891 - RNA, 19 nt, Homo sapiens
agaaacugauuuggacugu

SEQ ID NO: 1392892 - RNA, 19 nt, Homo sapiens
ucucaugcacuuaaacaga

SEQ ID NO: 1392893 - RNA, 19 nt, Homo sapiens
gaauaagguuaagcuucgu

SEQ ID NO: 1392894 - RNA, 19 nt, Homo sapiens
guuggacguucuaaaggau

SEQ ID NO: 1392895 - RNA, 19 nt, Homo sapiens
uguuggacguucuaaagga

SEQ ID NO: 1392896 - RNA, 19 nt, Homo sapiens
cauguuggacguucuaaag

SEQ ID NO: 1392897 - RNA, 19 nt, Homo sapiens
gccagagaaauaaagauau

SEQ ID NO: 1392898 - RNA, 19 nt, Homo sapiens
aagaagagaaaguggaaau

SEQ ID NO: 1392899 - RNA, 19 nt, Homo sapiens
uuuauacucuguucuucug

SEQ ID NO: 1392900 - RNA, 19 nt, Homo sapiens
aaauauguaugccugucau

SEQ ID NO: 1392901 - RNA, 19 nt, Homo sapiens
cacuugcuauguaaauaug

SEQ ID NO: 1392902 - RNA, 19 nt, Homo sapiens
gacagcgaacuaaagaaga

SEQ ID NO: 1392903 - RNA, 19 nt, Homo sapiens
aaggacagcgaacuaaaga

SEQ ID NO: 1392904 - RNA, 19 nt, Homo sapiens
caaacauguuggacguucu

SEQ ID NO: 1392905 - RNA, 19 nt, Homo sapiens
uuacguuuauacucuguuc

SEQ ID NO: 1392906 - RNA, 19 nt, Homo sapiens
ggaagaagcuggacauuca

SEQ ID NO: 1392907 - RNA, 19 nt, Homo sapiens
cagaggagcugguggauaa

SEQ ID NO: 1392908 - RNA, 19 nt, Homo sapiens
gaaagcccaucgucuuaaa

SEQ ID NO: 1392909 - RNA, 19 nt, Homo sapiens
cagcagaacucuugggaaa

SEQ ID NO: 1392910 - RNA, 19 nt, Homo sapiens
gcagaacucuugggaaaug

SEQ ID NO: 1392911 - RNA, 19 nt, Homo sapiens
gaacccaccuguguaaaga

SEQ ID NO: 1392912 - RNA, 19 nt, Homo sapiens
gcucaacgcucugugguuu

SEQ ID NO: 1392913 - RNA, 19 nt, Homo sapiens
caacuaugcuuguaaaguc

SEQ ID NO: 1392914 - RNA, 19 nt, Homo sapiens
ggcccacgcuggagucuua

SEQ ID NO: 1392915 - RNA, 19 nt, Homo sapiens
gaucaucauugcaaaguuc

SEQ ID NO: 1392916 - RNA, 19 nt, Homo sapiens
ggaaaugucuaagaaaguc

SEQ ID NO: 1392917 - RNA, 19 nt, Homo sapiens
gaaccgcacugaagaacuc

SEQ ID NO: 1392918 - RNA, 19 nt, Homo sapiens
guaaauagucccagagaga

SEQ ID NO: 1392919 - RNA, 19 nt, Homo sapiens
guaaagagguuuucaguuc

SEQ ID NO: 1392920 - RNA, 19 nt, Homo sapiens
guaaaguccucggaaaguu

SEQ ID NO: 1392921 - RNA, 19 nt, Homo sapiens
ggucccagcuguccaauca

SEQ ID NO: 1392922 - RNA, 19 nt, Homo sapiens
guugguggcuuucuucuug

SEQ ID NO: 1392923 - RNA, 19 nt, Homo sapiens
ggccaugaaugccgaguuu

SEQ ID NO: 1392924 - RNA, 19 nt, Homo sapiens
gcaguuugaucuccugguu

SEQ ID NO: 1392925 - RNA, 19 nt, Homo sapiens
aaacagaaacguaagaaga

SEQ ID NO: 1392926 - RNA, 19 nt, Homo sapiens
gaucguggcccaugcugua

SEQ ID NO: 1392927 - RNA, 19 nt, Homo sapiens
cagaaagcccaucgucuua

SEQ ID NO: 1392928 - RNA, 19 nt, Homo sapiens
gagcaaagggugcauuuca

SEQ ID NO: 1392929 - RNA, 19 nt, Homo sapiens
ccugaaaucuggccgaaga

SEQ ID NO: 1392930 - RNA, 19 nt, Homo sapiens
uuaaagggcugaggguuga

SEQ ID NO: 1392931 - RNA, 19 nt, Homo sapiens
ggucugcuguugagauguu

SEQ ID NO: 1392932 - RNA, 19 nt, Homo sapiens
aaaguaccauagccaguuu

SEQ ID NO: 1392933 - RNA, 19 nt, Homo sapiens
guaaaugccagguugauag

SEQ ID NO: 1392934 - RNA, 19 nt, Homo sapiens
guugagauguuugguaaau

SEQ ID NO: 1392935 - RNA, 19 nt, Homo sapiens
gaguugagaucaucauugc

SEQ ID NO: 1392936 - RNA, 19 nt, Homo sapiens
uaaaguccucggaaaguuu

SEQ ID NO: 1392937 - RNA, 19 nt, Homo sapiens
gaccauaaguguguacuac

SEQ ID NO: 1392938 - RNA, 19 nt, Homo sapiens
ugagggcaauucugucuug

SEQ ID NO: 1392939 - RNA, 19 nt, Homo sapiens
gagcugaaccgcacugaag

SEQ ID NO: 1392940 - RNA, 19 nt, Homo sapiens
ucagaaagcccaucgucuu

SEQ ID NO: 1392941 - RNA, 19 nt, Homo sapiens
gguaaaugccagguugaua

SEQ ID NO: 1392942 - RNA, 19 nt, Homo sapiens
caaaguaccauagccaguu

SEQ ID NO: 1392943 - RNA, 19 nt, Homo sapiens
cgcaggagcccuaggauuu

SEQ ID NO: 1392944 - RNA, 19 nt, Homo sapiens
aagaguuucugccuguuaa

SEQ ID NO: 1392945 - RNA, 19 nt, Homo sapiens
gcugguggauaacagagaa

SEQ ID NO: 1392946 - RNA, 19 nt, Homo sapiens
gaagagaaaguugaagagu

SEQ ID NO: 1392947 - RNA, 19 nt, Homo sapiens
gagaaacagaaacguaaga

SEQ ID NO: 1392948 - RNA, 19 nt, Homo sapiens
agacggagccuaguuaugu

SEQ ID NO: 1392949 - RNA, 19 nt, Homo sapiens
gcagaggagcugguggaua

SEQ ID NO: 1392950 - RNA, 19 nt, Homo sapiens
ggaugcaucucaugaucuc

SEQ ID NO: 1392951 - RNA, 19 nt, Homo sapiens
gaagcuguguuuucuaguu

SEQ ID NO: 1392952 - RNA, 19 nt, Homo sapiens
ccagagacuuggaaauguc

SEQ ID NO: 1392953 - RNA, 19 nt, Homo sapiens
gccagagacuuggaaaugu

SEQ ID NO: 1392954 - RNA, 19 nt, Homo sapiens
ccauacccauuucuuacaa

SEQ ID NO: 1392955 - RNA, 19 nt, Homo sapiens
cuguugagauguuugguaa

SEQ ID NO: 1392956 - RNA, 19 nt, Homo sapiens
uaaauagucccagagagaa

SEQ ID NO: 1392957 - RNA, 19 nt, Homo sapiens
ccgagaaacagaaacguaa

SEQ ID NO: 1392958 - RNA, 19 nt, Homo sapiens
aaagaguuucugccuguua

SEQ ID NO: 1392959 - RNA, 19 nt, Homo sapiens
ccugaggaacuaaauuuaa

SEQ ID NO: 1392960 - RNA, 19 nt, Homo sapiens
aaucaggagucaccagaug

SEQ ID NO: 1392961 - RNA, 19 nt, Homo sapiens
cguguggauucaauaguuu

SEQ ID NO: 1392962 - RNA, 19 nt, Homo sapiens
gcaacuaugcuuguaaagu

SEQ ID NO: 1392963 - RNA, 19 nt, Homo sapiens
gauguagggagccuuaguu

SEQ ID NO: 1392964 - RNA, 19 nt, Homo sapiens
ggucaggguacuuggauga

SEQ ID NO: 1392965 - RNA, 19 nt, Homo sapiens
uagaagagaaaguugaaga

SEQ ID NO: 1392966 - RNA, 19 nt, Homo sapiens
guggugugcuccaaacuca

SEQ ID NO: 1392967 - RNA, 19 nt, Homo sapiens
uugcaacuaugcuuguaaa

SEQ ID NO: 1392968 - RNA, 19 nt, Homo sapiens
gagcauccucccugaaauc

SEQ ID NO: 1392969 - RNA, 19 nt, Homo sapiens
gaaacagaaacguaagaag

SEQ ID NO: 1392970 - RNA, 19 nt, Homo sapiens
cugaggaacuaaauuuaag

SEQ ID NO: 1392971 - RNA, 19 nt, Homo sapiens
ucaggguacuuggaugaaa

SEQ ID NO: 1392972 - RNA, 19 nt, Homo sapiens
ugagauguuugguaaaugc

SEQ ID NO: 1392973 - RNA, 19 nt, Homo sapiens
gggcugagggcaauucugu

SEQ ID NO: 1392974 - RNA, 19 nt, Homo sapiens
cauagccaguuuccagaug

SEQ ID NO: 1392975 - RNA, 19 nt, Homo sapiens
ccaugaaugccgaguuuga

SEQ ID NO: 1392976 - RNA, 19 nt, Homo sapiens
gaaaaugccagagaucuug

SEQ ID NO: 1392977 - RNA, 19 nt, Homo sapiens
guugagaucaucauugcaa

SEQ ID NO: 1392978 - RNA, 19 nt, Homo sapiens
gagaaugccagggaagaug

SEQ ID NO: 1392979 - RNA, 19 nt, Homo sapiens
ugaguugccuucuguuggu

SEQ ID NO: 1392980 - RNA, 19 nt, Homo sapiens
ucguguggauucaauaguu

SEQ ID NO: 1392981 - RNA, 19 nt, Homo sapiens
ggaggaagaagcuggacau

SEQ ID NO: 1392982 - RNA, 19 nt, Homo sapiens
gcugaggguugaggugaga

SEQ ID NO: 1392983 - RNA, 19 nt, Homo sapiens
ucacugguguccugucucu

SEQ ID NO: 1392984 - RNA, 19 nt, Homo sapiens
gcaggagcccuaggauuuc

SEQ ID NO: 1392985 - RNA, 19 nt, Homo sapiens
uaaagaguuucugccuguu

SEQ ID NO: 1392986 - RNA, 19 nt, Homo sapiens
gaggaacuaaauuuaagga

SEQ ID NO: 1392987 - RNA, 19 nt, Homo sapiens
ucgagacggagccuaguua

SEQ ID NO: 1392988 - RNA, 19 nt, Homo sapiens
cuuguaaaguccucggaaa

SEQ ID NO: 1392989 - RNA, 19 nt, Homo sapiens
cuacuuggcccuagaagag

SEQ ID NO: 1392990 - RNA, 19 nt, Homo sapiens
uaaguuacaccgagucuac

SEQ ID NO: 1392991 - RNA, 19 nt, Homo sapiens
cauacccauuucuuacaaa

SEQ ID NO: 1392992 - RNA, 19 nt, Homo sapiens
cacccauacccauuucuua

SEQ ID NO: 1392993 - RNA, 19 nt, Homo sapiens
acuuggaaaugucuaagaa

SEQ ID NO: 1392994 - RNA, 19 nt, Homo sapiens
guucuggucugcuguugag

SEQ ID NO: 1392995 - RNA, 19 nt, Homo sapiens
aacagaaacguaagaagaa

SEQ ID NO: 1392996 - RNA, 19 nt, Homo sapiens
gagaucaucauugcaaagu

SEQ ID NO: 1392997 - RNA, 19 nt, Homo sapiens
ucaacgcucugugguuugu

SEQ ID NO: 1392998 - RNA, 19 nt, Homo sapiens
gaacacugccuggaugcau

SEQ ID NO: 1392999 - RNA, 19 nt, Homo sapiens
ucucagaccauaagugugu

SEQ ID NO: 1393000 - RNA, 19 nt, Homo sapiens
aguuugaucuccugguuga

SEQ ID NO: 1393001 - RNA, 19 nt, Homo sapiens
ccgagcauccucccugaaa

SEQ ID NO: 1393002 - RNA, 19 nt, Homo sapiens
gcuguugagauguuuggua

SEQ ID NO: 1393003 - RNA, 19 nt, Homo sapiens
gacaugacucucccuggaa

SEQ ID NO: 1393004 - RNA, 19 nt, Homo sapiens
ugaugcagcagaacucuug

SEQ ID NO: 1393005 - RNA, 19 nt, Homo sapiens
gcugauagcaauuuuaguu

SEQ ID NO: 1393006 - RNA, 19 nt, Homo sapiens
ggacguagcccaagguauu

SEQ ID NO: 1393007 - RNA, 19 nt, Homo sapiens
cagggaagcuccauaaaug

SEQ ID NO: 1393008 - RNA, 19 nt, Homo sapiens
gguauucucuccuauggaa

SEQ ID NO: 1393009 - RNA, 19 nt, Homo sapiens
gagcggacccagcaguuua

SEQ ID NO: 1393010 - RNA, 19 nt, Homo sapiens
cagcagagccacugagauu

SEQ ID NO: 1393011 - RNA, 19 nt, Homo sapiens
gcagagccacugagauuug

SEQ ID NO: 1393012 - RNA, 19 nt, Homo sapiens
gaacuucuccaacgacauc

SEQ ID NO: 1393013 - RNA, 19 nt, Homo sapiens
gcaggacuguaauaaaugg

SEQ ID NO: 1393014 - RNA, 19 nt, Homo sapiens
gggcagccuuccugagaaa

SEQ ID NO: 1393015 - RNA, 19 nt, Homo sapiens
ggauaaagagaacaaugaa

SEQ ID NO: 1393016 - RNA, 19 nt, Homo sapiens
caaccacacugcaggaagu

SEQ ID NO: 1393017 - RNA, 19 nt, Homo sapiens
ucaaugagcacuuuagcaa

SEQ ID NO: 1393018 - RNA, 19 nt, Homo sapiens
uugcaggacuguaauaaau

SEQ ID NO: 1393019 - RNA, 19 nt, Homo sapiens
ccuauaauccuaagaacuu

SEQ ID NO: 1393020 - RNA, 19 nt, Homo sapiens
caaugaagcgccucuaaca

SEQ ID NO: 1393021 - RNA, 19 nt, Homo sapiens
caagagaagagucggaaga

SEQ ID NO: 1393022 - RNA, 19 nt, Homo sapiens
cauccagccuauaauccua

SEQ ID NO: 1393023 - RNA, 19 nt, Homo sapiens
ccagggaagcuccauaaau

SEQ ID NO: 1393024 - RNA, 19 nt, Homo sapiens
aaauggaucucugguguag

SEQ ID NO: 1393025 - RNA, 19 nt, Homo sapiens
cccaagguauucucuccua

SEQ ID NO: 1393026 - RNA, 19 nt, Homo sapiens
uaaauggaucucuggugua

SEQ ID NO: 1393027 - RNA, 19 nt, Homo sapiens
gaacaaugaagcgccucua

SEQ ID NO: 1393028 - RNA, 19 nt, Homo sapiens
gcagcaaggcccaggugaa

SEQ ID NO: 1393029 - RNA, 19 nt, Homo sapiens
uacugcagcuggagagaaa

SEQ ID NO: 1393030 - RNA, 19 nt, Homo sapiens
uggauaaagagaacaauga

SEQ ID NO: 1393031 - RNA, 19 nt, Homo sapiens
auggaucucugguguagaa

SEQ ID NO: 1393032 - RNA, 19 nt, Homo sapiens
caucaaggucucacacuuc

SEQ ID NO: 1393033 - RNA, 19 nt, Homo sapiens
ccaagguauucucuccuau

SEQ ID NO: 1393034 - RNA, 19 nt, Homo sapiens
ggagcggacccagcaguuu

SEQ ID NO: 1393035 - RNA, 19 nt, Homo sapiens
cauggccuuuguucaguuu

SEQ ID NO: 1393036 - RNA, 19 nt, Homo sapiens
ucucuccuauggaaacaaa

SEQ ID NO: 1393037 - RNA, 19 nt, Homo sapiens
caagguauucucuccuaug

SEQ ID NO: 1393038 - RNA, 19 nt, Homo sapiens
ggaagcuccauaaauguca

SEQ ID NO: 1393039 - RNA, 19 nt, Homo sapiens
agaagacacagaccgguuu

SEQ ID NO: 1393040 - RNA, 19 nt, Homo sapiens
gcaguuuaucccugugaaa

SEQ ID NO: 1393041 - RNA, 19 nt, Homo sapiens
ucuaacagcaggcaugaga

SEQ ID NO: 1393042 - RNA, 19 nt, Homo sapiens
gaagacacagaccgguuuc

SEQ ID NO: 1393043 - RNA, 19 nt, Homo sapiens
cagggcagcugugcagugu

SEQ ID NO: 1393044 - RNA, 19 nt, Homo sapiens
acagcaggcaugagacuaa

SEQ ID NO: 1393045 - RNA, 19 nt, Homo sapiens
cagccuauaauccuaagaa

SEQ ID NO: 1393046 - RNA, 19 nt, Homo sapiens
gauaaagagaacaaugaag

SEQ ID NO: 1393047 - RNA, 19 nt, Homo sapiens
acaucaaggucucacacuu

SEQ ID NO: 1393048 - RNA, 19 nt, Homo sapiens
cuacauggccuuuguucag

SEQ ID NO: 1393049 - RNA, 19 nt, Homo sapiens
ccaacgacaucaugcuacu

SEQ ID NO: 1393050 - RNA, 19 nt, Homo sapiens
caggguugcaggacuguaa

SEQ ID NO: 1393051 - RNA, 19 nt, Homo sapiens
cagagccacugagauuugu

SEQ ID NO: 1393052 - RNA, 19 nt, Homo sapiens
gggaagcuccauaaauguc

SEQ ID NO: 1393053 - RNA, 19 nt, Homo sapiens
uuccugcccuggauaaaga

SEQ ID NO: 1393054 - RNA, 19 nt, Homo sapiens
cuguuggccuuucuucuga

SEQ ID NO: 1393055 - RNA, 19 nt, Homo sapiens
gcggcauccuagugagaaa

SEQ ID NO: 1393056 - RNA, 19 nt, Homo sapiens
gauccaaagaagacacaga

SEQ ID NO: 1393057 - RNA, 19 nt, Homo sapiens
guugcaggacuguaauaaa

SEQ ID NO: 1393058 - RNA, 19 nt, Homo sapiens
gagguguggcggcauccua

SEQ ID NO: 1393059 - RNA, 19 nt, Homo sapiens
gguugcaggacuguaauaa

SEQ ID NO: 1393060 - RNA, 19 nt, Homo sapiens
aagguauucucuccuaugg

SEQ ID NO: 1393061 - RNA, 19 nt, Homo sapiens
ggcccacaauaucaaggaa

SEQ ID NO: 1393062 - RNA, 19 nt, Homo sapiens
ucucuuccauggcaauuac

SEQ ID NO: 1393063 - RNA, 19 nt, Homo sapiens
cccacaauaucaaggaaca

SEQ ID NO: 1393064 - RNA, 19 nt, Homo sapiens
ccucguguguaaggacgua

SEQ ID NO: 1393065 - RNA, 19 nt, Homo sapiens
cagcaaggcccaggugaag

SEQ ID NO: 1393066 - RNA, 19 nt, Homo sapiens
ggguugcaggacuguaaua

SEQ ID NO: 1393067 - RNA, 19 nt, Homo sapiens
gcaugagacuaaccuuccu

SEQ ID NO: 1393068 - RNA, 19 nt, Homo sapiens
aacaaugaagcgccucuaa

SEQ ID NO: 1393069 - RNA, 19 nt, Homo sapiens
ugccagggaagcuccauaa

SEQ ID NO: 1393070 - RNA, 19 nt, Homo sapiens
gcaggaaguguugcugaca

SEQ ID NO: 1393071 - RNA, 19 nt, Homo sapiens
gacacagaccgguuucaag

SEQ ID NO: 1393072 - RNA, 19 nt, Homo sapiens
agacacagaccgguuucaa

SEQ ID NO: 1393073 - RNA, 19 nt, Homo sapiens
gagccacugagauuugugu

SEQ ID NO: 1393074 - RNA, 19 nt, Homo sapiens
cagaauggcuugauguuua

SEQ ID NO: 1393075 - RNA, 19 nt, Homo sapiens
gaaugaaauuugcagagua

SEQ ID NO: 1393076 - RNA, 19 nt, Homo sapiens
ugacggagcuugaugaaga

SEQ ID NO: 1393077 - RNA, 19 nt, Homo sapiens
ggacucauccagauuguua

SEQ ID NO: 1393078 - RNA, 19 nt, Homo sapiens
gagcaagaguaucuaaaga

SEQ ID NO: 1393079 - RNA, 19 nt, Homo sapiens
uggacaagcucuuugauuu

SEQ ID NO: 1393080 - RNA, 19 nt, Homo sapiens
ggacguggcuuuauuucuc

SEQ ID NO: 1393081 - RNA, 19 nt, Homo sapiens
gaagaaauggagaaugaaa

SEQ ID NO: 1393082 - RNA, 19 nt, Homo sapiens
gaaguguuccucugcauuu

SEQ ID NO: 1393083 - RNA, 19 nt, Homo sapiens
ggacugauuuaacccaaga

SEQ ID NO: 1393084 - RNA, 19 nt, Homo sapiens
gaacauccagcuauuuaug

SEQ ID NO: 1393085 - RNA, 19 nt, Homo sapiens
caaguguccucgauuaaga

SEQ ID NO: 1393086 - RNA, 19 nt, Homo sapiens
guccaaguguccucgauua

SEQ ID NO: 1393087 - RNA, 19 nt, Homo sapiens
gaauuuaaugcuccugaua

SEQ ID NO: 1393088 - RNA, 19 nt, Homo sapiens
auaaggcgcuugcugauga

SEQ ID NO: 1393089 - RNA, 19 nt, Homo sapiens
ggacaagcucuuugauuug

SEQ ID NO: 1393090 - RNA, 19 nt, Homo sapiens
uagguaauauggccuguuu

SEQ ID NO: 1393091 - RNA, 19 nt, Homo sapiens
ggagcuugaugaagaaaug

SEQ ID NO: 1393092 - RNA, 19 nt, Homo sapiens
ggaugagaaacuaauguua

SEQ ID NO: 1393093 - RNA, 19 nt, Homo sapiens
gcagguuguugcuuacuug

SEQ ID NO: 1393094 - RNA, 19 nt, Homo sapiens
ccaggaacauccagcuauu

SEQ ID NO: 1393095 - RNA, 19 nt, Homo sapiens
uaacacagaggaaacuaaa

SEQ ID NO: 1393096 - RNA, 19 nt, Homo sapiens
aaacaaguacguucugaaa

SEQ ID NO: 1393097 - RNA, 19 nt, Homo sapiens
augaagaaauggagaauga

SEQ ID NO: 1393098 - RNA, 19 nt, Homo sapiens
ggaauuacuucuguacaag

SEQ ID NO: 1393099 - RNA, 19 nt, Homo sapiens
gcagaaguggccaguguuu

SEQ ID NO: 1393100 - RNA, 19 nt, Homo sapiens
gacgguggcucagggagua

SEQ ID NO: 1393101 - RNA, 19 nt, Homo sapiens
ccaaacaaguacguucuga

SEQ ID NO: 1393102 - RNA, 19 nt, Homo sapiens
gcccugugguggaagauuu

SEQ ID NO: 1393103 - RNA, 19 nt, Homo sapiens
uacaguggaugauggaauu

SEQ ID NO: 1393104 - RNA, 19 nt, Homo sapiens
gaaaggauccaggaacauc

SEQ ID NO: 1393105 - RNA, 19 nt, Homo sapiens
ggagcacggucuacagcaa

SEQ ID NO: 1393106 - RNA, 19 nt, Homo sapiens
gacaagcucuuugauuugg

SEQ ID NO: 1393107 - RNA, 19 nt, Homo sapiens
agaaaucugugugggaauu

SEQ ID NO: 1393108 - RNA, 19 nt, Homo sapiens
uggaauuacuucuguacaa

SEQ ID NO: 1393109 - RNA, 19 nt, Homo sapiens
ggaaaagacauuuggaauu

SEQ ID NO: 1393110 - RNA, 19 nt, Homo sapiens
ugauuuggaugagaaacua

SEQ ID NO: 1393111 - RNA, 19 nt, Homo sapiens
aggaacauccagcuauuua

SEQ ID NO: 1393112 - RNA, 19 nt, Homo sapiens
gaauuacuucuguacaaga

SEQ ID NO: 1393113 - RNA, 19 nt, Homo sapiens
aagaugauuuccacuugaa

SEQ ID NO: 1393114 - RNA, 19 nt, Homo sapiens
aaacggugcuagccucugu

SEQ ID NO: 1393115 - RNA, 19 nt, Homo sapiens
uguccucgauuaagagaaa

SEQ ID NO: 1393116 - RNA, 19 nt, Homo sapiens
uaaugcuccugauauauuc

SEQ ID NO: 1393117 - RNA, 19 nt, Homo sapiens
ggaugaggacguggcuuua

SEQ ID NO: 1393118 - RNA, 19 nt, Homo sapiens
guaaaggaaggccaguuga

SEQ ID NO: 1393119 - RNA, 19 nt, Homo sapiens
gaugauggaauucaagcaa

SEQ ID NO: 1393120 - RNA, 19 nt, Homo sapiens
uagaaugggucagaaaugg

SEQ ID NO: 1393121 - RNA, 19 nt, Homo sapiens
gaaggccaguugagcaaac

SEQ ID NO: 1393122 - RNA, 19 nt, Homo sapiens
gacggagcuugaugaagaa

SEQ ID NO: 1393123 - RNA, 19 nt, Homo sapiens
uaugggauaugucaaugga

SEQ ID NO: 1393124 - RNA, 19 nt, Homo sapiens
acuugaagcugccaaacaa

SEQ ID NO: 1393125 - RNA, 19 nt, Homo sapiens
ggaacauccagcuauuuau

SEQ ID NO: 1393126 - RNA, 19 nt, Homo sapiens
ugaagcugccaaacaagua

SEQ ID NO: 1393127 - RNA, 19 nt, Homo sapiens
gagcacggucuacagcaaa

SEQ ID NO: 1393128 - RNA, 19 nt, Homo sapiens
agaaugaaauuugcagagu

SEQ ID NO: 1393129 - RNA, 19 nt, Homo sapiens
cuugugcccuguauacuug

SEQ ID NO: 1393130 - RNA, 19 nt, Homo sapiens
cuuaaaaccugaauuggaa

SEQ ID NO: 1393131 - RNA, 19 nt, Homo sapiens
gauuuaacccaagaugauu

SEQ ID NO: 1393132 - RNA, 19 nt, Homo sapiens
gaaacuaaaaggacugauu

SEQ ID NO: 1393133 - RNA, 19 nt, Homo sapiens
ccagaauggcuugauguuu

SEQ ID NO: 1393134 - RNA, 19 nt, Homo sapiens
caaacaaguacguucugaa

SEQ ID NO: 1393135 - RNA, 19 nt, Homo sapiens
gaagagcagccaguguuuc

SEQ ID NO: 1393136 - RNA, 19 nt, Homo sapiens
gcauuugcuucauuauguc

SEQ ID NO: 1393137 - RNA, 19 nt, Homo sapiens
ugaggacguggcuuuauuu

SEQ ID NO: 1393138 - RNA, 19 nt, Homo sapiens
cggcagagucuaacacaga

SEQ ID NO: 1393139 - RNA, 19 nt, Homo sapiens
ugaagagcagccaguguuu

SEQ ID NO: 1393140 - RNA, 19 nt, Homo sapiens
guuauugcacuguuuguau

SEQ ID NO: 1393141 - RNA, 19 nt, Homo sapiens
ggcgcuugcugaugacuug

SEQ ID NO: 1393142 - RNA, 19 nt, Homo sapiens
cagccucauucgggucuua

SEQ ID NO: 1393143 - RNA, 19 nt, Homo sapiens
aguguugucugccaucuau

SEQ ID NO: 1393144 - RNA, 19 nt, Homo sapiens
gaguaugggauaugucaau

SEQ ID NO: 1393145 - RNA, 19 nt, Homo sapiens
gauccacccaucauucuuc

SEQ ID NO: 1393146 - RNA, 19 nt, Homo sapiens
acaaguacguucugaaaau

SEQ ID NO: 1393147 - RNA, 19 nt, Homo sapiens
gcauagggagcacggucua

SEQ ID NO: 1393148 - RNA, 19 nt, Homo sapiens
aggcagaaguggccagugu

SEQ ID NO: 1393149 - RNA, 19 nt, Homo sapiens
gauaaggcgcuugcugaug

SEQ ID NO: 1393150 - RNA, 19 nt, Homo sapiens
caagcucuuugauuuggau

SEQ ID NO: 1393151 - RNA, 19 nt, Homo sapiens
cuacucugcuggaaacaag

SEQ ID NO: 1393152 - RNA, 19 nt, Homo sapiens
uuauugcacuguuuguaug

SEQ ID NO: 1393153 - RNA, 19 nt, Homo sapiens
gaugaggacguggcuuuau

SEQ ID NO: 1393154 - RNA, 19 nt, Homo sapiens
aaaccuucuuccuuucuau

SEQ ID NO: 1393155 - RNA, 19 nt, Homo sapiens
agacugagcaagaguaucu

SEQ ID NO: 1393156 - RNA, 19 nt, Homo sapiens
guggacaagcucuuugauu

SEQ ID NO: 1393157 - RNA, 19 nt, Homo sapiens
uugaaaggauccaggaaca

SEQ ID NO: 1393158 - RNA, 19 nt, Homo sapiens
augaggacguggcuuuauu

SEQ ID NO: 1393159 - RNA, 19 nt, Homo sapiens
cagaguaugggauauguca

SEQ ID NO: 1393160 - RNA, 19 nt, Homo sapiens
ugauuuaacccaagaugau

SEQ ID NO: 1393161 - RNA, 19 nt, Homo sapiens
cuaauugacagccucauuc

SEQ ID NO: 1393162 - RNA, 19 nt, Homo sapiens
gaucuuccucuaauugaca

SEQ ID NO: 1393163 - RNA, 19 nt, Homo sapiens
cuauagcccugugguggaa

SEQ ID NO: 1393164 - RNA, 19 nt, Homo sapiens
gaauucugccagucugaug

SEQ ID NO: 1393165 - RNA, 19 nt, Homo sapiens
agaauggcuugauguuuac

SEQ ID NO: 1393166 - RNA, 19 nt, Homo sapiens
ucagcggacucauccagau

SEQ ID NO: 1393167 - RNA, 19 nt, Homo sapiens
aauccuacgugaaguugau

SEQ ID NO: 1393168 - RNA, 19 nt, Homo sapiens
ccagauuguuagcccugaa

SEQ ID NO: 1393169 - RNA, 19 nt, Homo sapiens
ggaaggccaguugagcaaa

SEQ ID NO: 1393170 - RNA, 19 nt, Homo sapiens
cagcaaacacuggcucuuc

SEQ ID NO: 1393171 - RNA, 19 nt, Homo sapiens
cuaacacagaggaaacuaa

SEQ ID NO: 1393172 - RNA, 19 nt, Homo sapiens
uauggaacagugucagaaa

SEQ ID NO: 1393173 - RNA, 19 nt, Homo sapiens
auucgggucuuacaaaaua

SEQ ID NO: 1393174 - RNA, 19 nt, Homo sapiens
ccaaagugcugggauaaua

SEQ ID NO: 1393175 - RNA, 19 nt, Homo sapiens
gccgacagcuccuuuaauu

SEQ ID NO: 1393176 - RNA, 19 nt, Homo sapiens
ccaaauagcugggauuaca

SEQ ID NO: 1393177 - RNA, 19 nt, Homo sapiens
gcaacagccugcccgagua

SEQ ID NO: 1393178 - RNA, 19 nt, Homo sapiens
aaacagagaugucagaaaa

SEQ ID NO: 1393179 - RNA, 19 nt, Homo sapiens
cgacagcuccuuuaauuuc

SEQ ID NO: 1393180 - RNA, 19 nt, Homo sapiens
ccaggaugcuguugcugua

SEQ ID NO: 1393181 - RNA, 19 nt, Homo sapiens
ucaaaucugugccuuaugg

SEQ ID NO: 1393182 - RNA, 19 nt, Homo sapiens
gagcggaguuccucacaag

SEQ ID NO: 1393183 - RNA, 19 nt, Homo sapiens
gaaacagagaugucagaaa

SEQ ID NO: 1393184 - RNA, 19 nt, Homo sapiens
cgucaaaucugugccuuau

SEQ ID NO: 1393185 - RNA, 19 nt, Homo sapiens
auacauguuucugcacuua

SEQ ID NO: 1393186 - RNA, 19 nt, Homo sapiens
ggagugcaguggugugauc

SEQ ID NO: 1393187 - RNA, 19 nt, Homo sapiens
ggaguggccuuuuaugaga

SEQ ID NO: 1393188 - RNA, 19 nt, Homo sapiens
ggagaggccuuuguguuuu

SEQ ID NO: 1393189 - RNA, 19 nt, Homo sapiens
gacagcuccuuuaauuuca

SEQ ID NO: 1393190 - RNA, 19 nt, Homo sapiens
ugccucagccucccaaaua

SEQ ID NO: 1393191 - RNA, 19 nt, Homo sapiens
ucaugaaggugcacaggau

SEQ ID NO: 1393192 - RNA, 19 nt, Homo sapiens
ccaccacgcccagcuaauu

SEQ ID NO: 1393193 - RNA, 19 nt, Homo sapiens
aggagaggccuuuguguuu

SEQ ID NO: 1393194 - RNA, 19 nt, Homo sapiens
cgagggaggcccaguacaa

SEQ ID NO: 1393195 - RNA, 19 nt, Homo sapiens
gaacuccugaccucaagug

SEQ ID NO: 1393196 - RNA, 19 nt, Homo sapiens
gcacagacggaguggaaca

SEQ ID NO: 1393197 - RNA, 19 nt, Homo sapiens
caucuucggagcccaguuu

SEQ ID NO: 1393198 - RNA, 19 nt, Homo sapiens
caggagaggccuuuguguu

SEQ ID NO: 1393199 - RNA, 19 nt, Homo sapiens
gugaaaauauccuggaaau

SEQ ID NO: 1393200 - RNA, 19 nt, Homo sapiens
caaagugcugggauaauag

SEQ ID NO: 1393201 - RNA, 19 nt, Homo sapiens
caccacgcccagcuaauuu

SEQ ID NO: 1393202 - RNA, 19 nt, Homo sapiens
cgugucggcugccaugaug

SEQ ID NO: 1393203 - RNA, 19 nt, Homo sapiens
acauguuucugcacuuaga

SEQ ID NO: 1393204 - RNA, 19 nt, Homo sapiens
ccucucgccugcacugaug

SEQ ID NO: 1393205 - RNA, 19 nt, Homo sapiens
gggaggcccaguacaacaa

SEQ ID NO: 1393206 - RNA, 19 nt, Homo sapiens
ggaugcuguugcuguagga

SEQ ID NO: 1393207 - RNA, 19 nt, Homo sapiens
cacccucccugccuccaaa

SEQ ID NO: 1393208 - RNA, 19 nt, Homo sapiens
cuccugaccucaagugauc

SEQ ID NO: 1393209 - RNA, 19 nt, Homo sapiens
gagaggccuuuguguuuug

SEQ ID NO: 1393210 - RNA, 19 nt, Homo sapiens
gcacugaugcagacaaaau

SEQ ID NO: 1393211 - RNA, 19 nt, Homo sapiens
gcaggagaggccuuugugu

SEQ ID NO: 1393212 - RNA, 19 nt, Homo sapiens
gcccuuggccggaacuaau

SEQ ID NO: 1393213 - RNA, 19 nt, Homo sapiens
guuccggccugucuacaag

SEQ ID NO: 1393214 - RNA, 19 nt, Homo sapiens
gugaaacagagaugucaga

SEQ ID NO: 1393215 - RNA, 19 nt, Homo sapiens
gguacggccuugucuucag

SEQ ID NO: 1393216 - RNA, 19 nt, Homo sapiens
ccaucgcgaucaugaaggu

SEQ ID NO: 1393217 - RNA, 19 nt, Homo sapiens
cggcagcggccacaauugu

SEQ ID NO: 1393218 - RNA, 19 nt, Homo sapiens
gccucagccucccaaauag

SEQ ID NO: 1393219 - RNA, 19 nt, Homo sapiens
cagcuccuuuaauuucaug

SEQ ID NO: 1393220 - RNA, 19 nt, Homo sapiens
ucacagcaccauucacaac

SEQ ID NO: 1393221 - RNA, 19 nt, Homo sapiens
ugaaacagagaugucagaa

SEQ ID NO: 1393222 - RNA, 19 nt, Homo sapiens
ccgacagcuccuuuaauuu

SEQ ID NO: 1393223 - RNA, 19 nt, Homo sapiens
gcggcuacgugugcugguu

SEQ ID NO: 1393224 - RNA, 19 nt, Homo sapiens
ggaucuaccggcuguggau

SEQ ID NO: 1393225 - RNA, 19 nt, Homo sapiens
ccaguacaacaacuucuca

SEQ ID NO: 1393226 - RNA, 19 nt, Homo sapiens
cagaaaaggagaacaacuu

SEQ ID NO: 1393227 - RNA, 19 nt, Homo sapiens
ucguguggcugcuccuguu

SEQ ID NO: 1393228 - RNA, 19 nt, Homo sapiens
aaacugcucugaugggaaa

SEQ ID NO: 1393229 - RNA, 19 nt, Homo sapiens
gaaaauaaacagcccaaaa

SEQ ID NO: 1393230 - RNA, 19 nt, Homo sapiens
ggacuagccucagcuuugg

SEQ ID NO: 1393231 - RNA, 19 nt, Homo sapiens
ccgggaaacugcucugaug

SEQ ID NO: 1393232 - RNA, 19 nt, Homo sapiens
cggacuagccucagcuuug

SEQ ID NO: 1393233 - RNA, 19 nt, Homo sapiens
gcacuggcuacgaccugua

SEQ ID NO: 1393234 - RNA, 19 nt, Homo sapiens
caagccugaccguggauuu

SEQ ID NO: 1393235 - RNA, 19 nt, Homo sapiens
cccuggagaugcugcuuug

SEQ ID NO: 1393236 - RNA, 19 nt, Homo sapiens
gagggaguguagcucugau

SEQ ID NO: 1393237 - RNA, 19 nt, Homo sapiens
caacacaucugaucuaaag

SEQ ID NO: 1393238 - RNA, 19 nt, Homo sapiens
ugagauaccugguggauga

SEQ ID NO: 1393239 - RNA, 19 nt, Homo sapiens
gagcaaucauaccuuauaa

SEQ ID NO: 1393240 - RNA, 19 nt, Homo sapiens
ccacaaggccuuugagguu

SEQ ID NO: 1393241 - RNA, 19 nt, Homo sapiens
ggacuagagugagcaauca

SEQ ID NO: 1393242 - RNA, 19 nt, Homo sapiens
gcuggaggcugaugcaaau

SEQ ID NO: 1393243 - RNA, 19 nt, Homo sapiens
caacaaguuuggcgagauc

SEQ ID NO: 1393244 - RNA, 19 nt, Homo sapiens
gacaccaguuugccaauga

SEQ ID NO: 1393245 - RNA, 19 nt, Homo sapiens
ggaagcgggugaugaaggu

SEQ ID NO: 1393246 - RNA, 19 nt, Homo sapiens
ggaaccuccucccuaauuc

SEQ ID NO: 1393247 - RNA, 19 nt, Homo sapiens
aggaugugcugccuaagua

SEQ ID NO: 1393248 - RNA, 19 nt, Homo sapiens
ugagcaaucauaccuuaua

SEQ ID NO: 1393249 - RNA, 19 nt, Homo sapiens
agugagcaaucauaccuua

SEQ ID NO: 1393250 - RNA, 19 nt, Homo sapiens
gacuguggcugguauaucu

SEQ ID NO: 1393251 - RNA, 19 nt, Homo sapiens
gaugugcugccuaaguaua

SEQ ID NO: 1393252 - RNA, 19 nt, Homo sapiens
gcaacaaguuuggcgagau

SEQ ID NO: 1393253 - RNA, 19 nt, Homo sapiens
gagacugcccucagaaguu

SEQ ID NO: 1393254 - RNA, 19 nt, Homo sapiens
gcagugaccugguguuccu

SEQ ID NO: 1393255 - RNA, 19 nt, Homo sapiens
ggacguccgccucaagaug

SEQ ID NO: 1393256 - RNA, 19 nt, Homo sapiens
gggcuuuguuuuccuaaua

SEQ ID NO: 1393257 - RNA, 19 nt, Homo sapiens
ggauuaugcaguccacuug

SEQ ID NO: 1393258 - RNA, 19 nt, Homo sapiens
gcaacacaucugaucuaaa

SEQ ID NO: 1393259 - RNA, 19 nt, Homo sapiens
ccgaaagccugcauuacca

SEQ ID NO: 1393260 - RNA, 19 nt, Homo sapiens
gcuaccgccugcagcacua

SEQ ID NO: 1393261 - RNA, 19 nt, Homo sapiens
ggaggcgugucagcaguga

SEQ ID NO: 1393262 - RNA, 19 nt, Homo sapiens
cggaaccuccucccuaauu

SEQ ID NO: 1393263 - RNA, 19 nt, Homo sapiens
gccacauccucguaaguga

SEQ ID NO: 1393264 - RNA, 19 nt, Homo sapiens
cacuuggucuaccuuaauu

SEQ ID NO: 1393265 - RNA, 19 nt, Homo sapiens
agacugcccucagaaguuc

SEQ ID NO: 1393266 - RNA, 19 nt, Homo sapiens
ccuuugagguugugacugu

SEQ ID NO: 1393267 - RNA, 19 nt, Homo sapiens
ccacuuggucuaccuuaau

SEQ ID NO: 1393268 - RNA, 19 nt, Homo sapiens
uuugauagaacccuuguaa

SEQ ID NO: 1393269 - RNA, 19 nt, Homo sapiens
gauccgagaguaccagcaa

SEQ ID NO: 1393270 - RNA, 19 nt, Homo sapiens
aagcaacacaucugaucua

SEQ ID NO: 1393271 - RNA, 19 nt, Homo sapiens
gaagcaacacaucugaucu

SEQ ID NO: 1393272 - RNA, 19 nt, Homo sapiens
gaccugcugcuccucauug

SEQ ID NO: 1393273 - RNA, 19 nt, Homo sapiens
uuugugggcuccuaugaga

SEQ ID NO: 1393274 - RNA, 19 nt, Homo sapiens
cucggaaccuccucccuaa

SEQ ID NO: 1393275 - RNA, 19 nt, Homo sapiens
cuuggucuaccuuaauuua

SEQ ID NO: 1393276 - RNA, 19 nt, Homo sapiens
ugccuaaugucaccaagga

SEQ ID NO: 1393277 - RNA, 19 nt, Homo sapiens
gccaaacucagagauggua

SEQ ID NO: 1393278 - RNA, 19 nt, Homo sapiens
aagccugcauuaccacuug

SEQ ID NO: 1393279 - RNA, 19 nt, Homo sapiens
gccugcagcacuacuuuaa

SEQ ID NO: 1393280 - RNA, 19 nt, Homo sapiens
ccugccaguucuuuacauu

SEQ ID NO: 1393281 - RNA, 19 nt, Homo sapiens
aauuuaaccuguggccaaa

SEQ ID NO: 1393282 - RNA, 19 nt, Homo sapiens
agcaacacaucugaucuaa

SEQ ID NO: 1393283 - RNA, 19 nt, Homo sapiens
gcacccacagugacucaga

SEQ ID NO: 1393284 - RNA, 19 nt, Homo sapiens
ccuacccacugccuaaugu

SEQ ID NO: 1393285 - RNA, 19 nt, Homo sapiens
acccugagcgcaugaauga

SEQ ID NO: 1393286 - RNA, 19 nt, Homo sapiens
gaaccuccucccuaauucu

SEQ ID NO: 1393287 - RNA, 19 nt, Homo sapiens
ugaagcaacacaucugauc

SEQ ID NO: 1393288 - RNA, 19 nt, Homo sapiens
ccaaugaagcaacacaucu

SEQ ID NO: 1393289 - RNA, 19 nt, Homo sapiens
ccaagguggccugcucuaa

SEQ ID NO: 1393290 - RNA, 19 nt, Homo sapiens
caagguggccugcucuaac

SEQ ID NO: 1393291 - RNA, 19 nt, Homo sapiens
caaugaagcaacacaucug

SEQ ID NO: 1393292 - RNA, 19 nt, Homo sapiens
acaccaguuugccaaugaa

SEQ ID NO: 1393293 - RNA, 19 nt, Homo sapiens
agacaccaguuugccaaug

SEQ ID NO: 1393294 - RNA, 19 nt, Homo sapiens
gcuccagucucaaaauuuc

SEQ ID NO: 1393295 - RNA, 19 nt, Homo sapiens
ccaugugccucaggacuag

SEQ ID NO: 1393296 - RNA, 19 nt, Homo sapiens
cuacaccugccaguucuuu

SEQ ID NO: 1393297 - RNA, 19 nt, Homo sapiens
gcgggcugcugcucaugau

SEQ ID NO: 1393298 - RNA, 19 nt, Homo sapiens
ucaccaaggaggcguguca

SEQ ID NO: 1393299 - RNA, 19 nt, Homo sapiens
ccaccucacguccgauuuc

SEQ ID NO: 1393300 - RNA, 19 nt, Homo sapiens
uaagggcuuuguuuuccua

SEQ ID NO: 1393301 - RNA, 19 nt, Homo sapiens
gcugauguuugcggugauc

SEQ ID NO: 1393302 - RNA, 19 nt, Homo sapiens
acuagagugagcaaucaua

SEQ ID NO: 1393303 - RNA, 19 nt, Homo sapiens
aagguggccugcucuaacu

SEQ ID NO: 1393304 - RNA, 19 nt, Homo sapiens
ggaugugcugccuaaguau

SEQ ID NO: 1393305 - RNA, 19 nt, Homo sapiens
caggaugugcugccuaagu

SEQ ID NO: 1393306 - RNA, 19 nt, Homo sapiens
ggcuggaggcugaugcaaa

SEQ ID NO: 1393307 - RNA, 19 nt, Homo sapiens
gcaauuaccugccuuaguu

SEQ ID NO: 1393308 - RNA, 19 nt, Homo sapiens
gcucuaaacuggcggauua

SEQ ID NO: 1393309 - RNA, 19 nt, Homo sapiens
ggaaaggaauuggauauaa

SEQ ID NO: 1393310 - RNA, 19 nt, Homo sapiens
gcaaagacauaacaguauu

SEQ ID NO: 1393311 - RNA, 19 nt, Homo sapiens
gaaggaauguacccaugua

SEQ ID NO: 1393312 - RNA, 19 nt, Homo sapiens
gaagaacccucaagcaauc

SEQ ID NO: 1393313 - RNA, 19 nt, Homo sapiens
gcacagauaaauagaagua

SEQ ID NO: 1393314 - RNA, 19 nt, Homo sapiens
gagauaaccugcaaagaca

SEQ ID NO: 1393315 - RNA, 19 nt, Homo sapiens
ggaagaagauggugauggu

SEQ ID NO: 1393316 - RNA, 19 nt, Homo sapiens
caacauaucguaucagaug

SEQ ID NO: 1393317 - RNA, 19 nt, Homo sapiens
gaagaacaauacuuaccuu

SEQ ID NO: 1393318 - RNA, 19 nt, Homo sapiens
caugagugcugauguguuu

SEQ ID NO: 1393319 - RNA, 19 nt, Homo sapiens
gcucaaacuuggacaguga

SEQ ID NO: 1393320 - RNA, 19 nt, Homo sapiens
gacagcagaugaaggaauu

SEQ ID NO: 1393321 - RNA, 19 nt, Homo sapiens
gaagggcuacuguuaauug

SEQ ID NO: 1393322 - RNA, 19 nt, Homo sapiens
ccaguacuguuuaacuaua

SEQ ID NO: 1393323 - RNA, 19 nt, Homo sapiens
gaaaaugaauccccuguug

SEQ ID NO: 1393324 - RNA, 19 nt, Homo sapiens
caagcaaucucccaucuuc

SEQ ID NO: 1393325 - RNA, 19 nt, Homo sapiens
gaauagguauggugguuuc

SEQ ID NO: 1393326 - RNA, 19 nt, Homo sapiens
cgaauuguaucaguuguaa

SEQ ID NO: 1393327 - RNA, 19 nt, Homo sapiens
ucaaugauguccuuuaagu

SEQ ID NO: 1393328 - RNA, 19 nt, Homo sapiens
ccaaauaugccuccagauu

SEQ ID NO: 1393329 - RNA, 19 nt, Homo sapiens
aaaguuagcagaccaguuu

SEQ ID NO: 1393330 - RNA, 19 nt, Homo sapiens
gcagacauacaucauuuaa

SEQ ID NO: 1393331 - RNA, 19 nt, Homo sapiens
agaaacagaucgaccagaa

SEQ ID NO: 1393332 - RNA, 19 nt, Homo sapiens
gaaguacagugaggucuau

SEQ ID NO: 1393333 - RNA, 19 nt, Homo sapiens
ccaaguagcugggauuaca

SEQ ID NO: 1393334 - RNA, 19 nt, Homo sapiens
cagaagggcuacuguuaau

SEQ ID NO: 1393335 - RNA, 19 nt, Homo sapiens
cagcuaaucuuugcaucua

SEQ ID NO: 1393336 - RNA, 19 nt, Homo sapiens
ugaagagguuagaauauga

SEQ ID NO: 1393337 - RNA, 19 nt, Homo sapiens
caaaauaguuguacagguu

SEQ ID NO: 1393338 - RNA, 19 nt, Homo sapiens
gcuaaucuuugcaucuaaa

SEQ ID NO: 1393339 - RNA, 19 nt, Homo sapiens
cagcaacauuucuucaauu

SEQ ID NO: 1393340 - RNA, 19 nt, Homo sapiens
gggaagugauguacauuuc

SEQ ID NO: 1393341 - RNA, 19 nt, Homo sapiens
cuaaaggaaugcuucagaa

SEQ ID NO: 1393342 - RNA, 19 nt, Homo sapiens
gugaagagguuagaauaug

SEQ ID NO: 1393343 - RNA, 19 nt, Homo sapiens
gauggaaacucugcuuuua

SEQ ID NO: 1393344 - RNA, 19 nt, Homo sapiens
guaauaccaguacuguuua

SEQ ID NO: 1393345 - RNA, 19 nt, Homo sapiens
agucauaccuagaauaguu

SEQ ID NO: 1393346 - RNA, 19 nt, Homo sapiens
uuauugagccgacuuauuu

SEQ ID NO: 1393347 - RNA, 19 nt, Homo sapiens
ggacagagucagugauuuc

SEQ ID NO: 1393348 - RNA, 19 nt, Homo sapiens
ggucaggccuacaaugaau

SEQ ID NO: 1393349 - RNA, 19 nt, Homo sapiens
uaagcuagcuaauucuugu

SEQ ID NO: 1393350 - RNA, 19 nt, Homo sapiens
ugaaguuggugaagacauu

SEQ ID NO: 1393351 - RNA, 19 nt, Homo sapiens
caaccucucuccccaaaua

SEQ ID NO: 1393352 - RNA, 19 nt, Homo sapiens
uggcagacauacaucauuu

SEQ ID NO: 1393353 - RNA, 19 nt, Homo sapiens
ugaaaugaaucugcaauca

SEQ ID NO: 1393354 - RNA, 19 nt, Homo sapiens
gcugaggccugauggaaau

SEQ ID NO: 1393355 - RNA, 19 nt, Homo sapiens
gaacgagagcuucaaaugg

SEQ ID NO: 1393356 - RNA, 19 nt, Homo sapiens
cguccaagaugaugaagaa

SEQ ID NO: 1393357 - RNA, 19 nt, Homo sapiens
cugagaauguugcagauaa

SEQ ID NO: 1393358 - RNA, 19 nt, Homo sapiens
caacauuucuucaauuagc

SEQ ID NO: 1393359 - RNA, 19 nt, Homo sapiens
gaaauuguggaaugcauga

SEQ ID NO: 1393360 - RNA, 19 nt, Homo sapiens
aaauaugccuccagauuca

SEQ ID NO: 1393361 - RNA, 19 nt, Homo sapiens
caaauaugccuccagauuc

SEQ ID NO: 1393362 - RNA, 19 nt, Homo sapiens
uguguaagcuagcuaauuc

SEQ ID NO: 1393363 - RNA, 19 nt, Homo sapiens
uaccaguacuguuuaacua

SEQ ID NO: 1393364 - RNA, 19 nt, Homo sapiens
ucacuugguugguuguauu

SEQ ID NO: 1393365 - RNA, 19 nt, Homo sapiens
guagggagaugaaucaaaa

SEQ ID NO: 1393366 - RNA, 19 nt, Homo sapiens
gaaagucaccucccuacuc

SEQ ID NO: 1393367 - RNA, 19 nt, Homo sapiens
guaaagacgaauuguauca

SEQ ID NO: 1393368 - RNA, 19 nt, Homo sapiens
cuaaagugcuguaaaauga

SEQ ID NO: 1393369 - RNA, 19 nt, Homo sapiens
ggacagugaacccagaauu

SEQ ID NO: 1393370 - RNA, 19 nt, Homo sapiens
cagaaguacuaaauaagga

SEQ ID NO: 1393371 - RNA, 19 nt, Homo sapiens
aaaugaaucugcaaucagu

SEQ ID NO: 1393372 - RNA, 19 nt, Homo sapiens
gauaaccugcaaagacaua

SEQ ID NO: 1393373 - RNA, 19 nt, Homo sapiens
ccaguccucuucagcguuu

SEQ ID NO: 1393374 - RNA, 19 nt, Homo sapiens
aguaagaacagaacagaua

SEQ ID NO: 1393375 - RNA, 19 nt, Homo sapiens
uagcauaaccacaguaaga

SEQ ID NO: 1393376 - RNA, 19 nt, Homo sapiens
aggcugagcuggcuuacaa

SEQ ID NO: 1393377 - RNA, 19 nt, Homo sapiens
caaaugauggaaaggaauu

SEQ ID NO: 1393378 - RNA, 19 nt, Homo sapiens
agacuucuguuugaaauug

SEQ ID NO: 1393379 - RNA, 19 nt, Homo sapiens
gaaucugcaaucaguauuu

SEQ ID NO: 1393380 - RNA, 19 nt, Homo sapiens
aggaagacguccaagauga

SEQ ID NO: 1393381 - RNA, 19 nt, Homo sapiens
gaagagguuagaauaugaa

SEQ ID NO: 1393382 - RNA, 19 nt, Homo sapiens
ggagucauaccuagaauag

SEQ ID NO: 1393383 - RNA, 19 nt, Homo sapiens
aacgagagcuucaaaugga

SEQ ID NO: 1393384 - RNA, 19 nt, Homo sapiens
ccaagaugaugaagaacga

SEQ ID NO: 1393385 - RNA, 19 nt, Homo sapiens
acaaucaaguaguaccuaa

SEQ ID NO: 1393386 - RNA, 19 nt, Homo sapiens
ucaauuagcagucuagaca

SEQ ID NO: 1393387 - RNA, 19 nt, Homo sapiens
ucagaagggcuacuguuaa

SEQ ID NO: 1393388 - RNA, 19 nt, Homo sapiens
caaggagucauaccuagaa

SEQ ID NO: 1393389 - RNA, 19 nt, Homo sapiens
gagguuagaauaugaaagu

SEQ ID NO: 1393390 - RNA, 19 nt, Homo sapiens
auacuuaccuugugaagag

SEQ ID NO: 1393391 - RNA, 19 nt, Homo sapiens
aaagggaagugauguacau

SEQ ID NO: 1393392 - RNA, 19 nt, Homo sapiens
ucuuaagacuucuguuuga

SEQ ID NO: 1393393 - RNA, 19 nt, Homo sapiens
uuucaaagcuuuucuggua

SEQ ID NO: 1393394 - RNA, 19 nt, Homo sapiens
uaacguaggugaguaugag

SEQ ID NO: 1393395 - RNA, 19 nt, Homo sapiens
uaaagcaggcuaccaagga

SEQ ID NO: 1393396 - RNA, 19 nt, Homo sapiens
gcagaugaaggaauugaga

SEQ ID NO: 1393397 - RNA, 19 nt, Homo sapiens
gacuauaggaagaacaaua

SEQ ID NO: 1393398 - RNA, 19 nt, Homo sapiens
gcuauuacuuauacagcaa

SEQ ID NO: 1393399 - RNA, 19 nt, Homo sapiens
gaauguguaagcuagcuaa

SEQ ID NO: 1393400 - RNA, 19 nt, Homo sapiens
agaacaacauaucguauca

SEQ ID NO: 1393401 - RNA, 19 nt, Homo sapiens
gcucaaggagucauaccua

SEQ ID NO: 1393402 - RNA, 19 nt, Homo sapiens
uaaaggaaugcuucagaaa

SEQ ID NO: 1393403 - RNA, 19 nt, Homo sapiens
cuaaacuggcggauuauaa

SEQ ID NO: 1393404 - RNA, 19 nt, Homo sapiens
aagaccagcuucaggacua

SEQ ID NO: 1393405 - RNA, 19 nt, Homo sapiens
gcuuauauuugcuagacuu

SEQ ID NO: 1393406 - RNA, 19 nt, Homo sapiens
uagaauaguuacacacaag

SEQ ID NO: 1393407 - RNA, 19 nt, Homo sapiens
gggaugaaauacaugaaua

SEQ ID NO: 1393408 - RNA, 19 nt, Homo sapiens
ccaggagacugcuguguga

SEQ ID NO: 1393409 - RNA, 19 nt, Homo sapiens
acagcaagcucaccaaguu

SEQ ID NO: 1393410 - RNA, 19 nt, Homo sapiens
gagaggcucaggaaagaaa

SEQ ID NO: 1393411 - RNA, 19 nt, Homo sapiens
gaucuacaaugagcagguu

SEQ ID NO: 1393412 - RNA, 19 nt, Homo sapiens
gcagguccaugcacuagag

SEQ ID NO: 1393413 - RNA, 19 nt, Homo sapiens
ccaagucuccuguggcaaa

SEQ ID NO: 1393414 - RNA, 19 nt, Homo sapiens
ggucucagccgucgaagga

SEQ ID NO: 1393415 - RNA, 19 nt, Homo sapiens
agacugggcuccacacucu

SEQ ID NO: 1393416 - RNA, 19 nt, Homo sapiens
agagccagcugcagaauag

SEQ ID NO: 1393417 - RNA, 19 nt, Homo sapiens
gacccggacucugcaguuu

SEQ ID NO: 1393418 - RNA, 19 nt, Homo sapiens
gaaccuguacgggaugcua

SEQ ID NO: 1393419 - RNA, 19 nt, Homo sapiens
uacaggaguucaugcuaga

SEQ ID NO: 1393420 - RNA, 19 nt, Homo sapiens
caaagcagccccagcguuu

SEQ ID NO: 1393421 - RNA, 19 nt, Homo sapiens
gaccuucgccuggcuguug

SEQ ID NO: 1393422 - RNA, 19 nt, Homo sapiens
gccaagugcccaagagaga

SEQ ID NO: 1393423 - RNA, 19 nt, Homo sapiens
ggcaggcagugagaaggua

SEQ ID NO: 1393424 - RNA, 19 nt, Homo sapiens
ggacccggacucugcaguu

SEQ ID NO: 1393425 - RNA, 19 nt, Homo sapiens
gcccagugccuuccugaga

SEQ ID NO: 1393426 - RNA, 19 nt, Homo sapiens
ugccacaucugcccacugu

SEQ ID NO: 1393427 - RNA, 19 nt, Homo sapiens
gcuacaggaguucaugcua

SEQ ID NO: 1393428 - RNA, 19 nt, Homo sapiens
gcagagccacaucccuuuc

SEQ ID NO: 1393429 - RNA, 19 nt, Homo sapiens
guggggagcugaugcuuga

SEQ ID NO: 1393430 - RNA, 19 nt, Homo sapiens
ggaguucaugcuagagaau

SEQ ID NO: 1393431 - RNA, 19 nt, Homo sapiens
acaaggggauucaggagaa

SEQ ID NO: 1393432 - RNA, 19 nt, Homo sapiens
uacaucagccgucaaacug

SEQ ID NO: 1393433 - RNA, 19 nt, Homo sapiens
ugaauaaagagaggcauca

SEQ ID NO: 1393434 - RNA, 19 nt, Homo sapiens
gagaggcaucagcuccaaa

SEQ ID NO: 1393435 - RNA, 19 nt, Homo sapiens
aagagccagcugcagaaua

SEQ ID NO: 1393436 - RNA, 19 nt, Homo sapiens
agagaggcaucagcuccaa

SEQ ID NO: 1393437 - RNA, 19 nt, Homo sapiens
cagcaagcucaccaaguug

SEQ ID NO: 1393438 - RNA, 19 nt, Homo sapiens
caaaucagcuucagcaaac

SEQ ID NO: 1393439 - RNA, 19 nt, Homo sapiens
gaggaagaguguugccuuu

SEQ ID NO: 1393440 - RNA, 19 nt, Homo sapiens
caggacaucuuaacccuuu

SEQ ID NO: 1393441 - RNA, 19 nt, Homo sapiens
ggugaucacugugcacuuu

SEQ ID NO: 1393442 - RNA, 19 nt, Homo sapiens
ggugaucucuggaggaaga

SEQ ID NO: 1393443 - RNA, 19 nt, Homo sapiens
uaagggcagugcucucuuu

SEQ ID NO: 1393444 - RNA, 19 nt, Homo sapiens
ugaagagugccaaucauua

SEQ ID NO: 1393445 - RNA, 19 nt, Homo sapiens
ggaaacauuuagcccucua

SEQ ID NO: 1393446 - RNA, 19 nt, Homo sapiens
ugaaugugguaccugguua

SEQ ID NO: 1393447 - RNA, 19 nt, Homo sapiens
gggcagugcucucuuugga

SEQ ID NO: 1393448 - RNA, 19 nt, Homo sapiens
ggagcaaagugaacaccaa

SEQ ID NO: 1393449 - RNA, 19 nt, Homo sapiens
caucuuaacccuuuaugaa

SEQ ID NO: 1393450 - RNA, 19 nt, Homo sapiens
gcuguggccugugugaaua

SEQ ID NO: 1393451 - RNA, 19 nt, Homo sapiens
caucagccauuccuuaaca

SEQ ID NO: 1393452 - RNA, 19 nt, Homo sapiens
gaaguccaggaaacauuua

SEQ ID NO: 1393453 - RNA, 19 nt, Homo sapiens
cagccacucugaacuuuau

SEQ ID NO: 1393454 - RNA, 19 nt, Homo sapiens
gggcuaaacucuccaagcu

SEQ ID NO: 1393455 - RNA, 19 nt, Homo sapiens
ggaagaguguugccuuugc

SEQ ID NO: 1393456 - RNA, 19 nt, Homo sapiens
aaacuaaucggcuaugguu

SEQ ID NO: 1393457 - RNA, 19 nt, Homo sapiens
gaagagugccaaucauuac

SEQ ID NO: 1393458 - RNA, 19 nt, Homo sapiens
caucccggcuguucugauu

SEQ ID NO: 1393459 - RNA, 19 nt, Homo sapiens
gagaaguccaggaaacauu

SEQ ID NO: 1393460 - RNA, 19 nt, Homo sapiens
uaucacgccucucauguuc

SEQ ID NO: 1393461 - RNA, 19 nt, Homo sapiens
gcaagaggagcaaagugaa

SEQ ID NO: 1393462 - RNA, 19 nt, Homo sapiens
ggcaagaggagcaaaguga

SEQ ID NO: 1393463 - RNA, 19 nt, Homo sapiens
ccacccggcucuucacguu

SEQ ID NO: 1393464 - RNA, 19 nt, Homo sapiens
gagugccaaucauuacaaa

SEQ ID NO: 1393465 - RNA, 19 nt, Homo sapiens
ccagagaaguccaggaaac

SEQ ID NO: 1393466 - RNA, 19 nt, Homo sapiens
aagcaacucuugucuaagg

SEQ ID NO: 1393467 - RNA, 19 nt, Homo sapiens
cccugaagcuccugcagua

SEQ ID NO: 1393468 - RNA, 19 nt, Homo sapiens
ccacuggacccucuacaug

SEQ ID NO: 1393469 - RNA, 19 nt, Homo sapiens
cgacuucgguggccuucug

SEQ ID NO: 1393470 - RNA, 19 nt, Homo sapiens
gaagaguguugccuuugcu

SEQ ID NO: 1393471 - RNA, 19 nt, Homo sapiens
ggaaggagggagggaggua

SEQ ID NO: 1393472 - RNA, 19 nt, Homo sapiens
ggacgagguagucaagaga

SEQ ID NO: 1393473 - RNA, 19 nt, Homo sapiens
gaugguggucuuugccuuu

SEQ ID NO: 1393474 - RNA, 19 nt, Homo sapiens
gaaggagggagggagguaa

SEQ ID NO: 1393475 - RNA, 19 nt, Homo sapiens
ugcuauccaucacuuauaa

SEQ ID NO: 1393476 - RNA, 19 nt, Homo sapiens
gcaaagugaacaccaagca

SEQ ID NO: 1393477 - RNA, 19 nt, Homo sapiens
ggacaucuuaacccuuuau

SEQ ID NO: 1393478 - RNA, 19 nt, Homo sapiens
acaaaucagcuucagcaaa

SEQ ID NO: 1393479 - RNA, 19 nt, Homo sapiens
ugauagccaugacucucua

SEQ ID NO: 1393480 - RNA, 19 nt, Homo sapiens
acauuuagcccucuacuca

SEQ ID NO: 1393481 - RNA, 19 nt, Homo sapiens
gauccauuguccagcucua

SEQ ID NO: 1393482 - RNA, 19 nt, Homo sapiens
gcugaagagugccaaucau

SEQ ID NO: 1393483 - RNA, 19 nt, Homo sapiens
agucaucagccauuccuua

SEQ ID NO: 1393484 - RNA, 19 nt, Homo sapiens
cacgagggcuggcaucucu

SEQ ID NO: 1393485 - RNA, 19 nt, Homo sapiens
cuuaacccuuuaugaacua

SEQ ID NO: 1393486 - RNA, 19 nt, Homo sapiens
agaaguccaggaaacauuu

SEQ ID NO: 1393487 - RNA, 19 nt, Homo sapiens
gagcuuggagcgacagugu

SEQ ID NO: 1393488 - RNA, 19 nt, Homo sapiens
ccuucuggcugcuagcuuu

SEQ ID NO: 1393489 - RNA, 19 nt, Homo sapiens
gucaucagccauuccuuaa

SEQ ID NO: 1393490 - RNA, 19 nt, Homo sapiens
gaaucgauccuuggcuaug

SEQ ID NO: 1393491 - RNA, 19 nt, Homo sapiens
caaagugaacaccaagcaa

SEQ ID NO: 1393492 - RNA, 19 nt, Homo sapiens
ugccaaucauuacaaauca

SEQ ID NO: 1393493 - RNA, 19 nt, Homo sapiens
ugacccagccucugucuag

SEQ ID NO: 1393494 - RNA, 19 nt, Homo sapiens
ugaauagccuggccaugcu

SEQ ID NO: 1393495 - RNA, 19 nt, Homo sapiens
gugccaaucauuacaaauc

SEQ ID NO: 1393496 - RNA, 19 nt, Homo sapiens
ggaaucgauccuuggcuau

SEQ ID NO: 1393497 - RNA, 19 nt, Homo sapiens
gguggcagaggagcuauuu

SEQ ID NO: 1393498 - RNA, 19 nt, Homo sapiens
cgucaccaccgauccauug

SEQ ID NO: 1393499 - RNA, 19 nt, Homo sapiens
caacacguguagcagucau

SEQ ID NO: 1393500 - RNA, 19 nt, Homo sapiens
gcuggcaucucuccuucca

SEQ ID NO: 1393501 - RNA, 19 nt, Homo sapiens
acuggacccucuacaugaa

SEQ ID NO: 1393502 - RNA, 19 nt, Homo sapiens
ccucucauguucacaggau

SEQ ID NO: 1393503 - RNA, 19 nt, Homo sapiens
ugaagcuccugcaguacug

SEQ ID NO: 1393504 - RNA, 19 nt, Homo sapiens
ugcugggacuccaaacuaa

SEQ ID NO: 1393505 - RNA, 19 nt, Homo sapiens
cugcuuuggugagaccuua

SEQ ID NO: 1393506 - RNA, 19 nt, Homo sapiens
cugaagagugccaaucauu

SEQ ID NO: 1393507 - RNA, 19 nt, Homo sapiens
ggucuuccuggccaacuuu

SEQ ID NO: 1393508 - RNA, 19 nt, Homo sapiens
ccagccacucugaacuuua

SEQ ID NO: 1393509 - RNA, 19 nt, Homo sapiens
gccuuggccuugcugauag

SEQ ID NO: 1393510 - RNA, 19 nt, Homo sapiens
gcccacagcaggacaagca

SEQ ID NO: 1393511 - RNA, 19 nt, Homo sapiens
guagcagucaucagccauu

SEQ ID NO: 1393512 - RNA, 19 nt, Homo sapiens
cccagccacucugaacuuu

SEQ ID NO: 1393513 - RNA, 19 nt, Homo sapiens
gcagggugcucucuuuucu

SEQ ID NO: 1393514 - RNA, 19 nt, Homo sapiens
cacaggauauggguugcuu

SEQ ID NO: 1393515 - RNA, 19 nt, Homo sapiens
ccaaacuaaucggcuaugg

SEQ ID NO: 1393516 - RNA, 19 nt, Homo sapiens
cacuggacccucuacauga

SEQ ID NO: 1393517 - RNA, 19 nt, Homo sapiens
gugcugggucgcauccuuu

SEQ ID NO: 1393518 - RNA, 19 nt, Homo sapiens
caggaaguggagacccuua

SEQ ID NO: 1393519 - RNA, 19 nt, Homo sapiens
cugcugggacuccaaacua

SEQ ID NO: 1393520 - RNA, 19 nt, Homo sapiens
ucuacucacuggccaucuu

SEQ ID NO: 1393521 - RNA, 19 nt, Homo sapiens
ccggauggcccugcuagaa

SEQ ID NO: 1393522 - RNA, 19 nt, Homo sapiens
gaaugugguaccugguuag

SEQ ID NO: 1393523 - RNA, 19 nt, Homo sapiens
gcucaucccggcuguucug

SEQ ID NO: 1393524 - RNA, 19 nt, Homo sapiens
caaacuaaucggcuauggu

SEQ ID NO: 1393525 - RNA, 19 nt, Homo sapiens
ucuuaacccuuuaugaacu

SEQ ID NO: 1393526 - RNA, 19 nt, Homo sapiens
uagcagucaucagccauuc

SEQ ID NO: 1393527 - RNA, 19 nt, Homo sapiens
cagccucugucuaggaucu

SEQ ID NO: 1393528 - RNA, 19 nt, Homo sapiens
ccacucugaacuuuaugaa

SEQ ID NO: 1393529 - RNA, 19 nt, Homo sapiens
cagagaaguccaggaaaca

SEQ ID NO: 1393530 - RNA, 19 nt, Homo sapiens
uuggugaucucuggaggaa

SEQ ID NO: 1393531 - RNA, 19 nt, Homo sapiens
cugcuauccaucacuuaua

SEQ ID NO: 1393532 - RNA, 19 nt, Homo sapiens
ugauugggaugcuggaaaa

SEQ ID NO: 1393533 - RNA, 19 nt, Homo sapiens
caucuucaacucacucuac

SEQ ID NO: 1393534 - RNA, 19 nt, Homo sapiens
gcuuucugcuuuggugaga

SEQ ID NO: 1393535 - RNA, 19 nt, Homo sapiens
uaaaugcgccugugacuua

SEQ ID NO: 1393536 - RNA, 19 nt, Homo sapiens
ggacguggcucuuuauucg

SEQ ID NO: 1393537 - RNA, 19 nt, Homo sapiens
gaggaaaggccuugauguu

SEQ ID NO: 1393538 - RNA, 19 nt, Homo sapiens
uguaggacguggcucuuua

SEQ ID NO: 1393539 - RNA, 19 nt, Homo sapiens
gcaacgacauggguaagau

SEQ ID NO: 1393540 - RNA, 19 nt, Homo sapiens
uggguaagaugcugcaauu

SEQ ID NO: 1393541 - RNA, 19 nt, Homo sapiens
gcucuuuauucgugaguuu

SEQ ID NO: 1393542 - RNA, 19 nt, Homo sapiens
gauguuccagacaauaaua

SEQ ID NO: 1393543 - RNA, 19 nt, Homo sapiens
gaaaggccuugauguucca

SEQ ID NO: 1393544 - RNA, 19 nt, Homo sapiens
guaagaugcugcaauucgu

SEQ ID NO: 1393545 - RNA, 19 nt, Homo sapiens
ggaggaaaggccuugaugu

SEQ ID NO: 1393546 - RNA, 19 nt, Homo sapiens
ugagaucgccagccuguca

SEQ ID NO: 1393547 - RNA, 19 nt, Homo sapiens
gguaagaugcugcaauucg

SEQ ID NO: 1393548 - RNA, 19 nt, Homo sapiens
aaaugcgccugugacuuaa

SEQ ID NO: 1393549 - RNA, 19 nt, Homo sapiens
gggaggaaaggccuugaug

SEQ ID NO: 1393550 - RNA, 19 nt, Homo sapiens
uaccuccgcugaaccuaga

SEQ ID NO: 1393551 - RNA, 19 nt, Homo sapiens
gccuugauguuccagacaa

SEQ ID NO: 1393552 - RNA, 19 nt, Homo sapiens
gcgcugagcaagcaaaggu

SEQ ID NO: 1393553 - RNA, 19 nt, Homo sapiens
caacgacauggguaagaug

SEQ ID NO: 1393554 - RNA, 19 nt, Homo sapiens
ccagcaggagguuaucaaa

SEQ ID NO: 1393555 - RNA, 19 nt, Homo sapiens
guaggacguggcucuuuau

SEQ ID NO: 1393556 - RNA, 19 nt, Homo sapiens
guugggaacgguuguagga

SEQ ID NO: 1393557 - RNA, 19 nt, Homo sapiens
ccauuuaccuccgcugaac

SEQ ID NO: 1393558 - RNA, 19 nt, Homo sapiens
gcagauccagcaggagguu

SEQ ID NO: 1393559 - RNA, 19 nt, Homo sapiens
auaauaaaugcgccuguga

SEQ ID NO: 1393560 - RNA, 19 nt, Homo sapiens
aggaaaggccuugauguuc

SEQ ID NO: 1393561 - RNA, 19 nt, Homo sapiens
agaguuggcccucccuugu

SEQ ID NO: 1393562 - RNA, 19 nt, Homo sapiens
gaacagagacgccaguuua

SEQ ID NO: 1393563 - RNA, 19 nt, Homo sapiens
aaacauacauccuucagua

SEQ ID NO: 1393564 - RNA, 19 nt, Homo sapiens
gcagagcucucagaagaua

SEQ ID NO: 1393565 - RNA, 19 nt, Homo sapiens
cauaagcguuguauuguaa

SEQ ID NO: 1393566 - RNA, 19 nt, Homo sapiens
gaacugguuuaaauccuaa

SEQ ID NO: 1393567 - RNA, 19 nt, Homo sapiens
caaaucuguugucauguua

SEQ ID NO: 1393568 - RNA, 19 nt, Homo sapiens
ggaacugguuuaaauccua

SEQ ID NO: 1393569 - RNA, 19 nt, Homo sapiens
caacaguacucggucuaua

SEQ ID NO: 1393570 - RNA, 19 nt, Homo sapiens
ccaaaucuguugucauguu

SEQ ID NO: 1393571 - RNA, 19 nt, Homo sapiens
caaaguauggcaagaaauu

SEQ ID NO: 1393572 - RNA, 19 nt, Homo sapiens
guauaucacuuuccaguca

SEQ ID NO: 1393573 - RNA, 19 nt, Homo sapiens
gaaauugcuccuggaaaua

SEQ ID NO: 1393574 - RNA, 19 nt, Homo sapiens
ggagguagcaucuaaagga

SEQ ID NO: 1393575 - RNA, 19 nt, Homo sapiens
guacguccauuucauuaug

SEQ ID NO: 1393576 - RNA, 19 nt, Homo sapiens
gagcaaacuuaccuucaga

SEQ ID NO: 1393577 - RNA, 19 nt, Homo sapiens
gaaugguuaucgauuaaug

SEQ ID NO: 1393578 - RNA, 19 nt, Homo sapiens
gaacuguggcuauauugaa

SEQ ID NO: 1393579 - RNA, 19 nt, Homo sapiens
gagaauaggaugucugaug

SEQ ID NO: 1393580 - RNA, 19 nt, Homo sapiens
uuaaaggugucuacaaaga

SEQ ID NO: 1393581 - RNA, 19 nt, Homo sapiens
uagaggaagugaaagguuu

SEQ ID NO: 1393582 - RNA, 19 nt, Homo sapiens
gguuaucgauuaauggauu

SEQ ID NO: 1393583 - RNA, 19 nt, Homo sapiens
gugauaagcugugaguuug

SEQ ID NO: 1393584 - RNA, 19 nt, Homo sapiens
agaaauugcuccuggaaau

SEQ ID NO: 1393585 - RNA, 19 nt, Homo sapiens
aaaggugucuacaaagaaa

SEQ ID NO: 1393586 - RNA, 19 nt, Homo sapiens
gaaaccacaagaaauacua

SEQ ID NO: 1393587 - RNA, 19 nt, Homo sapiens
gagauuugcugccaggaau

SEQ ID NO: 1393588 - RNA, 19 nt, Homo sapiens
aauagcaacugguauauca

SEQ ID NO: 1393589 - RNA, 19 nt, Homo sapiens
ucauaagcguuguauugua

SEQ ID NO: 1393590 - RNA, 19 nt, Homo sapiens
gaaagcucuuggcaugaaa

SEQ ID NO: 1393591 - RNA, 19 nt, Homo sapiens
agauuuagcuuggaagaaa

SEQ ID NO: 1393592 - RNA, 19 nt, Homo sapiens
ucagaaggauggucucaau

SEQ ID NO: 1393593 - RNA, 19 nt, Homo sapiens
gagguagcaucuaaaggaa

SEQ ID NO: 1393594 - RNA, 19 nt, Homo sapiens
ugaaagcucuuggcaugaa

SEQ ID NO: 1393595 - RNA, 19 nt, Homo sapiens
gaaggaaacaagagaaagu

SEQ ID NO: 1393596 - RNA, 19 nt, Homo sapiens
caagggcuaguaaggauua

SEQ ID NO: 1393597 - RNA, 19 nt, Homo sapiens
caauggagcuccugagaac

SEQ ID NO: 1393598 - RNA, 19 nt, Homo sapiens
gcaagaaaaggaucuaaua

SEQ ID NO: 1393599 - RNA, 19 nt, Homo sapiens
uguuaaaggugucuacaaa

SEQ ID NO: 1393600 - RNA, 19 nt, Homo sapiens
gagcagaggacgacauguu

SEQ ID NO: 1393601 - RNA, 19 nt, Homo sapiens
gaugucugauguuguuaaa

SEQ ID NO: 1393602 - RNA, 19 nt, Homo sapiens
uaggaugucugauguuguu

SEQ ID NO: 1393603 - RNA, 19 nt, Homo sapiens
agaauaggaugucugaugu

SEQ ID NO: 1393604 - RNA, 19 nt, Homo sapiens
aauagaagauuccucuguu

SEQ ID NO: 1393605 - RNA, 19 nt, Homo sapiens
aaacaaaugcugcugcuau

SEQ ID NO: 1393606 - RNA, 19 nt, Homo sapiens
caacugguauaucacuuuc

SEQ ID NO: 1393607 - RNA, 19 nt, Homo sapiens
augcagagcucucagaaga

SEQ ID NO: 1393608 - RNA, 19 nt, Homo sapiens
gaugagggaaugagagaaa

SEQ ID NO: 1393609 - RNA, 19 nt, Homo sapiens
ggaaguucaucaagaaugc

SEQ ID NO: 1393610 - RNA, 19 nt, Homo sapiens
gcaacugguauaucacuuu

SEQ ID NO: 1393611 - RNA, 19 nt, Homo sapiens
cacaauagcaacugguaua

SEQ ID NO: 1393612 - RNA, 19 nt, Homo sapiens
ugaagaaugccaucucuga

SEQ ID NO: 1393613 - RNA, 19 nt, Homo sapiens
ugagaacuccguugagaaa

SEQ ID NO: 1393614 - RNA, 19 nt, Homo sapiens
gaagacgacgagaagauga

SEQ ID NO: 1393615 - RNA, 19 nt, Homo sapiens
ggacaguugaacagauaua

SEQ ID NO: 1393616 - RNA, 19 nt, Homo sapiens
agaaugccaucucugacua

SEQ ID NO: 1393617 - RNA, 19 nt, Homo sapiens
ccuggaaguucaucaagaa

SEQ ID NO: 1393618 - RNA, 19 nt, Homo sapiens
ggagcaaacuuaccuucag

SEQ ID NO: 1393619 - RNA, 19 nt, Homo sapiens
gaagccaaaucuguuguca

SEQ ID NO: 1393620 - RNA, 19 nt, Homo sapiens
cuacaggcauugaagaauc

SEQ ID NO: 1393621 - RNA, 19 nt, Homo sapiens
gaaauacuacaggcauuga

SEQ ID NO: 1393622 - RNA, 19 nt, Homo sapiens
guucagauuuagcuuggaa

SEQ ID NO: 1393623 - RNA, 19 nt, Homo sapiens
ccacccagaucaccaaagu

SEQ ID NO: 1393624 - RNA, 19 nt, Homo sapiens
aagcacaacucagcaagaa

SEQ ID NO: 1393625 - RNA, 19 nt, Homo sapiens
cagaugagcagacagaaug

SEQ ID NO: 1393626 - RNA, 19 nt, Homo sapiens
ggcaucaggagcaaacuua

SEQ ID NO: 1393627 - RNA, 19 nt, Homo sapiens
caaaugcugcugcuaugaa

SEQ ID NO: 1393628 - RNA, 19 nt, Homo sapiens
cuccaaauccuacaccuua

SEQ ID NO: 1393629 - RNA, 19 nt, Homo sapiens
ccaaagugauaagcuguga

SEQ ID NO: 1393630 - RNA, 19 nt, Homo sapiens
agccaaaucuguugucaug

SEQ ID NO: 1393631 - RNA, 19 nt, Homo sapiens
uauaggagaugagggaaug

SEQ ID NO: 1393632 - RNA, 19 nt, Homo sapiens
caaaggcuccaacaccaaa

SEQ ID NO: 1393633 - RNA, 19 nt, Homo sapiens
gagggaaccccgaaaguua

SEQ ID NO: 1393634 - RNA, 19 nt, Homo sapiens
gauggacaguugaacagau

SEQ ID NO: 1393635 - RNA, 19 nt, Homo sapiens
ggaagugaaagguuuguuc

SEQ ID NO: 1393636 - RNA, 19 nt, Homo sapiens
uuagagagauuccugaaac

SEQ ID NO: 1393637 - RNA, 19 nt, Homo sapiens
guaauggcaaagagcaaua

SEQ ID NO: 1393638 - RNA, 19 nt, Homo sapiens
uuaauucgccaggaucuua

SEQ ID NO: 1393639 - RNA, 19 nt, Homo sapiens
caacaccaauagaggaagu

SEQ ID NO: 1393640 - RNA, 19 nt, Homo sapiens
gagaugagggaaugagaga

SEQ ID NO: 1393641 - RNA, 19 nt, Homo sapiens
agagaaaguacguccauuu

SEQ ID NO: 1393642 - RNA, 19 nt, Homo sapiens
agacgccaguuuagccaua

SEQ ID NO: 1393643 - RNA, 19 nt, Homo sapiens
guuaaguuaugcugaagug

SEQ ID NO: 1393644 - RNA, 19 nt, Homo sapiens
gaaggauggucucaaucag

SEQ ID NO: 1393645 - RNA, 19 nt, Homo sapiens
gaaaacugccccaaaguga

SEQ ID NO: 1393646 - RNA, 19 nt, Homo sapiens
ggaacagagacgccaguuu

SEQ ID NO: 1393647 - RNA, 19 nt, Homo sapiens
ccugagaacuccguugaga

SEQ ID NO: 1393648 - RNA, 19 nt, Homo sapiens
uuucagggcaagccaauua

SEQ ID NO: 1393649 - RNA, 19 nt, Homo sapiens
agacacagaugcacaacag

SEQ ID NO: 1393650 - RNA, 19 nt, Homo sapiens
gauaagcugugaguuugca

SEQ ID NO: 1393651 - RNA, 19 nt, Homo sapiens
agucauaagcguuguauug

SEQ ID NO: 1393652 - RNA, 19 nt, Homo sapiens
gcucucagaagauauaugu

SEQ ID NO: 1393653 - RNA, 19 nt, Homo sapiens
ugccaucucugacuauaug

SEQ ID NO: 1393654 - RNA, 19 nt, Homo sapiens
uuuaaaugcuggaggauuc

SEQ ID NO: 1393655 - RNA, 19 nt, Homo sapiens
gcacaacucagcaagaaaa

SEQ ID NO: 1393656 - RNA, 19 nt, Homo sapiens
uaaaggugucuacaaagaa

SEQ ID NO: 1393657 - RNA, 19 nt, Homo sapiens
aauaggaugucugauguug

SEQ ID NO: 1393658 - RNA, 19 nt, Homo sapiens
caagaaauugcuccuggaa

SEQ ID NO: 1393659 - RNA, 19 nt, Homo sapiens
uauauaauccucaccaaca

SEQ ID NO: 1393660 - RNA, 19 nt, Homo sapiens
uauauggccuuguauugca

SEQ ID NO: 1393661 - RNA, 19 nt, Homo sapiens
aaguuuggcuugaagaaug

SEQ ID NO: 1393662 - RNA, 19 nt, Homo sapiens
ggagagagcuguaguuuua

SEQ ID NO: 1393663 - RNA, 19 nt, Homo sapiens
ggaaggauauuuguucauu

SEQ ID NO: 1393664 - RNA, 19 nt, Homo sapiens
gcacuuggauuacagaugu

SEQ ID NO: 1393665 - RNA, 19 nt, Homo sapiens
gagaagcccugccucauca

SEQ ID NO: 1393666 - RNA, 19 nt, Homo sapiens
gcccaggaauucaaguuua

SEQ ID NO: 1393667 - RNA, 19 nt, Homo sapiens
gaaaccuugucucuacuaa

SEQ ID NO: 1393668 - RNA, 19 nt, Homo sapiens
cgcaguagcuaccaagaua

SEQ ID NO: 1393669 - RNA, 19 nt, Homo sapiens
aaacagagccaaagacaga

SEQ ID NO: 1393670 - RNA, 19 nt, Homo sapiens
uaaagcgucuccucucuau

SEQ ID NO: 1393671 - RNA, 19 nt, Homo sapiens
ggugaaaccuugucucuac

SEQ ID NO: 1393672 - RNA, 19 nt, Homo sapiens
gcagcagaaucacuugaaa

SEQ ID NO: 1393673 - RNA, 19 nt, Homo sapiens
guaccuggcuggaaaucaa

SEQ ID NO: 1393674 - RNA, 19 nt, Homo sapiens
gaacaggaaggauauuugu

SEQ ID NO: 1393675 - RNA, 19 nt, Homo sapiens
gagaugaagcuaucaguau

SEQ ID NO: 1393676 - RNA, 19 nt, Homo sapiens
cagagcagcuggucuuuca

SEQ ID NO: 1393677 - RNA, 19 nt, Homo sapiens
gcugauaucuaccucaaca

SEQ ID NO: 1393678 - RNA, 19 nt, Homo sapiens
ggagaugaagcuaucagua

SEQ ID NO: 1393679 - RNA, 19 nt, Homo sapiens
acaacucccuggugacuaa

SEQ ID NO: 1393680 - RNA, 19 nt, Homo sapiens
guucauaccugagccauuc

SEQ ID NO: 1393681 - RNA, 19 nt, Homo sapiens
aacaugagcagcaacauua

SEQ ID NO: 1393682 - RNA, 19 nt, Homo sapiens
ccucuguccuuucugguua

SEQ ID NO: 1393683 - RNA, 19 nt, Homo sapiens
cugcaacccuggucuauau

SEQ ID NO: 1393684 - RNA, 19 nt, Homo sapiens
uagcagaacaggaaggaua

SEQ ID NO: 1393685 - RNA, 19 nt, Homo sapiens
gauaucuaccucaacauaa

SEQ ID NO: 1393686 - RNA, 19 nt, Homo sapiens
gcaaggcugucaacuacuc

SEQ ID NO: 1393687 - RNA, 19 nt, Homo sapiens
ggaauucaaguuuaacaug

SEQ ID NO: 1393688 - RNA, 19 nt, Homo sapiens
ccaacaaccuucuccuaca

SEQ ID NO: 1393689 - RNA, 19 nt, Homo sapiens
cccaagagcuggagaagca

SEQ ID NO: 1393690 - RNA, 19 nt, Homo sapiens
gaagaauggguaagacguu

SEQ ID NO: 1393691 - RNA, 19 nt, Homo sapiens
gaucauagaugcuuuucug

SEQ ID NO: 1393692 - RNA, 19 nt, Homo sapiens
gaaggacuacagaggcuuu

SEQ ID NO: 1393693 - RNA, 19 nt, Homo sapiens
uaacaugagcagcaacauu

SEQ ID NO: 1393694 - RNA, 19 nt, Homo sapiens
cccaggaauucaaguuuaa

SEQ ID NO: 1393695 - RNA, 19 nt, Homo sapiens
uaaagguggcuuggucuua

SEQ ID NO: 1393696 - RNA, 19 nt, Homo sapiens
aagcgucuccucucuauaa

SEQ ID NO: 1393697 - RNA, 19 nt, Homo sapiens
gagccaagaucgugcaacu

SEQ ID NO: 1393698 - RNA, 19 nt, Homo sapiens
ucagagcuaugaauaugug

SEQ ID NO: 1393699 - RNA, 19 nt, Homo sapiens
ccagggcaguggcaagauu

SEQ ID NO: 1393700 - RNA, 19 nt, Homo sapiens
ggagaagcccugccucauc

SEQ ID NO: 1393701 - RNA, 19 nt, Homo sapiens
ucccagaccugaacaagug

SEQ ID NO: 1393702 - RNA, 19 nt, Homo sapiens
gaaggcugcuggguucugu

SEQ ID NO: 1393703 - RNA, 19 nt, Homo sapiens
gcuaaagcgucuccucucu

SEQ ID NO: 1393704 - RNA, 19 nt, Homo sapiens
gcaccuggccuuucuguac

SEQ ID NO: 1393705 - RNA, 19 nt, Homo sapiens
acacucauauccuccaguu

SEQ ID NO: 1393706 - RNA, 19 nt, Homo sapiens
ugauaucuaccucaacaua

SEQ ID NO: 1393707 - RNA, 19 nt, Homo sapiens
gacccucccuuuccuguca

SEQ ID NO: 1393708 - RNA, 19 nt, Homo sapiens
caaagacagaaucauugua

SEQ ID NO: 1393709 - RNA, 19 nt, Homo sapiens
gaguuguucuccagcuaaa

SEQ ID NO: 1393710 - RNA, 19 nt, Homo sapiens
gcucuuggcgggaggauga

SEQ ID NO: 1393711 - RNA, 19 nt, Homo sapiens
gccaaagacagaaucauug

SEQ ID NO: 1393712 - RNA, 19 nt, Homo sapiens
ugaugaggcugauaucuac

SEQ ID NO: 1393713 - RNA, 19 nt, Homo sapiens
caggaaggauauuuguuca

SEQ ID NO: 1393714 - RNA, 19 nt, Homo sapiens
caaagacgcacuccagaag

SEQ ID NO: 1393715 - RNA, 19 nt, Homo sapiens
gcuucucucugguaacuug

SEQ ID NO: 1393716 - RNA, 19 nt, Homo sapiens
ccagugccaucuccaagga

SEQ ID NO: 1393717 - RNA, 19 nt, Homo sapiens
ccaaagacgcacuccagaa

SEQ ID NO: 1393718 - RNA, 19 nt, Homo sapiens
caaagcacuuggauuacag

SEQ ID NO: 1393719 - RNA, 19 nt, Homo sapiens
ccacccaucugauaguaag

SEQ ID NO: 1393720 - RNA, 19 nt, Homo sapiens
uauguggacugccgaggaa

SEQ ID NO: 1393721 - RNA, 19 nt, Homo sapiens
gagcagcuggucuuucaga

SEQ ID NO: 1393722 - RNA, 19 nt, Homo sapiens
acagcugggugcaguggua

SEQ ID NO: 1393723 - RNA, 19 nt, Homo sapiens
ccaaagacagaaucauugu

SEQ ID NO: 1393724 - RNA, 19 nt, Homo sapiens
aagaauggguaagacguuu

SEQ ID NO: 1393725 - RNA, 19 nt, Homo sapiens
caacaaccuucuccuacac

SEQ ID NO: 1393726 - RNA, 19 nt, Homo sapiens
gcaguugguggcucucauu

SEQ ID NO: 1393727 - RNA, 19 nt, Homo sapiens
gaugccagcuucgugacuu

SEQ ID NO: 1393728 - RNA, 19 nt, Homo sapiens
cgucuccucucuauaaagu

SEQ ID NO: 1393729 - RNA, 19 nt, Homo sapiens
cagaguuguucuccagcua

SEQ ID NO: 1393730 - RNA, 19 nt, Homo sapiens
caaaguccaccaugugcuu

SEQ ID NO: 1393731 - RNA, 19 nt, Homo sapiens
cuaccaagauacgggauga

SEQ ID NO: 1393732 - RNA, 19 nt, Homo sapiens
uaccucaacauaacgaaua

SEQ ID NO: 1393733 - RNA, 19 nt, Homo sapiens
gcuccuaguagaaauaguu

SEQ ID NO: 1393734 - RNA, 19 nt, Homo sapiens
agaugaagcuaucaguauc

SEQ ID NO: 1393735 - RNA, 19 nt, Homo sapiens
gaauguggagagagcugua

SEQ ID NO: 1393736 - RNA, 19 nt, Homo sapiens
guuccugugugccuuguga

SEQ ID NO: 1393737 - RNA, 19 nt, Homo sapiens
gcuggucuuucuugaggaa

SEQ ID NO: 1393738 - RNA, 19 nt, Homo sapiens
caagcgauccucccuucuu

SEQ ID NO: 1393739 - RNA, 19 nt, Homo sapiens
ggaaaucaaaguccaccau

SEQ ID NO: 1393740 - RNA, 19 nt, Homo sapiens
cagaacaggaaggauauuu

SEQ ID NO: 1393741 - RNA, 19 nt, Homo sapiens
aagcgauccucccuucuug

SEQ ID NO: 1393742 - RNA, 19 nt, Homo sapiens
aaaucaaaguccaccaugu

SEQ ID NO: 1393743 - RNA, 19 nt, Homo sapiens
ucuacccucugauaagaaa

SEQ ID NO: 1393744 - RNA, 19 nt, Homo sapiens
uuucauagcaggagccaaa

SEQ ID NO: 1393745 - RNA, 19 nt, Homo sapiens
ccuguaaucccaguacuuu

SEQ ID NO: 1393746 - RNA, 19 nt, Homo sapiens
ccagcccacucugcccuua

SEQ ID NO: 1393747 - RNA, 19 nt, Homo sapiens
ucuuaaacaucuccaaugg

SEQ ID NO: 1393748 - RNA, 19 nt, Homo sapiens
uguccuuucugguuauuga

SEQ ID NO: 1393749 - RNA, 19 nt, Homo sapiens
guggagagagcuguaguuu

SEQ ID NO: 1393750 - RNA, 19 nt, Homo sapiens
gugccuggcuggucuuucu

SEQ ID NO: 1393751 - RNA, 19 nt, Homo sapiens
ucauacacacacacucaua

SEQ ID NO: 1393752 - RNA, 19 nt, Homo sapiens
gcagcaacauuagcaagac

SEQ ID NO: 1393753 - RNA, 19 nt, Homo sapiens
aaagguggcuuggucuuac

SEQ ID NO: 1393754 - RNA, 19 nt, Homo sapiens
acaggaaggauauuuguuc

SEQ ID NO: 1393755 - RNA, 19 nt, Homo sapiens
ccacuggcuccuaguagaa

SEQ ID NO: 1393756 - RNA, 19 nt, Homo sapiens
gaaaaucugaccuggcauu

SEQ ID NO: 1393757 - RNA, 19 nt, Homo sapiens
cuaaagcgucuccucucua

SEQ ID NO: 1393758 - RNA, 19 nt, Homo sapiens
acucauauccuccaguuuc

SEQ ID NO: 1393759 - RNA, 19 nt, Homo sapiens
uuucuacccucugauaaga

SEQ ID NO: 1393760 - RNA, 19 nt, Homo sapiens
cuaggaagacagaguuguu

SEQ ID NO: 1393761 - RNA, 19 nt, Homo sapiens
gcacccugaccuguucaua

SEQ ID NO: 1393762 - RNA, 19 nt, Homo sapiens
gaagaaguauggaguuaaa

SEQ ID NO: 1393763 - RNA, 19 nt, Homo sapiens
agacagagccugaguaauu

SEQ ID NO: 1393764 - RNA, 19 nt, Homo sapiens
gcucagaucuccuuugcuu

SEQ ID NO: 1393765 - RNA, 19 nt, Homo sapiens
uggaagaccuccucaauga

SEQ ID NO: 1393766 - RNA, 19 nt, Homo sapiens
gaaguauucucucaaaugg

SEQ ID NO: 1393767 - RNA, 19 nt, Homo sapiens
gaagauggcaccuggaaau

SEQ ID NO: 1393768 - RNA, 19 nt, Homo sapiens
caucuuggcuuucggauuc

SEQ ID NO: 1393769 - RNA, 19 nt, Homo sapiens
ggaaguauucucucaaaug

SEQ ID NO: 1393770 - RNA, 19 nt, Homo sapiens
ggacuagaaggaagaagua

SEQ ID NO: 1393771 - RNA, 19 nt, Homo sapiens
ccauaaagcccacuaguug

SEQ ID NO: 1393772 - RNA, 19 nt, Homo sapiens
gacagagccugaguaauug

SEQ ID NO: 1393773 - RNA, 19 nt, Homo sapiens
gcugguaccugcccuccua

SEQ ID NO: 1393774 - RNA, 19 nt, Homo sapiens
ggacugauuugcagcaucu

SEQ ID NO: 1393775 - RNA, 19 nt, Homo sapiens
gauagaaucuugggcaucu

SEQ ID NO: 1393776 - RNA, 19 nt, Homo sapiens
gcaccuggccuucgucuau

SEQ ID NO: 1393777 - RNA, 19 nt, Homo sapiens
gaucugacaguccaucgua

SEQ ID NO: 1393778 - RNA, 19 nt, Homo sapiens
caaugucacugagauauca

SEQ ID NO: 1393779 - RNA, 19 nt, Homo sapiens
ggaagaaguauggaguuaa

SEQ ID NO: 1393780 - RNA, 19 nt, Homo sapiens
gcugcaggcugaucugaga

SEQ ID NO: 1393781 - RNA, 19 nt, Homo sapiens
aggaagaaguauggaguua

SEQ ID NO: 1393782 - RNA, 19 nt, Homo sapiens
acaagcagauaacgauaga

SEQ ID NO: 1393783 - RNA, 19 nt, Homo sapiens
cauccuuccuggcccauaa

SEQ ID NO: 1393784 - RNA, 19 nt, Homo sapiens
cuacaagacaagcagauaa

SEQ ID NO: 1393785 - RNA, 19 nt, Homo sapiens
gauggcaccuggaaaugca

SEQ ID NO: 1393786 - RNA, 19 nt, Homo sapiens
ucaaugggcucuggguaga

SEQ ID NO: 1393787 - RNA, 19 nt, Homo sapiens
cugaguaauugaaucauga

SEQ ID NO: 1393788 - RNA, 19 nt, Homo sapiens
ucagaucuccuuugcuuug

SEQ ID NO: 1393789 - RNA, 19 nt, Homo sapiens
cccacuaguuggagaguaa

SEQ ID NO: 1393790 - RNA, 19 nt, Homo sapiens
gagagacagagccugagua

SEQ ID NO: 1393791 - RNA, 19 nt, Homo sapiens
ccaacccucuugccucguu

SEQ ID NO: 1393792 - RNA, 19 nt, Homo sapiens
cuggaaguauucucucaaa

SEQ ID NO: 1393793 - RNA, 19 nt, Homo sapiens
caccuggccuucgucuaua

SEQ ID NO: 1393794 - RNA, 19 nt, Homo sapiens
ccacagcaucgcuuucuug

SEQ ID NO: 1393795 - RNA, 19 nt, Homo sapiens
ggaccucgucucccaucua

SEQ ID NO: 1393796 - RNA, 19 nt, Homo sapiens
gggaagauggcaccuggaa

SEQ ID NO: 1393797 - RNA, 19 nt, Homo sapiens
agagacagagccugaguaa

SEQ ID NO: 1393798 - RNA, 19 nt, Homo sapiens
ccuacuaccucaccaccuu

SEQ ID NO: 1393799 - RNA, 19 nt, Homo sapiens
gcuccugggugaccaucaa

SEQ ID NO: 1393800 - RNA, 19 nt, Homo sapiens
gaaagucauuuggcuucuc

SEQ ID NO: 1393801 - RNA, 19 nt, Homo sapiens
ggaaagucauuuggcuucu

SEQ ID NO: 1393802 - RNA, 19 nt, Homo sapiens
ggaagauggcaccuggaaa

SEQ ID NO: 1393803 - RNA, 19 nt, Homo sapiens
gagccugaguaauugaauc

SEQ ID NO: 1393804 - RNA, 19 nt, Homo sapiens
auaaaggcauucccugcuu

SEQ ID NO: 1393805 - RNA, 19 nt, Homo sapiens
gaccucgucucccaucuac

SEQ ID NO: 1393806 - RNA, 19 nt, Homo sapiens
ggaggcaacagaggugauu

SEQ ID NO: 1393807 - RNA, 19 nt, Homo sapiens
cagcucagaucuccuuugc

SEQ ID NO: 1393808 - RNA, 19 nt, Homo sapiens
cagaggugauuguuauuuu

SEQ ID NO: 1393809 - RNA, 19 nt, Homo sapiens
gaagcagggagagaugauu

SEQ ID NO: 1393810 - RNA, 19 nt, Homo sapiens
cagaggggcuucuacaaga

SEQ ID NO: 1393811 - RNA, 19 nt, Homo sapiens
gcaggaacagagagacaga

SEQ ID NO: 1393812 - RNA, 19 nt, Homo sapiens
ggcauucccugcuuuuaaa

SEQ ID NO: 1393813 - RNA, 19 nt, Homo sapiens
cucaagagaggacugauuu

SEQ ID NO: 1393814 - RNA, 19 nt, Homo sapiens
ccagcugccuuuccgaagu

SEQ ID NO: 1393815 - RNA, 19 nt, Homo sapiens
caagacaagcagauaacga

SEQ ID NO: 1393816 - RNA, 19 nt, Homo sapiens
gaccagcucagaucuccuu

SEQ ID NO: 1393817 - RNA, 19 nt, Homo sapiens
ccugaguaauugaaucaug

SEQ ID NO: 1393818 - RNA, 19 nt, Homo sapiens
agaaguauggaguuaaaga

SEQ ID NO: 1393819 - RNA, 19 nt, Homo sapiens
ugacaucgcacagggaguu

SEQ ID NO: 1393820 - RNA, 19 nt, Homo sapiens
gcuuucggauucucagugu

SEQ ID NO: 1393821 - RNA, 19 nt, Homo sapiens
gacaagcagauaacgauag

SEQ ID NO: 1393822 - RNA, 19 nt, Homo sapiens
agacaagcagauaacgaua

SEQ ID NO: 1393823 - RNA, 19 nt, Homo sapiens
ugacaguccaucguaguaa

SEQ ID NO: 1393824 - RNA, 19 nt, Homo sapiens
cagaucuccuuugcuuuga

SEQ ID NO: 1393825 - RNA, 19 nt, Homo sapiens
guuggcgugucucuacaaa

SEQ ID NO: 1393826 - RNA, 19 nt, Homo sapiens
ccucguuggucuccauguu

SEQ ID NO: 1393827 - RNA, 19 nt, Homo sapiens
gcgggaagagaaugacuug

SEQ ID NO: 1393828 - RNA, 19 nt, Homo sapiens
guggaagaccuccucaaug

SEQ ID NO: 1393829 - RNA, 19 nt, Homo sapiens
ggaauggaagcacccuugu

SEQ ID NO: 1393830 - RNA, 19 nt, Homo sapiens
cagcugccuuuccgaagug

SEQ ID NO: 1393831 - RNA, 19 nt, Homo sapiens
cuacaaaacgugaagauug

SEQ ID NO: 1393832 - RNA, 19 nt, Homo sapiens
cuaccucaccaccuucuuu

SEQ ID NO: 1393833 - RNA, 19 nt, Homo sapiens
acagaggugauuguuauuu

SEQ ID NO: 1393834 - RNA, 19 nt, Homo sapiens
aagcagggagagaugauuu

SEQ ID NO: 1393835 - RNA, 19 nt, Homo sapiens
ggaagcagggagagaugau

SEQ ID NO: 1393836 - RNA, 19 nt, Homo sapiens
gaaguauggaguuaaagac

SEQ ID NO: 1393837 - RNA, 19 nt, Homo sapiens
gcacggaggcaaaaggaaa

SEQ ID NO: 1393838 - RNA, 19 nt, Homo sapiens
gugaagauuggcccaguug

SEQ ID NO: 1393839 - RNA, 19 nt, Homo sapiens
aagcagauaacgauagaau

SEQ ID NO: 1393840 - RNA, 19 nt, Homo sapiens
cgccauggccuuccugaug

SEQ ID NO: 1393841 - RNA, 19 nt, Homo sapiens
aaagucauuuggcuucucu

SEQ ID NO: 1393842 - RNA, 19 nt, Homo sapiens
ggucugcgucuucggaaug

SEQ ID NO: 1393843 - RNA, 19 nt, Homo sapiens
gacaguccaucguaguaac

SEQ ID NO: 1393844 - RNA, 19 nt, Homo sapiens
ucauccagcuggccaacau

SEQ ID NO: 1393845 - RNA, 19 nt, Homo sapiens
ccucgucucccaucuacaa

SEQ ID NO: 1393846 - RNA, 19 nt, Homo sapiens
cagcguaccaagcccugua

SEQ ID NO: 1393847 - RNA, 19 nt, Homo sapiens
ggaaccgucaccugcauca

SEQ ID NO: 1393848 - RNA, 19 nt, Homo sapiens
ucacccugcuccaucacuu

SEQ ID NO: 1393849 - RNA, 19 nt, Homo sapiens
cuagaaggaagaaguaugg

SEQ ID NO: 1393850 - RNA, 19 nt, Homo sapiens
ugugugaccuugggaaagu

SEQ ID NO: 1393851 - RNA, 19 nt, Homo sapiens
gaucuccuuugcuuugacu

SEQ ID NO: 1393852 - RNA, 19 nt, Homo sapiens
cgugaagauuggcccaguu

SEQ ID NO: 1393853 - RNA, 19 nt, Homo sapiens
ggucuucuuccuccuccua

SEQ ID NO: 1393854 - RNA, 19 nt, Homo sapiens
gauaucagacagcguacca

SEQ ID NO: 1393855 - RNA, 19 nt, Homo sapiens
ccaguuggcgugucucuac

SEQ ID NO: 1393856 - RNA, 19 nt, Homo sapiens
cagaggauccaguccagau

SEQ ID NO: 1393857 - RNA, 19 nt, Homo sapiens
ucccugagccucugaaagu

SEQ ID NO: 1393858 - RNA, 19 nt, Homo sapiens
cccauaaagcccacuaguu

SEQ ID NO: 1393859 - RNA, 19 nt, Homo sapiens
gcaguggggauuccaguaa

SEQ ID NO: 1393860 - RNA, 19 nt, Homo sapiens
ccagagaggccaggucaca

SEQ ID NO: 1393861 - RNA, 19 nt, Homo sapiens
gaauggaagcacccuuguc

SEQ ID NO: 1393862 - RNA, 19 nt, Homo sapiens
ccaacucucugauauuaua

SEQ ID NO: 1393863 - RNA, 19 nt, Homo sapiens
acaagaagcugagaaacua

SEQ ID NO: 1393864 - RNA, 19 nt, Homo sapiens
gcaaacuguucucaugaaa

SEQ ID NO: 1393865 - RNA, 19 nt, Homo sapiens
gcagagaaagugaaacuga

SEQ ID NO: 1393866 - RNA, 19 nt, Homo sapiens
uacaauaugugguuucuug

SEQ ID NO: 1393867 - RNA, 19 nt, Homo sapiens
aaacugaucagacgaacua

SEQ ID NO: 1393868 - RNA, 19 nt, Homo sapiens
uuccaacucucugauauua

SEQ ID NO: 1393869 - RNA, 19 nt, Homo sapiens
gauauaccacaguuuguuu

SEQ ID NO: 1393870 - RNA, 19 nt, Homo sapiens
cguuauaugucuagauuug

SEQ ID NO: 1393871 - RNA, 19 nt, Homo sapiens
cacguuauaugucuagauu

SEQ ID NO: 1393872 - RNA, 19 nt, Homo sapiens
cgacaguccugcauguguu

SEQ ID NO: 1393873 - RNA, 19 nt, Homo sapiens
gggccuguguuaaaucaaa

SEQ ID NO: 1393874 - RNA, 19 nt, Homo sapiens
gagaauauaaggagaugga

SEQ ID NO: 1393875 - RNA, 19 nt, Homo sapiens
ucuggacacuucauauaaa

SEQ ID NO: 1393876 - RNA, 19 nt, Homo sapiens
ccacuaauccacguuauau

SEQ ID NO: 1393877 - RNA, 19 nt, Homo sapiens
gaaucugaaugcaaagaca

SEQ ID NO: 1393878 - RNA, 19 nt, Homo sapiens
caaccacuaauccacguua

SEQ ID NO: 1393879 - RNA, 19 nt, Homo sapiens
ggauauaccacaguuuguu

SEQ ID NO: 1393880 - RNA, 19 nt, Homo sapiens
guucauccauguuguagca

SEQ ID NO: 1393881 - RNA, 19 nt, Homo sapiens
cagagaaagugaaacugau

SEQ ID NO: 1393882 - RNA, 19 nt, Homo sapiens
caugugggccuguguuaaa

SEQ ID NO: 1393883 - RNA, 19 nt, Homo sapiens
gaacaaagaaaggaaucau

SEQ ID NO: 1393884 - RNA, 19 nt, Homo sapiens
gcugaauaauacugcauug

SEQ ID NO: 1393885 - RNA, 19 nt, Homo sapiens
gaaagugaaacugaucaga

SEQ ID NO: 1393886 - RNA, 19 nt, Homo sapiens
ccuauucacucuaccuaau

SEQ ID NO: 1393887 - RNA, 19 nt, Homo sapiens
ggagggauccaugguauuc

SEQ ID NO: 1393888 - RNA, 19 nt, Homo sapiens
ggacacuucauauaaaugg

SEQ ID NO: 1393889 - RNA, 19 nt, Homo sapiens
uaucaucacugccuauucg

SEQ ID NO: 1393890 - RNA, 19 nt, Homo sapiens
gacacaagaagcugagaaa

SEQ ID NO: 1393891 - RNA, 19 nt, Homo sapiens
ccuguuaccuccaguacga

SEQ ID NO: 1393892 - RNA, 19 nt, Homo sapiens
uuucagaguucauccaugu

SEQ ID NO: 1393893 - RNA, 19 nt, Homo sapiens
guuguagcauguaucaguu

SEQ ID NO: 1393894 - RNA, 19 nt, Homo sapiens
acaaagaaaggaaucaugu

SEQ ID NO: 1393895 - RNA, 19 nt, Homo sapiens
gagcagagaaagugaaacu

SEQ ID NO: 1393896 - RNA, 19 nt, Homo sapiens
cacaguuuguuuacucauu

SEQ ID NO: 1393897 - RNA, 19 nt, Homo sapiens
gaagcagccgugacaagug

SEQ ID NO: 1393898 - RNA, 19 nt, Homo sapiens
aaacuguucucaugaaagc

SEQ ID NO: 1393899 - RNA, 19 nt, Homo sapiens
cagcaaacuguucucauga

SEQ ID NO: 1393900 - RNA, 19 nt, Homo sapiens
uaaaugcuacugcugugaa

SEQ ID NO: 1393901 - RNA, 19 nt, Homo sapiens
gcaggauguuggcgaacug

SEQ ID NO: 1393902 - RNA, 19 nt, Homo sapiens
ccggagggauccaugguau

SEQ ID NO: 1393903 - RNA, 19 nt, Homo sapiens
gagguuauccacaggaaca

SEQ ID NO: 1393904 - RNA, 19 nt, Homo sapiens
ccaccaaccggcaauugaa

SEQ ID NO: 1393905 - RNA, 19 nt, Homo sapiens
aauaugugguuucuugugu

SEQ ID NO: 1393906 - RNA, 19 nt, Homo sapiens
gagaaagugaaacugauca

SEQ ID NO: 1393907 - RNA, 19 nt, Homo sapiens
caaagaaaggaaucaugug

SEQ ID NO: 1393908 - RNA, 19 nt, Homo sapiens
agccugaaauuaccuuuau

SEQ ID NO: 1393909 - RNA, 19 nt, Homo sapiens
aaaugcuacugcugugaaa

SEQ ID NO: 1393910 - RNA, 19 nt, Homo sapiens
uaaauaugaagggcuguaa

SEQ ID NO: 1393911 - RNA, 19 nt, Homo sapiens
guuuccaacucucugauau

SEQ ID NO: 1393912 - RNA, 19 nt, Homo sapiens
cuucuggacacuucauaua

SEQ ID NO: 1393913 - RNA, 19 nt, Homo sapiens
agcggaaucugaaugcaaa

SEQ ID NO: 1393914 - RNA, 19 nt, Homo sapiens
cagccugaaauuaccuuua

SEQ ID NO: 1393915 - RNA, 19 nt, Homo sapiens
guaguguccugugcgucua

SEQ ID NO: 1393916 - RNA, 19 nt, Homo sapiens
caagaaaacgacacaagaa

SEQ ID NO: 1393917 - RNA, 19 nt, Homo sapiens
ucagaguucauccauguug

SEQ ID NO: 1393918 - RNA, 19 nt, Homo sapiens
gauguuggcgaacugacaa

SEQ ID NO: 1393919 - RNA, 19 nt, Homo sapiens
gauguuggaggccgaagga

SEQ ID NO: 1393920 - RNA, 19 nt, Homo sapiens
gccugaaauuaccuuuauu

SEQ ID NO: 1393921 - RNA, 19 nt, Homo sapiens
gaaccaccaaccggcaauu

SEQ ID NO: 1393922 - RNA, 19 nt, Homo sapiens
gaaugcaaagacagaacaa

SEQ ID NO: 1393923 - RNA, 19 nt, Homo sapiens
uaccacaguuuguuuacuc

SEQ ID NO: 1393924 - RNA, 19 nt, Homo sapiens
cuggacacuucauauaaau

SEQ ID NO: 1393925 - RNA, 19 nt, Homo sapiens
gugggccuguguuaaauca

SEQ ID NO: 1393926 - RNA, 19 nt, Homo sapiens
agcaaacuguucucaugaa

SEQ ID NO: 1393927 - RNA, 19 nt, Homo sapiens
guuggaggccgaaggaaug

SEQ ID NO: 1393928 - RNA, 19 nt, Homo sapiens
ggacagaucaagaaaacga

SEQ ID NO: 1393929 - RNA, 19 nt, Homo sapiens
gccaugagccagcggaauc

SEQ ID NO: 1393930 - RNA, 19 nt, Homo sapiens
cagagcagagaaagugaaa

SEQ ID NO: 1393931 - RNA, 19 nt, Homo sapiens
guugaugccaccuguaugu

SEQ ID NO: 1393932 - RNA, 19 nt, Homo sapiens
aauagcugaccgacaguua

SEQ ID NO: 1393933 - RNA, 19 nt, Homo sapiens
auaaggagauggacaaacc

SEQ ID NO: 1393934 - RNA, 19 nt, Homo sapiens
cggagaauauaaggagaug

SEQ ID NO: 1393935 - RNA, 19 nt, Homo sapiens
cagaguucauccauguugu

SEQ ID NO: 1393936 - RNA, 19 nt, Homo sapiens
cgacacaagaagcugagaa

SEQ ID NO: 1393937 - RNA, 19 nt, Homo sapiens
aauauaaggagauggacaa

SEQ ID NO: 1393938 - RNA, 19 nt, Homo sapiens
gugaaacugaucagacgaa

SEQ ID NO: 1393939 - RNA, 19 nt, Homo sapiens
caauaugugguuucuugug

SEQ ID NO: 1393940 - RNA, 19 nt, Homo sapiens
uaauccacguuauaugucu

SEQ ID NO: 1393941 - RNA, 19 nt, Homo sapiens
acuaauccacguuauaugu

SEQ ID NO: 1393942 - RNA, 19 nt, Homo sapiens
gcgacaguccugcaugugu

SEQ ID NO: 1393943 - RNA, 19 nt, Homo sapiens
ccgcgacaguccugcaugu

SEQ ID NO: 1393944 - RNA, 19 nt, Homo sapiens
ccugaaauuaccuuuauuc

SEQ ID NO: 1393945 - RNA, 19 nt, Homo sapiens
ugucuagauuugccucuuc

SEQ ID NO: 1393946 - RNA, 19 nt, Homo sapiens
cugcacagccugaaauuac

SEQ ID NO: 1393947 - RNA, 19 nt, Homo sapiens
cacaagaagcugagaaacu

SEQ ID NO: 1393948 - RNA, 19 nt, Homo sapiens
gcauucgucguccuucguu

SEQ ID NO: 1393949 - RNA, 19 nt, Homo sapiens
caccaaccggcaauugaaa

SEQ ID NO: 1393950 - RNA, 19 nt, Homo sapiens
gaggaggcugccacaguga

SEQ ID NO: 1393951 - RNA, 19 nt, Homo sapiens
agaguucauccauguugua

SEQ ID NO: 1393952 - RNA, 19 nt, Homo sapiens
ugaagcagccgugacaagu

SEQ ID NO: 1393953 - RNA, 19 nt, Homo sapiens
aaauaugaagggcuguaaa

SEQ ID NO: 1393954 - RNA, 19 nt, Homo sapiens
ggccuguguuaaaucaaau

SEQ ID NO: 1393955 - RNA, 19 nt, Homo sapiens
acucauuaguucauagaca

SEQ ID NO: 1393956 - RNA, 19 nt, Homo sapiens
gacacuucauauaaaugga

SEQ ID NO: 1393957 - RNA, 19 nt, Homo sapiens
ccagagcagagaaagugaa

SEQ ID NO: 1393958 - RNA, 19 nt, Homo sapiens
cagcggaaucugaaugcaa

SEQ ID NO: 1393959 - RNA, 19 nt, Homo sapiens
caaacuguucucaugaaag

SEQ ID NO: 1393960 - RNA, 19 nt, Homo sapiens
agggauccaugguauucaa

SEQ ID NO: 1393961 - RNA, 19 nt, Homo sapiens
ggggacagaucaagaaaac

SEQ ID NO: 1393962 - RNA, 19 nt, Homo sapiens
aaagagcacuugaauguug

SEQ ID NO: 1393963 - RNA, 19 nt, Homo sapiens
gaaaagagcacuugaaugu

SEQ ID NO: 1393964 - RNA, 19 nt, Homo sapiens
gaagggacuggcuguguua

SEQ ID NO: 1393965 - RNA, 19 nt, Homo sapiens
gggaugcaguuauuaaaug

SEQ ID NO: 1393966 - RNA, 19 nt, Homo sapiens
guucuucucuccuaaguug

SEQ ID NO: 1393967 - RNA, 19 nt, Homo sapiens
gaauguugguacucuaugu

SEQ ID NO: 1393968 - RNA, 19 nt, Homo sapiens
caagggaugcaguuauuaa

SEQ ID NO: 1393969 - RNA, 19 nt, Homo sapiens
gcaagggaugcaguuauua

SEQ ID NO: 1393970 - RNA, 19 nt, Homo sapiens
gggacuggcuguguuauuc

SEQ ID NO: 1393971 - RNA, 19 nt, Homo sapiens
gcacuugaauguugguacu

SEQ ID NO: 1393972 - RNA, 19 nt, Homo sapiens
uugcaguucuugucaauga

SEQ ID NO: 1393973 - RNA, 19 nt, Homo sapiens
gaagaccguuuuguacuaa

SEQ ID NO: 1393974 - RNA, 19 nt, Homo sapiens
agaagggacuggcuguguu

SEQ ID NO: 1393975 - RNA, 19 nt, Homo sapiens
gcuguguuauucugcauau

SEQ ID NO: 1393976 - RNA, 19 nt, Homo sapiens
ugaagcaacugaagaaaau

SEQ ID NO: 1393977 - RNA, 19 nt, Homo sapiens
ggaugcaguuauuaaaugc

SEQ ID NO: 1393978 - RNA, 19 nt, Homo sapiens
ccucaucccuuaguuucaa

SEQ ID NO: 1393979 - RNA, 19 nt, Homo sapiens
gaccugguauagccuguca

SEQ ID NO: 1393980 - RNA, 19 nt, Homo sapiens
aggaacaacugacgugaca

SEQ ID NO: 1393981 - RNA, 19 nt, Homo sapiens
ugaagaccguuuuguacua

SEQ ID NO: 1393982 - RNA, 19 nt, Homo sapiens
caugcuugauuaaaccauu

SEQ ID NO: 1393983 - RNA, 19 nt, Homo sapiens
gcugcucuuugguggcaua

SEQ ID NO: 1393984 - RNA, 19 nt, Homo sapiens
guuagccaguacaugcuuu

SEQ ID NO: 1393985 - RNA, 19 nt, Homo sapiens
ccugguauagccugucaua

SEQ ID NO: 1393986 - RNA, 19 nt, Homo sapiens
gcauauugcaguucuuguc

SEQ ID NO: 1393987 - RNA, 19 nt, Homo sapiens
guuugaagcaacaagauug

SEQ ID NO: 1393988 - RNA, 19 nt, Homo sapiens
aaucagaaacuuguggaaa

SEQ ID NO: 1393989 - RNA, 19 nt, Homo sapiens
gcaguuauuaaaugcuguu

SEQ ID NO: 1393990 - RNA, 19 nt, Homo sapiens
ggaccugugaagcaacuga

SEQ ID NO: 1393991 - RNA, 19 nt, Homo sapiens
uguguuauucugcauauug

SEQ ID NO: 1393992 - RNA, 19 nt, Homo sapiens
guacuaagucucauuuugu

SEQ ID NO: 1393993 - RNA, 19 nt, Homo sapiens
aaugggaccugugaagcaa

SEQ ID NO: 1393994 - RNA, 19 nt, Homo sapiens
uuucauauuuacccugugu

SEQ ID NO: 1393995 - RNA, 19 nt, Homo sapiens
cuacaugcuugauuaaacc

SEQ ID NO: 1393996 - RNA, 19 nt, Homo sapiens
cauauugcaguucuuguca

SEQ ID NO: 1393997 - RNA, 19 nt, Homo sapiens
gaagaaaauguuugaagca

SEQ ID NO: 1393998 - RNA, 19 nt, Homo sapiens
ggaaaagagcacuugaaug

SEQ ID NO: 1393999 - RNA, 19 nt, Homo sapiens
uaaugggaccugugaagca

SEQ ID NO: 1394000 - RNA, 19 nt, Homo sapiens
ggacuggcuguguuauucu

SEQ ID NO: 1394001 - RNA, 19 nt, Homo sapiens
ccugugugcugcucuuugg

SEQ ID NO: 1394002 - RNA, 19 nt, Homo sapiens
acuacaugcuugauuaaac

SEQ ID NO: 1394003 - RNA, 19 nt, Homo sapiens
augcuguucuucucuccua

SEQ ID NO: 1394004 - RNA, 19 nt, Homo sapiens
aagggaugcaguuauuaaa

SEQ ID NO: 1394005 - RNA, 19 nt, Homo sapiens
caacaccagauugaaaugg

SEQ ID NO: 1394006 - RNA, 19 nt, Homo sapiens
gcacagaccugcauuuguu

SEQ ID NO: 1394007 - RNA, 19 nt, Homo sapiens
gagaugaacuguacacaug

SEQ ID NO: 1394008 - RNA, 19 nt, Homo sapiens
agaaagcacucaauaaaug

SEQ ID NO: 1394009 - RNA, 19 nt, Homo sapiens
gcagauuuccguuugaaua

SEQ ID NO: 1394010 - RNA, 19 nt, Homo sapiens
gaacuguacacaugugaua

SEQ ID NO: 1394011 - RNA, 19 nt, Homo sapiens
cagaagaacaucuacaaua

SEQ ID NO: 1394012 - RNA, 19 nt, Homo sapiens
ggccagagcuaucuuccua

SEQ ID NO: 1394013 - RNA, 19 nt, Homo sapiens
gaacaucuacaauauccua

SEQ ID NO: 1394014 - RNA, 19 nt, Homo sapiens
ugucaaaucucaacuuaga

SEQ ID NO: 1394015 - RNA, 19 nt, Homo sapiens
gcauuuaccuucucuuaag

SEQ ID NO: 1394016 - RNA, 19 nt, Homo sapiens
uaacaucucuugauuugag

SEQ ID NO: 1394017 - RNA, 19 nt, Homo sapiens
caucauagcccuucauuuc

SEQ ID NO: 1394018 - RNA, 19 nt, Homo sapiens
gaugucgucuccaauuauu

SEQ ID NO: 1394019 - RNA, 19 nt, Homo sapiens
ggaaugaagucccuaugag

SEQ ID NO: 1394020 - RNA, 19 nt, Homo sapiens
ggugaggaauuuagaguug

SEQ ID NO: 1394021 - RNA, 19 nt, Homo sapiens
cuagaaagcacucaauaaa

SEQ ID NO: 1394022 - RNA, 19 nt, Homo sapiens
gcaccucuguggcuaguug

SEQ ID NO: 1394023 - RNA, 19 nt, Homo sapiens
gggcaaggauuguguugga

SEQ ID NO: 1394024 - RNA, 19 nt, Homo sapiens
cuuaacaucucuugauuug

SEQ ID NO: 1394025 - RNA, 19 nt, Homo sapiens
caaggauggugaggaauuu

SEQ ID NO: 1394026 - RNA, 19 nt, Homo sapiens
cagagguccuggccuauuu

SEQ ID NO: 1394027 - RNA, 19 nt, Homo sapiens
ccagagcuaucuuccuaaa

SEQ ID NO: 1394028 - RNA, 19 nt, Homo sapiens
ucaccaaccucgucuacuu

SEQ ID NO: 1394029 - RNA, 19 nt, Homo sapiens
gagccagacaggaaacuua

SEQ ID NO: 1394030 - RNA, 19 nt, Homo sapiens
gagcagauggugacaaguu

SEQ ID NO: 1394031 - RNA, 19 nt, Homo sapiens
caaggauuguguuggaauu

SEQ ID NO: 1394032 - RNA, 19 nt, Homo sapiens
ucugucaaaucucaacuua

SEQ ID NO: 1394033 - RNA, 19 nt, Homo sapiens
gaaugaagucccuaugaga

SEQ ID NO: 1394034 - RNA, 19 nt, Homo sapiens
ucacuugccugccuaaugg

SEQ ID NO: 1394035 - RNA, 19 nt, Homo sapiens
gacaggaaacuuauucuau

SEQ ID NO: 1394036 - RNA, 19 nt, Homo sapiens
gaugguacuugcugucuuc

SEQ ID NO: 1394037 - RNA, 19 nt, Homo sapiens
gaugaugucgucuccaauu

SEQ ID NO: 1394038 - RNA, 19 nt, Homo sapiens
gauaauuccguuugcguuu

SEQ ID NO: 1394039 - RNA, 19 nt, Homo sapiens
gaaagcacucaauaaaugu

SEQ ID NO: 1394040 - RNA, 19 nt, Homo sapiens
ccaauuauuucaccaaagg

SEQ ID NO: 1394041 - RNA, 19 nt, Homo sapiens
cagcauggcuugugagacu

SEQ ID NO: 1394042 - RNA, 19 nt, Homo sapiens
caggaaacuuauucuauuc

SEQ ID NO: 1394043 - RNA, 19 nt, Homo sapiens
gaagcuguuugucacucua

SEQ ID NO: 1394044 - RNA, 19 nt, Homo sapiens
gaagaacaucuacaauauc

SEQ ID NO: 1394045 - RNA, 19 nt, Homo sapiens
ggugauuucuguccaagug

SEQ ID NO: 1394046 - RNA, 19 nt, Homo sapiens
caucaaagaggccauucua

SEQ ID NO: 1394047 - RNA, 19 nt, Homo sapiens
uuaccuagcauuucaguuu

SEQ ID NO: 1394048 - RNA, 19 nt, Homo sapiens
gguggugaaucauuaccua

SEQ ID NO: 1394049 - RNA, 19 nt, Homo sapiens
guugaacggugauuucugu

SEQ ID NO: 1394050 - RNA, 19 nt, Homo sapiens
gggcucagcuuggcucaga

SEQ ID NO: 1394051 - RNA, 19 nt, Homo sapiens
ccacucugauuccuccuuu

SEQ ID NO: 1394052 - RNA, 19 nt, Homo sapiens
ucugauuccuccuuucuuu

SEQ ID NO: 1394053 - RNA, 19 nt, Homo sapiens
ucucuggucucaucacuug

SEQ ID NO: 1394054 - RNA, 19 nt, Homo sapiens
acauguuggucuccucuua

SEQ ID NO: 1394055 - RNA, 19 nt, Homo sapiens
uagcauuuaccuucucuua

SEQ ID NO: 1394056 - RNA, 19 nt, Homo sapiens
uuccuuggcuuuagcauuu

SEQ ID NO: 1394057 - RNA, 19 nt, Homo sapiens
caacuauagugccuugcaa

SEQ ID NO: 1394058 - RNA, 19 nt, Homo sapiens
ggacugggcuagauuuuca

SEQ ID NO: 1394059 - RNA, 19 nt, Homo sapiens
uagugguggugaaucauua

SEQ ID NO: 1394060 - RNA, 19 nt, Homo sapiens
gaugaacuguacacaugug

SEQ ID NO: 1394061 - RNA, 19 nt, Homo sapiens
uuaauacccugacaguuca

SEQ ID NO: 1394062 - RNA, 19 nt, Homo sapiens
cagauuuccguuugaauaa

SEQ ID NO: 1394063 - RNA, 19 nt, Homo sapiens
ccacauccaaucucucaaa

SEQ ID NO: 1394064 - RNA, 19 nt, Homo sapiens
uaaagaaaugggacuaaug

SEQ ID NO: 1394065 - RNA, 19 nt, Homo sapiens
ccuagaaagcacucaauaa

SEQ ID NO: 1394066 - RNA, 19 nt, Homo sapiens
ucucaucacuugccuucuu

SEQ ID NO: 1394067 - RNA, 19 nt, Homo sapiens
cagggucugugaagcuuaa

SEQ ID NO: 1394068 - RNA, 19 nt, Homo sapiens
caaggugggucaggagguu

SEQ ID NO: 1394069 - RNA, 19 nt, Homo sapiens
aauauuaucccuucucaga

SEQ ID NO: 1394070 - RNA, 19 nt, Homo sapiens
ccaacauccuuccugauca

SEQ ID NO: 1394071 - RNA, 19 nt, Homo sapiens
gaucaccccuugcuucuug

SEQ ID NO: 1394072 - RNA, 19 nt, Homo sapiens
gcucaacaguacauauugg

SEQ ID NO: 1394073 - RNA, 19 nt, Homo sapiens
guuucuggcugaauacuau

SEQ ID NO: 1394074 - RNA, 19 nt, Homo sapiens
gacuagugguggugaauca

SEQ ID NO: 1394075 - RNA, 19 nt, Homo sapiens
cagcuuucaccuuggauua

SEQ ID NO: 1394076 - RNA, 19 nt, Homo sapiens
gugcaggcuucuccacuug

SEQ ID NO: 1394077 - RNA, 19 nt, Homo sapiens
gagaggaagagcacauguu

SEQ ID NO: 1394078 - RNA, 19 nt, Homo sapiens
caacaguacauauuggaau

SEQ ID NO: 1394079 - RNA, 19 nt, Homo sapiens
gagaacguccugcccucua

SEQ ID NO: 1394080 - RNA, 19 nt, Homo sapiens
gaaucauuaccuagcauuu

SEQ ID NO: 1394081 - RNA, 19 nt, Homo sapiens
gcucaccucucuggucuca

SEQ ID NO: 1394082 - RNA, 19 nt, Homo sapiens
ucaaggauggugaggaauu

SEQ ID NO: 1394083 - RNA, 19 nt, Homo sapiens
uuucaaggauggugaggaa

SEQ ID NO: 1394084 - RNA, 19 nt, Homo sapiens
guacauauuggaaugaagu

SEQ ID NO: 1394085 - RNA, 19 nt, Homo sapiens
gcccgucugugcacucuug

SEQ ID NO: 1394086 - RNA, 19 nt, Homo sapiens
ugacaguucaucuuccuuu

SEQ ID NO: 1394087 - RNA, 19 nt, Homo sapiens
ucaccucucuggucucauc

SEQ ID NO: 1394088 - RNA, 19 nt, Homo sapiens
cauuugacauggcugauca

SEQ ID NO: 1394089 - RNA, 19 nt, Homo sapiens
ugacagcuggcccuacuuu

SEQ ID NO: 1394090 - RNA, 19 nt, Homo sapiens
cuuaauacccugacaguuc

SEQ ID NO: 1394091 - RNA, 19 nt, Homo sapiens
gugcagauuuccguuugaa

SEQ ID NO: 1394092 - RNA, 19 nt, Homo sapiens
ggcaagaucaggagaguca

SEQ ID NO: 1394093 - RNA, 19 nt, Homo sapiens
ccagucgucagaagauaua

SEQ ID NO: 1394094 - RNA, 19 nt, Homo sapiens
caucagcuuucaccuugga

SEQ ID NO: 1394095 - RNA, 19 nt, Homo sapiens
ggacuggacucacuuuucu

SEQ ID NO: 1394096 - RNA, 19 nt, Homo sapiens
gcucuggacuggacucacu

SEQ ID NO: 1394097 - RNA, 19 nt, Homo sapiens
gcuuagggauccugguugu

SEQ ID NO: 1394098 - RNA, 19 nt, Homo sapiens
gcaaggauuguguuggaau

SEQ ID NO: 1394099 - RNA, 19 nt, Homo sapiens
gcuggcagguacagagaug

SEQ ID NO: 1394100 - RNA, 19 nt, Homo sapiens
cuccaccgcuguacugauu

SEQ ID NO: 1394101 - RNA, 19 nt, Homo sapiens
gauuuccguuugaauaaag

SEQ ID NO: 1394102 - RNA, 19 nt, Homo sapiens
caagugcagauuuccguuu

SEQ ID NO: 1394103 - RNA, 19 nt, Homo sapiens
augaugucgucuccaauua

SEQ ID NO: 1394104 - RNA, 19 nt, Homo sapiens
uugcauaguugaucaaguc

SEQ ID NO: 1394105 - RNA, 19 nt, Homo sapiens
aaagugaggcuggcaggua

SEQ ID NO: 1394106 - RNA, 19 nt, Homo sapiens
ggaaacugcuuuacuagug

SEQ ID NO: 1394107 - RNA, 19 nt, Homo sapiens
ggaaagaauucaaauaugc

SEQ ID NO: 1394108 - RNA, 19 nt, Homo sapiens
ccacacagccacacaaaua

SEQ ID NO: 1394109 - RNA, 19 nt, Homo sapiens
ccauaaugaucgaaucuua

SEQ ID NO: 1394110 - RNA, 19 nt, Homo sapiens
guucccagcucguuaauaa

SEQ ID NO: 1394111 - RNA, 19 nt, Homo sapiens
uaccucagcuuccuaagua

SEQ ID NO: 1394112 - RNA, 19 nt, Homo sapiens
caucgugccuggcuaguuu

SEQ ID NO: 1394113 - RNA, 19 nt, Homo sapiens
gaucgaaucuuaucaucca

SEQ ID NO: 1394114 - RNA, 19 nt, Homo sapiens
ccuggaaacugcuuuacua

SEQ ID NO: 1394115 - RNA, 19 nt, Homo sapiens
caggauaacauugguauua

SEQ ID NO: 1394116 - RNA, 19 nt, Homo sapiens
gaacaugugccucgugaau

SEQ ID NO: 1394117 - RNA, 19 nt, Homo sapiens
ccauauugcuggacauuug

SEQ ID NO: 1394118 - RNA, 19 nt, Homo sapiens
gcaacauaauugucuauca

SEQ ID NO: 1394119 - RNA, 19 nt, Homo sapiens
ggaggagaguuaugagaug

SEQ ID NO: 1394120 - RNA, 19 nt, Homo sapiens
cuaauucucugcauagguu

SEQ ID NO: 1394121 - RNA, 19 nt, Homo sapiens
gcagcaccuucaagucuaa

SEQ ID NO: 1394122 - RNA, 19 nt, Homo sapiens
ugauuaaagugguaucuga

SEQ ID NO: 1394123 - RNA, 19 nt, Homo sapiens
acaugugccucgugaauuu

SEQ ID NO: 1394124 - RNA, 19 nt, Homo sapiens
gaggagaguuaugagauga

SEQ ID NO: 1394125 - RNA, 19 nt, Homo sapiens
guuaugagaugaacauugg

SEQ ID NO: 1394126 - RNA, 19 nt, Homo sapiens
uaauuggcuuuguugcuua

SEQ ID NO: 1394127 - RNA, 19 nt, Homo sapiens
gaaccauaaugaucgaauc

SEQ ID NO: 1394128 - RNA, 19 nt, Homo sapiens
gcacuggaaagaauucaaa

SEQ ID NO: 1394129 - RNA, 19 nt, Homo sapiens
cuaaguagcugggauuaca

SEQ ID NO: 1394130 - RNA, 19 nt, Homo sapiens
ccagaacccacaucuaauu

SEQ ID NO: 1394131 - RNA, 19 nt, Homo sapiens
gaaccaggucucacuaugu

SEQ ID NO: 1394132 - RNA, 19 nt, Homo sapiens
uaucugagaaccauaauga

SEQ ID NO: 1394133 - RNA, 19 nt, Homo sapiens
gcaccuggcucccuucacu

SEQ ID NO: 1394134 - RNA, 19 nt, Homo sapiens
acugaaaucugucuuguca

SEQ ID NO: 1394135 - RNA, 19 nt, Homo sapiens
gggaauggcugggauuugg

SEQ ID NO: 1394136 - RNA, 19 nt, Homo sapiens
gcccagagaagaauuaaug

SEQ ID NO: 1394137 - RNA, 19 nt, Homo sapiens
cuaauuggcuuuguugcuu

SEQ ID NO: 1394138 - RNA, 19 nt, Homo sapiens
uaaggacaagcuagaauuu

SEQ ID NO: 1394139 - RNA, 19 nt, Homo sapiens
ccaaagugcugggauuaca

SEQ ID NO: 1394140 - RNA, 19 nt, Homo sapiens
gaggaaggccgcaucuguu

SEQ ID NO: 1394141 - RNA, 19 nt, Homo sapiens
uggcuguaguuguuuauaa

SEQ ID NO: 1394142 - RNA, 19 nt, Homo sapiens
gugccuggcuguaguuguu

SEQ ID NO: 1394143 - RNA, 19 nt, Homo sapiens
agacaggguuucaccaugu

SEQ ID NO: 1394144 - RNA, 19 nt, Homo sapiens
ggagugcaguggcgugauc

SEQ ID NO: 1394145 - RNA, 19 nt, Homo sapiens
gaugucauguggccugugu

SEQ ID NO: 1394146 - RNA, 19 nt, Homo sapiens
ggauuugggcguugccuuu

SEQ ID NO: 1394147 - RNA, 19 nt, Homo sapiens
guaccuaugcuccuuaugu

SEQ ID NO: 1394148 - RNA, 19 nt, Homo sapiens
gaccgugguucguaccuau

SEQ ID NO: 1394149 - RNA, 19 nt, Homo sapiens
caccaugcccagcuaauuu

SEQ ID NO: 1394150 - RNA, 19 nt, Homo sapiens
gaaaccgcccagagaagaa

SEQ ID NO: 1394151 - RNA, 19 nt, Homo sapiens
guuggucacucguuuagau

SEQ ID NO: 1394152 - RNA, 19 nt, Homo sapiens
uauggagucucgcuguauu

SEQ ID NO: 1394153 - RNA, 19 nt, Homo sapiens
aaccaggucucacuauguu

SEQ ID NO: 1394154 - RNA, 19 nt, Homo sapiens
ucacauacacacacauaga

SEQ ID NO: 1394155 - RNA, 19 nt, Homo sapiens
aauacuggcugcuccuuga

SEQ ID NO: 1394156 - RNA, 19 nt, Homo sapiens
uagacgccuuucccuauaa

SEQ ID NO: 1394157 - RNA, 19 nt, Homo sapiens
uuaaagugguaucugagaa

SEQ ID NO: 1394158 - RNA, 19 nt, Homo sapiens
agggauaccugcaugucua

SEQ ID NO: 1394159 - RNA, 19 nt, Homo sapiens
ggaccgugguucguaccua

SEQ ID NO: 1394160 - RNA, 19 nt, Homo sapiens
ucaaacuucugaccuugug

SEQ ID NO: 1394161 - RNA, 19 nt, Homo sapiens
aaaccugauuaaaguggua

SEQ ID NO: 1394162 - RNA, 19 nt, Homo sapiens
gaugaacauuggcugucaa

SEQ ID NO: 1394163 - RNA, 19 nt, Homo sapiens
cugcaacgaauaucuuaua

SEQ ID NO: 1394164 - RNA, 19 nt, Homo sapiens
gcuggacauuugaauuguu

SEQ ID NO: 1394165 - RNA, 19 nt, Homo sapiens
cuaaagugcugggauuaca

SEQ ID NO: 1394166 - RNA, 19 nt, Homo sapiens
gacaggguuucaccauguu

SEQ ID NO: 1394167 - RNA, 19 nt, Homo sapiens
uauauacgcacauucaaga

SEQ ID NO: 1394168 - RNA, 19 nt, Homo sapiens
cuggacauuugaauuguuu

SEQ ID NO: 1394169 - RNA, 19 nt, Homo sapiens
aauauggagucucgcugua

SEQ ID NO: 1394170 - RNA, 19 nt, Homo sapiens
cuggagugcaguacaauua

SEQ ID NO: 1394171 - RNA, 19 nt, Homo sapiens
gaaggccgcaucuguugug

SEQ ID NO: 1394172 - RNA, 19 nt, Homo sapiens
ggcuguaguuguuuauaau

SEQ ID NO: 1394173 - RNA, 19 nt, Homo sapiens
cuggcucccuucacuauuu

SEQ ID NO: 1394174 - RNA, 19 nt, Homo sapiens
gauuugggcguugccuuua

SEQ ID NO: 1394175 - RNA, 19 nt, Homo sapiens
uuagauacugcaacgaaua

SEQ ID NO: 1394176 - RNA, 19 nt, Homo sapiens
guagaaccaggucucacua

SEQ ID NO: 1394177 - RNA, 19 nt, Homo sapiens
agaugggacuacaggagua

SEQ ID NO: 1394178 - RNA, 19 nt, Homo sapiens
ccucacauacacacacaua

SEQ ID NO: 1394179 - RNA, 19 nt, Homo sapiens
aaacagucaccaucuucua

SEQ ID NO: 1394180 - RNA, 19 nt, Homo sapiens
gagcaggauaacauuggua

SEQ ID NO: 1394181 - RNA, 19 nt, Homo sapiens
guggugacuuguccugcua

SEQ ID NO: 1394182 - RNA, 19 nt, Homo sapiens
uuaaggacaagcuagaauu

SEQ ID NO: 1394183 - RNA, 19 nt, Homo sapiens
cgcuacgccuggcuaauuu

SEQ ID NO: 1394184 - RNA, 19 nt, Homo sapiens
agaaccaggucucacuaug

SEQ ID NO: 1394185 - RNA, 19 nt, Homo sapiens
acagaaaccgcccagagaa

SEQ ID NO: 1394186 - RNA, 19 nt, Homo sapiens
gggcagggacgaacaugug

SEQ ID NO: 1394187 - RNA, 19 nt, Homo sapiens
gcucauucuuacugaaauc

SEQ ID NO: 1394188 - RNA, 19 nt, Homo sapiens
agucugcacuggaaagaau

SEQ ID NO: 1394189 - RNA, 19 nt, Homo sapiens
gggaggagaguuaugagau

SEQ ID NO: 1394190 - RNA, 19 nt, Homo sapiens
caccuggaaugguucauca

SEQ ID NO: 1394191 - RNA, 19 nt, Homo sapiens
ggacacagggcccuauggu

SEQ ID NO: 1394192 - RNA, 19 nt, Homo sapiens
aguuuauccuggacaauuu

SEQ ID NO: 1394193 - RNA, 19 nt, Homo sapiens
cuucugaccuugugaucug

SEQ ID NO: 1394194 - RNA, 19 nt, Homo sapiens
cugaguagcugggauuaca

SEQ ID NO: 1394195 - RNA, 19 nt, Homo sapiens
uacauggucaucauaauug

SEQ ID NO: 1394196 - RNA, 19 nt, Homo sapiens
ccaaggagcccuggaaacu

SEQ ID NO: 1394197 - RNA, 19 nt, Homo sapiens
gaagaggaaggccgcaucu

SEQ ID NO: 1394198 - RNA, 19 nt, Homo sapiens
agacgccuuucccuauaaa

SEQ ID NO: 1394199 - RNA, 19 nt, Homo sapiens
gaccucacauacacacaca

SEQ ID NO: 1394200 - RNA, 19 nt, Homo sapiens
cuuaggaguuaggcaagua

SEQ ID NO: 1394201 - RNA, 19 nt, Homo sapiens
uuacugaaaucugucuugu

SEQ ID NO: 1394202 - RNA, 19 nt, Homo sapiens
gcugggaggagaguuauga

SEQ ID NO: 1394203 - RNA, 19 nt, Homo sapiens
caucuaauuggcuuuguug

SEQ ID NO: 1394204 - RNA, 19 nt, Homo sapiens
cauaauugucuaucaagug

SEQ ID NO: 1394205 - RNA, 19 nt, Homo sapiens
gccuggcuguaguuguuua

SEQ ID NO: 1394206 - RNA, 19 nt, Homo sapiens
guaaauaggaccagucuua

SEQ ID NO: 1394207 - RNA, 19 nt, Homo sapiens
cgagguagcugccuucuuc

SEQ ID NO: 1394208 - RNA, 19 nt, Homo sapiens
gggacuggcuggucuuuga

SEQ ID NO: 1394209 - RNA, 19 nt, Homo sapiens
gcaccgagcugggucacaa

SEQ ID NO: 1394210 - RNA, 19 nt, Homo sapiens
aaagugagauuugaagaga

SEQ ID NO: 1394211 - RNA, 19 nt, Homo sapiens
caagaugguucugugcauu

SEQ ID NO: 1394212 - RNA, 19 nt, Homo sapiens
gcugauggcugcagaacag

SEQ ID NO: 1394213 - RNA, 19 nt, Homo sapiens
uggcaaaggugguaaagag

SEQ ID NO: 1394214 - RNA, 19 nt, Homo sapiens
gagagcggacucgaacuua

SEQ ID NO: 1394215 - RNA, 19 nt, Homo sapiens
uaaauccuguuccuuccaa

SEQ ID NO: 1394216 - RNA, 19 nt, Homo sapiens
uacccgaggucaagcagua

SEQ ID NO: 1394217 - RNA, 19 nt, Homo sapiens
ggaaacugcggcuccgaaa

SEQ ID NO: 1394218 - RNA, 19 nt, Homo sapiens
gaaggaggacggaguuugg

SEQ ID NO: 1394219 - RNA, 19 nt, Homo sapiens
agagauugcuuccgugauc

SEQ ID NO: 1394220 - RNA, 19 nt, Homo sapiens
cuaguguguugcauacuuu

SEQ ID NO: 1394221 - RNA, 19 nt, Homo sapiens
cugcugagcuuugacaaug

SEQ ID NO: 1394222 - RNA, 19 nt, Homo sapiens
agagcggacucgaacuuaa

SEQ ID NO: 1394223 - RNA, 19 nt, Homo sapiens
agauggagcuggcaaaggu

SEQ ID NO: 1394224 - RNA, 19 nt, Homo sapiens
ugaccugggugccauagug

SEQ ID NO: 1394225 - RNA, 19 nt, Homo sapiens
caguguuucugcccuguaa

SEQ ID NO: 1394226 - RNA, 19 nt, Homo sapiens
agugagauuugaagagauu

SEQ ID NO: 1394227 - RNA, 19 nt, Homo sapiens
cgagcugggucacaagaug

SEQ ID NO: 1394228 - RNA, 19 nt, Homo sapiens
cccgagaccugcugaagga

SEQ ID NO: 1394229 - RNA, 19 nt, Homo sapiens
ggccgaagccguguaaaug

SEQ ID NO: 1394230 - RNA, 19 nt, Homo sapiens
caaauugcacagaucaaau

SEQ ID NO: 1394231 - RNA, 19 nt, Homo sapiens
cggcuacccucuagugugu

SEQ ID NO: 1394232 - RNA, 19 nt, Homo sapiens
ccuaaaguuuggaguguca

SEQ ID NO: 1394233 - RNA, 19 nt, Homo sapiens
ccaagaccaucguguacca

SEQ ID NO: 1394234 - RNA, 19 nt, Homo sapiens
gaguugguccagcauauug

SEQ ID NO: 1394235 - RNA, 19 nt, Homo sapiens
gcuacccucuaguguguug

SEQ ID NO: 1394236 - RNA, 19 nt, Homo sapiens
gaaggagguucugcuagac

SEQ ID NO: 1394237 - RNA, 19 nt, Homo sapiens
gagauugcuuccgugauca

SEQ ID NO: 1394238 - RNA, 19 nt, Homo sapiens
uggcuucccuggcacagaa

SEQ ID NO: 1394239 - RNA, 19 nt, Homo sapiens
gcuggucuuugacaacaug

SEQ ID NO: 1394240 - RNA, 19 nt, Homo sapiens
ccaagaugguucugugcau

SEQ ID NO: 1394241 - RNA, 19 nt, Homo sapiens
uguguugcauacuuucuaa

SEQ ID NO: 1394242 - RNA, 19 nt, Homo sapiens
ucuaguguguugcauacuu

SEQ ID NO: 1394243 - RNA, 19 nt, Homo sapiens
cagcaucauugccaagaag

SEQ ID NO: 1394244 - RNA, 19 nt, Homo sapiens
ggaguugguccagcauauu

SEQ ID NO: 1394245 - RNA, 19 nt, Homo sapiens
cuucaacucaguccuguuu

SEQ ID NO: 1394246 - RNA, 19 nt, Homo sapiens
cagcgagcaucaugugagu

SEQ ID NO: 1394247 - RNA, 19 nt, Homo sapiens
cugcagaacaggaggauga

SEQ ID NO: 1394248 - RNA, 19 nt, Homo sapiens
gggcguguaugggaucuuc

SEQ ID NO: 1394249 - RNA, 19 nt, Homo sapiens
uugcacagaucaaauaugc

SEQ ID NO: 1394250 - RNA, 19 nt, Homo sapiens
gacucgaacuuaagcucuu

SEQ ID NO: 1394251 - RNA, 19 nt, Homo sapiens
ugccugagccuaaaguuug

SEQ ID NO: 1394252 - RNA, 19 nt, Homo sapiens
gagcuuugacaaugagaug

SEQ ID NO: 1394253 - RNA, 19 nt, Homo sapiens
aggcagagauggaguuggu

SEQ ID NO: 1394254 - RNA, 19 nt, Homo sapiens
gcccaggugugcugaaggu

SEQ ID NO: 1394255 - RNA, 19 nt, Homo sapiens
ugaaucggacuuugugaug

SEQ ID NO: 1394256 - RNA, 19 nt, Homo sapiens
gcuguggcguggacaucuu

SEQ ID NO: 1394257 - RNA, 19 nt, Homo sapiens
gcugagacgccuugaugug

SEQ ID NO: 1394258 - RNA, 19 nt, Homo sapiens
gggccgaagccguguaaau

SEQ ID NO: 1394259 - RNA, 19 nt, Homo sapiens
uggaaucccugccaguaag

SEQ ID NO: 1394260 - RNA, 19 nt, Homo sapiens
ggcuuuagcugugccaaca

SEQ ID NO: 1394261 - RNA, 19 nt, Homo sapiens
gagugaaucggacuuugug

SEQ ID NO: 1394262 - RNA, 19 nt, Homo sapiens
acucaguccuguuugacaa

SEQ ID NO: 1394263 - RNA, 19 nt, Homo sapiens
uguaugggaucuucaacuc

SEQ ID NO: 1394264 - RNA, 19 nt, Homo sapiens
ccuccaagaccaucgugua

SEQ ID NO: 1394265 - RNA, 19 nt, Homo sapiens
ucagcaucauugccaagaa

SEQ ID NO: 1394266 - RNA, 19 nt, Homo sapiens
ggaaucccugccaguaaga

SEQ ID NO: 1394267 - RNA, 19 nt, Homo sapiens
gagcggacucgaacuuaag

SEQ ID NO: 1394268 - RNA, 19 nt, Homo sapiens
ccucuaguguguugcauac

SEQ ID NO: 1394269 - RNA, 19 nt, Homo sapiens
aacuuaagcucuugcucuu

SEQ ID NO: 1394270 - RNA, 19 nt, Homo sapiens
gcugagcuuugacaaugag

SEQ ID NO: 1394271 - RNA, 19 nt, Homo sapiens
cgaaggaggacggaguuug

SEQ ID NO: 1394272 - RNA, 19 nt, Homo sapiens
ccaacaaggcagagaugga

SEQ ID NO: 1394273 - RNA, 19 nt, Homo sapiens
gagaccugcugaaggaacu

SEQ ID NO: 1394274 - RNA, 19 nt, Homo sapiens
gaaacugcggcuccgaaag

SEQ ID NO: 1394275 - RNA, 19 nt, Homo sapiens
ggagcuggcaaagguggua

SEQ ID NO: 1394276 - RNA, 19 nt, Homo sapiens
gaccugggugccauaguga

SEQ ID NO: 1394277 - RNA, 19 nt, Homo sapiens
acucagccuuggaccugua

SEQ ID NO: 1394278 - RNA, 19 nt, Homo sapiens
ugagcugccugagccuaaa

SEQ ID NO: 1394279 - RNA, 19 nt, Homo sapiens
aaacugcggcuccgaaagg

SEQ ID NO: 1394280 - RNA, 19 nt, Homo sapiens
acccaggccugccacauca

SEQ ID NO: 1394281 - RNA, 19 nt, Homo sapiens
caggugugcugaagguucu

SEQ ID NO: 1394282 - RNA, 19 nt, Homo sapiens
guaguucaaguaugcaaca

SEQ ID NO: 1394283 - RNA, 19 nt, Homo sapiens
gcgccgaggauccgauuca

SEQ ID NO: 1394284 - RNA, 19 nt, Homo sapiens
uaaauaggaccagucuuac

SEQ ID NO: 1394285 - RNA, 19 nt, Homo sapiens
gaggguacccgaggucaag

SEQ ID NO: 1394286 - RNA, 19 nt, Homo sapiens
gaccaucguguaccaccuu

SEQ ID NO: 1394287 - RNA, 19 nt, Homo sapiens
gcacagaaggggccaaagu

SEQ ID NO: 1394288 - RNA, 19 nt, Homo sapiens
gucacaagaugcacguucu

SEQ ID NO: 1394289 - RNA, 19 nt, Homo sapiens
ugagugaaucggacuuugu

SEQ ID NO: 1394290 - RNA, 19 nt, Homo sapiens
gugcauugcuaccgaugac

SEQ ID NO: 1394291 - RNA, 19 nt, Homo sapiens
aaauaggaccagucuuaca

SEQ ID NO: 1394292 - RNA, 19 nt, Homo sapiens
uggcuggucuuugacaaca

SEQ ID NO: 1394293 - RNA, 19 nt, Homo sapiens
ugaccucggccuucacugu

SEQ ID NO: 1394294 - RNA, 19 nt, Homo sapiens
agagagcggacucgaacuu

SEQ ID NO: 1394295 - RNA, 19 nt, Homo sapiens
gccaaccccuguaagcaaa

SEQ ID NO: 1394296 - RNA, 19 nt, Homo sapiens
uuuaugcugucaagugcaa

SEQ ID NO: 1394297 - RNA, 19 nt, Homo sapiens
guggaggagggcuucagua

SEQ ID NO: 1394298 - RNA, 19 nt, Homo sapiens
aaucggacuuugugauggu

SEQ ID NO: 1394299 - RNA, 19 nt, Homo sapiens
ggaaggugcugaugaagac

SEQ ID NO: 1394300 - RNA, 19 nt, Homo sapiens
ggagaacguguuugcugua

SEQ ID NO: 1394301 - RNA, 19 nt, Homo sapiens
ccagcccacugcacugaaa

SEQ ID NO: 1394302 - RNA, 19 nt, Homo sapiens
caucgcagccaucguguug

SEQ ID NO: 1394303 - RNA, 19 nt, Homo sapiens
gaaaagcagccaccacaug

SEQ ID NO: 1394304 - RNA, 19 nt, Homo sapiens
gagaacguguuugcuguac

SEQ ID NO: 1394305 - RNA, 19 nt, Homo sapiens
ugggagcucugaacuacug

SEQ ID NO: 1394306 - RNA, 19 nt, Homo sapiens
ggccugugcucuccuuucu

SEQ ID NO: 1394307 - RNA, 19 nt, Homo sapiens
gucaacauccucucuguca

SEQ ID NO: 1394308 - RNA, 19 nt, Homo sapiens
uccggaaggugcugaugaa

SEQ ID NO: 1394309 - RNA, 19 nt, Homo sapiens
ccugugcucuccuuucucu

SEQ ID NO: 1394310 - RNA, 19 nt, Homo sapiens
uccuggagcuggccugaga

SEQ ID NO: 1394311 - RNA, 19 nt, Homo sapiens
cggaaggugcugaugaaga

SEQ ID NO: 1394312 - RNA, 19 nt, Homo sapiens
caacauccucucugucacu

SEQ ID NO: 1394313 - RNA, 19 nt, Homo sapiens
guacugcguggucaacauc

SEQ ID NO: 1394314 - RNA, 19 nt, Homo sapiens
ccaucguggucaucacuuc

SEQ ID NO: 1394315 - RNA, 19 nt, Homo sapiens
aaaagcagccaccacauga

SEQ ID NO: 1394316 - RNA, 19 nt, Homo sapiens
ggaaauaacuguugaauca

SEQ ID NO: 1394317 - RNA, 19 nt, Homo sapiens
gaaagaagguggacaagaa

SEQ ID NO: 1394318 - RNA, 19 nt, Homo sapiens
gcacuuagcuaaugcaaau

SEQ ID NO: 1394319 - RNA, 19 nt, Homo sapiens
aagaagagguccaauauaa

SEQ ID NO: 1394320 - RNA, 19 nt, Homo sapiens
gaaacaugcuacagacuuu

SEQ ID NO: 1394321 - RNA, 19 nt, Homo sapiens
gaagcuaucugaugagaau

SEQ ID NO: 1394322 - RNA, 19 nt, Homo sapiens
gcaugaagcuaucugauga

SEQ ID NO: 1394323 - RNA, 19 nt, Homo sapiens
gaagagguccaauauaauu

SEQ ID NO: 1394324 - RNA, 19 nt, Homo sapiens
cagaaguuauucccaauua

SEQ ID NO: 1394325 - RNA, 19 nt, Homo sapiens
gaagcugacuuacugugua

SEQ ID NO: 1394326 - RNA, 19 nt, Homo sapiens
ccaagaagcugacuuacug

SEQ ID NO: 1394327 - RNA, 19 nt, Homo sapiens
gauugaaacuggaagaauu

SEQ ID NO: 1394328 - RNA, 19 nt, Homo sapiens
gaagauuuccuccaacuaa

SEQ ID NO: 1394329 - RNA, 19 nt, Homo sapiens
gaacucgguuucuuuguug

SEQ ID NO: 1394330 - RNA, 19 nt, Homo sapiens
gaaguaaacagcucaaaga

SEQ ID NO: 1394331 - RNA, 19 nt, Homo sapiens
gcagaacucuucaaaugau

SEQ ID NO: 1394332 - RNA, 19 nt, Homo sapiens
ggacauagcuuggugaacu

SEQ ID NO: 1394333 - RNA, 19 nt, Homo sapiens
ggacauguuuggugacuau

SEQ ID NO: 1394334 - RNA, 19 nt, Homo sapiens
gaagaagagguccaauaua

SEQ ID NO: 1394335 - RNA, 19 nt, Homo sapiens
caacgaaucuugaugacau

SEQ ID NO: 1394336 - RNA, 19 nt, Homo sapiens
caaagacacucuccuaucu

SEQ ID NO: 1394337 - RNA, 19 nt, Homo sapiens
gagcugaucuuuuguauga

SEQ ID NO: 1394338 - RNA, 19 nt, Homo sapiens
gaaccagaguggauaugaa

SEQ ID NO: 1394339 - RNA, 19 nt, Homo sapiens
gaacauaagaaacaugcua

SEQ ID NO: 1394340 - RNA, 19 nt, Homo sapiens
caacagguauuggaguuaa

SEQ ID NO: 1394341 - RNA, 19 nt, Homo sapiens
gcacaugauuggugaagga

SEQ ID NO: 1394342 - RNA, 19 nt, Homo sapiens
ggaaguuacuggaguuuua

SEQ ID NO: 1394343 - RNA, 19 nt, Homo sapiens
gugaggagcuugaggaguu

SEQ ID NO: 1394344 - RNA, 19 nt, Homo sapiens
uaagauugccuucugauuu

SEQ ID NO: 1394345 - RNA, 19 nt, Homo sapiens
caucuuguguguuacauuu

SEQ ID NO: 1394346 - RNA, 19 nt, Homo sapiens
caagggaauccaaacauua

SEQ ID NO: 1394347 - RNA, 19 nt, Homo sapiens
gaagaacugugaaaaugua

SEQ ID NO: 1394348 - RNA, 19 nt, Homo sapiens
guacagagacuugaagaaa

SEQ ID NO: 1394349 - RNA, 19 nt, Homo sapiens
caucuaaucuaccuaacaa

SEQ ID NO: 1394350 - RNA, 19 nt, Homo sapiens
ugacaucuaucauuucaug

SEQ ID NO: 1394351 - RNA, 19 nt, Homo sapiens
gaaggaagccguggagcua

SEQ ID NO: 1394352 - RNA, 19 nt, Homo sapiens
ggaaagaggaggaggaaau

SEQ ID NO: 1394353 - RNA, 19 nt, Homo sapiens
guagaagaguuacuaagau

SEQ ID NO: 1394354 - RNA, 19 nt, Homo sapiens
ccaagggaauccaaacauu

SEQ ID NO: 1394355 - RNA, 19 nt, Homo sapiens
cagaagcccugcaagaaga

SEQ ID NO: 1394356 - RNA, 19 nt, Homo sapiens
uuuaagagcucccuauguu

SEQ ID NO: 1394357 - RNA, 19 nt, Homo sapiens
ugacaaagcaugaagcuau

SEQ ID NO: 1394358 - RNA, 19 nt, Homo sapiens
caaccuuacugaauuacaa

SEQ ID NO: 1394359 - RNA, 19 nt, Homo sapiens
cuacagacuuugccacuga

SEQ ID NO: 1394360 - RNA, 19 nt, Homo sapiens
gaaagccuucuucaucuaa

SEQ ID NO: 1394361 - RNA, 19 nt, Homo sapiens
gggagaguauccucauauu

SEQ ID NO: 1394362 - RNA, 19 nt, Homo sapiens
uugcagaacucuucaaaug

SEQ ID NO: 1394363 - RNA, 19 nt, Homo sapiens
gcaacucccugaacauaag

SEQ ID NO: 1394364 - RNA, 19 nt, Homo sapiens
aaugugaggugauuaagaa

SEQ ID NO: 1394365 - RNA, 19 nt, Homo sapiens
uagcagaaaugauaugcaa

SEQ ID NO: 1394366 - RNA, 19 nt, Homo sapiens
gaucugguuucacagugua

SEQ ID NO: 1394367 - RNA, 19 nt, Homo sapiens
cgacucaaauuaucgguau

SEQ ID NO: 1394368 - RNA, 19 nt, Homo sapiens
ugagaacgacgucugaaua

SEQ ID NO: 1394369 - RNA, 19 nt, Homo sapiens
ggaaauuaauguugcuaag

SEQ ID NO: 1394370 - RNA, 19 nt, Homo sapiens
gguagaagaguuacuaaga

SEQ ID NO: 1394371 - RNA, 19 nt, Homo sapiens
caaauuguuucaucagcaa

SEQ ID NO: 1394372 - RNA, 19 nt, Homo sapiens
auucucaucuuguguguua

SEQ ID NO: 1394373 - RNA, 19 nt, Homo sapiens
gcagaaaugauaugcaaau

SEQ ID NO: 1394374 - RNA, 19 nt, Homo sapiens
guagacgaguugcacauga

SEQ ID NO: 1394375 - RNA, 19 nt, Homo sapiens
guugggacgugcuucauuu

SEQ ID NO: 1394376 - RNA, 19 nt, Homo sapiens
aagaagagguagaagaguu

SEQ ID NO: 1394377 - RNA, 19 nt, Homo sapiens
ugaagaagagguccaauau

SEQ ID NO: 1394378 - RNA, 19 nt, Homo sapiens
cacaguggcuuaacaagug

SEQ ID NO: 1394379 - RNA, 19 nt, Homo sapiens
caagcaaauuguuucauca

SEQ ID NO: 1394380 - RNA, 19 nt, Homo sapiens
ccaagcaaauuguuucauc

SEQ ID NO: 1394381 - RNA, 19 nt, Homo sapiens
gguaugagugcaacauuaa

SEQ ID NO: 1394382 - RNA, 19 nt, Homo sapiens
cgguaugagugcaacauua

SEQ ID NO: 1394383 - RNA, 19 nt, Homo sapiens
gcucaaagacacucuccua

SEQ ID NO: 1394384 - RNA, 19 nt, Homo sapiens
gaaaaucuuugcucggaaa

SEQ ID NO: 1394385 - RNA, 19 nt, Homo sapiens
ccuaugaucugguuucaca

SEQ ID NO: 1394386 - RNA, 19 nt, Homo sapiens
gaaaggucuugaaggacuu

SEQ ID NO: 1394387 - RNA, 19 nt, Homo sapiens
agaaaucacucuauauugc

SEQ ID NO: 1394388 - RNA, 19 nt, Homo sapiens
uaggcaaccuuacugaauu

SEQ ID NO: 1394389 - RNA, 19 nt, Homo sapiens
gcaagaagagguagaagag

SEQ ID NO: 1394390 - RNA, 19 nt, Homo sapiens
gaaagaggaggaggaaaug

SEQ ID NO: 1394391 - RNA, 19 nt, Homo sapiens
gauaugaaggugucacuau

SEQ ID NO: 1394392 - RNA, 19 nt, Homo sapiens
gcucaaagagaccaacauu

SEQ ID NO: 1394393 - RNA, 19 nt, Homo sapiens
uggagucucugaaagcuuu

SEQ ID NO: 1394394 - RNA, 19 nt, Homo sapiens
ggacgugcuucauuuaagg

SEQ ID NO: 1394395 - RNA, 19 nt, Homo sapiens
uauaugaaguugacagcaa

SEQ ID NO: 1394396 - RNA, 19 nt, Homo sapiens
gugaacuccuugauugaaa

SEQ ID NO: 1394397 - RNA, 19 nt, Homo sapiens
gggaauccaaacauuauuu

SEQ ID NO: 1394398 - RNA, 19 nt, Homo sapiens
ggcaaccuguguccuguuu

SEQ ID NO: 1394399 - RNA, 19 nt, Homo sapiens
ggaaaugacccuagcaaaa

SEQ ID NO: 1394400 - RNA, 19 nt, Homo sapiens
ccucgaggauauauacaaa

SEQ ID NO: 1394401 - RNA, 19 nt, Homo sapiens
guuugaagauugcaacgaa

SEQ ID NO: 1394402 - RNA, 19 nt, Homo sapiens
aaagcgcacuaucccauuu

SEQ ID NO: 1394403 - RNA, 19 nt, Homo sapiens
caaccuguguccuguuuua

SEQ ID NO: 1394404 - RNA, 19 nt, Homo sapiens
caaggaauaucugaaacau

SEQ ID NO: 1394405 - RNA, 19 nt, Homo sapiens
gcaaaacgacucaaauuau

SEQ ID NO: 1394406 - RNA, 19 nt, Homo sapiens
gaugaguccucuuccaaag

SEQ ID NO: 1394407 - RNA, 19 nt, Homo sapiens
gaaccuggagcugaucuuu

SEQ ID NO: 1394408 - RNA, 19 nt, Homo sapiens
aggcaaccuuacugaauua

SEQ ID NO: 1394409 - RNA, 19 nt, Homo sapiens
aagauugccuucugauuuc

SEQ ID NO: 1394410 - RNA, 19 nt, Homo sapiens
uuacuaagauugccuucug

SEQ ID NO: 1394411 - RNA, 19 nt, Homo sapiens
gaagugcucguaaggacaa

SEQ ID NO: 1394412 - RNA, 19 nt, Homo sapiens
uuaccaagaagcugacuua

SEQ ID NO: 1394413 - RNA, 19 nt, Homo sapiens
ggaaagaagguggacaaga

SEQ ID NO: 1394414 - RNA, 19 nt, Homo sapiens
gagaguauccucauauugc

SEQ ID NO: 1394415 - RNA, 19 nt, Homo sapiens
guuuaacacugaauucugu

SEQ ID NO: 1394416 - RNA, 19 nt, Homo sapiens
ggauuaagccauacaauuu

SEQ ID NO: 1394417 - RNA, 19 nt, Homo sapiens
gaagacaacuacaagaaca

SEQ ID NO: 1394418 - RNA, 19 nt, Homo sapiens
ggagagagagcgcagaaua

SEQ ID NO: 1394419 - RNA, 19 nt, Homo sapiens
gagaaagaauggaaagaga

SEQ ID NO: 1394420 - RNA, 19 nt, Homo sapiens
gcaaagaggaugccaaugu

SEQ ID NO: 1394421 - RNA, 19 nt, Homo sapiens
gagaaagguuggagagaga

SEQ ID NO: 1394422 - RNA, 19 nt, Homo sapiens
gaaagaauggaaagagaaa

SEQ ID NO: 1394423 - RNA, 19 nt, Homo sapiens
gcagucauguguuaaaaua

SEQ ID NO: 1394424 - RNA, 19 nt, Homo sapiens
ggaaacagggccaacauug

SEQ ID NO: 1394425 - RNA, 19 nt, Homo sapiens
aagaacagcuggagagaga

SEQ ID NO: 1394426 - RNA, 19 nt, Homo sapiens
gaaguacaaucaagcuaca

SEQ ID NO: 1394427 - RNA, 19 nt, Homo sapiens
ggagagagagagacaagaa

SEQ ID NO: 1394428 - RNA, 19 nt, Homo sapiens
caaagaggaugccaauguc

SEQ ID NO: 1394429 - RNA, 19 nt, Homo sapiens
cuaaaggguugaaguacaa

SEQ ID NO: 1394430 - RNA, 19 nt, Homo sapiens
gagcuuggaugaugucucu

SEQ ID NO: 1394431 - RNA, 19 nt, Homo sapiens
uaucugagcuuggaugaug

SEQ ID NO: 1394432 - RNA, 19 nt, Homo sapiens
gguguauggucucaacuuu

SEQ ID NO: 1394433 - RNA, 19 nt, Homo sapiens
gggauuaagccauacaauu

SEQ ID NO: 1394434 - RNA, 19 nt, Homo sapiens
gaauaucaagugcugguaa

SEQ ID NO: 1394435 - RNA, 19 nt, Homo sapiens
gagagaggcuggagagacu

SEQ ID NO: 1394436 - RNA, 19 nt, Homo sapiens
gaacgggagaggcaagaaa

SEQ ID NO: 1394437 - RNA, 19 nt, Homo sapiens
uacaaacucuucuguguuc

SEQ ID NO: 1394438 - RNA, 19 nt, Homo sapiens
gacaagagcaguuagaaag

SEQ ID NO: 1394439 - RNA, 19 nt, Homo sapiens
ccuuagaaguguuaaauuc

SEQ ID NO: 1394440 - RNA, 19 nt, Homo sapiens
gugauaaacugugccauuc

SEQ ID NO: 1394441 - RNA, 19 nt, Homo sapiens
gagagagagcgcagaauau

SEQ ID NO: 1394442 - RNA, 19 nt, Homo sapiens
gcaagaaagacaagaacga

SEQ ID NO: 1394443 - RNA, 19 nt, Homo sapiens
caaagaagacaacuacaag

SEQ ID NO: 1394444 - RNA, 19 nt, Homo sapiens
gauuaagccauacaauuug

SEQ ID NO: 1394445 - RNA, 19 nt, Homo sapiens
uuugagauguuugggauua

SEQ ID NO: 1394446 - RNA, 19 nt, Homo sapiens
gggagcgacuggaacaaga

SEQ ID NO: 1394447 - RNA, 19 nt, Homo sapiens
gcagcaauuacuacuuuaa

SEQ ID NO: 1394448 - RNA, 19 nt, Homo sapiens
gaacagcuggagagagaga

SEQ ID NO: 1394449 - RNA, 19 nt, Homo sapiens
ucaaagaagacaacuacaa

SEQ ID NO: 1394450 - RNA, 19 nt, Homo sapiens
cuugugcagucauguguua

SEQ ID NO: 1394451 - RNA, 19 nt, Homo sapiens
gaaagacaagaacgagaga

SEQ ID NO: 1394452 - RNA, 19 nt, Homo sapiens
ggagagagagagguuagaa

SEQ ID NO: 1394453 - RNA, 19 nt, Homo sapiens
gaaaggcuggagcgagaaa

SEQ ID NO: 1394454 - RNA, 19 nt, Homo sapiens
cgacaagagcaguuagaaa

SEQ ID NO: 1394455 - RNA, 19 nt, Homo sapiens
ggagagggagcgacuggaa

SEQ ID NO: 1394456 - RNA, 19 nt, Homo sapiens
gccaaugucuucgcaagug

SEQ ID NO: 1394457 - RNA, 19 nt, Homo sapiens
augcagcaauuacuacuuu

SEQ ID NO: 1394458 - RNA, 19 nt, Homo sapiens
ccuaaaggguugaaguaca

SEQ ID NO: 1394459 - RNA, 19 nt, Homo sapiens
gagagagagagguuagaaa

SEQ ID NO: 1394460 - RNA, 19 nt, Homo sapiens
gaaauucaaagaagacaac

SEQ ID NO: 1394461 - RNA, 19 nt, Homo sapiens
gagcgcagaauaucaagug

SEQ ID NO: 1394462 - RNA, 19 nt, Homo sapiens
ggagcgacaagagcaguua

SEQ ID NO: 1394463 - RNA, 19 nt, Homo sapiens
uaaacugugccauuccuaa

SEQ ID NO: 1394464 - RNA, 19 nt, Homo sapiens
acucuucuguguucuugua

SEQ ID NO: 1394465 - RNA, 19 nt, Homo sapiens
ggaagauucaggaccauca

SEQ ID NO: 1394466 - RNA, 19 nt, Homo sapiens
gaaagggaacagcuggaau

SEQ ID NO: 1394467 - RNA, 19 nt, Homo sapiens
gaauggaaagagaaagguu

SEQ ID NO: 1394468 - RNA, 19 nt, Homo sapiens
uguuugggauuaagccaua

SEQ ID NO: 1394469 - RNA, 19 nt, Homo sapiens
aaacucuucuguguucuug

SEQ ID NO: 1394470 - RNA, 19 nt, Homo sapiens
gauaaacugugccauuccu

SEQ ID NO: 1394471 - RNA, 19 nt, Homo sapiens
aagaagacaacuacaagaa

SEQ ID NO: 1394472 - RNA, 19 nt, Homo sapiens
gaaacagggccaacauugc

SEQ ID NO: 1394473 - RNA, 19 nt, Homo sapiens
caagugcugguaagaaguu

SEQ ID NO: 1394474 - RNA, 19 nt, Homo sapiens
agacaaaacucacaacuac

SEQ ID NO: 1394475 - RNA, 19 nt, Homo sapiens
uuuacaaacucuucugugu

SEQ ID NO: 1394476 - RNA, 19 nt, Homo sapiens
gagagagcgcagaauauca

SEQ ID NO: 1394477 - RNA, 19 nt, Homo sapiens
ggagaggcaagaaagacaa

SEQ ID NO: 1394478 - RNA, 19 nt, Homo sapiens
gaucgggagaggcaagaaa

SEQ ID NO: 1394479 - RNA, 19 nt, Homo sapiens
gagcgagaaagaauggaaa

SEQ ID NO: 1394480 - RNA, 19 nt, Homo sapiens
aguguuaaauucacaggaa

SEQ ID NO: 1394481 - RNA, 19 nt, Homo sapiens
aaacugugccauuccuaaa

SEQ ID NO: 1394482 - RNA, 19 nt, Homo sapiens
ucuguguucuuguaucuga

SEQ ID NO: 1394483 - RNA, 19 nt, Homo sapiens
aaagggaacagcuggaaug

SEQ ID NO: 1394484 - RNA, 19 nt, Homo sapiens
cagcaaagaggaugccaau

SEQ ID NO: 1394485 - RNA, 19 nt, Homo sapiens
caagaacagcaacggcaaa

SEQ ID NO: 1394486 - RNA, 19 nt, Homo sapiens
uguauggucucaacuuugg

SEQ ID NO: 1394487 - RNA, 19 nt, Homo sapiens
agaaagaauggaaagagaa

SEQ ID NO: 1394488 - RNA, 19 nt, Homo sapiens
ggagcgagaaagaauggaa

SEQ ID NO: 1394489 - RNA, 19 nt, Homo sapiens
guguuaaauucacaggaaa

SEQ ID NO: 1394490 - RNA, 19 nt, Homo sapiens
gaggcaagaaagacaagaa

SEQ ID NO: 1394491 - RNA, 19 nt, Homo sapiens
aaagaagacaacuacaaga

SEQ ID NO: 1394492 - RNA, 19 nt, Homo sapiens
gcaugccuuagaaguguua

SEQ ID NO: 1394493 - RNA, 19 nt, Homo sapiens
caagaaagggagcgacaag

SEQ ID NO: 1394494 - RNA, 19 nt, Homo sapiens
gaugcaugccuuagaagug

SEQ ID NO: 1394495 - RNA, 19 nt, Homo sapiens
cgugauaaacugugccauu

SEQ ID NO: 1394496 - RNA, 19 nt, Homo sapiens
ggaaauucaaagaagacaa

SEQ ID NO: 1394497 - RNA, 19 nt, Homo sapiens
agagagcgcagaauaucaa

SEQ ID NO: 1394498 - RNA, 19 nt, Homo sapiens
gcaagaaagggagcgacaa

SEQ ID NO: 1394499 - RNA, 19 nt, Homo sapiens
ggagcgacuggaacaagaa

SEQ ID NO: 1394500 - RNA, 19 nt, Homo sapiens
gaaagguuggagagagaga

SEQ ID NO: 1394501 - RNA, 19 nt, Homo sapiens
ggccaacauugccuagaca

SEQ ID NO: 1394502 - RNA, 19 nt, Homo sapiens
uuacaaacucuucuguguu

SEQ ID NO: 1394503 - RNA, 19 nt, Homo sapiens
gggccaacauugccuagac

SEQ ID NO: 1394504 - RNA, 19 nt, Homo sapiens
caacauugccuagacaaaa

SEQ ID NO: 1394505 - RNA, 19 nt, Homo sapiens
ugcagcaauuacuacuuua

SEQ ID NO: 1394506 - RNA, 19 nt, Homo sapiens
gcgacaagagcaguuagaa

SEQ ID NO: 1394507 - RNA, 19 nt, Homo sapiens
agagagagagguuagaaag

SEQ ID NO: 1394508 - RNA, 19 nt, Homo sapiens
gagaugcuagacaggugua

SEQ ID NO: 1394509 - RNA, 19 nt, Homo sapiens
uaucaagugcugguaagaa

SEQ ID NO: 1394510 - RNA, 19 nt, Homo sapiens
cgagaaagaauggaaagag

SEQ ID NO: 1394511 - RNA, 19 nt, Homo sapiens
ccaacauugccuagacaaa

SEQ ID NO: 1394512 - RNA, 19 nt, Homo sapiens
gaacagcaacggcaaaagg

SEQ ID NO: 1394513 - RNA, 19 nt, Homo sapiens
gcuuggaugaugucucuug

SEQ ID NO: 1394514 - RNA, 19 nt, Homo sapiens
caaacucuucuguguucuu

SEQ ID NO: 1394515 - RNA, 19 nt, Homo sapiens
cuucgcaagugccaugaug

SEQ ID NO: 1394516 - RNA, 19 nt, Homo sapiens
uaaaugagauggcgaucaa

SEQ ID NO: 1394517 - RNA, 19 nt, Homo sapiens
gcacgugucugucgaaucg

SEQ ID NO: 1394518 - RNA, 19 nt, Homo sapiens
gaaggcauuuacucuaugu

SEQ ID NO: 1394519 - RNA, 19 nt, Homo sapiens
ccaaagucccguacaaauu

SEQ ID NO: 1394520 - RNA, 19 nt, Homo sapiens
gggacagccucaaacguuu

SEQ ID NO: 1394521 - RNA, 19 nt, Homo sapiens
gagccaaagucccguacaa

SEQ ID NO: 1394522 - RNA, 19 nt, Homo sapiens
ucacaagucuggaaaucug

SEQ ID NO: 1394523 - RNA, 19 nt, Homo sapiens
caaagucccguacaaauuc

SEQ ID NO: 1394524 - RNA, 19 nt, Homo sapiens
gccuaaaugugaccauaaa

SEQ ID NO: 1394525 - RNA, 19 nt, Homo sapiens
gaucuuaccaacaguauca

SEQ ID NO: 1394526 - RNA, 19 nt, Homo sapiens
ccacuggaauguugaagau

SEQ ID NO: 1394527 - RNA, 19 nt, Homo sapiens
gaugaggaccaacuugaaa

SEQ ID NO: 1394528 - RNA, 19 nt, Homo sapiens
aagaaggcauuuacucuau

SEQ ID NO: 1394529 - RNA, 19 nt, Homo sapiens
ggaaaucugcauugucguu

SEQ ID NO: 1394530 - RNA, 19 nt, Homo sapiens
ccacgaagaugaggaccaa

SEQ ID NO: 1394531 - RNA, 19 nt, Homo sapiens
uccaaacucuuaaaugaga

SEQ ID NO: 1394532 - RNA, 19 nt, Homo sapiens
gaagaugaggaccaacuug

SEQ ID NO: 1394533 - RNA, 19 nt, Homo sapiens
aaagaaggcauuuacucua

SEQ ID NO: 1394534 - RNA, 19 nt, Homo sapiens
gcauuagcuuguuucauca

SEQ ID NO: 1394535 - RNA, 19 nt, Homo sapiens
gaaaagaaaagaaggcauu

SEQ ID NO: 1394536 - RNA, 19 nt, Homo sapiens
gaaaucugcauugucguuu

SEQ ID NO: 1394537 - RNA, 19 nt, Homo sapiens
gagucgaaguugaaaggaa

SEQ ID NO: 1394538 - RNA, 19 nt, Homo sapiens
gaauccaaacucuuaaaug

SEQ ID NO: 1394539 - RNA, 19 nt, Homo sapiens
cuauuuacauuggcccuua

SEQ ID NO: 1394540 - RNA, 19 nt, Homo sapiens
cagccuaaaugugaccaua

SEQ ID NO: 1394541 - RNA, 19 nt, Homo sapiens
uugcugaccuauuuacauu

SEQ ID NO: 1394542 - RNA, 19 nt, Homo sapiens
gcuaacccuucaccacuug

SEQ ID NO: 1394543 - RNA, 19 nt, Homo sapiens
ggaccaacuugaaaagauu

SEQ ID NO: 1394544 - RNA, 19 nt, Homo sapiens
agcauuagcuuguuucauc

SEQ ID NO: 1394545 - RNA, 19 nt, Homo sapiens
uuacagcuguguuccuuuc

SEQ ID NO: 1394546 - RNA, 19 nt, Homo sapiens
uugaagauccugagacuga

SEQ ID NO: 1394547 - RNA, 19 nt, Homo sapiens
cacugaauccaaacucuua

SEQ ID NO: 1394548 - RNA, 19 nt, Homo sapiens
uaggagcauuagcuuguuu

SEQ ID NO: 1394549 - RNA, 19 nt, Homo sapiens
gccaaagucccguacaaau

SEQ ID NO: 1394550 - RNA, 19 nt, Homo sapiens
cagcgguaaucguguguug

SEQ ID NO: 1394551 - RNA, 19 nt, Homo sapiens
cauuacagcuguguuccuu

SEQ ID NO: 1394552 - RNA, 19 nt, Homo sapiens
gcugaccuauuuacauugg

SEQ ID NO: 1394553 - RNA, 19 nt, Homo sapiens
ccacuugcugaccuauuua

SEQ ID NO: 1394554 - RNA, 19 nt, Homo sapiens
caucaucacccaagccaau

SEQ ID NO: 1394555 - RNA, 19 nt, Homo sapiens
accacuugcugaccuauuu

SEQ ID NO: 1394556 - RNA, 19 nt, Homo sapiens
uauaugugcuaacccuuca

SEQ ID NO: 1394557 - RNA, 19 nt, Homo sapiens
uacauuggcccuuacuuga

SEQ ID NO: 1394558 - RNA, 19 nt, Homo sapiens
uuacauuggcccuuacuug

SEQ ID NO: 1394559 - RNA, 19 nt, Homo sapiens
aaauuagggcugcugcuuu

SEQ ID NO: 1394560 - RNA, 19 nt, Homo sapiens
agaaggcauuuacucuaug

SEQ ID NO: 1394561 - RNA, 19 nt, Homo sapiens
cuuaccaacaguaucauua

SEQ ID NO: 1394562 - RNA, 19 nt, Homo sapiens
gaaaagaaggcauuuacuc

SEQ ID NO: 1394563 - RNA, 19 nt, Homo sapiens
cauuggcccuuacuugauc

SEQ ID NO: 1394564 - RNA, 19 nt, Homo sapiens
aaucacaagucuggaaauc

SEQ ID NO: 1394565 - RNA, 19 nt, Homo sapiens
ggacagccucaaacguuuc

SEQ ID NO: 1394566 - RNA, 19 nt, Homo sapiens
uucaguaguugccaucuug

SEQ ID NO: 1394567 - RNA, 19 nt, Homo sapiens
aagaugaggaccaacuuga

SEQ ID NO: 1394568 - RNA, 19 nt, Homo sapiens
aaagucccguacaaauuca

SEQ ID NO: 1394569 - RNA, 19 nt, Homo sapiens
uaccaacaguaucauuaca

SEQ ID NO: 1394570 - RNA, 19 nt, Homo sapiens
ugcacacacugaauccaaa

SEQ ID NO: 1394571 - RNA, 19 nt, Homo sapiens
uguguuccuuucaguaguu

SEQ ID NO: 1394572 - RNA, 19 nt, Homo sapiens
cgaagaugaggaccaacuu

SEQ ID NO: 1394573 - RNA, 19 nt, Homo sapiens
cagcuguguuccuuucagu

SEQ ID NO: 1394574 - RNA, 19 nt, Homo sapiens
uaucauuacagcuguguuc

SEQ ID NO: 1394575 - RNA, 19 nt, Homo sapiens
agggacagccucaaacguu

SEQ ID NO: 1394576 - RNA, 19 nt, Homo sapiens
cacccaagccaaugaguca

SEQ ID NO: 1394577 - RNA, 19 nt, Homo sapiens
gaagauccugagacugagu

SEQ ID NO: 1394578 - RNA, 19 nt, Homo sapiens
aauuagggcugcugcuuuu

SEQ ID NO: 1394579 - RNA, 19 nt, Homo sapiens
cgcaugcugucacccauuc

SEQ ID NO: 1394580 - RNA, 19 nt, Homo sapiens
ugagauggcgaucaaagag

SEQ ID NO: 1394581 - RNA, 19 nt, Homo sapiens
gcuguguuccuuucaguag

SEQ ID NO: 1394582 - RNA, 19 nt, Homo sapiens
ccaaacucuuaaaugagau

SEQ ID NO: 1394583 - RNA, 19 nt, Homo sapiens
acaaucacaagucuggaaa

SEQ ID NO: 1394584 - RNA, 19 nt, Homo sapiens
cuuaggagcauuagcuugu

SEQ ID NO: 1394585 - RNA, 19 nt, Homo sapiens
gggagucgaaguugaaagg

SEQ ID NO: 1394586 - RNA, 19 nt, Homo sapiens
gcgguaaucguguguugca

SEQ ID NO: 1394587 - RNA, 19 nt, Homo sapiens
uacuugaucuuaccaacag

SEQ ID NO: 1394588 - RNA, 19 nt, Homo sapiens
uuaggagcauuagcuuguu

SEQ ID NO: 1394589 - RNA, 19 nt, Homo sapiens
agucuuaucuuaggagcau

SEQ ID NO: 1394590 - RNA, 19 nt, Homo sapiens
ucaaacguuucuccuucuc

SEQ ID NO: 1394591 - RNA, 19 nt, Homo sapiens
gaagaguacugcaggaaga

SEQ ID NO: 1394592 - RNA, 19 nt, Homo sapiens
gagaauggcccgugaguga

SEQ ID NO: 1394593 - RNA, 19 nt, Homo sapiens
gcucuuggcuacagaaaug

SEQ ID NO: 1394594 - RNA, 19 nt, Homo sapiens
aauccuaacuguugcauaa

SEQ ID NO: 1394595 - RNA, 19 nt, Homo sapiens
gaggagaaguaaagccauu

SEQ ID NO: 1394596 - RNA, 19 nt, Homo sapiens
gaaaagaccuacaggaagu

SEQ ID NO: 1394597 - RNA, 19 nt, Homo sapiens
ggaaaucguugagaagcuu

SEQ ID NO: 1394598 - RNA, 19 nt, Homo sapiens
cgacaauuaugaugcagaa

SEQ ID NO: 1394599 - RNA, 19 nt, Homo sapiens
gaaaaucaguaaagacuca

SEQ ID NO: 1394600 - RNA, 19 nt, Homo sapiens
ccacagaggagaaguaaag

SEQ ID NO: 1394601 - RNA, 19 nt, Homo sapiens
gagaugcuauguggaaauc

SEQ ID NO: 1394602 - RNA, 19 nt, Homo sapiens
ggugagaugcuauguggaa

SEQ ID NO: 1394603 - RNA, 19 nt, Homo sapiens
gggcugaggaggagacaaa

SEQ ID NO: 1394604 - RNA, 19 nt, Homo sapiens
agacccagcuaccauugaa

SEQ ID NO: 1394605 - RNA, 19 nt, Homo sapiens
cuaacucucuguuuccaau

SEQ ID NO: 1394606 - RNA, 19 nt, Homo sapiens
gcucagcuaaagcccaaua

SEQ ID NO: 1394607 - RNA, 19 nt, Homo sapiens
caauuaugaugcagaagag

SEQ ID NO: 1394608 - RNA, 19 nt, Homo sapiens
gcacugguuuuacuuugaa

SEQ ID NO: 1394609 - RNA, 19 nt, Homo sapiens
gggagauggugagaugcua

SEQ ID NO: 1394610 - RNA, 19 nt, Homo sapiens
ggcacacaccguucaauga

SEQ ID NO: 1394611 - RNA, 19 nt, Homo sapiens
gcuaaagcccaauaacuac

SEQ ID NO: 1394612 - RNA, 19 nt, Homo sapiens
acaucuaacucucuguuuc

SEQ ID NO: 1394613 - RNA, 19 nt, Homo sapiens
ggagaaguaaagccauuuc

SEQ ID NO: 1394614 - RNA, 19 nt, Homo sapiens
acaauuaugaugcagaaga

SEQ ID NO: 1394615 - RNA, 19 nt, Homo sapiens
gaaaugucugcaaggagaa

SEQ ID NO: 1394616 - RNA, 19 nt, Homo sapiens
ccacaucuaacucucuguu

SEQ ID NO: 1394617 - RNA, 19 nt, Homo sapiens
gggaaaagaccuacaggaa

SEQ ID NO: 1394618 - RNA, 19 nt, Homo sapiens
agcuaaagcccaauaacua

SEQ ID NO: 1394619 - RNA, 19 nt, Homo sapiens
gaugcuauguggaaaucgu

SEQ ID NO: 1394620 - RNA, 19 nt, Homo sapiens
ggagauggugagaugcuau

SEQ ID NO: 1394621 - RNA, 19 nt, Homo sapiens
gaauggcccgugagugaca

SEQ ID NO: 1394622 - RNA, 19 nt, Homo sapiens
gugagaugcuauguggaaa

SEQ ID NO: 1394623 - RNA, 19 nt, Homo sapiens
ccugggauggagaaauuua

SEQ ID NO: 1394624 - RNA, 19 nt, Homo sapiens
gagcacugguuuuacuuug

SEQ ID NO: 1394625 - RNA, 19 nt, Homo sapiens
ggugagggugucucuguga

SEQ ID NO: 1394626 - RNA, 19 nt, Homo sapiens
gcacuguaggcaugaagau

SEQ ID NO: 1394627 - RNA, 19 nt, Homo sapiens
gugccuggaugaucuguac

SEQ ID NO: 1394628 - RNA, 19 nt, Homo sapiens
gaauccuaacuguugcaua

SEQ ID NO: 1394629 - RNA, 19 nt, Homo sapiens
gugccugacuggccacauc

SEQ ID NO: 1394630 - RNA, 19 nt, Homo sapiens
gcgaugcucuuggcuacag

SEQ ID NO: 1394631 - RNA, 19 nt, Homo sapiens
cagcuaaagcccaauaacu

SEQ ID NO: 1394632 - RNA, 19 nt, Homo sapiens
gaggagaggaaaaucagua

SEQ ID NO: 1394633 - RNA, 19 nt, Homo sapiens
gagauggugagaugcuaug

SEQ ID NO: 1394634 - RNA, 19 nt, Homo sapiens
uucagaauccuaacuguug

SEQ ID NO: 1394635 - RNA, 19 nt, Homo sapiens
gggaagacgaggccacgau

SEQ ID NO: 1394636 - RNA, 19 nt, Homo sapiens
aacucucuguuuccaauuu

SEQ ID NO: 1394637 - RNA, 19 nt, Homo sapiens
gguuuuacuuugaagcuaa

SEQ ID NO: 1394638 - RNA, 19 nt, Homo sapiens
cagaagaguacugcaggaa

SEQ ID NO: 1394639 - RNA, 19 nt, Homo sapiens
ccaccaaggccaugugcau

SEQ ID NO: 1394640 - RNA, 19 nt, Homo sapiens
guccacagaggagaaguaa

SEQ ID NO: 1394641 - RNA, 19 nt, Homo sapiens
gaaguggagcucggaaggu

SEQ ID NO: 1394642 - RNA, 19 nt, Homo sapiens
caggaggagcugcaacguu

SEQ ID NO: 1394643 - RNA, 19 nt, Homo sapiens
aauuuaaggcugcgauguu

SEQ ID NO: 1394644 - RNA, 19 nt, Homo sapiens
caggaaacagcuggacuga

SEQ ID NO: 1394645 - RNA, 19 nt, Homo sapiens
auuuaaggcugcgauguug

SEQ ID NO: 1394646 - RNA, 19 nt, Homo sapiens
ccagacccagcuaccauug

SEQ ID NO: 1394647 - RNA, 19 nt, Homo sapiens
gccagacccagcuaccauu

SEQ ID NO: 1394648 - RNA, 19 nt, Homo sapiens
accgggagauggugagaug

SEQ ID NO: 1394649 - RNA, 19 nt, Homo sapiens
ggaaacugcugccucuguu

SEQ ID NO: 1394650 - RNA, 19 nt, Homo sapiens
gcacccagcaccuuucuuu

SEQ ID NO: 1394651 - RNA, 19 nt, Homo sapiens
uggcuggaguggucaauaa

SEQ ID NO: 1394652 - RNA, 19 nt, Homo sapiens
cauggacgcuggcacaauc

SEQ ID NO: 1394653 - RNA, 19 nt, Homo sapiens
gcucauccucucugccuuu

SEQ ID NO: 1394654 - RNA, 19 nt, Homo sapiens
gaaacugcugccucuguug

SEQ ID NO: 1394655 - RNA, 19 nt, Homo sapiens
gccuaugucugcagcacuu

SEQ ID NO: 1394656 - RNA, 19 nt, Homo sapiens
aaacugcugccucuguuga

SEQ ID NO: 1394657 - RNA, 19 nt, Homo sapiens
gguugcugcuguuguugaa

SEQ ID NO: 1394658 - RNA, 19 nt, Homo sapiens
caccuucacugggaugaug

SEQ ID NO: 1394659 - RNA, 19 nt, Homo sapiens
ggacgcuggcacaaucuug

SEQ ID NO: 1394660 - RNA, 19 nt, Homo sapiens
gaguugggacuguggaaug

SEQ ID NO: 1394661 - RNA, 19 nt, Homo sapiens
gggccuagccugucagacu

SEQ ID NO: 1394662 - RNA, 19 nt, Homo sapiens
guccagacccuagccugua

SEQ ID NO: 1394663 - RNA, 19 nt, Homo sapiens
gacgcuggcacaaucuuga

SEQ ID NO: 1394664 - RNA, 19 nt, Homo sapiens
acccagcaccuuucuuuga

SEQ ID NO: 1394665 - RNA, 19 nt, Homo sapiens
ggucaauaaagccacaugu

SEQ ID NO: 1394666 - RNA, 19 nt, Homo sapiens
ccuagcacccagcaccuuu

SEQ ID NO: 1394667 - RNA, 19 nt, Homo sapiens
gcauggacgcuggcacaau

SEQ ID NO: 1394668 - RNA, 19 nt, Homo sapiens
gugccgccaugcaggaugu

SEQ ID NO: 1394669 - RNA, 19 nt, Homo sapiens
cgacaacuccggccaauaa

SEQ ID NO: 1394670 - RNA, 19 nt, Homo sapiens
gccgagagcugcaggcuuu

SEQ ID NO: 1394671 - RNA, 19 nt, Homo sapiens
ccaauaaacacuuucugaa

SEQ ID NO: 1394672 - RNA, 19 nt, Homo sapiens
cugaguagcuggaauuaca

SEQ ID NO: 1394673 - RNA, 19 nt, Homo sapiens
gccaauaaacacuuucuga

SEQ ID NO: 1394674 - RNA, 19 nt, Homo sapiens
ugacuucaguugugguaau

SEQ ID NO: 1394675 - RNA, 19 nt, Homo sapiens
ugcagcagcuccuggauga

SEQ ID NO: 1394676 - RNA, 19 nt, Homo sapiens
ugugcaagauucacucuga

SEQ ID NO: 1394677 - RNA, 19 nt, Homo sapiens
caacuccggccaauaaaca

SEQ ID NO: 1394678 - RNA, 19 nt, Homo sapiens
ggucacacuuccagacauc

SEQ ID NO: 1394679 - RNA, 19 nt, Homo sapiens
cagcauguacccaucauug

SEQ ID NO: 1394680 - RNA, 19 nt, Homo sapiens
gcgcaagaguuggccaaga

SEQ ID NO: 1394681 - RNA, 19 nt, Homo sapiens
cagcggcuccuucaagauu

SEQ ID NO: 1394682 - RNA, 19 nt, Homo sapiens
gagguucagcugacuggaa

SEQ ID NO: 1394683 - RNA, 19 nt, Homo sapiens
cgcaagaguuggccaagag

SEQ ID NO: 1394684 - RNA, 19 nt, Homo sapiens
cccagcggcuccuucaaga

SEQ ID NO: 1394685 - RNA, 19 nt, Homo sapiens
ccaagcaggagcccuuuca

SEQ ID NO: 1394686 - RNA, 19 nt, Homo sapiens
ccuccuggacugcuucuuu

SEQ ID NO: 1394687 - RNA, 19 nt, Homo sapiens
gaagcugcccugugcaacu

SEQ ID NO: 1394688 - RNA, 19 nt, Homo sapiens
gagagcugcaggcuuugaa

SEQ ID NO: 1394689 - RNA, 19 nt, Homo sapiens
ggaggcaacaacaucaaca

SEQ ID NO: 1394690 - RNA, 19 nt, Homo sapiens
agguucagcugacuggaaa

SEQ ID NO: 1394691 - RNA, 19 nt, Homo sapiens
gacaacuccggccaauaaa

SEQ ID NO: 1394692 - RNA, 19 nt, Homo sapiens
gcaugccugucuuccucaa

SEQ ID NO: 1394693 - RNA, 19 nt, Homo sapiens
cagcagcuccuggaugaug

SEQ ID NO: 1394694 - RNA, 19 nt, Homo sapiens
acgcuggucugggauaguu

SEQ ID NO: 1394695 - RNA, 19 nt, Homo sapiens
uuccagacaucaccagugu

SEQ ID NO: 1394696 - RNA, 19 nt, Homo sapiens
ucugagggcgcaagaguug

SEQ ID NO: 1394697 - RNA, 19 nt, Homo sapiens
gcagauggcaguggaagcu

SEQ ID NO: 1394698 - RNA, 19 nt, Homo sapiens
gcuaggaagcugggcauuc

SEQ ID NO: 1394699 - RNA, 19 nt, Homo sapiens
caaccuuggcucacugcaa

SEQ ID NO: 1394700 - RNA, 19 nt, Homo sapiens
ucaccaguguggccaagag

SEQ ID NO: 1394701 - RNA, 19 nt, Homo sapiens
ccggcaagcuggucacacu

SEQ ID NO: 1394702 - RNA, 19 nt, Homo sapiens
gacuucaguugugguaauc

SEQ ID NO: 1394703 - RNA, 19 nt, Homo sapiens
gaggacaccgaggcuguga

SEQ ID NO: 1394704 - RNA, 19 nt, Homo sapiens
gcugcugccuaugcugcua

SEQ ID NO: 1394705 - RNA, 19 nt, Homo sapiens
ccucauaccuuaaccacua

SEQ ID NO: 1394706 - RNA, 19 nt, Homo sapiens
ccacuacccuuuaaaguuc

SEQ ID NO: 1394707 - RNA, 19 nt, Homo sapiens
ccaaucagauggucaagug

SEQ ID NO: 1394708 - RNA, 19 nt, Homo sapiens
accaguaucuuacacuuua

SEQ ID NO: 1394709 - RNA, 19 nt, Homo sapiens
ccaagaaggccuaccauga

SEQ ID NO: 1394710 - RNA, 19 nt, Homo sapiens
ugacagaauuccaaaccaa

SEQ ID NO: 1394711 - RNA, 19 nt, Homo sapiens
cagcuagguugcaaggaua

SEQ ID NO: 1394712 - RNA, 19 nt, Homo sapiens
caacagagcgagacuacau

SEQ ID NO: 1394713 - RNA, 19 nt, Homo sapiens
gggaugugguccugaaaga

SEQ ID NO: 1394714 - RNA, 19 nt, Homo sapiens
acacgacccuggaacauuc

SEQ ID NO: 1394715 - RNA, 19 nt, Homo sapiens
gcuacaaccagcugaauga

SEQ ID NO: 1394716 - RNA, 19 nt, Homo sapiens
ccuaccgccuuauacuuua

SEQ ID NO: 1394717 - RNA, 19 nt, Homo sapiens
gcaagcacaccaaccaguu

SEQ ID NO: 1394718 - RNA, 19 nt, Homo sapiens
gcaggaggauggcgugaac

SEQ ID NO: 1394719 - RNA, 19 nt, Homo sapiens
gguguccgauuggauuuaa

SEQ ID NO: 1394720 - RNA, 19 nt, Homo sapiens
caaagccaccuaugacaug

SEQ ID NO: 1394721 - RNA, 19 nt, Homo sapiens
gaugugguccugaaagaug

SEQ ID NO: 1394722 - RNA, 19 nt, Homo sapiens
caagaaggccuaccaugag

SEQ ID NO: 1394723 - RNA, 19 nt, Homo sapiens
guacuugacagaauuccaa

SEQ ID NO: 1394724 - RNA, 19 nt, Homo sapiens
gcaaagccaccuaugacau

SEQ ID NO: 1394725 - RNA, 19 nt, Homo sapiens
gaauaaugcugccccugaa

SEQ ID NO: 1394726 - RNA, 19 nt, Homo sapiens
caagcacaccaaccaguuu

SEQ ID NO: 1394727 - RNA, 19 nt, Homo sapiens
caacagcaaagccaccuau

SEQ ID NO: 1394728 - RNA, 19 nt, Homo sapiens
ucagcuagguugcaaggau

SEQ ID NO: 1394729 - RNA, 19 nt, Homo sapiens
ugacggagcccuacaacuc

SEQ ID NO: 1394730 - RNA, 19 nt, Homo sapiens
aucaggaacuuuaccauga

SEQ ID NO: 1394731 - RNA, 19 nt, Homo sapiens
ggagaccugcagaauaaug

SEQ ID NO: 1394732 - RNA, 19 nt, Homo sapiens
gaaggagguuaaaauggaa

SEQ ID NO: 1394733 - RNA, 19 nt, Homo sapiens
ccuggaacauucugacugu

SEQ ID NO: 1394734 - RNA, 19 nt, Homo sapiens
cugcagggcuuccucaucu

SEQ ID NO: 1394735 - RNA, 19 nt, Homo sapiens
guucgugucucugcucaug

SEQ ID NO: 1394736 - RNA, 19 nt, Homo sapiens
gaauguguacuugacagaa

SEQ ID NO: 1394737 - RNA, 19 nt, Homo sapiens
aagcuggaguuugccauuu

SEQ ID NO: 1394738 - RNA, 19 nt, Homo sapiens
gcucuggguucgugucucu

SEQ ID NO: 1394739 - RNA, 19 nt, Homo sapiens
uugagacgguccuggcuaa

SEQ ID NO: 1394740 - RNA, 19 nt, Homo sapiens
ggccaaggcaggcagauca

SEQ ID NO: 1394741 - RNA, 19 nt, Homo sapiens
uuuauuuccuaccgccuua

SEQ ID NO: 1394742 - RNA, 19 nt, Homo sapiens
uagguugcaaggauaauaa

SEQ ID NO: 1394743 - RNA, 19 nt, Homo sapiens
cagaucguguccuccauca

SEQ ID NO: 1394744 - RNA, 19 nt, Homo sapiens
ggcggcaucaggaacuuua

SEQ ID NO: 1394745 - RNA, 19 nt, Homo sapiens
agaaggagguuaaaaugga

SEQ ID NO: 1394746 - RNA, 19 nt, Homo sapiens
ccuguaaucccagcacuuu

SEQ ID NO: 1394747 - RNA, 19 nt, Homo sapiens
ggucaucucagccaagaag

SEQ ID NO: 1394748 - RNA, 19 nt, Homo sapiens
caggaacuuuaccaugaga

SEQ ID NO: 1394749 - RNA, 19 nt, Homo sapiens
uuaccaguaucuuacacuu

SEQ ID NO: 1394750 - RNA, 19 nt, Homo sapiens
uaaccacuacccuuuaaag

SEQ ID NO: 1394751 - RNA, 19 nt, Homo sapiens
acagcaaagccaccuauga

SEQ ID NO: 1394752 - RNA, 19 nt, Homo sapiens
ccuuaaccacuacccuuua

SEQ ID NO: 1394753 - RNA, 19 nt, Homo sapiens
gccuuauacuuuaccaaau

SEQ ID NO: 1394754 - RNA, 19 nt, Homo sapiens
cgauucagacuccgaccua

SEQ ID NO: 1394755 - RNA, 19 nt, Homo sapiens
aauguguacuugacagaau

SEQ ID NO: 1394756 - RNA, 19 nt, Homo sapiens
gcagggcuuccucaucuuc

SEQ ID NO: 1394757 - RNA, 19 nt, Homo sapiens
gaaaaucccgccagacagu

SEQ ID NO: 1394758 - RNA, 19 nt, Homo sapiens
ucaggaacuuuaccaugag

SEQ ID NO: 1394759 - RNA, 19 nt, Homo sapiens
caaccuggacaucgagugu

SEQ ID NO: 1394760 - RNA, 19 nt, Homo sapiens
cagcaaagccaccuaugac

SEQ ID NO: 1394761 - RNA, 19 nt, Homo sapiens
caagcuggaguuugccauu

SEQ ID NO: 1394762 - RNA, 19 nt, Homo sapiens
gcaauauuaccaguaucuu

SEQ ID NO: 1394763 - RNA, 19 nt, Homo sapiens
gauuggauuuaagguagga

SEQ ID NO: 1394764 - RNA, 19 nt, Homo sapiens
gccagacagugcaccaaag

SEQ ID NO: 1394765 - RNA, 19 nt, Homo sapiens
ccagcugaaugaccaagca

SEQ ID NO: 1394766 - RNA, 19 nt, Homo sapiens
cgccuuauacuuuaccaaa

SEQ ID NO: 1394767 - RNA, 19 nt, Homo sapiens
cggccucccugugauuuga

SEQ ID NO: 1394768 - RNA, 19 nt, Homo sapiens
gcuucgagccagccaauca

SEQ ID NO: 1394769 - RNA, 19 nt, Homo sapiens
ccucaucuuccacagcuuu

SEQ ID NO: 1394770 - RNA, 19 nt, Homo sapiens
caccuguggucccagcuau

SEQ ID NO: 1394771 - RNA, 19 nt, Homo sapiens
ggcaauauuaccaguaucu

SEQ ID NO: 1394772 - RNA, 19 nt, Homo sapiens
uaaaguucauggggcaaua

SEQ ID NO: 1394773 - RNA, 19 nt, Homo sapiens
ucgugucucugcucaugaa

SEQ ID NO: 1394774 - RNA, 19 nt, Homo sapiens
cacgaggucaggagauuga

SEQ ID NO: 1394775 - RNA, 19 nt, Homo sapiens
ugggugauguggaguccuu

SEQ ID NO: 1394776 - RNA, 19 nt, Homo sapiens
cgagccagccaaucagaug

SEQ ID NO: 1394777 - RNA, 19 nt, Homo sapiens
ggcccugaauguguacuug

SEQ ID NO: 1394778 - RNA, 19 nt, Homo sapiens
cuucauagucaacagcaaa

SEQ ID NO: 1394779 - RNA, 19 nt, Homo sapiens
ggaacuuuaccaugagaag

SEQ ID NO: 1394780 - RNA, 19 nt, Homo sapiens
ugaaugaccaagcagaucu

SEQ ID NO: 1394781 - RNA, 19 nt, Homo sapiens
gcagugagucgagauugca

SEQ ID NO: 1394782 - RNA, 19 nt, Homo sapiens
cuagguugcaaggauaaua

SEQ ID NO: 1394783 - RNA, 19 nt, Homo sapiens
gagacgguccuggcuaaca

SEQ ID NO: 1394784 - RNA, 19 nt, Homo sapiens
ggggcaauauuaccaguau

SEQ ID NO: 1394785 - RNA, 19 nt, Homo sapiens
gaggggaugugguccugaa

SEQ ID NO: 1394786 - RNA, 19 nt, Homo sapiens
gcugaaugaccaagcagau

SEQ ID NO: 1394787 - RNA, 19 nt, Homo sapiens
cagaauuccaaaccaacuu

SEQ ID NO: 1394788 - RNA, 19 nt, Homo sapiens
aaagccaccuaugacaugu

SEQ ID NO: 1394789 - RNA, 19 nt, Homo sapiens
cuuuaaagguugucgauua

SEQ ID NO: 1394790 - RNA, 19 nt, Homo sapiens
ccaacgaggucuucugcua

SEQ ID NO: 1394791 - RNA, 19 nt, Homo sapiens
gaacuuccugcucuuguuu

SEQ ID NO: 1394792 - RNA, 19 nt, Homo sapiens
gcacuuccacacacucuga

SEQ ID NO: 1394793 - RNA, 19 nt, Homo sapiens
gggcugggaucggaacuuc

SEQ ID NO: 1394794 - RNA, 19 nt, Homo sapiens
cccggaagcucaugguguu

SEQ ID NO: 1394795 - RNA, 19 nt, Homo sapiens
ggacgagugcccauacagu

SEQ ID NO: 1394796 - RNA, 19 nt, Homo sapiens
gcuacaacccucugaccaa

SEQ ID NO: 1394797 - RNA, 19 nt, Homo sapiens
ggaagcucaugguguuucu

SEQ ID NO: 1394798 - RNA, 19 nt, Homo sapiens
gguccucaguccauucauc

SEQ ID NO: 1394799 - RNA, 19 nt, Homo sapiens
gaaaccuuauugccauggu

SEQ ID NO: 1394800 - RNA, 19 nt, Homo sapiens
ggucagccacagccaagaa

SEQ ID NO: 1394801 - RNA, 19 nt, Homo sapiens
gcacaacuaccuguuucug

SEQ ID NO: 1394802 - RNA, 19 nt, Homo sapiens
caaagccucaggagagugu

SEQ ID NO: 1394803 - RNA, 19 nt, Homo sapiens
ccaaggccgucugcuccaa

SEQ ID NO: 1394804 - RNA, 19 nt, Homo sapiens
gcaccugcauguguucaac

SEQ ID NO: 1394805 - RNA, 19 nt, Homo sapiens
caagaagcuccgagaccaa

SEQ ID NO: 1394806 - RNA, 19 nt, Homo sapiens
cuuauugccaugguucuua

SEQ ID NO: 1394807 - RNA, 19 nt, Homo sapiens
caugcacaacuaccuguuu

SEQ ID NO: 1394808 - RNA, 19 nt, Homo sapiens
cugcgcaccugcauguguu

SEQ ID NO: 1394809 - RNA, 19 nt, Homo sapiens
gucaaagccucaggagagu

SEQ ID NO: 1394810 - RNA, 19 nt, Homo sapiens
gguugucgauuauuuugaa

SEQ ID NO: 1394811 - RNA, 19 nt, Homo sapiens
ggacaacuuuccccuucug

SEQ ID NO: 1394812 - RNA, 19 nt, Homo sapiens
gcuacgacccgcgaacaga

SEQ ID NO: 1394813 - RNA, 19 nt, Homo sapiens
acaacccucugaccaacau

SEQ ID NO: 1394814 - RNA, 19 nt, Homo sapiens
gagagggaaccagggagaa

SEQ ID NO: 1394815 - RNA, 19 nt, Homo sapiens
uggacgggcugcucuaugc

SEQ ID NO: 1394816 - RNA, 19 nt, Homo sapiens
caaacacucugauuacaug

SEQ ID NO: 1394817 - RNA, 19 nt, Homo sapiens
gggcagagcacgcuuguuu

SEQ ID NO: 1394818 - RNA, 19 nt, Homo sapiens
gggcaauuguaaucaguua

SEQ ID NO: 1394819 - RNA, 19 nt, Homo sapiens
gaaaggacagucucugaug

SEQ ID NO: 1394820 - RNA, 19 nt, Homo sapiens
ccagagaaauccaccaagu

SEQ ID NO: 1394821 - RNA, 19 nt, Homo sapiens
aaaggacagucucugauga

SEQ ID NO: 1394822 - RNA, 19 nt, Homo sapiens
gacagucucugaugaggau

SEQ ID NO: 1394823 - RNA, 19 nt, Homo sapiens
gcugguugauguggaauaa

SEQ ID NO: 1394824 - RNA, 19 nt, Homo sapiens
cagagaaauccaccaagua

SEQ ID NO: 1394825 - RNA, 19 nt, Homo sapiens
caacaacaggcuucaugaa

SEQ ID NO: 1394826 - RNA, 19 nt, Homo sapiens
ggacccaaguaccugauuc

SEQ ID NO: 1394827 - RNA, 19 nt, Homo sapiens
gggaaaggacagucucuga

SEQ ID NO: 1394828 - RNA, 19 nt, Homo sapiens
cagccucaaucaagaaguu

SEQ ID NO: 1394829 - RNA, 19 nt, Homo sapiens
ggaaaggacagucucugau

SEQ ID NO: 1394830 - RNA, 19 nt, Homo sapiens
ggugacuacuuuccagaga

SEQ ID NO: 1394831 - RNA, 19 nt, Homo sapiens
ggaaggccuuucucuccau

SEQ ID NO: 1394832 - RNA, 19 nt, Homo sapiens
guucaaggcuccgcaguac

SEQ ID NO: 1394833 - RNA, 19 nt, Homo sapiens
gcagagcacgcuuguuugg

SEQ ID NO: 1394834 - RNA, 19 nt, Homo sapiens
gcacugaagaaguuauagu

SEQ ID NO: 1394835 - RNA, 19 nt, Homo sapiens
ucccugcacugaagaaguu

SEQ ID NO: 1394836 - RNA, 19 nt, Homo sapiens
ucucuaggcugcucugagu

SEQ ID NO: 1394837 - RNA, 19 nt, Homo sapiens
gcugugcccaaauuauuaa

SEQ ID NO: 1394838 - RNA, 19 nt, Homo sapiens
gugacuacuuuccagagaa

SEQ ID NO: 1394839 - RNA, 19 nt, Homo sapiens
ccaacaacaggcuucauga

SEQ ID NO: 1394840 - RNA, 19 nt, Homo sapiens
uuucugcugugcccaaauu

SEQ ID NO: 1394841 - RNA, 19 nt, Homo sapiens
acagugagcuggccaugac

SEQ ID NO: 1394842 - RNA, 19 nt, Homo sapiens
cagcucagccucaaucaag

SEQ ID NO: 1394843 - RNA, 19 nt, Homo sapiens
guaagcccaugaggagaga

SEQ ID NO: 1394844 - RNA, 19 nt, Homo sapiens
guaccugauuccaccaaca

SEQ ID NO: 1394845 - RNA, 19 nt, Homo sapiens
cagccuaccgccaaacuga

SEQ ID NO: 1394846 - RNA, 19 nt, Homo sapiens
gcgacgaccuacacaagac

SEQ ID NO: 1394847 - RNA, 19 nt, Homo sapiens
gcacccagccacuccaucu

SEQ ID NO: 1394848 - RNA, 19 nt, Homo sapiens
caucacacccggcaucuac

SEQ ID NO: 1394849 - RNA, 19 nt, Homo sapiens
caauguaaaccccaagaua

SEQ ID NO: 1394850 - RNA, 19 nt, Homo sapiens
gcucagccucaaucaagaa

SEQ ID NO: 1394851 - RNA, 19 nt, Homo sapiens
caaguacguguucgacuca

SEQ ID NO: 1394852 - RNA, 19 nt, Homo sapiens
agagaaauccaccaaguac

SEQ ID NO: 1394853 - RNA, 19 nt, Homo sapiens
ucaaacacucugauuacau

SEQ ID NO: 1394854 - RNA, 19 nt, Homo sapiens
guugucaccuucggcauca

SEQ ID NO: 1394855 - RNA, 19 nt, Homo sapiens
ugacggaggagguauggau

SEQ ID NO: 1394856 - RNA, 19 nt, Homo sapiens
gagagaggaaggccuuucu

SEQ ID NO: 1394857 - RNA, 19 nt, Homo sapiens
ucuuugaccacuccaagua

SEQ ID NO: 1394858 - RNA, 19 nt, Homo sapiens
ggagagaggaaggccuuuc

SEQ ID NO: 1394859 - RNA, 19 nt, Homo sapiens
ugguccaggugacuacuuu

SEQ ID NO: 1394860 - RNA, 19 nt, Homo sapiens
cugcugugcccaaauuauu

SEQ ID NO: 1394861 - RNA, 19 nt, Homo sapiens
cacugaagaaguuauaguu

SEQ ID NO: 1394862 - RNA, 19 nt, Homo sapiens
ugaugaggaugggucucua

SEQ ID NO: 1394863 - RNA, 19 nt, Homo sapiens
ggccaugacggaggaggua

SEQ ID NO: 1394864 - RNA, 19 nt, Homo sapiens
gcacgcuuguuugggcaau

SEQ ID NO: 1394865 - RNA, 19 nt, Homo sapiens
ccaugcuccuggcagagaa

SEQ ID NO: 1394866 - RNA, 19 nt, Homo sapiens
ugcugugcccaaauuauua

SEQ ID NO: 1394867 - RNA, 19 nt, Homo sapiens
cagcgacgaccuacacaag

SEQ ID NO: 1394868 - RNA, 19 nt, Homo sapiens
ggaagucccuuauuuggaa

SEQ ID NO: 1394869 - RNA, 19 nt, Homo sapiens
gcucauggccagaaucuua

SEQ ID NO: 1394870 - RNA, 19 nt, Homo sapiens
ggaagcaaguccucgugua

SEQ ID NO: 1394871 - RNA, 19 nt, Homo sapiens
gccagaaucuuaaaccuau

SEQ ID NO: 1394872 - RNA, 19 nt, Homo sapiens
gagcaucuccucuucuuga

SEQ ID NO: 1394873 - RNA, 19 nt, Homo sapiens
gagcaaaacucuucucuca

SEQ ID NO: 1394874 - RNA, 19 nt, Homo sapiens
caaauggcguucuuaccaa

SEQ ID NO: 1394875 - RNA, 19 nt, Homo sapiens
ugaagggacugaccagcua

SEQ ID NO: 1394876 - RNA, 19 nt, Homo sapiens
ggauauguccucagccuuu

SEQ ID NO: 1394877 - RNA, 19 nt, Homo sapiens
cuacuuucauucagagaua

SEQ ID NO: 1394878 - RNA, 19 nt, Homo sapiens
uacaugugaugcucuguua

SEQ ID NO: 1394879 - RNA, 19 nt, Homo sapiens
agagggaaguacacacaua

SEQ ID NO: 1394880 - RNA, 19 nt, Homo sapiens
gagauuagagugucugaau

SEQ ID NO: 1394881 - RNA, 19 nt, Homo sapiens
agaaguaucugugggagaa

SEQ ID NO: 1394882 - RNA, 19 nt, Homo sapiens
gcaucauugucaagaagua

SEQ ID NO: 1394883 - RNA, 19 nt, Homo sapiens
gaggcuuacucucuucgua

SEQ ID NO: 1394884 - RNA, 19 nt, Homo sapiens
gcaaaacucuucucucaag

SEQ ID NO: 1394885 - RNA, 19 nt, Homo sapiens
acaggagccuucucugaaa

SEQ ID NO: 1394886 - RNA, 19 nt, Homo sapiens
guggauaaguggacacaug

SEQ ID NO: 1394887 - RNA, 19 nt, Homo sapiens
cuacguggcuuuguacaug

SEQ ID NO: 1394888 - RNA, 19 nt, Homo sapiens
agauuagagugucugaaua

SEQ ID NO: 1394889 - RNA, 19 nt, Homo sapiens
uaagaggcuugcuuucuca

SEQ ID NO: 1394890 - RNA, 19 nt, Homo sapiens
ggacacaugcccuuaagag

SEQ ID NO: 1394891 - RNA, 19 nt, Homo sapiens
cuugacagauugccauauu

SEQ ID NO: 1394892 - RNA, 19 nt, Homo sapiens
ccacaggagccuucucuga

SEQ ID NO: 1394893 - RNA, 19 nt, Homo sapiens
gggauuggaugggagaaga

SEQ ID NO: 1394894 - RNA, 19 nt, Homo sapiens
gaagagagaaaggaugugu

SEQ ID NO: 1394895 - RNA, 19 nt, Homo sapiens
gauauguccucagccuuug

SEQ ID NO: 1394896 - RNA, 19 nt, Homo sapiens
uaggguggcugcugagaug

SEQ ID NO: 1394897 - RNA, 19 nt, Homo sapiens
caccuugucuguguggaua

SEQ ID NO: 1394898 - RNA, 19 nt, Homo sapiens
uguacuacguggcuuugua

SEQ ID NO: 1394899 - RNA, 19 nt, Homo sapiens
gaacagccccacccuugua

SEQ ID NO: 1394900 - RNA, 19 nt, Homo sapiens
gaaggagauuagagugucu

SEQ ID NO: 1394901 - RNA, 19 nt, Homo sapiens
caugugaugcucuguuaaa

SEQ ID NO: 1394902 - RNA, 19 nt, Homo sapiens
uuaagaggcuugcuuucuc

SEQ ID NO: 1394903 - RNA, 19 nt, Homo sapiens
cuucguaggugacugugaa

SEQ ID NO: 1394904 - RNA, 19 nt, Homo sapiens
ggccagaaucuuaaaccua

SEQ ID NO: 1394905 - RNA, 19 nt, Homo sapiens
acacacucaucauggauug

SEQ ID NO: 1394906 - RNA, 19 nt, Homo sapiens
gaagcaaguccucguguac

SEQ ID NO: 1394907 - RNA, 19 nt, Homo sapiens
ggccuaacuuggagcaugu

SEQ ID NO: 1394908 - RNA, 19 nt, Homo sapiens
ucaaauggcguucuuacca

SEQ ID NO: 1394909 - RNA, 19 nt, Homo sapiens
gggccuggauaagcuauug

SEQ ID NO: 1394910 - RNA, 19 nt, Homo sapiens
cguaggugacugugaauuu

SEQ ID NO: 1394911 - RNA, 19 nt, Homo sapiens
cacaggagccuucucugaa

SEQ ID NO: 1394912 - RNA, 19 nt, Homo sapiens
cagcaucauugucaagaag

SEQ ID NO: 1394913 - RNA, 19 nt, Homo sapiens
gcuggcaggugggauaugu

SEQ ID NO: 1394914 - RNA, 19 nt, Homo sapiens
guaggugacugugaauuuu

SEQ ID NO: 1394915 - RNA, 19 nt, Homo sapiens
guuucucacuugacagauu

SEQ ID NO: 1394916 - RNA, 19 nt, Homo sapiens
agacgccaguccucaaaug

SEQ ID NO: 1394917 - RNA, 19 nt, Homo sapiens
guacaugugaugcucuguu

SEQ ID NO: 1394918 - RNA, 19 nt, Homo sapiens
ccagcaucauugucaagaa

SEQ ID NO: 1394919 - RNA, 19 nt, Homo sapiens
gauuagagugucugaauac

SEQ ID NO: 1394920 - RNA, 19 nt, Homo sapiens
gcagguucacacacacuuu

SEQ ID NO: 1394921 - RNA, 19 nt, Homo sapiens
agagaaaggauguguguag

SEQ ID NO: 1394922 - RNA, 19 nt, Homo sapiens
ccagaaucuuaaaccuauu

SEQ ID NO: 1394923 - RNA, 19 nt, Homo sapiens
uguacaaggugaaggagau

SEQ ID NO: 1394924 - RNA, 19 nt, Homo sapiens
uuacuuccuuuacgucuag

SEQ ID NO: 1394925 - RNA, 19 nt, Homo sapiens
gcacacacucaucauggau

SEQ ID NO: 1394926 - RNA, 19 nt, Homo sapiens
gaggcuugcuuucucaaaa

SEQ ID NO: 1394927 - RNA, 19 nt, Homo sapiens
cacugugaccaauucauua

SEQ ID NO: 1394928 - RNA, 19 nt, Homo sapiens
aggccaaccuggagcaguu

SEQ ID NO: 1394929 - RNA, 19 nt, Homo sapiens
gcaccuguuaaauaaaguu

SEQ ID NO: 1394930 - RNA, 19 nt, Homo sapiens
aaauggcguucuuaccaau

SEQ ID NO: 1394931 - RNA, 19 nt, Homo sapiens
uggagcagguucacacaca

SEQ ID NO: 1394932 - RNA, 19 nt, Homo sapiens
uugacagauugccauauuu

SEQ ID NO: 1394933 - RNA, 19 nt, Homo sapiens
ccaggaaccagugggauug

SEQ ID NO: 1394934 - RNA, 19 nt, Homo sapiens
guggacacaugcccuuaag

SEQ ID NO: 1394935 - RNA, 19 nt, Homo sapiens
cauugagcaucuccucuuc

SEQ ID NO: 1394936 - RNA, 19 nt, Homo sapiens
gagagaaaggaugugugua

SEQ ID NO: 1394937 - RNA, 19 nt, Homo sapiens
gacagcagccucaguagcu

SEQ ID NO: 1394938 - RNA, 19 nt, Homo sapiens
uccuuuacgucuagcagua

SEQ ID NO: 1394939 - RNA, 19 nt, Homo sapiens
uggaagccauugagcaucu

SEQ ID NO: 1394940 - RNA, 19 nt, Homo sapiens
gggccagcaucauugucaa

SEQ ID NO: 1394941 - RNA, 19 nt, Homo sapiens
gguugucagcccuguguuu

SEQ ID NO: 1394942 - RNA, 19 nt, Homo sapiens
gcauccagguagccuaagg

SEQ ID NO: 1394943 - RNA, 19 nt, Homo sapiens
agagagaaaggaugugugu

SEQ ID NO: 1394944 - RNA, 19 nt, Homo sapiens
ccagagggaaguacacaca

SEQ ID NO: 1394945 - RNA, 19 nt, Homo sapiens
gauguggagugggcaugug

SEQ ID NO: 1394946 - RNA, 19 nt, Homo sapiens
guacaaggugaaggagauu

SEQ ID NO: 1394947 - RNA, 19 nt, Homo sapiens
uugagcaucuccucuucuu

SEQ ID NO: 1394948 - RNA, 19 nt, Homo sapiens
ccauugagcaucuccucuu

SEQ ID NO: 1394949 - RNA, 19 nt, Homo sapiens
gguggaagccauugagcau

SEQ ID NO: 1394950 - RNA, 19 nt, Homo sapiens
ccaccaggguagccaagag

SEQ ID NO: 1394951 - RNA, 19 nt, Homo sapiens
guagcacacacucaucaug

SEQ ID NO: 1394952 - RNA, 19 nt, Homo sapiens
agugacagcagccucagua

SEQ ID NO: 1394953 - RNA, 19 nt, Homo sapiens
gagggaaguacacacauac

SEQ ID NO: 1394954 - RNA, 19 nt, Homo sapiens
ccgauuacuuccuuuacgu

SEQ ID NO: 1394955 - RNA, 19 nt, Homo sapiens
ggauuggaugggagaagaa

SEQ ID NO: 1394956 - RNA, 19 nt, Homo sapiens
guccucaaauggcguucuu

SEQ ID NO: 1394957 - RNA, 19 nt, Homo sapiens
uuucucacuugacagauug

SEQ ID NO: 1394958 - RNA, 19 nt, Homo sapiens
agggucaguuucucacuug

SEQ ID NO: 1394959 - RNA, 19 nt, Homo sapiens
gcucaacaagcucuucuac

SEQ ID NO: 1394960 - RNA, 19 nt, Homo sapiens
caggagccuucucugaaag

SEQ ID NO: 1394961 - RNA, 19 nt, Homo sapiens
ccaccaucuaucugucuua

SEQ ID NO: 1394962 - RNA, 19 nt, Homo sapiens
uugcaccuguuaaauaaag

SEQ ID NO: 1394963 - RNA, 19 nt, Homo sapiens
uaacuuggagcaugucacu

SEQ ID NO: 1394964 - RNA, 19 nt, Homo sapiens
gggacugaccagcuagcua

SEQ ID NO: 1394965 - RNA, 19 nt, Homo sapiens
ggccggagaaaccgacuga

SEQ ID NO: 1394966 - RNA, 19 nt, Homo sapiens
agcaaguccucguguacaa

SEQ ID NO: 1394967 - RNA, 19 nt, Homo sapiens
gacugugaauuuuguacua

SEQ ID NO: 1394968 - RNA, 19 nt, Homo sapiens
gcacugagcauuccacuua

SEQ ID NO: 1394969 - RNA, 19 nt, Homo sapiens
ggaaugagaucuagguugu

SEQ ID NO: 1394970 - RNA, 19 nt, Homo sapiens
ggauggaacucccuacuga

SEQ ID NO: 1394971 - RNA, 19 nt, Homo sapiens
gcaaugaugugccuugaca

SEQ ID NO: 1394972 - RNA, 19 nt, Homo sapiens
ggaagaggauagagaagga

SEQ ID NO: 1394973 - RNA, 19 nt, Homo sapiens
gcuaagggcuuccaaacau

SEQ ID NO: 1394974 - RNA, 19 nt, Homo sapiens
ggaaggauuugaaagaaca

SEQ ID NO: 1394975 - RNA, 19 nt, Homo sapiens
gaauauuacugguuucuac

SEQ ID NO: 1394976 - RNA, 19 nt, Homo sapiens
gcauuucucuauauacaug

SEQ ID NO: 1394977 - RNA, 19 nt, Homo sapiens
aggcuaaccuggaaacuaa

SEQ ID NO: 1394978 - RNA, 19 nt, Homo sapiens
caucggagcuggcaucauc

SEQ ID NO: 1394979 - RNA, 19 nt, Homo sapiens
gaccugcgcuguccagaga

SEQ ID NO: 1394980 - RNA, 19 nt, Homo sapiens
gagaggcuguuuaccagaa

SEQ ID NO: 1394981 - RNA, 19 nt, Homo sapiens
gaagagaauauuacugguu

SEQ ID NO: 1394982 - RNA, 19 nt, Homo sapiens
ggacucuuccuguuucaua

SEQ ID NO: 1394983 - RNA, 19 nt, Homo sapiens
gcucagaggcaagguaaua

SEQ ID NO: 1394984 - RNA, 19 nt, Homo sapiens
guaagagaguaguuagcua

SEQ ID NO: 1394985 - RNA, 19 nt, Homo sapiens
gaucagaaaguaugugaga

SEQ ID NO: 1394986 - RNA, 19 nt, Homo sapiens
acacuguuauucaugguua

SEQ ID NO: 1394987 - RNA, 19 nt, Homo sapiens
auagugaccugucuucauu

SEQ ID NO: 1394988 - RNA, 19 nt, Homo sapiens
gaacugaaccagggauaga

SEQ ID NO: 1394989 - RNA, 19 nt, Homo sapiens
ccugugagauuguggauga

SEQ ID NO: 1394990 - RNA, 19 nt, Homo sapiens
cuaagaggcuaaccuggaa

SEQ ID NO: 1394991 - RNA, 19 nt, Homo sapiens
uaagagaguaguuagcuaa

SEQ ID NO: 1394992 - RNA, 19 nt, Homo sapiens
guuaaacacuggucguuca

SEQ ID NO: 1394993 - RNA, 19 nt, Homo sapiens
ccucugugcuuuacuaaga

SEQ ID NO: 1394994 - RNA, 19 nt, Homo sapiens
ugaaagaacagcaugauca

SEQ ID NO: 1394995 - RNA, 19 nt, Homo sapiens
cagaugaggugcagguguu

SEQ ID NO: 1394996 - RNA, 19 nt, Homo sapiens
ccauagagcuuccuuucca

SEQ ID NO: 1394997 - RNA, 19 nt, Homo sapiens
caaagaaccauuagaaagg

SEQ ID NO: 1394998 - RNA, 19 nt, Homo sapiens
gcuccucugugcuuuacua

SEQ ID NO: 1394999 - RNA, 19 nt, Homo sapiens
cuucagggauggauaguga

SEQ ID NO: 1395000 - RNA, 19 nt, Homo sapiens
cauauagugugggaaauug

SEQ ID NO: 1395001 - RNA, 19 nt, Homo sapiens
uuacuaagauggccucagu

SEQ ID NO: 1395002 - RNA, 19 nt, Homo sapiens
ggaacuaccacuuuguguu

SEQ ID NO: 1395003 - RNA, 19 nt, Homo sapiens
ggacaacggccaccuguac

SEQ ID NO: 1395004 - RNA, 19 nt, Homo sapiens
cauuagaaagggcucauua

SEQ ID NO: 1395005 - RNA, 19 nt, Homo sapiens
gcauauagugugggaaauu

SEQ ID NO: 1395006 - RNA, 19 nt, Homo sapiens
ugacggagcgcaacauuuc

SEQ ID NO: 1395007 - RNA, 19 nt, Homo sapiens
ucaaagaaccauuagaaag

SEQ ID NO: 1395008 - RNA, 19 nt, Homo sapiens
gcaagguaauaaagcacuu

SEQ ID NO: 1395009 - RNA, 19 nt, Homo sapiens
uagcuaaccuaugggaauu

SEQ ID NO: 1395010 - RNA, 19 nt, Homo sapiens
gaggcaagguaauaaagca

SEQ ID NO: 1395011 - RNA, 19 nt, Homo sapiens
agaacagcaugaucagaaa

SEQ ID NO: 1395012 - RNA, 19 nt, Homo sapiens
gcucugcauuugacuuaau

SEQ ID NO: 1395013 - RNA, 19 nt, Homo sapiens
gcuaaccuaugggaauuau

SEQ ID NO: 1395014 - RNA, 19 nt, Homo sapiens
cuaagggcuuccaaacauu

SEQ ID NO: 1395015 - RNA, 19 nt, Homo sapiens
gaaucacucugcccuuguc

SEQ ID NO: 1395016 - RNA, 19 nt, Homo sapiens
gcuggagaagagaauauua

SEQ ID NO: 1395017 - RNA, 19 nt, Homo sapiens
ccucuaaccugugauguca

SEQ ID NO: 1395018 - RNA, 19 nt, Homo sapiens
ggucagcaccuuccuguag

SEQ ID NO: 1395019 - RNA, 19 nt, Homo sapiens
aaacacuggucguucaauc

SEQ ID NO: 1395020 - RNA, 19 nt, Homo sapiens
gacucuuccuguuucauaa

SEQ ID NO: 1395021 - RNA, 19 nt, Homo sapiens
gguuguggcugcugguaug

SEQ ID NO: 1395022 - RNA, 19 nt, Homo sapiens
ggcauacacuguuauucau

SEQ ID NO: 1395023 - RNA, 19 nt, Homo sapiens
gaggcuaaccuggaaacua

SEQ ID NO: 1395024 - RNA, 19 nt, Homo sapiens
cauaaggaaaggaagaauu

SEQ ID NO: 1395025 - RNA, 19 nt, Homo sapiens
agagggagaugcagcgaau

SEQ ID NO: 1395026 - RNA, 19 nt, Homo sapiens
gaaagaacagcaugaucag

SEQ ID NO: 1395027 - RNA, 19 nt, Homo sapiens
aagaacagcaugaucagaa

SEQ ID NO: 1395028 - RNA, 19 nt, Homo sapiens
cagguggucucuugguguu

SEQ ID NO: 1395029 - RNA, 19 nt, Homo sapiens
gcuccuagcagaagccuau

SEQ ID NO: 1395030 - RNA, 19 nt, Homo sapiens
gugcugggcauuaccauga

SEQ ID NO: 1395031 - RNA, 19 nt, Homo sapiens
gauagugaccugucuucau

SEQ ID NO: 1395032 - RNA, 19 nt, Homo sapiens
ccacuuuguguucugguua

SEQ ID NO: 1395033 - RNA, 19 nt, Homo sapiens
gggaaggauuugaaagaac

SEQ ID NO: 1395034 - RNA, 19 nt, Homo sapiens
auaaggaaaggaagaauug

SEQ ID NO: 1395035 - RNA, 19 nt, Homo sapiens
gcaaucaaagaaccauuag

SEQ ID NO: 1395036 - RNA, 19 nt, Homo sapiens
ucacagccccuaacucaua

SEQ ID NO: 1395037 - RNA, 19 nt, Homo sapiens
aggaggaacuaccacuuug

SEQ ID NO: 1395038 - RNA, 19 nt, Homo sapiens
uaggaggaacuaccacuuu

SEQ ID NO: 1395039 - RNA, 19 nt, Homo sapiens
uaccagaacagcauaacaa

SEQ ID NO: 1395040 - RNA, 19 nt, Homo sapiens
uaaccuaugggaauuauac

SEQ ID NO: 1395041 - RNA, 19 nt, Homo sapiens
gaacuuuggguugggaaug

SEQ ID NO: 1395042 - RNA, 19 nt, Homo sapiens
gaggaacuaccacuuugug

SEQ ID NO: 1395043 - RNA, 19 nt, Homo sapiens
ucugacaccugcauauagu

SEQ ID NO: 1395044 - RNA, 19 nt, Homo sapiens
aagcauuccucgucagcaa

SEQ ID NO: 1395045 - RNA, 19 nt, Homo sapiens
ccacuuaggaagaggauag

SEQ ID NO: 1395046 - RNA, 19 nt, Homo sapiens
aaaggaagaauugcacuga

SEQ ID NO: 1395047 - RNA, 19 nt, Homo sapiens
uggcauacacuguuauuca

SEQ ID NO: 1395048 - RNA, 19 nt, Homo sapiens
acagugaugcugcugcuaa

SEQ ID NO: 1395049 - RNA, 19 nt, Homo sapiens
gugagauuguggaugagaa

SEQ ID NO: 1395050 - RNA, 19 nt, Homo sapiens
gaacagcaugaucagaaag

SEQ ID NO: 1395051 - RNA, 19 nt, Homo sapiens
ucagaggcaagguaauaaa

SEQ ID NO: 1395052 - RNA, 19 nt, Homo sapiens
acagguaagagaguaguua

SEQ ID NO: 1395053 - RNA, 19 nt, Homo sapiens
cuacugaccucugagaacu

SEQ ID NO: 1395054 - RNA, 19 nt, Homo sapiens
aggcauuucucuauauaca

SEQ ID NO: 1395055 - RNA, 19 nt, Homo sapiens
ggagaagagaauauuacug

SEQ ID NO: 1395056 - RNA, 19 nt, Homo sapiens
cuugugagcugcuucuaag

SEQ ID NO: 1395057 - RNA, 19 nt, Homo sapiens
ggaggaacuaccacuuugu

SEQ ID NO: 1395058 - RNA, 19 nt, Homo sapiens
cuauaaaggcauuucucua

SEQ ID NO: 1395059 - RNA, 19 nt, Homo sapiens
gcauacacuguuauucaug

SEQ ID NO: 1395060 - RNA, 19 nt, Homo sapiens
uaagggcuuccaaacauug

SEQ ID NO: 1395061 - RNA, 19 nt, Homo sapiens
cacuuuguguucugguuaa

SEQ ID NO: 1395062 - RNA, 19 nt, Homo sapiens
acagcaugaucagaaagua

SEQ ID NO: 1395063 - RNA, 19 nt, Homo sapiens
caagugggccugauuuagc

SEQ ID NO: 1395064 - RNA, 19 nt, Homo sapiens
cgaauccuaguaagaguga

SEQ ID NO: 1395065 - RNA, 19 nt, Homo sapiens
gguggucucuugguguuag

SEQ ID NO: 1395066 - RNA, 19 nt, Homo sapiens
gauggauagugaccugucu

SEQ ID NO: 1395067 - RNA, 19 nt, Homo sapiens
uuaggaagaggauagagaa

SEQ ID NO: 1395068 - RNA, 19 nt, Homo sapiens
aaauagagcuugaaggaua

SEQ ID NO: 1395069 - RNA, 19 nt, Homo sapiens
ggacagaccugcuugagau

SEQ ID NO: 1395070 - RNA, 19 nt, Homo sapiens
guggaaagcuuaagaguga

SEQ ID NO: 1395071 - RNA, 19 nt, Homo sapiens
gcaacagaaucaugucuuu

SEQ ID NO: 1395072 - RNA, 19 nt, Homo sapiens
ucagugaccuuaagagauu

SEQ ID NO: 1395073 - RNA, 19 nt, Homo sapiens
agaaagauaugaggguuua

SEQ ID NO: 1395074 - RNA, 19 nt, Homo sapiens
gaggauaaauuacgaugga

SEQ ID NO: 1395075 - RNA, 19 nt, Homo sapiens
uggcugaccugcguaauua

SEQ ID NO: 1395076 - RNA, 19 nt, Homo sapiens
gaucugaauuugaccauca

SEQ ID NO: 1395077 - RNA, 19 nt, Homo sapiens
gaauaaagaaguuggaugu

SEQ ID NO: 1395078 - RNA, 19 nt, Homo sapiens
gagcugagaauguuggaua

SEQ ID NO: 1395079 - RNA, 19 nt, Homo sapiens
gaccugggcuuuauaugug

SEQ ID NO: 1395080 - RNA, 19 nt, Homo sapiens
agacggcaauucaguuuaa

SEQ ID NO: 1395081 - RNA, 19 nt, Homo sapiens
cgauaguugugcucacuua

SEQ ID NO: 1395082 - RNA, 19 nt, Homo sapiens
gaccugggauguggugaua

SEQ ID NO: 1395083 - RNA, 19 nt, Homo sapiens
ggaccagaauggaguuuca

SEQ ID NO: 1395084 - RNA, 19 nt, Homo sapiens
cagauuuccugaaguggua

SEQ ID NO: 1395085 - RNA, 19 nt, Homo sapiens
gcuuggauuugacuugaua

SEQ ID NO: 1395086 - RNA, 19 nt, Homo sapiens
caacaaaacuucgaaacaa

SEQ ID NO: 1395087 - RNA, 19 nt, Homo sapiens
ugaauugcuuguuggagua

SEQ ID NO: 1395088 - RNA, 19 nt, Homo sapiens
gaauuugaccaucacauug

SEQ ID NO: 1395089 - RNA, 19 nt, Homo sapiens
ggagacggcaauucaguuu

SEQ ID NO: 1395090 - RNA, 19 nt, Homo sapiens
guuuaaaccuccacuauac

SEQ ID NO: 1395091 - RNA, 19 nt, Homo sapiens
gaaaggcaacagaaucaug

SEQ ID NO: 1395092 - RNA, 19 nt, Homo sapiens
ggauuugacuugauaacgu

SEQ ID NO: 1395093 - RNA, 19 nt, Homo sapiens
gugcugauucucucaaaua

SEQ ID NO: 1395094 - RNA, 19 nt, Homo sapiens
uuaaugaggugucccaaca

SEQ ID NO: 1395095 - RNA, 19 nt, Homo sapiens
aaacuuguguugguuaaug

SEQ ID NO: 1395096 - RNA, 19 nt, Homo sapiens
ccgcuuaugugcuaaugaa

SEQ ID NO: 1395097 - RNA, 19 nt, Homo sapiens
ccaacaaguggaaagcuua

SEQ ID NO: 1395098 - RNA, 19 nt, Homo sapiens
gcacaccaaacucugaauu

SEQ ID NO: 1395099 - RNA, 19 nt, Homo sapiens
gggauucguuagcuccuuu

SEQ ID NO: 1395100 - RNA, 19 nt, Homo sapiens
ggccagauuuccugaagug

SEQ ID NO: 1395101 - RNA, 19 nt, Homo sapiens
caacaaguggaaagcuuaa

SEQ ID NO: 1395102 - RNA, 19 nt, Homo sapiens
gcagagacuccuugcguau

SEQ ID NO: 1395103 - RNA, 19 nt, Homo sapiens
aauagagcuugaaggauaa

SEQ ID NO: 1395104 - RNA, 19 nt, Homo sapiens
gagaaagauaugaggguuu

SEQ ID NO: 1395105 - RNA, 19 nt, Homo sapiens
uugaaccgcuuaugugcua

SEQ ID NO: 1395106 - RNA, 19 nt, Homo sapiens
cuuaagagauucagaucau

SEQ ID NO: 1395107 - RNA, 19 nt, Homo sapiens
gcagugagcccugagaaag

SEQ ID NO: 1395108 - RNA, 19 nt, Homo sapiens
gaggaaaggcaacagaauc

SEQ ID NO: 1395109 - RNA, 19 nt, Homo sapiens
acaccaaacucugaauuca

SEQ ID NO: 1395110 - RNA, 19 nt, Homo sapiens
caaguugaaccgcuuaugu

SEQ ID NO: 1395111 - RNA, 19 nt, Homo sapiens
gagaaggccaagauagaga

SEQ ID NO: 1395112 - RNA, 19 nt, Homo sapiens
gagaauguuggauacugua

SEQ ID NO: 1395113 - RNA, 19 nt, Homo sapiens
gagacggcaauucaguuua

SEQ ID NO: 1395114 - RNA, 19 nt, Homo sapiens
ugugcucacuuagaauuua

SEQ ID NO: 1395115 - RNA, 19 nt, Homo sapiens
uaguugugcucacuuagaa

SEQ ID NO: 1395116 - RNA, 19 nt, Homo sapiens
ggaggaaaggcaacagaau

SEQ ID NO: 1395117 - RNA, 19 nt, Homo sapiens
ugaauuugaccaucacauu

SEQ ID NO: 1395118 - RNA, 19 nt, Homo sapiens
gggauguggugauacuuca

SEQ ID NO: 1395119 - RNA, 19 nt, Homo sapiens
caauuccucugagcaguga

SEQ ID NO: 1395120 - RNA, 19 nt, Homo sapiens
uggauacuguacccagaua

SEQ ID NO: 1395121 - RNA, 19 nt, Homo sapiens
augaagagaugaugagauc

SEQ ID NO: 1395122 - RNA, 19 nt, Homo sapiens
ugagaauguuggauacugu

SEQ ID NO: 1395123 - RNA, 19 nt, Homo sapiens
uuucagaccugggcuuuau

SEQ ID NO: 1395124 - RNA, 19 nt, Homo sapiens
aaauuugaguggaccagaa

SEQ ID NO: 1395125 - RNA, 19 nt, Homo sapiens
ccagggagacggcaauuca

SEQ ID NO: 1395126 - RNA, 19 nt, Homo sapiens
gugauaagcccaaagacau

SEQ ID NO: 1395127 - RNA, 19 nt, Homo sapiens
accaaacucugaauucaau

SEQ ID NO: 1395128 - RNA, 19 nt, Homo sapiens
gcuaaugaagagaugauga

SEQ ID NO: 1395129 - RNA, 19 nt, Homo sapiens
agacauugguggcucaaag

SEQ ID NO: 1395130 - RNA, 19 nt, Homo sapiens
gauaagcccaaagacauug

SEQ ID NO: 1395131 - RNA, 19 nt, Homo sapiens
gaucagcauguuuauaaag

SEQ ID NO: 1395132 - RNA, 19 nt, Homo sapiens
ugaauucaauccccuguuu

SEQ ID NO: 1395133 - RNA, 19 nt, Homo sapiens
guauuuggguaccuguuuc

SEQ ID NO: 1395134 - RNA, 19 nt, Homo sapiens
gcaaaagucuauguuccaa

SEQ ID NO: 1395135 - RNA, 19 nt, Homo sapiens
ugaugaacaguuugaguuu

SEQ ID NO: 1395136 - RNA, 19 nt, Homo sapiens
ggugauaagcccaaagaca

SEQ ID NO: 1395137 - RNA, 19 nt, Homo sapiens
ggaagaggaccuugaaaau

SEQ ID NO: 1395138 - RNA, 19 nt, Homo sapiens
caucagugaccuuaagaga

SEQ ID NO: 1395139 - RNA, 19 nt, Homo sapiens
gaagaggaccuugaaaaug

SEQ ID NO: 1395140 - RNA, 19 nt, Homo sapiens
gcuuacagcaggaaagguu

SEQ ID NO: 1395141 - RNA, 19 nt, Homo sapiens
caccucauacccaagcuua

SEQ ID NO: 1395142 - RNA, 19 nt, Homo sapiens
gagcuugaaggauaaaucu

SEQ ID NO: 1395143 - RNA, 19 nt, Homo sapiens
gacuugauaacguguauug

SEQ ID NO: 1395144 - RNA, 19 nt, Homo sapiens
ugcauugaauugcuuguug

SEQ ID NO: 1395145 - RNA, 19 nt, Homo sapiens
cagaccugcuugagauaug

SEQ ID NO: 1395146 - RNA, 19 nt, Homo sapiens
ugauaagcccaaagacauu

SEQ ID NO: 1395147 - RNA, 19 nt, Homo sapiens
acagacagcgguaccaguu

SEQ ID NO: 1395148 - RNA, 19 nt, Homo sapiens
gcauguuuauaaagcuguu

SEQ ID NO: 1395149 - RNA, 19 nt, Homo sapiens
ggaagaaaauaaucuacag

SEQ ID NO: 1395150 - RNA, 19 nt, Homo sapiens
gaucaacaugagccuaaga

SEQ ID NO: 1395151 - RNA, 19 nt, Homo sapiens
aaagaaguuggauguggua

SEQ ID NO: 1395152 - RNA, 19 nt, Homo sapiens
aaacgggugcuuuccuuug

SEQ ID NO: 1395153 - RNA, 19 nt, Homo sapiens
gacagaccugcuugagaua

SEQ ID NO: 1395154 - RNA, 19 nt, Homo sapiens
gaugaacaguuugaguuuu

SEQ ID NO: 1395155 - RNA, 19 nt, Homo sapiens
gcugaccugcguaauuauu

SEQ ID NO: 1395156 - RNA, 19 nt, Homo sapiens
aauaaucuacagugcagua

SEQ ID NO: 1395157 - RNA, 19 nt, Homo sapiens
uuucagagcagcaugauca

SEQ ID NO: 1395158 - RNA, 19 nt, Homo sapiens
gacggcaauucaguuuaaa

SEQ ID NO: 1395159 - RNA, 19 nt, Homo sapiens
uggaguagauauuaaugag

SEQ ID NO: 1395160 - RNA, 19 nt, Homo sapiens
gcuuaugugcuaaugaaga

SEQ ID NO: 1395161 - RNA, 19 nt, Homo sapiens
cagcgguaccaguucguua

SEQ ID NO: 1395162 - RNA, 19 nt, Homo sapiens
aacgggugcuuuccuuuga

SEQ ID NO: 1395163 - RNA, 19 nt, Homo sapiens
uaaaacgggugcuuuccuu

SEQ ID NO: 1395164 - RNA, 19 nt, Homo sapiens
gggagacggcaauucaguu

SEQ ID NO: 1395165 - RNA, 19 nt, Homo sapiens
ugaggugucccaacaagug

SEQ ID NO: 1395166 - RNA, 19 nt, Homo sapiens
cuugauaacguguauugaa

SEQ ID NO: 1395167 - RNA, 19 nt, Homo sapiens
aaaagucaauccaugcauu

SEQ ID NO: 1395168 - RNA, 19 nt, Homo sapiens
ggaaaugccggcaguuuaa

SEQ ID NO: 1395169 - RNA, 19 nt, Homo sapiens
ggugagggcccauucuuua

SEQ ID NO: 1395170 - RNA, 19 nt, Homo sapiens
ggaagaggcccaacgagaa

SEQ ID NO: 1395171 - RNA, 19 nt, Homo sapiens
ccgaggagguggacuugua

SEQ ID NO: 1395172 - RNA, 19 nt, Homo sapiens
gaaagagaauuggaaaugc

SEQ ID NO: 1395173 - RNA, 19 nt, Homo sapiens
ucauggaccucuucacuga

SEQ ID NO: 1395174 - RNA, 19 nt, Homo sapiens
ugagaagucuuacaacauc

SEQ ID NO: 1395175 - RNA, 19 nt, Homo sapiens
gccacggccuccuuguuua

SEQ ID NO: 1395176 - RNA, 19 nt, Homo sapiens
aggcaggagugaaguauuu

SEQ ID NO: 1395177 - RNA, 19 nt, Homo sapiens
gaagaggcccaacgagaau

SEQ ID NO: 1395178 - RNA, 19 nt, Homo sapiens
gacgcuggaucccaaauga

SEQ ID NO: 1395179 - RNA, 19 nt, Homo sapiens
ccaaugagaagucuuacaa

SEQ ID NO: 1395180 - RNA, 19 nt, Homo sapiens
ggucauugcuguggucaug

SEQ ID NO: 1395181 - RNA, 19 nt, Homo sapiens
ccuagcaacugugugauuu

SEQ ID NO: 1395182 - RNA, 19 nt, Homo sapiens
caagagauugguggaauaa

SEQ ID NO: 1395183 - RNA, 19 nt, Homo sapiens
caucaaacacccaaugaga

SEQ ID NO: 1395184 - RNA, 19 nt, Homo sapiens
gguggacggugacaaagug

SEQ ID NO: 1395185 - RNA, 19 nt, Homo sapiens
gaugguggacggugacaaa

SEQ ID NO: 1395186 - RNA, 19 nt, Homo sapiens
guggagcccucuugucguu

SEQ ID NO: 1395187 - RNA, 19 nt, Homo sapiens
ugaaguauuuccuggagau

SEQ ID NO: 1395188 - RNA, 19 nt, Homo sapiens
uggaaaugccggcaguuua

SEQ ID NO: 1395189 - RNA, 19 nt, Homo sapiens
ccagaaagagaauuggaaa

SEQ ID NO: 1395190 - RNA, 19 nt, Homo sapiens
gaauuccagugcugacauc

SEQ ID NO: 1395191 - RNA, 19 nt, Homo sapiens
cuggagagcuuccugaaag

SEQ ID NO: 1395192 - RNA, 19 nt, Homo sapiens
gaacguagagcccuuugac

SEQ ID NO: 1395193 - RNA, 19 nt, Homo sapiens
ggacgaggcaggagugaag

SEQ ID NO: 1395194 - RNA, 19 nt, Homo sapiens
aaugagaagucuuacaaca

SEQ ID NO: 1395195 - RNA, 19 nt, Homo sapiens
gaggagacguugagcucau

SEQ ID NO: 1395196 - RNA, 19 nt, Homo sapiens
gcccauucuuuaaaccuuu

SEQ ID NO: 1395197 - RNA, 19 nt, Homo sapiens
gagaagucuuacaacauca

SEQ ID NO: 1395198 - RNA, 19 nt, Homo sapiens
agaaagagaauuggaaaug

SEQ ID NO: 1395199 - RNA, 19 nt, Homo sapiens
ugggagagcugagccagaa

SEQ ID NO: 1395200 - RNA, 19 nt, Homo sapiens
gcaggguuggccuccauua

SEQ ID NO: 1395201 - RNA, 19 nt, Homo sapiens
caggcaggaugucagauga

SEQ ID NO: 1395202 - RNA, 19 nt, Homo sapiens
gaaccaugccuucucuagu

SEQ ID NO: 1395203 - RNA, 19 nt, Homo sapiens
gcaggauggucucucacau

SEQ ID NO: 1395204 - RNA, 19 nt, Homo sapiens
ugacaggcgucggcuucua

SEQ ID NO: 1395205 - RNA, 19 nt, Homo sapiens
gcacaucagacgccaacug

SEQ ID NO: 1395206 - RNA, 19 nt, Homo sapiens
gugagggcccauucuuuaa

SEQ ID NO: 1395207 - RNA, 19 nt, Homo sapiens
guagguaaccaggucauug

SEQ ID NO: 1395208 - RNA, 19 nt, Homo sapiens
guaauuacggaguccagaa

SEQ ID NO: 1395209 - RNA, 19 nt, Homo sapiens
gaaaugccggcaguuuaau

SEQ ID NO: 1395210 - RNA, 19 nt, Homo sapiens
gagaggguccgaagcaucu

SEQ ID NO: 1395211 - RNA, 19 nt, Homo sapiens
aaccaugccuucucuaguc

SEQ ID NO: 1395212 - RNA, 19 nt, Homo sapiens
ccucugaaguggaguuucu

SEQ ID NO: 1395213 - RNA, 19 nt, Homo sapiens
cacccaaugagaagucuua

SEQ ID NO: 1395214 - RNA, 19 nt, Homo sapiens
ugacaggacagaacguaga

SEQ ID NO: 1395215 - RNA, 19 nt, Homo sapiens
cacugauggugauaucuuu

SEQ ID NO: 1395216 - RNA, 19 nt, Homo sapiens
ugagggcccauucuuuaaa

SEQ ID NO: 1395217 - RNA, 19 nt, Homo sapiens
aaugccggcaguuuaauua

SEQ ID NO: 1395218 - RNA, 19 nt, Homo sapiens
gcucaucaaacacccaaug

SEQ ID NO: 1395219 - RNA, 19 nt, Homo sapiens
uaauuacggaguccagaaa

SEQ ID NO: 1395220 - RNA, 19 nt, Homo sapiens
agagauugguggaauaaaa

SEQ ID NO: 1395221 - RNA, 19 nt, Homo sapiens
gagggcccauucuuuaaac

SEQ ID NO: 1395222 - RNA, 19 nt, Homo sapiens
gggugagggcccauucuuu

SEQ ID NO: 1395223 - RNA, 19 nt, Homo sapiens
ccucccauguggacagaaa

SEQ ID NO: 1395224 - RNA, 19 nt, Homo sapiens
ucaaacacccaaugagaag

SEQ ID NO: 1395225 - RNA, 19 nt, Homo sapiens
ugcaguggcuucuccuuuc

SEQ ID NO: 1395226 - RNA, 19 nt, Homo sapiens
gagaggcacccagccgaaa

SEQ ID NO: 1395227 - RNA, 19 nt, Homo sapiens
guccgaagcaucucaguca

SEQ ID NO: 1395228 - RNA, 19 nt, Homo sapiens
ggacgcuggaucccaaaug

SEQ ID NO: 1395229 - RNA, 19 nt, Homo sapiens
ccaccgagaccucugaagu

SEQ ID NO: 1395230 - RNA, 19 nt, Homo sapiens
uggagagcuuccugaaaga

SEQ ID NO: 1395231 - RNA, 19 nt, Homo sapiens
gcacgucaguagguaacca

SEQ ID NO: 1395232 - RNA, 19 nt, Homo sapiens
ggcccauucuuuaaaccuu

SEQ ID NO: 1395233 - RNA, 19 nt, Homo sapiens
cacuguggcucgaaagcuu

SEQ ID NO: 1395234 - RNA, 19 nt, Homo sapiens
ccacuggaucuuacagguu

SEQ ID NO: 1395235 - RNA, 19 nt, Homo sapiens
guggaagcuugaccagugu

SEQ ID NO: 1395236 - RNA, 19 nt, Homo sapiens
ugccacggccuccuuguuu

SEQ ID NO: 1395237 - RNA, 19 nt, Homo sapiens
ggagcccucuugucguuuu

SEQ ID NO: 1395238 - RNA, 19 nt, Homo sapiens
aaacugcugccgccucgaa

SEQ ID NO: 1395239 - RNA, 19 nt, Homo sapiens
ugcgacagcuuauagaaac

SEQ ID NO: 1395240 - RNA, 19 nt, Homo sapiens
gaagucuuacaacaucaga

SEQ ID NO: 1395241 - RNA, 19 nt, Homo sapiens
ggguuggccuccauuacuc

SEQ ID NO: 1395242 - RNA, 19 nt, Homo sapiens
gcucacugacuuccggauu

SEQ ID NO: 1395243 - RNA, 19 nt, Homo sapiens
gcaccaguuugcacaucag

SEQ ID NO: 1395244 - RNA, 19 nt, Homo sapiens
uuccagugcugacaucuca

SEQ ID NO: 1395245 - RNA, 19 nt, Homo sapiens
ucauugcuguggucaugga

SEQ ID NO: 1395246 - RNA, 19 nt, Homo sapiens
cauugcacgucaguaggua

SEQ ID NO: 1395247 - RNA, 19 nt, Homo sapiens
ugccaagccuagcaacugu

SEQ ID NO: 1395248 - RNA, 19 nt, Homo sapiens
caggauggucucucacaug

SEQ ID NO: 1395249 - RNA, 19 nt, Homo sapiens
gaggcaggagugaaguauu

SEQ ID NO: 1395250 - RNA, 19 nt, Homo sapiens
gcauugcacgucaguaggu

SEQ ID NO: 1395251 - RNA, 19 nt, Homo sapiens
ccaggcaggaugucagaug

SEQ ID NO: 1395252 - RNA, 19 nt, Homo sapiens
aagccuagcaacuguguga

SEQ ID NO: 1395253 - RNA, 19 nt, Homo sapiens
gcaguggcuucuccuuucc

SEQ ID NO: 1395254 - RNA, 19 nt, Homo sapiens
uuguuuacaugaaguggaa

SEQ ID NO: 1395255 - RNA, 19 nt, Homo sapiens
uaaaacaagucccaguucu

SEQ ID NO: 1395256 - RNA, 19 nt, Homo sapiens
caccgagaccucugaagug

SEQ ID NO: 1395257 - RNA, 19 nt, Homo sapiens
cagaaagagaauuggaaau

SEQ ID NO: 1395258 - RNA, 19 nt, Homo sapiens
ugucagaugaggagacguu

SEQ ID NO: 1395259 - RNA, 19 nt, Homo sapiens
aaaugccggcaguuuaauu

SEQ ID NO: 1395260 - RNA, 19 nt, Homo sapiens
gccuagcaacugugugauu

SEQ ID NO: 1395261 - RNA, 19 nt, Homo sapiens
gaguccagaaagagaauug

SEQ ID NO: 1395262 - RNA, 19 nt, Homo sapiens
aguauuuccuggagaugug

SEQ ID NO: 1395263 - RNA, 19 nt, Homo sapiens
gaaguauuuccuggagaug

SEQ ID NO: 1395264 - RNA, 19 nt, Homo sapiens
ugauggugauaucuuucaa

SEQ ID NO: 1395265 - RNA, 19 nt, Homo sapiens
gaacagaguugaugaaagu

SEQ ID NO: 1395266 - RNA, 19 nt, Homo sapiens
gugcaugacucuuccauaa

SEQ ID NO: 1395267 - RNA, 19 nt, Homo sapiens
gagaaaagcuggagaagug

SEQ ID NO: 1395268 - RNA, 19 nt, Homo sapiens
ugaucuaucuucagcguua

SEQ ID NO: 1395269 - RNA, 19 nt, Homo sapiens
gcuagucccugacaacuuc

SEQ ID NO: 1395270 - RNA, 19 nt, Homo sapiens
ugaccaagcuacuguuaug

SEQ ID NO: 1395271 - RNA, 19 nt, Homo sapiens
acaacaaccuggugaucua

SEQ ID NO: 1395272 - RNA, 19 nt, Homo sapiens
gaagauggcggaugacaag

SEQ ID NO: 1395273 - RNA, 19 nt, Homo sapiens
gggcugggcuugacucauc

SEQ ID NO: 1395274 - RNA, 19 nt, Homo sapiens
cuuccagacuaaagaauua

SEQ ID NO: 1395275 - RNA, 19 nt, Homo sapiens
uaaauggacugcucauguc

SEQ ID NO: 1395276 - RNA, 19 nt, Homo sapiens
uaccuaggccugagaaaua

SEQ ID NO: 1395277 - RNA, 19 nt, Homo sapiens
ggagacacuuuaucuggau

SEQ ID NO: 1395278 - RNA, 19 nt, Homo sapiens
gcaugacucuuccauaagg

SEQ ID NO: 1395279 - RNA, 19 nt, Homo sapiens
gcucacagccgccuucuuc

SEQ ID NO: 1395280 - RNA, 19 nt, Homo sapiens
ggaaaccuguagcucaauc

SEQ ID NO: 1395281 - RNA, 19 nt, Homo sapiens
ccaaguucuuccagacuaa

SEQ ID NO: 1395282 - RNA, 19 nt, Homo sapiens
cagcagcccuguaacaagu

SEQ ID NO: 1395283 - RNA, 19 nt, Homo sapiens
uaucagcccugcucuaugg

SEQ ID NO: 1395284 - RNA, 19 nt, Homo sapiens
gaccuggcauuucucaaga

SEQ ID NO: 1395285 - RNA, 19 nt, Homo sapiens
gaaguguggguuugguuaa

SEQ ID NO: 1395286 - RNA, 19 nt, Homo sapiens
caggauggcucgcuguugu

SEQ ID NO: 1395287 - RNA, 19 nt, Homo sapiens
gaugugaaguguggguuug

SEQ ID NO: 1395288 - RNA, 19 nt, Homo sapiens
caacguggagaagacauua

SEQ ID NO: 1395289 - RNA, 19 nt, Homo sapiens
uuaaggaccuggcauuucu

SEQ ID NO: 1395290 - RNA, 19 nt, Homo sapiens
cucaaucagugucucuuua

SEQ ID NO: 1395291 - RNA, 19 nt, Homo sapiens
ccuaccaggugcugaguaa

SEQ ID NO: 1395292 - RNA, 19 nt, Homo sapiens
cagcaucacacgccucuuu

SEQ ID NO: 1395293 - RNA, 19 nt, Homo sapiens
caccugcacuggcaucuau

SEQ ID NO: 1395294 - RNA, 19 nt, Homo sapiens
ugacucaucucagggaaug

SEQ ID NO: 1395295 - RNA, 19 nt, Homo sapiens
gacauuaagggacuauuug

SEQ ID NO: 1395296 - RNA, 19 nt, Homo sapiens
gagggcaucagcaguauug

SEQ ID NO: 1395297 - RNA, 19 nt, Homo sapiens
ucaaucagugucucuuuaa

SEQ ID NO: 1395298 - RNA, 19 nt, Homo sapiens
gaaauaaccccauccuugu

SEQ ID NO: 1395299 - RNA, 19 nt, Homo sapiens
ugaaguguggguuugguua

SEQ ID NO: 1395300 - RNA, 19 nt, Homo sapiens
cuaaauggacugcucaugu

SEQ ID NO: 1395301 - RNA, 19 nt, Homo sapiens
ccaagacuguggcuucaag

SEQ ID NO: 1395302 - RNA, 19 nt, Homo sapiens
ccugagggcugucuugaag

SEQ ID NO: 1395303 - RNA, 19 nt, Homo sapiens
gcccaguugccacagauua

SEQ ID NO: 1395304 - RNA, 19 nt, Homo sapiens
gaagcccgcuacccacucu

SEQ ID NO: 1395305 - RNA, 19 nt, Homo sapiens
ggaccuggcauuucucaag

SEQ ID NO: 1395306 - RNA, 19 nt, Homo sapiens
ccuaggagaugugaagugu

SEQ ID NO: 1395307 - RNA, 19 nt, Homo sapiens
cagaaccucuuccucuaca

SEQ ID NO: 1395308 - RNA, 19 nt, Homo sapiens
ggaagauggcggaugacaa

SEQ ID NO: 1395309 - RNA, 19 nt, Homo sapiens
gcugaccaagcuacuguua

SEQ ID NO: 1395310 - RNA, 19 nt, Homo sapiens
agacauuaagggacuauuu

SEQ ID NO: 1395311 - RNA, 19 nt, Homo sapiens
gauggcggaugacaaggau

SEQ ID NO: 1395312 - RNA, 19 nt, Homo sapiens
gcucaaucagugucucuuu

SEQ ID NO: 1395313 - RNA, 19 nt, Homo sapiens
ggucaacgccgugcucuca

SEQ ID NO: 1395314 - RNA, 19 nt, Homo sapiens
gagacacuuuaucuggauu

SEQ ID NO: 1395315 - RNA, 19 nt, Homo sapiens
ccuaggagguaccaugcuu

SEQ ID NO: 1395316 - RNA, 19 nt, Homo sapiens
gcaacaaguggcuuuccuu

SEQ ID NO: 1395317 - RNA, 19 nt, Homo sapiens
gcaugaacagaguugauga

SEQ ID NO: 1395318 - RNA, 19 nt, Homo sapiens
ccaguugccacagauuaua

SEQ ID NO: 1395319 - RNA, 19 nt, Homo sapiens
guugguagaugccucugau

SEQ ID NO: 1395320 - RNA, 19 nt, Homo sapiens
acaaggauucucugccuaa

SEQ ID NO: 1395321 - RNA, 19 nt, Homo sapiens
cgacacuccugaccucucu

SEQ ID NO: 1395322 - RNA, 19 nt, Homo sapiens
ugaacagaguugaugaaag

SEQ ID NO: 1395323 - RNA, 19 nt, Homo sapiens
gauucucugccuaagcuua

SEQ ID NO: 1395324 - RNA, 19 nt, Homo sapiens
cauggaagaggcaggauga

SEQ ID NO: 1395325 - RNA, 19 nt, Homo sapiens
gcauaagcaauaagaucuu

SEQ ID NO: 1395326 - RNA, 19 nt, Homo sapiens
gagccaggcacuaaaugga

SEQ ID NO: 1395327 - RNA, 19 nt, Homo sapiens
gcuaugugguggccaaacu

SEQ ID NO: 1395328 - RNA, 19 nt, Homo sapiens
gauccucacccuuccacuu

SEQ ID NO: 1395329 - RNA, 19 nt, Homo sapiens
ggguaugaguguagaggau

SEQ ID NO: 1395330 - RNA, 19 nt, Homo sapiens
cauuugcuaucuccaacuu

SEQ ID NO: 1395331 - RNA, 19 nt, Homo sapiens
uauacaaccauuacccaaa

SEQ ID NO: 1395332 - RNA, 19 nt, Homo sapiens
ucaagaaccagcuggaaag

SEQ ID NO: 1395333 - RNA, 19 nt, Homo sapiens
ugucgucaguguacacaga

SEQ ID NO: 1395334 - RNA, 19 nt, Homo sapiens
gauccucaguauucucucu

SEQ ID NO: 1395335 - RNA, 19 nt, Homo sapiens
cacccuggauuccuucuuc

SEQ ID NO: 1395336 - RNA, 19 nt, Homo sapiens
gcuuaaggaccuggcauuu

SEQ ID NO: 1395337 - RNA, 19 nt, Homo sapiens
gccaugcgccuguacuaug

SEQ ID NO: 1395338 - RNA, 19 nt, Homo sapiens
uucagaaccucuuccucua

SEQ ID NO: 1395339 - RNA, 19 nt, Homo sapiens
gagaccagguacaggaaac

SEQ ID NO: 1395340 - RNA, 19 nt, Homo sapiens
acaccuagccuuuguucug

SEQ ID NO: 1395341 - RNA, 19 nt, Homo sapiens
gagggcagccagguuauuc

SEQ ID NO: 1395342 - RNA, 19 nt, Homo sapiens
caucagcagcccuguaaca

SEQ ID NO: 1395343 - RNA, 19 nt, Homo sapiens
gaaucuaggucugcaugcu

SEQ ID NO: 1395344 - RNA, 19 nt, Homo sapiens
auacaaccauuacccaaac

SEQ ID NO: 1395345 - RNA, 19 nt, Homo sapiens
ggcuuuccuugccuacuuu

SEQ ID NO: 1395346 - RNA, 19 nt, Homo sapiens
uggcuuuccuugccuacuu

SEQ ID NO: 1395347 - RNA, 19 nt, Homo sapiens
accaaguucuuccagacua

SEQ ID NO: 1395348 - RNA, 19 nt, Homo sapiens
agugagggcagccagguua

SEQ ID NO: 1395349 - RNA, 19 nt, Homo sapiens
aagcauggcagcagcauca

SEQ ID NO: 1395350 - RNA, 19 nt, Homo sapiens
gcugcucccuucgcacuau

SEQ ID NO: 1395351 - RNA, 19 nt, Homo sapiens
ucuggagguugguggauga

SEQ ID NO: 1395352 - RNA, 19 nt, Homo sapiens
cccaucagcagcccuguaa

SEQ ID NO: 1395353 - RNA, 19 nt, Homo sapiens
caacaaccuggugaucuau

SEQ ID NO: 1395354 - RNA, 19 nt, Homo sapiens
uaacaacaaccuggugauc

SEQ ID NO: 1395355 - RNA, 19 nt, Homo sapiens
uaacuugauuuuccccaaa

SEQ ID NO: 1395356 - RNA, 19 nt, Homo sapiens
uaagggacuauuugcaguu

SEQ ID NO: 1395357 - RNA, 19 nt, Homo sapiens
gaaaccuguagcucaauca

SEQ ID NO: 1395358 - RNA, 19 nt, Homo sapiens
gcagcggcguguagaagac

SEQ ID NO: 1395359 - RNA, 19 nt, Homo sapiens
gaagacauuaagggacuau

SEQ ID NO: 1395360 - RNA, 19 nt, Homo sapiens
cuccugaccucucuguuca

SEQ ID NO: 1395361 - RNA, 19 nt, Homo sapiens
uauucucucuggcaauguu

SEQ ID NO: 1395362 - RNA, 19 nt, Homo sapiens
gcugucauccauuugcuau

SEQ ID NO: 1395363 - RNA, 19 nt, Homo sapiens
ccacagauuauacaaccau

SEQ ID NO: 1395364 - RNA, 19 nt, Homo sapiens
cauaugcugugcccaacgu

SEQ ID NO: 1395365 - RNA, 19 nt, Homo sapiens
ggacagaaauccuaaagug

SEQ ID NO: 1395366 - RNA, 19 nt, Homo sapiens
gaagagacaugagauggua

SEQ ID NO: 1395367 - RNA, 19 nt, Homo sapiens
caaaggagguuauaaugga

SEQ ID NO: 1395368 - RNA, 19 nt, Homo sapiens
gaggagauaugauaaaugu

SEQ ID NO: 1395369 - RNA, 19 nt, Homo sapiens
aaagagcccuguaauauga

SEQ ID NO: 1395370 - RNA, 19 nt, Homo sapiens
gagaaacucuugaaaugug

SEQ ID NO: 1395371 - RNA, 19 nt, Homo sapiens
gauaaagccuacaaauaug

SEQ ID NO: 1395372 - RNA, 19 nt, Homo sapiens
cuacaaaugugaagaaugu

SEQ ID NO: 1395373 - RNA, 19 nt, Homo sapiens
cuacaaaugugaagaaugu

SEQ ID NO: 1395374 - RNA, 19 nt, Homo sapiens
cuacaaaugugaagaaugu

SEQ ID NO: 1395375 - RNA, 19 nt, Homo sapiens
aaacuacaauccugaauga

SEQ ID NO: 1395376 - RNA, 19 nt, Homo sapiens
ggacuuaaccaaugucuga

SEQ ID NO: 1395377 - RNA, 19 nt, Homo sapiens
gagaaacccuuccaaugug

SEQ ID NO: 1395378 - RNA, 19 nt, Homo sapiens
ggaugugacuguagaauuc

SEQ ID NO: 1395379 - RNA, 19 nt, Homo sapiens
gagagaaacccuacaaaug

SEQ ID NO: 1395380 - RNA, 19 nt, Homo sapiens
gagagaaacccuacaaaug

SEQ ID NO: 1395381 - RNA, 19 nt, Homo sapiens
gagagaaacccuacaaaug

SEQ ID NO: 1395382 - RNA, 19 nt, Homo sapiens
gagagaaacccuacaaaug

SEQ ID NO: 1395383 - RNA, 19 nt, Homo sapiens
gagagaaacccuacaaaug

SEQ ID NO: 1395384 - RNA, 19 nt, Homo sapiens
gagagaaacccuacaaaug

SEQ ID NO: 1395385 - RNA, 19 nt, Homo sapiens
ccucaauucuuaacagaua

SEQ ID NO: 1395386 - RNA, 19 nt, Homo sapiens
ccucaaaccuuacuaaaca

SEQ ID NO: 1395387 - RNA, 19 nt, Homo sapiens
ucacaaccuucucaacaua

SEQ ID NO: 1395388 - RNA, 19 nt, Homo sapiens
ggagauaugauaaauguga

SEQ ID NO: 1395389 - RNA, 19 nt, Homo sapiens
gaaaagagcccuguaauau

SEQ ID NO: 1395390 - RNA, 19 nt, Homo sapiens
gaagauaaagccuacaaau

SEQ ID NO: 1395391 - RNA, 19 nt, Homo sapiens
gggagaagcccuacaaaug

SEQ ID NO: 1395392 - RNA, 19 nt, Homo sapiens
gagagaaggccuacaaaug

SEQ ID NO: 1395393 - RNA, 19 nt, Homo sapiens
uaaccggucuucacacauu

SEQ ID NO: 1395394 - RNA, 19 nt, Homo sapiens
gagaaacccuacaaaugug

SEQ ID NO: 1395395 - RNA, 19 nt, Homo sapiens
ggagaagcccuacaaaugu

SEQ ID NO: 1395396 - RNA, 19 nt, Homo sapiens
cuacaaaugugaagagugu

SEQ ID NO: 1395397 - RNA, 19 nt, Homo sapiens
gagaaacccuacaaaugug

SEQ ID NO: 1395398 - RNA, 19 nt, Homo sapiens
cuacaaaugugaagagugu

SEQ ID NO: 1395399 - RNA, 19 nt, Homo sapiens
gagaaacccuacaaaugug

SEQ ID NO: 1395400 - RNA, 19 nt, Homo sapiens
cuacaaaugugaagagugu

SEQ ID NO: 1395401 - RNA, 19 nt, Homo sapiens
gagaaacccuacaaaugug

SEQ ID NO: 1395402 - RNA, 19 nt, Homo sapiens
cuacaaaugugaagagugu

SEQ ID NO: 1395403 - RNA, 19 nt, Homo sapiens
gagaaacccuacaaaugug

SEQ ID NO: 1395404 - RNA, 19 nt, Homo sapiens
gcacagcagaauuuauaua

SEQ ID NO: 1395405 - RNA, 19 nt, Homo sapiens
cuacaaaugugaagagugu

SEQ ID NO: 1395406 - RNA, 19 nt, Homo sapiens
gagaaacccuacaaaugug

SEQ ID NO: 1395407 - RNA, 19 nt, Homo sapiens
cuacaaaugugaagagugu

SEQ ID NO: 1395408 - RNA, 19 nt, Homo sapiens
gagaaacccuacaaaugug

SEQ ID NO: 1395409 - RNA, 19 nt, Homo sapiens
gagaagcccuacaaaugug

SEQ ID NO: 1395410 - RNA, 19 nt, Homo sapiens
gagaaggccuacaaaugug

SEQ ID NO: 1395411 - RNA, 19 nt, Homo sapiens
gaaaugggaccacugacaa

SEQ ID NO: 1395412 - RNA, 19 nt, Homo sapiens
gagagaaacccuuccaaug

SEQ ID NO: 1395413 - RNA, 19 nt, Homo sapiens
guucucaacucuuacuaaa

SEQ ID NO: 1395414 - RNA, 19 nt, Homo sapiens
uaaaaguucucaacccuua

SEQ ID NO: 1395415 - RNA, 19 nt, Homo sapiens
ggagagaaacccuacaaau

SEQ ID NO: 1395416 - RNA, 19 nt, Homo sapiens
ggagagaaacccuacaaau

SEQ ID NO: 1395417 - RNA, 19 nt, Homo sapiens
ggagagaaacccuacaaau

SEQ ID NO: 1395418 - RNA, 19 nt, Homo sapiens
ggagagaaacccuacaaau

SEQ ID NO: 1395419 - RNA, 19 nt, Homo sapiens
ggagagaaacccuacaaau

SEQ ID NO: 1395420 - RNA, 19 nt, Homo sapiens
gagagaaccccaacaaaua

SEQ ID NO: 1395421 - RNA, 19 nt, Homo sapiens
guacauaagagaauucaug

SEQ ID NO: 1395422 - RNA, 19 nt, Homo sapiens
gaaacuacaauccugaaug

SEQ ID NO: 1395423 - RNA, 19 nt, Homo sapiens
cagaaauccuaaaguguga

SEQ ID NO: 1395424 - RNA, 19 nt, Homo sapiens
ucucaacucuuacuaaaca

SEQ ID NO: 1395425 - RNA, 19 nt, Homo sapiens
aagaaugugucaaagcuuu

SEQ ID NO: 1395426 - RNA, 19 nt, Homo sapiens
gaacguggccuggcuuuua

SEQ ID NO: 1395427 - RNA, 19 nt, Homo sapiens
ggaaaagagcccuguaaua

SEQ ID NO: 1395428 - RNA, 19 nt, Homo sapiens
cuacaauccugaaugaugu

SEQ ID NO: 1395429 - RNA, 19 nt, Homo sapiens
ccuaaagugugaagaaugu

SEQ ID NO: 1395430 - RNA, 19 nt, Homo sapiens
uggcaaagcuuguaaccau

SEQ ID NO: 1395431 - RNA, 19 nt, Homo sapiens
aaccauuccucaaaccuua

SEQ ID NO: 1395432 - RNA, 19 nt, Homo sapiens
agagaaacccuacaaaugu

SEQ ID NO: 1395433 - RNA, 19 nt, Homo sapiens
uaaccagucuucacaccuu

SEQ ID NO: 1395434 - RNA, 19 nt, Homo sapiens
agagaaacccuacaaaugu

SEQ ID NO: 1395435 - RNA, 19 nt, Homo sapiens
uaaccggucuucauaccuu

SEQ ID NO: 1395436 - RNA, 19 nt, Homo sapiens
agagaaacccuacaaaugu

SEQ ID NO: 1395437 - RNA, 19 nt, Homo sapiens
agagaaacccuacaaaugu

SEQ ID NO: 1395438 - RNA, 19 nt, Homo sapiens
agagaaacccuacaaaugu

SEQ ID NO: 1395439 - RNA, 19 nt, Homo sapiens
agagaaacccuacaaaugu

SEQ ID NO: 1395440 - RNA, 19 nt, Homo sapiens
agagaaacccuacaaaugu

SEQ ID NO: 1395441 - RNA, 19 nt, Homo sapiens
agaacacuguggaagauaa

SEQ ID NO: 1395442 - RNA, 19 nt, Homo sapiens
caaaugugaugaauauugc

SEQ ID NO: 1395443 - RNA, 19 nt, Homo sapiens
ggucuucacaccuuacuaa

SEQ ID NO: 1395444 - RNA, 19 nt, Homo sapiens
cuacaaaugugaagaacgu

SEQ ID NO: 1395445 - RNA, 19 nt, Homo sapiens
guuccucaauccuuacuaa

SEQ ID NO: 1395446 - RNA, 19 nt, Homo sapiens
ggagagaaacccuuccaau

SEQ ID NO: 1395447 - RNA, 19 nt, Homo sapiens
auaauggacuuaaccaaug

SEQ ID NO: 1395448 - RNA, 19 nt, Homo sapiens
gcaaaggagguuauaaugg

SEQ ID NO: 1395449 - RNA, 19 nt, Homo sapiens
uaaccggucuucacaccuu

SEQ ID NO: 1395450 - RNA, 19 nt, Homo sapiens
uaaccggucuucacaccuu

SEQ ID NO: 1395451 - RNA, 19 nt, Homo sapiens
agagaaacccuuccaaugu

SEQ ID NO: 1395452 - RNA, 19 nt, Homo sapiens
uaaccggucuucacaccuu

SEQ ID NO: 1395453 - RNA, 19 nt, Homo sapiens
gaacacuguggaagauaaa

SEQ ID NO: 1395454 - RNA, 19 nt, Homo sapiens
agagaaggccuacaaaugu

SEQ ID NO: 1395455 - RNA, 19 nt, Homo sapiens
cuucacaccuuacuaaaca

SEQ ID NO: 1395456 - RNA, 19 nt, Homo sapiens
cuugaaaugugaugaaugu

SEQ ID NO: 1395457 - RNA, 19 nt, Homo sapiens
ccucaauccuuacuaaaca

SEQ ID NO: 1395458 - RNA, 19 nt, Homo sapiens
aauacguucucauaccuua

SEQ ID NO: 1395459 - RNA, 19 nt, Homo sapiens
auacugaggagauaugaua

SEQ ID NO: 1395460 - RNA, 19 nt, Homo sapiens
guucucauauugcugaaga

SEQ ID NO: 1395461 - RNA, 19 nt, Homo sapiens
ucucaacccuuauuacaca

SEQ ID NO: 1395462 - RNA, 19 nt, Homo sapiens
ucucauaccuuaccguaca

SEQ ID NO: 1395463 - RNA, 19 nt, Homo sapiens
acacauuacucaacauaag

SEQ ID NO: 1395464 - RNA, 19 nt, Homo sapiens
cuuaaccaaugucugauaa

SEQ ID NO: 1395465 - RNA, 19 nt, Homo sapiens
caacaagacuuccagcuuu

SEQ ID NO: 1395466 - RNA, 19 nt, Homo sapiens
cagcaagccuuucagauuu

SEQ ID NO: 1395467 - RNA, 19 nt, Homo sapiens
ggaccauccucauaguuua

SEQ ID NO: 1395468 - RNA, 19 nt, Homo sapiens
gagauggaccgcaacauua

SEQ ID NO: 1395469 - RNA, 19 nt, Homo sapiens
cuaaggagcuggugucuuc

SEQ ID NO: 1395470 - RNA, 19 nt, Homo sapiens
ggaacgagauccaccacaa

SEQ ID NO: 1395471 - RNA, 19 nt, Homo sapiens
uaaaugcucuauagccaaa

SEQ ID NO: 1395472 - RNA, 19 nt, Homo sapiens
ugaccaaccucccugcaua

SEQ ID NO: 1395473 - RNA, 19 nt, Homo sapiens
caacuacacugucaacuac

SEQ ID NO: 1395474 - RNA, 19 nt, Homo sapiens
gcaaccagcucguggacuu

SEQ ID NO: 1395475 - RNA, 19 nt, Homo sapiens
gaugggaacucaaacaagu

SEQ ID NO: 1395476 - RNA, 19 nt, Homo sapiens
caggaccgcuucuguguuu

SEQ ID NO: 1395477 - RNA, 19 nt, Homo sapiens
ccaaagaagucaagaucug

SEQ ID NO: 1395478 - RNA, 19 nt, Homo sapiens
ccucauaguuuacagcauu

SEQ ID NO: 1395479 - RNA, 19 nt, Homo sapiens
gaaagcagcgggacuccuu

SEQ ID NO: 1395480 - RNA, 19 nt, Homo sapiens
guuaagagauugaggaaaa

SEQ ID NO: 1395481 - RNA, 19 nt, Homo sapiens
aaacaagucauuccuccua

SEQ ID NO: 1395482 - RNA, 19 nt, Homo sapiens
ugcaauaaaugcucuauag

SEQ ID NO: 1395483 - RNA, 19 nt, Homo sapiens
guauuacgguuccagaugu

SEQ ID NO: 1395484 - RNA, 19 nt, Homo sapiens
ucagcaagccuuucagauu

SEQ ID NO: 1395485 - RNA, 19 nt, Homo sapiens
ggaagucauugccaacucu

SEQ ID NO: 1395486 - RNA, 19 nt, Homo sapiens
gggaccauccucauaguuu

SEQ ID NO: 1395487 - RNA, 19 nt, Homo sapiens
ccaacuaccugcagaacgu

SEQ ID NO: 1395488 - RNA, 19 nt, Homo sapiens
agggaaagauggagguauu

SEQ ID NO: 1395489 - RNA, 19 nt, Homo sapiens
ggacucccugugugucuua

SEQ ID NO: 1395490 - RNA, 19 nt, Homo sapiens
ggaacucaaacaagucauu

SEQ ID NO: 1395491 - RNA, 19 nt, Homo sapiens
gggaaagauggagguauua

SEQ ID NO: 1395492 - RNA, 19 nt, Homo sapiens
ggauggaagucugcagugu

SEQ ID NO: 1395493 - RNA, 19 nt, Homo sapiens
ggguacaacuacacuguca

SEQ ID NO: 1395494 - RNA, 19 nt, Homo sapiens
ccgagaggcugggagguuu

SEQ ID NO: 1395495 - RNA, 19 nt, Homo sapiens
gaacucaaacaagucauuc

SEQ ID NO: 1395496 - RNA, 19 nt, Homo sapiens
gcuccuggacugccuauga

SEQ ID NO: 1395497 - RNA, 19 nt, Homo sapiens
aaaaggaucugguacuguu

SEQ ID NO: 1395498 - RNA, 19 nt, Homo sapiens
acaacuacacugucaacua

SEQ ID NO: 1395499 - RNA, 19 nt, Homo sapiens
uuucagauuugcccgguuu

SEQ ID NO: 1395500 - RNA, 19 nt, Homo sapiens
agagauggaccgcaacauu

SEQ ID NO: 1395501 - RNA, 19 nt, Homo sapiens
gcaauaaggauggaagucu

SEQ ID NO: 1395502 - RNA, 19 nt, Homo sapiens
gaaaauguccgugaaagga

SEQ ID NO: 1395503 - RNA, 19 nt, Homo sapiens
guaucaagaugggaacuca

SEQ ID NO: 1395504 - RNA, 19 nt, Homo sapiens
ccaacaagacuuccagcuu

SEQ ID NO: 1395505 - RNA, 19 nt, Homo sapiens
gaacgagauccaccacaag

SEQ ID NO: 1395506 - RNA, 19 nt, Homo sapiens
cagccucggugccuuggaa

SEQ ID NO: 1395507 - RNA, 19 nt, Homo sapiens
caagaugggaacucaaaca

SEQ ID NO: 1395508 - RNA, 19 nt, Homo sapiens
gguauuacgguuccagaug

SEQ ID NO: 1395509 - RNA, 19 nt, Homo sapiens
agucacggcucaguuaaga

SEQ ID NO: 1395510 - RNA, 19 nt, Homo sapiens
caugacgaguguucugaug

SEQ ID NO: 1395511 - RNA, 19 nt, Homo sapiens
gagcuggugucuucaucca

SEQ ID NO: 1395512 - RNA, 19 nt, Homo sapiens
ugacgaguguucugauguc

SEQ ID NO: 1395513 - RNA, 19 nt, Homo sapiens
caacggcaauaaggaugga

SEQ ID NO: 1395514 - RNA, 19 nt, Homo sapiens
gcagaagggccaacguuuu

SEQ ID NO: 1395515 - RNA, 19 nt, Homo sapiens
ucacggcucaguuaagaga

SEQ ID NO: 1395516 - RNA, 19 nt, Homo sapiens
guucuggaguggccuguag

SEQ ID NO: 1395517 - RNA, 19 nt, Homo sapiens
aacaagucauuccuccuaa

SEQ ID NO: 1395518 - RNA, 19 nt, Homo sapiens
aaaagucacggcucaguua

SEQ ID NO: 1395519 - RNA, 19 nt, Homo sapiens
gauacagcgaugugacuga

SEQ ID NO: 1395520 - RNA, 19 nt, Homo sapiens
agccagagcaggucauaaa

SEQ ID NO: 1395521 - RNA, 19 nt, Homo sapiens
cagcagaagggccaacguu

SEQ ID NO: 1395522 - RNA, 19 nt, Homo sapiens
ggaaagauggagguauuac

SEQ ID NO: 1395523 - RNA, 19 nt, Homo sapiens
guacugcaacggcaauaag

SEQ ID NO: 1395524 - RNA, 19 nt, Homo sapiens
ucgcaggcaugacgagugu

SEQ ID NO: 1395525 - RNA, 19 nt, Homo sapiens
gaagcuguuugggaaagca

SEQ ID NO: 1395526 - RNA, 19 nt, Homo sapiens
gcaggcaugacgaguguuc

SEQ ID NO: 1395527 - RNA, 19 nt, Homo sapiens
ccacugugcccaugcagau

SEQ ID NO: 1395528 - RNA, 19 nt, Homo sapiens
ccucggugccuuggaauuu

SEQ ID NO: 1395529 - RNA, 19 nt, Homo sapiens
cagcgucugugacuaucug

SEQ ID NO: 1395530 - RNA, 19 nt, Homo sapiens
gaagccagcgucugugacu

SEQ ID NO: 1395531 - RNA, 19 nt, Homo sapiens
uccuagagcuccugaaggu

SEQ ID NO: 1395532 - RNA, 19 nt, Homo sapiens
gcgggaccauccucauagu

SEQ ID NO: 1395533 - RNA, 19 nt, Homo sapiens
gagagaaaaggaucuggua

SEQ ID NO: 1395534 - RNA, 19 nt, Homo sapiens
gcaauaaaugcucuauagc

SEQ ID NO: 1395535 - RNA, 19 nt, Homo sapiens
guucugggucagcuucuuu

SEQ ID NO: 1395536 - RNA, 19 nt, Homo sapiens
cgagauccaccacaagaca

SEQ ID NO: 1395537 - RNA, 19 nt, Homo sapiens
aaagucacggcucaguuaa

SEQ ID NO: 1395538 - RNA, 19 nt, Homo sapiens
gaggcugggagguuuguug

SEQ ID NO: 1395539 - RNA, 19 nt, Homo sapiens
gaaagauggagguauuacg

SEQ ID NO: 1395540 - RNA, 19 nt, Homo sapiens
guacaacuacacugucaac

SEQ ID NO: 1395541 - RNA, 19 nt, Homo sapiens
cuccuggacugccuaugaa

SEQ ID NO: 1395542 - RNA, 19 nt, Homo sapiens
gccauuggacucccugugu

SEQ ID NO: 1395543 - RNA, 19 nt, Homo sapiens
gacgaguguucugauguca

SEQ ID NO: 1395544 - RNA, 19 nt, Homo sapiens
cggacaccgugguauggaa

SEQ ID NO: 1395545 - RNA, 19 nt, Homo sapiens
guucacugccagaggguuu

SEQ ID NO: 1395546 - RNA, 19 nt, Homo sapiens
agcaagccuuucagauuug

SEQ ID NO: 1395547 - RNA, 19 nt, Homo sapiens
agugcuaccuuccagacaa

SEQ ID NO: 1395548 - RNA, 19 nt, Homo sapiens
ugacugacagcaaggcaau

SEQ ID NO: 1395549 - RNA, 19 nt, Homo sapiens
gcgaugugacugacagcaa

SEQ ID NO: 1395550 - RNA, 19 nt, Homo sapiens
cauccagaagggacaguuu

SEQ ID NO: 1395551 - RNA, 19 nt, Homo sapiens
cuaugaagccagcgucugu

SEQ ID NO: 1395552 - RNA, 19 nt, Homo sapiens
uggaagaggcggcucaucu

SEQ ID NO: 1395553 - RNA, 19 nt, Homo sapiens
acacggaagagcugaaagu

SEQ ID NO: 1395554 - RNA, 19 nt, Homo sapiens
ugagucagcaagccuuuca

SEQ ID NO: 1395555 - RNA, 19 nt, Homo sapiens
cggcucaguuaagagauug

SEQ ID NO: 1395556 - RNA, 19 nt, Homo sapiens
gcuggccccuuacauuauu

SEQ ID NO: 1395557 - RNA, 19 nt, Homo sapiens
aagaugggaacucaaacaa

SEQ ID NO: 1395558 - RNA, 19 nt, Homo sapiens
cugcgggaccauccucaua

SEQ ID NO: 1395559 - RNA, 19 nt, Homo sapiens
acaagucauuccuccuaag

SEQ ID NO: 1395560 - RNA, 19 nt, Homo sapiens
guuugugguuuguaucaag

SEQ ID NO: 1395561 - RNA, 19 nt, Homo sapiens
gaagagagcuuaugagugu

SEQ ID NO: 1395562 - RNA, 19 nt, Homo sapiens
gcagaaagguguagaaugu

SEQ ID NO: 1395563 - RNA, 19 nt, Homo sapiens
gacaacaacugaaauguaa

SEQ ID NO: 1395564 - RNA, 19 nt, Homo sapiens
gagaaacccuauaaaugua

SEQ ID NO: 1395565 - RNA, 19 nt, Homo sapiens
gagaggaccuauagaugua

SEQ ID NO: 1395566 - RNA, 19 nt, Homo sapiens
agacagcacuuuauacuuu

SEQ ID NO: 1395567 - RNA, 19 nt, Homo sapiens
gcaauaauccauccaaauu

SEQ ID NO: 1395568 - RNA, 19 nt, Homo sapiens
gaagucccaucaaucaaua

SEQ ID NO: 1395569 - RNA, 19 nt, Homo sapiens
gaagguaucuuggcauuuc

SEQ ID NO: 1395570 - RNA, 19 nt, Homo sapiens
caaauaagacagcacuuua

SEQ ID NO: 1395571 - RNA, 19 nt, Homo sapiens
gaaauaccuuuauccagaa

SEQ ID NO: 1395572 - RNA, 19 nt, Homo sapiens
gagaaacccuaucagugua

SEQ ID NO: 1395573 - RNA, 19 nt, Homo sapiens
ggaaaggcccuauaaaugu

SEQ ID NO: 1395574 - RNA, 19 nt, Homo sapiens
gaaaggcccuauaaaugug

SEQ ID NO: 1395575 - RNA, 19 nt, Homo sapiens
ggacaacaacugaaaugua

SEQ ID NO: 1395576 - RNA, 19 nt, Homo sapiens
gagagaaacccuauaaaug

SEQ ID NO: 1395577 - RNA, 19 nt, Homo sapiens
gaaaucauccugcauuaau

SEQ ID NO: 1395578 - RNA, 19 nt, Homo sapiens
gaacaggaaaugaacaauu

SEQ ID NO: 1395579 - RNA, 19 nt, Homo sapiens
gaagucaaaucucuuucaa

SEQ ID NO: 1395580 - RNA, 19 nt, Homo sapiens
caagagaagucccaucaau

SEQ ID NO: 1395581 - RNA, 19 nt, Homo sapiens
ggagagaaacccuauaaau

SEQ ID NO: 1395582 - RNA, 19 nt, Homo sapiens
ucaaaucucuuucaacauc

SEQ ID NO: 1395583 - RNA, 19 nt, Homo sapiens
gggaugauuucuauaauuc

SEQ ID NO: 1395584 - RNA, 19 nt, Homo sapiens
caagaaauccuaucagugu

SEQ ID NO: 1395585 - RNA, 19 nt, Homo sapiens
guagaaaguuauucaguuc

SEQ ID NO: 1395586 - RNA, 19 nt, Homo sapiens
gaacucaacccucauucaa

SEQ ID NO: 1395587 - RNA, 19 nt, Homo sapiens
gaaauguaaugccuguaga

SEQ ID NO: 1395588 - RNA, 19 nt, Homo sapiens
guagagggccgauuaaguu

SEQ ID NO: 1395589 - RNA, 19 nt, Homo sapiens
gaggaaaggcccuauaaau

SEQ ID NO: 1395590 - RNA, 19 nt, Homo sapiens
cuuaaacacugaagaugua

SEQ ID NO: 1395591 - RNA, 19 nt, Homo sapiens
gaaauccaaugucaucgau

SEQ ID NO: 1395592 - RNA, 19 nt, Homo sapiens
gagccaauauugcaccauu

SEQ ID NO: 1395593 - RNA, 19 nt, Homo sapiens
gcagaagucaaaucucuuu

SEQ ID NO: 1395594 - RNA, 19 nt, Homo sapiens
gaauguaacagauguggaa

SEQ ID NO: 1395595 - RNA, 19 nt, Homo sapiens
cacugaagauguagcaaua

SEQ ID NO: 1395596 - RNA, 19 nt, Homo sapiens
gaaaagcccuaugaaugua

SEQ ID NO: 1395597 - RNA, 19 nt, Homo sapiens
gaaaccacauccaggaagu

SEQ ID NO: 1395598 - RNA, 19 nt, Homo sapiens
ggaaguggccgugcagaaa

SEQ ID NO: 1395599 - RNA, 19 nt, Homo sapiens
gaacagagaaacuuguaca

SEQ ID NO: 1395600 - RNA, 19 nt, Homo sapiens
ucacugcaauugccauuug

SEQ ID NO: 1395601 - RNA, 19 nt, Homo sapiens
agaauuccauguugaaaug

SEQ ID NO: 1395602 - RNA, 19 nt, Homo sapiens
ggagagaggaccuauagau

SEQ ID NO: 1395603 - RNA, 19 nt, Homo sapiens
agucagaucuugugaaaca

SEQ ID NO: 1395604 - RNA, 19 nt, Homo sapiens
agagaaacccuauaaaugu

SEQ ID NO: 1395605 - RNA, 19 nt, Homo sapiens
uggaaaucauccugcauua

SEQ ID NO: 1395606 - RNA, 19 nt, Homo sapiens
gaaaggagccaugguugga

SEQ ID NO: 1395607 - RNA, 19 nt, Homo sapiens
ggacuuauuaucacaguau

SEQ ID NO: 1395608 - RNA, 19 nt, Homo sapiens
ggaaaucauccugcauuaa

SEQ ID NO: 1395609 - RNA, 19 nt, Homo sapiens
gaaguggaagcuugauaaa

SEQ ID NO: 1395610 - RNA, 19 nt, Homo sapiens
agucaaaucucuuucaaca

SEQ ID NO: 1395611 - RNA, 19 nt, Homo sapiens
gaaugugacggaucuaaga

SEQ ID NO: 1395612 - RNA, 19 nt, Homo sapiens
agaaagguguagaauguga

SEQ ID NO: 1395613 - RNA, 19 nt, Homo sapiens
gaaacugauugggcagauu

SEQ ID NO: 1395614 - RNA, 19 nt, Homo sapiens
gcuaauuuaugccagauuc

SEQ ID NO: 1395615 - RNA, 19 nt, Homo sapiens
ccacaggcaucagaaauca

SEQ ID NO: 1395616 - RNA, 19 nt, Homo sapiens
gccaagaaauccuaucagu

SEQ ID NO: 1395617 - RNA, 19 nt, Homo sapiens
gaaaucaaucaacuugcua

SEQ ID NO: 1395618 - RNA, 19 nt, Homo sapiens
caucagaaaucaaucaacu

SEQ ID NO: 1395619 - RNA, 19 nt, Homo sapiens
uuucuugacuggauuauga

SEQ ID NO: 1395620 - RNA, 19 nt, Homo sapiens
gaaacccugucucuaccaa

SEQ ID NO: 1395621 - RNA, 19 nt, Homo sapiens
gaaauccuaucaguguaau

SEQ ID NO: 1395622 - RNA, 19 nt, Homo sapiens
caacccucauucaacauaa

SEQ ID NO: 1395623 - RNA, 19 nt, Homo sapiens
uaaugccuguagaaaguua

SEQ ID NO: 1395624 - RNA, 19 nt, Homo sapiens
uguaaugccuguagaaagu

SEQ ID NO: 1395625 - RNA, 19 nt, Homo sapiens
ugauguaucuuccuugcaa

SEQ ID NO: 1395626 - RNA, 19 nt, Homo sapiens
gcggguagagggccgauua

SEQ ID NO: 1395627 - RNA, 19 nt, Homo sapiens
gagagaggaccuauagaug

SEQ ID NO: 1395628 - RNA, 19 nt, Homo sapiens
aguggaagcuugauaaaca

SEQ ID NO: 1395629 - RNA, 19 nt, Homo sapiens
caauaaaccaaaugugcua

SEQ ID NO: 1395630 - RNA, 19 nt, Homo sapiens
cugaagauguagcaauaaa

SEQ ID NO: 1395631 - RNA, 19 nt, Homo sapiens
gcagaacucaacccucauu

SEQ ID NO: 1395632 - RNA, 19 nt, Homo sapiens
cauccugcauuaaucauga

SEQ ID NO: 1395633 - RNA, 19 nt, Homo sapiens
gcagaggaaaggcccuaua

SEQ ID NO: 1395634 - RNA, 19 nt, Homo sapiens
guuauucaguucaaaguca

SEQ ID NO: 1395635 - RNA, 19 nt, Homo sapiens
gcagugagccaauauugca

SEQ ID NO: 1395636 - RNA, 19 nt, Homo sapiens
ugugaucuauguggaaaua

SEQ ID NO: 1395637 - RNA, 19 nt, Homo sapiens
cagaggaaaggcccuauaa

SEQ ID NO: 1395638 - RNA, 19 nt, Homo sapiens
caacaacugaaauguaaug

SEQ ID NO: 1395639 - RNA, 19 nt, Homo sapiens
gugaagaacaggaaaugaa

SEQ ID NO: 1395640 - RNA, 19 nt, Homo sapiens
aaagaauucacuccagaua

SEQ ID NO: 1395641 - RNA, 19 nt, Homo sapiens
gagaaguggaagcuugaua

SEQ ID NO: 1395642 - RNA, 19 nt, Homo sapiens
ugacggaucuaagaaaaua

SEQ ID NO: 1395643 - RNA, 19 nt, Homo sapiens
gggaugugaugcuggagaa

SEQ ID NO: 1395644 - RNA, 19 nt, Homo sapiens
aacaggaaaugaacaauuc

SEQ ID NO: 1395645 - RNA, 19 nt, Homo sapiens
ucagaaaucaaucaacuug

SEQ ID NO: 1395646 - RNA, 19 nt, Homo sapiens
gagggccgauuaaguuuua

SEQ ID NO: 1395647 - RNA, 19 nt, Homo sapiens
gguaaagccuucgcugaca

SEQ ID NO: 1395648 - RNA, 19 nt, Homo sapiens
cuauagauguagugaaugu

SEQ ID NO: 1395649 - RNA, 19 nt, Homo sapiens
ggaaaagcccuaugaaugu

SEQ ID NO: 1395650 - RNA, 19 nt, Homo sapiens
ugugagaacuguggaaaug

SEQ ID NO: 1395651 - RNA, 19 nt, Homo sapiens
gcaggagaauugcuugaac

SEQ ID NO: 1395652 - RNA, 19 nt, Homo sapiens
gaagguagcgaggacuuau

SEQ ID NO: 1395653 - RNA, 19 nt, Homo sapiens
gaaaaugcauacuaaagag

SEQ ID NO: 1395654 - RNA, 19 nt, Homo sapiens
gaaaugccuacaagcagaa

SEQ ID NO: 1395655 - RNA, 19 nt, Homo sapiens
gacauuggagggcagauuu

SEQ ID NO: 1395656 - RNA, 19 nt, Homo sapiens
caaacccgaugugaucuug

SEQ ID NO: 1395657 - RNA, 19 nt, Homo sapiens
aaauguagcauaugugaga

SEQ ID NO: 1395658 - RNA, 19 nt, Homo sapiens
agagaaacccuaucagugu

SEQ ID NO: 1395659 - RNA, 19 nt, Homo sapiens
cuaaagagaaacccuauca

SEQ ID NO: 1395660 - RNA, 19 nt, Homo sapiens
aagcagaagucaaaucucu

SEQ ID NO: 1395661 - RNA, 19 nt, Homo sapiens
gaaaggagcaguacaaaga

SEQ ID NO: 1395662 - RNA, 19 nt, Homo sapiens
gcaggaaucuugagaaugg

SEQ ID NO: 1395663 - RNA, 19 nt, Homo sapiens
ggaagauccugcugugaaa

SEQ ID NO: 1395664 - RNA, 19 nt, Homo sapiens
caacaaaggcgugaaagaa

SEQ ID NO: 1395665 - RNA, 19 nt, Homo sapiens
gaaacagaauagucaaugg

SEQ ID NO: 1395666 - RNA, 19 nt, Homo sapiens
aaagacaucugagaaacaa

SEQ ID NO: 1395667 - RNA, 19 nt, Homo sapiens
gaucgcggauuuuggauua

SEQ ID NO: 1395668 - RNA, 19 nt, Homo sapiens
gaagcaaccacagcuaauu

SEQ ID NO: 1395669 - RNA, 19 nt, Homo sapiens
ggaaacagaauagucaaug

SEQ ID NO: 1395670 - RNA, 19 nt, Homo sapiens
gcaacaaaggcgugaaaga

SEQ ID NO: 1395671 - RNA, 19 nt, Homo sapiens
gagcaacaaaggcgugaaa

SEQ ID NO: 1395672 - RNA, 19 nt, Homo sapiens
gccuagcacugaaauggaa

SEQ ID NO: 1395673 - RNA, 19 nt, Homo sapiens
uuuagaacaugcacucuga

SEQ ID NO: 1395674 - RNA, 19 nt, Homo sapiens
acaaaggcgugaaagaagu

SEQ ID NO: 1395675 - RNA, 19 nt, Homo sapiens
aaaggaaacagaauaguca

SEQ ID NO: 1395676 - RNA, 19 nt, Homo sapiens
gaagucaccaccaugaagu

SEQ ID NO: 1395677 - RNA, 19 nt, Homo sapiens
gaaaagacaucugagaaac

SEQ ID NO: 1395678 - RNA, 19 nt, Homo sapiens
aagaaagaauguacagaca

SEQ ID NO: 1395679 - RNA, 19 nt, Homo sapiens
acucggaacugcagaagau

SEQ ID NO: 1395680 - RNA, 19 nt, Homo sapiens
ccgcaggaaucuugagaau

SEQ ID NO: 1395681 - RNA, 19 nt, Homo sapiens
gcaguacaaagaaagaaug

SEQ ID NO: 1395682 - RNA, 19 nt, Homo sapiens
acagaauagucaauggaaa

SEQ ID NO: 1395683 - RNA, 19 nt, Homo sapiens
ucaccaccaugaaguuguu

SEQ ID NO: 1395684 - RNA, 19 nt, Homo sapiens
caaaacauccuuccuugaa

SEQ ID NO: 1395685 - RNA, 19 nt, Homo sapiens
ccacaaggcagcugucaag

SEQ ID NO: 1395686 - RNA, 19 nt, Homo sapiens
ugagaagucaccaccauga

SEQ ID NO: 1395687 - RNA, 19 nt, Homo sapiens
caacaccaguggccuacag

SEQ ID NO: 1395688 - RNA, 19 nt, Homo sapiens
gagaagucaccaccaugaa

SEQ ID NO: 1395689 - RNA, 19 nt, Homo sapiens
aagcaaccacagcuaauuu

SEQ ID NO: 1395690 - RNA, 19 nt, Homo sapiens
ugaaagaagugaaaagaag

SEQ ID NO: 1395691 - RNA, 19 nt, Homo sapiens
aaggagcaguacaaagaaa

SEQ ID NO: 1395692 - RNA, 19 nt, Homo sapiens
uggaagauccugcugugaa

SEQ ID NO: 1395693 - RNA, 19 nt, Homo sapiens
aaacagaauagucaaugga

SEQ ID NO: 1395694 - RNA, 19 nt, Homo sapiens
ggagcaguacaaagaaaga

SEQ ID NO: 1395695 - RNA, 19 nt, Homo sapiens
gggguuggauugcggauuu

SEQ ID NO: 1395696 - RNA, 19 nt, Homo sapiens
gcaaccacagcuaauuuua

SEQ ID NO: 1395697 - RNA, 19 nt, Homo sapiens
ccaguggccuacagagaag

SEQ ID NO: 1395698 - RNA, 19 nt, Homo sapiens
aagaagcaaccacagcuaa

SEQ ID NO: 1395699 - RNA, 19 nt, Homo sapiens
accaguggcuucagaggaa

SEQ ID NO: 1395700 - RNA, 19 nt, Homo sapiens
cgggcuggaucgcggauuu

SEQ ID NO: 1395701 - RNA, 19 nt, Homo sapiens
caaagaaagaauguacaga

SEQ ID NO: 1395702 - RNA, 19 nt, Homo sapiens
caccauagaccaccuguac

SEQ ID NO: 1395703 - RNA, 19 nt, Homo sapiens
aaagaagcaaccacagcua

SEQ ID NO: 1395704 - RNA, 19 nt, Homo sapiens
gagcaguacaaagaaagaa

SEQ ID NO: 1395705 - RNA, 19 nt, Homo sapiens
aaaggagcaguacaaagaa

SEQ ID NO: 1395706 - RNA, 19 nt, Homo sapiens
ggaaaaggaaacagaauag

SEQ ID NO: 1395707 - RNA, 19 nt, Homo sapiens
gugaaaggagcaguacaaa

SEQ ID NO: 1395708 - RNA, 19 nt, Homo sapiens
gagcugccuccucucaaga

SEQ ID NO: 1395709 - RNA, 19 nt, Homo sapiens
caaaggcgugaaagaagug

SEQ ID NO: 1395710 - RNA, 19 nt, Homo sapiens
cggagagguuucagcaaca

SEQ ID NO: 1395711 - RNA, 19 nt, Homo sapiens
ugugaaaggagcaguacaa

SEQ ID NO: 1395712 - RNA, 19 nt, Homo sapiens
gcaaaacauccuuccuuga

SEQ ID NO: 1395713 - RNA, 19 nt, Homo sapiens
ucugagaagucaccaccau

SEQ ID NO: 1395714 - RNA, 19 nt, Homo sapiens
ucagaggaagagcaacaaa

SEQ ID NO: 1395715 - RNA, 19 nt, Homo sapiens
cuugaagccuagcacugaa

SEQ ID NO: 1395716 - RNA, 19 nt, Homo sapiens
ccuugaagccuagcacuga

SEQ ID NO: 1395717 - RNA, 19 nt, Homo sapiens
gcaccauagaccaccugua

SEQ ID NO: 1395718 - RNA, 19 nt, Homo sapiens
cccagacuccagacucuaa

SEQ ID NO: 1395719 - RNA, 19 nt, Homo sapiens
ugaaaggagcaguacaaag

SEQ ID NO: 1395720 - RNA, 19 nt, Homo sapiens
cagaauagucaauggaaaa

SEQ ID NO: 1395721 - RNA, 19 nt, Homo sapiens
ggagagguuucagcaacac

SEQ ID NO: 1395722 - RNA, 19 nt, Homo sapiens
agaaaagacaucugagaaa

SEQ ID NO: 1395723 - RNA, 19 nt, Homo sapiens
gcaagaagcugaucgaugu

SEQ ID NO: 1395724 - RNA, 19 nt, Homo sapiens
ucacaaacauucagaaauc

SEQ ID NO: 1395725 - RNA, 19 nt, Homo sapiens
ccaaaccaaucuucccuua

SEQ ID NO: 1395726 - RNA, 19 nt, Homo sapiens
agacaaggcugcaaauuca

SEQ ID NO: 1395727 - RNA, 19 nt, Homo sapiens
gcaaagggauugguuggau

SEQ ID NO: 1395728 - RNA, 19 nt, Homo sapiens
caagagaaguuugggaaau

SEQ ID NO: 1395729 - RNA, 19 nt, Homo sapiens
gaaugggacucaagagaag

SEQ ID NO: 1395730 - RNA, 19 nt, Homo sapiens
gaagacaugaacacaauug

SEQ ID NO: 1395731 - RNA, 19 nt, Homo sapiens
aaaccaaucuucccuuaca

SEQ ID NO: 1395732 - RNA, 19 nt, Homo sapiens
caaagggauugguuggauu

SEQ ID NO: 1395733 - RNA, 19 nt, Homo sapiens
gagacaaggcugcaaauuc

SEQ ID NO: 1395734 - RNA, 19 nt, Homo sapiens
gaucgauguugcuggcuuu

SEQ ID NO: 1395735 - RNA, 19 nt, Homo sapiens
acaagaagcagcagacaaa

SEQ ID NO: 1395736 - RNA, 19 nt, Homo sapiens
ucagaaaucccuaaaucuu

SEQ ID NO: 1395737 - RNA, 19 nt, Homo sapiens
agaaaucccuaaaucuugu

SEQ ID NO: 1395738 - RNA, 19 nt, Homo sapiens
cccuaaaucuugugaguug

SEQ ID NO: 1395739 - RNA, 19 nt, Homo sapiens
gaaucugagucuuccacaa

SEQ ID NO: 1395740 - RNA, 19 nt, Homo sapiens
cagaaaucccuaaaucuug

SEQ ID NO: 1395741 - RNA, 19 nt, Homo sapiens
ugugugacaucaacaagaa

SEQ ID NO: 1395742 - RNA, 19 nt, Homo sapiens
gaugagaaucugagucuuc

SEQ ID NO: 1395743 - RNA, 19 nt, Homo sapiens
gcaaucauggugcacagaa

SEQ ID NO: 1395744 - RNA, 19 nt, Homo sapiens
ggcuuuggauucuuuguga

SEQ ID NO: 1395745 - RNA, 19 nt, Homo sapiens
gacaugaacacaauugcaa

SEQ ID NO: 1395746 - RNA, 19 nt, Homo sapiens
ugaaugggacucaagagaa

SEQ ID NO: 1395747 - RNA, 19 nt, Homo sapiens
gauugcauaucucugugaa

SEQ ID NO: 1395748 - RNA, 19 nt, Homo sapiens
ggaaugucuuuggguaugu

SEQ ID NO: 1395749 - RNA, 19 nt, Homo sapiens
aagagaaguuugggaaaug

SEQ ID NO: 1395750 - RNA, 19 nt, Homo sapiens
uugcauaucucugugaaug

SEQ ID NO: 1395751 - RNA, 19 nt, Homo sapiens
auucagaaaucccuaaauc

SEQ ID NO: 1395752 - RNA, 19 nt, Homo sapiens
cagaugacccuugcaauca

SEQ ID NO: 1395753 - RNA, 19 nt, Homo sapiens
ccagaugacccuugcaauc

SEQ ID NO: 1395754 - RNA, 19 nt, Homo sapiens
ugaguugucguaucauuug

SEQ ID NO: 1395755 - RNA, 19 nt, Homo sapiens
cuugugaguugucguauca

SEQ ID NO: 1395756 - RNA, 19 nt, Homo sapiens
cgauguugcuggcuuugga

SEQ ID NO: 1395757 - RNA, 19 nt, Homo sapiens
gaauuaaaaccgucaaguu

SEQ ID NO: 1395758 - RNA, 19 nt, Homo sapiens
augaagacaugaacacaau

SEQ ID NO: 1395759 - RNA, 19 nt, Homo sapiens
gggauugguuggauugcau

SEQ ID NO: 1395760 - RNA, 19 nt, Homo sapiens
gaaugucuuuggguaugug

SEQ ID NO: 1395761 - RNA, 19 nt, Homo sapiens
ugacacaccaacaugaaga

SEQ ID NO: 1395762 - RNA, 19 nt, Homo sapiens
gaacccaggccaagacacu

SEQ ID NO: 1395763 - RNA, 19 nt, Homo sapiens
ggacucaagagaaguuugg

SEQ ID NO: 1395764 - RNA, 19 nt, Homo sapiens
uggaaugucuuuggguaug

SEQ ID NO: 1395765 - RNA, 19 nt, Homo sapiens
caaucauggugcacagaau

SEQ ID NO: 1395766 - RNA, 19 nt, Homo sapiens
gaccagaugacccuugcaa

SEQ ID NO: 1395767 - RNA, 19 nt, Homo sapiens
gugaaugggacucaagaga

SEQ ID NO: 1395768 - RNA, 19 nt, Homo sapiens
ugugaguugucguaucauu

SEQ ID NO: 1395769 - RNA, 19 nt, Homo sapiens
ggauugguuggauugcaua

SEQ ID NO: 1395770 - RNA, 19 nt, Homo sapiens
gugaguugucguaucauuu

SEQ ID NO: 1395771 - RNA, 19 nt, Homo sapiens
aaaugacacaccaacauga

SEQ ID NO: 1395772 - RNA, 19 nt, Homo sapiens
ugucguaucauuuguagau

SEQ ID NO: 1395773 - RNA, 19 nt, Homo sapiens
cuagaguuguaggcaagua

SEQ ID NO: 1395774 - RNA, 19 nt, Homo sapiens
ucaagagaaguuugggaaa

SEQ ID NO: 1395775 - RNA, 19 nt, Homo sapiens
ugcaggcuaugcuuucuga

SEQ ID NO: 1395776 - RNA, 19 nt, Homo sapiens
acucuugucugcugagauc

SEQ ID NO: 1395777 - RNA, 19 nt, Homo sapiens
cagcagacaaaacaaaaua

SEQ ID NO: 1395778 - RNA, 19 nt, Homo sapiens
cacaagaugcccaagacuu

SEQ ID NO: 1395779 - RNA, 19 nt, Homo sapiens
ggaugagaaucugagucuu

SEQ ID NO: 1395780 - RNA, 19 nt, Homo sapiens
guugucguaucauuuguag

SEQ ID NO: 1395781 - RNA, 19 nt, Homo sapiens
uuaaacccguggaaugucu

SEQ ID NO: 1395782 - RNA, 19 nt, Homo sapiens
ggauugcauaucucuguga

SEQ ID NO: 1395783 - RNA, 19 nt, Homo sapiens
aaagggauugguuggauug

SEQ ID NO: 1395784 - RNA, 19 nt, Homo sapiens
aaucauggugcacagaauu

SEQ ID NO: 1395785 - RNA, 19 nt, Homo sapiens
gcuuuggauucuuugugaa

SEQ ID NO: 1395786 - RNA, 19 nt, Homo sapiens
ccaagacacuaaaaugaca

SEQ ID NO: 1395787 - RNA, 19 nt, Homo sapiens
gaguugucguaucauuugu

SEQ ID NO: 1395788 - RNA, 19 nt, Homo sapiens
caacaagaagcagcagaca

SEQ ID NO: 1395789 - RNA, 19 nt, Homo sapiens
ugagacaaggcugcaaauu

SEQ ID NO: 1395790 - RNA, 19 nt, Homo sapiens
agaucacucuccaaaccaa

SEQ ID NO: 1395791 - RNA, 19 nt, Homo sapiens
gauccucccagaagauaag

SEQ ID NO: 1395792 - RNA, 19 nt, Homo sapiens
aauggcacaugaugcugaa

SEQ ID NO: 1395793 - RNA, 19 nt, Homo sapiens
aaucuugugaguugucgua

SEQ ID NO: 1395794 - RNA, 19 nt, Homo sapiens
gaaaucccuaaaucuugug

SEQ ID NO: 1395795 - RNA, 19 nt, Homo sapiens
cauggugcacagaauuaaa

SEQ ID NO: 1395796 - RNA, 19 nt, Homo sapiens
uugguuggauugcauaucu

SEQ ID NO: 1395797 - RNA, 19 nt, Homo sapiens
ggccaagacacuaaaauga

SEQ ID NO: 1395798 - RNA, 19 nt, Homo sapiens
caagaagcugaucgauguu

SEQ ID NO: 1395799 - RNA, 19 nt, Homo sapiens
aaugacacaccaacaugaa

SEQ ID NO: 1395800 - RNA, 19 nt, Homo sapiens
gggcaaaggugcaugacaa

SEQ ID NO: 1395801 - RNA, 19 nt, Homo sapiens
gaaccucugugcacacgau

SEQ ID NO: 1395802 - RNA, 19 nt, Homo sapiens
gggcagugcugggagauga

SEQ ID NO: 1395803 - RNA, 19 nt, Homo sapiens
aaaccucgaugaacaaaca

SEQ ID NO: 1395804 - RNA, 19 nt, Homo sapiens
gaacaaacaccgggagagu

SEQ ID NO: 1395805 - RNA, 19 nt, Homo sapiens
gaagcccgaugggaaagaa

SEQ ID NO: 1395806 - RNA, 19 nt, Homo sapiens
cugcaucucuucccacuau

SEQ ID NO: 1395807 - RNA, 19 nt, Homo sapiens
ggagaguguuucugcagau

SEQ ID NO: 1395808 - RNA, 19 nt, Homo sapiens
cgggaaaccucgaugaaca

SEQ ID NO: 1395809 - RNA, 19 nt, Homo sapiens
ugacaacucugagcaaguc

SEQ ID NO: 1395810 - RNA, 19 nt, Homo sapiens
cgagaagcccgaugggaaa

SEQ ID NO: 1395811 - RNA, 19 nt, Homo sapiens
gaacuuggcgcugcuaagg

SEQ ID NO: 1395812 - RNA, 19 nt, Homo sapiens
gauccugcuuugugacuuc

SEQ ID NO: 1395813 - RNA, 19 nt, Homo sapiens
cccacuaucugcuaggaaa

SEQ ID NO: 1395814 - RNA, 19 nt, Homo sapiens
ggaaaccucgaugaacaaa

SEQ ID NO: 1395815 - RNA, 19 nt, Homo sapiens
gaaggaaaugaccgcagaa

SEQ ID NO: 1395816 - RNA, 19 nt, Homo sapiens
gaaaccaacagcggcgauu

SEQ ID NO: 1395817 - RNA, 19 nt, Homo sapiens
gaggcuugcgugacaguuu

SEQ ID NO: 1395818 - RNA, 19 nt, Homo sapiens
caacucugagcaagucaaa

SEQ ID NO: 1395819 - RNA, 19 nt, Homo sapiens
aaaggugcaugacaacucu

SEQ ID NO: 1395820 - RNA, 19 nt, Homo sapiens
gggaaaccucgaugaacaa

SEQ ID NO: 1395821 - RNA, 19 nt, Homo sapiens
gcgugacaguuuccacuca

SEQ ID NO: 1395822 - RNA, 19 nt, Homo sapiens
gaagcgcuggaagcacuua

SEQ ID NO: 1395823 - RNA, 19 nt, Homo sapiens
gagaguguuucugcagauc

SEQ ID NO: 1395824 - RNA, 19 nt, Homo sapiens
caaaggugcaugacaacuc

SEQ ID NO: 1395825 - RNA, 19 nt, Homo sapiens
gcaugacaacucugagcaa

SEQ ID NO: 1395826 - RNA, 19 nt, Homo sapiens
gcagugcugggagaugaaa

SEQ ID NO: 1395827 - RNA, 19 nt, Homo sapiens
gggcuuccuggauugcaua

SEQ ID NO: 1395828 - RNA, 19 nt, Homo sapiens
cuuccuggauugcauaaag

SEQ ID NO: 1395829 - RNA, 19 nt, Homo sapiens
uuacauagccagggcaaag

SEQ ID NO: 1395830 - RNA, 19 nt, Homo sapiens
ccagggcaaaggugcauga

SEQ ID NO: 1395831 - RNA, 19 nt, Homo sapiens
gcuuugugacuucgaguga

SEQ ID NO: 1395832 - RNA, 19 nt, Homo sapiens
ggcuccuucuccuuacaua

SEQ ID NO: 1395833 - RNA, 19 nt, Homo sapiens
cagcgggaaaccucgauga

SEQ ID NO: 1395834 - RNA, 19 nt, Homo sapiens
gaagugagaugaaauguca

SEQ ID NO: 1395835 - RNA, 19 nt, Homo sapiens
ggagaaagcauacuuguga

SEQ ID NO: 1395836 - RNA, 19 nt, Homo sapiens
gaagugagaugcuuuaacu

SEQ ID NO: 1395837 - RNA, 19 nt, Homo sapiens
ggacaauagugaauaauag

SEQ ID NO: 1395838 - RNA, 19 nt, Homo sapiens
gaaacauacugaacaugaa

SEQ ID NO: 1395839 - RNA, 19 nt, Homo sapiens
gcauguaggauguuaauuu

SEQ ID NO: 1395840 - RNA, 19 nt, Homo sapiens
gagaaggcaucugacauuu

SEQ ID NO: 1395841 - RNA, 19 nt, Homo sapiens
acacauaucugaccaucuu

SEQ ID NO: 1395842 - RNA, 19 nt, Homo sapiens
caacuguacugucuggaaa

SEQ ID NO: 1395843 - RNA, 19 nt, Homo sapiens
gaacuuaccaguacugaca

SEQ ID NO: 1395844 - RNA, 19 nt, Homo sapiens
gugaggagaccaaggauua

SEQ ID NO: 1395845 - RNA, 19 nt, Homo sapiens
ccaggacaauagugaauaa

SEQ ID NO: 1395846 - RNA, 19 nt, Homo sapiens
gcauuaacauguaagaaca

SEQ ID NO: 1395847 - RNA, 19 nt, Homo sapiens
gcaaaccauguuagucuua

SEQ ID NO: 1395848 - RNA, 19 nt, Homo sapiens
uaauuuggccuaacacuuu

SEQ ID NO: 1395849 - RNA, 19 nt, Homo sapiens
guagauacauuugcacaug

SEQ ID NO: 1395850 - RNA, 19 nt, Homo sapiens
cacauauucugacucuuua

SEQ ID NO: 1395851 - RNA, 19 nt, Homo sapiens
ucacauauucugacucuuu

SEQ ID NO: 1395852 - RNA, 19 nt, Homo sapiens
guacucuccugguuaggua

SEQ ID NO: 1395853 - RNA, 19 nt, Homo sapiens
gacaguuucuccuuccuuu

SEQ ID NO: 1395854 - RNA, 19 nt, Homo sapiens
gagaaagcauacuugugaa

SEQ ID NO: 1395855 - RNA, 19 nt, Homo sapiens
ggacuggauuuggcaugua

SEQ ID NO: 1395856 - RNA, 19 nt, Homo sapiens
auagauagcucuuggauac

SEQ ID NO: 1395857 - RNA, 19 nt, Homo sapiens
gaacaagaaggaacagcaa

SEQ ID NO: 1395858 - RNA, 19 nt, Homo sapiens
ucaauaauuuggccuaaca

SEQ ID NO: 1395859 - RNA, 19 nt, Homo sapiens
gugagaugcuuuaacuuug

SEQ ID NO: 1395860 - RNA, 19 nt, Homo sapiens
cauguaggauguuaauuuc

SEQ ID NO: 1395861 - RNA, 19 nt, Homo sapiens
uaaaugaagugagaugcuu

SEQ ID NO: 1395862 - RNA, 19 nt, Homo sapiens
ccugauaaaugaagugaga

SEQ ID NO: 1395863 - RNA, 19 nt, Homo sapiens
gacaaaggaacaucauauu

SEQ ID NO: 1395864 - RNA, 19 nt, Homo sapiens
cgacaaaggaacaucauau

SEQ ID NO: 1395865 - RNA, 19 nt, Homo sapiens
gacaaacacugcgccaaga

SEQ ID NO: 1395866 - RNA, 19 nt, Homo sapiens
uagguagccuuaucaaguu

SEQ ID NO: 1395867 - RNA, 19 nt, Homo sapiens
caagagcuccucagcagaa

SEQ ID NO: 1395868 - RNA, 19 nt, Homo sapiens
gcaugggaaugaucuguuc

SEQ ID NO: 1395869 - RNA, 19 nt, Homo sapiens
uuuaaguacuggagcuuua

SEQ ID NO: 1395870 - RNA, 19 nt, Homo sapiens
gagcuuuacuguaugucuu

SEQ ID NO: 1395871 - RNA, 19 nt, Homo sapiens
gagaugcuuuaacuuuguu

SEQ ID NO: 1395872 - RNA, 19 nt, Homo sapiens
gaugaaaugucagcuguac

SEQ ID NO: 1395873 - RNA, 19 nt, Homo sapiens
aagcauacuugugaacuuu

SEQ ID NO: 1395874 - RNA, 19 nt, Homo sapiens
uacuggagcuuuacuguau

SEQ ID NO: 1395875 - RNA, 19 nt, Homo sapiens
ggauacauuuggaaguaau

SEQ ID NO: 1395876 - RNA, 19 nt, Homo sapiens
gcauugagacugccuguuc

SEQ ID NO: 1395877 - RNA, 19 nt, Homo sapiens
agaaacauacugaacauga

SEQ ID NO: 1395878 - RNA, 19 nt, Homo sapiens
ggacuugacuuuucuugga

SEQ ID NO: 1395879 - RNA, 19 nt, Homo sapiens
gcucuuggauacauuugga

SEQ ID NO: 1395880 - RNA, 19 nt, Homo sapiens
gaagcaaugguaugggaaa

SEQ ID NO: 1395881 - RNA, 19 nt, Homo sapiens
uaucugaucaccuuauuga

SEQ ID NO: 1395882 - RNA, 19 nt, Homo sapiens
ccacuccuauuaugaagau

SEQ ID NO: 1395883 - RNA, 19 nt, Homo sapiens
guacuggagcuuuacugua

SEQ ID NO: 1395884 - RNA, 19 nt, Homo sapiens
ugagagagaaggcaucuga

SEQ ID NO: 1395885 - RNA, 19 nt, Homo sapiens
ucaagaggcagcuagguuu

SEQ ID NO: 1395886 - RNA, 19 nt, Homo sapiens
gcaagcaacagaaacauac

SEQ ID NO: 1395887 - RNA, 19 nt, Homo sapiens
caggaacagguauaaauuu

SEQ ID NO: 1395888 - RNA, 19 nt, Homo sapiens
ggaagcuucugcucucaag

SEQ ID NO: 1395889 - RNA, 19 nt, Homo sapiens
gcacagaggcauugagacu

SEQ ID NO: 1395890 - RNA, 19 nt, Homo sapiens
agguaugccugauaaauga

SEQ ID NO: 1395891 - RNA, 19 nt, Homo sapiens
gaaaguacccaaaauaaag

SEQ ID NO: 1395892 - RNA, 19 nt, Homo sapiens
gaaugguucuauggacuug

SEQ ID NO: 1395893 - RNA, 19 nt, Homo sapiens
gguuuauuguugugaauga

SEQ ID NO: 1395894 - RNA, 19 nt, Homo sapiens
ugagaugcuuuaacuuugu

SEQ ID NO: 1395895 - RNA, 19 nt, Homo sapiens
ucaggaacagguauaaauu

SEQ ID NO: 1395896 - RNA, 19 nt, Homo sapiens
caaaccauguuagucuuau

SEQ ID NO: 1395897 - RNA, 19 nt, Homo sapiens
gcaaugguaugggaaaauu

SEQ ID NO: 1395898 - RNA, 19 nt, Homo sapiens
gagacugccuguuccucuu

SEQ ID NO: 1395899 - RNA, 19 nt, Homo sapiens
agagaaggcaucugacauu

SEQ ID NO: 1395900 - RNA, 19 nt, Homo sapiens
gauuuggcauguaggaugu

SEQ ID NO: 1395901 - RNA, 19 nt, Homo sapiens
gcuguacucuccugguuag

SEQ ID NO: 1395902 - RNA, 19 nt, Homo sapiens
cagguuuccuuugcacaua

SEQ ID NO: 1395903 - RNA, 19 nt, Homo sapiens
caacagaaacauacugaac

SEQ ID NO: 1395904 - RNA, 19 nt, Homo sapiens
cagcuguacucuccugguu

SEQ ID NO: 1395905 - RNA, 19 nt, Homo sapiens
caacaggcugguucugauu

SEQ ID NO: 1395906 - RNA, 19 nt, Homo sapiens
guacuucaaggaucucuau

SEQ ID NO: 1395907 - RNA, 19 nt, Homo sapiens
uuggauacauuuggaagua

SEQ ID NO: 1395908 - RNA, 19 nt, Homo sapiens
gauagcucuuggauacauu

SEQ ID NO: 1395909 - RNA, 19 nt, Homo sapiens
acagaaacauacugaacau

SEQ ID NO: 1395910 - RNA, 19 nt, Homo sapiens
aaagcauacuugugaacuu

SEQ ID NO: 1395911 - RNA, 19 nt, Homo sapiens
cugcuaaaauuaccacuua

SEQ ID NO: 1395912 - RNA, 19 nt, Homo sapiens
gcuaaagaaaguacccaaa

SEQ ID NO: 1395913 - RNA, 19 nt, Homo sapiens
gacaacaggcugguucuga

SEQ ID NO: 1395914 - RNA, 19 nt, Homo sapiens
gcuuuaacuuuguucuaga

SEQ ID NO: 1395915 - RNA, 19 nt, Homo sapiens
gaggugaggagaccaagga

SEQ ID NO: 1395916 - RNA, 19 nt, Homo sapiens
uaccaguacugacaucuuc

SEQ ID NO: 1395917 - RNA, 19 nt, Homo sapiens
guuuacaaauggugagaga

SEQ ID NO: 1395918 - RNA, 19 nt, Homo sapiens
agugagaugcuuuaacuuu

SEQ ID NO: 1395919 - RNA, 19 nt, Homo sapiens
uauguuagguagccuuauc

SEQ ID NO: 1395920 - RNA, 19 nt, Homo sapiens
gcuccacuccuauuaugaa

SEQ ID NO: 1395921 - RNA, 19 nt, Homo sapiens
gagaacucauauguuaaug

SEQ ID NO: 1395922 - RNA, 19 nt, Homo sapiens
caucuucacagcauuguau

SEQ ID NO: 1395923 - RNA, 19 nt, Homo sapiens
gauccucugugcugggaau

SEQ ID NO: 1395924 - RNA, 19 nt, Homo sapiens
uuagguagccuuaucaagu

SEQ ID NO: 1395925 - RNA, 19 nt, Homo sapiens
cuaucuaucugaucaccuu

SEQ ID NO: 1395926 - RNA, 19 nt, Homo sapiens
cuuccaagcuuccaucaag

SEQ ID NO: 1395927 - RNA, 19 nt, Homo sapiens
ggccaagcaaaccauguua

SEQ ID NO: 1395928 - RNA, 19 nt, Homo sapiens
ggccaacccugucucaaaa

SEQ ID NO: 1395929 - RNA, 19 nt, Homo sapiens
acaacaggcugguucugau

SEQ ID NO: 1395930 - RNA, 19 nt, Homo sapiens
gcagaagcuccucgcauca

SEQ ID NO: 1395931 - RNA, 19 nt, Homo sapiens
ggacugacaacuguacugu

SEQ ID NO: 1395932 - RNA, 19 nt, Homo sapiens
ccucaaugguucagguuuc

SEQ ID NO: 1395933 - RNA, 19 nt, Homo sapiens
ucaacaaccuagucugaac

SEQ ID NO: 1395934 - RNA, 19 nt, Homo sapiens
ggaaugaaguccuuguuuc

SEQ ID NO: 1395935 - RNA, 19 nt, Homo sapiens
guagaugccuugacgauuc

SEQ ID NO: 1395936 - RNA, 19 nt, Homo sapiens
caaaucucaucuugaauug

SEQ ID NO: 1395937 - RNA, 19 nt, Homo sapiens
cauguaaugugccauauuc

SEQ ID NO: 1395938 - RNA, 19 nt, Homo sapiens
ccagaacuaugagucaauu

SEQ ID NO: 1395939 - RNA, 19 nt, Homo sapiens
ucagagggcagguauauug

SEQ ID NO: 1395940 - RNA, 19 nt, Homo sapiens
ccauucaaaucucaucuug

SEQ ID NO: 1395941 - RNA, 19 nt, Homo sapiens
caauuaaaccucuuuccuu

SEQ ID NO: 1395942 - RNA, 19 nt, Homo sapiens
cuggagcaauacuuaaaua

SEQ ID NO: 1395943 - RNA, 19 nt, Homo sapiens
ucacaggugucaggaauca

SEQ ID NO: 1395944 - RNA, 19 nt, Homo sapiens
gggagguaauuaaaucaug

SEQ ID NO: 1395945 - RNA, 19 nt, Homo sapiens
ggaaucagagggcagguau

SEQ ID NO: 1395946 - RNA, 19 nt, Homo sapiens
uaagagugcaugugaguau

SEQ ID NO: 1395947 - RNA, 19 nt, Homo sapiens
ccaagugaaggacaaguuu

SEQ ID NO: 1395948 - RNA, 19 nt, Homo sapiens
gcagccaagugaaggacaa

SEQ ID NO: 1395949 - RNA, 19 nt, Homo sapiens
gagugcaugugaguauauu

SEQ ID NO: 1395950 - RNA, 19 nt, Homo sapiens
gggcucugcuggcuucugu

SEQ ID NO: 1395951 - RNA, 19 nt, Homo sapiens
gugacgacccagugaagua

SEQ ID NO: 1395952 - RNA, 19 nt, Homo sapiens
ugugggagguaauuaaauc

SEQ ID NO: 1395953 - RNA, 19 nt, Homo sapiens
cacgagaucugaagguuuu

SEQ ID NO: 1395954 - RNA, 19 nt, Homo sapiens
acacagggccuuauauggu

SEQ ID NO: 1395955 - RNA, 19 nt, Homo sapiens
aagagugcaugugaguaua

SEQ ID NO: 1395956 - RNA, 19 nt, Homo sapiens
cuacacagggccuuauaug

SEQ ID NO: 1395957 - RNA, 19 nt, Homo sapiens
gaaucagagggcagguaua

SEQ ID NO: 1395958 - RNA, 19 nt, Homo sapiens
gcagugacgacccagugaa

SEQ ID NO: 1395959 - RNA, 19 nt, Homo sapiens
ggagcaauacuuaaauagg

SEQ ID NO: 1395960 - RNA, 19 nt, Homo sapiens
caagugaaggacaaguuug

SEQ ID NO: 1395961 - RNA, 19 nt, Homo sapiens
ucaugcuguucuugugaua

SEQ ID NO: 1395962 - RNA, 19 nt, Homo sapiens
ucacgagaucugaagguuu

SEQ ID NO: 1395963 - RNA, 19 nt, Homo sapiens
aaucagagggcagguauau

SEQ ID NO: 1395964 - RNA, 19 nt, Homo sapiens
ccauuauucugccaacuac

SEQ ID NO: 1395965 - RNA, 19 nt, Homo sapiens
caacuacacagggccuuau

SEQ ID NO: 1395966 - RNA, 19 nt, Homo sapiens
gcuaaccuccccauuuuaa

SEQ ID NO: 1395967 - RNA, 19 nt, Homo sapiens
uauauuggaccuaccugaa

SEQ ID NO: 1395968 - RNA, 19 nt, Homo sapiens
gccucccucuuucaucuuu

SEQ ID NO: 1395969 - RNA, 19 nt, Homo sapiens
gaaugaaguccuuguuucc

SEQ ID NO: 1395970 - RNA, 19 nt, Homo sapiens
ccuugacgauucccauuuc

SEQ ID NO: 1395971 - RNA, 19 nt, Homo sapiens
ccaacuacacagggccuua

SEQ ID NO: 1395972 - RNA, 19 nt, Homo sapiens
aggcuaaccuccccauuuu

SEQ ID NO: 1395973 - RNA, 19 nt, Homo sapiens
uauuggaccuaccugaauc

SEQ ID NO: 1395974 - RNA, 19 nt, Homo sapiens
gccaagugaaggacaaguu

SEQ ID NO: 1395975 - RNA, 19 nt, Homo sapiens
cagaacuaugagucaauua

SEQ ID NO: 1395976 - RNA, 19 nt, Homo sapiens
gcuggagcaauacuuaaau

SEQ ID NO: 1395977 - RNA, 19 nt, Homo sapiens
gugacucucucccgucucu

SEQ ID NO: 1395978 - RNA, 19 nt, Homo sapiens
ccuuaauucuaccugcaaa

SEQ ID NO: 1395979 - RNA, 19 nt, Homo sapiens
ccauguaaugugccauauu

SEQ ID NO: 1395980 - RNA, 19 nt, Homo sapiens
gccauguaaugugccauau

SEQ ID NO: 1395981 - RNA, 19 nt, Homo sapiens
uggcagaauucagcugugu

SEQ ID NO: 1395982 - RNA, 19 nt, Homo sapiens
ucugcuggcuucugugcuu

SEQ ID NO: 1395983 - RNA, 19 nt, Homo sapiens
cgguuacccucaugcuguu

SEQ ID NO: 1395984 - RNA, 19 nt, Homo sapiens
gucugcagccuuaauucua

SEQ ID NO: 1395985 - RNA, 19 nt, Homo sapiens
ggucugcagccuuaauucu

SEQ ID NO: 1395986 - RNA, 19 nt, Homo sapiens
gcuguucuugugauaguga

SEQ ID NO: 1395987 - RNA, 19 nt, Homo sapiens
augaaguccuuguuuccuu

SEQ ID NO: 1395988 - RNA, 19 nt, Homo sapiens
gccuugacgauucccauuu

SEQ ID NO: 1395989 - RNA, 19 nt, Homo sapiens
ugaagaaucuauccagugu

SEQ ID NO: 1395990 - RNA, 19 nt, Homo sapiens
gaaucuauccagugucuuu

SEQ ID NO: 1395991 - RNA, 19 nt, Homo sapiens
ucaaaugccuccugacgau

SEQ ID NO: 1395992 - RNA, 19 nt, Homo sapiens
gagcugcacgugcuaauga

SEQ ID NO: 1395993 - RNA, 19 nt, Homo sapiens
ggucguggguucuccuuug

SEQ ID NO: 1395994 - RNA, 19 nt, Homo sapiens
gcacagccggacaucauuu

SEQ ID NO: 1395995 - RNA, 19 nt, Homo sapiens
gacaucauuuguacugaga

SEQ ID NO: 1395996 - RNA, 19 nt, Homo sapiens
caucauuuguacugagaga

SEQ ID NO: 1395997 - RNA, 19 nt, Homo sapiens
gcuggccgguuucucaaau

SEQ ID NO: 1395998 - RNA, 19 nt, Homo sapiens
gcgcacagccggacaucau

SEQ ID NO: 1395999 - RNA, 19 nt, Homo sapiens
aagaaucuauccagugucu

SEQ ID NO: 1396000 - RNA, 19 nt, Homo sapiens
cgagggcuauuuuaaaaga

SEQ ID NO: 1396001 - RNA, 19 nt, Homo sapiens
cagccggacaucauuugua

SEQ ID NO: 1396002 - RNA, 19 nt, Homo sapiens
cuugauuucuccuccuuug

SEQ ID NO: 1396003 - RNA, 19 nt, Homo sapiens
gucguggguucuccuuuga

SEQ ID NO: 1396004 - RNA, 19 nt, Homo sapiens
gauuucuccuccuuuggau

SEQ ID NO: 1396005 - RNA, 19 nt, Homo sapiens
gacaaaaggaaaucacuga

SEQ ID NO: 1396006 - RNA, 19 nt, Homo sapiens
cccgagggcuauuuuaaaa

SEQ ID NO: 1396007 - RNA, 19 nt, Homo sapiens
ccgcaagguugagcugugu

SEQ ID NO: 1396008 - RNA, 19 nt, Homo sapiens
gcaaaacuaagugucaaaa

SEQ ID NO: 1396009 - RNA, 19 nt, Homo sapiens
aaaugccuccugacgauug

SEQ ID NO: 1396010 - RNA, 19 nt, Homo sapiens
caaaugccuccugacgauu

SEQ ID NO: 1396011 - RNA, 19 nt, Homo sapiens
ugauuucuccuccuuugga

SEQ ID NO: 1396012 - RNA, 19 nt, Homo sapiens
uaugagaacuaacccaaua

SEQ ID NO: 1396013 - RNA, 19 nt, Homo sapiens
gaccagcacuagccaauga

SEQ ID NO: 1396014 - RNA, 19 nt, Homo sapiens
ggacaucacucgccuucag

SEQ ID NO: 1396015 - RNA, 19 nt, Homo sapiens
gcaggaagccacugacaug

SEQ ID NO: 1396016 - RNA, 19 nt, Homo sapiens
ccaaugagcugugaguaca

SEQ ID NO: 1396017 - RNA, 19 nt, Homo sapiens
guucugaucuucucauucu

SEQ ID NO: 1396018 - RNA, 19 nt, Homo sapiens
gacuugauaugagaacuaa

SEQ ID NO: 1396019 - RNA, 19 nt, Homo sapiens
gacaggagacugggucaua

SEQ ID NO: 1396020 - RNA, 19 nt, Homo sapiens
gggacaagcugggucaugu

SEQ ID NO: 1396021 - RNA, 19 nt, Homo sapiens
ucaaguccugcaacuauua

SEQ ID NO: 1396022 - RNA, 19 nt, Homo sapiens
cuccuugucugacuugaua

SEQ ID NO: 1396023 - RNA, 19 nt, Homo sapiens
gcgcgacucugcucucaag

SEQ ID NO: 1396024 - RNA, 19 nt, Homo sapiens
ccucaaguccugcaacuau

SEQ ID NO: 1396025 - RNA, 19 nt, Homo sapiens
ccugugugcuuugaaguuu

SEQ ID NO: 1396026 - RNA, 19 nt, Homo sapiens
guuagaugauuggaaguga

SEQ ID NO: 1396027 - RNA, 19 nt, Homo sapiens
ugucugacuugauaugaga

SEQ ID NO: 1396028 - RNA, 19 nt, Homo sapiens
ccuccuaccuccugauauc

SEQ ID NO: 1396029 - RNA, 19 nt, Homo sapiens
gcuaggcugggucauauga

SEQ ID NO: 1396030 - RNA, 19 nt, Homo sapiens
gacaagcugggucauguga

SEQ ID NO: 1396031 - RNA, 19 nt, Homo sapiens
caaguccugcaacuauuaa

SEQ ID NO: 1396032 - RNA, 19 nt, Homo sapiens
acaggagacugggucauau

SEQ ID NO: 1396033 - RNA, 19 nt, Homo sapiens
acccuuagcuggagaggau

SEQ ID NO: 1396034 - RNA, 19 nt, Homo sapiens
ugacuugauaugagaacua

SEQ ID NO: 1396035 - RNA, 19 nt, Homo sapiens
ggagccaccacuuccaguu

SEQ ID NO: 1396036 - RNA, 19 nt, Homo sapiens
gcuccugugugcuuugaag

SEQ ID NO: 1396037 - RNA, 19 nt, Homo sapiens
ggacaagcugggucaugug

SEQ ID NO: 1396038 - RNA, 19 nt, Homo sapiens
gagaacuaacccaauaugg

SEQ ID NO: 1396039 - RNA, 19 nt, Homo sapiens
gcuaggcugggacauguga

SEQ ID NO: 1396040 - RNA, 19 nt, Homo sapiens
caguucugaucuucucauu

SEQ ID NO: 1396041 - RNA, 19 nt, Homo sapiens
cgucuucuuucaggauaaa

SEQ ID NO: 1396042 - RNA, 19 nt, Homo sapiens
uacgucuucuuucaggaua

SEQ ID NO: 1396043 - RNA, 19 nt, Homo sapiens
cucaaguccugcaacuauu

SEQ ID NO: 1396044 - RNA, 19 nt, Homo sapiens
ugagaacuaacccaauaug

SEQ ID NO: 1396045 - RNA, 19 nt, Homo sapiens
gagccaccacuuccaguuc

SEQ ID NO: 1396046 - RNA, 19 nt, Homo sapiens
gugaguacagguccagcua

SEQ ID NO: 1396047 - RNA, 19 nt, Homo sapiens
cugccuacgucuucuuuca

SEQ ID NO: 1396048 - RNA, 19 nt, Homo sapiens
gaggauggcaugggugaca

SEQ ID NO: 1396049 - RNA, 19 nt, Homo sapiens
gcccuccuaccuccugaua

SEQ ID NO: 1396050 - RNA, 19 nt, Homo sapiens
ucacucgccuucagaacac

SEQ ID NO: 1396051 - RNA, 19 nt, Homo sapiens
ccaggaacaccgccuaguc

SEQ ID NO: 1396052 - RNA, 19 nt, Homo sapiens
caggauaaagccucaaguc

SEQ ID NO: 1396053 - RNA, 19 nt, Homo sapiens
acacugagcccuccuaccu

SEQ ID NO: 1396054 - RNA, 19 nt, Homo sapiens
gacaucacucgccuucaga

SEQ ID NO: 1396055 - RNA, 19 nt, Homo sapiens
caccgugugugcuccuugu

SEQ ID NO: 1396056 - RNA, 19 nt, Homo sapiens
gcugugaggacacgugagu

SEQ ID NO: 1396057 - RNA, 19 nt, Homo sapiens
gaugaaaugugacuuugua

SEQ ID NO: 1396058 - RNA, 19 nt, Homo sapiens
gaacauggauggaucaagu

SEQ ID NO: 1396059 - RNA, 19 nt, Homo sapiens
ggaauaagguaacuaauac

SEQ ID NO: 1396060 - RNA, 19 nt, Homo sapiens
gagcuacuaugucucauuu

SEQ ID NO: 1396061 - RNA, 19 nt, Homo sapiens
ggacacauaugcucacaau

SEQ ID NO: 1396062 - RNA, 19 nt, Homo sapiens
gaaagaggcuggaaguuuu

SEQ ID NO: 1396063 - RNA, 19 nt, Homo sapiens
gaagaaaggaguuaagaga

SEQ ID NO: 1396064 - RNA, 19 nt, Homo sapiens
ggaagaauuugcaccaaga

SEQ ID NO: 1396065 - RNA, 19 nt, Homo sapiens
gaagguaacagcagcagua

SEQ ID NO: 1396066 - RNA, 19 nt, Homo sapiens
gcucuuaucaucaucuuua

SEQ ID NO: 1396067 - RNA, 19 nt, Homo sapiens
caucuaggcucaccucuug

SEQ ID NO: 1396068 - RNA, 19 nt, Homo sapiens
ggaaaacucuaccgagaua

SEQ ID NO: 1396069 - RNA, 19 nt, Homo sapiens
gaaacugccucaccaagca

SEQ ID NO: 1396070 - RNA, 19 nt, Homo sapiens
acacagaaguaaacacaaa

SEQ ID NO: 1396071 - RNA, 19 nt, Homo sapiens
ggaaaagacucagaaaauu

SEQ ID NO: 1396072 - RNA, 19 nt, Homo sapiens
gccaaacucuuaagguauu

SEQ ID NO: 1396073 - RNA, 19 nt, Homo sapiens
ggcauuauuugacuucuuu

SEQ ID NO: 1396074 - RNA, 19 nt, Homo sapiens
gaaaugugacuuuguaauc

SEQ ID NO: 1396075 - RNA, 19 nt, Homo sapiens
gaaguaauacaaagugcua

SEQ ID NO: 1396076 - RNA, 19 nt, Homo sapiens
guaagugugugaucuggaa

SEQ ID NO: 1396077 - RNA, 19 nt, Homo sapiens
gaacuugacuuuuaaccaa

SEQ ID NO: 1396078 - RNA, 19 nt, Homo sapiens
ucacguggguggcauuauu

SEQ ID NO: 1396079 - RNA, 19 nt, Homo sapiens
ggaagugaauccugacaca

SEQ ID NO: 1396080 - RNA, 19 nt, Homo sapiens
cagcagcaguaaacuaauu

SEQ ID NO: 1396081 - RNA, 19 nt, Homo sapiens
acacauaugcucacaauga

SEQ ID NO: 1396082 - RNA, 19 nt, Homo sapiens
gacacaagcucacuagagu

SEQ ID NO: 1396083 - RNA, 19 nt, Homo sapiens
caagugaagugacagaaca

SEQ ID NO: 1396084 - RNA, 19 nt, Homo sapiens
agaaauggcuguguaagug

SEQ ID NO: 1396085 - RNA, 19 nt, Homo sapiens
cagucaagcuuucagauga

SEQ ID NO: 1396086 - RNA, 19 nt, Homo sapiens
gggaguaagugaaaguaau

SEQ ID NO: 1396087 - RNA, 19 nt, Homo sapiens
gaagucagcagagaacauu

SEQ ID NO: 1396088 - RNA, 19 nt, Homo sapiens
uaaggcaacucuacuucuu

SEQ ID NO: 1396089 - RNA, 19 nt, Homo sapiens
ucacagagccaucaaaaua

SEQ ID NO: 1396090 - RNA, 19 nt, Homo sapiens
auacacacguuaacagaaa

SEQ ID NO: 1396091 - RNA, 19 nt, Homo sapiens
gaaggaggagcuacuaugu

SEQ ID NO: 1396092 - RNA, 19 nt, Homo sapiens
cagcagagaacauuuaaau

SEQ ID NO: 1396093 - RNA, 19 nt, Homo sapiens
gcuacuaugucucauuuua

SEQ ID NO: 1396094 - RNA, 19 nt, Homo sapiens
cccacucacugaaguaaua

SEQ ID NO: 1396095 - RNA, 19 nt, Homo sapiens
gggauaauaaguaacagua

SEQ ID NO: 1396096 - RNA, 19 nt, Homo sapiens
gcagaggcuugggcaguuu

SEQ ID NO: 1396097 - RNA, 19 nt, Homo sapiens
gaauuugcaccaagaaguu

SEQ ID NO: 1396098 - RNA, 19 nt, Homo sapiens
guagaugaaaugugacuuu

SEQ ID NO: 1396099 - RNA, 19 nt, Homo sapiens
uccaguagaugaaauguga

SEQ ID NO: 1396100 - RNA, 19 nt, Homo sapiens
caaggaccauggcacaaga

SEQ ID NO: 1396101 - RNA, 19 nt, Homo sapiens
gagaccagcccacagauga

SEQ ID NO: 1396102 - RNA, 19 nt, Homo sapiens
caagagcuccucagcagaa

SEQ ID NO: 1396103 - RNA, 19 nt, Homo sapiens
gacaaacacugcgccaaga

SEQ ID NO: 1396104 - RNA, 19 nt, Homo sapiens
agaaagaggcuggaaguuu

SEQ ID NO: 1396105 - RNA, 19 nt, Homo sapiens
cagauaccaugauaacaga

SEQ ID NO: 1396106 - RNA, 19 nt, Homo sapiens
aacaggaugucacuucuaa

SEQ ID NO: 1396107 - RNA, 19 nt, Homo sapiens
agaacuacauuaagugaga

SEQ ID NO: 1396108 - RNA, 19 nt, Homo sapiens
guaaacuaauuuccaguag

SEQ ID NO: 1396109 - RNA, 19 nt, Homo sapiens
uaacagcagcaguaaacua

SEQ ID NO: 1396110 - RNA, 19 nt, Homo sapiens
ggaaggaggagcuacuaug

SEQ ID NO: 1396111 - RNA, 19 nt, Homo sapiens
guagauacccuucagucaa

SEQ ID NO: 1396112 - RNA, 19 nt, Homo sapiens
gcaacaggaugucacuucu

SEQ ID NO: 1396113 - RNA, 19 nt, Homo sapiens
gaacugaggaagucuuugg

SEQ ID NO: 1396114 - RNA, 19 nt, Homo sapiens
gcagaaagaggcuggaagu

SEQ ID NO: 1396115 - RNA, 19 nt, Homo sapiens
caauuugacuggcuuaaaa

SEQ ID NO: 1396116 - RNA, 19 nt, Homo sapiens
cccaugaacuugacuuuua

SEQ ID NO: 1396117 - RNA, 19 nt, Homo sapiens
ggaguaagugaaaguaaug

SEQ ID NO: 1396118 - RNA, 19 nt, Homo sapiens
uugcaugguuccagugaua

SEQ ID NO: 1396119 - RNA, 19 nt, Homo sapiens
gcaccaagaaguuacuguu

SEQ ID NO: 1396120 - RNA, 19 nt, Homo sapiens
gcugcuauguuaggaguaa

SEQ ID NO: 1396121 - RNA, 19 nt, Homo sapiens
gccagaagacccaagcuaa

SEQ ID NO: 1396122 - RNA, 19 nt, Homo sapiens
ucacugaaguaauacaaag

SEQ ID NO: 1396123 - RNA, 19 nt, Homo sapiens
ggacagagggaacauggau

SEQ ID NO: 1396124 - RNA, 19 nt, Homo sapiens
uugccaaacucuuaaggua

SEQ ID NO: 1396125 - RNA, 19 nt, Homo sapiens
gaagcaaugguaugggaaa

SEQ ID NO: 1396126 - RNA, 19 nt, Homo sapiens
caccaagaaguuacuguua

SEQ ID NO: 1396127 - RNA, 19 nt, Homo sapiens
gagaaaccuugagccagaa

SEQ ID NO: 1396128 - RNA, 19 nt, Homo sapiens
ggaggagcagggacacaua

SEQ ID NO: 1396129 - RNA, 19 nt, Homo sapiens
gagaaauggcuguguaagu

SEQ ID NO: 1396130 - RNA, 19 nt, Homo sapiens
ggugcccacuacucaauuu

SEQ ID NO: 1396131 - RNA, 19 nt, Homo sapiens
agagugagcugggaaguag

SEQ ID NO: 1396132 - RNA, 19 nt, Homo sapiens
auaaguaacaguacccaua

SEQ ID NO: 1396133 - RNA, 19 nt, Homo sapiens
gaaaauuccccucgcauga

SEQ ID NO: 1396134 - RNA, 19 nt, Homo sapiens
gcaaugguaugggaaaauu

SEQ ID NO: 1396135 - RNA, 19 nt, Homo sapiens
gaagaauuugcaccaagaa

SEQ ID NO: 1396136 - RNA, 19 nt, Homo sapiens
uagaugaaaugugacuuug

SEQ ID NO: 1396137 - RNA, 19 nt, Homo sapiens
ggccacagccugcaaggaa

SEQ ID NO: 1396138 - RNA, 19 nt, Homo sapiens
ccuagccacucacuucuga

SEQ ID NO: 1396139 - RNA, 19 nt, Homo sapiens
ugaagugacagaacauuug

SEQ ID NO: 1396140 - RNA, 19 nt, Homo sapiens
gaaaagacucagaaaauuc

SEQ ID NO: 1396141 - RNA, 19 nt, Homo sapiens
gaaauggcuguguaagugu

SEQ ID NO: 1396142 - RNA, 19 nt, Homo sapiens
uagauacccuucagucaag

SEQ ID NO: 1396143 - RNA, 19 nt, Homo sapiens
gguaacagcagcaguaaac

SEQ ID NO: 1396144 - RNA, 19 nt, Homo sapiens
acugagaaauggcugugua

SEQ ID NO: 1396145 - RNA, 19 nt, Homo sapiens
acccacagauaccaugaua

SEQ ID NO: 1396146 - RNA, 19 nt, Homo sapiens
ccacaauccuagccaacau

SEQ ID NO: 1396147 - RNA, 19 nt, Homo sapiens
caacaggaugucacuucua

SEQ ID NO: 1396148 - RNA, 19 nt, Homo sapiens
cacaagaggccacgcugua

SEQ ID NO: 1396149 - RNA, 19 nt, Homo sapiens
ucacucuacuucucuggaa

SEQ ID NO: 1396150 - RNA, 19 nt, Homo sapiens
gcugcuaagugaguugaaa

SEQ ID NO: 1396151 - RNA, 19 nt, Homo sapiens
aaacacagaaguaaacaca

SEQ ID NO: 1396152 - RNA, 19 nt, Homo sapiens
gcauggauggcucuuauca

SEQ ID NO: 1396153 - RNA, 19 nt, Homo sapiens
gaggagcuacuaugucuca

SEQ ID NO: 1396154 - RNA, 19 nt, Homo sapiens
uggauaaacugagaaaugg

SEQ ID NO: 1396155 - RNA, 19 nt, Homo sapiens
caauaaggcaacucuacuu

SEQ ID NO: 1396156 - RNA, 19 nt, Homo sapiens
gagauaaagagaacuacau

SEQ ID NO: 1396157 - RNA, 19 nt, Homo sapiens
gaaauacguucgcaacuca

SEQ ID NO: 1396158 - RNA, 19 nt, Homo sapiens
gcacuugccucugcacuuu

SEQ ID NO: 1396159 - RNA, 19 nt, Homo sapiens
gggcaugggugcuggagaa

SEQ ID NO: 1396160 - RNA, 19 nt, Homo sapiens
ggaaauacguucgcaacuc

SEQ ID NO: 1396161 - RNA, 19 nt, Homo sapiens
cauuggagcuucuuuaucu

SEQ ID NO: 1396162 - RNA, 19 nt, Homo sapiens
gagcauuggagcuucuuua

SEQ ID NO: 1396163 - RNA, 19 nt, Homo sapiens
guucgcaacucacggauga

SEQ ID NO: 1396164 - RNA, 19 nt, Homo sapiens
gaguggaaguuaucuguca

SEQ ID NO: 1396165 - RNA, 19 nt, Homo sapiens
cagagaauaagcccuguua

SEQ ID NO: 1396166 - RNA, 19 nt, Homo sapiens
ccuguuaccugcuggauau

SEQ ID NO: 1396167 - RNA, 19 nt, Homo sapiens
gcaacucacggaugauuga

SEQ ID NO: 1396168 - RNA, 19 nt, Homo sapiens
agacagaagcccggaaaua

SEQ ID NO: 1396169 - RNA, 19 nt, Homo sapiens
gagagcaucuuauuuuguu

SEQ ID NO: 1396170 - RNA, 19 nt, Homo sapiens
caugggugcuggagaagaa

SEQ ID NO: 1396171 - RNA, 19 nt, Homo sapiens
ccccagagcuguuuuauga

SEQ ID NO: 1396172 - RNA, 19 nt, Homo sapiens
gggagucuguguucaccaa

SEQ ID NO: 1396173 - RNA, 19 nt, Homo sapiens
ucacaacccaggccacaaa

SEQ ID NO: 1396174 - RNA, 19 nt, Homo sapiens
caguggcucuguaaugcua

SEQ ID NO: 1396175 - RNA, 19 nt, Homo sapiens
gcugugcaguggcucugua

SEQ ID NO: 1396176 - RNA, 19 nt, Homo sapiens
gagagguucccauuaagga

SEQ ID NO: 1396177 - RNA, 19 nt, Homo sapiens
gcccugccaugcuggauga

SEQ ID NO: 1396178 - RNA, 19 nt, Homo sapiens
cagaugaagggcacuauug

SEQ ID NO: 1396179 - RNA, 19 nt, Homo sapiens
aaaucaggaugaaguugaa

SEQ ID NO: 1396180 - RNA, 19 nt, Homo sapiens
gacagaagcccggaaauac

SEQ ID NO: 1396181 - RNA, 19 nt, Homo sapiens
acucacggaugauugauau

SEQ ID NO: 1396182 - RNA, 19 nt, Homo sapiens
gcacuuuucuauauuguuc

SEQ ID NO: 1396183 - RNA, 19 nt, Homo sapiens
gaggugggaggaucauuug

SEQ ID NO: 1396184 - RNA, 19 nt, Homo sapiens
uaacagugccaaagcaaag

SEQ ID NO: 1396185 - RNA, 19 nt, Homo sapiens
gcuaacaagaagucugaaa

SEQ ID NO: 1396186 - RNA, 19 nt, Homo sapiens
ugaggugggaggaucauuu

SEQ ID NO: 1396187 - RNA, 19 nt, Homo sapiens
ccucugcacuuuucuauau

SEQ ID NO: 1396188 - RNA, 19 nt, Homo sapiens
gcucuguaaugcuaacaag

SEQ ID NO: 1396189 - RNA, 19 nt, Homo sapiens
ccaggcacauuugaugguu

SEQ ID NO: 1396190 - RNA, 19 nt, Homo sapiens
gagucuguguucaccaaug

SEQ ID NO: 1396191 - RNA, 19 nt, Homo sapiens
cgagacagaagcccggaaa

SEQ ID NO: 1396192 - RNA, 19 nt, Homo sapiens
gaacccagggagucugugu

SEQ ID NO: 1396193 - RNA, 19 nt, Homo sapiens
ggccagggcaucccauuca

SEQ ID NO: 1396194 - RNA, 19 nt, Homo sapiens
gugccaaagcaaagaaauu

SEQ ID NO: 1396195 - RNA, 19 nt, Homo sapiens
guaaugcuaacaagaaguc

SEQ ID NO: 1396196 - RNA, 19 nt, Homo sapiens
gugcaguggcucuguaaug

SEQ ID NO: 1396197 - RNA, 19 nt, Homo sapiens
agucuguguucaccaauga

SEQ ID NO: 1396198 - RNA, 19 nt, Homo sapiens
ucuguaaugcuaacaagaa

SEQ ID NO: 1396199 - RNA, 19 nt, Homo sapiens
gccagggcaucccauucaa

SEQ ID NO: 1396200 - RNA, 19 nt, Homo sapiens
ggcaacauaaugaaacuuc

SEQ ID NO: 1396201 - RNA, 19 nt, Homo sapiens
gcauuggagcuucuuuauc

SEQ ID NO: 1396202 - RNA, 19 nt, Homo sapiens
ucugggccuucgaccuuua

SEQ ID NO: 1396203 - RNA, 19 nt, Homo sapiens
cauuugaggccaggaguuu

SEQ ID NO: 1396204 - RNA, 19 nt, Homo sapiens
ucaccacgcgguucuggaa

SEQ ID NO: 1396205 - RNA, 19 nt, Homo sapiens
gagaauaagcccuguuacc

SEQ ID NO: 1396206 - RNA, 19 nt, Homo sapiens
cagaggggcugagugaaaa

SEQ ID NO: 1396207 - RNA, 19 nt, Homo sapiens
cagagcaguuggagcugau

SEQ ID NO: 1396208 - RNA, 19 nt, Homo sapiens
ggcuguggaccgagagaua

SEQ ID NO: 1396209 - RNA, 19 nt, Homo sapiens
gggcugaguggaaguuauc

SEQ ID NO: 1396210 - RNA, 19 nt, Homo sapiens
ucugagagcaucuuauuuu

SEQ ID NO: 1396211 - RNA, 19 nt, Homo sapiens
ucagaugaagggcacuauu

SEQ ID NO: 1396212 - RNA, 19 nt, Homo sapiens
cagcugacaaaguaguauu

SEQ ID NO: 1396213 - RNA, 19 nt, Homo sapiens
guggcauggugguagacua

SEQ ID NO: 1396214 - RNA, 19 nt, Homo sapiens
auucaagccaggcacauuu

SEQ ID NO: 1396215 - RNA, 19 nt, Homo sapiens
cuaacagugccaaagcaaa

SEQ ID NO: 1396216 - RNA, 19 nt, Homo sapiens
gcaguuggagcugaucaca

SEQ ID NO: 1396217 - RNA, 19 nt, Homo sapiens
cugcagcuguacccugaga

SEQ ID NO: 1396218 - RNA, 19 nt, Homo sapiens
guuaccugcuggauauugg

SEQ ID NO: 1396219 - RNA, 19 nt, Homo sapiens
uaggauggcucuauaauua

SEQ ID NO: 1396220 - RNA, 19 nt, Homo sapiens
agaaugagcugaauuugua

SEQ ID NO: 1396221 - RNA, 19 nt, Homo sapiens
ugggaaagcuaacaaauua

SEQ ID NO: 1396222 - RNA, 19 nt, Homo sapiens
cagcugcacuauuuaauua

SEQ ID NO: 1396223 - RNA, 19 nt, Homo sapiens
gaugaaggaugugauguua

SEQ ID NO: 1396224 - RNA, 19 nt, Homo sapiens
gcauacagcuuaccugcua

SEQ ID NO: 1396225 - RNA, 19 nt, Homo sapiens
caauguauguggacaauaa

SEQ ID NO: 1396226 - RNA, 19 nt, Homo sapiens
ucaagacacuagaacauua

SEQ ID NO: 1396227 - RNA, 19 nt, Homo sapiens
ccacaggucucauggagua

SEQ ID NO: 1396228 - RNA, 19 nt, Homo sapiens
gggcaacacuaguuugaua

SEQ ID NO: 1396229 - RNA, 19 nt, Homo sapiens
gcauacaacuacuauacua

SEQ ID NO: 1396230 - RNA, 19 nt, Homo sapiens
gagcugaauuuguagcaua

SEQ ID NO: 1396231 - RNA, 19 nt, Homo sapiens
ggaagaaugagcugaauuu

SEQ ID NO: 1396232 - RNA, 19 nt, Homo sapiens
cgacaaagcuugggcaaug

SEQ ID NO: 1396233 - RNA, 19 nt, Homo sapiens
gaugucagcauucuuauuu

SEQ ID NO: 1396234 - RNA, 19 nt, Homo sapiens
gccaagaaauucaccauga

SEQ ID NO: 1396235 - RNA, 19 nt, Homo sapiens
uuacauagguuacccuuga

SEQ ID NO: 1396236 - RNA, 19 nt, Homo sapiens
caacaauucuaaccaacaa

SEQ ID NO: 1396237 - RNA, 19 nt, Homo sapiens
ggagaacaguguggaguuu

SEQ ID NO: 1396238 - RNA, 19 nt, Homo sapiens
ggucaaggccuucaacaaa

SEQ ID NO: 1396239 - RNA, 19 nt, Homo sapiens
gagauagacuuacauaggu

SEQ ID NO: 1396240 - RNA, 19 nt, Homo sapiens
aaacaugcuugucuccaua

SEQ ID NO: 1396241 - RNA, 19 nt, Homo sapiens
cagcuuaccugcuagaaug

SEQ ID NO: 1396242 - RNA, 19 nt, Homo sapiens
caaagaagccaaggaguuu

SEQ ID NO: 1396243 - RNA, 19 nt, Homo sapiens
gaagagauaggaugggaaa

SEQ ID NO: 1396244 - RNA, 19 nt, Homo sapiens
uaucaacgaugaacaacaa

SEQ ID NO: 1396245 - RNA, 19 nt, Homo sapiens
gaagagugcaccugacuga

SEQ ID NO: 1396246 - RNA, 19 nt, Homo sapiens
gcuaugauaccacgccuua

SEQ ID NO: 1396247 - RNA, 19 nt, Homo sapiens
gcauggacgugaugaagga

SEQ ID NO: 1396248 - RNA, 19 nt, Homo sapiens
guaccuaauuuauggaaug

SEQ ID NO: 1396249 - RNA, 19 nt, Homo sapiens
gaauguucuuacccucuua

SEQ ID NO: 1396250 - RNA, 19 nt, Homo sapiens
ccagaaauguaccaacuca

SEQ ID NO: 1396251 - RNA, 19 nt, Homo sapiens
gcaagaugcccgugugcua

SEQ ID NO: 1396252 - RNA, 19 nt, Homo sapiens
ggucauauguacuagaaag

SEQ ID NO: 1396253 - RNA, 19 nt, Homo sapiens
gaacaacaaggucccauag

SEQ ID NO: 1396254 - RNA, 19 nt, Homo sapiens
gcccugcucucacaauuug

SEQ ID NO: 1396255 - RNA, 19 nt, Homo sapiens
ggccauagcaccagaaaug

SEQ ID NO: 1396256 - RNA, 19 nt, Homo sapiens
gauaggaugggaaagcuaa

SEQ ID NO: 1396257 - RNA, 19 nt, Homo sapiens
gacuguaugucauuacuau

SEQ ID NO: 1396258 - RNA, 19 nt, Homo sapiens
gaaauguaccaacucaaug

SEQ ID NO: 1396259 - RNA, 19 nt, Homo sapiens
gcuuggaggugauuaagga

SEQ ID NO: 1396260 - RNA, 19 nt, Homo sapiens
ccaaagaagccaaggaguu

SEQ ID NO: 1396261 - RNA, 19 nt, Homo sapiens
gcaucuuacuucuauauag

SEQ ID NO: 1396262 - RNA, 19 nt, Homo sapiens
aaugggagaucuugaguug

SEQ ID NO: 1396263 - RNA, 19 nt, Homo sapiens
gaaaugggcaagggucaaa

SEQ ID NO: 1396264 - RNA, 19 nt, Homo sapiens
ccucuuaccucuccuguag

SEQ ID NO: 1396265 - RNA, 19 nt, Homo sapiens
gauagacuuacauagguua

SEQ ID NO: 1396266 - RNA, 19 nt, Homo sapiens
ggaguaguccaaacaaugu

SEQ ID NO: 1396267 - RNA, 19 nt, Homo sapiens
gagguggccugguuugcuu

SEQ ID NO: 1396268 - RNA, 19 nt, Homo sapiens
uggcaacgguggucaauuc

SEQ ID NO: 1396269 - RNA, 19 nt, Homo sapiens
ccaaggaguuucugguaca

SEQ ID NO: 1396270 - RNA, 19 nt, Homo sapiens
caaggaagccaccgucaug

SEQ ID NO: 1396271 - RNA, 19 nt, Homo sapiens
aaauagaagggaagagaua

SEQ ID NO: 1396272 - RNA, 19 nt, Homo sapiens
augcuugucuccauauaua

SEQ ID NO: 1396273 - RNA, 19 nt, Homo sapiens
ucagguuauuggugacuua

SEQ ID NO: 1396274 - RNA, 19 nt, Homo sapiens
caacggcguccgcguguuu

SEQ ID NO: 1396275 - RNA, 19 nt, Homo sapiens
gagcaucaauagccuaagg

SEQ ID NO: 1396276 - RNA, 19 nt, Homo sapiens
ucuagugacuuguaacaug

SEQ ID NO: 1396277 - RNA, 19 nt, Homo sapiens
uaguuccucuuguucuuua

SEQ ID NO: 1396278 - RNA, 19 nt, Homo sapiens
acucauaguuccucuuguu

SEQ ID NO: 1396279 - RNA, 19 nt, Homo sapiens
gcaacacuaguuugauauu

SEQ ID NO: 1396280 - RNA, 19 nt, Homo sapiens
ucacagagcccuucuuggu

SEQ ID NO: 1396281 - RNA, 19 nt, Homo sapiens
gggagaaggaggagagaaa

SEQ ID NO: 1396282 - RNA, 19 nt, Homo sapiens
cgucugagguggccugguu

SEQ ID NO: 1396283 - RNA, 19 nt, Homo sapiens
gcgcuacguuguccuggaa

SEQ ID NO: 1396284 - RNA, 19 nt, Homo sapiens
gaagaaugagcugaauuug

SEQ ID NO: 1396285 - RNA, 19 nt, Homo sapiens
uaagcuuucugucaaacaa

SEQ ID NO: 1396286 - RNA, 19 nt, Homo sapiens
uuacagaugcauacaacua

SEQ ID NO: 1396287 - RNA, 19 nt, Homo sapiens
gcagaauaauaaugcaucu

SEQ ID NO: 1396288 - RNA, 19 nt, Homo sapiens
gcauucacauucucaggau

SEQ ID NO: 1396289 - RNA, 19 nt, Homo sapiens
caaaggacccauucucagu

SEQ ID NO: 1396290 - RNA, 19 nt, Homo sapiens
uuucugaugugccaauaaa

SEQ ID NO: 1396291 - RNA, 19 nt, Homo sapiens
cuaguuaaguguaccuaau

SEQ ID NO: 1396292 - RNA, 19 nt, Homo sapiens
cauauguacuagaaaggaa

SEQ ID NO: 1396293 - RNA, 19 nt, Homo sapiens
ccaggggacuuaaugauuu

SEQ ID NO: 1396294 - RNA, 19 nt, Homo sapiens
ugaaggaugugauguuagg

SEQ ID NO: 1396295 - RNA, 19 nt, Homo sapiens
gcaacaugguccagcagau

SEQ ID NO: 1396296 - RNA, 19 nt, Homo sapiens
gauuucuagugacuuguaa

SEQ ID NO: 1396297 - RNA, 19 nt, Homo sapiens
cauccacucugcugccauu

SEQ ID NO: 1396298 - RNA, 19 nt, Homo sapiens
uaaacaugcuugucuccau

SEQ ID NO: 1396299 - RNA, 19 nt, Homo sapiens
uaugauaccacgccuuaaa

SEQ ID NO: 1396300 - RNA, 19 nt, Homo sapiens
gaacccuggccacuguaua

SEQ ID NO: 1396301 - RNA, 19 nt, Homo sapiens
caucaggguaggaucguua

SEQ ID NO: 1396302 - RNA, 19 nt, Homo sapiens
aaauucuccugcuaacuuu

SEQ ID NO: 1396303 - RNA, 19 nt, Homo sapiens
acaacaaggucccauagca

SEQ ID NO: 1396304 - RNA, 19 nt, Homo sapiens
ggagcugguucaugcacaa

SEQ ID NO: 1396305 - RNA, 19 nt, Homo sapiens
gaaggugguucgagaucag

SEQ ID NO: 1396306 - RNA, 19 nt, Homo sapiens
cauaguuccucuuguucuu

SEQ ID NO: 1396307 - RNA, 19 nt, Homo sapiens
ggugcuauccuguuuaugu

SEQ ID NO: 1396308 - RNA, 19 nt, Homo sapiens
gcugcacuauuuaauuaug

SEQ ID NO: 1396309 - RNA, 19 nt, Homo sapiens
ccaagggcauccacuacug

SEQ ID NO: 1396310 - RNA, 19 nt, Homo sapiens
gacaucauccucuccaaug

SEQ ID NO: 1396311 - RNA, 19 nt, Homo sapiens
gaccacggacuuugacuug

SEQ ID NO: 1396312 - RNA, 19 nt, Homo sapiens
agaacaguguggaguuuga

SEQ ID NO: 1396313 - RNA, 19 nt, Homo sapiens
uugauuuacucuccaauga

SEQ ID NO: 1396314 - RNA, 19 nt, Homo sapiens
uaugacugauagcagaaua

SEQ ID NO: 1396315 - RNA, 19 nt, Homo sapiens
agaaugaaucuaucacuga

SEQ ID NO: 1396316 - RNA, 19 nt, Homo sapiens
ggagauggaagaggaguug

SEQ ID NO: 1396317 - RNA, 19 nt, Homo sapiens
cuagugacuuguaacaugu

SEQ ID NO: 1396318 - RNA, 19 nt, Homo sapiens
gggccgugguagacucaua

SEQ ID NO: 1396319 - RNA, 19 nt, Homo sapiens
uaaauaagcugcaguugaa

SEQ ID NO: 1396320 - RNA, 19 nt, Homo sapiens
gcacuuaugucucucguuu

SEQ ID NO: 1396321 - RNA, 19 nt, Homo sapiens
gaaauaaaguucacacaca

SEQ ID NO: 1396322 - RNA, 19 nt, Homo sapiens
caaagaaacuguacuguag

SEQ ID NO: 1396323 - RNA, 19 nt, Homo sapiens
ccacaggucucauggagua

SEQ ID NO: 1396324 - RNA, 19 nt, Homo sapiens
gcuaauauguguuaucaga

SEQ ID NO: 1396325 - RNA, 19 nt, Homo sapiens
caaguucucuuccaacaaa

SEQ ID NO: 1396326 - RNA, 19 nt, Homo sapiens
gaaauuaaaccuacaagga

SEQ ID NO: 1396327 - RNA, 19 nt, Homo sapiens
ccacauuccugaaguguuu

SEQ ID NO: 1396328 - RNA, 19 nt, Homo sapiens
gcaagacacaugaaauuaa

SEQ ID NO: 1396329 - RNA, 19 nt, Homo sapiens
gaaacaaacggaacaaguu

SEQ ID NO: 1396330 - RNA, 19 nt, Homo sapiens
ggaguacagugauguggua

SEQ ID NO: 1396331 - RNA, 19 nt, Homo sapiens
ggagaacaguguggaguuu

SEQ ID NO: 1396332 - RNA, 19 nt, Homo sapiens
ugaauuugauggccagaua

SEQ ID NO: 1396333 - RNA, 19 nt, Homo sapiens
ggucaaggccuucaacaaa

SEQ ID NO: 1396334 - RNA, 19 nt, Homo sapiens
gagcagagagaaauuugua

SEQ ID NO: 1396335 - RNA, 19 nt, Homo sapiens
gcaccaggauugagacuuc

SEQ ID NO: 1396336 - RNA, 19 nt, Homo sapiens
caaagaagccaaggaguuu

SEQ ID NO: 1396337 - RNA, 19 nt, Homo sapiens
ggauguagcgccucaguuu

SEQ ID NO: 1396338 - RNA, 19 nt, Homo sapiens
gggaugaccuaucaguuug

SEQ ID NO: 1396339 - RNA, 19 nt, Homo sapiens
gaccagcaacuucgcauua

SEQ ID NO: 1396340 - RNA, 19 nt, Homo sapiens
cccagaugauucuaaauua

SEQ ID NO: 1396341 - RNA, 19 nt, Homo sapiens
gaagagugcaccugacuga

SEQ ID NO: 1396342 - RNA, 19 nt, Homo sapiens
cauaauacaucaugggaau

SEQ ID NO: 1396343 - RNA, 19 nt, Homo sapiens
ucaccgggauucuccauaa

SEQ ID NO: 1396344 - RNA, 19 nt, Homo sapiens
caaguaaugugucucagau

SEQ ID NO: 1396345 - RNA, 19 nt, Homo sapiens
gagagaaauuuguagcaau

SEQ ID NO: 1396346 - RNA, 19 nt, Homo sapiens
ggauuuguaugacugaaug

SEQ ID NO: 1396347 - RNA, 19 nt, Homo sapiens
cauacaagguucaucucua

SEQ ID NO: 1396348 - RNA, 19 nt, Homo sapiens
gcaagaugcccgugugcua

SEQ ID NO: 1396349 - RNA, 19 nt, Homo sapiens
cacaugaccuguucccauu

SEQ ID NO: 1396350 - RNA, 19 nt, Homo sapiens
gcccugcucucacaauuug

SEQ ID NO: 1396351 - RNA, 19 nt, Homo sapiens
gaugagaggcuugaauuug

SEQ ID NO: 1396352 - RNA, 19 nt, Homo sapiens
gaaacuguacuguagaaau

SEQ ID NO: 1396353 - RNA, 19 nt, Homo sapiens
acaaagaaacuguacugua

SEQ ID NO: 1396354 - RNA, 19 nt, Homo sapiens
gaaauuuguagcaauguug

SEQ ID NO: 1396355 - RNA, 19 nt, Homo sapiens
gccagucccuucagucuug

SEQ ID NO: 1396356 - RNA, 19 nt, Homo sapiens
gcuuggaggugauuaagga

SEQ ID NO: 1396357 - RNA, 19 nt, Homo sapiens
ccaaagaagccaaggaguu

SEQ ID NO: 1396358 - RNA, 19 nt, Homo sapiens
cugcagaacuaauuauguu

SEQ ID NO: 1396359 - RNA, 19 nt, Homo sapiens
agagaaauuuguagcaaug

SEQ ID NO: 1396360 - RNA, 19 nt, Homo sapiens
ucucagggaugaccuauca

SEQ ID NO: 1396361 - RNA, 19 nt, Homo sapiens
gcagaacuaauuauguuga

SEQ ID NO: 1396362 - RNA, 19 nt, Homo sapiens
ggucaucaaagacaaguaa

SEQ ID NO: 1396363 - RNA, 19 nt, Homo sapiens
caacaaagaaacuguacug

SEQ ID NO: 1396364 - RNA, 19 nt, Homo sapiens
uguacaaggugguuugauu

SEQ ID NO: 1396365 - RNA, 19 nt, Homo sapiens
ggugggaccuagguucuuu

SEQ ID NO: 1396366 - RNA, 19 nt, Homo sapiens
gaacugcguggcaucuaaa

SEQ ID NO: 1396367 - RNA, 19 nt, Homo sapiens
gauguagcgccucaguuua

SEQ ID NO: 1396368 - RNA, 19 nt, Homo sapiens
gcagagcagagagaaauuu

SEQ ID NO: 1396369 - RNA, 19 nt, Homo sapiens
guacaaggugguuugauug

SEQ ID NO: 1396370 - RNA, 19 nt, Homo sapiens
gcccagaugauucuaaauu

SEQ ID NO: 1396371 - RNA, 19 nt, Homo sapiens
cuaaauaagcugcaguuga

SEQ ID NO: 1396372 - RNA, 19 nt, Homo sapiens
uggcaacgguggucaauuc

SEQ ID NO: 1396373 - RNA, 19 nt, Homo sapiens
ccaaggaguuucugguaca

SEQ ID NO: 1396374 - RNA, 19 nt, Homo sapiens
caaggaagccaccgucaug

SEQ ID NO: 1396375 - RNA, 19 nt, Homo sapiens
caauguugcuaauaugugu

SEQ ID NO: 1396376 - RNA, 19 nt, Homo sapiens
aaagaacuauggugguguu

SEQ ID NO: 1396377 - RNA, 19 nt, Homo sapiens
gcuccuggcuuacccacuu

SEQ ID NO: 1396378 - RNA, 19 nt, Homo sapiens
guauguggaugugaucaaa

SEQ ID NO: 1396379 - RNA, 19 nt, Homo sapiens
caaggugguuugauugaag

SEQ ID NO: 1396380 - RNA, 19 nt, Homo sapiens
caacggcguccgcguguuu

SEQ ID NO: 1396381 - RNA, 19 nt, Homo sapiens
gaugugaucaaaccaaaga

SEQ ID NO: 1396382 - RNA, 19 nt, Homo sapiens
agaaaagccuaucaucaua

SEQ ID NO: 1396383 - RNA, 19 nt, Homo sapiens
cauaacagccugagcacuu

SEQ ID NO: 1396384 - RNA, 19 nt, Homo sapiens
gcgcuacguuguccuggaa

SEQ ID NO: 1396385 - RNA, 19 nt, Homo sapiens
aagaaacuguacuguagaa

SEQ ID NO: 1396386 - RNA, 19 nt, Homo sapiens
gggagcaguugucagucua

SEQ ID NO: 1396387 - RNA, 19 nt, Homo sapiens
augagaggcuugaauuuga

SEQ ID NO: 1396388 - RNA, 19 nt, Homo sapiens
cagaugagaggcuugaauu

SEQ ID NO: 1396389 - RNA, 19 nt, Homo sapiens
aguaaugugucucagauga

SEQ ID NO: 1396390 - RNA, 19 nt, Homo sapiens
agaacugcguggcaucuaa

SEQ ID NO: 1396391 - RNA, 19 nt, Homo sapiens
auaacagccugagcacuua

SEQ ID NO: 1396392 - RNA, 19 nt, Homo sapiens
gugaugcuauuccaagaga

SEQ ID NO: 1396393 - RNA, 19 nt, Homo sapiens
gcaguugucagucuaagug

SEQ ID NO: 1396394 - RNA, 19 nt, Homo sapiens
aagcaagacacaugaaauu

SEQ ID NO: 1396395 - RNA, 19 nt, Homo sapiens
guaagcaagacacaugaaa

SEQ ID NO: 1396396 - RNA, 19 nt, Homo sapiens
ucaaagacaaguaaugugu

SEQ ID NO: 1396397 - RNA, 19 nt, Homo sapiens
ugcuagagcuguuuagaga

SEQ ID NO: 1396398 - RNA, 19 nt, Homo sapiens
ccagaugauucuaaauuac

SEQ ID NO: 1396399 - RNA, 19 nt, Homo sapiens
uuagagagccuaugguaug

SEQ ID NO: 1396400 - RNA, 19 nt, Homo sapiens
gcaacaugguccagcagau

SEQ ID NO: 1396401 - RNA, 19 nt, Homo sapiens
guuggcugcuccuggcuua

SEQ ID NO: 1396402 - RNA, 19 nt, Homo sapiens
gaaggugguucgagaucag

SEQ ID NO: 1396403 - RNA, 19 nt, Homo sapiens
gauuggaacugcgauccuu

SEQ ID NO: 1396404 - RNA, 19 nt, Homo sapiens
gcaguugccucuuuucuca

SEQ ID NO: 1396405 - RNA, 19 nt, Homo sapiens
auacaagguucaucucuag

SEQ ID NO: 1396406 - RNA, 19 nt, Homo sapiens
gaccacggacuuugacuug

SEQ ID NO: 1396407 - RNA, 19 nt, Homo sapiens
agaacaguguggaguuuga

SEQ ID NO: 1396408 - RNA, 19 nt, Homo sapiens
agagagaaauuuguagcaa

SEQ ID NO: 1396409 - RNA, 19 nt, Homo sapiens
caugaccuguucccauuug

SEQ ID NO: 1396410 - RNA, 19 nt, Homo sapiens
caucaaagacaaguaaugu

SEQ ID NO: 1396411 - RNA, 19 nt, Homo sapiens
ggagauggaagaggaguug

SEQ ID NO: 1396412 - RNA, 19 nt, Homo sapiens
ggaacugcgauccuuggua

SEQ ID NO: 1396413 - RNA, 19 nt, Homo sapiens
caucaugggaaucauacua

SEQ ID NO: 1396414 - RNA, 19 nt, Homo sapiens
gauggaagaggaguugaaa

SEQ ID NO: 1396415 - RNA, 19 nt, Homo sapiens
gcuaaagcccuccaagagu

SEQ ID NO: 1396416 - RNA, 19 nt, Homo sapiens
ucaugggaaucauacuauu

SEQ ID NO: 1396417 - RNA, 19 nt, Homo sapiens
uggaagaggaguugaaaug

SEQ ID NO: 1396418 - RNA, 19 nt, Homo sapiens
uggacaagaugagccuaua

SEQ ID NO: 1396419 - RNA, 19 nt, Homo sapiens
caaauuagcuggucucuga

SEQ ID NO: 1396420 - RNA, 19 nt, Homo sapiens
gagcagauauugucaaguu

SEQ ID NO: 1396421 - RNA, 19 nt, Homo sapiens
ggcaaaggcuuacugauaa

SEQ ID NO: 1396422 - RNA, 19 nt, Homo sapiens
gggcaaaggcuuacugaua

SEQ ID NO: 1396423 - RNA, 19 nt, Homo sapiens
ggucuuaacucugauugua

SEQ ID NO: 1396424 - RNA, 19 nt, Homo sapiens
gcaaaggcuuacugauaaa

SEQ ID NO: 1396425 - RNA, 19 nt, Homo sapiens
ggccuuugguguugaaaua

SEQ ID NO: 1396426 - RNA, 19 nt, Homo sapiens
uaucuggucuuaacucuga

SEQ ID NO: 1396427 - RNA, 19 nt, Homo sapiens
ccauuggguuuaaaucaua

SEQ ID NO: 1396428 - RNA, 19 nt, Homo sapiens
gcaacacucuucaguacau

SEQ ID NO: 1396429 - RNA, 19 nt, Homo sapiens
uagcauguaucuggucuua

SEQ ID NO: 1396430 - RNA, 19 nt, Homo sapiens
gcauguaucuggucuuaac

SEQ ID NO: 1396431 - RNA, 19 nt, Homo sapiens
gaggcuagguuguuucugu

SEQ ID NO: 1396432 - RNA, 19 nt, Homo sapiens
uaaggagaaucuaagcauu

SEQ ID NO: 1396433 - RNA, 19 nt, Homo sapiens
guggaauucuguuuguuaa

SEQ ID NO: 1396434 - RNA, 19 nt, Homo sapiens
gaaauaggaagguuuaagg

SEQ ID NO: 1396435 - RNA, 19 nt, Homo sapiens
ggccuuagguagcauguau

SEQ ID NO: 1396436 - RNA, 19 nt, Homo sapiens
cagcaacacucuucaguac

SEQ ID NO: 1396437 - RNA, 19 nt, Homo sapiens
uagcuggucucugaauuaa

SEQ ID NO: 1396438 - RNA, 19 nt, Homo sapiens
gacuugaucugcuguuuca

SEQ ID NO: 1396439 - RNA, 19 nt, Homo sapiens
uaacucugauuguagcaaa

SEQ ID NO: 1396440 - RNA, 19 nt, Homo sapiens
guucuuagccaguuucuug

SEQ ID NO: 1396441 - RNA, 19 nt, Homo sapiens
guugaaauaggaagguuua

SEQ ID NO: 1396442 - RNA, 19 nt, Homo sapiens
caacacucuucaguacaua

SEQ ID NO: 1396443 - RNA, 19 nt, Homo sapiens
gcccuguuguggcccauua

SEQ ID NO: 1396444 - RNA, 19 nt, Homo sapiens
gggcuuaccauuggguuua

SEQ ID NO: 1396445 - RNA, 19 nt, Homo sapiens
ggucaaacccuuaagacau

SEQ ID NO: 1396446 - RNA, 19 nt, Homo sapiens
gcucuuacuucuccagcaa

SEQ ID NO: 1396447 - RNA, 19 nt, Homo sapiens
gucaaacccuuaagacauc

SEQ ID NO: 1396448 - RNA, 19 nt, Homo sapiens
aaaggucccucauccuguu

SEQ ID NO: 1396449 - RNA, 19 nt, Homo sapiens
gggcagagggugcuuacaa

SEQ ID NO: 1396450 - RNA, 19 nt, Homo sapiens
aagcuuaacugauaaacag

SEQ ID NO: 1396451 - RNA, 19 nt, Homo sapiens
gcuggucucugaauuaagg

SEQ ID NO: 1396452 - RNA, 19 nt, Homo sapiens
ugguugagcucagggaaua

SEQ ID NO: 1396453 - RNA, 19 nt, Homo sapiens
uaggaagguuuaaggagaa

SEQ ID NO: 1396454 - RNA, 19 nt, Homo sapiens
caaccuggccuuugguguu

SEQ ID NO: 1396455 - RNA, 19 nt, Homo sapiens
caaauuccaauguguacuu

SEQ ID NO: 1396456 - RNA, 19 nt, Homo sapiens
gcagauauugucaaguuca

SEQ ID NO: 1396457 - RNA, 19 nt, Homo sapiens
ucagaggcauggccggauu

SEQ ID NO: 1396458 - RNA, 19 nt, Homo sapiens
guauauugcuguaucuacu

SEQ ID NO: 1396459 - RNA, 19 nt, Homo sapiens
cagggaauaugguucuuag

SEQ ID NO: 1396460 - RNA, 19 nt, Homo sapiens
guaauguauuggccuuuua

SEQ ID NO: 1396461 - RNA, 19 nt, Homo sapiens
gacuugggcuuaccauugg

SEQ ID NO: 1396462 - RNA, 19 nt, Homo sapiens
agacuugggcuuaccauug

SEQ ID NO: 1396463 - RNA, 19 nt, Homo sapiens
ccagcaacacucuucagua

SEQ ID NO: 1396464 - RNA, 19 nt, Homo sapiens
uguggaauucuguuuguua

SEQ ID NO: 1396465 - RNA, 19 nt, Homo sapiens
uuagcuggucucugaauua

SEQ ID NO: 1396466 - RNA, 19 nt, Homo sapiens
ggccggauuuggcaacuca

SEQ ID NO: 1396467 - RNA, 19 nt, Homo sapiens
gcugcaaccuggccuuugg

SEQ ID NO: 1396468 - RNA, 19 nt, Homo sapiens
aaggagaaucuaagcauuu

SEQ ID NO: 1396469 - RNA, 19 nt, Homo sapiens
augcagagcucuuacuucu

SEQ ID NO: 1396470 - RNA, 19 nt, Homo sapiens
ggacaugaugcacacuaug

SEQ ID NO: 1396471 - RNA, 19 nt, Homo sapiens
cucaggaccucauggaaga

SEQ ID NO: 1396472 - RNA, 19 nt, Homo sapiens
gcugggauacuucugauuc

SEQ ID NO: 1396473 - RNA, 19 nt, Homo sapiens
ggacuugaucugcuguuuc

SEQ ID NO: 1396474 - RNA, 19 nt, Homo sapiens
agagggugcuuacaaccuu

SEQ ID NO: 1396475 - RNA, 19 nt, Homo sapiens
ccuggccacugcauucaaa

SEQ ID NO: 1396476 - RNA, 19 nt, Homo sapiens
gcuagaggcaugucuccuu

SEQ ID NO: 1396477 - RNA, 19 nt, Homo sapiens
ggaaucccguggguugcuu

SEQ ID NO: 1396478 - RNA, 19 nt, Homo sapiens
gccaguuucuuggugauau

SEQ ID NO: 1396479 - RNA, 19 nt, Homo sapiens
caauguguacuucauagug

SEQ ID NO: 1396480 - RNA, 19 nt, Homo sapiens
gagcucagggaauaugguu

SEQ ID NO: 1396481 - RNA, 19 nt, Homo sapiens
gaguuucuguggaauucug

SEQ ID NO: 1396482 - RNA, 19 nt, Homo sapiens
cgccuuggcuggcuagcuu

SEQ ID NO: 1396483 - RNA, 19 nt, Homo sapiens
gggcugggauacuucugau

SEQ ID NO: 1396484 - RNA, 19 nt, Homo sapiens
gaggagcugagcccuguug

SEQ ID NO: 1396485 - RNA, 19 nt, Homo sapiens
gaagguuuaaggagaaucu

SEQ ID NO: 1396486 - RNA, 19 nt, Homo sapiens
ccucagcugaucagaguuu

SEQ ID NO: 1396487 - RNA, 19 nt, Homo sapiens
ugagucugcccucguauga

SEQ ID NO: 1396488 - RNA, 19 nt, Homo sapiens
cuacuuuaacuuccagaaa

SEQ ID NO: 1396489 - RNA, 19 nt, Homo sapiens
aauguguacuucauagugu

SEQ ID NO: 1396490 - RNA, 19 nt, Homo sapiens
guugcuuaccuaccuauaa

SEQ ID NO: 1396491 - RNA, 19 nt, Homo sapiens
ucagggaauaugguucuua

SEQ ID NO: 1396492 - RNA, 19 nt, Homo sapiens
ggcagagggugcuuacaac

SEQ ID NO: 1396493 - RNA, 19 nt, Homo sapiens
gaaucccguggguugcuua

SEQ ID NO: 1396494 - RNA, 19 nt, Homo sapiens
aaggugagacuugggcuua

SEQ ID NO: 1396495 - RNA, 19 nt, Homo sapiens
gacaugaugcacacuaugg

SEQ ID NO: 1396496 - RNA, 19 nt, Homo sapiens
ucccucauccuguuuguuu

SEQ ID NO: 1396497 - RNA, 19 nt, Homo sapiens
ccacugcauucaaauucca

SEQ ID NO: 1396498 - RNA, 19 nt, Homo sapiens
ugccucagcugaucagagu

SEQ ID NO: 1396499 - RNA, 19 nt, Homo sapiens
ggccacugcauucaaauuc

SEQ ID NO: 1396500 - RNA, 19 nt, Homo sapiens
ggcuuaccauuggguuuaa

SEQ ID NO: 1396501 - RNA, 19 nt, Homo sapiens
guuguggcccauuaaagaa

SEQ ID NO: 1396502 - RNA, 19 nt, Homo sapiens
gugcguaugggaacaccua

SEQ ID NO: 1396503 - RNA, 19 nt, Homo sapiens
acuugagucugcccucgua

SEQ ID NO: 1396504 - RNA, 19 nt, Homo sapiens
uuauauaggaaccgucaaa

SEQ ID NO: 1396505 - RNA, 19 nt, Homo sapiens
cagauauugucaaguucau

SEQ ID NO: 1396506 - RNA, 19 nt, Homo sapiens
gcuuaacugauaaacagaa

SEQ ID NO: 1396507 - RNA, 19 nt, Homo sapiens
ucuguggaauucuguuugu

SEQ ID NO: 1396508 - RNA, 19 nt, Homo sapiens
auaccuggccucccucuga

SEQ ID NO: 1396509 - RNA, 19 nt, Homo sapiens
uguuguggcccauuaaaga

SEQ ID NO: 1396510 - RNA, 19 nt, Homo sapiens
aaccuggccuuugguguug

SEQ ID NO: 1396511 - RNA, 19 nt, Homo sapiens
aaauaggaagguuuaagga

SEQ ID NO: 1396512 - RNA, 19 nt, Homo sapiens
uggacaugaugcacacuau

SEQ ID NO: 1396513 - RNA, 19 nt, Homo sapiens
guuacagguuggacaugau

SEQ ID NO: 1396514 - RNA, 19 nt, Homo sapiens
uggagcagauauugucaag

SEQ ID NO: 1396515 - RNA, 19 nt, Homo sapiens
caugcagggcaaaggcuua

SEQ ID NO: 1396516 - RNA, 19 nt, Homo sapiens
gcucagggaauaugguucu

SEQ ID NO: 1396517 - RNA, 19 nt, Homo sapiens
ucaggucaaacccuuaaga

SEQ ID NO: 1396518 - RNA, 19 nt, Homo sapiens
uccaauguguacuucauag

SEQ ID NO: 1396519 - RNA, 19 nt, Homo sapiens
gaagagagcucagaagugu

SEQ ID NO: 1396520 - RNA, 19 nt, Homo sapiens
ggaccgcacuaaagaauuu

SEQ ID NO: 1396521 - RNA, 19 nt, Homo sapiens
ccaagucacuggccaagua

SEQ ID NO: 1396522 - RNA, 19 nt, Homo sapiens
gaacuuaagcccaagaaga

SEQ ID NO: 1396523 - RNA, 19 nt, Homo sapiens
gauguuggaugccaguuaa

SEQ ID NO: 1396524 - RNA, 19 nt, Homo sapiens
ccuuauaucuguacaguuu

SEQ ID NO: 1396525 - RNA, 19 nt, Homo sapiens
uuccagagcucaugcuuua

SEQ ID NO: 1396526 - RNA, 19 nt, Homo sapiens
uagcgaaugugucuaauau

SEQ ID NO: 1396527 - RNA, 19 nt, Homo sapiens
gcucagaaguguuuguguu

SEQ ID NO: 1396528 - RNA, 19 nt, Homo sapiens
cagaagacaugcuuuauac

SEQ ID NO: 1396529 - RNA, 19 nt, Homo sapiens
gcagucaaggcauagauua

SEQ ID NO: 1396530 - RNA, 19 nt, Homo sapiens
guaccugucucugcucuuu

SEQ ID NO: 1396531 - RNA, 19 nt, Homo sapiens
cccaugaacugagguguua

SEQ ID NO: 1396532 - RNA, 19 nt, Homo sapiens
gucaaggcauagauuauuu

SEQ ID NO: 1396533 - RNA, 19 nt, Homo sapiens
ggucaggucuguaacucuu

SEQ ID NO: 1396534 - RNA, 19 nt, Homo sapiens
gaagacaugcuuuauacau

SEQ ID NO: 1396535 - RNA, 19 nt, Homo sapiens
ccagugcagucaaggcaua

SEQ ID NO: 1396536 - RNA, 19 nt, Homo sapiens
agacagaagacaugcuuua

SEQ ID NO: 1396537 - RNA, 19 nt, Homo sapiens
uuacaugucuucucuccuu

SEQ ID NO: 1396538 - RNA, 19 nt, Homo sapiens
ugacaaacuuacucagguu

SEQ ID NO: 1396539 - RNA, 19 nt, Homo sapiens
cuacaugaccuauuggaaa

SEQ ID NO: 1396540 - RNA, 19 nt, Homo sapiens
cgugguagauugaaacuuc

SEQ ID NO: 1396541 - RNA, 19 nt, Homo sapiens
gcaccaaagucccaugaac

SEQ ID NO: 1396542 - RNA, 19 nt, Homo sapiens
acagaagacaugcuuuaua

SEQ ID NO: 1396543 - RNA, 19 nt, Homo sapiens
guguuuguguuacucuuua

SEQ ID NO: 1396544 - RNA, 19 nt, Homo sapiens
gcacugaggguaaccagau

SEQ ID NO: 1396545 - RNA, 19 nt, Homo sapiens
ggacuuuaucgaucucuuu

SEQ ID NO: 1396546 - RNA, 19 nt, Homo sapiens
ggaaggugcaguagcagaa

SEQ ID NO: 1396547 - RNA, 19 nt, Homo sapiens
gccacugccucuuaccuaa

SEQ ID NO: 1396548 - RNA, 19 nt, Homo sapiens
cauccuagcuucgguuugu

SEQ ID NO: 1396549 - RNA, 19 nt, Homo sapiens
gugggaggcugaucacuca

SEQ ID NO: 1396550 - RNA, 19 nt, Homo sapiens
agaagucucugggaccuuu

SEQ ID NO: 1396551 - RNA, 19 nt, Homo sapiens
ggccugggcugagugguuu

SEQ ID NO: 1396552 - RNA, 19 nt, Homo sapiens
ugucuucucuccuuuaaca

SEQ ID NO: 1396553 - RNA, 19 nt, Homo sapiens
caugucuucucuccuuuaa

SEQ ID NO: 1396554 - RNA, 19 nt, Homo sapiens
gcauucagacacauaauuc

SEQ ID NO: 1396555 - RNA, 19 nt, Homo sapiens
uacaugaccuauuggaaau

SEQ ID NO: 1396556 - RNA, 19 nt, Homo sapiens
uggcagaucucaccagucu

SEQ ID NO: 1396557 - RNA, 19 nt, Homo sapiens
cuacuuugcuccugaacau

SEQ ID NO: 1396558 - RNA, 19 nt, Homo sapiens
guagcgaaugugucuaaua

SEQ ID NO: 1396559 - RNA, 19 nt, Homo sapiens
ggaugccaguuaauaaagu

SEQ ID NO: 1396560 - RNA, 19 nt, Homo sapiens
ggagacagaagacaugcuu

SEQ ID NO: 1396561 - RNA, 19 nt, Homo sapiens
ggacaucgaggagacagaa

SEQ ID NO: 1396562 - RNA, 19 nt, Homo sapiens
cagucuacaugaccuauug

SEQ ID NO: 1396563 - RNA, 19 nt, Homo sapiens
gaucucaccagucuacaug

SEQ ID NO: 1396564 - RNA, 19 nt, Homo sapiens
aggcauagauuauuuccau

SEQ ID NO: 1396565 - RNA, 19 nt, Homo sapiens
gacuuuaucgaucucuuua

SEQ ID NO: 1396566 - RNA, 19 nt, Homo sapiens
cacgagggcuguuugaaag

SEQ ID NO: 1396567 - RNA, 19 nt, Homo sapiens
acaggaaggugcaguagca

SEQ ID NO: 1396568 - RNA, 19 nt, Homo sapiens
agagagcucagaaguguuu

SEQ ID NO: 1396569 - RNA, 19 nt, Homo sapiens
cgagaugcacugaggguaa

SEQ ID NO: 1396570 - RNA, 19 nt, Homo sapiens
gcagaucucaccagucuac

SEQ ID NO: 1396571 - RNA, 19 nt, Homo sapiens
ggugggaccgcacuaaaga

SEQ ID NO: 1396572 - RNA, 19 nt, Homo sapiens
ggcgggugcggucuuauua

SEQ ID NO: 1396573 - RNA, 19 nt, Homo sapiens
ccaagaagagagcucagaa

SEQ ID NO: 1396574 - RNA, 19 nt, Homo sapiens
guuggaugccaguuaauaa

SEQ ID NO: 1396575 - RNA, 19 nt, Homo sapiens
guagcagaauggcgagaug

SEQ ID NO: 1396576 - RNA, 19 nt, Homo sapiens
ugacucauguuuggugaug

SEQ ID NO: 1396577 - RNA, 19 nt, Homo sapiens
gcggucagguccaucauac

SEQ ID NO: 1396578 - RNA, 19 nt, Homo sapiens
gcggucagguccaucauac

SEQ ID NO: 1396579 - RNA, 19 nt, Homo sapiens
gcggucagguccaucauac

SEQ ID NO: 1396580 - RNA, 19 nt, Homo sapiens
gcggucagguccaucauac

SEQ ID NO: 1396581 - RNA, 19 nt, Homo sapiens
gcggucagguccaucauac

SEQ ID NO: 1396582 - RNA, 19 nt, Homo sapiens
gcggucagguccaucauac

SEQ ID NO: 1396583 - RNA, 19 nt, Homo sapiens
cuccuuuggugccagauua

SEQ ID NO: 1396584 - RNA, 19 nt, Homo sapiens
ggugccagauuauaaaggu

SEQ ID NO: 1396585 - RNA, 19 nt, Homo sapiens
gcugagugguuuacauguc

SEQ ID NO: 1396586 - RNA, 19 nt, Homo sapiens
ggacuuacccaguguuagc

SEQ ID NO: 1396587 - RNA, 19 nt, Homo sapiens
uagccugggugacaaagug

SEQ ID NO: 1396588 - RNA, 19 nt, Homo sapiens
caaacuuacucagguugug

SEQ ID NO: 1396589 - RNA, 19 nt, Homo sapiens
ucaggucuguaacucuuga

SEQ ID NO: 1396590 - RNA, 19 nt, Homo sapiens
gucuuauuaucccaucuua

SEQ ID NO: 1396591 - RNA, 19 nt, Homo sapiens
gacagaagacaugcuuuau

SEQ ID NO: 1396592 - RNA, 19 nt, Homo sapiens
gcacuuucucucacugcua

SEQ ID NO: 1396593 - RNA, 19 nt, Homo sapiens
uagcuucgguuuguugugu

SEQ ID NO: 1396594 - RNA, 19 nt, Homo sapiens
ggcauucagacacauaauu

SEQ ID NO: 1396595 - RNA, 19 nt, Homo sapiens
gggcugagugguuuacaug

SEQ ID NO: 1396596 - RNA, 19 nt, Homo sapiens
uccugaacaucucugauuu

SEQ ID NO: 1396597 - RNA, 19 nt, Homo sapiens
gaugccaguuaauaaaguc

SEQ ID NO: 1396598 - RNA, 19 nt, Homo sapiens
cauguuuggugauguugga

SEQ ID NO: 1396599 - RNA, 19 nt, Homo sapiens
cgagggcuguuugaaagga

SEQ ID NO: 1396600 - RNA, 19 nt, Homo sapiens
aaaggccuguguccucaga

SEQ ID NO: 1396601 - RNA, 19 nt, Homo sapiens
gagaugcacugaggguaac

SEQ ID NO: 1396602 - RNA, 19 nt, Homo sapiens
cucagaaguguuuguguua

SEQ ID NO: 1396603 - RNA, 19 nt, Homo sapiens
caugaacugagguguuaaa

SEQ ID NO: 1396604 - RNA, 19 nt, Homo sapiens
gugccagauuauaaaggua

SEQ ID NO: 1396605 - RNA, 19 nt, Homo sapiens
gcagugagccaugguugca

SEQ ID NO: 1396606 - RNA, 19 nt, Homo sapiens
gaggugggaggaucacuuc

SEQ ID NO: 1396607 - RNA, 19 nt, Homo sapiens
acucauguuuggugauguu

SEQ ID NO: 1396608 - RNA, 19 nt, Homo sapiens
gcaguugcuuaugcuguca

SEQ ID NO: 1396609 - RNA, 19 nt, Homo sapiens
guagacggaagcuccuuug

SEQ ID NO: 1396610 - RNA, 19 nt, Homo sapiens
cagaaguguuuguguuacu

SEQ ID NO: 1396611 - RNA, 19 nt, Homo sapiens
ccaaagucccaugaacuga

SEQ ID NO: 1396612 - RNA, 19 nt, Homo sapiens
cgggugcggucuuauuauc

SEQ ID NO: 1396613 - RNA, 19 nt, Homo sapiens
ccacugccucuuaccuaaa

SEQ ID NO: 1396614 - RNA, 19 nt, Homo sapiens
cgaggagacagaagacaug

SEQ ID NO: 1396615 - RNA, 19 nt, Homo sapiens
agaaauuuguggaggacau

SEQ ID NO: 1396616 - RNA, 19 nt, Homo sapiens
gagcguccugugucucuga

SEQ ID NO: 1396617 - RNA, 19 nt, Homo sapiens
ugauguuggaugccaguua

SEQ ID NO: 1396618 - RNA, 19 nt, Homo sapiens
aagaagagagcucagaagu

SEQ ID NO: 1396619 - RNA, 19 nt, Homo sapiens
gcaagaggagcuuccacua

SEQ ID NO: 1396620 - RNA, 19 nt, Homo sapiens
ggaggagggcaaagagaaa

SEQ ID NO: 1396621 - RNA, 19 nt, Homo sapiens
gaggcacccguuacagaua

SEQ ID NO: 1396622 - RNA, 19 nt, Homo sapiens
ggaggcacccguuacagau

SEQ ID NO: 1396623 - RNA, 19 nt, Homo sapiens
aaauugggaggaagaagua

SEQ ID NO: 1396624 - RNA, 19 nt, Homo sapiens
caaauugggaggaagaagu

SEQ ID NO: 1396625 - RNA, 19 nt, Homo sapiens
caucaugaaccuccucuuc

SEQ ID NO: 1396626 - RNA, 19 nt, Homo sapiens
gaaccuccucuucaacauc

SEQ ID NO: 1396627 - RNA, 19 nt, Homo sapiens
gcgcaaauugggaggaaga

SEQ ID NO: 1396628 - RNA, 19 nt, Homo sapiens
caagaggagcuuccacuac

SEQ ID NO: 1396629 - RNA, 19 nt, Homo sapiens
ccaccaacaucaugaaccu

SEQ ID NO: 1396630 - RNA, 19 nt, Homo sapiens
caccugauggcgcaaauug

SEQ ID NO: 1396631 - RNA, 19 nt, Homo sapiens
gaggaggagggcaaagaga

SEQ ID NO: 1396632 - RNA, 19 nt, Homo sapiens
gcugaugccgguccacuuc

SEQ ID NO: 1396633 - RNA, 19 nt, Homo sapiens
ggaggaggagggcaaagag

SEQ ID NO: 1396634 - RNA, 19 nt, Homo sapiens
caaagccaagcccaucuuc

SEQ ID NO: 1396635 - RNA, 19 nt, Homo sapiens
cggaggcacccguuacaga

SEQ ID NO: 1396636 - RNA, 19 nt, Homo sapiens
ucaacaccgcccugucuga

SEQ ID NO: 1396637 - RNA, 19 nt, Homo sapiens
uaacagcccugacuaagaa

SEQ ID NO: 1396638 - RNA, 19 nt, Homo sapiens
gagacucuguuucuaaaua

SEQ ID NO: 1396639 - RNA, 19 nt, Homo sapiens
gaacaaggaucccaguuac

SEQ ID NO: 1396640 - RNA, 19 nt, Homo sapiens
gaagugagccucccauuuc

SEQ ID NO: 1396641 - RNA, 19 nt, Homo sapiens
gaacuggacucagauuuca

SEQ ID NO: 1396642 - RNA, 19 nt, Homo sapiens
gcaaugcguucuuucuaaa

SEQ ID NO: 1396643 - RNA, 19 nt, Homo sapiens
ccaaagaccuuauuaucag

SEQ ID NO: 1396644 - RNA, 19 nt, Homo sapiens
augaagagcuugaguuuga

SEQ ID NO: 1396645 - RNA, 19 nt, Homo sapiens
ccaagugguucccauuuga

SEQ ID NO: 1396646 - RNA, 19 nt, Homo sapiens
ccagagaaccugagaguga

SEQ ID NO: 1396647 - RNA, 19 nt, Homo sapiens
ucauauaucuggaaguuca

SEQ ID NO: 1396648 - RNA, 19 nt, Homo sapiens
uaagaagccugaugucuac

SEQ ID NO: 1396649 - RNA, 19 nt, Homo sapiens
gugagacucuguuucuaaa

SEQ ID NO: 1396650 - RNA, 19 nt, Homo sapiens
gagcuugaguuugaagauu

SEQ ID NO: 1396651 - RNA, 19 nt, Homo sapiens
ggaccucucugugcaguau

SEQ ID NO: 1396652 - RNA, 19 nt, Homo sapiens
caaugaagagcuugaguuu

SEQ ID NO: 1396653 - RNA, 19 nt, Homo sapiens
ugaacaaggaucccaguua

SEQ ID NO: 1396654 - RNA, 19 nt, Homo sapiens
cuaagaagccugaugucua

SEQ ID NO: 1396655 - RNA, 19 nt, Homo sapiens
gagcaaugcguucuuucua

SEQ ID NO: 1396656 - RNA, 19 nt, Homo sapiens
gaucacaagucaggaguuc

SEQ ID NO: 1396657 - RNA, 19 nt, Homo sapiens
gagacuaggcagagaauug

SEQ ID NO: 1396658 - RNA, 19 nt, Homo sapiens
cgucauauaucuggaaguu

SEQ ID NO: 1396659 - RNA, 19 nt, Homo sapiens
ugaaguggguggaucacaa

SEQ ID NO: 1396660 - RNA, 19 nt, Homo sapiens
aagcuucucuggaugugua

SEQ ID NO: 1396661 - RNA, 19 nt, Homo sapiens
ccagggaaacgucauauau

SEQ ID NO: 1396662 - RNA, 19 nt, Homo sapiens
guuugaagaugacacuuug

SEQ ID NO: 1396663 - RNA, 19 nt, Homo sapiens
ugucagggaugguuccaaa

SEQ ID NO: 1396664 - RNA, 19 nt, Homo sapiens
gcuuugggcuucaauugga

SEQ ID NO: 1396665 - RNA, 19 nt, Homo sapiens
guaacagcccugacuaaga

SEQ ID NO: 1396666 - RNA, 19 nt, Homo sapiens
ggaagccgugugagacaua

SEQ ID NO: 1396667 - RNA, 19 nt, Homo sapiens
ugucuaugguucauuacua

SEQ ID NO: 1396668 - RNA, 19 nt, Homo sapiens
gagaggaagccgugugaga

SEQ ID NO: 1396669 - RNA, 19 nt, Homo sapiens
agagcgaguuugaagauga

SEQ ID NO: 1396670 - RNA, 19 nt, Homo sapiens
gagcugccacccauucaaa

SEQ ID NO: 1396671 - RNA, 19 nt, Homo sapiens
gaccuuauuaucagcauuu

SEQ ID NO: 1396672 - RNA, 19 nt, Homo sapiens
gcuuauggcuacugguuca

SEQ ID NO: 1396673 - RNA, 19 nt, Homo sapiens
caggcucauuguuguauuu

SEQ ID NO: 1396674 - RNA, 19 nt, Homo sapiens
gagagaggaagccguguga

SEQ ID NO: 1396675 - RNA, 19 nt, Homo sapiens
ucgugucuaugguucauua

SEQ ID NO: 1396676 - RNA, 19 nt, Homo sapiens
ggcugaagauuauacuuuc

SEQ ID NO: 1396677 - RNA, 19 nt, Homo sapiens
ugaagugagccucccauuu

SEQ ID NO: 1396678 - RNA, 19 nt, Homo sapiens
agcaaugcguucuuucuaa

SEQ ID NO: 1396679 - RNA, 19 nt, Homo sapiens
caacaggacaccagcaagu

SEQ ID NO: 1396680 - RNA, 19 nt, Homo sapiens
gcaguauccuccagagaac

SEQ ID NO: 1396681 - RNA, 19 nt, Homo sapiens
ccaagcaccucccacuucu

SEQ ID NO: 1396682 - RNA, 19 nt, Homo sapiens
gaugaggcaugguacuucu

SEQ ID NO: 1396683 - RNA, 19 nt, Homo sapiens
ccaaguggcugggacuaca

SEQ ID NO: 1396684 - RNA, 19 nt, Homo sapiens
ccaaugaagagcuugaguu

SEQ ID NO: 1396685 - RNA, 19 nt, Homo sapiens
gaucccaguuacagucuuc

SEQ ID NO: 1396686 - RNA, 19 nt, Homo sapiens
ggaguccaguggugcaauc

SEQ ID NO: 1396687 - RNA, 19 nt, Homo sapiens
agcuugaguuugaagauua

SEQ ID NO: 1396688 - RNA, 19 nt, Homo sapiens
ucgcugcccugcucgcuuu

SEQ ID NO: 1396689 - RNA, 19 nt, Homo sapiens
ucaaauggagcacgaagga

SEQ ID NO: 1396690 - RNA, 19 nt, Homo sapiens
gugcuccuguggccacuaa

SEQ ID NO: 1396691 - RNA, 19 nt, Homo sapiens
caacacgucagcccuggaa

SEQ ID NO: 1396692 - RNA, 19 nt, Homo sapiens
ugacuaagaagccugaugu

SEQ ID NO: 1396693 - RNA, 19 nt, Homo sapiens
gggaggaugaggcauggua

SEQ ID NO: 1396694 - RNA, 19 nt, Homo sapiens
guggguggaucacaaguca

SEQ ID NO: 1396695 - RNA, 19 nt, Homo sapiens
ugaccaugcucuuccuuca

SEQ ID NO: 1396696 - RNA, 19 nt, Homo sapiens
cccaaagaccuuauuauca

SEQ ID NO: 1396697 - RNA, 19 nt, Homo sapiens
gacauaguuuccugagcaa

SEQ ID NO: 1396698 - RNA, 19 nt, Homo sapiens
gcucacgccuguggucuca

SEQ ID NO: 1396699 - RNA, 19 nt, Homo sapiens
caauucagagcgaguuuga

SEQ ID NO: 1396700 - RNA, 19 nt, Homo sapiens
gggugaagaucugcaggaa

SEQ ID NO: 1396701 - RNA, 19 nt, Homo sapiens
gcuccuuggugaucagaga

SEQ ID NO: 1396702 - RNA, 19 nt, Homo sapiens
ccuguggucucagcacuuu

SEQ ID NO: 1396703 - RNA, 19 nt, Homo sapiens
gcuugaguuugaagauuau

SEQ ID NO: 1396704 - RNA, 19 nt, Homo sapiens
ggagaugucagggaugguu

SEQ ID NO: 1396705 - RNA, 19 nt, Homo sapiens
gaagaucugcaggaaggaa

SEQ ID NO: 1396706 - RNA, 19 nt, Homo sapiens
ccugagcaaugcguucuuu

SEQ ID NO: 1396707 - RNA, 19 nt, Homo sapiens
cagagaaccugagagugau

SEQ ID NO: 1396708 - RNA, 19 nt, Homo sapiens
uggcugaagauuauacuuu

SEQ ID NO: 1396709 - RNA, 19 nt, Homo sapiens
agggaaacgucauauaucu

SEQ ID NO: 1396710 - RNA, 19 nt, Homo sapiens
cagaagagggagagugaga

SEQ ID NO: 1396711 - RNA, 19 nt, Homo sapiens
acggucaucuguguguuua

SEQ ID NO: 1396712 - RNA, 19 nt, Homo sapiens
cgagucuacugcugcuuau

SEQ ID NO: 1396713 - RNA, 19 nt, Homo sapiens
agggaugguuccaaaguga

SEQ ID NO: 1396714 - RNA, 19 nt, Homo sapiens
aaaguaacagcccugacua

SEQ ID NO: 1396715 - RNA, 19 nt, Homo sapiens
uccaagugguucccauuug

SEQ ID NO: 1396716 - RNA, 19 nt, Homo sapiens
ugaagagcuugaguuugaa

SEQ ID NO: 1396717 - RNA, 19 nt, Homo sapiens
cagggaugguuccaaagug

SEQ ID NO: 1396718 - RNA, 19 nt, Homo sapiens
ggaaggaagcucgcaagag

SEQ ID NO: 1396719 - RNA, 19 nt, Homo sapiens
guguuuaacugggcuuuca

SEQ ID NO: 1396720 - RNA, 19 nt, Homo sapiens
ggucaucuguguguuuaac

SEQ ID NO: 1396721 - RNA, 19 nt, Homo sapiens
gaaguggguggaucacaag

SEQ ID NO: 1396722 - RNA, 19 nt, Homo sapiens
caagugguucccauuugaa

SEQ ID NO: 1396723 - RNA, 19 nt, Homo sapiens
caguuacagucuucaagug

SEQ ID NO: 1396724 - RNA, 19 nt, Homo sapiens
gucgagagguggaaaugag

SEQ ID NO: 1396725 - RNA, 19 nt, Homo sapiens
uuaacugggcuuucaagaa

SEQ ID NO: 1396726 - RNA, 19 nt, Homo sapiens
gaagccgugugagacauag

SEQ ID NO: 1396727 - RNA, 19 nt, Homo sapiens
gaggaagccgugugagaca

SEQ ID NO: 1396728 - RNA, 19 nt, Homo sapiens
ucagagcgaguuugaagau

SEQ ID NO: 1396729 - RNA, 19 nt, Homo sapiens
gggagucgcacugguguga

SEQ ID NO: 1396730 - RNA, 19 nt, Homo sapiens
ugaggcaugguacuucuuu

SEQ ID NO: 1396731 - RNA, 19 nt, Homo sapiens
uaugguucauuacuacaga

SEQ ID NO: 1396732 - RNA, 19 nt, Homo sapiens
ccaaggugcugggauugca

SEQ ID NO: 1396733 - RNA, 19 nt, Homo sapiens
cagaacuggacucagauuu

SEQ ID NO: 1396734 - RNA, 19 nt, Homo sapiens
agcaggagcuccacuaugc

SEQ ID NO: 1396735 - RNA, 19 nt, Homo sapiens
cauaguuuccugagcaaug

SEQ ID NO: 1396736 - RNA, 19 nt, Homo sapiens
gagcgaguuugaagaugac

SEQ ID NO: 1396737 - RNA, 19 nt, Homo sapiens
ggaaguaacuaucaucuuu

SEQ ID NO: 1396738 - RNA, 19 nt, Homo sapiens
gaaauugaaucacucuuug

SEQ ID NO: 1396739 - RNA, 19 nt, Homo sapiens
caaauugguuagucacuua

SEQ ID NO: 1396740 - RNA, 19 nt, Homo sapiens
gaucagcuguuacaaacua

SEQ ID NO: 1396741 - RNA, 19 nt, Homo sapiens
gaagggagauauauugaau

SEQ ID NO: 1396742 - RNA, 19 nt, Homo sapiens
gaacaaaucaacugucauu

SEQ ID NO: 1396743 - RNA, 19 nt, Homo sapiens
ucacuuagguaugcaauua

SEQ ID NO: 1396744 - RNA, 19 nt, Homo sapiens
gaaaucaguggcagaaaua

SEQ ID NO: 1396745 - RNA, 19 nt, Homo sapiens
guaaugccuuccugaaaua

SEQ ID NO: 1396746 - RNA, 19 nt, Homo sapiens
ggaaaucaguggcagaaau

SEQ ID NO: 1396747 - RNA, 19 nt, Homo sapiens
auacauagcugcaagcaaa

SEQ ID NO: 1396748 - RNA, 19 nt, Homo sapiens
gaagauacaaccaugauga

SEQ ID NO: 1396749 - RNA, 19 nt, Homo sapiens
cagcagcucucaggcauua

SEQ ID NO: 1396750 - RNA, 19 nt, Homo sapiens
gaaaguaacagauuaaagg

SEQ ID NO: 1396751 - RNA, 19 nt, Homo sapiens
ggaaauugaaucacucuuu

SEQ ID NO: 1396752 - RNA, 19 nt, Homo sapiens
gaacagcaauuggugacuu

SEQ ID NO: 1396753 - RNA, 19 nt, Homo sapiens
ggaauaaacuggauuuuca

SEQ ID NO: 1396754 - RNA, 19 nt, Homo sapiens
cagaugagcuaggaaguuu

SEQ ID NO: 1396755 - RNA, 19 nt, Homo sapiens
ggaaaugcauguucaucug

SEQ ID NO: 1396756 - RNA, 19 nt, Homo sapiens
ucaguuaucuccagaagga

SEQ ID NO: 1396757 - RNA, 19 nt, Homo sapiens
gacugugaauucugaaaua

SEQ ID NO: 1396758 - RNA, 19 nt, Homo sapiens
uuacagccuucacaaauuu

SEQ ID NO: 1396759 - RNA, 19 nt, Homo sapiens
gaugauagacuugcaauau

SEQ ID NO: 1396760 - RNA, 19 nt, Homo sapiens
cagaaggcccguagaauuu

SEQ ID NO: 1396761 - RNA, 19 nt, Homo sapiens
caauauggcuggcuucagu

SEQ ID NO: 1396762 - RNA, 19 nt, Homo sapiens
gcacuucugggccuuauuu

SEQ ID NO: 1396763 - RNA, 19 nt, Homo sapiens
guacuacagugcaaccauu

SEQ ID NO: 1396764 - RNA, 19 nt, Homo sapiens
auacaaccaugaugacuuu

SEQ ID NO: 1396765 - RNA, 19 nt, Homo sapiens
gaugaagggagauauauug

SEQ ID NO: 1396766 - RNA, 19 nt, Homo sapiens
guuacagccuucacaaauu

SEQ ID NO: 1396767 - RNA, 19 nt, Homo sapiens
ugccagaucuuuaacugua

SEQ ID NO: 1396768 - RNA, 19 nt, Homo sapiens
guaacuaucaucuuucuga

SEQ ID NO: 1396769 - RNA, 19 nt, Homo sapiens
gcauuaacaccaucaugua

SEQ ID NO: 1396770 - RNA, 19 nt, Homo sapiens
cagcagaguaucuuacaua

SEQ ID NO: 1396771 - RNA, 19 nt, Homo sapiens
ggucucaccacccaauuua

SEQ ID NO: 1396772 - RNA, 19 nt, Homo sapiens
gggcacagcuguccguauc

SEQ ID NO: 1396773 - RNA, 19 nt, Homo sapiens
cuucugauguggaauaauu

SEQ ID NO: 1396774 - RNA, 19 nt, Homo sapiens
caauuuaagaggccgauua

SEQ ID NO: 1396775 - RNA, 19 nt, Homo sapiens
cauguaagcuuucaucaac

SEQ ID NO: 1396776 - RNA, 19 nt, Homo sapiens
gaccauugaugaggaauau

SEQ ID NO: 1396777 - RNA, 19 nt, Homo sapiens
ccagaucuuuaacuguaua

SEQ ID NO: 1396778 - RNA, 19 nt, Homo sapiens
aguaguggcuuaucucuga

SEQ ID NO: 1396779 - RNA, 19 nt, Homo sapiens
ucagaaggcccguagaauu

SEQ ID NO: 1396780 - RNA, 19 nt, Homo sapiens
gauggagccuucaguuauc

SEQ ID NO: 1396781 - RNA, 19 nt, Homo sapiens
gcaacagagucagugcuaa

SEQ ID NO: 1396782 - RNA, 19 nt, Homo sapiens
cuagaauacuugauuagga

SEQ ID NO: 1396783 - RNA, 19 nt, Homo sapiens
gagucuggcuuguugagaa

SEQ ID NO: 1396784 - RNA, 19 nt, Homo sapiens
ggagggcaguucuuugcaa

SEQ ID NO: 1396785 - RNA, 19 nt, Homo sapiens
gcauguucaucuggaauaa

SEQ ID NO: 1396786 - RNA, 19 nt, Homo sapiens
ccugagaauuuaccagaaa

SEQ ID NO: 1396787 - RNA, 19 nt, Homo sapiens
agaaauaauccugcuguua

SEQ ID NO: 1396788 - RNA, 19 nt, Homo sapiens
gguaugcaauuauaaaugc

SEQ ID NO: 1396789 - RNA, 19 nt, Homo sapiens
ccaaggguguucuguguca

SEQ ID NO: 1396790 - RNA, 19 nt, Homo sapiens
cagagucagugcuaaucua

SEQ ID NO: 1396791 - RNA, 19 nt, Homo sapiens
uguaaugccuuccugaaau

SEQ ID NO: 1396792 - RNA, 19 nt, Homo sapiens
guaaccagaccauugauga

SEQ ID NO: 1396793 - RNA, 19 nt, Homo sapiens
ucacuacaccuuccucauu

SEQ ID NO: 1396794 - RNA, 19 nt, Homo sapiens
ugacuucacugcccugcuu

SEQ ID NO: 1396795 - RNA, 19 nt, Homo sapiens
caaugaugcuucugaugug

SEQ ID NO: 1396796 - RNA, 19 nt, Homo sapiens
ggcaagaaguacaggaaau

SEQ ID NO: 1396797 - RNA, 19 nt, Homo sapiens
uaaagcaucuacaaaugag

SEQ ID NO: 1396798 - RNA, 19 nt, Homo sapiens
gcaguucuuugcaaguguu

SEQ ID NO: 1396799 - RNA, 19 nt, Homo sapiens
ucacugcccugcuucuaau

SEQ ID NO: 1396800 - RNA, 19 nt, Homo sapiens
guucagaaaguaacagauu

SEQ ID NO: 1396801 - RNA, 19 nt, Homo sapiens
gagaagaacagcaauuggu

SEQ ID NO: 1396802 - RNA, 19 nt, Homo sapiens
gcaagaaguacaggaaaug

SEQ ID NO: 1396803 - RNA, 19 nt, Homo sapiens
caagcgagaauguggagua

SEQ ID NO: 1396804 - RNA, 19 nt, Homo sapiens
cccagugacuucaguggua

SEQ ID NO: 1396805 - RNA, 19 nt, Homo sapiens
cuucuaaucugguucuuuc

SEQ ID NO: 1396806 - RNA, 19 nt, Homo sapiens
uuaacaccaucauguacua

SEQ ID NO: 1396807 - RNA, 19 nt, Homo sapiens
gaaggcccguagaauuuua

SEQ ID NO: 1396808 - RNA, 19 nt, Homo sapiens
gccgauuagucaccauuaa

SEQ ID NO: 1396809 - RNA, 19 nt, Homo sapiens
aaauagugccagaucuuua

SEQ ID NO: 1396810 - RNA, 19 nt, Homo sapiens
gaaguaacuaucaucuuuc

SEQ ID NO: 1396811 - RNA, 19 nt, Homo sapiens
gaaucacucuuugacaaca

SEQ ID NO: 1396812 - RNA, 19 nt, Homo sapiens
caccguagcacucauuauu

SEQ ID NO: 1396813 - RNA, 19 nt, Homo sapiens
gugggagucuggcuuguug

SEQ ID NO: 1396814 - RNA, 19 nt, Homo sapiens
gcagaaugcugaguuaucc

SEQ ID NO: 1396815 - RNA, 19 nt, Homo sapiens
gcaucggcauugcuucuau

SEQ ID NO: 1396816 - RNA, 19 nt, Homo sapiens
cggcauugcuucuaugaca

SEQ ID NO: 1396817 - RNA, 19 nt, Homo sapiens
gucaaaagauggccuauug

SEQ ID NO: 1396818 - RNA, 19 nt, Homo sapiens
caacagagucagugcuaau

SEQ ID NO: 1396819 - RNA, 19 nt, Homo sapiens
ugacuucagugguauccuu

SEQ ID NO: 1396820 - RNA, 19 nt, Homo sapiens
ggagcuuucuuccucuaug

SEQ ID NO: 1396821 - RNA, 19 nt, Homo sapiens
cacuacaccuuccucauug

SEQ ID NO: 1396822 - RNA, 19 nt, Homo sapiens
gcagaugagcuaggaaguu

SEQ ID NO: 1396823 - RNA, 19 nt, Homo sapiens
gugauaaggcauacauuug

SEQ ID NO: 1396824 - RNA, 19 nt, Homo sapiens
gcaaggcaagcgagaaugu

SEQ ID NO: 1396825 - RNA, 19 nt, Homo sapiens
uaaagggaaguaacuauca

SEQ ID NO: 1396826 - RNA, 19 nt, Homo sapiens
ucgccgagcuuuaauugug

SEQ ID NO: 1396827 - RNA, 19 nt, Homo sapiens
agaaguaccuuuuauguuc

SEQ ID NO: 1396828 - RNA, 19 nt, Homo sapiens
gggcaguucuuugcaagug

SEQ ID NO: 1396829 - RNA, 19 nt, Homo sapiens
guccguaucuccuuuggau

SEQ ID NO: 1396830 - RNA, 19 nt, Homo sapiens
guccaaggguguucugugu

SEQ ID NO: 1396831 - RNA, 19 nt, Homo sapiens
gauacaaccaugaugacuu

SEQ ID NO: 1396832 - RNA, 19 nt, Homo sapiens
gggagaagaacagcaauug

SEQ ID NO: 1396833 - RNA, 19 nt, Homo sapiens
ugacaaugaugcuucugau

SEQ ID NO: 1396834 - RNA, 19 nt, Homo sapiens
guacaggaaaugcauguuc

SEQ ID NO: 1396835 - RNA, 19 nt, Homo sapiens
ugauagacuugcaauaugg

SEQ ID NO: 1396836 - RNA, 19 nt, Homo sapiens
uaucucugaucagcuguua

SEQ ID NO: 1396837 - RNA, 19 nt, Homo sapiens
gagcugguauccuuaauua

SEQ ID NO: 1396838 - RNA, 19 nt, Homo sapiens
ggaaauacggacuaaauua

SEQ ID NO: 1396839 - RNA, 19 nt, Homo sapiens
gaccaacccugucaacuaa

SEQ ID NO: 1396840 - RNA, 19 nt, Homo sapiens
ggaaggugaugaauaggua

SEQ ID NO: 1396841 - RNA, 19 nt, Homo sapiens
caaggaaggugaugaauag

SEQ ID NO: 1396842 - RNA, 19 nt, Homo sapiens
gggcauaaauuccuaucua

SEQ ID NO: 1396843 - RNA, 19 nt, Homo sapiens
ucagacagcugccaaagaa

SEQ ID NO: 1396844 - RNA, 19 nt, Homo sapiens
caacuaagcuaaugcuaca

SEQ ID NO: 1396845 - RNA, 19 nt, Homo sapiens
gcugguauccuuaauuaua

SEQ ID NO: 1396846 - RNA, 19 nt, Homo sapiens
cauaugagcugguauccuu

SEQ ID NO: 1396847 - RNA, 19 nt, Homo sapiens
gaacaaggaaggugaugaa

SEQ ID NO: 1396848 - RNA, 19 nt, Homo sapiens
ggaccaacccugucaacua

SEQ ID NO: 1396849 - RNA, 19 nt, Homo sapiens
ugaacucgaucauauguuu

SEQ ID NO: 1396850 - RNA, 19 nt, Homo sapiens
ggcauaaauuccuaucuaa

SEQ ID NO: 1396851 - RNA, 19 nt, Homo sapiens
gcugaaaacugucuaagua

SEQ ID NO: 1396852 - RNA, 19 nt, Homo sapiens
gaauaaagaacaugucugu

SEQ ID NO: 1396853 - RNA, 19 nt, Homo sapiens
uuugguagcuuguuacuaa

SEQ ID NO: 1396854 - RNA, 19 nt, Homo sapiens
cauguuugcuuuccaguuu

SEQ ID NO: 1396855 - RNA, 19 nt, Homo sapiens
agaagcaagucaugaaauu

SEQ ID NO: 1396856 - RNA, 19 nt, Homo sapiens
aguauagucuccaugaaua

SEQ ID NO: 1396857 - RNA, 19 nt, Homo sapiens
gcucaucacaaaccacuua

SEQ ID NO: 1396858 - RNA, 19 nt, Homo sapiens
caaaguauagucuccauga

SEQ ID NO: 1396859 - RNA, 19 nt, Homo sapiens
acaaaccacuuauggaaug

SEQ ID NO: 1396860 - RNA, 19 nt, Homo sapiens
gaacaauaugcgauguaua

SEQ ID NO: 1396861 - RNA, 19 nt, Homo sapiens
aaacaaaacucacccagaa

SEQ ID NO: 1396862 - RNA, 19 nt, Homo sapiens
cacaaacucuggguucuuu

SEQ ID NO: 1396863 - RNA, 19 nt, Homo sapiens
ucacaaaccacuuauggaa

SEQ ID NO: 1396864 - RNA, 19 nt, Homo sapiens
gaagcaagucaugaaauuu

SEQ ID NO: 1396865 - RNA, 19 nt, Homo sapiens
ugaaugcacucugauguau

SEQ ID NO: 1396866 - RNA, 19 nt, Homo sapiens
cggacuaaauuaacuauuc

SEQ ID NO: 1396867 - RNA, 19 nt, Homo sapiens
ucaaggauuugugaugaaa

SEQ ID NO: 1396868 - RNA, 19 nt, Homo sapiens
ccucaaggauuugugauga

SEQ ID NO: 1396869 - RNA, 19 nt, Homo sapiens
acacucugcucaucacaaa

SEQ ID NO: 1396870 - RNA, 19 nt, Homo sapiens
caauggcagauacuaaaua

SEQ ID NO: 1396871 - RNA, 19 nt, Homo sapiens
caagaagcaagucaugaaa

SEQ ID NO: 1396872 - RNA, 19 nt, Homo sapiens
acaaggaaggugaugaaua

SEQ ID NO: 1396873 - RNA, 19 nt, Homo sapiens
ucucuuugguagcuuguua

SEQ ID NO: 1396874 - RNA, 19 nt, Homo sapiens
ucaagaagcaagucaugaa

SEQ ID NO: 1396875 - RNA, 19 nt, Homo sapiens
acacacacacacauauaua

SEQ ID NO: 1396876 - RNA, 19 nt, Homo sapiens
cuaagcuaaugcuacauaa

SEQ ID NO: 1396877 - RNA, 19 nt, Homo sapiens
cccagcaccuagaacaaua

SEQ ID NO: 1396878 - RNA, 19 nt, Homo sapiens
ggucuucaauucucuuugg

SEQ ID NO: 1396879 - RNA, 19 nt, Homo sapiens
caacacccgccauguauca

SEQ ID NO: 1396880 - RNA, 19 nt, Homo sapiens
ccauguaucaauucuguaa

SEQ ID NO: 1396881 - RNA, 19 nt, Homo sapiens
gugaaugcacucugaugua

SEQ ID NO: 1396882 - RNA, 19 nt, Homo sapiens
acacacacacacacauaua

SEQ ID NO: 1396883 - RNA, 19 nt, Homo sapiens
ugaagaggugggcuaauuu

SEQ ID NO: 1396884 - RNA, 19 nt, Homo sapiens
aggauuagcuaaagaacau

SEQ ID NO: 1396885 - RNA, 19 nt, Homo sapiens
caucucacauccucaucaa

SEQ ID NO: 1396886 - RNA, 19 nt, Homo sapiens
acacacacacacacacaua

SEQ ID NO: 1396887 - RNA, 19 nt, Homo sapiens
acacacacacacacacaua

SEQ ID NO: 1396888 - RNA, 19 nt, Homo sapiens
augaagaggugggcuaauu

SEQ ID NO: 1396889 - RNA, 19 nt, Homo sapiens
agaacaauaugcgauguau

SEQ ID NO: 1396890 - RNA, 19 nt, Homo sapiens
caaaccacuuauggaauga

SEQ ID NO: 1396891 - RNA, 19 nt, Homo sapiens
gguaaggauaggaguauga

SEQ ID NO: 1396892 - RNA, 19 nt, Homo sapiens
gcagaaaacaauaaaguug

SEQ ID NO: 1396893 - RNA, 19 nt, Homo sapiens
aaaguauagucuccaugaa

SEQ ID NO: 1396894 - RNA, 19 nt, Homo sapiens
guauagucuccaugaauaa

SEQ ID NO: 1396895 - RNA, 19 nt, Homo sapiens
guaucaaacucuugcaaaa

SEQ ID NO: 1396896 - RNA, 19 nt, Homo sapiens
gcacacacacacacacaca

SEQ ID NO: 1396897 - RNA, 19 nt, Homo sapiens
uacaauggcagauacuaaa

SEQ ID NO: 1396898 - RNA, 19 nt, Homo sapiens
ucucaacacccgccaugua

SEQ ID NO: 1396899 - RNA, 19 nt, Homo sapiens
gaagaggugggcuaauuuu

SEQ ID NO: 1396900 - RNA, 19 nt, Homo sapiens
aaaugggcauaaauuccua

SEQ ID NO: 1396901 - RNA, 19 nt, Homo sapiens
ucacccagaacaaaguaua

SEQ ID NO: 1396902 - RNA, 19 nt, Homo sapiens
cgccauguaucaauucugu

SEQ ID NO: 1396903 - RNA, 19 nt, Homo sapiens
ucucacauccucaucaaga

SEQ ID NO: 1396904 - RNA, 19 nt, Homo sapiens
caauaugcgauguauacaa

SEQ ID NO: 1396905 - RNA, 19 nt, Homo sapiens
uauugugaaugcacucuga

SEQ ID NO: 1396906 - RNA, 19 nt, Homo sapiens
ggugaugaauagguauaga

SEQ ID NO: 1396907 - RNA, 19 nt, Homo sapiens
guaaggauaggaguaugaa

SEQ ID NO: 1396908 - RNA, 19 nt, Homo sapiens
caucacaaaccacuuaugg

SEQ ID NO: 1396909 - RNA, 19 nt, Homo sapiens
caacaaucacguuuucuuu

SEQ ID NO: 1396910 - RNA, 19 nt, Homo sapiens
ccacuuauggaaugaaaca

SEQ ID NO: 1396911 - RNA, 19 nt, Homo sapiens
cuuauggaaugaaacaugu

SEQ ID NO: 1396912 - RNA, 19 nt, Homo sapiens
ucaauucucuuugguagcu

SEQ ID NO: 1396913 - RNA, 19 nt, Homo sapiens
uaaacuuucuaagccuuga

SEQ ID NO: 1396914 - RNA, 19 nt, Homo sapiens
ucuguaaccuuaggcaaau

SEQ ID NO: 1396915 - RNA, 19 nt, Homo sapiens
cacccgccauguaucaauu

SEQ ID NO: 1396916 - RNA, 19 nt, Homo sapiens
uggaaauacggacuaaauu

SEQ ID NO: 1396917 - RNA, 19 nt, Homo sapiens
acuaagcuaaugcuacaua

SEQ ID NO: 1396918 - RNA, 19 nt, Homo sapiens
auacaauggcagauacuaa

SEQ ID NO: 1396919 - RNA, 19 nt, Homo sapiens
uguaaccuuaggcaaauua

SEQ ID NO: 1396920 - RNA, 19 nt, Homo sapiens
aaggauaggaguaugaaga

SEQ ID NO: 1396921 - RNA, 19 nt, Homo sapiens
gugaugaauagguauagaa

SEQ ID NO: 1396922 - RNA, 19 nt, Homo sapiens
caucaagaagcaagucaug

SEQ ID NO: 1396923 - RNA, 19 nt, Homo sapiens
uuaaagugcugaaaacugu

SEQ ID NO: 1396924 - RNA, 19 nt, Homo sapiens
cugguauccuuaauuauag

SEQ ID NO: 1396925 - RNA, 19 nt, Homo sapiens
uuacaugcaggauuagcua

SEQ ID NO: 1396926 - RNA, 19 nt, Homo sapiens
uagaacaauaugcgaugua

SEQ ID NO: 1396927 - RNA, 19 nt, Homo sapiens
uuucguauauugugaaugc

SEQ ID NO: 1396928 - RNA, 19 nt, Homo sapiens
cagaaaaugggcauaaauu

SEQ ID NO: 1396929 - RNA, 19 nt, Homo sapiens
guaugaagaggugggcuaa

SEQ ID NO: 1396930 - RNA, 19 nt, Homo sapiens
ucaauucuguaaccuuagg

SEQ ID NO: 1396931 - RNA, 19 nt, Homo sapiens
aaggauuugugaugaaaca

SEQ ID NO: 1396932 - RNA, 19 nt, Homo sapiens
gaaggugaugaauagguau

SEQ ID NO: 1396933 - RNA, 19 nt, Homo sapiens
aacaauaugcgauguauac

SEQ ID NO: 1396934 - RNA, 19 nt, Homo sapiens
uagucuccaugaauaaaga

SEQ ID NO: 1396935 - RNA, 19 nt, Homo sapiens
cacacacacacauauauau

SEQ ID NO: 1396936 - RNA, 19 nt, Homo sapiens
ggagaacaaggaaggugau

SEQ ID NO: 1396937 - RNA, 19 nt, Homo sapiens
gcacaggacugaaaugauu

SEQ ID NO: 1396938 - RNA, 19 nt, Homo sapiens
caaagcaucuggcucaaua

SEQ ID NO: 1396939 - RNA, 19 nt, Homo sapiens
cauaggagaucuucaauaa

SEQ ID NO: 1396940 - RNA, 19 nt, Homo sapiens
gcacaccacuuuaguagaa

SEQ ID NO: 1396941 - RNA, 19 nt, Homo sapiens
ccaaaugccuauucuuuaa

SEQ ID NO: 1396942 - RNA, 19 nt, Homo sapiens
gaagaaaggguuuaagaaa

SEQ ID NO: 1396943 - RNA, 19 nt, Homo sapiens
gaacaaaugaguagcuuaa

SEQ ID NO: 1396944 - RNA, 19 nt, Homo sapiens
cuaauuagaugguuacuga

SEQ ID NO: 1396945 - RNA, 19 nt, Homo sapiens
gagcucaagugcuucuuua

SEQ ID NO: 1396946 - RNA, 19 nt, Homo sapiens
gaaguaauccuaggaaauu

SEQ ID NO: 1396947 - RNA, 19 nt, Homo sapiens
agucagggcuaccuaauua

SEQ ID NO: 1396948 - RNA, 19 nt, Homo sapiens
ucucagauuuggauucuua

SEQ ID NO: 1396949 - RNA, 19 nt, Homo sapiens
caaaugaggcuaauauaga

SEQ ID NO: 1396950 - RNA, 19 nt, Homo sapiens
gaaccaugccuaaauuaaa

SEQ ID NO: 1396951 - RNA, 19 nt, Homo sapiens
ccacaaguacuucuuuaua

SEQ ID NO: 1396952 - RNA, 19 nt, Homo sapiens
caccuuggcuccagaagua

SEQ ID NO: 1396953 - RNA, 19 nt, Homo sapiens
uauaggcacuggagauuaa

SEQ ID NO: 1396954 - RNA, 19 nt, Homo sapiens
caaagucacacaucuaauu

SEQ ID NO: 1396955 - RNA, 19 nt, Homo sapiens
ggaaaguccuggaaguugu

SEQ ID NO: 1396956 - RNA, 19 nt, Homo sapiens
ugaaugagguauugguaaa

SEQ ID NO: 1396957 - RNA, 19 nt, Homo sapiens
ugaaguagccacugaauga

SEQ ID NO: 1396958 - RNA, 19 nt, Homo sapiens
caaguucagcuuuguguua

SEQ ID NO: 1396959 - RNA, 19 nt, Homo sapiens
gcacauaggagaucuucaa

SEQ ID NO: 1396960 - RNA, 19 nt, Homo sapiens
gcaucuggcucaauauguu

SEQ ID NO: 1396961 - RNA, 19 nt, Homo sapiens
ucacacaucuaauugauag

SEQ ID NO: 1396962 - RNA, 19 nt, Homo sapiens
gggaggauaacauggauua

SEQ ID NO: 1396963 - RNA, 19 nt, Homo sapiens
gauuaggacuuucugacaa

SEQ ID NO: 1396964 - RNA, 19 nt, Homo sapiens
ggaaccaugccuaaauuaa

SEQ ID NO: 1396965 - RNA, 19 nt, Homo sapiens
caaaugaguagcuuaaaug

SEQ ID NO: 1396966 - RNA, 19 nt, Homo sapiens
guacaagaccgaagacaga

SEQ ID NO: 1396967 - RNA, 19 nt, Homo sapiens
gccaaaugcuuucucuuau

SEQ ID NO: 1396968 - RNA, 19 nt, Homo sapiens
agucaaauaucacugcuaa

SEQ ID NO: 1396969 - RNA, 19 nt, Homo sapiens
ggaaacaaaugaggcuaau

SEQ ID NO: 1396970 - RNA, 19 nt, Homo sapiens
gcacucagagggauagaaa

SEQ ID NO: 1396971 - RNA, 19 nt, Homo sapiens
uaaaauagcacaccacuuu

SEQ ID NO: 1396972 - RNA, 19 nt, Homo sapiens
ugacuuccuuuauccuaua

SEQ ID NO: 1396973 - RNA, 19 nt, Homo sapiens
ggagacagaaguaauccua

SEQ ID NO: 1396974 - RNA, 19 nt, Homo sapiens
gaauucagaagaacauuug

SEQ ID NO: 1396975 - RNA, 19 nt, Homo sapiens
ccuaagaccugaagaaagg

SEQ ID NO: 1396976 - RNA, 19 nt, Homo sapiens
ggacuuguguuacuuccau

SEQ ID NO: 1396977 - RNA, 19 nt, Homo sapiens
gaaaguccuggaaguugua

SEQ ID NO: 1396978 - RNA, 19 nt, Homo sapiens
gugcaugacuuccuuuauc

SEQ ID NO: 1396979 - RNA, 19 nt, Homo sapiens
caaguaauccaaacaaaca

SEQ ID NO: 1396980 - RNA, 19 nt, Homo sapiens
caaauaucacugcuaauug

SEQ ID NO: 1396981 - RNA, 19 nt, Homo sapiens
uagacagcauuuagagaua

SEQ ID NO: 1396982 - RNA, 19 nt, Homo sapiens
cuacugggcucaagcaauc

SEQ ID NO: 1396983 - RNA, 19 nt, Homo sapiens
gcagacaggcagcaucauu

SEQ ID NO: 1396984 - RNA, 19 nt, Homo sapiens
cuaccuaauuagaugguua

SEQ ID NO: 1396985 - RNA, 19 nt, Homo sapiens
ugaaaugucaguuaagcua

SEQ ID NO: 1396986 - RNA, 19 nt, Homo sapiens
ccaaaugcuuucucuuauc

SEQ ID NO: 1396987 - RNA, 19 nt, Homo sapiens
gaaagacuccaugcaguau

SEQ ID NO: 1396988 - RNA, 19 nt, Homo sapiens
ggaaguaugaaauauagug

SEQ ID NO: 1396989 - RNA, 19 nt, Homo sapiens
gaguacaugugcucuggaa

SEQ ID NO: 1396990 - RNA, 19 nt, Homo sapiens
ugucauauuugccauucua

SEQ ID NO: 1396991 - RNA, 19 nt, Homo sapiens
cucaauauguucucaaaga

SEQ ID NO: 1396992 - RNA, 19 nt, Homo sapiens
caaaccagcccuucugaau

SEQ ID NO: 1396993 - RNA, 19 nt, Homo sapiens
gaaacaaaugaggcuaaua

SEQ ID NO: 1396994 - RNA, 19 nt, Homo sapiens
ggauuaauauuggaaaguc

SEQ ID NO: 1396995 - RNA, 19 nt, Homo sapiens
ugccaaaugcuuucucuua

SEQ ID NO: 1396996 - RNA, 19 nt, Homo sapiens
aguaucauccucuucauua

SEQ ID NO: 1396997 - RNA, 19 nt, Homo sapiens
cuaguuaaguguuggcuau

SEQ ID NO: 1396998 - RNA, 19 nt, Homo sapiens
gacagacaauggaaaauaa

SEQ ID NO: 1396999 - RNA, 19 nt, Homo sapiens
caaccacuucccagaguua

SEQ ID NO: 1397000 - RNA, 19 nt, Homo sapiens
ucaagugucugccaaaugc

SEQ ID NO: 1397001 - RNA, 19 nt, Homo sapiens
gagcaauucacaauaacaa

SEQ ID NO: 1397002 - RNA, 19 nt, Homo sapiens
guuaaguguuggcuauuau

SEQ ID NO: 1397003 - RNA, 19 nt, Homo sapiens
gcaaccacuucccagaguu

SEQ ID NO: 1397004 - RNA, 19 nt, Homo sapiens
cagaaguaauccuaggaaa

SEQ ID NO: 1397005 - RNA, 19 nt, Homo sapiens
gcuguuucuuccaauuaua

SEQ ID NO: 1397006 - RNA, 19 nt, Homo sapiens
aagacuccaugcaguauaa

SEQ ID NO: 1397007 - RNA, 19 nt, Homo sapiens
gaagggaaccaugccuaaa

SEQ ID NO: 1397008 - RNA, 19 nt, Homo sapiens
aaagcaagguuuucaagua

SEQ ID NO: 1397009 - RNA, 19 nt, Homo sapiens
ugaagaaaggguuuaagaa

SEQ ID NO: 1397010 - RNA, 19 nt, Homo sapiens
gggaaccaugccuaaauua

SEQ ID NO: 1397011 - RNA, 19 nt, Homo sapiens
ucucugacaucuuguacaa

SEQ ID NO: 1397012 - RNA, 19 nt, Homo sapiens
ugccuaugcuuacaaauau

SEQ ID NO: 1397013 - RNA, 19 nt, Homo sapiens
ucaaagacagauaugguaa

SEQ ID NO: 1397014 - RNA, 19 nt, Homo sapiens
gcuaauugauuccuauacu

SEQ ID NO: 1397015 - RNA, 19 nt, Homo sapiens
cacaaagucacacaucuaa

SEQ ID NO: 1397016 - RNA, 19 nt, Homo sapiens
cagaagaacauuugauaca

SEQ ID NO: 1397017 - RNA, 19 nt, Homo sapiens
ucacagcacaggacugaaa

SEQ ID NO: 1397018 - RNA, 19 nt, Homo sapiens
agaaagacuccaugcagua

SEQ ID NO: 1397019 - RNA, 19 nt, Homo sapiens
cgccaaagccuaauucaau

SEQ ID NO: 1397020 - RNA, 19 nt, Homo sapiens
gaugaaaugucaguuaagc

SEQ ID NO: 1397021 - RNA, 19 nt, Homo sapiens
gggcuguuucuuccaauua

SEQ ID NO: 1397022 - RNA, 19 nt, Homo sapiens
caaauuccacccucaguuc

SEQ ID NO: 1397023 - RNA, 19 nt, Homo sapiens
aaccagcccuucugaaugu

SEQ ID NO: 1397024 - RNA, 19 nt, Homo sapiens
gauaguagcaccaaaauuc

SEQ ID NO: 1397025 - RNA, 19 nt, Homo sapiens
gcauuuagagauagugcua

SEQ ID NO: 1397026 - RNA, 19 nt, Homo sapiens
gcaguauaaccaagucaaa

SEQ ID NO: 1397027 - RNA, 19 nt, Homo sapiens
gaauaauugcuucuucuag

SEQ ID NO: 1397028 - RNA, 19 nt, Homo sapiens
uccaaaugccuauucuuua

SEQ ID NO: 1397029 - RNA, 19 nt, Homo sapiens
acuuugaucucucuuaaga

SEQ ID NO: 1397030 - RNA, 19 nt, Homo sapiens
gaaacucauuuggaaacau

SEQ ID NO: 1397031 - RNA, 19 nt, Homo sapiens
gaggauaacauggauuaau

SEQ ID NO: 1397032 - RNA, 19 nt, Homo sapiens
acagauuuguggaugauau

SEQ ID NO: 1397033 - RNA, 19 nt, Homo sapiens
aaagacagauaugguaaca

SEQ ID NO: 1397034 - RNA, 19 nt, Homo sapiens
auucagaggacuuguguua

SEQ ID NO: 1397035 - RNA, 19 nt, Homo sapiens
ucagaggacuuguguuacu

SEQ ID NO: 1397036 - RNA, 19 nt, Homo sapiens
cuccagaaguacugaaauu

SEQ ID NO: 1397037 - RNA, 19 nt, Homo sapiens
gaagauugcccuugaauuu

SEQ ID NO: 1397038 - RNA, 19 nt, Homo sapiens
gaaacuggaucuugauauu

SEQ ID NO: 1397039 - RNA, 19 nt, Homo sapiens
gaacaaggcgaauuauauu

SEQ ID NO: 1397040 - RNA, 19 nt, Homo sapiens
aaacagagcaggagaauga

SEQ ID NO: 1397041 - RNA, 19 nt, Homo sapiens
uauaaagccuugaagauga

SEQ ID NO: 1397042 - RNA, 19 nt, Homo sapiens
guggauaacuccuauaaau

SEQ ID NO: 1397043 - RNA, 19 nt, Homo sapiens
caacacaccuuacguggau

SEQ ID NO: 1397044 - RNA, 19 nt, Homo sapiens
ggauaaagaggguaaauau

SEQ ID NO: 1397045 - RNA, 19 nt, Homo sapiens
ggaaugcaaugcuuuaugg

SEQ ID NO: 1397046 - RNA, 19 nt, Homo sapiens
agagagagcuucaggaugu

SEQ ID NO: 1397047 - RNA, 19 nt, Homo sapiens
uaaguggaauucgucauua

SEQ ID NO: 1397048 - RNA, 19 nt, Homo sapiens
acagagaugucuugggaua

SEQ ID NO: 1397049 - RNA, 19 nt, Homo sapiens
gaagccaaaugccggaauu

SEQ ID NO: 1397050 - RNA, 19 nt, Homo sapiens
gaagagaaagcuuauaaag

SEQ ID NO: 1397051 - RNA, 19 nt, Homo sapiens
gaaagaagagaaagcuuau

SEQ ID NO: 1397052 - RNA, 19 nt, Homo sapiens
ugaaagaagagaaagcuua

SEQ ID NO: 1397053 - RNA, 19 nt, Homo sapiens
guagaaagcaacggcauua

SEQ ID NO: 1397054 - RNA, 19 nt, Homo sapiens
ggucagaagguuuagguua

SEQ ID NO: 1397055 - RNA, 19 nt, Homo sapiens
gcaggagaaugaagccaaa

SEQ ID NO: 1397056 - RNA, 19 nt, Homo sapiens
caagaggaaucauuguuuc

SEQ ID NO: 1397057 - RNA, 19 nt, Homo sapiens
caaggcgaauuauauuuga

SEQ ID NO: 1397058 - RNA, 19 nt, Homo sapiens
gaggaaucauuguuucuau

SEQ ID NO: 1397059 - RNA, 19 nt, Homo sapiens
caacaagauuacugauuuc

SEQ ID NO: 1397060 - RNA, 19 nt, Homo sapiens
cugaagaacuggauacaga

SEQ ID NO: 1397061 - RNA, 19 nt, Homo sapiens
gauuacugauuucccauuu

SEQ ID NO: 1397062 - RNA, 19 nt, Homo sapiens
cagggaaacuggaucuuga

SEQ ID NO: 1397063 - RNA, 19 nt, Homo sapiens
gaaaggaaacaaacguaug

SEQ ID NO: 1397064 - RNA, 19 nt, Homo sapiens
ugggugaccuucugaaauu

SEQ ID NO: 1397065 - RNA, 19 nt, Homo sapiens
aaacaaugguuaugaugug

SEQ ID NO: 1397066 - RNA, 19 nt, Homo sapiens
gaaacaaugguuaugaugu

SEQ ID NO: 1397067 - RNA, 19 nt, Homo sapiens
ccaaaugccggaauucaaa

SEQ ID NO: 1397068 - RNA, 19 nt, Homo sapiens
augcaaugcuuuaugguua

SEQ ID NO: 1397069 - RNA, 19 nt, Homo sapiens
ugaacaaggcgaauuauau

SEQ ID NO: 1397070 - RNA, 19 nt, Homo sapiens
ccaagaggaaucauuguuu

SEQ ID NO: 1397071 - RNA, 19 nt, Homo sapiens
caaguugggcuguuuaaga

SEQ ID NO: 1397072 - RNA, 19 nt, Homo sapiens
ggauaacuccuauaaaugg

SEQ ID NO: 1397073 - RNA, 19 nt, Homo sapiens
ugaagaugaugaaagagaa

SEQ ID NO: 1397074 - RNA, 19 nt, Homo sapiens
gaaaauauuccaugacuug

SEQ ID NO: 1397075 - RNA, 19 nt, Homo sapiens
ggaaaggaaacaaacguau

SEQ ID NO: 1397076 - RNA, 19 nt, Homo sapiens
ucaauugaaucccuaagau

SEQ ID NO: 1397077 - RNA, 19 nt, Homo sapiens
gucagaagguuuagguuau

SEQ ID NO: 1397078 - RNA, 19 nt, Homo sapiens
gaaugcagagaauuaugua

SEQ ID NO: 1397079 - RNA, 19 nt, Homo sapiens
uagcaccgcuuugaagauu

SEQ ID NO: 1397080 - RNA, 19 nt, Homo sapiens
agagaugucuugggauaaa

SEQ ID NO: 1397081 - RNA, 19 nt, Homo sapiens
cagaaacaaugguuaugau

SEQ ID NO: 1397082 - RNA, 19 nt, Homo sapiens
ccuugaagaugaugaaaga

SEQ ID NO: 1397083 - RNA, 19 nt, Homo sapiens
ggugguggauuucugucua

SEQ ID NO: 1397084 - RNA, 19 nt, Homo sapiens
uaaagaggguaaauaugca

SEQ ID NO: 1397085 - RNA, 19 nt, Homo sapiens
gauaaagaggguaaauaug

SEQ ID NO: 1397086 - RNA, 19 nt, Homo sapiens
gggauaaagaggguaaaua

SEQ ID NO: 1397087 - RNA, 19 nt, Homo sapiens
agauugcccuugaauuuga

SEQ ID NO: 1397088 - RNA, 19 nt, Homo sapiens
ggaaucauuguuucuauca

SEQ ID NO: 1397089 - RNA, 19 nt, Homo sapiens
gauauuccaguacaacauu

SEQ ID NO: 1397090 - RNA, 19 nt, Homo sapiens
aaguugggcuguuuaagaa

SEQ ID NO: 1397091 - RNA, 19 nt, Homo sapiens
gcuucaggauguaaauauu

SEQ ID NO: 1397092 - RNA, 19 nt, Homo sapiens
gagagagcuucaggaugua

SEQ ID NO: 1397093 - RNA, 19 nt, Homo sapiens
ugacgacugugcaggaaga

SEQ ID NO: 1397094 - RNA, 19 nt, Homo sapiens
ggaucuugauauuccagua

SEQ ID NO: 1397095 - RNA, 19 nt, Homo sapiens
ggaaacuggaucuugauau

SEQ ID NO: 1397096 - RNA, 19 nt, Homo sapiens
caugguugcucuugccaaa

SEQ ID NO: 1397097 - RNA, 19 nt, Homo sapiens
ugagaaccguguaccaugu

SEQ ID NO: 1397098 - RNA, 19 nt, Homo sapiens
gaagaacuggauacagaga

SEQ ID NO: 1397099 - RNA, 19 nt, Homo sapiens
gagccagugauuuacaaua

SEQ ID NO: 1397100 - RNA, 19 nt, Homo sapiens
gcaaucuguuggccucaau

SEQ ID NO: 1397101 - RNA, 19 nt, Homo sapiens
gaaauuugggaaugcaaug

SEQ ID NO: 1397102 - RNA, 19 nt, Homo sapiens
gagaauuauguaccucuaa

SEQ ID NO: 1397103 - RNA, 19 nt, Homo sapiens
gguuggaguuucuguagau

SEQ ID NO: 1397104 - RNA, 19 nt, Homo sapiens
ggauacagagacuauaaau

SEQ ID NO: 1397105 - RNA, 19 nt, Homo sapiens
ccagaaacaaugguuauga

SEQ ID NO: 1397106 - RNA, 19 nt, Homo sapiens
gggaaacuggaucuugaua

SEQ ID NO: 1397107 - RNA, 19 nt, Homo sapiens
gcagggaaacuggaucuug

SEQ ID NO: 1397108 - RNA, 19 nt, Homo sapiens
gaaacgucuugucaacaca

SEQ ID NO: 1397109 - RNA, 19 nt, Homo sapiens
gauuuacaauagagcaaga

SEQ ID NO: 1397110 - RNA, 19 nt, Homo sapiens
gcaaaagucucaccauggu

SEQ ID NO: 1397111 - RNA, 19 nt, Homo sapiens
gagaaccguguaccaugua

SEQ ID NO: 1397112 - RNA, 19 nt, Homo sapiens
ccucaaaccagaaacaaug

SEQ ID NO: 1397113 - RNA, 19 nt, Homo sapiens
guagagagagcuucaggau

SEQ ID NO: 1397114 - RNA, 19 nt, Homo sapiens
aaaacgagccagugauuua

SEQ ID NO: 1397115 - RNA, 19 nt, Homo sapiens
gaagaaaacgagccaguga

SEQ ID NO: 1397116 - RNA, 19 nt, Homo sapiens
gggcauagugguuggaguu

SEQ ID NO: 1397117 - RNA, 19 nt, Homo sapiens
ugauaaccuuaacaccaua

SEQ ID NO: 1397118 - RNA, 19 nt, Homo sapiens
ucagaagguuuagguuaug

SEQ ID NO: 1397119 - RNA, 19 nt, Homo sapiens
uuacguggauaacuccuau

SEQ ID NO: 1397120 - RNA, 19 nt, Homo sapiens
gccagugauuuacaauaga

SEQ ID NO: 1397121 - RNA, 19 nt, Homo sapiens
aaagguuucugucacaaca

SEQ ID NO: 1397122 - RNA, 19 nt, Homo sapiens
acucagggaaguaauuaua

SEQ ID NO: 1397123 - RNA, 19 nt, Homo sapiens
cagagacaguuaugcgaau

SEQ ID NO: 1397124 - RNA, 19 nt, Homo sapiens
gauaaagacagaucagacu

SEQ ID NO: 1397125 - RNA, 19 nt, Homo sapiens
gaggguaaauaugcaaugg

SEQ ID NO: 1397126 - RNA, 19 nt, Homo sapiens
gagcuucaggauguaaaua

SEQ ID NO: 1397127 - RNA, 19 nt, Homo sapiens
acaaggcgaauuauauuug

SEQ ID NO: 1397128 - RNA, 19 nt, Homo sapiens
ugguugcucuugccaaauu

SEQ ID NO: 1397129 - RNA, 19 nt, Homo sapiens
gaagaugaugaaagagaau

SEQ ID NO: 1397130 - RNA, 19 nt, Homo sapiens
cugauaaccuuaacaccau

SEQ ID NO: 1397131 - RNA, 19 nt, Homo sapiens
gcauagugguuggaguuuc

SEQ ID NO: 1397132 - RNA, 19 nt, Homo sapiens
caauagcaccgcuuugaag

SEQ ID NO: 1397133 - RNA, 19 nt, Homo sapiens
uggauaugcugacgacugu

SEQ ID NO: 1397134 - RNA, 19 nt, Homo sapiens
acaguuaugcgaauugcua

SEQ ID NO: 1397135 - RNA, 19 nt, Homo sapiens
cauagugguuggaguuucu

SEQ ID NO: 1397136 - RNA, 19 nt, Homo sapiens
gaacuggauacagagacua

SEQ ID NO: 1397137 - RNA, 19 nt, Homo sapiens
gaaacuggaucuugauauu

SEQ ID NO: 1397138 - RNA, 19 nt, Homo sapiens
gaacaaggcgaauuauauu

SEQ ID NO: 1397139 - RNA, 19 nt, Homo sapiens
aaacagagcaggagaauga

SEQ ID NO: 1397140 - RNA, 19 nt, Homo sapiens
uauaaagccuugaagauga

SEQ ID NO: 1397141 - RNA, 19 nt, Homo sapiens
agagagagcuucaggaugu

SEQ ID NO: 1397142 - RNA, 19 nt, Homo sapiens
uaaguggaauucgucauua

SEQ ID NO: 1397143 - RNA, 19 nt, Homo sapiens
cuagcuauaucgcaucuua

SEQ ID NO: 1397144 - RNA, 19 nt, Homo sapiens
gaagccaaaugccggaauu

SEQ ID NO: 1397145 - RNA, 19 nt, Homo sapiens
gaagagaaagcuuauaaag

SEQ ID NO: 1397146 - RNA, 19 nt, Homo sapiens
gaaagaagagaaagcuuau

SEQ ID NO: 1397147 - RNA, 19 nt, Homo sapiens
ugaaagaagagaaagcuua

SEQ ID NO: 1397148 - RNA, 19 nt, Homo sapiens
ggucagaagguuuagguua

SEQ ID NO: 1397149 - RNA, 19 nt, Homo sapiens
gcaggagaaugaagccaaa

SEQ ID NO: 1397150 - RNA, 19 nt, Homo sapiens
uaucgcaucuuaacacuau

SEQ ID NO: 1397151 - RNA, 19 nt, Homo sapiens
caaggcgaauuauauuuga

SEQ ID NO: 1397152 - RNA, 19 nt, Homo sapiens
caacaagauuacugauuuc

SEQ ID NO: 1397153 - RNA, 19 nt, Homo sapiens
agagcaagguaaaugaaua

SEQ ID NO: 1397154 - RNA, 19 nt, Homo sapiens
gauuacugauuucccauuu

SEQ ID NO: 1397155 - RNA, 19 nt, Homo sapiens
cagggaaacuggaucuuga

SEQ ID NO: 1397156 - RNA, 19 nt, Homo sapiens
ccaaaugccggaauucaaa

SEQ ID NO: 1397157 - RNA, 19 nt, Homo sapiens
ugaacaaggcgaauuauau

SEQ ID NO: 1397158 - RNA, 19 nt, Homo sapiens
ugaagaugaugaaagagaa

SEQ ID NO: 1397159 - RNA, 19 nt, Homo sapiens
gaaaauauuccaugacuug

SEQ ID NO: 1397160 - RNA, 19 nt, Homo sapiens
ucaauugaaucccuaagau

SEQ ID NO: 1397161 - RNA, 19 nt, Homo sapiens
gucagaagguuuagguuau

SEQ ID NO: 1397162 - RNA, 19 nt, Homo sapiens
ccuugaagaugaugaaaga

SEQ ID NO: 1397163 - RNA, 19 nt, Homo sapiens
gauauuccaguacaacauu

SEQ ID NO: 1397164 - RNA, 19 nt, Homo sapiens
uuucucaucuguaaaguga

SEQ ID NO: 1397165 - RNA, 19 nt, Homo sapiens
gcuucaggauguaaauauu

SEQ ID NO: 1397166 - RNA, 19 nt, Homo sapiens
gagagagcuucaggaugua

SEQ ID NO: 1397167 - RNA, 19 nt, Homo sapiens
ugacgacugugcaggaaga

SEQ ID NO: 1397168 - RNA, 19 nt, Homo sapiens
ggaucuugauauuccagua

SEQ ID NO: 1397169 - RNA, 19 nt, Homo sapiens
ggaaacuggaucuugauau

SEQ ID NO: 1397170 - RNA, 19 nt, Homo sapiens
caugguugcucuugccaaa

SEQ ID NO: 1397171 - RNA, 19 nt, Homo sapiens
guaaagugaaggaaguaaa

SEQ ID NO: 1397172 - RNA, 19 nt, Homo sapiens
gagccagugauuuacaaua

SEQ ID NO: 1397173 - RNA, 19 nt, Homo sapiens
ugagaaccguguaccaugu

SEQ ID NO: 1397174 - RNA, 19 nt, Homo sapiens
caauagagcaagguaaaug

SEQ ID NO: 1397175 - RNA, 19 nt, Homo sapiens
gguuggaguuucuguagau

SEQ ID NO: 1397176 - RNA, 19 nt, Homo sapiens
gggaaacuggaucuugaua

SEQ ID NO: 1397177 - RNA, 19 nt, Homo sapiens
gcagggaaacuggaucuug

SEQ ID NO: 1397178 - RNA, 19 nt, Homo sapiens
gcaaaagucucaccauggu

SEQ ID NO: 1397179 - RNA, 19 nt, Homo sapiens
guagagagagcuucaggau

SEQ ID NO: 1397180 - RNA, 19 nt, Homo sapiens
gagaaccguguaccaugua

SEQ ID NO: 1397181 - RNA, 19 nt, Homo sapiens
aaaacgagccagugauuua

SEQ ID NO: 1397182 - RNA, 19 nt, Homo sapiens
gaagaaaacgagccaguga

SEQ ID NO: 1397183 - RNA, 19 nt, Homo sapiens
gggcauagugguuggaguu

SEQ ID NO: 1397184 - RNA, 19 nt, Homo sapiens
gccagugauuuacaauaga

SEQ ID NO: 1397185 - RNA, 19 nt, Homo sapiens
aaagguuucugucacaaca

SEQ ID NO: 1397186 - RNA, 19 nt, Homo sapiens
ucagaagguuuagguuaug

SEQ ID NO: 1397187 - RNA, 19 nt, Homo sapiens
cuacaugucuguuuucuca

SEQ ID NO: 1397188 - RNA, 19 nt, Homo sapiens
gagcuucaggauguaaaua

SEQ ID NO: 1397189 - RNA, 19 nt, Homo sapiens
acaaggcgaauuauauuug

SEQ ID NO: 1397190 - RNA, 19 nt, Homo sapiens
ugguugcucuugccaaauu

SEQ ID NO: 1397191 - RNA, 19 nt, Homo sapiens
cagagacaguuaugcgaau

SEQ ID NO: 1397192 - RNA, 19 nt, Homo sapiens
uacaauagagcaagguaaa

SEQ ID NO: 1397193 - RNA, 19 nt, Homo sapiens
gaagaugaugaaagagaau

SEQ ID NO: 1397194 - RNA, 19 nt, Homo sapiens
gcauagugguuggaguuuc

SEQ ID NO: 1397195 - RNA, 19 nt, Homo sapiens
uggauaugcugacgacugu

SEQ ID NO: 1397196 - RNA, 19 nt, Homo sapiens
cauagugguuggaguuucu

SEQ ID NO: 1397197 - RNA, 19 nt, Homo sapiens
acaguuaugcgaauugcua

SEQ ID NO: 1397198 - RNA, 19 nt, Homo sapiens
ccagugauuuacaauagag

SEQ ID NO: 1397199 - RNA, 19 nt, Homo sapiens
gcugacgacugugcaggaa

SEQ ID NO: 1397200 - RNA, 19 nt, Homo sapiens
gugcagagacgccauguac

SEQ ID NO: 1397201 - RNA, 19 nt, Homo sapiens
gaugaaagagaauguugca

SEQ ID NO: 1397202 - RNA, 19 nt, Homo sapiens
uuauaaagccuugaagaug

SEQ ID NO: 1397203 - RNA, 19 nt, Homo sapiens
uuaaguggaauucgucauu

SEQ ID NO: 1397204 - RNA, 19 nt, Homo sapiens
gagcaagguaaaugaauac

SEQ ID NO: 1397205 - RNA, 19 nt, Homo sapiens
gccaaaugccggaauucaa

SEQ ID NO: 1397206 - RNA, 19 nt, Homo sapiens
uguaaaccagagacaguua

SEQ ID NO: 1397207 - RNA, 19 nt, Homo sapiens
guaaaccagagacaguuau

SEQ ID NO: 1397208 - RNA, 19 nt, Homo sapiens
gaaccguguaccauguaaa

SEQ ID NO: 1397209 - RNA, 19 nt, Homo sapiens
cuucugcugugucuagcua

SEQ ID NO: 1397210 - RNA, 19 nt, Homo sapiens
aaaggugaaagaagagaaa

SEQ ID NO: 1397211 - RNA, 19 nt, Homo sapiens
agagacaguuaugcgaauu

SEQ ID NO: 1397212 - RNA, 19 nt, Homo sapiens
cacaacaagauuacugauu

SEQ ID NO: 1397213 - RNA, 19 nt, Homo sapiens
gagacaguuaugcgaauug

SEQ ID NO: 1397214 - RNA, 19 nt, Homo sapiens
gaaaacgagccagugauuu

SEQ ID NO: 1397215 - RNA, 19 nt, Homo sapiens
agaaccguguaccauguaa

SEQ ID NO: 1397216 - RNA, 19 nt, Homo sapiens
ggagaaugaagccaaaugc

SEQ ID NO: 1397217 - RNA, 19 nt, Homo sapiens
ccauuuaaguggaauucgu

SEQ ID NO: 1397218 - RNA, 19 nt, Homo sapiens
ggaagcagggaaacuggau

SEQ ID NO: 1397219 - RNA, 19 nt, Homo sapiens
ucuguaaagugaaggaagu

SEQ ID NO: 1397220 - RNA, 19 nt, Homo sapiens
agccagugauuuacaauag

SEQ ID NO: 1397221 - RNA, 19 nt, Homo sapiens
uagguuaugcugauguuga

SEQ ID NO: 1397222 - RNA, 19 nt, Homo sapiens
guauucaacuuuuggcuau

SEQ ID NO: 1397223 - RNA, 19 nt, Homo sapiens
gaaggcaaaaguaaugaaa

SEQ ID NO: 1397224 - RNA, 19 nt, Homo sapiens
auaaagccuugaagaugau

SEQ ID NO: 1397225 - RNA, 19 nt, Homo sapiens
guucccgaauucccagaaa

SEQ ID NO: 1397226 - RNA, 19 nt, Homo sapiens
aauagagcaagguaaauga

SEQ ID NO: 1397227 - RNA, 19 nt, Homo sapiens
ugcacaggaucaaggauga

SEQ ID NO: 1397228 - RNA, 19 nt, Homo sapiens
aaaugauccuuuguucuuc

SEQ ID NO: 1397229 - RNA, 19 nt, Homo sapiens
uggaguuucuguagaugga

SEQ ID NO: 1397230 - RNA, 19 nt, Homo sapiens
gaugaugaaagagaauguu

SEQ ID NO: 1397231 - RNA, 19 nt, Homo sapiens
aaguggaauucgucauuau

SEQ ID NO: 1397232 - RNA, 19 nt, Homo sapiens
ucugcugugucuagcuaua

SEQ ID NO: 1397233 - RNA, 19 nt, Homo sapiens
ugaauaccuucugcugugu

SEQ ID NO: 1397234 - RNA, 19 nt, Homo sapiens
cggcucaugucagcaguga

SEQ ID NO: 1397235 - RNA, 19 nt, Homo sapiens
uugaacaaggcgaauuaua

SEQ ID NO: 1397236 - RNA, 19 nt, Homo sapiens
ugaaggaaguaaaacaugu

SEQ ID NO: 1397237 - RNA, 19 nt, Homo sapiens
uagaagagcuuauucagaa

SEQ ID NO: 1397238 - RNA, 19 nt, Homo sapiens
ggauggagaugcaguaaau

SEQ ID NO: 1397239 - RNA, 19 nt, Homo sapiens
guacauaagucuaggaaag

SEQ ID NO: 1397240 - RNA, 19 nt, Homo sapiens
ucagaaggcuggacaauca

SEQ ID NO: 1397241 - RNA, 19 nt, Homo sapiens
gcacaaaggauguagaaga

SEQ ID NO: 1397242 - RNA, 19 nt, Homo sapiens
guaccaaaguaguguauga

SEQ ID NO: 1397243 - RNA, 19 nt, Homo sapiens
gaaagaggcagacugaaau

SEQ ID NO: 1397244 - RNA, 19 nt, Homo sapiens
gaaaggagucaaagucuau

SEQ ID NO: 1397245 - RNA, 19 nt, Homo sapiens
ggaaauuaauguggagaaa

SEQ ID NO: 1397246 - RNA, 19 nt, Homo sapiens
gaaauacaaacgcuagaaa

SEQ ID NO: 1397247 - RNA, 19 nt, Homo sapiens
gagcaaaucauccuagaga

SEQ ID NO: 1397248 - RNA, 19 nt, Homo sapiens
ggagaaagacaaacaaaca

SEQ ID NO: 1397249 - RNA, 19 nt, Homo sapiens
gcaaaucauccuagagaaa

SEQ ID NO: 1397250 - RNA, 19 nt, Homo sapiens
gaggcagacugaaauagaa

SEQ ID NO: 1397251 - RNA, 19 nt, Homo sapiens
uacaaacgcuagaaaguga

SEQ ID NO: 1397252 - RNA, 19 nt, Homo sapiens
gaggaugaguucagaguca

SEQ ID NO: 1397253 - RNA, 19 nt, Homo sapiens
gaacgcggcugagcuugug

SEQ ID NO: 1397254 - RNA, 19 nt, Homo sapiens
gaacacaugcucugcaaag

SEQ ID NO: 1397255 - RNA, 19 nt, Homo sapiens
ccaauccucuguucacgaa

SEQ ID NO: 1397256 - RNA, 19 nt, Homo sapiens
gagucaaagucuaugauga

SEQ ID NO: 1397257 - RNA, 19 nt, Homo sapiens
gaagagagccuagcuacag

SEQ ID NO: 1397258 - RNA, 19 nt, Homo sapiens
gaauugguccucauugaug

SEQ ID NO: 1397259 - RNA, 19 nt, Homo sapiens
gaaaugguacauaagucua

SEQ ID NO: 1397260 - RNA, 19 nt, Homo sapiens
cugcaaagaagcuaaguua

SEQ ID NO: 1397261 - RNA, 19 nt, Homo sapiens
ccaaagugcuucgggagaa

SEQ ID NO: 1397262 - RNA, 19 nt, Homo sapiens
gaucagcccgucaccauga

SEQ ID NO: 1397263 - RNA, 19 nt, Homo sapiens
aaauggagugcacaaauua

SEQ ID NO: 1397264 - RNA, 19 nt, Homo sapiens
agaaaggagucaaagucua

SEQ ID NO: 1397265 - RNA, 19 nt, Homo sapiens
aaagaaagaggcagacuga

SEQ ID NO: 1397266 - RNA, 19 nt, Homo sapiens
caaagucuaugaugauggu

SEQ ID NO: 1397267 - RNA, 19 nt, Homo sapiens
ucaaugcuguguugucaug

SEQ ID NO: 1397268 - RNA, 19 nt, Homo sapiens
gaggagggcacgugucuga

SEQ ID NO: 1397269 - RNA, 19 nt, Homo sapiens
agaaagaggcagacugaaa

SEQ ID NO: 1397270 - RNA, 19 nt, Homo sapiens
ccaagauucucucuacauc

SEQ ID NO: 1397271 - RNA, 19 nt, Homo sapiens
gaaacugaaggaaacagaa

SEQ ID NO: 1397272 - RNA, 19 nt, Homo sapiens
uagagaaacugaaggaaac

SEQ ID NO: 1397273 - RNA, 19 nt, Homo sapiens
gugcuaggcuaugaugaaa

SEQ ID NO: 1397274 - RNA, 19 nt, Homo sapiens
ggagggcacgugucugaaa

SEQ ID NO: 1397275 - RNA, 19 nt, Homo sapiens
guagaagagcuuauucaga

SEQ ID NO: 1397276 - RNA, 19 nt, Homo sapiens
gaggcuggagcaagaaaua

SEQ ID NO: 1397277 - RNA, 19 nt, Homo sapiens
caaagugcuucgggagaaa

SEQ ID NO: 1397278 - RNA, 19 nt, Homo sapiens
ugaugaagaugaugagaag

SEQ ID NO: 1397279 - RNA, 19 nt, Homo sapiens
cacaaaggauguagaagag

SEQ ID NO: 1397280 - RNA, 19 nt, Homo sapiens
agaccaagauucucucuac

SEQ ID NO: 1397281 - RNA, 19 nt, Homo sapiens
gcaacuugaagauaacauu

SEQ ID NO: 1397282 - RNA, 19 nt, Homo sapiens
caaauuaagcacaaaggau

SEQ ID NO: 1397283 - RNA, 19 nt, Homo sapiens
ccacuucuuucuucuccuu

SEQ ID NO: 1397284 - RNA, 19 nt, Homo sapiens
aaagaggcagacugaaaua

SEQ ID NO: 1397285 - RNA, 19 nt, Homo sapiens
cuagagaaacugaaggaaa

SEQ ID NO: 1397286 - RNA, 19 nt, Homo sapiens
cugaauugguccucauuga

SEQ ID NO: 1397287 - RNA, 19 nt, Homo sapiens
ugaaaggacugugauugca

SEQ ID NO: 1397288 - RNA, 19 nt, Homo sapiens
aaaauggagugcacaaauu

SEQ ID NO: 1397289 - RNA, 19 nt, Homo sapiens
ccucagccaucccaaggaa

SEQ ID NO: 1397290 - RNA, 19 nt, Homo sapiens
ggauguagaagagcuuauu

SEQ ID NO: 1397291 - RNA, 19 nt, Homo sapiens
gaaaauggagugcacaaau

SEQ ID NO: 1397292 - RNA, 19 nt, Homo sapiens
ugaugaugguaccaaagua

SEQ ID NO: 1397293 - RNA, 19 nt, Homo sapiens
uguacgccauggaaauuaa

SEQ ID NO: 1397294 - RNA, 19 nt, Homo sapiens
aaacugaaggaaacagaaa

SEQ ID NO: 1397295 - RNA, 19 nt, Homo sapiens
ggagucaaagucuaugaug

SEQ ID NO: 1397296 - RNA, 19 nt, Homo sapiens
gcacaaauuaagcacaaag

SEQ ID NO: 1397297 - RNA, 19 nt, Homo sapiens
gaccaagauucucucuaca

SEQ ID NO: 1397298 - RNA, 19 nt, Homo sapiens
gaaauuaauguggagaaag

SEQ ID NO: 1397299 - RNA, 19 nt, Homo sapiens
ugaagaugaugagaaguca

SEQ ID NO: 1397300 - RNA, 19 nt, Homo sapiens
cacaugcucugcaaagaag

SEQ ID NO: 1397301 - RNA, 19 nt, Homo sapiens
gagggcacgugucugaaag

SEQ ID NO: 1397302 - RNA, 19 nt, Homo sapiens
ggaggcaccguaguagaaa

SEQ ID NO: 1397303 - RNA, 19 nt, Homo sapiens
cagagcggcugcuguguac

SEQ ID NO: 1397304 - RNA, 19 nt, Homo sapiens
ggaggcggcagucugaaga

SEQ ID NO: 1397305 - RNA, 19 nt, Homo sapiens
uagaaaugguacauaaguc

SEQ ID NO: 1397306 - RNA, 19 nt, Homo sapiens
ucagaaaggagucaaaguc

SEQ ID NO: 1397307 - RNA, 19 nt, Homo sapiens
caaagagcaaaucauccua

SEQ ID NO: 1397308 - RNA, 19 nt, Homo sapiens
caacuugaagauaacauuc

SEQ ID NO: 1397309 - RNA, 19 nt, Homo sapiens
ugugaccacuucuuucuuc

SEQ ID NO: 1397310 - RNA, 19 nt, Homo sapiens
ugucaaugcuguguuguca

SEQ ID NO: 1397311 - RNA, 19 nt, Homo sapiens
aagagagccuagcuacaga

SEQ ID NO: 1397312 - RNA, 19 nt, Homo sapiens
ggugcuaggcuaugaugaa

SEQ ID NO: 1397313 - RNA, 19 nt, Homo sapiens
gggcauacccgcuggaacu

SEQ ID NO: 1397314 - RNA, 19 nt, Homo sapiens
gcuggacaaucaagcuuag

SEQ ID NO: 1397315 - RNA, 19 nt, Homo sapiens
ggaagagagccuagcuaca

SEQ ID NO: 1397316 - RNA, 19 nt, Homo sapiens
auggagaugcaguaaauua

SEQ ID NO: 1397317 - RNA, 19 nt, Homo sapiens
acacaugcucugcaaagaa

SEQ ID NO: 1397318 - RNA, 19 nt, Homo sapiens
gaugaugguaccaaaguag

SEQ ID NO: 1397319 - RNA, 19 nt, Homo sapiens
gucaaagucuaugaugaug

SEQ ID NO: 1397320 - RNA, 19 nt, Homo sapiens
caggagagaccaagauucu

SEQ ID NO: 1397321 - RNA, 19 nt, Homo sapiens
aagagcaaaucauccuaga

SEQ ID NO: 1397322 - RNA, 19 nt, Homo sapiens
gugaagagucccagauauc

SEQ ID NO: 1397323 - RNA, 19 nt, Homo sapiens
ggaacgcggcugagcuugu

SEQ ID NO: 1397324 - RNA, 19 nt, Homo sapiens
ggaugaagaggagacgaaa

SEQ ID NO: 1397325 - RNA, 19 nt, Homo sapiens
uuuaugggcuaccaaaaua

SEQ ID NO: 1397326 - RNA, 19 nt, Homo sapiens
gggcacgugucugaaagga

SEQ ID NO: 1397327 - RNA, 19 nt, Homo sapiens
gaaggaagagagccuagcu

SEQ ID NO: 1397328 - RNA, 19 nt, Homo sapiens
ggagugcacaaauuaagca

SEQ ID NO: 1397329 - RNA, 19 nt, Homo sapiens
cuaugaugaugguaccaaa

SEQ ID NO: 1397330 - RNA, 19 nt, Homo sapiens
gagaaagacaaacaaacag

SEQ ID NO: 1397331 - RNA, 19 nt, Homo sapiens
caaaucauccuagagaaac

SEQ ID NO: 1397332 - RNA, 19 nt, Homo sapiens
agugaagagucccagauau

SEQ ID NO: 1397333 - RNA, 19 nt, Homo sapiens
gcggcagucugaagaggau

SEQ ID NO: 1397334 - RNA, 19 nt, Homo sapiens
aaacaggagagaccaagau

SEQ ID NO: 1397335 - RNA, 19 nt, Homo sapiens
agaggcagacugaaauaga

SEQ ID NO: 1397336 - RNA, 19 nt, Homo sapiens
gauggcagaggcggaauug

SEQ ID NO: 1397337 - RNA, 19 nt, Homo sapiens
caaagaggcugcugcuguu

SEQ ID NO: 1397338 - RNA, 19 nt, Homo sapiens
gaagauaucccgcuaagag

SEQ ID NO: 1397339 - RNA, 19 nt, Homo sapiens
gcucucagcugucaaugug

SEQ ID NO: 1397340 - RNA, 19 nt, Homo sapiens
gagagagacaugucaaaga

SEQ ID NO: 1397341 - RNA, 19 nt, Homo sapiens
caauaaaggcuucucaauc

SEQ ID NO: 1397342 - RNA, 19 nt, Homo sapiens
gaacugcaucugagagaga

SEQ ID NO: 1397343 - RNA, 19 nt, Homo sapiens
aauaaaggcuucucaaucc

SEQ ID NO: 1397344 - RNA, 19 nt, Homo sapiens
agagagacaugucaaagag

SEQ ID NO: 1397345 - RNA, 19 nt, Homo sapiens
ccacggagacucaauuuac

SEQ ID NO: 1397346 - RNA, 19 nt, Homo sapiens
ucaauuuacuuuccauguc

SEQ ID NO: 1397347 - RNA, 19 nt, Homo sapiens
gagagagagcagccaauug

SEQ ID NO: 1397348 - RNA, 19 nt, Homo sapiens
cggaagauaucccgcuaag

SEQ ID NO: 1397349 - RNA, 19 nt, Homo sapiens
gauaucccgcuaagagaga

SEQ ID NO: 1397350 - RNA, 19 nt, Homo sapiens
ugagagagagcagccaauu

SEQ ID NO: 1397351 - RNA, 19 nt, Homo sapiens
uaagagagagacaugucaa

SEQ ID NO: 1397352 - RNA, 19 nt, Homo sapiens
agagagagcagccaauugg

SEQ ID NO: 1397353 - RNA, 19 nt, Homo sapiens
ucccagugcuugcggaaga

SEQ ID NO: 1397354 - RNA, 19 nt, Homo sapiens
acaauaaaggcuucucaau

SEQ ID NO: 1397355 - RNA, 19 nt, Homo sapiens
gagacucaauuuacuuucc

SEQ ID NO: 1397356 - RNA, 19 nt, Homo sapiens
cggagacucaauuuacuuu

SEQ ID NO: 1397357 - RNA, 19 nt, Homo sapiens
gggaacugcaucugagaga

SEQ ID NO: 1397358 - RNA, 19 nt, Homo sapiens
gcuaagagagagacauguc

SEQ ID NO: 1397359 - RNA, 19 nt, Homo sapiens
gaaggggaacugcaucuga

SEQ ID NO: 1397360 - RNA, 19 nt, Homo sapiens
ccacaauaaaggcuucuca

SEQ ID NO: 1397361 - RNA, 19 nt, Homo sapiens
ccgauccucccacaauaaa

SEQ ID NO: 1397362 - RNA, 19 nt, Homo sapiens
ccaauuggguccgcugacu

SEQ ID NO: 1397363 - RNA, 19 nt, Homo sapiens
gauccucccacaauaaagg

SEQ ID NO: 1397364 - RNA, 19 nt, Homo sapiens
ggaagauaucccgcuaaga

SEQ ID NO: 1397365 - RNA, 19 nt, Homo sapiens
cacggagacucaauuuacu

SEQ ID NO: 1397366 - RNA, 19 nt, Homo sapiens
cgucaacaccaccaucugu

SEQ ID NO: 1397367 - RNA, 19 nt, Homo sapiens
agacucaauuuacuuucca

SEQ ID NO: 1397368 - RNA, 19 nt, Homo sapiens
cacaauaaaggcuucucaa

SEQ ID NO: 1397369 - RNA, 19 nt, Homo sapiens
ggagacucaauuuacuuuc

SEQ ID NO: 1397370 - RNA, 19 nt, Homo sapiens
gaagauaucccgcuaagag

SEQ ID NO: 1397371 - RNA, 19 nt, Homo sapiens
gcucucagcugucaaugug

SEQ ID NO: 1397372 - RNA, 19 nt, Homo sapiens
caauaaaggcuucucaauc

SEQ ID NO: 1397373 - RNA, 19 nt, Homo sapiens
aauaaaggcuucucaaucc

SEQ ID NO: 1397374 - RNA, 19 nt, Homo sapiens
ccacggagacucaauuuac

SEQ ID NO: 1397375 - RNA, 19 nt, Homo sapiens
ucaauuuacuuuccauguc

SEQ ID NO: 1397376 - RNA, 19 nt, Homo sapiens
gaacuguaucugagagaga

SEQ ID NO: 1397377 - RNA, 19 nt, Homo sapiens
gagagagagcagccaauug

SEQ ID NO: 1397378 - RNA, 19 nt, Homo sapiens
caaaggggcugcugcuguu

SEQ ID NO: 1397379 - RNA, 19 nt, Homo sapiens
cggaagauaucccgcuaag

SEQ ID NO: 1397380 - RNA, 19 nt, Homo sapiens
gagagagacaugucaaagg

SEQ ID NO: 1397381 - RNA, 19 nt, Homo sapiens
gauaucccgcuaagagaga

SEQ ID NO: 1397382 - RNA, 19 nt, Homo sapiens
ugagagagagcagccaauu

SEQ ID NO: 1397383 - RNA, 19 nt, Homo sapiens
uaagagagagacaugucaa

SEQ ID NO: 1397384 - RNA, 19 nt, Homo sapiens
agagagagcagccaauugg

SEQ ID NO: 1397385 - RNA, 19 nt, Homo sapiens
acaauaaaggcuucucaau

SEQ ID NO: 1397386 - RNA, 19 nt, Homo sapiens
gagacucaauuuacuuucc

SEQ ID NO: 1397387 - RNA, 19 nt, Homo sapiens
gaaggggaacuguaucuga

SEQ ID NO: 1397388 - RNA, 19 nt, Homo sapiens
cggagacucaauuuacuuu

SEQ ID NO: 1397389 - RNA, 19 nt, Homo sapiens
gcuaagagagagacauguc

SEQ ID NO: 1397390 - RNA, 19 nt, Homo sapiens
ccacaauaaaggcuucuca

SEQ ID NO: 1397391 - RNA, 19 nt, Homo sapiens
ccgauccucccacaauaaa

SEQ ID NO: 1397392 - RNA, 19 nt, Homo sapiens
ccaauuggguccgcugacu

SEQ ID NO: 1397393 - RNA, 19 nt, Homo sapiens
ggaggaaggggaacuguau

SEQ ID NO: 1397394 - RNA, 19 nt, Homo sapiens
gauccucccacaauaaagg

SEQ ID NO: 1397395 - RNA, 19 nt, Homo sapiens
ggaagauaucccgcuaaga

SEQ ID NO: 1397396 - RNA, 19 nt, Homo sapiens
cacggagacucaauuuacu

SEQ ID NO: 1397397 - RNA, 19 nt, Homo sapiens
cgucaacaccaccaucugu

SEQ ID NO: 1397398 - RNA, 19 nt, Homo sapiens
agacucaauuuacuuucca

SEQ ID NO: 1397399 - RNA, 19 nt, Homo sapiens
cacaauaaaggcuucucaa

SEQ ID NO: 1397400 - RNA, 19 nt, Homo sapiens
ggagacucaauuuacuuuc

SEQ ID NO: 1397401 - RNA, 19 nt, Homo sapiens
ggagagaccuuuaugagaa

SEQ ID NO: 1397402 - RNA, 19 nt, Homo sapiens
gaaauuaaguugcaagauc

SEQ ID NO: 1397403 - RNA, 19 nt, Homo sapiens
gaaauggauugaagugaaa

SEQ ID NO: 1397404 - RNA, 19 nt, Homo sapiens
gaaaacagcugcagaugaa

SEQ ID NO: 1397405 - RNA, 19 nt, Homo sapiens
gaaaagggguauuugauuu

SEQ ID NO: 1397406 - RNA, 19 nt, Homo sapiens
gaagacaccaggacaauga

SEQ ID NO: 1397407 - RNA, 19 nt, Homo sapiens
ccacaugguuucuuccuuu

SEQ ID NO: 1397408 - RNA, 19 nt, Homo sapiens
gagaagaaauuaaguugca

SEQ ID NO: 1397409 - RNA, 19 nt, Homo sapiens
ugaaauggauugaagugaa

SEQ ID NO: 1397410 - RNA, 19 nt, Homo sapiens
caucacagcgccucaguua

SEQ ID NO: 1397411 - RNA, 19 nt, Homo sapiens
gaggaauagugaagaguuu

SEQ ID NO: 1397412 - RNA, 19 nt, Homo sapiens
gcugcaagcuggccaggua

SEQ ID NO: 1397413 - RNA, 19 nt, Homo sapiens
gauguggacuugaagaaau

SEQ ID NO: 1397414 - RNA, 19 nt, Homo sapiens
ggaucaaacuacucuguga

SEQ ID NO: 1397415 - RNA, 19 nt, Homo sapiens
ccaagaauccacaguguaa

SEQ ID NO: 1397416 - RNA, 19 nt, Homo sapiens
aaagggccauggacuauuu

SEQ ID NO: 1397417 - RNA, 19 nt, Homo sapiens
gagagaccuuuaugagaaa

SEQ ID NO: 1397418 - RNA, 19 nt, Homo sapiens
ggagagagcugcgauccau

SEQ ID NO: 1397419 - RNA, 19 nt, Homo sapiens
ucaaguacuucucugauga

SEQ ID NO: 1397420 - RNA, 19 nt, Homo sapiens
gugaagaguuuguccaaug

SEQ ID NO: 1397421 - RNA, 19 nt, Homo sapiens
caagaucucucagcaaauc

SEQ ID NO: 1397422 - RNA, 19 nt, Homo sapiens
ggaugagaguguuguguga

SEQ ID NO: 1397423 - RNA, 19 nt, Homo sapiens
gaagugaaagccaaagcua

SEQ ID NO: 1397424 - RNA, 19 nt, Homo sapiens
ggaaaacuauggcaaauuc

SEQ ID NO: 1397425 - RNA, 19 nt, Homo sapiens
ccaggaagaugauguugga

SEQ ID NO: 1397426 - RNA, 19 nt, Homo sapiens
gaucuugcaucaguauuga

SEQ ID NO: 1397427 - RNA, 19 nt, Homo sapiens
guacucagcacuaaucaga

SEQ ID NO: 1397428 - RNA, 19 nt, Homo sapiens
cauccuggcuguaacauuc

SEQ ID NO: 1397429 - RNA, 19 nt, Homo sapiens
gcaaagggccauggacuau

SEQ ID NO: 1397430 - RNA, 19 nt, Homo sapiens
gaggaggacuucgugcaaa

SEQ ID NO: 1397431 - RNA, 19 nt, Homo sapiens
guaagcauuuggcuaacuu

SEQ ID NO: 1397432 - RNA, 19 nt, Homo sapiens
ucacagcgccucaguuaga

SEQ ID NO: 1397433 - RNA, 19 nt, Homo sapiens
gcuguggccucucgcauga

SEQ ID NO: 1397434 - RNA, 19 nt, Homo sapiens
gaauuguucuacuguuugu

SEQ ID NO: 1397435 - RNA, 19 nt, Homo sapiens
ggcuggagcugcugaaaug

SEQ ID NO: 1397436 - RNA, 19 nt, Homo sapiens
gaaguggacugcgagaagu

SEQ ID NO: 1397437 - RNA, 19 nt, Homo sapiens
ugcaagaucucucagcaaa

SEQ ID NO: 1397438 - RNA, 19 nt, Homo sapiens
guaagaaguacagaaagua

SEQ ID NO: 1397439 - RNA, 19 nt, Homo sapiens
gccagagucuaacugaauu

SEQ ID NO: 1397440 - RNA, 19 nt, Homo sapiens
uuggugaccucauguaauu

SEQ ID NO: 1397441 - RNA, 19 nt, Homo sapiens
guuagaaacacuucaagaa

SEQ ID NO: 1397442 - RNA, 19 nt, Homo sapiens
uggaguaccuuucgagaau

SEQ ID NO: 1397443 - RNA, 19 nt, Homo sapiens
gcuguaacauucggagauu

SEQ ID NO: 1397444 - RNA, 19 nt, Homo sapiens
ggaauuguucuacuguuug

SEQ ID NO: 1397445 - RNA, 19 nt, Homo sapiens
uggaauuguucuacuguuu

SEQ ID NO: 1397446 - RNA, 19 nt, Homo sapiens
ugaagaguuuguccaaugu

SEQ ID NO: 1397447 - RNA, 19 nt, Homo sapiens
caacaggagagaccuuuau

SEQ ID NO: 1397448 - RNA, 19 nt, Homo sapiens
gugcagagcuugggcaucu

SEQ ID NO: 1397449 - RNA, 19 nt, Homo sapiens
ugaagaagcucugguuggu

SEQ ID NO: 1397450 - RNA, 19 nt, Homo sapiens
ggaccucagugacaauucu

SEQ ID NO: 1397451 - RNA, 19 nt, Homo sapiens
gaguuuguccaaugucaua

SEQ ID NO: 1397452 - RNA, 19 nt, Homo sapiens
caagacagguuugacuauc

SEQ ID NO: 1397453 - RNA, 19 nt, Homo sapiens
gcaagaccaagacguguga

SEQ ID NO: 1397454 - RNA, 19 nt, Homo sapiens
cguaagaaguacagaaagu

SEQ ID NO: 1397455 - RNA, 19 nt, Homo sapiens
gaagugggguucagauaau

SEQ ID NO: 1397456 - RNA, 19 nt, Homo sapiens
gaaggcagaccauguggau

SEQ ID NO: 1397457 - RNA, 19 nt, Homo sapiens
ggagugcaguggcgugauc

SEQ ID NO: 1397458 - RNA, 19 nt, Homo sapiens
gcagaaggcggaugugucu

SEQ ID NO: 1397459 - RNA, 19 nt, Homo sapiens
gagcuugggcaucuccuuu

SEQ ID NO: 1397460 - RNA, 19 nt, Homo sapiens
gaauuggaccucagugaca

SEQ ID NO: 1397461 - RNA, 19 nt, Homo sapiens
ggaaguggacugcgagaag

SEQ ID NO: 1397462 - RNA, 19 nt, Homo sapiens
cgugugcacuggacugaaa

SEQ ID NO: 1397463 - RNA, 19 nt, Homo sapiens
uggagaaacugcagcacuu

SEQ ID NO: 1397464 - RNA, 19 nt, Homo sapiens
agauggaguugcuguuuga

SEQ ID NO: 1397465 - RNA, 19 nt, Homo sapiens
ucaaagugcugggauuaca

SEQ ID NO: 1397466 - RNA, 19 nt, Homo sapiens
gcugggaucuuuccacacu

SEQ ID NO: 1397467 - RNA, 19 nt, Homo sapiens
cagaaucucacgcaccuuu

SEQ ID NO: 1397468 - RNA, 19 nt, Homo sapiens
gagaaugccuugggagacu

SEQ ID NO: 1397469 - RNA, 19 nt, Homo sapiens
guauugagcaccagccauu

SEQ ID NO: 1397470 - RNA, 19 nt, Homo sapiens
ggaccgcucugcacugacu

SEQ ID NO: 1397471 - RNA, 19 nt, Homo sapiens
uaagauggaguugcuguuu

SEQ ID NO: 1397472 - RNA, 19 nt, Homo sapiens
gaucuuuccacacuucuga

SEQ ID NO: 1397473 - RNA, 19 nt, Homo sapiens
gucaggaucuugcaucagu

SEQ ID NO: 1397474 - RNA, 19 nt, Homo sapiens
uguacuaccugcuggaaga

SEQ ID NO: 1397475 - RNA, 19 nt, Homo sapiens
guguacgucuucuuccuuu

SEQ ID NO: 1397476 - RNA, 19 nt, Homo sapiens
uggaggaccuggaggaugu

SEQ ID NO: 1397477 - RNA, 19 nt, Homo sapiens
caccacacccggcucauuu

SEQ ID NO: 1397478 - RNA, 19 nt, Homo sapiens
auacaauccuguuuaugga

SEQ ID NO: 1397479 - RNA, 19 nt, Homo sapiens
cuacuuggagaagaaauua

SEQ ID NO: 1397480 - RNA, 19 nt, Homo sapiens
uguuguacguuuccucuuu

SEQ ID NO: 1397481 - RNA, 19 nt, Homo sapiens
ucagauaaugcacguguuu

SEQ ID NO: 1397482 - RNA, 19 nt, Homo sapiens
ggaggaggacuucgugcaa

SEQ ID NO: 1397483 - RNA, 19 nt, Homo sapiens
uggaggauguggacuugaa

SEQ ID NO: 1397484 - RNA, 19 nt, Homo sapiens
uccacaagaucgugagaaa

SEQ ID NO: 1397485 - RNA, 19 nt, Homo sapiens
ggaucuugcaucaguauug

SEQ ID NO: 1397486 - RNA, 19 nt, Homo sapiens
ggacugaagcaccuguugu

SEQ ID NO: 1397487 - RNA, 19 nt, Homo sapiens
gagcuggaccugagugaca

SEQ ID NO: 1397488 - RNA, 19 nt, Homo sapiens
aggcggaugugucugcuuu

SEQ ID NO: 1397489 - RNA, 19 nt, Homo sapiens
ggauguggacuugaagaaa

SEQ ID NO: 1397490 - RNA, 19 nt, Homo sapiens
ucuuugagccuucuuggua

SEQ ID NO: 1397491 - RNA, 19 nt, Homo sapiens
ccaggaagacagcauugaa

SEQ ID NO: 1397492 - RNA, 19 nt, Homo sapiens
uucacugccugguaucuua

SEQ ID NO: 1397493 - RNA, 19 nt, Homo sapiens
gaacuuucugguaagcauu

SEQ ID NO: 1397494 - RNA, 19 nt, Homo sapiens
gccaagaauccacagugua

SEQ ID NO: 1397495 - RNA, 19 nt, Homo sapiens
guuguacguuuccucuuug

SEQ ID NO: 1397496 - RNA, 19 nt, Homo sapiens
uaggaccgcucugcacuga

SEQ ID NO: 1397497 - RNA, 19 nt, Homo sapiens
ggaagacaccaggacaaug

SEQ ID NO: 1397498 - RNA, 19 nt, Homo sapiens
acucagcacuaaucagaau

SEQ ID NO: 1397499 - RNA, 19 nt, Homo sapiens
ggaggaagaggaggaggaa

SEQ ID NO: 1397500 - RNA, 19 nt, Homo sapiens
ugacaguccuucuggaaaa

SEQ ID NO: 1397501 - RNA, 19 nt, Homo sapiens
caaauaggcuucccacuaa

SEQ ID NO: 1397502 - RNA, 19 nt, Homo sapiens
gaacauagaacaaccauga

SEQ ID NO: 1397503 - RNA, 19 nt, Homo sapiens
gaaagcagcuauacacaau

SEQ ID NO: 1397504 - RNA, 19 nt, Homo sapiens
gaauuuaggugugagauuu

SEQ ID NO: 1397505 - RNA, 19 nt, Homo sapiens
ccacaucccugcaugauuu

SEQ ID NO: 1397506 - RNA, 19 nt, Homo sapiens
uaacaugucuuagcuguaa

SEQ ID NO: 1397507 - RNA, 19 nt, Homo sapiens
guaaacagauugcuucuag

SEQ ID NO: 1397508 - RNA, 19 nt, Homo sapiens
aaauagagcucucagaaga

SEQ ID NO: 1397509 - RNA, 19 nt, Homo sapiens
gaaagaacccuguuagauc

SEQ ID NO: 1397510 - RNA, 19 nt, Homo sapiens
gaucuugguuugugauaaa

SEQ ID NO: 1397511 - RNA, 19 nt, Homo sapiens
gcuuaaugaucaaguguua

SEQ ID NO: 1397512 - RNA, 19 nt, Homo sapiens
ggagugccauguauaaguu

SEQ ID NO: 1397513 - RNA, 19 nt, Homo sapiens
gaggaaaucaggcauauga

SEQ ID NO: 1397514 - RNA, 19 nt, Homo sapiens
uuucauggauggaauguua

SEQ ID NO: 1397515 - RNA, 19 nt, Homo sapiens
ccacacaccuaaaccugua

SEQ ID NO: 1397516 - RNA, 19 nt, Homo sapiens
cagagaccauuaaccaaua

SEQ ID NO: 1397517 - RNA, 19 nt, Homo sapiens
ucaggcauaugacuuuaua

SEQ ID NO: 1397518 - RNA, 19 nt, Homo sapiens
uguauaaguugggcuauua

SEQ ID NO: 1397519 - RNA, 19 nt, Homo sapiens
gaaugagugugguuauguu

SEQ ID NO: 1397520 - RNA, 19 nt, Homo sapiens
ugacaaagcaguugaacaa

SEQ ID NO: 1397521 - RNA, 19 nt, Homo sapiens
acagauugcuucuagauug

SEQ ID NO: 1397522 - RNA, 19 nt, Homo sapiens
ucaaauaggcuucccacua

SEQ ID NO: 1397523 - RNA, 19 nt, Homo sapiens
caugauccgugcuuaauga

SEQ ID NO: 1397524 - RNA, 19 nt, Homo sapiens
ggagaauacuuaccuuugg

SEQ ID NO: 1397525 - RNA, 19 nt, Homo sapiens
ugagucaccugaaccuuaa

SEQ ID NO: 1397526 - RNA, 19 nt, Homo sapiens
aaacguagcagccucaauu

SEQ ID NO: 1397527 - RNA, 19 nt, Homo sapiens
cuacugaugucuuacuuug

SEQ ID NO: 1397528 - RNA, 19 nt, Homo sapiens
ccaaauagagcucucagaa

SEQ ID NO: 1397529 - RNA, 19 nt, Homo sapiens
gagaauacuuaccuuugga

SEQ ID NO: 1397530 - RNA, 19 nt, Homo sapiens
gcauugcaauacaaccaua

SEQ ID NO: 1397531 - RNA, 19 nt, Homo sapiens
ggccagaugguaaauauuu

SEQ ID NO: 1397532 - RNA, 19 nt, Homo sapiens
gagaaaguguugguugguu

SEQ ID NO: 1397533 - RNA, 19 nt, Homo sapiens
gaaaucaggcauaugacuu

SEQ ID NO: 1397534 - RNA, 19 nt, Homo sapiens
gauauacaguacauucuag

SEQ ID NO: 1397535 - RNA, 19 nt, Homo sapiens
gugcaugaauauacccaua

SEQ ID NO: 1397536 - RNA, 19 nt, Homo sapiens
gaagauggcgaccguaaca

SEQ ID NO: 1397537 - RNA, 19 nt, Homo sapiens
ggauauacaguacauucua

SEQ ID NO: 1397538 - RNA, 19 nt, Homo sapiens
uaaaugugccauauggaua

SEQ ID NO: 1397539 - RNA, 19 nt, Homo sapiens
aaagaacccuguuagaucu

SEQ ID NO: 1397540 - RNA, 19 nt, Homo sapiens
gaacugguaucuagcuacu

SEQ ID NO: 1397541 - RNA, 19 nt, Homo sapiens
aagcucaaguucugguuua

SEQ ID NO: 1397542 - RNA, 19 nt, Homo sapiens
ucugguaacuccaugauga

SEQ ID NO: 1397543 - RNA, 19 nt, Homo sapiens
gauugcuucuagauuguua

SEQ ID NO: 1397544 - RNA, 19 nt, Homo sapiens
gaaggacaaguaagaguga

SEQ ID NO: 1397545 - RNA, 19 nt, Homo sapiens
gacgacagcuuguuauggu

SEQ ID NO: 1397546 - RNA, 19 nt, Homo sapiens
ggaaaggugccaaacuguu

SEQ ID NO: 1397547 - RNA, 19 nt, Homo sapiens
agaaaguguugguugguuu

SEQ ID NO: 1397548 - RNA, 19 nt, Homo sapiens
ccuguuagaucuugguuug

SEQ ID NO: 1397549 - RNA, 19 nt, Homo sapiens
gcuauuagaguucauggaa

SEQ ID NO: 1397550 - RNA, 19 nt, Homo sapiens
cucaaguucugguuuauuu

SEQ ID NO: 1397551 - RNA, 19 nt, Homo sapiens
ugagugauaaccaguauaa

SEQ ID NO: 1397552 - RNA, 19 nt, Homo sapiens
ucuagcuacugaugucuua

SEQ ID NO: 1397553 - RNA, 19 nt, Homo sapiens
gcagaguccuggauauagg

SEQ ID NO: 1397554 - RNA, 19 nt, Homo sapiens
ggaaucguuuacucugcua

SEQ ID NO: 1397555 - RNA, 19 nt, Homo sapiens
accuaaaccuguauuauga

SEQ ID NO: 1397556 - RNA, 19 nt, Homo sapiens
gaaaugaaugagugugguu

SEQ ID NO: 1397557 - RNA, 19 nt, Homo sapiens
gcagucguauguuaguuuc

SEQ ID NO: 1397558 - RNA, 19 nt, Homo sapiens
ccguaacacuccuuagaaa

SEQ ID NO: 1397559 - RNA, 19 nt, Homo sapiens
aaaccaagccuaagacaca

SEQ ID NO: 1397560 - RNA, 19 nt, Homo sapiens
ugagugugguuauguucua

SEQ ID NO: 1397561 - RNA, 19 nt, Homo sapiens
cuaauaauccucuagaaag

SEQ ID NO: 1397562 - RNA, 19 nt, Homo sapiens
auacuuaccuuuggaggaa

SEQ ID NO: 1397563 - RNA, 19 nt, Homo sapiens
ggccauaguuugucaacca

SEQ ID NO: 1397564 - RNA, 19 nt, Homo sapiens
gauuuugccuaccauuuua

SEQ ID NO: 1397565 - RNA, 19 nt, Homo sapiens
caauguuccucuaccucua

SEQ ID NO: 1397566 - RNA, 19 nt, Homo sapiens
cuacaaggaugggucaugu

SEQ ID NO: 1397567 - RNA, 19 nt, Homo sapiens
agagcucucagaagaauua

SEQ ID NO: 1397568 - RNA, 19 nt, Homo sapiens
auacuuaccuuuggagaau

SEQ ID NO: 1397569 - RNA, 19 nt, Homo sapiens
gugugguuauguucuaaua

SEQ ID NO: 1397570 - RNA, 19 nt, Homo sapiens
gaaugggccagaugguaaa

SEQ ID NO: 1397571 - RNA, 19 nt, Homo sapiens
acucuaagcucaaguucug

SEQ ID NO: 1397572 - RNA, 19 nt, Homo sapiens
guaauguguuuaguagaga

SEQ ID NO: 1397573 - RNA, 19 nt, Homo sapiens
gaccguaacacuccuuaga

SEQ ID NO: 1397574 - RNA, 19 nt, Homo sapiens
uauguuugguggcauuaaa

SEQ ID NO: 1397575 - RNA, 19 nt, Homo sapiens
cguuuacucugcuagaauu

SEQ ID NO: 1397576 - RNA, 19 nt, Homo sapiens
caccuaaaccuguauuaug

SEQ ID NO: 1397577 - RNA, 19 nt, Homo sapiens
aaucaggcauaugacuuua

SEQ ID NO: 1397578 - RNA, 19 nt, Homo sapiens
cagaaaagccacauaauau

SEQ ID NO: 1397579 - RNA, 19 nt, Homo sapiens
gggucuggcuuuacgaaga

SEQ ID NO: 1397580 - RNA, 19 nt, Homo sapiens
guagcuuaaucacauucua

SEQ ID NO: 1397581 - RNA, 19 nt, Homo sapiens
uuacaaaccaagccuaaga

SEQ ID NO: 1397582 - RNA, 19 nt, Homo sapiens
guauagcaggcuuauguuu

SEQ ID NO: 1397583 - RNA, 19 nt, Homo sapiens
acaaggaugggucauguuu

SEQ ID NO: 1397584 - RNA, 19 nt, Homo sapiens
ugaauggaaggacaaguaa

SEQ ID NO: 1397585 - RNA, 19 nt, Homo sapiens
ccagagaccauuaaccaau

SEQ ID NO: 1397586 - RNA, 19 nt, Homo sapiens
gcuauacacaauacagaaa

SEQ ID NO: 1397587 - RNA, 19 nt, Homo sapiens
agaaugggccagaugguaa

SEQ ID NO: 1397588 - RNA, 19 nt, Homo sapiens
uaaacagauugcuucuaga

SEQ ID NO: 1397589 - RNA, 19 nt, Homo sapiens
agucauaaaugugccauau

SEQ ID NO: 1397590 - RNA, 19 nt, Homo sapiens
agaaagaacccuguuagau

SEQ ID NO: 1397591 - RNA, 19 nt, Homo sapiens
guaucuagcuacugauguc

SEQ ID NO: 1397592 - RNA, 19 nt, Homo sapiens
aaggaugggucauguuugu

SEQ ID NO: 1397593 - RNA, 19 nt, Homo sapiens
ggcauuaaauugguuucuu

SEQ ID NO: 1397594 - RNA, 19 nt, Homo sapiens
uaacagaaaagccacauaa

SEQ ID NO: 1397595 - RNA, 19 nt, Homo sapiens
auucaguucugcuaguaua

SEQ ID NO: 1397596 - RNA, 19 nt, Homo sapiens
caccugaaccuuaauuuua

SEQ ID NO: 1397597 - RNA, 19 nt, Homo sapiens
uaguuucacuugucuacuu

SEQ ID NO: 1397598 - RNA, 19 nt, Homo sapiens
ggucuggcuuuacgaagau

SEQ ID NO: 1397599 - RNA, 19 nt, Homo sapiens
caguuugggucuggcuuua

SEQ ID NO: 1397600 - RNA, 19 nt, Homo sapiens
gaauuuaacaugucuuagc

SEQ ID NO: 1397601 - RNA, 19 nt, Homo sapiens
gaacuucacugcauucaua

SEQ ID NO: 1397602 - RNA, 19 nt, Homo sapiens
gaaacccugucucuacuaa

SEQ ID NO: 1397603 - RNA, 19 nt, Homo sapiens
ccacuggacucaaacauga

SEQ ID NO: 1397604 - RNA, 19 nt, Homo sapiens
gggaguaucugagcaaauu

SEQ ID NO: 1397605 - RNA, 19 nt, Homo sapiens
gaaguaauucccaccauaa

SEQ ID NO: 1397606 - RNA, 19 nt, Homo sapiens
gaucaucuauggagucuuc

SEQ ID NO: 1397607 - RNA, 19 nt, Homo sapiens
caaacuuuauggccuauuu

SEQ ID NO: 1397608 - RNA, 19 nt, Homo sapiens
gaaccucucuggauacagu

SEQ ID NO: 1397609 - RNA, 19 nt, Homo sapiens
ccauggaaaugaaguaauu

SEQ ID NO: 1397610 - RNA, 19 nt, Homo sapiens
ggaaugugcccuucuggua

SEQ ID NO: 1397611 - RNA, 19 nt, Homo sapiens
gaagcacagucgucaagaa

SEQ ID NO: 1397612 - RNA, 19 nt, Homo sapiens
ugaaguaauucccaccaua

SEQ ID NO: 1397613 - RNA, 19 nt, Homo sapiens
ugacuucaguggcuaaauu

SEQ ID NO: 1397614 - RNA, 19 nt, Homo sapiens
uuacgugacuuuagagaaa

SEQ ID NO: 1397615 - RNA, 19 nt, Homo sapiens
gcucccaccuuccucauuu

SEQ ID NO: 1397616 - RNA, 19 nt, Homo sapiens
ggaacaaucaggacuauuc

SEQ ID NO: 1397617 - RNA, 19 nt, Homo sapiens
cauccuaggcggucauuua

SEQ ID NO: 1397618 - RNA, 19 nt, Homo sapiens
gaagugucgucgcuuuguu

SEQ ID NO: 1397619 - RNA, 19 nt, Homo sapiens
gaaugaagaaugccagaga

SEQ ID NO: 1397620 - RNA, 19 nt, Homo sapiens
gaagguucgugcucagaug

SEQ ID NO: 1397621 - RNA, 19 nt, Homo sapiens
guaauucccaccauaauca

SEQ ID NO: 1397622 - RNA, 19 nt, Homo sapiens
gcacagucgucaagaagag

SEQ ID NO: 1397623 - RNA, 19 nt, Homo sapiens
uacgagauuugcaaacuuu

SEQ ID NO: 1397624 - RNA, 19 nt, Homo sapiens
ccuaggcggucauuuauca

SEQ ID NO: 1397625 - RNA, 19 nt, Homo sapiens
caaccucaauggccuuuca

SEQ ID NO: 1397626 - RNA, 19 nt, Homo sapiens
ccuugaaccucucuggaua

SEQ ID NO: 1397627 - RNA, 19 nt, Homo sapiens
ggagcugacugccgaucaa

SEQ ID NO: 1397628 - RNA, 19 nt, Homo sapiens
gaugcacucuugagaaucu

SEQ ID NO: 1397629 - RNA, 19 nt, Homo sapiens
gaguggaagugacgcaguu

SEQ ID NO: 1397630 - RNA, 19 nt, Homo sapiens
gccagaugcuucucauguu

SEQ ID NO: 1397631 - RNA, 19 nt, Homo sapiens
uaaaccagaggaaggcuua

SEQ ID NO: 1397632 - RNA, 19 nt, Homo sapiens
gaaugugcccuucugguau

SEQ ID NO: 1397633 - RNA, 19 nt, Homo sapiens
agagaagugucgucgcuuu

SEQ ID NO: 1397634 - RNA, 19 nt, Homo sapiens
ccagagaaccaaagcaaga

SEQ ID NO: 1397635 - RNA, 19 nt, Homo sapiens
ccagaugcuucucauguuc

SEQ ID NO: 1397636 - RNA, 19 nt, Homo sapiens
agugggaucugguauguga

SEQ ID NO: 1397637 - RNA, 19 nt, Homo sapiens
ucagacagguuugggagaa

SEQ ID NO: 1397638 - RNA, 19 nt, Homo sapiens
ggacuauuccuagacacua

SEQ ID NO: 1397639 - RNA, 19 nt, Homo sapiens
gcugacugccgaucaauga

SEQ ID NO: 1397640 - RNA, 19 nt, Homo sapiens
gaaaacggcuaccuaucug

SEQ ID NO: 1397641 - RNA, 19 nt, Homo sapiens
ucugcucgguggcucauua

SEQ ID NO: 1397642 - RNA, 19 nt, Homo sapiens
ggcuaaauuuguauucaug

SEQ ID NO: 1397643 - RNA, 19 nt, Homo sapiens
ggugaaacccugucucuac

SEQ ID NO: 1397644 - RNA, 19 nt, Homo sapiens
gaucaaugagccagaugaa

SEQ ID NO: 1397645 - RNA, 19 nt, Homo sapiens
cgucugcucuugccaauac

SEQ ID NO: 1397646 - RNA, 19 nt, Homo sapiens
caugaggucagaagauaaa

SEQ ID NO: 1397647 - RNA, 19 nt, Homo sapiens
gaucaugaggucagaagau

SEQ ID NO: 1397648 - RNA, 19 nt, Homo sapiens
ggaucucccuccuguccuu

SEQ ID NO: 1397649 - RNA, 19 nt, Homo sapiens
ggaguaucugagcaaauua

SEQ ID NO: 1397650 - RNA, 19 nt, Homo sapiens
cauccaccaucgugacuga

SEQ ID NO: 1397651 - RNA, 19 nt, Homo sapiens
guaaacgacugggaguauc

SEQ ID NO: 1397652 - RNA, 19 nt, Homo sapiens
gaucaaaacacauuuagug

SEQ ID NO: 1397653 - RNA, 19 nt, Homo sapiens
gauccuaaguguguauucu

SEQ ID NO: 1397654 - RNA, 19 nt, Homo sapiens
ucauuuaucagacagguuu

SEQ ID NO: 1397655 - RNA, 19 nt, Homo sapiens
caccuugggcacugaaaua

SEQ ID NO: 1397656 - RNA, 19 nt, Homo sapiens
gagauuugcaaacuuuaug

SEQ ID NO: 1397657 - RNA, 19 nt, Homo sapiens
agaggaaggcuuaaaggaa

SEQ ID NO: 1397658 - RNA, 19 nt, Homo sapiens
caacaauaaaccagaggaa

SEQ ID NO: 1397659 - RNA, 19 nt, Homo sapiens
uaccauacuuugugaucuu

SEQ ID NO: 1397660 - RNA, 19 nt, Homo sapiens
uucaguggcuaaauuugua

SEQ ID NO: 1397661 - RNA, 19 nt, Homo sapiens
gguaugugacucucaauca

SEQ ID NO: 1397662 - RNA, 19 nt, Homo sapiens
ugagugggaucugguaugu

SEQ ID NO: 1397663 - RNA, 19 nt, Homo sapiens
uuucuuacgugacuuuaga

SEQ ID NO: 1397664 - RNA, 19 nt, Homo sapiens
gaccucaaguuggcugcua

SEQ ID NO: 1397665 - RNA, 19 nt, Homo sapiens
cuucugguauugcauuuau

SEQ ID NO: 1397666 - RNA, 19 nt, Homo sapiens
aaugugcccuucugguauu

SEQ ID NO: 1397667 - RNA, 19 nt, Homo sapiens
ccaccuuccucauuuacug

SEQ ID NO: 1397668 - RNA, 19 nt, Homo sapiens
cagaugaagggaacaauca

SEQ ID NO: 1397669 - RNA, 19 nt, Homo sapiens
uuacgagauuugcaaacuu

SEQ ID NO: 1397670 - RNA, 19 nt, Homo sapiens
guugcuacauaccuucauu

SEQ ID NO: 1397671 - RNA, 19 nt, Homo sapiens
ucuuugcuguugcuacaua

SEQ ID NO: 1397672 - RNA, 19 nt, Homo sapiens
gugaaacccugucucuacu

SEQ ID NO: 1397673 - RNA, 19 nt, Homo sapiens
guggauggcuggguguaug

SEQ ID NO: 1397674 - RNA, 19 nt, Homo sapiens
gagaagugucgucgcuuug

SEQ ID NO: 1397675 - RNA, 19 nt, Homo sapiens
uggagaacuucacugcauu

SEQ ID NO: 1397676 - RNA, 19 nt, Homo sapiens
gauccgagaguggaaguga

SEQ ID NO: 1397677 - RNA, 19 nt, Homo sapiens
gaguaucugagcaaauuau

SEQ ID NO: 1397678 - RNA, 19 nt, Homo sapiens
ggagauuccagauccuuca

SEQ ID NO: 1397679 - RNA, 19 nt, Homo sapiens
gcucgguggcucauuauca

SEQ ID NO: 1397680 - RNA, 19 nt, Homo sapiens
ccaucccacuggacucaaa

SEQ ID NO: 1397681 - RNA, 19 nt, Homo sapiens
ggagaacuucacugcauuc

SEQ ID NO: 1397682 - RNA, 19 nt, Homo sapiens
aucaugaggucagaagaua

SEQ ID NO: 1397683 - RNA, 19 nt, Homo sapiens
aaucuuugcuguugcuaca

SEQ ID NO: 1397684 - RNA, 19 nt, Homo sapiens
gacuucaguggcuaaauuu

SEQ ID NO: 1397685 - RNA, 19 nt, Homo sapiens
cuggagaacuucacugcau

SEQ ID NO: 1397686 - RNA, 19 nt, Homo sapiens
ggggaucaaugcaaccuuu

SEQ ID NO: 1397687 - RNA, 19 nt, Homo sapiens
cagaggaaggcuuaaagga

SEQ ID NO: 1397688 - RNA, 19 nt, Homo sapiens
ugucgucgcuuuguucauc

SEQ ID NO: 1397689 - RNA, 19 nt, Homo sapiens
ucaaacaugaggccagaga

SEQ ID NO: 1397690 - RNA, 19 nt, Homo sapiens
caaaacgacuugaggaaac

SEQ ID NO: 1397691 - RNA, 19 nt, Homo sapiens
guaccauacuuugugaucu

SEQ ID NO: 1397692 - RNA, 19 nt, Homo sapiens
ggccaugggaauuacauug

SEQ ID NO: 1397693 - RNA, 19 nt, Homo sapiens
cuggugaccuguggagauu

SEQ ID NO: 1397694 - RNA, 19 nt, Homo sapiens
gggaagcacagucgucaag

SEQ ID NO: 1397695 - RNA, 19 nt, Homo sapiens
ggaagcacagucgucaaga

SEQ ID NO: 1397696 - RNA, 19 nt, Homo sapiens
caagugacgcagacaugga

SEQ ID NO: 1397697 - RNA, 19 nt, Homo sapiens
caacuguucaaccucaaug

SEQ ID NO: 1397698 - RNA, 19 nt, Homo sapiens
agaccacccuggccaacau

SEQ ID NO: 1397699 - RNA, 19 nt, Homo sapiens
ggaagugacgcaguuuuaa

SEQ ID NO: 1397700 - RNA, 19 nt, Homo sapiens
cuaccuaucugaccccaaa

SEQ ID NO: 1397701 - RNA, 19 nt, Homo sapiens
ggacucaucuccugccuaa

SEQ ID NO: 1397702 - RNA, 19 nt, Homo sapiens
ggacuuacauggaauuugu

SEQ ID NO: 1397703 - RNA, 19 nt, Homo sapiens
uaauaagccugcaccauuu

SEQ ID NO: 1397704 - RNA, 19 nt, Homo sapiens
gaacauggccuuacauagg

SEQ ID NO: 1397705 - RNA, 19 nt, Homo sapiens
caacaagaauccaguccuu

SEQ ID NO: 1397706 - RNA, 19 nt, Homo sapiens
caguaaagcuuucuaucuu

SEQ ID NO: 1397707 - RNA, 19 nt, Homo sapiens
gagugaagcuagaaacaga

SEQ ID NO: 1397708 - RNA, 19 nt, Homo sapiens
gcacuggcguacacuggua

SEQ ID NO: 1397709 - RNA, 19 nt, Homo sapiens
ucacugcugucacauauug

SEQ ID NO: 1397710 - RNA, 19 nt, Homo sapiens
aagaagcugucaugcguua

SEQ ID NO: 1397711 - RNA, 19 nt, Homo sapiens
ggaaugggcaucaggagaa

SEQ ID NO: 1397712 - RNA, 19 nt, Homo sapiens
gaaagaguguccgccauca

SEQ ID NO: 1397713 - RNA, 19 nt, Homo sapiens
ccuuuacucuuccauauaa

SEQ ID NO: 1397714 - RNA, 19 nt, Homo sapiens
gaugguggcuuucgucaag

SEQ ID NO: 1397715 - RNA, 19 nt, Homo sapiens
ggagaaagcaacaagaauc

SEQ ID NO: 1397716 - RNA, 19 nt, Homo sapiens
ugacucaccugacugauca

SEQ ID NO: 1397717 - RNA, 19 nt, Homo sapiens
gcugucacauauugucaua

SEQ ID NO: 1397718 - RNA, 19 nt, Homo sapiens
guaugucuccauuuacuua

SEQ ID NO: 1397719 - RNA, 19 nt, Homo sapiens
uuaauaagccugcaccauu

SEQ ID NO: 1397720 - RNA, 19 nt, Homo sapiens
gaagugguacugaucaaug

SEQ ID NO: 1397721 - RNA, 19 nt, Homo sapiens
gaaugggcaucaggagaaa

SEQ ID NO: 1397722 - RNA, 19 nt, Homo sapiens
ccaagaaggccaugaggaa

SEQ ID NO: 1397723 - RNA, 19 nt, Homo sapiens
gcagauccaccaaagagaa

SEQ ID NO: 1397724 - RNA, 19 nt, Homo sapiens
cgcccagccugaaauaaua

SEQ ID NO: 1397725 - RNA, 19 nt, Homo sapiens
acacugguaucccuccuaa

SEQ ID NO: 1397726 - RNA, 19 nt, Homo sapiens
ugaagaagcccaagaagag

SEQ ID NO: 1397727 - RNA, 19 nt, Homo sapiens
ucauuggacuuacauggaa

SEQ ID NO: 1397728 - RNA, 19 nt, Homo sapiens
ccaaagugcugggauuaca

SEQ ID NO: 1397729 - RNA, 19 nt, Homo sapiens
uggauggucuuccuaguug

SEQ ID NO: 1397730 - RNA, 19 nt, Homo sapiens
ucaguugacacuuguuaua

SEQ ID NO: 1397731 - RNA, 19 nt, Homo sapiens
gaaauuggaggugguagga

SEQ ID NO: 1397732 - RNA, 19 nt, Homo sapiens
gacacucaguugacacuug

SEQ ID NO: 1397733 - RNA, 19 nt, Homo sapiens
guugacacuuguuauauca

SEQ ID NO: 1397734 - RNA, 19 nt, Homo sapiens
gguaggaagugguacugau

SEQ ID NO: 1397735 - RNA, 19 nt, Homo sapiens
gcaagauggcugacugguu

SEQ ID NO: 1397736 - RNA, 19 nt, Homo sapiens
ugacacuuguuauaucaug

SEQ ID NO: 1397737 - RNA, 19 nt, Homo sapiens
gcgcgcagauccaccaaag

SEQ ID NO: 1397738 - RNA, 19 nt, Homo sapiens
ugucacugcugucacauau

SEQ ID NO: 1397739 - RNA, 19 nt, Homo sapiens
acacuacucuguuccucuu

SEQ ID NO: 1397740 - RNA, 19 nt, Homo sapiens
gaaacuuaaggcugaaaga

SEQ ID NO: 1397741 - RNA, 19 nt, Homo sapiens
ugguaucccuccuaaagaa

SEQ ID NO: 1397742 - RNA, 19 nt, Homo sapiens
ggaaauuggagugaagcua

SEQ ID NO: 1397743 - RNA, 19 nt, Homo sapiens
ucuccucccuuuacuuuau

SEQ ID NO: 1397744 - RNA, 19 nt, Homo sapiens
caggagaaagcaacaagaa

SEQ ID NO: 1397745 - RNA, 19 nt, Homo sapiens
uuaugagucuuccuauuca

SEQ ID NO: 1397746 - RNA, 19 nt, Homo sapiens
gaggaagccagaaauugga

SEQ ID NO: 1397747 - RNA, 19 nt, Homo sapiens
aacauggccuuacauagga

SEQ ID NO: 1397748 - RNA, 19 nt, Homo sapiens
gagucuuccuauucauaaa

SEQ ID NO: 1397749 - RNA, 19 nt, Homo sapiens
gcgcagauccaccaaagag

SEQ ID NO: 1397750 - RNA, 19 nt, Homo sapiens
aagaacauggccuuacaua

SEQ ID NO: 1397751 - RNA, 19 nt, Homo sapiens
ucuccagucuccucccuuu

SEQ ID NO: 1397752 - RNA, 19 nt, Homo sapiens
ccacgcccagccugaaaua

SEQ ID NO: 1397753 - RNA, 19 nt, Homo sapiens
cugccuaacuggacaggaa

SEQ ID NO: 1397754 - RNA, 19 nt, Homo sapiens
acacucaguugacacuugu

SEQ ID NO: 1397755 - RNA, 19 nt, Homo sapiens
gaagcugucaugcguuauc

SEQ ID NO: 1397756 - RNA, 19 nt, Homo sapiens
ucaguaaagcuuucuaucu

SEQ ID NO: 1397757 - RNA, 19 nt, Homo sapiens
guauuucaguaaagcuuuc

SEQ ID NO: 1397758 - RNA, 19 nt, Homo sapiens
ugagucuuccuauucauaa

SEQ ID NO: 1397759 - RNA, 19 nt, Homo sapiens
ccauuuguaugucaauucu

SEQ ID NO: 1397760 - RNA, 19 nt, Homo sapiens
ugaugucacugcugucaca

SEQ ID NO: 1397761 - RNA, 19 nt, Homo sapiens
cagcaagaagccuagauug

SEQ ID NO: 1397762 - RNA, 19 nt, Homo sapiens
aagugguacugaucaauga

SEQ ID NO: 1397763 - RNA, 19 nt, Homo sapiens
gaggugguaggaaguggua

SEQ ID NO: 1397764 - RNA, 19 nt, Homo sapiens
caugaggaagccagaaauu

SEQ ID NO: 1397765 - RNA, 19 nt, Homo sapiens
gagcuccgauucauguacu

SEQ ID NO: 1397766 - RNA, 19 nt, Homo sapiens
cccuuuacuuuaucuguuu

SEQ ID NO: 1397767 - RNA, 19 nt, Homo sapiens
aaauuggagugaagcuaga

SEQ ID NO: 1397768 - RNA, 19 nt, Homo sapiens
aagcagcccugugccaguu

SEQ ID NO: 1397769 - RNA, 19 nt, Homo sapiens
aaccaucauugacugacua

SEQ ID NO: 1397770 - RNA, 19 nt, Homo sapiens
ugaggaagccagaaauugg

SEQ ID NO: 1397771 - RNA, 19 nt, Homo sapiens
aguagucgcuggagcaaag

SEQ ID NO: 1397772 - RNA, 19 nt, Homo sapiens
ucagcaagaagccuagauu

SEQ ID NO: 1397773 - RNA, 19 nt, Homo sapiens
caccugagcuccgauucau

SEQ ID NO: 1397774 - RNA, 19 nt, Homo sapiens
acaagaauccaguccuuca

SEQ ID NO: 1397775 - RNA, 19 nt, Homo sapiens
gcucuucuuauccaucaaa

SEQ ID NO: 1397776 - RNA, 19 nt, Homo sapiens
uggcuuucgucaagucaaa

SEQ ID NO: 1397777 - RNA, 19 nt, Homo sapiens
caucagggacauccucugu

SEQ ID NO: 1397778 - RNA, 19 nt, Homo sapiens
cagauccaccaaagagaaa

SEQ ID NO: 1397779 - RNA, 19 nt, Homo sapiens
ggcacccacuucugucuuc

SEQ ID NO: 1397780 - RNA, 19 nt, Homo sapiens
aaaagaacauggccuuaca

SEQ ID NO: 1397781 - RNA, 19 nt, Homo sapiens
ggaagugguacugaucaau

SEQ ID NO: 1397782 - RNA, 19 nt, Homo sapiens
guaggaagugguacugauc

SEQ ID NO: 1397783 - RNA, 19 nt, Homo sapiens
gccaugaggaagccagaaa

SEQ ID NO: 1397784 - RNA, 19 nt, Homo sapiens
gggcccugaugguggcuuu

SEQ ID NO: 1397785 - RNA, 19 nt, Homo sapiens
ccaagaagaggcccaacuc

SEQ ID NO: 1397786 - RNA, 19 nt, Homo sapiens
ggaaaagaacauggccuua

SEQ ID NO: 1397787 - RNA, 19 nt, Homo sapiens
uugcaggccucaccaugga

SEQ ID NO: 1397788 - RNA, 19 nt, Homo sapiens
ccagaaauuggagguggua

SEQ ID NO: 1397789 - RNA, 19 nt, Homo sapiens
agucaaagaagcugucaug

SEQ ID NO: 1397790 - RNA, 19 nt, Homo sapiens
gcgagugacaguggcagua

SEQ ID NO: 1397791 - RNA, 19 nt, Homo sapiens
cugaagaagcccaagaaga

SEQ ID NO: 1397792 - RNA, 19 nt, Homo sapiens
uuuaugagucuuccuauuc

SEQ ID NO: 1397793 - RNA, 19 nt, Homo sapiens
gugaagcuagaaacagaaa

SEQ ID NO: 1397794 - RNA, 19 nt, Homo sapiens
gagaaagcaacaagaaucc

SEQ ID NO: 1397795 - RNA, 19 nt, Homo sapiens
cuucacagccuaccucaca

SEQ ID NO: 1397796 - RNA, 19 nt, Homo sapiens
ugucuccauuuacuuaugu

SEQ ID NO: 1397797 - RNA, 19 nt, Homo sapiens
acugacuaguccauccuua

SEQ ID NO: 1397798 - RNA, 19 nt, Homo sapiens
ccugagcuccgauucaugu

SEQ ID NO: 1397799 - RNA, 19 nt, Homo sapiens
caccauuuguaugucaauu

SEQ ID NO: 1397800 - RNA, 19 nt, Homo sapiens
agucuccucccuuuacuuu

SEQ ID NO: 1397801 - RNA, 19 nt, Homo sapiens
gaacauggccuuacauagg

SEQ ID NO: 1397802 - RNA, 19 nt, Homo sapiens
gaaagaguguccgccauca

SEQ ID NO: 1397803 - RNA, 19 nt, Homo sapiens
ggauucagcuacaguaucu

SEQ ID NO: 1397804 - RNA, 19 nt, Homo sapiens
gaugguggcuuucgucaag

SEQ ID NO: 1397805 - RNA, 19 nt, Homo sapiens
gaagcugucaugcguugua

SEQ ID NO: 1397806 - RNA, 19 nt, Homo sapiens
gcagauccaccaaagagaa

SEQ ID NO: 1397807 - RNA, 19 nt, Homo sapiens
ggaacgggauucagcuaca

SEQ ID NO: 1397808 - RNA, 19 nt, Homo sapiens
ugaagaagcccaagaagag

SEQ ID NO: 1397809 - RNA, 19 nt, Homo sapiens
ugucaugcguuguaagcua

SEQ ID NO: 1397810 - RNA, 19 nt, Homo sapiens
gcaagauggcugacugguu

SEQ ID NO: 1397811 - RNA, 19 nt, Homo sapiens
gcgcgcagauccaccaaag

SEQ ID NO: 1397812 - RNA, 19 nt, Homo sapiens
gaaacuuaaggcugaaaga

SEQ ID NO: 1397813 - RNA, 19 nt, Homo sapiens
uaucugaucuacuuugacu

SEQ ID NO: 1397814 - RNA, 19 nt, Homo sapiens
aacauggccuuacauagga

SEQ ID NO: 1397815 - RNA, 19 nt, Homo sapiens
gcgcagauccaccaaagag

SEQ ID NO: 1397816 - RNA, 19 nt, Homo sapiens
aagaacauggccuuacaua

SEQ ID NO: 1397817 - RNA, 19 nt, Homo sapiens
gaacgggauucagcuacag

SEQ ID NO: 1397818 - RNA, 19 nt, Homo sapiens
ucugaucuacuuugacuuu

SEQ ID NO: 1397819 - RNA, 19 nt, Homo sapiens
gagcuccgauucauguacu

SEQ ID NO: 1397820 - RNA, 19 nt, Homo sapiens
aguagucgcuggagcaaag

SEQ ID NO: 1397821 - RNA, 19 nt, Homo sapiens
aagcagcccugugccaguu

SEQ ID NO: 1397822 - RNA, 19 nt, Homo sapiens
caccugagcuccgauucau

SEQ ID NO: 1397823 - RNA, 19 nt, Homo sapiens
uggcuuucgucaagucaaa

SEQ ID NO: 1397824 - RNA, 19 nt, Homo sapiens
gggcccugaugguggcuuu

SEQ ID NO: 1397825 - RNA, 19 nt, Homo sapiens
ccaagaagaggcccaacuc

SEQ ID NO: 1397826 - RNA, 19 nt, Homo sapiens
cagauccaccaaagagaaa

SEQ ID NO: 1397827 - RNA, 19 nt, Homo sapiens
aaaagaacauggccuuaca

SEQ ID NO: 1397828 - RNA, 19 nt, Homo sapiens
caucagggacauccucugu

SEQ ID NO: 1397829 - RNA, 19 nt, Homo sapiens
gaucuacuuugacuuuuag

SEQ ID NO: 1397830 - RNA, 19 nt, Homo sapiens
cagcuacaguaucugaucu

SEQ ID NO: 1397831 - RNA, 19 nt, Homo sapiens
agucaaagaagcugucaug

SEQ ID NO: 1397832 - RNA, 19 nt, Homo sapiens
gcgagugacaguggcagua

SEQ ID NO: 1397833 - RNA, 19 nt, Homo sapiens
cugaagaagcccaagaaga

SEQ ID NO: 1397834 - RNA, 19 nt, Homo sapiens
ggaaaagaacauggccuua

SEQ ID NO: 1397835 - RNA, 19 nt, Homo sapiens
cuucacagccuaccucaca

SEQ ID NO: 1397836 - RNA, 19 nt, Homo sapiens
aagcugucaugcguuguaa

SEQ ID NO: 1397837 - RNA, 19 nt, Homo sapiens
ccugagcuccgauucaugu

SEQ ID NO: 1397838 - RNA, 19 nt, Homo sapiens
ccuguagccuaguaguuca

SEQ ID NO: 1397839 - RNA, 19 nt, Homo sapiens
gagugacaguggcaguagu

SEQ ID NO: 1397840 - RNA, 19 nt, Homo sapiens
gcuacaguaucugaucuac

SEQ ID NO: 1397841 - RNA, 19 nt, Homo sapiens
ccaagccucagcucaguca

SEQ ID NO: 1397842 - RNA, 19 nt, Homo sapiens
gaaaagaacauggccuuac

SEQ ID NO: 1397843 - RNA, 19 nt, Homo sapiens
gcuggagcaaagacuauga

SEQ ID NO: 1397844 - RNA, 19 nt, Homo sapiens
gcaguagucgcuggagcaa

SEQ ID NO: 1397845 - RNA, 19 nt, Homo sapiens
ucacuacggugggaaaaga

SEQ ID NO: 1397846 - RNA, 19 nt, Homo sapiens
gggauucagcuacaguauc

SEQ ID NO: 1397847 - RNA, 19 nt, Homo sapiens
acagaaacuuaaggcugaa

SEQ ID NO: 1397848 - RNA, 19 nt, Homo sapiens
ccuggucuccuacuuggaa

SEQ ID NO: 1397849 - RNA, 19 nt, Homo sapiens
gaacgucucuucaccuuaa

SEQ ID NO: 1397850 - RNA, 19 nt, Homo sapiens
ggaauuggcucacgugauu

SEQ ID NO: 1397851 - RNA, 19 nt, Homo sapiens
caugagagcugaugguuua

SEQ ID NO: 1397852 - RNA, 19 nt, Homo sapiens
gggaaaggcugaugaguaa

SEQ ID NO: 1397853 - RNA, 19 nt, Homo sapiens
ccauaaagcugucaagaaa

SEQ ID NO: 1397854 - RNA, 19 nt, Homo sapiens
ccaguuaaguggauacaua

SEQ ID NO: 1397855 - RNA, 19 nt, Homo sapiens
gcagagaacucagcuguau

SEQ ID NO: 1397856 - RNA, 19 nt, Homo sapiens
gcaaacagccucuuagguu

SEQ ID NO: 1397857 - RNA, 19 nt, Homo sapiens
caacauaguuuggugauau

SEQ ID NO: 1397858 - RNA, 19 nt, Homo sapiens
ggugaacucuucuuuacua

SEQ ID NO: 1397859 - RNA, 19 nt, Homo sapiens
caacaagucccacaucuuu

SEQ ID NO: 1397860 - RNA, 19 nt, Homo sapiens
aagcuuaccuuucuucuaa

SEQ ID NO: 1397861 - RNA, 19 nt, Homo sapiens
aggaagagaugauguuuaa

SEQ ID NO: 1397862 - RNA, 19 nt, Homo sapiens
gagcuaauguacaugcuuu

SEQ ID NO: 1397863 - RNA, 19 nt, Homo sapiens
gaauauguguuaccaagau

SEQ ID NO: 1397864 - RNA, 19 nt, Homo sapiens
gaaacacaguugcagagaa

SEQ ID NO: 1397865 - RNA, 19 nt, Homo sapiens
gaagagcccgguugcauuu

SEQ ID NO: 1397866 - RNA, 19 nt, Homo sapiens
ccaaauagcugggcaucuu

SEQ ID NO: 1397867 - RNA, 19 nt, Homo sapiens
caaauggauucuuggagua

SEQ ID NO: 1397868 - RNA, 19 nt, Homo sapiens
cccaagaucugcaggauaa

SEQ ID NO: 1397869 - RNA, 19 nt, Homo sapiens
uuagggauaugccacauua

SEQ ID NO: 1397870 - RNA, 19 nt, Homo sapiens
gaaaagagcugcagcaaac

SEQ ID NO: 1397871 - RNA, 19 nt, Homo sapiens
gauccugccuguccuggua

SEQ ID NO: 1397872 - RNA, 19 nt, Homo sapiens
cagagaaacagaaucaaua

SEQ ID NO: 1397873 - RNA, 19 nt, Homo sapiens
gcagaugaauacacaguuc

SEQ ID NO: 1397874 - RNA, 19 nt, Homo sapiens
ggacggugcuagugagaga

SEQ ID NO: 1397875 - RNA, 19 nt, Homo sapiens
ccagagauuugauuucguu

SEQ ID NO: 1397876 - RNA, 19 nt, Homo sapiens
ggagucaucucuuucuaca

SEQ ID NO: 1397877 - RNA, 19 nt, Homo sapiens
ggaaggaccaggaugaaga

SEQ ID NO: 1397878 - RNA, 19 nt, Homo sapiens
cagcacagguucagggaaa

SEQ ID NO: 1397879 - RNA, 19 nt, Homo sapiens
guggagauguugaauaugu

SEQ ID NO: 1397880 - RNA, 19 nt, Homo sapiens
caaaucagaggaaucaauu

SEQ ID NO: 1397881 - RNA, 19 nt, Homo sapiens
gaaggaguguucccagcuu

SEQ ID NO: 1397882 - RNA, 19 nt, Homo sapiens
ccaagggucuuaccgaugu

SEQ ID NO: 1397883 - RNA, 19 nt, Homo sapiens
guacugcaauacuugacua

SEQ ID NO: 1397884 - RNA, 19 nt, Homo sapiens
guacagcgacuuuaaauac

SEQ ID NO: 1397885 - RNA, 19 nt, Homo sapiens
gucccugacuucuuacuua

SEQ ID NO: 1397886 - RNA, 19 nt, Homo sapiens
gaauugaagcucccaguga

SEQ ID NO: 1397887 - RNA, 19 nt, Homo sapiens
caaggugaacucuucuuua

SEQ ID NO: 1397888 - RNA, 19 nt, Homo sapiens
uccguuaguuccuguauua

SEQ ID NO: 1397889 - RNA, 19 nt, Homo sapiens
ucagagagguccagcuaga

SEQ ID NO: 1397890 - RNA, 19 nt, Homo sapiens
ugacggagguggacaaucu

SEQ ID NO: 1397891 - RNA, 19 nt, Homo sapiens
gcuuucaagucacaucaua

SEQ ID NO: 1397892 - RNA, 19 nt, Homo sapiens
aagcuaaucugccuguuga

SEQ ID NO: 1397893 - RNA, 19 nt, Homo sapiens
gaaccuugccuucaugaug

SEQ ID NO: 1397894 - RNA, 19 nt, Homo sapiens
gggaggacagucugcauua

SEQ ID NO: 1397895 - RNA, 19 nt, Homo sapiens
gagagcugaugguuuaguu

SEQ ID NO: 1397896 - RNA, 19 nt, Homo sapiens
aagcaggagucaucucuuu

SEQ ID NO: 1397897 - RNA, 19 nt, Homo sapiens
gaucugaugccggaauaua

SEQ ID NO: 1397898 - RNA, 19 nt, Homo sapiens
guuaucaguuugcagauga

SEQ ID NO: 1397899 - RNA, 19 nt, Homo sapiens
gaagggaaaggccaugcua

SEQ ID NO: 1397900 - RNA, 19 nt, Homo sapiens
ccucgucgcuuucaaguca

SEQ ID NO: 1397901 - RNA, 19 nt, Homo sapiens
gugacugucuuaugaauca

SEQ ID NO: 1397902 - RNA, 19 nt, Homo sapiens
ggaacacucagaauaaugu

SEQ ID NO: 1397903 - RNA, 19 nt, Homo sapiens
gaucuggccuaaccaugga

SEQ ID NO: 1397904 - RNA, 19 nt, Homo sapiens
gaugaaauaaugaccuuga

SEQ ID NO: 1397905 - RNA, 19 nt, Homo sapiens
ccaccaacguagaagcuuu

SEQ ID NO: 1397906 - RNA, 19 nt, Homo sapiens
cacagcaccucuagucauu

SEQ ID NO: 1397907 - RNA, 19 nt, Homo sapiens
ccaaacucauccuuucuga

SEQ ID NO: 1397908 - RNA, 19 nt, Homo sapiens
ggaccaggaugaagaucug

SEQ ID NO: 1397909 - RNA, 19 nt, Homo sapiens
acaggaacacucagaauaa

SEQ ID NO: 1397910 - RNA, 19 nt, Homo sapiens
caagucacaucauauaugc

SEQ ID NO: 1397911 - RNA, 19 nt, Homo sapiens
cagcaccucuagucauuug

SEQ ID NO: 1397912 - RNA, 19 nt, Homo sapiens
ggaacaagcgucccugauc

SEQ ID NO: 1397913 - RNA, 19 nt, Homo sapiens
ccucaucccucucgucuuc

SEQ ID NO: 1397914 - RNA, 19 nt, Homo sapiens
gagauuugauuucguuguc

SEQ ID NO: 1397915 - RNA, 19 nt, Homo sapiens
cacaggaacacucagaaua

SEQ ID NO: 1397916 - RNA, 19 nt, Homo sapiens
ccauggagauauugguuau

SEQ ID NO: 1397917 - RNA, 19 nt, Homo sapiens
agucaucucuuucuacaau

SEQ ID NO: 1397918 - RNA, 19 nt, Homo sapiens
uggacaaucuucuuucaga

SEQ ID NO: 1397919 - RNA, 19 nt, Homo sapiens
gcgguuaaaucccaagauc

SEQ ID NO: 1397920 - RNA, 19 nt, Homo sapiens
ggaaguugguagacuaggu

SEQ ID NO: 1397921 - RNA, 19 nt, Homo sapiens
cagaagguguucagaugga

SEQ ID NO: 1397922 - RNA, 19 nt, Homo sapiens
ggacugccuuucucucucu

SEQ ID NO: 1397923 - RNA, 19 nt, Homo sapiens
ggaaaccaaacaaucaguu

SEQ ID NO: 1397924 - RNA, 19 nt, Homo sapiens
gguuggagaguauugauuu

SEQ ID NO: 1397925 - RNA, 19 nt, Homo sapiens
gguggacaaucuucuuuca

SEQ ID NO: 1397926 - RNA, 19 nt, Homo sapiens
ugccuuaucuggaagcaaa

SEQ ID NO: 1397927 - RNA, 19 nt, Homo sapiens
uauaugcgaucuggccuaa

SEQ ID NO: 1397928 - RNA, 19 nt, Homo sapiens
gugugaggaugaaauaaug

SEQ ID NO: 1397929 - RNA, 19 nt, Homo sapiens
caaauaggaaguugguaga

SEQ ID NO: 1397930 - RNA, 19 nt, Homo sapiens
aaacacaguugcagagaac

SEQ ID NO: 1397931 - RNA, 19 nt, Homo sapiens
gacaagaccaaauggauuc

SEQ ID NO: 1397932 - RNA, 19 nt, Homo sapiens
caggaacacucagaauaau

SEQ ID NO: 1397933 - RNA, 19 nt, Homo sapiens
agaaacacccucacaggaa

SEQ ID NO: 1397934 - RNA, 19 nt, Homo sapiens
auaggaaguugguagacua

SEQ ID NO: 1397935 - RNA, 19 nt, Homo sapiens
uguugugacugucuuauga

SEQ ID NO: 1397936 - RNA, 19 nt, Homo sapiens
gguacagcgacuuuaaaua

SEQ ID NO: 1397937 - RNA, 19 nt, Homo sapiens
aaacacagcaccucuaguc

SEQ ID NO: 1397938 - RNA, 19 nt, Homo sapiens
ucccacaucuuuacuuuca

SEQ ID NO: 1397939 - RNA, 19 nt, Homo sapiens
gagacaagaccaaauggau

SEQ ID NO: 1397940 - RNA, 19 nt, Homo sapiens
agacacagcacaucccaaa

SEQ ID NO: 1397941 - RNA, 19 nt, Homo sapiens
gcaaagaagagcaaaagaa

SEQ ID NO: 1397942 - RNA, 19 nt, Homo sapiens
caaguuggaaaucugagua

SEQ ID NO: 1397943 - RNA, 19 nt, Homo sapiens
caaggaagagaugauguuu

SEQ ID NO: 1397944 - RNA, 19 nt, Homo sapiens
gagaagagcccgguugcau

SEQ ID NO: 1397945 - RNA, 19 nt, Homo sapiens
uuggaaaucugaguaaaga

SEQ ID NO: 1397946 - RNA, 19 nt, Homo sapiens
caagaccauuguacugcaa

SEQ ID NO: 1397947 - RNA, 19 nt, Homo sapiens
ugggaaaggcugaugagua

SEQ ID NO: 1397948 - RNA, 19 nt, Homo sapiens
aagcgucccugauccagaa

SEQ ID NO: 1397949 - RNA, 19 nt, Homo sapiens
gcacucagcugacuauuga

SEQ ID NO: 1397950 - RNA, 19 nt, Homo sapiens
gaagaaagaucuagcugaa

SEQ ID NO: 1397951 - RNA, 19 nt, Homo sapiens
caagugagcucaugaaaga

SEQ ID NO: 1397952 - RNA, 19 nt, Homo sapiens
ccaagaaccugaagaaaga

SEQ ID NO: 1397953 - RNA, 19 nt, Homo sapiens
gaaagaaguuccaggagau

SEQ ID NO: 1397954 - RNA, 19 nt, Homo sapiens
ggaucaagcucauuauaau

SEQ ID NO: 1397955 - RNA, 19 nt, Homo sapiens
ggaacagaaugaacagaaa

SEQ ID NO: 1397956 - RNA, 19 nt, Homo sapiens
gaucuuaccuagccauaug

SEQ ID NO: 1397957 - RNA, 19 nt, Homo sapiens
gaaggagcguucaugaaga

SEQ ID NO: 1397958 - RNA, 19 nt, Homo sapiens
aaucugggcugcaauuuaa

SEQ ID NO: 1397959 - RNA, 19 nt, Homo sapiens
ugaaauacuuguuccacua

SEQ ID NO: 1397960 - RNA, 19 nt, Homo sapiens
ggagaugacuauaagaaca

SEQ ID NO: 1397961 - RNA, 19 nt, Homo sapiens
gcaauccucugacuacugu

SEQ ID NO: 1397962 - RNA, 19 nt, Homo sapiens
caaagacaacccaucaaua

SEQ ID NO: 1397963 - RNA, 19 nt, Homo sapiens
ggaaauguauggaaagcau

SEQ ID NO: 1397964 - RNA, 19 nt, Homo sapiens
aaacucaucuucgcaauau

SEQ ID NO: 1397965 - RNA, 19 nt, Homo sapiens
aaacuccacugaaucauga

SEQ ID NO: 1397966 - RNA, 19 nt, Homo sapiens
gaacugagccuuggaacau

SEQ ID NO: 1397967 - RNA, 19 nt, Homo sapiens
cuacagagccuacuacaga

SEQ ID NO: 1397968 - RNA, 19 nt, Homo sapiens
aaacagacuuugccagaug

SEQ ID NO: 1397969 - RNA, 19 nt, Homo sapiens
caucaggacuuaaaugaca

SEQ ID NO: 1397970 - RNA, 19 nt, Homo sapiens
cuacaaaguuagaaucuuc

SEQ ID NO: 1397971 - RNA, 19 nt, Homo sapiens
aaagacaacccaucaauau

SEQ ID NO: 1397972 - RNA, 19 nt, Homo sapiens
cagcauacauuguccugaa

SEQ ID NO: 1397973 - RNA, 19 nt, Homo sapiens
gaacagaaggccuccacaa

SEQ ID NO: 1397974 - RNA, 19 nt, Homo sapiens
cuacagagauuggacauuc

SEQ ID NO: 1397975 - RNA, 19 nt, Homo sapiens
caagcggacuccagaagaa

SEQ ID NO: 1397976 - RNA, 19 nt, Homo sapiens
gaacauggaacagaaugaa

SEQ ID NO: 1397977 - RNA, 19 nt, Homo sapiens
ccuccaguauuuagauuua

SEQ ID NO: 1397978 - RNA, 19 nt, Homo sapiens
gaaacagacuuugccagau

SEQ ID NO: 1397979 - RNA, 19 nt, Homo sapiens
caacacacaucacacuuac

SEQ ID NO: 1397980 - RNA, 19 nt, Homo sapiens
caacuauugucuuuacuag

SEQ ID NO: 1397981 - RNA, 19 nt, Homo sapiens
gaagucaagugagcucaug

SEQ ID NO: 1397982 - RNA, 19 nt, Homo sapiens
ccagaugauuauuugagua

SEQ ID NO: 1397983 - RNA, 19 nt, Homo sapiens
gaggaucaagcucauuaua

SEQ ID NO: 1397984 - RNA, 19 nt, Homo sapiens
ucaggcagaugaaauacuu

SEQ ID NO: 1397985 - RNA, 19 nt, Homo sapiens
gaacaacacacaucacacu

SEQ ID NO: 1397986 - RNA, 19 nt, Homo sapiens
gcaacuauugucuuuacua

SEQ ID NO: 1397987 - RNA, 19 nt, Homo sapiens
ggaaccaacugaaaauuug

SEQ ID NO: 1397988 - RNA, 19 nt, Homo sapiens
gaacagaaagagcagaagu

SEQ ID NO: 1397989 - RNA, 19 nt, Homo sapiens
caauaucugugacuguaau

SEQ ID NO: 1397990 - RNA, 19 nt, Homo sapiens
agacuuugccagaugauua

SEQ ID NO: 1397991 - RNA, 19 nt, Homo sapiens
gagcguucaugaagauguu

SEQ ID NO: 1397992 - RNA, 19 nt, Homo sapiens
ugauggaaauguauggaaa

SEQ ID NO: 1397993 - RNA, 19 nt, Homo sapiens
cagaaggccuccacaagca

SEQ ID NO: 1397994 - RNA, 19 nt, Homo sapiens
ggaccuggagcuuagcaua

SEQ ID NO: 1397995 - RNA, 19 nt, Homo sapiens
ucaaguggguucaaacuac

SEQ ID NO: 1397996 - RNA, 19 nt, Homo sapiens
gcacaucaggacuuaaaug

SEQ ID NO: 1397997 - RNA, 19 nt, Homo sapiens
cgcaauaucugugacugua

SEQ ID NO: 1397998 - RNA, 19 nt, Homo sapiens
caaacucaucuucgcaaua

SEQ ID NO: 1397999 - RNA, 19 nt, Homo sapiens
caacgaggaugugagaaag

SEQ ID NO: 1398000 - RNA, 19 nt, Homo sapiens
ccacagcccuggagaagac

SEQ ID NO: 1398001 - RNA, 19 nt, Homo sapiens
gagcuuagcauaacuacag

SEQ ID NO: 1398002 - RNA, 19 nt, Homo sapiens
ccacuagacaguaagguuu

SEQ ID NO: 1398003 - RNA, 19 nt, Homo sapiens
gcagaugaaauacuuguuc

SEQ ID NO: 1398004 - RNA, 19 nt, Homo sapiens
gaaaauggaauguucagaa

SEQ ID NO: 1398005 - RNA, 19 nt, Homo sapiens
cguggcaacuauugucuuu

SEQ ID NO: 1398006 - RNA, 19 nt, Homo sapiens
gaacagaaugaacagaaag

SEQ ID NO: 1398007 - RNA, 19 nt, Homo sapiens
agaagcaucuguagggaau

SEQ ID NO: 1398008 - RNA, 19 nt, Homo sapiens
ugacugaauuaccuaagga

SEQ ID NO: 1398009 - RNA, 19 nt, Homo sapiens
agucaaaccugcagaugug

SEQ ID NO: 1398010 - RNA, 19 nt, Homo sapiens
agaaagagcagaagucaag

SEQ ID NO: 1398011 - RNA, 19 nt, Homo sapiens
gcaguggcaucaacuuguc

SEQ ID NO: 1398012 - RNA, 19 nt, Homo sapiens
acaacacacaucacacuua

SEQ ID NO: 1398013 - RNA, 19 nt, Homo sapiens
gacuagagcuccucaucca

SEQ ID NO: 1398014 - RNA, 19 nt, Homo sapiens
gaccuggagcuuagcauaa

SEQ ID NO: 1398015 - RNA, 19 nt, Homo sapiens
gaugauuauuugaguaugg

SEQ ID NO: 1398016 - RNA, 19 nt, Homo sapiens
gaaauacuuguuccacuag

SEQ ID NO: 1398017 - RNA, 19 nt, Homo sapiens
agacaacccaucaauauca

SEQ ID NO: 1398018 - RNA, 19 nt, Homo sapiens
gcaggaagcaaaggcauug

SEQ ID NO: 1398019 - RNA, 19 nt, Homo sapiens
ugacuaacagcauacauug

SEQ ID NO: 1398020 - RNA, 19 nt, Homo sapiens
gguucaaacuacagaucua

SEQ ID NO: 1398021 - RNA, 19 nt, Homo sapiens
ccaacgaggaugugagaaa

SEQ ID NO: 1398022 - RNA, 19 nt, Homo sapiens
gcauugaggcugucugcaa

SEQ ID NO: 1398023 - RNA, 19 nt, Homo sapiens
ugcuaucccuccaguauuu

SEQ ID NO: 1398024 - RNA, 19 nt, Homo sapiens
ccacaagcaccaacauaug

SEQ ID NO: 1398025 - RNA, 19 nt, Homo sapiens
caucgaagccugacugaag

SEQ ID NO: 1398026 - RNA, 19 nt, Homo sapiens
caaguggguucaaacuaca

SEQ ID NO: 1398027 - RNA, 19 nt, Homo sapiens
gcaauaucugugacuguaa

SEQ ID NO: 1398028 - RNA, 19 nt, Homo sapiens
gagaugacuauaagaacaa

SEQ ID NO: 1398029 - RNA, 19 nt, Homo sapiens
ggaagcaaaggcauugaau

SEQ ID NO: 1398030 - RNA, 19 nt, Homo sapiens
ccagaaggagcguucauga

SEQ ID NO: 1398031 - RNA, 19 nt, Homo sapiens
gaugacuguugaacuggaa

SEQ ID NO: 1398032 - RNA, 19 nt, Homo sapiens
guuagaaucuucgcaggau

SEQ ID NO: 1398033 - RNA, 19 nt, Homo sapiens
gcccaaguuuacagucaaa

SEQ ID NO: 1398034 - RNA, 19 nt, Homo sapiens
caggagaugacuauaagaa

SEQ ID NO: 1398035 - RNA, 19 nt, Homo sapiens
cauguuauccggaccuuga

SEQ ID NO: 1398036 - RNA, 19 nt, Homo sapiens
gaaccugaagaaagaucua

SEQ ID NO: 1398037 - RNA, 19 nt, Homo sapiens
gcgagcagcaggaagcaaa

SEQ ID NO: 1398038 - RNA, 19 nt, Homo sapiens
cacgaugacuguugaacug

SEQ ID NO: 1398039 - RNA, 19 nt, Homo sapiens
acacacaucacacuuacaa

SEQ ID NO: 1398040 - RNA, 19 nt, Homo sapiens
cagagacccuugaagacau

SEQ ID NO: 1398041 - RNA, 19 nt, Homo sapiens
ccacaccaauuauccaaac

SEQ ID NO: 1398042 - RNA, 19 nt, Homo sapiens
ggcggaaccuucuucuaca

SEQ ID NO: 1398043 - RNA, 19 nt, Homo sapiens
caaacuccacugaaucaug

SEQ ID NO: 1398044 - RNA, 19 nt, Homo sapiens
gaugugagaaaguucaugu

SEQ ID NO: 1398045 - RNA, 19 nt, Homo sapiens
cacaucaggacuuaaauga

SEQ ID NO: 1398046 - RNA, 19 nt, Homo sapiens
cauacauuguccugaagaa

SEQ ID NO: 1398047 - RNA, 19 nt, Homo sapiens
ccagaacccacuacagaga

SEQ ID NO: 1398048 - RNA, 19 nt, Homo sapiens
cagccuaccuccagaacuc

SEQ ID NO: 1398049 - RNA, 19 nt, Homo sapiens
ggaaggcggugcaggcuau

SEQ ID NO: 1398050 - RNA, 19 nt, Homo sapiens
gaaccgguguacuucaaga

SEQ ID NO: 1398051 - RNA, 19 nt, Homo sapiens
gaaagugccaggcgagaug

SEQ ID NO: 1398052 - RNA, 19 nt, Homo sapiens
ggaauuugccagugacuuc

SEQ ID NO: 1398053 - RNA, 19 nt, Homo sapiens
ggcagcaccucgagcagaa

SEQ ID NO: 1398054 - RNA, 19 nt, Homo sapiens
cuggugagguucuuuguga

SEQ ID NO: 1398055 - RNA, 19 nt, Homo sapiens
gguggucgccgaggaauuu

SEQ ID NO: 1398056 - RNA, 19 nt, Homo sapiens
ccgaggaauuugccaguga

SEQ ID NO: 1398057 - RNA, 19 nt, Homo sapiens
ggaaagcccacgcccucaa

SEQ ID NO: 1398058 - RNA, 19 nt, Homo sapiens
ucaacacugucguggagaa

SEQ ID NO: 1398059 - RNA, 19 nt, Homo sapiens
aagcacgccugccgaguca

SEQ ID NO: 1398060 - RNA, 19 nt, Homo sapiens
uggaaccgguguacuucaa

SEQ ID NO: 1398061 - RNA, 19 nt, Homo sapiens
gaaagcccacgcccucaag

SEQ ID NO: 1398062 - RNA, 19 nt, Homo sapiens
caagcugcguggccucauc

SEQ ID NO: 1398063 - RNA, 19 nt, Homo sapiens
cgugaccgcugccuacaag

SEQ ID NO: 1398064 - RNA, 19 nt, Homo sapiens
caggcgagauggagaucga

SEQ ID NO: 1398065 - RNA, 19 nt, Homo sapiens
ccucugugcucgcccuugu

SEQ ID NO: 1398066 - RNA, 19 nt, Homo sapiens
gaccgcugccuacaaggaa

SEQ ID NO: 1398067 - RNA, 19 nt, Homo sapiens
gcaguacuucagccaguuc

SEQ ID NO: 1398068 - RNA, 19 nt, Homo sapiens
gauccucucuggggucauu

SEQ ID NO: 1398069 - RNA, 19 nt, Homo sapiens
gcacaggcaugccaaauuu

SEQ ID NO: 1398070 - RNA, 19 nt, Homo sapiens
gagaagagaaagcuguuua

SEQ ID NO: 1398071 - RNA, 19 nt, Homo sapiens
gaagagauggagaaaguaa

SEQ ID NO: 1398072 - RNA, 19 nt, Homo sapiens
gauaagacccgagcuuuga

SEQ ID NO: 1398073 - RNA, 19 nt, Homo sapiens
gaaagcuguuuauccauuc

SEQ ID NO: 1398074 - RNA, 19 nt, Homo sapiens
gaaggcagaaucaagcuuu

SEQ ID NO: 1398075 - RNA, 19 nt, Homo sapiens
agaaagcuguuuauccauu

SEQ ID NO: 1398076 - RNA, 19 nt, Homo sapiens
agagaaagcuguuuaucca

SEQ ID NO: 1398077 - RNA, 19 nt, Homo sapiens
uaaauggcuuacuggauga

SEQ ID NO: 1398078 - RNA, 19 nt, Homo sapiens
gggugaagguacaauaaau

SEQ ID NO: 1398079 - RNA, 19 nt, Homo sapiens
aggaagagauggagaaagu

SEQ ID NO: 1398080 - RNA, 19 nt, Homo sapiens
ggauaagacccgagcuuug

SEQ ID NO: 1398081 - RNA, 19 nt, Homo sapiens
uacaauaaauggcuuacug

SEQ ID NO: 1398082 - RNA, 19 nt, Homo sapiens
gaagagaaagcuguuuauc

SEQ ID NO: 1398083 - RNA, 19 nt, Homo sapiens
caaauuugcaucacauaca

SEQ ID NO: 1398084 - RNA, 19 nt, Homo sapiens
agacaagggugcugaacca

SEQ ID NO: 1398085 - RNA, 19 nt, Homo sapiens
ggaagagauggagaaagua

SEQ ID NO: 1398086 - RNA, 19 nt, Homo sapiens
uggcuuacuggaugaauua

SEQ ID NO: 1398087 - RNA, 19 nt, Homo sapiens
cuggaugaauuauuacaga

SEQ ID NO: 1398088 - RNA, 19 nt, Homo sapiens
ggugaagguacaauaaaug

SEQ ID NO: 1398089 - RNA, 19 nt, Homo sapiens
ggagaagagaaagcuguuu

SEQ ID NO: 1398090 - RNA, 19 nt, Homo sapiens
ugacuccguuauuccgaaa

SEQ ID NO: 1398091 - RNA, 19 nt, Homo sapiens
ugaaaaugcuacaguuaug

SEQ ID NO: 1398092 - RNA, 19 nt, Homo sapiens
gacccgagcuuugauugac

SEQ ID NO: 1398093 - RNA, 19 nt, Homo sapiens
uugauugacuccguuauuc

SEQ ID NO: 1398094 - RNA, 19 nt, Homo sapiens
uaagacccgagcuuugauu

SEQ ID NO: 1398095 - RNA, 19 nt, Homo sapiens
caugggugaagguacaaua

SEQ ID NO: 1398096 - RNA, 19 nt, Homo sapiens
ggaugaauuauuacagaca

SEQ ID NO: 1398097 - RNA, 19 nt, Homo sapiens
gcgaggacaacccagcuau

SEQ ID NO: 1398098 - RNA, 19 nt, Homo sapiens
gccaaauuugcaucacaua

SEQ ID NO: 1398099 - RNA, 19 nt, Homo sapiens
agaagagaaagcuguuuau

SEQ ID NO: 1398100 - RNA, 19 nt, Homo sapiens
gugaagguacaauaaaugg

SEQ ID NO: 1398101 - RNA, 19 nt, Homo sapiens
uggauaagacccgagcuuu

SEQ ID NO: 1398102 - RNA, 19 nt, Homo sapiens
gaggacaacccagcuaugc

SEQ ID NO: 1398103 - RNA, 19 nt, Homo sapiens
ccaggaagagauggagaaa

SEQ ID NO: 1398104 - RNA, 19 nt, Homo sapiens
gcugaaccaggaagagaug

SEQ ID NO: 1398105 - RNA, 19 nt, Homo sapiens
gagaaagcuguuuauccau

SEQ ID NO: 1398106 - RNA, 19 nt, Homo sapiens
gcuaugcccacaugcucaa

SEQ ID NO: 1398107 - RNA, 19 nt, Homo sapiens
auacauuugugaagaagac

SEQ ID NO: 1398108 - RNA, 19 nt, Homo sapiens
gcuuugauugacuccguua

SEQ ID NO: 1398109 - RNA, 19 nt, Homo sapiens
ggagauaccuuuccagaug

SEQ ID NO: 1398110 - RNA, 19 nt, Homo sapiens
ccacagaccuccaauaaag

SEQ ID NO: 1398111 - RNA, 19 nt, Homo sapiens
caaaggcucugcucaguuc

SEQ ID NO: 1398112 - RNA, 19 nt, Homo sapiens
gcacaacuuugaccugaug

SEQ ID NO: 1398113 - RNA, 19 nt, Homo sapiens
ggccauugcuccagaugua

SEQ ID NO: 1398114 - RNA, 19 nt, Homo sapiens
ccuaauaccucuaccuuuc

SEQ ID NO: 1398115 - RNA, 19 nt, Homo sapiens
ccucggaccuuuacgcuuu

SEQ ID NO: 1398116 - RNA, 19 nt, Homo sapiens
gaacggugcugcucugacu

SEQ ID NO: 1398117 - RNA, 19 nt, Homo sapiens
gggcagacccagccacaua

SEQ ID NO: 1398118 - RNA, 19 nt, Homo sapiens
gaugucagcuccaaacucu

SEQ ID NO: 1398119 - RNA, 19 nt, Homo sapiens
acucugagguugcuuguuu

SEQ ID NO: 1398120 - RNA, 19 nt, Homo sapiens
gaaccuaggcugugaccuu

SEQ ID NO: 1398121 - RNA, 19 nt, Homo sapiens
ucauuaagcuauugacuag

SEQ ID NO: 1398122 - RNA, 19 nt, Homo sapiens
uggcugagcuggagcagaa

SEQ ID NO: 1398123 - RNA, 19 nt, Homo sapiens
gcacgucuauucaggaaac

SEQ ID NO: 1398124 - RNA, 19 nt, Homo sapiens
ggcgcagggucauaaauuu

SEQ ID NO: 1398125 - RNA, 19 nt, Homo sapiens
gagauaccuuuccagaugu

SEQ ID NO: 1398126 - RNA, 19 nt, Homo sapiens
ccucaaugcuacagaguug

SEQ ID NO: 1398127 - RNA, 19 nt, Homo sapiens
aaucacaccuggacaaucu

SEQ ID NO: 1398128 - RNA, 19 nt, Homo sapiens
uuucgucccugacuccuua

SEQ ID NO: 1398129 - RNA, 19 nt, Homo sapiens
ugucaccacugcagauauu

SEQ ID NO: 1398130 - RNA, 19 nt, Homo sapiens
gacaaucucgugcuaccua

SEQ ID NO: 1398131 - RNA, 19 nt, Homo sapiens
gagaagggaaggaauaugg

SEQ ID NO: 1398132 - RNA, 19 nt, Homo sapiens
ccaaugcuaccaaggaauu

SEQ ID NO: 1398133 - RNA, 19 nt, Homo sapiens
caaccucuguccaguccuu

SEQ ID NO: 1398134 - RNA, 19 nt, Homo sapiens
ggauggcucuccagauguc

SEQ ID NO: 1398135 - RNA, 19 nt, Homo sapiens
gggcgcagggucauaaauu

SEQ ID NO: 1398136 - RNA, 19 nt, Homo sapiens
uuaauccuguguugcaauu

SEQ ID NO: 1398137 - RNA, 19 nt, Homo sapiens
cccaaggcaucucuguuaa

SEQ ID NO: 1398138 - RNA, 19 nt, Homo sapiens
gcuggaauccugcaacaau

SEQ ID NO: 1398139 - RNA, 19 nt, Homo sapiens
gggaacccuuguccuucua

SEQ ID NO: 1398140 - RNA, 19 nt, Homo sapiens
caagggcgcagggucauaa

SEQ ID NO: 1398141 - RNA, 19 nt, Homo sapiens
uuggaucccugcccacuaa

SEQ ID NO: 1398142 - RNA, 19 nt, Homo sapiens
acaaaaggcuguccagaug

SEQ ID NO: 1398143 - RNA, 19 nt, Homo sapiens
gcucauggacucugucauc

SEQ ID NO: 1398144 - RNA, 19 nt, Homo sapiens
cuacucggauugcuacugu

SEQ ID NO: 1398145 - RNA, 19 nt, Homo sapiens
ucauaaauuugcccuugga

SEQ ID NO: 1398146 - RNA, 19 nt, Homo sapiens
ggucauccuuggagacuac

SEQ ID NO: 1398147 - RNA, 19 nt, Homo sapiens
gaugucaccacugcagaua

SEQ ID NO: 1398148 - RNA, 19 nt, Homo sapiens
agggauggcucuccagaug

SEQ ID NO: 1398149 - RNA, 19 nt, Homo sapiens
gcgcagggucauaaauuug

SEQ ID NO: 1398150 - RNA, 19 nt, Homo sapiens
ggagacuggagauaccuuu

SEQ ID NO: 1398151 - RNA, 19 nt, Homo sapiens
acaaucgccucuaccacuu

SEQ ID NO: 1398152 - RNA, 19 nt, Homo sapiens
aaccuaggcugugaccuuu

SEQ ID NO: 1398153 - RNA, 19 nt, Homo sapiens
caguacaccuccagcuuca

SEQ ID NO: 1398154 - RNA, 19 nt, Homo sapiens
gcaagggcgcagggucaua

SEQ ID NO: 1398155 - RNA, 19 nt, Homo sapiens
cggcacgucuauucaggaa

SEQ ID NO: 1398156 - RNA, 19 nt, Homo sapiens
agccacagaccuccaauaa

SEQ ID NO: 1398157 - RNA, 19 nt, Homo sapiens
gcagucacccuggcuggaa

SEQ ID NO: 1398158 - RNA, 19 nt, Homo sapiens
gucaaaggcucugcucagu

SEQ ID NO: 1398159 - RNA, 19 nt, Homo sapiens
gaacccuuguccuucuaca

SEQ ID NO: 1398160 - RNA, 19 nt, Homo sapiens
gccacuugcugagccagua

SEQ ID NO: 1398161 - RNA, 19 nt, Homo sapiens
ggccaucccucagccacuu

SEQ ID NO: 1398162 - RNA, 19 nt, Homo sapiens
uacgagaagggaaggaaua

SEQ ID NO: 1398163 - RNA, 19 nt, Homo sapiens
gccacagaccuccaauaaa

SEQ ID NO: 1398164 - RNA, 19 nt, Homo sapiens
ccuggacaaucucgugcua

SEQ ID NO: 1398165 - RNA, 19 nt, Homo sapiens
gcucggacggcuacgugua

SEQ ID NO: 1398166 - RNA, 19 nt, Homo sapiens
agacaucggcuacgguuuc

SEQ ID NO: 1398167 - RNA, 19 nt, Homo sapiens
gccaggagugucucuaaga

SEQ ID NO: 1398168 - RNA, 19 nt, Homo sapiens
gcucugcucaguucucugu

SEQ ID NO: 1398169 - RNA, 19 nt, Homo sapiens
ccgaggccaaccagaaaua

SEQ ID NO: 1398170 - RNA, 19 nt, Homo sapiens
acaugaaccuaggcuguga

SEQ ID NO: 1398171 - RNA, 19 nt, Homo sapiens
uguuaggccugaccaagga

SEQ ID NO: 1398172 - RNA, 19 nt, Homo sapiens
gccuauaguuggcuuuguc

SEQ ID NO: 1398173 - RNA, 19 nt, Homo sapiens
ucaaaggcucugcucaguu

SEQ ID NO: 1398174 - RNA, 19 nt, Homo sapiens
ugccaaugcuaccaaggaa

SEQ ID NO: 1398175 - RNA, 19 nt, Homo sapiens
ccauuucauuaagcuauug

SEQ ID NO: 1398176 - RNA, 19 nt, Homo sapiens
uagaaucacaccuggacaa

SEQ ID NO: 1398177 - RNA, 19 nt, Homo sapiens
cuccagcacugccgagguu

SEQ ID NO: 1398178 - RNA, 19 nt, Homo sapiens
cuaccaaggaauucacuga

SEQ ID NO: 1398179 - RNA, 19 nt, Homo sapiens
guacaccuccagcuucagu

SEQ ID NO: 1398180 - RNA, 19 nt, Homo sapiens
caaggcaucucuguuaacc

SEQ ID NO: 1398181 - RNA, 19 nt, Homo sapiens
cugccacuccauuucauua

SEQ ID NO: 1398182 - RNA, 19 nt, Homo sapiens
cuggaauccugcaacaaug

SEQ ID NO: 1398183 - RNA, 19 nt, Homo sapiens
acuaagcccagagcuguua

SEQ ID NO: 1398184 - RNA, 19 nt, Homo sapiens
uguccucacucucucacuu

SEQ ID NO: 1398185 - RNA, 19 nt, Homo sapiens
gccacuccauuucauuaag

SEQ ID NO: 1398186 - RNA, 19 nt, Homo sapiens
aagcuggaauccugcaaca

SEQ ID NO: 1398187 - RNA, 19 nt, Homo sapiens
cagucacccuggcuggaaa

SEQ ID NO: 1398188 - RNA, 19 nt, Homo sapiens
ccacuccauuucauuaagc

SEQ ID NO: 1398189 - RNA, 19 nt, Homo sapiens
uaugccagcacaacuuuga

SEQ ID NO: 1398190 - RNA, 19 nt, Homo sapiens
ccagccagccuguccuuuc

SEQ ID NO: 1398191 - RNA, 19 nt, Homo sapiens
guacgagaagggaaggaau

SEQ ID NO: 1398192 - RNA, 19 nt, Homo sapiens
cagccacagaccuccaaua

SEQ ID NO: 1398193 - RNA, 19 nt, Homo sapiens
ccaucucggccuauaguug

SEQ ID NO: 1398194 - RNA, 19 nt, Homo sapiens
acauccaucucggccuaua

SEQ ID NO: 1398195 - RNA, 19 nt, Homo sapiens
gaaucacaccuggacaauc

SEQ ID NO: 1398196 - RNA, 19 nt, Homo sapiens
uaauaccucuaccuuucca

SEQ ID NO: 1398197 - RNA, 19 nt, Homo sapiens
gccaguacaccuccagcuu

SEQ ID NO: 1398198 - RNA, 19 nt, Homo sapiens
ucccugauccugugacuuc

SEQ ID NO: 1398199 - RNA, 19 nt, Homo sapiens
ccaaauaugucaucaucau

SEQ ID NO: 1398200 - RNA, 19 nt, Homo sapiens
ccaaggcucucacacuuau

SEQ ID NO: 1398201 - RNA, 19 nt, Homo sapiens
ggcacaagcugcacuguau

SEQ ID NO: 1398202 - RNA, 19 nt, Homo sapiens
gaaccucccagccaaauau

SEQ ID NO: 1398203 - RNA, 19 nt, Homo sapiens
gauauugcccuaggaauug

SEQ ID NO: 1398204 - RNA, 19 nt, Homo sapiens
gcaccuggccucauuucaa

SEQ ID NO: 1398205 - RNA, 19 nt, Homo sapiens
guaccugacuccaaacuac

SEQ ID NO: 1398206 - RNA, 19 nt, Homo sapiens
gggcaggcuuuguauaaca

SEQ ID NO: 1398207 - RNA, 19 nt, Homo sapiens
gauccagugugccgugguu

SEQ ID NO: 1398208 - RNA, 19 nt, Homo sapiens
gagacacacugcccuaaaa

SEQ ID NO: 1398209 - RNA, 19 nt, Homo sapiens
cgauauugcccuaggaauu

SEQ ID NO: 1398210 - RNA, 19 nt, Homo sapiens
caacgauauugcccuagga

SEQ ID NO: 1398211 - RNA, 19 nt, Homo sapiens
acuuauggauucaacgaua

SEQ ID NO: 1398212 - RNA, 19 nt, Homo sapiens
cgacguggcguacaacuuc

SEQ ID NO: 1398213 - RNA, 19 nt, Homo sapiens
ccaggaugguggcguguau

SEQ ID NO: 1398214 - RNA, 19 nt, Homo sapiens
cuucuugccuucuucauuc

SEQ ID NO: 1398215 - RNA, 19 nt, Homo sapiens
cuucaucggcuacuuugua

SEQ ID NO: 1398216 - RNA, 19 nt, Homo sapiens
gccagacugucguccgaaa

SEQ ID NO: 1398217 - RNA, 19 nt, Homo sapiens
gcucucacacuuauggauu

SEQ ID NO: 1398218 - RNA, 19 nt, Homo sapiens
gaacuuuugugacauugga

SEQ ID NO: 1398219 - RNA, 19 nt, Homo sapiens
gcagucccauuccgucuac

SEQ ID NO: 1398220 - RNA, 19 nt, Homo sapiens
ggugcgacguggcguacaa

SEQ ID NO: 1398221 - RNA, 19 nt, Homo sapiens
gagagacacacugcccuaa

SEQ ID NO: 1398222 - RNA, 19 nt, Homo sapiens
caccuggccucauuucaag

SEQ ID NO: 1398223 - RNA, 19 nt, Homo sapiens
gaugguggcguguaugaag

SEQ ID NO: 1398224 - RNA, 19 nt, Homo sapiens
ccuaggaauugccuucauc

SEQ ID NO: 1398225 - RNA, 19 nt, Homo sapiens
ugacauuggauaucacuuc

SEQ ID NO: 1398226 - RNA, 19 nt, Homo sapiens
uggccuacaucaucacaga

SEQ ID NO: 1398227 - RNA, 19 nt, Homo sapiens
agccaaauaugucaucauc

SEQ ID NO: 1398228 - RNA, 19 nt, Homo sapiens
cauacaguccuuucacaug

SEQ ID NO: 1398229 - RNA, 19 nt, Homo sapiens
gacugucguccgaaacaua

SEQ ID NO: 1398230 - RNA, 19 nt, Homo sapiens
caggguguaugaagguguu

SEQ ID NO: 1398231 - RNA, 19 nt, Homo sapiens
guagaaaagccuccaaaug

SEQ ID NO: 1398232 - RNA, 19 nt, Homo sapiens
cuuauggauucaacgauau

SEQ ID NO: 1398233 - RNA, 19 nt, Homo sapiens
cugggcaggcuuuguauaa

SEQ ID NO: 1398234 - RNA, 19 nt, Homo sapiens
acacggaacuuuugugaca

SEQ ID NO: 1398235 - RNA, 19 nt, Homo sapiens
gugaugcccaggaagguuu

SEQ ID NO: 1398236 - RNA, 19 nt, Homo sapiens
gaugauggcaggguguaug

SEQ ID NO: 1398237 - RNA, 19 nt, Homo sapiens
caacaucaucaaacgaucu

SEQ ID NO: 1398238 - RNA, 19 nt, Homo sapiens
ccuguggccuacaucauca

SEQ ID NO: 1398239 - RNA, 19 nt, Homo sapiens
ggcaggcuuuguauaacau

SEQ ID NO: 1398240 - RNA, 19 nt, Homo sapiens
gcacaagcugcacuguauc

SEQ ID NO: 1398241 - RNA, 19 nt, Homo sapiens
acgcugccauggcuucuug

SEQ ID NO: 1398242 - RNA, 19 nt, Homo sapiens
uauauucagccacuucuuc

SEQ ID NO: 1398243 - RNA, 19 nt, Homo sapiens
uccaaggcucucacacuua

SEQ ID NO: 1398244 - RNA, 19 nt, Homo sapiens
auccaaggcucucacacuu

SEQ ID NO: 1398245 - RNA, 19 nt, Homo sapiens
caaauaugucaucaucauc

SEQ ID NO: 1398246 - RNA, 19 nt, Homo sapiens
ccagggcuacaacaacauu

SEQ ID NO: 1398247 - RNA, 19 nt, Homo sapiens
ucacacuuauggauucaac

SEQ ID NO: 1398248 - RNA, 19 nt, Homo sapiens
agagacacacugcccuaaa

SEQ ID NO: 1398249 - RNA, 19 nt, Homo sapiens
gcuucuugccuucuucauu

SEQ ID NO: 1398250 - RNA, 19 nt, Homo sapiens
uuugugacauuggauauca

SEQ ID NO: 1398251 - RNA, 19 nt, Homo sapiens
ugaaccucccagccaaaua

SEQ ID NO: 1398252 - RNA, 19 nt, Homo sapiens
acccagggcuacaacaaca

SEQ ID NO: 1398253 - RNA, 19 nt, Homo sapiens
gauggcaggguguaugaag

SEQ ID NO: 1398254 - RNA, 19 nt, Homo sapiens
gguaccugacuccaaacua

SEQ ID NO: 1398255 - RNA, 19 nt, Homo sapiens
uagaaaagccuccaaaugc

SEQ ID NO: 1398256 - RNA, 19 nt, Homo sapiens
ggucuccaggcuugggaua

SEQ ID NO: 1398257 - RNA, 19 nt, Homo sapiens
aacauacaguccuuucaca

SEQ ID NO: 1398258 - RNA, 19 nt, Homo sapiens
uggcacaagcugcacugua

SEQ ID NO: 1398259 - RNA, 19 nt, Homo sapiens
ccauuccgucuacaccaua

SEQ ID NO: 1398260 - RNA, 19 nt, Homo sapiens
cauggacacacggaacuuu

SEQ ID NO: 1398261 - RNA, 19 nt, Homo sapiens
gggaugauggcagggugua

SEQ ID NO: 1398262 - RNA, 19 nt, Homo sapiens
ggaggaaacuucauaguaa

SEQ ID NO: 1398263 - RNA, 19 nt, Homo sapiens
ucacaaugcuacucaaaua

SEQ ID NO: 1398264 - RNA, 19 nt, Homo sapiens
gaacuaaagucuccugcaa

SEQ ID NO: 1398265 - RNA, 19 nt, Homo sapiens
gaaaucagccuuauuagau

SEQ ID NO: 1398266 - RNA, 19 nt, Homo sapiens
gggcaacgcugacagauga

SEQ ID NO: 1398267 - RNA, 19 nt, Homo sapiens
ucaauacgguuacuacuuu

SEQ ID NO: 1398268 - RNA, 19 nt, Homo sapiens
gauauggaccucaauuaua

SEQ ID NO: 1398269 - RNA, 19 nt, Homo sapiens
gcacaaccguacaugauug

SEQ ID NO: 1398270 - RNA, 19 nt, Homo sapiens
cgaaaugccuugcugaaug

SEQ ID NO: 1398271 - RNA, 19 nt, Homo sapiens
gcauugagaauccaaauaa

SEQ ID NO: 1398272 - RNA, 19 nt, Homo sapiens
gaggaaacuucauaguaaa

SEQ ID NO: 1398273 - RNA, 19 nt, Homo sapiens
gaaaugccuugcugaaugg

SEQ ID NO: 1398274 - RNA, 19 nt, Homo sapiens
ggacugcugucuccugaug

SEQ ID NO: 1398275 - RNA, 19 nt, Homo sapiens
gcaccauacuuaacauuca

SEQ ID NO: 1398276 - RNA, 19 nt, Homo sapiens
guauggagcccaaguugua

SEQ ID NO: 1398277 - RNA, 19 nt, Homo sapiens
gaugcucucuggauuaaug

SEQ ID NO: 1398278 - RNA, 19 nt, Homo sapiens
ccaaauaaauaccauggau

SEQ ID NO: 1398279 - RNA, 19 nt, Homo sapiens
gaaguccucucaagugaag

SEQ ID NO: 1398280 - RNA, 19 nt, Homo sapiens
ggauaggaaugcucaggaa

SEQ ID NO: 1398281 - RNA, 19 nt, Homo sapiens
uguaugugcugcauguuua

SEQ ID NO: 1398282 - RNA, 19 nt, Homo sapiens
gcagguauauucgaauugu

SEQ ID NO: 1398283 - RNA, 19 nt, Homo sapiens
ggagaaucaugcugaaauc

SEQ ID NO: 1398284 - RNA, 19 nt, Homo sapiens
gcuaggaaguggugcgauu

SEQ ID NO: 1398285 - RNA, 19 nt, Homo sapiens
gguguaagcacaauucaaa

SEQ ID NO: 1398286 - RNA, 19 nt, Homo sapiens
ggauauggaccucaauuau

SEQ ID NO: 1398287 - RNA, 19 nt, Homo sapiens
gcccgugucugcagguaua

SEQ ID NO: 1398288 - RNA, 19 nt, Homo sapiens
gaccaugguugcugacaga

SEQ ID NO: 1398289 - RNA, 19 nt, Homo sapiens
cuacacaugucaccagcua

SEQ ID NO: 1398290 - RNA, 19 nt, Homo sapiens
uaaauaccauggaucauac

SEQ ID NO: 1398291 - RNA, 19 nt, Homo sapiens
gggauauggaccucaauua

SEQ ID NO: 1398292 - RNA, 19 nt, Homo sapiens
gugcuugucuccuuguuga

SEQ ID NO: 1398293 - RNA, 19 nt, Homo sapiens
ggaauuguauaggaggaaa

SEQ ID NO: 1398294 - RNA, 19 nt, Homo sapiens
gugaagagagcauuauuau

SEQ ID NO: 1398295 - RNA, 19 nt, Homo sapiens
ggacacacaacacagcaaa

SEQ ID NO: 1398296 - RNA, 19 nt, Homo sapiens
caauaucugugucguucuu

SEQ ID NO: 1398297 - RNA, 19 nt, Homo sapiens
ggucagccauccguuauca

SEQ ID NO: 1398298 - RNA, 19 nt, Homo sapiens
caugcaggcugugcguuua

SEQ ID NO: 1398299 - RNA, 19 nt, Homo sapiens
gcauguuuauggauaggaa

SEQ ID NO: 1398300 - RNA, 19 nt, Homo sapiens
caacacagugaacaagauu

SEQ ID NO: 1398301 - RNA, 19 nt, Homo sapiens
ugaaaucagccuuauuaga

SEQ ID NO: 1398302 - RNA, 19 nt, Homo sapiens
gaagaaaacauugcaacua

SEQ ID NO: 1398303 - RNA, 19 nt, Homo sapiens
auauggaccucaauuauag

SEQ ID NO: 1398304 - RNA, 19 nt, Homo sapiens
gcuacuacguugagguuuc

SEQ ID NO: 1398305 - RNA, 19 nt, Homo sapiens
uauaggaggaaacuucaua

SEQ ID NO: 1398306 - RNA, 19 nt, Homo sapiens
caaggcacccaauugauga

SEQ ID NO: 1398307 - RNA, 19 nt, Homo sapiens
gaaguauggagcccaaguu

SEQ ID NO: 1398308 - RNA, 19 nt, Homo sapiens
gaaauuccucuccaagaca

SEQ ID NO: 1398309 - RNA, 19 nt, Homo sapiens
guuccacuguguccacuuu

SEQ ID NO: 1398310 - RNA, 19 nt, Homo sapiens
guuccggcaucgagauuaa

SEQ ID NO: 1398311 - RNA, 19 nt, Homo sapiens
ccauuaaagugcgaucuga

SEQ ID NO: 1398312 - RNA, 19 nt, Homo sapiens
caaccggcagcaccaauaa

SEQ ID NO: 1398313 - RNA, 19 nt, Homo sapiens
cgagauagccggucuuacu

SEQ ID NO: 1398314 - RNA, 19 nt, Homo sapiens
gaaaacauugcaacuauga

SEQ ID NO: 1398315 - RNA, 19 nt, Homo sapiens
caagggagccucaucaaaa

SEQ ID NO: 1398316 - RNA, 19 nt, Homo sapiens
uggaugcucucuggauuaa

SEQ ID NO: 1398317 - RNA, 19 nt, Homo sapiens
aaaucagccuuauuagaug

SEQ ID NO: 1398318 - RNA, 19 nt, Homo sapiens
aaaggagaaucaugcugaa

SEQ ID NO: 1398319 - RNA, 19 nt, Homo sapiens
gaguauaacccagugaaga

SEQ ID NO: 1398320 - RNA, 19 nt, Homo sapiens
guuggaugcucucuggauu

SEQ ID NO: 1398321 - RNA, 19 nt, Homo sapiens
ggguucauguuuauuguuc

SEQ ID NO: 1398322 - RNA, 19 nt, Homo sapiens
ccaagggagccucaucaaa

SEQ ID NO: 1398323 - RNA, 19 nt, Homo sapiens
gcugugcguuuaccucuca

SEQ ID NO: 1398324 - RNA, 19 nt, Homo sapiens
guuaagagacucauuugca

SEQ ID NO: 1398325 - RNA, 19 nt, Homo sapiens
gccagucucuacucacuuc

SEQ ID NO: 1398326 - RNA, 19 nt, Homo sapiens
agacaccacugcagaagca

SEQ ID NO: 1398327 - RNA, 19 nt, Homo sapiens
caauacgguuacuacuuug

SEQ ID NO: 1398328 - RNA, 19 nt, Homo sapiens
ucacauacggauacucuug

SEQ ID NO: 1398329 - RNA, 19 nt, Homo sapiens
ccaaccggcagcaccaaua

SEQ ID NO: 1398330 - RNA, 19 nt, Homo sapiens
aggaggaaacuucauagua

SEQ ID NO: 1398331 - RNA, 19 nt, Homo sapiens
gaucugagagccgggauau

SEQ ID NO: 1398332 - RNA, 19 nt, Homo sapiens
guaagcacaauucaaagga

SEQ ID NO: 1398333 - RNA, 19 nt, Homo sapiens
gguuuccucucccuuucua

SEQ ID NO: 1398334 - RNA, 19 nt, Homo sapiens
uaucucugcaccauacuua

SEQ ID NO: 1398335 - RNA, 19 nt, Homo sapiens
uuccagagcuagaggauuc

SEQ ID NO: 1398336 - RNA, 19 nt, Homo sapiens
cagaaauuccucuccaaga

SEQ ID NO: 1398337 - RNA, 19 nt, Homo sapiens
ggaggaaaauagugaggaa

SEQ ID NO: 1398338 - RNA, 19 nt, Homo sapiens
acuaaagucuccugcaagu

SEQ ID NO: 1398339 - RNA, 19 nt, Homo sapiens
cugcagguauauucgaauu

SEQ ID NO: 1398340 - RNA, 19 nt, Homo sapiens
ggaaguccucucaagugaa

SEQ ID NO: 1398341 - RNA, 19 nt, Homo sapiens
ccucugugcuugucuccuu

SEQ ID NO: 1398342 - RNA, 19 nt, Homo sapiens
gauagccggucuuacucau

SEQ ID NO: 1398343 - RNA, 19 nt, Homo sapiens
ccaagacaccacugcagaa

SEQ ID NO: 1398344 - RNA, 19 nt, Homo sapiens
agaaauuccucuccaagac

SEQ ID NO: 1398345 - RNA, 19 nt, Homo sapiens
agugaagagagcauuauua

SEQ ID NO: 1398346 - RNA, 19 nt, Homo sapiens
gggacacuaagaauuauga

SEQ ID NO: 1398347 - RNA, 19 nt, Homo sapiens
aacaaaaccuucacucuug

SEQ ID NO: 1398348 - RNA, 19 nt, Homo sapiens
acaacacagugaacaagau

SEQ ID NO: 1398349 - RNA, 19 nt, Homo sapiens
cuuauuagauggugauacu

SEQ ID NO: 1398350 - RNA, 19 nt, Homo sapiens
ccauggaucauacaggauu

SEQ ID NO: 1398351 - RNA, 19 nt, Homo sapiens
gaucauucacaauaucugu

SEQ ID NO: 1398352 - RNA, 19 nt, Homo sapiens
ggcacaaccguacaugauu

SEQ ID NO: 1398353 - RNA, 19 nt, Homo sapiens
ggaaacuucauaguaaaca

SEQ ID NO: 1398354 - RNA, 19 nt, Homo sapiens
cuaggucagccauccguua

SEQ ID NO: 1398355 - RNA, 19 nt, Homo sapiens
uuauuaaacugguguaagc

SEQ ID NO: 1398356 - RNA, 19 nt, Homo sapiens
guggugcgauugugguuca

SEQ ID NO: 1398357 - RNA, 19 nt, Homo sapiens
acauugcaacuaugaagua

SEQ ID NO: 1398358 - RNA, 19 nt, Homo sapiens
uaacuuguaugugcugcau

SEQ ID NO: 1398359 - RNA, 19 nt, Homo sapiens
agccauccguuaucaauca

SEQ ID NO: 1398360 - RNA, 19 nt, Homo sapiens
ggcacccaauugaugauga

SEQ ID NO: 1398361 - RNA, 19 nt, Homo sapiens
uugcaacuaugaaguaugg

SEQ ID NO: 1398362 - RNA, 19 nt, Homo sapiens
gauggaagcuuuaaccuuu

SEQ ID NO: 1398363 - RNA, 19 nt, Homo sapiens
gggagacacucuuaauuua

SEQ ID NO: 1398364 - RNA, 19 nt, Homo sapiens
gcggaaagcuguugcuaug

SEQ ID NO: 1398365 - RNA, 19 nt, Homo sapiens
ccucauagcuuuaaauucu

SEQ ID NO: 1398366 - RNA, 19 nt, Homo sapiens
gaaagagacguugugauga

SEQ ID NO: 1398367 - RNA, 19 nt, Homo sapiens
ugaaagagacguugugaug

SEQ ID NO: 1398368 - RNA, 19 nt, Homo sapiens
ccaccuaccuccaguguca

SEQ ID NO: 1398369 - RNA, 19 nt, Homo sapiens
ggaggaaacuggccccaua

SEQ ID NO: 1398370 - RNA, 19 nt, Homo sapiens
gcucaaccacaguuuauuu

SEQ ID NO: 1398371 - RNA, 19 nt, Homo sapiens
aaagagacguugugaugau

SEQ ID NO: 1398372 - RNA, 19 nt, Homo sapiens
caagaagaacccaccauug

SEQ ID NO: 1398373 - RNA, 19 nt, Homo sapiens
ccacucugauggaagcuuu

SEQ ID NO: 1398374 - RNA, 19 nt, Homo sapiens
ggagccaucccaaccaauu

SEQ ID NO: 1398375 - RNA, 19 nt, Homo sapiens
ugggagacacucuuaauuu

SEQ ID NO: 1398376 - RNA, 19 nt, Homo sapiens
ccaagaagaacccaccauu

SEQ ID NO: 1398377 - RNA, 19 nt, Homo sapiens
guauuucgauugcuagaag

SEQ ID NO: 1398378 - RNA, 19 nt, Homo sapiens
ccagaaccacccucaguuu

SEQ ID NO: 1398379 - RNA, 19 nt, Homo sapiens
guggagaggcuuucccuuu

SEQ ID NO: 1398380 - RNA, 19 nt, Homo sapiens
ccacaauguuugcagagau

SEQ ID NO: 1398381 - RNA, 19 nt, Homo sapiens
gccaggacauuaccuugga

SEQ ID NO: 1398382 - RNA, 19 nt, Homo sapiens
ucaaugcucccucauacaa

SEQ ID NO: 1398383 - RNA, 19 nt, Homo sapiens
caagugcggucuggagugu

SEQ ID NO: 1398384 - RNA, 19 nt, Homo sapiens
uggagaggcuuucccuuuc

SEQ ID NO: 1398385 - RNA, 19 nt, Homo sapiens
ccucaaugcucccucauac

SEQ ID NO: 1398386 - RNA, 19 nt, Homo sapiens
uggcuucaauggacaaaug

SEQ ID NO: 1398387 - RNA, 19 nt, Homo sapiens
ccuccucucuuccacugua

SEQ ID NO: 1398388 - RNA, 19 nt, Homo sapiens
ggaaagguccccaagaaga

SEQ ID NO: 1398389 - RNA, 19 nt, Homo sapiens
ggacuuaggggcauuaaug

SEQ ID NO: 1398390 - RNA, 19 nt, Homo sapiens
ucaaagcccauccgaagga

SEQ ID NO: 1398391 - RNA, 19 nt, Homo sapiens
cacaauguuugcagagaug

SEQ ID NO: 1398392 - RNA, 19 nt, Homo sapiens
gagcugauuacacacaaug

SEQ ID NO: 1398393 - RNA, 19 nt, Homo sapiens
gagaccaccugcucacacu

SEQ ID NO: 1398394 - RNA, 19 nt, Homo sapiens
ugaccaagcugugcaacca

SEQ ID NO: 1398395 - RNA, 19 nt, Homo sapiens
gaaagguccccaagaagaa

SEQ ID NO: 1398396 - RNA, 19 nt, Homo sapiens
cgcgggagcugauuacaca

SEQ ID NO: 1398397 - RNA, 19 nt, Homo sapiens
caaccuccuugccucuuuc

SEQ ID NO: 1398398 - RNA, 19 nt, Homo sapiens
cuacaacuccacuuaaugg

SEQ ID NO: 1398399 - RNA, 19 nt, Homo sapiens
gggagcugauuacacacaa

SEQ ID NO: 1398400 - RNA, 19 nt, Homo sapiens
ccuccuacaacuccacuua

SEQ ID NO: 1398401 - RNA, 19 nt, Homo sapiens
aagaagaacccaccauugg

SEQ ID NO: 1398402 - RNA, 19 nt, Homo sapiens
gagcaguggagcagacaga

SEQ ID NO: 1398403 - RNA, 19 nt, Homo sapiens
gcuacagagucuccagauc

SEQ ID NO: 1398404 - RNA, 19 nt, Homo sapiens
ggagcugauuacacacaau

SEQ ID NO: 1398405 - RNA, 19 nt, Homo sapiens
augaugcgacugaggauua

SEQ ID NO: 1398406 - RNA, 19 nt, Homo sapiens
cgucguggccguaggagaa

SEQ ID NO: 1398407 - RNA, 19 nt, Homo sapiens
gacacgugguggcuucaau

SEQ ID NO: 1398408 - RNA, 19 nt, Homo sapiens
ucuaugggagacacucuua

SEQ ID NO: 1398409 - RNA, 19 nt, Homo sapiens
ccaggacauuaccuuggaa

SEQ ID NO: 1398410 - RNA, 19 nt, Homo sapiens
ggagaggcuuucccuuucc

SEQ ID NO: 1398411 - RNA, 19 nt, Homo sapiens
gcugauuacacacaaugaa

SEQ ID NO: 1398412 - RNA, 19 nt, Homo sapiens
cccaccagcugccuccaaa

SEQ ID NO: 1398413 - RNA, 19 nt, Homo sapiens
aaccaauucucccuucugu

SEQ ID NO: 1398414 - RNA, 19 nt, Homo sapiens
cagaggaggacaugaccaa

SEQ ID NO: 1398415 - RNA, 19 nt, Homo sapiens
gccuccaccuucuccauug

SEQ ID NO: 1398416 - RNA, 19 nt, Homo sapiens
cagaaccacccucaguuuc

SEQ ID NO: 1398417 - RNA, 19 nt, Homo sapiens
uuugguggcuuccuugcuu

SEQ ID NO: 1398418 - RNA, 19 nt, Homo sapiens
uacuguauuucgauugcua

SEQ ID NO: 1398419 - RNA, 19 nt, Homo sapiens
gauuacacacaaugaaugg

SEQ ID NO: 1398420 - RNA, 19 nt, Homo sapiens
guugugaugaugcgacuga

SEQ ID NO: 1398421 - RNA, 19 nt, Homo sapiens
ucaccacggcaacuacuga

SEQ ID NO: 1398422 - RNA, 19 nt, Homo sapiens
gagccaucccaaccaauuc

SEQ ID NO: 1398423 - RNA, 19 nt, Homo sapiens
ugaugcgacugaggauuau

SEQ ID NO: 1398424 - RNA, 19 nt, Homo sapiens
ugauuacacacaaugaaug

SEQ ID NO: 1398425 - RNA, 19 nt, Homo sapiens
ccggagccaucccaaccaa

SEQ ID NO: 1398426 - RNA, 19 nt, Homo sapiens
uccuacaacuccacuuaau

SEQ ID NO: 1398427 - RNA, 19 nt, Homo sapiens
gugcugugcucuacaucag

SEQ ID NO: 1398428 - RNA, 19 nt, Homo sapiens
uaugggagacacucuuaau

SEQ ID NO: 1398429 - RNA, 19 nt, Homo sapiens
aagagacguugugaugaug

SEQ ID NO: 1398430 - RNA, 19 nt, Homo sapiens
gcacgcgggagcugauuac

SEQ ID NO: 1398431 - RNA, 19 nt, Homo sapiens
gggaguagucagaaagucu

SEQ ID NO: 1398432 - RNA, 19 nt, Homo sapiens
caaccaauucucccuucug

SEQ ID NO: 1398433 - RNA, 19 nt, Homo sapiens
ccccaagguuuucaacuuu

SEQ ID NO: 1398434 - RNA, 19 nt, Homo sapiens
gaccaccuaccuccagugu

SEQ ID NO: 1398435 - RNA, 19 nt, Homo sapiens
ugauggaagcuuuaaccuu

SEQ ID NO: 1398436 - RNA, 19 nt, Homo sapiens
cccaaauguuccacacugu

SEQ ID NO: 1398437 - RNA, 19 nt, Homo sapiens
ggcacgcgggagcugauua

SEQ ID NO: 1398438 - RNA, 19 nt, Homo sapiens
gcgaugggaccugcaagug

SEQ ID NO: 1398439 - RNA, 19 nt, Homo sapiens
ggcggaaagcuguugcuau

SEQ ID NO: 1398440 - RNA, 19 nt, Homo sapiens
cuucagacccuccucucuu

SEQ ID NO: 1398441 - RNA, 19 nt, Homo sapiens
gccucaaugcucccucaua

SEQ ID NO: 1398442 - RNA, 19 nt, Homo sapiens
ccaggccuuucccacucua

SEQ ID NO: 1398443 - RNA, 19 nt, Homo sapiens
ccagugaggucccaaauga

SEQ ID NO: 1398444 - RNA, 19 nt, Homo sapiens
gagccacgcuguagacauu

SEQ ID NO: 1398445 - RNA, 19 nt, Homo sapiens
gcaguugcgucgcuauuug

SEQ ID NO: 1398446 - RNA, 19 nt, Homo sapiens
ccaaaugacccagggcuua

SEQ ID NO: 1398447 - RNA, 19 nt, Homo sapiens
gaaccuaagccacaaucaa

SEQ ID NO: 1398448 - RNA, 19 nt, Homo sapiens
ccacagggcccaucaagau

SEQ ID NO: 1398449 - RNA, 19 nt, Homo sapiens
ggaggcagcugagauagag

SEQ ID NO: 1398450 - RNA, 19 nt, Homo sapiens
gcacugaccgccuuagaca

SEQ ID NO: 1398451 - RNA, 19 nt, Homo sapiens
caaaugacccagggcuuaa

SEQ ID NO: 1398452 - RNA, 19 nt, Homo sapiens
ggagcuccuugaugucuug

SEQ ID NO: 1398453 - RNA, 19 nt, Homo sapiens
ccuauaaucgccugcauuu

SEQ ID NO: 1398454 - RNA, 19 nt, Homo sapiens
aagaggcgcuggcccuuga

SEQ ID NO: 1398455 - RNA, 19 nt, Homo sapiens
ucucagguaucaauaaagu

SEQ ID NO: 1398456 - RNA, 19 nt, Homo sapiens
gggagaggcgagagaauga

SEQ ID NO: 1398457 - RNA, 19 nt, Homo sapiens
gggauuagacagugaggaa

SEQ ID NO: 1398458 - RNA, 19 nt, Homo sapiens
gcaccuggauuuggcauac

SEQ ID NO: 1398459 - RNA, 19 nt, Homo sapiens
ggaugggauuagacaguga

SEQ ID NO: 1398460 - RNA, 19 nt, Homo sapiens
ggagcugcuugccguguug

SEQ ID NO: 1398461 - RNA, 19 nt, Homo sapiens
caucuggacaucuccuaua

SEQ ID NO: 1398462 - RNA, 19 nt, Homo sapiens
uauaaucgccugcauuugg

SEQ ID NO: 1398463 - RNA, 19 nt, Homo sapiens
ucagguaucaauaaaguug

SEQ ID NO: 1398464 - RNA, 19 nt, Homo sapiens
cuggacaucuccuauaauc

SEQ ID NO: 1398465 - RNA, 19 nt, Homo sapiens
agggauuccugauggauuu

SEQ ID NO: 1398466 - RNA, 19 nt, Homo sapiens
ggcagggaaugcuuucuca

SEQ ID NO: 1398467 - RNA, 19 nt, Homo sapiens
uagagcagcugaggaaucu

SEQ ID NO: 1398468 - RNA, 19 nt, Homo sapiens
ggaggccucuguuccaaaa

SEQ ID NO: 1398469 - RNA, 19 nt, Homo sapiens
ugugugagcuccaccaucu

SEQ ID NO: 1398470 - RNA, 19 nt, Homo sapiens
cugcguuucuugaaccuaa

SEQ ID NO: 1398471 - RNA, 19 nt, Homo sapiens
caggagaggaggaagaaga

SEQ ID NO: 1398472 - RNA, 19 nt, Homo sapiens
ccaggagucaccacagaaa

SEQ ID NO: 1398473 - RNA, 19 nt, Homo sapiens
aagaggagcaggaccagaa

SEQ ID NO: 1398474 - RNA, 19 nt, Homo sapiens
ugacagauuuucagacuca

SEQ ID NO: 1398475 - RNA, 19 nt, Homo sapiens
caacuucagcuacaaugca

SEQ ID NO: 1398476 - RNA, 19 nt, Homo sapiens
gaaggugacuggggagaug

SEQ ID NO: 1398477 - RNA, 19 nt, Homo sapiens
ucaugugccuugugguugu

SEQ ID NO: 1398478 - RNA, 19 nt, Homo sapiens
ggaccagaaggaaguggaa

SEQ ID NO: 1398479 - RNA, 19 nt, Homo sapiens
gagccugcauggccuagag

SEQ ID NO: 1398480 - RNA, 19 nt, Homo sapiens
cacucaagcugguccaugu

SEQ ID NO: 1398481 - RNA, 19 nt, Homo sapiens
guucaugugccuugugguu

SEQ ID NO: 1398482 - RNA, 19 nt, Homo sapiens
caacagcugaaccacguau

SEQ ID NO: 1398483 - RNA, 19 nt, Homo sapiens
acagggcccaucaagauuu

SEQ ID NO: 1398484 - RNA, 19 nt, Homo sapiens
cuuggaggcucgccaguuc

SEQ ID NO: 1398485 - RNA, 19 nt, Homo sapiens
ggaucugaguggcauagag

SEQ ID NO: 1398486 - RNA, 19 nt, Homo sapiens
gccuagagcagcugaggaa

SEQ ID NO: 1398487 - RNA, 19 nt, Homo sapiens
cagcugaaccacguauuug

SEQ ID NO: 1398488 - RNA, 19 nt, Homo sapiens
agaaucuccugcugugugu

SEQ ID NO: 1398489 - RNA, 19 nt, Homo sapiens
caauguggcucgggaacag

SEQ ID NO: 1398490 - RNA, 19 nt, Homo sapiens
ucuggaggcagcugagaua

SEQ ID NO: 1398491 - RNA, 19 nt, Homo sapiens
acagcugaaccacguauuu

SEQ ID NO: 1398492 - RNA, 19 nt, Homo sapiens
uguccuaacugugguagug

SEQ ID NO: 1398493 - RNA, 19 nt, Homo sapiens
ccaggacugucagggauuc

SEQ ID NO: 1398494 - RNA, 19 nt, Homo sapiens
ugucagcucugcguuucuu

SEQ ID NO: 1398495 - RNA, 19 nt, Homo sapiens
cagcuggagacccugauuu

SEQ ID NO: 1398496 - RNA, 19 nt, Homo sapiens
gccuugugguugugucuga

SEQ ID NO: 1398497 - RNA, 19 nt, Homo sapiens
gcgaugcccaggaggaguu

SEQ ID NO: 1398498 - RNA, 19 nt, Homo sapiens
agucugcgcuucuccuaca

SEQ ID NO: 1398499 - RNA, 19 nt, Homo sapiens
uggcgaagccucugagaag

SEQ ID NO: 1398500 - RNA, 19 nt, Homo sapiens
cguccacccuguuccuguu

SEQ ID NO: 1398501 - RNA, 19 nt, Homo sapiens
ggcaguugcgucgcuauuu

SEQ ID NO: 1398502 - RNA, 19 nt, Homo sapiens
cgggagcugucaccacugu

SEQ ID NO: 1398503 - RNA, 19 nt, Homo sapiens
uaagggagaggcgagagaa

SEQ ID NO: 1398504 - RNA, 19 nt, Homo sapiens
gcuggcccuugaccgauga

SEQ ID NO: 1398505 - RNA, 19 nt, Homo sapiens
ggccagggaugcugcuacu

SEQ ID NO: 1398506 - RNA, 19 nt, Homo sapiens
ggagcaggaccagaaggaa

SEQ ID NO: 1398507 - RNA, 19 nt, Homo sapiens
gagaggcgagagaaugauc

SEQ ID NO: 1398508 - RNA, 19 nt, Homo sapiens
gcaacagcugaaccacgua

SEQ ID NO: 1398509 - RNA, 19 nt, Homo sapiens
cuggucaggaggaauauuu

SEQ ID NO: 1398510 - RNA, 19 nt, Homo sapiens
ccucaggagccacgcugua

SEQ ID NO: 1398511 - RNA, 19 nt, Homo sapiens
ggcaggagaggaggaagaa

SEQ ID NO: 1398512 - RNA, 19 nt, Homo sapiens
ggaggcaggagaggaggaa

SEQ ID NO: 1398513 - RNA, 19 nt, Homo sapiens
aucuggacaucuccuauaa

SEQ ID NO: 1398514 - RNA, 19 nt, Homo sapiens
ggacuugcggcugcucuuc

SEQ ID NO: 1398515 - RNA, 19 nt, Homo sapiens
ccacccuguuccuguuaga

SEQ ID NO: 1398516 - RNA, 19 nt, Homo sapiens
gaaacagggagagcagucu

SEQ ID NO: 1398517 - RNA, 19 nt, Homo sapiens
cacagggcccaucaagauu

SEQ ID NO: 1398518 - RNA, 19 nt, Homo sapiens
ucacuucugcccaccuguu

SEQ ID NO: 1398519 - RNA, 19 nt, Homo sapiens
gaacuuggcucucauguuu

SEQ ID NO: 1398520 - RNA, 19 nt, Homo sapiens
gaaagaagcuaucaugaag

SEQ ID NO: 1398521 - RNA, 19 nt, Homo sapiens
gagugaagcucaugcauuu

SEQ ID NO: 1398522 - RNA, 19 nt, Homo sapiens
gauggaagaugaagaaaug

SEQ ID NO: 1398523 - RNA, 19 nt, Homo sapiens
guacagggcuggaguuuca

SEQ ID NO: 1398524 - RNA, 19 nt, Homo sapiens
guaugcaacuuacacguua

SEQ ID NO: 1398525 - RNA, 19 nt, Homo sapiens
acacauagcuguuuacgau

SEQ ID NO: 1398526 - RNA, 19 nt, Homo sapiens
gaagcuggcuggaacauca

SEQ ID NO: 1398527 - RNA, 19 nt, Homo sapiens
guacagcagugauccauug

SEQ ID NO: 1398528 - RNA, 19 nt, Homo sapiens
uuaaaugucuucagcguaa

SEQ ID NO: 1398529 - RNA, 19 nt, Homo sapiens
ucaaguguuucuucucuua

SEQ ID NO: 1398530 - RNA, 19 nt, Homo sapiens
caucauacauguacauuuc

SEQ ID NO: 1398531 - RNA, 19 nt, Homo sapiens
agaagugcaucaucaauaa

SEQ ID NO: 1398532 - RNA, 19 nt, Homo sapiens
gagaagugcaucaucaaua

SEQ ID NO: 1398533 - RNA, 19 nt, Homo sapiens
aaagacagaugcacauuau

SEQ ID NO: 1398534 - RNA, 19 nt, Homo sapiens
ccaguuuccucauaguuua

SEQ ID NO: 1398535 - RNA, 19 nt, Homo sapiens
guagaauacuugcaagcua

SEQ ID NO: 1398536 - RNA, 19 nt, Homo sapiens
ggaaagaugagccagauga

SEQ ID NO: 1398537 - RNA, 19 nt, Homo sapiens
ggaacaaaguuaaaugucu

SEQ ID NO: 1398538 - RNA, 19 nt, Homo sapiens
gaucugugcuggaacaaau

SEQ ID NO: 1398539 - RNA, 19 nt, Homo sapiens
gaaaauacuugauggaaga

SEQ ID NO: 1398540 - RNA, 19 nt, Homo sapiens
aaacaaagccgucuguaga

SEQ ID NO: 1398541 - RNA, 19 nt, Homo sapiens
caacuuacacguuauauag

SEQ ID NO: 1398542 - RNA, 19 nt, Homo sapiens
aagaaggccuuauacauga

SEQ ID NO: 1398543 - RNA, 19 nt, Homo sapiens
ggacauuguuauaaguuug

SEQ ID NO: 1398544 - RNA, 19 nt, Homo sapiens
ggagaagccucugagcaaa

SEQ ID NO: 1398545 - RNA, 19 nt, Homo sapiens
ugaagaaagugaagaggaa

SEQ ID NO: 1398546 - RNA, 19 nt, Homo sapiens
gagauuaacggaggaauuu

SEQ ID NO: 1398547 - RNA, 19 nt, Homo sapiens
agaagaagcugccuguuca

SEQ ID NO: 1398548 - RNA, 19 nt, Homo sapiens
gaagcugccuguucauauc

SEQ ID NO: 1398549 - RNA, 19 nt, Homo sapiens
gaagguaacugugagaaac

SEQ ID NO: 1398550 - RNA, 19 nt, Homo sapiens
cgaauggaaucuauagaga

SEQ ID NO: 1398551 - RNA, 19 nt, Homo sapiens
caauaacucuugcaauagu

SEQ ID NO: 1398552 - RNA, 19 nt, Homo sapiens
ugccauauguuucuuguaa

SEQ ID NO: 1398553 - RNA, 19 nt, Homo sapiens
ccaaggauuuagaucaauu

SEQ ID NO: 1398554 - RNA, 19 nt, Homo sapiens
gaaguuugcugguggugau

SEQ ID NO: 1398555 - RNA, 19 nt, Homo sapiens
uaaagacagaugcacauua

SEQ ID NO: 1398556 - RNA, 19 nt, Homo sapiens
gacaagcaguaucuagauu

SEQ ID NO: 1398557 - RNA, 19 nt, Homo sapiens
gaacaaauagcagcauaug

SEQ ID NO: 1398558 - RNA, 19 nt, Homo sapiens
guugauagaugggaaggua

SEQ ID NO: 1398559 - RNA, 19 nt, Homo sapiens
gcagugauccauuguaugu

SEQ ID NO: 1398560 - RNA, 19 nt, Homo sapiens
gcacauuauuccauacugu

SEQ ID NO: 1398561 - RNA, 19 nt, Homo sapiens
gcagaaguuccaccugaua

SEQ ID NO: 1398562 - RNA, 19 nt, Homo sapiens
caauagugguggacaaguu

SEQ ID NO: 1398563 - RNA, 19 nt, Homo sapiens
gaagugggucuguuccuaa

SEQ ID NO: 1398564 - RNA, 19 nt, Homo sapiens
gcagauucaucgcauguuc

SEQ ID NO: 1398565 - RNA, 19 nt, Homo sapiens
caaaccgucucccuccuuu

SEQ ID NO: 1398566 - RNA, 19 nt, Homo sapiens
guggagacaccaagaaaua

SEQ ID NO: 1398567 - RNA, 19 nt, Homo sapiens
cgaggaagccaaggauuua

SEQ ID NO: 1398568 - RNA, 19 nt, Homo sapiens
aaagaaggccuuauacaug

SEQ ID NO: 1398569 - RNA, 19 nt, Homo sapiens
ugaaagaagcuaucaugaa

SEQ ID NO: 1398570 - RNA, 19 nt, Homo sapiens
gcaacuuacacguuauaua

SEQ ID NO: 1398571 - RNA, 19 nt, Homo sapiens
ugugggcccuguacaaaua

SEQ ID NO: 1398572 - RNA, 19 nt, Homo sapiens
cagcagugauccauuguau

SEQ ID NO: 1398573 - RNA, 19 nt, Homo sapiens
auaaauaucuccgacuuug

SEQ ID NO: 1398574 - RNA, 19 nt, Homo sapiens
caucgcauguuccucuuaa

SEQ ID NO: 1398575 - RNA, 19 nt, Homo sapiens
ggacagcguuauccugaag

SEQ ID NO: 1398576 - RNA, 19 nt, Homo sapiens
aagaggaacuugcagaaau

SEQ ID NO: 1398577 - RNA, 19 nt, Homo sapiens
ggagacaccaagaaauaaa

SEQ ID NO: 1398578 - RNA, 19 nt, Homo sapiens
ucaugaagguguugaacuu

SEQ ID NO: 1398579 - RNA, 19 nt, Homo sapiens
uaaagaaggccuuauacau

SEQ ID NO: 1398580 - RNA, 19 nt, Homo sapiens
gcugagauccugccucuau

SEQ ID NO: 1398581 - RNA, 19 nt, Homo sapiens
uagaauacuugcaagcuau

SEQ ID NO: 1398582 - RNA, 19 nt, Homo sapiens
guggauagaucaucggaau

SEQ ID NO: 1398583 - RNA, 19 nt, Homo sapiens
gccauuaacuuugcaagga

SEQ ID NO: 1398584 - RNA, 19 nt, Homo sapiens
ccucaaaccuguccugaag

SEQ ID NO: 1398585 - RNA, 19 nt, Homo sapiens
gcucaagguucugcacaaa

SEQ ID NO: 1398586 - RNA, 19 nt, Homo sapiens
agaggaacuugcagaaauu

SEQ ID NO: 1398587 - RNA, 19 nt, Homo sapiens
gaauggaaucuauagagaa

SEQ ID NO: 1398588 - RNA, 19 nt, Homo sapiens
ggugauguauguguggaua

SEQ ID NO: 1398589 - RNA, 19 nt, Homo sapiens
ugaaagccaucuugaacug

SEQ ID NO: 1398590 - RNA, 19 nt, Homo sapiens
gcaccacuucccaguauaa

SEQ ID NO: 1398591 - RNA, 19 nt, Homo sapiens
caaguuggcaccucgauug

SEQ ID NO: 1398592 - RNA, 19 nt, Homo sapiens
cauuguauguuccagauga

SEQ ID NO: 1398593 - RNA, 19 nt, Homo sapiens
gugaacagcuugcacaacu

SEQ ID NO: 1398594 - RNA, 19 nt, Homo sapiens
agacacaguugcucaguuc

SEQ ID NO: 1398595 - RNA, 19 nt, Homo sapiens
gaaaucucaugcaaacucu

SEQ ID NO: 1398596 - RNA, 19 nt, Homo sapiens
ggaaaucucaugcaaacuc

SEQ ID NO: 1398597 - RNA, 19 nt, Homo sapiens
caacugaagcucccuuuag

SEQ ID NO: 1398598 - RNA, 19 nt, Homo sapiens
gacaggcaccaauucguua

SEQ ID NO: 1398599 - RNA, 19 nt, Homo sapiens
ggacaccguuagaagaaca

SEQ ID NO: 1398600 - RNA, 19 nt, Homo sapiens
ucacgucuaucuauaucuu

SEQ ID NO: 1398601 - RNA, 19 nt, Homo sapiens
ggaagguaacugugagaaa

SEQ ID NO: 1398602 - RNA, 19 nt, Homo sapiens
guggaaaucucaugcaaac

SEQ ID NO: 1398603 - RNA, 19 nt, Homo sapiens
agccagagaugcagaaaga

SEQ ID NO: 1398604 - RNA, 19 nt, Homo sapiens
gauacuacaauaacucuug

SEQ ID NO: 1398605 - RNA, 19 nt, Homo sapiens
gaacuugcagaaauugaga

SEQ ID NO: 1398606 - RNA, 19 nt, Homo sapiens
caaagaggaacuugcagaa

SEQ ID NO: 1398607 - RNA, 19 nt, Homo sapiens
ccuaagaagucaacugaag

SEQ ID NO: 1398608 - RNA, 19 nt, Homo sapiens
aaauuggucugaagaaagu

SEQ ID NO: 1398609 - RNA, 19 nt, Homo sapiens
gauuacagguugguagaau

SEQ ID NO: 1398610 - RNA, 19 nt, Homo sapiens
guaacugugagaaacaaua

SEQ ID NO: 1398611 - RNA, 19 nt, Homo sapiens
ccaaggagaaccugaugaa

SEQ ID NO: 1398612 - RNA, 19 nt, Homo sapiens
ccagagaugcagaaagaaa

SEQ ID NO: 1398613 - RNA, 19 nt, Homo sapiens
cagauuucaucguuucuug

SEQ ID NO: 1398614 - RNA, 19 nt, Homo sapiens
ucaagguucugcacaaagu

SEQ ID NO: 1398615 - RNA, 19 nt, Homo sapiens
uaacggaggaauuucuaaa

SEQ ID NO: 1398616 - RNA, 19 nt, Homo sapiens
gcaaagcugcuaguuggaa

SEQ ID NO: 1398617 - RNA, 19 nt, Homo sapiens
guacauggacacaccaaau

SEQ ID NO: 1398618 - RNA, 19 nt, Homo sapiens
ugacacagcuaagaagaag

SEQ ID NO: 1398619 - RNA, 19 nt, Homo sapiens
ggaaacauguuguggaaua

SEQ ID NO: 1398620 - RNA, 19 nt, Homo sapiens
gcaaugaccuagacuacaa

SEQ ID NO: 1398621 - RNA, 19 nt, Homo sapiens
guacagguaucuaaacuug

SEQ ID NO: 1398622 - RNA, 19 nt, Homo sapiens
uaacuaauacggcacaaua

SEQ ID NO: 1398623 - RNA, 19 nt, Homo sapiens
gaacuucgguacuucaauc

SEQ ID NO: 1398624 - RNA, 19 nt, Homo sapiens
caacagcccuugucaacga

SEQ ID NO: 1398625 - RNA, 19 nt, Homo sapiens
ucaaguaacucucagaugu

SEQ ID NO: 1398626 - RNA, 19 nt, Homo sapiens
ggaggauaauuacugauuu

SEQ ID NO: 1398627 - RNA, 19 nt, Homo sapiens
gaaacauguuguggaauaa

SEQ ID NO: 1398628 - RNA, 19 nt, Homo sapiens
gaaauuccaugcucacaag

SEQ ID NO: 1398629 - RNA, 19 nt, Homo sapiens
gauagaauuuggaaacaug

SEQ ID NO: 1398630 - RNA, 19 nt, Homo sapiens
ggagugagcuggcuuccau

SEQ ID NO: 1398631 - RNA, 19 nt, Homo sapiens
gggagaauauauuuaguug

SEQ ID NO: 1398632 - RNA, 19 nt, Homo sapiens
uguuggagcuucucaauuu

SEQ ID NO: 1398633 - RNA, 19 nt, Homo sapiens
gagcugaugagguuaauuu

SEQ ID NO: 1398634 - RNA, 19 nt, Homo sapiens
ugaaagagacacacaauga

SEQ ID NO: 1398635 - RNA, 19 nt, Homo sapiens
gcagagccauugugcauca

SEQ ID NO: 1398636 - RNA, 19 nt, Homo sapiens
uaaggaggauaauuacuga

SEQ ID NO: 1398637 - RNA, 19 nt, Homo sapiens
aaucagcacugucuuaaga

SEQ ID NO: 1398638 - RNA, 19 nt, Homo sapiens
uggacgagcuccugcaaua

SEQ ID NO: 1398639 - RNA, 19 nt, Homo sapiens
guaauacuuugcccaagaa

SEQ ID NO: 1398640 - RNA, 19 nt, Homo sapiens
gaccuagacuacaauaaug

SEQ ID NO: 1398641 - RNA, 19 nt, Homo sapiens
gaauuggcaguucuaauaa

SEQ ID NO: 1398642 - RNA, 19 nt, Homo sapiens
guaacucucagaugucuua

SEQ ID NO: 1398643 - RNA, 19 nt, Homo sapiens
gaaccuaaccagaauaagu

SEQ ID NO: 1398644 - RNA, 19 nt, Homo sapiens
acucucagaugucuuauuu

SEQ ID NO: 1398645 - RNA, 19 nt, Homo sapiens
guugguggauauucaauuu

SEQ ID NO: 1398646 - RNA, 19 nt, Homo sapiens
gaacgcugccucaguauuc

SEQ ID NO: 1398647 - RNA, 19 nt, Homo sapiens
gaggauaauuacugauuuc

SEQ ID NO: 1398648 - RNA, 19 nt, Homo sapiens
uggcaucgaugaucuuaaa

SEQ ID NO: 1398649 - RNA, 19 nt, Homo sapiens
gauaucagguggaguaacu

SEQ ID NO: 1398650 - RNA, 19 nt, Homo sapiens
gcagagauagcacccauga

SEQ ID NO: 1398651 - RNA, 19 nt, Homo sapiens
ggaaggagccaccauugug

SEQ ID NO: 1398652 - RNA, 19 nt, Homo sapiens
agaaggcagugaucgauuu

SEQ ID NO: 1398653 - RNA, 19 nt, Homo sapiens
ucaaggaacuucgguacuu

SEQ ID NO: 1398654 - RNA, 19 nt, Homo sapiens
gcaauguucagucuuugua

SEQ ID NO: 1398655 - RNA, 19 nt, Homo sapiens
uaauagacauacacuggaa

SEQ ID NO: 1398656 - RNA, 19 nt, Homo sapiens
ccauauagauucuuacaac

SEQ ID NO: 1398657 - RNA, 19 nt, Homo sapiens
cagacuugcugaccucuuu

SEQ ID NO: 1398658 - RNA, 19 nt, Homo sapiens
gacacacaaugaggaaaua

SEQ ID NO: 1398659 - RNA, 19 nt, Homo sapiens
gaauaccucuaugcaguug

SEQ ID NO: 1398660 - RNA, 19 nt, Homo sapiens
uuacugauuuccacguuaa

SEQ ID NO: 1398661 - RNA, 19 nt, Homo sapiens
ggucagaaccuaacuuuac

SEQ ID NO: 1398662 - RNA, 19 nt, Homo sapiens
gcagagaaggcaaagaaga

SEQ ID NO: 1398663 - RNA, 19 nt, Homo sapiens
guaugaaccuaaccagaau

SEQ ID NO: 1398664 - RNA, 19 nt, Homo sapiens
agagauagcacccaugaaa

SEQ ID NO: 1398665 - RNA, 19 nt, Homo sapiens
ugaaacaucucucugaacu

SEQ ID NO: 1398666 - RNA, 19 nt, Homo sapiens
guuggagcuucucaauuua

SEQ ID NO: 1398667 - RNA, 19 nt, Homo sapiens
gcagucaccuacagcuguu

SEQ ID NO: 1398668 - RNA, 19 nt, Homo sapiens
gagacucacucagcauuau

SEQ ID NO: 1398669 - RNA, 19 nt, Homo sapiens
ucaacgaggcccuggaaua

SEQ ID NO: 1398670 - RNA, 19 nt, Homo sapiens
gcccuaaccuucaaacucu

SEQ ID NO: 1398671 - RNA, 19 nt, Homo sapiens
agagaagggucuaccauuc

SEQ ID NO: 1398672 - RNA, 19 nt, Homo sapiens
ucagguggaguaacuaaua

SEQ ID NO: 1398673 - RNA, 19 nt, Homo sapiens
aaagcaggcucuggaguuu

SEQ ID NO: 1398674 - RNA, 19 nt, Homo sapiens
caaggugauacgaauaaua

SEQ ID NO: 1398675 - RNA, 19 nt, Homo sapiens
agaacaggcuaauggugua

SEQ ID NO: 1398676 - RNA, 19 nt, Homo sapiens
gcauacacaggacagauuu

SEQ ID NO: 1398677 - RNA, 19 nt, Homo sapiens
gaaccuagaauuggcaguu

SEQ ID NO: 1398678 - RNA, 19 nt, Homo sapiens
gaagcuuuauguucuugga

SEQ ID NO: 1398679 - RNA, 19 nt, Homo sapiens
cagcaugcagugacuauuu

SEQ ID NO: 1398680 - RNA, 19 nt, Homo sapiens
gaaagagacacacaaugag

SEQ ID NO: 1398681 - RNA, 19 nt, Homo sapiens
gaaggagccaccauugugu

SEQ ID NO: 1398682 - RNA, 19 nt, Homo sapiens
guauaucauuggugggaaa

SEQ ID NO: 1398683 - RNA, 19 nt, Homo sapiens
uguaauacuuugcccaaga

SEQ ID NO: 1398684 - RNA, 19 nt, Homo sapiens
gagcauucuuuguacacuu

SEQ ID NO: 1398685 - RNA, 19 nt, Homo sapiens
uaaagcaggcucuggaguu

SEQ ID NO: 1398686 - RNA, 19 nt, Homo sapiens
uaagguauauuguguucca

SEQ ID NO: 1398687 - RNA, 19 nt, Homo sapiens
uuccuugucuugcuuuaua

SEQ ID NO: 1398688 - RNA, 19 nt, Homo sapiens
cagagaaggcaaagaagaa

SEQ ID NO: 1398689 - RNA, 19 nt, Homo sapiens
ggaauaccucuaugcaguu

SEQ ID NO: 1398690 - RNA, 19 nt, Homo sapiens
caauuuaugcucccacuau

SEQ ID NO: 1398691 - RNA, 19 nt, Homo sapiens
gaacccagcuggaaaaugc

SEQ ID NO: 1398692 - RNA, 19 nt, Homo sapiens
cgaacacuuuguaauacuu

SEQ ID NO: 1398693 - RNA, 19 nt, Homo sapiens
aggcgaacacuuuguaaua

SEQ ID NO: 1398694 - RNA, 19 nt, Homo sapiens
aaguggagcugaugagguu

SEQ ID NO: 1398695 - RNA, 19 nt, Homo sapiens
uagcuuagugccaauuuaa

SEQ ID NO: 1398696 - RNA, 19 nt, Homo sapiens
guggacacguuguaauuuc

SEQ ID NO: 1398697 - RNA, 19 nt, Homo sapiens
gacacucuguauaucauug

SEQ ID NO: 1398698 - RNA, 19 nt, Homo sapiens
uaagacaacacaacacugu

SEQ ID NO: 1398699 - RNA, 19 nt, Homo sapiens
ugaccuagacuacaauaau

SEQ ID NO: 1398700 - RNA, 19 nt, Homo sapiens
uaaccagaauaaguggaua

SEQ ID NO: 1398701 - RNA, 19 nt, Homo sapiens
caaggaacuucgguacuuc

SEQ ID NO: 1398702 - RNA, 19 nt, Homo sapiens
gauacucuccauacaguug

SEQ ID NO: 1398703 - RNA, 19 nt, Homo sapiens
uaauggauguggauacucu

SEQ ID NO: 1398704 - RNA, 19 nt, Homo sapiens
cgggcaauguucagucuuu

SEQ ID NO: 1398705 - RNA, 19 nt, Homo sapiens
aagcagagaaggcaaagaa

SEQ ID NO: 1398706 - RNA, 19 nt, Homo sapiens
ggcagugaucgauuucuua

SEQ ID NO: 1398707 - RNA, 19 nt, Homo sapiens
gagaaggcagugaucgauu

SEQ ID NO: 1398708 - RNA, 19 nt, Homo sapiens
ucuuuaaccucacuuuguu

SEQ ID NO: 1398709 - RNA, 19 nt, Homo sapiens
aggauuaggcgaacacuuu

SEQ ID NO: 1398710 - RNA, 19 nt, Homo sapiens
ggauuggcaccaucugaaa

SEQ ID NO: 1398711 - RNA, 19 nt, Homo sapiens
caacgaggcccuggaauac

SEQ ID NO: 1398712 - RNA, 19 nt, Homo sapiens
gucagaaccuaacuuuaca

SEQ ID NO: 1398713 - RNA, 19 nt, Homo sapiens
ucuaaucagcacugucuua

SEQ ID NO: 1398714 - RNA, 19 nt, Homo sapiens
uguaugaaccuaaccagaa

SEQ ID NO: 1398715 - RNA, 19 nt, Homo sapiens
uaucagaacaggcuaaugg

SEQ ID NO: 1398716 - RNA, 19 nt, Homo sapiens
agugaucgauuucuuagug

SEQ ID NO: 1398717 - RNA, 19 nt, Homo sapiens
gcagugaucgauuucuuag

SEQ ID NO: 1398718 - RNA, 19 nt, Homo sapiens
aaauagggaguuucucaaa

SEQ ID NO: 1398719 - RNA, 19 nt, Homo sapiens
gaauaucacuguucaaugg

SEQ ID NO: 1398720 - RNA, 19 nt, Homo sapiens
ggcaagagaccaccuauaa

SEQ ID NO: 1398721 - RNA, 19 nt, Homo sapiens
gcaccaagaacuuaguaua

SEQ ID NO: 1398722 - RNA, 19 nt, Homo sapiens
uaacaucuaucugauccua

SEQ ID NO: 1398723 - RNA, 19 nt, Homo sapiens
ggagauucaugccuuuaga

SEQ ID NO: 1398724 - RNA, 19 nt, Homo sapiens
gaucuuaacaucucacuuc

SEQ ID NO: 1398725 - RNA, 19 nt, Homo sapiens
ggacacugauguuccugaa

SEQ ID NO: 1398726 - RNA, 19 nt, Homo sapiens
gaugccaccuggaauauca

SEQ ID NO: 1398727 - RNA, 19 nt, Homo sapiens
guaagucuuuagugccaua

SEQ ID NO: 1398728 - RNA, 19 nt, Homo sapiens
gaacagaauaguaagucuu

SEQ ID NO: 1398729 - RNA, 19 nt, Homo sapiens
ccuauaaccucuucaccuu

SEQ ID NO: 1398730 - RNA, 19 nt, Homo sapiens
gaagagggcaccaagaacu

SEQ ID NO: 1398731 - RNA, 19 nt, Homo sapiens
ugaaacuaauggccacgua

SEQ ID NO: 1398732 - RNA, 19 nt, Homo sapiens
uguaggaacagaauaguaa

SEQ ID NO: 1398733 - RNA, 19 nt, Homo sapiens
aaagaagggucugggagaa

SEQ ID NO: 1398734 - RNA, 19 nt, Homo sapiens
gauccuaacagaguaugua

SEQ ID NO: 1398735 - RNA, 19 nt, Homo sapiens
uuagacagcuggaaguaca

SEQ ID NO: 1398736 - RNA, 19 nt, Homo sapiens
gcccagacccuuucacuca

SEQ ID NO: 1398737 - RNA, 19 nt, Homo sapiens
ggaauaucacuguucaaug

SEQ ID NO: 1398738 - RNA, 19 nt, Homo sapiens
ggaacagaauaguaagucu

SEQ ID NO: 1398739 - RNA, 19 nt, Homo sapiens
cuggacaccuuauuaccua

SEQ ID NO: 1398740 - RNA, 19 nt, Homo sapiens
ccacguauucugcagcuuu

SEQ ID NO: 1398741 - RNA, 19 nt, Homo sapiens
ccucaaugcuccuuuggau

SEQ ID NO: 1398742 - RNA, 19 nt, Homo sapiens
gaaacuaauggccacguau

SEQ ID NO: 1398743 - RNA, 19 nt, Homo sapiens
cuuaacaucucacuucuac

SEQ ID NO: 1398744 - RNA, 19 nt, Homo sapiens
gaacuuaguauagacucuu

SEQ ID NO: 1398745 - RNA, 19 nt, Homo sapiens
gaagggcaggagaaacaaa

SEQ ID NO: 1398746 - RNA, 19 nt, Homo sapiens
uaacaucucacuucuacuc

SEQ ID NO: 1398747 - RNA, 19 nt, Homo sapiens
gaauaguaagucuuuagug

SEQ ID NO: 1398748 - RNA, 19 nt, Homo sapiens
gaggagauucaugccuuua

SEQ ID NO: 1398749 - RNA, 19 nt, Homo sapiens
accaagaacuuaguauaga

SEQ ID NO: 1398750 - RNA, 19 nt, Homo sapiens
ccgaagagggcaccaagaa

SEQ ID NO: 1398751 - RNA, 19 nt, Homo sapiens
gaccaccuauaaccucuuc

SEQ ID NO: 1398752 - RNA, 19 nt, Homo sapiens
guacucaacccgcuuggau

SEQ ID NO: 1398753 - RNA, 19 nt, Homo sapiens
aaacuaauggccacguauu

SEQ ID NO: 1398754 - RNA, 19 nt, Homo sapiens
acacugauguuccugaaac

SEQ ID NO: 1398755 - RNA, 19 nt, Homo sapiens
agaagggucugggagaaug

SEQ ID NO: 1398756 - RNA, 19 nt, Homo sapiens
cagaguauguaggaacaga

SEQ ID NO: 1398757 - RNA, 19 nt, Homo sapiens
agaggagauucaugccuuu

SEQ ID NO: 1398758 - RNA, 19 nt, Homo sapiens
ccaagaacuuaguauagac

SEQ ID NO: 1398759 - RNA, 19 nt, Homo sapiens
caucugcuauagccgcauu

SEQ ID NO: 1398760 - RNA, 19 nt, Homo sapiens
ccuggaauaucacuguuca

SEQ ID NO: 1398761 - RNA, 19 nt, Homo sapiens
uauaaccucuucaccuucu

SEQ ID NO: 1398762 - RNA, 19 nt, Homo sapiens
gcaagagaccaccuauaac

SEQ ID NO: 1398763 - RNA, 19 nt, Homo sapiens
ucaagaagggcaggagaaa

SEQ ID NO: 1398764 - RNA, 19 nt, Homo sapiens
caccaagaacuuaguauag

SEQ ID NO: 1398765 - RNA, 19 nt, Homo sapiens
ccaccaugcuaacugaagu

SEQ ID NO: 1398766 - RNA, 19 nt, Homo sapiens
caaaaggcauuucuauaac

SEQ ID NO: 1398767 - RNA, 19 nt, Homo sapiens
gacuggcccugcuuaucuu

SEQ ID NO: 1398768 - RNA, 19 nt, Homo sapiens
gccauggccaucugcuaua

SEQ ID NO: 1398769 - RNA, 19 nt, Homo sapiens
guauguaggaacagaauag

SEQ ID NO: 1398770 - RNA, 19 nt, Homo sapiens
ccacauccuuuuccucuug

SEQ ID NO: 1398771 - RNA, 19 nt, Homo sapiens
cagaauaguaagucuuuag

SEQ ID NO: 1398772 - RNA, 19 nt, Homo sapiens
aagaagggcaggagaaaca

SEQ ID NO: 1398773 - RNA, 19 nt, Homo sapiens
gggcaccaagaacuuagua

SEQ ID NO: 1398774 - RNA, 19 nt, Homo sapiens
caagagaccaccuauaacc

SEQ ID NO: 1398775 - RNA, 19 nt, Homo sapiens
ccguucagguguaaggaaa

SEQ ID NO: 1398776 - RNA, 19 nt, Homo sapiens
ggaucccguucagguguaa

SEQ ID NO: 1398777 - RNA, 19 nt, Homo sapiens
ugacugccauggccaucug

SEQ ID NO: 1398778 - RNA, 19 nt, Homo sapiens
ugauguuccugaaacuaau

SEQ ID NO: 1398779 - RNA, 19 nt, Homo sapiens
ugggaugccaccuggaaua

SEQ ID NO: 1398780 - RNA, 19 nt, Homo sapiens
cugauguuccugaaacuaa

SEQ ID NO: 1398781 - RNA, 19 nt, Homo sapiens
agagggcaccaagaacuua

SEQ ID NO: 1398782 - RNA, 19 nt, Homo sapiens
caccuucugcugccucuuu

SEQ ID NO: 1398783 - RNA, 19 nt, Homo sapiens
gaguauguaggaacagaau

SEQ ID NO: 1398784 - RNA, 19 nt, Homo sapiens
gggaugccaccuggaauau

SEQ ID NO: 1398785 - RNA, 19 nt, Homo sapiens
uggauccucuccucuaugg

SEQ ID NO: 1398786 - RNA, 19 nt, Homo sapiens
ucugcuggacaccuuauua

SEQ ID NO: 1398787 - RNA, 19 nt, Homo sapiens
agacuggcccugcuuaucu

SEQ ID NO: 1398788 - RNA, 19 nt, Homo sapiens
ccuccucaaugcuccuuug

SEQ ID NO: 1398789 - RNA, 19 nt, Homo sapiens
ccaccuggaauaucacugu

SEQ ID NO: 1398790 - RNA, 19 nt, Homo sapiens
gagacuggcccugcuuauc

SEQ ID NO: 1398791 - RNA, 19 nt, Homo sapiens
ccauggccaucugcuauag

SEQ ID NO: 1398792 - RNA, 19 nt, Homo sapiens
ccagacccuuucacucagu

SEQ ID NO: 1398793 - RNA, 19 nt, Homo sapiens
gggacuuaguuuccugcuu

SEQ ID NO: 1398794 - RNA, 19 nt, Homo sapiens
uggaauaucacuguucaau

SEQ ID NO: 1398795 - RNA, 19 nt, Homo sapiens
caccuggaauaucacuguu

SEQ ID NO: 1398796 - RNA, 19 nt, Homo sapiens
uggaucccguucaggugua

SEQ ID NO: 1398797 - RNA, 19 nt, Homo sapiens
aacagaguauguaggaaca

SEQ ID NO: 1398798 - RNA, 19 nt, Homo sapiens
gguaugugguacugguucu

SEQ ID NO: 1398799 - RNA, 19 nt, Homo sapiens
uggcaagagaccaccuaua

SEQ ID NO: 1398800 - RNA, 19 nt, Homo sapiens
caccaaaggcagcuucaag

SEQ ID NO: 1398801 - RNA, 19 nt, Homo sapiens
cacguauucugcagcuuuc

SEQ ID NO: 1398802 - RNA, 19 nt, Homo sapiens
agccugagccacauccuuu

SEQ ID NO: 1398803 - RNA, 19 nt, Homo sapiens
ggacagaguuaccucaaua

SEQ ID NO: 1398804 - RNA, 19 nt, Homo sapiens
ugacaaagcucuaugacua

SEQ ID NO: 1398805 - RNA, 19 nt, Homo sapiens
gaacaaagaugcgaguuga

SEQ ID NO: 1398806 - RNA, 19 nt, Homo sapiens
aaaugaagcuuccgaaaua

SEQ ID NO: 1398807 - RNA, 19 nt, Homo sapiens
ggugagaguuugauuauuu

SEQ ID NO: 1398808 - RNA, 19 nt, Homo sapiens
gaaagaaggcucagagaaa

SEQ ID NO: 1398809 - RNA, 19 nt, Homo sapiens
gggagaagauggcagcuua

SEQ ID NO: 1398810 - RNA, 19 nt, Homo sapiens
cauaaaggcuaauugcaua

SEQ ID NO: 1398811 - RNA, 19 nt, Homo sapiens
gaccaaagauggccagcua

SEQ ID NO: 1398812 - RNA, 19 nt, Homo sapiens
ccaaacauauugcuagauu

SEQ ID NO: 1398813 - RNA, 19 nt, Homo sapiens
gauaaugucucuaaagucu

SEQ ID NO: 1398814 - RNA, 19 nt, Homo sapiens
caaagaccaucgcaguaua

SEQ ID NO: 1398815 - RNA, 19 nt, Homo sapiens
gcaccugucucuucccuuu

SEQ ID NO: 1398816 - RNA, 19 nt, Homo sapiens
gaagcugaaugauaaaguu

SEQ ID NO: 1398817 - RNA, 19 nt, Homo sapiens
ggaaagacauagggaagaa

SEQ ID NO: 1398818 - RNA, 19 nt, Homo sapiens
ucauuucccuucuaaguua

SEQ ID NO: 1398819 - RNA, 19 nt, Homo sapiens
ggacaucggucgagucauc

SEQ ID NO: 1398820 - RNA, 19 nt, Homo sapiens
ggaaguguaugcaaggaaa

SEQ ID NO: 1398821 - RNA, 19 nt, Homo sapiens
ggauguauguggaagguaa

SEQ ID NO: 1398822 - RNA, 19 nt, Homo sapiens
gcaaggugcugcucagaga

SEQ ID NO: 1398823 - RNA, 19 nt, Homo sapiens
caaacagucugagagaaua

SEQ ID NO: 1398824 - RNA, 19 nt, Homo sapiens
gauggcagcuuauccaaga

SEQ ID NO: 1398825 - RNA, 19 nt, Homo sapiens
gaagaggacuacagaccuu

SEQ ID NO: 1398826 - RNA, 19 nt, Homo sapiens
ggaccuaagugccuaccua

SEQ ID NO: 1398827 - RNA, 19 nt, Homo sapiens
ggaaugccauccuacaaga

SEQ ID NO: 1398828 - RNA, 19 nt, Homo sapiens
gaaggugguuuccaauaau

SEQ ID NO: 1398829 - RNA, 19 nt, Homo sapiens
guauaaaggaggagaguua

SEQ ID NO: 1398830 - RNA, 19 nt, Homo sapiens
gcuagauucuggacauuaa

SEQ ID NO: 1398831 - RNA, 19 nt, Homo sapiens
acacacaucucucccaauu

SEQ ID NO: 1398832 - RNA, 19 nt, Homo sapiens
ggaggagaguuacugauug

SEQ ID NO: 1398833 - RNA, 19 nt, Homo sapiens
cgaaagaguugauauaugc

SEQ ID NO: 1398834 - RNA, 19 nt, Homo sapiens
agaaaucccuaccuaugua

SEQ ID NO: 1398835 - RNA, 19 nt, Homo sapiens
ggaaacauccucauugauc

SEQ ID NO: 1398836 - RNA, 19 nt, Homo sapiens
gcacaaagcaugaagaaac

SEQ ID NO: 1398837 - RNA, 19 nt, Homo sapiens
gaaauauucuuggcucuag

SEQ ID NO: 1398838 - RNA, 19 nt, Homo sapiens
ugacucaucucuccgauug

SEQ ID NO: 1398839 - RNA, 19 nt, Homo sapiens
gaaacaacacggagccuuu

SEQ ID NO: 1398840 - RNA, 19 nt, Homo sapiens
gggaacaccuggagacaga

SEQ ID NO: 1398841 - RNA, 19 nt, Homo sapiens
augagaagcugaaugauaa

SEQ ID NO: 1398842 - RNA, 19 nt, Homo sapiens
gaauagugguguucucugu

SEQ ID NO: 1398843 - RNA, 19 nt, Homo sapiens
gcgaaagaguugauauaug

SEQ ID NO: 1398844 - RNA, 19 nt, Homo sapiens
auucuuggcucuagauuua

SEQ ID NO: 1398845 - RNA, 19 nt, Homo sapiens
gaagaagagcacaguguuu

SEQ ID NO: 1398846 - RNA, 19 nt, Homo sapiens
guacagaggccaacaggaa

SEQ ID NO: 1398847 - RNA, 19 nt, Homo sapiens
gagagcaguuuauugauca

SEQ ID NO: 1398848 - RNA, 19 nt, Homo sapiens
caaguaaguuguccuucaa

SEQ ID NO: 1398849 - RNA, 19 nt, Homo sapiens
ccaaggaaaucugcaugua

SEQ ID NO: 1398850 - RNA, 19 nt, Homo sapiens
aagcauauccuucagauuu

SEQ ID NO: 1398851 - RNA, 19 nt, Homo sapiens
ucaaacacgucuaucagaa

SEQ ID NO: 1398852 - RNA, 19 nt, Homo sapiens
acagagagcucgcuuugga

SEQ ID NO: 1398853 - RNA, 19 nt, Homo sapiens
guguacaggugcucuauuu

SEQ ID NO: 1398854 - RNA, 19 nt, Homo sapiens
gaauggaggacgccaguaa

SEQ ID NO: 1398855 - RNA, 19 nt, Homo sapiens
ucacagacccggagauuga

SEQ ID NO: 1398856 - RNA, 19 nt, Homo sapiens
gcauguauaggauuucaua

SEQ ID NO: 1398857 - RNA, 19 nt, Homo sapiens
uaacaagcccucccaguga

SEQ ID NO: 1398858 - RNA, 19 nt, Homo sapiens
ugauaaaccucuuaguaug

SEQ ID NO: 1398859 - RNA, 19 nt, Homo sapiens
guuaauggacuuuguguuu

SEQ ID NO: 1398860 - RNA, 19 nt, Homo sapiens
ggaaggagaaacagguuaa

SEQ ID NO: 1398861 - RNA, 19 nt, Homo sapiens
gcacagcaggguucaguuu

SEQ ID NO: 1398862 - RNA, 19 nt, Homo sapiens
aaggaaaucugcauguauu

SEQ ID NO: 1398863 - RNA, 19 nt, Homo sapiens
caaaagaaaucccuaccua

SEQ ID NO: 1398864 - RNA, 19 nt, Homo sapiens
guuguucuguuuccuauuu

SEQ ID NO: 1398865 - RNA, 19 nt, Homo sapiens
cagauaaugucucuaaagu

SEQ ID NO: 1398866 - RNA, 19 nt, Homo sapiens
gcagucaccuauuuguaga

SEQ ID NO: 1398867 - RNA, 19 nt, Homo sapiens
ccaaguaaguuguccuuca

SEQ ID NO: 1398868 - RNA, 19 nt, Homo sapiens
caaauacaguuucacaucu

SEQ ID NO: 1398869 - RNA, 19 nt, Homo sapiens
gcaaauacaguuucacauc

SEQ ID NO: 1398870 - RNA, 19 nt, Homo sapiens
caacaagcguaagauaaug

SEQ ID NO: 1398871 - RNA, 19 nt, Homo sapiens
ggaagaaugggcuguaaau

SEQ ID NO: 1398872 - RNA, 19 nt, Homo sapiens
gaagacaaaguguuggaaa

SEQ ID NO: 1398873 - RNA, 19 nt, Homo sapiens
gcacagaaagaauagcaaa

SEQ ID NO: 1398874 - RNA, 19 nt, Homo sapiens
ggacaauacucugagaaca

SEQ ID NO: 1398875 - RNA, 19 nt, Homo sapiens
gggcacaguaugcaauuua

SEQ ID NO: 1398876 - RNA, 19 nt, Homo sapiens
ggacacaacgucacucuca

SEQ ID NO: 1398877 - RNA, 19 nt, Homo sapiens
gacccagacucuuugauug

SEQ ID NO: 1398878 - RNA, 19 nt, Homo sapiens
cggcugaacuucuacauuc

SEQ ID NO: 1398879 - RNA, 19 nt, Homo sapiens
gaauccaacugagcauuga

SEQ ID NO: 1398880 - RNA, 19 nt, Homo sapiens
gaaacagguuaauggacuu

SEQ ID NO: 1398881 - RNA, 19 nt, Homo sapiens
cgacaucuuugguugaguu

SEQ ID NO: 1398882 - RNA, 19 nt, Homo sapiens
cuaccugcauuucaauuaa

SEQ ID NO: 1398883 - RNA, 19 nt, Homo sapiens
gcuaauugcauaagaaaga

SEQ ID NO: 1398884 - RNA, 19 nt, Homo sapiens
ggcuguaaauccuaauuaa

SEQ ID NO: 1398885 - RNA, 19 nt, Homo sapiens
gaaagcauagagaugaauu

SEQ ID NO: 1398886 - RNA, 19 nt, Homo sapiens
acaaagcucuaugacuaua

SEQ ID NO: 1398887 - RNA, 19 nt, Homo sapiens
ucaaguacaucauccuuca

SEQ ID NO: 1398888 - RNA, 19 nt, Homo sapiens
caaaugaagcuuccgaaau

SEQ ID NO: 1398889 - RNA, 19 nt, Homo sapiens
uaacaaggcagaauguaug

SEQ ID NO: 1398890 - RNA, 19 nt, Homo sapiens
aaagaaagcauagagauga

SEQ ID NO: 1398891 - RNA, 19 nt, Homo sapiens
auucaaaccuggccaugua

SEQ ID NO: 1398892 - RNA, 19 nt, Homo sapiens
ucacuuacgugugguggua

SEQ ID NO: 1398893 - RNA, 19 nt, Homo sapiens
uaugagaagcugaaugaua

SEQ ID NO: 1398894 - RNA, 19 nt, Homo sapiens
gcagagguuugcuuugcuu

SEQ ID NO: 1398895 - RNA, 19 nt, Homo sapiens
ggaccuugguuuccuguuc

SEQ ID NO: 1398896 - RNA, 19 nt, Homo sapiens
caccacugcugaacucuuu

SEQ ID NO: 1398897 - RNA, 19 nt, Homo sapiens
caagaagauugacaaccaa

SEQ ID NO: 1398898 - RNA, 19 nt, Homo sapiens
uagaaguguugcauguaua

SEQ ID NO: 1398899 - RNA, 19 nt, Homo sapiens
guaaugagagccuacaaau

SEQ ID NO: 1398900 - RNA, 19 nt, Homo sapiens
gcucuagauuuaucagcua

SEQ ID NO: 1398901 - RNA, 19 nt, Homo sapiens
caggagcuauggaaucuga

SEQ ID NO: 1398902 - RNA, 19 nt, Homo sapiens
uguccaugcugcucacuua

SEQ ID NO: 1398903 - RNA, 19 nt, Homo sapiens
ggacugcccuggugcaugu

SEQ ID NO: 1398904 - RNA, 19 nt, Homo sapiens
ccucaucgcugccgucauu

SEQ ID NO: 1398905 - RNA, 19 nt, Homo sapiens
gaaggagggcgacuacauu

SEQ ID NO: 1398906 - RNA, 19 nt, Homo sapiens
gcucuagacugcccagcuu

SEQ ID NO: 1398907 - RNA, 19 nt, Homo sapiens
gcaacaaccgggugagaga

SEQ ID NO: 1398908 - RNA, 19 nt, Homo sapiens
gcuccgcccucauccuuga

SEQ ID NO: 1398909 - RNA, 19 nt, Homo sapiens
gcucacagccuauuacaac

SEQ ID NO: 1398910 - RNA, 19 nt, Homo sapiens
gcgacuacauugugucagu

SEQ ID NO: 1398911 - RNA, 19 nt, Homo sapiens
gagcuggacuggucuacac

SEQ ID NO: 1398912 - RNA, 19 nt, Homo sapiens
gcagcguucucuucaacau

SEQ ID NO: 1398913 - RNA, 19 nt, Homo sapiens
ggagggcgacuacauugug

SEQ ID NO: 1398914 - RNA, 19 nt, Homo sapiens
ggucuacaccgcugaagga

SEQ ID NO: 1398915 - RNA, 19 nt, Homo sapiens
gagggcgacuacauugugu

SEQ ID NO: 1398916 - RNA, 19 nt, Homo sapiens
gggcagcguucucuucaac

SEQ ID NO: 1398917 - RNA, 19 nt, Homo sapiens
cagauucaccagcagauug

SEQ ID NO: 1398918 - RNA, 19 nt, Homo sapiens
ggagcgaagcugucacugu

SEQ ID NO: 1398919 - RNA, 19 nt, Homo sapiens
ugagcuacgucaacuccaa

SEQ ID NO: 1398920 - RNA, 19 nt, Homo sapiens
gcccaggaauguguguuug

SEQ ID NO: 1398921 - RNA, 19 nt, Homo sapiens
gugaggaugacuucuguga

SEQ ID NO: 1398922 - RNA, 19 nt, Homo sapiens
agacucgccuguccucauc

SEQ ID NO: 1398923 - RNA, 19 nt, Homo sapiens
ggaaggggccugacaucuu

SEQ ID NO: 1398924 - RNA, 19 nt, Homo sapiens
gaucucagugcacuuugga

SEQ ID NO: 1398925 - RNA, 19 nt, Homo sapiens
ugaaggagggcgacuacau

SEQ ID NO: 1398926 - RNA, 19 nt, Homo sapiens
gugacucccugacgcagau

SEQ ID NO: 1398927 - RNA, 19 nt, Homo sapiens
ccaggaauguguguuugag

SEQ ID NO: 1398928 - RNA, 19 nt, Homo sapiens
accagcagauugacaagga

SEQ ID NO: 1398929 - RNA, 19 nt, Homo sapiens
ggagcucgaccgugaggau

SEQ ID NO: 1398930 - RNA, 19 nt, Homo sapiens
ggcccaggaauguguguuu

SEQ ID NO: 1398931 - RNA, 19 nt, Homo sapiens
ccgugaggaugacuucugu

SEQ ID NO: 1398932 - RNA, 19 nt, Homo sapiens
ugucaaggccgaguacuuc

SEQ ID NO: 1398933 - RNA, 19 nt, Homo sapiens
gagacucgccuguccucau

SEQ ID NO: 1398934 - RNA, 19 nt, Homo sapiens
ugacaaggagcugcagaug

SEQ ID NO: 1398935 - RNA, 19 nt, Homo sapiens
cagcuccgcccucauccuu

SEQ ID NO: 1398936 - RNA, 19 nt, Homo sapiens
ccggacauccagccuaaga

SEQ ID NO: 1398937 - RNA, 19 nt, Homo sapiens
gcgcugagaaccucuacag

SEQ ID NO: 1398938 - RNA, 19 nt, Homo sapiens
gggcgacuacauuguguca

SEQ ID NO: 1398939 - RNA, 19 nt, Homo sapiens
aaggagggcgacuacauug

SEQ ID NO: 1398940 - RNA, 19 nt, Homo sapiens
ggacuuggguuguaaauuu

SEQ ID NO: 1398941 - RNA, 19 nt, Homo sapiens
ggagaagggugaccaugaa

SEQ ID NO: 1398942 - RNA, 19 nt, Homo sapiens
ggaaagagaagcaggacua

SEQ ID NO: 1398943 - RNA, 19 nt, Homo sapiens
gacuuggguuguaaauuua

SEQ ID NO: 1398944 - RNA, 19 nt, Homo sapiens
gcacugagcaccauuugga

SEQ ID NO: 1398945 - RNA, 19 nt, Homo sapiens
gcugagagcccuaagaaga

SEQ ID NO: 1398946 - RNA, 19 nt, Homo sapiens
gaggaugugcuaugaguuu

SEQ ID NO: 1398947 - RNA, 19 nt, Homo sapiens
gcaacagcuucaccaaguu

SEQ ID NO: 1398948 - RNA, 19 nt, Homo sapiens
ggcaacagcuucaccaagu

SEQ ID NO: 1398949 - RNA, 19 nt, Homo sapiens
gacaacagcucuucuucca

SEQ ID NO: 1398950 - RNA, 19 nt, Homo sapiens
ccauguaacuggaggaugu

SEQ ID NO: 1398951 - RNA, 19 nt, Homo sapiens
uuuggaagcuugagagaaa

SEQ ID NO: 1398952 - RNA, 19 nt, Homo sapiens
gaagcaggacuacgcguuu

SEQ ID NO: 1398953 - RNA, 19 nt, Homo sapiens
aagcgacccuuugcuguua

SEQ ID NO: 1398954 - RNA, 19 nt, Homo sapiens
gaagcgacccuuugcuguu

SEQ ID NO: 1398955 - RNA, 19 nt, Homo sapiens
gcacagauuggucuucuca

SEQ ID NO: 1398956 - RNA, 19 nt, Homo sapiens
ccacggagcuggcauaccu

SEQ ID NO: 1398957 - RNA, 19 nt, Homo sapiens
gcccaacccugagaaaguu

SEQ ID NO: 1398958 - RNA, 19 nt, Homo sapiens
caacagcuucaccaaguuu

SEQ ID NO: 1398959 - RNA, 19 nt, Homo sapiens
gaucaacguagcacagauu

SEQ ID NO: 1398960 - RNA, 19 nt, Homo sapiens
gcgagcagaugaagucgau

SEQ ID NO: 1398961 - RNA, 19 nt, Homo sapiens
cccaggacaugaaagagua

SEQ ID NO: 1398962 - RNA, 19 nt, Homo sapiens
gacuggaggucucaaguuc

SEQ ID NO: 1398963 - RNA, 19 nt, Homo sapiens
gggugaccaugaagaguuu

SEQ ID NO: 1398964 - RNA, 19 nt, Homo sapiens
ggacuggaggucucaaguu

SEQ ID NO: 1398965 - RNA, 19 nt, Homo sapiens
gacaaggaccgcacggaaa

SEQ ID NO: 1398966 - RNA, 19 nt, Homo sapiens
gcccacgccuuggcauuaa

SEQ ID NO: 1398967 - RNA, 19 nt, Homo sapiens
gauccugguugacagugaa

SEQ ID NO: 1398968 - RNA, 19 nt, Homo sapiens
cggaaaagcugcucaagga

SEQ ID NO: 1398969 - RNA, 19 nt, Homo sapiens
ggacagcuccagccacaca

SEQ ID NO: 1398970 - RNA, 19 nt, Homo sapiens
gggcaacuaccaccgcuuu

SEQ ID NO: 1398971 - RNA, 19 nt, Homo sapiens
caggacggcucggccuaua

SEQ ID NO: 1398972 - RNA, 19 nt, Homo sapiens
gccuuucacuccacuaaug

SEQ ID NO: 1398973 - RNA, 19 nt, Homo sapiens
caaguuguauaaaguuguc

SEQ ID NO: 1398974 - RNA, 19 nt, Homo sapiens
cuaaugcugucucaguguu

SEQ ID NO: 1398975 - RNA, 19 nt, Homo sapiens
cagauuggucuucucagua

SEQ ID NO: 1398976 - RNA, 19 nt, Homo sapiens
cgucucaaguuguauaaag

SEQ ID NO: 1398977 - RNA, 19 nt, Homo sapiens
caacaccaagggacucuga

SEQ ID NO: 1398978 - RNA, 19 nt, Homo sapiens
gcccugacaucaccaagca

SEQ ID NO: 1398979 - RNA, 19 nt, Homo sapiens
uuaaagagagaaagagaga

SEQ ID NO: 1398980 - RNA, 19 nt, Homo sapiens
caagaacucgggagacauc

SEQ ID NO: 1398981 - RNA, 19 nt, Homo sapiens
cgaauccucuacuacaucu

SEQ ID NO: 1398982 - RNA, 19 nt, Homo sapiens
ccacuaaugcugucucagu

SEQ ID NO: 1398983 - RNA, 19 nt, Homo sapiens
gaaccugccaagcccaaga

SEQ ID NO: 1398984 - RNA, 19 nt, Homo sapiens
agacgccgaugcacgagaa

SEQ ID NO: 1398985 - RNA, 19 nt, Homo sapiens
guaacuggaggaugugcua

SEQ ID NO: 1398986 - RNA, 19 nt, Homo sapiens
cgccucgucucaaguugua

SEQ ID NO: 1398987 - RNA, 19 nt, Homo sapiens
gccguggacuuggguugua

SEQ ID NO: 1398988 - RNA, 19 nt, Homo sapiens
gaagggugaccaugaagag

SEQ ID NO: 1398989 - RNA, 19 nt, Homo sapiens
ggagcacugagcaccauuu

SEQ ID NO: 1398990 - RNA, 19 nt, Homo sapiens
caacguagcacagauuggu

SEQ ID NO: 1398991 - RNA, 19 nt, Homo sapiens
gcgcugccuuugcggauuc

SEQ ID NO: 1398992 - RNA, 19 nt, Homo sapiens
ggcccacgccuuggcauua

SEQ ID NO: 1398993 - RNA, 19 nt, Homo sapiens
ggauccugguugacaguga

SEQ ID NO: 1398994 - RNA, 19 nt, Homo sapiens
agcgagagcugaagaagca

SEQ ID NO: 1398995 - RNA, 19 nt, Homo sapiens
acagauuggucuucucagu

SEQ ID NO: 1398996 - RNA, 19 nt, Homo sapiens
gcuguacgccgagaacuug

SEQ ID NO: 1398997 - RNA, 19 nt, Homo sapiens
caagcgcagucgaaagaag

SEQ ID NO: 1398998 - RNA, 19 nt, Homo sapiens
cgaaggauccugguugaca

SEQ ID NO: 1398999 - RNA, 19 nt, Homo sapiens
gagcauguaccagagcuau

SEQ ID NO: 1399000 - RNA, 19 nt, Homo sapiens
guacgugucccaggcagaa

SEQ ID NO: 1399001 - RNA, 19 nt, Homo sapiens
gagcacugagcaccauuug

SEQ ID NO: 1399002 - RNA, 19 nt, Homo sapiens
caaccgcaacgucuucaug

SEQ ID NO: 1399003 - RNA, 19 nt, Homo sapiens
uggaggaugugcuaugagu

SEQ ID NO: 1399004 - RNA, 19 nt, Homo sapiens
gcugaucgccugggugguu

SEQ ID NO: 1399005 - RNA, 19 nt, Homo sapiens
ggagcuggcauaccucaca

SEQ ID NO: 1399006 - RNA, 19 nt, Homo sapiens
ucuacuacaucuucaccaa

SEQ ID NO: 1399007 - RNA, 19 nt, Homo sapiens
cuggaggucucaaguucaa

SEQ ID NO: 1399008 - RNA, 19 nt, Homo sapiens
ccucaaggccaugaucaaa

SEQ ID NO: 1399009 - RNA, 19 nt, Homo sapiens
ccaccaagcgcagucgaaa

SEQ ID NO: 1399010 - RNA, 19 nt, Homo sapiens
gcuguggaaccgcaugaaa

SEQ ID NO: 1399011 - RNA, 19 nt, Homo sapiens
gagcaccauuuggaagcuu

SEQ ID NO: 1399012 - RNA, 19 nt, Homo sapiens
agauuggucuucucaguac

SEQ ID NO: 1399013 - RNA, 19 nt, Homo sapiens
cccaguguuucuucugauu

SEQ ID NO: 1399014 - RNA, 19 nt, Homo sapiens
ggagcugcuuagagacugu

SEQ ID NO: 1399015 - RNA, 19 nt, Homo sapiens
ccuaccgaauccucuacua

SEQ ID NO: 1399016 - RNA, 19 nt, Homo sapiens
uggagaagggugaccauga

SEQ ID NO: 1399017 - RNA, 19 nt, Homo sapiens
gaaagagaagcaggacuac

SEQ ID NO: 1399018 - RNA, 19 nt, Homo sapiens
ggaggucucaaguucaaca

SEQ ID NO: 1399019 - RNA, 19 nt, Homo sapiens
gaugugcuaugaguuugca

SEQ ID NO: 1399020 - RNA, 19 nt, Homo sapiens
ccaguguuucuucugauuu

SEQ ID NO: 1399021 - RNA, 19 nt, Homo sapiens
ucugcaggcucaucugugu

SEQ ID NO: 1399022 - RNA, 19 nt, Homo sapiens
gcaaugugggcgaguuuac

SEQ ID NO: 1399023 - RNA, 19 nt, Homo sapiens
ccuaugggccacacaccua

SEQ ID NO: 1399024 - RNA, 19 nt, Homo sapiens
uggaugagagcauguccua

SEQ ID NO: 1399025 - RNA, 19 nt, Homo sapiens
acuggaggaugugcuauga

SEQ ID NO: 1399026 - RNA, 19 nt, Homo sapiens
uagcacagauuggucuucu

SEQ ID NO: 1399027 - RNA, 19 nt, Homo sapiens
ugagagcccuaagaagaag

SEQ ID NO: 1399028 - RNA, 19 nt, Homo sapiens
cugagagcccuaagaagaa

SEQ ID NO: 1399029 - RNA, 19 nt, Homo sapiens
gcauguaccagagcuaugg

SEQ ID NO: 1399030 - RNA, 19 nt, Homo sapiens
ucaccugcuucgccacaga

SEQ ID NO: 1399031 - RNA, 19 nt, Homo sapiens
ucaccacggagcuggcaua

SEQ ID NO: 1399032 - RNA, 19 nt, Homo sapiens
aagcaggacuacgcguuug

SEQ ID NO: 1399033 - RNA, 19 nt, Homo sapiens
ggaggaugugcuaugaguu

SEQ ID NO: 1399034 - RNA, 19 nt, Homo sapiens
ccucgucucaaguuguaua

SEQ ID NO: 1399035 - RNA, 19 nt, Homo sapiens
gcuaccucguggacaaguu

SEQ ID NO: 1399036 - RNA, 19 nt, Homo sapiens
ggcaaugugggcgaguuua

SEQ ID NO: 1399037 - RNA, 19 nt, Homo sapiens
caccagcucacgucauguu

SEQ ID NO: 1399038 - RNA, 19 nt, Homo sapiens
cggcucggccuauaccauu

SEQ ID NO: 1399039 - RNA, 19 nt, Homo sapiens
uaccagcaguacaacuaug

SEQ ID NO: 1399040 - RNA, 19 nt, Homo sapiens
gaaaggcccugcugauugu

SEQ ID NO: 1399041 - RNA, 19 nt, Homo sapiens
agaaagaggaggagaauua

SEQ ID NO: 1399042 - RNA, 19 nt, Homo sapiens
uaacccagaugaugaguuu

SEQ ID NO: 1399043 - RNA, 19 nt, Homo sapiens
gcugauugcugcccuagua

SEQ ID NO: 1399044 - RNA, 19 nt, Homo sapiens
gaugagggccgaaguauga

SEQ ID NO: 1399045 - RNA, 19 nt, Homo sapiens
guagugagguggaaauuca

SEQ ID NO: 1399046 - RNA, 19 nt, Homo sapiens
gaagagaccuuugaagacu

SEQ ID NO: 1399047 - RNA, 19 nt, Homo sapiens
gguguucccugcuauguuu

SEQ ID NO: 1399048 - RNA, 19 nt, Homo sapiens
gagaagagaggauguguug

SEQ ID NO: 1399049 - RNA, 19 nt, Homo sapiens
gaaagaggaggagaauuaa

SEQ ID NO: 1399050 - RNA, 19 nt, Homo sapiens
gcaggucacugagauaaug

SEQ ID NO: 1399051 - RNA, 19 nt, Homo sapiens
cgaaagaaaguauguggua

SEQ ID NO: 1399052 - RNA, 19 nt, Homo sapiens
gcagagcucagccaucuuu

SEQ ID NO: 1399053 - RNA, 19 nt, Homo sapiens
ccaaggcagucuucauuga

SEQ ID NO: 1399054 - RNA, 19 nt, Homo sapiens
gaagaaguguaagaagaga

SEQ ID NO: 1399055 - RNA, 19 nt, Homo sapiens
ggccaacaaugacuccaua

SEQ ID NO: 1399056 - RNA, 19 nt, Homo sapiens
gcgaagagaccuuugaaga

SEQ ID NO: 1399057 - RNA, 19 nt, Homo sapiens
ccaaauagcaucugguuca

SEQ ID NO: 1399058 - RNA, 19 nt, Homo sapiens
gcagaccucuccgaagauu

SEQ ID NO: 1399059 - RNA, 19 nt, Homo sapiens
gaagccaggucgagaucaa

SEQ ID NO: 1399060 - RNA, 19 nt, Homo sapiens
gaacuccaccucugcuuug

SEQ ID NO: 1399061 - RNA, 19 nt, Homo sapiens
ggaggaggaagaaguguaa

SEQ ID NO: 1399062 - RNA, 19 nt, Homo sapiens
gaccauacagggaggcuua

SEQ ID NO: 1399063 - RNA, 19 nt, Homo sapiens
gaagaagagugggagaaca

SEQ ID NO: 1399064 - RNA, 19 nt, Homo sapiens
ggaggagaauuaagaagag

SEQ ID NO: 1399065 - RNA, 19 nt, Homo sapiens
aggcagugaugaagaauaa

SEQ ID NO: 1399066 - RNA, 19 nt, Homo sapiens
gcgcagagcucagccaucu

SEQ ID NO: 1399067 - RNA, 19 nt, Homo sapiens
caggaaggcagcauucaua

SEQ ID NO: 1399068 - RNA, 19 nt, Homo sapiens
acaggaaacugaaaguguu

SEQ ID NO: 1399069 - RNA, 19 nt, Homo sapiens
gauugcugcccuaguauua

SEQ ID NO: 1399070 - RNA, 19 nt, Homo sapiens
uuagaucaguccauagaaa

SEQ ID NO: 1399071 - RNA, 19 nt, Homo sapiens
ucauguuucucuucaguaa

SEQ ID NO: 1399072 - RNA, 19 nt, Homo sapiens
ccacuacacuuagcacaug

SEQ ID NO: 1399073 - RNA, 19 nt, Homo sapiens
ugaacuacuuccugaaaga

SEQ ID NO: 1399074 - RNA, 19 nt, Homo sapiens
gaaauucaggacacuguga

SEQ ID NO: 1399075 - RNA, 19 nt, Homo sapiens
gcagcuccuuuccagagua

SEQ ID NO: 1399076 - RNA, 19 nt, Homo sapiens
uaucuacccuguggacuuu

SEQ ID NO: 1399077 - RNA, 19 nt, Homo sapiens
gcagaaagccgugcacaag

SEQ ID NO: 1399078 - RNA, 19 nt, Homo sapiens
gagcaggucacugagauaa

SEQ ID NO: 1399079 - RNA, 19 nt, Homo sapiens
ugacacugcuagaggauug

SEQ ID NO: 1399080 - RNA, 19 nt, Homo sapiens
cugcagaccucuccgaaga

SEQ ID NO: 1399081 - RNA, 19 nt, Homo sapiens
gcaguuucucucuguguua

SEQ ID NO: 1399082 - RNA, 19 nt, Homo sapiens
aggaagaaguguaagaaga

SEQ ID NO: 1399083 - RNA, 19 nt, Homo sapiens
ggaggaagaaguguaagaa

SEQ ID NO: 1399084 - RNA, 19 nt, Homo sapiens
gaaggaggaggaagaagug

SEQ ID NO: 1399085 - RNA, 19 nt, Homo sapiens
acacuacucugcccaguca

SEQ ID NO: 1399086 - RNA, 19 nt, Homo sapiens
aguauuagaucaguccaua

SEQ ID NO: 1399087 - RNA, 19 nt, Homo sapiens
ggaaggaggaggaagaagu

SEQ ID NO: 1399088 - RNA, 19 nt, Homo sapiens
caaccaagaccaaauagca

SEQ ID NO: 1399089 - RNA, 19 nt, Homo sapiens
gcagggacauuugaacaag

SEQ ID NO: 1399090 - RNA, 19 nt, Homo sapiens
gaccacuucugccuuccua

SEQ ID NO: 1399091 - RNA, 19 nt, Homo sapiens
gcaggcagcagggacauuu

SEQ ID NO: 1399092 - RNA, 19 nt, Homo sapiens
gagaggaguugggaaacga

SEQ ID NO: 1399093 - RNA, 19 nt, Homo sapiens
ggcagacgcucaccuugug

SEQ ID NO: 1399094 - RNA, 19 nt, Homo sapiens
ggaagaaguguaagaagag

SEQ ID NO: 1399095 - RNA, 19 nt, Homo sapiens
gcgcagcacagacaugauu

SEQ ID NO: 1399096 - RNA, 19 nt, Homo sapiens
agaaaggcccugcugauug

SEQ ID NO: 1399097 - RNA, 19 nt, Homo sapiens
gaaggcagcauucauaagc

SEQ ID NO: 1399098 - RNA, 19 nt, Homo sapiens
cagccugucuuuaggauca

SEQ ID NO: 1399099 - RNA, 19 nt, Homo sapiens
ggaggaggcugugugaaac

SEQ ID NO: 1399100 - RNA, 19 nt, Homo sapiens
gaaacgcaggcggcuguua

SEQ ID NO: 1399101 - RNA, 19 nt, Homo sapiens
ucacugcuguuccguguca

SEQ ID NO: 1399102 - RNA, 19 nt, Homo sapiens
aaacauaggcucagaagac

SEQ ID NO: 1399103 - RNA, 19 nt, Homo sapiens
gcaggaggaggcuguguga

SEQ ID NO: 1399104 - RNA, 19 nt, Homo sapiens
cagaaaggcccugcugauu

SEQ ID NO: 1399105 - RNA, 19 nt, Homo sapiens
gcaguuucaguucauguuu

SEQ ID NO: 1399106 - RNA, 19 nt, Homo sapiens
caacaaugacuccauaacu

SEQ ID NO: 1399107 - RNA, 19 nt, Homo sapiens
caccaaccaagaccaaaua

SEQ ID NO: 1399108 - RNA, 19 nt, Homo sapiens
ggaaacauaggcucagaag

SEQ ID NO: 1399109 - RNA, 19 nt, Homo sapiens
ggcaguggcucagaguuau

SEQ ID NO: 1399110 - RNA, 19 nt, Homo sapiens
aacaaugacuccauaacug

SEQ ID NO: 1399111 - RNA, 19 nt, Homo sapiens
aaagaugagggccgaagua

SEQ ID NO: 1399112 - RNA, 19 nt, Homo sapiens
ggacuugugaccuguagug

SEQ ID NO: 1399113 - RNA, 19 nt, Homo sapiens
gaagagaagagaggaugug

SEQ ID NO: 1399114 - RNA, 19 nt, Homo sapiens
gaagaccgaagcacuccuu

SEQ ID NO: 1399115 - RNA, 19 nt, Homo sapiens
gccgaaguaugacagaugu

SEQ ID NO: 1399116 - RNA, 19 nt, Homo sapiens
gggaggagaaggaggaaga

SEQ ID NO: 1399117 - RNA, 19 nt, Homo sapiens
gaacuacuuccugaaagau

SEQ ID NO: 1399118 - RNA, 19 nt, Homo sapiens
ccagucacauaccaggaaa

SEQ ID NO: 1399119 - RNA, 19 nt, Homo sapiens
uggcaguggcucagaguua

SEQ ID NO: 1399120 - RNA, 19 nt, Homo sapiens
agaaagccgugcacaagag

SEQ ID NO: 1399121 - RNA, 19 nt, Homo sapiens
uagagcaggucacugagau

SEQ ID NO: 1399122 - RNA, 19 nt, Homo sapiens
caaguuagauccccaccuu

SEQ ID NO: 1399123 - RNA, 19 nt, Homo sapiens
gcaaggggauggacaugga

SEQ ID NO: 1399124 - RNA, 19 nt, Homo sapiens
guucauguuucucuucagu

SEQ ID NO: 1399125 - RNA, 19 nt, Homo sapiens
gcucagccaucuuucucau

SEQ ID NO: 1399126 - RNA, 19 nt, Homo sapiens
aagaggaggagaauuaaga

SEQ ID NO: 1399127 - RNA, 19 nt, Homo sapiens
ugucugagguggagaagag

SEQ ID NO: 1399128 - RNA, 19 nt, Homo sapiens
ggcuagagcaggucacuga

SEQ ID NO: 1399129 - RNA, 19 nt, Homo sapiens
ccugggaaguggugguaaa

SEQ ID NO: 1399130 - RNA, 19 nt, Homo sapiens
gaccuguaguggcuguuug

SEQ ID NO: 1399131 - RNA, 19 nt, Homo sapiens
gaauuaagaagaggaugau

SEQ ID NO: 1399132 - RNA, 19 nt, Homo sapiens
ccagugaggaagagaaaga

SEQ ID NO: 1399133 - RNA, 19 nt, Homo sapiens
cagaaagccgugcacaaga

SEQ ID NO: 1399134 - RNA, 19 nt, Homo sapiens
ccauauggcaagugucuga

SEQ ID NO: 1399135 - RNA, 19 nt, Homo sapiens
gaaagaugagggccgaagu

SEQ ID NO: 1399136 - RNA, 19 nt, Homo sapiens
caggagaggaguugggaaa

SEQ ID NO: 1399137 - RNA, 19 nt, Homo sapiens
gaggcagugaugaagaaua

SEQ ID NO: 1399138 - RNA, 19 nt, Homo sapiens
cuggagggcucgucagugu

SEQ ID NO: 1399139 - RNA, 19 nt, Homo sapiens
ggaguguagugagguggaa

SEQ ID NO: 1399140 - RNA, 19 nt, Homo sapiens
gaacaguuguccucacuuu

SEQ ID NO: 1399141 - RNA, 19 nt, Homo sapiens
cugcaaagcuguccaguua

SEQ ID NO: 1399142 - RNA, 19 nt, Homo sapiens
gagcaucccuugucugaaa

SEQ ID NO: 1399143 - RNA, 19 nt, Homo sapiens
gcaugugguucaaauaaua

SEQ ID NO: 1399144 - RNA, 19 nt, Homo sapiens
caacugcccuugacaaugu

SEQ ID NO: 1399145 - RNA, 19 nt, Homo sapiens
uaaauuggauccuucaguu

SEQ ID NO: 1399146 - RNA, 19 nt, Homo sapiens
ggaagaggaugguauuaca

SEQ ID NO: 1399147 - RNA, 19 nt, Homo sapiens
caaauggaauuaugguuga

SEQ ID NO: 1399148 - RNA, 19 nt, Homo sapiens
gaaauaaugcaguguguug

SEQ ID NO: 1399149 - RNA, 19 nt, Homo sapiens
gcacauugacucucucuuu

SEQ ID NO: 1399150 - RNA, 19 nt, Homo sapiens
caaggaaccuagaguaugu

SEQ ID NO: 1399151 - RNA, 19 nt, Homo sapiens
uaaccugaauccuaccuua

SEQ ID NO: 1399152 - RNA, 19 nt, Homo sapiens
gcagcaggauugacuuauu

SEQ ID NO: 1399153 - RNA, 19 nt, Homo sapiens
ggaaugacacgucuucuga

SEQ ID NO: 1399154 - RNA, 19 nt, Homo sapiens
gcaaagcuguccaguuaca

SEQ ID NO: 1399155 - RNA, 19 nt, Homo sapiens
uuaaauaugucaccuccua

SEQ ID NO: 1399156 - RNA, 19 nt, Homo sapiens
ucuuucagcuccucuauua

SEQ ID NO: 1399157 - RNA, 19 nt, Homo sapiens
uacaucagcuccauuguuu

SEQ ID NO: 1399158 - RNA, 19 nt, Homo sapiens
gaacauacaaguuaccaau

SEQ ID NO: 1399159 - RNA, 19 nt, Homo sapiens
gcccagauauccacaaaga

SEQ ID NO: 1399160 - RNA, 19 nt, Homo sapiens
ggacucuaccucagaaaua

SEQ ID NO: 1399161 - RNA, 19 nt, Homo sapiens
gcauuucccuugaguuuca

SEQ ID NO: 1399162 - RNA, 19 nt, Homo sapiens
gaauuaugguugacagaga

SEQ ID NO: 1399163 - RNA, 19 nt, Homo sapiens
gaaccuagaguauguuuca

SEQ ID NO: 1399164 - RNA, 19 nt, Homo sapiens
ccacaaagaccucugcaaa

SEQ ID NO: 1399165 - RNA, 19 nt, Homo sapiens
ccaaugcacucagaaagaa

SEQ ID NO: 1399166 - RNA, 19 nt, Homo sapiens
caagauggccagaguaaug

SEQ ID NO: 1399167 - RNA, 19 nt, Homo sapiens
caauaagcauuucccuuga

SEQ ID NO: 1399168 - RNA, 19 nt, Homo sapiens
cagcaggauugacuuauug

SEQ ID NO: 1399169 - RNA, 19 nt, Homo sapiens
ccagaccacucuuucuaaa

SEQ ID NO: 1399170 - RNA, 19 nt, Homo sapiens
gagaaauaaugcagugugu

SEQ ID NO: 1399171 - RNA, 19 nt, Homo sapiens
ggauugacuuauugagaaa

SEQ ID NO: 1399172 - RNA, 19 nt, Homo sapiens
gaauguaguuucacaaagc

SEQ ID NO: 1399173 - RNA, 19 nt, Homo sapiens
ucacuuggcuuuucaauga

SEQ ID NO: 1399174 - RNA, 19 nt, Homo sapiens
uaacacaccagcacauuga

SEQ ID NO: 1399175 - RNA, 19 nt, Homo sapiens
ccacgugacuaauccgaaa

SEQ ID NO: 1399176 - RNA, 19 nt, Homo sapiens
aaacaucucuugccuucau

SEQ ID NO: 1399177 - RNA, 19 nt, Homo sapiens
agucuucgguuucaucaua

SEQ ID NO: 1399178 - RNA, 19 nt, Homo sapiens
agaaugcugucaguaauuu

SEQ ID NO: 1399179 - RNA, 19 nt, Homo sapiens
gagcccagauauccacaaa

SEQ ID NO: 1399180 - RNA, 19 nt, Homo sapiens
gaaaugcuugggauuagaa

SEQ ID NO: 1399181 - RNA, 19 nt, Homo sapiens
gagaguuuaugauccagaa

SEQ ID NO: 1399182 - RNA, 19 nt, Homo sapiens
ggaauguaguuucacaaag

SEQ ID NO: 1399183 - RNA, 19 nt, Homo sapiens
gaaauccacgugacuaauc

SEQ ID NO: 1399184 - RNA, 19 nt, Homo sapiens
gauuugggaugcucaacuu

SEQ ID NO: 1399185 - RNA, 19 nt, Homo sapiens
auacugcuguuacuuguuu

SEQ ID NO: 1399186 - RNA, 19 nt, Homo sapiens
cagagaaugcugucaguaa

SEQ ID NO: 1399187 - RNA, 19 nt, Homo sapiens
gacaaccacuucucuccuu

SEQ ID NO: 1399188 - RNA, 19 nt, Homo sapiens
cuaagcaaauggaauuaug

SEQ ID NO: 1399189 - RNA, 19 nt, Homo sapiens
cagcaugugguucaaauaa

SEQ ID NO: 1399190 - RNA, 19 nt, Homo sapiens
ucagaaagaaauccaguuu

SEQ ID NO: 1399191 - RNA, 19 nt, Homo sapiens
gaaagcagcaggauugacu

SEQ ID NO: 1399192 - RNA, 19 nt, Homo sapiens
gucaaacaccuaaggauaa

SEQ ID NO: 1399193 - RNA, 19 nt, Homo sapiens
gcaaggaaccuagaguaug

SEQ ID NO: 1399194 - RNA, 19 nt, Homo sapiens
ggacuacaccugcauagca

SEQ ID NO: 1399195 - RNA, 19 nt, Homo sapiens
acagucagcuauuucagaa

SEQ ID NO: 1399196 - RNA, 19 nt, Homo sapiens
gcaguguguugguuacaug

SEQ ID NO: 1399197 - RNA, 19 nt, Homo sapiens
gagaaugcugucaguaauu

SEQ ID NO: 1399198 - RNA, 19 nt, Homo sapiens
uuagaaagcagcaggauug

SEQ ID NO: 1399199 - RNA, 19 nt, Homo sapiens
cacauugacucucucuuug

SEQ ID NO: 1399200 - RNA, 19 nt, Homo sapiens
ggcaacagaauuugaauau

SEQ ID NO: 1399201 - RNA, 19 nt, Homo sapiens
cugaggaacauacaaguua

SEQ ID NO: 1399202 - RNA, 19 nt, Homo sapiens
guuuaugguuucugggaua

SEQ ID NO: 1399203 - RNA, 19 nt, Homo sapiens
uaagacaacugaggaacau

SEQ ID NO: 1399204 - RNA, 19 nt, Homo sapiens
ugacagagaguuuaugauc

SEQ ID NO: 1399205 - RNA, 19 nt, Homo sapiens
gcaacagaauuugaauauc

SEQ ID NO: 1399206 - RNA, 19 nt, Homo sapiens
gaagcuugguuccuguugu

SEQ ID NO: 1399207 - RNA, 19 nt, Homo sapiens
gaacaaagaacaggaagcu

SEQ ID NO: 1399208 - RNA, 19 nt, Homo sapiens
gcgaagauguuaaaauuca

SEQ ID NO: 1399209 - RNA, 19 nt, Homo sapiens
gaugggaggccuugggaaa

SEQ ID NO: 1399210 - RNA, 19 nt, Homo sapiens
gggaauguaguuucacaaa

SEQ ID NO: 1399211 - RNA, 19 nt, Homo sapiens
caaucacagucagcuauuu

SEQ ID NO: 1399212 - RNA, 19 nt, Homo sapiens
acauacaaguuaccaauca

SEQ ID NO: 1399213 - RNA, 19 nt, Homo sapiens
gaaaccccgucuuuacuaa

SEQ ID NO: 1399214 - RNA, 19 nt, Homo sapiens
uaugucaccuccuaagaga

SEQ ID NO: 1399215 - RNA, 19 nt, Homo sapiens
caucagcuccauuguuuga

SEQ ID NO: 1399216 - RNA, 19 nt, Homo sapiens
ggacauacugccuaaccuu

SEQ ID NO: 1399217 - RNA, 19 nt, Homo sapiens
acacaucuccugggacaua

SEQ ID NO: 1399218 - RNA, 19 nt, Homo sapiens
aggauugacuuauugagaa

SEQ ID NO: 1399219 - RNA, 19 nt, Homo sapiens
agagaaugcugucaguaau

SEQ ID NO: 1399220 - RNA, 19 nt, Homo sapiens
gcauuacccuucugacacu

SEQ ID NO: 1399221 - RNA, 19 nt, Homo sapiens
gacucuaccucagaaauau

SEQ ID NO: 1399222 - RNA, 19 nt, Homo sapiens
gauaacacaccagcacauu

SEQ ID NO: 1399223 - RNA, 19 nt, Homo sapiens
uccaaucgcuccuguuugu

SEQ ID NO: 1399224 - RNA, 19 nt, Homo sapiens
gagccaagaaucuaaguca

SEQ ID NO: 1399225 - RNA, 19 nt, Homo sapiens
uugacucucucuuugauaa

SEQ ID NO: 1399226 - RNA, 19 nt, Homo sapiens
gcaggagaaucgcuugaac

SEQ ID NO: 1399227 - RNA, 19 nt, Homo sapiens
ccagaagcuuugcgaagau

SEQ ID NO: 1399228 - RNA, 19 nt, Homo sapiens
cagaaauccacgugacuaa

SEQ ID NO: 1399229 - RNA, 19 nt, Homo sapiens
gacauacugccuaaccuuu

SEQ ID NO: 1399230 - RNA, 19 nt, Homo sapiens
ucaaacagggaaacagaaa

SEQ ID NO: 1399231 - RNA, 19 nt, Homo sapiens
cccagaagcuuugcgaaga

SEQ ID NO: 1399232 - RNA, 19 nt, Homo sapiens
gaaugcugucaguaauuua

SEQ ID NO: 1399233 - RNA, 19 nt, Homo sapiens
gcagagaaugcugucagua

SEQ ID NO: 1399234 - RNA, 19 nt, Homo sapiens
agacacaggcucuuacaga

SEQ ID NO: 1399235 - RNA, 19 nt, Homo sapiens
cacaagauggccagaguaa

SEQ ID NO: 1399236 - RNA, 19 nt, Homo sapiens
cuuaagaucagaacaguug

SEQ ID NO: 1399237 - RNA, 19 nt, Homo sapiens
agucaaacaccuaaggaua

SEQ ID NO: 1399238 - RNA, 19 nt, Homo sapiens
acaaagaccucugcaaagc

SEQ ID NO: 1399239 - RNA, 19 nt, Homo sapiens
aaaggaagaggaugguauu

SEQ ID NO: 1399240 - RNA, 19 nt, Homo sapiens
gaaguggacugaauguuua

SEQ ID NO: 1399241 - RNA, 19 nt, Homo sapiens
gggagagacuuaugaauua

SEQ ID NO: 1399242 - RNA, 19 nt, Homo sapiens
ggacagaaauuacuucaau

SEQ ID NO: 1399243 - RNA, 19 nt, Homo sapiens
ggaaguggacugaauguuu

SEQ ID NO: 1399244 - RNA, 19 nt, Homo sapiens
ggacaaauguguguugaau

SEQ ID NO: 1399245 - RNA, 19 nt, Homo sapiens
gcauauacauggacaaauc

SEQ ID NO: 1399246 - RNA, 19 nt, Homo sapiens
caagacagacugcagguua

SEQ ID NO: 1399247 - RNA, 19 nt, Homo sapiens
gaaaguaaguugcacucau

SEQ ID NO: 1399248 - RNA, 19 nt, Homo sapiens
gaacucuccuccuauacaa

SEQ ID NO: 1399249 - RNA, 19 nt, Homo sapiens
gcacauucaucuuaaaucu

SEQ ID NO: 1399250 - RNA, 19 nt, Homo sapiens
ucaauuugccugacauuua

SEQ ID NO: 1399251 - RNA, 19 nt, Homo sapiens
gcacaggacuggauuuacu

SEQ ID NO: 1399252 - RNA, 19 nt, Homo sapiens
gaaaguguauucauuaucc

SEQ ID NO: 1399253 - RNA, 19 nt, Homo sapiens
caauuugccugacauuuau

SEQ ID NO: 1399254 - RNA, 19 nt, Homo sapiens
gcugaaggauuaaacaaug

SEQ ID NO: 1399255 - RNA, 19 nt, Homo sapiens
gagaugaccuuggauuuag

SEQ ID NO: 1399256 - RNA, 19 nt, Homo sapiens
cacugaacaucaugaauua

SEQ ID NO: 1399257 - RNA, 19 nt, Homo sapiens
uuagaacucuccuccuaua

SEQ ID NO: 1399258 - RNA, 19 nt, Homo sapiens
ugaaugaaguagacaaaga

SEQ ID NO: 1399259 - RNA, 19 nt, Homo sapiens
agaaaugacuucaguaucu

SEQ ID NO: 1399260 - RNA, 19 nt, Homo sapiens
gcgccuaacugaauacaug

SEQ ID NO: 1399261 - RNA, 19 nt, Homo sapiens
gcaaaugccacuagggaaa

SEQ ID NO: 1399262 - RNA, 19 nt, Homo sapiens
gaccuuggauuuagacuca

SEQ ID NO: 1399263 - RNA, 19 nt, Homo sapiens
acaaagacauggagagugu

SEQ ID NO: 1399264 - RNA, 19 nt, Homo sapiens
gaagcucugugcccucuau

SEQ ID NO: 1399265 - RNA, 19 nt, Homo sapiens
ggaauuacacaaaguugaa

SEQ ID NO: 1399266 - RNA, 19 nt, Homo sapiens
ccacugaacaucaugaauu

SEQ ID NO: 1399267 - RNA, 19 nt, Homo sapiens
guaaguugcacucauguaa

SEQ ID NO: 1399268 - RNA, 19 nt, Homo sapiens
cgagaugaccuuggauuua

SEQ ID NO: 1399269 - RNA, 19 nt, Homo sapiens
uaaucuaccugaugcuaaa

SEQ ID NO: 1399270 - RNA, 19 nt, Homo sapiens
aaaguaaguugcacucaug

SEQ ID NO: 1399271 - RNA, 19 nt, Homo sapiens
gagcacaggacuggauuua

SEQ ID NO: 1399272 - RNA, 19 nt, Homo sapiens
gaaaugacuucaguaucug

SEQ ID NO: 1399273 - RNA, 19 nt, Homo sapiens
gaaaggaugcaguguguag

SEQ ID NO: 1399274 - RNA, 19 nt, Homo sapiens
ccaauggcaucaagaaaca

SEQ ID NO: 1399275 - RNA, 19 nt, Homo sapiens
ggagagcauuugggcagua

SEQ ID NO: 1399276 - RNA, 19 nt, Homo sapiens
gaauguuuauacaguguug

SEQ ID NO: 1399277 - RNA, 19 nt, Homo sapiens
gaaggcuacauucaagaua

SEQ ID NO: 1399278 - RNA, 19 nt, Homo sapiens
gaaaggucccugaguagau

SEQ ID NO: 1399279 - RNA, 19 nt, Homo sapiens
uaauugcugucuugaaguu

SEQ ID NO: 1399280 - RNA, 19 nt, Homo sapiens
gcccagauguauaauuuua

SEQ ID NO: 1399281 - RNA, 19 nt, Homo sapiens
gaagaacagcaaacagaug

SEQ ID NO: 1399282 - RNA, 19 nt, Homo sapiens
auacuuaccucauccacaa

SEQ ID NO: 1399283 - RNA, 19 nt, Homo sapiens
aaauauguguggagaccua

SEQ ID NO: 1399284 - RNA, 19 nt, Homo sapiens
ugaugaaagucuuaggaaa

SEQ ID NO: 1399285 - RNA, 19 nt, Homo sapiens
acaaagagcagcccgcaaa

SEQ ID NO: 1399286 - RNA, 19 nt, Homo sapiens
agagauagaucaagcuagu

SEQ ID NO: 1399287 - RNA, 19 nt, Homo sapiens
ggagagauagaucaagcua

SEQ ID NO: 1399288 - RNA, 19 nt, Homo sapiens
cugcccagauguauaauuu

SEQ ID NO: 1399289 - RNA, 19 nt, Homo sapiens
gaggacgaguucuaugaug

SEQ ID NO: 1399290 - RNA, 19 nt, Homo sapiens
gaacacugcuggggaauau

SEQ ID NO: 1399291 - RNA, 19 nt, Homo sapiens
ggagagacuuaugaauuag

SEQ ID NO: 1399292 - RNA, 19 nt, Homo sapiens
uggagacgcuggccacuga

SEQ ID NO: 1399293 - RNA, 19 nt, Homo sapiens
cuacagcgccuaacugaau

SEQ ID NO: 1399294 - RNA, 19 nt, Homo sapiens
cgaugccaguuauauuuaa

SEQ ID NO: 1399295 - RNA, 19 nt, Homo sapiens
gaaaugccagugccggauu

SEQ ID NO: 1399296 - RNA, 19 nt, Homo sapiens
gaacacaaugaggcauaua

SEQ ID NO: 1399297 - RNA, 19 nt, Homo sapiens
aaaggucccugaguagauu

SEQ ID NO: 1399298 - RNA, 19 nt, Homo sapiens
ugaaauaaucuaccugaug

SEQ ID NO: 1399299 - RNA, 19 nt, Homo sapiens
agaucaagcuagugaagaa

SEQ ID NO: 1399300 - RNA, 19 nt, Homo sapiens
aaggcuacauucaagauaa

SEQ ID NO: 1399301 - RNA, 19 nt, Homo sapiens
uccgaaaggucccugagua

SEQ ID NO: 1399302 - RNA, 19 nt, Homo sapiens
ccagaaaugacuucaguau

SEQ ID NO: 1399303 - RNA, 19 nt, Homo sapiens
gcacucauguaaguaucaa

SEQ ID NO: 1399304 - RNA, 19 nt, Homo sapiens
guauggcaauguggaaauu

SEQ ID NO: 1399305 - RNA, 19 nt, Homo sapiens
gcgaggacgaguucuauga

SEQ ID NO: 1399306 - RNA, 19 nt, Homo sapiens
gaaaauguauuggaaugga

SEQ ID NO: 1399307 - RNA, 19 nt, Homo sapiens
guaaucccaaaucaaguua

SEQ ID NO: 1399308 - RNA, 19 nt, Homo sapiens
cgauauuggugaugaaagu

SEQ ID NO: 1399309 - RNA, 19 nt, Homo sapiens
ugagauaacugcauuucac

SEQ ID NO: 1399310 - RNA, 19 nt, Homo sapiens
ugaaguagacaaagacaug

SEQ ID NO: 1399311 - RNA, 19 nt, Homo sapiens
gcgcacagcagcucuagga

SEQ ID NO: 1399312 - RNA, 19 nt, Homo sapiens
caaaguugaaggcuacauu

SEQ ID NO: 1399313 - RNA, 19 nt, Homo sapiens
uggaaaggaugcagugugu

SEQ ID NO: 1399314 - RNA, 19 nt, Homo sapiens
ggagcauacuuaccucauc

SEQ ID NO: 1399315 - RNA, 19 nt, Homo sapiens
uuaaugagccucugagcuu

SEQ ID NO: 1399316 - RNA, 19 nt, Homo sapiens
caaguuugccuucuccuau

SEQ ID NO: 1399317 - RNA, 19 nt, Homo sapiens
ugacagcacgcuccuuuga

SEQ ID NO: 1399318 - RNA, 19 nt, Homo sapiens
ucucagauauagagguuau

SEQ ID NO: 1399319 - RNA, 19 nt, Homo sapiens
gcgagaugaccuuggauuu

SEQ ID NO: 1399320 - RNA, 19 nt, Homo sapiens
cacgaugccaguuauauuu

SEQ ID NO: 1399321 - RNA, 19 nt, Homo sapiens
auacuaauccucccaaugu

SEQ ID NO: 1399322 - RNA, 19 nt, Homo sapiens
agacuucauugauaagaug

SEQ ID NO: 1399323 - RNA, 19 nt, Homo sapiens
gcuacugggacagaaauua

SEQ ID NO: 1399324 - RNA, 19 nt, Homo sapiens
ggcaauguggaaauuauaa

SEQ ID NO: 1399325 - RNA, 19 nt, Homo sapiens
gaagcagaacccaaaggaa

SEQ ID NO: 1399326 - RNA, 19 nt, Homo sapiens
gaagaguguagaagcagaa

SEQ ID NO: 1399327 - RNA, 19 nt, Homo sapiens
ugggagagacuuaugaauu

SEQ ID NO: 1399328 - RNA, 19 nt, Homo sapiens
gaucacgaugccaguuaua

SEQ ID NO: 1399329 - RNA, 19 nt, Homo sapiens
cacagaauguccgaagaaa

SEQ ID NO: 1399330 - RNA, 19 nt, Homo sapiens
acuuagugcucugaauuua

SEQ ID NO: 1399331 - RNA, 19 nt, Homo sapiens
cauggaaaauggagagaua

SEQ ID NO: 1399332 - RNA, 19 nt, Homo sapiens
aagaagaacagcaaacaga

SEQ ID NO: 1399333 - RNA, 19 nt, Homo sapiens
gaacccaaaggaaccauca

SEQ ID NO: 1399334 - RNA, 19 nt, Homo sapiens
uaaauuggaacaagagcaa

SEQ ID NO: 1399335 - RNA, 19 nt, Homo sapiens
uaucugcuguugcuucuca

SEQ ID NO: 1399336 - RNA, 19 nt, Homo sapiens
caagaaacacagaacaagu

SEQ ID NO: 1399337 - RNA, 19 nt, Homo sapiens
uggcuaaucuacaaauaag

SEQ ID NO: 1399338 - RNA, 19 nt, Homo sapiens
guguuuggcuaaucuacaa

SEQ ID NO: 1399339 - RNA, 19 nt, Homo sapiens
gcauacaagucaggguguu

SEQ ID NO: 1399340 - RNA, 19 nt, Homo sapiens
gaaguggacugaauguuua

SEQ ID NO: 1399341 - RNA, 19 nt, Homo sapiens
gggagagacuuaugaauua

SEQ ID NO: 1399342 - RNA, 19 nt, Homo sapiens
ggacagaaauuacuucaau

SEQ ID NO: 1399343 - RNA, 19 nt, Homo sapiens
guaauaaggucaucuacaa

SEQ ID NO: 1399344 - RNA, 19 nt, Homo sapiens
gaaauacacccuugcauug

SEQ ID NO: 1399345 - RNA, 19 nt, Homo sapiens
gaaacagccugaugcaguu

SEQ ID NO: 1399346 - RNA, 19 nt, Homo sapiens
ugacauggcuaaagaaaug

SEQ ID NO: 1399347 - RNA, 19 nt, Homo sapiens
ggaaguggacugaauguuu

SEQ ID NO: 1399348 - RNA, 19 nt, Homo sapiens
ggacaaauguguguugaau

SEQ ID NO: 1399349 - RNA, 19 nt, Homo sapiens
gcauauacauggacaaauc

SEQ ID NO: 1399350 - RNA, 19 nt, Homo sapiens
agaaaggacucaacaaaga

SEQ ID NO: 1399351 - RNA, 19 nt, Homo sapiens
ggaaauacacccuugcauu

SEQ ID NO: 1399352 - RNA, 19 nt, Homo sapiens
caagacagacugcagguua

SEQ ID NO: 1399353 - RNA, 19 nt, Homo sapiens
gaaaguaaguugcacucau

SEQ ID NO: 1399354 - RNA, 19 nt, Homo sapiens
gaacucuccuccuauacaa

SEQ ID NO: 1399355 - RNA, 19 nt, Homo sapiens
gcacauucaucuuaaaucu

SEQ ID NO: 1399356 - RNA, 19 nt, Homo sapiens
ucaauuugccugacauuua

SEQ ID NO: 1399357 - RNA, 19 nt, Homo sapiens
gcacaggacuggauuuacu

SEQ ID NO: 1399358 - RNA, 19 nt, Homo sapiens
gaaaguguauucauuaucc

SEQ ID NO: 1399359 - RNA, 19 nt, Homo sapiens
caauuugccugacauuuau

SEQ ID NO: 1399360 - RNA, 19 nt, Homo sapiens
gcugaaggauuaaacaaug

SEQ ID NO: 1399361 - RNA, 19 nt, Homo sapiens
gagaugaccuuggauuuag

SEQ ID NO: 1399362 - RNA, 19 nt, Homo sapiens
cacugaacaucaugaauua

SEQ ID NO: 1399363 - RNA, 19 nt, Homo sapiens
uggcaaugcugaagaagua

SEQ ID NO: 1399364 - RNA, 19 nt, Homo sapiens
ucagaaaccucuugaccuu

SEQ ID NO: 1399365 - RNA, 19 nt, Homo sapiens
gaaaggaguugguaaugcu

SEQ ID NO: 1399366 - RNA, 19 nt, Homo sapiens
gaaguaagacaacuauuag

SEQ ID NO: 1399367 - RNA, 19 nt, Homo sapiens
uuagaacucuccuccuaua

SEQ ID NO: 1399368 - RNA, 19 nt, Homo sapiens
ugaaugaaguagacaaaga

SEQ ID NO: 1399369 - RNA, 19 nt, Homo sapiens
agaaaugacuucaguaucu

SEQ ID NO: 1399370 - RNA, 19 nt, Homo sapiens
gcgccuaacugaauacaug

SEQ ID NO: 1399371 - RNA, 19 nt, Homo sapiens
gaaguugucucagaagcuu

SEQ ID NO: 1399372 - RNA, 19 nt, Homo sapiens
gaaaggacucaacaaagaa

SEQ ID NO: 1399373 - RNA, 19 nt, Homo sapiens
guagaaaggacucaacaaa

SEQ ID NO: 1399374 - RNA, 19 nt, Homo sapiens
gcaaaugccacuagggaaa

SEQ ID NO: 1399375 - RNA, 19 nt, Homo sapiens
ccagggugcugaaaugaaa

SEQ ID NO: 1399376 - RNA, 19 nt, Homo sapiens
gaagaaguaagacaacuau

SEQ ID NO: 1399377 - RNA, 19 nt, Homo sapiens
gaccuuggauuuagacuca

SEQ ID NO: 1399378 - RNA, 19 nt, Homo sapiens
acaaagcauugaaacgaua

SEQ ID NO: 1399379 - RNA, 19 nt, Homo sapiens
uaaacaaugugccuuaaag

SEQ ID NO: 1399380 - RNA, 19 nt, Homo sapiens
gacauuaauugcaaaggaa

SEQ ID NO: 1399381 - RNA, 19 nt, Homo sapiens
acaaagacauggagagugu

SEQ ID NO: 1399382 - RNA, 19 nt, Homo sapiens
gaagcucugugcccucuau

SEQ ID NO: 1399383 - RNA, 19 nt, Homo sapiens
ggaauuacacaaaguugaa

SEQ ID NO: 1399384 - RNA, 19 nt, Homo sapiens
ccacugaacaucaugaauu

SEQ ID NO: 1399385 - RNA, 19 nt, Homo sapiens
gaagugauugcugacauua

SEQ ID NO: 1399386 - RNA, 19 nt, Homo sapiens
guaaguugcacucauguaa

SEQ ID NO: 1399387 - RNA, 19 nt, Homo sapiens
cgagaugaccuuggauuua

SEQ ID NO: 1399388 - RNA, 19 nt, Homo sapiens
gauagcugccucuucuuua

SEQ ID NO: 1399389 - RNA, 19 nt, Homo sapiens
guugaaggcuggugcagaa

SEQ ID NO: 1399390 - RNA, 19 nt, Homo sapiens
uaaucuaccugaugcuaaa

SEQ ID NO: 1399391 - RNA, 19 nt, Homo sapiens
aaaguaaguugcacucaug

SEQ ID NO: 1399392 - RNA, 19 nt, Homo sapiens
gagcacaggacuggauuua

SEQ ID NO: 1399393 - RNA, 19 nt, Homo sapiens
gcugauacuacuauuguua

SEQ ID NO: 1399394 - RNA, 19 nt, Homo sapiens
gaaaugacuucaguaucug

SEQ ID NO: 1399395 - RNA, 19 nt, Homo sapiens
gcguagaaaugaacacaga

SEQ ID NO: 1399396 - RNA, 19 nt, Homo sapiens
gaaaggaugcaguguguag

SEQ ID NO: 1399397 - RNA, 19 nt, Homo sapiens
ccaauggcaucaagaaaca

SEQ ID NO: 1399398 - RNA, 19 nt, Homo sapiens
ggaguccuuucaugguaua

SEQ ID NO: 1399399 - RNA, 19 nt, Homo sapiens
ggagagcauuugggcagua

SEQ ID NO: 1399400 - RNA, 19 nt, Homo sapiens
cauaaacaaugugccuuaa

SEQ ID NO: 1399401 - RNA, 19 nt, Homo sapiens
gugcagaagugaauguguu

SEQ ID NO: 1399402 - RNA, 19 nt, Homo sapiens
gaauguuuauacaguguug

SEQ ID NO: 1399403 - RNA, 19 nt, Homo sapiens
gaaggcuacauucaagaua

SEQ ID NO: 1399404 - RNA, 19 nt, Homo sapiens
gaaauggcaaugcugaaga

SEQ ID NO: 1399405 - RNA, 19 nt, Homo sapiens
gaaaggucccugaguagau

SEQ ID NO: 1399406 - RNA, 19 nt, Homo sapiens
cugaagaaaucauuagaga

SEQ ID NO: 1399407 - RNA, 19 nt, Homo sapiens
cugcagaccugaagaaauc

SEQ ID NO: 1399408 - RNA, 19 nt, Homo sapiens
acaccugacucaagcagua

SEQ ID NO: 1399409 - RNA, 19 nt, Homo sapiens
ugacauuaauugcaaagga

SEQ ID NO: 1399410 - RNA, 19 nt, Homo sapiens
uaauugcugucuugaaguu

SEQ ID NO: 1399411 - RNA, 19 nt, Homo sapiens
caagcaguaugcacgguaa

SEQ ID NO: 1399412 - RNA, 19 nt, Homo sapiens
gcccagauguauaauuuua

SEQ ID NO: 1399413 - RNA, 19 nt, Homo sapiens
gaagaacagcaaacagaug

SEQ ID NO: 1399414 - RNA, 19 nt, Homo sapiens
auacuuaccucauccacaa

SEQ ID NO: 1399415 - RNA, 19 nt, Homo sapiens
gaaaguugaaguugucuca

SEQ ID NO: 1399416 - RNA, 19 nt, Homo sapiens
gcgacuagauagggaaauu

SEQ ID NO: 1399417 - RNA, 19 nt, Homo sapiens
ugaagugauugcugacauu

SEQ ID NO: 1399418 - RNA, 19 nt, Homo sapiens
ccauaaacaaugugccuua

SEQ ID NO: 1399419 - RNA, 19 nt, Homo sapiens
ggacgaaaggaguugguaa

SEQ ID NO: 1399420 - RNA, 19 nt, Homo sapiens
gaaggcuggugcagaagug

SEQ ID NO: 1399421 - RNA, 19 nt, Homo sapiens
aaauauguguggagaccua

SEQ ID NO: 1399422 - RNA, 19 nt, Homo sapiens
guaagacaacuauuagaga

SEQ ID NO: 1399423 - RNA, 19 nt, Homo sapiens
ugaugaaagucuuaggaaa

SEQ ID NO: 1399424 - RNA, 19 nt, Homo sapiens
acaaagagcagcccgcaaa

SEQ ID NO: 1399425 - RNA, 19 nt, Homo sapiens
agagauagaucaagcuagu

SEQ ID NO: 1399426 - RNA, 19 nt, Homo sapiens
ggagagauagaucaagcua

SEQ ID NO: 1399427 - RNA, 19 nt, Homo sapiens
cugcccagauguauaauuu

SEQ ID NO: 1399428 - RNA, 19 nt, Homo sapiens
gaggacgaguucuaugaug

SEQ ID NO: 1399429 - RNA, 19 nt, Homo sapiens
ucagaaaguugaaguuguc

SEQ ID NO: 1399430 - RNA, 19 nt, Homo sapiens
gaagugaauguguugaaug

SEQ ID NO: 1399431 - RNA, 19 nt, Homo sapiens
gaacacugcuggggaauau

SEQ ID NO: 1399432 - RNA, 19 nt, Homo sapiens
ggagagacuuaugaauuag

SEQ ID NO: 1399433 - RNA, 19 nt, Homo sapiens
cuacagcgccuaacugaau

SEQ ID NO: 1399434 - RNA, 19 nt, Homo sapiens
cgaugccaguuauauuuaa

SEQ ID NO: 1399435 - RNA, 19 nt, Homo sapiens
uggagacgcuggccacuga

SEQ ID NO: 1399436 - RNA, 19 nt, Homo sapiens
acaaagaaagcuugaagaa

SEQ ID NO: 1399437 - RNA, 19 nt, Homo sapiens
gaaaugccagugccggauu

SEQ ID NO: 1399438 - RNA, 19 nt, Homo sapiens
gaacacaaugaggcauaua

SEQ ID NO: 1399439 - RNA, 19 nt, Homo sapiens
aaaggucccugaguagauu

SEQ ID NO: 1399440 - RNA, 19 nt, Homo sapiens
gaaguggacugaauguuua

SEQ ID NO: 1399441 - RNA, 19 nt, Homo sapiens
ggacagaaauuacuucaau

SEQ ID NO: 1399442 - RNA, 19 nt, Homo sapiens
guaauaaggucaucuacaa

SEQ ID NO: 1399443 - RNA, 19 nt, Homo sapiens
gaaauacacccuugcauug

SEQ ID NO: 1399444 - RNA, 19 nt, Homo sapiens
gaaacagccugaugcaguu

SEQ ID NO: 1399445 - RNA, 19 nt, Homo sapiens
ugacauggcuaaagaaaug

SEQ ID NO: 1399446 - RNA, 19 nt, Homo sapiens
ggaaguggacugaauguuu

SEQ ID NO: 1399447 - RNA, 19 nt, Homo sapiens
ggacaaauguguguugaau

SEQ ID NO: 1399448 - RNA, 19 nt, Homo sapiens
gcauauacauggacaaauc

SEQ ID NO: 1399449 - RNA, 19 nt, Homo sapiens
agaaaggacucaacaaaga

SEQ ID NO: 1399450 - RNA, 19 nt, Homo sapiens
ggaaauacacccuugcauu

SEQ ID NO: 1399451 - RNA, 19 nt, Homo sapiens
caagacagacugcagguua

SEQ ID NO: 1399452 - RNA, 19 nt, Homo sapiens
gaaaguaaguugcacucau

SEQ ID NO: 1399453 - RNA, 19 nt, Homo sapiens
gaacucuccuccuauacaa

SEQ ID NO: 1399454 - RNA, 19 nt, Homo sapiens
gcacauucaucuuaaaucu

SEQ ID NO: 1399455 - RNA, 19 nt, Homo sapiens
ucaauuugccugacauuua

SEQ ID NO: 1399456 - RNA, 19 nt, Homo sapiens
gcacaggacuggauuuacu

SEQ ID NO: 1399457 - RNA, 19 nt, Homo sapiens
gaaaguguauucauuaucc

SEQ ID NO: 1399458 - RNA, 19 nt, Homo sapiens
caauuugccugacauuuau

SEQ ID NO: 1399459 - RNA, 19 nt, Homo sapiens
gcugaaggauuaaacaaug

SEQ ID NO: 1399460 - RNA, 19 nt, Homo sapiens
cacugaacaucaugaauua

SEQ ID NO: 1399461 - RNA, 19 nt, Homo sapiens
uggcaaugcugaagaagua

SEQ ID NO: 1399462 - RNA, 19 nt, Homo sapiens
ucagaaaccucuugaccuu

SEQ ID NO: 1399463 - RNA, 19 nt, Homo sapiens
gaaaggaguugguaaugcu

SEQ ID NO: 1399464 - RNA, 19 nt, Homo sapiens
gaaguaagacaacuauuag

SEQ ID NO: 1399465 - RNA, 19 nt, Homo sapiens
uuagaacucuccuccuaua

SEQ ID NO: 1399466 - RNA, 19 nt, Homo sapiens
ugaaugaaguagacaaaga

SEQ ID NO: 1399467 - RNA, 19 nt, Homo sapiens
agaaaugacuucaguaucu

SEQ ID NO: 1399468 - RNA, 19 nt, Homo sapiens
gcgccuaacugaauacaug

SEQ ID NO: 1399469 - RNA, 19 nt, Homo sapiens
gaaguugucucagaagcuu

SEQ ID NO: 1399470 - RNA, 19 nt, Homo sapiens
gaaaggacucaacaaagaa

SEQ ID NO: 1399471 - RNA, 19 nt, Homo sapiens
guagaaaggacucaacaaa

SEQ ID NO: 1399472 - RNA, 19 nt, Homo sapiens
gcaaaugccacuagggaaa

SEQ ID NO: 1399473 - RNA, 19 nt, Homo sapiens
ccagggugcugaaaugaaa

SEQ ID NO: 1399474 - RNA, 19 nt, Homo sapiens
gaagaaguaagacaacuau

SEQ ID NO: 1399475 - RNA, 19 nt, Homo sapiens
acaaagcauugaaacgaua

SEQ ID NO: 1399476 - RNA, 19 nt, Homo sapiens
uaaacaaugugccuuaaag

SEQ ID NO: 1399477 - RNA, 19 nt, Homo sapiens
gacauuaauugcaaaggaa

SEQ ID NO: 1399478 - RNA, 19 nt, Homo sapiens
acaaagacauggagagugu

SEQ ID NO: 1399479 - RNA, 19 nt, Homo sapiens
gaagcucugugcccucuau

SEQ ID NO: 1399480 - RNA, 19 nt, Homo sapiens
ggaauuacacaaaguugaa

SEQ ID NO: 1399481 - RNA, 19 nt, Homo sapiens
ccacugaacaucaugaauu

SEQ ID NO: 1399482 - RNA, 19 nt, Homo sapiens
gaagugauugcugacauua

SEQ ID NO: 1399483 - RNA, 19 nt, Homo sapiens
guaaguugcacucauguaa

SEQ ID NO: 1399484 - RNA, 19 nt, Homo sapiens
gauagcugccucuucuuua

SEQ ID NO: 1399485 - RNA, 19 nt, Homo sapiens
guugaaggcuggugcagaa

SEQ ID NO: 1399486 - RNA, 19 nt, Homo sapiens
uaaucuaccugaugcuaaa

SEQ ID NO: 1399487 - RNA, 19 nt, Homo sapiens
aaaguaaguugcacucaug

SEQ ID NO: 1399488 - RNA, 19 nt, Homo sapiens
gagcacaggacuggauuua

SEQ ID NO: 1399489 - RNA, 19 nt, Homo sapiens
gcugauacuacuauuguua

SEQ ID NO: 1399490 - RNA, 19 nt, Homo sapiens
gaaaugacuucaguaucug

SEQ ID NO: 1399491 - RNA, 19 nt, Homo sapiens
gcguagaaaugaacacaga

SEQ ID NO: 1399492 - RNA, 19 nt, Homo sapiens
gaaaggaugcaguguguag

SEQ ID NO: 1399493 - RNA, 19 nt, Homo sapiens
ccaauggcaucaagaaaca

SEQ ID NO: 1399494 - RNA, 19 nt, Homo sapiens
ggaguccuuucaugguaua

SEQ ID NO: 1399495 - RNA, 19 nt, Homo sapiens
ggagagcauuugggcagua

SEQ ID NO: 1399496 - RNA, 19 nt, Homo sapiens
cauaaacaaugugccuuaa

SEQ ID NO: 1399497 - RNA, 19 nt, Homo sapiens
gugcagaagugaauguguu

SEQ ID NO: 1399498 - RNA, 19 nt, Homo sapiens
gaauguuuauacaguguug

SEQ ID NO: 1399499 - RNA, 19 nt, Homo sapiens
gaaggcuacauucaagaua

SEQ ID NO: 1399500 - RNA, 19 nt, Homo sapiens
gaaaggucccugaguagau

SEQ ID NO: 1399501 - RNA, 19 nt, Homo sapiens
gaaauggcaaugcugaaga

SEQ ID NO: 1399502 - RNA, 19 nt, Homo sapiens
cugaagaaaucauuagaga

SEQ ID NO: 1399503 - RNA, 19 nt, Homo sapiens
cugcagaccugaagaaauc

SEQ ID NO: 1399504 - RNA, 19 nt, Homo sapiens
acaccugacucaagcagua

SEQ ID NO: 1399505 - RNA, 19 nt, Homo sapiens
ugacauuaauugcaaagga

SEQ ID NO: 1399506 - RNA, 19 nt, Homo sapiens
uaauugcugucuugaaguu

SEQ ID NO: 1399507 - RNA, 19 nt, Homo sapiens
caagcaguaugcacgguaa

SEQ ID NO: 1399508 - RNA, 19 nt, Homo sapiens
gcccagauguauaauuuua

SEQ ID NO: 1399509 - RNA, 19 nt, Homo sapiens
gaagaacagcaaacagaug

SEQ ID NO: 1399510 - RNA, 19 nt, Homo sapiens
auacuuaccucauccacaa

SEQ ID NO: 1399511 - RNA, 19 nt, Homo sapiens
gaaaguugaaguugucuca

SEQ ID NO: 1399512 - RNA, 19 nt, Homo sapiens
gcgacuagauagggaaauu

SEQ ID NO: 1399513 - RNA, 19 nt, Homo sapiens
ugaagugauugcugacauu

SEQ ID NO: 1399514 - RNA, 19 nt, Homo sapiens
ccauaaacaaugugccuua

SEQ ID NO: 1399515 - RNA, 19 nt, Homo sapiens
ggacgaaaggaguugguaa

SEQ ID NO: 1399516 - RNA, 19 nt, Homo sapiens
gaaggcuggugcagaagug

SEQ ID NO: 1399517 - RNA, 19 nt, Homo sapiens
guaagacaacuauuagaga

SEQ ID NO: 1399518 - RNA, 19 nt, Homo sapiens
aaauauguguggagaccua

SEQ ID NO: 1399519 - RNA, 19 nt, Homo sapiens
ugaugaaagucuuaggaaa

SEQ ID NO: 1399520 - RNA, 19 nt, Homo sapiens
acaaagagcagcccgcaaa

SEQ ID NO: 1399521 - RNA, 19 nt, Homo sapiens
agagauagaucaagcuagu

SEQ ID NO: 1399522 - RNA, 19 nt, Homo sapiens
ggagagauagaucaagcua

SEQ ID NO: 1399523 - RNA, 19 nt, Homo sapiens
cugcccagauguauaauuu

SEQ ID NO: 1399524 - RNA, 19 nt, Homo sapiens
gaggacgaguucuaugaug

SEQ ID NO: 1399525 - RNA, 19 nt, Homo sapiens
ucagaaaguugaaguuguc

SEQ ID NO: 1399526 - RNA, 19 nt, Homo sapiens
gaagugaauguguugaaug

SEQ ID NO: 1399527 - RNA, 19 nt, Homo sapiens
gaacacugcuggggaauau

SEQ ID NO: 1399528 - RNA, 19 nt, Homo sapiens
cuacagcgccuaacugaau

SEQ ID NO: 1399529 - RNA, 19 nt, Homo sapiens
cgaugccaguuauauuuaa

SEQ ID NO: 1399530 - RNA, 19 nt, Homo sapiens
uggagacgcuggccacuga

SEQ ID NO: 1399531 - RNA, 19 nt, Homo sapiens
acaaagaaagcuugaagaa

SEQ ID NO: 1399532 - RNA, 19 nt, Homo sapiens
gaaaugccagugccggauu

SEQ ID NO: 1399533 - RNA, 19 nt, Homo sapiens
ggcgaggaaugaagugauu

SEQ ID NO: 1399534 - RNA, 19 nt, Homo sapiens
gaacacaaugaggcauaua

SEQ ID NO: 1399535 - RNA, 19 nt, Homo sapiens
aaaggucccugaguagauu

SEQ ID NO: 1399536 - RNA, 19 nt, Homo sapiens
ggacuggcuggaagcaaua

SEQ ID NO: 1399537 - RNA, 19 nt, Homo sapiens
caacaaagaaagcuugaag

SEQ ID NO: 1399538 - RNA, 19 nt, Homo sapiens
ugaaauaaucuaccugaug

SEQ ID NO: 1399539 - RNA, 19 nt, Homo sapiens
agaucaagcuagugaagaa

SEQ ID NO: 1399540 - RNA, 19 nt, Homo sapiens
ugaacaagcucuccgacua

SEQ ID NO: 1399541 - RNA, 19 nt, Homo sapiens
ggagcaggauggugacuuu

SEQ ID NO: 1399542 - RNA, 19 nt, Homo sapiens
gaaauaaacagacacauac

SEQ ID NO: 1399543 - RNA, 19 nt, Homo sapiens
gcgcuggccuuaaugcuaa

SEQ ID NO: 1399544 - RNA, 19 nt, Homo sapiens
cgugucagcuguucauuaa

SEQ ID NO: 1399545 - RNA, 19 nt, Homo sapiens
uuaaccacauccucaaaua

SEQ ID NO: 1399546 - RNA, 19 nt, Homo sapiens
caagaccuguucccacuga

SEQ ID NO: 1399547 - RNA, 19 nt, Homo sapiens
ggagagggaccaccuaugu

SEQ ID NO: 1399548 - RNA, 19 nt, Homo sapiens
ugaaggacaucgcccaguu

SEQ ID NO: 1399549 - RNA, 19 nt, Homo sapiens
gcacagucuucccauuuua

SEQ ID NO: 1399550 - RNA, 19 nt, Homo sapiens
gaaggacaucgcccaguuu

SEQ ID NO: 1399551 - RNA, 19 nt, Homo sapiens
gugagccucuacacauaua

SEQ ID NO: 1399552 - RNA, 19 nt, Homo sapiens
gaggagaacaagagucuga

SEQ ID NO: 1399553 - RNA, 19 nt, Homo sapiens
ggucuucccuggagaacga

SEQ ID NO: 1399554 - RNA, 19 nt, Homo sapiens
cggagacccuguccacauu

SEQ ID NO: 1399555 - RNA, 19 nt, Homo sapiens
ucaaccagaucucgggaaa

SEQ ID NO: 1399556 - RNA, 19 nt, Homo sapiens
gaaccgagccgaggauuac

SEQ ID NO: 1399557 - RNA, 19 nt, Homo sapiens
gcaccagcaucaaccagau

SEQ ID NO: 1399558 - RNA, 19 nt, Homo sapiens
cagcuggaauucaaacuca

SEQ ID NO: 1399559 - RNA, 19 nt, Homo sapiens
guaccugucuggcuucuac

SEQ ID NO: 1399560 - RNA, 19 nt, Homo sapiens
gcagugagugggcagguuu

SEQ ID NO: 1399561 - RNA, 19 nt, Homo sapiens
gaaggucaccaucgagugu

SEQ ID NO: 1399562 - RNA, 19 nt, Homo sapiens
gcaaagccacgcucaccuu

SEQ ID NO: 1399563 - RNA, 19 nt, Homo sapiens
gaacaagcucuccgacuac

SEQ ID NO: 1399564 - RNA, 19 nt, Homo sapiens
aaccagaucucgggaaaga

SEQ ID NO: 1399565 - RNA, 19 nt, Homo sapiens
gaaucaagaagccguacaa

SEQ ID NO: 1399566 - RNA, 19 nt, Homo sapiens
caacgggucagacaaggaa

SEQ ID NO: 1399567 - RNA, 19 nt, Homo sapiens
uuccacaccuugaaauaaa

SEQ ID NO: 1399568 - RNA, 19 nt, Homo sapiens
gagccucuacacauauaua

SEQ ID NO: 1399569 - RNA, 19 nt, Homo sapiens
ggacagggacguguuuauc

SEQ ID NO: 1399570 - RNA, 19 nt, Homo sapiens
acaagaagcccaagggaau

SEQ ID NO: 1399571 - RNA, 19 nt, Homo sapiens
gaugcacagucuucccauu

SEQ ID NO: 1399572 - RNA, 19 nt, Homo sapiens
gcaggauggugacuuuguc

SEQ ID NO: 1399573 - RNA, 19 nt, Homo sapiens
ggacaucgcccaguuugag

SEQ ID NO: 1399574 - RNA, 19 nt, Homo sapiens
ccaggcacccagcacuuua

SEQ ID NO: 1399575 - RNA, 19 nt, Homo sapiens
acagggacguguuuaucaa

SEQ ID NO: 1399576 - RNA, 19 nt, Homo sapiens
gagaacaagagucugaugu

SEQ ID NO: 1399577 - RNA, 19 nt, Homo sapiens
gggaaggcauuuugguuuu

SEQ ID NO: 1399578 - RNA, 19 nt, Homo sapiens
ggucagacaaggaaugugu

SEQ ID NO: 1399579 - RNA, 19 nt, Homo sapiens
gaagcucacccggaacuug

SEQ ID NO: 1399580 - RNA, 19 nt, Homo sapiens
gcgugucagcuguucauua

SEQ ID NO: 1399581 - RNA, 19 nt, Homo sapiens
gacagggacguguuuauca

SEQ ID NO: 1399582 - RNA, 19 nt, Homo sapiens
gccgaggauuacacccuua

SEQ ID NO: 1399583 - RNA, 19 nt, Homo sapiens
aaggacggcuucugcauca

SEQ ID NO: 1399584 - RNA, 19 nt, Homo sapiens
ucaaggcgcagaaggagaa

SEQ ID NO: 1399585 - RNA, 19 nt, Homo sapiens
acauacguguucucuuaaa

SEQ ID NO: 1399586 - RNA, 19 nt, Homo sapiens
gaucacgucgggagaggaa

SEQ ID NO: 1399587 - RNA, 19 nt, Homo sapiens
gcgcugcucuagccuacug

SEQ ID NO: 1399588 - RNA, 19 nt, Homo sapiens
guuccacaccuugaaauaa

SEQ ID NO: 1399589 - RNA, 19 nt, Homo sapiens
gcccuacgcccacugcaaa

SEQ ID NO: 1399590 - RNA, 19 nt, Homo sapiens
cagccgcacauucuacaua

SEQ ID NO: 1399591 - RNA, 19 nt, Homo sapiens
agagaacccugaggaguca

SEQ ID NO: 1399592 - RNA, 19 nt, Homo sapiens
ccgccagggucaccaagaa

SEQ ID NO: 1399593 - RNA, 19 nt, Homo sapiens
gugggaaggucaccaucga

SEQ ID NO: 1399594 - RNA, 19 nt, Homo sapiens
ggagaacaagagucugaug

SEQ ID NO: 1399595 - RNA, 19 nt, Homo sapiens
ccuuaaugcuaaagccaaa

SEQ ID NO: 1399596 - RNA, 19 nt, Homo sapiens
gggacguguuuaucaagga

SEQ ID NO: 1399597 - RNA, 19 nt, Homo sapiens
gcucuagccuacugagacu

SEQ ID NO: 1399598 - RNA, 19 nt, Homo sapiens
aaggacggcuucugcuuca

SEQ ID NO: 1399599 - RNA, 19 nt, Homo sapiens
ugaaccgagccgaggauua

SEQ ID NO: 1399600 - RNA, 19 nt, Homo sapiens
gagagggaccaccuaugug

SEQ ID NO: 1399601 - RNA, 19 nt, Homo sapiens
gggugcugcucaucuacaa

SEQ ID NO: 1399602 - RNA, 19 nt, Homo sapiens
gcggagacaaugagcucua

SEQ ID NO: 1399603 - RNA, 19 nt, Homo sapiens
guggcuuuguuuccaguuu

SEQ ID NO: 1399604 - RNA, 19 nt, Homo sapiens
uaaccacauccucaaauag

SEQ ID NO: 1399605 - RNA, 19 nt, Homo sapiens
gcgcgugugugagccucua

SEQ ID NO: 1399606 - RNA, 19 nt, Homo sapiens
gcaacgggucagacaagga

SEQ ID NO: 1399607 - RNA, 19 nt, Homo sapiens
caaacucaagcccuucuuc

SEQ ID NO: 1399608 - RNA, 19 nt, Homo sapiens
ggacggcuucugcaucagu

SEQ ID NO: 1399609 - RNA, 19 nt, Homo sapiens
ggacggcuucugcuucaag

SEQ ID NO: 1399610 - RNA, 19 nt, Homo sapiens
uguagcggguggcuuuguu

SEQ ID NO: 1399611 - RNA, 19 nt, Homo sapiens
gugcugcucaucuacaaga

SEQ ID NO: 1399612 - RNA, 19 nt, Homo sapiens
ggagacccuguccacauug

SEQ ID NO: 1399613 - RNA, 19 nt, Homo sapiens
gggccacacaggagaaguu

SEQ ID NO: 1399614 - RNA, 19 nt, Homo sapiens
ucacagccaaguccagguu

SEQ ID NO: 1399615 - RNA, 19 nt, Homo sapiens
guagcggguggcuuuguuu

SEQ ID NO: 1399616 - RNA, 19 nt, Homo sapiens
ccuggaagccgcagcuguu

SEQ ID NO: 1399617 - RNA, 19 nt, Homo sapiens
ccacacaggagaaguuugc

SEQ ID NO: 1399618 - RNA, 19 nt, Homo sapiens
aggcccagcuggaauucaa

SEQ ID NO: 1399619 - RNA, 19 nt, Homo sapiens
agaacuaccggcaggagaa

SEQ ID NO: 1399620 - RNA, 19 nt, Homo sapiens
caagcucuccgacuacuac

SEQ ID NO: 1399621 - RNA, 19 nt, Homo sapiens
cagaggagaacaagagucu

SEQ ID NO: 1399622 - RNA, 19 nt, Homo sapiens
cagacaagucggagagaga

SEQ ID NO: 1399623 - RNA, 19 nt, Homo sapiens
gcguguuccuggcguguca

SEQ ID NO: 1399624 - RNA, 19 nt, Homo sapiens
gcggguggcuuuguuucca

SEQ ID NO: 1399625 - RNA, 19 nt, Homo sapiens
auuccacgcugugcuguuu

SEQ ID NO: 1399626 - RNA, 19 nt, Homo sapiens
gggacagggacguguuuau

SEQ ID NO: 1399627 - RNA, 19 nt, Homo sapiens
gcggagagggaccaccuau

SEQ ID NO: 1399628 - RNA, 19 nt, Homo sapiens
cacauacguguucucuuaa

SEQ ID NO: 1399629 - RNA, 19 nt, Homo sapiens
gcacugcugcgagcucauc

SEQ ID NO: 1399630 - RNA, 19 nt, Homo sapiens
ggggaaggcauuuugguuu

SEQ ID NO: 1399631 - RNA, 19 nt, Homo sapiens
gcuguucauuaaccacauc

SEQ ID NO: 1399632 - RNA, 19 nt, Homo sapiens
caagaagcccaagggaauc

SEQ ID NO: 1399633 - RNA, 19 nt, Homo sapiens
gaacuaccggcaggagaag

SEQ ID NO: 1399634 - RNA, 19 nt, Homo sapiens
gccucuacacauauauaua

SEQ ID NO: 1399635 - RNA, 19 nt, Homo sapiens
caggcacccagcacuuuaa

SEQ ID NO: 1399636 - RNA, 19 nt, Homo sapiens
agaacaagagucugaugug

SEQ ID NO: 1399637 - RNA, 19 nt, Homo sapiens
gaugcauucucagacaagu

SEQ ID NO: 1399638 - RNA, 19 nt, Homo sapiens
cuucacgucuggccucagu

SEQ ID NO: 1399639 - RNA, 19 nt, Homo sapiens
cauuaaccacauccucaaa

SEQ ID NO: 1399640 - RNA, 19 nt, Homo sapiens
ugaacaagcucuccgacua

SEQ ID NO: 1399641 - RNA, 19 nt, Homo sapiens
ggagcaggauggugacuuu

SEQ ID NO: 1399642 - RNA, 19 nt, Homo sapiens
gaaauaaacagacacauac

SEQ ID NO: 1399643 - RNA, 19 nt, Homo sapiens
gcgcuggccuuaaugcuaa

SEQ ID NO: 1399644 - RNA, 19 nt, Homo sapiens
cgugucagcuguucauuaa

SEQ ID NO: 1399645 - RNA, 19 nt, Homo sapiens
uuaaccacauccucaaaua

SEQ ID NO: 1399646 - RNA, 19 nt, Homo sapiens
caagaccuguucccacuga

SEQ ID NO: 1399647 - RNA, 19 nt, Homo sapiens
ggagagggaccaccuaugu

SEQ ID NO: 1399648 - RNA, 19 nt, Homo sapiens
ugaaggacaucgcccaguu

SEQ ID NO: 1399649 - RNA, 19 nt, Homo sapiens
gcacagucuucccauuuua

SEQ ID NO: 1399650 - RNA, 19 nt, Homo sapiens
gaaggacaucgcccaguuu

SEQ ID NO: 1399651 - RNA, 19 nt, Homo sapiens
gugagccucuacacauaua

SEQ ID NO: 1399652 - RNA, 19 nt, Homo sapiens
gaggagaacaagagucuga

SEQ ID NO: 1399653 - RNA, 19 nt, Homo sapiens
ggucuucccuggagaacga

SEQ ID NO: 1399654 - RNA, 19 nt, Homo sapiens
cggagacccuguccacauu

SEQ ID NO: 1399655 - RNA, 19 nt, Homo sapiens
ucaaccagaucucgggaaa

SEQ ID NO: 1399656 - RNA, 19 nt, Homo sapiens
gaaccgagccgaggauuac

SEQ ID NO: 1399657 - RNA, 19 nt, Homo sapiens
gcaccagcaucaaccagau

SEQ ID NO: 1399658 - RNA, 19 nt, Homo sapiens
cagcuggaauucaaacuca

SEQ ID NO: 1399659 - RNA, 19 nt, Homo sapiens
guaccugucuggcuucuac

SEQ ID NO: 1399660 - RNA, 19 nt, Homo sapiens
gcagugagugggcagguuu

SEQ ID NO: 1399661 - RNA, 19 nt, Homo sapiens
gaaggucaccaucgagugu

SEQ ID NO: 1399662 - RNA, 19 nt, Homo sapiens
gcaaagccacgcucaccuu

SEQ ID NO: 1399663 - RNA, 19 nt, Homo sapiens
gaacaagcucuccgacuac

SEQ ID NO: 1399664 - RNA, 19 nt, Homo sapiens
aaccagaucucgggaaaga

SEQ ID NO: 1399665 - RNA, 19 nt, Homo sapiens
gaaucaagaagccguacaa

SEQ ID NO: 1399666 - RNA, 19 nt, Homo sapiens
caacgggucagacaaggaa

SEQ ID NO: 1399667 - RNA, 19 nt, Homo sapiens
uuccacaccuugaaauaaa

SEQ ID NO: 1399668 - RNA, 19 nt, Homo sapiens
gagccucuacacauauaua

SEQ ID NO: 1399669 - RNA, 19 nt, Homo sapiens
ggacagggacguguuuauc

SEQ ID NO: 1399670 - RNA, 19 nt, Homo sapiens
acaagaagcccaagggaau

SEQ ID NO: 1399671 - RNA, 19 nt, Homo sapiens
gaugcacagucuucccauu

SEQ ID NO: 1399672 - RNA, 19 nt, Homo sapiens
gcaggauggugacuuuguc

SEQ ID NO: 1399673 - RNA, 19 nt, Homo sapiens
ggacaucgcccaguuugag

SEQ ID NO: 1399674 - RNA, 19 nt, Homo sapiens
ccaggcacccagcacuuua

SEQ ID NO: 1399675 - RNA, 19 nt, Homo sapiens
acagggacguguuuaucaa

SEQ ID NO: 1399676 - RNA, 19 nt, Homo sapiens
gagaacaagagucugaugu

SEQ ID NO: 1399677 - RNA, 19 nt, Homo sapiens
gggaaggcauuuugguuuu

SEQ ID NO: 1399678 - RNA, 19 nt, Homo sapiens
gcgugucagcuguucauua

SEQ ID NO: 1399679 - RNA, 19 nt, Homo sapiens
gacagggacguguuuauca

SEQ ID NO: 1399680 - RNA, 19 nt, Homo sapiens
ggucagacaaggaaugugu

SEQ ID NO: 1399681 - RNA, 19 nt, Homo sapiens
gaagcucacccggaacuug

SEQ ID NO: 1399682 - RNA, 19 nt, Homo sapiens
gccgaggauuacacccuua

SEQ ID NO: 1399683 - RNA, 19 nt, Homo sapiens
aaggacggcuucugcauca

SEQ ID NO: 1399684 - RNA, 19 nt, Homo sapiens
ucaaggcgcagaaggagaa

SEQ ID NO: 1399685 - RNA, 19 nt, Homo sapiens
acauacguguucucuuaaa

SEQ ID NO: 1399686 - RNA, 19 nt, Homo sapiens
gaucacgucgggagaggaa

SEQ ID NO: 1399687 - RNA, 19 nt, Homo sapiens
gcgcugcucuagccuacug

SEQ ID NO: 1399688 - RNA, 19 nt, Homo sapiens
guuccacaccuugaaauaa

SEQ ID NO: 1399689 - RNA, 19 nt, Homo sapiens
gcccuacgcccacugcaaa

SEQ ID NO: 1399690 - RNA, 19 nt, Homo sapiens
cagccgcacauucuacaua

SEQ ID NO: 1399691 - RNA, 19 nt, Homo sapiens
agagaacccugaggaguca

SEQ ID NO: 1399692 - RNA, 19 nt, Homo sapiens
ccgccagggucaccaagaa

SEQ ID NO: 1399693 - RNA, 19 nt, Homo sapiens
gugggaaggucaccaucga

SEQ ID NO: 1399694 - RNA, 19 nt, Homo sapiens
ggagaacaagagucugaug

SEQ ID NO: 1399695 - RNA, 19 nt, Homo sapiens
ccuuaaugcuaaagccaaa

SEQ ID NO: 1399696 - RNA, 19 nt, Homo sapiens
gggacguguuuaucaagga

SEQ ID NO: 1399697 - RNA, 19 nt, Homo sapiens
gcucuagccuacugagacu

SEQ ID NO: 1399698 - RNA, 19 nt, Homo sapiens
ugaaccgagccgaggauua

SEQ ID NO: 1399699 - RNA, 19 nt, Homo sapiens
gagagggaccaccuaugug

SEQ ID NO: 1399700 - RNA, 19 nt, Homo sapiens
gcggagacaaugagcucua

SEQ ID NO: 1399701 - RNA, 19 nt, Homo sapiens
guggcuuuguuuccaguuu

SEQ ID NO: 1399702 - RNA, 19 nt, Homo sapiens
uaaccacauccucaaauag

SEQ ID NO: 1399703 - RNA, 19 nt, Homo sapiens
gcgcgugugugagccucua

SEQ ID NO: 1399704 - RNA, 19 nt, Homo sapiens
caaacucaagcccuucuuc

SEQ ID NO: 1399705 - RNA, 19 nt, Homo sapiens
ggacggcuucugcaucagu

SEQ ID NO: 1399706 - RNA, 19 nt, Homo sapiens
gcaacgggucagacaagga

SEQ ID NO: 1399707 - RNA, 19 nt, Homo sapiens
uguagcggguggcuuuguu

SEQ ID NO: 1399708 - RNA, 19 nt, Homo sapiens
ggagacccuguccacauug

SEQ ID NO: 1399709 - RNA, 19 nt, Homo sapiens
gggccacacaggagaaguu

SEQ ID NO: 1399710 - RNA, 19 nt, Homo sapiens
ucacagccaaguccagguu

SEQ ID NO: 1399711 - RNA, 19 nt, Homo sapiens
guagcggguggcuuuguuu

SEQ ID NO: 1399712 - RNA, 19 nt, Homo sapiens
ccuggaagccgcagcuguu

SEQ ID NO: 1399713 - RNA, 19 nt, Homo sapiens
ccacacaggagaaguuugc

SEQ ID NO: 1399714 - RNA, 19 nt, Homo sapiens
agaacuaccggcaggagaa

SEQ ID NO: 1399715 - RNA, 19 nt, Homo sapiens
aggcccagcuggaauucaa

SEQ ID NO: 1399716 - RNA, 19 nt, Homo sapiens
caagcucuccgacuacuac

SEQ ID NO: 1399717 - RNA, 19 nt, Homo sapiens
cagaggagaacaagagucu

SEQ ID NO: 1399718 - RNA, 19 nt, Homo sapiens
cagacaagucggagagaga

SEQ ID NO: 1399719 - RNA, 19 nt, Homo sapiens
gcguguuccuggcguguca

SEQ ID NO: 1399720 - RNA, 19 nt, Homo sapiens
gcggguggcuuuguuucca

SEQ ID NO: 1399721 - RNA, 19 nt, Homo sapiens
auuccacgcugugcuguuu

SEQ ID NO: 1399722 - RNA, 19 nt, Homo sapiens
gggacagggacguguuuau

SEQ ID NO: 1399723 - RNA, 19 nt, Homo sapiens
gcggagagggaccaccuau

SEQ ID NO: 1399724 - RNA, 19 nt, Homo sapiens
cacauacguguucucuuaa

SEQ ID NO: 1399725 - RNA, 19 nt, Homo sapiens
ggggaaggcauuuugguuu

SEQ ID NO: 1399726 - RNA, 19 nt, Homo sapiens
gcuguucauuaaccacauc

SEQ ID NO: 1399727 - RNA, 19 nt, Homo sapiens
gaacuaccggcaggagaag

SEQ ID NO: 1399728 - RNA, 19 nt, Homo sapiens
caagaagcccaagggaauc

SEQ ID NO: 1399729 - RNA, 19 nt, Homo sapiens
gccucuacacauauauaua

SEQ ID NO: 1399730 - RNA, 19 nt, Homo sapiens
caggcacccagcacuuuaa

SEQ ID NO: 1399731 - RNA, 19 nt, Homo sapiens
agaacaagagucugaugug

SEQ ID NO: 1399732 - RNA, 19 nt, Homo sapiens
gaugcauucucagacaagu

SEQ ID NO: 1399733 - RNA, 19 nt, Homo sapiens
cuucacgucuggccucagu

SEQ ID NO: 1399734 - RNA, 19 nt, Homo sapiens
cccagcagcuaccugaucu

SEQ ID NO: 1399735 - RNA, 19 nt, Homo sapiens
cauuaaccacauccucaaa

SEQ ID NO: 1399736 - RNA, 19 nt, Homo sapiens
ggccacacaggagaaguuu

SEQ ID NO: 1399737 - RNA, 19 nt, Homo sapiens
cugucuggcuucuacaaga

SEQ ID NO: 1399738 - RNA, 19 nt, Homo sapiens
gcucuccgacuacuacuac

SEQ ID NO: 1399739 - RNA, 19 nt, Homo sapiens
gcuccuuccugaacaagcu

SEQ ID NO: 1399740 - RNA, 19 nt, Homo sapiens
gaagauggauagaacauua

SEQ ID NO: 1399741 - RNA, 19 nt, Homo sapiens
aaagaaagcucgaagaaua

SEQ ID NO: 1399742 - RNA, 19 nt, Homo sapiens
gaaguaaccaucagaaaua

SEQ ID NO: 1399743 - RNA, 19 nt, Homo sapiens
cagaagaucuugcacauug

SEQ ID NO: 1399744 - RNA, 19 nt, Homo sapiens
gagcacaucuaucauuuga

SEQ ID NO: 1399745 - RNA, 19 nt, Homo sapiens
gauagaacauuauggagaa

SEQ ID NO: 1399746 - RNA, 19 nt, Homo sapiens
ccauaaagcugacuuggaa

SEQ ID NO: 1399747 - RNA, 19 nt, Homo sapiens
gaaacagcuuugaccauaa

SEQ ID NO: 1399748 - RNA, 19 nt, Homo sapiens
ugaaacagcuuugaccaua

SEQ ID NO: 1399749 - RNA, 19 nt, Homo sapiens
gaaauggaaugaagcugaa

SEQ ID NO: 1399750 - RNA, 19 nt, Homo sapiens
auacaaagcugcaagaaga

SEQ ID NO: 1399751 - RNA, 19 nt, Homo sapiens
gcaccuaacuuuacugaca

SEQ ID NO: 1399752 - RNA, 19 nt, Homo sapiens
ugaguuagauccaguacua

SEQ ID NO: 1399753 - RNA, 19 nt, Homo sapiens
ggaaacugaugauccauau

SEQ ID NO: 1399754 - RNA, 19 nt, Homo sapiens
gcacaucuaucauuugaag

SEQ ID NO: 1399755 - RNA, 19 nt, Homo sapiens
gaagagcacaucuaucauu

SEQ ID NO: 1399756 - RNA, 19 nt, Homo sapiens
guucaugccuuaagaaaug

SEQ ID NO: 1399757 - RNA, 19 nt, Homo sapiens
gaaugaggcuucagaugau

SEQ ID NO: 1399758 - RNA, 19 nt, Homo sapiens
ggacaggugugcagaagau

SEQ ID NO: 1399759 - RNA, 19 nt, Homo sapiens
gaacuaaggagucgguuga

SEQ ID NO: 1399760 - RNA, 19 nt, Homo sapiens
ucacaagguuugcuauuga

SEQ ID NO: 1399761 - RNA, 19 nt, Homo sapiens
ggaacaacauugguaaaga

SEQ ID NO: 1399762 - RNA, 19 nt, Homo sapiens
ggacaaggcuucggaaacu

SEQ ID NO: 1399763 - RNA, 19 nt, Homo sapiens
caacauaucacauucugaa

SEQ ID NO: 1399764 - RNA, 19 nt, Homo sapiens
ggaagaaggaaauuuagaa

SEQ ID NO: 1399765 - RNA, 19 nt, Homo sapiens
agucaaaccugauucauga

SEQ ID NO: 1399766 - RNA, 19 nt, Homo sapiens
gaacaacauugguaaagac

SEQ ID NO: 1399767 - RNA, 19 nt, Homo sapiens
gacaauauuucucggcaaa

SEQ ID NO: 1399768 - RNA, 19 nt, Homo sapiens
caaccagaaugcugaacua

SEQ ID NO: 1399769 - RNA, 19 nt, Homo sapiens
uaaaguggcagccugguua

SEQ ID NO: 1399770 - RNA, 19 nt, Homo sapiens
gcaggcaucugaggauaaa

SEQ ID NO: 1399771 - RNA, 19 nt, Homo sapiens
aaacagcuuugaccauaaa

SEQ ID NO: 1399772 - RNA, 19 nt, Homo sapiens
ccaaaccaauguccagaaa

SEQ ID NO: 1399773 - RNA, 19 nt, Homo sapiens
cagagucuauuauuuguga

SEQ ID NO: 1399774 - RNA, 19 nt, Homo sapiens
gcaaacuccugcaaaauuu

SEQ ID NO: 1399775 - RNA, 19 nt, Homo sapiens
gcacaacuggccagaguaa

SEQ ID NO: 1399776 - RNA, 19 nt, Homo sapiens
ggaaagaugcaaccaaaca

SEQ ID NO: 1399777 - RNA, 19 nt, Homo sapiens
gaaaugcaaagauguacaa

SEQ ID NO: 1399778 - RNA, 19 nt, Homo sapiens
guauggagauuacuaugug

SEQ ID NO: 1399779 - RNA, 19 nt, Homo sapiens
aaugguaacuggugcuuaa

SEQ ID NO: 1399780 - RNA, 19 nt, Homo sapiens
uuacugacaugcaggcuaa

SEQ ID NO: 1399781 - RNA, 19 nt, Homo sapiens
ggauacugcuccaccuauu

SEQ ID NO: 1399782 - RNA, 19 nt, Homo sapiens
uggaauaucuugaggaaca

SEQ ID NO: 1399783 - RNA, 19 nt, Homo sapiens
gaacucagucagcaccuaa

SEQ ID NO: 1399784 - RNA, 19 nt, Homo sapiens
ucagugaugugagugauaa

SEQ ID NO: 1399785 - RNA, 19 nt, Homo sapiens
agacaaacaugagggcuuu

SEQ ID NO: 1399786 - RNA, 19 nt, Homo sapiens
caagaaaguuaacaacaac

SEQ ID NO: 1399787 - RNA, 19 nt, Homo sapiens
uccaaagucugaccaguuu

SEQ ID NO: 1399788 - RNA, 19 nt, Homo sapiens
aaacugaugauccauauga

SEQ ID NO: 1399789 - RNA, 19 nt, Homo sapiens
gaaugaaauugugagauca

SEQ ID NO: 1399790 - RNA, 19 nt, Homo sapiens
acuaugagcuguacuaugg

SEQ ID NO: 1399791 - RNA, 19 nt, Homo sapiens
caacaaacuaugagcugua

SEQ ID NO: 1399792 - RNA, 19 nt, Homo sapiens
caaggugaauuauuggaau

SEQ ID NO: 1399793 - RNA, 19 nt, Homo sapiens
gggagaagauggauagaac

SEQ ID NO: 1399794 - RNA, 19 nt, Homo sapiens
ggagacuuaugaaugcauu

SEQ ID NO: 1399795 - RNA, 19 nt, Homo sapiens
gcauagcuauagagaagga

SEQ ID NO: 1399796 - RNA, 19 nt, Homo sapiens
acaagacgauggagaacaa

SEQ ID NO: 1399797 - RNA, 19 nt, Homo sapiens
caggcuaacuguguagaua

SEQ ID NO: 1399798 - RNA, 19 nt, Homo sapiens
agaaugaaauugugagauc

SEQ ID NO: 1399799 - RNA, 19 nt, Homo sapiens
aagagcacaucuaucauuu

SEQ ID NO: 1399800 - RNA, 19 nt, Homo sapiens
ccuauaauuuacccagaua

SEQ ID NO: 1399801 - RNA, 19 nt, Homo sapiens
cuuaagaaaugcaaagaug

SEQ ID NO: 1399802 - RNA, 19 nt, Homo sapiens
agaaugaggcuucagauga

SEQ ID NO: 1399803 - RNA, 19 nt, Homo sapiens
ccagaaugcugaacuaagg

SEQ ID NO: 1399804 - RNA, 19 nt, Homo sapiens
uguaauggauggaaagaug

SEQ ID NO: 1399805 - RNA, 19 nt, Homo sapiens
gcaaccauauuccuuaaaa

SEQ ID NO: 1399806 - RNA, 19 nt, Homo sapiens
uagaggaacuccagagauc

SEQ ID NO: 1399807 - RNA, 19 nt, Homo sapiens
caaccuuugugcagauauu

SEQ ID NO: 1399808 - RNA, 19 nt, Homo sapiens
ggaaauacuucagagaacu

SEQ ID NO: 1399809 - RNA, 19 nt, Homo sapiens
ccgaagagcacaucuauca

SEQ ID NO: 1399810 - RNA, 19 nt, Homo sapiens
gaaaauaggccaaaccaau

SEQ ID NO: 1399811 - RNA, 19 nt, Homo sapiens
uuuagaagcugcagcauca

SEQ ID NO: 1399812 - RNA, 19 nt, Homo sapiens
caaacuaugagcuguacua

SEQ ID NO: 1399813 - RNA, 19 nt, Homo sapiens
ugacagcugggaaauuaua

SEQ ID NO: 1399814 - RNA, 19 nt, Homo sapiens
gagaaguaaccaucagaaa

SEQ ID NO: 1399815 - RNA, 19 nt, Homo sapiens
ggcaagauaucagauggaa

SEQ ID NO: 1399816 - RNA, 19 nt, Homo sapiens
aacauuaaccuguggaaua

SEQ ID NO: 1399817 - RNA, 19 nt, Homo sapiens
ggaaaguucaacagauuau

SEQ ID NO: 1399818 - RNA, 19 nt, Homo sapiens
gagacgauauauggaagaa

SEQ ID NO: 1399819 - RNA, 19 nt, Homo sapiens
acauuaaccuguggaauau

SEQ ID NO: 1399820 - RNA, 19 nt, Homo sapiens
gaucagguugucaguguaa

SEQ ID NO: 1399821 - RNA, 19 nt, Homo sapiens
gcgaugaguucagaugaga

SEQ ID NO: 1399822 - RNA, 19 nt, Homo sapiens
aagcugaucaagaaaguua

SEQ ID NO: 1399823 - RNA, 19 nt, Homo sapiens
uaaagcugaucaagaaagu

SEQ ID NO: 1399824 - RNA, 19 nt, Homo sapiens
gcugcaaccauauuccuua

SEQ ID NO: 1399825 - RNA, 19 nt, Homo sapiens
gaagaaggaaauuuagaag

SEQ ID NO: 1399826 - RNA, 19 nt, Homo sapiens
gguugucaguguaaauauu

SEQ ID NO: 1399827 - RNA, 19 nt, Homo sapiens
ggagucgguugaacagaau

SEQ ID NO: 1399828 - RNA, 19 nt, Homo sapiens
cuggaaaguucaacagauu

SEQ ID NO: 1399829 - RNA, 19 nt, Homo sapiens
ucagucagcaccuaacuuu

SEQ ID NO: 1399830 - RNA, 19 nt, Homo sapiens
ucucagucaugucaauuaa

SEQ ID NO: 1399831 - RNA, 19 nt, Homo sapiens
caaaggcaccacucgauau

SEQ ID NO: 1399832 - RNA, 19 nt, Homo sapiens
ucaaaggcaccacucgaua

SEQ ID NO: 1399833 - RNA, 19 nt, Homo sapiens
gagagaagauugggauggu

SEQ ID NO: 1399834 - RNA, 19 nt, Homo sapiens
cauagaaaccacacgauug

SEQ ID NO: 1399835 - RNA, 19 nt, Homo sapiens
gaacauuauggagaaguaa

SEQ ID NO: 1399836 - RNA, 19 nt, Homo sapiens
cagaacagguuagccauca

SEQ ID NO: 1399837 - RNA, 19 nt, Homo sapiens
ccugacaccaguaacauua

SEQ ID NO: 1399838 - RNA, 19 nt, Homo sapiens
gugaucagguugucagugu

SEQ ID NO: 1399839 - RNA, 19 nt, Homo sapiens
ccuggauaauggaauguua

SEQ ID NO: 1399840 - RNA, 19 nt, Homo sapiens
gaagauggauagaacauua

SEQ ID NO: 1399841 - RNA, 19 nt, Homo sapiens
aaagaaagcucgaagaaua

SEQ ID NO: 1399842 - RNA, 19 nt, Homo sapiens
gaaguaaccaucagaaaua

SEQ ID NO: 1399843 - RNA, 19 nt, Homo sapiens
cagaagaucuugcacauug

SEQ ID NO: 1399844 - RNA, 19 nt, Homo sapiens
gagcacaucuaucauuuga

SEQ ID NO: 1399845 - RNA, 19 nt, Homo sapiens
uuaaagagcuacagugaaa

SEQ ID NO: 1399846 - RNA, 19 nt, Homo sapiens
gauagaacauuauggagaa

SEQ ID NO: 1399847 - RNA, 19 nt, Homo sapiens
auacaaagcugcaagaaga

SEQ ID NO: 1399848 - RNA, 19 nt, Homo sapiens
gcaccuaacuuuacugaca

SEQ ID NO: 1399849 - RNA, 19 nt, Homo sapiens
ugaguuagauccaguacua

SEQ ID NO: 1399850 - RNA, 19 nt, Homo sapiens
ggaaacugaugauccauau

SEQ ID NO: 1399851 - RNA, 19 nt, Homo sapiens
gcacaucuaucauuugaag

SEQ ID NO: 1399852 - RNA, 19 nt, Homo sapiens
gaagagcacaucuaucauu

SEQ ID NO: 1399853 - RNA, 19 nt, Homo sapiens
guucaugccuuaagaaaug

SEQ ID NO: 1399854 - RNA, 19 nt, Homo sapiens
gaaugaggcuucagaugau

SEQ ID NO: 1399855 - RNA, 19 nt, Homo sapiens
ugagaucaaugaacacuaa

SEQ ID NO: 1399856 - RNA, 19 nt, Homo sapiens
ggacaggugugcagaagau

SEQ ID NO: 1399857 - RNA, 19 nt, Homo sapiens
gaacuaaggagucgguuga

SEQ ID NO: 1399858 - RNA, 19 nt, Homo sapiens
ucacaagguuugcuauuga

SEQ ID NO: 1399859 - RNA, 19 nt, Homo sapiens
ggaacaacauugguaaaga

SEQ ID NO: 1399860 - RNA, 19 nt, Homo sapiens
gagcuacagugaaauaugu

SEQ ID NO: 1399861 - RNA, 19 nt, Homo sapiens
ggacaaggcuucggaaacu

SEQ ID NO: 1399862 - RNA, 19 nt, Homo sapiens
caacauaucacauucugaa

SEQ ID NO: 1399863 - RNA, 19 nt, Homo sapiens
ggaagaaggaaauuuagaa

SEQ ID NO: 1399864 - RNA, 19 nt, Homo sapiens
gaacaacauugguaaagac

SEQ ID NO: 1399865 - RNA, 19 nt, Homo sapiens
gacaauauuucucggcaaa

SEQ ID NO: 1399866 - RNA, 19 nt, Homo sapiens
caaccagaaugcugaacua

SEQ ID NO: 1399867 - RNA, 19 nt, Homo sapiens
uaaaguggcagccugguua

SEQ ID NO: 1399868 - RNA, 19 nt, Homo sapiens
ggaaacagagggcggagua

SEQ ID NO: 1399869 - RNA, 19 nt, Homo sapiens
ccaaaccaauguccagaaa

SEQ ID NO: 1399870 - RNA, 19 nt, Homo sapiens
cagagucuauuauuuguga

SEQ ID NO: 1399871 - RNA, 19 nt, Homo sapiens
gcaaacuccugcaaaauuu

SEQ ID NO: 1399872 - RNA, 19 nt, Homo sapiens
gcacaacuggccagaguaa

SEQ ID NO: 1399873 - RNA, 19 nt, Homo sapiens
ggaaagaugcaaccaaaca

SEQ ID NO: 1399874 - RNA, 19 nt, Homo sapiens
gaaaugcaaagauguacaa

SEQ ID NO: 1399875 - RNA, 19 nt, Homo sapiens
guauggagauuacuaugug

SEQ ID NO: 1399876 - RNA, 19 nt, Homo sapiens
aaugguaacuggugcuuaa

SEQ ID NO: 1399877 - RNA, 19 nt, Homo sapiens
uuacugacaugcaggcuaa

SEQ ID NO: 1399878 - RNA, 19 nt, Homo sapiens
ggauacugcuccaccuauu

SEQ ID NO: 1399879 - RNA, 19 nt, Homo sapiens
uggaauaucuugaggaaca

SEQ ID NO: 1399880 - RNA, 19 nt, Homo sapiens
gaacucagucagcaccuaa

SEQ ID NO: 1399881 - RNA, 19 nt, Homo sapiens
ucagugaugugagugauaa

SEQ ID NO: 1399882 - RNA, 19 nt, Homo sapiens
agacaaacaugagggcuuu

SEQ ID NO: 1399883 - RNA, 19 nt, Homo sapiens
caagaaaguuaacaacaac

SEQ ID NO: 1399884 - RNA, 19 nt, Homo sapiens
uccaaagucugaccaguuu

SEQ ID NO: 1399885 - RNA, 19 nt, Homo sapiens
aaacugaugauccauauga

SEQ ID NO: 1399886 - RNA, 19 nt, Homo sapiens
gaaugaaauugugagauca

SEQ ID NO: 1399887 - RNA, 19 nt, Homo sapiens
acuaugagcuguacuaugg

SEQ ID NO: 1399888 - RNA, 19 nt, Homo sapiens
caacaaacuaugagcugua

SEQ ID NO: 1399889 - RNA, 19 nt, Homo sapiens
caaggugaauuauuggaau

SEQ ID NO: 1399890 - RNA, 19 nt, Homo sapiens
gggagaagauggauagaac

SEQ ID NO: 1399891 - RNA, 19 nt, Homo sapiens
ggagacuuaugaaugcauu

SEQ ID NO: 1399892 - RNA, 19 nt, Homo sapiens
gcauagcuauagagaagga

SEQ ID NO: 1399893 - RNA, 19 nt, Homo sapiens
acaagacgauggagaacaa

SEQ ID NO: 1399894 - RNA, 19 nt, Homo sapiens
caggcuaacuguguagaua

SEQ ID NO: 1399895 - RNA, 19 nt, Homo sapiens
agaaugaaauugugagauc

SEQ ID NO: 1399896 - RNA, 19 nt, Homo sapiens
aagagcacaucuaucauuu

SEQ ID NO: 1399897 - RNA, 19 nt, Homo sapiens
cuuaagaaaugcaaagaug

SEQ ID NO: 1399898 - RNA, 19 nt, Homo sapiens
aaagagcuacagugaaaua

SEQ ID NO: 1399899 - RNA, 19 nt, Homo sapiens
agaaugaggcuucagauga

SEQ ID NO: 1399900 - RNA, 19 nt, Homo sapiens
ccagaaugcugaacuaagg

SEQ ID NO: 1399901 - RNA, 19 nt, Homo sapiens
uguaauggauggaaagaug

SEQ ID NO: 1399902 - RNA, 19 nt, Homo sapiens
gcaaccauauuccuuaaaa

SEQ ID NO: 1399903 - RNA, 19 nt, Homo sapiens
uagaggaacuccagagauc

SEQ ID NO: 1399904 - RNA, 19 nt, Homo sapiens
caaccuuugugcagauauu

SEQ ID NO: 1399905 - RNA, 19 nt, Homo sapiens
ggaaauacuucagagaacu

SEQ ID NO: 1399906 - RNA, 19 nt, Homo sapiens
ccgaagagcacaucuauca

SEQ ID NO: 1399907 - RNA, 19 nt, Homo sapiens
gaaaauaggccaaaccaau

SEQ ID NO: 1399908 - RNA, 19 nt, Homo sapiens
uuuagaagcugcagcauca

SEQ ID NO: 1399909 - RNA, 19 nt, Homo sapiens
caaacuaugagcuguacua

SEQ ID NO: 1399910 - RNA, 19 nt, Homo sapiens
ugacagcugggaaauuaua

SEQ ID NO: 1399911 - RNA, 19 nt, Homo sapiens
gagaaguaaccaucagaaa

SEQ ID NO: 1399912 - RNA, 19 nt, Homo sapiens
ggcaagauaucagauggaa

SEQ ID NO: 1399913 - RNA, 19 nt, Homo sapiens
aacauuaaccuguggaaua

SEQ ID NO: 1399914 - RNA, 19 nt, Homo sapiens
ggaaaguucaacagauuau

SEQ ID NO: 1399915 - RNA, 19 nt, Homo sapiens
gagacgauauauggaagaa

SEQ ID NO: 1399916 - RNA, 19 nt, Homo sapiens
acauuaaccuguggaauau

SEQ ID NO: 1399917 - RNA, 19 nt, Homo sapiens
gaucagguugucaguguaa

SEQ ID NO: 1399918 - RNA, 19 nt, Homo sapiens
aagcugaucaagaaaguua

SEQ ID NO: 1399919 - RNA, 19 nt, Homo sapiens
uaaagcugaucaagaaagu

SEQ ID NO: 1399920 - RNA, 19 nt, Homo sapiens
gcugcaaccauauuccuua

SEQ ID NO: 1399921 - RNA, 19 nt, Homo sapiens
gaagaaggaaauuuagaag

SEQ ID NO: 1399922 - RNA, 19 nt, Homo sapiens
gguugucaguguaaauauu

SEQ ID NO: 1399923 - RNA, 19 nt, Homo sapiens
ggagucgguugaacagaau

SEQ ID NO: 1399924 - RNA, 19 nt, Homo sapiens
cuggaaaguucaacagauu

SEQ ID NO: 1399925 - RNA, 19 nt, Homo sapiens
ucagucagcaccuaacuuu

SEQ ID NO: 1399926 - RNA, 19 nt, Homo sapiens
ucucagucaugucaauuaa

SEQ ID NO: 1399927 - RNA, 19 nt, Homo sapiens
caaaggcaccacucgauau

SEQ ID NO: 1399928 - RNA, 19 nt, Homo sapiens
ucaaaggcaccacucgaua

SEQ ID NO: 1399929 - RNA, 19 nt, Homo sapiens
cauagaaaccacacgauug

SEQ ID NO: 1399930 - RNA, 19 nt, Homo sapiens
gaacauuauggagaaguaa

SEQ ID NO: 1399931 - RNA, 19 nt, Homo sapiens
cagaacagguuagccauca

SEQ ID NO: 1399932 - RNA, 19 nt, Homo sapiens
ccugacaccaguaacauua

SEQ ID NO: 1399933 - RNA, 19 nt, Homo sapiens
gugaucagguugucagugu

SEQ ID NO: 1399934 - RNA, 19 nt, Homo sapiens
ccuggauaauggaauguua

SEQ ID NO: 1399935 - RNA, 19 nt, Homo sapiens
gacgauauauggaagaaaa

SEQ ID NO: 1399936 - RNA, 19 nt, Homo sapiens
gaagcaaagaguagaggaa

SEQ ID NO: 1399937 - RNA, 19 nt, Homo sapiens
ggagaaguaaccaucagaa

SEQ ID NO: 1399938 - RNA, 19 nt, Homo sapiens
agaacauuauggagaagua

SEQ ID NO: 1399939 - RNA, 19 nt, Homo sapiens
ggaagucgauggaaauccu

SEQ ID NO: 1399940 - RNA, 19 nt, Homo sapiens
gcaagaagcucuguacaug

SEQ ID NO: 1399941 - RNA, 19 nt, Homo sapiens
gcauugaccuugacacuga

SEQ ID NO: 1399942 - RNA, 19 nt, Homo sapiens
gcucagaguugucaagaau

SEQ ID NO: 1399943 - RNA, 19 nt, Homo sapiens
caaggcaccuguccucuga

SEQ ID NO: 1399944 - RNA, 19 nt, Homo sapiens
gauaugaaguggaagaaca

SEQ ID NO: 1399945 - RNA, 19 nt, Homo sapiens
ccacaucgcugcucuuucu

SEQ ID NO: 1399946 - RNA, 19 nt, Homo sapiens
ggcaagauaugaaguggaa

SEQ ID NO: 1399947 - RNA, 19 nt, Homo sapiens
gcaacaacaucggcaaaga

SEQ ID NO: 1399948 - RNA, 19 nt, Homo sapiens
gaucaaaucccaggaccua

SEQ ID NO: 1399949 - RNA, 19 nt, Homo sapiens
aagaagcucuguacaugaa

SEQ ID NO: 1399950 - RNA, 19 nt, Homo sapiens
gcgaggagcuggaguacag

SEQ ID NO: 1399951 - RNA, 19 nt, Homo sapiens
gggaggugcucauccgaaa

SEQ ID NO: 1399952 - RNA, 19 nt, Homo sapiens
gaccgaggcuuccgcuuca

SEQ ID NO: 1399953 - RNA, 19 nt, Homo sapiens
gcgcaagggccaaggagua

SEQ ID NO: 1399954 - RNA, 19 nt, Homo sapiens
ggucauguccaucaacaaa

SEQ ID NO: 1399955 - RNA, 19 nt, Homo sapiens
cugaagggcuggcacaaga

SEQ ID NO: 1399956 - RNA, 19 nt, Homo sapiens
gcaccagggcucagaguug

SEQ ID NO: 1399957 - RNA, 19 nt, Homo sapiens
gcaacaacccggcaagaca

SEQ ID NO: 1399958 - RNA, 19 nt, Homo sapiens
acaccaggcucgcuucuuc

SEQ ID NO: 1399959 - RNA, 19 nt, Homo sapiens
gcaaagucauggaggaaaa

SEQ ID NO: 1399960 - RNA, 19 nt, Homo sapiens
caagaagcucuguacauga

SEQ ID NO: 1399961 - RNA, 19 nt, Homo sapiens
ggaacauucugcgcaacaa

SEQ ID NO: 1399962 - RNA, 19 nt, Homo sapiens
ggacgggauccuucauuau

SEQ ID NO: 1399963 - RNA, 19 nt, Homo sapiens
gacgggauccuucauuaug

SEQ ID NO: 1399964 - RNA, 19 nt, Homo sapiens
gacauuccaagcuccaaua

SEQ ID NO: 1399965 - RNA, 19 nt, Homo sapiens
cuggaucccuucucccuaa

SEQ ID NO: 1399966 - RNA, 19 nt, Homo sapiens
caagauaugaaguggaaga

SEQ ID NO: 1399967 - RNA, 19 nt, Homo sapiens
caacaucuaccaccucaag

SEQ ID NO: 1399968 - RNA, 19 nt, Homo sapiens
ugaaguggaagaacaaguu

SEQ ID NO: 1399969 - RNA, 19 nt, Homo sapiens
ucaaaucccaggaccuauu

SEQ ID NO: 1399970 - RNA, 19 nt, Homo sapiens
gaugagggcgaauugcuau

SEQ ID NO: 1399971 - RNA, 19 nt, Homo sapiens
gauagcagcgggaaagagu

SEQ ID NO: 1399972 - RNA, 19 nt, Homo sapiens
gacgugagccuguggaaca

SEQ ID NO: 1399973 - RNA, 19 nt, Homo sapiens
cgagacaggcgcaaaguca

SEQ ID NO: 1399974 - RNA, 19 nt, Homo sapiens
caaggugacauccugcauu

SEQ ID NO: 1399975 - RNA, 19 nt, Homo sapiens
gaagggcuggcacaagaga

SEQ ID NO: 1399976 - RNA, 19 nt, Homo sapiens
ugccaaggaugacaccauu

SEQ ID NO: 1399977 - RNA, 19 nt, Homo sapiens
ucagaguugucaagaaugg

SEQ ID NO: 1399978 - RNA, 19 nt, Homo sapiens
gauccuucauuaugcaaca

SEQ ID NO: 1399979 - RNA, 19 nt, Homo sapiens
auuccaagcuccaauaaag

SEQ ID NO: 1399980 - RNA, 19 nt, Homo sapiens
caacaacccggcaagacau

SEQ ID NO: 1399981 - RNA, 19 nt, Homo sapiens
gugcgcaggugugagugua

SEQ ID NO: 1399982 - RNA, 19 nt, Homo sapiens
aaggugacauccugcauuc

SEQ ID NO: 1399983 - RNA, 19 nt, Homo sapiens
aguguaaguucauguagga

SEQ ID NO: 1399984 - RNA, 19 nt, Homo sapiens
gcaagaucaccuucugcaa

SEQ ID NO: 1399985 - RNA, 19 nt, Homo sapiens
ggaguccuguaccagugaa

SEQ ID NO: 1399986 - RNA, 19 nt, Homo sapiens
caccagggcucagaguugu

SEQ ID NO: 1399987 - RNA, 19 nt, Homo sapiens
ccagagcuuugccaaggau

SEQ ID NO: 1399988 - RNA, 19 nt, Homo sapiens
caaccgaaagacccaagaa

SEQ ID NO: 1399989 - RNA, 19 nt, Homo sapiens
acacugaagacaacaucua

SEQ ID NO: 1399990 - RNA, 19 nt, Homo sapiens
caaaucccaggaccuauuc

SEQ ID NO: 1399991 - RNA, 19 nt, Homo sapiens
cuccagcucccuuugguua

SEQ ID NO: 1399992 - RNA, 19 nt, Homo sapiens
gagggugucaugccugaga

SEQ ID NO: 1399993 - RNA, 19 nt, Homo sapiens
gaggugcucauccgaaaca

SEQ ID NO: 1399994 - RNA, 19 nt, Homo sapiens
guacaucgcagccuuugcu

SEQ ID NO: 1399995 - RNA, 19 nt, Homo sapiens
gugaguguaaguucaugua

SEQ ID NO: 1399996 - RNA, 19 nt, Homo sapiens
gaucccuucucccuaacug

SEQ ID NO: 1399997 - RNA, 19 nt, Homo sapiens
gcugaggcccagaagagaa

SEQ ID NO: 1399998 - RNA, 19 nt, Homo sapiens
ucacccaguuugccuugga

SEQ ID NO: 1399999 - RNA, 19 nt, Homo sapiens
ggucaccugcucaagaaga

SEQ ID NO: 1400000 - RNA, 19 nt, Homo sapiens
gcgcaacaacaucggcaaa

SEQ ID NO: 1400001 - RNA, 19 nt, Homo sapiens
acaccacggcggacucuuu

SEQ ID NO: 1400002 - RNA, 19 nt, Homo sapiens
gauugugccugugggaaca

SEQ ID NO: 1400003 - RNA, 19 nt, Homo sapiens
gugagccuguggaacauuc

SEQ ID NO: 1400004 - RNA, 19 nt, Homo sapiens
caccaggccucagugacaa

SEQ ID NO: 1400005 - RNA, 19 nt, Homo sapiens
ggaggaaaacaacaucgua

SEQ ID NO: 1400006 - RNA, 19 nt, Homo sapiens
ccacacaccaggccucagu

SEQ ID NO: 1400007 - RNA, 19 nt, Homo sapiens
cuggaccgcugcucucaug

SEQ ID NO: 1400008 - RNA, 19 nt, Homo sapiens
ucuaccaccucaagaucaa

SEQ ID NO: 1400009 - RNA, 19 nt, Homo sapiens
gcaggugugaguguaaguu

SEQ ID NO: 1400010 - RNA, 19 nt, Homo sapiens
gcccaucuccagcaucuuc

SEQ ID NO: 1400011 - RNA, 19 nt, Homo sapiens
gcucugacaucuccuuccu

SEQ ID NO: 1400012 - RNA, 19 nt, Homo sapiens
caacaacaucggcaaagac

SEQ ID NO: 1400013 - RNA, 19 nt, Homo sapiens
cagccugucugaggagaug

SEQ ID NO: 1400014 - RNA, 19 nt, Homo sapiens
aaacggacaagccgcaugu

SEQ ID NO: 1400015 - RNA, 19 nt, Homo sapiens
gcgcaaagucauggaggaa

SEQ ID NO: 1400016 - RNA, 19 nt, Homo sapiens
gcgagcgcaugguguacau

SEQ ID NO: 1400017 - RNA, 19 nt, Homo sapiens
uggagucccugcaccgaau

SEQ ID NO: 1400018 - RNA, 19 nt, Homo sapiens
ugaugagggcgaauugcua

SEQ ID NO: 1400019 - RNA, 19 nt, Homo sapiens
ucucacagucugccucuga

SEQ ID NO: 1400020 - RNA, 19 nt, Homo sapiens
caccacaucgcugcucuuu

SEQ ID NO: 1400021 - RNA, 19 nt, Homo sapiens
gcgcaggugugaguguaag

SEQ ID NO: 1400022 - RNA, 19 nt, Homo sapiens
ucuggaaacccaacucaau

SEQ ID NO: 1400023 - RNA, 19 nt, Homo sapiens
gccaggcuaugggaacaug

SEQ ID NO: 1400024 - RNA, 19 nt, Homo sapiens
gagcagcugcagcgagaca

SEQ ID NO: 1400025 - RNA, 19 nt, Homo sapiens
ccacacggaguucuucgau

SEQ ID NO: 1400026 - RNA, 19 nt, Homo sapiens
ugagggcgaauugcuauga

SEQ ID NO: 1400027 - RNA, 19 nt, Homo sapiens
cacagucugccucugauga

SEQ ID NO: 1400028 - RNA, 19 nt, Homo sapiens
cuucgucccugauccucaa

SEQ ID NO: 1400029 - RNA, 19 nt, Homo sapiens
gaacauucugcgcaacaac

SEQ ID NO: 1400030 - RNA, 19 nt, Homo sapiens
ggcucagaguugucaagaa

SEQ ID NO: 1400031 - RNA, 19 nt, Homo sapiens
ggcgaauugcuaugacauu

SEQ ID NO: 1400032 - RNA, 19 nt, Homo sapiens
cgagugcgcaggugugagu

SEQ ID NO: 1400033 - RNA, 19 nt, Homo sapiens
ccagcucccuuugguuagu

SEQ ID NO: 1400034 - RNA, 19 nt, Homo sapiens
gcagcgagacaggcgcaaa

SEQ ID NO: 1400035 - RNA, 19 nt, Homo sapiens
cggccuacuccuccacaua

SEQ ID NO: 1400036 - RNA, 19 nt, Homo sapiens
gguguacaucgcagccuuu

SEQ ID NO: 1400037 - RNA, 19 nt, Homo sapiens
caccgacucuuugggaagu

SEQ ID NO: 1400038 - RNA, 19 nt, Homo sapiens
caaugccugugcagcucaa

SEQ ID NO: 1400039 - RNA, 19 nt, Homo sapiens
acaccaggccucagugaca

SEQ ID NO: 1400040 - RNA, 19 nt, Homo sapiens
gcaagaagcucuguacaug

SEQ ID NO: 1400041 - RNA, 19 nt, Homo sapiens
gcauugaccuugacacuga

SEQ ID NO: 1400042 - RNA, 19 nt, Homo sapiens
gcucagaguugucaagaau

SEQ ID NO: 1400043 - RNA, 19 nt, Homo sapiens
gauaugaaguggaagaaca

SEQ ID NO: 1400044 - RNA, 19 nt, Homo sapiens
ggcaagauaugaaguggaa

SEQ ID NO: 1400045 - RNA, 19 nt, Homo sapiens
gcaacaacaucggcaaaga

SEQ ID NO: 1400046 - RNA, 19 nt, Homo sapiens
gaucaaaucccaggaccua

SEQ ID NO: 1400047 - RNA, 19 nt, Homo sapiens
aagaagcucuguacaugaa

SEQ ID NO: 1400048 - RNA, 19 nt, Homo sapiens
gcgaggagcuggaguacag

SEQ ID NO: 1400049 - RNA, 19 nt, Homo sapiens
gggaggugcucauccgaaa

SEQ ID NO: 1400050 - RNA, 19 nt, Homo sapiens
gaccgaggcuuccgcuuca

SEQ ID NO: 1400051 - RNA, 19 nt, Homo sapiens
ggucauguccaucaacaaa

SEQ ID NO: 1400052 - RNA, 19 nt, Homo sapiens
gcgcaagggccaaggagua

SEQ ID NO: 1400053 - RNA, 19 nt, Homo sapiens
ucacugcccuugagaccaa

SEQ ID NO: 1400054 - RNA, 19 nt, Homo sapiens
cugaagggcuggcacaaga

SEQ ID NO: 1400055 - RNA, 19 nt, Homo sapiens
gcaccagggcucagaguug

SEQ ID NO: 1400056 - RNA, 19 nt, Homo sapiens
gcaacaacccggcaagaca

SEQ ID NO: 1400057 - RNA, 19 nt, Homo sapiens
acaccaggcucgcuucuuc

SEQ ID NO: 1400058 - RNA, 19 nt, Homo sapiens
gcaaagucauggaggaaaa

SEQ ID NO: 1400059 - RNA, 19 nt, Homo sapiens
caagaagcucuguacauga

SEQ ID NO: 1400060 - RNA, 19 nt, Homo sapiens
ggaacauucugcgcaacaa

SEQ ID NO: 1400061 - RNA, 19 nt, Homo sapiens
ggacgggauccuucauuau

SEQ ID NO: 1400062 - RNA, 19 nt, Homo sapiens
gacgggauccuucauuaug

SEQ ID NO: 1400063 - RNA, 19 nt, Homo sapiens
caagauaugaaguggaaga

SEQ ID NO: 1400064 - RNA, 19 nt, Homo sapiens
caacaucuaccaccucaag

SEQ ID NO: 1400065 - RNA, 19 nt, Homo sapiens
ugaaguggaagaacaaguu

SEQ ID NO: 1400066 - RNA, 19 nt, Homo sapiens
ucaaaucccaggaccuauu

SEQ ID NO: 1400067 - RNA, 19 nt, Homo sapiens
gauagcagcgggaaagagu

SEQ ID NO: 1400068 - RNA, 19 nt, Homo sapiens
gacgugagccuguggaaca

SEQ ID NO: 1400069 - RNA, 19 nt, Homo sapiens
cgagacaggcgcaaaguca

SEQ ID NO: 1400070 - RNA, 19 nt, Homo sapiens
caaggugacauccugcauu

SEQ ID NO: 1400071 - RNA, 19 nt, Homo sapiens
gaagggcuggcacaagaga

SEQ ID NO: 1400072 - RNA, 19 nt, Homo sapiens
ugccaaggaugacaccauu

SEQ ID NO: 1400073 - RNA, 19 nt, Homo sapiens
ucagaguugucaagaaugg

SEQ ID NO: 1400074 - RNA, 19 nt, Homo sapiens
gauccuucauuaugcaaca

SEQ ID NO: 1400075 - RNA, 19 nt, Homo sapiens
caacaacccggcaagacau

SEQ ID NO: 1400076 - RNA, 19 nt, Homo sapiens
aaggugacauccugcauuc

SEQ ID NO: 1400077 - RNA, 19 nt, Homo sapiens
gcaagaucaccuucugcaa

SEQ ID NO: 1400078 - RNA, 19 nt, Homo sapiens
ggaguccuguaccagugaa

SEQ ID NO: 1400079 - RNA, 19 nt, Homo sapiens
caccagggcucagaguugu

SEQ ID NO: 1400080 - RNA, 19 nt, Homo sapiens
ccagagcuuugccaaggau

SEQ ID NO: 1400081 - RNA, 19 nt, Homo sapiens
caaccgaaagacccaagaa

SEQ ID NO: 1400082 - RNA, 19 nt, Homo sapiens
acacugaagacaacaucua

SEQ ID NO: 1400083 - RNA, 19 nt, Homo sapiens
caaaucccaggaccuauuc

SEQ ID NO: 1400084 - RNA, 19 nt, Homo sapiens
gaggugcucauccgaaaca

SEQ ID NO: 1400085 - RNA, 19 nt, Homo sapiens
guacaucgcagccuuugcu

SEQ ID NO: 1400086 - RNA, 19 nt, Homo sapiens
gagggugucaugccugaga

SEQ ID NO: 1400087 - RNA, 19 nt, Homo sapiens
gcugaggcccagaagagaa

SEQ ID NO: 1400088 - RNA, 19 nt, Homo sapiens
ucacccaguuugccuugga

SEQ ID NO: 1400089 - RNA, 19 nt, Homo sapiens
gcgcaacaacaucggcaaa

SEQ ID NO: 1400090 - RNA, 19 nt, Homo sapiens
acaccacggcggacucuuu

SEQ ID NO: 1400091 - RNA, 19 nt, Homo sapiens
ggucaccugcucaagaaga

SEQ ID NO: 1400092 - RNA, 19 nt, Homo sapiens
gauugugccugugggaaca

SEQ ID NO: 1400093 - RNA, 19 nt, Homo sapiens
gugagccuguggaacauuc

SEQ ID NO: 1400094 - RNA, 19 nt, Homo sapiens
caccaggccucagugacaa

SEQ ID NO: 1400095 - RNA, 19 nt, Homo sapiens
ggaggaaaacaacaucgua

SEQ ID NO: 1400096 - RNA, 19 nt, Homo sapiens
ccacacaccaggccucagu

SEQ ID NO: 1400097 - RNA, 19 nt, Homo sapiens
cuggaccgcugcucucaug

SEQ ID NO: 1400098 - RNA, 19 nt, Homo sapiens
ucuaccaccucaagaucaa

SEQ ID NO: 1400099 - RNA, 19 nt, Homo sapiens
gcucugacaucuccuuccu

SEQ ID NO: 1400100 - RNA, 19 nt, Homo sapiens
caacaacaucggcaaagac

SEQ ID NO: 1400101 - RNA, 19 nt, Homo sapiens
cagccugucugaggagaug

SEQ ID NO: 1400102 - RNA, 19 nt, Homo sapiens
aaacggacaagccgcaugu

SEQ ID NO: 1400103 - RNA, 19 nt, Homo sapiens
gcgcaaagucauggaggaa

SEQ ID NO: 1400104 - RNA, 19 nt, Homo sapiens
gcgagcgcaugguguacau

SEQ ID NO: 1400105 - RNA, 19 nt, Homo sapiens
uggagucccugcaccgaau

SEQ ID NO: 1400106 - RNA, 19 nt, Homo sapiens
ucuggaaacccaacucaau

SEQ ID NO: 1400107 - RNA, 19 nt, Homo sapiens
gccaggcuaugggaacaug

SEQ ID NO: 1400108 - RNA, 19 nt, Homo sapiens
gagcagcugcagcgagaca

SEQ ID NO: 1400109 - RNA, 19 nt, Homo sapiens
ccacacggaguucuucgau

SEQ ID NO: 1400110 - RNA, 19 nt, Homo sapiens
gaacauucugcgcaacaac

SEQ ID NO: 1400111 - RNA, 19 nt, Homo sapiens
ggcucagaguugucaagaa

SEQ ID NO: 1400112 - RNA, 19 nt, Homo sapiens
gcagcgagacaggcgcaaa

SEQ ID NO: 1400113 - RNA, 19 nt, Homo sapiens
cggccuacuccuccacaua

SEQ ID NO: 1400114 - RNA, 19 nt, Homo sapiens
gguguacaucgcagccuuu

SEQ ID NO: 1400115 - RNA, 19 nt, Homo sapiens
caccgacucuuugggaagu

SEQ ID NO: 1400116 - RNA, 19 nt, Homo sapiens
caaugccugugcagcucaa

SEQ ID NO: 1400117 - RNA, 19 nt, Homo sapiens
acaccaggccucagugaca

SEQ ID NO: 1400118 - RNA, 19 nt, Homo sapiens
caaguaggcuucuaaauaa

SEQ ID NO: 1400119 - RNA, 19 nt, Homo sapiens
gaauagaggugaagauuau

SEQ ID NO: 1400120 - RNA, 19 nt, Homo sapiens
ggagauaaauguagaggua

SEQ ID NO: 1400121 - RNA, 19 nt, Homo sapiens
ggaagaagcucaaagacaa

SEQ ID NO: 1400122 - RNA, 19 nt, Homo sapiens
gcauaaaccuaucuucuuu

SEQ ID NO: 1400123 - RNA, 19 nt, Homo sapiens
uaagucagcugguucauaa

SEQ ID NO: 1400124 - RNA, 19 nt, Homo sapiens
gcacucagcucaauuaucu

SEQ ID NO: 1400125 - RNA, 19 nt, Homo sapiens
gcaugcaucuaaucuaaua

SEQ ID NO: 1400126 - RNA, 19 nt, Homo sapiens
gaacaugaccugagcguuu

SEQ ID NO: 1400127 - RNA, 19 nt, Homo sapiens
gagcaagucugaaucuaaa

SEQ ID NO: 1400128 - RNA, 19 nt, Homo sapiens
gagcuauccuauuugauua

SEQ ID NO: 1400129 - RNA, 19 nt, Homo sapiens
agaguggucuugcaaauua

SEQ ID NO: 1400130 - RNA, 19 nt, Homo sapiens
gaugauggcauuauugaua

SEQ ID NO: 1400131 - RNA, 19 nt, Homo sapiens
gaagaaccauuucccaugu

SEQ ID NO: 1400132 - RNA, 19 nt, Homo sapiens
aacaagagcuauccuauuu

SEQ ID NO: 1400133 - RNA, 19 nt, Homo sapiens
guaguucaguuuaggaaua

SEQ ID NO: 1400134 - RNA, 19 nt, Homo sapiens
gaaguucucuaccauugaa

SEQ ID NO: 1400135 - RNA, 19 nt, Homo sapiens
uaacauaggccaaauucua

SEQ ID NO: 1400136 - RNA, 19 nt, Homo sapiens
caagagcuauccuauuuga

SEQ ID NO: 1400137 - RNA, 19 nt, Homo sapiens
gaacaggugucccaucauc

SEQ ID NO: 1400138 - RNA, 19 nt, Homo sapiens
gauguagacuugucagauu

SEQ ID NO: 1400139 - RNA, 19 nt, Homo sapiens
gaagaaaccuuauaauccu

SEQ ID NO: 1400140 - RNA, 19 nt, Homo sapiens
gaaggaagauauuucucaa

SEQ ID NO: 1400141 - RNA, 19 nt, Homo sapiens
acaaguaggcuucuaaaua

SEQ ID NO: 1400142 - RNA, 19 nt, Homo sapiens
agagauaaauggcaaauug

SEQ ID NO: 1400143 - RNA, 19 nt, Homo sapiens
gaagaaagugacacagaua

SEQ ID NO: 1400144 - RNA, 19 nt, Homo sapiens
gaaauugaacgacaacauu

SEQ ID NO: 1400145 - RNA, 19 nt, Homo sapiens
gcacgggauuugcagauuu

SEQ ID NO: 1400146 - RNA, 19 nt, Homo sapiens
ggaguuggcuuugaaaugu

SEQ ID NO: 1400147 - RNA, 19 nt, Homo sapiens
gcagugagguuguuugaca

SEQ ID NO: 1400148 - RNA, 19 nt, Homo sapiens
gcacaccggccacggauua

SEQ ID NO: 1400149 - RNA, 19 nt, Homo sapiens
gcacauuaauggaaagaga

SEQ ID NO: 1400150 - RNA, 19 nt, Homo sapiens
ccacauguauacacaauug

SEQ ID NO: 1400151 - RNA, 19 nt, Homo sapiens
cuaaagagcuggaccaagu

SEQ ID NO: 1400152 - RNA, 19 nt, Homo sapiens
cacaguaaauguacagaua

SEQ ID NO: 1400153 - RNA, 19 nt, Homo sapiens
ccacagaaaucaguaaguu

SEQ ID NO: 1400154 - RNA, 19 nt, Homo sapiens
gcaaagcacucagcucaau

SEQ ID NO: 1400155 - RNA, 19 nt, Homo sapiens
gaagauggacuguugaaau

SEQ ID NO: 1400156 - RNA, 19 nt, Homo sapiens
caaauguuauggguucuua

SEQ ID NO: 1400157 - RNA, 19 nt, Homo sapiens
uaaagugagcuauguguua

SEQ ID NO: 1400158 - RNA, 19 nt, Homo sapiens
gaaacuguaucugaagaaa

SEQ ID NO: 1400159 - RNA, 19 nt, Homo sapiens
ggaggaggcugugaaauag

SEQ ID NO: 1400160 - RNA, 19 nt, Homo sapiens
gagaagcacgguuaacuuu

SEQ ID NO: 1400161 - RNA, 19 nt, Homo sapiens
gaaauguucuagucuucuu

SEQ ID NO: 1400162 - RNA, 19 nt, Homo sapiens
ucuaugaacugaacacaaa

SEQ ID NO: 1400163 - RNA, 19 nt, Homo sapiens
gaauacaucgagagagaua

SEQ ID NO: 1400164 - RNA, 19 nt, Homo sapiens
gaacuagaaagaucugauu

SEQ ID NO: 1400165 - RNA, 19 nt, Homo sapiens
gccauacgcucauuguaaa

SEQ ID NO: 1400166 - RNA, 19 nt, Homo sapiens
caucugaguuuaaauguuc

SEQ ID NO: 1400167 - RNA, 19 nt, Homo sapiens
uaggaccagugucuuauua

SEQ ID NO: 1400168 - RNA, 19 nt, Homo sapiens
aagauggacuguugaaauu

SEQ ID NO: 1400169 - RNA, 19 nt, Homo sapiens
aaagugagcuauguguuaa

SEQ ID NO: 1400170 - RNA, 19 nt, Homo sapiens
caaguugguuuggucuuua

SEQ ID NO: 1400171 - RNA, 19 nt, Homo sapiens
ggacugaagaaaccuuaua

SEQ ID NO: 1400172 - RNA, 19 nt, Homo sapiens
uguuauggcugauugguua

SEQ ID NO: 1400173 - RNA, 19 nt, Homo sapiens
gcugucaccuugugccaua

SEQ ID NO: 1400174 - RNA, 19 nt, Homo sapiens
aagcaugcaucuaaucuaa

SEQ ID NO: 1400175 - RNA, 19 nt, Homo sapiens
cuaaauagguaguuguguu

SEQ ID NO: 1400176 - RNA, 19 nt, Homo sapiens
gaaacaagagcuauccuau

SEQ ID NO: 1400177 - RNA, 19 nt, Homo sapiens
gguggaacagucaauauua

SEQ ID NO: 1400178 - RNA, 19 nt, Homo sapiens
ugaagaaaguagugaaaug

SEQ ID NO: 1400179 - RNA, 19 nt, Homo sapiens
gaacaugaugagucugaua

SEQ ID NO: 1400180 - RNA, 19 nt, Homo sapiens
gaucagagaaggaaaggaa

SEQ ID NO: 1400181 - RNA, 19 nt, Homo sapiens
ugacacagauacaucagaa

SEQ ID NO: 1400182 - RNA, 19 nt, Homo sapiens
gaacugaugagccacagaa

SEQ ID NO: 1400183 - RNA, 19 nt, Homo sapiens
ggaccagugucuuauuaau

SEQ ID NO: 1400184 - RNA, 19 nt, Homo sapiens
gaauagaacugggagacau

SEQ ID NO: 1400185 - RNA, 19 nt, Homo sapiens
aagugaagcucaaucagua

SEQ ID NO: 1400186 - RNA, 19 nt, Homo sapiens
gaacaaacagcaaaacuuu

SEQ ID NO: 1400187 - RNA, 19 nt, Homo sapiens
uagggcaugugaaauguua

SEQ ID NO: 1400188 - RNA, 19 nt, Homo sapiens
ccaguuaaaugauagugaa

SEQ ID NO: 1400189 - RNA, 19 nt, Homo sapiens
gaccagugucuuauuaaua

SEQ ID NO: 1400190 - RNA, 19 nt, Homo sapiens
cagcucaauuaucuucuua

SEQ ID NO: 1400191 - RNA, 19 nt, Homo sapiens
ggaauuacagauugagaaa

SEQ ID NO: 1400192 - RNA, 19 nt, Homo sapiens
gaagcacgguuaacuuucu

SEQ ID NO: 1400193 - RNA, 19 nt, Homo sapiens
ggauaaacuuucagauuac

SEQ ID NO: 1400194 - RNA, 19 nt, Homo sapiens
caugaaacauuugaacuga

SEQ ID NO: 1400195 - RNA, 19 nt, Homo sapiens
guauaggaccagugucuua

SEQ ID NO: 1400196 - RNA, 19 nt, Homo sapiens
uacaugagacugcagauua

SEQ ID NO: 1400197 - RNA, 19 nt, Homo sapiens
cguaaacgguucccaguug

SEQ ID NO: 1400198 - RNA, 19 nt, Homo sapiens
uaauugcccugaccacauu

SEQ ID NO: 1400199 - RNA, 19 nt, Homo sapiens
agaaaguagugaaauggua

SEQ ID NO: 1400200 - RNA, 19 nt, Homo sapiens
gaagaaaacaaaagccuua

SEQ ID NO: 1400201 - RNA, 19 nt, Homo sapiens
caucauccaccauuuagua

SEQ ID NO: 1400202 - RNA, 19 nt, Homo sapiens
guagaugcagguaaauaua

SEQ ID NO: 1400203 - RNA, 19 nt, Homo sapiens
gcucaauuaucuucuuaga

SEQ ID NO: 1400204 - RNA, 19 nt, Homo sapiens
caaauaucagggaaacuua

SEQ ID NO: 1400205 - RNA, 19 nt, Homo sapiens
gaaaguagugaaaugguau

SEQ ID NO: 1400206 - RNA, 19 nt, Homo sapiens
ggaaggaagauauuucuca

SEQ ID NO: 1400207 - RNA, 19 nt, Homo sapiens
ugaaacauuugaacugaug

SEQ ID NO: 1400208 - RNA, 19 nt, Homo sapiens
uuagaauccugaaagcaua

SEQ ID NO: 1400209 - RNA, 19 nt, Homo sapiens
ggaaacucauuaucugcaa

SEQ ID NO: 1400210 - RNA, 19 nt, Homo sapiens
aaagauggauuuugccuua

SEQ ID NO: 1400211 - RNA, 19 nt, Homo sapiens
gaacagagccaugaagaac

SEQ ID NO: 1400212 - RNA, 19 nt, Homo sapiens
ugucacagcucaguuggua

SEQ ID NO: 1400213 - RNA, 19 nt, Homo sapiens
ccuccucucuucuuaguaa

SEQ ID NO: 1400214 - RNA, 19 nt, Homo sapiens
gaacagucaauauuacaug

SEQ ID NO: 1400215 - RNA, 19 nt, Homo sapiens
gcugauugguuaaagauuc

SEQ ID NO: 1400216 - RNA, 19 nt, Homo sapiens
gaaagagggaaggaagaua

SEQ ID NO: 1400217 - RNA, 19 nt, Homo sapiens
gauggacuguugaaauugu

SEQ ID NO: 1400218 - RNA, 19 nt, Homo sapiens
ggaggagaaugcaauauua

SEQ ID NO: 1400219 - RNA, 19 nt, Homo sapiens
gcacgcagauggaaugaua

SEQ ID NO: 1400220 - RNA, 19 nt, Homo sapiens
ccaaagcgcuuaauagauu

SEQ ID NO: 1400221 - RNA, 19 nt, Homo sapiens
ugacgcagaugaacaauua

SEQ ID NO: 1400222 - RNA, 19 nt, Homo sapiens
ggaugucacuuucaacuua

SEQ ID NO: 1400223 - RNA, 19 nt, Homo sapiens
caaagaagaugaacagaga

SEQ ID NO: 1400224 - RNA, 19 nt, Homo sapiens
gaacuugucuccaaauaca

SEQ ID NO: 1400225 - RNA, 19 nt, Homo sapiens
gacagcaccuucacaauaa

SEQ ID NO: 1400226 - RNA, 19 nt, Homo sapiens
gcucauaucuggaccaaau

SEQ ID NO: 1400227 - RNA, 19 nt, Homo sapiens
gcacaggcuugaagaaaga

SEQ ID NO: 1400228 - RNA, 19 nt, Homo sapiens
ggaaggaugucacuuucaa

SEQ ID NO: 1400229 - RNA, 19 nt, Homo sapiens
gaaacaauucuucgacaua

SEQ ID NO: 1400230 - RNA, 19 nt, Homo sapiens
gagacaagguuauuucaug

SEQ ID NO: 1400231 - RNA, 19 nt, Homo sapiens
gaaaggaucaguugccaaa

SEQ ID NO: 1400232 - RNA, 19 nt, Homo sapiens
gcagauggaaugauaagua

SEQ ID NO: 1400233 - RNA, 19 nt, Homo sapiens
agaaauguaugcagacuuu

SEQ ID NO: 1400234 - RNA, 19 nt, Homo sapiens
cgacagcaccuucacaaua

SEQ ID NO: 1400235 - RNA, 19 nt, Homo sapiens
guuggaagaugcaaaguuu

SEQ ID NO: 1400236 - RNA, 19 nt, Homo sapiens
gaacacagaacuaguuuca

SEQ ID NO: 1400237 - RNA, 19 nt, Homo sapiens
ggaauggaauggugugaug

SEQ ID NO: 1400238 - RNA, 19 nt, Homo sapiens
caacaaacaaucuuccuuu

SEQ ID NO: 1400239 - RNA, 19 nt, Homo sapiens
gaucagggcaguaggcaua

SEQ ID NO: 1400240 - RNA, 19 nt, Homo sapiens
acacagaacuaguuucaga

SEQ ID NO: 1400241 - RNA, 19 nt, Homo sapiens
gaaguugccuauaaucaag

SEQ ID NO: 1400242 - RNA, 19 nt, Homo sapiens
caaauggacuaacgugaug

SEQ ID NO: 1400243 - RNA, 19 nt, Homo sapiens
gaaacucugcgcucuagua

SEQ ID NO: 1400244 - RNA, 19 nt, Homo sapiens
ccaagaaguugccuauaau

SEQ ID NO: 1400245 - RNA, 19 nt, Homo sapiens
caaauacagucccagaguu

SEQ ID NO: 1400246 - RNA, 19 nt, Homo sapiens
ggagaaaccuguucauucc

SEQ ID NO: 1400247 - RNA, 19 nt, Homo sapiens
gacaacaaauagcauggua

SEQ ID NO: 1400248 - RNA, 19 nt, Homo sapiens
gcuuaaggcuucauaaagu

SEQ ID NO: 1400249 - RNA, 19 nt, Homo sapiens
ggcaagaagcacagaauua

SEQ ID NO: 1400250 - RNA, 19 nt, Homo sapiens
caaaugauacugaagagaa

SEQ ID NO: 1400251 - RNA, 19 nt, Homo sapiens
ggagaaugcuggguuuaug

SEQ ID NO: 1400252 - RNA, 19 nt, Homo sapiens
ggacugcucuccuacuaca

SEQ ID NO: 1400253 - RNA, 19 nt, Homo sapiens
caauaacuguugaucagaa

SEQ ID NO: 1400254 - RNA, 19 nt, Homo sapiens
ggaaggagaaggaaauuca

SEQ ID NO: 1400255 - RNA, 19 nt, Homo sapiens
caaauagcaugguagaauc

SEQ ID NO: 1400256 - RNA, 19 nt, Homo sapiens
gaagaugaacagagaaaga

SEQ ID NO: 1400257 - RNA, 19 nt, Homo sapiens
uaaauauucugccuacugu

SEQ ID NO: 1400258 - RNA, 19 nt, Homo sapiens
gaaauucagugggagacaa

SEQ ID NO: 1400259 - RNA, 19 nt, Homo sapiens
cagaauuacugccgagauu

SEQ ID NO: 1400260 - RNA, 19 nt, Homo sapiens
cacagcagcucgggaaaua

SEQ ID NO: 1400261 - RNA, 19 nt, Homo sapiens
ggaauggugugauguaugc

SEQ ID NO: 1400262 - RNA, 19 nt, Homo sapiens
gaaggucuauccucacagu

SEQ ID NO: 1400263 - RNA, 19 nt, Homo sapiens
ggaaggaaaggaucaguug

SEQ ID NO: 1400264 - RNA, 19 nt, Homo sapiens
gaaguggauccaugccuua

SEQ ID NO: 1400265 - RNA, 19 nt, Homo sapiens
gauggagaaugcuggguuu

SEQ ID NO: 1400266 - RNA, 19 nt, Homo sapiens
gaugucacuuucaacuuaa

SEQ ID NO: 1400267 - RNA, 19 nt, Homo sapiens
gcacaagagcguuaucaug

SEQ ID NO: 1400268 - RNA, 19 nt, Homo sapiens
gaacagagaaagaaaauug

SEQ ID NO: 1400269 - RNA, 19 nt, Homo sapiens
caaaguuuauaccugauga

SEQ ID NO: 1400270 - RNA, 19 nt, Homo sapiens
accaagaaguugccuauaa

SEQ ID NO: 1400271 - RNA, 19 nt, Homo sapiens
ucaaagagacaacaaauag

SEQ ID NO: 1400272 - RNA, 19 nt, Homo sapiens
agacaagguuauuucauga

SEQ ID NO: 1400273 - RNA, 19 nt, Homo sapiens
gaggagcugugauugguau

SEQ ID NO: 1400274 - RNA, 19 nt, Homo sapiens
gaagagaacacagaacuag

SEQ ID NO: 1400275 - RNA, 19 nt, Homo sapiens
ggucuuaccuacaauaacu

SEQ ID NO: 1400276 - RNA, 19 nt, Homo sapiens
guacugcuguuaagauaca

SEQ ID NO: 1400277 - RNA, 19 nt, Homo sapiens
aauaucaucuuccacacua

SEQ ID NO: 1400278 - RNA, 19 nt, Homo sapiens
gaggagaaugcaauauuaa

SEQ ID NO: 1400279 - RNA, 19 nt, Homo sapiens
gugaacuugucuccaaaua

SEQ ID NO: 1400280 - RNA, 19 nt, Homo sapiens
gaaaggaaggagaaggaaa

SEQ ID NO: 1400281 - RNA, 19 nt, Homo sapiens
gaugcaauauaucaaccua

SEQ ID NO: 1400282 - RNA, 19 nt, Homo sapiens
gggagaaaccuguucauuc

SEQ ID NO: 1400283 - RNA, 19 nt, Homo sapiens
gaucagaacgaguaugaau

SEQ ID NO: 1400284 - RNA, 19 nt, Homo sapiens
ucccguagaugcaauauau

SEQ ID NO: 1400285 - RNA, 19 nt, Homo sapiens
caacaaauagcaugguaga

SEQ ID NO: 1400286 - RNA, 19 nt, Homo sapiens
gcaaauggacuaacgugau

SEQ ID NO: 1400287 - RNA, 19 nt, Homo sapiens
gaugaugucuucuccuuuu

SEQ ID NO: 1400288 - RNA, 19 nt, Homo sapiens
gcagggcugugucucaugu

SEQ ID NO: 1400289 - RNA, 19 nt, Homo sapiens
gauggaaugauaaguacua

SEQ ID NO: 1400290 - RNA, 19 nt, Homo sapiens
gacauacucuccagcuuca

SEQ ID NO: 1400291 - RNA, 19 nt, Homo sapiens
uaguacugcuguuaagaua

SEQ ID NO: 1400292 - RNA, 19 nt, Homo sapiens
ugaggaaguuggaagauca

SEQ ID NO: 1400293 - RNA, 19 nt, Homo sapiens
cuuaaggcuucauaaagua

SEQ ID NO: 1400294 - RNA, 19 nt, Homo sapiens
cagaugaugucuucuccuu

SEQ ID NO: 1400295 - RNA, 19 nt, Homo sapiens
ggaagaugcaaaguuuaua

SEQ ID NO: 1400296 - RNA, 19 nt, Homo sapiens
ggaauuaggaggagaaugc

SEQ ID NO: 1400297 - RNA, 19 nt, Homo sapiens
gagaaaggaaggagaagga

SEQ ID NO: 1400298 - RNA, 19 nt, Homo sapiens
agaagaaagugaggaaguu

SEQ ID NO: 1400299 - RNA, 19 nt, Homo sapiens
gcaagaagcacagaauuac

SEQ ID NO: 1400300 - RNA, 19 nt, Homo sapiens
gagaacacagaacuaguuu

SEQ ID NO: 1400301 - RNA, 19 nt, Homo sapiens
caacguuuauucuugaaag

SEQ ID NO: 1400302 - RNA, 19 nt, Homo sapiens
cauauaaucucgggauaca

SEQ ID NO: 1400303 - RNA, 19 nt, Homo sapiens
gaugaaccauuacugaaac

SEQ ID NO: 1400304 - RNA, 19 nt, Homo sapiens
gagaaugcuggguuuauga

SEQ ID NO: 1400305 - RNA, 19 nt, Homo sapiens
gaacauuacauucucacau

SEQ ID NO: 1400306 - RNA, 19 nt, Homo sapiens
gaugaacauuacauucuca

SEQ ID NO: 1400307 - RNA, 19 nt, Homo sapiens
gagcagguuucccaucauc

SEQ ID NO: 1400308 - RNA, 19 nt, Homo sapiens
agaacuaguuucagaagga

SEQ ID NO: 1400309 - RNA, 19 nt, Homo sapiens
gaagcacgcagauggaaug

SEQ ID NO: 1400310 - RNA, 19 nt, Homo sapiens
gauccaugccuuagaagaa

SEQ ID NO: 1400311 - RNA, 19 nt, Homo sapiens
gaggagcacaagagcguua

SEQ ID NO: 1400312 - RNA, 19 nt, Homo sapiens
ucacuuaauucuuccuugu

SEQ ID NO: 1400313 - RNA, 19 nt, Homo sapiens
guggauccaugccuuagaa

SEQ ID NO: 1400314 - RNA, 19 nt, Homo sapiens
gaagaaagugaggaaguug

SEQ ID NO: 1400315 - RNA, 19 nt, Homo sapiens
cagcagugaagaugaauuu

SEQ ID NO: 1400316 - RNA, 19 nt, Homo sapiens
acacacacacacauauaua

SEQ ID NO: 1400317 - RNA, 19 nt, Homo sapiens
ccaaacaccacacguugaa

SEQ ID NO: 1400318 - RNA, 19 nt, Homo sapiens
ggaggagaaugcaauauua

SEQ ID NO: 1400319 - RNA, 19 nt, Homo sapiens
ccaaagcgcuuaauagauu

SEQ ID NO: 1400320 - RNA, 19 nt, Homo sapiens
ugacgcagaugaacaauua

SEQ ID NO: 1400321 - RNA, 19 nt, Homo sapiens
ggaugucacuuucaacuua

SEQ ID NO: 1400322 - RNA, 19 nt, Homo sapiens
caaagaagaugaacagaga

SEQ ID NO: 1400323 - RNA, 19 nt, Homo sapiens
gaacuugucuccaaauaca

SEQ ID NO: 1400324 - RNA, 19 nt, Homo sapiens
gcucauaucuggaccaaau

SEQ ID NO: 1400325 - RNA, 19 nt, Homo sapiens
gcacaggcuugaagaaaga

SEQ ID NO: 1400326 - RNA, 19 nt, Homo sapiens
ggaaggaugucacuuucaa

SEQ ID NO: 1400327 - RNA, 19 nt, Homo sapiens
gagacaagguuauuucaug

SEQ ID NO: 1400328 - RNA, 19 nt, Homo sapiens
gaaaggaucaguugccaaa

SEQ ID NO: 1400329 - RNA, 19 nt, Homo sapiens
agaaauguaugcagacuuu

SEQ ID NO: 1400330 - RNA, 19 nt, Homo sapiens
guuggaagaugcaaaguuu

SEQ ID NO: 1400331 - RNA, 19 nt, Homo sapiens
gaacacagaacuaguuuca

SEQ ID NO: 1400332 - RNA, 19 nt, Homo sapiens
ggaauggaauggugugaug

SEQ ID NO: 1400333 - RNA, 19 nt, Homo sapiens
caacaaacaaucuuccuuu

SEQ ID NO: 1400334 - RNA, 19 nt, Homo sapiens
gaucagggcaguaggcaua

SEQ ID NO: 1400335 - RNA, 19 nt, Homo sapiens
acacagaacuaguuucaga

SEQ ID NO: 1400336 - RNA, 19 nt, Homo sapiens
gaaguugccuauaaucaag

SEQ ID NO: 1400337 - RNA, 19 nt, Homo sapiens
gaaacucugcgcucuagua

SEQ ID NO: 1400338 - RNA, 19 nt, Homo sapiens
ccaagaaguugccuauaau

SEQ ID NO: 1400339 - RNA, 19 nt, Homo sapiens
caaauacagucccagaguu

SEQ ID NO: 1400340 - RNA, 19 nt, Homo sapiens
ggagaaaccuguucauucc

SEQ ID NO: 1400341 - RNA, 19 nt, Homo sapiens
gacaacaaauagcauggua

SEQ ID NO: 1400342 - RNA, 19 nt, Homo sapiens
gcuuaaggcuucauaaagu

SEQ ID NO: 1400343 - RNA, 19 nt, Homo sapiens
ggcaagaagcacagaauua

SEQ ID NO: 1400344 - RNA, 19 nt, Homo sapiens
caaaugauacugaagagaa

SEQ ID NO: 1400345 - RNA, 19 nt, Homo sapiens
ggagaaugcuggguuuaug

SEQ ID NO: 1400346 - RNA, 19 nt, Homo sapiens
ggaaggagaaggaaauuca

SEQ ID NO: 1400347 - RNA, 19 nt, Homo sapiens
caaauagcaugguagaauc

SEQ ID NO: 1400348 - RNA, 19 nt, Homo sapiens
gaagaugaacagagaaaga

SEQ ID NO: 1400349 - RNA, 19 nt, Homo sapiens
uaaauauucugccuacugu

SEQ ID NO: 1400350 - RNA, 19 nt, Homo sapiens
gaaauucagugggagacaa

SEQ ID NO: 1400351 - RNA, 19 nt, Homo sapiens
cagaauuacugccgagauu

SEQ ID NO: 1400352 - RNA, 19 nt, Homo sapiens
cacagcagcucgggaaaua

SEQ ID NO: 1400353 - RNA, 19 nt, Homo sapiens
ggaauggugugauguaugc

SEQ ID NO: 1400354 - RNA, 19 nt, Homo sapiens
gaaggucuauccucacagu

SEQ ID NO: 1400355 - RNA, 19 nt, Homo sapiens
ggaaggaaaggaucaguug

SEQ ID NO: 1400356 - RNA, 19 nt, Homo sapiens
gauggagaaugcuggguuu

SEQ ID NO: 1400357 - RNA, 19 nt, Homo sapiens
gaugucacuuucaacuuaa

SEQ ID NO: 1400358 - RNA, 19 nt, Homo sapiens
ggguuuggauucaggauuu

SEQ ID NO: 1400359 - RNA, 19 nt, Homo sapiens
gcacaagagcguuaucaug

SEQ ID NO: 1400360 - RNA, 19 nt, Homo sapiens
gaacagagaaagaaaauug

SEQ ID NO: 1400361 - RNA, 19 nt, Homo sapiens
caaaguuuauaccugauga

SEQ ID NO: 1400362 - RNA, 19 nt, Homo sapiens
accaagaaguugccuauaa

SEQ ID NO: 1400363 - RNA, 19 nt, Homo sapiens
ucaaagagacaacaaauag

SEQ ID NO: 1400364 - RNA, 19 nt, Homo sapiens
agacaagguuauuucauga

SEQ ID NO: 1400365 - RNA, 19 nt, Homo sapiens
gaagagaacacagaacuag

SEQ ID NO: 1400366 - RNA, 19 nt, Homo sapiens
ggucuuaccuacaauaacu

SEQ ID NO: 1400367 - RNA, 19 nt, Homo sapiens
guacugcuguuaagauaca

SEQ ID NO: 1400368 - RNA, 19 nt, Homo sapiens
aauaucaucuuccacacua

SEQ ID NO: 1400369 - RNA, 19 nt, Homo sapiens
gaggagaaugcaauauuaa

SEQ ID NO: 1400370 - RNA, 19 nt, Homo sapiens
gugaacuugucuccaaaua

SEQ ID NO: 1400371 - RNA, 19 nt, Homo sapiens
gaaaggaaggagaaggaaa

SEQ ID NO: 1400372 - RNA, 19 nt, Homo sapiens
gaugcaauauaucaaccua

SEQ ID NO: 1400373 - RNA, 19 nt, Homo sapiens
gggagaaaccuguucauuc

SEQ ID NO: 1400374 - RNA, 19 nt, Homo sapiens
gaucagaacgaguaugaau

SEQ ID NO: 1400375 - RNA, 19 nt, Homo sapiens
ucccguagaugcaauauau

SEQ ID NO: 1400376 - RNA, 19 nt, Homo sapiens
caacaaauagcaugguaga

SEQ ID NO: 1400377 - RNA, 19 nt, Homo sapiens
gaugaugucuucuccuuuu

SEQ ID NO: 1400378 - RNA, 19 nt, Homo sapiens
gcagggcugugucucaugu

SEQ ID NO: 1400379 - RNA, 19 nt, Homo sapiens
uaguacugcuguuaagaua

SEQ ID NO: 1400380 - RNA, 19 nt, Homo sapiens
ugaggaaguuggaagauca

SEQ ID NO: 1400381 - RNA, 19 nt, Homo sapiens
cuuaaggcuucauaaagua

SEQ ID NO: 1400382 - RNA, 19 nt, Homo sapiens
cagaugaugucuucuccuu

SEQ ID NO: 1400383 - RNA, 19 nt, Homo sapiens
ggaagaugcaaaguuuaua

SEQ ID NO: 1400384 - RNA, 19 nt, Homo sapiens
ggaauuaggaggagaaugc

SEQ ID NO: 1400385 - RNA, 19 nt, Homo sapiens
gagaaaggaaggagaagga

SEQ ID NO: 1400386 - RNA, 19 nt, Homo sapiens
agaagaaagugaggaaguu

SEQ ID NO: 1400387 - RNA, 19 nt, Homo sapiens
gcaagaagcacagaauuac

SEQ ID NO: 1400388 - RNA, 19 nt, Homo sapiens
gagaacacagaacuaguuu

SEQ ID NO: 1400389 - RNA, 19 nt, Homo sapiens
caacguuuauucuugaaag

SEQ ID NO: 1400390 - RNA, 19 nt, Homo sapiens
cauauaaucucgggauaca

SEQ ID NO: 1400391 - RNA, 19 nt, Homo sapiens
gaugaaccauuacugaaac

SEQ ID NO: 1400392 - RNA, 19 nt, Homo sapiens
gagaaugcuggguuuauga

SEQ ID NO: 1400393 - RNA, 19 nt, Homo sapiens
gaacauuacauucucacau

SEQ ID NO: 1400394 - RNA, 19 nt, Homo sapiens
gaugaacauuacauucuca

SEQ ID NO: 1400395 - RNA, 19 nt, Homo sapiens
gagcagguuucccaucauc

SEQ ID NO: 1400396 - RNA, 19 nt, Homo sapiens
agaacuaguuucagaagga

SEQ ID NO: 1400397 - RNA, 19 nt, Homo sapiens
gaggagcacaagagcguua

SEQ ID NO: 1400398 - RNA, 19 nt, Homo sapiens
ucacuuaauucuuccuugu

SEQ ID NO: 1400399 - RNA, 19 nt, Homo sapiens
gaagaaagugaggaaguug

SEQ ID NO: 1400400 - RNA, 19 nt, Homo sapiens
cagcagugaagaugaauuu

SEQ ID NO: 1400401 - RNA, 19 nt, Homo sapiens
acacacacacacauauaua

SEQ ID NO: 1400402 - RNA, 19 nt, Homo sapiens
ccaaacaccacacguugaa

SEQ ID NO: 1400403 - RNA, 19 nt, Homo sapiens
gagcauuagugaccagaag

SEQ ID NO: 1400404 - RNA, 19 nt, Homo sapiens
guaguucuuccaacguuua

SEQ ID NO: 1400405 - RNA, 19 nt, Homo sapiens
gcagugaagaugaauuuua

SEQ ID NO: 1400406 - RNA, 19 nt, Homo sapiens
gaagaugcaaaguuuauac

SEQ ID NO: 1400407 - RNA, 19 nt, Homo sapiens
uggaagaucagaacgagua

SEQ ID NO: 1400408 - RNA, 19 nt, Homo sapiens
uaauuacagugguuccuau

SEQ ID NO: 1400409 - RNA, 19 nt, Homo sapiens
caagguuauuucaugaaga

SEQ ID NO: 1400410 - RNA, 19 nt, Homo sapiens
acacuaaacccuucuaugg

SEQ ID NO: 1400411 - RNA, 19 nt, Homo sapiens
ggacaucaucagacuccua

SEQ ID NO: 1400412 - RNA, 19 nt, Homo sapiens
acacacacacacacauaua

SEQ ID NO: 1400413 - RNA, 19 nt, Homo sapiens
gcucuaguacugcuguuaa

SEQ ID NO: 1400414 - RNA, 19 nt, Homo sapiens
gcagaagcccgagaaagga

SEQ ID NO: 1400415 - RNA, 19 nt, Homo sapiens
gcugaugcuuaccuacaaa

SEQ ID NO: 1400416 - RNA, 19 nt, Homo sapiens
gugcaaauaucaucuucca

SEQ ID NO: 1400417 - RNA, 19 nt, Homo sapiens
acaauucaaugcucauauc

SEQ ID NO: 1400418 - RNA, 19 nt, Homo sapiens
ggaggagaaugcaauauua

SEQ ID NO: 1400419 - RNA, 19 nt, Homo sapiens
ccaaagcgcuuaauagauu

SEQ ID NO: 1400420 - RNA, 19 nt, Homo sapiens
ugacgcagaugaacaauua

SEQ ID NO: 1400421 - RNA, 19 nt, Homo sapiens
ggaugucacuuucaacuua

SEQ ID NO: 1400422 - RNA, 19 nt, Homo sapiens
caaagaagaugaacagaga

SEQ ID NO: 1400423 - RNA, 19 nt, Homo sapiens
gaacuugucuccaaauaca

SEQ ID NO: 1400424 - RNA, 19 nt, Homo sapiens
gcucauaucuggaccaaau

SEQ ID NO: 1400425 - RNA, 19 nt, Homo sapiens
gcacaggcuugaagaaaga

SEQ ID NO: 1400426 - RNA, 19 nt, Homo sapiens
ggaaggaugucacuuucaa

SEQ ID NO: 1400427 - RNA, 19 nt, Homo sapiens
gagacaagguuauuucaug

SEQ ID NO: 1400428 - RNA, 19 nt, Homo sapiens
gaaaggaucaguugccaaa

SEQ ID NO: 1400429 - RNA, 19 nt, Homo sapiens
agaaauguaugcagacuuu

SEQ ID NO: 1400430 - RNA, 19 nt, Homo sapiens
guuggaagaugcaaaguuu

SEQ ID NO: 1400431 - RNA, 19 nt, Homo sapiens
gaacacagaacuaguuuca

SEQ ID NO: 1400432 - RNA, 19 nt, Homo sapiens
ggaauggaauggugugaug

SEQ ID NO: 1400433 - RNA, 19 nt, Homo sapiens
caacaaacaaucuuccuuu

SEQ ID NO: 1400434 - RNA, 19 nt, Homo sapiens
gaucagggcaguaggcaua

SEQ ID NO: 1400435 - RNA, 19 nt, Homo sapiens
acacagaacuaguuucaga

SEQ ID NO: 1400436 - RNA, 19 nt, Homo sapiens
gaaguugccuauaaucaag

SEQ ID NO: 1400437 - RNA, 19 nt, Homo sapiens
gaaacucugcgcucuagua

SEQ ID NO: 1400438 - RNA, 19 nt, Homo sapiens
ccaagaaguugccuauaau

SEQ ID NO: 1400439 - RNA, 19 nt, Homo sapiens
caaauacagucccagaguu

SEQ ID NO: 1400440 - RNA, 19 nt, Homo sapiens
ggagaaaccuguucauucc

SEQ ID NO: 1400441 - RNA, 19 nt, Homo sapiens
gacaacaaauagcauggua

SEQ ID NO: 1400442 - RNA, 19 nt, Homo sapiens
gcuuaaggcuucauaaagu

SEQ ID NO: 1400443 - RNA, 19 nt, Homo sapiens
ggcaagaagcacagaauua

SEQ ID NO: 1400444 - RNA, 19 nt, Homo sapiens
caaaugauacugaagagaa

SEQ ID NO: 1400445 - RNA, 19 nt, Homo sapiens
ggagaaugcuggguuuaug

SEQ ID NO: 1400446 - RNA, 19 nt, Homo sapiens
ggaaggagaaggaaauuca

SEQ ID NO: 1400447 - RNA, 19 nt, Homo sapiens
caaauagcaugguagaauc

SEQ ID NO: 1400448 - RNA, 19 nt, Homo sapiens
gaagaugaacagagaaaga

SEQ ID NO: 1400449 - RNA, 19 nt, Homo sapiens
uaaauauucugccuacugu

SEQ ID NO: 1400450 - RNA, 19 nt, Homo sapiens
gaaauucagugggagacaa

SEQ ID NO: 1400451 - RNA, 19 nt, Homo sapiens
cagaauuacugccgagauu

SEQ ID NO: 1400452 - RNA, 19 nt, Homo sapiens
cacagcagcucgggaaaua

SEQ ID NO: 1400453 - RNA, 19 nt, Homo sapiens
ggaauggugugauguaugc

SEQ ID NO: 1400454 - RNA, 19 nt, Homo sapiens
gaaggucuauccucacagu

SEQ ID NO: 1400455 - RNA, 19 nt, Homo sapiens
ggaaggaaaggaucaguug

SEQ ID NO: 1400456 - RNA, 19 nt, Homo sapiens
gauggagaaugcuggguuu

SEQ ID NO: 1400457 - RNA, 19 nt, Homo sapiens
gaugucacuuucaacuuaa

SEQ ID NO: 1400458 - RNA, 19 nt, Homo sapiens
gcacaagagcguuaucaug

SEQ ID NO: 1400459 - RNA, 19 nt, Homo sapiens
gaacagagaaagaaaauug

SEQ ID NO: 1400460 - RNA, 19 nt, Homo sapiens
caaaguuuauaccugauga

SEQ ID NO: 1400461 - RNA, 19 nt, Homo sapiens
accaagaaguugccuauaa

SEQ ID NO: 1400462 - RNA, 19 nt, Homo sapiens
ucaaagagacaacaaauag

SEQ ID NO: 1400463 - RNA, 19 nt, Homo sapiens
agacaagguuauuucauga

SEQ ID NO: 1400464 - RNA, 19 nt, Homo sapiens
gaagagaacacagaacuag

SEQ ID NO: 1400465 - RNA, 19 nt, Homo sapiens
ggucuuaccuacaauaacu

SEQ ID NO: 1400466 - RNA, 19 nt, Homo sapiens
guacugcuguuaagauaca

SEQ ID NO: 1400467 - RNA, 19 nt, Homo sapiens
aauaucaucuuccacacua

SEQ ID NO: 1400468 - RNA, 19 nt, Homo sapiens
gaggagaaugcaauauuaa

SEQ ID NO: 1400469 - RNA, 19 nt, Homo sapiens
gugaacuugucuccaaaua

SEQ ID NO: 1400470 - RNA, 19 nt, Homo sapiens
gaaaggaaggagaaggaaa

SEQ ID NO: 1400471 - RNA, 19 nt, Homo sapiens
gaugcaauauaucaaccua

SEQ ID NO: 1400472 - RNA, 19 nt, Homo sapiens
gggagaaaccuguucauuc

SEQ ID NO: 1400473 - RNA, 19 nt, Homo sapiens
gaucagaacgaguaugaau

SEQ ID NO: 1400474 - RNA, 19 nt, Homo sapiens
caacaaauagcaugguaga

SEQ ID NO: 1400475 - RNA, 19 nt, Homo sapiens
ucccguagaugcaauauau

SEQ ID NO: 1400476 - RNA, 19 nt, Homo sapiens
gaugaugucuucuccuuuu

SEQ ID NO: 1400477 - RNA, 19 nt, Homo sapiens
gcagggcugugucucaugu

SEQ ID NO: 1400478 - RNA, 19 nt, Homo sapiens
uaguacugcuguuaagaua

SEQ ID NO: 1400479 - RNA, 19 nt, Homo sapiens
ugaggaaguuggaagauca

SEQ ID NO: 1400480 - RNA, 19 nt, Homo sapiens
cuuaaggcuucauaaagua

SEQ ID NO: 1400481 - RNA, 19 nt, Homo sapiens
cagaugaugucuucuccuu

SEQ ID NO: 1400482 - RNA, 19 nt, Homo sapiens
ggaagaugcaaaguuuaua

SEQ ID NO: 1400483 - RNA, 19 nt, Homo sapiens
ggaauuaggaggagaaugc

SEQ ID NO: 1400484 - RNA, 19 nt, Homo sapiens
gagaaaggaaggagaagga

SEQ ID NO: 1400485 - RNA, 19 nt, Homo sapiens
agaagaaagugaggaaguu

SEQ ID NO: 1400486 - RNA, 19 nt, Homo sapiens
gcaagaagcacagaauuac

SEQ ID NO: 1400487 - RNA, 19 nt, Homo sapiens
gagaacacagaacuaguuu

SEQ ID NO: 1400488 - RNA, 19 nt, Homo sapiens
caacguuuauucuugaaag

SEQ ID NO: 1400489 - RNA, 19 nt, Homo sapiens
cauauaaucucgggauaca

SEQ ID NO: 1400490 - RNA, 19 nt, Homo sapiens
gaugaaccauuacugaaac

SEQ ID NO: 1400491 - RNA, 19 nt, Homo sapiens
gagaaugcuggguuuauga

SEQ ID NO: 1400492 - RNA, 19 nt, Homo sapiens
gaacauuacauucucacau

SEQ ID NO: 1400493 - RNA, 19 nt, Homo sapiens
gaugaacauuacauucuca

SEQ ID NO: 1400494 - RNA, 19 nt, Homo sapiens
gagcagguuucccaucauc

SEQ ID NO: 1400495 - RNA, 19 nt, Homo sapiens
agaacuaguuucagaagga

SEQ ID NO: 1400496 - RNA, 19 nt, Homo sapiens
gaggagcacaagagcguua

SEQ ID NO: 1400497 - RNA, 19 nt, Homo sapiens
ucacuuaauucuuccuugu

SEQ ID NO: 1400498 - RNA, 19 nt, Homo sapiens
gaagaaagugaggaaguug

SEQ ID NO: 1400499 - RNA, 19 nt, Homo sapiens
cagcagugaagaugaauuu

SEQ ID NO: 1400500 - RNA, 19 nt, Homo sapiens
acacacacacacauauaua

SEQ ID NO: 1400501 - RNA, 19 nt, Homo sapiens
ccaaacaccacacguugaa

SEQ ID NO: 1400502 - RNA, 19 nt, Homo sapiens
gagcauuagugaccagaag

SEQ ID NO: 1400503 - RNA, 19 nt, Homo sapiens
guaguucuuccaacguuua

SEQ ID NO: 1400504 - RNA, 19 nt, Homo sapiens
gcagugaagaugaauuuua

SEQ ID NO: 1400505 - RNA, 19 nt, Homo sapiens
gaagaugcaaaguuuauac

SEQ ID NO: 1400506 - RNA, 19 nt, Homo sapiens
uggaagaucagaacgagua

SEQ ID NO: 1400507 - RNA, 19 nt, Homo sapiens
uaauuacagugguuccuau

SEQ ID NO: 1400508 - RNA, 19 nt, Homo sapiens
caagguuauuucaugaaga

SEQ ID NO: 1400509 - RNA, 19 nt, Homo sapiens
acacuaaacccuucuaugg

SEQ ID NO: 1400510 - RNA, 19 nt, Homo sapiens
ggacaucaucagacuccua

SEQ ID NO: 1400511 - RNA, 19 nt, Homo sapiens
acacacacacacacauaua

SEQ ID NO: 1400512 - RNA, 19 nt, Homo sapiens
gcucuaguacugcuguuaa

SEQ ID NO: 1400513 - RNA, 19 nt, Homo sapiens
gcagaagcccgagaaagga

SEQ ID NO: 1400514 - RNA, 19 nt, Homo sapiens
gugcaaauaucaucuucca

SEQ ID NO: 1400515 - RNA, 19 nt, Homo sapiens
acaauucaaugcucauauc

SEQ ID NO: 1400516 - RNA, 19 nt, Homo sapiens
gaagauacaauucaaugcu

SEQ ID NO: 1400517 - RNA, 19 nt, Homo sapiens
gaugcugaccuguuugauu

SEQ ID NO: 1400518 - RNA, 19 nt, Homo sapiens
ggaggagaaugcaauauua

SEQ ID NO: 1400519 - RNA, 19 nt, Homo sapiens
gcacgcagauggaaugaua

SEQ ID NO: 1400520 - RNA, 19 nt, Homo sapiens
ccaaagcgcuuaauagauu

SEQ ID NO: 1400521 - RNA, 19 nt, Homo sapiens
ugacgcagaugaacaauua

SEQ ID NO: 1400522 - RNA, 19 nt, Homo sapiens
ggaugucacuuucaacuua

SEQ ID NO: 1400523 - RNA, 19 nt, Homo sapiens
caaagaagaugaacagaga

SEQ ID NO: 1400524 - RNA, 19 nt, Homo sapiens
gaacuugucuccaaauaca

SEQ ID NO: 1400525 - RNA, 19 nt, Homo sapiens
gcucauaucuggaccaaau

SEQ ID NO: 1400526 - RNA, 19 nt, Homo sapiens
gcacaggcuugaagaaaga

SEQ ID NO: 1400527 - RNA, 19 nt, Homo sapiens
ggaaggaugucacuuucaa

SEQ ID NO: 1400528 - RNA, 19 nt, Homo sapiens
gaaacaauucuucgacaua

SEQ ID NO: 1400529 - RNA, 19 nt, Homo sapiens
gagacaagguuauuucaug

SEQ ID NO: 1400530 - RNA, 19 nt, Homo sapiens
gaaaggaucaguugccaaa

SEQ ID NO: 1400531 - RNA, 19 nt, Homo sapiens
gcagauggaaugauaagua

SEQ ID NO: 1400532 - RNA, 19 nt, Homo sapiens
agaaauguaugcagacuuu

SEQ ID NO: 1400533 - RNA, 19 nt, Homo sapiens
guuggaagaugcaaaguuu

SEQ ID NO: 1400534 - RNA, 19 nt, Homo sapiens
gaacacagaacuaguuuca

SEQ ID NO: 1400535 - RNA, 19 nt, Homo sapiens
ggaauggaauggugugaug

SEQ ID NO: 1400536 - RNA, 19 nt, Homo sapiens
caacaaacaaucuuccuuu

SEQ ID NO: 1400537 - RNA, 19 nt, Homo sapiens
gaucagggcaguaggcaua

SEQ ID NO: 1400538 - RNA, 19 nt, Homo sapiens
acacagaacuaguuucaga

SEQ ID NO: 1400539 - RNA, 19 nt, Homo sapiens
gaaguugccuauaaucaag

SEQ ID NO: 1400540 - RNA, 19 nt, Homo sapiens
caaauggacuaacgugaug

SEQ ID NO: 1400541 - RNA, 19 nt, Homo sapiens
gaaacucugcgcucuagua

SEQ ID NO: 1400542 - RNA, 19 nt, Homo sapiens
ccaagaaguugccuauaau

SEQ ID NO: 1400543 - RNA, 19 nt, Homo sapiens
caaauacagucccagaguu

SEQ ID NO: 1400544 - RNA, 19 nt, Homo sapiens
ggagaaaccuguucauucc

SEQ ID NO: 1400545 - RNA, 19 nt, Homo sapiens
gacaacaaauagcauggua

SEQ ID NO: 1400546 - RNA, 19 nt, Homo sapiens
gcuuaaggcuucauaaagu

SEQ ID NO: 1400547 - RNA, 19 nt, Homo sapiens
ggcaagaagcacagaauua

SEQ ID NO: 1400548 - RNA, 19 nt, Homo sapiens
caaaugauacugaagagaa

SEQ ID NO: 1400549 - RNA, 19 nt, Homo sapiens
ggacugcucuccuacuaca

SEQ ID NO: 1400550 - RNA, 19 nt, Homo sapiens
ggagaaugcuggguuuaug

SEQ ID NO: 1400551 - RNA, 19 nt, Homo sapiens
ggaaggagaaggaaauuca

SEQ ID NO: 1400552 - RNA, 19 nt, Homo sapiens
caaauagcaugguagaauc

SEQ ID NO: 1400553 - RNA, 19 nt, Homo sapiens
gaagaugaacagagaaaga

SEQ ID NO: 1400554 - RNA, 19 nt, Homo sapiens
uaaauauucugccuacugu

SEQ ID NO: 1400555 - RNA, 19 nt, Homo sapiens
gaaauucagugggagacaa

SEQ ID NO: 1400556 - RNA, 19 nt, Homo sapiens
cagaauuacugccgagauu

SEQ ID NO: 1400557 - RNA, 19 nt, Homo sapiens
cacagcagcucgggaaaua

SEQ ID NO: 1400558 - RNA, 19 nt, Homo sapiens
ggaauggugugauguaugc

SEQ ID NO: 1400559 - RNA, 19 nt, Homo sapiens
gaaggucuauccucacagu

SEQ ID NO: 1400560 - RNA, 19 nt, Homo sapiens
ggaaggaaaggaucaguug

SEQ ID NO: 1400561 - RNA, 19 nt, Homo sapiens
gaaguggauccaugccuua

SEQ ID NO: 1400562 - RNA, 19 nt, Homo sapiens
gauggagaaugcuggguuu

SEQ ID NO: 1400563 - RNA, 19 nt, Homo sapiens
gaugucacuuucaacuuaa

SEQ ID NO: 1400564 - RNA, 19 nt, Homo sapiens
gcacaagagcguuaucaug

SEQ ID NO: 1400565 - RNA, 19 nt, Homo sapiens
gaacagagaaagaaaauug

SEQ ID NO: 1400566 - RNA, 19 nt, Homo sapiens
caaaguuuauaccugauga

SEQ ID NO: 1400567 - RNA, 19 nt, Homo sapiens
accaagaaguugccuauaa

SEQ ID NO: 1400568 - RNA, 19 nt, Homo sapiens
ucaaagagacaacaaauag

SEQ ID NO: 1400569 - RNA, 19 nt, Homo sapiens
agacaagguuauuucauga

SEQ ID NO: 1400570 - RNA, 19 nt, Homo sapiens
gaagagaacacagaacuag

SEQ ID NO: 1400571 - RNA, 19 nt, Homo sapiens
ggucuuaccuacaauaacu

SEQ ID NO: 1400572 - RNA, 19 nt, Homo sapiens
guacugcuguuaagauaca

SEQ ID NO: 1400573 - RNA, 19 nt, Homo sapiens
aauaucaucuuccacacua

SEQ ID NO: 1400574 - RNA, 19 nt, Homo sapiens
gaggagaaugcaauauuaa

SEQ ID NO: 1400575 - RNA, 19 nt, Homo sapiens
gugaacuugucuccaaaua

SEQ ID NO: 1400576 - RNA, 19 nt, Homo sapiens
gaaaggaaggagaaggaaa

SEQ ID NO: 1400577 - RNA, 19 nt, Homo sapiens
gaugcaauauaucaaccua

SEQ ID NO: 1400578 - RNA, 19 nt, Homo sapiens
gggagaaaccuguucauuc

SEQ ID NO: 1400579 - RNA, 19 nt, Homo sapiens
gaucagaacgaguaugaau

SEQ ID NO: 1400580 - RNA, 19 nt, Homo sapiens
ucccguagaugcaauauau

SEQ ID NO: 1400581 - RNA, 19 nt, Homo sapiens
caacaaauagcaugguaga

SEQ ID NO: 1400582 - RNA, 19 nt, Homo sapiens
gcaaauggacuaacgugau

SEQ ID NO: 1400583 - RNA, 19 nt, Homo sapiens
gaugaugucuucuccuuuu

SEQ ID NO: 1400584 - RNA, 19 nt, Homo sapiens
gcagggcugugucucaugu

SEQ ID NO: 1400585 - RNA, 19 nt, Homo sapiens
gauggaaugauaaguacua

SEQ ID NO: 1400586 - RNA, 19 nt, Homo sapiens
gacauacucuccagcuuca

SEQ ID NO: 1400587 - RNA, 19 nt, Homo sapiens
uaguacugcuguuaagaua

SEQ ID NO: 1400588 - RNA, 19 nt, Homo sapiens
ugaggaaguuggaagauca

SEQ ID NO: 1400589 - RNA, 19 nt, Homo sapiens
cuuaaggcuucauaaagua

SEQ ID NO: 1400590 - RNA, 19 nt, Homo sapiens
cagaugaugucuucuccuu

SEQ ID NO: 1400591 - RNA, 19 nt, Homo sapiens
ggaagaugcaaaguuuaua

SEQ ID NO: 1400592 - RNA, 19 nt, Homo sapiens
ggaauuaggaggagaaugc

SEQ ID NO: 1400593 - RNA, 19 nt, Homo sapiens
gagaaaggaaggagaagga

SEQ ID NO: 1400594 - RNA, 19 nt, Homo sapiens
agaagaaagugaggaaguu

SEQ ID NO: 1400595 - RNA, 19 nt, Homo sapiens
gcaagaagcacagaauuac

SEQ ID NO: 1400596 - RNA, 19 nt, Homo sapiens
gagaacacagaacuaguuu

SEQ ID NO: 1400597 - RNA, 19 nt, Homo sapiens
caacguuuauucuugaaag

SEQ ID NO: 1400598 - RNA, 19 nt, Homo sapiens
cauauaaucucgggauaca

SEQ ID NO: 1400599 - RNA, 19 nt, Homo sapiens
gaugaaccauuacugaaac

SEQ ID NO: 1400600 - RNA, 19 nt, Homo sapiens
gagaaugcuggguuuauga

SEQ ID NO: 1400601 - RNA, 19 nt, Homo sapiens
gaacauuacauucucacau

SEQ ID NO: 1400602 - RNA, 19 nt, Homo sapiens
gaugaacauuacauucuca

SEQ ID NO: 1400603 - RNA, 19 nt, Homo sapiens
gagcagguuucccaucauc

SEQ ID NO: 1400604 - RNA, 19 nt, Homo sapiens
agaacuaguuucagaagga

SEQ ID NO: 1400605 - RNA, 19 nt, Homo sapiens
gauccaugccuuagaagaa

SEQ ID NO: 1400606 - RNA, 19 nt, Homo sapiens
gaagcacgcagauggaaug

SEQ ID NO: 1400607 - RNA, 19 nt, Homo sapiens
guggauccaugccuuagaa

SEQ ID NO: 1400608 - RNA, 19 nt, Homo sapiens
gaggagcacaagagcguua

SEQ ID NO: 1400609 - RNA, 19 nt, Homo sapiens
ucacuuaauucuuccuugu

SEQ ID NO: 1400610 - RNA, 19 nt, Homo sapiens
gaagaaagugaggaaguug

SEQ ID NO: 1400611 - RNA, 19 nt, Homo sapiens
cagcagugaagaugaauuu

SEQ ID NO: 1400612 - RNA, 19 nt, Homo sapiens
acacacacacacauauaua

SEQ ID NO: 1400613 - RNA, 19 nt, Homo sapiens
ccaaacaccacacguugaa

SEQ ID NO: 1400614 - RNA, 19 nt, Homo sapiens
gagcauuagugaccagaag

SEQ ID NO: 1400615 - RNA, 19 nt, Homo sapiens
guaguucuuccaacguuua

SEQ ID NO: 1400616 - RNA, 19 nt, Homo sapiens
gcagugaagaugaauuuua

SEQ ID NO: 1400617 - RNA, 19 nt, Homo sapiens
gaagaugcaaaguuuauac

SEQ ID NO: 1400618 - RNA, 19 nt, Homo sapiens
ggaggagaaugcaauauua

SEQ ID NO: 1400619 - RNA, 19 nt, Homo sapiens
ccaaagcgcuuaauagauu

SEQ ID NO: 1400620 - RNA, 19 nt, Homo sapiens
ugacgcagaugaacaauua

SEQ ID NO: 1400621 - RNA, 19 nt, Homo sapiens
ggaugucacuuucaacuua

SEQ ID NO: 1400622 - RNA, 19 nt, Homo sapiens
caaagaagaugaacagaga

SEQ ID NO: 1400623 - RNA, 19 nt, Homo sapiens
gaacuugucuccaaauaca

SEQ ID NO: 1400624 - RNA, 19 nt, Homo sapiens
gcucauaucuggaccaaau

SEQ ID NO: 1400625 - RNA, 19 nt, Homo sapiens
gcacaggcuugaagaaaga

SEQ ID NO: 1400626 - RNA, 19 nt, Homo sapiens
ggaaggaugucacuuucaa

SEQ ID NO: 1400627 - RNA, 19 nt, Homo sapiens
gagacaagguuauuucaug

SEQ ID NO: 1400628 - RNA, 19 nt, Homo sapiens
gaaaggaucaguugccaaa

SEQ ID NO: 1400629 - RNA, 19 nt, Homo sapiens
agaaauguaugcagacuuu

SEQ ID NO: 1400630 - RNA, 19 nt, Homo sapiens
guuggaagaugcaaaguuu

SEQ ID NO: 1400631 - RNA, 19 nt, Homo sapiens
gaacacagaacuaguuuca

SEQ ID NO: 1400632 - RNA, 19 nt, Homo sapiens
ggaauggaauggugugaug

SEQ ID NO: 1400633 - RNA, 19 nt, Homo sapiens
caacaaacaaucuuccuuu

SEQ ID NO: 1400634 - RNA, 19 nt, Homo sapiens
gaucagggcaguaggcaua

SEQ ID NO: 1400635 - RNA, 19 nt, Homo sapiens
acacagaacuaguuucaga

SEQ ID NO: 1400636 - RNA, 19 nt, Homo sapiens
gaaguugccuauaaucaag

SEQ ID NO: 1400637 - RNA, 19 nt, Homo sapiens
gaaacucugcgcucuagua

SEQ ID NO: 1400638 - RNA, 19 nt, Homo sapiens
ccaagaaguugccuauaau

SEQ ID NO: 1400639 - RNA, 19 nt, Homo sapiens
caaauacagucccagaguu

SEQ ID NO: 1400640 - RNA, 19 nt, Homo sapiens
ggagaaaccuguucauucc

SEQ ID NO: 1400641 - RNA, 19 nt, Homo sapiens
gacaacaaauagcauggua

SEQ ID NO: 1400642 - RNA, 19 nt, Homo sapiens
gcuuaaggcuucauaaagu

SEQ ID NO: 1400643 - RNA, 19 nt, Homo sapiens
ggcaagaagcacagaauua

SEQ ID NO: 1400644 - RNA, 19 nt, Homo sapiens
caaaugauacugaagagaa

SEQ ID NO: 1400645 - RNA, 19 nt, Homo sapiens
ggagaaugcuggguuuaug

SEQ ID NO: 1400646 - RNA, 19 nt, Homo sapiens
ggaaggagaaggaaauuca

SEQ ID NO: 1400647 - RNA, 19 nt, Homo sapiens
caaauagcaugguagaauc

SEQ ID NO: 1400648 - RNA, 19 nt, Homo sapiens
gaagaugaacagagaaaga

SEQ ID NO: 1400649 - RNA, 19 nt, Homo sapiens
uaaauauucugccuacugu

SEQ ID NO: 1400650 - RNA, 19 nt, Homo sapiens
gaaauucagugggagacaa

SEQ ID NO: 1400651 - RNA, 19 nt, Homo sapiens
cagaauuacugccgagauu

SEQ ID NO: 1400652 - RNA, 19 nt, Homo sapiens
cacagcagcucgggaaaua

SEQ ID NO: 1400653 - RNA, 19 nt, Homo sapiens
ggaauggugugauguaugc

SEQ ID NO: 1400654 - RNA, 19 nt, Homo sapiens
gaaggucuauccucacagu

SEQ ID NO: 1400655 - RNA, 19 nt, Homo sapiens
ggaaggaaaggaucaguug

SEQ ID NO: 1400656 - RNA, 19 nt, Homo sapiens
gauggagaaugcuggguuu

SEQ ID NO: 1400657 - RNA, 19 nt, Homo sapiens
gaugucacuuucaacuuaa

SEQ ID NO: 1400658 - RNA, 19 nt, Homo sapiens
gcacaagagcguuaucaug

SEQ ID NO: 1400659 - RNA, 19 nt, Homo sapiens
gaacagagaaagaaaauug

SEQ ID NO: 1400660 - RNA, 19 nt, Homo sapiens
caaaguuuauaccugauga

SEQ ID NO: 1400661 - RNA, 19 nt, Homo sapiens
accaagaaguugccuauaa

SEQ ID NO: 1400662 - RNA, 19 nt, Homo sapiens
ucaaagagacaacaaauag

SEQ ID NO: 1400663 - RNA, 19 nt, Homo sapiens
agacaagguuauuucauga

SEQ ID NO: 1400664 - RNA, 19 nt, Homo sapiens
gaagagaacacagaacuag

SEQ ID NO: 1400665 - RNA, 19 nt, Homo sapiens
ggucuuaccuacaauaacu

SEQ ID NO: 1400666 - RNA, 19 nt, Homo sapiens
guacugcuguuaagauaca

SEQ ID NO: 1400667 - RNA, 19 nt, Homo sapiens
aauaucaucuuccacacua

SEQ ID NO: 1400668 - RNA, 19 nt, Homo sapiens
gaggagaaugcaauauuaa

SEQ ID NO: 1400669 - RNA, 19 nt, Homo sapiens
gugaacuugucuccaaaua

SEQ ID NO: 1400670 - RNA, 19 nt, Homo sapiens
gaaaggaaggagaaggaaa

SEQ ID NO: 1400671 - RNA, 19 nt, Homo sapiens
gaugcaauauaucaaccua

SEQ ID NO: 1400672 - RNA, 19 nt, Homo sapiens
gggagaaaccuguucauuc

SEQ ID NO: 1400673 - RNA, 19 nt, Homo sapiens
gaucagaacgaguaugaau

SEQ ID NO: 1400674 - RNA, 19 nt, Homo sapiens
ucccguagaugcaauauau

SEQ ID NO: 1400675 - RNA, 19 nt, Homo sapiens
caacaaauagcaugguaga

SEQ ID NO: 1400676 - RNA, 19 nt, Homo sapiens
gaugaugucuucuccuuuu

SEQ ID NO: 1400677 - RNA, 19 nt, Homo sapiens
gcagggcugugucucaugu

SEQ ID NO: 1400678 - RNA, 19 nt, Homo sapiens
uaguacugcuguuaagaua

SEQ ID NO: 1400679 - RNA, 19 nt, Homo sapiens
ugaggaaguuggaagauca

SEQ ID NO: 1400680 - RNA, 19 nt, Homo sapiens
cuuaaggcuucauaaagua

SEQ ID NO: 1400681 - RNA, 19 nt, Homo sapiens
cagaugaugucuucuccuu

SEQ ID NO: 1400682 - RNA, 19 nt, Homo sapiens
ggaagaugcaaaguuuaua

SEQ ID NO: 1400683 - RNA, 19 nt, Homo sapiens
ggaauuaggaggagaaugc

SEQ ID NO: 1400684 - RNA, 19 nt, Homo sapiens
gagaaaggaaggagaagga

SEQ ID NO: 1400685 - RNA, 19 nt, Homo sapiens
agaagaaagugaggaaguu

SEQ ID NO: 1400686 - RNA, 19 nt, Homo sapiens
gcaagaagcacagaauuac

SEQ ID NO: 1400687 - RNA, 19 nt, Homo sapiens
gagaacacagaacuaguuu

SEQ ID NO: 1400688 - RNA, 19 nt, Homo sapiens
caacguuuauucuugaaag

SEQ ID NO: 1400689 - RNA, 19 nt, Homo sapiens
cauauaaucucgggauaca

SEQ ID NO: 1400690 - RNA, 19 nt, Homo sapiens
gaugaaccauuacugaaac

SEQ ID NO: 1400691 - RNA, 19 nt, Homo sapiens
gagaaugcuggguuuauga

SEQ ID NO: 1400692 - RNA, 19 nt, Homo sapiens
gaacauuacauucucacau

SEQ ID NO: 1400693 - RNA, 19 nt, Homo sapiens
gaugaacauuacauucuca

SEQ ID NO: 1400694 - RNA, 19 nt, Homo sapiens
gagcagguuucccaucauc

SEQ ID NO: 1400695 - RNA, 19 nt, Homo sapiens
agaacuaguuucagaagga

SEQ ID NO: 1400696 - RNA, 19 nt, Homo sapiens
gaggagcacaagagcguua

SEQ ID NO: 1400697 - RNA, 19 nt, Homo sapiens
ucacuuaauucuuccuugu

SEQ ID NO: 1400698 - RNA, 19 nt, Homo sapiens
gaagaaagugaggaaguug

SEQ ID NO: 1400699 - RNA, 19 nt, Homo sapiens
cagcagugaagaugaauuu

SEQ ID NO: 1400700 - RNA, 19 nt, Homo sapiens
acacacacacacauauaua

SEQ ID NO: 1400701 - RNA, 19 nt, Homo sapiens
ccaaacaccacacguugaa

SEQ ID NO: 1400702 - RNA, 19 nt, Homo sapiens
gagcauuagugaccagaag

SEQ ID NO: 1400703 - RNA, 19 nt, Homo sapiens
guaguucuuccaacguuua

SEQ ID NO: 1400704 - RNA, 19 nt, Homo sapiens
gcagugaagaugaauuuua

SEQ ID NO: 1400705 - RNA, 19 nt, Homo sapiens
gaagaugcaaaguuuauac

SEQ ID NO: 1400706 - RNA, 19 nt, Homo sapiens
uggaagaucagaacgagua

SEQ ID NO: 1400707 - RNA, 19 nt, Homo sapiens
uaauuacagugguuccuau

SEQ ID NO: 1400708 - RNA, 19 nt, Homo sapiens
caagguuauuucaugaaga

SEQ ID NO: 1400709 - RNA, 19 nt, Homo sapiens
acacuaaacccuucuaugg

SEQ ID NO: 1400710 - RNA, 19 nt, Homo sapiens
ggacaucaucagacuccua

SEQ ID NO: 1400711 - RNA, 19 nt, Homo sapiens
acacacacacacacauaua

SEQ ID NO: 1400712 - RNA, 19 nt, Homo sapiens
gcugaugcuuaccuacaaa

SEQ ID NO: 1400713 - RNA, 19 nt, Homo sapiens
gcucuaguacugcuguuaa

SEQ ID NO: 1400714 - RNA, 19 nt, Homo sapiens
gcagaagcccgagaaagga

SEQ ID NO: 1400715 - RNA, 19 nt, Homo sapiens
acaaauagcaugguagaau

SEQ ID NO: 1400716 - RNA, 19 nt, Homo sapiens
gugcaaauaucaucuucca

SEQ ID NO: 1400717 - RNA, 19 nt, Homo sapiens
acaauucaaugcucauauc

SEQ ID NO: 1400718 - RNA, 19 nt, Homo sapiens
ggaggagaaugcaauauua

SEQ ID NO: 1400719 - RNA, 19 nt, Homo sapiens
ccaaagcgcuuaauagauu

SEQ ID NO: 1400720 - RNA, 19 nt, Homo sapiens
ugacgcagaugaacaauua

SEQ ID NO: 1400721 - RNA, 19 nt, Homo sapiens
ggaugucacuuucaacuua

SEQ ID NO: 1400722 - RNA, 19 nt, Homo sapiens
caaagaagaugaacagaga

SEQ ID NO: 1400723 - RNA, 19 nt, Homo sapiens
gaacuugucuccaaauaca

SEQ ID NO: 1400724 - RNA, 19 nt, Homo sapiens
gacagcaccuucacaauaa

SEQ ID NO: 1400725 - RNA, 19 nt, Homo sapiens
gcucauaucuggaccaaau

SEQ ID NO: 1400726 - RNA, 19 nt, Homo sapiens
gcacaggcuugaagaaaga

SEQ ID NO: 1400727 - RNA, 19 nt, Homo sapiens
ggaaggaugucacuuucaa

SEQ ID NO: 1400728 - RNA, 19 nt, Homo sapiens
gaaacaauucuucgacaua

SEQ ID NO: 1400729 - RNA, 19 nt, Homo sapiens
gagacaagguuauuucaug

SEQ ID NO: 1400730 - RNA, 19 nt, Homo sapiens
gaaaggaucaguugccaaa

SEQ ID NO: 1400731 - RNA, 19 nt, Homo sapiens
agaaauguaugcagacuuu

SEQ ID NO: 1400732 - RNA, 19 nt, Homo sapiens
cgacagcaccuucacaaua

SEQ ID NO: 1400733 - RNA, 19 nt, Homo sapiens
guuggaagaugcaaaguuu

SEQ ID NO: 1400734 - RNA, 19 nt, Homo sapiens
gaacacagaacuaguuuca

SEQ ID NO: 1400735 - RNA, 19 nt, Homo sapiens
ggaauggaauggugugaug

SEQ ID NO: 1400736 - RNA, 19 nt, Homo sapiens
caacaaacaaucuuccuuu

SEQ ID NO: 1400737 - RNA, 19 nt, Homo sapiens
gaucagggcaguaggcaua

SEQ ID NO: 1400738 - RNA, 19 nt, Homo sapiens
acacagaacuaguuucaga

SEQ ID NO: 1400739 - RNA, 19 nt, Homo sapiens
gaaguugccuauaaucaag

SEQ ID NO: 1400740 - RNA, 19 nt, Homo sapiens
caaauggacuaacgugaug

SEQ ID NO: 1400741 - RNA, 19 nt, Homo sapiens
gaaacucugcgcucuagua

SEQ ID NO: 1400742 - RNA, 19 nt, Homo sapiens
ccaagaaguugccuauaau

SEQ ID NO: 1400743 - RNA, 19 nt, Homo sapiens
caaauacagucccagaguu

SEQ ID NO: 1400744 - RNA, 19 nt, Homo sapiens
ggagaaaccuguucauucc

SEQ ID NO: 1400745 - RNA, 19 nt, Homo sapiens
gacaacaaauagcauggua

SEQ ID NO: 1400746 - RNA, 19 nt, Homo sapiens
gcuuaaggcuucauaaagu

SEQ ID NO: 1400747 - RNA, 19 nt, Homo sapiens
ggcaagaagcacagaauua

SEQ ID NO: 1400748 - RNA, 19 nt, Homo sapiens
caaaugauacugaagagaa

SEQ ID NO: 1400749 - RNA, 19 nt, Homo sapiens
ggacugcucuccuacuaca

SEQ ID NO: 1400750 - RNA, 19 nt, Homo sapiens
ggagaaugcuggguuuaug

SEQ ID NO: 1400751 - RNA, 19 nt, Homo sapiens
caauaacuguugaucagaa

SEQ ID NO: 1400752 - RNA, 19 nt, Homo sapiens
ggaaggagaaggaaauuca

SEQ ID NO: 1400753 - RNA, 19 nt, Homo sapiens
caaauagcaugguagaauc

SEQ ID NO: 1400754 - RNA, 19 nt, Homo sapiens
gaagaugaacagagaaaga

SEQ ID NO: 1400755 - RNA, 19 nt, Homo sapiens
uaaauauucugccuacugu

SEQ ID NO: 1400756 - RNA, 19 nt, Homo sapiens
gaaauucagugggagacaa

SEQ ID NO: 1400757 - RNA, 19 nt, Homo sapiens
cagaauuacugccgagauu

SEQ ID NO: 1400758 - RNA, 19 nt, Homo sapiens
cacagcagcucgggaaaua

SEQ ID NO: 1400759 - RNA, 19 nt, Homo sapiens
ggaauggugugauguaugc

SEQ ID NO: 1400760 - RNA, 19 nt, Homo sapiens
gaaggucuauccucacagu

SEQ ID NO: 1400761 - RNA, 19 nt, Homo sapiens
ggaaggaaaggaucaguug

SEQ ID NO: 1400762 - RNA, 19 nt, Homo sapiens
gaaguggauccaugccuua

SEQ ID NO: 1400763 - RNA, 19 nt, Homo sapiens
gauggagaaugcuggguuu

SEQ ID NO: 1400764 - RNA, 19 nt, Homo sapiens
gaugucacuuucaacuuaa

SEQ ID NO: 1400765 - RNA, 19 nt, Homo sapiens
gcacaagagcguuaucaug

SEQ ID NO: 1400766 - RNA, 19 nt, Homo sapiens
gaacagagaaagaaaauug

SEQ ID NO: 1400767 - RNA, 19 nt, Homo sapiens
caaaguuuauaccugauga

SEQ ID NO: 1400768 - RNA, 19 nt, Homo sapiens
accaagaaguugccuauaa

SEQ ID NO: 1400769 - RNA, 19 nt, Homo sapiens
ucaaagagacaacaaauag

SEQ ID NO: 1400770 - RNA, 19 nt, Homo sapiens
agacaagguuauuucauga

SEQ ID NO: 1400771 - RNA, 19 nt, Homo sapiens
gaagagaacacagaacuag

SEQ ID NO: 1400772 - RNA, 19 nt, Homo sapiens
gaggagcugugauugguau

SEQ ID NO: 1400773 - RNA, 19 nt, Homo sapiens
ggucuuaccuacaauaacu

SEQ ID NO: 1400774 - RNA, 19 nt, Homo sapiens
guacugcuguuaagauaca

SEQ ID NO: 1400775 - RNA, 19 nt, Homo sapiens
aauaucaucuuccacacua

SEQ ID NO: 1400776 - RNA, 19 nt, Homo sapiens
gaggagaaugcaauauuaa

SEQ ID NO: 1400777 - RNA, 19 nt, Homo sapiens
gugaacuugucuccaaaua

SEQ ID NO: 1400778 - RNA, 19 nt, Homo sapiens
gaaaggaaggagaaggaaa

SEQ ID NO: 1400779 - RNA, 19 nt, Homo sapiens
gaugcaauauaucaaccua

SEQ ID NO: 1400780 - RNA, 19 nt, Homo sapiens
gggagaaaccuguucauuc

SEQ ID NO: 1400781 - RNA, 19 nt, Homo sapiens
gaucagaacgaguaugaau

SEQ ID NO: 1400782 - RNA, 19 nt, Homo sapiens
gcaaauggacuaacgugau

SEQ ID NO: 1400783 - RNA, 19 nt, Homo sapiens
ucccguagaugcaauauau

SEQ ID NO: 1400784 - RNA, 19 nt, Homo sapiens
caacaaauagcaugguaga

SEQ ID NO: 1400785 - RNA, 19 nt, Homo sapiens
gaugaugucuucuccuuuu

SEQ ID NO: 1400786 - RNA, 19 nt, Homo sapiens
gcagggcugugucucaugu

SEQ ID NO: 1400787 - RNA, 19 nt, Homo sapiens
gacauacucuccagcuuca

SEQ ID NO: 1400788 - RNA, 19 nt, Homo sapiens
uaguacugcuguuaagaua

SEQ ID NO: 1400789 - RNA, 19 nt, Homo sapiens
ugaggaaguuggaagauca

SEQ ID NO: 1400790 - RNA, 19 nt, Homo sapiens
cuuaaggcuucauaaagua

SEQ ID NO: 1400791 - RNA, 19 nt, Homo sapiens
cagaugaugucuucuccuu

SEQ ID NO: 1400792 - RNA, 19 nt, Homo sapiens
ggaagaugcaaaguuuaua

SEQ ID NO: 1400793 - RNA, 19 nt, Homo sapiens
ggaauuaggaggagaaugc

SEQ ID NO: 1400794 - RNA, 19 nt, Homo sapiens
gagaaaggaaggagaagga

SEQ ID NO: 1400795 - RNA, 19 nt, Homo sapiens
agaagaaagugaggaaguu

SEQ ID NO: 1400796 - RNA, 19 nt, Homo sapiens
gcaagaagcacagaauuac

SEQ ID NO: 1400797 - RNA, 19 nt, Homo sapiens
gagaacacagaacuaguuu

SEQ ID NO: 1400798 - RNA, 19 nt, Homo sapiens
caacguuuauucuugaaag

SEQ ID NO: 1400799 - RNA, 19 nt, Homo sapiens
cauauaaucucgggauaca

SEQ ID NO: 1400800 - RNA, 19 nt, Homo sapiens
gaugaaccauuacugaaac

SEQ ID NO: 1400801 - RNA, 19 nt, Homo sapiens
gagaaugcuggguuuauga

SEQ ID NO: 1400802 - RNA, 19 nt, Homo sapiens
gaacauuacauucucacau

SEQ ID NO: 1400803 - RNA, 19 nt, Homo sapiens
gaugaacauuacauucuca

SEQ ID NO: 1400804 - RNA, 19 nt, Homo sapiens
gagcagguuucccaucauc

SEQ ID NO: 1400805 - RNA, 19 nt, Homo sapiens
agaacuaguuucagaagga

SEQ ID NO: 1400806 - RNA, 19 nt, Homo sapiens
gauccaugccuuagaagaa

SEQ ID NO: 1400807 - RNA, 19 nt, Homo sapiens
gaggagcacaagagcguua

SEQ ID NO: 1400808 - RNA, 19 nt, Homo sapiens
ucacuuaauucuuccuugu

SEQ ID NO: 1400809 - RNA, 19 nt, Homo sapiens
guggauccaugccuuagaa

SEQ ID NO: 1400810 - RNA, 19 nt, Homo sapiens
gaagaaagugaggaaguug

SEQ ID NO: 1400811 - RNA, 19 nt, Homo sapiens
cagcagugaagaugaauuu

SEQ ID NO: 1400812 - RNA, 19 nt, Homo sapiens
acacacacacacauauaua

SEQ ID NO: 1400813 - RNA, 19 nt, Homo sapiens
cacaauaacuguugaucag

SEQ ID NO: 1400814 - RNA, 19 nt, Homo sapiens
ccaaacaccacacguugaa

SEQ ID NO: 1400815 - RNA, 19 nt, Homo sapiens
gagcauuagugaccagaag

SEQ ID NO: 1400816 - RNA, 19 nt, Homo sapiens
guaguucuuccaacguuua

SEQ ID NO: 1400817 - RNA, 19 nt, Homo sapiens
gagcugugauugguauaga

SEQ ID NO: 1400818 - RNA, 19 nt, Homo sapiens
ggaggagaaugcaauauua

SEQ ID NO: 1400819 - RNA, 19 nt, Homo sapiens
ccaaagcgcuuaauagauu

SEQ ID NO: 1400820 - RNA, 19 nt, Homo sapiens
ugacgcagaugaacaauua

SEQ ID NO: 1400821 - RNA, 19 nt, Homo sapiens
ggaugucacuuucaacuua

SEQ ID NO: 1400822 - RNA, 19 nt, Homo sapiens
caaagaagaugaacagaga

SEQ ID NO: 1400823 - RNA, 19 nt, Homo sapiens
gaacuugucuccaaauaca

SEQ ID NO: 1400824 - RNA, 19 nt, Homo sapiens
gacagcaccuucacaauaa

SEQ ID NO: 1400825 - RNA, 19 nt, Homo sapiens
gcucauaucuggaccaaau

SEQ ID NO: 1400826 - RNA, 19 nt, Homo sapiens
gcacaggcuugaagaaaga

SEQ ID NO: 1400827 - RNA, 19 nt, Homo sapiens
ggaaggaugucacuuucaa

SEQ ID NO: 1400828 - RNA, 19 nt, Homo sapiens
gaaacaauucuucgacaua

SEQ ID NO: 1400829 - RNA, 19 nt, Homo sapiens
gagacaagguuauuucaug

SEQ ID NO: 1400830 - RNA, 19 nt, Homo sapiens
gaaaggaucaguugccaaa

SEQ ID NO: 1400831 - RNA, 19 nt, Homo sapiens
agaaauguaugcagacuuu

SEQ ID NO: 1400832 - RNA, 19 nt, Homo sapiens
cgacagcaccuucacaaua

SEQ ID NO: 1400833 - RNA, 19 nt, Homo sapiens
guuggaagaugcaaaguuu

SEQ ID NO: 1400834 - RNA, 19 nt, Homo sapiens
gaacacagaacuaguuuca

SEQ ID NO: 1400835 - RNA, 19 nt, Homo sapiens
ggaauggaauggugugaug

SEQ ID NO: 1400836 - RNA, 19 nt, Homo sapiens
caacaaacaaucuuccuuu

SEQ ID NO: 1400837 - RNA, 19 nt, Homo sapiens
gaucagggcaguaggcaua

SEQ ID NO: 1400838 - RNA, 19 nt, Homo sapiens
acacagaacuaguuucaga

SEQ ID NO: 1400839 - RNA, 19 nt, Homo sapiens
gaaguugccuauaaucaag

SEQ ID NO: 1400840 - RNA, 19 nt, Homo sapiens
caaauggacuaacgugaug

SEQ ID NO: 1400841 - RNA, 19 nt, Homo sapiens
gaaacucugcgcucuagua

SEQ ID NO: 1400842 - RNA, 19 nt, Homo sapiens
ccaagaaguugccuauaau

SEQ ID NO: 1400843 - RNA, 19 nt, Homo sapiens
caaauacagucccagaguu

SEQ ID NO: 1400844 - RNA, 19 nt, Homo sapiens
ggagaaaccuguucauucc

SEQ ID NO: 1400845 - RNA, 19 nt, Homo sapiens
gacaacaaauagcauggua

SEQ ID NO: 1400846 - RNA, 19 nt, Homo sapiens
gcuuaaggcuucauaaagu

SEQ ID NO: 1400847 - RNA, 19 nt, Homo sapiens
ggcaagaagcacagaauua

SEQ ID NO: 1400848 - RNA, 19 nt, Homo sapiens
caaaugauacugaagagaa

SEQ ID NO: 1400849 - RNA, 19 nt, Homo sapiens
ggacugcucuccuacuaca

SEQ ID NO: 1400850 - RNA, 19 nt, Homo sapiens
ggagaaugcuggguuuaug

SEQ ID NO: 1400851 - RNA, 19 nt, Homo sapiens
caauaacuguugaucagaa

SEQ ID NO: 1400852 - RNA, 19 nt, Homo sapiens
ggaaggagaaggaaauuca

SEQ ID NO: 1400853 - RNA, 19 nt, Homo sapiens
caaauagcaugguagaauc

SEQ ID NO: 1400854 - RNA, 19 nt, Homo sapiens
gaagaugaacagagaaaga

SEQ ID NO: 1400855 - RNA, 19 nt, Homo sapiens
uaaauauucugccuacugu

SEQ ID NO: 1400856 - RNA, 19 nt, Homo sapiens
gaaauucagugggagacaa

SEQ ID NO: 1400857 - RNA, 19 nt, Homo sapiens
cagaauuacugccgagauu

SEQ ID NO: 1400858 - RNA, 19 nt, Homo sapiens
cacagcagcucgggaaaua

SEQ ID NO: 1400859 - RNA, 19 nt, Homo sapiens
ggaauggugugauguaugc

SEQ ID NO: 1400860 - RNA, 19 nt, Homo sapiens
gaaggucuauccucacagu

SEQ ID NO: 1400861 - RNA, 19 nt, Homo sapiens
ggaaggaaaggaucaguug

SEQ ID NO: 1400862 - RNA, 19 nt, Homo sapiens
gaaguggauccaugccuua

SEQ ID NO: 1400863 - RNA, 19 nt, Homo sapiens
gauggagaaugcuggguuu

SEQ ID NO: 1400864 - RNA, 19 nt, Homo sapiens
gaugucacuuucaacuuaa

SEQ ID NO: 1400865 - RNA, 19 nt, Homo sapiens
gcacaagagcguuaucaug

SEQ ID NO: 1400866 - RNA, 19 nt, Homo sapiens
gaacagagaaagaaaauug

SEQ ID NO: 1400867 - RNA, 19 nt, Homo sapiens
caaaguuuauaccugauga

SEQ ID NO: 1400868 - RNA, 19 nt, Homo sapiens
accaagaaguugccuauaa

SEQ ID NO: 1400869 - RNA, 19 nt, Homo sapiens
ucaaagagacaacaaauag

SEQ ID NO: 1400870 - RNA, 19 nt, Homo sapiens
agacaagguuauuucauga

SEQ ID NO: 1400871 - RNA, 19 nt, Homo sapiens
gaagagaacacagaacuag

SEQ ID NO: 1400872 - RNA, 19 nt, Homo sapiens
gaggagcugugauugguau

SEQ ID NO: 1400873 - RNA, 19 nt, Homo sapiens
ggucuuaccuacaauaacu

SEQ ID NO: 1400874 - RNA, 19 nt, Homo sapiens
guacugcuguuaagauaca

SEQ ID NO: 1400875 - RNA, 19 nt, Homo sapiens
aauaucaucuuccacacua

SEQ ID NO: 1400876 - RNA, 19 nt, Homo sapiens
gaggagaaugcaauauuaa

SEQ ID NO: 1400877 - RNA, 19 nt, Homo sapiens
gugaacuugucuccaaaua

SEQ ID NO: 1400878 - RNA, 19 nt, Homo sapiens
gaaaggaaggagaaggaaa

SEQ ID NO: 1400879 - RNA, 19 nt, Homo sapiens
gaugcaauauaucaaccua

SEQ ID NO: 1400880 - RNA, 19 nt, Homo sapiens
gggagaaaccuguucauuc

SEQ ID NO: 1400881 - RNA, 19 nt, Homo sapiens
gaucagaacgaguaugaau

SEQ ID NO: 1400882 - RNA, 19 nt, Homo sapiens
gcaaauggacuaacgugau

SEQ ID NO: 1400883 - RNA, 19 nt, Homo sapiens
ucccguagaugcaauauau

SEQ ID NO: 1400884 - RNA, 19 nt, Homo sapiens
caacaaauagcaugguaga

SEQ ID NO: 1400885 - RNA, 19 nt, Homo sapiens
gaugaugucuucuccuuuu

SEQ ID NO: 1400886 - RNA, 19 nt, Homo sapiens
gcagggcugugucucaugu

SEQ ID NO: 1400887 - RNA, 19 nt, Homo sapiens
gacauacucuccagcuuca

SEQ ID NO: 1400888 - RNA, 19 nt, Homo sapiens
uaguacugcuguuaagaua

SEQ ID NO: 1400889 - RNA, 19 nt, Homo sapiens
ugaggaaguuggaagauca

SEQ ID NO: 1400890 - RNA, 19 nt, Homo sapiens
cuuaaggcuucauaaagua

SEQ ID NO: 1400891 - RNA, 19 nt, Homo sapiens
cagaugaugucuucuccuu

SEQ ID NO: 1400892 - RNA, 19 nt, Homo sapiens
ggaagaugcaaaguuuaua

SEQ ID NO: 1400893 - RNA, 19 nt, Homo sapiens
ggaauuaggaggagaaugc

SEQ ID NO: 1400894 - RNA, 19 nt, Homo sapiens
gagaaaggaaggagaagga

SEQ ID NO: 1400895 - RNA, 19 nt, Homo sapiens
agaagaaagugaggaaguu

SEQ ID NO: 1400896 - RNA, 19 nt, Homo sapiens
gcaagaagcacagaauuac

SEQ ID NO: 1400897 - RNA, 19 nt, Homo sapiens
gagaacacagaacuaguuu

SEQ ID NO: 1400898 - RNA, 19 nt, Homo sapiens
caacguuuauucuugaaag

SEQ ID NO: 1400899 - RNA, 19 nt, Homo sapiens
cauauaaucucgggauaca

SEQ ID NO: 1400900 - RNA, 19 nt, Homo sapiens
gaugaaccauuacugaaac

SEQ ID NO: 1400901 - RNA, 19 nt, Homo sapiens
gagaaugcuggguuuauga

SEQ ID NO: 1400902 - RNA, 19 nt, Homo sapiens
gaacauuacauucucacau

SEQ ID NO: 1400903 - RNA, 19 nt, Homo sapiens
gaugaacauuacauucuca

SEQ ID NO: 1400904 - RNA, 19 nt, Homo sapiens
gagcagguuucccaucauc

SEQ ID NO: 1400905 - RNA, 19 nt, Homo sapiens
agaacuaguuucagaagga

SEQ ID NO: 1400906 - RNA, 19 nt, Homo sapiens
gauccaugccuuagaagaa

SEQ ID NO: 1400907 - RNA, 19 nt, Homo sapiens
gaggagcacaagagcguua

SEQ ID NO: 1400908 - RNA, 19 nt, Homo sapiens
ucacuuaauucuuccuugu

SEQ ID NO: 1400909 - RNA, 19 nt, Homo sapiens
guggauccaugccuuagaa

SEQ ID NO: 1400910 - RNA, 19 nt, Homo sapiens
gaagaaagugaggaaguug

SEQ ID NO: 1400911 - RNA, 19 nt, Homo sapiens
cagcagugaagaugaauuu

SEQ ID NO: 1400912 - RNA, 19 nt, Homo sapiens
acacacacacacauauaua

SEQ ID NO: 1400913 - RNA, 19 nt, Homo sapiens
cacaauaacuguugaucag

SEQ ID NO: 1400914 - RNA, 19 nt, Homo sapiens
ccaaacaccacacguugaa

SEQ ID NO: 1400915 - RNA, 19 nt, Homo sapiens
gagcauuagugaccagaag

SEQ ID NO: 1400916 - RNA, 19 nt, Homo sapiens
guaguucuuccaacguuua

SEQ ID NO: 1400917 - RNA, 19 nt, Homo sapiens
gagcugugauugguauaga

SEQ ID NO: 1400918 - RNA, 19 nt, Homo sapiens
ggagagauguuuaaacuga

SEQ ID NO: 1400919 - RNA, 19 nt, Homo sapiens
ggaauggaaugguacuuua

SEQ ID NO: 1400920 - RNA, 19 nt, Homo sapiens
gcaggaagcuguuaaagau

SEQ ID NO: 1400921 - RNA, 19 nt, Homo sapiens
caagaaagauaagcaagua

SEQ ID NO: 1400922 - RNA, 19 nt, Homo sapiens
cauaacgccugcauaaaua

SEQ ID NO: 1400923 - RNA, 19 nt, Homo sapiens
gugcagagcuuuccaguau

SEQ ID NO: 1400924 - RNA, 19 nt, Homo sapiens
gcauaaauauuccaugguu

SEQ ID NO: 1400925 - RNA, 19 nt, Homo sapiens
gaucagaccucuugagaag

SEQ ID NO: 1400926 - RNA, 19 nt, Homo sapiens
gagaauuuccuguggauua

SEQ ID NO: 1400927 - RNA, 19 nt, Homo sapiens
ggaaaugaauucuaagagu

SEQ ID NO: 1400928 - RNA, 19 nt, Homo sapiens
ggagugacgugcagagauu

SEQ ID NO: 1400929 - RNA, 19 nt, Homo sapiens
cauggaagcccaaauauuu

SEQ ID NO: 1400930 - RNA, 19 nt, Homo sapiens
ggagauguaugcagauuuc

SEQ ID NO: 1400931 - RNA, 19 nt, Homo sapiens
caacauaaccugggcaauu

SEQ ID NO: 1400932 - RNA, 19 nt, Homo sapiens
guagaaguaugggugguua

SEQ ID NO: 1400933 - RNA, 19 nt, Homo sapiens
gaaugguacuuuagaguuc

SEQ ID NO: 1400934 - RNA, 19 nt, Homo sapiens
ucacagcgcuagucauuca

SEQ ID NO: 1400935 - RNA, 19 nt, Homo sapiens
gcagagcuuuccaguauag

SEQ ID NO: 1400936 - RNA, 19 nt, Homo sapiens
gaggaucagcguaguauaa

SEQ ID NO: 1400937 - RNA, 19 nt, Homo sapiens
gaccaguuguucacacuuu

SEQ ID NO: 1400938 - RNA, 19 nt, Homo sapiens
guaaacaucugaguaugau

SEQ ID NO: 1400939 - RNA, 19 nt, Homo sapiens
cagccucaaucuuguauuu

SEQ ID NO: 1400940 - RNA, 19 nt, Homo sapiens
gaugagagagagagaaauu

SEQ ID NO: 1400941 - RNA, 19 nt, Homo sapiens
gggagaaaguggcucauuc

SEQ ID NO: 1400942 - RNA, 19 nt, Homo sapiens
guacucagcgacagugaua

SEQ ID NO: 1400943 - RNA, 19 nt, Homo sapiens
gggagugccucaacuuguu

SEQ ID NO: 1400944 - RNA, 19 nt, Homo sapiens
caagaaagcacugugacua

SEQ ID NO: 1400945 - RNA, 19 nt, Homo sapiens
ccaaauaccacauggaaau

SEQ ID NO: 1400946 - RNA, 19 nt, Homo sapiens
gagagagagagaaauuaua

SEQ ID NO: 1400947 - RNA, 19 nt, Homo sapiens
ggaaugguacuuuagaguu

SEQ ID NO: 1400948 - RNA, 19 nt, Homo sapiens
gggaaaguccacaggguua

SEQ ID NO: 1400949 - RNA, 19 nt, Homo sapiens
augcuucucuguaguaaua

SEQ ID NO: 1400950 - RNA, 19 nt, Homo sapiens
ggucacagcgcuagucauu

SEQ ID NO: 1400951 - RNA, 19 nt, Homo sapiens
gaaugcuucucuguaguaa

SEQ ID NO: 1400952 - RNA, 19 nt, Homo sapiens
ucacaaagauauucucacu

SEQ ID NO: 1400953 - RNA, 19 nt, Homo sapiens
caucauaggcgagacauuu

SEQ ID NO: 1400954 - RNA, 19 nt, Homo sapiens
ucagagagaugaugaacca

SEQ ID NO: 1400955 - RNA, 19 nt, Homo sapiens
gcuaauggagagauguuua

SEQ ID NO: 1400956 - RNA, 19 nt, Homo sapiens
ucaaucauauggagacuuc

SEQ ID NO: 1400957 - RNA, 19 nt, Homo sapiens
aggaagcuguuaaagauuu

SEQ ID NO: 1400958 - RNA, 19 nt, Homo sapiens
gagagucauuugcuucguu

SEQ ID NO: 1400959 - RNA, 19 nt, Homo sapiens
gaauggauuugaccaaggu

SEQ ID NO: 1400960 - RNA, 19 nt, Homo sapiens
aacauaaccugggcaauuu

SEQ ID NO: 1400961 - RNA, 19 nt, Homo sapiens
gcagaacagguacuucgua

SEQ ID NO: 1400962 - RNA, 19 nt, Homo sapiens
gaaggaagagaaggcauuu

SEQ ID NO: 1400963 - RNA, 19 nt, Homo sapiens
caugaaugcuucucuguag

SEQ ID NO: 1400964 - RNA, 19 nt, Homo sapiens
auacauaacgccugcauaa

SEQ ID NO: 1400965 - RNA, 19 nt, Homo sapiens
agaaagcacugugacuaaa

SEQ ID NO: 1400966 - RNA, 19 nt, Homo sapiens
uuagucaacuccugucaaa

SEQ ID NO: 1400967 - RNA, 19 nt, Homo sapiens
uaaaguggguaaucauaag

SEQ ID NO: 1400968 - RNA, 19 nt, Homo sapiens
cgucaacacucauguaugg

SEQ ID NO: 1400969 - RNA, 19 nt, Homo sapiens
gaagucagagagaugauga

SEQ ID NO: 1400970 - RNA, 19 nt, Homo sapiens
guucacacuuuguagauau

SEQ ID NO: 1400971 - RNA, 19 nt, Homo sapiens
caagaaaugaugagagaga

SEQ ID NO: 1400972 - RNA, 19 nt, Homo sapiens
gaucagcguaguauaauuc

SEQ ID NO: 1400973 - RNA, 19 nt, Homo sapiens
aaacucugcugaagacgaa

SEQ ID NO: 1400974 - RNA, 19 nt, Homo sapiens
gcuucgagcuugugccaaa

SEQ ID NO: 1400975 - RNA, 19 nt, Homo sapiens
acacgaagccuuucuaugg

SEQ ID NO: 1400976 - RNA, 19 nt, Homo sapiens
ggaucagcguaguauaauu

SEQ ID NO: 1400977 - RNA, 19 nt, Homo sapiens
ccacauggaacacccaauu

SEQ ID NO: 1400978 - RNA, 19 nt, Homo sapiens
gcucauuccugguagaagu

SEQ ID NO: 1400979 - RNA, 19 nt, Homo sapiens
gguguacucugcuaaugga

SEQ ID NO: 1400980 - RNA, 19 nt, Homo sapiens
guuaaaguggguaaucaua

SEQ ID NO: 1400981 - RNA, 19 nt, Homo sapiens
ccacaggguuaccgcagaa

SEQ ID NO: 1400982 - RNA, 19 nt, Homo sapiens
gcagggacacgaaggaaga

SEQ ID NO: 1400983 - RNA, 19 nt, Homo sapiens
ggagugccucaacuuguua

SEQ ID NO: 1400984 - RNA, 19 nt, Homo sapiens
gagccaagagucaguauuc

SEQ ID NO: 1400985 - RNA, 19 nt, Homo sapiens
gucuuuaucuggagccaua

SEQ ID NO: 1400986 - RNA, 19 nt, Homo sapiens
gggaaagagaagagaauuu

SEQ ID NO: 1400987 - RNA, 19 nt, Homo sapiens
caccauggaagcccaaaua

SEQ ID NO: 1400988 - RNA, 19 nt, Homo sapiens
caacaauggagaaaccaaa

SEQ ID NO: 1400989 - RNA, 19 nt, Homo sapiens
gaagagccaagagucagua

SEQ ID NO: 1400990 - RNA, 19 nt, Homo sapiens
gaguucaccuacaacaaug

SEQ ID NO: 1400991 - RNA, 19 nt, Homo sapiens
ccgcagaagugaagcacaa

SEQ ID NO: 1400992 - RNA, 19 nt, Homo sapiens
gugcagagauucccuuucg

SEQ ID NO: 1400993 - RNA, 19 nt, Homo sapiens
uccaagaaaugaugagaga

SEQ ID NO: 1400994 - RNA, 19 nt, Homo sapiens
caagugcaccucucugguu

SEQ ID NO: 1400995 - RNA, 19 nt, Homo sapiens
gcuagaggaaugaauuuau

SEQ ID NO: 1400996 - RNA, 19 nt, Homo sapiens
ggaaugcgugggugacuug

SEQ ID NO: 1400997 - RNA, 19 nt, Homo sapiens
ugaaugcuucucuguagua

SEQ ID NO: 1400998 - RNA, 19 nt, Homo sapiens
aagugcaccucucugguua

SEQ ID NO: 1400999 - RNA, 19 nt, Homo sapiens
gggaauggaaugguacuuu

SEQ ID NO: 1401000 - RNA, 19 nt, Homo sapiens
gcacaaccacagccucaau

SEQ ID NO: 1401001 - RNA, 19 nt, Homo sapiens
ggguggagcucggaggaaa

SEQ ID NO: 1401002 - RNA, 19 nt, Homo sapiens
acauaacgccugcauaaau

SEQ ID NO: 1401003 - RNA, 19 nt, Homo sapiens
gcacugugacuaaaacaua

SEQ ID NO: 1401004 - RNA, 19 nt, Homo sapiens
aagaaagcacugugacuaa

SEQ ID NO: 1401005 - RNA, 19 nt, Homo sapiens
caaagauauucucacuuag

SEQ ID NO: 1401006 - RNA, 19 nt, Homo sapiens
ugagagagagagaaauuau

SEQ ID NO: 1401007 - RNA, 19 nt, Homo sapiens
ucagaccucuugagaagca

SEQ ID NO: 1401008 - RNA, 19 nt, Homo sapiens
uccaaaagcuacaaacuaa

SEQ ID NO: 1401009 - RNA, 19 nt, Homo sapiens
caucucauuucacaacuca

SEQ ID NO: 1401010 - RNA, 19 nt, Homo sapiens
gcagaucggccuccuagag

SEQ ID NO: 1401011 - RNA, 19 nt, Homo sapiens
gcaaagcaaacaccagaag

SEQ ID NO: 1401012 - RNA, 19 nt, Homo sapiens
ggcaggaagcuguuaaaga

SEQ ID NO: 1401013 - RNA, 19 nt, Homo sapiens
cacgaagccuuucuaugga

SEQ ID NO: 1401014 - RNA, 19 nt, Homo sapiens
cagcgcuagucauucauuu

SEQ ID NO: 1401015 - RNA, 19 nt, Homo sapiens
gauauucucacuuagucaa

SEQ ID NO: 1401016 - RNA, 19 nt, Homo sapiens
ccaagucacauuccacaga

SEQ ID NO: 1401017 - RNA, 19 nt, Homo sapiens
gaaaauacaaagcaaggaa

SEQ ID NO: 1401018 - RNA, 19 nt, Homo sapiens
ggaaauguaugcagacuuu

SEQ ID NO: 1401019 - RNA, 19 nt, Homo sapiens
ggagaaagaugacccagaa

SEQ ID NO: 1401020 - RNA, 19 nt, Homo sapiens
gaaacuagcuaaaccugaa

SEQ ID NO: 1401021 - RNA, 19 nt, Homo sapiens
gagggagccugaagaaaua

SEQ ID NO: 1401022 - RNA, 19 nt, Homo sapiens
gaacuaaggcauuaaagaa

SEQ ID NO: 1401023 - RNA, 19 nt, Homo sapiens
cugaggaacuuaccuauua

SEQ ID NO: 1401024 - RNA, 19 nt, Homo sapiens
ucacggagcuucucacuug

SEQ ID NO: 1401025 - RNA, 19 nt, Homo sapiens
gaaccaguguccacaauga

SEQ ID NO: 1401026 - RNA, 19 nt, Homo sapiens
cuacagaacuacagaauug

SEQ ID NO: 1401027 - RNA, 19 nt, Homo sapiens
gagagaaucugaaauugau

SEQ ID NO: 1401028 - RNA, 19 nt, Homo sapiens
gaacgacaaucgagugguu

SEQ ID NO: 1401029 - RNA, 19 nt, Homo sapiens
ggaauaguguucuugaguu

SEQ ID NO: 1401030 - RNA, 19 nt, Homo sapiens
ggagagagauacaugugaa

SEQ ID NO: 1401031 - RNA, 19 nt, Homo sapiens
gcgcaugucuggacuaaga

SEQ ID NO: 1401032 - RNA, 19 nt, Homo sapiens
ggaccaggaucucuuaaug

SEQ ID NO: 1401033 - RNA, 19 nt, Homo sapiens
gggcauggauuuaacaaga

SEQ ID NO: 1401034 - RNA, 19 nt, Homo sapiens
guccauaacugaaguauuc

SEQ ID NO: 1401035 - RNA, 19 nt, Homo sapiens
gaagcaggauccauuugaa

SEQ ID NO: 1401036 - RNA, 19 nt, Homo sapiens
ucacuugcaucuaguagua

SEQ ID NO: 1401037 - RNA, 19 nt, Homo sapiens
guacacagcaucauacuga

SEQ ID NO: 1401038 - RNA, 19 nt, Homo sapiens
ggaacaauauaaacucaga

SEQ ID NO: 1401039 - RNA, 19 nt, Homo sapiens
guacagugaucacauggaa

SEQ ID NO: 1401040 - RNA, 19 nt, Homo sapiens
uaacugaacgcgcauguaa

SEQ ID NO: 1401041 - RNA, 19 nt, Homo sapiens
guaacaaggcauucuauuu

SEQ ID NO: 1401042 - RNA, 19 nt, Homo sapiens
aaaugcagaugaugagaua

SEQ ID NO: 1401043 - RNA, 19 nt, Homo sapiens
guucuugaguucacauaua

SEQ ID NO: 1401044 - RNA, 19 nt, Homo sapiens
caaagagacuuaauuagac

SEQ ID NO: 1401045 - RNA, 19 nt, Homo sapiens
ucucacaccuucacuguaa

SEQ ID NO: 1401046 - RNA, 19 nt, Homo sapiens
gaacgcgcauguaagguau

SEQ ID NO: 1401047 - RNA, 19 nt, Homo sapiens
ggagauggcuggguuuauc

SEQ ID NO: 1401048 - RNA, 19 nt, Homo sapiens
gagguagcauccaguguuu

SEQ ID NO: 1401049 - RNA, 19 nt, Homo sapiens
caaugaagcugggcuguug

SEQ ID NO: 1401050 - RNA, 19 nt, Homo sapiens
gcugugaaaugcacugaaa

SEQ ID NO: 1401051 - RNA, 19 nt, Homo sapiens
uaacaaggcauucuauuuc

SEQ ID NO: 1401052 - RNA, 19 nt, Homo sapiens
guguauggcuauuuaauga

SEQ ID NO: 1401053 - RNA, 19 nt, Homo sapiens
gaaaggagagagauacaug

SEQ ID NO: 1401054 - RNA, 19 nt, Homo sapiens
ccugggagcuguagaagaa

SEQ ID NO: 1401055 - RNA, 19 nt, Homo sapiens
gcaauggagagacaaagua

SEQ ID NO: 1401056 - RNA, 19 nt, Homo sapiens
gaauaguguucuugaguuc

SEQ ID NO: 1401057 - RNA, 19 nt, Homo sapiens
ucacaaaucaugcuccuuu

SEQ ID NO: 1401058 - RNA, 19 nt, Homo sapiens
cgaauugaaugccuuccua

SEQ ID NO: 1401059 - RNA, 19 nt, Homo sapiens
gcaguacagugaucacaug

SEQ ID NO: 1401060 - RNA, 19 nt, Homo sapiens
gaagaaaggcaucguacug

SEQ ID NO: 1401061 - RNA, 19 nt, Homo sapiens
gcugagagaaucugaaauu

SEQ ID NO: 1401062 - RNA, 19 nt, Homo sapiens
gaagaacaacguaguguca

SEQ ID NO: 1401063 - RNA, 19 nt, Homo sapiens
gaaaggcaucguacugaaa

SEQ ID NO: 1401064 - RNA, 19 nt, Homo sapiens
acuaugaacugcuuaaaug

SEQ ID NO: 1401065 - RNA, 19 nt, Homo sapiens
gaauaauccuccucugaag

SEQ ID NO: 1401066 - RNA, 19 nt, Homo sapiens
aagcugggcuguuggagua

SEQ ID NO: 1401067 - RNA, 19 nt, Homo sapiens
uuucagaguuugugucuuu

SEQ ID NO: 1401068 - RNA, 19 nt, Homo sapiens
gagaggaagauguguguaa

SEQ ID NO: 1401069 - RNA, 19 nt, Homo sapiens
guacuaccuuaccucauuu

SEQ ID NO: 1401070 - RNA, 19 nt, Homo sapiens
aaagucaccuacagaacua

SEQ ID NO: 1401071 - RNA, 19 nt, Homo sapiens
ggcauucuauuucuucaaa

SEQ ID NO: 1401072 - RNA, 19 nt, Homo sapiens
ggaauggaauaguguucuu

SEQ ID NO: 1401073 - RNA, 19 nt, Homo sapiens
ugcaggagcuguaauauca

SEQ ID NO: 1401074 - RNA, 19 nt, Homo sapiens
caauauaaacucagagcua

SEQ ID NO: 1401075 - RNA, 19 nt, Homo sapiens
ugaaugaacagucuagaaa

SEQ ID NO: 1401076 - RNA, 19 nt, Homo sapiens
gaaagaugacccagaagug

SEQ ID NO: 1401077 - RNA, 19 nt, Homo sapiens
ggagaagcaggauccauuu

SEQ ID NO: 1401078 - RNA, 19 nt, Homo sapiens
gaaguaaagcacaacauca

SEQ ID NO: 1401079 - RNA, 19 nt, Homo sapiens
gaguggugcuuccuacauu

SEQ ID NO: 1401080 - RNA, 19 nt, Homo sapiens
ccacagagcauaagcauac

SEQ ID NO: 1401081 - RNA, 19 nt, Homo sapiens
uaccuuaccucauuucaug

SEQ ID NO: 1401082 - RNA, 19 nt, Homo sapiens
gaaguggauucagccauug

SEQ ID NO: 1401083 - RNA, 19 nt, Homo sapiens
agaaguggauucagccauu

SEQ ID NO: 1401084 - RNA, 19 nt, Homo sapiens
gcagauacacacaacaaug

SEQ ID NO: 1401085 - RNA, 19 nt, Homo sapiens
ccaaagugguaaagaaaca

SEQ ID NO: 1401086 - RNA, 19 nt, Homo sapiens
gcauaugcucggucaauuu

SEQ ID NO: 1401087 - RNA, 19 nt, Homo sapiens
cacaaaucaugcuccuuua

SEQ ID NO: 1401088 - RNA, 19 nt, Homo sapiens
cagcaugcaucacaucaga

SEQ ID NO: 1401089 - RNA, 19 nt, Homo sapiens
gguaucauauucagaucaa

SEQ ID NO: 1401090 - RNA, 19 nt, Homo sapiens
gaacucagugacuuugauu

SEQ ID NO: 1401091 - RNA, 19 nt, Homo sapiens
uauguggacuugacuaaau

SEQ ID NO: 1401092 - RNA, 19 nt, Homo sapiens
guacagagaggaagaugug

SEQ ID NO: 1401093 - RNA, 19 nt, Homo sapiens
gagcagguuucucaucauc

SEQ ID NO: 1401094 - RNA, 19 nt, Homo sapiens
uaagggagccauugcuaaa

SEQ ID NO: 1401095 - RNA, 19 nt, Homo sapiens
cagaggagaccaagucaaa

SEQ ID NO: 1401096 - RNA, 19 nt, Homo sapiens
gaaacaggcacaccuugga

SEQ ID NO: 1401097 - RNA, 19 nt, Homo sapiens
gcauaagcauacccuggaa

SEQ ID NO: 1401098 - RNA, 19 nt, Homo sapiens
cgagggagccugaagaaau

SEQ ID NO: 1401099 - RNA, 19 nt, Homo sapiens
uggaguacuuugugaauga

SEQ ID NO: 1401100 - RNA, 19 nt, Homo sapiens
gauauggucuuccaaucag

SEQ ID NO: 1401101 - RNA, 19 nt, Homo sapiens
ucacuacucuuguaaacca

SEQ ID NO: 1401102 - RNA, 19 nt, Homo sapiens
ugugagcaauaccaucuua

SEQ ID NO: 1401103 - RNA, 19 nt, Homo sapiens
cuacuagggcaccauaaua

SEQ ID NO: 1401104 - RNA, 19 nt, Homo sapiens
cuacauuuauccuagagaa

SEQ ID NO: 1401105 - RNA, 19 nt, Homo sapiens
cuacuuccauggcaacuau

SEQ ID NO: 1401106 - RNA, 19 nt, Homo sapiens
gcacuggguuagcagacuu

SEQ ID NO: 1401107 - RNA, 19 nt, Homo sapiens
gcaaaaggcuggcaguaca

SEQ ID NO: 1401108 - RNA, 19 nt, Homo sapiens
uuaaagagguuaguaggau

SEQ ID NO: 1401109 - RNA, 19 nt, Homo sapiens
uaagcuuugugcucugaua

SEQ ID NO: 1401110 - RNA, 19 nt, Homo sapiens
cugcuuaaaugacugcuuu

SEQ ID NO: 1401111 - RNA, 19 nt, Homo sapiens
ggacaacaaagagacuuaa

SEQ ID NO: 1401112 - RNA, 19 nt, Homo sapiens
cuaaagaaacaacgaaaug

SEQ ID NO: 1401113 - RNA, 19 nt, Homo sapiens
cuccagaacuaaggcauua

SEQ ID NO: 1401114 - RNA, 19 nt, Homo sapiens
aaagugaagucuccguuuc

SEQ ID NO: 1401115 - RNA, 19 nt, Homo sapiens
cagauacacacaacaauga

SEQ ID NO: 1401116 - RNA, 19 nt, Homo sapiens
ccauaauacugcagcaaga

SEQ ID NO: 1401117 - RNA, 19 nt, Homo sapiens
gauaaggccacagagcaua

SEQ ID NO: 1401118 - RNA, 19 nt, Homo sapiens
caacaucacuaucuugaaa

SEQ ID NO: 1401119 - RNA, 19 nt, Homo sapiens
gaaacuaccucuggcuuaa

SEQ ID NO: 1401120 - RNA, 19 nt, Homo sapiens
aagagaagauccaaaguua

SEQ ID NO: 1401121 - RNA, 19 nt, Homo sapiens
gcgaggagcuggacaccua

SEQ ID NO: 1401122 - RNA, 19 nt, Homo sapiens
gagaagauccaaaguuaaa

SEQ ID NO: 1401123 - RNA, 19 nt, Homo sapiens
ggaacuuucuugagggaua

SEQ ID NO: 1401124 - RNA, 19 nt, Homo sapiens
cgagagggcugaagaacaa

SEQ ID NO: 1401125 - RNA, 19 nt, Homo sapiens
cuaagucccucucuuuaaa

SEQ ID NO: 1401126 - RNA, 19 nt, Homo sapiens
gggcagagcuccugguaca

SEQ ID NO: 1401127 - RNA, 19 nt, Homo sapiens
ggaaacuaccucuggcuua

SEQ ID NO: 1401128 - RNA, 19 nt, Homo sapiens
gcgccacacucgcugcuua

SEQ ID NO: 1401129 - RNA, 19 nt, Homo sapiens
gaaguacacaucccaauca

SEQ ID NO: 1401130 - RNA, 19 nt, Homo sapiens
uaagagaagauccaaaguu

SEQ ID NO: 1401131 - RNA, 19 nt, Homo sapiens
gcacugcagucucccaucu

SEQ ID NO: 1401132 - RNA, 19 nt, Homo sapiens
ccgaagggcuccugacagu

SEQ ID NO: 1401133 - RNA, 19 nt, Homo sapiens
caagggcucugcuggucuu

SEQ ID NO: 1401134 - RNA, 19 nt, Homo sapiens
gaaccucuacgaccacuuc

SEQ ID NO: 1401135 - RNA, 19 nt, Homo sapiens
gcacagcaaccacuacuac

SEQ ID NO: 1401136 - RNA, 19 nt, Homo sapiens
gggccacacuggacccaaa

SEQ ID NO: 1401137 - RNA, 19 nt, Homo sapiens
ggaaguacacaucccaauc

SEQ ID NO: 1401138 - RNA, 19 nt, Homo sapiens
gagacgcccugcacacaca

SEQ ID NO: 1401139 - RNA, 19 nt, Homo sapiens
gaacuuucuugagggauag

SEQ ID NO: 1401140 - RNA, 19 nt, Homo sapiens
ccacguaggaacuuucuug

SEQ ID NO: 1401141 - RNA, 19 nt, Homo sapiens
gaucaacaucacuaucuug

SEQ ID NO: 1401142 - RNA, 19 nt, Homo sapiens
gcacacacagaaagccaaa

SEQ ID NO: 1401143 - RNA, 19 nt, Homo sapiens
ggaaccagaaggagaccua

SEQ ID NO: 1401144 - RNA, 19 nt, Homo sapiens
ccuaagucccucucuuuaa

SEQ ID NO: 1401145 - RNA, 19 nt, Homo sapiens
gagcuggacaccuacauca

SEQ ID NO: 1401146 - RNA, 19 nt, Homo sapiens
caguugagacucugcuuaa

SEQ ID NO: 1401147 - RNA, 19 nt, Homo sapiens
ccaggccucugaccaguag

SEQ ID NO: 1401148 - RNA, 19 nt, Homo sapiens
gcugaagaacaacaugaaa

SEQ ID NO: 1401149 - RNA, 19 nt, Homo sapiens
ccacguguguuguguuggu

SEQ ID NO: 1401150 - RNA, 19 nt, Homo sapiens
gcagagcuccugguacauc

SEQ ID NO: 1401151 - RNA, 19 nt, Homo sapiens
gcuuuggcauucagugaga

SEQ ID NO: 1401152 - RNA, 19 nt, Homo sapiens
gcaaagccagagccugaug

SEQ ID NO: 1401153 - RNA, 19 nt, Homo sapiens
agaccuaccugcacaucau

SEQ ID NO: 1401154 - RNA, 19 nt, Homo sapiens
gagcaggguugcggugucu

SEQ ID NO: 1401155 - RNA, 19 nt, Homo sapiens
agaccagagucaagaggaa

SEQ ID NO: 1401156 - RNA, 19 nt, Homo sapiens
guugagacucugcuuaaga

SEQ ID NO: 1401157 - RNA, 19 nt, Homo sapiens
ucaguugagacucugcuua

SEQ ID NO: 1401158 - RNA, 19 nt, Homo sapiens
gagcugacggcagaugaaa

SEQ ID NO: 1401159 - RNA, 19 nt, Homo sapiens
caugcggccuccuuguuug

SEQ ID NO: 1401160 - RNA, 19 nt, Homo sapiens
gggcugaagaacaacauga

SEQ ID NO: 1401161 - RNA, 19 nt, Homo sapiens
aggaggagguggugaucuu

SEQ ID NO: 1401162 - RNA, 19 nt, Homo sapiens
ucaugcggccuccuuguuu

SEQ ID NO: 1401163 - RNA, 19 nt, Homo sapiens
gggcucugcuggucuuucu

SEQ ID NO: 1401164 - RNA, 19 nt, Homo sapiens
aacuaccucuggcuuaauu

SEQ ID NO: 1401165 - RNA, 19 nt, Homo sapiens
gagagaggccuuuucaguu

SEQ ID NO: 1401166 - RNA, 19 nt, Homo sapiens
ccugcuggcucccaagaga

SEQ ID NO: 1401167 - RNA, 19 nt, Homo sapiens
cugcacacauccucaagug

SEQ ID NO: 1401168 - RNA, 19 nt, Homo sapiens
ccaagggaaauauggcaaa

SEQ ID NO: 1401169 - RNA, 19 nt, Homo sapiens
agacucugaucuccaggaa

SEQ ID NO: 1401170 - RNA, 19 nt, Homo sapiens
cugcagauguuucuaugag

SEQ ID NO: 1401171 - RNA, 19 nt, Homo sapiens
gcucugcuggucuuucuga

SEQ ID NO: 1401172 - RNA, 19 nt, Homo sapiens
uaagccacguaggaacuuu

SEQ ID NO: 1401173 - RNA, 19 nt, Homo sapiens
agagaagauccaaaguuaa

SEQ ID NO: 1401174 - RNA, 19 nt, Homo sapiens
agagaggccuuuucaguug

SEQ ID NO: 1401175 - RNA, 19 nt, Homo sapiens
gcugacggcagaugaaauc

SEQ ID NO: 1401176 - RNA, 19 nt, Homo sapiens
gagagcugacggcagauga

SEQ ID NO: 1401177 - RNA, 19 nt, Homo sapiens
guggcuaccuggucaagca

SEQ ID NO: 1401178 - RNA, 19 nt, Homo sapiens
ccggcaaguucuacugcua

SEQ ID NO: 1401179 - RNA, 19 nt, Homo sapiens
gaagauccaaaguuaaagc

SEQ ID NO: 1401180 - RNA, 19 nt, Homo sapiens
gaagggugaccgcggagau

SEQ ID NO: 1401181 - RNA, 19 nt, Homo sapiens
uacgaccacuucaacaugu

SEQ ID NO: 1401182 - RNA, 19 nt, Homo sapiens
gaauuguguuuucagcaaa

SEQ ID NO: 1401183 - RNA, 19 nt, Homo sapiens
ggcccucucugcacacauc

SEQ ID NO: 1401184 - RNA, 19 nt, Homo sapiens
ccagaaaacauuaaacuca

SEQ ID NO: 1401185 - RNA, 19 nt, Homo sapiens
cccuaagucccucucuuua

SEQ ID NO: 1401186 - RNA, 19 nt, Homo sapiens
gaucuggggucccuaaguc

SEQ ID NO: 1401187 - RNA, 19 nt, Homo sapiens
gccugcagauguuucuaug

SEQ ID NO: 1401188 - RNA, 19 nt, Homo sapiens
aguaaaccguggaggacaa

SEQ ID NO: 1401189 - RNA, 19 nt, Homo sapiens
cauguucaccggcaaguuc

SEQ ID NO: 1401190 - RNA, 19 nt, Homo sapiens
ucaagaggaaguacacauc

SEQ ID NO: 1401191 - RNA, 19 nt, Homo sapiens
accucuggcuuaauucuuu

SEQ ID NO: 1401192 - RNA, 19 nt, Homo sapiens
cuacgaccacuucaacaug

SEQ ID NO: 1401193 - RNA, 19 nt, Homo sapiens
ggaagcagagcgccacacu

SEQ ID NO: 1401194 - RNA, 19 nt, Homo sapiens
ucccuaagucccucucuuu

SEQ ID NO: 1401195 - RNA, 19 nt, Homo sapiens
caagggaaauauggcaaaa

SEQ ID NO: 1401196 - RNA, 19 nt, Homo sapiens
cacacucgcugcuuaagcu

SEQ ID NO: 1401197 - RNA, 19 nt, Homo sapiens
caagagagaggccuuuuca

SEQ ID NO: 1401198 - RNA, 19 nt, Homo sapiens
guaaaccguggaggacaaa

SEQ ID NO: 1401199 - RNA, 19 nt, Homo sapiens
gaucuucgacacggaguuc

SEQ ID NO: 1401200 - RNA, 19 nt, Homo sapiens
agaagcccaugcacagcaa

SEQ ID NO: 1401201 - RNA, 19 nt, Homo sapiens
gguggcaggagaggcaaua

SEQ ID NO: 1401202 - RNA, 19 nt, Homo sapiens
gagaggccuuuucaguuga

SEQ ID NO: 1401203 - RNA, 19 nt, Homo sapiens
ggagguggugaucuuguuc

SEQ ID NO: 1401204 - RNA, 19 nt, Homo sapiens
ggaggagguggugaucuug

SEQ ID NO: 1401205 - RNA, 19 nt, Homo sapiens
gugucaggauucacucuca

SEQ ID NO: 1401206 - RNA, 19 nt, Homo sapiens
cuuaagagaagauccaaag

SEQ ID NO: 1401207 - RNA, 19 nt, Homo sapiens
caaagaaaaggguuguuau

SEQ ID NO: 1401208 - RNA, 19 nt, Homo sapiens
ccucgugggcuaagcauca

SEQ ID NO: 1401209 - RNA, 19 nt, Homo sapiens
cgugagaacgccaucuuca

SEQ ID NO: 1401210 - RNA, 19 nt, Homo sapiens
aggagguggugaucuuguu

SEQ ID NO: 1401211 - RNA, 19 nt, Homo sapiens
gaggagguggugaucuugu

SEQ ID NO: 1401212 - RNA, 19 nt, Homo sapiens
ccaguccuuggaaauaauu

SEQ ID NO: 1401213 - RNA, 19 nt, Homo sapiens
ggagcuggacaccuacauc

SEQ ID NO: 1401214 - RNA, 19 nt, Homo sapiens
gcaaagaccuugacaggaa

SEQ ID NO: 1401215 - RNA, 19 nt, Homo sapiens
cuugagcgcuuuauuauua

SEQ ID NO: 1401216 - RNA, 19 nt, Homo sapiens
gggaagagguggaaauuug

SEQ ID NO: 1401217 - RNA, 19 nt, Homo sapiens
ggaaauagagcaacacaaa

SEQ ID NO: 1401218 - RNA, 19 nt, Homo sapiens
ggaacaagcuucuggacuu

SEQ ID NO: 1401219 - RNA, 19 nt, Homo sapiens
gcacuaugcuauucucuga

SEQ ID NO: 1401220 - RNA, 19 nt, Homo sapiens
gcacagguguugccaguau

SEQ ID NO: 1401221 - RNA, 19 nt, Homo sapiens
gagaaccgcugcucugaga

SEQ ID NO: 1401222 - RNA, 19 nt, Homo sapiens
gaaaagaggucuccagcaa

SEQ ID NO: 1401223 - RNA, 19 nt, Homo sapiens
gaacgaggguggccacuac

SEQ ID NO: 1401224 - RNA, 19 nt, Homo sapiens
gaucaaagaacaagcuauu

SEQ ID NO: 1401225 - RNA, 19 nt, Homo sapiens
uggcagagcucguuccauu

SEQ ID NO: 1401226 - RNA, 19 nt, Homo sapiens
gcgugaggcuggaagauaa

SEQ ID NO: 1401227 - RNA, 19 nt, Homo sapiens
ggaagauaauacagaaugu

SEQ ID NO: 1401228 - RNA, 19 nt, Homo sapiens
gcuggaagauaauacagaa

SEQ ID NO: 1401229 - RNA, 19 nt, Homo sapiens
gagcugaguuccaaagaag

SEQ ID NO: 1401230 - RNA, 19 nt, Homo sapiens
uuaagaagcugcaguaaaa

SEQ ID NO: 1401231 - RNA, 19 nt, Homo sapiens
agacuugagcgcuuuauua

SEQ ID NO: 1401232 - RNA, 19 nt, Homo sapiens
ucaugcagcuuacauucua

SEQ ID NO: 1401233 - RNA, 19 nt, Homo sapiens
gaauggaucccacgcaaau

SEQ ID NO: 1401234 - RNA, 19 nt, Homo sapiens
gcucugagauggcaggaau

SEQ ID NO: 1401235 - RNA, 19 nt, Homo sapiens
caaagaccuugacaggaaa

SEQ ID NO: 1401236 - RNA, 19 nt, Homo sapiens
caagcagggugacgaaguu

SEQ ID NO: 1401237 - RNA, 19 nt, Homo sapiens
ccacagacuugagcgcuuu

SEQ ID NO: 1401238 - RNA, 19 nt, Homo sapiens
cacgaaggcuuaucagaau

SEQ ID NO: 1401239 - RNA, 19 nt, Homo sapiens
ccauguagaucaaagaaca

SEQ ID NO: 1401240 - RNA, 19 nt, Homo sapiens
ccaacgagguauagacaug

SEQ ID NO: 1401241 - RNA, 19 nt, Homo sapiens
ccaaccaucuauuuauuca

SEQ ID NO: 1401242 - RNA, 19 nt, Homo sapiens
ucacgaaggcuuaucagaa

SEQ ID NO: 1401243 - RNA, 19 nt, Homo sapiens
gcaaaaggcucugcaagug

SEQ ID NO: 1401244 - RNA, 19 nt, Homo sapiens
uagcaggagauacaauuua

SEQ ID NO: 1401245 - RNA, 19 nt, Homo sapiens
uaacaggcacuaugcuauu

SEQ ID NO: 1401246 - RNA, 19 nt, Homo sapiens
ggcaaaacaucgucuaaaa

SEQ ID NO: 1401247 - RNA, 19 nt, Homo sapiens
ugugguagcucaugccuau

SEQ ID NO: 1401248 - RNA, 19 nt, Homo sapiens
ccagggcccucaggaauga

SEQ ID NO: 1401249 - RNA, 19 nt, Homo sapiens
gcagagcucguuccauuca

SEQ ID NO: 1401250 - RNA, 19 nt, Homo sapiens
ucugaaaccuccauguaga

SEQ ID NO: 1401251 - RNA, 19 nt, Homo sapiens
uacagugacucuccagauu

SEQ ID NO: 1401252 - RNA, 19 nt, Homo sapiens
ggaaugaugggacgaaugg

SEQ ID NO: 1401253 - RNA, 19 nt, Homo sapiens
gucaguaccuggaaaauuu

SEQ ID NO: 1401254 - RNA, 19 nt, Homo sapiens
ucaaagaacaagcuauuuc

SEQ ID NO: 1401255 - RNA, 19 nt, Homo sapiens
ggacagacagccucuuuac

SEQ ID NO: 1401256 - RNA, 19 nt, Homo sapiens
gaagagguggaaauuuguu

SEQ ID NO: 1401257 - RNA, 19 nt, Homo sapiens
caacacaaaggccucgaaa

SEQ ID NO: 1401258 - RNA, 19 nt, Homo sapiens
gaaauagagcaacacaaag

SEQ ID NO: 1401259 - RNA, 19 nt, Homo sapiens
cccaaaagcucucuuaaga

SEQ ID NO: 1401260 - RNA, 19 nt, Homo sapiens
caaagacggccaagaugga

SEQ ID NO: 1401261 - RNA, 19 nt, Homo sapiens
ugagguggacggaucauuu

SEQ ID NO: 1401262 - RNA, 19 nt, Homo sapiens
gaaccgcugcucugagaug

SEQ ID NO: 1401263 - RNA, 19 nt, Homo sapiens
gacuugagcgcuuuauuau

SEQ ID NO: 1401264 - RNA, 19 nt, Homo sapiens
caucuugaaucugcucauu

SEQ ID NO: 1401265 - RNA, 19 nt, Homo sapiens
gauaggcggaucaucuuga

SEQ ID NO: 1401266 - RNA, 19 nt, Homo sapiens
gggccaagguaagaacuga

SEQ ID NO: 1401267 - RNA, 19 nt, Homo sapiens
ggaagagguggaaauuugu

SEQ ID NO: 1401268 - RNA, 19 nt, Homo sapiens
caacagagugagacuaucu

SEQ ID NO: 1401269 - RNA, 19 nt, Homo sapiens
ccuauaaucccaggacuuu

SEQ ID NO: 1401270 - RNA, 19 nt, Homo sapiens
aaagaggucuccagcaaaa

SEQ ID NO: 1401271 - RNA, 19 nt, Homo sapiens
guaacaggcacuaugcuau

SEQ ID NO: 1401272 - RNA, 19 nt, Homo sapiens
acaagauucugaugaacga

SEQ ID NO: 1401273 - RNA, 19 nt, Homo sapiens
ggaauggaucccacgcaaa

SEQ ID NO: 1401274 - RNA, 19 nt, Homo sapiens
agaaggaaauagagcaaca

SEQ ID NO: 1401275 - RNA, 19 nt, Homo sapiens
ugagcugaguuccaaagaa

SEQ ID NO: 1401276 - RNA, 19 nt, Homo sapiens
acuaugcuauucucugaaa

SEQ ID NO: 1401277 - RNA, 19 nt, Homo sapiens
gagguggacggaucauuug

SEQ ID NO: 1401278 - RNA, 19 nt, Homo sapiens
aaaccuccauguagaucaa

SEQ ID NO: 1401279 - RNA, 19 nt, Homo sapiens
cauccaaccaucuauuuau

SEQ ID NO: 1401280 - RNA, 19 nt, Homo sapiens
ggagguggagguugcaguu

SEQ ID NO: 1401281 - RNA, 19 nt, Homo sapiens
cuaagucaguaccuggaaa

SEQ ID NO: 1401282 - RNA, 19 nt, Homo sapiens
aacaagcuauuuccaacuu

SEQ ID NO: 1401283 - RNA, 19 nt, Homo sapiens
gaggguggccacuacaaug

SEQ ID NO: 1401284 - RNA, 19 nt, Homo sapiens
uugacaagauucugaugaa

SEQ ID NO: 1401285 - RNA, 19 nt, Homo sapiens
acgaaggcuuaucagaaua

SEQ ID NO: 1401286 - RNA, 19 nt, Homo sapiens
gaacaagcuauuuccaacu

SEQ ID NO: 1401287 - RNA, 19 nt, Homo sapiens
gaaguuuggcugcagaucu

SEQ ID NO: 1401288 - RNA, 19 nt, Homo sapiens
ggcaacagagugagacuau

SEQ ID NO: 1401289 - RNA, 19 nt, Homo sapiens
ggaaagccaggaccaaagg

SEQ ID NO: 1401290 - RNA, 19 nt, Homo sapiens
caggagauacaauuuacaa

SEQ ID NO: 1401291 - RNA, 19 nt, Homo sapiens
gaguaucuguccucaugca

SEQ ID NO: 1401292 - RNA, 19 nt, Homo sapiens
gcucuucuaugacccuuac

SEQ ID NO: 1401293 - RNA, 19 nt, Homo sapiens
gaggguaaccaccaugauc

SEQ ID NO: 1401294 - RNA, 19 nt, Homo sapiens
ucauccaaccaucuauuua

SEQ ID NO: 1401295 - RNA, 19 nt, Homo sapiens
uuacgggcuuccuaaucua

SEQ ID NO: 1401296 - RNA, 19 nt, Homo sapiens
aggcuuaucagaauacaaa

SEQ ID NO: 1401297 - RNA, 19 nt, Homo sapiens
caagcuauuuccaacuucu

SEQ ID NO: 1401298 - RNA, 19 nt, Homo sapiens
gcaacagagugagacuauc

SEQ ID NO: 1401299 - RNA, 19 nt, Homo sapiens
gagguggagguugcaguua

SEQ ID NO: 1401300 - RNA, 19 nt, Homo sapiens
cauuugaggucaggaguuc

SEQ ID NO: 1401301 - RNA, 19 nt, Homo sapiens
gaagauaauacagaauguc

SEQ ID NO: 1401302 - RNA, 19 nt, Homo sapiens
gcaguggccauaccaaguc

SEQ ID NO: 1401303 - RNA, 19 nt, Homo sapiens
acagugacucuccagauuu

SEQ ID NO: 1401304 - RNA, 19 nt, Homo sapiens
ccugggaucuacuacuuca

SEQ ID NO: 1401305 - RNA, 19 nt, Homo sapiens
cuuaagaagcugcaguaaa

SEQ ID NO: 1401306 - RNA, 19 nt, Homo sapiens
gaaggcuuaucagaauaca

SEQ ID NO: 1401307 - RNA, 19 nt, Homo sapiens
ggcgugaggcuggaagaua

SEQ ID NO: 1401308 - RNA, 19 nt, Homo sapiens
gaaaccuccauguagauca

SEQ ID NO: 1401309 - RNA, 19 nt, Homo sapiens
acaucacgcuggccaacaa

SEQ ID NO: 1401310 - RNA, 19 nt, Homo sapiens
ugagauggcaggaauggau

SEQ ID NO: 1401311 - RNA, 19 nt, Homo sapiens
aaugagauacaccaggaua

SEQ ID NO: 1401312 - RNA, 19 nt, Homo sapiens
gcaacacaaaggccucgaa

SEQ ID NO: 1401313 - RNA, 19 nt, Homo sapiens
gacaacucagugaauaauu

SEQ ID NO: 1401314 - RNA, 19 nt, Homo sapiens
cagaugaccuugacuaaua

SEQ ID NO: 1401315 - RNA, 19 nt, Homo sapiens
ggaggcagcucaucuauug

SEQ ID NO: 1401316 - RNA, 19 nt, Homo sapiens
gaaauaaacacaccuuugu

SEQ ID NO: 1401317 - RNA, 19 nt, Homo sapiens
gagguucacuauuaacaaa

SEQ ID NO: 1401318 - RNA, 19 nt, Homo sapiens
uagaauagcuccacuuugg

SEQ ID NO: 1401319 - RNA, 19 nt, Homo sapiens
aaagauaauucuccucuga

SEQ ID NO: 1401320 - RNA, 19 nt, Homo sapiens
ugucaugacugguagauuu

SEQ ID NO: 1401321 - RNA, 19 nt, Homo sapiens
uaaagugcuugaccaguaa

SEQ ID NO: 1401322 - RNA, 19 nt, Homo sapiens
gaagucauuugcaaagaau

SEQ ID NO: 1401323 - RNA, 19 nt, Homo sapiens
ucacagaagucauuugcaa

SEQ ID NO: 1401324 - RNA, 19 nt, Homo sapiens
ggaaauaaacacaccuuug

SEQ ID NO: 1401325 - RNA, 19 nt, Homo sapiens
auaaagugcuugaccagua

SEQ ID NO: 1401326 - RNA, 19 nt, Homo sapiens
gaauucacauacaaugcua

SEQ ID NO: 1401327 - RNA, 19 nt, Homo sapiens
guacagcuaugaaaugaag

SEQ ID NO: 1401328 - RNA, 19 nt, Homo sapiens
gcaugaggauguugaggaa

SEQ ID NO: 1401329 - RNA, 19 nt, Homo sapiens
agguugagguucacuauua

SEQ ID NO: 1401330 - RNA, 19 nt, Homo sapiens
ugaggaacauuaaaguuga

SEQ ID NO: 1401331 - RNA, 19 nt, Homo sapiens
ggaaacuucuuugauguca

SEQ ID NO: 1401332 - RNA, 19 nt, Homo sapiens
caauaauguuggacaauuc

SEQ ID NO: 1401333 - RNA, 19 nt, Homo sapiens
guacagugccaauagauau

SEQ ID NO: 1401334 - RNA, 19 nt, Homo sapiens
ugacgcagguuggaaauau

SEQ ID NO: 1401335 - RNA, 19 nt, Homo sapiens
guaaugagcaauauaugga

SEQ ID NO: 1401336 - RNA, 19 nt, Homo sapiens
gagcucugcugucuucuca

SEQ ID NO: 1401337 - RNA, 19 nt, Homo sapiens
ucagauacauccagcaauc

SEQ ID NO: 1401338 - RNA, 19 nt, Homo sapiens
gguugagguucacuauuaa

SEQ ID NO: 1401339 - RNA, 19 nt, Homo sapiens
gagguacagugccaauaga

SEQ ID NO: 1401340 - RNA, 19 nt, Homo sapiens
ccaguaaugugguuguaau

SEQ ID NO: 1401341 - RNA, 19 nt, Homo sapiens
ggaaguguauguguaccuu

SEQ ID NO: 1401342 - RNA, 19 nt, Homo sapiens
caacauuggaaacuucuuu

SEQ ID NO: 1401343 - RNA, 19 nt, Homo sapiens
gcaacccacuucagcaauc

SEQ ID NO: 1401344 - RNA, 19 nt, Homo sapiens
gaaacaauggcaacaaugg

SEQ ID NO: 1401345 - RNA, 19 nt, Homo sapiens
acauuaaaguugaggguuu

SEQ ID NO: 1401346 - RNA, 19 nt, Homo sapiens
aaacuucuuugaugucaug

SEQ ID NO: 1401347 - RNA, 19 nt, Homo sapiens
agaagucauuugcaaagaa

SEQ ID NO: 1401348 - RNA, 19 nt, Homo sapiens
caacgcuucuccaccuuug

SEQ ID NO: 1401349 - RNA, 19 nt, Homo sapiens
gaacagugggauuaucuuc

SEQ ID NO: 1401350 - RNA, 19 nt, Homo sapiens
ucagaagaaucaaccacaa

SEQ ID NO: 1401351 - RNA, 19 nt, Homo sapiens
gaugaagcaugaggauguu

SEQ ID NO: 1401352 - RNA, 19 nt, Homo sapiens
auucaaauguugcauguug

SEQ ID NO: 1401353 - RNA, 19 nt, Homo sapiens
gaggcucuguugagaauca

SEQ ID NO: 1401354 - RNA, 19 nt, Homo sapiens
uaucagguguguauuucuu

SEQ ID NO: 1401355 - RNA, 19 nt, Homo sapiens
caccagaacuucagauugc

SEQ ID NO: 1401356 - RNA, 19 nt, Homo sapiens
gaaguguauguguaccuua

SEQ ID NO: 1401357 - RNA, 19 nt, Homo sapiens
gcaaucaugcugugcugaa

SEQ ID NO: 1401358 - RNA, 19 nt, Homo sapiens
ggaaacaauggcaacaaug

SEQ ID NO: 1401359 - RNA, 19 nt, Homo sapiens
ggcaacugcuggcuuuguu

SEQ ID NO: 1401360 - RNA, 19 nt, Homo sapiens
gguacagugccaauagaua

SEQ ID NO: 1401361 - RNA, 19 nt, Homo sapiens
gaccuugacuaauauacuc

SEQ ID NO: 1401362 - RNA, 19 nt, Homo sapiens
gaucugaggaacauuaaag

SEQ ID NO: 1401363 - RNA, 19 nt, Homo sapiens
gcaacacagucuucagcau

SEQ ID NO: 1401364 - RNA, 19 nt, Homo sapiens
gcuuagccuuugacccuuu

SEQ ID NO: 1401365 - RNA, 19 nt, Homo sapiens
cagaagucauuugcaaaga

SEQ ID NO: 1401366 - RNA, 19 nt, Homo sapiens
gacgcagguuggaaauauu

SEQ ID NO: 1401367 - RNA, 19 nt, Homo sapiens
ugacuaauauacucagcau

SEQ ID NO: 1401368 - RNA, 19 nt, Homo sapiens
aaaauagucuucucagaug

SEQ ID NO: 1401369 - RNA, 19 nt, Homo sapiens
gaaaugaagggcaaaucag

SEQ ID NO: 1401370 - RNA, 19 nt, Homo sapiens
ugaaaugaagggcaaauca

SEQ ID NO: 1401371 - RNA, 19 nt, Homo sapiens
gaacuucagauugcauuca

SEQ ID NO: 1401372 - RNA, 19 nt, Homo sapiens
uggaaacaauggcaacaau

SEQ ID NO: 1401373 - RNA, 19 nt, Homo sapiens
ucauggagacuacagcuuu

SEQ ID NO: 1401374 - RNA, 19 nt, Homo sapiens
gguucacuauuaacaaaug

SEQ ID NO: 1401375 - RNA, 19 nt, Homo sapiens
gucaggagguugagguuca

SEQ ID NO: 1401376 - RNA, 19 nt, Homo sapiens
gcucaucuauuggcaacug

SEQ ID NO: 1401377 - RNA, 19 nt, Homo sapiens
uugaggaaguguaugugua

SEQ ID NO: 1401378 - RNA, 19 nt, Homo sapiens
cagaagaaucaaccacaaa

SEQ ID NO: 1401379 - RNA, 19 nt, Homo sapiens
gugucaagaugaauacaug

SEQ ID NO: 1401380 - RNA, 19 nt, Homo sapiens
gcaacugcuggcuuuguuu

SEQ ID NO: 1401381 - RNA, 19 nt, Homo sapiens
auacucagcaucuuuauca

SEQ ID NO: 1401382 - RNA, 19 nt, Homo sapiens
gcuacagguacaccaauaa

SEQ ID NO: 1401383 - RNA, 19 nt, Homo sapiens
gcauguacagcuaugaaau

SEQ ID NO: 1401384 - RNA, 19 nt, Homo sapiens
aaauagucuucucagauga

SEQ ID NO: 1401385 - RNA, 19 nt, Homo sapiens
gaagggcaaaucagauaca

SEQ ID NO: 1401386 - RNA, 19 nt, Homo sapiens
cugaagaacauacacuauu

SEQ ID NO: 1401387 - RNA, 19 nt, Homo sapiens
ggagguugagguucacuau

SEQ ID NO: 1401388 - RNA, 19 nt, Homo sapiens
auuggaaacuucuuugaug

SEQ ID NO: 1401389 - RNA, 19 nt, Homo sapiens
caacccacuucagcaauca

SEQ ID NO: 1401390 - RNA, 19 nt, Homo sapiens
ggaaaccauggaaacaaug

SEQ ID NO: 1401391 - RNA, 19 nt, Homo sapiens
ccagagggauuuuauaucu

SEQ ID NO: 1401392 - RNA, 19 nt, Homo sapiens
aggaaaccauggaaacaau

SEQ ID NO: 1401393 - RNA, 19 nt, Homo sapiens
acucugaauucacauacaa

SEQ ID NO: 1401394 - RNA, 19 nt, Homo sapiens
acagguacaccaauaaugu

SEQ ID NO: 1401395 - RNA, 19 nt, Homo sapiens
gcucuuugaaacuaaguaa

SEQ ID NO: 1401396 - RNA, 19 nt, Homo sapiens
ugcaguaaguguugucaug

SEQ ID NO: 1401397 - RNA, 19 nt, Homo sapiens
agaugaccuugacuaauau

SEQ ID NO: 1401398 - RNA, 19 nt, Homo sapiens
cgcuacagguacaccaaua

SEQ ID NO: 1401399 - RNA, 19 nt, Homo sapiens
ggauuccugcucuuugaaa

SEQ ID NO: 1401400 - RNA, 19 nt, Homo sapiens
cugaggcucuguugagaau

SEQ ID NO: 1401401 - RNA, 19 nt, Homo sapiens
caguaucagguguguauuu

SEQ ID NO: 1401402 - RNA, 19 nt, Homo sapiens
ccaccagaacuucagauug

SEQ ID NO: 1401403 - RNA, 19 nt, Homo sapiens
caguaaguguugucaugga

SEQ ID NO: 1401404 - RNA, 19 nt, Homo sapiens
cugaggaacauuaaaguug

SEQ ID NO: 1401405 - RNA, 19 nt, Homo sapiens
ugaugaagcaugaggaugu

SEQ ID NO: 1401406 - RNA, 19 nt, Homo sapiens
gaaacuucuuugaugucau

SEQ ID NO: 1401407 - RNA, 19 nt, Homo sapiens
cuggagcucugcugucuuc

SEQ ID NO: 1401408 - RNA, 19 nt, Homo sapiens
cauggagacuacagcuuuc

SEQ ID NO: 1401409 - RNA, 19 nt, Homo sapiens
caaaauagucuucucagau

SEQ ID NO: 1401410 - RNA, 19 nt, Homo sapiens
aaaugaagggcaaaucaga

SEQ ID NO: 1401411 - RNA, 19 nt, Homo sapiens
gcacuagcugccuuauuag

SEQ ID NO: 1401412 - RNA, 19 nt, Homo sapiens
cuaauauacucagcaucuu

SEQ ID NO: 1401413 - RNA, 19 nt, Homo sapiens
gaggaacauuaaaguugag

SEQ ID NO: 1401414 - RNA, 19 nt, Homo sapiens
guaagacgcugucgguuaa

SEQ ID NO: 1401415 - RNA, 19 nt, Homo sapiens
gcaaguacaucaccuucuc

SEQ ID NO: 1401416 - RNA, 19 nt, Homo sapiens
cgguuaagcugaugaagaa

SEQ ID NO: 1401417 - RNA, 19 nt, Homo sapiens
cguaagacgcugucgguua

SEQ ID NO: 1401418 - RNA, 19 nt, Homo sapiens
ccuggacucugccaauaaa

SEQ ID NO: 1401419 - RNA, 19 nt, Homo sapiens
cgccuggacucugccaaua

SEQ ID NO: 1401420 - RNA, 19 nt, Homo sapiens
gaggugcaggccaugauuu

SEQ ID NO: 1401421 - RNA, 19 nt, Homo sapiens
gcgccuacuucuucuccuu

SEQ ID NO: 1401422 - RNA, 19 nt, Homo sapiens
acaagagccugucggugau

SEQ ID NO: 1401423 - RNA, 19 nt, Homo sapiens
gcgccuacuucuucuccuu

SEQ ID NO: 1401424 - RNA, 19 nt, Homo sapiens
ucgacaagguguacgugaa

SEQ ID NO: 1401425 - RNA, 19 nt, Homo sapiens
acaccgaguucgucaacau

SEQ ID NO: 1401426 - RNA, 19 nt, Homo sapiens
gacaagguguacgugaaca

SEQ ID NO: 1401427 - RNA, 19 nt, Homo sapiens
gcagagccagagcgugaug

SEQ ID NO: 1401428 - RNA, 19 nt, Homo sapiens
gccuggacucugccaauaa

SEQ ID NO: 1401429 - RNA, 19 nt, Homo sapiens
cggugaugcuggugcgaaa

SEQ ID NO: 1401430 - RNA, 19 nt, Homo sapiens
cgaggugcaggccaugauu

SEQ ID NO: 1401431 - RNA, 19 nt, Homo sapiens
gcaaccacggcaaguacau

SEQ ID NO: 1401432 - RNA, 19 nt, Homo sapiens
aggugcaggccaugauuua

SEQ ID NO: 1401433 - RNA, 19 nt, Homo sapiens
gcgaauccauugccucuuu

SEQ ID NO: 1401434 - RNA, 19 nt, Homo sapiens
ggaauauugugaaugacua

SEQ ID NO: 1401435 - RNA, 19 nt, Homo sapiens
ccuggaauauugugaauga

SEQ ID NO: 1401436 - RNA, 19 nt, Homo sapiens
ucagagaucacucaauaaa

SEQ ID NO: 1401437 - RNA, 19 nt, Homo sapiens
gggccagccugcaguuuga

SEQ ID NO: 1401438 - RNA, 19 nt, Homo sapiens
ugaacgagcagggacauua

SEQ ID NO: 1401439 - RNA, 19 nt, Homo sapiens
ugacuacauuggcaucuau

SEQ ID NO: 1401440 - RNA, 19 nt, Homo sapiens
gcacagcuccccagucuuu

SEQ ID NO: 1401441 - RNA, 19 nt, Homo sapiens
gggugugggugacuacauu

SEQ ID NO: 1401442 - RNA, 19 nt, Homo sapiens
ggcaguggcuggauuucug

SEQ ID NO: 1401443 - RNA, 19 nt, Homo sapiens
gugcugugcuggcaagugu

SEQ ID NO: 1401444 - RNA, 19 nt, Homo sapiens
aguuugaucuggugaagaa

SEQ ID NO: 1401445 - RNA, 19 nt, Homo sapiens
gaacgagcagggacauuac

SEQ ID NO: 1401446 - RNA, 19 nt, Homo sapiens
gaucacucaauaaaccuaa

SEQ ID NO: 1401447 - RNA, 19 nt, Homo sapiens
gcaguuugaucuggugaag

SEQ ID NO: 1401448 - RNA, 19 nt, Homo sapiens
agagaucacucaauaaacc

SEQ ID NO: 1401449 - RNA, 19 nt, Homo sapiens
gcucaugcucucacuccua

SEQ ID NO: 1401450 - RNA, 19 nt, Homo sapiens
gugacuacauuggcaucua

SEQ ID NO: 1401451 - RNA, 19 nt, Homo sapiens
ggugaagaauggcgaaucc

SEQ ID NO: 1401452 - RNA, 19 nt, Homo sapiens
cgaauccauugccucuuuc

SEQ ID NO: 1401453 - RNA, 19 nt, Homo sapiens
gcugugcuggcaaguguaa

SEQ ID NO: 1401454 - RNA, 19 nt, Homo sapiens
ccacuggacgacaacaaga

SEQ ID NO: 1401455 - RNA, 19 nt, Homo sapiens
gcuggagccugaggaccaa

SEQ ID NO: 1401456 - RNA, 19 nt, Homo sapiens
aaaccuaagaacccucaaa

SEQ ID NO: 1401457 - RNA, 19 nt, Homo sapiens
gaauauugugaaugacuag

SEQ ID NO: 1401458 - RNA, 19 nt, Homo sapiens
cagcaccuucuccggauuu

SEQ ID NO: 1401459 - RNA, 19 nt, Homo sapiens
ggcaaggaaugggaacagu

SEQ ID NO: 1401460 - RNA, 19 nt, Homo sapiens
ggugugaggcugacaacca

SEQ ID NO: 1401461 - RNA, 19 nt, Homo sapiens
ccggauuucugguguacuc

SEQ ID NO: 1401462 - RNA, 19 nt, Homo sapiens
gagaucagacccuacauua

SEQ ID NO: 1401463 - RNA, 19 nt, Homo sapiens
gaucagacccuacauuaau

SEQ ID NO: 1401464 - RNA, 19 nt, Homo sapiens
agaaugcugucuccucuua

SEQ ID NO: 1401465 - RNA, 19 nt, Homo sapiens
uaccaugccuggcuaauuu

SEQ ID NO: 1401466 - RNA, 19 nt, Homo sapiens
gaagcuugcuaaccuaaau

SEQ ID NO: 1401467 - RNA, 19 nt, Homo sapiens
ggaauuacaaggagacgua

SEQ ID NO: 1401468 - RNA, 19 nt, Homo sapiens
gguccaggauucuguguuu

SEQ ID NO: 1401469 - RNA, 19 nt, Homo sapiens
aggaagaccugugcuauaa

SEQ ID NO: 1401470 - RNA, 19 nt, Homo sapiens
acaaacaccugcaggagaa

SEQ ID NO: 1401471 - RNA, 19 nt, Homo sapiens
gcaacgacuucgacaccua

SEQ ID NO: 1401472 - RNA, 19 nt, Homo sapiens
gaagaccugugcuauaaac

SEQ ID NO: 1401473 - RNA, 19 nt, Homo sapiens
gugcacagcuggaauuaca

SEQ ID NO: 1401474 - RNA, 19 nt, Homo sapiens
gaaccuugaugggugcuuu

SEQ ID NO: 1401475 - RNA, 19 nt, Homo sapiens
guacauagguuuuaaagca

SEQ ID NO: 1401476 - RNA, 19 nt, Homo sapiens
uaagaagcuugcuaaccua

SEQ ID NO: 1401477 - RNA, 19 nt, Homo sapiens
gcuccucucuucucucuug

SEQ ID NO: 1401478 - RNA, 19 nt, Homo sapiens
agacguacgugcacauuau

SEQ ID NO: 1401479 - RNA, 19 nt, Homo sapiens
gaacuuucccagccucgua

SEQ ID NO: 1401480 - RNA, 19 nt, Homo sapiens
cuagaauucucccaacauu

SEQ ID NO: 1401481 - RNA, 19 nt, Homo sapiens
ucuaggacuuucucaauau

SEQ ID NO: 1401482 - RNA, 19 nt, Homo sapiens
gcacuucucaaacuuggaa

SEQ ID NO: 1401483 - RNA, 19 nt, Homo sapiens
uuaagaagcuugcuaaccu

SEQ ID NO: 1401484 - RNA, 19 nt, Homo sapiens
gagacguacgugcacauua

SEQ ID NO: 1401485 - RNA, 19 nt, Homo sapiens
gcccagcacuucucaaacu

SEQ ID NO: 1401486 - RNA, 19 nt, Homo sapiens
cagcaacaaguuaguauug

SEQ ID NO: 1401487 - RNA, 19 nt, Homo sapiens
ggaagaccugugcuauaaa

SEQ ID NO: 1401488 - RNA, 19 nt, Homo sapiens
ggugcugccuuuacaaaca

SEQ ID NO: 1401489 - RNA, 19 nt, Homo sapiens
cagccaccguucauuuauu

SEQ ID NO: 1401490 - RNA, 19 nt, Homo sapiens
ccaauuccaacauucuuaa

SEQ ID NO: 1401491 - RNA, 19 nt, Homo sapiens
caccgugccuggccaauuc

SEQ ID NO: 1401492 - RNA, 19 nt, Homo sapiens
gggagacccugcuucuauc

SEQ ID NO: 1401493 - RNA, 19 nt, Homo sapiens
ggagcucaccuuugacaga

SEQ ID NO: 1401494 - RNA, 19 nt, Homo sapiens
gaccucaggccuuccguuu

SEQ ID NO: 1401495 - RNA, 19 nt, Homo sapiens
gccaauuccaacauucuua

SEQ ID NO: 1401496 - RNA, 19 nt, Homo sapiens
cuaggacuuucucaauauu

SEQ ID NO: 1401497 - RNA, 19 nt, Homo sapiens
ccagcaugauuaaagaaug

SEQ ID NO: 1401498 - RNA, 19 nt, Homo sapiens
caucugaacuuccguuucc

SEQ ID NO: 1401499 - RNA, 19 nt, Homo sapiens
ggccuuccguuucuucuuc

SEQ ID NO: 1401500 - RNA, 19 nt, Homo sapiens
ccaccaaagucaucugaac

SEQ ID NO: 1401501 - RNA, 19 nt, Homo sapiens
caccguucauuuauucauu

SEQ ID NO: 1401502 - RNA, 19 nt, Homo sapiens
gcagccaccguucauuuau

SEQ ID NO: 1401503 - RNA, 19 nt, Homo sapiens
aaugcugucuccucuuaaa

SEQ ID NO: 1401504 - RNA, 19 nt, Homo sapiens
cguccagcaugauuaaaga

SEQ ID NO: 1401505 - RNA, 19 nt, Homo sapiens
ccucaggccuuccguuucu

SEQ ID NO: 1401506 - RNA, 19 nt, Homo sapiens
agacccugcuucuaucuug

SEQ ID NO: 1401507 - RNA, 19 nt, Homo sapiens
ccagaaagaggcugucauc

SEQ ID NO: 1401508 - RNA, 19 nt, Homo sapiens
ggagaggacccaggagugu

SEQ ID NO: 1401509 - RNA, 19 nt, Homo sapiens
uucuaggacuuucucaaua

SEQ ID NO: 1401510 - RNA, 19 nt, Homo sapiens
aucagacccuacauuaaua

SEQ ID NO: 1401511 - RNA, 19 nt, Homo sapiens
aagaggcugucauccugua

SEQ ID NO: 1401512 - RNA, 19 nt, Homo sapiens
gcccagugcucaucguuac

SEQ ID NO: 1401513 - RNA, 19 nt, Homo sapiens
gucuugaacuccugacuuc

SEQ ID NO: 1401514 - RNA, 19 nt, Homo sapiens
gcucaucguuacagcaaac

SEQ ID NO: 1401515 - RNA, 19 nt, Homo sapiens
guucuaggacuuucucaau

SEQ ID NO: 1401516 - RNA, 19 nt, Homo sapiens
ggaaaugcaugcgaaucac

SEQ ID NO: 1401517 - RNA, 19 nt, Homo sapiens
ccuggauccugcccaugua

SEQ ID NO: 1401518 - RNA, 19 nt, Homo sapiens
cccgugcuauguucucuuu

SEQ ID NO: 1401519 - RNA, 19 nt, Homo sapiens
ccaacauucuuaaauucuc

SEQ ID NO: 1401520 - RNA, 19 nt, Homo sapiens
ggacuuucucaauauucua

SEQ ID NO: 1401521 - RNA, 19 nt, Homo sapiens
cguguuaaaugcagauucu

SEQ ID NO: 1401522 - RNA, 19 nt, Homo sapiens
ccuaguggcugggauuaca

SEQ ID NO: 1401523 - RNA, 19 nt, Homo sapiens
gcacagcuggaauuacaag

SEQ ID NO: 1401524 - RNA, 19 nt, Homo sapiens
ucucaaacuuggaaaugca

SEQ ID NO: 1401525 - RNA, 19 nt, Homo sapiens
ggagacguacgugcacauu

SEQ ID NO: 1401526 - RNA, 19 nt, Homo sapiens
gaaugcugucuccucuuaa

SEQ ID NO: 1401527 - RNA, 19 nt, Homo sapiens
ugagaucagacccuacauu

SEQ ID NO: 1401528 - RNA, 19 nt, Homo sapiens
ucuaguacuuucugaacau

SEQ ID NO: 1401529 - RNA, 19 nt, Homo sapiens
cugaguggguccaggauuc

SEQ ID NO: 1401530 - RNA, 19 nt, Homo sapiens
uaaaccacccugccugauc

SEQ ID NO: 1401531 - RNA, 19 nt, Homo sapiens
gcucagucccuuccaccaa

SEQ ID NO: 1401532 - RNA, 19 nt, Homo sapiens
ugcagcugguccuccauua

SEQ ID NO: 1401533 - RNA, 19 nt, Homo sapiens
cuaguacuuucugaacauu

SEQ ID NO: 1401534 - RNA, 19 nt, Homo sapiens
uagcccagcacuucucaaa

SEQ ID NO: 1401535 - RNA, 19 nt, Homo sapiens
gcagagccagagugugaug

SEQ ID NO: 1401536 - RNA, 19 nt, Homo sapiens
augcagagccagaguguga

SEQ ID NO: 1401537 - RNA, 19 nt, Homo sapiens
cuugaugggugcuuugaca

SEQ ID NO: 1401538 - RNA, 19 nt, Homo sapiens
gcccauuggugcucaugca

SEQ ID NO: 1401539 - RNA, 19 nt, Homo sapiens
ggucuugaacuccugacuu

SEQ ID NO: 1401540 - RNA, 19 nt, Homo sapiens
uggaaaugcaugcgaauca

SEQ ID NO: 1401541 - RNA, 19 nt, Homo sapiens
caaggccgaggacgacuga

SEQ ID NO: 1401542 - RNA, 19 nt, Homo sapiens
agaacgccaucuacagcaa

SEQ ID NO: 1401543 - RNA, 19 nt, Homo sapiens
gacacagggucaccauggu

SEQ ID NO: 1401544 - RNA, 19 nt, Homo sapiens
agaucagacccuacauuaa

SEQ ID NO: 1401545 - RNA, 19 nt, Homo sapiens
cucagucccuuccaccaaa

SEQ ID NO: 1401546 - RNA, 19 nt, Homo sapiens
ugcagccaccguucauuua

SEQ ID NO: 1401547 - RNA, 19 nt, Homo sapiens
cugcagccaccguucauuu

SEQ ID NO: 1401548 - RNA, 19 nt, Homo sapiens
ccuggccaauuccaacauu

SEQ ID NO: 1401549 - RNA, 19 nt, Homo sapiens
guggugcaaucucaguuca

SEQ ID NO: 1401550 - RNA, 19 nt, Homo sapiens
ccucguagcccagcacuuc

SEQ ID NO: 1401551 - RNA, 19 nt, Homo sapiens
cuugcuaaccuaaauauuc

SEQ ID NO: 1401552 - RNA, 19 nt, Homo sapiens
gacccuacauuaauaucac

SEQ ID NO: 1401553 - RNA, 19 nt, Homo sapiens
cgacuucgacaccuacauc

SEQ ID NO: 1401554 - RNA, 19 nt, Homo sapiens
ggccagcaacaaguuagua

SEQ ID NO: 1401555 - RNA, 19 nt, Homo sapiens
uaauaucaccauccugaag

SEQ ID NO: 1401556 - RNA, 19 nt, Homo sapiens
ccagcaacaaguuaguauu

SEQ ID NO: 1401557 - RNA, 19 nt, Homo sapiens
ugugugagaucccuauggu

SEQ ID NO: 1401558 - RNA, 19 nt, Homo sapiens
ggcagcuccucgucucaga

SEQ ID NO: 1401559 - RNA, 19 nt, Homo sapiens
ggugcaaucucaguucacu

SEQ ID NO: 1401560 - RNA, 19 nt, Homo sapiens
cguggcaucuacuucuuca

SEQ ID NO: 1401561 - RNA, 19 nt, Homo sapiens
agccaccguucauuuauuc

SEQ ID NO: 1401562 - RNA, 19 nt, Homo sapiens
gaagaaagacuaccuauua

SEQ ID NO: 1401563 - RNA, 19 nt, Homo sapiens
ccuaauagcuuucucauaa

SEQ ID NO: 1401564 - RNA, 19 nt, Homo sapiens
gaaagaagaggaaauguuu

SEQ ID NO: 1401565 - RNA, 19 nt, Homo sapiens
gguaagagaugcuaacuau

SEQ ID NO: 1401566 - RNA, 19 nt, Homo sapiens
ggacauugcuuacuuaucu

SEQ ID NO: 1401567 - RNA, 19 nt, Homo sapiens
gaacauaugggcccuuuaa

SEQ ID NO: 1401568 - RNA, 19 nt, Homo sapiens
gaacagagacccagaagga

SEQ ID NO: 1401569 - RNA, 19 nt, Homo sapiens
guagagacccuguguauuu

SEQ ID NO: 1401570 - RNA, 19 nt, Homo sapiens
ggaguagcuucgaauaaua

SEQ ID NO: 1401571 - RNA, 19 nt, Homo sapiens
ggaaugggauccaaagaga

SEQ ID NO: 1401572 - RNA, 19 nt, Homo sapiens
gauaucacauuggcuaaua

SEQ ID NO: 1401573 - RNA, 19 nt, Homo sapiens
gcaagaaagccucauguuu

SEQ ID NO: 1401574 - RNA, 19 nt, Homo sapiens
ccaagaacaaugaguauua

SEQ ID NO: 1401575 - RNA, 19 nt, Homo sapiens
caagcaagcuacagagaaa

SEQ ID NO: 1401576 - RNA, 19 nt, Homo sapiens
gcaaugaucuagcaguugu

SEQ ID NO: 1401577 - RNA, 19 nt, Homo sapiens
gaaauccucucugcucauu

SEQ ID NO: 1401578 - RNA, 19 nt, Homo sapiens
gaaaggcuauauaguaagu

SEQ ID NO: 1401579 - RNA, 19 nt, Homo sapiens
uaaaugcccugagugauaa

SEQ ID NO: 1401580 - RNA, 19 nt, Homo sapiens
gguaagacauugcuucuca

SEQ ID NO: 1401581 - RNA, 19 nt, Homo sapiens
guauagcucugacugguaa

SEQ ID NO: 1401582 - RNA, 19 nt, Homo sapiens
ucgaaaggcuauauaguaa

SEQ ID NO: 1401583 - RNA, 19 nt, Homo sapiens
gaaauggcaugcacacaca

SEQ ID NO: 1401584 - RNA, 19 nt, Homo sapiens
gaagaaaggacccauagga

SEQ ID NO: 1401585 - RNA, 19 nt, Homo sapiens
cuacaagauuugcuagaua

SEQ ID NO: 1401586 - RNA, 19 nt, Homo sapiens
gaugaaaguugcaaugauc

SEQ ID NO: 1401587 - RNA, 19 nt, Homo sapiens
cagaagaguaucaagauua

SEQ ID NO: 1401588 - RNA, 19 nt, Homo sapiens
aaacagauaucccuuccaa

SEQ ID NO: 1401589 - RNA, 19 nt, Homo sapiens
gcaaagggaaugaggaauu

SEQ ID NO: 1401590 - RNA, 19 nt, Homo sapiens
ucacugaacugcaauucuu

SEQ ID NO: 1401591 - RNA, 19 nt, Homo sapiens
ugacacagauuaccuagau

SEQ ID NO: 1401592 - RNA, 19 nt, Homo sapiens
caaggcauauguucacuga

SEQ ID NO: 1401593 - RNA, 19 nt, Homo sapiens
uuagagaacugacaugaga

SEQ ID NO: 1401594 - RNA, 19 nt, Homo sapiens
gauaacagccaaagauaga

SEQ ID NO: 1401595 - RNA, 19 nt, Homo sapiens
gcggaaacaucacauacaa

SEQ ID NO: 1401596 - RNA, 19 nt, Homo sapiens
ccaaaugucugaguaaaca

SEQ ID NO: 1401597 - RNA, 19 nt, Homo sapiens
gcaaugaacaggagaagga

SEQ ID NO: 1401598 - RNA, 19 nt, Homo sapiens
guagucaccugcuuacaga

SEQ ID NO: 1401599 - RNA, 19 nt, Homo sapiens
gguaaacacucugauugaa

SEQ ID NO: 1401600 - RNA, 19 nt, Homo sapiens
aaagggaacugcagguuug

SEQ ID NO: 1401601 - RNA, 19 nt, Homo sapiens
uagauaaacuggaaaugga

SEQ ID NO: 1401602 - RNA, 19 nt, Homo sapiens
caaauuaggaugugacaga

SEQ ID NO: 1401603 - RNA, 19 nt, Homo sapiens
gacaagagccaaagauguu

SEQ ID NO: 1401604 - RNA, 19 nt, Homo sapiens
uuaaaugcccugagugaua

SEQ ID NO: 1401605 - RNA, 19 nt, Homo sapiens
uuaccuagauuccauauca

SEQ ID NO: 1401606 - RNA, 19 nt, Homo sapiens
ggaaagcgcacuugagaca

SEQ ID NO: 1401607 - RNA, 19 nt, Homo sapiens
ucaaauaaagcaaggcaua

SEQ ID NO: 1401608 - RNA, 19 nt, Homo sapiens
ccacucagauucuaaagca

SEQ ID NO: 1401609 - RNA, 19 nt, Homo sapiens
ccaaagagacucccacuca

SEQ ID NO: 1401610 - RNA, 19 nt, Homo sapiens
caacagaaguaacuaaucc

SEQ ID NO: 1401611 - RNA, 19 nt, Homo sapiens
gaagaggaaauguuuacuu

SEQ ID NO: 1401612 - RNA, 19 nt, Homo sapiens
gaacugacaugagaaaaga

SEQ ID NO: 1401613 - RNA, 19 nt, Homo sapiens
cauacaagguuuccacuuc

SEQ ID NO: 1401614 - RNA, 19 nt, Homo sapiens
gggcaccacuuuacauugu

SEQ ID NO: 1401615 - RNA, 19 nt, Homo sapiens
gaaaggagagaaaggugaa

SEQ ID NO: 1401616 - RNA, 19 nt, Homo sapiens
cauaugggcccuuuaaaga

SEQ ID NO: 1401617 - RNA, 19 nt, Homo sapiens
gcaccuuguucuucacuga

SEQ ID NO: 1401618 - RNA, 19 nt, Homo sapiens
caagaaagccucauguuuu

SEQ ID NO: 1401619 - RNA, 19 nt, Homo sapiens
gcacacagggucugcuauu

SEQ ID NO: 1401620 - RNA, 19 nt, Homo sapiens
gaucaaacuaucacaauuc

SEQ ID NO: 1401621 - RNA, 19 nt, Homo sapiens
agaagaugaugaauuguga

SEQ ID NO: 1401622 - RNA, 19 nt, Homo sapiens
ggagaaguagguccaauug

SEQ ID NO: 1401623 - RNA, 19 nt, Homo sapiens
ggaaauggagaaguuauug

SEQ ID NO: 1401624 - RNA, 19 nt, Homo sapiens
gcaaaaugcugugaaagaa

SEQ ID NO: 1401625 - RNA, 19 nt, Homo sapiens
agacauugcuucucaugga

SEQ ID NO: 1401626 - RNA, 19 nt, Homo sapiens
caagaacaaugaguauuag

SEQ ID NO: 1401627 - RNA, 19 nt, Homo sapiens
ccugagaauuggaggauuu

SEQ ID NO: 1401628 - RNA, 19 nt, Homo sapiens
gcauauguucacugauuua

SEQ ID NO: 1401629 - RNA, 19 nt, Homo sapiens
aggcauauguucacugauu

SEQ ID NO: 1401630 - RNA, 19 nt, Homo sapiens
ggaaguucaucugugcuuu

SEQ ID NO: 1401631 - RNA, 19 nt, Homo sapiens
guucuaggcuggaaauaag

SEQ ID NO: 1401632 - RNA, 19 nt, Homo sapiens
guucacugauuuacgagua

SEQ ID NO: 1401633 - RNA, 19 nt, Homo sapiens
gagaagggauagggaaauc

SEQ ID NO: 1401634 - RNA, 19 nt, Homo sapiens
cagauaacagccaaagaua

SEQ ID NO: 1401635 - RNA, 19 nt, Homo sapiens
gagaauuggaggauuuauu

SEQ ID NO: 1401636 - RNA, 19 nt, Homo sapiens
aagaggaaauguuuacuuc

SEQ ID NO: 1401637 - RNA, 19 nt, Homo sapiens
ucauggaucugcuagguau

SEQ ID NO: 1401638 - RNA, 19 nt, Homo sapiens
gaguagcuucgaauaauaa

SEQ ID NO: 1401639 - RNA, 19 nt, Homo sapiens
aaacaucacauacaagguu

SEQ ID NO: 1401640 - RNA, 19 nt, Homo sapiens
ccaauccuccuucuaugua

SEQ ID NO: 1401641 - RNA, 19 nt, Homo sapiens
cagauggauuugaagcuaa

SEQ ID NO: 1401642 - RNA, 19 nt, Homo sapiens
ggacaaccaaagcaagaaa

SEQ ID NO: 1401643 - RNA, 19 nt, Homo sapiens
ggcauauguucacugauuu

SEQ ID NO: 1401644 - RNA, 19 nt, Homo sapiens
caagaucccugugguaaac

SEQ ID NO: 1401645 - RNA, 19 nt, Homo sapiens
agccagcucugacuaguaa

SEQ ID NO: 1401646 - RNA, 19 nt, Homo sapiens
acagaagaguaucaagauu

SEQ ID NO: 1401647 - RNA, 19 nt, Homo sapiens
gaucugcuagguauuuauu

SEQ ID NO: 1401648 - RNA, 19 nt, Homo sapiens
acagauggauuugaagcua

SEQ ID NO: 1401649 - RNA, 19 nt, Homo sapiens
uggaguagcuucgaauaau

SEQ ID NO: 1401650 - RNA, 19 nt, Homo sapiens
gggcaauaccggauaaaga

SEQ ID NO: 1401651 - RNA, 19 nt, Homo sapiens
agaaguagguccaauuggu

SEQ ID NO: 1401652 - RNA, 19 nt, Homo sapiens
aagaggagcuguuuuggua

SEQ ID NO: 1401653 - RNA, 19 nt, Homo sapiens
gccauacuuugugcacuua

SEQ ID NO: 1401654 - RNA, 19 nt, Homo sapiens
aaagccagccugagaauug

SEQ ID NO: 1401655 - RNA, 19 nt, Homo sapiens
ugaaagaagaggaaauguu

SEQ ID NO: 1401656 - RNA, 19 nt, Homo sapiens
gccaagguguauguguuua

SEQ ID NO: 1401657 - RNA, 19 nt, Homo sapiens
ccaguuggcgauaauauug

SEQ ID NO: 1401658 - RNA, 19 nt, Homo sapiens
uaaauaugggcaccacuuu

SEQ ID NO: 1401659 - RNA, 19 nt, Homo sapiens
caaacuaucacaauucagu

SEQ ID NO: 1401660 - RNA, 19 nt, Homo sapiens
gcuaguguguggugaucaa

SEQ ID NO: 1401661 - RNA, 19 nt, Homo sapiens
cagauuaccuagauuccau

SEQ ID NO: 1401662 - RNA, 19 nt, Homo sapiens
gcucgaaacuucagagaua

SEQ ID NO: 1401663 - RNA, 19 nt, Homo sapiens
ggaagaagauguauuucaa

SEQ ID NO: 1401664 - RNA, 19 nt, Homo sapiens
ggaagaaacucugccagua

SEQ ID NO: 1401665 - RNA, 19 nt, Homo sapiens
acaaggagguauacaauaa

SEQ ID NO: 1401666 - RNA, 19 nt, Homo sapiens
cuaaagagcgccauggaua

SEQ ID NO: 1401667 - RNA, 19 nt, Homo sapiens
gaaagaaggacaugcugaa

SEQ ID NO: 1401668 - RNA, 19 nt, Homo sapiens
ucaacagccugaacuauga

SEQ ID NO: 1401669 - RNA, 19 nt, Homo sapiens
gcagauccgcaaacgauua

SEQ ID NO: 1401670 - RNA, 19 nt, Homo sapiens
caacugccauucuggauuc

SEQ ID NO: 1401671 - RNA, 19 nt, Homo sapiens
gggcagaacugggugaaga

SEQ ID NO: 1401672 - RNA, 19 nt, Homo sapiens
ucacugaccugccuuugug

SEQ ID NO: 1401673 - RNA, 19 nt, Homo sapiens
caaaggaaguacuaaagag

SEQ ID NO: 1401674 - RNA, 19 nt, Homo sapiens
agaaggacaugcugaauag

SEQ ID NO: 1401675 - RNA, 19 nt, Homo sapiens
gaucuauguucacaaagga

SEQ ID NO: 1401676 - RNA, 19 nt, Homo sapiens
caacaaggagguauacaau

SEQ ID NO: 1401677 - RNA, 19 nt, Homo sapiens
gcaacaaggagguauacaa

SEQ ID NO: 1401678 - RNA, 19 nt, Homo sapiens
gcauuuggacacuucauuu

SEQ ID NO: 1401679 - RNA, 19 nt, Homo sapiens
ucaaacuuguccgauguua

SEQ ID NO: 1401680 - RNA, 19 nt, Homo sapiens
gaagaaacucugccaguac

SEQ ID NO: 1401681 - RNA, 19 nt, Homo sapiens
caaacacugucacauccuu

SEQ ID NO: 1401682 - RNA, 19 nt, Homo sapiens
aaagagcaguauggagaua

SEQ ID NO: 1401683 - RNA, 19 nt, Homo sapiens
cgcaaacgauuaauucugu

SEQ ID NO: 1401684 - RNA, 19 nt, Homo sapiens
guugcugacugggaauuua

SEQ ID NO: 1401685 - RNA, 19 nt, Homo sapiens
gagaagagcggcaguuucg

SEQ ID NO: 1401686 - RNA, 19 nt, Homo sapiens
acaaagggcagcuggauug

SEQ ID NO: 1401687 - RNA, 19 nt, Homo sapiens
gugcuggucgggaacauua

SEQ ID NO: 1401688 - RNA, 19 nt, Homo sapiens
uguuggagcugauagcaaa

SEQ ID NO: 1401689 - RNA, 19 nt, Homo sapiens
agacuggacuucucaacug

SEQ ID NO: 1401690 - RNA, 19 nt, Homo sapiens
ucacaaaggaaguacuaaa

SEQ ID NO: 1401691 - RNA, 19 nt, Homo sapiens
aagaaggacaugcugaaua

SEQ ID NO: 1401692 - RNA, 19 nt, Homo sapiens
aacauuggcucgaaacuuc

SEQ ID NO: 1401693 - RNA, 19 nt, Homo sapiens
ggaucuauguucacaaagg

SEQ ID NO: 1401694 - RNA, 19 nt, Homo sapiens
gaaagagcaguauggagau

SEQ ID NO: 1401695 - RNA, 19 nt, Homo sapiens
guacacugguccaaagagu

SEQ ID NO: 1401696 - RNA, 19 nt, Homo sapiens
caacagacuggacuucuca

SEQ ID NO: 1401697 - RNA, 19 nt, Homo sapiens
ggacuucucaacugccauu

SEQ ID NO: 1401698 - RNA, 19 nt, Homo sapiens
uaaagagcgccauggauau

SEQ ID NO: 1401699 - RNA, 19 nt, Homo sapiens
aagggcagcuggauuggaa

SEQ ID NO: 1401700 - RNA, 19 nt, Homo sapiens
uuuggacacuucauuugua

SEQ ID NO: 1401701 - RNA, 19 nt, Homo sapiens
gagcugggaauauggcauu

SEQ ID NO: 1401702 - RNA, 19 nt, Homo sapiens
ccaagaagagaaagaagga

SEQ ID NO: 1401703 - RNA, 19 nt, Homo sapiens
gauguuacccaaggaaaga

SEQ ID NO: 1401704 - RNA, 19 nt, Homo sapiens
gauccgcaaacgauuaauu

SEQ ID NO: 1401705 - RNA, 19 nt, Homo sapiens
gaagagaaagaaggacaug

SEQ ID NO: 1401706 - RNA, 19 nt, Homo sapiens
ccaaagagucggcaagucu

SEQ ID NO: 1401707 - RNA, 19 nt, Homo sapiens
gaagaccagcaaaacauua

SEQ ID NO: 1401708 - RNA, 19 nt, Homo sapiens
caaagucacagcucacauc

SEQ ID NO: 1401709 - RNA, 19 nt, Homo sapiens
acaaaggaaguacuaaaga

SEQ ID NO: 1401710 - RNA, 19 nt, Homo sapiens
gacugggaauuuaagaaug

SEQ ID NO: 1401711 - RNA, 19 nt, Homo sapiens
cuggagagcugggaauaug

SEQ ID NO: 1401712 - RNA, 19 nt, Homo sapiens
ccaggacuuuaucaacuug

SEQ ID NO: 1401713 - RNA, 19 nt, Homo sapiens
guucacaaaggaaguacua

SEQ ID NO: 1401714 - RNA, 19 nt, Homo sapiens
cagcuggauuggaagaaga

SEQ ID NO: 1401715 - RNA, 19 nt, Homo sapiens
gacaaagggcagcuggauu

SEQ ID NO: 1401716 - RNA, 19 nt, Homo sapiens
guacugaaaguccuugaag

SEQ ID NO: 1401717 - RNA, 19 nt, Homo sapiens
ccagaagauuuaacuacgu

SEQ ID NO: 1401718 - RNA, 19 nt, Homo sapiens
aaagagcgccauggauauu

SEQ ID NO: 1401719 - RNA, 19 nt, Homo sapiens
ucacuagaauugguaugga

SEQ ID NO: 1401720 - RNA, 19 nt, Homo sapiens
ugacugggaauuuaagaau

SEQ ID NO: 1401721 - RNA, 19 nt, Homo sapiens
caaggaaagagcaguaugg

SEQ ID NO: 1401722 - RNA, 19 nt, Homo sapiens
gcagcuggauuggaagaag

SEQ ID NO: 1401723 - RNA, 19 nt, Homo sapiens
uauguacacugguccaaag

SEQ ID NO: 1401724 - RNA, 19 nt, Homo sapiens
cacuagaauugguauggaa

SEQ ID NO: 1401725 - RNA, 19 nt, Homo sapiens
uuggacacuucauuuguaa

SEQ ID NO: 1401726 - RNA, 19 nt, Homo sapiens
gguauacaauaaggagaau

SEQ ID NO: 1401727 - RNA, 19 nt, Homo sapiens
cagauccgcaaacgauuaa

SEQ ID NO: 1401728 - RNA, 19 nt, Homo sapiens
gggaagcuuucaacagacu

SEQ ID NO: 1401729 - RNA, 19 nt, Homo sapiens
uuucaaacuuguccgaugu

SEQ ID NO: 1401730 - RNA, 19 nt, Homo sapiens
cggcagauccgcaaacgau

SEQ ID NO: 1401731 - RNA, 19 nt, Homo sapiens
cccaggacuuuaucaacuu

SEQ ID NO: 1401732 - RNA, 19 nt, Homo sapiens
aaauggaucuauguucaca

SEQ ID NO: 1401733 - RNA, 19 nt, Homo sapiens
acugggaauuuaagaaugu

SEQ ID NO: 1401734 - RNA, 19 nt, Homo sapiens
aacaaggagguauacaaua

SEQ ID NO: 1401735 - RNA, 19 nt, Homo sapiens
gacccucuacacauccuua

SEQ ID NO: 1401736 - RNA, 19 nt, Homo sapiens
auggaucuauguucacaaa

SEQ ID NO: 1401737 - RNA, 19 nt, Homo sapiens
gaauugguauggaaaagca

SEQ ID NO: 1401738 - RNA, 19 nt, Homo sapiens
uuuaaacauuggcucgaaa

SEQ ID NO: 1401739 - RNA, 19 nt, Homo sapiens
gccuacaacugaacaucau

SEQ ID NO: 1401740 - RNA, 19 nt, Homo sapiens
ucaacagacuggacuucuc

SEQ ID NO: 1401741 - RNA, 19 nt, Homo sapiens
aaacauuggcucgaaacuu

SEQ ID NO: 1401742 - RNA, 19 nt, Homo sapiens
gcacaugacaacacuucag

SEQ ID NO: 1401743 - RNA, 19 nt, Homo sapiens
gcaaaaccaaaacucagua

SEQ ID NO: 1401744 - RNA, 19 nt, Homo sapiens
uggaagaagauguauuuca

SEQ ID NO: 1401745 - RNA, 19 nt, Homo sapiens
uggauuggaagaagaugua

SEQ ID NO: 1401746 - RNA, 19 nt, Homo sapiens
aagaccggcugcuguggaa

SEQ ID NO: 1401747 - RNA, 19 nt, Homo sapiens
uacugaaaguccuugaaga

SEQ ID NO: 1401748 - RNA, 19 nt, Homo sapiens
ggacuuuaucaacuuguuc

SEQ ID NO: 1401749 - RNA, 19 nt, Homo sapiens
cuucagcucugcaaacacu

SEQ ID NO: 1401750 - RNA, 19 nt, Homo sapiens
gauguugcagccaagaaga

SEQ ID NO: 1401751 - RNA, 19 nt, Homo sapiens
cacaaaggaaguacuaaag

SEQ ID NO: 1401752 - RNA, 19 nt, Homo sapiens
cagcacaugacaacacuuc

SEQ ID NO: 1401753 - RNA, 19 nt, Homo sapiens
gaugagaagagcggcaguu

SEQ ID NO: 1401754 - RNA, 19 nt, Homo sapiens
ccugaacuaugauguugca

SEQ ID NO: 1401755 - RNA, 19 nt, Homo sapiens
uauggcauuuggacacuuc

SEQ ID NO: 1401756 - RNA, 19 nt, Homo sapiens
gacuggagagcugggaaua

SEQ ID NO: 1401757 - RNA, 19 nt, Homo sapiens
gcugcuccguuucacuuuc

SEQ ID NO: 1401758 - RNA, 19 nt, Homo sapiens
caaacgauuaauucuguca

SEQ ID NO: 1401759 - RNA, 19 nt, Homo sapiens
ucaacugccauucuggauu

SEQ ID NO: 1401760 - RNA, 19 nt, Homo sapiens
ggaaaagcaaaauacugua

SEQ ID NO: 1401761 - RNA, 19 nt, Homo sapiens
gggaauuuaagaaugugaa

SEQ ID NO: 1401762 - RNA, 19 nt, Homo sapiens
gcucgaaacuucagagaua

SEQ ID NO: 1401763 - RNA, 19 nt, Homo sapiens
ggaagaagauguauuucaa

SEQ ID NO: 1401764 - RNA, 19 nt, Homo sapiens
ggaagaaacucugccagua

SEQ ID NO: 1401765 - RNA, 19 nt, Homo sapiens
gcagauccgcaaacgauua

SEQ ID NO: 1401766 - RNA, 19 nt, Homo sapiens
caacugccauucuggauuc

SEQ ID NO: 1401767 - RNA, 19 nt, Homo sapiens
uaacuucugugccuuuguu

SEQ ID NO: 1401768 - RNA, 19 nt, Homo sapiens
ucacugaccugccuuugug

SEQ ID NO: 1401769 - RNA, 19 nt, Homo sapiens
gcauuuggacacuucauuu

SEQ ID NO: 1401770 - RNA, 19 nt, Homo sapiens
ucaaacuuguccgauguua

SEQ ID NO: 1401771 - RNA, 19 nt, Homo sapiens
gaagaaacucugccaguac

SEQ ID NO: 1401772 - RNA, 19 nt, Homo sapiens
caaacacugucacauccuu

SEQ ID NO: 1401773 - RNA, 19 nt, Homo sapiens
aaagagcaguauggagaua

SEQ ID NO: 1401774 - RNA, 19 nt, Homo sapiens
cgcaaacgauuaauucugu

SEQ ID NO: 1401775 - RNA, 19 nt, Homo sapiens
guugcugacugggaauuua

SEQ ID NO: 1401776 - RNA, 19 nt, Homo sapiens
acaaagggcagcuggauug

SEQ ID NO: 1401777 - RNA, 19 nt, Homo sapiens
gugcuggucgggaacauua

SEQ ID NO: 1401778 - RNA, 19 nt, Homo sapiens
uguuggagcugauagcaaa

SEQ ID NO: 1401779 - RNA, 19 nt, Homo sapiens
agacuggacuucucaacug

SEQ ID NO: 1401780 - RNA, 19 nt, Homo sapiens
aacauuggcucgaaacuuc

SEQ ID NO: 1401781 - RNA, 19 nt, Homo sapiens
gaaagagcaguauggagau

SEQ ID NO: 1401782 - RNA, 19 nt, Homo sapiens
guacacugguccaaagagu

SEQ ID NO: 1401783 - RNA, 19 nt, Homo sapiens
caacagacuggacuucuca

SEQ ID NO: 1401784 - RNA, 19 nt, Homo sapiens
ggacuucucaacugccauu

SEQ ID NO: 1401785 - RNA, 19 nt, Homo sapiens
aagggcagcuggauuggaa

SEQ ID NO: 1401786 - RNA, 19 nt, Homo sapiens
uuuggacacuucauuugua

SEQ ID NO: 1401787 - RNA, 19 nt, Homo sapiens
gagcugggaauauggcauu

SEQ ID NO: 1401788 - RNA, 19 nt, Homo sapiens
gauguuacccaaggaaaga

SEQ ID NO: 1401789 - RNA, 19 nt, Homo sapiens
gauccgcaaacgauuaauu

SEQ ID NO: 1401790 - RNA, 19 nt, Homo sapiens
cuaacuggcucauucuuac

SEQ ID NO: 1401791 - RNA, 19 nt, Homo sapiens
ccaaagagucggcaagucu

SEQ ID NO: 1401792 - RNA, 19 nt, Homo sapiens
gaagaccagcaaaacauua

SEQ ID NO: 1401793 - RNA, 19 nt, Homo sapiens
caaagucacagcucacauc

SEQ ID NO: 1401794 - RNA, 19 nt, Homo sapiens
gacugggaauuuaagaaug

SEQ ID NO: 1401795 - RNA, 19 nt, Homo sapiens
cuggagagcugggaauaug

SEQ ID NO: 1401796 - RNA, 19 nt, Homo sapiens
ccaggacuuuaucaacuug

SEQ ID NO: 1401797 - RNA, 19 nt, Homo sapiens
cagcuggauuggaagaaga

SEQ ID NO: 1401798 - RNA, 19 nt, Homo sapiens
ucuaacuggcucauucuua

SEQ ID NO: 1401799 - RNA, 19 nt, Homo sapiens
gacaaagggcagcuggauu

SEQ ID NO: 1401800 - RNA, 19 nt, Homo sapiens
guacugaaaguccuugaag

SEQ ID NO: 1401801 - RNA, 19 nt, Homo sapiens
ccagaagauuuaacuacgu

SEQ ID NO: 1401802 - RNA, 19 nt, Homo sapiens
ucacuagaauugguaugga

SEQ ID NO: 1401803 - RNA, 19 nt, Homo sapiens
ugacugggaauuuaagaau

SEQ ID NO: 1401804 - RNA, 19 nt, Homo sapiens
caaggaaagagcaguaugg

SEQ ID NO: 1401805 - RNA, 19 nt, Homo sapiens
gcagcuggauuggaagaag

SEQ ID NO: 1401806 - RNA, 19 nt, Homo sapiens
uauguacacugguccaaag

SEQ ID NO: 1401807 - RNA, 19 nt, Homo sapiens
cacuagaauugguauggaa

SEQ ID NO: 1401808 - RNA, 19 nt, Homo sapiens
uuggacacuucauuuguaa

SEQ ID NO: 1401809 - RNA, 19 nt, Homo sapiens
cagauccgcaaacgauuaa

SEQ ID NO: 1401810 - RNA, 19 nt, Homo sapiens
gaguaacuucugugccuuu

SEQ ID NO: 1401811 - RNA, 19 nt, Homo sapiens
ccaguuggguuguucuaac

SEQ ID NO: 1401812 - RNA, 19 nt, Homo sapiens
gggaagcuuucaacagacu

SEQ ID NO: 1401813 - RNA, 19 nt, Homo sapiens
uuucaaacuuguccgaugu

SEQ ID NO: 1401814 - RNA, 19 nt, Homo sapiens
cggcagauccgcaaacgau

SEQ ID NO: 1401815 - RNA, 19 nt, Homo sapiens
guucagcgccauggauauu

SEQ ID NO: 1401816 - RNA, 19 nt, Homo sapiens
cccaggacuuuaucaacuu

SEQ ID NO: 1401817 - RNA, 19 nt, Homo sapiens
acugggaauuuaagaaugu

SEQ ID NO: 1401818 - RNA, 19 nt, Homo sapiens
gacccucuacacauccuua

SEQ ID NO: 1401819 - RNA, 19 nt, Homo sapiens
gaauugguauggaaaagca

SEQ ID NO: 1401820 - RNA, 19 nt, Homo sapiens
uuuaaacauuggcucgaaa

SEQ ID NO: 1401821 - RNA, 19 nt, Homo sapiens
gccuacaacugaacaucau

SEQ ID NO: 1401822 - RNA, 19 nt, Homo sapiens
ucaacagacuggacuucuc

SEQ ID NO: 1401823 - RNA, 19 nt, Homo sapiens
aaacauuggcucgaaacuu

SEQ ID NO: 1401824 - RNA, 19 nt, Homo sapiens
gcacaugacaacacuucag

SEQ ID NO: 1401825 - RNA, 19 nt, Homo sapiens
uggaagaagauguauuuca

SEQ ID NO: 1401826 - RNA, 19 nt, Homo sapiens
uggauuggaagaagaugua

SEQ ID NO: 1401827 - RNA, 19 nt, Homo sapiens
aagaccggcugcuguggaa

SEQ ID NO: 1401828 - RNA, 19 nt, Homo sapiens
uacugaaaguccuugaaga

SEQ ID NO: 1401829 - RNA, 19 nt, Homo sapiens
uguucuaacuggcucauuc

SEQ ID NO: 1401830 - RNA, 19 nt, Homo sapiens
ggacuuuaucaacuuguuc

SEQ ID NO: 1401831 - RNA, 19 nt, Homo sapiens
cuucagcucugcaaacacu

SEQ ID NO: 1401832 - RNA, 19 nt, Homo sapiens
agacaggcaucaagcucau

SEQ ID NO: 1401833 - RNA, 19 nt, Homo sapiens
cagcacaugacaacacuuc

SEQ ID NO: 1401834 - RNA, 19 nt, Homo sapiens
uggcaggaguaacuucugu

SEQ ID NO: 1401835 - RNA, 19 nt, Homo sapiens
uauggcauuuggacacuuc

SEQ ID NO: 1401836 - RNA, 19 nt, Homo sapiens
gacuggagagcugggaaua

SEQ ID NO: 1401837 - RNA, 19 nt, Homo sapiens
gcugcuccguuucacuuuc

SEQ ID NO: 1401838 - RNA, 19 nt, Homo sapiens
ucaacugccauucuggauu

SEQ ID NO: 1401839 - RNA, 19 nt, Homo sapiens
caaacgauuaauucuguca

SEQ ID NO: 1401840 - RNA, 19 nt, Homo sapiens
ggaaaagcaaaauacugua

SEQ ID NO: 1401841 - RNA, 19 nt, Homo sapiens
gggaauuuaagaaugugaa

SEQ ID NO: 1401842 - RNA, 19 nt, Homo sapiens
cucgaaacuucagagauaa

SEQ ID NO: 1401843 - RNA, 19 nt, Homo sapiens
cuucucaacugccauucug

SEQ ID NO: 1401844 - RNA, 19 nt, Homo sapiens
gaccggcugcuguggaaga

SEQ ID NO: 1401845 - RNA, 19 nt, Homo sapiens
ggucgggaacauuaacaug

SEQ ID NO: 1401846 - RNA, 19 nt, Homo sapiens
cauuuggacacuucauuug

SEQ ID NO: 1401847 - RNA, 19 nt, Homo sapiens
gauuggaagaagauguauu

SEQ ID NO: 1401848 - RNA, 19 nt, Homo sapiens
cacaugacaacacuucaga

SEQ ID NO: 1401849 - RNA, 19 nt, Homo sapiens
ccaaggaaagagcaguaug

SEQ ID NO: 1401850 - RNA, 19 nt, Homo sapiens
uccagacccucuacacauc

SEQ ID NO: 1401851 - RNA, 19 nt, Homo sapiens
ggcauuuggacacuucauu

SEQ ID NO: 1401852 - RNA, 19 nt, Homo sapiens
aaacacugucacauccuuu

SEQ ID NO: 1401853 - RNA, 19 nt, Homo sapiens
gcaaagucacagcucacau

SEQ ID NO: 1401854 - RNA, 19 nt, Homo sapiens
ccaaaagaacuucaugaau

SEQ ID NO: 1401855 - RNA, 19 nt, Homo sapiens
gaacaugcaccuacauuua

SEQ ID NO: 1401856 - RNA, 19 nt, Homo sapiens
gggauggucucaacaaaua

SEQ ID NO: 1401857 - RNA, 19 nt, Homo sapiens
caacaacuaugcauucuga

SEQ ID NO: 1401858 - RNA, 19 nt, Homo sapiens
aaacagaguuggcaguaua

SEQ ID NO: 1401859 - RNA, 19 nt, Homo sapiens
caacaaauaugacuucuac

SEQ ID NO: 1401860 - RNA, 19 nt, Homo sapiens
ugaaagacgucaucacuga

SEQ ID NO: 1401861 - RNA, 19 nt, Homo sapiens
agagaacgcuagauauuaa

SEQ ID NO: 1401862 - RNA, 19 nt, Homo sapiens
gcucagauguccuaaugaa

SEQ ID NO: 1401863 - RNA, 19 nt, Homo sapiens
acaaacaaguccuaucuuu

SEQ ID NO: 1401864 - RNA, 19 nt, Homo sapiens
ccucaaaucccuccucuua

SEQ ID NO: 1401865 - RNA, 19 nt, Homo sapiens
gggcauuggucacauauga

SEQ ID NO: 1401866 - RNA, 19 nt, Homo sapiens
caauccagauguauaagua

SEQ ID NO: 1401867 - RNA, 19 nt, Homo sapiens
gaaauaaacaucuggaucu

SEQ ID NO: 1401868 - RNA, 19 nt, Homo sapiens
aaacaggccaugcauauaa

SEQ ID NO: 1401869 - RNA, 19 nt, Homo sapiens
gaugcugcccuaucaauua

SEQ ID NO: 1401870 - RNA, 19 nt, Homo sapiens
caaacaauccagauguaua

SEQ ID NO: 1401871 - RNA, 19 nt, Homo sapiens
ucauuugccuugaaaguuu

SEQ ID NO: 1401872 - RNA, 19 nt, Homo sapiens
caucugggcauacaaauaa

SEQ ID NO: 1401873 - RNA, 19 nt, Homo sapiens
aagaaccgcuuguaugauu

SEQ ID NO: 1401874 - RNA, 19 nt, Homo sapiens
auaaagaacuucagugcuu

SEQ ID NO: 1401875 - RNA, 19 nt, Homo sapiens
gcugauggcugaguuguau

SEQ ID NO: 1401876 - RNA, 19 nt, Homo sapiens
guaacaaucacaacaacua

SEQ ID NO: 1401877 - RNA, 19 nt, Homo sapiens
gagcugcuuucaauaucua

SEQ ID NO: 1401878 - RNA, 19 nt, Homo sapiens
agacuuaguugucaguauu

SEQ ID NO: 1401879 - RNA, 19 nt, Homo sapiens
uuacagagaacgcuagaua

SEQ ID NO: 1401880 - RNA, 19 nt, Homo sapiens
ucacauaugaccaguaauu

SEQ ID NO: 1401881 - RNA, 19 nt, Homo sapiens
cagagaacgcuagauauua

SEQ ID NO: 1401882 - RNA, 19 nt, Homo sapiens
aaacacaccuaacuuuaag

SEQ ID NO: 1401883 - RNA, 19 nt, Homo sapiens
uagcucagauguccuaaug

SEQ ID NO: 1401884 - RNA, 19 nt, Homo sapiens
aacuagaucugaagcauaa

SEQ ID NO: 1401885 - RNA, 19 nt, Homo sapiens
guugucagcuuuuguuuua

SEQ ID NO: 1401886 - RNA, 19 nt, Homo sapiens
guagagcugcuuucaauau

SEQ ID NO: 1401887 - RNA, 19 nt, Homo sapiens
uuucagagcuggauauauc

SEQ ID NO: 1401888 - RNA, 19 nt, Homo sapiens
gcauuaaggagcacauauu

SEQ ID NO: 1401889 - RNA, 19 nt, Homo sapiens
gaaguacucucagaugcau

SEQ ID NO: 1401890 - RNA, 19 nt, Homo sapiens
uguaguaguuggucuagaa

SEQ ID NO: 1401891 - RNA, 19 nt, Homo sapiens
ucacagaacacaucucaga

SEQ ID NO: 1401892 - RNA, 19 nt, Homo sapiens
aaugaaacuuccaacagua

SEQ ID NO: 1401893 - RNA, 19 nt, Homo sapiens
guagagacaccaauauuag

SEQ ID NO: 1401894 - RNA, 19 nt, Homo sapiens
uguagagacaccaauauua

SEQ ID NO: 1401895 - RNA, 19 nt, Homo sapiens
gcacaguauuguagagaca

SEQ ID NO: 1401896 - RNA, 19 nt, Homo sapiens
ucucagaugcauuauguua

SEQ ID NO: 1401897 - RNA, 19 nt, Homo sapiens
aaaugaaacuuccaacagu

SEQ ID NO: 1401898 - RNA, 19 nt, Homo sapiens
gaccauauuucuuaagcau

SEQ ID NO: 1401899 - RNA, 19 nt, Homo sapiens
guaacaaggguuuggguuu

SEQ ID NO: 1401900 - RNA, 19 nt, Homo sapiens
ggauaugauuggauguaug

SEQ ID NO: 1401901 - RNA, 19 nt, Homo sapiens
ucaaaucccuccucuuacu

SEQ ID NO: 1401902 - RNA, 19 nt, Homo sapiens
gaccaaggauggaauacag

SEQ ID NO: 1401903 - RNA, 19 nt, Homo sapiens
gagcuuuguuggugguauu

SEQ ID NO: 1401904 - RNA, 19 nt, Homo sapiens
cagaguuggcaguauauua

SEQ ID NO: 1401905 - RNA, 19 nt, Homo sapiens
gaauaauccaugaaaggaa

SEQ ID NO: 1401906 - RNA, 19 nt, Homo sapiens
aacaaacaauccagaugua

SEQ ID NO: 1401907 - RNA, 19 nt, Homo sapiens
gguuugaaguaguuuaguu

SEQ ID NO: 1401908 - RNA, 19 nt, Homo sapiens
caaucaaacuagaucugaa

SEQ ID NO: 1401909 - RNA, 19 nt, Homo sapiens
gaagaggcauucgguaucg

SEQ ID NO: 1401910 - RNA, 19 nt, Homo sapiens
gauaucaacauccacaaug

SEQ ID NO: 1401911 - RNA, 19 nt, Homo sapiens
ccacugcauucuugguauu

SEQ ID NO: 1401912 - RNA, 19 nt, Homo sapiens
aaagagguauguagucaca

SEQ ID NO: 1401913 - RNA, 19 nt, Homo sapiens
ccuccuagaaguuagauua

SEQ ID NO: 1401914 - RNA, 19 nt, Homo sapiens
gaaacaaaauacuccaaga

SEQ ID NO: 1401915 - RNA, 19 nt, Homo sapiens
gccucagacuccaguaaua

SEQ ID NO: 1401916 - RNA, 19 nt, Homo sapiens
acagagaacgcuagauauu

SEQ ID NO: 1401917 - RNA, 19 nt, Homo sapiens
agacaccaauauuagcuaa

SEQ ID NO: 1401918 - RNA, 19 nt, Homo sapiens
gcguaaugcuguguuuauu

SEQ ID NO: 1401919 - RNA, 19 nt, Homo sapiens
caaacuagaucugaagcau

SEQ ID NO: 1401920 - RNA, 19 nt, Homo sapiens
cauaugaccaguaauugaa

SEQ ID NO: 1401921 - RNA, 19 nt, Homo sapiens
aaccauagaugaacaugau

SEQ ID NO: 1401922 - RNA, 19 nt, Homo sapiens
gacaucugcugcuucauca

SEQ ID NO: 1401923 - RNA, 19 nt, Homo sapiens
aaacaaacaauccagaugu

SEQ ID NO: 1401924 - RNA, 19 nt, Homo sapiens
gaaguaguuuaguuauguc

SEQ ID NO: 1401925 - RNA, 19 nt, Homo sapiens
gauaugauuggauguaugu

SEQ ID NO: 1401926 - RNA, 19 nt, Homo sapiens
auacuaagauggcauuucu

SEQ ID NO: 1401927 - RNA, 19 nt, Homo sapiens
gguauguagucacaguaaa

SEQ ID NO: 1401928 - RNA, 19 nt, Homo sapiens
gaaagacgucaucacugaa

SEQ ID NO: 1401929 - RNA, 19 nt, Homo sapiens
gcaaguucauaguaagaca

SEQ ID NO: 1401930 - RNA, 19 nt, Homo sapiens
ccacaauaguucagugaca

SEQ ID NO: 1401931 - RNA, 19 nt, Homo sapiens
cuguagagcugcuuucaau

SEQ ID NO: 1401932 - RNA, 19 nt, Homo sapiens
cauuaaggagcacauauuu

SEQ ID NO: 1401933 - RNA, 19 nt, Homo sapiens
uaaacaggccaugcauaua

SEQ ID NO: 1401934 - RNA, 19 nt, Homo sapiens
guacuuugaauguagguuu

SEQ ID NO: 1401935 - RNA, 19 nt, Homo sapiens
gaacgcuagauauuaagaa

SEQ ID NO: 1401936 - RNA, 19 nt, Homo sapiens
aacuaaaccugcaggauga

SEQ ID NO: 1401937 - RNA, 19 nt, Homo sapiens
gaaucacaccaguuucuga

SEQ ID NO: 1401938 - RNA, 19 nt, Homo sapiens
caaaugaaacuuccaacag

SEQ ID NO: 1401939 - RNA, 19 nt, Homo sapiens
uguaaacacaccuaacuuu

SEQ ID NO: 1401940 - RNA, 19 nt, Homo sapiens
ccacacagaaauuauacaa

SEQ ID NO: 1401941 - RNA, 19 nt, Homo sapiens
uauagaccguucauacaau

SEQ ID NO: 1401942 - RNA, 19 nt, Homo sapiens
ucacaacaacuaugcauuc

SEQ ID NO: 1401943 - RNA, 19 nt, Homo sapiens
acucucagaugcauuaugu

SEQ ID NO: 1401944 - RNA, 19 nt, Homo sapiens
aaacuagaucugaagcaua

SEQ ID NO: 1401945 - RNA, 19 nt, Homo sapiens
ggguuuggguuuugaaaua

SEQ ID NO: 1401946 - RNA, 19 nt, Homo sapiens
gcugcccuaucaauuaauu

SEQ ID NO: 1401947 - RNA, 19 nt, Homo sapiens
gaaccauagaugaacauga

SEQ ID NO: 1401948 - RNA, 19 nt, Homo sapiens
gcaaagaaaggaucaaaau

SEQ ID NO: 1401949 - RNA, 19 nt, Homo sapiens
cuuaaagucuacacccaaa

SEQ ID NO: 1401950 - RNA, 19 nt, Homo sapiens
uaaacagaguuggcaguau

SEQ ID NO: 1401951 - RNA, 19 nt, Homo sapiens
guacuaggcagaagccaau

SEQ ID NO: 1401952 - RNA, 19 nt, Homo sapiens
aaauugagggaaaugguua

SEQ ID NO: 1401953 - RNA, 19 nt, Homo sapiens
caaaagagguauguaguca

SEQ ID NO: 1401954 - RNA, 19 nt, Homo sapiens
aauaauagcuuugcuuagc

SEQ ID NO: 1401955 - RNA, 19 nt, Homo sapiens
ggaaagaacuggccacaca

SEQ ID NO: 1401956 - RNA, 19 nt, Homo sapiens
gugaggaugugaauaaaua

SEQ ID NO: 1401957 - RNA, 19 nt, Homo sapiens
gaaaaggccuuaccguaua

SEQ ID NO: 1401958 - RNA, 19 nt, Homo sapiens
gaggaguacugacauaauu

SEQ ID NO: 1401959 - RNA, 19 nt, Homo sapiens
gaagauggaugccugaagu

SEQ ID NO: 1401960 - RNA, 19 nt, Homo sapiens
agaguugccuggaucauuu

SEQ ID NO: 1401961 - RNA, 19 nt, Homo sapiens
caaaauacguggucuaaag

SEQ ID NO: 1401962 - RNA, 19 nt, Homo sapiens
gcacugaucauaugcucuu

SEQ ID NO: 1401963 - RNA, 19 nt, Homo sapiens
acagugaggaugugaauaa

SEQ ID NO: 1401964 - RNA, 19 nt, Homo sapiens
gcugcuagcugaauaccau

SEQ ID NO: 1401965 - RNA, 19 nt, Homo sapiens
aaagcagcgugccugguua

SEQ ID NO: 1401966 - RNA, 19 nt, Homo sapiens
ucacaagaguugccuggau

SEQ ID NO: 1401967 - RNA, 19 nt, Homo sapiens
gauggaugccugaagugua

SEQ ID NO: 1401968 - RNA, 19 nt, Homo sapiens
ggccuuaccguauaacuga

SEQ ID NO: 1401969 - RNA, 19 nt, Homo sapiens
cuucgucgauuuguguuua

SEQ ID NO: 1401970 - RNA, 19 nt, Homo sapiens
guguuuacaucaucgacua

SEQ ID NO: 1401971 - RNA, 19 nt, Homo sapiens
gaaauuucugggagucuga

SEQ ID NO: 1401972 - RNA, 19 nt, Homo sapiens
ucugaggaguacugacaua

SEQ ID NO: 1401973 - RNA, 19 nt, Homo sapiens
ggauaccuccucuguggaa

SEQ ID NO: 1401974 - RNA, 19 nt, Homo sapiens
ggccugcguucccacguuu

SEQ ID NO: 1401975 - RNA, 19 nt, Homo sapiens
gacggaagccuguccuuuc

SEQ ID NO: 1401976 - RNA, 19 nt, Homo sapiens
ugccagcacugaucauaug

SEQ ID NO: 1401977 - RNA, 19 nt, Homo sapiens
cugcuggagucuguaaaua

SEQ ID NO: 1401978 - RNA, 19 nt, Homo sapiens
gagcuucgucgauuugugu

SEQ ID NO: 1401979 - RNA, 19 nt, Homo sapiens
gacugcugcuagcugaaua

SEQ ID NO: 1401980 - RNA, 19 nt, Homo sapiens
gaaagaacuggccacacau

SEQ ID NO: 1401981 - RNA, 19 nt, Homo sapiens
cgucgggagugaucaccua

SEQ ID NO: 1401982 - RNA, 19 nt, Homo sapiens
cagugaggaugugaauaaa

SEQ ID NO: 1401983 - RNA, 19 nt, Homo sapiens
ccaggcuccuccucccuuu

SEQ ID NO: 1401984 - RNA, 19 nt, Homo sapiens
aauaccaucugggagcaua

SEQ ID NO: 1401985 - RNA, 19 nt, Homo sapiens
gauuuguguuuacaucauc

SEQ ID NO: 1401986 - RNA, 19 nt, Homo sapiens
uugccuggaucauuugaaa

SEQ ID NO: 1401987 - RNA, 19 nt, Homo sapiens
ggagcuucgucgauuugug

SEQ ID NO: 1401988 - RNA, 19 nt, Homo sapiens
ggaguacugacauaauuac

SEQ ID NO: 1401989 - RNA, 19 nt, Homo sapiens
cgauuuguguuuacaucau

SEQ ID NO: 1401990 - RNA, 19 nt, Homo sapiens
aggaguacugacauaauua

SEQ ID NO: 1401991 - RNA, 19 nt, Homo sapiens
aaaaggccuuaccguauaa

SEQ ID NO: 1401992 - RNA, 19 nt, Homo sapiens
ugaaaaggccuuaccguau

SEQ ID NO: 1401993 - RNA, 19 nt, Homo sapiens
gauaccuccucuguggaaa

SEQ ID NO: 1401994 - RNA, 19 nt, Homo sapiens
ggaagauggaugccugaag

SEQ ID NO: 1401995 - RNA, 19 nt, Homo sapiens
gugcgagcuugcugugguu

SEQ ID NO: 1401996 - RNA, 19 nt, Homo sapiens
ugaggaguacugacauaau

SEQ ID NO: 1401997 - RNA, 19 nt, Homo sapiens
gugaucaccuacccuacag

SEQ ID NO: 1401998 - RNA, 19 nt, Homo sapiens
uaccguauaacugacuuua

SEQ ID NO: 1401999 - RNA, 19 nt, Homo sapiens
uaccuccucuguggaaaga

SEQ ID NO: 1402000 - RNA, 19 nt, Homo sapiens
gccuguccuuucuuccuuu

SEQ ID NO: 1402001 - RNA, 19 nt, Homo sapiens
ucugggagucugaggagua

SEQ ID NO: 1402002 - RNA, 19 nt, Homo sapiens
auggaugccugaaguguag

SEQ ID NO: 1402003 - RNA, 19 nt, Homo sapiens
gguccuuccacuuguagaa

SEQ ID NO: 1402004 - RNA, 19 nt, Homo sapiens
gaaguguagacugcugcua

SEQ ID NO: 1402005 - RNA, 19 nt, Homo sapiens
gacagugaggaugugaaua

SEQ ID NO: 1402006 - RNA, 19 nt, Homo sapiens
agacagugaggaugugaau

SEQ ID NO: 1402007 - RNA, 19 nt, Homo sapiens
uuaagacagugaggaugug

SEQ ID NO: 1402008 - RNA, 19 nt, Homo sapiens
acggaagccuguccuuucu

SEQ ID NO: 1402009 - RNA, 19 nt, Homo sapiens
gacaacaacuggaaaugua

SEQ ID NO: 1402010 - RNA, 19 nt, Homo sapiens
aaacauuucugucugcaua

SEQ ID NO: 1402011 - RNA, 19 nt, Homo sapiens
uaaauuacaucuccaagug

SEQ ID NO: 1402012 - RNA, 19 nt, Homo sapiens
ggaaugaagccaccaaugu

SEQ ID NO: 1402013 - RNA, 19 nt, Homo sapiens
gaaugaagccaccaauguu

SEQ ID NO: 1402014 - RNA, 19 nt, Homo sapiens
gacgaugguucuauugauu

SEQ ID NO: 1402015 - RNA, 19 nt, Homo sapiens
aaacacaucuugggaagug

SEQ ID NO: 1402016 - RNA, 19 nt, Homo sapiens
ggagaauuaugaggauauu

SEQ ID NO: 1402017 - RNA, 19 nt, Homo sapiens
gauaagcaagauucguuua

SEQ ID NO: 1402018 - RNA, 19 nt, Homo sapiens
caccaauguuuacuugaua

SEQ ID NO: 1402019 - RNA, 19 nt, Homo sapiens
caagaaaguacgacuauca

SEQ ID NO: 1402020 - RNA, 19 nt, Homo sapiens
caagauucguuuaagacaa

SEQ ID NO: 1402021 - RNA, 19 nt, Homo sapiens
gugcaacucucauuggaau

SEQ ID NO: 1402022 - RNA, 19 nt, Homo sapiens
ccaccaauguuuacuugau

SEQ ID NO: 1402023 - RNA, 19 nt, Homo sapiens
aagcaagauucguuuaaga

SEQ ID NO: 1402024 - RNA, 19 nt, Homo sapiens
uagcuucggucucuucaug

SEQ ID NO: 1402025 - RNA, 19 nt, Homo sapiens
ugucagagcccaacuuuua

SEQ ID NO: 1402026 - RNA, 19 nt, Homo sapiens
gcuucggucucuucaugua

SEQ ID NO: 1402027 - RNA, 19 nt, Homo sapiens
ucacgaagccuggaaugaa

SEQ ID NO: 1402028 - RNA, 19 nt, Homo sapiens
ggaaugaaaccucagaaaa

SEQ ID NO: 1402029 - RNA, 19 nt, Homo sapiens
caacaacuggaaauguauu

SEQ ID NO: 1402030 - RNA, 19 nt, Homo sapiens
gggugacgaugguucuauu

SEQ ID NO: 1402031 - RNA, 19 nt, Homo sapiens
uaagcaagauucguuuaag

SEQ ID NO: 1402032 - RNA, 19 nt, Homo sapiens
caacuuuuaugacacgaua

SEQ ID NO: 1402033 - RNA, 19 nt, Homo sapiens
aaaggagaauuaugaggau

SEQ ID NO: 1402034 - RNA, 19 nt, Homo sapiens
guuuaugccauuugcaaua

SEQ ID NO: 1402035 - RNA, 19 nt, Homo sapiens
cagaaguaauuguuucaag

SEQ ID NO: 1402036 - RNA, 19 nt, Homo sapiens
ugacgaugguucuauugau

SEQ ID NO: 1402037 - RNA, 19 nt, Homo sapiens
gcaagauucguuuaagaca

SEQ ID NO: 1402038 - RNA, 19 nt, Homo sapiens
cagaggaaacuuugucaga

SEQ ID NO: 1402039 - RNA, 19 nt, Homo sapiens
ugauuauacuguucacgaa

SEQ ID NO: 1402040 - RNA, 19 nt, Homo sapiens
gugggaauccuggaguuua

SEQ ID NO: 1402041 - RNA, 19 nt, Homo sapiens
cgaugguucuauugauuau

SEQ ID NO: 1402042 - RNA, 19 nt, Homo sapiens
gaacaaaaggagaauuaug

SEQ ID NO: 1402043 - RNA, 19 nt, Homo sapiens
aagagcaacagaaguaauu

SEQ ID NO: 1402044 - RNA, 19 nt, Homo sapiens
ggauacaaucagugagaaa

SEQ ID NO: 1402045 - RNA, 19 nt, Homo sapiens
ugggaauccuggaguuuau

SEQ ID NO: 1402046 - RNA, 19 nt, Homo sapiens
gauacaaucagugagaaau

SEQ ID NO: 1402047 - RNA, 19 nt, Homo sapiens
gaaguaauuguuucaagcu

SEQ ID NO: 1402048 - RNA, 19 nt, Homo sapiens
uaagacaacaacuggaaau

SEQ ID NO: 1402049 - RNA, 19 nt, Homo sapiens
aaugaagccaccaauguuu

SEQ ID NO: 1402050 - RNA, 19 nt, Homo sapiens
gaguuuaugccauuugcaa

SEQ ID NO: 1402051 - RNA, 19 nt, Homo sapiens
ucaagcuccugauucuuuc

SEQ ID NO: 1402052 - RNA, 19 nt, Homo sapiens
guuucaagcuccugauucu

SEQ ID NO: 1402053 - RNA, 19 nt, Homo sapiens
cacgaagccuggaaugaag

SEQ ID NO: 1402054 - RNA, 19 nt, Homo sapiens
gagcaacagaaguaauugu

SEQ ID NO: 1402055 - RNA, 19 nt, Homo sapiens
caggauacaaucagugaga

SEQ ID NO: 1402056 - RNA, 19 nt, Homo sapiens
cgauaagcaagauucguuu

SEQ ID NO: 1402057 - RNA, 19 nt, Homo sapiens
acgaugguucuauugauua

SEQ ID NO: 1402058 - RNA, 19 nt, Homo sapiens
aaggagaauuaugaggaua

SEQ ID NO: 1402059 - RNA, 19 nt, Homo sapiens
uucaagcuccugauucuuu

SEQ ID NO: 1402060 - RNA, 19 nt, Homo sapiens
gugugcaacucucauugga

SEQ ID NO: 1402061 - RNA, 19 nt, Homo sapiens
auuguucugugcauuguuu

SEQ ID NO: 1402062 - RNA, 19 nt, Homo sapiens
ucaagaaaguacgacuauc

SEQ ID NO: 1402063 - RNA, 19 nt, Homo sapiens
agacaacaacuggaaaugu

SEQ ID NO: 1402064 - RNA, 19 nt, Homo sapiens
gagcccaacuuuuaugaca

SEQ ID NO: 1402065 - RNA, 19 nt, Homo sapiens
acauuucugucugcauaaa

SEQ ID NO: 1402066 - RNA, 19 nt, Homo sapiens
ccugauucuuucuacuaaa

SEQ ID NO: 1402067 - RNA, 19 nt, Homo sapiens
gacacgauaagcaagauuc

SEQ ID NO: 1402068 - RNA, 19 nt, Homo sapiens
augaagccaccaauguuua

SEQ ID NO: 1402069 - RNA, 19 nt, Homo sapiens
uccugauucuuucuacuaa

SEQ ID NO: 1402070 - RNA, 19 nt, Homo sapiens
gugacgaugguucuauuga

SEQ ID NO: 1402071 - RNA, 19 nt, Homo sapiens
aagauucguuuaagacaac

SEQ ID NO: 1402072 - RNA, 19 nt, Homo sapiens
uuaugaggauauucagugu

SEQ ID NO: 1402073 - RNA, 19 nt, Homo sapiens
uggaaugaaaccucagaaa

SEQ ID NO: 1402074 - RNA, 19 nt, Homo sapiens
caccuacagaggaaacuuu

SEQ ID NO: 1402075 - RNA, 19 nt, Homo sapiens
cuuguuagcuucggucucu

SEQ ID NO: 1402076 - RNA, 19 nt, Homo sapiens
cuaaaucaugaacagcuuu

SEQ ID NO: 1402077 - RNA, 19 nt, Homo sapiens
acuaaaucaugaacagcuu

SEQ ID NO: 1402078 - RNA, 19 nt, Homo sapiens
ucuacuaaaucaugaacag

SEQ ID NO: 1402079 - RNA, 19 nt, Homo sapiens
cuacagaggaaacuuuguc

SEQ ID NO: 1402080 - RNA, 19 nt, Homo sapiens
agccaccaauguuuacuug

SEQ ID NO: 1402081 - RNA, 19 nt, Homo sapiens
gccaagaccugugauuccu

SEQ ID NO: 1402082 - RNA, 19 nt, Homo sapiens
uaguuauccuuguuagcuu

SEQ ID NO: 1402083 - RNA, 19 nt, Homo sapiens
ggugacgaugguucuauug

SEQ ID NO: 1402084 - RNA, 19 nt, Homo sapiens
aaagagcaacagaaguaau

SEQ ID NO: 1402085 - RNA, 19 nt, Homo sapiens
uuuaagacaacaacuggaa

SEQ ID NO: 1402086 - RNA, 19 nt, Homo sapiens
ggaaagauguccuuaauug

SEQ ID NO: 1402087 - RNA, 19 nt, Homo sapiens
gaaauucgagagcaucuua

SEQ ID NO: 1402088 - RNA, 19 nt, Homo sapiens
gaucugugguugagguuua

SEQ ID NO: 1402089 - RNA, 19 nt, Homo sapiens
gaaggaggcugagugacua

SEQ ID NO: 1402090 - RNA, 19 nt, Homo sapiens
uaaguaagcuacccugcua

SEQ ID NO: 1402091 - RNA, 19 nt, Homo sapiens
agaaagauguugacaguga

SEQ ID NO: 1402092 - RNA, 19 nt, Homo sapiens
gcaagaagccuauguugau

SEQ ID NO: 1402093 - RNA, 19 nt, Homo sapiens
ucacauggcuccaccuuau

SEQ ID NO: 1402094 - RNA, 19 nt, Homo sapiens
gguguugucucacuuauug

SEQ ID NO: 1402095 - RNA, 19 nt, Homo sapiens
caaagaagauccuaauacu

SEQ ID NO: 1402096 - RNA, 19 nt, Homo sapiens
gaaggagugucccagacua

SEQ ID NO: 1402097 - RNA, 19 nt, Homo sapiens
gagcaaggcccaaggauga

SEQ ID NO: 1402098 - RNA, 19 nt, Homo sapiens
gcaacuacaagcccaaaua

SEQ ID NO: 1402099 - RNA, 19 nt, Homo sapiens
ccagaaagauguugacagu

SEQ ID NO: 1402100 - RNA, 19 nt, Homo sapiens
gcacagagacaaagaagau

SEQ ID NO: 1402101 - RNA, 19 nt, Homo sapiens
gaagaugaguucuauaagc

SEQ ID NO: 1402102 - RNA, 19 nt, Homo sapiens
ccaagaaccuggaacuuag

SEQ ID NO: 1402103 - RNA, 19 nt, Homo sapiens
gauauugacucuaacucuu

SEQ ID NO: 1402104 - RNA, 19 nt, Homo sapiens
gaggaaacccuugcacaua

SEQ ID NO: 1402105 - RNA, 19 nt, Homo sapiens
ugaagaagaggccauauuu

SEQ ID NO: 1402106 - RNA, 19 nt, Homo sapiens
cuacuggacuggauauuga

SEQ ID NO: 1402107 - RNA, 19 nt, Homo sapiens
gagaagaggccaauaguag

SEQ ID NO: 1402108 - RNA, 19 nt, Homo sapiens
gaugaugauuucagucuug

SEQ ID NO: 1402109 - RNA, 19 nt, Homo sapiens
ggguuucucuccuuauuaa

SEQ ID NO: 1402110 - RNA, 19 nt, Homo sapiens
cgaggucacuguugaauuc

SEQ ID NO: 1402111 - RNA, 19 nt, Homo sapiens
ggacaaauagagaagauug

SEQ ID NO: 1402112 - RNA, 19 nt, Homo sapiens
aaacugagguccaaguaau

SEQ ID NO: 1402113 - RNA, 19 nt, Homo sapiens
gaaagauguccuuaauuga

SEQ ID NO: 1402114 - RNA, 19 nt, Homo sapiens
gacuggauauugacucuaa

SEQ ID NO: 1402115 - RNA, 19 nt, Homo sapiens
caagaagccuauguugauu

SEQ ID NO: 1402116 - RNA, 19 nt, Homo sapiens
gggcuaaacaucagacuaa

SEQ ID NO: 1402117 - RNA, 19 nt, Homo sapiens
guggaaagauguccuuaau

SEQ ID NO: 1402118 - RNA, 19 nt, Homo sapiens
gcacagggcuaaacaucag

SEQ ID NO: 1402119 - RNA, 19 nt, Homo sapiens
cuaaaucccuguccugugu

SEQ ID NO: 1402120 - RNA, 19 nt, Homo sapiens
gaagaagaggccauauuug

SEQ ID NO: 1402121 - RNA, 19 nt, Homo sapiens
ggagaagaggccaauagua

SEQ ID NO: 1402122 - RNA, 19 nt, Homo sapiens
cugaagaguuugaagaauu

SEQ ID NO: 1402123 - RNA, 19 nt, Homo sapiens
ggacaacaaaguuaauaug

SEQ ID NO: 1402124 - RNA, 19 nt, Homo sapiens
gaacugugucaccuaagua

SEQ ID NO: 1402125 - RNA, 19 nt, Homo sapiens
uauccauccucuagaguua

SEQ ID NO: 1402126 - RNA, 19 nt, Homo sapiens
uuaccugacuuucuuugua

SEQ ID NO: 1402127 - RNA, 19 nt, Homo sapiens
gggacgaggucacuguuga

SEQ ID NO: 1402128 - RNA, 19 nt, Homo sapiens
uauaagcaguccuggguuu

SEQ ID NO: 1402129 - RNA, 19 nt, Homo sapiens
gaaagauguugacagugau

SEQ ID NO: 1402130 - RNA, 19 nt, Homo sapiens
ugaagaguuugaagaauuc

SEQ ID NO: 1402131 - RNA, 19 nt, Homo sapiens
gugauagggucaaacaaga

SEQ ID NO: 1402132 - RNA, 19 nt, Homo sapiens
auagagaacuagucaaugu

SEQ ID NO: 1402133 - RNA, 19 nt, Homo sapiens
gacaaagaagauccuaaua

SEQ ID NO: 1402134 - RNA, 19 nt, Homo sapiens
ggauagagaacuagucaau

SEQ ID NO: 1402135 - RNA, 19 nt, Homo sapiens
caaagagcccugaguagug

SEQ ID NO: 1402136 - RNA, 19 nt, Homo sapiens
uaccugacuuucuuuguaa

SEQ ID NO: 1402137 - RNA, 19 nt, Homo sapiens
ggguggagcuucagcaauc

SEQ ID NO: 1402138 - RNA, 19 nt, Homo sapiens
acacacugauugccaacua

SEQ ID NO: 1402139 - RNA, 19 nt, Homo sapiens
gcagcugacuggaauaagg

SEQ ID NO: 1402140 - RNA, 19 nt, Homo sapiens
gcagcugcauacaauguga

SEQ ID NO: 1402141 - RNA, 19 nt, Homo sapiens
gagaugaggccugcuuuga

SEQ ID NO: 1402142 - RNA, 19 nt, Homo sapiens
gaagaggccaauaguagau

SEQ ID NO: 1402143 - RNA, 19 nt, Homo sapiens
gaucauggcccagggaaga

SEQ ID NO: 1402144 - RNA, 19 nt, Homo sapiens
gaaaauugguucugaagag

SEQ ID NO: 1402145 - RNA, 19 nt, Homo sapiens
gaggaggaagucauuauug

SEQ ID NO: 1402146 - RNA, 19 nt, Homo sapiens
ggaaacccuugcacauagu

SEQ ID NO: 1402147 - RNA, 19 nt, Homo sapiens
cccaagaaccuggaacuua

SEQ ID NO: 1402148 - RNA, 19 nt, Homo sapiens
aaugaacugugucaccuaa

SEQ ID NO: 1402149 - RNA, 19 nt, Homo sapiens
gagcagcugacuggaauaa

SEQ ID NO: 1402150 - RNA, 19 nt, Homo sapiens
cugaaaugcuugaggcaaa

SEQ ID NO: 1402151 - RNA, 19 nt, Homo sapiens
gaauucaaaccuggucuuu

SEQ ID NO: 1402152 - RNA, 19 nt, Homo sapiens
agugauagguucagagaug

SEQ ID NO: 1402153 - RNA, 19 nt, Homo sapiens
cuaagggccugucuaugga

SEQ ID NO: 1402154 - RNA, 19 nt, Homo sapiens
ggaaggaggcugagugacu

SEQ ID NO: 1402155 - RNA, 19 nt, Homo sapiens
ugaagaaacaaaccuguga

SEQ ID NO: 1402156 - RNA, 19 nt, Homo sapiens
gcaggaaucuuugcuucag

SEQ ID NO: 1402157 - RNA, 19 nt, Homo sapiens
gaaacucagggcccagaaa

SEQ ID NO: 1402158 - RNA, 19 nt, Homo sapiens
cugaagaugaguucuauaa

SEQ ID NO: 1402159 - RNA, 19 nt, Homo sapiens
gaugccaaaugaauaucaa

SEQ ID NO: 1402160 - RNA, 19 nt, Homo sapiens
gaguagugcuuugguguuc

SEQ ID NO: 1402161 - RNA, 19 nt, Homo sapiens
gugggucucuuuaacauag

SEQ ID NO: 1402162 - RNA, 19 nt, Homo sapiens
aaacaugauugagacauuc

SEQ ID NO: 1402163 - RNA, 19 nt, Homo sapiens
cauacaaugugagcugaaa

SEQ ID NO: 1402164 - RNA, 19 nt, Homo sapiens
aagaugaguucuauaagca

SEQ ID NO: 1402165 - RNA, 19 nt, Homo sapiens
ugacuuucuuuguaacuug

SEQ ID NO: 1402166 - RNA, 19 nt, Homo sapiens
guuuugagcuggaucauuu

SEQ ID NO: 1402167 - RNA, 19 nt, Homo sapiens
caacuacaagcccaaauag

SEQ ID NO: 1402168 - RNA, 19 nt, Homo sapiens
gcaauggguaugagaagug

SEQ ID NO: 1402169 - RNA, 19 nt, Homo sapiens
guccugaguucacauuuca

SEQ ID NO: 1402170 - RNA, 19 nt, Homo sapiens
aguaauggguggugcaaga

SEQ ID NO: 1402171 - RNA, 19 nt, Homo sapiens
gcuauugaauuugucugaa

SEQ ID NO: 1402172 - RNA, 19 nt, Homo sapiens
gaguucacauuucaguaug

SEQ ID NO: 1402173 - RNA, 19 nt, Homo sapiens
guagguggcgcucguucua

SEQ ID NO: 1402174 - RNA, 19 nt, Homo sapiens
ccaaagagcccugaguagu

SEQ ID NO: 1402175 - RNA, 19 nt, Homo sapiens
aagauguccuuaauugaug

SEQ ID NO: 1402176 - RNA, 19 nt, Homo sapiens
cuaugacuauugacuauca

SEQ ID NO: 1402177 - RNA, 19 nt, Homo sapiens
aggaaacccuugcacauag

SEQ ID NO: 1402178 - RNA, 19 nt, Homo sapiens
gagauuucauucgagauuc

SEQ ID NO: 1402179 - RNA, 19 nt, Homo sapiens
ucagggaggaggcaaauau

SEQ ID NO: 1402180 - RNA, 19 nt, Homo sapiens
uguggaugcugaaaccuuu

SEQ ID NO: 1402181 - RNA, 19 nt, Homo sapiens
gagucuggaucaguuacua

SEQ ID NO: 1402182 - RNA, 19 nt, Homo sapiens
aaacggaggcucaaggaau

SEQ ID NO: 1402183 - RNA, 19 nt, Homo sapiens
aaacugaggcccaagcaau

SEQ ID NO: 1402184 - RNA, 19 nt, Homo sapiens
ucacuaugacuauugacua

SEQ ID NO: 1402185 - RNA, 19 nt, Homo sapiens
gagcuucagcaaucuguga

SEQ ID NO: 1402186 - RNA, 19 nt, Homo sapiens
caacauagcugaccuuuua

SEQ ID NO: 1402187 - RNA, 19 nt, Homo sapiens
gcgaaaggcuuacaauuaa

SEQ ID NO: 1402188 - RNA, 19 nt, Homo sapiens
ggacaucgcgucucuuaua

SEQ ID NO: 1402189 - RNA, 19 nt, Homo sapiens
gaaagucucuuccaguuca

SEQ ID NO: 1402190 - RNA, 19 nt, Homo sapiens
gaagacaguuggagaugga

SEQ ID NO: 1402191 - RNA, 19 nt, Homo sapiens
ugacaaggcaguuugaaua

SEQ ID NO: 1402192 - RNA, 19 nt, Homo sapiens
gaaagagaaguaaagagua

SEQ ID NO: 1402193 - RNA, 19 nt, Homo sapiens
gaacugacaccuugaggaa

SEQ ID NO: 1402194 - RNA, 19 nt, Homo sapiens
ccaaggagauugcgaagau

SEQ ID NO: 1402195 - RNA, 19 nt, Homo sapiens
ggugaagaauguauuaaug

SEQ ID NO: 1402196 - RNA, 19 nt, Homo sapiens
ugaaacagcuugucauuuu

SEQ ID NO: 1402197 - RNA, 19 nt, Homo sapiens
ucaaagaaauacucucaga

SEQ ID NO: 1402198 - RNA, 19 nt, Homo sapiens
ggaaagagaaguaaagagu

SEQ ID NO: 1402199 - RNA, 19 nt, Homo sapiens
cgagaaggcugaggagaaa

SEQ ID NO: 1402200 - RNA, 19 nt, Homo sapiens
gaggacaucgcgucucuua

SEQ ID NO: 1402201 - RNA, 19 nt, Homo sapiens
gucaaugucuucaugguaa

SEQ ID NO: 1402202 - RNA, 19 nt, Homo sapiens
gagagucaaugucuucaug

SEQ ID NO: 1402203 - RNA, 19 nt, Homo sapiens
ggagaaagccaaggagauu

SEQ ID NO: 1402204 - RNA, 19 nt, Homo sapiens
ggacauagacgagguggaa

SEQ ID NO: 1402205 - RNA, 19 nt, Homo sapiens
uaguagaccugucagauug

SEQ ID NO: 1402206 - RNA, 19 nt, Homo sapiens
gcagaguugugaagcgaaa

SEQ ID NO: 1402207 - RNA, 19 nt, Homo sapiens
cgaaaggcuuacaauuaaa

SEQ ID NO: 1402208 - RNA, 19 nt, Homo sapiens
uaacaguaacuucgguuua

SEQ ID NO: 1402209 - RNA, 19 nt, Homo sapiens
gagcucgucuggcgaauag

SEQ ID NO: 1402210 - RNA, 19 nt, Homo sapiens
gauggaagaugguuuugua

SEQ ID NO: 1402211 - RNA, 19 nt, Homo sapiens
guaacagucucccuuaugg

SEQ ID NO: 1402212 - RNA, 19 nt, Homo sapiens
gagauggacaauaugcuua

SEQ ID NO: 1402213 - RNA, 19 nt, Homo sapiens
ggaagacacuacgcuacuu

SEQ ID NO: 1402214 - RNA, 19 nt, Homo sapiens
ggaagaugguuuuguauau

SEQ ID NO: 1402215 - RNA, 19 nt, Homo sapiens
gaucagaaucuuccaacuu

SEQ ID NO: 1402216 - RNA, 19 nt, Homo sapiens
guagucaacugguaaggau

SEQ ID NO: 1402217 - RNA, 19 nt, Homo sapiens
gaaagaaugcgugcugguu

SEQ ID NO: 1402218 - RNA, 19 nt, Homo sapiens
gaagagaaauggggcuuaa

SEQ ID NO: 1402219 - RNA, 19 nt, Homo sapiens
ucagaaucuuccaacuuua

SEQ ID NO: 1402220 - RNA, 19 nt, Homo sapiens
uaccugaaauuuccagauu

SEQ ID NO: 1402221 - RNA, 19 nt, Homo sapiens
ugugggagauggacaauau

SEQ ID NO: 1402222 - RNA, 19 nt, Homo sapiens
guaguagaccugucagauu

SEQ ID NO: 1402223 - RNA, 19 nt, Homo sapiens
uguaauacccucacacauu

SEQ ID NO: 1402224 - RNA, 19 nt, Homo sapiens
gaaagaggagagcuauguu

SEQ ID NO: 1402225 - RNA, 19 nt, Homo sapiens
gaagaaagagaagacaguu

SEQ ID NO: 1402226 - RNA, 19 nt, Homo sapiens
ugaccucgauauggauuua

SEQ ID NO: 1402227 - RNA, 19 nt, Homo sapiens
cagaggccauuaccugaaa

SEQ ID NO: 1402228 - RNA, 19 nt, Homo sapiens
ggagcaagcugugggagau

SEQ ID NO: 1402229 - RNA, 19 nt, Homo sapiens
gauuggaggucaaagucaa

SEQ ID NO: 1402230 - RNA, 19 nt, Homo sapiens
caauugugcuuuagguuca

SEQ ID NO: 1402231 - RNA, 19 nt, Homo sapiens
gaccgugucucaaagaagu

SEQ ID NO: 1402232 - RNA, 19 nt, Homo sapiens
gcauaaaacugggaagaaa

SEQ ID NO: 1402233 - RNA, 19 nt, Homo sapiens
agcgaaaggcuuacaauua

SEQ ID NO: 1402234 - RNA, 19 nt, Homo sapiens
uaaagauaauucgggagua

SEQ ID NO: 1402235 - RNA, 19 nt, Homo sapiens
gguugagccuggugaagaa

SEQ ID NO: 1402236 - RNA, 19 nt, Homo sapiens
aagaaauacucucagaaga

SEQ ID NO: 1402237 - RNA, 19 nt, Homo sapiens
acaauaugcuuauccagau

SEQ ID NO: 1402238 - RNA, 19 nt, Homo sapiens
gaagacacuacgcuacuug

SEQ ID NO: 1402239 - RNA, 19 nt, Homo sapiens
ggaagcgccugaggaagug

SEQ ID NO: 1402240 - RNA, 19 nt, Homo sapiens
gugguaaggucggaaacua

SEQ ID NO: 1402241 - RNA, 19 nt, Homo sapiens
ggaguacaauugacaaagc

SEQ ID NO: 1402242 - RNA, 19 nt, Homo sapiens
gagaauggcauggaagaga

SEQ ID NO: 1402243 - RNA, 19 nt, Homo sapiens
gaaagccaaagaagaccua

SEQ ID NO: 1402244 - RNA, 19 nt, Homo sapiens
gcgagaaggcugaggagaa

SEQ ID NO: 1402245 - RNA, 19 nt, Homo sapiens
ucaggugaguugauuuaga

SEQ ID NO: 1402246 - RNA, 19 nt, Homo sapiens
aucagaaucuuccaacuuu

SEQ ID NO: 1402247 - RNA, 19 nt, Homo sapiens
caaagaaauacucucagaa

SEQ ID NO: 1402248 - RNA, 19 nt, Homo sapiens
gaaagauaacaguaacuuc

SEQ ID NO: 1402249 - RNA, 19 nt, Homo sapiens
ggagauggacaauaugcuu

SEQ ID NO: 1402250 - RNA, 19 nt, Homo sapiens
ggaagaaagagaagacagu

SEQ ID NO: 1402251 - RNA, 19 nt, Homo sapiens
ucugggugguucacauuua

SEQ ID NO: 1402252 - RNA, 19 nt, Homo sapiens
ugagacugcuuugcauaaa

SEQ ID NO: 1402253 - RNA, 19 nt, Homo sapiens
gagaaauggggcuuaauua

SEQ ID NO: 1402254 - RNA, 19 nt, Homo sapiens
uauggucagugauugauga

SEQ ID NO: 1402255 - RNA, 19 nt, Homo sapiens
ccacacugguaauuagaga

SEQ ID NO: 1402256 - RNA, 19 nt, Homo sapiens
cgaaagaggagagcuaugu

SEQ ID NO: 1402257 - RNA, 19 nt, Homo sapiens
guggucacguuuauucuug

SEQ ID NO: 1402258 - RNA, 19 nt, Homo sapiens
cagaggaccgugucucaaa

SEQ ID NO: 1402259 - RNA, 19 nt, Homo sapiens
aaagaagaccuaggccaua

SEQ ID NO: 1402260 - RNA, 19 nt, Homo sapiens
gaacaaaguuggggucaag

SEQ ID NO: 1402261 - RNA, 19 nt, Homo sapiens
aaagaggagagcuauguuu

SEQ ID NO: 1402262 - RNA, 19 nt, Homo sapiens
cuacugcgguacugaggaa

SEQ ID NO: 1402263 - RNA, 19 nt, Homo sapiens
cauguaacagucucccuua

SEQ ID NO: 1402264 - RNA, 19 nt, Homo sapiens
aaagaaugcgugcugguuu

SEQ ID NO: 1402265 - RNA, 19 nt, Homo sapiens
guguuaauuugccuugaaa

SEQ ID NO: 1402266 - RNA, 19 nt, Homo sapiens
ggagagcuauguuuugugu

SEQ ID NO: 1402267 - RNA, 19 nt, Homo sapiens
aaagaaauacucucagaag

SEQ ID NO: 1402268 - RNA, 19 nt, Homo sapiens
ccugaaauuuccagauugu

SEQ ID NO: 1402269 - RNA, 19 nt, Homo sapiens
gccauuaccugaaauuucc

SEQ ID NO: 1402270 - RNA, 19 nt, Homo sapiens
guaaagccagaggccauua

SEQ ID NO: 1402271 - RNA, 19 nt, Homo sapiens
ccuccuguguguguuaaua

SEQ ID NO: 1402272 - RNA, 19 nt, Homo sapiens
ugucaggugaguugauuua

SEQ ID NO: 1402273 - RNA, 19 nt, Homo sapiens
gguggaagcgccugaggaa

SEQ ID NO: 1402274 - RNA, 19 nt, Homo sapiens
guauuaaugagacugcuuu

SEQ ID NO: 1402275 - RNA, 19 nt, Homo sapiens
cuuuagaggugcaauggaa

SEQ ID NO: 1402276 - RNA, 19 nt, Homo sapiens
gaaauuuccagauuguucu

SEQ ID NO: 1402277 - RNA, 19 nt, Homo sapiens
cugcugaucuccaguucuu

SEQ ID NO: 1402278 - RNA, 19 nt, Homo sapiens
gaaagagaagacaguugga

SEQ ID NO: 1402279 - RNA, 19 nt, Homo sapiens
aaacugggaagaaagagaa

SEQ ID NO: 1402280 - RNA, 19 nt, Homo sapiens
uaaugagacugcuuugcau

SEQ ID NO: 1402281 - RNA, 19 nt, Homo sapiens
gcagggaaagagaaguaaa

SEQ ID NO: 1402282 - RNA, 19 nt, Homo sapiens
cuacagagagcuuuaagag

SEQ ID NO: 1402283 - RNA, 19 nt, Homo sapiens
gacaaggcaguuugaauag

SEQ ID NO: 1402284 - RNA, 19 nt, Homo sapiens
gagaagacaguuggagaug

SEQ ID NO: 1402285 - RNA, 19 nt, Homo sapiens
uugaugaccucgauaugga

SEQ ID NO: 1402286 - RNA, 19 nt, Homo sapiens
gauaagacguuacugauua

SEQ ID NO: 1402287 - RNA, 19 nt, Homo sapiens
gaucuaagcugaaaccaau

SEQ ID NO: 1402288 - RNA, 19 nt, Homo sapiens
aaaccaaucuucccuuuga

SEQ ID NO: 1402289 - RNA, 19 nt, Homo sapiens
uagagaaccuucggcauua

SEQ ID NO: 1402290 - RNA, 19 nt, Homo sapiens
gcagaacguggacuauuua

SEQ ID NO: 1402291 - RNA, 19 nt, Homo sapiens
gaacaaugguuuagguuuu

SEQ ID NO: 1402292 - RNA, 19 nt, Homo sapiens
ggaaagaauauuuggauug

SEQ ID NO: 1402293 - RNA, 19 nt, Homo sapiens
ggacuuacaauuccagaaa

SEQ ID NO: 1402294 - RNA, 19 nt, Homo sapiens
gaagucgccacccaaauaa

SEQ ID NO: 1402295 - RNA, 19 nt, Homo sapiens
guuaagaucuaagcugaaa

SEQ ID NO: 1402296 - RNA, 19 nt, Homo sapiens
gaacguggacuauuuagag

SEQ ID NO: 1402297 - RNA, 19 nt, Homo sapiens
ugaaaccaaucuucccuuu

SEQ ID NO: 1402298 - RNA, 19 nt, Homo sapiens
gaagacaugcccaccagaa

SEQ ID NO: 1402299 - RNA, 19 nt, Homo sapiens
gcaaaucaaagacuucaga

SEQ ID NO: 1402300 - RNA, 19 nt, Homo sapiens
agaagucgccacccaaaua

SEQ ID NO: 1402301 - RNA, 19 nt, Homo sapiens
ggauaagacguuacugauu

SEQ ID NO: 1402302 - RNA, 19 nt, Homo sapiens
gacuuauacugcccaauuu

SEQ ID NO: 1402303 - RNA, 19 nt, Homo sapiens
aaacuaugauuucgugaug

SEQ ID NO: 1402304 - RNA, 19 nt, Homo sapiens
ccaccucccugcucaauca

SEQ ID NO: 1402305 - RNA, 19 nt, Homo sapiens
caaauuuggcccaguacua

SEQ ID NO: 1402306 - RNA, 19 nt, Homo sapiens
gaaaggaaugguugucaau

SEQ ID NO: 1402307 - RNA, 19 nt, Homo sapiens
gggaagucguccaagauga

SEQ ID NO: 1402308 - RNA, 19 nt, Homo sapiens
ugcagaacguggacuauuu

SEQ ID NO: 1402309 - RNA, 19 nt, Homo sapiens
agagagauaugaggaaaga

SEQ ID NO: 1402310 - RNA, 19 nt, Homo sapiens
gcgaagggaaguauucaaa

SEQ ID NO: 1402311 - RNA, 19 nt, Homo sapiens
ugagagagauaugaggaaa

SEQ ID NO: 1402312 - RNA, 19 nt, Homo sapiens
gcacaaacccacugagaac

SEQ ID NO: 1402313 - RNA, 19 nt, Homo sapiens
gcugggaagucguccaaga

SEQ ID NO: 1402314 - RNA, 19 nt, Homo sapiens
gcagaagucgccacccaaa

SEQ ID NO: 1402315 - RNA, 19 nt, Homo sapiens
cgagaacaaugguuuaggu

SEQ ID NO: 1402316 - RNA, 19 nt, Homo sapiens
gaaugguugucaauagcaa

SEQ ID NO: 1402317 - RNA, 19 nt, Homo sapiens
gcuaaggaaagaauauuug

SEQ ID NO: 1402318 - RNA, 19 nt, Homo sapiens
caagcgagaacaaugguuu

SEQ ID NO: 1402319 - RNA, 19 nt, Homo sapiens
acacaguccauccaaauuu

SEQ ID NO: 1402320 - RNA, 19 nt, Homo sapiens
cuagagaaccuucggcauu

SEQ ID NO: 1402321 - RNA, 19 nt, Homo sapiens
ggacacagaagaaaaugua

SEQ ID NO: 1402322 - RNA, 19 nt, Homo sapiens
caaagagauuucugaugca

SEQ ID NO: 1402323 - RNA, 19 nt, Homo sapiens
agacuuauacugcccaauu

SEQ ID NO: 1402324 - RNA, 19 nt, Homo sapiens
guguuugugugauuuguuu

SEQ ID NO: 1402325 - RNA, 19 nt, Homo sapiens
gagagugcaucaaaauauu

SEQ ID NO: 1402326 - RNA, 19 nt, Homo sapiens
acaaggagagugcaucaaa

SEQ ID NO: 1402327 - RNA, 19 nt, Homo sapiens
ugaccaggauaagacguua

SEQ ID NO: 1402328 - RNA, 19 nt, Homo sapiens
cacaguccauccaaauuug

SEQ ID NO: 1402329 - RNA, 19 nt, Homo sapiens
gggcaugaguacacacugu

SEQ ID NO: 1402330 - RNA, 19 nt, Homo sapiens
auuaaaggcucaagaaugg

SEQ ID NO: 1402331 - RNA, 19 nt, Homo sapiens
gcgagugaaaggccaauuu

SEQ ID NO: 1402332 - RNA, 19 nt, Homo sapiens
gaaaccaaucuucccuuug

SEQ ID NO: 1402333 - RNA, 19 nt, Homo sapiens
agaaaggaaugguugucaa

SEQ ID NO: 1402334 - RNA, 19 nt, Homo sapiens
acuagcaacccaagacuua

SEQ ID NO: 1402335 - RNA, 19 nt, Homo sapiens
gaagggaaguauucaaaag

SEQ ID NO: 1402336 - RNA, 19 nt, Homo sapiens
ccaaggaguuacugcucaa

SEQ ID NO: 1402337 - RNA, 19 nt, Homo sapiens
ccaauuugacagcucauuu

SEQ ID NO: 1402338 - RNA, 19 nt, Homo sapiens
ccaagaagucagcgaguga

SEQ ID NO: 1402339 - RNA, 19 nt, Homo sapiens
gaauuuggccuugggugaa

SEQ ID NO: 1402340 - RNA, 19 nt, Homo sapiens
uagcaacccaagacuuaua

SEQ ID NO: 1402341 - RNA, 19 nt, Homo sapiens
ggaagucguccaagaugau

SEQ ID NO: 1402342 - RNA, 19 nt, Homo sapiens
gaagucagcgagugaaagg

SEQ ID NO: 1402343 - RNA, 19 nt, Homo sapiens
gucaauagcaaagagauuu

SEQ ID NO: 1402344 - RNA, 19 nt, Homo sapiens
caaaauggcaaaucaaaga

SEQ ID NO: 1402345 - RNA, 19 nt, Homo sapiens
gagaacaaugguuuagguu

SEQ ID NO: 1402346 - RNA, 19 nt, Homo sapiens
ucaaggucauggaaaguca

SEQ ID NO: 1402347 - RNA, 19 nt, Homo sapiens
caggauaagacguuacuga

SEQ ID NO: 1402348 - RNA, 19 nt, Homo sapiens
aaggaaugguugucaauag

SEQ ID NO: 1402349 - RNA, 19 nt, Homo sapiens
gaagucguccaagaugauu

SEQ ID NO: 1402350 - RNA, 19 nt, Homo sapiens
aaaggaaugguugucaaua

SEQ ID NO: 1402351 - RNA, 19 nt, Homo sapiens
gagaaaggaaugguuguca

SEQ ID NO: 1402352 - RNA, 19 nt, Homo sapiens
caacagcaaugagccaaaa

SEQ ID NO: 1402353 - RNA, 19 nt, Homo sapiens
ccacugacaaugauuucaa

SEQ ID NO: 1402354 - RNA, 19 nt, Homo sapiens
caaaucaaagacuucagaa

SEQ ID NO: 1402355 - RNA, 19 nt, Homo sapiens
ggagagugcaucaaaauau

SEQ ID NO: 1402356 - RNA, 19 nt, Homo sapiens
caaggagagugcaucaaaa

SEQ ID NO: 1402357 - RNA, 19 nt, Homo sapiens
acaccagcuucauguuaaa

SEQ ID NO: 1402358 - RNA, 19 nt, Homo sapiens
aaaguucccaugccaaaga

SEQ ID NO: 1402359 - RNA, 19 nt, Homo sapiens
aaaggccaauuuccaaagu

SEQ ID NO: 1402360 - RNA, 19 nt, Homo sapiens
cacaguaugaccaggauaa

SEQ ID NO: 1402361 - RNA, 19 nt, Homo sapiens
caagagcgaagggaaguau

SEQ ID NO: 1402362 - RNA, 19 nt, Homo sapiens
acuaugauuucgugauguu

SEQ ID NO: 1402363 - RNA, 19 nt, Homo sapiens
gaauugaaccccugcagaa

SEQ ID NO: 1402364 - RNA, 19 nt, Homo sapiens
gccaauuuccaaagugauu

SEQ ID NO: 1402365 - RNA, 19 nt, Homo sapiens
cagcacaaacccacugaga

SEQ ID NO: 1402366 - RNA, 19 nt, Homo sapiens
agaaauuccuggcucaaaa

SEQ ID NO: 1402367 - RNA, 19 nt, Homo sapiens
agaacaaugguuuagguuu

SEQ ID NO: 1402368 - RNA, 19 nt, Homo sapiens
cagccuggccugcagacua

SEQ ID NO: 1402369 - RNA, 19 nt, Homo sapiens
aauuaaaggcucaagaaug

SEQ ID NO: 1402370 - RNA, 19 nt, Homo sapiens
agagauaugaggaaagaug

SEQ ID NO: 1402371 - RNA, 19 nt, Homo sapiens
gguaguguacaccagguuu

SEQ ID NO: 1402372 - RNA, 19 nt, Homo sapiens
cagaaauuccuggcucaaa

SEQ ID NO: 1402373 - RNA, 19 nt, Homo sapiens
ggaaugguugucaauagca

SEQ ID NO: 1402374 - RNA, 19 nt, Homo sapiens
cagcuaaacgugagaaagg

SEQ ID NO: 1402375 - RNA, 19 nt, Homo sapiens
uacaugaauuggacuuaca

SEQ ID NO: 1402376 - RNA, 19 nt, Homo sapiens
gucaucgggugaacacaga

SEQ ID NO: 1402377 - RNA, 19 nt, Homo sapiens
cauccaagcgagaacaaug

SEQ ID NO: 1402378 - RNA, 19 nt, Homo sapiens
aaucuucccuuugauacug

SEQ ID NO: 1402379 - RNA, 19 nt, Homo sapiens
aaauuuggcccaguacuau

SEQ ID NO: 1402380 - RNA, 19 nt, Homo sapiens
uuacacaguccauccaaau

SEQ ID NO: 1402381 - RNA, 19 nt, Homo sapiens
cuucuucaccaaacuauga

SEQ ID NO: 1402382 - RNA, 19 nt, Homo sapiens
caaacuaugauuucgugau

SEQ ID NO: 1402383 - RNA, 19 nt, Homo sapiens
gcucaaucacccagcaaga

SEQ ID NO: 1402384 - RNA, 19 nt, Homo sapiens
gcuaaacgugagaaaggaa

SEQ ID NO: 1402385 - RNA, 19 nt, Homo sapiens
caaaagagacaaaccaagu

SEQ ID NO: 1402386 - RNA, 19 nt, Homo sapiens
gcagguagcucauauguuu

SEQ ID NO: 1402387 - RNA, 19 nt, Homo sapiens
ggaauucacuuacucagaa

SEQ ID NO: 1402388 - RNA, 19 nt, Homo sapiens
gaagagagaauucaaacua

SEQ ID NO: 1402389 - RNA, 19 nt, Homo sapiens
caaagucacacacauauua

SEQ ID NO: 1402390 - RNA, 19 nt, Homo sapiens
gaaacuccaucucaauaaa

SEQ ID NO: 1402391 - RNA, 19 nt, Homo sapiens
cacauaagguucucuauuu

SEQ ID NO: 1402392 - RNA, 19 nt, Homo sapiens
uaacagaggaauucacuua

SEQ ID NO: 1402393 - RNA, 19 nt, Homo sapiens
aagaagagcugagguauga

SEQ ID NO: 1402394 - RNA, 19 nt, Homo sapiens
uuacagagauuaagaagug

SEQ ID NO: 1402395 - RNA, 19 nt, Homo sapiens
gaaagguggugacaaaugg

SEQ ID NO: 1402396 - RNA, 19 nt, Homo sapiens
caggaaagguggugacaaa

SEQ ID NO: 1402397 - RNA, 19 nt, Homo sapiens
aaacauggacuacacauaa

SEQ ID NO: 1402398 - RNA, 19 nt, Homo sapiens
gaacugacccuuugcaagu

SEQ ID NO: 1402399 - RNA, 19 nt, Homo sapiens
gagcgaaacuccaucucaa

SEQ ID NO: 1402400 - RNA, 19 nt, Homo sapiens
ggaaguggcagcauucuga

SEQ ID NO: 1402401 - RNA, 19 nt, Homo sapiens
gcucauauguuuccugcaa

SEQ ID NO: 1402402 - RNA, 19 nt, Homo sapiens
acagagggcuaaauauauu

SEQ ID NO: 1402403 - RNA, 19 nt, Homo sapiens
cuacagagggcuaaauaua

SEQ ID NO: 1402404 - RNA, 19 nt, Homo sapiens
gagccgagauugugccauu

SEQ ID NO: 1402405 - RNA, 19 nt, Homo sapiens
gagcaucugucuccaggaa

SEQ ID NO: 1402406 - RNA, 19 nt, Homo sapiens
acacagcacuuauaaauac

SEQ ID NO: 1402407 - RNA, 19 nt, Homo sapiens
ccacagaagguuucguuua

SEQ ID NO: 1402408 - RNA, 19 nt, Homo sapiens
ucagaaugaugaccuguaa

SEQ ID NO: 1402409 - RNA, 19 nt, Homo sapiens
gaaacagaauaugugagua

SEQ ID NO: 1402410 - RNA, 19 nt, Homo sapiens
gcaaacaugcuuagacaga

SEQ ID NO: 1402411 - RNA, 19 nt, Homo sapiens
cugcugagcuugugugaaa

SEQ ID NO: 1402412 - RNA, 19 nt, Homo sapiens
gacacucacuggacaauau

SEQ ID NO: 1402413 - RNA, 19 nt, Homo sapiens
gcgaaacuccaucucaaua

SEQ ID NO: 1402414 - RNA, 19 nt, Homo sapiens
cacaccagcucuacagaua

SEQ ID NO: 1402415 - RNA, 19 nt, Homo sapiens
acaaugagauuaagcuuca

SEQ ID NO: 1402416 - RNA, 19 nt, Homo sapiens
agacaguuguggccuauaa

SEQ ID NO: 1402417 - RNA, 19 nt, Homo sapiens
gaaacauggacuacacaua

SEQ ID NO: 1402418 - RNA, 19 nt, Homo sapiens
cuagaaacaugcaguacuu

SEQ ID NO: 1402419 - RNA, 19 nt, Homo sapiens
gcugagggcuagaaacaug

SEQ ID NO: 1402420 - RNA, 19 nt, Homo sapiens
uaauugagaugggaaagaa

SEQ ID NO: 1402421 - RNA, 19 nt, Homo sapiens
cagacuaaauguucccuuu

SEQ ID NO: 1402422 - RNA, 19 nt, Homo sapiens
ucaaacacagcacuuauaa

SEQ ID NO: 1402423 - RNA, 19 nt, Homo sapiens
aagaagauccuauugguuu

SEQ ID NO: 1402424 - RNA, 19 nt, Homo sapiens
ggaaagguggugacaaaug

SEQ ID NO: 1402425 - RNA, 19 nt, Homo sapiens
gagacggacuguagacaau

SEQ ID NO: 1402426 - RNA, 19 nt, Homo sapiens
gaucaggacccuugacuuc

SEQ ID NO: 1402427 - RNA, 19 nt, Homo sapiens
auacgggccugaugaaauu

SEQ ID NO: 1402428 - RNA, 19 nt, Homo sapiens
gaccugagauggcuagaag

SEQ ID NO: 1402429 - RNA, 19 nt, Homo sapiens
ggaaagauaagacaguugu

SEQ ID NO: 1402430 - RNA, 19 nt, Homo sapiens
gaagguuucguuuagguuu

SEQ ID NO: 1402431 - RNA, 19 nt, Homo sapiens
gugcaaacaugcuuagaca

SEQ ID NO: 1402432 - RNA, 19 nt, Homo sapiens
cagagaaccauacauacua

SEQ ID NO: 1402433 - RNA, 19 nt, Homo sapiens
gaauagggcagcuaaccaa

SEQ ID NO: 1402434 - RNA, 19 nt, Homo sapiens
ggagagaggcagcaaguca

SEQ ID NO: 1402435 - RNA, 19 nt, Homo sapiens
ugacauuguuuguaucuuc

SEQ ID NO: 1402436 - RNA, 19 nt, Homo sapiens
cauccauucuuagaucuua

SEQ ID NO: 1402437 - RNA, 19 nt, Homo sapiens
augaugaccuguaaaugua

SEQ ID NO: 1402438 - RNA, 19 nt, Homo sapiens
gguauagaguccagaaaca

SEQ ID NO: 1402439 - RNA, 19 nt, Homo sapiens
cacagaagguuucguuuag

SEQ ID NO: 1402440 - RNA, 19 nt, Homo sapiens
guggcugccugaacuauuu

SEQ ID NO: 1402441 - RNA, 19 nt, Homo sapiens
caaaggauacacauuacaa

SEQ ID NO: 1402442 - RNA, 19 nt, Homo sapiens
ucagaaaguucacgggaau

SEQ ID NO: 1402443 - RNA, 19 nt, Homo sapiens
gaggaagcccggucacuga

SEQ ID NO: 1402444 - RNA, 19 nt, Homo sapiens
auaaguaaaugccaggaaa

SEQ ID NO: 1402445 - RNA, 19 nt, Homo sapiens
ucagcaaugugaagaauca

SEQ ID NO: 1402446 - RNA, 19 nt, Homo sapiens
gcaggccucugucugugaa

SEQ ID NO: 1402447 - RNA, 19 nt, Homo sapiens
gaaauguggugaaaagguu

SEQ ID NO: 1402448 - RNA, 19 nt, Homo sapiens
gcuuugaacucagaccuuu

SEQ ID NO: 1402449 - RNA, 19 nt, Homo sapiens
cauagaccaugacauuguu

SEQ ID NO: 1402450 - RNA, 19 nt, Homo sapiens
cgaaacuccaucucaauaa

SEQ ID NO: 1402451 - RNA, 19 nt, Homo sapiens
gcaaagcagcacauucaga

SEQ ID NO: 1402452 - RNA, 19 nt, Homo sapiens
ccaggaacguggucacuca

SEQ ID NO: 1402453 - RNA, 19 nt, Homo sapiens
ucaccaagguagccuguau

SEQ ID NO: 1402454 - RNA, 19 nt, Homo sapiens
gaagagcugagguaugaau

SEQ ID NO: 1402455 - RNA, 19 nt, Homo sapiens
acacacauauuaagaagag

SEQ ID NO: 1402456 - RNA, 19 nt, Homo sapiens
gguauucuuugcuuagguu

SEQ ID NO: 1402457 - RNA, 19 nt, Homo sapiens
gcccaaagucacacacaua

SEQ ID NO: 1402458 - RNA, 19 nt, Homo sapiens
uagggcagcuaaccaagaa

SEQ ID NO: 1402459 - RNA, 19 nt, Homo sapiens
cagaauaugugaguauaag

SEQ ID NO: 1402460 - RNA, 19 nt, Homo sapiens
guauugugauuuccauuuc

SEQ ID NO: 1402461 - RNA, 19 nt, Homo sapiens
gacggacuguagacaauga

SEQ ID NO: 1402462 - RNA, 19 nt, Homo sapiens
aaacaugcuuagacagaga

SEQ ID NO: 1402463 - RNA, 19 nt, Homo sapiens
gaaccauacauacuacaga

SEQ ID NO: 1402464 - RNA, 19 nt, Homo sapiens
ucacacacauauuaagaag

SEQ ID NO: 1402465 - RNA, 19 nt, Homo sapiens
uaaccaagaagauccuauu

SEQ ID NO: 1402466 - RNA, 19 nt, Homo sapiens
ggaaagacaaagagauagu

SEQ ID NO: 1402467 - RNA, 19 nt, Homo sapiens
gcgaaaucuuggacuucua

SEQ ID NO: 1402468 - RNA, 19 nt, Homo sapiens
gaauagugcagcuccauag

SEQ ID NO: 1402469 - RNA, 19 nt, Homo sapiens
caagauguaucaguguugu

SEQ ID NO: 1402470 - RNA, 19 nt, Homo sapiens
gggcugguauucuuugcuu

SEQ ID NO: 1402471 - RNA, 19 nt, Homo sapiens
cagcauggcuuugugucuu

SEQ ID NO: 1402472 - RNA, 19 nt, Homo sapiens
gacaacacccugcuucugu

SEQ ID NO: 1402473 - RNA, 19 nt, Homo sapiens
guaggguucuguuaccaau

SEQ ID NO: 1402474 - RNA, 19 nt, Homo sapiens
gaccaugacauuguuugua

SEQ ID NO: 1402475 - RNA, 19 nt, Homo sapiens
cuccuuugauuccuuguua

SEQ ID NO: 1402476 - RNA, 19 nt, Homo sapiens
gcaaggugaagauuuggaa

SEQ ID NO: 1402477 - RNA, 19 nt, Homo sapiens
ucacauggauaccgucucu

SEQ ID NO: 1402478 - RNA, 19 nt, Homo sapiens
aggguucuguuaccaauaa

SEQ ID NO: 1402479 - RNA, 19 nt, Homo sapiens
gggcucugaugaguuagua

SEQ ID NO: 1402480 - RNA, 19 nt, Homo sapiens
ggaaaguacacgggagaaa

SEQ ID NO: 1402481 - RNA, 19 nt, Homo sapiens
gacauuguuuguaucuuca

SEQ ID NO: 1402482 - RNA, 19 nt, Homo sapiens
gaaagacaaagagauagug

SEQ ID NO: 1402483 - RNA, 19 nt, Homo sapiens
gaucuuauccucuaaaccu

SEQ ID NO: 1402484 - RNA, 19 nt, Homo sapiens
ccuccuucauccauucuua

SEQ ID NO: 1402485 - RNA, 19 nt, Homo sapiens
gcccagugcugcugagcuu

SEQ ID NO: 1402486 - RNA, 19 nt, Homo sapiens
gaucaaagcugugguguuu

SEQ ID NO: 1402487 - RNA, 19 nt, Homo sapiens
aaacaucucugcuggaaua

SEQ ID NO: 1402488 - RNA, 19 nt, Homo sapiens
ggagagaucugccacaugu

SEQ ID NO: 1402489 - RNA, 19 nt, Homo sapiens
gcaaagagccaaucauguu

SEQ ID NO: 1402490 - RNA, 19 nt, Homo sapiens
gcaaaguagugaaauaauc

SEQ ID NO: 1402491 - RNA, 19 nt, Homo sapiens
uaacaagucuucuuagagu

SEQ ID NO: 1402492 - RNA, 19 nt, Homo sapiens
ucacagagccucaggaauu

SEQ ID NO: 1402493 - RNA, 19 nt, Homo sapiens
ucagagaucuucaggcaaa

SEQ ID NO: 1402494 - RNA, 19 nt, Homo sapiens
gaggcaaaguagugaaaua

SEQ ID NO: 1402495 - RNA, 19 nt, Homo sapiens
ggacuuccauaaaggauga

SEQ ID NO: 1402496 - RNA, 19 nt, Homo sapiens
gaggaggucucuauucaug

SEQ ID NO: 1402497 - RNA, 19 nt, Homo sapiens
auacugaccugugauaaua

SEQ ID NO: 1402498 - RNA, 19 nt, Homo sapiens
gaaaauagggguuaaguuu

SEQ ID NO: 1402499 - RNA, 19 nt, Homo sapiens
aaacaucacugcccucaga

SEQ ID NO: 1402500 - RNA, 19 nt, Homo sapiens
ggacauagggauaaacuug

SEQ ID NO: 1402501 - RNA, 19 nt, Homo sapiens
uaaauagguuccaugugua

SEQ ID NO: 1402502 - RNA, 19 nt, Homo sapiens
ggaaaugccucccuuuggu

SEQ ID NO: 1402503 - RNA, 19 nt, Homo sapiens
gcacgucuuucccagcaua

SEQ ID NO: 1402504 - RNA, 19 nt, Homo sapiens
ccagguaccuuugccguua

SEQ ID NO: 1402505 - RNA, 19 nt, Homo sapiens
caucucugcuggaauauuu

SEQ ID NO: 1402506 - RNA, 19 nt, Homo sapiens
gaaagauggaggcaaagua

SEQ ID NO: 1402507 - RNA, 19 nt, Homo sapiens
gagaggaacccuacuguug

SEQ ID NO: 1402508 - RNA, 19 nt, Homo sapiens
caaagagccaaucauguua

SEQ ID NO: 1402509 - RNA, 19 nt, Homo sapiens
gcaccagcguguccuauau

SEQ ID NO: 1402510 - RNA, 19 nt, Homo sapiens
ggaggucucuauucaugaa

SEQ ID NO: 1402511 - RNA, 19 nt, Homo sapiens
caggaaagauggaggcaaa

SEQ ID NO: 1402512 - RNA, 19 nt, Homo sapiens
gcacuugggacuuccauaa

SEQ ID NO: 1402513 - RNA, 19 nt, Homo sapiens
gcucaaugcucgcuacaug

SEQ ID NO: 1402514 - RNA, 19 nt, Homo sapiens
auaaauagguuccaugugu

SEQ ID NO: 1402515 - RNA, 19 nt, Homo sapiens
gaacccuacuguugacuug

SEQ ID NO: 1402516 - RNA, 19 nt, Homo sapiens
cauguuaacucuuccuuau

SEQ ID NO: 1402517 - RNA, 19 nt, Homo sapiens
gggauaaacuugguuagga

SEQ ID NO: 1402518 - RNA, 19 nt, Homo sapiens
guagugaaauaauccagaa

SEQ ID NO: 1402519 - RNA, 19 nt, Homo sapiens
gaacugaaggagauuguug

SEQ ID NO: 1402520 - RNA, 19 nt, Homo sapiens
ccaaucauguuaacucuuc

SEQ ID NO: 1402521 - RNA, 19 nt, Homo sapiens
gaaaugccucccuuuggua

SEQ ID NO: 1402522 - RNA, 19 nt, Homo sapiens
ggagagaaacuucgcaaug

SEQ ID NO: 1402523 - RNA, 19 nt, Homo sapiens
agaaucaucuggcauccua

SEQ ID NO: 1402524 - RNA, 19 nt, Homo sapiens
gacaagagccuuagccaau

SEQ ID NO: 1402525 - RNA, 19 nt, Homo sapiens
ugauuucggugcucaagua

SEQ ID NO: 1402526 - RNA, 19 nt, Homo sapiens
caagagccuuagccaauga

SEQ ID NO: 1402527 - RNA, 19 nt, Homo sapiens
agagcaagcuggacuguug

SEQ ID NO: 1402528 - RNA, 19 nt, Homo sapiens
gaaaacaucucugcuggaa

SEQ ID NO: 1402529 - RNA, 19 nt, Homo sapiens
cagcuaacaagucuucuua

SEQ ID NO: 1402530 - RNA, 19 nt, Homo sapiens
gagagaaacuucgcaaugc

SEQ ID NO: 1402531 - RNA, 19 nt, Homo sapiens
cauggacacugacauuuau

SEQ ID NO: 1402532 - RNA, 19 nt, Homo sapiens
ggauggagcuggaggaaaa

SEQ ID NO: 1402533 - RNA, 19 nt, Homo sapiens
gaaaggggcugauccagau

SEQ ID NO: 1402534 - RNA, 19 nt, Homo sapiens
gguaauaaacuggauuuga

SEQ ID NO: 1402535 - RNA, 19 nt, Homo sapiens
gggaagacauugaagaaaa

SEQ ID NO: 1402536 - RNA, 19 nt, Homo sapiens
guacaaggagguauugaga

SEQ ID NO: 1402537 - RNA, 19 nt, Homo sapiens
gcaagcacaucagacucua

SEQ ID NO: 1402538 - RNA, 19 nt, Homo sapiens
caccuugacuuccagcuuu

SEQ ID NO: 1402539 - RNA, 19 nt, Homo sapiens
augcugagcucuccuugua

SEQ ID NO: 1402540 - RNA, 19 nt, Homo sapiens
ccaaguacaagauuaaaga

SEQ ID NO: 1402541 - RNA, 19 nt, Homo sapiens
gagggaagacauugaagaa

SEQ ID NO: 1402542 - RNA, 19 nt, Homo sapiens
uauaauagggcccaggaua

SEQ ID NO: 1402543 - RNA, 19 nt, Homo sapiens
gcagagggaagacauugaa

SEQ ID NO: 1402544 - RNA, 19 nt, Homo sapiens
cacagagccucaggaauuu

SEQ ID NO: 1402545 - RNA, 19 nt, Homo sapiens
ggaaggcgaaggacaaugu

SEQ ID NO: 1402546 - RNA, 19 nt, Homo sapiens
ccuggaggcuggcuagaaa

SEQ ID NO: 1402547 - RNA, 19 nt, Homo sapiens
cagcaggacuuugagaaug

SEQ ID NO: 1402548 - RNA, 19 nt, Homo sapiens
gaaugaggcccacacaaca

SEQ ID NO: 1402549 - RNA, 19 nt, Homo sapiens
ucauggacacugacauuua

SEQ ID NO: 1402550 - RNA, 19 nt, Homo sapiens
gcuacgacguggauucgaa

SEQ ID NO: 1402551 - RNA, 19 nt, Homo sapiens
caauggaacucaaaacuug

SEQ ID NO: 1402552 - RNA, 19 nt, Homo sapiens
caagaacucccucaagcaa

SEQ ID NO: 1402553 - RNA, 19 nt, Homo sapiens
gccaagagccaacacauuc

SEQ ID NO: 1402554 - RNA, 19 nt, Homo sapiens
caaccuuccugcagucaau

SEQ ID NO: 1402555 - RNA, 19 nt, Homo sapiens
acaagucuucuuagaguua

SEQ ID NO: 1402556 - RNA, 19 nt, Homo sapiens
caguggaaaugcacagaaa

SEQ ID NO: 1402557 - RNA, 19 nt, Homo sapiens
guaaaucugccuuauccuu

SEQ ID NO: 1402558 - RNA, 19 nt, Homo sapiens
gcaaugccuucagauguuc

SEQ ID NO: 1402559 - RNA, 19 nt, Homo sapiens
caggagaagcggagaauga

SEQ ID NO: 1402560 - RNA, 19 nt, Homo sapiens
guacaagauuaaagacuac

SEQ ID NO: 1402561 - RNA, 19 nt, Homo sapiens
acgaugaguuugagaagaa

SEQ ID NO: 1402562 - RNA, 19 nt, Homo sapiens
cugggaaccuuaucucuug

SEQ ID NO: 1402563 - RNA, 19 nt, Homo sapiens
caagucuucuuagaguuaa

SEQ ID NO: 1402564 - RNA, 19 nt, Homo sapiens
gugcuggccugcuguacaa

SEQ ID NO: 1402565 - RNA, 19 nt, Homo sapiens
ucaacaaugccaccaauga

SEQ ID NO: 1402566 - RNA, 19 nt, Homo sapiens
uugaugaagugauccuuaa

SEQ ID NO: 1402567 - RNA, 19 nt, Homo sapiens
uguuaacucuuccuuauca

SEQ ID NO: 1402568 - RNA, 19 nt, Homo sapiens
ggacuuagagcaggagaug

SEQ ID NO: 1402569 - RNA, 19 nt, Homo sapiens
cgcaaugccuucagauguu

SEQ ID NO: 1402570 - RNA, 19 nt, Homo sapiens
caacaucgccucgcucauc

SEQ ID NO: 1402571 - RNA, 19 nt, Homo sapiens
cagacucaguuucgaaaug

SEQ ID NO: 1402572 - RNA, 19 nt, Homo sapiens
ccacaaggcauggcauuug

SEQ ID NO: 1402573 - RNA, 19 nt, Homo sapiens
aaacuggauuugaauugug

SEQ ID NO: 1402574 - RNA, 19 nt, Homo sapiens
gauacugaccugugauaau

SEQ ID NO: 1402575 - RNA, 19 nt, Homo sapiens
ucacggacauagggauaaa

SEQ ID NO: 1402576 - RNA, 19 nt, Homo sapiens
gaaggacaaguacaacugu

SEQ ID NO: 1402577 - RNA, 19 nt, Homo sapiens
gcucacccacugcuuguaa

SEQ ID NO: 1402578 - RNA, 19 nt, Homo sapiens
gaagaaggaccggacauac

SEQ ID NO: 1402579 - RNA, 19 nt, Homo sapiens
gacgaugaguuugagaaga

SEQ ID NO: 1402580 - RNA, 19 nt, Homo sapiens
ccucuucgacgaugaguuu

SEQ ID NO: 1402581 - RNA, 19 nt, Homo sapiens
acugaccugugauaauaua

SEQ ID NO: 1402582 - RNA, 19 nt, Homo sapiens
acaagagccuuagccaaug

SEQ ID NO: 1402583 - RNA, 19 nt, Homo sapiens
ccagcugccucaacucugu

SEQ ID NO: 1402584 - RNA, 19 nt, Homo sapiens
ggaugggagucuagaaugc

SEQ ID NO: 1402585 - RNA, 19 nt, Homo sapiens
gcagaucgugggagaaauc

SEQ ID NO: 1402586 - RNA, 19 nt, Homo sapiens
gaucaaagcugugguguuu

SEQ ID NO: 1402587 - RNA, 19 nt, Homo sapiens
aaacaucucugcuggaaua

SEQ ID NO: 1402588 - RNA, 19 nt, Homo sapiens
ggagagaucugccacaugu

SEQ ID NO: 1402589 - RNA, 19 nt, Homo sapiens
gcaaagagccaaucauguu

SEQ ID NO: 1402590 - RNA, 19 nt, Homo sapiens
gcaaaguagugaaauaauc

SEQ ID NO: 1402591 - RNA, 19 nt, Homo sapiens
uaacaagucuucuuagagu

SEQ ID NO: 1402592 - RNA, 19 nt, Homo sapiens
ucacagagccucaggaauu

SEQ ID NO: 1402593 - RNA, 19 nt, Homo sapiens
ucagagaucuucaggcaaa

SEQ ID NO: 1402594 - RNA, 19 nt, Homo sapiens
gaggcaaaguagugaaaua

SEQ ID NO: 1402595 - RNA, 19 nt, Homo sapiens
gaggaggucucuauucaug

SEQ ID NO: 1402596 - RNA, 19 nt, Homo sapiens
auacugaccugugauaaua

SEQ ID NO: 1402597 - RNA, 19 nt, Homo sapiens
gaaaauagggguuaaguuu

SEQ ID NO: 1402598 - RNA, 19 nt, Homo sapiens
aaacaucacugcccucaga

SEQ ID NO: 1402599 - RNA, 19 nt, Homo sapiens
ggacauagggauaaacuug

SEQ ID NO: 1402600 - RNA, 19 nt, Homo sapiens
uaaauagguuccaugugua

SEQ ID NO: 1402601 - RNA, 19 nt, Homo sapiens
ggaaaugccucccuuuggu

SEQ ID NO: 1402602 - RNA, 19 nt, Homo sapiens
gcacgucuuucccagcaua

SEQ ID NO: 1402603 - RNA, 19 nt, Homo sapiens
ccagguaccuuugccguua

SEQ ID NO: 1402604 - RNA, 19 nt, Homo sapiens
caucucugcuggaauauuu

SEQ ID NO: 1402605 - RNA, 19 nt, Homo sapiens
gaaagauggaggcaaagua

SEQ ID NO: 1402606 - RNA, 19 nt, Homo sapiens
gagaggaacccuacuguug

SEQ ID NO: 1402607 - RNA, 19 nt, Homo sapiens
caaagagccaaucauguua

SEQ ID NO: 1402608 - RNA, 19 nt, Homo sapiens
gcaccagcguguccuauau

SEQ ID NO: 1402609 - RNA, 19 nt, Homo sapiens
ggaggucucuauucaugaa

SEQ ID NO: 1402610 - RNA, 19 nt, Homo sapiens
caggaaagauggaggcaaa

SEQ ID NO: 1402611 - RNA, 19 nt, Homo sapiens
gcucaaugcucgcuacaug

SEQ ID NO: 1402612 - RNA, 19 nt, Homo sapiens
auaaauagguuccaugugu

SEQ ID NO: 1402613 - RNA, 19 nt, Homo sapiens
gaacccuacuguugacuug

SEQ ID NO: 1402614 - RNA, 19 nt, Homo sapiens
cauguuaacucuuccuuau

SEQ ID NO: 1402615 - RNA, 19 nt, Homo sapiens
gggauaaacuugguuagga

SEQ ID NO: 1402616 - RNA, 19 nt, Homo sapiens
guagugaaauaauccagaa

SEQ ID NO: 1402617 - RNA, 19 nt, Homo sapiens
gaacugaaggagauuguug

SEQ ID NO: 1402618 - RNA, 19 nt, Homo sapiens
ccaaucauguuaacucuuc

SEQ ID NO: 1402619 - RNA, 19 nt, Homo sapiens
gaaaugccucccuuuggua

SEQ ID NO: 1402620 - RNA, 19 nt, Homo sapiens
ggagagaaacuucgcaaug

SEQ ID NO: 1402621 - RNA, 19 nt, Homo sapiens
agaaucaucuggcauccua

SEQ ID NO: 1402622 - RNA, 19 nt, Homo sapiens
gacaagagccuuagccaau

SEQ ID NO: 1402623 - RNA, 19 nt, Homo sapiens
ugauuucggugcucaagua

SEQ ID NO: 1402624 - RNA, 19 nt, Homo sapiens
caagagccuuagccaauga

SEQ ID NO: 1402625 - RNA, 19 nt, Homo sapiens
agagcaagcuggacuguug

SEQ ID NO: 1402626 - RNA, 19 nt, Homo sapiens
gaaaacaucucugcuggaa

SEQ ID NO: 1402627 - RNA, 19 nt, Homo sapiens
cagcuaacaagucuucuua

SEQ ID NO: 1402628 - RNA, 19 nt, Homo sapiens
gagagaaacuucgcaaugc

SEQ ID NO: 1402629 - RNA, 19 nt, Homo sapiens
cauggacacugacauuuau

SEQ ID NO: 1402630 - RNA, 19 nt, Homo sapiens
ggauggagcuggaggaaaa

SEQ ID NO: 1402631 - RNA, 19 nt, Homo sapiens
gaaaggggcugauccagau

SEQ ID NO: 1402632 - RNA, 19 nt, Homo sapiens
gguaauaaacuggauuuga

SEQ ID NO: 1402633 - RNA, 19 nt, Homo sapiens
gggaagacauugaagaaaa

SEQ ID NO: 1402634 - RNA, 19 nt, Homo sapiens
guacaaggagguauugaga

SEQ ID NO: 1402635 - RNA, 19 nt, Homo sapiens
gcaagcacaucagacucua

SEQ ID NO: 1402636 - RNA, 19 nt, Homo sapiens
caccuugacuuccagcuuu

SEQ ID NO: 1402637 - RNA, 19 nt, Homo sapiens
augcugagcucuccuugua

SEQ ID NO: 1402638 - RNA, 19 nt, Homo sapiens
ccaaguacaagauuaaaga

SEQ ID NO: 1402639 - RNA, 19 nt, Homo sapiens
gagggaagacauugaagaa

SEQ ID NO: 1402640 - RNA, 19 nt, Homo sapiens
uauaauagggcccaggaua

SEQ ID NO: 1402641 - RNA, 19 nt, Homo sapiens
gcagagggaagacauugaa

SEQ ID NO: 1402642 - RNA, 19 nt, Homo sapiens
cacagagccucaggaauuu

SEQ ID NO: 1402643 - RNA, 19 nt, Homo sapiens
ggaaggcgaaggacaaugu

SEQ ID NO: 1402644 - RNA, 19 nt, Homo sapiens
ccuggaggcuggcuagaaa

SEQ ID NO: 1402645 - RNA, 19 nt, Homo sapiens
cagcaggacuuugagaaug

SEQ ID NO: 1402646 - RNA, 19 nt, Homo sapiens
gaaugaggcccacacaaca

SEQ ID NO: 1402647 - RNA, 19 nt, Homo sapiens
ucauggacacugacauuua

SEQ ID NO: 1402648 - RNA, 19 nt, Homo sapiens
gcuacgacguggauucgaa

SEQ ID NO: 1402649 - RNA, 19 nt, Homo sapiens
caauggaacucaaaacuug

SEQ ID NO: 1402650 - RNA, 19 nt, Homo sapiens
caagaacucccucaagcaa

SEQ ID NO: 1402651 - RNA, 19 nt, Homo sapiens
gccaagagccaacacauuc

SEQ ID NO: 1402652 - RNA, 19 nt, Homo sapiens
caaccuuccugcagucaau

SEQ ID NO: 1402653 - RNA, 19 nt, Homo sapiens
acaagucuucuuagaguua

SEQ ID NO: 1402654 - RNA, 19 nt, Homo sapiens
caguggaaaugcacagaaa

SEQ ID NO: 1402655 - RNA, 19 nt, Homo sapiens
guaaaucugccuuauccuu

SEQ ID NO: 1402656 - RNA, 19 nt, Homo sapiens
caggagaagcggagaauga

SEQ ID NO: 1402657 - RNA, 19 nt, Homo sapiens
acgaugaguuugagaagaa

SEQ ID NO: 1402658 - RNA, 19 nt, Homo sapiens
gcaaugccuucagauguuc

SEQ ID NO: 1402659 - RNA, 19 nt, Homo sapiens
guacaagauuaaagacuac

SEQ ID NO: 1402660 - RNA, 19 nt, Homo sapiens
cugggaaccuuaucucuug

SEQ ID NO: 1402661 - RNA, 19 nt, Homo sapiens
caagucuucuuagaguuaa

SEQ ID NO: 1402662 - RNA, 19 nt, Homo sapiens
gugcuggccugcuguacaa

SEQ ID NO: 1402663 - RNA, 19 nt, Homo sapiens
ucaacaaugccaccaauga

SEQ ID NO: 1402664 - RNA, 19 nt, Homo sapiens
uugaugaagugauccuuaa

SEQ ID NO: 1402665 - RNA, 19 nt, Homo sapiens
uguuaacucuuccuuauca

SEQ ID NO: 1402666 - RNA, 19 nt, Homo sapiens
ggacuuagagcaggagaug

SEQ ID NO: 1402667 - RNA, 19 nt, Homo sapiens
cgcaaugccuucagauguu

SEQ ID NO: 1402668 - RNA, 19 nt, Homo sapiens
caacaucgccucgcucauc

SEQ ID NO: 1402669 - RNA, 19 nt, Homo sapiens
cagacucaguuucgaaaug

SEQ ID NO: 1402670 - RNA, 19 nt, Homo sapiens
ccacaaggcauggcauuug

SEQ ID NO: 1402671 - RNA, 19 nt, Homo sapiens
aaacuggauuugaauugug

SEQ ID NO: 1402672 - RNA, 19 nt, Homo sapiens
gauacugaccugugauaau

SEQ ID NO: 1402673 - RNA, 19 nt, Homo sapiens
ucacggacauagggauaaa

SEQ ID NO: 1402674 - RNA, 19 nt, Homo sapiens
gaaggacaaguacaacugu

SEQ ID NO: 1402675 - RNA, 19 nt, Homo sapiens
gcucacccacugcuuguaa

SEQ ID NO: 1402676 - RNA, 19 nt, Homo sapiens
gaagaaggaccggacauac

SEQ ID NO: 1402677 - RNA, 19 nt, Homo sapiens
ccucuucgacgaugaguuu

SEQ ID NO: 1402678 - RNA, 19 nt, Homo sapiens
gacgaugaguuugagaaga

SEQ ID NO: 1402679 - RNA, 19 nt, Homo sapiens
acugaccugugauaauaua

SEQ ID NO: 1402680 - RNA, 19 nt, Homo sapiens
acaagagccuuagccaaug

SEQ ID NO: 1402681 - RNA, 19 nt, Homo sapiens
ccagcugccucaacucugu

SEQ ID NO: 1402682 - RNA, 19 nt, Homo sapiens
ggaugggagucuagaaugc

SEQ ID NO: 1402683 - RNA, 19 nt, Homo sapiens
gcagaucgugggagaaauc

SEQ ID NO: 1402684 - RNA, 19 nt, Homo sapiens
gauggugccagguaccuuu

SEQ ID NO: 1402685 - RNA, 19 nt, Homo sapiens
gggaggacugggaaccuua

SEQ ID NO: 1402686 - RNA, 19 nt, Homo sapiens
gaaauuauccgacagauga

SEQ ID NO: 1402687 - RNA, 19 nt, Homo sapiens
ggaaagcgaugcccuucuu

SEQ ID NO: 1402688 - RNA, 19 nt, Homo sapiens
ucaacacacucuaccauaa

SEQ ID NO: 1402689 - RNA, 19 nt, Homo sapiens
gauaauagcaagaucauca

SEQ ID NO: 1402690 - RNA, 19 nt, Homo sapiens
gcagaagauucagaaguuu

SEQ ID NO: 1402691 - RNA, 19 nt, Homo sapiens
gguuacaggugauuucuga

SEQ ID NO: 1402692 - RNA, 19 nt, Homo sapiens
caugggaaguucaaacaaa

SEQ ID NO: 1402693 - RNA, 19 nt, Homo sapiens
gagcagguuugcauauaau

SEQ ID NO: 1402694 - RNA, 19 nt, Homo sapiens
gaagaaauuauccgacaga

SEQ ID NO: 1402695 - RNA, 19 nt, Homo sapiens
ugagcagguuugcauauaa

SEQ ID NO: 1402696 - RNA, 19 nt, Homo sapiens
ggacgagacucuggaugug

SEQ ID NO: 1402697 - RNA, 19 nt, Homo sapiens
gaucaucagugaggagugu

SEQ ID NO: 1402698 - RNA, 19 nt, Homo sapiens
ggugauauccuggaagaaa

SEQ ID NO: 1402699 - RNA, 19 nt, Homo sapiens
aggagaagcuaccucauau

SEQ ID NO: 1402700 - RNA, 19 nt, Homo sapiens
ucaccacuauuacccaauu

SEQ ID NO: 1402701 - RNA, 19 nt, Homo sapiens
caucgugucuaacuacaug

SEQ ID NO: 1402702 - RNA, 19 nt, Homo sapiens
uacaggugauuucugauuu

SEQ ID NO: 1402703 - RNA, 19 nt, Homo sapiens
ugucagugcucuagggauu

SEQ ID NO: 1402704 - RNA, 19 nt, Homo sapiens
aaaauuggcuuccugaaug

SEQ ID NO: 1402705 - RNA, 19 nt, Homo sapiens
gagaagcuaccucauaugg

SEQ ID NO: 1402706 - RNA, 19 nt, Homo sapiens
auagcaagaucaucaguga

SEQ ID NO: 1402707 - RNA, 19 nt, Homo sapiens
agcagaagauucagaaguu

SEQ ID NO: 1402708 - RNA, 19 nt, Homo sapiens
aaauuggcuuccugaauga

SEQ ID NO: 1402709 - RNA, 19 nt, Homo sapiens
aaggagaagcuaccucaua

SEQ ID NO: 1402710 - RNA, 19 nt, Homo sapiens
gcgaugcccuucuucuuac

SEQ ID NO: 1402711 - RNA, 19 nt, Homo sapiens
gugauauccuggaagaaau

SEQ ID NO: 1402712 - RNA, 19 nt, Homo sapiens
ucagauagcccaggugguu

SEQ ID NO: 1402713 - RNA, 19 nt, Homo sapiens
ggaccaaagcgcacaaucu

SEQ ID NO: 1402714 - RNA, 19 nt, Homo sapiens
auacacacauacaacaaga

SEQ ID NO: 1402715 - RNA, 19 nt, Homo sapiens
gauauccuggaagaaauua

SEQ ID NO: 1402716 - RNA, 19 nt, Homo sapiens
guuagagaguccaaugcaa

SEQ ID NO: 1402717 - RNA, 19 nt, Homo sapiens
auucagaaguuucagauag

SEQ ID NO: 1402718 - RNA, 19 nt, Homo sapiens
cgcacaaucuccuauguca

SEQ ID NO: 1402719 - RNA, 19 nt, Homo sapiens
gaccaaagcgcacaaucuc

SEQ ID NO: 1402720 - RNA, 19 nt, Homo sapiens
uugagcagguuugcauaua

SEQ ID NO: 1402721 - RNA, 19 nt, Homo sapiens
uagcccaggugguuagaga

SEQ ID NO: 1402722 - RNA, 19 nt, Homo sapiens
gaaggccacgguccugaug

SEQ ID NO: 1402723 - RNA, 19 nt, Homo sapiens
uacauggacuccuaugaca

SEQ ID NO: 1402724 - RNA, 19 nt, Homo sapiens
uuacaggugauuucugauu

SEQ ID NO: 1402725 - RNA, 19 nt, Homo sapiens
ggagaagcuaccucauaug

SEQ ID NO: 1402726 - RNA, 19 nt, Homo sapiens
cagcgcuccuucaccacua

SEQ ID NO: 1402727 - RNA, 19 nt, Homo sapiens
acauccacaucgugucuaa

SEQ ID NO: 1402728 - RNA, 19 nt, Homo sapiens
gauucagaaguuucagaua

SEQ ID NO: 1402729 - RNA, 19 nt, Homo sapiens
uaccucauaugguggaaug

SEQ ID NO: 1402730 - RNA, 19 nt, Homo sapiens
gugucuaacuacauggauu

SEQ ID NO: 1402731 - RNA, 19 nt, Homo sapiens
caacauccacaucgugucu

SEQ ID NO: 1402732 - RNA, 19 nt, Homo sapiens
agcgaugcccuucuucuua

SEQ ID NO: 1402733 - RNA, 19 nt, Homo sapiens
uaacaacauuccccuuuuc

SEQ ID NO: 1402734 - RNA, 19 nt, Homo sapiens
gaaggacgagacucuggau

SEQ ID NO: 1402735 - RNA, 19 nt, Homo sapiens
acucuaccauaacaacauu

SEQ ID NO: 1402736 - RNA, 19 nt, Homo sapiens
gaaagcgaugcccuucuuc

SEQ ID NO: 1402737 - RNA, 19 nt, Homo sapiens
gcccuucuucuuacaauau

SEQ ID NO: 1402738 - RNA, 19 nt, Homo sapiens
caacacacucuaccauaac

SEQ ID NO: 1402739 - RNA, 19 nt, Homo sapiens
gcucagggagggauauaag

SEQ ID NO: 1402740 - RNA, 19 nt, Homo sapiens
cagauagcccaggugguua

SEQ ID NO: 1402741 - RNA, 19 nt, Homo sapiens
cagcagaagauucagaagu

SEQ ID NO: 1402742 - RNA, 19 nt, Homo sapiens
caaagcgcacaaucuccua

SEQ ID NO: 1402743 - RNA, 19 nt, Homo sapiens
caccagaggcuugaaggaa

SEQ ID NO: 1402744 - RNA, 19 nt, Homo sapiens
ccacaucgugucuaacuac

SEQ ID NO: 1402745 - RNA, 19 nt, Homo sapiens
uaugucagcagaagauuca

SEQ ID NO: 1402746 - RNA, 19 nt, Homo sapiens
gcuacauggacuccuauga

SEQ ID NO: 1402747 - RNA, 19 nt, Homo sapiens
ugucuaacuacauggauuu

SEQ ID NO: 1402748 - RNA, 19 nt, Homo sapiens
uccgacagaugaaaguguu

SEQ ID NO: 1402749 - RNA, 19 nt, Homo sapiens
uuggugauauccuggaaga

SEQ ID NO: 1402750 - RNA, 19 nt, Homo sapiens
uuagagaguccaaugcaau

SEQ ID NO: 1402751 - RNA, 19 nt, Homo sapiens
cagaagauucagaaguuuc

SEQ ID NO: 1402752 - RNA, 19 nt, Homo sapiens
ucagugcucuagggauugu

SEQ ID NO: 1402753 - RNA, 19 nt, Homo sapiens
ugauauccuggaagaaauu

SEQ ID NO: 1402754 - RNA, 19 nt, Homo sapiens
uagagaguccaaugcaaug

SEQ ID NO: 1402755 - RNA, 19 nt, Homo sapiens
cauggacuccuaugacauc

SEQ ID NO: 1402756 - RNA, 19 nt, Homo sapiens
ccagcaacuugagggcaaa

SEQ ID NO: 1402757 - RNA, 19 nt, Homo sapiens
caaaauuggcuuccugaau

SEQ ID NO: 1402758 - RNA, 19 nt, Homo sapiens
acacauacaacaagaacag

SEQ ID NO: 1402759 - RNA, 19 nt, Homo sapiens
gcagguuugcauauaaugg

SEQ ID NO: 1402760 - RNA, 19 nt, Homo sapiens
uuaaacaugggaaguucaa

SEQ ID NO: 1402761 - RNA, 19 nt, Homo sapiens
acaucgugcuggagaagga

SEQ ID NO: 1402762 - RNA, 19 nt, Homo sapiens
agaagauucagaaguuuca

SEQ ID NO: 1402763 - RNA, 19 nt, Homo sapiens
cauaacaacauuccccuuu

SEQ ID NO: 1402764 - RNA, 19 nt, Homo sapiens
gguuagagaguccaaugca

SEQ ID NO: 1402765 - RNA, 19 nt, Homo sapiens
ugaaacagcugcucaagaa

SEQ ID NO: 1402766 - RNA, 19 nt, Homo sapiens
gcugagggaugcccaagaa

SEQ ID NO: 1402767 - RNA, 19 nt, Homo sapiens
gcaaggaggagaaggagaa

SEQ ID NO: 1402768 - RNA, 19 nt, Homo sapiens
acaaacacgucaugaggaa

SEQ ID NO: 1402769 - RNA, 19 nt, Homo sapiens
gacggacucuugcuauguu

SEQ ID NO: 1402770 - RNA, 19 nt, Homo sapiens
gagacggacucuugcuaug

SEQ ID NO: 1402771 - RNA, 19 nt, Homo sapiens
ggaaggagcagcgcaagga

SEQ ID NO: 1402772 - RNA, 19 nt, Homo sapiens
ggaaggacgacgacaaaca

SEQ ID NO: 1402773 - RNA, 19 nt, Homo sapiens
ucgaccagcuggaacguaa

SEQ ID NO: 1402774 - RNA, 19 nt, Homo sapiens
cgagggagacggacucuug

SEQ ID NO: 1402775 - RNA, 19 nt, Homo sapiens
ggagacggacucuugcuau

SEQ ID NO: 1402776 - RNA, 19 nt, Homo sapiens
gagggaugcccaagaaguu

SEQ ID NO: 1402777 - RNA, 19 nt, Homo sapiens
cuucacagccuuugaggaa

SEQ ID NO: 1402778 - RNA, 19 nt, Homo sapiens
gaaggacgacgacaaacac

SEQ ID NO: 1402779 - RNA, 19 nt, Homo sapiens
gggagacggacucuugcua

SEQ ID NO: 1402780 - RNA, 19 nt, Homo sapiens
gcugagugcccaauaaagg

SEQ ID NO: 1402781 - RNA, 19 nt, Homo sapiens
gcuccgcucuccugacaac

SEQ ID NO: 1402782 - RNA, 19 nt, Homo sapiens
gaacuccuggccucaagca

SEQ ID NO: 1402783 - RNA, 19 nt, Homo sapiens
gaccagcuggaacguaaga

SEQ ID NO: 1402784 - RNA, 19 nt, Homo sapiens
cgaccggcacccagaaaga

SEQ ID NO: 1402785 - RNA, 19 nt, Homo sapiens
uggcuccgcucuccugaca

SEQ ID NO: 1402786 - RNA, 19 nt, Homo sapiens
gaaacagcugcucaagaag

SEQ ID NO: 1402787 - RNA, 19 nt, Homo sapiens
gcagaaggagcuggaggau

SEQ ID NO: 1402788 - RNA, 19 nt, Homo sapiens
aacagcugcucaagaagga

SEQ ID NO: 1402789 - RNA, 19 nt, Homo sapiens
cuggaaggacgacgacaaa

SEQ ID NO: 1402790 - RNA, 19 nt, Homo sapiens
cagcugcgagggucacaga

SEQ ID NO: 1402791 - RNA, 19 nt, Homo sapiens
caccaucgaggacgccauu

SEQ ID NO: 1402792 - RNA, 19 nt, Homo sapiens
uggaggaugccuacuggaa

SEQ ID NO: 1402793 - RNA, 19 nt, Homo sapiens
ccagguaucugaaugcuuu

SEQ ID NO: 1402794 - RNA, 19 nt, Homo sapiens
gaauaggacuuuacagagu

SEQ ID NO: 1402795 - RNA, 19 nt, Homo sapiens
cagagaaacuggcaagauu

SEQ ID NO: 1402796 - RNA, 19 nt, Homo sapiens
gaauaugguuucuuacugu

SEQ ID NO: 1402797 - RNA, 19 nt, Homo sapiens
gcaaagcgagaacuagaua

SEQ ID NO: 1402798 - RNA, 19 nt, Homo sapiens
gaacauggacuuucuaaaa

SEQ ID NO: 1402799 - RNA, 19 nt, Homo sapiens
gcaacagacuauaccuuug

SEQ ID NO: 1402800 - RNA, 19 nt, Homo sapiens
acaagaggaugucaagaaa

SEQ ID NO: 1402801 - RNA, 19 nt, Homo sapiens
gaacuuacaagaagaguag

SEQ ID NO: 1402802 - RNA, 19 nt, Homo sapiens
gacuauaccuuugaagaaa

SEQ ID NO: 1402803 - RNA, 19 nt, Homo sapiens
ugaaugauuugaccucuga

SEQ ID NO: 1402804 - RNA, 19 nt, Homo sapiens
gcagaaagcaagugaauac

SEQ ID NO: 1402805 - RNA, 19 nt, Homo sapiens
gagaaacuggcaagauuaa

SEQ ID NO: 1402806 - RNA, 19 nt, Homo sapiens
ucagaggaauucagauuug

SEQ ID NO: 1402807 - RNA, 19 nt, Homo sapiens
caacagacuauaccuuuga

SEQ ID NO: 1402808 - RNA, 19 nt, Homo sapiens
gaaagggccaaaguugaua

SEQ ID NO: 1402809 - RNA, 19 nt, Homo sapiens
aaggauaccucgcuagcua

SEQ ID NO: 1402810 - RNA, 19 nt, Homo sapiens
ccacagagauuuuacauca

SEQ ID NO: 1402811 - RNA, 19 nt, Homo sapiens
gaagcugaacuuacaagaa

SEQ ID NO: 1402812 - RNA, 19 nt, Homo sapiens
cauugaagcugaacuuaca

SEQ ID NO: 1402813 - RNA, 19 nt, Homo sapiens
gauuaaagcaacagacuau

SEQ ID NO: 1402814 - RNA, 19 nt, Homo sapiens
gaaacuggcaagauuaaag

SEQ ID NO: 1402815 - RNA, 19 nt, Homo sapiens
agaacuagauagcauugaa

SEQ ID NO: 1402816 - RNA, 19 nt, Homo sapiens
aagcugaacuuacaagaag

SEQ ID NO: 1402817 - RNA, 19 nt, Homo sapiens
caagaagaguagacaugau

SEQ ID NO: 1402818 - RNA, 19 nt, Homo sapiens
ggcauuuccuaauaacaaa

SEQ ID NO: 1402819 - RNA, 19 nt, Homo sapiens
auaccucgcuagcuaguuu

SEQ ID NO: 1402820 - RNA, 19 nt, Homo sapiens
ucauggagagugugaauuu

SEQ ID NO: 1402821 - RNA, 19 nt, Homo sapiens
ggacuuuacagaguucuuu

SEQ ID NO: 1402822 - RNA, 19 nt, Homo sapiens
agagaaacuggcaagauua

SEQ ID NO: 1402823 - RNA, 19 nt, Homo sapiens
gguaauagaggacuugaag

SEQ ID NO: 1402824 - RNA, 19 nt, Homo sapiens
ccacggaccacagagauuu

SEQ ID NO: 1402825 - RNA, 19 nt, Homo sapiens
gaguagacaugauggaacu

SEQ ID NO: 1402826 - RNA, 19 nt, Homo sapiens
gauaaucgucgucagaaca

SEQ ID NO: 1402827 - RNA, 19 nt, Homo sapiens
cagaaagggccaaaguuga

SEQ ID NO: 1402828 - RNA, 19 nt, Homo sapiens
uagaggacuugaagcagaa

SEQ ID NO: 1402829 - RNA, 19 nt, Homo sapiens
aauaggacuuuacagaguu

SEQ ID NO: 1402830 - RNA, 19 nt, Homo sapiens
acagaaagggccaaaguug

SEQ ID NO: 1402831 - RNA, 19 nt, Homo sapiens
gugcccaaauacauaguuu

SEQ ID NO: 1402832 - RNA, 19 nt, Homo sapiens
gggccaaaguugauaaucg

SEQ ID NO: 1402833 - RNA, 19 nt, Homo sapiens
uacaagaggaugucaagaa

SEQ ID NO: 1402834 - RNA, 19 nt, Homo sapiens
gauuugaccucugaucucu

SEQ ID NO: 1402835 - RNA, 19 nt, Homo sapiens
ggccaaaguugauaaucgu

SEQ ID NO: 1402836 - RNA, 19 nt, Homo sapiens
uuugaccucugaucucuuu

SEQ ID NO: 1402837 - RNA, 19 nt, Homo sapiens
gaauccgucucuugcucaa

SEQ ID NO: 1402838 - RNA, 19 nt, Homo sapiens
agacuauaccuuugaagaa

SEQ ID NO: 1402839 - RNA, 19 nt, Homo sapiens
ucucaucaguccuuaguag

SEQ ID NO: 1402840 - RNA, 19 nt, Homo sapiens
gaggaauucagauuuggaa

SEQ ID NO: 1402841 - RNA, 19 nt, Homo sapiens
gaacuagauagcauugaag

SEQ ID NO: 1402842 - RNA, 19 nt, Homo sapiens
caagaaagcagaguugcau

SEQ ID NO: 1402843 - RNA, 19 nt, Homo sapiens
guaucugaaugcuuugguu

SEQ ID NO: 1402844 - RNA, 19 nt, Homo sapiens
gacaaaagccaaauaaaca

SEQ ID NO: 1402845 - RNA, 19 nt, Homo sapiens
ucccugcagugaaugauuu

SEQ ID NO: 1402846 - RNA, 19 nt, Homo sapiens
cuuacuguguguugcauuu

SEQ ID NO: 1402847 - RNA, 19 nt, Homo sapiens
gaagaguagacaugaugga

SEQ ID NO: 1402848 - RNA, 19 nt, Homo sapiens
uaauagaggacuugaagca

SEQ ID NO: 1402849 - RNA, 19 nt, Homo sapiens
acagugcgguggcccuuga

SEQ ID NO: 1402850 - RNA, 19 nt, Homo sapiens
uucaagaccuucucaugga

SEQ ID NO: 1402851 - RNA, 19 nt, Homo sapiens
acaagaagaguagacauga

SEQ ID NO: 1402852 - RNA, 19 nt, Homo sapiens
gaagcaaagcgagaacuag

SEQ ID NO: 1402853 - RNA, 19 nt, Homo sapiens
ggagagagaaacgcagguu

SEQ ID NO: 1402854 - RNA, 19 nt, Homo sapiens
cgguggcccuugaaacaaa

SEQ ID NO: 1402855 - RNA, 19 nt, Homo sapiens
cagacuauaccuuugaaga

SEQ ID NO: 1402856 - RNA, 19 nt, Homo sapiens
cauggaugcuucucugucu

SEQ ID NO: 1402857 - RNA, 19 nt, Homo sapiens
aagcaaagucagaggaauu

SEQ ID NO: 1402858 - RNA, 19 nt, Homo sapiens
agaaagggccaaaguugau

SEQ ID NO: 1402859 - RNA, 19 nt, Homo sapiens
ucuuggcauuuccuaauaa

SEQ ID NO: 1402860 - RNA, 19 nt, Homo sapiens
uaaacauccuuuucccuaa

SEQ ID NO: 1402861 - RNA, 19 nt, Homo sapiens
caagugaauacgagucaga

SEQ ID NO: 1402862 - RNA, 19 nt, Homo sapiens
gucagaggaauucagauuu

SEQ ID NO: 1402863 - RNA, 19 nt, Homo sapiens
aaagucagaggaauucaga

SEQ ID NO: 1402864 - RNA, 19 nt, Homo sapiens
cuacagaaagggccaaagu

SEQ ID NO: 1402865 - RNA, 19 nt, Homo sapiens
cgagucagaagccaaguau

SEQ ID NO: 1402866 - RNA, 19 nt, Homo sapiens
aagcaaagcgagaacuaga

SEQ ID NO: 1402867 - RNA, 19 nt, Homo sapiens
ugaagaagcaaagcgagaa

SEQ ID NO: 1402868 - RNA, 19 nt, Homo sapiens
ugaagcagaaagcaaguga

SEQ ID NO: 1402869 - RNA, 19 nt, Homo sapiens
gcauugaagcugaacuuac

SEQ ID NO: 1402870 - RNA, 19 nt, Homo sapiens
gauuuuacaucaccuuuca

SEQ ID NO: 1402871 - RNA, 19 nt, Homo sapiens
ucugaucucuuucguacca

SEQ ID NO: 1402872 - RNA, 19 nt, Homo sapiens
gaagcagaaagcaagugaa

SEQ ID NO: 1402873 - RNA, 19 nt, Homo sapiens
uugaauaggacuuuacaga

SEQ ID NO: 1402874 - RNA, 19 nt, Homo sapiens
aagaagaguagacaugaug

SEQ ID NO: 1402875 - RNA, 19 nt, Homo sapiens
cgagaacuagauagcauug

SEQ ID NO: 1402876 - RNA, 19 nt, Homo sapiens
gcgagaacuagauagcauu

SEQ ID NO: 1402877 - RNA, 19 nt, Homo sapiens
agaagcaaagcgagaacua

SEQ ID NO: 1402878 - RNA, 19 nt, Homo sapiens
aagaggaugucaagaaagc

SEQ ID NO: 1402879 - RNA, 19 nt, Homo sapiens
uggcauuuccuaauaacaa

SEQ ID NO: 1402880 - RNA, 19 nt, Homo sapiens
cucuuggcauuuccuaaua

SEQ ID NO: 1402881 - RNA, 19 nt, Homo sapiens
gcaagauuaaagcaacaga

SEQ ID NO: 1402882 - RNA, 19 nt, Homo sapiens
guugauaaucgucgucaga

SEQ ID NO: 1402883 - RNA, 19 nt, Homo sapiens
uuacaucaccuuucagaac

SEQ ID NO: 1402884 - RNA, 19 nt, Homo sapiens
augcuucucugucucauca

SEQ ID NO: 1402885 - RNA, 19 nt, Homo sapiens
agacaugauggaacuguga

SEQ ID NO: 1402886 - RNA, 19 nt, Homo sapiens
aagcagaaagcaagugaau

SEQ ID NO: 1402887 - RNA, 19 nt, Homo sapiens
agcaacagacuauaccuuu

SEQ ID NO: 1402888 - RNA, 19 nt, Homo sapiens
cagaggaauucagauuugg

SEQ ID NO: 1402889 - RNA, 19 nt, Homo sapiens
agucagaggaauucagauu

SEQ ID NO: 1402890 - RNA, 19 nt, Homo sapiens
uacaagaagaguagacaug

SEQ ID NO: 1402891 - RNA, 19 nt, Homo sapiens
gaaaauugaagaagcaaag

SEQ ID NO: 1402892 - RNA, 19 nt, Homo sapiens
ucagagaaacuggcaagau

SEQ ID NO: 1402893 - RNA, 19 nt, Homo sapiens
gaaaggagguguucugcaa

SEQ ID NO: 1402894 - RNA, 19 nt, Homo sapiens
ugacagaucucuauucuau

SEQ ID NO: 1402895 - RNA, 19 nt, Homo sapiens
gcaggcacuuucuaauuua

SEQ ID NO: 1402896 - RNA, 19 nt, Homo sapiens
uaccauagcuauagugaua

SEQ ID NO: 1402897 - RNA, 19 nt, Homo sapiens
gaugaccucugcuacaaua

SEQ ID NO: 1402898 - RNA, 19 nt, Homo sapiens
gaguguggauguauuguua

SEQ ID NO: 1402899 - RNA, 19 nt, Homo sapiens
acagguggcuugucuaaua

SEQ ID NO: 1402900 - RNA, 19 nt, Homo sapiens
gauuauugcugcaucauuu

SEQ ID NO: 1402901 - RNA, 19 nt, Homo sapiens
gauaagaauucaagcuuug

SEQ ID NO: 1402902 - RNA, 19 nt, Homo sapiens
gaaagagaauuaagaaagg

SEQ ID NO: 1402903 - RNA, 19 nt, Homo sapiens
gcaaugacguauuauggaa

SEQ ID NO: 1402904 - RNA, 19 nt, Homo sapiens
guagguagaucuucauaga

SEQ ID NO: 1402905 - RNA, 19 nt, Homo sapiens
gcuguaaguugauguuuaa

SEQ ID NO: 1402906 - RNA, 19 nt, Homo sapiens
cgagagagcuguagaccaa

SEQ ID NO: 1402907 - RNA, 19 nt, Homo sapiens
gaacaaaacacauugcuua

SEQ ID NO: 1402908 - RNA, 19 nt, Homo sapiens
uuaaagagcugaaugaaca

SEQ ID NO: 1402909 - RNA, 19 nt, Homo sapiens
ucaaauaucucuugggaau

SEQ ID NO: 1402910 - RNA, 19 nt, Homo sapiens
ggaaaagacuguuaacauu

SEQ ID NO: 1402911 - RNA, 19 nt, Homo sapiens
gccaagugauggauuauaa

SEQ ID NO: 1402912 - RNA, 19 nt, Homo sapiens
gaggagagcuugaugugau

SEQ ID NO: 1402913 - RNA, 19 nt, Homo sapiens
gcaaugacuguaaguauaa

SEQ ID NO: 1402914 - RNA, 19 nt, Homo sapiens
guaaugugaugaagaaaga

SEQ ID NO: 1402915 - RNA, 19 nt, Homo sapiens
gaccaaaccauguaccuua

SEQ ID NO: 1402916 - RNA, 19 nt, Homo sapiens
caguacagcucuugucuuu

SEQ ID NO: 1402917 - RNA, 19 nt, Homo sapiens
agacagaaauggacaguga

SEQ ID NO: 1402918 - RNA, 19 nt, Homo sapiens
guacagcucuugucuuuac

SEQ ID NO: 1402919 - RNA, 19 nt, Homo sapiens
gaaagaaacggguauccaa

SEQ ID NO: 1402920 - RNA, 19 nt, Homo sapiens
gagguaaaguuuccuuaga

SEQ ID NO: 1402921 - RNA, 19 nt, Homo sapiens
ggagaaagagaauaugaaa

SEQ ID NO: 1402922 - RNA, 19 nt, Homo sapiens
agaaacggguauccaaaua

SEQ ID NO: 1402923 - RNA, 19 nt, Homo sapiens
caauaggaccuuugcuuua

SEQ ID NO: 1402924 - RNA, 19 nt, Homo sapiens
ggaauucccucaccuagag

SEQ ID NO: 1402925 - RNA, 19 nt, Homo sapiens
gcauguaacaaccaauuua

SEQ ID NO: 1402926 - RNA, 19 nt, Homo sapiens
cccaauagcucuaauuuua

SEQ ID NO: 1402927 - RNA, 19 nt, Homo sapiens
ucacacaacuucucucugu

SEQ ID NO: 1402928 - RNA, 19 nt, Homo sapiens
gaaacggguauccaaauaa

SEQ ID NO: 1402929 - RNA, 19 nt, Homo sapiens
agaaguaguuggucauauu

SEQ ID NO: 1402930 - RNA, 19 nt, Homo sapiens
ucacuaacuuggauugaaa

SEQ ID NO: 1402931 - RNA, 19 nt, Homo sapiens
aaacggguauccaaauaaa

SEQ ID NO: 1402932 - RNA, 19 nt, Homo sapiens
ggaaaacacauauggauua

SEQ ID NO: 1402933 - RNA, 19 nt, Homo sapiens
caaaccauguaccuuauga

SEQ ID NO: 1402934 - RNA, 19 nt, Homo sapiens
acacugaacccauuacuuu

SEQ ID NO: 1402935 - RNA, 19 nt, Homo sapiens
guagaaguuuaguggauaa

SEQ ID NO: 1402936 - RNA, 19 nt, Homo sapiens
ccuaauagagugacauaua

SEQ ID NO: 1402937 - RNA, 19 nt, Homo sapiens
guuaauugauggaugguuu

SEQ ID NO: 1402938 - RNA, 19 nt, Homo sapiens
gcccauggccucagcaaua

SEQ ID NO: 1402939 - RNA, 19 nt, Homo sapiens
uaacauauccagccauuuc

SEQ ID NO: 1402940 - RNA, 19 nt, Homo sapiens
aggcauagacacauaauua

SEQ ID NO: 1402941 - RNA, 19 nt, Homo sapiens
guauaggccucugaaauau

SEQ ID NO: 1402942 - RNA, 19 nt, Homo sapiens
gaagauucgcuuaguuauu

SEQ ID NO: 1402943 - RNA, 19 nt, Homo sapiens
gcaggaguguggauguauu

SEQ ID NO: 1402944 - RNA, 19 nt, Homo sapiens
ggacugaagggaaugcuaa

SEQ ID NO: 1402945 - RNA, 19 nt, Homo sapiens
ugucugagcaguuauauuu

SEQ ID NO: 1402946 - RNA, 19 nt, Homo sapiens
uguauaggccucugaaaua

SEQ ID NO: 1402947 - RNA, 19 nt, Homo sapiens
gcaauaagucauauccauu

SEQ ID NO: 1402948 - RNA, 19 nt, Homo sapiens
ggacugcuguuugguguug

SEQ ID NO: 1402949 - RNA, 19 nt, Homo sapiens
aaauaucucuugggaauga

SEQ ID NO: 1402950 - RNA, 19 nt, Homo sapiens
gagguguucugcaaugauu

SEQ ID NO: 1402951 - RNA, 19 nt, Homo sapiens
caacucacauucccaucaa

SEQ ID NO: 1402952 - RNA, 19 nt, Homo sapiens
ccacuuggauucuuuuaua

SEQ ID NO: 1402953 - RNA, 19 nt, Homo sapiens
gcccuuaaauuucaccauu

SEQ ID NO: 1402954 - RNA, 19 nt, Homo sapiens
gguaaaguuuccuuagaga

SEQ ID NO: 1402955 - RNA, 19 nt, Homo sapiens
gaaguaauaauuggaggua

SEQ ID NO: 1402956 - RNA, 19 nt, Homo sapiens
ucacaguccugcccuaaug

SEQ ID NO: 1402957 - RNA, 19 nt, Homo sapiens
guuauuugcucccgauuau

SEQ ID NO: 1402958 - RNA, 19 nt, Homo sapiens
uaacuuggauugaaaugag

SEQ ID NO: 1402959 - RNA, 19 nt, Homo sapiens
aaauaccacuagcagaaua

SEQ ID NO: 1402960 - RNA, 19 nt, Homo sapiens
ugucauagguaauuuggaa

SEQ ID NO: 1402961 - RNA, 19 nt, Homo sapiens
uaaaguuguucuuccugua

SEQ ID NO: 1402962 - RNA, 19 nt, Homo sapiens
gggaauuacuggcgagaga

SEQ ID NO: 1402963 - RNA, 19 nt, Homo sapiens
cuacuucuccuucagauaa

SEQ ID NO: 1402964 - RNA, 19 nt, Homo sapiens
ugcaggcacuuucuaauuu

SEQ ID NO: 1402965 - RNA, 19 nt, Homo sapiens
guaaaccacagacgaauug

SEQ ID NO: 1402966 - RNA, 19 nt, Homo sapiens
gaaaauaccacuagcagaa

SEQ ID NO: 1402967 - RNA, 19 nt, Homo sapiens
gcauagcaguuggaaagaa

SEQ ID NO: 1402968 - RNA, 19 nt, Homo sapiens
cuaauacaguuccgagauu

SEQ ID NO: 1402969 - RNA, 19 nt, Homo sapiens
ggugaucacugaagcuuuc

SEQ ID NO: 1402970 - RNA, 19 nt, Homo sapiens
uaaaguggacacaguauug

SEQ ID NO: 1402971 - RNA, 19 nt, Homo sapiens
cuaugcaacuccuguaauu

SEQ ID NO: 1402972 - RNA, 19 nt, Homo sapiens
uauaacauauccagccauu

SEQ ID NO: 1402973 - RNA, 19 nt, Homo sapiens
caaaccaacaggauaauug

SEQ ID NO: 1402974 - RNA, 19 nt, Homo sapiens
aagaagauucgcuuaguua

SEQ ID NO: 1402975 - RNA, 19 nt, Homo sapiens
gagcaaugacuguaaguau

SEQ ID NO: 1402976 - RNA, 19 nt, Homo sapiens
uaaaaucgauuggggaaua

SEQ ID NO: 1402977 - RNA, 19 nt, Homo sapiens
cugcaucauuugcuuguua

SEQ ID NO: 1402978 - RNA, 19 nt, Homo sapiens
caaccaauuuacauggaaa

SEQ ID NO: 1402979 - RNA, 19 nt, Homo sapiens
gaacuacuucuccuucaga

SEQ ID NO: 1402980 - RNA, 19 nt, Homo sapiens
acaguaagaugugaaauuc

SEQ ID NO: 1402981 - RNA, 19 nt, Homo sapiens
uaauacaguuccgagauuu

SEQ ID NO: 1402982 - RNA, 19 nt, Homo sapiens
gggcuuauccgacuuugaa

SEQ ID NO: 1402983 - RNA, 19 nt, Homo sapiens
caccauuugucuuucauuu

SEQ ID NO: 1402984 - RNA, 19 nt, Homo sapiens
caaacuacuucuauaaugc

SEQ ID NO: 1402985 - RNA, 19 nt, Homo sapiens
gaacauuuacaagccauuu

SEQ ID NO: 1402986 - RNA, 19 nt, Homo sapiens
aaaccuagacucagagaaa

SEQ ID NO: 1402987 - RNA, 19 nt, Homo sapiens
uagaccaacuuaacacuga

SEQ ID NO: 1402988 - RNA, 19 nt, Homo sapiens
gaacuguauguuacuguuu

SEQ ID NO: 1402989 - RNA, 19 nt, Homo sapiens
uuguacagcuuccuugaua

SEQ ID NO: 1402990 - RNA, 19 nt, Homo sapiens
agcaaugacuguaaguaua

SEQ ID NO: 1402991 - RNA, 19 nt, Homo sapiens
gcaccacauuacaaucuga

SEQ ID NO: 1402992 - RNA, 19 nt, Homo sapiens
guacuaacucagcauguaa

SEQ ID NO: 1402993 - RNA, 19 nt, Homo sapiens
gaaaggagguguucugcaa

SEQ ID NO: 1402994 - RNA, 19 nt, Homo sapiens
gaucugaagugucaaaguu

SEQ ID NO: 1402995 - RNA, 19 nt, Homo sapiens
uaccauagcuauagugaua

SEQ ID NO: 1402996 - RNA, 19 nt, Homo sapiens
gaguguggauguauuguua

SEQ ID NO: 1402997 - RNA, 19 nt, Homo sapiens
acagguggcuugucuaaua

SEQ ID NO: 1402998 - RNA, 19 nt, Homo sapiens
gauuauugcugcaucauuu

SEQ ID NO: 1402999 - RNA, 19 nt, Homo sapiens
gauaagaauucaagcuuug

SEQ ID NO: 1403000 - RNA, 19 nt, Homo sapiens
gcaaugacguauuauggaa

SEQ ID NO: 1403001 - RNA, 19 nt, Homo sapiens
gaacaaaacacauugcuua

SEQ ID NO: 1403002 - RNA, 19 nt, Homo sapiens
cgagagagcuguagaccaa

SEQ ID NO: 1403003 - RNA, 19 nt, Homo sapiens
uuaaagagcugaaugaaca

SEQ ID NO: 1403004 - RNA, 19 nt, Homo sapiens
ucaaauaucucuugggaau

SEQ ID NO: 1403005 - RNA, 19 nt, Homo sapiens
uaucuugccucuaagcuua

SEQ ID NO: 1403006 - RNA, 19 nt, Homo sapiens
ccaccuuucucaaauauaa

SEQ ID NO: 1403007 - RNA, 19 nt, Homo sapiens
gcaaugacuguaaguauaa

SEQ ID NO: 1403008 - RNA, 19 nt, Homo sapiens
ucugauaucuugccucuaa

SEQ ID NO: 1403009 - RNA, 19 nt, Homo sapiens
agacagaaauggacaguga

SEQ ID NO: 1403010 - RNA, 19 nt, Homo sapiens
gcaaacugcuuacuuguac

SEQ ID NO: 1403011 - RNA, 19 nt, Homo sapiens
caauaggaccuuugcuuua

SEQ ID NO: 1403012 - RNA, 19 nt, Homo sapiens
ggaauucccucaccuagag

SEQ ID NO: 1403013 - RNA, 19 nt, Homo sapiens
agaaguaguuggucauauu

SEQ ID NO: 1403014 - RNA, 19 nt, Homo sapiens
ggaaaacacauauggauua

SEQ ID NO: 1403015 - RNA, 19 nt, Homo sapiens
gaauccaccuuucucaaau

SEQ ID NO: 1403016 - RNA, 19 nt, Homo sapiens
acacugaacccauuacuuu

SEQ ID NO: 1403017 - RNA, 19 nt, Homo sapiens
ggacuugaauccaccuuuc

SEQ ID NO: 1403018 - RNA, 19 nt, Homo sapiens
gcccauggccucagcaaua

SEQ ID NO: 1403019 - RNA, 19 nt, Homo sapiens
caacuguucuuagagcuuu

SEQ ID NO: 1403020 - RNA, 19 nt, Homo sapiens
gcaggaguguggauguauu

SEQ ID NO: 1403021 - RNA, 19 nt, Homo sapiens
ggacugaagggaaugcuaa

SEQ ID NO: 1403022 - RNA, 19 nt, Homo sapiens
gcaauaagucauauccauu

SEQ ID NO: 1403023 - RNA, 19 nt, Homo sapiens
ggacugcuguuugguguug

SEQ ID NO: 1403024 - RNA, 19 nt, Homo sapiens
aaauaucucuugggaauga

SEQ ID NO: 1403025 - RNA, 19 nt, Homo sapiens
gagguguucugcaaugauu

SEQ ID NO: 1403026 - RNA, 19 nt, Homo sapiens
ccacuuggauucuuuuaua

SEQ ID NO: 1403027 - RNA, 19 nt, Homo sapiens
cacaugaucugaaguguca

SEQ ID NO: 1403028 - RNA, 19 nt, Homo sapiens
ucacaguccugcccuaaug

SEQ ID NO: 1403029 - RNA, 19 nt, Homo sapiens
uaaaguuguucuuccugua

SEQ ID NO: 1403030 - RNA, 19 nt, Homo sapiens
gggaauuacuggcgagaga

SEQ ID NO: 1403031 - RNA, 19 nt, Homo sapiens
cuaauacaguuccgagauu

SEQ ID NO: 1403032 - RNA, 19 nt, Homo sapiens
ggugaucacugaagcuuuc

SEQ ID NO: 1403033 - RNA, 19 nt, Homo sapiens
guaaaccacagacgaauug

SEQ ID NO: 1403034 - RNA, 19 nt, Homo sapiens
cuacuucuccuucagauaa

SEQ ID NO: 1403035 - RNA, 19 nt, Homo sapiens
gagcaaugacuguaaguau

SEQ ID NO: 1403036 - RNA, 19 nt, Homo sapiens
uaaaaucgauuggggaaua

SEQ ID NO: 1403037 - RNA, 19 nt, Homo sapiens
cugcaucauuugcuuguua

SEQ ID NO: 1403038 - RNA, 19 nt, Homo sapiens
gcagagucaucccuauugu

SEQ ID NO: 1403039 - RNA, 19 nt, Homo sapiens
uaauacaguuccgagauuu

SEQ ID NO: 1403040 - RNA, 19 nt, Homo sapiens
gggcuuauccgacuuugaa

SEQ ID NO: 1403041 - RNA, 19 nt, Homo sapiens
gaacuacuucuccuucaga

SEQ ID NO: 1403042 - RNA, 19 nt, Homo sapiens
augcugggcuuaugguuua

SEQ ID NO: 1403043 - RNA, 19 nt, Homo sapiens
aaaccuagacucagagaaa

SEQ ID NO: 1403044 - RNA, 19 nt, Homo sapiens
uagaccaacuuaacacuga

SEQ ID NO: 1403045 - RNA, 19 nt, Homo sapiens
uuguacagcuuccuugaua

SEQ ID NO: 1403046 - RNA, 19 nt, Homo sapiens
agcaaugacuguaaguaua

SEQ ID NO: 1403047 - RNA, 19 nt, Homo sapiens
gcaccacauuacaaucuga

SEQ ID NO: 1403048 - RNA, 19 nt, Homo sapiens
guacagcuuccuugauaaa

SEQ ID NO: 1403049 - RNA, 19 nt, Homo sapiens
gcccuaaugagaaguguua

SEQ ID NO: 1403050 - RNA, 19 nt, Homo sapiens
gaacggauugucccucaga

SEQ ID NO: 1403051 - RNA, 19 nt, Homo sapiens
gcacccaguguuugguuua

SEQ ID NO: 1403052 - RNA, 19 nt, Homo sapiens
gaaggcgacugcccauuuu

SEQ ID NO: 1403053 - RNA, 19 nt, Homo sapiens
gguaucugcugcaauaagu

SEQ ID NO: 1403054 - RNA, 19 nt, Homo sapiens
caagagcaaugacuguaag

SEQ ID NO: 1403055 - RNA, 19 nt, Homo sapiens
gauaggacgcuucccaaga

SEQ ID NO: 1403056 - RNA, 19 nt, Homo sapiens
gccuugacauccuuaauau

SEQ ID NO: 1403057 - RNA, 19 nt, Homo sapiens
gagcuuuaauuuccugcaa

SEQ ID NO: 1403058 - RNA, 19 nt, Homo sapiens
gggauaauguuggcaguuc

SEQ ID NO: 1403059 - RNA, 19 nt, Homo sapiens
caacugcaaugaagaagcu

SEQ ID NO: 1403060 - RNA, 19 nt, Homo sapiens
gagcugaaugaacaguuua

SEQ ID NO: 1403061 - RNA, 19 nt, Homo sapiens
ggaaugaaaaugccauaua

SEQ ID NO: 1403062 - RNA, 19 nt, Homo sapiens
gaaguaguuggucauauuc

SEQ ID NO: 1403063 - RNA, 19 nt, Homo sapiens
ggccuuugcuguucucuca

SEQ ID NO: 1403064 - RNA, 19 nt, Homo sapiens
ggauuggccuuugcuguuc

SEQ ID NO: 1403065 - RNA, 19 nt, Homo sapiens
aauccaccuuucucaaaua

SEQ ID NO: 1403066 - RNA, 19 nt, Homo sapiens
guacaacaaaugcuucuuc

SEQ ID NO: 1403067 - RNA, 19 nt, Homo sapiens
caauaagucauauccauuc

SEQ ID NO: 1403068 - RNA, 19 nt, Homo sapiens
ugaagggaaugcuaauaca

SEQ ID NO: 1403069 - RNA, 19 nt, Homo sapiens
gcacaggagcgaagacaca

SEQ ID NO: 1403070 - RNA, 19 nt, Homo sapiens
gaaucuagugcucacauga

SEQ ID NO: 1403071 - RNA, 19 nt, Homo sapiens
ccaagagcaaugacuguaa

SEQ ID NO: 1403072 - RNA, 19 nt, Homo sapiens
uggcuugucuaauaucuug

SEQ ID NO: 1403073 - RNA, 19 nt, Homo sapiens
ucucugcggugaucacuga

SEQ ID NO: 1403074 - RNA, 19 nt, Homo sapiens
aagcuuauauugccaucuu

SEQ ID NO: 1403075 - RNA, 19 nt, Homo sapiens
uuucugcucugauaucuug

SEQ ID NO: 1403076 - RNA, 19 nt, Homo sapiens
ugaauccaccuuucucaaa

SEQ ID NO: 1403077 - RNA, 19 nt, Homo sapiens
agagcugaaugaacaguuu

SEQ ID NO: 1403078 - RNA, 19 nt, Homo sapiens
ggauaauguuggcaguuca

SEQ ID NO: 1403079 - RNA, 19 nt, Homo sapiens
gguccuuguucuuguuaaa

SEQ ID NO: 1403080 - RNA, 19 nt, Homo sapiens
agaaggcgacugcccauuu

SEQ ID NO: 1403081 - RNA, 19 nt, Homo sapiens
uuaauucccuauccaaugg

SEQ ID NO: 1403082 - RNA, 19 nt, Homo sapiens
gaaggacggcuggccugua

SEQ ID NO: 1403083 - RNA, 19 nt, Homo sapiens
caaggaauucccucaccua

SEQ ID NO: 1403084 - RNA, 19 nt, Homo sapiens
gacguauuauggaaaccua

SEQ ID NO: 1403085 - RNA, 19 nt, Homo sapiens
gcuguuugguguuguuugu

SEQ ID NO: 1403086 - RNA, 19 nt, Homo sapiens
cagguggcuugucuaauau

SEQ ID NO: 1403087 - RNA, 19 nt, Homo sapiens
ggccucagcaauauaguuu

SEQ ID NO: 1403088 - RNA, 19 nt, Homo sapiens
aauuggagcuuggcauuga

SEQ ID NO: 1403089 - RNA, 19 nt, Homo sapiens
gagcuuggcauugaaagga

SEQ ID NO: 1403090 - RNA, 19 nt, Homo sapiens
ggugguugccuaucauuug

SEQ ID NO: 1403091 - RNA, 19 nt, Homo sapiens
ucagcaauauaguuucuuc

SEQ ID NO: 1403092 - RNA, 19 nt, Homo sapiens
gauugucccucagaacaug

SEQ ID NO: 1403093 - RNA, 19 nt, Homo sapiens
gaacaggcauuggcgugua

SEQ ID NO: 1403094 - RNA, 19 nt, Homo sapiens
gcagaacagucaaaucuca

SEQ ID NO: 1403095 - RNA, 19 nt, Homo sapiens
ucagagagaugccaaagug

SEQ ID NO: 1403096 - RNA, 19 nt, Homo sapiens
gaaagggcaagcacauuaa

SEQ ID NO: 1403097 - RNA, 19 nt, Homo sapiens
ucaccucugugucuucuua

SEQ ID NO: 1403098 - RNA, 19 nt, Homo sapiens
agaaagggcaagcacauua

SEQ ID NO: 1403099 - RNA, 19 nt, Homo sapiens
ugacugugauggccuauga

SEQ ID NO: 1403100 - RNA, 19 nt, Homo sapiens
gcaguuggauuguguugca

SEQ ID NO: 1403101 - RNA, 19 nt, Homo sapiens
gccaguuguuugcuuauuu

SEQ ID NO: 1403102 - RNA, 19 nt, Homo sapiens
ucgauagcauguucauaua

SEQ ID NO: 1403103 - RNA, 19 nt, Homo sapiens
caucaucgauagcauguuc

SEQ ID NO: 1403104 - RNA, 19 nt, Homo sapiens
gcaauucaccuucuucaag

SEQ ID NO: 1403105 - RNA, 19 nt, Homo sapiens
cgucagauggguaguauaa

SEQ ID NO: 1403106 - RNA, 19 nt, Homo sapiens
cggcaaagguguccaaguc

SEQ ID NO: 1403107 - RNA, 19 nt, Homo sapiens
gaacagucaaaucucauga

SEQ ID NO: 1403108 - RNA, 19 nt, Homo sapiens
ucagauggguaguauaaag

SEQ ID NO: 1403109 - RNA, 19 nt, Homo sapiens
cagguagacuucagagaga

SEQ ID NO: 1403110 - RNA, 19 nt, Homo sapiens
uuacggaucggcucacaua

SEQ ID NO: 1403111 - RNA, 19 nt, Homo sapiens
caaaucucaugaucuguuc

SEQ ID NO: 1403112 - RNA, 19 nt, Homo sapiens
gcucucaccugccaguugu

SEQ ID NO: 1403113 - RNA, 19 nt, Homo sapiens
gacaugcuccugacuguga

SEQ ID NO: 1403114 - RNA, 19 nt, Homo sapiens
agucaaaucucaugaucug

SEQ ID NO: 1403115 - RNA, 19 nt, Homo sapiens
cacauuaaaucccuacauc

SEQ ID NO: 1403116 - RNA, 19 nt, Homo sapiens
cagcagaacagucaaaucu

SEQ ID NO: 1403117 - RNA, 19 nt, Homo sapiens
ucaagaauguggaaaucuc

SEQ ID NO: 1403118 - RNA, 19 nt, Homo sapiens
caagaugauuguggacaug

SEQ ID NO: 1403119 - RNA, 19 nt, Homo sapiens
gaaacagggacauucaaag

SEQ ID NO: 1403120 - RNA, 19 nt, Homo sapiens
caugaucuguuccauccuu

SEQ ID NO: 1403121 - RNA, 19 nt, Homo sapiens
ucaaaucucaugaucuguu

SEQ ID NO: 1403122 - RNA, 19 nt, Homo sapiens
auagcggagucaucucuua

SEQ ID NO: 1403123 - RNA, 19 nt, Homo sapiens
ggcugucccuguccaugua

SEQ ID NO: 1403124 - RNA, 19 nt, Homo sapiens
cagcugcgcaguuggauug

SEQ ID NO: 1403125 - RNA, 19 nt, Homo sapiens
ccaagaugauuguggacau

SEQ ID NO: 1403126 - RNA, 19 nt, Homo sapiens
gagaaacagggacauucaa

SEQ ID NO: 1403127 - RNA, 19 nt, Homo sapiens
ccugccaguuguuugcuua

SEQ ID NO: 1403128 - RNA, 19 nt, Homo sapiens
ucugacagcaucaucgaua

SEQ ID NO: 1403129 - RNA, 19 nt, Homo sapiens
agaaacagggacauucaaa

SEQ ID NO: 1403130 - RNA, 19 nt, Homo sapiens
aagcuugccuguucugaca

SEQ ID NO: 1403131 - RNA, 19 nt, Homo sapiens
uaagaaagggcaagcacau

SEQ ID NO: 1403132 - RNA, 19 nt, Homo sapiens
gcacauuaaaucccuacau

SEQ ID NO: 1403133 - RNA, 19 nt, Homo sapiens
acagucaaaucucaugauc

SEQ ID NO: 1403134 - RNA, 19 nt, Homo sapiens
gccaaaguguggagaucug

SEQ ID NO: 1403135 - RNA, 19 nt, Homo sapiens
cagggauccuuuugucuua

SEQ ID NO: 1403136 - RNA, 19 nt, Homo sapiens
ugagaaacagggacauuca

SEQ ID NO: 1403137 - RNA, 19 nt, Homo sapiens
ccucugcacuacccaguca

SEQ ID NO: 1403138 - RNA, 19 nt, Homo sapiens
ggccacgguucccaagaug

SEQ ID NO: 1403139 - RNA, 19 nt, Homo sapiens
cauuaaaucccuacaucug

SEQ ID NO: 1403140 - RNA, 19 nt, Homo sapiens
ccaguuguuugcuuauuuu

SEQ ID NO: 1403141 - RNA, 19 nt, Homo sapiens
gaauguggaaaucucuaau

SEQ ID NO: 1403142 - RNA, 19 nt, Homo sapiens
cucugugucuucuuaguuu

SEQ ID NO: 1403143 - RNA, 19 nt, Homo sapiens
acacagagccacggaaucu

SEQ ID NO: 1403144 - RNA, 19 nt, Homo sapiens
aaagggcaagcacauuaaa

SEQ ID NO: 1403145 - RNA, 19 nt, Homo sapiens
cgauagcauguucauauau

SEQ ID NO: 1403146 - RNA, 19 nt, Homo sapiens
aagacaugcuccugacugu

SEQ ID NO: 1403147 - RNA, 19 nt, Homo sapiens
gcggagucaucucuuaugc

SEQ ID NO: 1403148 - RNA, 19 nt, Homo sapiens
gcgcagcagaacagucaaa

SEQ ID NO: 1403149 - RNA, 19 nt, Homo sapiens
gcauguucauauauuucga

SEQ ID NO: 1403150 - RNA, 19 nt, Homo sapiens
gcauagcggagucaucucu

SEQ ID NO: 1403151 - RNA, 19 nt, Homo sapiens
cuucaagaauguggaaauc

SEQ ID NO: 1403152 - RNA, 19 nt, Homo sapiens
ucacacagagccacggaau

SEQ ID NO: 1403153 - RNA, 19 nt, Homo sapiens
aaacagggacauucaaagc

SEQ ID NO: 1403154 - RNA, 19 nt, Homo sapiens
agaauguggaaaucucuaa

SEQ ID NO: 1403155 - RNA, 19 nt, Homo sapiens
caaagguguccaagucaca

SEQ ID NO: 1403156 - RNA, 19 nt, Homo sapiens
aaaguguggagaucugauu

SEQ ID NO: 1403157 - RNA, 19 nt, Homo sapiens
uuccuuagccuguuggauu

SEQ ID NO: 1403158 - RNA, 19 nt, Homo sapiens
cggccacgguucccaagau

SEQ ID NO: 1403159 - RNA, 19 nt, Homo sapiens
gcagcagaacagucaaauc

SEQ ID NO: 1403160 - RNA, 19 nt, Homo sapiens
cgcccagcauacaagcuua

SEQ ID NO: 1403161 - RNA, 19 nt, Homo sapiens
cggaucggcucacauaacg

SEQ ID NO: 1403162 - RNA, 19 nt, Homo sapiens
guacagaagacggcaaagg

SEQ ID NO: 1403163 - RNA, 19 nt, Homo sapiens
ccacgguucccaagaugau

SEQ ID NO: 1403164 - RNA, 19 nt, Homo sapiens
cugcgcaguuggauugugu

SEQ ID NO: 1403165 - RNA, 19 nt, Homo sapiens
gggcugucccuguccaugu

SEQ ID NO: 1403166 - RNA, 19 nt, Homo sapiens
ggcaaagguguccaaguca

SEQ ID NO: 1403167 - RNA, 19 nt, Homo sapiens
acagagccacggaaucuca

SEQ ID NO: 1403168 - RNA, 19 nt, Homo sapiens
gcacaaaccucacaaguca

SEQ ID NO: 1403169 - RNA, 19 nt, Homo sapiens
gaacagacaucuuauugga

SEQ ID NO: 1403170 - RNA, 19 nt, Homo sapiens
ggaagauguuuguguauuu

SEQ ID NO: 1403171 - RNA, 19 nt, Homo sapiens
gagcgaacaucaaagaauu

SEQ ID NO: 1403172 - RNA, 19 nt, Homo sapiens
ccagguagcuaguacuaua

SEQ ID NO: 1403173 - RNA, 19 nt, Homo sapiens
uaagaaagcucugagaaug

SEQ ID NO: 1403174 - RNA, 19 nt, Homo sapiens
gaaacccugucucuacuaa

SEQ ID NO: 1403175 - RNA, 19 nt, Homo sapiens
acagacaucuuauuggaua

SEQ ID NO: 1403176 - RNA, 19 nt, Homo sapiens
gaagauguuuguguauuug

SEQ ID NO: 1403177 - RNA, 19 nt, Homo sapiens
gaaaccaagacucaacuua

SEQ ID NO: 1403178 - RNA, 19 nt, Homo sapiens
gcucaugccuauaauccua

SEQ ID NO: 1403179 - RNA, 19 nt, Homo sapiens
gagagaagcccuacgaaug

SEQ ID NO: 1403180 - RNA, 19 nt, Homo sapiens
gaucggagaccuugugaaa

SEQ ID NO: 1403181 - RNA, 19 nt, Homo sapiens
agaagaaccuguacagaga

SEQ ID NO: 1403182 - RNA, 19 nt, Homo sapiens
ggagaaacccuacgagugu

SEQ ID NO: 1403183 - RNA, 19 nt, Homo sapiens
ccagaacagucacuuuauu

SEQ ID NO: 1403184 - RNA, 19 nt, Homo sapiens
ggcauccgauucagucuua

SEQ ID NO: 1403185 - RNA, 19 nt, Homo sapiens
gaaccaauguacugaugug

SEQ ID NO: 1403186 - RNA, 19 nt, Homo sapiens
gaaaugccauccgccagaa

SEQ ID NO: 1403187 - RNA, 19 nt, Homo sapiens
gagaagcccuguggauaga

SEQ ID NO: 1403188 - RNA, 19 nt, Homo sapiens
ucacuagucuuuccucaug

SEQ ID NO: 1403189 - RNA, 19 nt, Homo sapiens
ccuauaauccuaacacuuu

SEQ ID NO: 1403190 - RNA, 19 nt, Homo sapiens
gggaagauguuuguguauu

SEQ ID NO: 1403191 - RNA, 19 nt, Homo sapiens
gcucaucccuugucacaca

SEQ ID NO: 1403192 - RNA, 19 nt, Homo sapiens
uaccagaacagacaucuua

SEQ ID NO: 1403193 - RNA, 19 nt, Homo sapiens
ggaaagccuucaacaggau

SEQ ID NO: 1403194 - RNA, 19 nt, Homo sapiens
gaacaucaaagaauucaca

SEQ ID NO: 1403195 - RNA, 19 nt, Homo sapiens
gcucuuaccugaucuugca

SEQ ID NO: 1403196 - RNA, 19 nt, Homo sapiens
ucacaagucacuagucuuu

SEQ ID NO: 1403197 - RNA, 19 nt, Homo sapiens
gaaaagaaguggguuuaug

SEQ ID NO: 1403198 - RNA, 19 nt, Homo sapiens
gaacagucacuuuauucaa

SEQ ID NO: 1403199 - RNA, 19 nt, Homo sapiens
ccagagcucuuaccugauc

SEQ ID NO: 1403200 - RNA, 19 nt, Homo sapiens
gaaaagcccuauaaaugug

SEQ ID NO: 1403201 - RNA, 19 nt, Homo sapiens
ggaugacuguacuaagaaa

SEQ ID NO: 1403202 - RNA, 19 nt, Homo sapiens
gagaggugaugcuggagaa

SEQ ID NO: 1403203 - RNA, 19 nt, Homo sapiens
gaacguggucucccuggaa

SEQ ID NO: 1403204 - RNA, 19 nt, Homo sapiens
ccagaggucuucccuugug

SEQ ID NO: 1403205 - RNA, 19 nt, Homo sapiens
cagaacagacaucuuauug

SEQ ID NO: 1403206 - RNA, 19 nt, Homo sapiens
gaaaguaaugaauguggaa

SEQ ID NO: 1403207 - RNA, 19 nt, Homo sapiens
gcagagaaacccuuugagu

SEQ ID NO: 1403208 - RNA, 19 nt, Homo sapiens
ggcagcgaguuagauauua

SEQ ID NO: 1403209 - RNA, 19 nt, Homo sapiens
cuauaaaugugaagacugu

SEQ ID NO: 1403210 - RNA, 19 nt, Homo sapiens
gggaaaagcccuauaaaug

SEQ ID NO: 1403211 - RNA, 19 nt, Homo sapiens
ggaaaagcccuauaaaugu

SEQ ID NO: 1403212 - RNA, 19 nt, Homo sapiens
gaacucauacuggagagaa

SEQ ID NO: 1403213 - RNA, 19 nt, Homo sapiens
agacucaacuuacaagaag

SEQ ID NO: 1403214 - RNA, 19 nt, Homo sapiens
gcaauugcacgcugcuuug

SEQ ID NO: 1403215 - RNA, 19 nt, Homo sapiens
ggagagaagcccuacgaau

SEQ ID NO: 1403216 - RNA, 19 nt, Homo sapiens
ucggagaccuugugaaagu

SEQ ID NO: 1403217 - RNA, 19 nt, Homo sapiens
gaacucacacuggagagaa

SEQ ID NO: 1403218 - RNA, 19 nt, Homo sapiens
guggaaaggccuucaguga

SEQ ID NO: 1403219 - RNA, 19 nt, Homo sapiens
acaagaagguggcuuugca

SEQ ID NO: 1403220 - RNA, 19 nt, Homo sapiens
cgaggcggguggaucauga

SEQ ID NO: 1403221 - RNA, 19 nt, Homo sapiens
cgccagaacagucacuuua

SEQ ID NO: 1403222 - RNA, 19 nt, Homo sapiens
gcccuguugugauggauaa

SEQ ID NO: 1403223 - RNA, 19 nt, Homo sapiens
gcagcgaguuagauauuac

SEQ ID NO: 1403224 - RNA, 19 nt, Homo sapiens
uuggaugacuguacuaaga

SEQ ID NO: 1403225 - RNA, 19 nt, Homo sapiens
gcaggagaauggugugaac

SEQ ID NO: 1403226 - RNA, 19 nt, Homo sapiens
gagcucaucccuugucaca

SEQ ID NO: 1403227 - RNA, 19 nt, Homo sapiens
cuacaggugucaggaaugu

SEQ ID NO: 1403228 - RNA, 19 nt, Homo sapiens
ggagaccuugugaaaguaa

SEQ ID NO: 1403229 - RNA, 19 nt, Homo sapiens
gagcccagcccuuguuuua

SEQ ID NO: 1403230 - RNA, 19 nt, Homo sapiens
guacugauguggggauuaa

SEQ ID NO: 1403231 - RNA, 19 nt, Homo sapiens
gaacucacacgggcgagaa

SEQ ID NO: 1403232 - RNA, 19 nt, Homo sapiens
ggacacacaccggagagaa

SEQ ID NO: 1403233 - RNA, 19 nt, Homo sapiens
caagccuccuguucagauu

SEQ ID NO: 1403234 - RNA, 19 nt, Homo sapiens
aagagaagcccuguggaua

SEQ ID NO: 1403235 - RNA, 19 nt, Homo sapiens
uauaagaaagcucugagaa

SEQ ID NO: 1403236 - RNA, 19 nt, Homo sapiens
gaagaaccaauguacugau

SEQ ID NO: 1403237 - RNA, 19 nt, Homo sapiens
ccaccacgcccagcaaauu

SEQ ID NO: 1403238 - RNA, 19 nt, Homo sapiens
ccagaacagacaucuuauu

SEQ ID NO: 1403239 - RNA, 19 nt, Homo sapiens
gcagaucggagaccuugug

SEQ ID NO: 1403240 - RNA, 19 nt, Homo sapiens
aaccaagacucaacuuaca

SEQ ID NO: 1403241 - RNA, 19 nt, Homo sapiens
ccacuuggagcaaagagaa

SEQ ID NO: 1403242 - RNA, 19 nt, Homo sapiens
gauuaaagaggguccacuu

SEQ ID NO: 1403243 - RNA, 19 nt, Homo sapiens
uaugucaccuucucaccuu

SEQ ID NO: 1403244 - RNA, 19 nt, Homo sapiens
gagaagcccuacgaaugca

SEQ ID NO: 1403245 - RNA, 19 nt, Homo sapiens
uaaagggaaccacuugugu

SEQ ID NO: 1403246 - RNA, 19 nt, Homo sapiens
ggaguccaguggcgugauc

SEQ ID NO: 1403247 - RNA, 19 nt, Homo sapiens
uuaguacucugacacauac

SEQ ID NO: 1403248 - RNA, 19 nt, Homo sapiens
cagaacagucacuuuauuc

SEQ ID NO: 1403249 - RNA, 19 nt, Homo sapiens
ccagccagugguauaaaua

SEQ ID NO: 1403250 - RNA, 19 nt, Homo sapiens
gcuggugccugcucagaag

SEQ ID NO: 1403251 - RNA, 19 nt, Homo sapiens
aagaaccaauguacugaug

SEQ ID NO: 1403252 - RNA, 19 nt, Homo sapiens
ucgagaccauccuggcuaa

SEQ ID NO: 1403253 - RNA, 19 nt, Homo sapiens
ccagaaaaccuauaaaauc

SEQ ID NO: 1403254 - RNA, 19 nt, Homo sapiens
ccagugguauaaauaugau

SEQ ID NO: 1403255 - RNA, 19 nt, Homo sapiens
gugaaacccugucucuacu

SEQ ID NO: 1403256 - RNA, 19 nt, Homo sapiens
aaucaacacggcagagaaa

SEQ ID NO: 1403257 - RNA, 19 nt, Homo sapiens
gccagugguauaaauauga

SEQ ID NO: 1403258 - RNA, 19 nt, Homo sapiens
gcugggacuacaggaauua

SEQ ID NO: 1403259 - RNA, 19 nt, Homo sapiens
cuguugugauggauaauuu

SEQ ID NO: 1403260 - RNA, 19 nt, Homo sapiens
aguaaugaauguggaaaug

SEQ ID NO: 1403261 - RNA, 19 nt, Homo sapiens
ucacagggaagcucuaaag

SEQ ID NO: 1403262 - RNA, 19 nt, Homo sapiens
ccucacaagucacuagucu

SEQ ID NO: 1403263 - RNA, 19 nt, Homo sapiens
cuucucaccuucuuauaag

SEQ ID NO: 1403264 - RNA, 19 nt, Homo sapiens
auugcacgcugcuuuguaa

SEQ ID NO: 1403265 - RNA, 19 nt, Homo sapiens
gaucaugaggucaggagau

SEQ ID NO: 1403266 - RNA, 19 nt, Homo sapiens
caccacgcccagcaaauuu

SEQ ID NO: 1403267 - RNA, 19 nt, Homo sapiens
cuacgaaugcagugaaugu

SEQ ID NO: 1403268 - RNA, 19 nt, Homo sapiens
gaaacgaugucaaauauac

SEQ ID NO: 1403269 - RNA, 19 nt, Homo sapiens
cuacagugcuucuuagaua

SEQ ID NO: 1403270 - RNA, 19 nt, Homo sapiens
ggaauuccuuggcuguuua

SEQ ID NO: 1403271 - RNA, 19 nt, Homo sapiens
gcagcaaucuguucucuug

SEQ ID NO: 1403272 - RNA, 19 nt, Homo sapiens
ggaaagaaauagaacaauc

SEQ ID NO: 1403273 - RNA, 19 nt, Homo sapiens
aaucuaagcuguugucuga

SEQ ID NO: 1403274 - RNA, 19 nt, Homo sapiens
gauaagagaugguuaagcu

SEQ ID NO: 1403275 - RNA, 19 nt, Homo sapiens
gaugacagcuggagaaugg

SEQ ID NO: 1403276 - RNA, 19 nt, Homo sapiens
gaagagaauggaacgguua

SEQ ID NO: 1403277 - RNA, 19 nt, Homo sapiens
ccaaaucaauccugucuau

SEQ ID NO: 1403278 - RNA, 19 nt, Homo sapiens
gaaaucaauuggagaaugg

SEQ ID NO: 1403279 - RNA, 19 nt, Homo sapiens
gaaaugggcaucuggaaga

SEQ ID NO: 1403280 - RNA, 19 nt, Homo sapiens
ggaaaucaauuggagaaug

SEQ ID NO: 1403281 - RNA, 19 nt, Homo sapiens
ggacuaagcagcaaucugu

SEQ ID NO: 1403282 - RNA, 19 nt, Homo sapiens
gaagcagcaucuccuuaaa

SEQ ID NO: 1403283 - RNA, 19 nt, Homo sapiens
ggaagcagcaucuccuuaa

SEQ ID NO: 1403284 - RNA, 19 nt, Homo sapiens
caauagcaaucaugacuga

SEQ ID NO: 1403285 - RNA, 19 nt, Homo sapiens
gcagauaagagaugguuaa

SEQ ID NO: 1403286 - RNA, 19 nt, Homo sapiens
cagaugagcugguauggau

SEQ ID NO: 1403287 - RNA, 19 nt, Homo sapiens
ucaaagaaacgaugucaaa

SEQ ID NO: 1403288 - RNA, 19 nt, Homo sapiens
ggaaaagguucuuguuaaa

SEQ ID NO: 1403289 - RNA, 19 nt, Homo sapiens
ggaggaagauuuugagauu

SEQ ID NO: 1403290 - RNA, 19 nt, Homo sapiens
acaaauggguguaggagaa

SEQ ID NO: 1403291 - RNA, 19 nt, Homo sapiens
gauaucacccuguccuuaa

SEQ ID NO: 1403292 - RNA, 19 nt, Homo sapiens
ucuaagcuguugucugaua

SEQ ID NO: 1403293 - RNA, 19 nt, Homo sapiens
guaaaugaguguggcugua

SEQ ID NO: 1403294 - RNA, 19 nt, Homo sapiens
acacuggccucccuuugua

SEQ ID NO: 1403295 - RNA, 19 nt, Homo sapiens
cauacaaacucaauagcaa

SEQ ID NO: 1403296 - RNA, 19 nt, Homo sapiens
gccaaucagugacuuaaau

SEQ ID NO: 1403297 - RNA, 19 nt, Homo sapiens
aagaacaacccaaagaaua

SEQ ID NO: 1403298 - RNA, 19 nt, Homo sapiens
ggagaagggaaaucaauug

SEQ ID NO: 1403299 - RNA, 19 nt, Homo sapiens
gcuguugucugauauaagu

SEQ ID NO: 1403300 - RNA, 19 nt, Homo sapiens
ggcuguagcuugccaauca

SEQ ID NO: 1403301 - RNA, 19 nt, Homo sapiens
gaguguggcuguaauccaa

SEQ ID NO: 1403302 - RNA, 19 nt, Homo sapiens
uuucagaugugaccucuuu

SEQ ID NO: 1403303 - RNA, 19 nt, Homo sapiens
gguguagccuuguucagaa

SEQ ID NO: 1403304 - RNA, 19 nt, Homo sapiens
gcucaagcccuuaucugua

SEQ ID NO: 1403305 - RNA, 19 nt, Homo sapiens
cuucccagcuuguguuaua

SEQ ID NO: 1403306 - RNA, 19 nt, Homo sapiens
uauaagugcucgucuaugg

SEQ ID NO: 1403307 - RNA, 19 nt, Homo sapiens
gaggaggaguucauugcuu

SEQ ID NO: 1403308 - RNA, 19 nt, Homo sapiens
gugacgagcucaucuucuu

SEQ ID NO: 1403309 - RNA, 19 nt, Homo sapiens
gggcauaaaccaaaucaau

SEQ ID NO: 1403310 - RNA, 19 nt, Homo sapiens
ggccagacgggaaauauuu

SEQ ID NO: 1403311 - RNA, 19 nt, Homo sapiens
gaaauagaacaaucaugga

SEQ ID NO: 1403312 - RNA, 19 nt, Homo sapiens
aaaccuggauccuucaguu

SEQ ID NO: 1403313 - RNA, 19 nt, Homo sapiens
gauauaagugcucgucuau

SEQ ID NO: 1403314 - RNA, 19 nt, Homo sapiens
gaugucaaauauacacuuc

SEQ ID NO: 1403315 - RNA, 19 nt, Homo sapiens
acacaguggucauugaaga

SEQ ID NO: 1403316 - RNA, 19 nt, Homo sapiens
ugauauaagugcucgucua

SEQ ID NO: 1403317 - RNA, 19 nt, Homo sapiens
guucauugcuucccagcuu

SEQ ID NO: 1403318 - RNA, 19 nt, Homo sapiens
ccaauagcauacaaacuca

SEQ ID NO: 1403319 - RNA, 19 nt, Homo sapiens
gaaugaacauccuaaaccu

SEQ ID NO: 1403320 - RNA, 19 nt, Homo sapiens
gagcugguauggaucuuag

SEQ ID NO: 1403321 - RNA, 19 nt, Homo sapiens
cugacuaccuagaagaaua

SEQ ID NO: 1403322 - RNA, 19 nt, Homo sapiens
gagaauggagucaguuuua

SEQ ID NO: 1403323 - RNA, 19 nt, Homo sapiens
aagcagcaauagacaauau

SEQ ID NO: 1403324 - RNA, 19 nt, Homo sapiens
uaacugguguagccuuguu

SEQ ID NO: 1403325 - RNA, 19 nt, Homo sapiens
ugacaggccucccgauucu

SEQ ID NO: 1403326 - RNA, 19 nt, Homo sapiens
ucagugacuuaaauuguug

SEQ ID NO: 1403327 - RNA, 19 nt, Homo sapiens
gacaauaugcguguaaaug

SEQ ID NO: 1403328 - RNA, 19 nt, Homo sapiens
aaucaauccugucuauguu

SEQ ID NO: 1403329 - RNA, 19 nt, Homo sapiens
acaauaugcguguaaauga

SEQ ID NO: 1403330 - RNA, 19 nt, Homo sapiens
ugacugagccaaucacugu

SEQ ID NO: 1403331 - RNA, 19 nt, Homo sapiens
ggaguuugaucuggaggaa

SEQ ID NO: 1403332 - RNA, 19 nt, Homo sapiens
gggaagcagcaucuccuua

SEQ ID NO: 1403333 - RNA, 19 nt, Homo sapiens
uaaaugaguguggcuguaa

SEQ ID NO: 1403334 - RNA, 19 nt, Homo sapiens
cauccuacagugcuucuua

SEQ ID NO: 1403335 - RNA, 19 nt, Homo sapiens
gagaauggaacgguuaaug

SEQ ID NO: 1403336 - RNA, 19 nt, Homo sapiens
gcuacucuauccaucaaau

SEQ ID NO: 1403337 - RNA, 19 nt, Homo sapiens
aaagauuguugcuacucua

SEQ ID NO: 1403338 - RNA, 19 nt, Homo sapiens
gcccuuaucuguagacacu

SEQ ID NO: 1403339 - RNA, 19 nt, Homo sapiens
gcucgucuaugguuuacau

SEQ ID NO: 1403340 - RNA, 19 nt, Homo sapiens
ucaaguugccgguggaauu

SEQ ID NO: 1403341 - RNA, 19 nt, Homo sapiens
gaggaaaagguucuuguua

SEQ ID NO: 1403342 - RNA, 19 nt, Homo sapiens
guagaauccugggaacuca

SEQ ID NO: 1403343 - RNA, 19 nt, Homo sapiens
agaauggaacgguuaauga

SEQ ID NO: 1403344 - RNA, 19 nt, Homo sapiens
uaacacaguggucauugaa

SEQ ID NO: 1403345 - RNA, 19 nt, Homo sapiens
caauaugcguguaaaugag

SEQ ID NO: 1403346 - RNA, 19 nt, Homo sapiens
caaagaguguuuuaagaug

SEQ ID NO: 1403347 - RNA, 19 nt, Homo sapiens
ggaaauauuuugggcuuug

SEQ ID NO: 1403348 - RNA, 19 nt, Homo sapiens
gcggggaucuuacuauuug

SEQ ID NO: 1403349 - RNA, 19 nt, Homo sapiens
agauacagaugagcuggua

SEQ ID NO: 1403350 - RNA, 19 nt, Homo sapiens
aagcuguucuucacccuuu

SEQ ID NO: 1403351 - RNA, 19 nt, Homo sapiens
gccaauagcauacaaacuc

SEQ ID NO: 1403352 - RNA, 19 nt, Homo sapiens
gaagacaaacagcaacucu

SEQ ID NO: 1403353 - RNA, 19 nt, Homo sapiens
ccaaucagugacuuaaauu

SEQ ID NO: 1403354 - RNA, 19 nt, Homo sapiens
caaguaugaagaucagauu

SEQ ID NO: 1403355 - RNA, 19 nt, Homo sapiens
gcauacaaacucaauagca

SEQ ID NO: 1403356 - RNA, 19 nt, Homo sapiens
aaggagaauuuaaggaugu

SEQ ID NO: 1403357 - RNA, 19 nt, Homo sapiens
uggaauuccuuggcuguuu

SEQ ID NO: 1403358 - RNA, 19 nt, Homo sapiens
caaagaaacgaugucaaau

SEQ ID NO: 1403359 - RNA, 19 nt, Homo sapiens
ggauaacacaguggucauu

SEQ ID NO: 1403360 - RNA, 19 nt, Homo sapiens
ggacuggagcugggagaaa

SEQ ID NO: 1403361 - RNA, 19 nt, Homo sapiens
uaaagggccagacgggaaa

SEQ ID NO: 1403362 - RNA, 19 nt, Homo sapiens
aggaaaagguucuuguuaa

SEQ ID NO: 1403363 - RNA, 19 nt, Homo sapiens
cagaauucauugacucuac

SEQ ID NO: 1403364 - RNA, 19 nt, Homo sapiens
gagaauuuaaggauguuug

SEQ ID NO: 1403365 - RNA, 19 nt, Homo sapiens
gauaacacaguggucauug

SEQ ID NO: 1403366 - RNA, 19 nt, Homo sapiens
gagccuaggagcagagaga

SEQ ID NO: 1403367 - RNA, 19 nt, Homo sapiens
aaaucaauccugucuaugu

SEQ ID NO: 1403368 - RNA, 19 nt, Homo sapiens
aaagugagcugagcaauaa

SEQ ID NO: 1403369 - RNA, 19 nt, Homo sapiens
gcaaacaugccaaguauuu

SEQ ID NO: 1403370 - RNA, 19 nt, Homo sapiens
ggacagcacacguggauua

SEQ ID NO: 1403371 - RNA, 19 nt, Homo sapiens
gaaguuaaguggaauccuu

SEQ ID NO: 1403372 - RNA, 19 nt, Homo sapiens
gaagggagaagcagacaua

SEQ ID NO: 1403373 - RNA, 19 nt, Homo sapiens
gcaauaaaaugguccaaua

SEQ ID NO: 1403374 - RNA, 19 nt, Homo sapiens
ggaaauaaaccucgucaug

SEQ ID NO: 1403375 - RNA, 19 nt, Homo sapiens
aagcagacauagucauuua

SEQ ID NO: 1403376 - RNA, 19 nt, Homo sapiens
gcuauuaccucaaguucaa

SEQ ID NO: 1403377 - RNA, 19 nt, Homo sapiens
ccuuaugccuuuacucuua

SEQ ID NO: 1403378 - RNA, 19 nt, Homo sapiens
gcagagaacucagcaccaa

SEQ ID NO: 1403379 - RNA, 19 nt, Homo sapiens
ggucucagccuguagcuua

SEQ ID NO: 1403380 - RNA, 19 nt, Homo sapiens
aaaugaaucucguacugua

SEQ ID NO: 1403381 - RNA, 19 nt, Homo sapiens
gcaguuuguuugaaguuaa

SEQ ID NO: 1403382 - RNA, 19 nt, Homo sapiens
acucuuaccuggcaguuua

SEQ ID NO: 1403383 - RNA, 19 nt, Homo sapiens
uaaguggaauccuuucaaa

SEQ ID NO: 1403384 - RNA, 19 nt, Homo sapiens
aaaggacgcugccgccuaa

SEQ ID NO: 1403385 - RNA, 19 nt, Homo sapiens
aauaacagaccuacucuua

SEQ ID NO: 1403386 - RNA, 19 nt, Homo sapiens
ggaccuuccuuuagcugua

SEQ ID NO: 1403387 - RNA, 19 nt, Homo sapiens
guagauagcuguaaaaugg

SEQ ID NO: 1403388 - RNA, 19 nt, Homo sapiens
guggaauccuuucaaauga

SEQ ID NO: 1403389 - RNA, 19 nt, Homo sapiens
ccaaagaguuacccaguag

SEQ ID NO: 1403390 - RNA, 19 nt, Homo sapiens
ccauacagauguuacaaau

SEQ ID NO: 1403391 - RNA, 19 nt, Homo sapiens
gaaaucuucucaagcucuu

SEQ ID NO: 1403392 - RNA, 19 nt, Homo sapiens
guagggagcugggucauag

SEQ ID NO: 1403393 - RNA, 19 nt, Homo sapiens
gccuguagcuuaaacuuau

SEQ ID NO: 1403394 - RNA, 19 nt, Homo sapiens
uaagagaucaggauugguu

SEQ ID NO: 1403395 - RNA, 19 nt, Homo sapiens
guacuucaguuuggaucua

SEQ ID NO: 1403396 - RNA, 19 nt, Homo sapiens
agacgucgcuggccaagga

SEQ ID NO: 1403397 - RNA, 19 nt, Homo sapiens
gauccaagcuguauauacc

SEQ ID NO: 1403398 - RNA, 19 nt, Homo sapiens
cagcaaacguugacuucug

SEQ ID NO: 1403399 - RNA, 19 nt, Homo sapiens
uuaccuggcaguuuacuua

SEQ ID NO: 1403400 - RNA, 19 nt, Homo sapiens
uguaccaucuguuugagua

SEQ ID NO: 1403401 - RNA, 19 nt, Homo sapiens
gaagcagacauagucauuu

SEQ ID NO: 1403402 - RNA, 19 nt, Homo sapiens
gcugugagguguccuuugg

SEQ ID NO: 1403403 - RNA, 19 nt, Homo sapiens
aaccauaagugaagggaaa

SEQ ID NO: 1403404 - RNA, 19 nt, Homo sapiens
uaggaaagccuguauucuu

SEQ ID NO: 1403405 - RNA, 19 nt, Homo sapiens
cccgagagaugauuacaga

SEQ ID NO: 1403406 - RNA, 19 nt, Homo sapiens
auacagauguuacaaaucg

SEQ ID NO: 1403407 - RNA, 19 nt, Homo sapiens
gagguguccuuuggauauu

SEQ ID NO: 1403408 - RNA, 19 nt, Homo sapiens
uaacagaccuacucuuacc

SEQ ID NO: 1403409 - RNA, 19 nt, Homo sapiens
gggagaagcagacauaguc

SEQ ID NO: 1403410 - RNA, 19 nt, Homo sapiens
gaccuuccuuuagcuguaa

SEQ ID NO: 1403411 - RNA, 19 nt, Homo sapiens
auagguaaaugcaacagaa

SEQ ID NO: 1403412 - RNA, 19 nt, Homo sapiens
cauggaggcaguucaguaa

SEQ ID NO: 1403413 - RNA, 19 nt, Homo sapiens
ccagaugguacuucaguuu

SEQ ID NO: 1403414 - RNA, 19 nt, Homo sapiens
uguuacaaaucgacaguuu

SEQ ID NO: 1403415 - RNA, 19 nt, Homo sapiens
ccacuuucaugcaguuugu

SEQ ID NO: 1403416 - RNA, 19 nt, Homo sapiens
aaauaaaccucgucaugcu

SEQ ID NO: 1403417 - RNA, 19 nt, Homo sapiens
uaccaucuguuugaguaua

SEQ ID NO: 1403418 - RNA, 19 nt, Homo sapiens
augcaaacaugccaaguau

SEQ ID NO: 1403419 - RNA, 19 nt, Homo sapiens
caaauccucugggcugcuu

SEQ ID NO: 1403420 - RNA, 19 nt, Homo sapiens
ugagguguccuuuggauau

SEQ ID NO: 1403421 - RNA, 19 nt, Homo sapiens
uaaaaggucucagccugua

SEQ ID NO: 1403422 - RNA, 19 nt, Homo sapiens
cauaagugaagggaaauaa

SEQ ID NO: 1403423 - RNA, 19 nt, Homo sapiens
ccuuuacucuuacauggaa

SEQ ID NO: 1403424 - RNA, 19 nt, Homo sapiens
uaaaugcaacagaaacaga

SEQ ID NO: 1403425 - RNA, 19 nt, Homo sapiens
caagggcugccuaucugua

SEQ ID NO: 1403426 - RNA, 19 nt, Homo sapiens
cgucguggguauuaggaaa

SEQ ID NO: 1403427 - RNA, 19 nt, Homo sapiens
cucaagcucuuaugacuca

SEQ ID NO: 1403428 - RNA, 19 nt, Homo sapiens
gggacacccugaacgaaag

SEQ ID NO: 1403429 - RNA, 19 nt, Homo sapiens
aaucucguacuguaucuua

SEQ ID NO: 1403430 - RNA, 19 nt, Homo sapiens
cugguugccuuaugccuuu

SEQ ID NO: 1403431 - RNA, 19 nt, Homo sapiens
accaaagaguuacccagua

SEQ ID NO: 1403432 - RNA, 19 nt, Homo sapiens
gaugguacuucaguuugga

SEQ ID NO: 1403433 - RNA, 19 nt, Homo sapiens
agagaagccuauuuuguuu

SEQ ID NO: 1403434 - RNA, 19 nt, Homo sapiens
ugacagagaagccuauuuu

SEQ ID NO: 1403435 - RNA, 19 nt, Homo sapiens
ccuguagcuuaaacuuaua

SEQ ID NO: 1403436 - RNA, 19 nt, Homo sapiens
ccauggaggcaguucagua

SEQ ID NO: 1403437 - RNA, 19 nt, Homo sapiens
ccaaugugcggaagauuuc

SEQ ID NO: 1403438 - RNA, 19 nt, Homo sapiens
uguaagagcuguuuucagu

SEQ ID NO: 1403439 - RNA, 19 nt, Homo sapiens
gguaaaugcaacagaaaca

SEQ ID NO: 1403440 - RNA, 19 nt, Homo sapiens
agaagcagacauagucauu

SEQ ID NO: 1403441 - RNA, 19 nt, Homo sapiens
ggagcaggccuucgacaag

SEQ ID NO: 1403442 - RNA, 19 nt, Homo sapiens
gggcugcuucgucuucuuu

SEQ ID NO: 1403443 - RNA, 19 nt, Homo sapiens
gagaccugguugccuuaug

SEQ ID NO: 1403444 - RNA, 19 nt, Homo sapiens
ccaauaauagguaaaugca

SEQ ID NO: 1403445 - RNA, 19 nt, Homo sapiens
uguuugaaguuaaguggaa

SEQ ID NO: 1403446 - RNA, 19 nt, Homo sapiens
ggagaagcagacauaguca

SEQ ID NO: 1403447 - RNA, 19 nt, Homo sapiens
gaccagagcgaggacaaga

SEQ ID NO: 1403448 - RNA, 19 nt, Homo sapiens
guacuguaucuuacuaugu

SEQ ID NO: 1403449 - RNA, 19 nt, Homo sapiens
cagagaagccuauuuuguu

SEQ ID NO: 1403450 - RNA, 19 nt, Homo sapiens
uccuuuagcuguaagacuu

SEQ ID NO: 1403451 - RNA, 19 nt, Homo sapiens
caucaccguuugcggaaag

SEQ ID NO: 1403452 - RNA, 19 nt, Homo sapiens
aguggaauccuuucaaaug

SEQ ID NO: 1403453 - RNA, 19 nt, Homo sapiens
aaugcaaacaugccaagua

SEQ ID NO: 1403454 - RNA, 19 nt, Homo sapiens
gcccuugauuccacugguu

SEQ ID NO: 1403455 - RNA, 19 nt, Homo sapiens
uaagagcuguuuucagugu

SEQ ID NO: 1403456 - RNA, 19 nt, Homo sapiens
uaagugaagggaaauaaac

SEQ ID NO: 1403457 - RNA, 19 nt, Homo sapiens
ucgcugcucuggcgcaugu

SEQ ID NO: 1403458 - RNA, 19 nt, Homo sapiens
ucaaugaaugucaguagga

SEQ ID NO: 1403459 - RNA, 19 nt, Homo sapiens
uuuacaaggucauuacaca

SEQ ID NO: 1403460 - RNA, 19 nt, Homo sapiens
cagaugguacuucaguuug

SEQ ID NO: 1403461 - RNA, 19 nt, Homo sapiens
ugaaggcaaauaaguacuu

SEQ ID NO: 1403462 - RNA, 19 nt, Homo sapiens
ggaccagcuacaccgagua

SEQ ID NO: 1403463 - RNA, 19 nt, Homo sapiens
ugacauggcagcaguuacu

SEQ ID NO: 1403464 - RNA, 19 nt, Homo sapiens
gaagguagaguuuuagaag

SEQ ID NO: 1403465 - RNA, 19 nt, Homo sapiens
uuuaagagaucaggauugg

SEQ ID NO: 1403466 - RNA, 19 nt, Homo sapiens
gcuacaccucgcgcuauua

SEQ ID NO: 1403467 - RNA, 19 nt, Homo sapiens
ugcaguuuguuugaaguua

SEQ ID NO: 1403468 - RNA, 19 nt, Homo sapiens
caagacagcugcuaauaaa

SEQ ID NO: 1403469 - RNA, 19 nt, Homo sapiens
ggucaaaucauguacauua

SEQ ID NO: 1403470 - RNA, 19 nt, Homo sapiens
cgagauagcuuggcacuuu

SEQ ID NO: 1403471 - RNA, 19 nt, Homo sapiens
guacuuggauagacuuaua

SEQ ID NO: 1403472 - RNA, 19 nt, Homo sapiens
ggagcaagcuacuauuauu

SEQ ID NO: 1403473 - RNA, 19 nt, Homo sapiens
gaagugcuuugucaucuaa

SEQ ID NO: 1403474 - RNA, 19 nt, Homo sapiens
guacagaaguuauuugcaa

SEQ ID NO: 1403475 - RNA, 19 nt, Homo sapiens
gaaagaagaccuaaauauc

SEQ ID NO: 1403476 - RNA, 19 nt, Homo sapiens
uaucggaacuggaauauga

SEQ ID NO: 1403477 - RNA, 19 nt, Homo sapiens
ugaaauagcacaugcagua

SEQ ID NO: 1403478 - RNA, 19 nt, Homo sapiens
ggaaguaaguccaaucaca

SEQ ID NO: 1403479 - RNA, 19 nt, Homo sapiens
caaauggaguucguugaua

SEQ ID NO: 1403480 - RNA, 19 nt, Homo sapiens
cauaagagcuauuaggaau

SEQ ID NO: 1403481 - RNA, 19 nt, Homo sapiens
gcaaauaccauuaacauac

SEQ ID NO: 1403482 - RNA, 19 nt, Homo sapiens
gaaggaaguaguuaaagaa

SEQ ID NO: 1403483 - RNA, 19 nt, Homo sapiens
caagaugccagaaugguua

SEQ ID NO: 1403484 - RNA, 19 nt, Homo sapiens
gcaaauguacuguauggaa

SEQ ID NO: 1403485 - RNA, 19 nt, Homo sapiens
aaggaaauuuggaggauua

SEQ ID NO: 1403486 - RNA, 19 nt, Homo sapiens
ggaaggagcaagcuacuau

SEQ ID NO: 1403487 - RNA, 19 nt, Homo sapiens
uuagagagauguguaauug

SEQ ID NO: 1403488 - RNA, 19 nt, Homo sapiens
gagaaagaagaccuaaaua

SEQ ID NO: 1403489 - RNA, 19 nt, Homo sapiens
ucaauuggguuauucaugu

SEQ ID NO: 1403490 - RNA, 19 nt, Homo sapiens
gaagaauguugcaguccuu

SEQ ID NO: 1403491 - RNA, 19 nt, Homo sapiens
gcaaucgaguugaguacuu

SEQ ID NO: 1403492 - RNA, 19 nt, Homo sapiens
aagcauggauggaagaauu

SEQ ID NO: 1403493 - RNA, 19 nt, Homo sapiens
caaauguacuguauggaau

SEQ ID NO: 1403494 - RNA, 19 nt, Homo sapiens
gacacaagauauaugaaga

SEQ ID NO: 1403495 - RNA, 19 nt, Homo sapiens
caagaaggaaguaguuaaa

SEQ ID NO: 1403496 - RNA, 19 nt, Homo sapiens
agaaggaaguaguuaaaga

SEQ ID NO: 1403497 - RNA, 19 nt, Homo sapiens
agaacgggcaguugaauua

SEQ ID NO: 1403498 - RNA, 19 nt, Homo sapiens
gagcaaauaccauuaacau

SEQ ID NO: 1403499 - RNA, 19 nt, Homo sapiens
ugagaaagaugcccgauac

SEQ ID NO: 1403500 - RNA, 19 nt, Homo sapiens
gccaguggauacagucuaa

SEQ ID NO: 1403501 - RNA, 19 nt, Homo sapiens
ggcaggcacuuccuccuaa

SEQ ID NO: 1403502 - RNA, 19 nt, Homo sapiens
ucaagacagcugcuaauaa

SEQ ID NO: 1403503 - RNA, 19 nt, Homo sapiens
ggccgaagcugacaaaauu

SEQ ID NO: 1403504 - RNA, 19 nt, Homo sapiens
auaccuggcuguuaaagaa

SEQ ID NO: 1403505 - RNA, 19 nt, Homo sapiens
gaacgggcaguugaauuaa

SEQ ID NO: 1403506 - RNA, 19 nt, Homo sapiens
ccauuaacauacauaguug

SEQ ID NO: 1403507 - RNA, 19 nt, Homo sapiens
guuccucucuuguugauga

SEQ ID NO: 1403508 - RNA, 19 nt, Homo sapiens
cagcaaauguacuguaugg

SEQ ID NO: 1403509 - RNA, 19 nt, Homo sapiens
gcaaauggaguucguugau

SEQ ID NO: 1403510 - RNA, 19 nt, Homo sapiens
cccgauaccuggcuguuaa

SEQ ID NO: 1403511 - RNA, 19 nt, Homo sapiens
uaacaagaaggaaguaguu

SEQ ID NO: 1403512 - RNA, 19 nt, Homo sapiens
gaaaagaacgggcaguuga

SEQ ID NO: 1403513 - RNA, 19 nt, Homo sapiens
cgaguugaguacuuggaua

SEQ ID NO: 1403514 - RNA, 19 nt, Homo sapiens
guaaggaaauuuggaggau

SEQ ID NO: 1403515 - RNA, 19 nt, Homo sapiens
uuaauucacugucuaacug

SEQ ID NO: 1403516 - RNA, 19 nt, Homo sapiens
gacccucgauuacuauuca

SEQ ID NO: 1403517 - RNA, 19 nt, Homo sapiens
cuaaauugcaggaguauau

SEQ ID NO: 1403518 - RNA, 19 nt, Homo sapiens
gagcaagcuacuauuauug

SEQ ID NO: 1403519 - RNA, 19 nt, Homo sapiens
gaugauucuuaaaccagua

SEQ ID NO: 1403520 - RNA, 19 nt, Homo sapiens
acaggaggccucucaagua

SEQ ID NO: 1403521 - RNA, 19 nt, Homo sapiens
uggcaugguucauuuguug

SEQ ID NO: 1403522 - RNA, 19 nt, Homo sapiens
ucagaucaauuggguuauu

SEQ ID NO: 1403523 - RNA, 19 nt, Homo sapiens
caaguacaaguuaaccaua

SEQ ID NO: 1403524 - RNA, 19 nt, Homo sapiens
gcacgaagcauuuucuuga

SEQ ID NO: 1403525 - RNA, 19 nt, Homo sapiens
uaaccgauauucaucaacu

SEQ ID NO: 1403526 - RNA, 19 nt, Homo sapiens
uggauacucuuccuauuca

SEQ ID NO: 1403527 - RNA, 19 nt, Homo sapiens
aaacucagcacgaagcauu

SEQ ID NO: 1403528 - RNA, 19 nt, Homo sapiens
cgauuacuauucaaacuca

SEQ ID NO: 1403529 - RNA, 19 nt, Homo sapiens
aaauggaguucguugauag

SEQ ID NO: 1403530 - RNA, 19 nt, Homo sapiens
ucucagaucaauuggguua

SEQ ID NO: 1403531 - RNA, 19 nt, Homo sapiens
gaagcuauuccuugguuug

SEQ ID NO: 1403532 - RNA, 19 nt, Homo sapiens
gauauucagggucaaauca

SEQ ID NO: 1403533 - RNA, 19 nt, Homo sapiens
agagaaagaagaccuaaau

SEQ ID NO: 1403534 - RNA, 19 nt, Homo sapiens
ugucaucaaguacaaguua

SEQ ID NO: 1403535 - RNA, 19 nt, Homo sapiens
agagagauguguaauuguc

SEQ ID NO: 1403536 - RNA, 19 nt, Homo sapiens
gcaaaggcuugugcagaca

SEQ ID NO: 1403537 - RNA, 19 nt, Homo sapiens
gaaggagcaagcuacuauu

SEQ ID NO: 1403538 - RNA, 19 nt, Homo sapiens
cgauuuaauucacugucua

SEQ ID NO: 1403539 - RNA, 19 nt, Homo sapiens
uaaggaaauuuggaggauu

SEQ ID NO: 1403540 - RNA, 19 nt, Homo sapiens
ugagacacaagauauauga

SEQ ID NO: 1403541 - RNA, 19 nt, Homo sapiens
ugaagaaucagagaaagaa

SEQ ID NO: 1403542 - RNA, 19 nt, Homo sapiens
uugcaggaguauauguuua

SEQ ID NO: 1403543 - RNA, 19 nt, Homo sapiens
guggauacagucuaaauug

SEQ ID NO: 1403544 - RNA, 19 nt, Homo sapiens
gaacuggaauaugaagcau

SEQ ID NO: 1403545 - RNA, 19 nt, Homo sapiens
gcacuuccuccuaacaaga

SEQ ID NO: 1403546 - RNA, 19 nt, Homo sapiens
gaacaggaggccucucaag

SEQ ID NO: 1403547 - RNA, 19 nt, Homo sapiens
gcaggaguauauguuuaau

SEQ ID NO: 1403548 - RNA, 19 nt, Homo sapiens
agucuaaauugcaggagua

SEQ ID NO: 1403549 - RNA, 19 nt, Homo sapiens
agaagugcuuugucaucua

SEQ ID NO: 1403550 - RNA, 19 nt, Homo sapiens
ggaggccucucaaguacca

SEQ ID NO: 1403551 - RNA, 19 nt, Homo sapiens
uccagacccucgauuacua

SEQ ID NO: 1403552 - RNA, 19 nt, Homo sapiens
caaucgaguugaguacuug

SEQ ID NO: 1403553 - RNA, 19 nt, Homo sapiens
cagaaugguuaucuacaca

SEQ ID NO: 1403554 - RNA, 19 nt, Homo sapiens
aaggagcaagcuacuauua

SEQ ID NO: 1403555 - RNA, 19 nt, Homo sapiens
cagaaguuauuugcaauca

SEQ ID NO: 1403556 - RNA, 19 nt, Homo sapiens
ccauacuucuccacgguuu

SEQ ID NO: 1403557 - RNA, 19 nt, Homo sapiens
gggcugucaucaaguacaa

SEQ ID NO: 1403558 - RNA, 19 nt, Homo sapiens
caggaggccucucaaguac

SEQ ID NO: 1403559 - RNA, 19 nt, Homo sapiens
aaaggcuugugcagacaua

SEQ ID NO: 1403560 - RNA, 19 nt, Homo sapiens
agaaaaggcuggcaugguu

SEQ ID NO: 1403561 - RNA, 19 nt, Homo sapiens
gcauggauggaagaauuua

SEQ ID NO: 1403562 - RNA, 19 nt, Homo sapiens
uuaaaccaguacagaaguu

SEQ ID NO: 1403563 - RNA, 19 nt, Homo sapiens
acaagaaggaaguaguuaa

SEQ ID NO: 1403564 - RNA, 19 nt, Homo sapiens
gagcuucaucuguggauug

SEQ ID NO: 1403565 - RNA, 19 nt, Homo sapiens
aggaaaaugucacagaaua

SEQ ID NO: 1403566 - RNA, 19 nt, Homo sapiens
gauacucuuccuauucaaa

SEQ ID NO: 1403567 - RNA, 19 nt, Homo sapiens
cauguuuucuuccgauuua

SEQ ID NO: 1403568 - RNA, 19 nt, Homo sapiens
ggaaucaacuugccagaau

SEQ ID NO: 1403569 - RNA, 19 nt, Homo sapiens
ggagauaugguuuauagua

SEQ ID NO: 1403570 - RNA, 19 nt, Homo sapiens
ccaacuaaguagaucauua

SEQ ID NO: 1403571 - RNA, 19 nt, Homo sapiens
gaaacucaccguccagaua

SEQ ID NO: 1403572 - RNA, 19 nt, Homo sapiens
ucaaaugcuuggaaagaua

SEQ ID NO: 1403573 - RNA, 19 nt, Homo sapiens
gauaggaaauuaguucuga

SEQ ID NO: 1403574 - RNA, 19 nt, Homo sapiens
auggaaggcuguuaaauua

SEQ ID NO: 1403575 - RNA, 19 nt, Homo sapiens
gaaauuaguucugagaucu

SEQ ID NO: 1403576 - RNA, 19 nt, Homo sapiens
gagaacugcucauggacua

SEQ ID NO: 1403577 - RNA, 19 nt, Homo sapiens
ggaaauuaguucugagauc

SEQ ID NO: 1403578 - RNA, 19 nt, Homo sapiens
aaacuuuacucacugauug

SEQ ID NO: 1403579 - RNA, 19 nt, Homo sapiens
gagaauugcucaagauguc

SEQ ID NO: 1403580 - RNA, 19 nt, Homo sapiens
gaaucaacuugccagaauu

SEQ ID NO: 1403581 - RNA, 19 nt, Homo sapiens
gaauuuagccuccacucaa

SEQ ID NO: 1403582 - RNA, 19 nt, Homo sapiens
gguaauauuugaggaauca

SEQ ID NO: 1403583 - RNA, 19 nt, Homo sapiens
cagagagccugcuaaguga

SEQ ID NO: 1403584 - RNA, 19 nt, Homo sapiens
ccagagagccugcuaagug

SEQ ID NO: 1403585 - RNA, 19 nt, Homo sapiens
gggcaucgauguagaacug

SEQ ID NO: 1403586 - RNA, 19 nt, Homo sapiens
aaaccagauuugccuauuu

SEQ ID NO: 1403587 - RNA, 19 nt, Homo sapiens
gauuucgacuuguuaagaa

SEQ ID NO: 1403588 - RNA, 19 nt, Homo sapiens
caagauguccugcggcuuu

SEQ ID NO: 1403589 - RNA, 19 nt, Homo sapiens
gaagccaccugccuguguu

SEQ ID NO: 1403590 - RNA, 19 nt, Homo sapiens
gcuaaagucauuuguaguu

SEQ ID NO: 1403591 - RNA, 19 nt, Homo sapiens
cagcuaaagucauuuguag

SEQ ID NO: 1403592 - RNA, 19 nt, Homo sapiens
cuagucagcuaaagucauu

SEQ ID NO: 1403593 - RNA, 19 nt, Homo sapiens
ccaaaucaaagcaaacuaa

SEQ ID NO: 1403594 - RNA, 19 nt, Homo sapiens
cuacugggauuauguuguu

SEQ ID NO: 1403595 - RNA, 19 nt, Homo sapiens
ugaaguaucucuccuuaac

SEQ ID NO: 1403596 - RNA, 19 nt, Homo sapiens
ugagaaauauuacggcaau

SEQ ID NO: 1403597 - RNA, 19 nt, Homo sapiens
caggagaacugcucaugga

SEQ ID NO: 1403598 - RNA, 19 nt, Homo sapiens
ggagaacugucuguccaaa

SEQ ID NO: 1403599 - RNA, 19 nt, Homo sapiens
gagauaugguuuauaguac

SEQ ID NO: 1403600 - RNA, 19 nt, Homo sapiens
guucuuaaguguugaauac

SEQ ID NO: 1403601 - RNA, 19 nt, Homo sapiens
gggccaagauaaaucaaug

SEQ ID NO: 1403602 - RNA, 19 nt, Homo sapiens
cuaacaaacuaaacucuuc

SEQ ID NO: 1403603 - RNA, 19 nt, Homo sapiens
cagcaaggcuuucauaucc

SEQ ID NO: 1403604 - RNA, 19 nt, Homo sapiens
uaaccacgguguuguuuua

SEQ ID NO: 1403605 - RNA, 19 nt, Homo sapiens
ggccagcauuucagaauug

SEQ ID NO: 1403606 - RNA, 19 nt, Homo sapiens
guugauuacucuuccauug

SEQ ID NO: 1403607 - RNA, 19 nt, Homo sapiens
ggauuaaguaggugaguuu

SEQ ID NO: 1403608 - RNA, 19 nt, Homo sapiens
uggaacugcuucacuguuu

SEQ ID NO: 1403609 - RNA, 19 nt, Homo sapiens
aaacagagccguugaccau

SEQ ID NO: 1403610 - RNA, 19 nt, Homo sapiens
ucagguaggcuugguaaua

SEQ ID NO: 1403611 - RNA, 19 nt, Homo sapiens
gcacgugaacuuggaaauu

SEQ ID NO: 1403612 - RNA, 19 nt, Homo sapiens
uauggaaggcuguuaaauu

SEQ ID NO: 1403613 - RNA, 19 nt, Homo sapiens
aaacucaccguccagauaa

SEQ ID NO: 1403614 - RNA, 19 nt, Homo sapiens
agacaggaagguaggauua

SEQ ID NO: 1403615 - RNA, 19 nt, Homo sapiens
ugaaugggauggaauaggu

SEQ ID NO: 1403616 - RNA, 19 nt, Homo sapiens
uggauaggauuguguguga

SEQ ID NO: 1403617 - RNA, 19 nt, Homo sapiens
cacgugaacuuggaaauug

SEQ ID NO: 1403618 - RNA, 19 nt, Homo sapiens
uaaaccagauuugccuauu

SEQ ID NO: 1403619 - RNA, 19 nt, Homo sapiens
gguaagaguaaaugagaaa

SEQ ID NO: 1403620 - RNA, 19 nt, Homo sapiens
uagaagcccauuugaguuu

SEQ ID NO: 1403621 - RNA, 19 nt, Homo sapiens
uugacucucuugccuguua

SEQ ID NO: 1403622 - RNA, 19 nt, Homo sapiens
gcuauggagauaugguuua

SEQ ID NO: 1403623 - RNA, 19 nt, Homo sapiens
cuaccacuuugaauuauug

SEQ ID NO: 1403624 - RNA, 19 nt, Homo sapiens
gaggauaggaaauuaguuc

SEQ ID NO: 1403625 - RNA, 19 nt, Homo sapiens
gagaagugauucaaaauag

SEQ ID NO: 1403626 - RNA, 19 nt, Homo sapiens
gagguaauauuugaggaau

SEQ ID NO: 1403627 - RNA, 19 nt, Homo sapiens
caaggguaguagcuguaua

SEQ ID NO: 1403628 - RNA, 19 nt, Homo sapiens
cuuccucacucuaauguuu

SEQ ID NO: 1403629 - RNA, 19 nt, Homo sapiens
cagguaggcuugguaauag

SEQ ID NO: 1403630 - RNA, 19 nt, Homo sapiens
caccugcccuaaauaagaa

SEQ ID NO: 1403631 - RNA, 19 nt, Homo sapiens
gauaggauugugugugauu

SEQ ID NO: 1403632 - RNA, 19 nt, Homo sapiens
uaucucaucucugggcuuu

SEQ ID NO: 1403633 - RNA, 19 nt, Homo sapiens
augaauaccugugaggaua

SEQ ID NO: 1403634 - RNA, 19 nt, Homo sapiens
agaacugucuguccaaauc

SEQ ID NO: 1403635 - RNA, 19 nt, Homo sapiens
ggaacugcuucacuguuuc

SEQ ID NO: 1403636 - RNA, 19 nt, Homo sapiens
guagaagcccauuugaguu

SEQ ID NO: 1403637 - RNA, 19 nt, Homo sapiens
ggagaagugauucaaaaua

SEQ ID NO: 1403638 - RNA, 19 nt, Homo sapiens
ccaccugcccuaaauaaga

SEQ ID NO: 1403639 - RNA, 19 nt, Homo sapiens
ucaaagcaaacuaaacuug

SEQ ID NO: 1403640 - RNA, 19 nt, Homo sapiens
gaaugaugaauaccuguga

SEQ ID NO: 1403641 - RNA, 19 nt, Homo sapiens
cacagaaucauacuaaaug

SEQ ID NO: 1403642 - RNA, 19 nt, Homo sapiens
aaacuugguugcucaaagg

SEQ ID NO: 1403643 - RNA, 19 nt, Homo sapiens
gauggaauagguaagcaaa

SEQ ID NO: 1403644 - RNA, 19 nt, Homo sapiens
acaaaauggugauggcuua

SEQ ID NO: 1403645 - RNA, 19 nt, Homo sapiens
guagaacuguuguccuuuu

SEQ ID NO: 1403646 - RNA, 19 nt, Homo sapiens
ccaaagguucacuguguuu

SEQ ID NO: 1403647 - RNA, 19 nt, Homo sapiens
gcaguguuaucucaucucu

SEQ ID NO: 1403648 - RNA, 19 nt, Homo sapiens
ucuagucccucucugauuc

SEQ ID NO: 1403649 - RNA, 19 nt, Homo sapiens
ggauuucgacuuguuaaga

SEQ ID NO: 1403650 - RNA, 19 nt, Homo sapiens
cuccaaagguucacugugu

SEQ ID NO: 1403651 - RNA, 19 nt, Homo sapiens
auugaaguaucucuccuua

SEQ ID NO: 1403652 - RNA, 19 nt, Homo sapiens
ggauuauguuguuccugaa

SEQ ID NO: 1403653 - RNA, 19 nt, Homo sapiens
gaagcccauuugaguuuua

SEQ ID NO: 1403654 - RNA, 19 nt, Homo sapiens
uaaacuugguugcucaaag

SEQ ID NO: 1403655 - RNA, 19 nt, Homo sapiens
gcaucgauguagaacuguu

SEQ ID NO: 1403656 - RNA, 19 nt, Homo sapiens
uuagaugccuuuauaagcu

SEQ ID NO: 1403657 - RNA, 19 nt, Homo sapiens
gaaugggauggaauaggua

SEQ ID NO: 1403658 - RNA, 19 nt, Homo sapiens
gaacugucuguccaaauca

SEQ ID NO: 1403659 - RNA, 19 nt, Homo sapiens
ucucuugccuguuaugcuu

SEQ ID NO: 1403660 - RNA, 19 nt, Homo sapiens
gagagccugcuaagugauu

SEQ ID NO: 1403661 - RNA, 19 nt, Homo sapiens
gauuggaacaacagugauu

SEQ ID NO: 1403662 - RNA, 19 nt, Homo sapiens
ggacuagcuucagggacuu

SEQ ID NO: 1403663 - RNA, 19 nt, Homo sapiens
ugcauuggcuauggagaua

SEQ ID NO: 1403664 - RNA, 19 nt, Homo sapiens
gaaacgggucaauuuacga

SEQ ID NO: 1403665 - RNA, 19 nt, Homo sapiens
gcuguauacuaccacuuug

SEQ ID NO: 1403666 - RNA, 19 nt, Homo sapiens
ccauggcaguguuaucuca

SEQ ID NO: 1403667 - RNA, 19 nt, Homo sapiens
gaauagguaagcaaaagua

SEQ ID NO: 1403668 - RNA, 19 nt, Homo sapiens
gaaacccugucucuacuaa

SEQ ID NO: 1403669 - RNA, 19 nt, Homo sapiens
gacagaaggguucauauaa

SEQ ID NO: 1403670 - RNA, 19 nt, Homo sapiens
acagaaggguucauauaaa

SEQ ID NO: 1403671 - RNA, 19 nt, Homo sapiens
gcucacgccuguaauccua

SEQ ID NO: 1403672 - RNA, 19 nt, Homo sapiens
ugacagaaggguucauaua

SEQ ID NO: 1403673 - RNA, 19 nt, Homo sapiens
gaauugaggcuucgagaga

SEQ ID NO: 1403674 - RNA, 19 nt, Homo sapiens
uaaagcagucccagccuua

SEQ ID NO: 1403675 - RNA, 19 nt, Homo sapiens
gaaguaggggucaucauua

SEQ ID NO: 1403676 - RNA, 19 nt, Homo sapiens
cagaaggguucauauaaac

SEQ ID NO: 1403677 - RNA, 19 nt, Homo sapiens
gaaguccuuugaacacauc

SEQ ID NO: 1403678 - RNA, 19 nt, Homo sapiens
ggaaguccuuugaacacau

SEQ ID NO: 1403679 - RNA, 19 nt, Homo sapiens
gcaggagaauugcuugaac

SEQ ID NO: 1403680 - RNA, 19 nt, Homo sapiens
agucgaggcuuucuacaga

SEQ ID NO: 1403681 - RNA, 19 nt, Homo sapiens
uaaacaguauccugacaca

SEQ ID NO: 1403682 - RNA, 19 nt, Homo sapiens
ggugaaacccugucucuac

SEQ ID NO: 1403683 - RNA, 19 nt, Homo sapiens
ggacaucaagcuagaagag

SEQ ID NO: 1403684 - RNA, 19 nt, Homo sapiens
agucaugcuuccuggauuu

SEQ ID NO: 1403685 - RNA, 19 nt, Homo sapiens
caucuaguuuagucccuuu

SEQ ID NO: 1403686 - RNA, 19 nt, Homo sapiens
gagagaaaggguuaaagca

SEQ ID NO: 1403687 - RNA, 19 nt, Homo sapiens
uauaaacaguauccugaca

SEQ ID NO: 1403688 - RNA, 19 nt, Homo sapiens
ggguucauauaaacaguau

SEQ ID NO: 1403689 - RNA, 19 nt, Homo sapiens
ggagagaaaggguuaaagc

SEQ ID NO: 1403690 - RNA, 19 nt, Homo sapiens
gugagacucuguuucaaaa

SEQ ID NO: 1403691 - RNA, 19 nt, Homo sapiens
uuacagaggagagaauuga

SEQ ID NO: 1403692 - RNA, 19 nt, Homo sapiens
ggcuaaggcaggagaauug

SEQ ID NO: 1403693 - RNA, 19 nt, Homo sapiens
gugaaacccugucucuacu

SEQ ID NO: 1403694 - RNA, 19 nt, Homo sapiens
gaaccugggaggcagagau

SEQ ID NO: 1403695 - RNA, 19 nt, Homo sapiens
ucuaggagagaaaggguua

SEQ ID NO: 1403696 - RNA, 19 nt, Homo sapiens
guggagaccucgguuaaaa

SEQ ID NO: 1403697 - RNA, 19 nt, Homo sapiens
cugcuggucuuugauguga

SEQ ID NO: 1403698 - RNA, 19 nt, Homo sapiens
cccuuuauccugugaagua

SEQ ID NO: 1403699 - RNA, 19 nt, Homo sapiens
gguggugcaugccuguaau

SEQ ID NO: 1403700 - RNA, 19 nt, Homo sapiens
gaaggguucauauaaacag

SEQ ID NO: 1403701 - RNA, 19 nt, Homo sapiens
ccucacuucaucuaguuua

SEQ ID NO: 1403702 - RNA, 19 nt, Homo sapiens
gagcacccgcugugucuca

SEQ ID NO: 1403703 - RNA, 19 nt, Homo sapiens
gcuggucuuugaugugaca

SEQ ID NO: 1403704 - RNA, 19 nt, Homo sapiens
uaaggcaggagaauugcuu

SEQ ID NO: 1403705 - RNA, 19 nt, Homo sapiens
cagucaugcuuccuggauu

SEQ ID NO: 1403706 - RNA, 19 nt, Homo sapiens
cacccucgcugaugcuauc

SEQ ID NO: 1403707 - RNA, 19 nt, Homo sapiens
caauguggaccuggccuuu

SEQ ID NO: 1403708 - RNA, 19 nt, Homo sapiens
ggaggacaaaugacagaag

SEQ ID NO: 1403709 - RNA, 19 nt, Homo sapiens
ugaaacccugucucuacua

SEQ ID NO: 1403710 - RNA, 19 nt, Homo sapiens
ggccaaggacaguggauca

SEQ ID NO: 1403711 - RNA, 19 nt, Homo sapiens
gccuguaauccuagcauuu

SEQ ID NO: 1403712 - RNA, 19 nt, Homo sapiens
cuaguuuagucccuuuauc

SEQ ID NO: 1403713 - RNA, 19 nt, Homo sapiens
ccuccucacuucaucuagu

SEQ ID NO: 1403714 - RNA, 19 nt, Homo sapiens
gugcaucaccagguccuuu

SEQ ID NO: 1403715 - RNA, 19 nt, Homo sapiens
auguggaccuggccuuuga

SEQ ID NO: 1403716 - RNA, 19 nt, Homo sapiens
ggaugcuucagcgcuguua

SEQ ID NO: 1403717 - RNA, 19 nt, Homo sapiens
agugagacucuguuucaaa

SEQ ID NO: 1403718 - RNA, 19 nt, Homo sapiens
ggcaggagaauugcuugaa

SEQ ID NO: 1403719 - RNA, 19 nt, Homo sapiens
ugaaguaggggucaucauu

SEQ ID NO: 1403720 - RNA, 19 nt, Homo sapiens
ggaaaggucaccacacuua

SEQ ID NO: 1403721 - RNA, 19 nt, Homo sapiens
gaaagcagcuagaacucaa

SEQ ID NO: 1403722 - RNA, 19 nt, Homo sapiens
ccucagaaccucuuaauaa

SEQ ID NO: 1403723 - RNA, 19 nt, Homo sapiens
guuaauuccuguuguguaa

SEQ ID NO: 1403724 - RNA, 19 nt, Homo sapiens
gcagaaggcaagaugguua

SEQ ID NO: 1403725 - RNA, 19 nt, Homo sapiens
ccaacuauacugacauuua

SEQ ID NO: 1403726 - RNA, 19 nt, Homo sapiens
cuaacaagcuccaggugua

SEQ ID NO: 1403727 - RNA, 19 nt, Homo sapiens
gcaggugucuucccucgaa

SEQ ID NO: 1403728 - RNA, 19 nt, Homo sapiens
gcacagguaucugcuucua

SEQ ID NO: 1403729 - RNA, 19 nt, Homo sapiens
gguauaggcuggcugguau

SEQ ID NO: 1403730 - RNA, 19 nt, Homo sapiens
gaccaguugugcuaagaua

SEQ ID NO: 1403731 - RNA, 19 nt, Homo sapiens
gcagcugucugaacuauag

SEQ ID NO: 1403732 - RNA, 19 nt, Homo sapiens
cagaaugacugcguuugua

SEQ ID NO: 1403733 - RNA, 19 nt, Homo sapiens
gcaaacaaacaguauguga

SEQ ID NO: 1403734 - RNA, 19 nt, Homo sapiens
ccucagauuucacccauaa

SEQ ID NO: 1403735 - RNA, 19 nt, Homo sapiens
gcaagaugguuauaauucu

SEQ ID NO: 1403736 - RNA, 19 nt, Homo sapiens
gaugguggauucagcagaa

SEQ ID NO: 1403737 - RNA, 19 nt, Homo sapiens
ccagagagcuaagagaaga

SEQ ID NO: 1403738 - RNA, 19 nt, Homo sapiens
gagcagcugucugaacuau

SEQ ID NO: 1403739 - RNA, 19 nt, Homo sapiens
ucugggagguuucaucuuu

SEQ ID NO: 1403740 - RNA, 19 nt, Homo sapiens
guaacuaggcugcugguuu

SEQ ID NO: 1403741 - RNA, 19 nt, Homo sapiens
uaacuaggcugcugguuuu

SEQ ID NO: 1403742 - RNA, 19 nt, Homo sapiens
gaaggcaagaugguuauaa

SEQ ID NO: 1403743 - RNA, 19 nt, Homo sapiens
gguaucugcuucuacaaga

SEQ ID NO: 1403744 - RNA, 19 nt, Homo sapiens
gcugauucaucuucauauu

SEQ ID NO: 1403745 - RNA, 19 nt, Homo sapiens
aaagaaggaccaccaacua

SEQ ID NO: 1403746 - RNA, 19 nt, Homo sapiens
cucagaaccucuuaauaaa

SEQ ID NO: 1403747 - RNA, 19 nt, Homo sapiens
gcagaaagaguccuugaag

SEQ ID NO: 1403748 - RNA, 19 nt, Homo sapiens
ucaccacacuuagggauuu

SEQ ID NO: 1403749 - RNA, 19 nt, Homo sapiens
gcagcuagaacucaaguga

SEQ ID NO: 1403750 - RNA, 19 nt, Homo sapiens
gaagaccaguugugcuaag

SEQ ID NO: 1403751 - RNA, 19 nt, Homo sapiens
caucugaagugguuaagca

SEQ ID NO: 1403752 - RNA, 19 nt, Homo sapiens
gagcaaacaaacaguaugu

SEQ ID NO: 1403753 - RNA, 19 nt, Homo sapiens
gggaagaguuguguaugug

SEQ ID NO: 1403754 - RNA, 19 nt, Homo sapiens
agaaggaccaccaacuaua

SEQ ID NO: 1403755 - RNA, 19 nt, Homo sapiens
gaaggaccaccaacuauac

SEQ ID NO: 1403756 - RNA, 19 nt, Homo sapiens
gaaugacugcguuuguaaa

SEQ ID NO: 1403757 - RNA, 19 nt, Homo sapiens
ucaggaaucuagcaguguu

SEQ ID NO: 1403758 - RNA, 19 nt, Homo sapiens
uuaauuacccucagauuuc

SEQ ID NO: 1403759 - RNA, 19 nt, Homo sapiens
caccaacuauacugacauu

SEQ ID NO: 1403760 - RNA, 19 nt, Homo sapiens
gaaagaaagauugaacuac

SEQ ID NO: 1403761 - RNA, 19 nt, Homo sapiens
ggcaagaugguuauaauuc

SEQ ID NO: 1403762 - RNA, 19 nt, Homo sapiens
ugaagucauuggccuguau

SEQ ID NO: 1403763 - RNA, 19 nt, Homo sapiens
gaacuacaggugcauagca

SEQ ID NO: 1403764 - RNA, 19 nt, Homo sapiens
acagguaucugcuucuaca

SEQ ID NO: 1403765 - RNA, 19 nt, Homo sapiens
uaauuacccucagauuuca

SEQ ID NO: 1403766 - RNA, 19 nt, Homo sapiens
uaucugaucuuucauuucc

SEQ ID NO: 1403767 - RNA, 19 nt, Homo sapiens
cuucauauuugacaccuau

SEQ ID NO: 1403768 - RNA, 19 nt, Homo sapiens
ggaccaccaacuauacuga

SEQ ID NO: 1403769 - RNA, 19 nt, Homo sapiens
augaauaugugaagugguu

SEQ ID NO: 1403770 - RNA, 19 nt, Homo sapiens
cauuugaucuguaucugau

SEQ ID NO: 1403771 - RNA, 19 nt, Homo sapiens
guaaggguaggcuuuguug

SEQ ID NO: 1403772 - RNA, 19 nt, Homo sapiens
gauucgaguuccaucugaa

SEQ ID NO: 1403773 - RNA, 19 nt, Homo sapiens
caaacaaacaguaugugau

SEQ ID NO: 1403774 - RNA, 19 nt, Homo sapiens
gaaaaggcaggaugaaaug

SEQ ID NO: 1403775 - RNA, 19 nt, Homo sapiens
uaucaccuaugaauaugug

SEQ ID NO: 1403776 - RNA, 19 nt, Homo sapiens
gugguugccugccugauuc

SEQ ID NO: 1403777 - RNA, 19 nt, Homo sapiens
gauaauuaaaggcagaaug

SEQ ID NO: 1403778 - RNA, 19 nt, Homo sapiens
gaaaggucaccacacuuag

SEQ ID NO: 1403779 - RNA, 19 nt, Homo sapiens
aaggcaagaugguuauaau

SEQ ID NO: 1403780 - RNA, 19 nt, Homo sapiens
gcuuucauuugaucuguau

SEQ ID NO: 1403781 - RNA, 19 nt, Homo sapiens
gagcuuucauuugaucugu

SEQ ID NO: 1403782 - RNA, 19 nt, Homo sapiens
agaaugacugcguuuguaa

SEQ ID NO: 1403783 - RNA, 19 nt, Homo sapiens
cuaguuaauuccuguugug

SEQ ID NO: 1403784 - RNA, 19 nt, Homo sapiens
agaaagaguccuugaagca

SEQ ID NO: 1403785 - RNA, 19 nt, Homo sapiens
caagaauuacgcuggcaaa

SEQ ID NO: 1403786 - RNA, 19 nt, Homo sapiens
gcagagggcacagguaucu

SEQ ID NO: 1403787 - RNA, 19 nt, Homo sapiens
gcaugcugauucaucuuca

SEQ ID NO: 1403788 - RNA, 19 nt, Homo sapiens
gagccauucucgccauucu

SEQ ID NO: 1403789 - RNA, 19 nt, Homo sapiens
gauugugccauccguggua

SEQ ID NO: 1403790 - RNA, 19 nt, Homo sapiens
guuggaaguuggcagaaag

SEQ ID NO: 1403791 - RNA, 19 nt, Homo sapiens
aggguaggcuuuguugaaa

SEQ ID NO: 1403792 - RNA, 19 nt, Homo sapiens
ugacugcguuuguaaaaga

SEQ ID NO: 1403793 - RNA, 19 nt, Homo sapiens
ugauucgaguuccaucuga

SEQ ID NO: 1403794 - RNA, 19 nt, Homo sapiens
ggagcaaacaaacaguaug

SEQ ID NO: 1403795 - RNA, 19 nt, Homo sapiens
gcacggugggugagccauu

SEQ ID NO: 1403796 - RNA, 19 nt, Homo sapiens
cugaagaccaguugugcua

SEQ ID NO: 1403797 - RNA, 19 nt, Homo sapiens
uuagagcuuucauuugauc

SEQ ID NO: 1403798 - RNA, 19 nt, Homo sapiens
gaaucuagcaguguugucu

SEQ ID NO: 1403799 - RNA, 19 nt, Homo sapiens
aagaaggaccaccaacuau

SEQ ID NO: 1403800 - RNA, 19 nt, Homo sapiens
gauuuugcuucgccuauuu

SEQ ID NO: 1403801 - RNA, 19 nt, Homo sapiens
agagaaagcagcuagaacu

SEQ ID NO: 1403802 - RNA, 19 nt, Homo sapiens
ugaacaauuuccucagaac

SEQ ID NO: 1403803 - RNA, 19 nt, Homo sapiens
gcuaagauaccggcaugga

SEQ ID NO: 1403804 - RNA, 19 nt, Homo sapiens
ggaaguuggcagaaagagu

SEQ ID NO: 1403805 - RNA, 19 nt, Homo sapiens
ccaucagucugggagguuu

SEQ ID NO: 1403806 - RNA, 19 nt, Homo sapiens
gggcuggcaggauuauuug

SEQ ID NO: 1403807 - RNA, 19 nt, Homo sapiens
gcacugcugaugggaaugu

SEQ ID NO: 1403808 - RNA, 19 nt, Homo sapiens
caaaaugucaggaaucuag

SEQ ID NO: 1403809 - RNA, 19 nt, Homo sapiens
aaggcaggaugaaauggaa

SEQ ID NO: 1403810 - RNA, 19 nt, Homo sapiens
gagaaagcagcuagaacuc

SEQ ID NO: 1403811 - RNA, 19 nt, Homo sapiens
ugagagaaagcagcuagaa

SEQ ID NO: 1403812 - RNA, 19 nt, Homo sapiens
aaggguaggcuuuguugaa

SEQ ID NO: 1403813 - RNA, 19 nt, Homo sapiens
gguuguaucgaggcuauaa

SEQ ID NO: 1403814 - RNA, 19 nt, Homo sapiens
gaagucauuggccuguaug

SEQ ID NO: 1403815 - RNA, 19 nt, Homo sapiens
uaggcuggcugguaugaag

SEQ ID NO: 1403816 - RNA, 19 nt, Homo sapiens
gguccaguuucccuuaugg

SEQ ID NO: 1403817 - RNA, 19 nt, Homo sapiens
gcauagcaagcacucuuuc

SEQ ID NO: 1403818 - RNA, 19 nt, Homo sapiens
aagcagagggcacagguau

SEQ ID NO: 1403819 - RNA, 19 nt, Homo sapiens
ggggaagaguuguguaugu

SEQ ID NO: 1403820 - RNA, 19 nt, Homo sapiens
gaaaccgucuccacaaaua

SEQ ID NO: 1403821 - RNA, 19 nt, Homo sapiens
gaagagacauuuaguucau

SEQ ID NO: 1403822 - RNA, 19 nt, Homo sapiens
gcaagacccuauaucaaug

SEQ ID NO: 1403823 - RNA, 19 nt, Homo sapiens
gcagcacugugacauguuu

SEQ ID NO: 1403824 - RNA, 19 nt, Homo sapiens
cagcacaccuuccaugaau

SEQ ID NO: 1403825 - RNA, 19 nt, Homo sapiens
gugaaaccgucuccacaaa

SEQ ID NO: 1403826 - RNA, 19 nt, Homo sapiens
gcagugagccgugauuuca

SEQ ID NO: 1403827 - RNA, 19 nt, Homo sapiens
ggcuugcugucaauaaaua

SEQ ID NO: 1403828 - RNA, 19 nt, Homo sapiens
gagaaagcaagacccuaua

SEQ ID NO: 1403829 - RNA, 19 nt, Homo sapiens
gaacggcugggccauagaa

SEQ ID NO: 1403830 - RNA, 19 nt, Homo sapiens
ggaagagacauuuaguuca

SEQ ID NO: 1403831 - RNA, 19 nt, Homo sapiens
ccagacccaucccuuuauu

SEQ ID NO: 1403832 - RNA, 19 nt, Homo sapiens
gagacuugccggcauguuu

SEQ ID NO: 1403833 - RNA, 19 nt, Homo sapiens
gaacugcggcugcgucuac

SEQ ID NO: 1403834 - RNA, 19 nt, Homo sapiens
aaaccaggauuuauaagag

SEQ ID NO: 1403835 - RNA, 19 nt, Homo sapiens
aaagucaucugcuguuugg

SEQ ID NO: 1403836 - RNA, 19 nt, Homo sapiens
agagagggcuuauaaaucc

SEQ ID NO: 1403837 - RNA, 19 nt, Homo sapiens
gaaagcaagacccuauauc

SEQ ID NO: 1403838 - RNA, 19 nt, Homo sapiens
gguuguggguuuacuggaa

SEQ ID NO: 1403839 - RNA, 19 nt, Homo sapiens
acaaagucaucugcuguuu

SEQ ID NO: 1403840 - RNA, 19 nt, Homo sapiens
aaagcaagacccuauauca

SEQ ID NO: 1403841 - RNA, 19 nt, Homo sapiens
ggguaaaucucuguucaag

SEQ ID NO: 1403842 - RNA, 19 nt, Homo sapiens
aaaaggaaguggucaaguu

SEQ ID NO: 1403843 - RNA, 19 nt, Homo sapiens
ugacaaaccaggcuguuca

SEQ ID NO: 1403844 - RNA, 19 nt, Homo sapiens
caaaccauagcauaaguga

SEQ ID NO: 1403845 - RNA, 19 nt, Homo sapiens
ccugaagguuguggguuua

SEQ ID NO: 1403846 - RNA, 19 nt, Homo sapiens
ugagaaagcaagacccuau

SEQ ID NO: 1403847 - RNA, 19 nt, Homo sapiens
ggacagcgcccagauugag

SEQ ID NO: 1403848 - RNA, 19 nt, Homo sapiens
guggguaaaucucuguuca

SEQ ID NO: 1403849 - RNA, 19 nt, Homo sapiens
gccgcaaucucaucuucaa

SEQ ID NO: 1403850 - RNA, 19 nt, Homo sapiens
gugggaggauugccugaga

SEQ ID NO: 1403851 - RNA, 19 nt, Homo sapiens
gcaaucucaucuucaacuc

SEQ ID NO: 1403852 - RNA, 19 nt, Homo sapiens
gacccuauaucaaugaaaa

SEQ ID NO: 1403853 - RNA, 19 nt, Homo sapiens
caagacccuauaucaauga

SEQ ID NO: 1403854 - RNA, 19 nt, Homo sapiens
ucacuggcuugcugucaau

SEQ ID NO: 1403855 - RNA, 19 nt, Homo sapiens
cacaaaccauagcauaagu

SEQ ID NO: 1403856 - RNA, 19 nt, Homo sapiens
ggaacgagggcgaggaaca

SEQ ID NO: 1403857 - RNA, 19 nt, Homo sapiens
ggaucucgguggacucagu

SEQ ID NO: 1403858 - RNA, 19 nt, Homo sapiens
ccacaaaccauagcauaag

SEQ ID NO: 1403859 - RNA, 19 nt, Homo sapiens
gcacaccuuccaugaaucu

SEQ ID NO: 1403860 - RNA, 19 nt, Homo sapiens
ggggaaaucucugguguug

SEQ ID NO: 1403861 - RNA, 19 nt, Homo sapiens
cccugaagguuguggguuu

SEQ ID NO: 1403862 - RNA, 19 nt, Homo sapiens
ccccaaaacuggccauaaa

SEQ ID NO: 1403863 - RNA, 19 nt, Homo sapiens
ccccaaaucuggccauaaa

SEQ ID NO: 1403864 - RNA, 19 nt, Homo sapiens
caagggcauccgcuacgua

SEQ ID NO: 1403865 - RNA, 19 nt, Homo sapiens
cgugaccucuuucgaaugg

SEQ ID NO: 1403866 - RNA, 19 nt, Homo sapiens
uauuucagcccaucccuuu

SEQ ID NO: 1403867 - RNA, 19 nt, Homo sapiens
aaccauagcauaagugauc

SEQ ID NO: 1403868 - RNA, 19 nt, Homo sapiens
aaccaggauuuauaagaga

SEQ ID NO: 1403869 - RNA, 19 nt, Homo sapiens
aagcaagacccuauaucaa

SEQ ID NO: 1403870 - RNA, 19 nt, Homo sapiens
gaggcagucuguccuugag

SEQ ID NO: 1403871 - RNA, 19 nt, Homo sapiens
gcaagggcauccgcuacgu

SEQ ID NO: 1403872 - RNA, 19 nt, Homo sapiens
ccacgucuucaccaacuuu

SEQ ID NO: 1403873 - RNA, 19 nt, Homo sapiens
caggaagagacauuuaguu

SEQ ID NO: 1403874 - RNA, 19 nt, Homo sapiens
gggcauccgcuacguaucu

SEQ ID NO: 1403875 - RNA, 19 nt, Homo sapiens
ggauguguaugaaaaggaa

SEQ ID NO: 1403876 - RNA, 19 nt, Homo sapiens
gcccaucccuuuauuuccu

SEQ ID NO: 1403877 - RNA, 19 nt, Homo sapiens
agccagacccaucccuuua

SEQ ID NO: 1403878 - RNA, 19 nt, Homo sapiens
aaccacaaaccauagcaua

SEQ ID NO: 1403879 - RNA, 19 nt, Homo sapiens
caaaggcuaaaccaggauu

SEQ ID NO: 1403880 - RNA, 19 nt, Homo sapiens
aggaagagacauuuaguuc

SEQ ID NO: 1403881 - RNA, 19 nt, Homo sapiens
agaaagcaagacccuauau

SEQ ID NO: 1403882 - RNA, 19 nt, Homo sapiens
aaaggaaguggucaaguuc

SEQ ID NO: 1403883 - RNA, 19 nt, Homo sapiens
caaaucuggccauaaacug

SEQ ID NO: 1403884 - RNA, 19 nt, Homo sapiens
aagagagggcuuauaaauc

SEQ ID NO: 1403885 - RNA, 19 nt, Homo sapiens
caucaugcugugugacaaa

SEQ ID NO: 1403886 - RNA, 19 nt, Homo sapiens
gccagaagccagaggauac

SEQ ID NO: 1403887 - RNA, 19 nt, Homo sapiens
cagcccaucccuuuauuuc

SEQ ID NO: 1403888 - RNA, 19 nt, Homo sapiens
agacccaucccuuuauuuc

SEQ ID NO: 1403889 - RNA, 19 nt, Homo sapiens
gaaccacaaaccauagcau

SEQ ID NO: 1403890 - RNA, 19 nt, Homo sapiens
ccaaaucuggccauaaacu

SEQ ID NO: 1403891 - RNA, 19 nt, Homo sapiens
agcaagacccuauaucaau

SEQ ID NO: 1403892 - RNA, 19 nt, Homo sapiens
aaaccgucuccacaaauaa

SEQ ID NO: 1403893 - RNA, 19 nt, Homo sapiens
ugaaaccgucuccacaaau

SEQ ID NO: 1403894 - RNA, 19 nt, Homo sapiens
ggaaguggucaaguucuca

SEQ ID NO: 1403895 - RNA, 19 nt, Homo sapiens
cuggcuugcugucaauaaa

SEQ ID NO: 1403896 - RNA, 19 nt, Homo sapiens
cugcagcacugugacaugu

SEQ ID NO: 1403897 - RNA, 19 nt, Homo sapiens
ccuagcgacuggacuacug

SEQ ID NO: 1403898 - RNA, 19 nt, Homo sapiens
gccagacccaucccuuuau

SEQ ID NO: 1403899 - RNA, 19 nt, Homo sapiens
uagccagacccaucccuuu

SEQ ID NO: 1403900 - RNA, 19 nt, Homo sapiens
gaagguuguggguuuacug

SEQ ID NO: 1403901 - RNA, 19 nt, Homo sapiens
cacuggagcucgggaguuc

SEQ ID NO: 1403902 - RNA, 19 nt, Homo sapiens
cccuuuauuuccuguaaga

SEQ ID NO: 1403903 - RNA, 19 nt, Homo sapiens
ucagcacaccuuccaugaa

SEQ ID NO: 1403904 - RNA, 19 nt, Homo sapiens
gaggauacccagggacagu

SEQ ID NO: 1403905 - RNA, 19 nt, Homo sapiens
gacccaucccuuuauuuca

SEQ ID NO: 1403906 - RNA, 19 nt, Homo sapiens
gaacgagggcgaggaacac

SEQ ID NO: 1403907 - RNA, 19 nt, Homo sapiens
cgacugccucccagaacaa

SEQ ID NO: 1403908 - RNA, 19 nt, Homo sapiens
acaggucucccacgucuuc

SEQ ID NO: 1403909 - RNA, 19 nt, Homo sapiens
cagacccaucccuuuauuu

SEQ ID NO: 1403910 - RNA, 19 nt, Homo sapiens
aaacuggccauaaacaaaa

SEQ ID NO: 1403911 - RNA, 19 nt, Homo sapiens
gacucuggcuacuggagau

SEQ ID NO: 1403912 - RNA, 19 nt, Homo sapiens
ugaggcagucuguccuuga

SEQ ID NO: 1403913 - RNA, 19 nt, Homo sapiens
ggagcucgggaguucaaga

SEQ ID NO: 1403914 - RNA, 19 nt, Homo sapiens
gaaaccgucuccacaaaua

SEQ ID NO: 1403915 - RNA, 19 nt, Homo sapiens
gaagagacauuuaguucau

SEQ ID NO: 1403916 - RNA, 19 nt, Homo sapiens
gcaagacccuauaucaaug

SEQ ID NO: 1403917 - RNA, 19 nt, Homo sapiens
gcagcacugugacauguuu

SEQ ID NO: 1403918 - RNA, 19 nt, Homo sapiens
gaagagaggagucaugauc

SEQ ID NO: 1403919 - RNA, 19 nt, Homo sapiens
cagcacaccuuccaugaau

SEQ ID NO: 1403920 - RNA, 19 nt, Homo sapiens
gugaaaccgucuccacaaa

SEQ ID NO: 1403921 - RNA, 19 nt, Homo sapiens
gcagugagccgugauuuca

SEQ ID NO: 1403922 - RNA, 19 nt, Homo sapiens
gagaagagaggagucauga

SEQ ID NO: 1403923 - RNA, 19 nt, Homo sapiens
ggcuugcugucaauaaaua

SEQ ID NO: 1403924 - RNA, 19 nt, Homo sapiens
gagaaagcaagacccuaua

SEQ ID NO: 1403925 - RNA, 19 nt, Homo sapiens
ucacugagaaugaugcuaa

SEQ ID NO: 1403926 - RNA, 19 nt, Homo sapiens
gaacggcugggccauagaa

SEQ ID NO: 1403927 - RNA, 19 nt, Homo sapiens
ggaagagacauuuaguuca

SEQ ID NO: 1403928 - RNA, 19 nt, Homo sapiens
ccagacccaucccuuuauu

SEQ ID NO: 1403929 - RNA, 19 nt, Homo sapiens
gagacuugccggcauguuu

SEQ ID NO: 1403930 - RNA, 19 nt, Homo sapiens
gaacugcggcugcgucuac

SEQ ID NO: 1403931 - RNA, 19 nt, Homo sapiens
aaaccaggauuuauaagag

SEQ ID NO: 1403932 - RNA, 19 nt, Homo sapiens
aaagucaucugcuguuugg

SEQ ID NO: 1403933 - RNA, 19 nt, Homo sapiens
agagagggcuuauaaaucc

SEQ ID NO: 1403934 - RNA, 19 nt, Homo sapiens
gaaagcaagacccuauauc

SEQ ID NO: 1403935 - RNA, 19 nt, Homo sapiens
gguuguggguuuacuggaa

SEQ ID NO: 1403936 - RNA, 19 nt, Homo sapiens
gcagaugacgcaugaagca

SEQ ID NO: 1403937 - RNA, 19 nt, Homo sapiens
acaaagucaucugcuguuu

SEQ ID NO: 1403938 - RNA, 19 nt, Homo sapiens
aaagcaagacccuauauca

SEQ ID NO: 1403939 - RNA, 19 nt, Homo sapiens
ggguaaaucucuguucaag

SEQ ID NO: 1403940 - RNA, 19 nt, Homo sapiens
aaaaggaaguggucaaguu

SEQ ID NO: 1403941 - RNA, 19 nt, Homo sapiens
ugacaaaccaggcuguuca

SEQ ID NO: 1403942 - RNA, 19 nt, Homo sapiens
caaaccauagcauaaguga

SEQ ID NO: 1403943 - RNA, 19 nt, Homo sapiens
ccugaagguuguggguuua

SEQ ID NO: 1403944 - RNA, 19 nt, Homo sapiens
ugagaaagcaagacccuau

SEQ ID NO: 1403945 - RNA, 19 nt, Homo sapiens
ggagaagagaggagucaug

SEQ ID NO: 1403946 - RNA, 19 nt, Homo sapiens
ggacagcgcccagauugag

SEQ ID NO: 1403947 - RNA, 19 nt, Homo sapiens
guggguaaaucucuguuca

SEQ ID NO: 1403948 - RNA, 19 nt, Homo sapiens
gccgcaaucucaucuucaa

SEQ ID NO: 1403949 - RNA, 19 nt, Homo sapiens
gugggaggauugccugaga

SEQ ID NO: 1403950 - RNA, 19 nt, Homo sapiens
gcaaucucaucuucaacuc

SEQ ID NO: 1403951 - RNA, 19 nt, Homo sapiens
gacccuauaucaaugaaaa

SEQ ID NO: 1403952 - RNA, 19 nt, Homo sapiens
caagacccuauaucaauga

SEQ ID NO: 1403953 - RNA, 19 nt, Homo sapiens
gagcccagagcuaaaauua

SEQ ID NO: 1403954 - RNA, 19 nt, Homo sapiens
ucacuggcuugcugucaau

SEQ ID NO: 1403955 - RNA, 19 nt, Homo sapiens
cacaaaccauagcauaagu

SEQ ID NO: 1403956 - RNA, 19 nt, Homo sapiens
ggaacgagggcgaggaaca

SEQ ID NO: 1403957 - RNA, 19 nt, Homo sapiens
ggaucucgguggacucagu

SEQ ID NO: 1403958 - RNA, 19 nt, Homo sapiens
ccacaaaccauagcauaag

SEQ ID NO: 1403959 - RNA, 19 nt, Homo sapiens
gcacaccuuccaugaaucu

SEQ ID NO: 1403960 - RNA, 19 nt, Homo sapiens
ggggaaaucucugguguug

SEQ ID NO: 1403961 - RNA, 19 nt, Homo sapiens
cccugaagguuguggguuu

SEQ ID NO: 1403962 - RNA, 19 nt, Homo sapiens
ccccaaaacuggccauaaa

SEQ ID NO: 1403963 - RNA, 19 nt, Homo sapiens
ccccaaaucuggccauaaa

SEQ ID NO: 1403964 - RNA, 19 nt, Homo sapiens
caagggcauccgcuacgua

SEQ ID NO: 1403965 - RNA, 19 nt, Homo sapiens
cgugaccucuuucgaaugg

SEQ ID NO: 1403966 - RNA, 19 nt, Homo sapiens
uauuucagcccaucccuuu

SEQ ID NO: 1403967 - RNA, 19 nt, Homo sapiens
aaccauagcauaagugauc

SEQ ID NO: 1403968 - RNA, 19 nt, Homo sapiens
aaccaggauuuauaagaga

SEQ ID NO: 1403969 - RNA, 19 nt, Homo sapiens
aagcaagacccuauaucaa

SEQ ID NO: 1403970 - RNA, 19 nt, Homo sapiens
gaggcagucuguccuugag

SEQ ID NO: 1403971 - RNA, 19 nt, Homo sapiens
gcaagggcauccgcuacgu

SEQ ID NO: 1403972 - RNA, 19 nt, Homo sapiens
ccacgucuucaccaacuuu

SEQ ID NO: 1403973 - RNA, 19 nt, Homo sapiens
gccgugagcccagagcuaa

SEQ ID NO: 1403974 - RNA, 19 nt, Homo sapiens
caggaagagacauuuaguu

SEQ ID NO: 1403975 - RNA, 19 nt, Homo sapiens
gggcauccgcuacguaucu

SEQ ID NO: 1403976 - RNA, 19 nt, Homo sapiens
ggauguguaugaaaaggaa

SEQ ID NO: 1403977 - RNA, 19 nt, Homo sapiens
gcccaucccuuuauuuccu

SEQ ID NO: 1403978 - RNA, 19 nt, Homo sapiens
agccagacccaucccuuua

SEQ ID NO: 1403979 - RNA, 19 nt, Homo sapiens
aaccacaaaccauagcaua

SEQ ID NO: 1403980 - RNA, 19 nt, Homo sapiens
agagaggagucaugaucug

SEQ ID NO: 1403981 - RNA, 19 nt, Homo sapiens
caaaggcuaaaccaggauu

SEQ ID NO: 1403982 - RNA, 19 nt, Homo sapiens
aggaagagacauuuaguuc

SEQ ID NO: 1403983 - RNA, 19 nt, Homo sapiens
agaaagcaagacccuauau

SEQ ID NO: 1403984 - RNA, 19 nt, Homo sapiens
aaaggaaguggucaaguuc

SEQ ID NO: 1403985 - RNA, 19 nt, Homo sapiens
caaaucuggccauaaacug

SEQ ID NO: 1403986 - RNA, 19 nt, Homo sapiens
aagagagggcuuauaaauc

SEQ ID NO: 1403987 - RNA, 19 nt, Homo sapiens
caucaugcugugugacaaa

SEQ ID NO: 1403988 - RNA, 19 nt, Homo sapiens
gccagaagccagaggauac

SEQ ID NO: 1403989 - RNA, 19 nt, Homo sapiens
cagcccaucccuuuauuuc

SEQ ID NO: 1403990 - RNA, 19 nt, Homo sapiens
agacccaucccuuuauuuc

SEQ ID NO: 1403991 - RNA, 19 nt, Homo sapiens
gaaccacaaaccauagcau

SEQ ID NO: 1403992 - RNA, 19 nt, Homo sapiens
ccaaaucuggccauaaacu

SEQ ID NO: 1403993 - RNA, 19 nt, Homo sapiens
agcaagacccuauaucaau

SEQ ID NO: 1403994 - RNA, 19 nt, Homo sapiens
aaaccgucuccacaaauaa

SEQ ID NO: 1403995 - RNA, 19 nt, Homo sapiens
ugaaaccgucuccacaaau

SEQ ID NO: 1403996 - RNA, 19 nt, Homo sapiens
ggaaguggucaaguucuca

SEQ ID NO: 1403997 - RNA, 19 nt, Homo sapiens
cuggcuugcugucaauaaa

SEQ ID NO: 1403998 - RNA, 19 nt, Homo sapiens
cugcagcacugugacaugu

SEQ ID NO: 1403999 - RNA, 19 nt, Homo sapiens
ccuagcgacuggacuacug

SEQ ID NO: 1404000 - RNA, 19 nt, Homo sapiens
gcaaggacucuggcuacug

SEQ ID NO: 1404001 - RNA, 19 nt, Homo sapiens
gccagacccaucccuuuau

SEQ ID NO: 1404002 - RNA, 19 nt, Homo sapiens
uagccagacccaucccuuu

SEQ ID NO: 1404003 - RNA, 19 nt, Homo sapiens
gaagguuguggguuuacug

SEQ ID NO: 1404004 - RNA, 19 nt, Homo sapiens
cacuggagcucgggaguuc

SEQ ID NO: 1404005 - RNA, 19 nt, Homo sapiens
cccuuuauuuccuguaaga

SEQ ID NO: 1404006 - RNA, 19 nt, Homo sapiens
ucagcacaccuuccaugaa

SEQ ID NO: 1404007 - RNA, 19 nt, Homo sapiens
gaggauacccagggacagu

SEQ ID NO: 1404008 - RNA, 19 nt, Homo sapiens
cagcagaugacgcaugaag

SEQ ID NO: 1404009 - RNA, 19 nt, Homo sapiens
gacccaucccuuuauuuca

SEQ ID NO: 1404010 - RNA, 19 nt, Homo sapiens
gaacgagggcgaggaacac

SEQ ID NO: 1404011 - RNA, 19 nt, Homo sapiens
acaggucucccacgucuuc

SEQ ID NO: 1404012 - RNA, 19 nt, Homo sapiens
cagacccaucccuuuauuu

SEQ ID NO: 1404013 - RNA, 19 nt, Homo sapiens
aaacuggccauaaacaaaa

SEQ ID NO: 1404014 - RNA, 19 nt, Homo sapiens
gaaaucaagugcaauauug

SEQ ID NO: 1404015 - RNA, 19 nt, Homo sapiens
gugaugagguuuagauuua

SEQ ID NO: 1404016 - RNA, 19 nt, Homo sapiens
ggaagauaaugaugacuua

SEQ ID NO: 1404017 - RNA, 19 nt, Homo sapiens
ggauugagcuucauucaga

SEQ ID NO: 1404018 - RNA, 19 nt, Homo sapiens
gagcacagcaagugaauua

SEQ ID NO: 1404019 - RNA, 19 nt, Homo sapiens
gauaauuccuuuagucuug

SEQ ID NO: 1404020 - RNA, 19 nt, Homo sapiens
ggaagaggauaucaaagaa

SEQ ID NO: 1404021 - RNA, 19 nt, Homo sapiens
caaaugauguauucaguga

SEQ ID NO: 1404022 - RNA, 19 nt, Homo sapiens
ggacuuggcucguauuuac

SEQ ID NO: 1404023 - RNA, 19 nt, Homo sapiens
uaacugccauuguuuguuu

SEQ ID NO: 1404024 - RNA, 19 nt, Homo sapiens
gcauauuucuugucauuga

SEQ ID NO: 1404025 - RNA, 19 nt, Homo sapiens
gguaguaacugccauuguu

SEQ ID NO: 1404026 - RNA, 19 nt, Homo sapiens
cacagcaagugaauuauua

SEQ ID NO: 1404027 - RNA, 19 nt, Homo sapiens
ucaaagggcuccacccaaa

SEQ ID NO: 1404028 - RNA, 19 nt, Homo sapiens
gacgauuacuaaacuguua

SEQ ID NO: 1404029 - RNA, 19 nt, Homo sapiens
ucacagaaauuguauguag

SEQ ID NO: 1404030 - RNA, 19 nt, Homo sapiens
ggacagaacacuugggaaa

SEQ ID NO: 1404031 - RNA, 19 nt, Homo sapiens
ggaaccggauauuuaagua

SEQ ID NO: 1404032 - RNA, 19 nt, Homo sapiens
gaagccauuucuacuaauu

SEQ ID NO: 1404033 - RNA, 19 nt, Homo sapiens
aaucucagcuccaguaauu

SEQ ID NO: 1404034 - RNA, 19 nt, Homo sapiens
caaagccuguuaaaucauu

SEQ ID NO: 1404035 - RNA, 19 nt, Homo sapiens
gaacuggacagaacacuug

SEQ ID NO: 1404036 - RNA, 19 nt, Homo sapiens
guaguucacuguauaaagu

SEQ ID NO: 1404037 - RNA, 19 nt, Homo sapiens
gaagcucaguauauucgua

SEQ ID NO: 1404038 - RNA, 19 nt, Homo sapiens
gaucugaauugcaguuguu

SEQ ID NO: 1404039 - RNA, 19 nt, Homo sapiens
ggaaaucaagugcaauauu

SEQ ID NO: 1404040 - RNA, 19 nt, Homo sapiens
gaucauugcauauuucuug

SEQ ID NO: 1404041 - RNA, 19 nt, Homo sapiens
guuaaacuguccauauuug

SEQ ID NO: 1404042 - RNA, 19 nt, Homo sapiens
gaggaucaguuaacacaga

SEQ ID NO: 1404043 - RNA, 19 nt, Homo sapiens
gaaccugcauuuguuguug

SEQ ID NO: 1404044 - RNA, 19 nt, Homo sapiens
ccaaguaagugaggauauu

SEQ ID NO: 1404045 - RNA, 19 nt, Homo sapiens
gcacagcaagugaauuauu

SEQ ID NO: 1404046 - RNA, 19 nt, Homo sapiens
gauaauggcaaaccagauu

SEQ ID NO: 1404047 - RNA, 19 nt, Homo sapiens
caagcaauguauagugaaa

SEQ ID NO: 1404048 - RNA, 19 nt, Homo sapiens
gaucaguuaacacagauua

SEQ ID NO: 1404049 - RNA, 19 nt, Homo sapiens
ugaaacauacagugaguua

SEQ ID NO: 1404050 - RNA, 19 nt, Homo sapiens
ggauauauuugaagauugg

SEQ ID NO: 1404051 - RNA, 19 nt, Homo sapiens
aaagagaguuaaacagaga

SEQ ID NO: 1404052 - RNA, 19 nt, Homo sapiens
cugcuaagauucagauauu

SEQ ID NO: 1404053 - RNA, 19 nt, Homo sapiens
uaaggaagcccaagcaaug

SEQ ID NO: 1404054 - RNA, 19 nt, Homo sapiens
aaaguggaaugcaacagua

SEQ ID NO: 1404055 - RNA, 19 nt, Homo sapiens
ggagccaccucaaaauuua

SEQ ID NO: 1404056 - RNA, 19 nt, Homo sapiens
gaaguggaaccggauauuu

SEQ ID NO: 1404057 - RNA, 19 nt, Homo sapiens
caucuaauuuggguguuua

SEQ ID NO: 1404058 - RNA, 19 nt, Homo sapiens
ugaaguaccuaguuaccuu

SEQ ID NO: 1404059 - RNA, 19 nt, Homo sapiens
uauccuugcuguuucauuu

SEQ ID NO: 1404060 - RNA, 19 nt, Homo sapiens
uggaagccauuucuacuaa

SEQ ID NO: 1404061 - RNA, 19 nt, Homo sapiens
cagagacaaugcuuacaaa

SEQ ID NO: 1404062 - RNA, 19 nt, Homo sapiens
cuagaaccguggcauguuu

SEQ ID NO: 1404063 - RNA, 19 nt, Homo sapiens
gguuggagcugcuguuuag

SEQ ID NO: 1404064 - RNA, 19 nt, Homo sapiens
aaaguuaucugucccaucu

SEQ ID NO: 1404065 - RNA, 19 nt, Homo sapiens
cuacaggacuuggcucgua

SEQ ID NO: 1404066 - RNA, 19 nt, Homo sapiens
gagcuggaguacagaaaga

SEQ ID NO: 1404067 - RNA, 19 nt, Homo sapiens
aagcaaagccuguuaaauc

SEQ ID NO: 1404068 - RNA, 19 nt, Homo sapiens
caaaguguacaguagauuu

SEQ ID NO: 1404069 - RNA, 19 nt, Homo sapiens
gaaauuguuccaaguaagu

SEQ ID NO: 1404070 - RNA, 19 nt, Homo sapiens
ggucagcggaugcacuuua

SEQ ID NO: 1404071 - RNA, 19 nt, Homo sapiens
ggacacagaacgagugaau

SEQ ID NO: 1404072 - RNA, 19 nt, Homo sapiens
guuguuggguugcuguaua

SEQ ID NO: 1404073 - RNA, 19 nt, Homo sapiens
gguggaauaugccaaggaa

SEQ ID NO: 1404074 - RNA, 19 nt, Homo sapiens
gggguuauuucuacaauua

SEQ ID NO: 1404075 - RNA, 19 nt, Homo sapiens
gacgcacacuuagaaauuu

SEQ ID NO: 1404076 - RNA, 19 nt, Homo sapiens
gagacaaugcuuacaaaga

SEQ ID NO: 1404077 - RNA, 19 nt, Homo sapiens
guaauuccacaacaucuaa

SEQ ID NO: 1404078 - RNA, 19 nt, Homo sapiens
uagcauuuguuaggaguua

SEQ ID NO: 1404079 - RNA, 19 nt, Homo sapiens
guacagaaagaccaugaaa

SEQ ID NO: 1404080 - RNA, 19 nt, Homo sapiens
gagcugcuguuuagaugau

SEQ ID NO: 1404081 - RNA, 19 nt, Homo sapiens
aagaggauaucaaagaaga

SEQ ID NO: 1404082 - RNA, 19 nt, Homo sapiens
agaaagagaguuaaacaga

SEQ ID NO: 1404083 - RNA, 19 nt, Homo sapiens
caaguaagaaugauaaugg

SEQ ID NO: 1404084 - RNA, 19 nt, Homo sapiens
ucauugacuuuaagaggua

SEQ ID NO: 1404085 - RNA, 19 nt, Homo sapiens
guaccuaguuaccuugaau

SEQ ID NO: 1404086 - RNA, 19 nt, Homo sapiens
acacagaacgagugaauga

SEQ ID NO: 1404087 - RNA, 19 nt, Homo sapiens
ucagagugauuucaaagug

SEQ ID NO: 1404088 - RNA, 19 nt, Homo sapiens
cgacgcacacuuagaaauu

SEQ ID NO: 1404089 - RNA, 19 nt, Homo sapiens
caaccaaguaagaaugaua

SEQ ID NO: 1404090 - RNA, 19 nt, Homo sapiens
gccuauagaggaucaguua

SEQ ID NO: 1404091 - RNA, 19 nt, Homo sapiens
ucagaucaaucccaagaau

SEQ ID NO: 1404092 - RNA, 19 nt, Homo sapiens
aaacauacagugaguuaga

SEQ ID NO: 1404093 - RNA, 19 nt, Homo sapiens
gcaugaaauuguuccaagu

SEQ ID NO: 1404094 - RNA, 19 nt, Homo sapiens
caccuugcauuuauucuga

SEQ ID NO: 1404095 - RNA, 19 nt, Homo sapiens
uggaagacuuggaaaauua

SEQ ID NO: 1404096 - RNA, 19 nt, Homo sapiens
gaccaacccaagaagauaa

SEQ ID NO: 1404097 - RNA, 19 nt, Homo sapiens
ggccuaagauagcuucuag

SEQ ID NO: 1404098 - RNA, 19 nt, Homo sapiens
aaauguggcuuuugaagua

SEQ ID NO: 1404099 - RNA, 19 nt, Homo sapiens
caaaagacauggguaaaau

SEQ ID NO: 1404100 - RNA, 19 nt, Homo sapiens
guacaauggugggcuuaau

SEQ ID NO: 1404101 - RNA, 19 nt, Homo sapiens
agaaaucucagcuccagua

SEQ ID NO: 1404102 - RNA, 19 nt, Homo sapiens
gcaaaaccauuguuaugug

SEQ ID NO: 1404103 - RNA, 19 nt, Homo sapiens
gagaauuaacacuuacgua

SEQ ID NO: 1404104 - RNA, 19 nt, Homo sapiens
ucaggaaucuacaggacuu

SEQ ID NO: 1404105 - RNA, 19 nt, Homo sapiens
agacaaugcuuacaaagac

SEQ ID NO: 1404106 - RNA, 19 nt, Homo sapiens
gucagcaccuugcauuuau

SEQ ID NO: 1404107 - RNA, 19 nt, Homo sapiens
ggaagccauuucuacuaau

SEQ ID NO: 1404108 - RNA, 19 nt, Homo sapiens
gaaaucucagcuccaguaa

SEQ ID NO: 1404109 - RNA, 19 nt, Homo sapiens
gugaaaggauuauuaucuc

SEQ ID NO: 1404110 - RNA, 19 nt, Homo sapiens
cccaagcaauguauaguga

SEQ ID NO: 1404111 - RNA, 19 nt, Homo sapiens
gccauuccuuguuaagaaa

SEQ ID NO: 1404112 - RNA, 19 nt, Homo sapiens
guaauugccuccagauagc

SEQ ID NO: 1404113 - RNA, 19 nt, Homo sapiens
gguaauugccuccagauag

SEQ ID NO: 1404114 - RNA, 19 nt, Homo sapiens
agacauggcugguguuaaa

SEQ ID NO: 1404115 - RNA, 19 nt, Homo sapiens
gagacgagcugcuggaaga

SEQ ID NO: 1404116 - RNA, 19 nt, Homo sapiens
guaugaaccuguccuaaau

SEQ ID NO: 1404117 - RNA, 19 nt, Homo sapiens
gaaccuguccuaaaucaau

SEQ ID NO: 1404118 - RNA, 19 nt, Homo sapiens
gguguuaaauggagcuauu

SEQ ID NO: 1404119 - RNA, 19 nt, Homo sapiens
gagaacauuucacagaagu

SEQ ID NO: 1404120 - RNA, 19 nt, Homo sapiens
ggacgcagagcacuuaguu

SEQ ID NO: 1404121 - RNA, 19 nt, Homo sapiens
gauaacaucagcugagguu

SEQ ID NO: 1404122 - RNA, 19 nt, Homo sapiens
cuaaaucaauuccucaaag

SEQ ID NO: 1404123 - RNA, 19 nt, Homo sapiens
gaacaaaacccuacgaaag

SEQ ID NO: 1404124 - RNA, 19 nt, Homo sapiens
gcuuagagccaguauuuau

SEQ ID NO: 1404125 - RNA, 19 nt, Homo sapiens
ggagacauggcugguguua

SEQ ID NO: 1404126 - RNA, 19 nt, Homo sapiens
aagcuuagagccaguauuu

SEQ ID NO: 1404127 - RNA, 19 nt, Homo sapiens
ucaaugaagugaugaaagc

SEQ ID NO: 1404128 - RNA, 19 nt, Homo sapiens
ugugaaggauuucuccaaa

SEQ ID NO: 1404129 - RNA, 19 nt, Homo sapiens
augaagugaugaaagcuua

SEQ ID NO: 1404130 - RNA, 19 nt, Homo sapiens
cugagaacauuucacagaa

SEQ ID NO: 1404131 - RNA, 19 nt, Homo sapiens
ugaaggauuucuccaaacu

SEQ ID NO: 1404132 - RNA, 19 nt, Homo sapiens
gguggacgcagagcacuua

SEQ ID NO: 1404133 - RNA, 19 nt, Homo sapiens
ucuccucgcugcucuucua

SEQ ID NO: 1404134 - RNA, 19 nt, Homo sapiens
gcuggcaucuggcuugagu

SEQ ID NO: 1404135 - RNA, 19 nt, Homo sapiens
ccacuucucuaccgcuaca

SEQ ID NO: 1404136 - RNA, 19 nt, Homo sapiens
ccucacugguggccaugua

SEQ ID NO: 1404137 - RNA, 19 nt, Homo sapiens
ugagaacauuucacagaag

SEQ ID NO: 1404138 - RNA, 19 nt, Homo sapiens
cuuagagccaguauuuaua

SEQ ID NO: 1404139 - RNA, 19 nt, Homo sapiens
gaagugaugaaagcuuaga

SEQ ID NO: 1404140 - RNA, 19 nt, Homo sapiens
ggacguguacuuugucaac

SEQ ID NO: 1404141 - RNA, 19 nt, Homo sapiens
gcucuggacgccacacuau

SEQ ID NO: 1404142 - RNA, 19 nt, Homo sapiens
aguaugaaccuguccuaaa

SEQ ID NO: 1404143 - RNA, 19 nt, Homo sapiens
caaacacgcagcucaaggu

SEQ ID NO: 1404144 - RNA, 19 nt, Homo sapiens
guuugucaaugaagugaug

SEQ ID NO: 1404145 - RNA, 19 nt, Homo sapiens
ucgcugcucuucuacaucu

SEQ ID NO: 1404146 - RNA, 19 nt, Homo sapiens
gggcuacugcacuuuguga

SEQ ID NO: 1404147 - RNA, 19 nt, Homo sapiens
uaacaucagcugagguuuu

SEQ ID NO: 1404148 - RNA, 19 nt, Homo sapiens
gacgcagagcacuuaguua

SEQ ID NO: 1404149 - RNA, 19 nt, Homo sapiens
caagaugcagaacgcagaa

SEQ ID NO: 1404150 - RNA, 19 nt, Homo sapiens
gcuagagugcgccaagaug

SEQ ID NO: 1404151 - RNA, 19 nt, Homo sapiens
gagccucgaccacuacauc

SEQ ID NO: 1404152 - RNA, 19 nt, Homo sapiens
aaucaauuccucaaagugu

SEQ ID NO: 1404153 - RNA, 19 nt, Homo sapiens
aaccuguccuaaaucaauu

SEQ ID NO: 1404154 - RNA, 19 nt, Homo sapiens
gugaaggauuucuccaaac

SEQ ID NO: 1404155 - RNA, 19 nt, Homo sapiens
gaaagcuuagagccaguau

SEQ ID NO: 1404156 - RNA, 19 nt, Homo sapiens
ugaccaugccggacgugua

SEQ ID NO: 1404157 - RNA, 19 nt, Homo sapiens
ggccuucuccagcagcuuu

SEQ ID NO: 1404158 - RNA, 19 nt, Homo sapiens
ccaaacuccuggccuucuc

SEQ ID NO: 1404159 - RNA, 19 nt, Homo sapiens
ccagugggccugugcuaca

SEQ ID NO: 1404160 - RNA, 19 nt, Homo sapiens
ugccggacguguacuuugu

SEQ ID NO: 1404161 - RNA, 19 nt, Homo sapiens
ggacgccacacuaucugau

SEQ ID NO: 1404162 - RNA, 19 nt, Homo sapiens
cguguacuuugucaacaug

SEQ ID NO: 1404163 - RNA, 19 nt, Homo sapiens
gaccaugccggacguguac

SEQ ID NO: 1404164 - RNA, 19 nt, Homo sapiens
gcagauccccuucaaugug

SEQ ID NO: 1404165 - RNA, 19 nt, Homo sapiens
augaaccuguccuaaauca

SEQ ID NO: 1404166 - RNA, 19 nt, Homo sapiens
uggccaaccuacacagcaa

SEQ ID NO: 1404167 - RNA, 19 nt, Homo sapiens
gacguguacuuugucaaca

SEQ ID NO: 1404168 - RNA, 19 nt, Homo sapiens
ccuaaaucaauuccucaaa

SEQ ID NO: 1404169 - RNA, 19 nt, Homo sapiens
cauggcugguguuaaaugg

SEQ ID NO: 1404170 - RNA, 19 nt, Homo sapiens
gagacauggcugguguuaa

SEQ ID NO: 1404171 - RNA, 19 nt, Homo sapiens
ccucgcugcucuucuacau

SEQ ID NO: 1404172 - RNA, 19 nt, Homo sapiens
caaagugugcacaaaacua

SEQ ID NO: 1404173 - RNA, 19 nt, Homo sapiens
gcucuccucagccaccaaa

SEQ ID NO: 1404174 - RNA, 19 nt, Homo sapiens
guuaaauggagcuauucaa

SEQ ID NO: 1404175 - RNA, 19 nt, Homo sapiens
acaaaacccuacgaaagaa

SEQ ID NO: 1404176 - RNA, 19 nt, Homo sapiens
acgagcugcuggaagagaa

SEQ ID NO: 1404177 - RNA, 19 nt, Homo sapiens
gcaaggccagcaugaccau

SEQ ID NO: 1404178 - RNA, 19 nt, Homo sapiens
ccugagacgcggagacaug

SEQ ID NO: 1404179 - RNA, 19 nt, Homo sapiens
ugaaagcuuagagccagua

SEQ ID NO: 1404180 - RNA, 19 nt, Homo sapiens
gaaggauuucuccaaacuc

SEQ ID NO: 1404181 - RNA, 19 nt, Homo sapiens
acagguagcucucuagaua

SEQ ID NO: 1404182 - RNA, 19 nt, Homo sapiens
gcacaugaacucaagguua

SEQ ID NO: 1404183 - RNA, 19 nt, Homo sapiens
guaccuaucuaacaaacua

SEQ ID NO: 1404184 - RNA, 19 nt, Homo sapiens
ggcauuagcuuuccaguau

SEQ ID NO: 1404185 - RNA, 19 nt, Homo sapiens
uuacagauguggacuauga

SEQ ID NO: 1404186 - RNA, 19 nt, Homo sapiens
ggacacauauggaggacaa

SEQ ID NO: 1404187 - RNA, 19 nt, Homo sapiens
gagcaucacugucagaauc

SEQ ID NO: 1404188 - RNA, 19 nt, Homo sapiens
caaaggggcuguagguuua

SEQ ID NO: 1404189 - RNA, 19 nt, Homo sapiens
cuaugaagaugcuauguaa

SEQ ID NO: 1404190 - RNA, 19 nt, Homo sapiens
guuuaaaccuucagucaaa

SEQ ID NO: 1404191 - RNA, 19 nt, Homo sapiens
gcacaugccaccaaacuug

SEQ ID NO: 1404192 - RNA, 19 nt, Homo sapiens
gaggaaacaagauggaaua

SEQ ID NO: 1404193 - RNA, 19 nt, Homo sapiens
gaaaacaggucauauugug

SEQ ID NO: 1404194 - RNA, 19 nt, Homo sapiens
gaucugugcuccacucugu

SEQ ID NO: 1404195 - RNA, 19 nt, Homo sapiens
gccagaagcaaucaucuua

SEQ ID NO: 1404196 - RNA, 19 nt, Homo sapiens
ggaaugcaguggcacaauc

SEQ ID NO: 1404197 - RNA, 19 nt, Homo sapiens
uuacauggaucaucgaguu

SEQ ID NO: 1404198 - RNA, 19 nt, Homo sapiens
ggagggacagugaagcuua

SEQ ID NO: 1404199 - RNA, 19 nt, Homo sapiens
ggagacaucaccuuccuuu

SEQ ID NO: 1404200 - RNA, 19 nt, Homo sapiens
gugguaauaugguuugaaa

SEQ ID NO: 1404201 - RNA, 19 nt, Homo sapiens
gcauuagcuuuccaguaua

SEQ ID NO: 1404202 - RNA, 19 nt, Homo sapiens
uauguaagguuauggaaga

SEQ ID NO: 1404203 - RNA, 19 nt, Homo sapiens
aagaugcuauguaagguua

SEQ ID NO: 1404204 - RNA, 19 nt, Homo sapiens
ggagaucccagauaaaugu

SEQ ID NO: 1404205 - RNA, 19 nt, Homo sapiens
gauauguucuucagagauc

SEQ ID NO: 1404206 - RNA, 19 nt, Homo sapiens
caccguggccuuauuauuu

SEQ ID NO: 1404207 - RNA, 19 nt, Homo sapiens
cacucacucuuaugaauua

SEQ ID NO: 1404208 - RNA, 19 nt, Homo sapiens
ggaaagcaaacauuacaga

SEQ ID NO: 1404209 - RNA, 19 nt, Homo sapiens
gacagggacuuuguuauca

SEQ ID NO: 1404210 - RNA, 19 nt, Homo sapiens
gggaugagguuuauucacu

SEQ ID NO: 1404211 - RNA, 19 nt, Homo sapiens
gaaguguaccuaucuaaca

SEQ ID NO: 1404212 - RNA, 19 nt, Homo sapiens
gcacucacucuuaugaauu

SEQ ID NO: 1404213 - RNA, 19 nt, Homo sapiens
agacaagauuucaccguuu

SEQ ID NO: 1404214 - RNA, 19 nt, Homo sapiens
cuaccuaggagaacuaaua

SEQ ID NO: 1404215 - RNA, 19 nt, Homo sapiens
gagcaggagaucccagaua

SEQ ID NO: 1404216 - RNA, 19 nt, Homo sapiens
guaagguuauggaagauuc

SEQ ID NO: 1404217 - RNA, 19 nt, Homo sapiens
ugagcaauauuacugugua

SEQ ID NO: 1404218 - RNA, 19 nt, Homo sapiens
gcgcagcccugaagaaacu

SEQ ID NO: 1404219 - RNA, 19 nt, Homo sapiens
ggaaacaagauggaauaaa

SEQ ID NO: 1404220 - RNA, 19 nt, Homo sapiens
caucuuaccucaggaguca

SEQ ID NO: 1404221 - RNA, 19 nt, Homo sapiens
gagucacuguuaccaaauu

SEQ ID NO: 1404222 - RNA, 19 nt, Homo sapiens
cacaugaacucaagguuag

SEQ ID NO: 1404223 - RNA, 19 nt, Homo sapiens
gaaacuaccuaggagaacu

SEQ ID NO: 1404224 - RNA, 19 nt, Homo sapiens
caguauaccucuucuggau

SEQ ID NO: 1404225 - RNA, 19 nt, Homo sapiens
cagugacccugacguguaa

SEQ ID NO: 1404226 - RNA, 19 nt, Homo sapiens
gaggaaagcaaacauuaca

SEQ ID NO: 1404227 - RNA, 19 nt, Homo sapiens
gcuacagccuauauaugaa

SEQ ID NO: 1404228 - RNA, 19 nt, Homo sapiens
gaaagcaaacauuacagau

SEQ ID NO: 1404229 - RNA, 19 nt, Homo sapiens
gaguucagaugcccaguuc

SEQ ID NO: 1404230 - RNA, 19 nt, Homo sapiens
gaagaugcuauguaagguu

SEQ ID NO: 1404231 - RNA, 19 nt, Homo sapiens
gcagcuacagccuauauau

SEQ ID NO: 1404232 - RNA, 19 nt, Homo sapiens
aagaugcccuuucuacaga

SEQ ID NO: 1404233 - RNA, 19 nt, Homo sapiens
ccagugacccugacgugua

SEQ ID NO: 1404234 - RNA, 19 nt, Homo sapiens
agcaggagaucccagauaa

SEQ ID NO: 1404235 - RNA, 19 nt, Homo sapiens
uuuauucacuggcguacua

SEQ ID NO: 1404236 - RNA, 19 nt, Homo sapiens
guccucaucugcucaguug

SEQ ID NO: 1404237 - RNA, 19 nt, Homo sapiens
aauacagugugucuucuuu

SEQ ID NO: 1404238 - RNA, 19 nt, Homo sapiens
gagcugugcccaucauuca

SEQ ID NO: 1404239 - RNA, 19 nt, Homo sapiens
gacaucaccuuccuuuggu

SEQ ID NO: 1404240 - RNA, 19 nt, Homo sapiens
guuauugugacuccacuua

SEQ ID NO: 1404241 - RNA, 19 nt, Homo sapiens
cugcaggacuucacagaga

SEQ ID NO: 1404242 - RNA, 19 nt, Homo sapiens
auauugugcucuucuguuu

SEQ ID NO: 1404243 - RNA, 19 nt, Homo sapiens
gcacuauuccuucaucuac

SEQ ID NO: 1404244 - RNA, 19 nt, Homo sapiens
ggaaucaguagcagcagaa

SEQ ID NO: 1404245 - RNA, 19 nt, Homo sapiens
ggcacucacucuuaugaau

SEQ ID NO: 1404246 - RNA, 19 nt, Homo sapiens
gauguggacuaugaagaug

SEQ ID NO: 1404247 - RNA, 19 nt, Homo sapiens
gacaagauuucaccguuuu

SEQ ID NO: 1404248 - RNA, 19 nt, Homo sapiens
uuacguagagacaagauuu

SEQ ID NO: 1404249 - RNA, 19 nt, Homo sapiens
caaccuauaccacauccaa

SEQ ID NO: 1404250 - RNA, 19 nt, Homo sapiens
ucaucgaguuuccaccuaa

SEQ ID NO: 1404251 - RNA, 19 nt, Homo sapiens
ugacagggacuuuguuauc

SEQ ID NO: 1404252 - RNA, 19 nt, Homo sapiens
gacagcagaguaugagauu

SEQ ID NO: 1404253 - RNA, 19 nt, Homo sapiens
gacaauggcguccaaaguc

SEQ ID NO: 1404254 - RNA, 19 nt, Homo sapiens
gggcauuagcuuuccagua

SEQ ID NO: 1404255 - RNA, 19 nt, Homo sapiens
gagcaauauuacuguguag

SEQ ID NO: 1404256 - RNA, 19 nt, Homo sapiens
gcacaggagacaucaccuu

SEQ ID NO: 1404257 - RNA, 19 nt, Homo sapiens
gagacaggcugguccucau

SEQ ID NO: 1404258 - RNA, 19 nt, Homo sapiens
gcaggagaucccagauaaa

SEQ ID NO: 1404259 - RNA, 19 nt, Homo sapiens
agucuuuccuguaaguuaa

SEQ ID NO: 1404260 - RNA, 19 nt, Homo sapiens
agucacuguuaccaaauua

SEQ ID NO: 1404261 - RNA, 19 nt, Homo sapiens
caucgaguuuccaccuaaa

SEQ ID NO: 1404262 - RNA, 19 nt, Homo sapiens
gagggacagugaagcuuag

SEQ ID NO: 1404263 - RNA, 19 nt, Homo sapiens
cauuacagauguggacuau

SEQ ID NO: 1404264 - RNA, 19 nt, Homo sapiens
cugaggaaagcaaacauua

SEQ ID NO: 1404265 - RNA, 19 nt, Homo sapiens
aguaugagauuccuucagu

SEQ ID NO: 1404266 - RNA, 19 nt, Homo sapiens
ggagugacagggacuuugu

SEQ ID NO: 1404267 - RNA, 19 nt, Homo sapiens
caucuacugugaagugaag

SEQ ID NO: 1404268 - RNA, 19 nt, Homo sapiens
cagggcagcuacagccuau

SEQ ID NO: 1404269 - RNA, 19 nt, Homo sapiens
caggagaucccagauaaau

SEQ ID NO: 1404270 - RNA, 19 nt, Homo sapiens
uugagucacuguuaccaaa

SEQ ID NO: 1404271 - RNA, 19 nt, Homo sapiens
gggcagcuacagccuauau

SEQ ID NO: 1404272 - RNA, 19 nt, Homo sapiens
agguagcucucuagauauu

SEQ ID NO: 1404273 - RNA, 19 nt, Homo sapiens
guaagaugcccuuucuaca

SEQ ID NO: 1404274 - RNA, 19 nt, Homo sapiens
cguguaagaugcccuuucu

SEQ ID NO: 1404275 - RNA, 19 nt, Homo sapiens
aaccaggcacucacucuua

SEQ ID NO: 1404276 - RNA, 19 nt, Homo sapiens
uauugugacuccacuuaau

SEQ ID NO: 1404277 - RNA, 19 nt, Homo sapiens
gaacucaagguuagugacu

SEQ ID NO: 1404278 - RNA, 19 nt, Homo sapiens
ggacuaugaagaugcuaug

SEQ ID NO: 1404279 - RNA, 19 nt, Homo sapiens
aaguguaccuaucuaacaa

SEQ ID NO: 1404280 - RNA, 19 nt, Homo sapiens
ccuguaaguuaacacaaau

SEQ ID NO: 1404281 - RNA, 19 nt, Homo sapiens
gaaacagccugcaccauuu

SEQ ID NO: 1404282 - RNA, 19 nt, Homo sapiens
gaauguaccacguguauua

SEQ ID NO: 1404283 - RNA, 19 nt, Homo sapiens
gaaaacagcuuccuaauag

SEQ ID NO: 1404284 - RNA, 19 nt, Homo sapiens
gcaaauacacaacuugaua

SEQ ID NO: 1404285 - RNA, 19 nt, Homo sapiens
ugaagaagaugaugaagaa

SEQ ID NO: 1404286 - RNA, 19 nt, Homo sapiens
gcacaaagaaggaagagua

SEQ ID NO: 1404287 - RNA, 19 nt, Homo sapiens
uuacagagccuggaaauua

SEQ ID NO: 1404288 - RNA, 19 nt, Homo sapiens
ggaaacagccugcaccauu

SEQ ID NO: 1404289 - RNA, 19 nt, Homo sapiens
gcacaaucaugaccauuug

SEQ ID NO: 1404290 - RNA, 19 nt, Homo sapiens
ggagauagcaacccgauuu

SEQ ID NO: 1404291 - RNA, 19 nt, Homo sapiens
ggaaacuacuccugugaug

SEQ ID NO: 1404292 - RNA, 19 nt, Homo sapiens
gaacuuacaguccucuauu

SEQ ID NO: 1404293 - RNA, 19 nt, Homo sapiens
uuaaugugcucucuguaua

SEQ ID NO: 1404294 - RNA, 19 nt, Homo sapiens
gauagcaacccgauuuauu

SEQ ID NO: 1404295 - RNA, 19 nt, Homo sapiens
uaagaagccuggguagaaa

SEQ ID NO: 1404296 - RNA, 19 nt, Homo sapiens
guaagaagccuggguagaa

SEQ ID NO: 1404297 - RNA, 19 nt, Homo sapiens
gcaauucucccucuucaga

SEQ ID NO: 1404298 - RNA, 19 nt, Homo sapiens
caauggagcuggagccaau

SEQ ID NO: 1404299 - RNA, 19 nt, Homo sapiens
ucagauacguguacagaga

SEQ ID NO: 1404300 - RNA, 19 nt, Homo sapiens
gaucgaaagcuguuaaugu

SEQ ID NO: 1404301 - RNA, 19 nt, Homo sapiens
gaauagaggaggagagaga

SEQ ID NO: 1404302 - RNA, 19 nt, Homo sapiens
caagagcuguuucuacauc

SEQ ID NO: 1404303 - RNA, 19 nt, Homo sapiens
gauccugacuccuggaaga

SEQ ID NO: 1404304 - RNA, 19 nt, Homo sapiens
uuaggaaggucucaucuga

SEQ ID NO: 1404305 - RNA, 19 nt, Homo sapiens
gagauagcaacccgauuua

SEQ ID NO: 1404306 - RNA, 19 nt, Homo sapiens
cugcugcucugcugcauua

SEQ ID NO: 1404307 - RNA, 19 nt, Homo sapiens
gagcaagcacuguguuauu

SEQ ID NO: 1404308 - RNA, 19 nt, Homo sapiens
caaagaaggaagaguaaga

SEQ ID NO: 1404309 - RNA, 19 nt, Homo sapiens
caugacaagauccaaauua

SEQ ID NO: 1404310 - RNA, 19 nt, Homo sapiens
gaugagaaguuguugaaaa

SEQ ID NO: 1404311 - RNA, 19 nt, Homo sapiens
gagaauguaccacguguau

SEQ ID NO: 1404312 - RNA, 19 nt, Homo sapiens
guccaggccuuccaggaua

SEQ ID NO: 1404313 - RNA, 19 nt, Homo sapiens
gaagaaaacuaugagaaug

SEQ ID NO: 1404314 - RNA, 19 nt, Homo sapiens
agacauuacuccugagaga

SEQ ID NO: 1404315 - RNA, 19 nt, Homo sapiens
gcacagucauggagugagu

SEQ ID NO: 1404316 - RNA, 19 nt, Homo sapiens
gagaaaauaugguccuuau

SEQ ID NO: 1404317 - RNA, 19 nt, Homo sapiens
gaacaucucggcccacucu

SEQ ID NO: 1404318 - RNA, 19 nt, Homo sapiens
uuacaguccucuauucaga

SEQ ID NO: 1404319 - RNA, 19 nt, Homo sapiens
caauguaaauccuggagau

SEQ ID NO: 1404320 - RNA, 19 nt, Homo sapiens
guggugacacucaauguua

SEQ ID NO: 1404321 - RNA, 19 nt, Homo sapiens
gagccaauguacagcaaug

SEQ ID NO: 1404322 - RNA, 19 nt, Homo sapiens
gacugcagcugauggaaga

SEQ ID NO: 1404323 - RNA, 19 nt, Homo sapiens
ccaugacccugaccuguga

SEQ ID NO: 1404324 - RNA, 19 nt, Homo sapiens
ggcuuuacauccugucuuu

SEQ ID NO: 1404325 - RNA, 19 nt, Homo sapiens
gagauacaaacagcauuua

SEQ ID NO: 1404326 - RNA, 19 nt, Homo sapiens
gaacccaggcacagucuug

SEQ ID NO: 1404327 - RNA, 19 nt, Homo sapiens
ggagacacauauugguauc

SEQ ID NO: 1404328 - RNA, 19 nt, Homo sapiens
guaguggcauugcugaugu

SEQ ID NO: 1404329 - RNA, 19 nt, Homo sapiens
ggugugagguggagacagu

SEQ ID NO: 1404330 - RNA, 19 nt, Homo sapiens
cauguggacugaagacuca

SEQ ID NO: 1404331 - RNA, 19 nt, Homo sapiens
gagagucccugugucuaau

SEQ ID NO: 1404332 - RNA, 19 nt, Homo sapiens
uauccuugcuaccauauug

SEQ ID NO: 1404333 - RNA, 19 nt, Homo sapiens
gaagggguuucccauauga

SEQ ID NO: 1404334 - RNA, 19 nt, Homo sapiens
guucagggacugucacauu

SEQ ID NO: 1404335 - RNA, 19 nt, Homo sapiens
aaacagcuuccuaauaguu

SEQ ID NO: 1404336 - RNA, 19 nt, Homo sapiens
agcaagcacuguguuauuu

SEQ ID NO: 1404337 - RNA, 19 nt, Homo sapiens
gcagcugauugaaggagaa

SEQ ID NO: 1404338 - RNA, 19 nt, Homo sapiens
ccagggauaauagcaaaua

SEQ ID NO: 1404339 - RNA, 19 nt, Homo sapiens
gaacagaacaggccuuacc

SEQ ID NO: 1404340 - RNA, 19 nt, Homo sapiens
ugagauacaaacagcauuu

SEQ ID NO: 1404341 - RNA, 19 nt, Homo sapiens
gcagcagcauaucacauuc

SEQ ID NO: 1404342 - RNA, 19 nt, Homo sapiens
ggagauaagucgggcuuuu

SEQ ID NO: 1404343 - RNA, 19 nt, Homo sapiens
ggcacaaucaugaccauuu

SEQ ID NO: 1404344 - RNA, 19 nt, Homo sapiens
aaacaugacaagauccaaa

SEQ ID NO: 1404345 - RNA, 19 nt, Homo sapiens
gcagggcccaugaagaaga

SEQ ID NO: 1404346 - RNA, 19 nt, Homo sapiens
caaaagaaaacucagcuaa

SEQ ID NO: 1404347 - RNA, 19 nt, Homo sapiens
gccuggaaauuaccaaugu

SEQ ID NO: 1404348 - RNA, 19 nt, Homo sapiens
caaauuacagagccuggaa

SEQ ID NO: 1404349 - RNA, 19 nt, Homo sapiens
uaaugugcucucuguauaa

SEQ ID NO: 1404350 - RNA, 19 nt, Homo sapiens
guuaaugugcucucuguau

SEQ ID NO: 1404351 - RNA, 19 nt, Homo sapiens
uacaagggcacaaucauga

SEQ ID NO: 1404352 - RNA, 19 nt, Homo sapiens
gacaagauccaaauuacag

SEQ ID NO: 1404353 - RNA, 19 nt, Homo sapiens
gacccagcguucccuguug

SEQ ID NO: 1404354 - RNA, 19 nt, Homo sapiens
uucaagagcuguuucuaca

SEQ ID NO: 1404355 - RNA, 19 nt, Homo sapiens
ggaacuuacaguccucuau

SEQ ID NO: 1404356 - RNA, 19 nt, Homo sapiens
uagcaaauacacaacuuga

SEQ ID NO: 1404357 - RNA, 19 nt, Homo sapiens
aaugugcucucuguauaaa

SEQ ID NO: 1404358 - RNA, 19 nt, Homo sapiens
ucaagagcaugaggaacuu

SEQ ID NO: 1404359 - RNA, 19 nt, Homo sapiens
cacaaagaaggaagaguaa

SEQ ID NO: 1404360 - RNA, 19 nt, Homo sapiens
agagagucccugugucuaa

SEQ ID NO: 1404361 - RNA, 19 nt, Homo sapiens
ccuggaaauuaccaaugua

SEQ ID NO: 1404362 - RNA, 19 nt, Homo sapiens
guaucacgaugagaaguug

SEQ ID NO: 1404363 - RNA, 19 nt, Homo sapiens
gcaucaagagcaugaggaa

SEQ ID NO: 1404364 - RNA, 19 nt, Homo sapiens
caaccucucucugacuaca

SEQ ID NO: 1404365 - RNA, 19 nt, Homo sapiens
gguccuuauuugcucagua

SEQ ID NO: 1404366 - RNA, 19 nt, Homo sapiens
gggagacacauauugguau

SEQ ID NO: 1404367 - RNA, 19 nt, Homo sapiens
ggagagagaaauggucuag

SEQ ID NO: 1404368 - RNA, 19 nt, Homo sapiens
caaaaggucugcaaaucuc

SEQ ID NO: 1404369 - RNA, 19 nt, Homo sapiens
ccacacaucauccaucucu

SEQ ID NO: 1404370 - RNA, 19 nt, Homo sapiens
gaagaagaugaugaagaaa

SEQ ID NO: 1404371 - RNA, 19 nt, Homo sapiens
ccaugaagaagaugaugaa

SEQ ID NO: 1404372 - RNA, 19 nt, Homo sapiens
aggcagggcccaugaagaa

SEQ ID NO: 1404373 - RNA, 19 nt, Homo sapiens
cuaccgggauugagauaca

SEQ ID NO: 1404374 - RNA, 19 nt, Homo sapiens
aaagaaggaagaguaagaa

SEQ ID NO: 1404375 - RNA, 19 nt, Homo sapiens
cagggauaauagcaaauau

SEQ ID NO: 1404376 - RNA, 19 nt, Homo sapiens
gguaucacgaugagaaguu

SEQ ID NO: 1404377 - RNA, 19 nt, Homo sapiens
aaaaguggcucucauaugc

SEQ ID NO: 1404378 - RNA, 19 nt, Homo sapiens
aucgaaagcuguuaaugug

SEQ ID NO: 1404379 - RNA, 19 nt, Homo sapiens
aggcugggcugcaggguau

SEQ ID NO: 1404380 - RNA, 19 nt, Homo sapiens
caggauagacccucaagag

SEQ ID NO: 1404381 - RNA, 19 nt, Homo sapiens
gaauuuaccuauggcauua

SEQ ID NO: 1404382 - RNA, 19 nt, Homo sapiens
gcugagggcuuuacagaaa

SEQ ID NO: 1404383 - RNA, 19 nt, Homo sapiens
uagaacaucucaccaauga

SEQ ID NO: 1404384 - RNA, 19 nt, Homo sapiens
gcagaaauauguaugucuu

SEQ ID NO: 1404385 - RNA, 19 nt, Homo sapiens
ggacagggcucaaggacau

SEQ ID NO: 1404386 - RNA, 19 nt, Homo sapiens
gaaauucacugaggccuau

SEQ ID NO: 1404387 - RNA, 19 nt, Homo sapiens
ggaaagagaagacugauca

SEQ ID NO: 1404388 - RNA, 19 nt, Homo sapiens
aaacagguaucucgugauu

SEQ ID NO: 1404389 - RNA, 19 nt, Homo sapiens
caaccaaggcaaugucuua

SEQ ID NO: 1404390 - RNA, 19 nt, Homo sapiens
gaaggaauuugaucauagu

SEQ ID NO: 1404391 - RNA, 19 nt, Homo sapiens
ccaaggcaaugucuuacua

SEQ ID NO: 1404392 - RNA, 19 nt, Homo sapiens
uaaaggagacugaggauga

SEQ ID NO: 1404393 - RNA, 19 nt, Homo sapiens
ggaagacugggacuuguua

SEQ ID NO: 1404394 - RNA, 19 nt, Homo sapiens
ucacauugauucccuuauu

SEQ ID NO: 1404395 - RNA, 19 nt, Homo sapiens
caugaacucuuccgagaaa

SEQ ID NO: 1404396 - RNA, 19 nt, Homo sapiens
gaagcggucucgagcagaa

SEQ ID NO: 1404397 - RNA, 19 nt, Homo sapiens
gaagcccugucuaguguaa

SEQ ID NO: 1404398 - RNA, 19 nt, Homo sapiens
gaagacugaucauuucauc

SEQ ID NO: 1404399 - RNA, 19 nt, Homo sapiens
cagaauaacucuucacaac

SEQ ID NO: 1404400 - RNA, 19 nt, Homo sapiens
ggauaccucuuuucuuuua

SEQ ID NO: 1404401 - RNA, 19 nt, Homo sapiens
ccugaaggauaauuguuua

SEQ ID NO: 1404402 - RNA, 19 nt, Homo sapiens
gaacaucucaccaaugaag

SEQ ID NO: 1404403 - RNA, 19 nt, Homo sapiens
gacugggacuuguuaaauu

SEQ ID NO: 1404404 - RNA, 19 nt, Homo sapiens
gaagaugacagcaccaguu

SEQ ID NO: 1404405 - RNA, 19 nt, Homo sapiens
uugaggagauuaagucuuu

SEQ ID NO: 1404406 - RNA, 19 nt, Homo sapiens
gaauaacucuucacaaccu

SEQ ID NO: 1404407 - RNA, 19 nt, Homo sapiens
aaagaggccuugagaaucu

SEQ ID NO: 1404408 - RNA, 19 nt, Homo sapiens
agagaagacugaucauuuc

SEQ ID NO: 1404409 - RNA, 19 nt, Homo sapiens
gcuauggaaguaaguaaua

SEQ ID NO: 1404410 - RNA, 19 nt, Homo sapiens
acagguaucucgugauuuc

SEQ ID NO: 1404411 - RNA, 19 nt, Homo sapiens
ggaaugcuauggaaguaag

SEQ ID NO: 1404412 - RNA, 19 nt, Homo sapiens
gcagauauuucuacuuuug

SEQ ID NO: 1404413 - RNA, 19 nt, Homo sapiens
ggagacugaggaugauuua

SEQ ID NO: 1404414 - RNA, 19 nt, Homo sapiens
ugaaggaauuugaucauag

SEQ ID NO: 1404415 - RNA, 19 nt, Homo sapiens
gaaaagaggccuugagaau

SEQ ID NO: 1404416 - RNA, 19 nt, Homo sapiens
aagagaagacugaucauuu

SEQ ID NO: 1404417 - RNA, 19 nt, Homo sapiens
gauacaaguugaccuuucu

SEQ ID NO: 1404418 - RNA, 19 nt, Homo sapiens
gugcagggcugagggcuuu

SEQ ID NO: 1404419 - RNA, 19 nt, Homo sapiens
ggaauuugaucauaguaac

SEQ ID NO: 1404420 - RNA, 19 nt, Homo sapiens
ccuugagaaucuaacauua

SEQ ID NO: 1404421 - RNA, 19 nt, Homo sapiens
gaaacacgaagcuaucuca

SEQ ID NO: 1404422 - RNA, 19 nt, Homo sapiens
agacgacacugcacggaaa

SEQ ID NO: 1404423 - RNA, 19 nt, Homo sapiens
gccuggaucuuuccuguug

SEQ ID NO: 1404424 - RNA, 19 nt, Homo sapiens
cuucaaagcagaaauaugu

SEQ ID NO: 1404425 - RNA, 19 nt, Homo sapiens
caaagaagagcaagaagag

SEQ ID NO: 1404426 - RNA, 19 nt, Homo sapiens
gcaugaacuucuagaacau

SEQ ID NO: 1404427 - RNA, 19 nt, Homo sapiens
gaucauaguaacugcaaga

SEQ ID NO: 1404428 - RNA, 19 nt, Homo sapiens
guugcaagcuuggagauga

SEQ ID NO: 1404429 - RNA, 19 nt, Homo sapiens
gacugaggaugauuuacuu

SEQ ID NO: 1404430 - RNA, 19 nt, Homo sapiens
gaacuucuagaacaucuca

SEQ ID NO: 1404431 - RNA, 19 nt, Homo sapiens
gagaugagcaugaacuucu

SEQ ID NO: 1404432 - RNA, 19 nt, Homo sapiens
cagaaaagcuugaggagau

SEQ ID NO: 1404433 - RNA, 19 nt, Homo sapiens
gcuguucucugcugcugaa

SEQ ID NO: 1404434 - RNA, 19 nt, Homo sapiens
ucaaagaagagcaagaaga

SEQ ID NO: 1404435 - RNA, 19 nt, Homo sapiens
cacauugauucccuuauug

SEQ ID NO: 1404436 - RNA, 19 nt, Homo sapiens
gaacagggaagacgacacu

SEQ ID NO: 1404437 - RNA, 19 nt, Homo sapiens
gcucuaguguuugaguaaa

SEQ ID NO: 1404438 - RNA, 19 nt, Homo sapiens
ucagagacagaacagaaua

SEQ ID NO: 1404439 - RNA, 19 nt, Homo sapiens
guaagcagauauuucuacu

SEQ ID NO: 1404440 - RNA, 19 nt, Homo sapiens
gaagccagacagaaauuca

SEQ ID NO: 1404441 - RNA, 19 nt, Homo sapiens
guagauacaaguugaccuu

SEQ ID NO: 1404442 - RNA, 19 nt, Homo sapiens
ccaaggccuuucagacugu

SEQ ID NO: 1404443 - RNA, 19 nt, Homo sapiens
cagaacagaauaacucuuc

SEQ ID NO: 1404444 - RNA, 19 nt, Homo sapiens
ccaaugaagcccugucuag

SEQ ID NO: 1404445 - RNA, 19 nt, Homo sapiens
gcuuggagaugagcaugaa

SEQ ID NO: 1404446 - RNA, 19 nt, Homo sapiens
ugaccugccuggaucuuuc

SEQ ID NO: 1404447 - RNA, 19 nt, Homo sapiens
gugcuuugcucccuguguu

SEQ ID NO: 1404448 - RNA, 19 nt, Homo sapiens
uauggaaguuuggugcuuu

SEQ ID NO: 1404449 - RNA, 19 nt, Homo sapiens
ugagggcuuuacagaaauu

SEQ ID NO: 1404450 - RNA, 19 nt, Homo sapiens
gggcugagggcuuuacaga

SEQ ID NO: 1404451 - RNA, 19 nt, Homo sapiens
gaagacugggacuuguuaa

SEQ ID NO: 1404452 - RNA, 19 nt, Homo sapiens
cauuucaucuucacauaca

SEQ ID NO: 1404453 - RNA, 19 nt, Homo sapiens
ugaauuuaccuauggcauu

SEQ ID NO: 1404454 - RNA, 19 nt, Homo sapiens
cagcucuaguguuugagua

SEQ ID NO: 1404455 - RNA, 19 nt, Homo sapiens
ccagacagaaauucacuga

SEQ ID NO: 1404456 - RNA, 19 nt, Homo sapiens
caaagcagaaauauguaug

SEQ ID NO: 1404457 - RNA, 19 nt, Homo sapiens
gaugacagcaccaguucga

SEQ ID NO: 1404458 - RNA, 19 nt, Homo sapiens
ucuagaacaucucaccaau

SEQ ID NO: 1404459 - RNA, 19 nt, Homo sapiens
agacugaucauuucaucuu

SEQ ID NO: 1404460 - RNA, 19 nt, Homo sapiens
gagaagacugaucauuuca

SEQ ID NO: 1404461 - RNA, 19 nt, Homo sapiens
gcauaguaagcagauauuu

SEQ ID NO: 1404462 - RNA, 19 nt, Homo sapiens
agacagaacagaauaacuc

SEQ ID NO: 1404463 - RNA, 19 nt, Homo sapiens
cagcuccaccugaaggaua

SEQ ID NO: 1404464 - RNA, 19 nt, Homo sapiens
gagcaugaacuucuagaac

SEQ ID NO: 1404465 - RNA, 19 nt, Homo sapiens
cauaguaagcagauauuuc

SEQ ID NO: 1404466 - RNA, 19 nt, Homo sapiens
gguaucucgugauuucaga

SEQ ID NO: 1404467 - RNA, 19 nt, Homo sapiens
cagagacagaacagaauaa

SEQ ID NO: 1404468 - RNA, 19 nt, Homo sapiens
caagccaggagucaaagaa

SEQ ID NO: 1404469 - RNA, 19 nt, Homo sapiens
agcaugaacuucuagaaca

SEQ ID NO: 1404470 - RNA, 19 nt, Homo sapiens
agaugagcaugaacuucua

SEQ ID NO: 1404471 - RNA, 19 nt, Homo sapiens
aaagagaagacugaucauu

SEQ ID NO: 1404472 - RNA, 19 nt, Homo sapiens
gcaagaagagaccuuuuga

SEQ ID NO: 1404473 - RNA, 19 nt, Homo sapiens
acacccacaugaacucuuc

SEQ ID NO: 1404474 - RNA, 19 nt, Homo sapiens
uuggauaccucuuuucuuu

SEQ ID NO: 1404475 - RNA, 19 nt, Homo sapiens
gaagccaaggccuuucaga

SEQ ID NO: 1404476 - RNA, 19 nt, Homo sapiens
aaaggagacugaggaugau

SEQ ID NO: 1404477 - RNA, 19 nt, Homo sapiens
agauacaaguugaccuuuc

SEQ ID NO: 1404478 - RNA, 19 nt, Homo sapiens
gcugaagccagacagaaau

SEQ ID NO: 1404479 - RNA, 19 nt, Homo sapiens
gguuucaucuccgacaaug

SEQ ID NO: 1404480 - RNA, 19 nt, Homo sapiens
gaucauuucaucuucacau

SEQ ID NO: 1404481 - RNA, 19 nt, Homo sapiens
ggacagaaauugugcauuc

SEQ ID NO: 1404482 - RNA, 19 nt, Homo sapiens
aaagaaaucugagcaguua

SEQ ID NO: 1404483 - RNA, 19 nt, Homo sapiens
ugacauggcuagcaacaua

SEQ ID NO: 1404484 - RNA, 19 nt, Homo sapiens
uaucuuggcucacguauuu

SEQ ID NO: 1404485 - RNA, 19 nt, Homo sapiens
gcacaaacaugggucauug

SEQ ID NO: 1404486 - RNA, 19 nt, Homo sapiens
gaaacucacugccuuguuc

SEQ ID NO: 1404487 - RNA, 19 nt, Homo sapiens
ugcagaagcucuuuaauuu

SEQ ID NO: 1404488 - RNA, 19 nt, Homo sapiens
ggacucugguggugacuua

SEQ ID NO: 1404489 - RNA, 19 nt, Homo sapiens
agagagaccuucuuauauu

SEQ ID NO: 1404490 - RNA, 19 nt, Homo sapiens
aaagacaacugguaagauu

SEQ ID NO: 1404491 - RNA, 19 nt, Homo sapiens
cagcaucuguuauuuauug

SEQ ID NO: 1404492 - RNA, 19 nt, Homo sapiens
gacuagcucuugccgauua

SEQ ID NO: 1404493 - RNA, 19 nt, Homo sapiens
gcucuuggcuuaauguuau

SEQ ID NO: 1404494 - RNA, 19 nt, Homo sapiens
gcagaagcucuuuaauuua

SEQ ID NO: 1404495 - RNA, 19 nt, Homo sapiens
ggaagcagcugagaaggaa

SEQ ID NO: 1404496 - RNA, 19 nt, Homo sapiens
gacaacuucuguucuuaua

SEQ ID NO: 1404497 - RNA, 19 nt, Homo sapiens
ugauuuggcucuuggcuua

SEQ ID NO: 1404498 - RNA, 19 nt, Homo sapiens
ggaagugcuuugucuuuga

SEQ ID NO: 1404499 - RNA, 19 nt, Homo sapiens
gagagaccuucuuauauug

SEQ ID NO: 1404500 - RNA, 19 nt, Homo sapiens
gauggaggcucaagagaga

SEQ ID NO: 1404501 - RNA, 19 nt, Homo sapiens
gggauugcauuccugauuu

SEQ ID NO: 1404502 - RNA, 19 nt, Homo sapiens
uuacaaagcugugcuccua

SEQ ID NO: 1404503 - RNA, 19 nt, Homo sapiens
ugugaaaucuuuaguguug

SEQ ID NO: 1404504 - RNA, 19 nt, Homo sapiens
gagagagaccuucuuauau

SEQ ID NO: 1404505 - RNA, 19 nt, Homo sapiens
cuacugagcucaagcaauc

SEQ ID NO: 1404506 - RNA, 19 nt, Homo sapiens
gaaauguguucauguucuu

SEQ ID NO: 1404507 - RNA, 19 nt, Homo sapiens
gcagcagcuuugucuauaa

SEQ ID NO: 1404508 - RNA, 19 nt, Homo sapiens
gaaucugaauccaucauga

SEQ ID NO: 1404509 - RNA, 19 nt, Homo sapiens
agagagagaccuucuuaua

SEQ ID NO: 1404510 - RNA, 19 nt, Homo sapiens
ggaaacaagucagaaguag

SEQ ID NO: 1404511 - RNA, 19 nt, Homo sapiens
gaagguacaagaagaaaug

SEQ ID NO: 1404512 - RNA, 19 nt, Homo sapiens
caucaacaguggagcagua

SEQ ID NO: 1404513 - RNA, 19 nt, Homo sapiens
caacuucuguucuuauauc

SEQ ID NO: 1404514 - RNA, 19 nt, Homo sapiens
gaagagcagcugacaguga

SEQ ID NO: 1404515 - RNA, 19 nt, Homo sapiens
gaaugaacuccuuguaauu

SEQ ID NO: 1404516 - RNA, 19 nt, Homo sapiens
cacaguggcuaaacuaauu

SEQ ID NO: 1404517 - RNA, 19 nt, Homo sapiens
gaaaaggaguuaaggcaaa

SEQ ID NO: 1404518 - RNA, 19 nt, Homo sapiens
gaucguuguuggaugcaua

SEQ ID NO: 1404519 - RNA, 19 nt, Homo sapiens
gugagaacaugugguauuu

SEQ ID NO: 1404520 - RNA, 19 nt, Homo sapiens
aagaagccauuaaccauuu

SEQ ID NO: 1404521 - RNA, 19 nt, Homo sapiens
gagaguguaucaggcauuu

SEQ ID NO: 1404522 - RNA, 19 nt, Homo sapiens
agaaugaacuccuuguaau

SEQ ID NO: 1404523 - RNA, 19 nt, Homo sapiens
ccacauagcugggacuaca

SEQ ID NO: 1404524 - RNA, 19 nt, Homo sapiens
gauuagugaugaugaguga

SEQ ID NO: 1404525 - RNA, 19 nt, Homo sapiens
gccagcaucuguuauuuau

SEQ ID NO: 1404526 - RNA, 19 nt, Homo sapiens
gagaacaugugguauuugg

SEQ ID NO: 1404527 - RNA, 19 nt, Homo sapiens
caaccuacacccucaagua

SEQ ID NO: 1404528 - RNA, 19 nt, Homo sapiens
cauaauacccaauagguuu

SEQ ID NO: 1404529 - RNA, 19 nt, Homo sapiens
cacccuauguccuuuauuu

SEQ ID NO: 1404530 - RNA, 19 nt, Homo sapiens
aagaagaaaugcuuaagga

SEQ ID NO: 1404531 - RNA, 19 nt, Homo sapiens
cuacaaaugacaagcaaua

SEQ ID NO: 1404532 - RNA, 19 nt, Homo sapiens
gaaggaagcagcugagaag

SEQ ID NO: 1404533 - RNA, 19 nt, Homo sapiens
aaacaugccuagagagugu

SEQ ID NO: 1404534 - RNA, 19 nt, Homo sapiens
gugcagaagcucuuuaauu

SEQ ID NO: 1404535 - RNA, 19 nt, Homo sapiens
aagaaaugcuuaaggaaga

SEQ ID NO: 1404536 - RNA, 19 nt, Homo sapiens
cagaggacaugaucuuguu

SEQ ID NO: 1404537 - RNA, 19 nt, Homo sapiens
guacaagaagaaaugcuua

SEQ ID NO: 1404538 - RNA, 19 nt, Homo sapiens
ggacgaagugccagaagaa

SEQ ID NO: 1404539 - RNA, 19 nt, Homo sapiens
ccagcgaguuugcgaguuu

SEQ ID NO: 1404540 - RNA, 19 nt, Homo sapiens
cauuagagauucuugacaa

SEQ ID NO: 1404541 - RNA, 19 nt, Homo sapiens
gaaauugugcauucaagga

SEQ ID NO: 1404542 - RNA, 19 nt, Homo sapiens
caguguauguguuccauuu

SEQ ID NO: 1404543 - RNA, 19 nt, Homo sapiens
uaaugggacugcugaguug

SEQ ID NO: 1404544 - RNA, 19 nt, Homo sapiens
gacaugaucuuguuguuuu

SEQ ID NO: 1404545 - RNA, 19 nt, Homo sapiens
uaagugagaacauguggua

SEQ ID NO: 1404546 - RNA, 19 nt, Homo sapiens
agaguaacccuaagaauga

SEQ ID NO: 1404547 - RNA, 19 nt, Homo sapiens
ucacugccuuguucuguuu

SEQ ID NO: 1404548 - RNA, 19 nt, Homo sapiens
gaaaccggauguuauucau

SEQ ID NO: 1404549 - RNA, 19 nt, Homo sapiens
gcauauaugucuucuuuug

SEQ ID NO: 1404550 - RNA, 19 nt, Homo sapiens
ggacaugaucuuguuguuu

SEQ ID NO: 1404551 - RNA, 19 nt, Homo sapiens
uguguuaguuugcuuauga

SEQ ID NO: 1404552 - RNA, 19 nt, Homo sapiens
cagaaguagugacauuauu

SEQ ID NO: 1404553 - RNA, 19 nt, Homo sapiens
gaauauuccagguaagaaa

SEQ ID NO: 1404554 - RNA, 19 nt, Homo sapiens
uaaaucauauggacgaagu

SEQ ID NO: 1404555 - RNA, 19 nt, Homo sapiens
ggacacaggcuucuuaaaa

SEQ ID NO: 1404556 - RNA, 19 nt, Homo sapiens
cagaaugaacuccuuguaa

SEQ ID NO: 1404557 - RNA, 19 nt, Homo sapiens
ggccuaaacccaguaguua

SEQ ID NO: 1404558 - RNA, 19 nt, Homo sapiens
caccacaucuggccaauag

SEQ ID NO: 1404559 - RNA, 19 nt, Homo sapiens
cauuuagguugauuccuua

SEQ ID NO: 1404560 - RNA, 19 nt, Homo sapiens
gaacaggagcugcuaagag

SEQ ID NO: 1404561 - RNA, 19 nt, Homo sapiens
gguggugacuuauguagau

SEQ ID NO: 1404562 - RNA, 19 nt, Homo sapiens
caugugaaaucuuuagugu

SEQ ID NO: 1404563 - RNA, 19 nt, Homo sapiens
gggaaacaagucagaagua

SEQ ID NO: 1404564 - RNA, 19 nt, Homo sapiens
uuuaagagccugaauauuc

SEQ ID NO: 1404565 - RNA, 19 nt, Homo sapiens
aacaggagcugcuaagaga

SEQ ID NO: 1404566 - RNA, 19 nt, Homo sapiens
ugaaucgucuugcaggaaa

SEQ ID NO: 1404567 - RNA, 19 nt, Homo sapiens
ggauugcauuccugauuug

SEQ ID NO: 1404568 - RNA, 19 nt, Homo sapiens
acaaagcugugcuccuauu

SEQ ID NO: 1404569 - RNA, 19 nt, Homo sapiens
guuguuggaugcauaguug

SEQ ID NO: 1404570 - RNA, 19 nt, Homo sapiens
gcuuccagcuccauccaua

SEQ ID NO: 1404571 - RNA, 19 nt, Homo sapiens
ggguauaugugcagguuug

SEQ ID NO: 1404572 - RNA, 19 nt, Homo sapiens
gaguuucuuuccagacuuu

SEQ ID NO: 1404573 - RNA, 19 nt, Homo sapiens
gagcgaaacuccgucucaa

SEQ ID NO: 1404574 - RNA, 19 nt, Homo sapiens
ugucauugguaguuugaua

SEQ ID NO: 1404575 - RNA, 19 nt, Homo sapiens
aauuagaucuccuuuguca

SEQ ID NO: 1404576 - RNA, 19 nt, Homo sapiens
ggaaaauccuaucucauga

SEQ ID NO: 1404577 - RNA, 19 nt, Homo sapiens
uauaugugcagguuuguua

SEQ ID NO: 1404578 - RNA, 19 nt, Homo sapiens
caacugguaagauuaagaa

SEQ ID NO: 1404579 - RNA, 19 nt, Homo sapiens
aaacggaagugcuuugucu

SEQ ID NO: 1404580 - RNA, 19 nt, Homo sapiens
ccuaaacccaguaguuaua

SEQ ID NO: 1404581 - RNA, 19 nt, Homo sapiens
ggaagaaacuccaaacaca

SEQ ID NO: 1404582 - RNA, 19 nt, Homo sapiens
ggaaauagaugggcaacuu

SEQ ID NO: 1404583 - RNA, 19 nt, Homo sapiens
gaaagaggcacaagugaaa

SEQ ID NO: 1404584 - RNA, 19 nt, Homo sapiens
cagaagaacugaaggcaaa

SEQ ID NO: 1404585 - RNA, 19 nt, Homo sapiens
cauaaucucuucauucaga

SEQ ID NO: 1404586 - RNA, 19 nt, Homo sapiens
ucugagagauuucugcuua

SEQ ID NO: 1404587 - RNA, 19 nt, Homo sapiens
gaagaaagaggcacaagug

SEQ ID NO: 1404588 - RNA, 19 nt, Homo sapiens
gcaagguagugaucaaaga

SEQ ID NO: 1404589 - RNA, 19 nt, Homo sapiens
ugacagaacugacagaucu

SEQ ID NO: 1404590 - RNA, 19 nt, Homo sapiens
guacaauacugugaacaaa

SEQ ID NO: 1404591 - RNA, 19 nt, Homo sapiens
gccauaaucucuucauuca

SEQ ID NO: 1404592 - RNA, 19 nt, Homo sapiens
agacauggcuuuagagauc

SEQ ID NO: 1404593 - RNA, 19 nt, Homo sapiens
caauggaucucgucuaaag

SEQ ID NO: 1404594 - RNA, 19 nt, Homo sapiens
gucaauggaucucgucuaa

SEQ ID NO: 1404595 - RNA, 19 nt, Homo sapiens
caaccagaauucuacauau

SEQ ID NO: 1404596 - RNA, 19 nt, Homo sapiens
gcaaccagaauucuacaua

SEQ ID NO: 1404597 - RNA, 19 nt, Homo sapiens
ugacuuaccugcucaccaa

SEQ ID NO: 1404598 - RNA, 19 nt, Homo sapiens
uaauaacgaugauccaugu

SEQ ID NO: 1404599 - RNA, 19 nt, Homo sapiens
gagauccugucugccauua

SEQ ID NO: 1404600 - RNA, 19 nt, Homo sapiens
gggaaugucugcagcuuca

SEQ ID NO: 1404601 - RNA, 19 nt, Homo sapiens
gaacaagugagacaaaugg

SEQ ID NO: 1404602 - RNA, 19 nt, Homo sapiens
gaaacucacccgaccuuga

SEQ ID NO: 1404603 - RNA, 19 nt, Homo sapiens
ugugagucaugcaauauua

SEQ ID NO: 1404604 - RNA, 19 nt, Homo sapiens
gcuagagccugaauuugug

SEQ ID NO: 1404605 - RNA, 19 nt, Homo sapiens
gagcuucuucccagacuua

SEQ ID NO: 1404606 - RNA, 19 nt, Homo sapiens
gcacuggcacucuuacuga

SEQ ID NO: 1404607 - RNA, 19 nt, Homo sapiens
aauacaggcugaagaaguu

SEQ ID NO: 1404608 - RNA, 19 nt, Homo sapiens
caaaguaacauccuagaca

SEQ ID NO: 1404609 - RNA, 19 nt, Homo sapiens
gcuuaggccuggaaauaga

SEQ ID NO: 1404610 - RNA, 19 nt, Homo sapiens
agaaugauauccagaucuu

SEQ ID NO: 1404611 - RNA, 19 nt, Homo sapiens
ggccuccgcugcauacaaa

SEQ ID NO: 1404612 - RNA, 19 nt, Homo sapiens
ucaaggugcccauaucuuu

SEQ ID NO: 1404613 - RNA, 19 nt, Homo sapiens
uaacgaugauccauguguu

SEQ ID NO: 1404614 - RNA, 19 nt, Homo sapiens
gcagaacgagcaaaugaug

SEQ ID NO: 1404615 - RNA, 19 nt, Homo sapiens
gaucugccuugcauagaga

SEQ ID NO: 1404616 - RNA, 19 nt, Homo sapiens
gaaauagaugggcaacuug

SEQ ID NO: 1404617 - RNA, 19 nt, Homo sapiens
agagaaggcugacaacaag

SEQ ID NO: 1404618 - RNA, 19 nt, Homo sapiens
ccaaaucacacauuaguuc

SEQ ID NO: 1404619 - RNA, 19 nt, Homo sapiens
gaauacaggcugaagaagu

SEQ ID NO: 1404620 - RNA, 19 nt, Homo sapiens
gcaaaugggccagaaagug

SEQ ID NO: 1404621 - RNA, 19 nt, Homo sapiens
gcccagaggacuguuaaua

SEQ ID NO: 1404622 - RNA, 19 nt, Homo sapiens
caucuacggugcagucuca

SEQ ID NO: 1404623 - RNA, 19 nt, Homo sapiens
ggagauagccaaacaaaau

SEQ ID NO: 1404624 - RNA, 19 nt, Homo sapiens
gguccacacugccuuuaug

SEQ ID NO: 1404625 - RNA, 19 nt, Homo sapiens
uugaaacacugccugauga

SEQ ID NO: 1404626 - RNA, 19 nt, Homo sapiens
caagaaugauauccagauc

SEQ ID NO: 1404627 - RNA, 19 nt, Homo sapiens
aauccuaccugaugaacaa

SEQ ID NO: 1404628 - RNA, 19 nt, Homo sapiens
ucaggaagcuuuggagauc

SEQ ID NO: 1404629 - RNA, 19 nt, Homo sapiens
gaagaaacuccaaacacau

SEQ ID NO: 1404630 - RNA, 19 nt, Homo sapiens
gaacccaccagaaggaaga

SEQ ID NO: 1404631 - RNA, 19 nt, Homo sapiens
gcagugaagcagggaauuu

SEQ ID NO: 1404632 - RNA, 19 nt, Homo sapiens
ggauguagaccaaaguuuc

SEQ ID NO: 1404633 - RNA, 19 nt, Homo sapiens
aaacacugccugaugauga

SEQ ID NO: 1404634 - RNA, 19 nt, Homo sapiens
gcugacaacaagaaugaua

SEQ ID NO: 1404635 - RNA, 19 nt, Homo sapiens
gaauuuggauauggugugu

SEQ ID NO: 1404636 - RNA, 19 nt, Homo sapiens
gggcuucucuguugcaucu

SEQ ID NO: 1404637 - RNA, 19 nt, Homo sapiens
gcacagcucagcacaacau

SEQ ID NO: 1404638 - RNA, 19 nt, Homo sapiens
gagcagcaccuuuguguac

SEQ ID NO: 1404639 - RNA, 19 nt, Homo sapiens
ggcaaauccuaccugauga

SEQ ID NO: 1404640 - RNA, 19 nt, Homo sapiens
caacuugucacaccagaug

SEQ ID NO: 1404641 - RNA, 19 nt, Homo sapiens
ccaugugccucaucgagaa

SEQ ID NO: 1404642 - RNA, 19 nt, Homo sapiens
uaagaaccgugacacucaa

SEQ ID NO: 1404643 - RNA, 19 nt, Homo sapiens
aaauggagauagccaaaca

SEQ ID NO: 1404644 - RNA, 19 nt, Homo sapiens
cggcuuuacuuaaggauau

SEQ ID NO: 1404645 - RNA, 19 nt, Homo sapiens
agaaagaauuggagacucu

SEQ ID NO: 1404646 - RNA, 19 nt, Homo sapiens
acacauuaguucugcuuga

SEQ ID NO: 1404647 - RNA, 19 nt, Homo sapiens
gaccaagaacccaccaauu

SEQ ID NO: 1404648 - RNA, 19 nt, Homo sapiens
ugagcuagagccugaauuu

SEQ ID NO: 1404649 - RNA, 19 nt, Homo sapiens
gaaaugcuuuaucuuugac

SEQ ID NO: 1404650 - RNA, 19 nt, Homo sapiens
gcaaauccuaccugaugaa

SEQ ID NO: 1404651 - RNA, 19 nt, Homo sapiens
aaaguaacauccuagacau

SEQ ID NO: 1404652 - RNA, 19 nt, Homo sapiens
uugggacaaucaacauuua

SEQ ID NO: 1404653 - RNA, 19 nt, Homo sapiens
aaaagaaacuguagaccuu

SEQ ID NO: 1404654 - RNA, 19 nt, Homo sapiens
augagcagcugaagguuaa

SEQ ID NO: 1404655 - RNA, 19 nt, Homo sapiens
ccauaucuuucuaguggaa

SEQ ID NO: 1404656 - RNA, 19 nt, Homo sapiens
ggaacaagugagacaaaug

SEQ ID NO: 1404657 - RNA, 19 nt, Homo sapiens
ccaaggagucugugaguca

SEQ ID NO: 1404658 - RNA, 19 nt, Homo sapiens
gcaacaagugacagaauuc

SEQ ID NO: 1404659 - RNA, 19 nt, Homo sapiens
caucccaacuggccaaauc

SEQ ID NO: 1404660 - RNA, 19 nt, Homo sapiens
caagggaauuuggauaugg

SEQ ID NO: 1404661 - RNA, 19 nt, Homo sapiens
caaaucaggcaaccagaau

SEQ ID NO: 1404662 - RNA, 19 nt, Homo sapiens
ccaaacacauccgaacauc

SEQ ID NO: 1404663 - RNA, 19 nt, Homo sapiens
cagugaagcagggaauuua

SEQ ID NO: 1404664 - RNA, 19 nt, Homo sapiens
gaaagaauuggagacucua

SEQ ID NO: 1404665 - RNA, 19 nt, Homo sapiens
ucaaggauguagaccaaag

SEQ ID NO: 1404666 - RNA, 19 nt, Homo sapiens
agaauucuguuccuacauc

SEQ ID NO: 1404667 - RNA, 19 nt, Homo sapiens
gcucaaggcaagaaacuca

SEQ ID NO: 1404668 - RNA, 19 nt, Homo sapiens
uagagaaggcugacaacaa

SEQ ID NO: 1404669 - RNA, 19 nt, Homo sapiens
gggacaaucaacauuuaaa

SEQ ID NO: 1404670 - RNA, 19 nt, Homo sapiens
cccagaggacuguuaauaa

SEQ ID NO: 1404671 - RNA, 19 nt, Homo sapiens
ggaucugccuugcauagag

SEQ ID NO: 1404672 - RNA, 19 nt, Homo sapiens
ugcaacaagugacagaauu

SEQ ID NO: 1404673 - RNA, 19 nt, Homo sapiens
aaagcaagguagugaucaa

SEQ ID NO: 1404674 - RNA, 19 nt, Homo sapiens
gacuuaguguggacucuga

SEQ ID NO: 1404675 - RNA, 19 nt, Homo sapiens
uggcaaauccuaccugaug

SEQ ID NO: 1404676 - RNA, 19 nt, Homo sapiens
ucagggugcuaucgaccua

SEQ ID NO: 1404677 - RNA, 19 nt, Homo sapiens
uuacugagcagcaccuuug

SEQ ID NO: 1404678 - RNA, 19 nt, Homo sapiens
gcuaauuguuguagaucau

SEQ ID NO: 1404679 - RNA, 19 nt, Homo sapiens
gaacugaaggcaaaguacu

SEQ ID NO: 1404680 - RNA, 19 nt, Homo sapiens
gaugaauaccuggagaauu

SEQ ID NO: 1404681 - RNA, 19 nt, Homo sapiens
acaaacaccugaaauguaa

SEQ ID NO: 1404682 - RNA, 19 nt, Homo sapiens
ccagagaaaucuaugaauu

SEQ ID NO: 1404683 - RNA, 19 nt, Homo sapiens
aaacgugacccucauguua

SEQ ID NO: 1404684 - RNA, 19 nt, Homo sapiens
gauagcaccugagacagua

SEQ ID NO: 1404685 - RNA, 19 nt, Homo sapiens
gcagcauggugauucauuu

SEQ ID NO: 1404686 - RNA, 19 nt, Homo sapiens
gcaagagacauuuguguga

SEQ ID NO: 1404687 - RNA, 19 nt, Homo sapiens
ccaguuagcucagauagca

SEQ ID NO: 1404688 - RNA, 19 nt, Homo sapiens
guacaaacaccugaaaugu

SEQ ID NO: 1404689 - RNA, 19 nt, Homo sapiens
cagauuacuuugugauugu

SEQ ID NO: 1404690 - RNA, 19 nt, Homo sapiens
ccagguuccuccagaaaug

SEQ ID NO: 1404691 - RNA, 19 nt, Homo sapiens
gauaugaugguuucacuuc

SEQ ID NO: 1404692 - RNA, 19 nt, Homo sapiens
gauccagguuccuccagaa

SEQ ID NO: 1404693 - RNA, 19 nt, Homo sapiens
caagagacauuugugugau

SEQ ID NO: 1404694 - RNA, 19 nt, Homo sapiens
uauggacccuacguucuua

SEQ ID NO: 1404695 - RNA, 19 nt, Homo sapiens
gcauggugauucauuugau

SEQ ID NO: 1404696 - RNA, 19 nt, Homo sapiens
acagauuacuuugugauug

SEQ ID NO: 1404697 - RNA, 19 nt, Homo sapiens
gacccuacguucuuaugau

SEQ ID NO: 1404698 - RNA, 19 nt, Homo sapiens
ucauacuggucccaaguuu

SEQ ID NO: 1404699 - RNA, 19 nt, Homo sapiens
gaagggaaggacacugaug

SEQ ID NO: 1404700 - RNA, 19 nt, Homo sapiens
gaaaccagagaaaucuaug

SEQ ID NO: 1404701 - RNA, 19 nt, Homo sapiens
ugacccucauguuaagaua

SEQ ID NO: 1404702 - RNA, 19 nt, Homo sapiens
acgcaaggcugcugcuaug

SEQ ID NO: 1404703 - RNA, 19 nt, Homo sapiens
gaacuucuacccgacacuu

SEQ ID NO: 1404704 - RNA, 19 nt, Homo sapiens
gaugaccaguuagcucaga

SEQ ID NO: 1404705 - RNA, 19 nt, Homo sapiens
gaaauuauggacccuacgu

SEQ ID NO: 1404706 - RNA, 19 nt, Homo sapiens
caacgagggacgcccagaa

SEQ ID NO: 1404707 - RNA, 19 nt, Homo sapiens
ggacccuacguucuuauga

SEQ ID NO: 1404708 - RNA, 19 nt, Homo sapiens
uagaagggaaggacacuga

SEQ ID NO: 1404709 - RNA, 19 nt, Homo sapiens
cauggugauucauuugaug

SEQ ID NO: 1404710 - RNA, 19 nt, Homo sapiens
auacuggucccaaguuuga

SEQ ID NO: 1404711 - RNA, 19 nt, Homo sapiens
gaucauacuggucccaagu

SEQ ID NO: 1404712 - RNA, 19 nt, Homo sapiens
ccagaaaccagagaaaucu

SEQ ID NO: 1404713 - RNA, 19 nt, Homo sapiens
cauuugaugcuuccagaaa

SEQ ID NO: 1404714 - RNA, 19 nt, Homo sapiens
ggccuucuacguugugaaa

SEQ ID NO: 1404715 - RNA, 19 nt, Homo sapiens
uaugaugguuucacuucug

SEQ ID NO: 1404716 - RNA, 19 nt, Homo sapiens
guucuuaugaugaccaguu

SEQ ID NO: 1404717 - RNA, 19 nt, Homo sapiens
caaguuugacaucgauaug

SEQ ID NO: 1404718 - RNA, 19 nt, Homo sapiens
ggaauagaagaugauacuu

SEQ ID NO: 1404719 - RNA, 19 nt, Homo sapiens
agacaguaccugaagacuu

SEQ ID NO: 1404720 - RNA, 19 nt, Homo sapiens
ggacgcggcagaucauacu

SEQ ID NO: 1404721 - RNA, 19 nt, Homo sapiens
aacgugacccucauguuaa

SEQ ID NO: 1404722 - RNA, 19 nt, Homo sapiens
uaaacgugacccucauguu

SEQ ID NO: 1404723 - RNA, 19 nt, Homo sapiens
guaaacgugacccucaugu

SEQ ID NO: 1404724 - RNA, 19 nt, Homo sapiens
ugccauggccuucuacguu

SEQ ID NO: 1404725 - RNA, 19 nt, Homo sapiens
ccagaaaugagauauacag

SEQ ID NO: 1404726 - RNA, 19 nt, Homo sapiens
aaaccagagaaaucuauga

SEQ ID NO: 1404727 - RNA, 19 nt, Homo sapiens
cagaaaccagagaaaucua

SEQ ID NO: 1404728 - RNA, 19 nt, Homo sapiens
ggugauucauuugaugcuu

SEQ ID NO: 1404729 - RNA, 19 nt, Homo sapiens
cagcauggugauucauuug

SEQ ID NO: 1404730 - RNA, 19 nt, Homo sapiens
uguacaaacaccugaaaug

SEQ ID NO: 1404731 - RNA, 19 nt, Homo sapiens
ccaaguuugacaucgauau

SEQ ID NO: 1404732 - RNA, 19 nt, Homo sapiens
agaaaccagagaaaucuau

SEQ ID NO: 1404733 - RNA, 19 nt, Homo sapiens
gacgcaaggcugcugcuau

SEQ ID NO: 1404734 - RNA, 19 nt, Homo sapiens
aagggaaggacacugauga

SEQ ID NO: 1404735 - RNA, 19 nt, Homo sapiens
cagaaaugagauauacaga

SEQ ID NO: 1404736 - RNA, 19 nt, Homo sapiens
cuccagaaaugagauauac

SEQ ID NO: 1404737 - RNA, 19 nt, Homo sapiens
aagagacauuugugugauc

SEQ ID NO: 1404738 - RNA, 19 nt, Homo sapiens
ugaccaguuagcucagaua

SEQ ID NO: 1404739 - RNA, 19 nt, Homo sapiens
uucuuaugaugaccaguua

SEQ ID NO: 1404740 - RNA, 19 nt, Homo sapiens
ggcagcauggugauucauu

SEQ ID NO: 1404741 - RNA, 19 nt, Homo sapiens
ccuccagaaaugagauaua

SEQ ID NO: 1404742 - RNA, 19 nt, Homo sapiens
aaccagagaaaucuaugaa

SEQ ID NO: 1404743 - RNA, 19 nt, Homo sapiens
acccucauguuaagauaga

SEQ ID NO: 1404744 - RNA, 19 nt, Homo sapiens
gaacacagcuucuaaagug

SEQ ID NO: 1404745 - RNA, 19 nt, Homo sapiens
gcuaaacccuguucuaaua

SEQ ID NO: 1404746 - RNA, 19 nt, Homo sapiens
gagauuaugucuacguuua

SEQ ID NO: 1404747 - RNA, 19 nt, Homo sapiens
ggaggaagaucagcaaaua

SEQ ID NO: 1404748 - RNA, 19 nt, Homo sapiens
gaaaugacccugaauguga

SEQ ID NO: 1404749 - RNA, 19 nt, Homo sapiens
caacagauaugauggcauu

SEQ ID NO: 1404750 - RNA, 19 nt, Homo sapiens
caaauaugcuccugaagaa

SEQ ID NO: 1404751 - RNA, 19 nt, Homo sapiens
ccaaagagaacacaaauaa

SEQ ID NO: 1404752 - RNA, 19 nt, Homo sapiens
gaaauuaccacauugaaga

SEQ ID NO: 1404753 - RNA, 19 nt, Homo sapiens
uaacgucucuucuuccauu

SEQ ID NO: 1404754 - RNA, 19 nt, Homo sapiens
guacaaagcaucagauuca

SEQ ID NO: 1404755 - RNA, 19 nt, Homo sapiens
gcaaauaugcuccugaaga

SEQ ID NO: 1404756 - RNA, 19 nt, Homo sapiens
ggaucaacuuggagauuua

SEQ ID NO: 1404757 - RNA, 19 nt, Homo sapiens
cuacacagauugaggcuaa

SEQ ID NO: 1404758 - RNA, 19 nt, Homo sapiens
gaaauugcuucauauugug

SEQ ID NO: 1404759 - RNA, 19 nt, Homo sapiens
ccacauagccaucaucuug

SEQ ID NO: 1404760 - RNA, 19 nt, Homo sapiens
gaagugcuuucacaucuug

SEQ ID NO: 1404761 - RNA, 19 nt, Homo sapiens
gaugaugacuguccaagug

SEQ ID NO: 1404762 - RNA, 19 nt, Homo sapiens
gcaaagaugccgucagcua

SEQ ID NO: 1404763 - RNA, 19 nt, Homo sapiens
caaauaaauuggacagugu

SEQ ID NO: 1404764 - RNA, 19 nt, Homo sapiens
cacaaugucuguaaagauu

SEQ ID NO: 1404765 - RNA, 19 nt, Homo sapiens
gcaaguugacuacuaauga

SEQ ID NO: 1404766 - RNA, 19 nt, Homo sapiens
aagaagagaugauguugaa

SEQ ID NO: 1404767 - RNA, 19 nt, Homo sapiens
gaaguauucuaaacuguuc

SEQ ID NO: 1404768 - RNA, 19 nt, Homo sapiens
uguaaaggcuggugaaaga

SEQ ID NO: 1404769 - RNA, 19 nt, Homo sapiens
gauccuggcuuuggaauau

SEQ ID NO: 1404770 - RNA, 19 nt, Homo sapiens
guacuauugucccuucuaa

SEQ ID NO: 1404771 - RNA, 19 nt, Homo sapiens
gaauggcaguucuuguaaa

SEQ ID NO: 1404772 - RNA, 19 nt, Homo sapiens
gcaacuaccucaggacaga

SEQ ID NO: 1404773 - RNA, 19 nt, Homo sapiens
gauguuggacugaaugaua

SEQ ID NO: 1404774 - RNA, 19 nt, Homo sapiens
gaugaagucuugacagagu

SEQ ID NO: 1404775 - RNA, 19 nt, Homo sapiens
gguauuguccuucuuguaa

SEQ ID NO: 1404776 - RNA, 19 nt, Homo sapiens
gaucuuagaccacgagcua

SEQ ID NO: 1404777 - RNA, 19 nt, Homo sapiens
ucaaggagauuaugucuac

SEQ ID NO: 1404778 - RNA, 19 nt, Homo sapiens
ggugaaagacucaagauga

SEQ ID NO: 1404779 - RNA, 19 nt, Homo sapiens
gaagaaggcaacagauaug

SEQ ID NO: 1404780 - RNA, 19 nt, Homo sapiens
cgaagcagguguucacaga

SEQ ID NO: 1404781 - RNA, 19 nt, Homo sapiens
gggcugugcugaccuuuga

SEQ ID NO: 1404782 - RNA, 19 nt, Homo sapiens
gaaugaacacagcuucuaa

SEQ ID NO: 1404783 - RNA, 19 nt, Homo sapiens
gcgcagacauggccucuuc

SEQ ID NO: 1404784 - RNA, 19 nt, Homo sapiens
ccaagugccuccaaagugu

SEQ ID NO: 1404785 - RNA, 19 nt, Homo sapiens
gaaauacuggccagagauu

SEQ ID NO: 1404786 - RNA, 19 nt, Homo sapiens
gggaauggcuuguguuggu

SEQ ID NO: 1404787 - RNA, 19 nt, Homo sapiens
aagcauaaauccaaagaga

SEQ ID NO: 1404788 - RNA, 19 nt, Homo sapiens
guaagaggcccauuucuca

SEQ ID NO: 1404789 - RNA, 19 nt, Homo sapiens
gcagguuacccuucagaua

SEQ ID NO: 1404790 - RNA, 19 nt, Homo sapiens
ggccagagauuucaucaag

SEQ ID NO: 1404791 - RNA, 19 nt, Homo sapiens
agaaagcgguacucuagaa

SEQ ID NO: 1404792 - RNA, 19 nt, Homo sapiens
ggaaaugacacuugagauc

SEQ ID NO: 1404793 - RNA, 19 nt, Homo sapiens
aaacugugaugcuccauug

SEQ ID NO: 1404794 - RNA, 19 nt, Homo sapiens
guauucauaugcucuaguu

SEQ ID NO: 1404795 - RNA, 19 nt, Homo sapiens
aaagguaguuccuguaaca

SEQ ID NO: 1404796 - RNA, 19 nt, Homo sapiens
cagguuacccuucagauaa

SEQ ID NO: 1404797 - RNA, 19 nt, Homo sapiens
gaaggcaacagauaugaug

SEQ ID NO: 1404798 - RNA, 19 nt, Homo sapiens
gcagaaauuaccacauuga

SEQ ID NO: 1404799 - RNA, 19 nt, Homo sapiens
cauaugcucuaguuguaaa

SEQ ID NO: 1404800 - RNA, 19 nt, Homo sapiens
ggaaugaacacagcuucua

SEQ ID NO: 1404801 - RNA, 19 nt, Homo sapiens
gagcagagucucggaauug

SEQ ID NO: 1404802 - RNA, 19 nt, Homo sapiens
ggagcagagucucggaauu

SEQ ID NO: 1404803 - RNA, 19 nt, Homo sapiens
gaagaaaugguggacugua

SEQ ID NO: 1404804 - RNA, 19 nt, Homo sapiens
ugaccgaggugaugaguuc

SEQ ID NO: 1404805 - RNA, 19 nt, Homo sapiens
ggaauucauggucgaagua

SEQ ID NO: 1404806 - RNA, 19 nt, Homo sapiens
acaaagaggauucugguuu

SEQ ID NO: 1404807 - RNA, 19 nt, Homo sapiens
uaugcaaguugacuacuaa

SEQ ID NO: 1404808 - RNA, 19 nt, Homo sapiens
cagauaugauggcauuuau

SEQ ID NO: 1404809 - RNA, 19 nt, Homo sapiens
uguacuggcugguggauuu

SEQ ID NO: 1404810 - RNA, 19 nt, Homo sapiens
acacacugccucccaaaua

SEQ ID NO: 1404811 - RNA, 19 nt, Homo sapiens
ccucagcucuaguugauau

SEQ ID NO: 1404812 - RNA, 19 nt, Homo sapiens
acgaugaucugccugcuuu

SEQ ID NO: 1404813 - RNA, 19 nt, Homo sapiens
ggccagaauuacaucauga

SEQ ID NO: 1404814 - RNA, 19 nt, Homo sapiens
ggaauagaacggucaagga

SEQ ID NO: 1404815 - RNA, 19 nt, Homo sapiens
gagagaauguacuauuguc

SEQ ID NO: 1404816 - RNA, 19 nt, Homo sapiens
acaugcagcuucuguguga

SEQ ID NO: 1404817 - RNA, 19 nt, Homo sapiens
ccagaaagcgguacucuag

SEQ ID NO: 1404818 - RNA, 19 nt, Homo sapiens
caucuuguguguguaguaa

SEQ ID NO: 1404819 - RNA, 19 nt, Homo sapiens
gaagacguuauuuaccaua

SEQ ID NO: 1404820 - RNA, 19 nt, Homo sapiens
aaacuccacugaagaaugg

SEQ ID NO: 1404821 - RNA, 19 nt, Homo sapiens
gcucgugcccgucuuauug

SEQ ID NO: 1404822 - RNA, 19 nt, Homo sapiens
gauacagguucgcaccauu

SEQ ID NO: 1404823 - RNA, 19 nt, Homo sapiens
gccaucaucuugugugugu

SEQ ID NO: 1404824 - RNA, 19 nt, Homo sapiens
ggaauuggagagcugguaa

SEQ ID NO: 1404825 - RNA, 19 nt, Homo sapiens
ugacagaguuaugaauaug

SEQ ID NO: 1404826 - RNA, 19 nt, Homo sapiens
gaaagcgguacucuagaaa

SEQ ID NO: 1404827 - RNA, 19 nt, Homo sapiens
ggucgucucuccucaaguc

SEQ ID NO: 1404828 - RNA, 19 nt, Homo sapiens
gugaaauacuggccagaga

SEQ ID NO: 1404829 - RNA, 19 nt, Homo sapiens
guauuguccuucuuguaaa

SEQ ID NO: 1404830 - RNA, 19 nt, Homo sapiens
guaauguggcuuaucauau

SEQ ID NO: 1404831 - RNA, 19 nt, Homo sapiens
gaacuucgugugaaaauuu

SEQ ID NO: 1404832 - RNA, 19 nt, Homo sapiens
agaaaugaaugucaaggau

SEQ ID NO: 1404833 - RNA, 19 nt, Homo sapiens
cuaaaggacagucaaagaa

SEQ ID NO: 1404834 - RNA, 19 nt, Homo sapiens
agacauggccucuuccuau

SEQ ID NO: 1404835 - RNA, 19 nt, Homo sapiens
cggaugaagucuugacaga

SEQ ID NO: 1404836 - RNA, 19 nt, Homo sapiens
cagaagaggaauacuggua

SEQ ID NO: 1404837 - RNA, 19 nt, Homo sapiens
aauguaauguggcuuauca

SEQ ID NO: 1404838 - RNA, 19 nt, Homo sapiens
gcgguacucuagaaaugaa

SEQ ID NO: 1404839 - RNA, 19 nt, Homo sapiens
cuucuaaagugugcauaua

SEQ ID NO: 1404840 - RNA, 19 nt, Homo sapiens
ugaagcagcuaauccucuu

SEQ ID NO: 1404841 - RNA, 19 nt, Homo sapiens
ggcaugaucuuggccagaa

SEQ ID NO: 1404842 - RNA, 19 nt, Homo sapiens
ugaagaaggcaacagauau

SEQ ID NO: 1404843 - RNA, 19 nt, Homo sapiens
gugccugguucuuguaauu

SEQ ID NO: 1404844 - RNA, 19 nt, Homo sapiens
gaacacagcuucuaaagug

SEQ ID NO: 1404845 - RNA, 19 nt, Homo sapiens
gcuaaacccuguucuaaua

SEQ ID NO: 1404846 - RNA, 19 nt, Homo sapiens
gagauuaugucuacguuua

SEQ ID NO: 1404847 - RNA, 19 nt, Homo sapiens
ggaggaagaucagcaaaua

SEQ ID NO: 1404848 - RNA, 19 nt, Homo sapiens
gaaaugacccugaauguga

SEQ ID NO: 1404849 - RNA, 19 nt, Homo sapiens
caacagauaugauggcauu

SEQ ID NO: 1404850 - RNA, 19 nt, Homo sapiens
caaauaugcuccugaagaa

SEQ ID NO: 1404851 - RNA, 19 nt, Homo sapiens
ccaaagagaacacaaauaa

SEQ ID NO: 1404852 - RNA, 19 nt, Homo sapiens
gaaauuaccacauugaaga

SEQ ID NO: 1404853 - RNA, 19 nt, Homo sapiens
uaacgucucuucuuccauu

SEQ ID NO: 1404854 - RNA, 19 nt, Homo sapiens
guacaaagcaucagauuca

SEQ ID NO: 1404855 - RNA, 19 nt, Homo sapiens
gcaaauaugcuccugaaga

SEQ ID NO: 1404856 - RNA, 19 nt, Homo sapiens
ggaucaacuuggagauuua

SEQ ID NO: 1404857 - RNA, 19 nt, Homo sapiens
cuacacagauugaggcuaa

SEQ ID NO: 1404858 - RNA, 19 nt, Homo sapiens
gaaauugcuucauauugug

SEQ ID NO: 1404859 - RNA, 19 nt, Homo sapiens
ccacauagccaucaucuug

SEQ ID NO: 1404860 - RNA, 19 nt, Homo sapiens
gaagugcuuucacaucuug

SEQ ID NO: 1404861 - RNA, 19 nt, Homo sapiens
gaugaugacuguccaagug

SEQ ID NO: 1404862 - RNA, 19 nt, Homo sapiens
gcaaagaugccgucagcua

SEQ ID NO: 1404863 - RNA, 19 nt, Homo sapiens
caaauaaauuggacagugu

SEQ ID NO: 1404864 - RNA, 19 nt, Homo sapiens
cacaaugucuguaaagauu

SEQ ID NO: 1404865 - RNA, 19 nt, Homo sapiens
gcaaguugacuacuaauga

SEQ ID NO: 1404866 - RNA, 19 nt, Homo sapiens
aagaagagaugauguugaa

SEQ ID NO: 1404867 - RNA, 19 nt, Homo sapiens
uguaaaggcuggugaaaga

SEQ ID NO: 1404868 - RNA, 19 nt, Homo sapiens
gauccuggcuuuggaauau

SEQ ID NO: 1404869 - RNA, 19 nt, Homo sapiens
guacuauugucccuucuaa

SEQ ID NO: 1404870 - RNA, 19 nt, Homo sapiens
gaauggcaguucuuguaaa

SEQ ID NO: 1404871 - RNA, 19 nt, Homo sapiens
gcaacuaccucaggacaga

SEQ ID NO: 1404872 - RNA, 19 nt, Homo sapiens
gauguuggacugaaugaua

SEQ ID NO: 1404873 - RNA, 19 nt, Homo sapiens
gguauuguccuucuuguaa

SEQ ID NO: 1404874 - RNA, 19 nt, Homo sapiens
gaucuuagaccacgagcua

SEQ ID NO: 1404875 - RNA, 19 nt, Homo sapiens
ucaaggagauuaugucuac

SEQ ID NO: 1404876 - RNA, 19 nt, Homo sapiens
ggugaaagacucaagauga

SEQ ID NO: 1404877 - RNA, 19 nt, Homo sapiens
gaagaaggcaacagauaug

SEQ ID NO: 1404878 - RNA, 19 nt, Homo sapiens
cgaagcagguguucacaga

SEQ ID NO: 1404879 - RNA, 19 nt, Homo sapiens
gggcugugcugaccuuuga

SEQ ID NO: 1404880 - RNA, 19 nt, Homo sapiens
gaaugaacacagcuucuaa

SEQ ID NO: 1404881 - RNA, 19 nt, Homo sapiens
gcgcagacauggccucuuc

SEQ ID NO: 1404882 - RNA, 19 nt, Homo sapiens
ccaagugccuccaaagugu

SEQ ID NO: 1404883 - RNA, 19 nt, Homo sapiens
gaaauacuggccagagauu

SEQ ID NO: 1404884 - RNA, 19 nt, Homo sapiens
gggaauggcuuguguuggu

SEQ ID NO: 1404885 - RNA, 19 nt, Homo sapiens
aagcauaaauccaaagaga

SEQ ID NO: 1404886 - RNA, 19 nt, Homo sapiens
guaagaggcccauuucuca

SEQ ID NO: 1404887 - RNA, 19 nt, Homo sapiens
gcagguuacccuucagaua

SEQ ID NO: 1404888 - RNA, 19 nt, Homo sapiens
ggccagagauuucaucaag

SEQ ID NO: 1404889 - RNA, 19 nt, Homo sapiens
agaaagcgguacucuagaa

SEQ ID NO: 1404890 - RNA, 19 nt, Homo sapiens
cgaccgaggugaugaguuc

SEQ ID NO: 1404891 - RNA, 19 nt, Homo sapiens
ggaaaugacacuugagauc

SEQ ID NO: 1404892 - RNA, 19 nt, Homo sapiens
aaacugugaugcuccauug

SEQ ID NO: 1404893 - RNA, 19 nt, Homo sapiens
guauucauaugcucuaguu

SEQ ID NO: 1404894 - RNA, 19 nt, Homo sapiens
aaagguaguuccuguaaca

SEQ ID NO: 1404895 - RNA, 19 nt, Homo sapiens
cagguuacccuucagauaa

SEQ ID NO: 1404896 - RNA, 19 nt, Homo sapiens
gaaggcaacagauaugaug

SEQ ID NO: 1404897 - RNA, 19 nt, Homo sapiens
gcagaaauuaccacauuga

SEQ ID NO: 1404898 - RNA, 19 nt, Homo sapiens
cauaugcucuaguuguaaa

SEQ ID NO: 1404899 - RNA, 19 nt, Homo sapiens
ggaaugaacacagcuucua

SEQ ID NO: 1404900 - RNA, 19 nt, Homo sapiens
gagcagagucucggaauug

SEQ ID NO: 1404901 - RNA, 19 nt, Homo sapiens
ggagcagagucucggaauu

SEQ ID NO: 1404902 - RNA, 19 nt, Homo sapiens
gaagaaaugguggacugua

SEQ ID NO: 1404903 - RNA, 19 nt, Homo sapiens
ggaauucauggucgaagua

SEQ ID NO: 1404904 - RNA, 19 nt, Homo sapiens
acaaagaggauucugguuu

SEQ ID NO: 1404905 - RNA, 19 nt, Homo sapiens
uaugcaaguugacuacuaa

SEQ ID NO: 1404906 - RNA, 19 nt, Homo sapiens
cagauaugauggcauuuau

SEQ ID NO: 1404907 - RNA, 19 nt, Homo sapiens
uguacuggcugguggauuu

SEQ ID NO: 1404908 - RNA, 19 nt, Homo sapiens
acacacugccucccaaaua

SEQ ID NO: 1404909 - RNA, 19 nt, Homo sapiens
ccucagcucuaguugauau

SEQ ID NO: 1404910 - RNA, 19 nt, Homo sapiens
acgaugaucugccugcuuu

SEQ ID NO: 1404911 - RNA, 19 nt, Homo sapiens
ggccagaauuacaucauga

SEQ ID NO: 1404912 - RNA, 19 nt, Homo sapiens
ggaauagaacggucaagga

SEQ ID NO: 1404913 - RNA, 19 nt, Homo sapiens
gagagaauguacuauuguc

SEQ ID NO: 1404914 - RNA, 19 nt, Homo sapiens
acaugcagcuucuguguga

SEQ ID NO: 1404915 - RNA, 19 nt, Homo sapiens
ccagaaagcgguacucuag

SEQ ID NO: 1404916 - RNA, 19 nt, Homo sapiens
caucuuguguguguaguaa

SEQ ID NO: 1404917 - RNA, 19 nt, Homo sapiens
gaagacguuauuuaccaua

SEQ ID NO: 1404918 - RNA, 19 nt, Homo sapiens
aaacuccacugaagaaugg

SEQ ID NO: 1404919 - RNA, 19 nt, Homo sapiens
gcucgugcccgucuuauug

SEQ ID NO: 1404920 - RNA, 19 nt, Homo sapiens
gccaucaucuugugugugu

SEQ ID NO: 1404921 - RNA, 19 nt, Homo sapiens
gauacagguucgcaccauu

SEQ ID NO: 1404922 - RNA, 19 nt, Homo sapiens
ggaauuggagagcugguaa

SEQ ID NO: 1404923 - RNA, 19 nt, Homo sapiens
ggucgucucuccucaaguc

SEQ ID NO: 1404924 - RNA, 19 nt, Homo sapiens
gaaagcgguacucuagaaa

SEQ ID NO: 1404925 - RNA, 19 nt, Homo sapiens
gugaaauacuggccagaga

SEQ ID NO: 1404926 - RNA, 19 nt, Homo sapiens
guauuguccuucuuguaaa

SEQ ID NO: 1404927 - RNA, 19 nt, Homo sapiens
guaauguggcuuaucauau

SEQ ID NO: 1404928 - RNA, 19 nt, Homo sapiens
gaacuucgugugaaaauuu

SEQ ID NO: 1404929 - RNA, 19 nt, Homo sapiens
agaaaugaaugucaaggau

SEQ ID NO: 1404930 - RNA, 19 nt, Homo sapiens
cuaaaggacagucaaagaa

SEQ ID NO: 1404931 - RNA, 19 nt, Homo sapiens
agacauggccucuuccuau

SEQ ID NO: 1404932 - RNA, 19 nt, Homo sapiens
cagaagaggaauacuggua

SEQ ID NO: 1404933 - RNA, 19 nt, Homo sapiens
aauguaauguggcuuauca

SEQ ID NO: 1404934 - RNA, 19 nt, Homo sapiens
gcgguacucuagaaaugaa

SEQ ID NO: 1404935 - RNA, 19 nt, Homo sapiens
cuucuaaagugugcauaua

SEQ ID NO: 1404936 - RNA, 19 nt, Homo sapiens
ugaagcagcuaauccucuu

SEQ ID NO: 1404937 - RNA, 19 nt, Homo sapiens
ggcaugaucuuggccagaa

SEQ ID NO: 1404938 - RNA, 19 nt, Homo sapiens
ugaagaaggcaacagauau

SEQ ID NO: 1404939 - RNA, 19 nt, Homo sapiens
gugccugguucuuguaauu

SEQ ID NO: 1404940 - RNA, 19 nt, Homo sapiens
aagaaaugguggacuguau

SEQ ID NO: 1404941 - RNA, 19 nt, Homo sapiens
aaaggccaauuucagauga

SEQ ID NO: 1404942 - RNA, 19 nt, Homo sapiens
aaaucuugcugguaacaaa

SEQ ID NO: 1404943 - RNA, 19 nt, Homo sapiens
uggaucaacuuggagauuu

SEQ ID NO: 1404944 - RNA, 19 nt, Homo sapiens
gaacacagccuggauaugu

SEQ ID NO: 1404945 - RNA, 19 nt, Homo sapiens
ggaugaagaugagcuguaa

SEQ ID NO: 1404946 - RNA, 19 nt, Homo sapiens
gaaaagugcuggcaaaaug

SEQ ID NO: 1404947 - RNA, 19 nt, Homo sapiens
gaagaaggcucuggaaagg

SEQ ID NO: 1404948 - RNA, 19 nt, Homo sapiens
ggagaugguuggaucauuc

SEQ ID NO: 1404949 - RNA, 19 nt, Homo sapiens
gcaccgagacuauuucuug

SEQ ID NO: 1404950 - RNA, 19 nt, Homo sapiens
ggagggauaucaacuugga

SEQ ID NO: 1404951 - RNA, 19 nt, Homo sapiens
gcauguggcucagaucuug

SEQ ID NO: 1404952 - RNA, 19 nt, Homo sapiens
guauguauguccugaguga

SEQ ID NO: 1404953 - RNA, 19 nt, Homo sapiens
gagaggagcugccggaacu

SEQ ID NO: 1404954 - RNA, 19 nt, Homo sapiens
cccaagcgcugcaacgaua

SEQ ID NO: 1404955 - RNA, 19 nt, Homo sapiens
gagcaaaucaucaucuuca

SEQ ID NO: 1404956 - RNA, 19 nt, Homo sapiens
caauagagcugggauggau

SEQ ID NO: 1404957 - RNA, 19 nt, Homo sapiens
gaacgaccuccucaucaaa

SEQ ID NO: 1404958 - RNA, 19 nt, Homo sapiens
agaauaagcccaagucaga

SEQ ID NO: 1404959 - RNA, 19 nt, Homo sapiens
gcauugcagucacccauug

SEQ ID NO: 1404960 - RNA, 19 nt, Homo sapiens
gaauucggcuuggagauca

SEQ ID NO: 1404961 - RNA, 19 nt, Homo sapiens
gauggauacugcagaccua

SEQ ID NO: 1404962 - RNA, 19 nt, Homo sapiens
gaauauccagcaaaucuau

SEQ ID NO: 1404963 - RNA, 19 nt, Homo sapiens
ggagggcccuggagauaag

SEQ ID NO: 1404964 - RNA, 19 nt, Homo sapiens
ugaacgaccuccucaucaa

SEQ ID NO: 1404965 - RNA, 19 nt, Homo sapiens
gugguguacugucagaaua

SEQ ID NO: 1404966 - RNA, 19 nt, Homo sapiens
gaagaagaaggcucuggaa

SEQ ID NO: 1404967 - RNA, 19 nt, Homo sapiens
ggauauguauacaagaaca

SEQ ID NO: 1404968 - RNA, 19 nt, Homo sapiens
cuacaacggugucugaaag

SEQ ID NO: 1404969 - RNA, 19 nt, Homo sapiens
ggaauauccagcaaaucua

SEQ ID NO: 1404970 - RNA, 19 nt, Homo sapiens
gagaagacccugggaguuc

SEQ ID NO: 1404971 - RNA, 19 nt, Homo sapiens
gggaauauccagcaaaucu

SEQ ID NO: 1404972 - RNA, 19 nt, Homo sapiens
ugagugaacugguagaaac

SEQ ID NO: 1404973 - RNA, 19 nt, Homo sapiens
gaggauggcaagagaguga

SEQ ID NO: 1404974 - RNA, 19 nt, Homo sapiens
gcucagcuauucaucaaac

SEQ ID NO: 1404975 - RNA, 19 nt, Homo sapiens
gagcuacaacggugucuga

SEQ ID NO: 1404976 - RNA, 19 nt, Homo sapiens
ucaaggauuuucucaagua

SEQ ID NO: 1404977 - RNA, 19 nt, Homo sapiens
ugcagcggaucaugaaaua

SEQ ID NO: 1404978 - RNA, 19 nt, Homo sapiens
aaaugaggauggcaagaga

SEQ ID NO: 1404979 - RNA, 19 nt, Homo sapiens
ggcagauuguggaggguua

SEQ ID NO: 1404980 - RNA, 19 nt, Homo sapiens
gagagaggcugagcaucau

SEQ ID NO: 1404981 - RNA, 19 nt, Homo sapiens
gaacugguagaaacagaga

SEQ ID NO: 1404982 - RNA, 19 nt, Homo sapiens
guauacaagaacagcauua

SEQ ID NO: 1404983 - RNA, 19 nt, Homo sapiens
cagagcauguggugucaga

SEQ ID NO: 1404984 - RNA, 19 nt, Homo sapiens
gaguauguauguccugagu

SEQ ID NO: 1404985 - RNA, 19 nt, Homo sapiens
ggaaaggaguauguauguc

SEQ ID NO: 1404986 - RNA, 19 nt, Homo sapiens
ggccagauagaaauuauug

SEQ ID NO: 1404987 - RNA, 19 nt, Homo sapiens
cuggauauguauacaagaa

SEQ ID NO: 1404988 - RNA, 19 nt, Homo sapiens
ucugaaagauccugauugg

SEQ ID NO: 1404989 - RNA, 19 nt, Homo sapiens
ggauuguguuugggaauau

SEQ ID NO: 1404990 - RNA, 19 nt, Homo sapiens
uugccaagcuggaugaaga

SEQ ID NO: 1404991 - RNA, 19 nt, Homo sapiens
uggcacugcuccagaauuc

SEQ ID NO: 1404992 - RNA, 19 nt, Homo sapiens
gcacacacacacccaucaa

SEQ ID NO: 1404993 - RNA, 19 nt, Homo sapiens
ggagagagaggcugagcau

SEQ ID NO: 1404994 - RNA, 19 nt, Homo sapiens
gggacuuccucaacgcauu

SEQ ID NO: 1404995 - RNA, 19 nt, Homo sapiens
ucaagcauguggcucagau

SEQ ID NO: 1404996 - RNA, 19 nt, Homo sapiens
gcauguggugucagaguuu

SEQ ID NO: 1404997 - RNA, 19 nt, Homo sapiens
agagagaggcugagcauca

SEQ ID NO: 1404998 - RNA, 19 nt, Homo sapiens
aaauguacguggacgacuu

SEQ ID NO: 1404999 - RNA, 19 nt, Homo sapiens
gaacaccuagacccaagga

SEQ ID NO: 1405000 - RNA, 19 nt, Homo sapiens
caagcuggaugaagaugag

SEQ ID NO: 1405001 - RNA, 19 nt, Homo sapiens
gagaggcugagcaucauga

SEQ ID NO: 1405002 - RNA, 19 nt, Homo sapiens
ugggagggauaucaacuug

SEQ ID NO: 1405003 - RNA, 19 nt, Homo sapiens
ggacuuccucaacgcauug

SEQ ID NO: 1405004 - RNA, 19 nt, Homo sapiens
aacacagccuggauaugua

SEQ ID NO: 1405005 - RNA, 19 nt, Homo sapiens
gcaaaucaucaucuucagu

SEQ ID NO: 1405006 - RNA, 19 nt, Homo sapiens
uggcucagcuauucaucaa

SEQ ID NO: 1405007 - RNA, 19 nt, Homo sapiens
ccgagacuauuucuugcaa

SEQ ID NO: 1405008 - RNA, 19 nt, Homo sapiens
ggggagcccuggaagaauu

SEQ ID NO: 1405009 - RNA, 19 nt, Homo sapiens
aggauuguguuugggaaua

SEQ ID NO: 1405010 - RNA, 19 nt, Homo sapiens
gaccauaugagaacuggau

SEQ ID NO: 1405011 - RNA, 19 nt, Homo sapiens
guggaacacagccuggaua

SEQ ID NO: 1405012 - RNA, 19 nt, Homo sapiens
gcucaaggauuuucucaag

SEQ ID NO: 1405013 - RNA, 19 nt, Homo sapiens
gcuacaacggugucugaaa

SEQ ID NO: 1405014 - RNA, 19 nt, Homo sapiens
agaagaaggcucuggaaag

SEQ ID NO: 1405015 - RNA, 19 nt, Homo sapiens
gaggaggaacagaagaaga

SEQ ID NO: 1405016 - RNA, 19 nt, Homo sapiens
acacacacacccaucaaug

SEQ ID NO: 1405017 - RNA, 19 nt, Homo sapiens
gcagucacccauugaguac

SEQ ID NO: 1405018 - RNA, 19 nt, Homo sapiens
ggggugcccuggugaaauu

SEQ ID NO: 1405019 - RNA, 19 nt, Homo sapiens
uguccugagugaacuggua

SEQ ID NO: 1405020 - RNA, 19 nt, Homo sapiens
caaaugaggauggcaagag

SEQ ID NO: 1405021 - RNA, 19 nt, Homo sapiens
gcgcugcaacgauaugaug

SEQ ID NO: 1405022 - RNA, 19 nt, Homo sapiens
gugacaggauuguguuugg

SEQ ID NO: 1405023 - RNA, 19 nt, Homo sapiens
gugaacugguagaaacaga

SEQ ID NO: 1405024 - RNA, 19 nt, Homo sapiens
caccugaagaggagacuuu

SEQ ID NO: 1405025 - RNA, 19 nt, Homo sapiens
gcugaacgaccuccucauc

SEQ ID NO: 1405026 - RNA, 19 nt, Homo sapiens
uguaugugguguacuguca

SEQ ID NO: 1405027 - RNA, 19 nt, Homo sapiens
uggaaaggaguauguaugu

SEQ ID NO: 1405028 - RNA, 19 nt, Homo sapiens
gugaggaggaacagaagaa

SEQ ID NO: 1405029 - RNA, 19 nt, Homo sapiens
ccagauagaaauuauuggu

SEQ ID NO: 1405030 - RNA, 19 nt, Homo sapiens
gagcauguggugucagagu

SEQ ID NO: 1405031 - RNA, 19 nt, Homo sapiens
agacgcagccaccugaaga

SEQ ID NO: 1405032 - RNA, 19 nt, Homo sapiens
gccuggauauguauacaag

SEQ ID NO: 1405033 - RNA, 19 nt, Homo sapiens
aaaucaucaucuucaguga

SEQ ID NO: 1405034 - RNA, 19 nt, Homo sapiens
ccaaacauugucucagugu

SEQ ID NO: 1405035 - RNA, 19 nt, Homo sapiens
cauaugagaacuggauguu

SEQ ID NO: 1405036 - RNA, 19 nt, Homo sapiens
aggcugagcaucaugaaga

SEQ ID NO: 1405037 - RNA, 19 nt, Homo sapiens
gcucuggaaaggaguaugu

SEQ ID NO: 1405038 - RNA, 19 nt, Homo sapiens
aagaagaaggcucuggaaa

SEQ ID NO: 1405039 - RNA, 19 nt, Homo sapiens
aggaggaacagaagaagaa

SEQ ID NO: 1405040 - RNA, 19 nt, Homo sapiens
gcaaggcugggagggauau

SEQ ID NO: 1405041 - RNA, 19 nt, Homo sapiens
gugcagcggaucaugaaau

SEQ ID NO: 1405042 - RNA, 19 nt, Homo sapiens
gauuguggaggguuauaug

SEQ ID NO: 1405043 - RNA, 19 nt, Homo sapiens
gaggagcugccggaacuga

SEQ ID NO: 1405044 - RNA, 19 nt, Homo sapiens
uaacagaccuuuaucagau

SEQ ID NO: 1405045 - RNA, 19 nt, Homo sapiens
caagaaauguuguguccua

SEQ ID NO: 1405046 - RNA, 19 nt, Homo sapiens
gaaauguuguguccuaaug

SEQ ID NO: 1405047 - RNA, 19 nt, Homo sapiens
cguaaacagucaaaucuua

SEQ ID NO: 1405048 - RNA, 19 nt, Homo sapiens
cuacagacgucuauuuaaa

SEQ ID NO: 1405049 - RNA, 19 nt, Homo sapiens
gagagaaaccuuauaaaug

SEQ ID NO: 1405050 - RNA, 19 nt, Homo sapiens
ggacuucuguguguguuua

SEQ ID NO: 1405051 - RNA, 19 nt, Homo sapiens
ggauguggcuguauuuguu

SEQ ID NO: 1405052 - RNA, 19 nt, Homo sapiens
gagagaaacccuauaaaug

SEQ ID NO: 1405053 - RNA, 19 nt, Homo sapiens
gguaaagccuucacucaga

SEQ ID NO: 1405054 - RNA, 19 nt, Homo sapiens
ggagagaaaccauauaaau

SEQ ID NO: 1405055 - RNA, 19 nt, Homo sapiens
ggagagaaaccuuauaaau

SEQ ID NO: 1405056 - RNA, 19 nt, Homo sapiens
gguagaagauguuaagauc

SEQ ID NO: 1405057 - RNA, 19 nt, Homo sapiens
gaaagccucccugacauua

SEQ ID NO: 1405058 - RNA, 19 nt, Homo sapiens
gcaguucaccaauaauaua

SEQ ID NO: 1405059 - RNA, 19 nt, Homo sapiens
ggagagaaacccuauaaau

SEQ ID NO: 1405060 - RNA, 19 nt, Homo sapiens
caacaucugagaauucaua

SEQ ID NO: 1405061 - RNA, 19 nt, Homo sapiens
gagagaagcccuacacaug

SEQ ID NO: 1405062 - RNA, 19 nt, Homo sapiens
gaaggcauaugacaguaga

SEQ ID NO: 1405063 - RNA, 19 nt, Homo sapiens
gagagaaaccauauaaaug

SEQ ID NO: 1405064 - RNA, 19 nt, Homo sapiens
gauaaucaccuuugaggaa

SEQ ID NO: 1405065 - RNA, 19 nt, Homo sapiens
uaauagguauguaguggua

SEQ ID NO: 1405066 - RNA, 19 nt, Homo sapiens
gcaagaaagguaggaguua

SEQ ID NO: 1405067 - RNA, 19 nt, Homo sapiens
gauuugcaguucugguuua

SEQ ID NO: 1405068 - RNA, 19 nt, Homo sapiens
gagcauuacagaauucaua

SEQ ID NO: 1405069 - RNA, 19 nt, Homo sapiens
cagagcccaucccuuauua

SEQ ID NO: 1405070 - RNA, 19 nt, Homo sapiens
gcaguucugguuuauauaa

SEQ ID NO: 1405071 - RNA, 19 nt, Homo sapiens
ugucagagcccaucccuua

SEQ ID NO: 1405072 - RNA, 19 nt, Homo sapiens
gggaaguucuuuacucaga

SEQ ID NO: 1405073 - RNA, 19 nt, Homo sapiens
ggagaacuguauuacucua

SEQ ID NO: 1405074 - RNA, 19 nt, Homo sapiens
guaaagccuucacucagaa

SEQ ID NO: 1405075 - RNA, 19 nt, Homo sapiens
gcccaucccuuauuaaaca

SEQ ID NO: 1405076 - RNA, 19 nt, Homo sapiens
ccaaauaucacucagaaug

SEQ ID NO: 1405077 - RNA, 19 nt, Homo sapiens
ucagaacucuucccuuguu

SEQ ID NO: 1405078 - RNA, 19 nt, Homo sapiens
caaagucacauacagguaa

SEQ ID NO: 1405079 - RNA, 19 nt, Homo sapiens
ugauggagcuuuaggcuau

SEQ ID NO: 1405080 - RNA, 19 nt, Homo sapiens
gagaaacccuauaaaugca

SEQ ID NO: 1405081 - RNA, 19 nt, Homo sapiens
cuaacaaccugucucuuga

SEQ ID NO: 1405082 - RNA, 19 nt, Homo sapiens
agagaggacuggaauauag

SEQ ID NO: 1405083 - RNA, 19 nt, Homo sapiens
ggcaaagccuucagucaga

SEQ ID NO: 1405084 - RNA, 19 nt, Homo sapiens
acaguaaccuuuccuagga

SEQ ID NO: 1405085 - RNA, 19 nt, Homo sapiens
caacugaugccacugacua

SEQ ID NO: 1405086 - RNA, 19 nt, Homo sapiens
gagaaggcauaugacagua

SEQ ID NO: 1405087 - RNA, 19 nt, Homo sapiens
gaaguucuuuacucagaga

SEQ ID NO: 1405088 - RNA, 19 nt, Homo sapiens
gaucuacagacgucuauuu

SEQ ID NO: 1405089 - RNA, 19 nt, Homo sapiens
ggaguuugaugccuuaucu

SEQ ID NO: 1405090 - RNA, 19 nt, Homo sapiens
aaucugcaguucaccaaua

SEQ ID NO: 1405091 - RNA, 19 nt, Homo sapiens
agucagagcauaugccuua

SEQ ID NO: 1405092 - RNA, 19 nt, Homo sapiens
ggagagaagcccuaugugu

SEQ ID NO: 1405093 - RNA, 19 nt, Homo sapiens
caaauaucacucagaauga

SEQ ID NO: 1405094 - RNA, 19 nt, Homo sapiens
guauagcuuuggugaggua

SEQ ID NO: 1405095 - RNA, 19 nt, Homo sapiens
agucaaaucuuacucaaca

SEQ ID NO: 1405096 - RNA, 19 nt, Homo sapiens
gaaugugggaaguucuuua

SEQ ID NO: 1405097 - RNA, 19 nt, Homo sapiens
aagagaagauguuugacuu

SEQ ID NO: 1405098 - RNA, 19 nt, Homo sapiens
aaagcacccuugcaagaaa

SEQ ID NO: 1405099 - RNA, 19 nt, Homo sapiens
caaauguggucucuuaagg

SEQ ID NO: 1405100 - RNA, 19 nt, Homo sapiens
gagaauauaagcauguaga

SEQ ID NO: 1405101 - RNA, 19 nt, Homo sapiens
ggaaagccucccugacauu

SEQ ID NO: 1405102 - RNA, 19 nt, Homo sapiens
gaacaugaaaggacucaca

SEQ ID NO: 1405103 - RNA, 19 nt, Homo sapiens
gagcacacacacacaguaa

SEQ ID NO: 1405104 - RNA, 19 nt, Homo sapiens
gcagguaaugucagaauug

SEQ ID NO: 1405105 - RNA, 19 nt, Homo sapiens
ggagaaggcauaugacagu

SEQ ID NO: 1405106 - RNA, 19 nt, Homo sapiens
aaacaccagcgaauucaua

SEQ ID NO: 1405107 - RNA, 19 nt, Homo sapiens
ucagagaaguugagaaugc

SEQ ID NO: 1405108 - RNA, 19 nt, Homo sapiens
ucaagcagguaaugucaga

SEQ ID NO: 1405109 - RNA, 19 nt, Homo sapiens
ggauuugaguggacauugu

SEQ ID NO: 1405110 - RNA, 19 nt, Homo sapiens
gguuuguccuugagaaauu

SEQ ID NO: 1405111 - RNA, 19 nt, Homo sapiens
uaaaaugaguucuguguga

SEQ ID NO: 1405112 - RNA, 19 nt, Homo sapiens
gaacucuucccuuguugaa

SEQ ID NO: 1405113 - RNA, 19 nt, Homo sapiens
gagaagcccuacacaugca

SEQ ID NO: 1405114 - RNA, 19 nt, Homo sapiens
gagcccaucccuuauuaaa

SEQ ID NO: 1405115 - RNA, 19 nt, Homo sapiens
gaggagagaagcccuaugu

SEQ ID NO: 1405116 - RNA, 19 nt, Homo sapiens
uaggagaacuguauuacuc

SEQ ID NO: 1405117 - RNA, 19 nt, Homo sapiens
uauacacaguuguccauuu

SEQ ID NO: 1405118 - RNA, 19 nt, Homo sapiens
gguaauuucccaccauuga

SEQ ID NO: 1405119 - RNA, 19 nt, Homo sapiens
gaagaugaggguagaagau

SEQ ID NO: 1405120 - RNA, 19 nt, Homo sapiens
gcauguagaugaggaugug

SEQ ID NO: 1405121 - RNA, 19 nt, Homo sapiens
guccuagucuggaguuuga

SEQ ID NO: 1405122 - RNA, 19 nt, Homo sapiens
ccaaagugcugggauuaca

SEQ ID NO: 1405123 - RNA, 19 nt, Homo sapiens
gguaaugucagaauugaau

SEQ ID NO: 1405124 - RNA, 19 nt, Homo sapiens
guagagaggacuggaauau

SEQ ID NO: 1405125 - RNA, 19 nt, Homo sapiens
gaagucauucuggagauaa

SEQ ID NO: 1405126 - RNA, 19 nt, Homo sapiens
cagcaucugagaauucaua

SEQ ID NO: 1405127 - RNA, 19 nt, Homo sapiens
caacuagccacuugucaga

SEQ ID NO: 1405128 - RNA, 19 nt, Homo sapiens
cccucaagaucuucauuua

SEQ ID NO: 1405129 - RNA, 19 nt, Homo sapiens
caaacaagcacaccuuagu

SEQ ID NO: 1405130 - RNA, 19 nt, Homo sapiens
gaaacccuauaaaugcaau

SEQ ID NO: 1405131 - RNA, 19 nt, Homo sapiens
ccauugaaccuuccuguug

SEQ ID NO: 1405132 - RNA, 19 nt, Homo sapiens
cagguaaugucagaauuga

SEQ ID NO: 1405133 - RNA, 19 nt, Homo sapiens
gugauuaggagaaggcaua

SEQ ID NO: 1405134 - RNA, 19 nt, Homo sapiens
guaaaucagcauuguuguu

SEQ ID NO: 1405135 - RNA, 19 nt, Homo sapiens
gcuucaugcuggagaguaa

SEQ ID NO: 1405136 - RNA, 19 nt, Homo sapiens
gugggaaguucuuuacuca

SEQ ID NO: 1405137 - RNA, 19 nt, Homo sapiens
guuacaagcagcaugaauu

SEQ ID NO: 1405138 - RNA, 19 nt, Homo sapiens
gguauguagugguauuaau

SEQ ID NO: 1405139 - RNA, 19 nt, Homo sapiens
ccuaacaaccugucucuug

SEQ ID NO: 1405140 - RNA, 19 nt, Homo sapiens
uugcaguucugguuuauau

SEQ ID NO: 1405141 - RNA, 19 nt, Homo sapiens
caagaaagguaggaguuac

SEQ ID NO: 1405142 - RNA, 19 nt, Homo sapiens
gcuaagccuuuuaauguaa

SEQ ID NO: 1405143 - RNA, 19 nt, Homo sapiens
gaauauaagcauguagaug

SEQ ID NO: 1405144 - RNA, 19 nt, Homo sapiens
ccaccuggcugccuuguaa

SEQ ID NO: 1405145 - RNA, 19 nt, Homo sapiens
gaacguggagcucaaguuu

SEQ ID NO: 1405146 - RNA, 19 nt, Homo sapiens
ggaggacccuuugguuauu

SEQ ID NO: 1405147 - RNA, 19 nt, Homo sapiens
gcaagaacguggagcucaa

SEQ ID NO: 1405148 - RNA, 19 nt, Homo sapiens
cuuaacaccugccaauaaa

SEQ ID NO: 1405149 - RNA, 19 nt, Homo sapiens
ccugggagcuuguucuuug

SEQ ID NO: 1405150 - RNA, 19 nt, Homo sapiens
uacagggacuugucacuuu

SEQ ID NO: 1405151 - RNA, 19 nt, Homo sapiens
gaccagaggcgcagaaugu

SEQ ID NO: 1405152 - RNA, 19 nt, Homo sapiens
gugguggccuccucaagua

SEQ ID NO: 1405153 - RNA, 19 nt, Homo sapiens
ggaaggugcugagccugaa

SEQ ID NO: 1405154 - RNA, 19 nt, Homo sapiens
caggaggacccuuugguua

SEQ ID NO: 1405155 - RNA, 19 nt, Homo sapiens
uaacaccugccaauaaaga

SEQ ID NO: 1405156 - RNA, 19 nt, Homo sapiens
cagccacugucaauuacua

SEQ ID NO: 1405157 - RNA, 19 nt, Homo sapiens
gcaggaggacccuuugguu

SEQ ID NO: 1405158 - RNA, 19 nt, Homo sapiens
ugcagaagcuggugaaagu

SEQ ID NO: 1405159 - RNA, 19 nt, Homo sapiens
gcccacacacugacugaua

SEQ ID NO: 1405160 - RNA, 19 nt, Homo sapiens
gccaagaucacgccacuga

SEQ ID NO: 1405161 - RNA, 19 nt, Homo sapiens
ggaucaggcugggccacua

SEQ ID NO: 1405162 - RNA, 19 nt, Homo sapiens
gcgagccgauucccauuca

SEQ ID NO: 1405163 - RNA, 19 nt, Homo sapiens
cgacuggacgcucuucuga

SEQ ID NO: 1405164 - RNA, 19 nt, Homo sapiens
gguuauugcaucacacuuu

SEQ ID NO: 1405165 - RNA, 19 nt, Homo sapiens
gaggacccuuugguuauug

SEQ ID NO: 1405166 - RNA, 19 nt, Homo sapiens
gugcuggccugccuacuag

SEQ ID NO: 1405167 - RNA, 19 nt, Homo sapiens
ggguugggccuuugauuga

SEQ ID NO: 1405168 - RNA, 19 nt, Homo sapiens
ugccagccacugucaauua

SEQ ID NO: 1405169 - RNA, 19 nt, Homo sapiens
ucuuaacaccugccaauaa

SEQ ID NO: 1405170 - RNA, 19 nt, Homo sapiens
gacuacaugugcacagugu

SEQ ID NO: 1405171 - RNA, 19 nt, Homo sapiens
ggguugaggugggcaguau

SEQ ID NO: 1405172 - RNA, 19 nt, Homo sapiens
ccauuugucuuggaaguca

SEQ ID NO: 1405173 - RNA, 19 nt, Homo sapiens
gcaggcgccauuugucuug

SEQ ID NO: 1405174 - RNA, 19 nt, Homo sapiens
caagaucacgccacugaca

SEQ ID NO: 1405175 - RNA, 19 nt, Homo sapiens
ggugcuggccugccuacua

SEQ ID NO: 1405176 - RNA, 19 nt, Homo sapiens
acagggacuugucacuuug

SEQ ID NO: 1405177 - RNA, 19 nt, Homo sapiens
gguguucccuggcuuuguc

SEQ ID NO: 1405178 - RNA, 19 nt, Homo sapiens
ccagcaccuuggauugauu

SEQ ID NO: 1405179 - RNA, 19 nt, Homo sapiens
ucaucucacuguccaacaa

SEQ ID NO: 1405180 - RNA, 19 nt, Homo sapiens
caggagacaaagcaaguuu

SEQ ID NO: 1405181 - RNA, 19 nt, Homo sapiens
ccaguuugaauucagcaua

SEQ ID NO: 1405182 - RNA, 19 nt, Homo sapiens
ucacgccacugacacucaa

SEQ ID NO: 1405183 - RNA, 19 nt, Homo sapiens
gugcugagccugaauuugc

SEQ ID NO: 1405184 - RNA, 19 nt, Homo sapiens
gcauagacuccuuccagau

SEQ ID NO: 1405185 - RNA, 19 nt, Homo sapiens
acguggagcucaaguuugu

SEQ ID NO: 1405186 - RNA, 19 nt, Homo sapiens
caacaagagcggcaagaac

SEQ ID NO: 1405187 - RNA, 19 nt, Homo sapiens
gggagcuuguucuuuggaa

SEQ ID NO: 1405188 - RNA, 19 nt, Homo sapiens
gguugggccuuugauugaa

SEQ ID NO: 1405189 - RNA, 19 nt, Homo sapiens
ucuccuggcucacgccuau

SEQ ID NO: 1405190 - RNA, 19 nt, Homo sapiens
ugauucccauggucuaaga

SEQ ID NO: 1405191 - RNA, 19 nt, Homo sapiens
cauagacuccuuccagauc

SEQ ID NO: 1405192 - RNA, 19 nt, Homo sapiens
caguuugaauucagcauag

SEQ ID NO: 1405193 - RNA, 19 nt, Homo sapiens
ugagacgccaguuugaauu

SEQ ID NO: 1405194 - RNA, 19 nt, Homo sapiens
gcuggagccucaucucacu

SEQ ID NO: 1405195 - RNA, 19 nt, Homo sapiens
gugaaagugugcacagacu

SEQ ID NO: 1405196 - RNA, 19 nt, Homo sapiens
ggugaucccagcagcuuug

SEQ ID NO: 1405197 - RNA, 19 nt, Homo sapiens
gcccagcaccuuggauuga

SEQ ID NO: 1405198 - RNA, 19 nt, Homo sapiens
gccagccacugucaauuac

SEQ ID NO: 1405199 - RNA, 19 nt, Homo sapiens
gagacgccaguuugaauuc

SEQ ID NO: 1405200 - RNA, 19 nt, Homo sapiens
gagcgagccgauucccauu

SEQ ID NO: 1405201 - RNA, 19 nt, Homo sapiens
gugagacgccaguuugaau

SEQ ID NO: 1405202 - RNA, 19 nt, Homo sapiens
gaggagcagggacuacaug

SEQ ID NO: 1405203 - RNA, 19 nt, Homo sapiens
ccaacaagagcggcaagaa

SEQ ID NO: 1405204 - RNA, 19 nt, Homo sapiens
guuauugcaucacacuuuu

SEQ ID NO: 1405205 - RNA, 19 nt, Homo sapiens
ggugguggccuccucaagu

SEQ ID NO: 1405206 - RNA, 19 nt, Homo sapiens
cauccuggacucccuguug

SEQ ID NO: 1405207 - RNA, 19 nt, Homo sapiens
ggugagacgccaguuugaa

SEQ ID NO: 1405208 - RNA, 19 nt, Homo sapiens
agaguggccugggcuacaa

SEQ ID NO: 1405209 - RNA, 19 nt, Homo sapiens
gggacuacaugugcacagu

SEQ ID NO: 1405210 - RNA, 19 nt, Homo sapiens
cuggcugccuuguaacuga

SEQ ID NO: 1405211 - RNA, 19 nt, Homo sapiens
guuagucgucgccgucuga

SEQ ID NO: 1405212 - RNA, 19 nt, Homo sapiens
gcagugaggcauccuucca

SEQ ID NO: 1405213 - RNA, 19 nt, Homo sapiens
ccacagucaagucaacguu

SEQ ID NO: 1405214 - RNA, 19 nt, Homo sapiens
caugugcucccgcuucuuc

SEQ ID NO: 1405215 - RNA, 19 nt, Homo sapiens
gagaguggccugggcuaca

SEQ ID NO: 1405216 - RNA, 19 nt, Homo sapiens
cagaagcuggugaaagugu

SEQ ID NO: 1405217 - RNA, 19 nt, Homo sapiens
gaauuugccacagucaagu

SEQ ID NO: 1405218 - RNA, 19 nt, Homo sapiens
gauugauucccauggucua

SEQ ID NO: 1405219 - RNA, 19 nt, Homo sapiens
aggaggacccuuugguuau

SEQ ID NO: 1405220 - RNA, 19 nt, Homo sapiens
auagacuccuuccagauca

SEQ ID NO: 1405221 - RNA, 19 nt, Homo sapiens
acacacugacugauacaug

SEQ ID NO: 1405222 - RNA, 19 nt, Homo sapiens
cguccacucccaugucuga

SEQ ID NO: 1405223 - RNA, 19 nt, Homo sapiens
ugaauuugccacagucaag

SEQ ID NO: 1405224 - RNA, 19 nt, Homo sapiens
guuuagcccgguucucuga

SEQ ID NO: 1405225 - RNA, 19 nt, Homo sapiens
ggagcagggacuacaugug

SEQ ID NO: 1405226 - RNA, 19 nt, Homo sapiens
aggcauacgugcagaagcu

SEQ ID NO: 1405227 - RNA, 19 nt, Homo sapiens
ggacucccuguugcucuuu

SEQ ID NO: 1405228 - RNA, 19 nt, Homo sapiens
agacgccaguuugaauuca

SEQ ID NO: 1405229 - RNA, 19 nt, Homo sapiens
gcagcucccuugucucuua

SEQ ID NO: 1405230 - RNA, 19 nt, Homo sapiens
caaaggaggugcucugaug

SEQ ID NO: 1405231 - RNA, 19 nt, Homo sapiens
gcuguacucuaccuauuua

SEQ ID NO: 1405232 - RNA, 19 nt, Homo sapiens
ggccagcucuucaucuaua

SEQ ID NO: 1405233 - RNA, 19 nt, Homo sapiens
agaaggagcucaugauugu

SEQ ID NO: 1405234 - RNA, 19 nt, Homo sapiens
gcagaagccaucauaguuu

SEQ ID NO: 1405235 - RNA, 19 nt, Homo sapiens
ggacaucgcguaucccaaa

SEQ ID NO: 1405236 - RNA, 19 nt, Homo sapiens
gcauuucuguaucagcuua

SEQ ID NO: 1405237 - RNA, 19 nt, Homo sapiens
ucaccacgaugccagaaua

SEQ ID NO: 1405238 - RNA, 19 nt, Homo sapiens
ccggguaucucccuccuua

SEQ ID NO: 1405239 - RNA, 19 nt, Homo sapiens
ggaaguggacauuucauug

SEQ ID NO: 1405240 - RNA, 19 nt, Homo sapiens
gagagaggaucccggguau

SEQ ID NO: 1405241 - RNA, 19 nt, Homo sapiens
gaaccugucccaugccaaa

SEQ ID NO: 1405242 - RNA, 19 nt, Homo sapiens
uguaucagcuuaugaacuu

SEQ ID NO: 1405243 - RNA, 19 nt, Homo sapiens
ggacaucgcggugcuaguu

SEQ ID NO: 1405244 - RNA, 19 nt, Homo sapiens
gagaaggagcucaugauug

SEQ ID NO: 1405245 - RNA, 19 nt, Homo sapiens
ggccaucacugcuguauac

SEQ ID NO: 1405246 - RNA, 19 nt, Homo sapiens
gcgcuucgguggcaucaga

SEQ ID NO: 1405247 - RNA, 19 nt, Homo sapiens
gcggccagcucuucaucua

SEQ ID NO: 1405248 - RNA, 19 nt, Homo sapiens
ucaccaagaucucgguaga

SEQ ID NO: 1405249 - RNA, 19 nt, Homo sapiens
uggaaggacugaaggagaa

SEQ ID NO: 1405250 - RNA, 19 nt, Homo sapiens
cagaagccaucauaguuuc

SEQ ID NO: 1405251 - RNA, 19 nt, Homo sapiens
gagcagaagccaucauagu

SEQ ID NO: 1405252 - RNA, 19 nt, Homo sapiens
caagaaaacacgucuaaaa

SEQ ID NO: 1405253 - RNA, 19 nt, Homo sapiens
ucccucaccuccaucuuua

SEQ ID NO: 1405254 - RNA, 19 nt, Homo sapiens
ugaacuuaauggcuuguuu

SEQ ID NO: 1405255 - RNA, 19 nt, Homo sapiens
guaugcaggugccaucuuc

SEQ ID NO: 1405256 - RNA, 19 nt, Homo sapiens
caagaucucgguagacaug

SEQ ID NO: 1405257 - RNA, 19 nt, Homo sapiens
ucucuucagugcuccauuu

SEQ ID NO: 1405258 - RNA, 19 nt, Homo sapiens
ccauggaccucuggaauca

SEQ ID NO: 1405259 - RNA, 19 nt, Homo sapiens
gaaguggacauuucauugg

SEQ ID NO: 1405260 - RNA, 19 nt, Homo sapiens
ucacagagccacccuccaa

SEQ ID NO: 1405261 - RNA, 19 nt, Homo sapiens
gaaaaccccuuggugaaga

SEQ ID NO: 1405262 - RNA, 19 nt, Homo sapiens
uaggagcgcucaccuugau

SEQ ID NO: 1405263 - RNA, 19 nt, Homo sapiens
caaaagagacacagugaaa

SEQ ID NO: 1405264 - RNA, 19 nt, Homo sapiens
cagagcagaagccaucaua

SEQ ID NO: 1405265 - RNA, 19 nt, Homo sapiens
guucuguacuuccucuuug

SEQ ID NO: 1405266 - RNA, 19 nt, Homo sapiens
gcuggaguuuggaguuuga

SEQ ID NO: 1405267 - RNA, 19 nt, Homo sapiens
cauccuggcuguacucuac

SEQ ID NO: 1405268 - RNA, 19 nt, Homo sapiens
gagcugcgccaucuuuauc

SEQ ID NO: 1405269 - RNA, 19 nt, Homo sapiens
ggaagaggaccaaugaaaa

SEQ ID NO: 1405270 - RNA, 19 nt, Homo sapiens
caccugaccugguuuacuc

SEQ ID NO: 1405271 - RNA, 19 nt, Homo sapiens
uggaagaggaccaaugaaa

SEQ ID NO: 1405272 - RNA, 19 nt, Homo sapiens
caaguggccugugcagauc

SEQ ID NO: 1405273 - RNA, 19 nt, Homo sapiens
gcuagcaaccggagugaga

SEQ ID NO: 1405274 - RNA, 19 nt, Homo sapiens
ggaagcucuuggcugcaaa

SEQ ID NO: 1405275 - RNA, 19 nt, Homo sapiens
gaugcgaccagccagauga

SEQ ID NO: 1405276 - RNA, 19 nt, Homo sapiens
gaacuuaauggcuuguuuu

SEQ ID NO: 1405277 - RNA, 19 nt, Homo sapiens
gcuacgggcauuucuguau

SEQ ID NO: 1405278 - RNA, 19 nt, Homo sapiens
gaugguggcggcucucaug

SEQ ID NO: 1405279 - RNA, 19 nt, Homo sapiens
ucaaguggccugugcagau

SEQ ID NO: 1405280 - RNA, 19 nt, Homo sapiens
gugcucugauggcugcaua

SEQ ID NO: 1405281 - RNA, 19 nt, Homo sapiens
gagaggaucccggguaucu

SEQ ID NO: 1405282 - RNA, 19 nt, Homo sapiens
gauguuggccuggaucuuc

SEQ ID NO: 1405283 - RNA, 19 nt, Homo sapiens
gagcccugcaucuggaaua

SEQ ID NO: 1405284 - RNA, 19 nt, Homo sapiens
ggaucuuccuacccaucua

SEQ ID NO: 1405285 - RNA, 19 nt, Homo sapiens
gcccucagccuccacaguu

SEQ ID NO: 1405286 - RNA, 19 nt, Homo sapiens
ucucuuacccucucucaga

SEQ ID NO: 1405287 - RNA, 19 nt, Homo sapiens
ggccauaguugggcuacug

SEQ ID NO: 1405288 - RNA, 19 nt, Homo sapiens
guacucuaccuauuuaucu

SEQ ID NO: 1405289 - RNA, 19 nt, Homo sapiens
uggcuguacucuaccuauu

SEQ ID NO: 1405290 - RNA, 19 nt, Homo sapiens
guaucagcuuaugaacuua

SEQ ID NO: 1405291 - RNA, 19 nt, Homo sapiens
gcagcagcguccaguucga

SEQ ID NO: 1405292 - RNA, 19 nt, Homo sapiens
cggaagcucuuggcugcaa

SEQ ID NO: 1405293 - RNA, 19 nt, Homo sapiens
cagcagcgggcauauagga

SEQ ID NO: 1405294 - RNA, 19 nt, Homo sapiens
cuacgggcauuucuguauc

SEQ ID NO: 1405295 - RNA, 19 nt, Homo sapiens
gugggugcauccuuguuug

SEQ ID NO: 1405296 - RNA, 19 nt, Homo sapiens
ggugcuaguucuguacuuc

SEQ ID NO: 1405297 - RNA, 19 nt, Homo sapiens
caaccaccgccaccuccua

SEQ ID NO: 1405298 - RNA, 19 nt, Homo sapiens
gaagaggaccaaugaaaag

SEQ ID NO: 1405299 - RNA, 19 nt, Homo sapiens
ucgcggugcuaguucugua

SEQ ID NO: 1405300 - RNA, 19 nt, Homo sapiens
uaccucuacuucuccauga

SEQ ID NO: 1405301 - RNA, 19 nt, Homo sapiens
ucuggaagaggaccaauga

SEQ ID NO: 1405302 - RNA, 19 nt, Homo sapiens
agacgcugaucaugcuuau

SEQ ID NO: 1405303 - RNA, 19 nt, Homo sapiens
cccucagccuccacaguua

SEQ ID NO: 1405304 - RNA, 19 nt, Homo sapiens
gaucucgguagacauguau

SEQ ID NO: 1405305 - RNA, 19 nt, Homo sapiens
ggcuguacucuaccuauuu

SEQ ID NO: 1405306 - RNA, 19 nt, Homo sapiens
cagcagcucccuugucucu

SEQ ID NO: 1405307 - RNA, 19 nt, Homo sapiens
gagcauucacuaccucuac

SEQ ID NO: 1405308 - RNA, 19 nt, Homo sapiens
cuaccuauuuaucuacauc

SEQ ID NO: 1405309 - RNA, 19 nt, Homo sapiens
gugagcugcgccaucuuua

SEQ ID NO: 1405310 - RNA, 19 nt, Homo sapiens
guucggacaucgcguaucc

SEQ ID NO: 1405311 - RNA, 19 nt, Homo sapiens
agaucucgguagacaugua

SEQ ID NO: 1405312 - RNA, 19 nt, Homo sapiens
cgugagcugcgccaucuuu

SEQ ID NO: 1405313 - RNA, 19 nt, Homo sapiens
cagcagcagcguccaguuc

SEQ ID NO: 1405314 - RNA, 19 nt, Homo sapiens
gacugaaggagaaguacuu

SEQ ID NO: 1405315 - RNA, 19 nt, Homo sapiens
guaucucccuccuuacaac

SEQ ID NO: 1405316 - RNA, 19 nt, Homo sapiens
cagacgcugaucaugcuua

SEQ ID NO: 1405317 - RNA, 19 nt, Homo sapiens
agcagaagccaucauaguu

SEQ ID NO: 1405318 - RNA, 19 nt, Homo sapiens
ucaccuccaucuuuaacag

SEQ ID NO: 1405319 - RNA, 19 nt, Homo sapiens
uggccuggcugcugugauc

SEQ ID NO: 1405320 - RNA, 19 nt, Homo sapiens
uguuggaaguggacauuuc

SEQ ID NO: 1405321 - RNA, 19 nt, Homo sapiens
aaagagacacagugaaagg

SEQ ID NO: 1405322 - RNA, 19 nt, Homo sapiens
gccagcucuucaucuauau

SEQ ID NO: 1405323 - RNA, 19 nt, Homo sapiens
gccaccuccuagugccuua

SEQ ID NO: 1405324 - RNA, 19 nt, Homo sapiens
aggcuggaguuuggaguuu

SEQ ID NO: 1405325 - RNA, 19 nt, Homo sapiens
ggauggaaggacugaagga

SEQ ID NO: 1405326 - RNA, 19 nt, Homo sapiens
acgcugaucaugcuuauag

SEQ ID NO: 1405327 - RNA, 19 nt, Homo sapiens
cuuugcaccuggaucugua

SEQ ID NO: 1405328 - RNA, 19 nt, Homo sapiens
gguaucucccuccuuacaa

SEQ ID NO: 1405329 - RNA, 19 nt, Homo sapiens
ggaaagugauguuagagaa

SEQ ID NO: 1405330 - RNA, 19 nt, Homo sapiens
aaagaucccuggaauauga

SEQ ID NO: 1405331 - RNA, 19 nt, Homo sapiens
ggaaauccauagcuaagau

SEQ ID NO: 1405332 - RNA, 19 nt, Homo sapiens
caguguagguaucuuaaua

SEQ ID NO: 1405333 - RNA, 19 nt, Homo sapiens
ccugugcaguuucauauua

SEQ ID NO: 1405334 - RNA, 19 nt, Homo sapiens
acauuaggguccauauuua

SEQ ID NO: 1405335 - RNA, 19 nt, Homo sapiens
ccaaagugcugguauuaca

SEQ ID NO: 1405336 - RNA, 19 nt, Homo sapiens
gaaaagaucccuggaauau

SEQ ID NO: 1405337 - RNA, 19 nt, Homo sapiens
guacaguuacagucaaaua

SEQ ID NO: 1405338 - RNA, 19 nt, Homo sapiens
aaagauagccauaugucua

SEQ ID NO: 1405339 - RNA, 19 nt, Homo sapiens
guagguaucuuaauaucag

SEQ ID NO: 1405340 - RNA, 19 nt, Homo sapiens
caaauacuguaguuagaca

SEQ ID NO: 1405341 - RNA, 19 nt, Homo sapiens
gaguacaguuacagucaaa

SEQ ID NO: 1405342 - RNA, 19 nt, Homo sapiens
ugacaaagggcacaauaga

SEQ ID NO: 1405343 - RNA, 19 nt, Homo sapiens
ggagugcaguggugugauc

SEQ ID NO: 1405344 - RNA, 19 nt, Homo sapiens
ccagugcuauguuaaaaua

SEQ ID NO: 1405345 - RNA, 19 nt, Homo sapiens
ggauguggccauagaauuc

SEQ ID NO: 1405346 - RNA, 19 nt, Homo sapiens
uacauuaggguccauauuu

SEQ ID NO: 1405347 - RNA, 19 nt, Homo sapiens
cagcaggauuuguauagga

SEQ ID NO: 1405348 - RNA, 19 nt, Homo sapiens
gucaaauacuguaguuaga

SEQ ID NO: 1405349 - RNA, 19 nt, Homo sapiens
uaguuguacuucccaauuu

SEQ ID NO: 1405350 - RNA, 19 nt, Homo sapiens
uugcaauucugucuguaua

SEQ ID NO: 1405351 - RNA, 19 nt, Homo sapiens
ggagugggguuguaacuug

SEQ ID NO: 1405352 - RNA, 19 nt, Homo sapiens
caccaugcccagccuaaua

SEQ ID NO: 1405353 - RNA, 19 nt, Homo sapiens
guaguuguacuucccaauu

SEQ ID NO: 1405354 - RNA, 19 nt, Homo sapiens
gcaauucugucuguauacu

SEQ ID NO: 1405355 - RNA, 19 nt, Homo sapiens
gaucucagcucaucaaaac

SEQ ID NO: 1405356 - RNA, 19 nt, Homo sapiens
caguuucaauggcuuuaaa

SEQ ID NO: 1405357 - RNA, 19 nt, Homo sapiens
auaggaaagugauguuaga

SEQ ID NO: 1405358 - RNA, 19 nt, Homo sapiens
cagcacgcccagcuaauuu

SEQ ID NO: 1405359 - RNA, 19 nt, Homo sapiens
ggugugaucucagcucauc

SEQ ID NO: 1405360 - RNA, 19 nt, Homo sapiens
gauguuagagaacuacaga

SEQ ID NO: 1405361 - RNA, 19 nt, Homo sapiens
gggaugcccucuggguuug

SEQ ID NO: 1405362 - RNA, 19 nt, Homo sapiens
auagaaacauugacaaagg

SEQ ID NO: 1405363 - RNA, 19 nt, Homo sapiens
ggaaaagaucccuggaaua

SEQ ID NO: 1405364 - RNA, 19 nt, Homo sapiens
guauaggaaagugauguua

SEQ ID NO: 1405365 - RNA, 19 nt, Homo sapiens
uuagggauguggccauaga

SEQ ID NO: 1405366 - RNA, 19 nt, Homo sapiens
gguuguaacuugguugcaa

SEQ ID NO: 1405367 - RNA, 19 nt, Homo sapiens
cugcauauucucugaaauu

SEQ ID NO: 1405368 - RNA, 19 nt, Homo sapiens
gaaauccauagcuaagaug

SEQ ID NO: 1405369 - RNA, 19 nt, Homo sapiens
caaagggcacaauagaguu

SEQ ID NO: 1405370 - RNA, 19 nt, Homo sapiens
aauguugcauaccaaauug

SEQ ID NO: 1405371 - RNA, 19 nt, Homo sapiens
gggauguggccauagaauu

SEQ ID NO: 1405372 - RNA, 19 nt, Homo sapiens
gcucagcaggauuuguaua

SEQ ID NO: 1405373 - RNA, 19 nt, Homo sapiens
gaugcccucuggguuugua

SEQ ID NO: 1405374 - RNA, 19 nt, Homo sapiens
uauacugcauauucucuga

SEQ ID NO: 1405375 - RNA, 19 nt, Homo sapiens
ggcugcugguucuacauua

SEQ ID NO: 1405376 - RNA, 19 nt, Homo sapiens
caaggcugcugguucuaca

SEQ ID NO: 1405377 - RNA, 19 nt, Homo sapiens
acaaagggcacaauagagu

SEQ ID NO: 1405378 - RNA, 19 nt, Homo sapiens
ggauuuguauaggaaagug

SEQ ID NO: 1405379 - RNA, 19 nt, Homo sapiens
aaagggcacaauagaguuu

SEQ ID NO: 1405380 - RNA, 19 nt, Homo sapiens
guagaacaauaacuuacac

SEQ ID NO: 1405381 - RNA, 19 nt, Homo sapiens
gaauaugaagggacacagu

SEQ ID NO: 1405382 - RNA, 19 nt, Homo sapiens
gaagauacugggaaaucca

SEQ ID NO: 1405383 - RNA, 19 nt, Homo sapiens
ugaguacaguuacagucaa

SEQ ID NO: 1405384 - RNA, 19 nt, Homo sapiens
cugaguagcugggauuaca

SEQ ID NO: 1405385 - RNA, 19 nt, Homo sapiens
uaggguccauauuuaguug

SEQ ID NO: 1405386 - RNA, 19 nt, Homo sapiens
acugggaaauccauagcua

SEQ ID NO: 1405387 - RNA, 19 nt, Homo sapiens
ccauaugucuaucacaaaa

SEQ ID NO: 1405388 - RNA, 19 nt, Homo sapiens
agccauaugucuaucacaa

SEQ ID NO: 1405389 - RNA, 19 nt, Homo sapiens
guguagguaucuuaauauc

SEQ ID NO: 1405390 - RNA, 19 nt, Homo sapiens
uguauccaauagcuuguuu

SEQ ID NO: 1405391 - RNA, 19 nt, Homo sapiens
acacaguacgguagucaaa

SEQ ID NO: 1405392 - RNA, 19 nt, Homo sapiens
ggacacaguacgguaguca

SEQ ID NO: 1405393 - RNA, 19 nt, Homo sapiens
aauaugaagggacacagua

SEQ ID NO: 1405394 - RNA, 19 nt, Homo sapiens
gaaagugauguuagagaac

SEQ ID NO: 1405395 - RNA, 19 nt, Homo sapiens
uaagcugggucucgaacuc

SEQ ID NO: 1405396 - RNA, 19 nt, Homo sapiens
ccagcacgcccagcuaauu

SEQ ID NO: 1405397 - RNA, 19 nt, Homo sapiens
gcugcugguucuacauuag

SEQ ID NO: 1405398 - RNA, 19 nt, Homo sapiens
ggcaaacaacuccuuaagu

SEQ ID NO: 1405399 - RNA, 19 nt, Homo sapiens
ucccaaagugcugguauua

SEQ ID NO: 1405400 - RNA, 19 nt, Homo sapiens
uggccaggauggucucuau

SEQ ID NO: 1405401 - RNA, 19 nt, Homo sapiens
cuacagaaaccuggucuuc

SEQ ID NO: 1405402 - RNA, 19 nt, Homo sapiens
aaagugauguuagagaacu

SEQ ID NO: 1405403 - RNA, 19 nt, Homo sapiens
gugcaguggugugaucuca

SEQ ID NO: 1405404 - RNA, 19 nt, Homo sapiens
uuagagaacuacagaaacc

SEQ ID NO: 1405405 - RNA, 19 nt, Homo sapiens
gacaaagggcacaauagag

SEQ ID NO: 1405406 - RNA, 19 nt, Homo sapiens
ccuccugggugcugggauu

SEQ ID NO: 1405407 - RNA, 19 nt, Homo sapiens
uguuagagaacuacagaaa

SEQ ID NO: 1405408 - RNA, 19 nt, Homo sapiens
gggaaauccauagcuaaga

SEQ ID NO: 1405409 - RNA, 19 nt, Homo sapiens
caaugugagguugaauuaa

SEQ ID NO: 1405410 - RNA, 19 nt, Homo sapiens
uacugcauauucucugaaa

SEQ ID NO: 1405411 - RNA, 19 nt, Homo sapiens
caccagcacgcccagcuaa

SEQ ID NO: 1405412 - RNA, 19 nt, Homo sapiens
uccaauagcuuguuuuaag

SEQ ID NO: 1405413 - RNA, 19 nt, Homo sapiens
uugcaaggcugcugguucu

SEQ ID NO: 1405414 - RNA, 19 nt, Homo sapiens
gauuucaggagguaaagau

SEQ ID NO: 1405415 - RNA, 19 nt, Homo sapiens
gccauaugucuaucacaaa

SEQ ID NO: 1405416 - RNA, 19 nt, Homo sapiens
guuucaccauguuggcuaa

SEQ ID NO: 1405417 - RNA, 19 nt, Homo sapiens
cuacauuaggguccauauu

SEQ ID NO: 1405418 - RNA, 19 nt, Homo sapiens
cuauuggugucugugaauu

SEQ ID NO: 1405419 - RNA, 19 nt, Homo sapiens
ggucaccugucuggagcaa

SEQ ID NO: 1405420 - RNA, 19 nt, Homo sapiens
cagguauugcugucucuaa

SEQ ID NO: 1405421 - RNA, 19 nt, Homo sapiens
ugggaugcccucuggguuu

SEQ ID NO: 1405422 - RNA, 19 nt, Homo sapiens
gaucuucuuuucuuguguu

SEQ ID NO: 1405423 - RNA, 19 nt, Homo sapiens
agucaaauacuguaguuag

SEQ ID NO: 1405424 - RNA, 19 nt, Homo sapiens
agcaggauuuguauaggaa

SEQ ID NO: 1405425 - RNA, 19 nt, Homo sapiens
guguguagaacaauaacuu

SEQ ID NO: 1405426 - RNA, 19 nt, Homo sapiens
gauacugggaaauccauag

SEQ ID NO: 1405427 - RNA, 19 nt, Homo sapiens
gcaaggcugcugguucuac

SEQ ID NO: 1405428 - RNA, 19 nt, Homo sapiens
gcaggauuuguauaggaaa

SEQ ID NO: 1405429 - RNA, 19 nt, Homo sapiens
gaaaucaaauucagcucuu

SEQ ID NO: 1405430 - RNA, 19 nt, Homo sapiens
cuucagaccucaccaucuu

SEQ ID NO: 1405431 - RNA, 19 nt, Homo sapiens
gacaaggucaucauucugu

SEQ ID NO: 1405432 - RNA, 19 nt, Homo sapiens
ggacaaggucaucauucug

SEQ ID NO: 1405433 - RNA, 19 nt, Homo sapiens
aggcuaaccugcagaagca

SEQ ID NO: 1405434 - RNA, 19 nt, Homo sapiens
ucaaaaggcuggggcacua

SEQ ID NO: 1405435 - RNA, 19 nt, Homo sapiens
gaagcacagacacuacaga

SEQ ID NO: 1405436 - RNA, 19 nt, Homo sapiens
gggcuuggaaaucaaauuc

SEQ ID NO: 1405437 - RNA, 19 nt, Homo sapiens
cuacagaccacagcauuca

SEQ ID NO: 1405438 - RNA, 19 nt, Homo sapiens
uggacaaggucaucauucu

SEQ ID NO: 1405439 - RNA, 19 nt, Homo sapiens
gcagaagcacagacacuac

SEQ ID NO: 1405440 - RNA, 19 nt, Homo sapiens
gugcuugccuuuggcuuca

SEQ ID NO: 1405441 - RNA, 19 nt, Homo sapiens
gcuuggaaaucaaauucag

SEQ ID NO: 1405442 - RNA, 19 nt, Homo sapiens
gaccucaccaucuuugaca

SEQ ID NO: 1405443 - RNA, 19 nt, Homo sapiens
gcccugagcaacaauagca

SEQ ID NO: 1405444 - RNA, 19 nt, Homo sapiens
ucagaccucaccaucuuug

SEQ ID NO: 1405445 - RNA, 19 nt, Homo sapiens
cauggaguuuggugugcuu

SEQ ID NO: 1405446 - RNA, 19 nt, Homo sapiens
cagaagcacagacacuaca

SEQ ID NO: 1405447 - RNA, 19 nt, Homo sapiens
gcacuuagauacaugcuau

SEQ ID NO: 1405448 - RNA, 19 nt, Homo sapiens
caaccuaacuggcuuacuu

SEQ ID NO: 1405449 - RNA, 19 nt, Homo sapiens
gagcgcagauccaaaguug

SEQ ID NO: 1405450 - RNA, 19 nt, Homo sapiens
ggaggacucugaugaacaa

SEQ ID NO: 1405451 - RNA, 19 nt, Homo sapiens
aaagaaugcuguuguaaug

SEQ ID NO: 1405452 - RNA, 19 nt, Homo sapiens
ggagcuuguuugacauuua

SEQ ID NO: 1405453 - RNA, 19 nt, Homo sapiens
gcagggaccuacagauguu

SEQ ID NO: 1405454 - RNA, 19 nt, Homo sapiens
gcucucaucuuggguuuaa

SEQ ID NO: 1405455 - RNA, 19 nt, Homo sapiens
ggucagaugucagguuuga

SEQ ID NO: 1405456 - RNA, 19 nt, Homo sapiens
cuaacuggcuuacuuccua

SEQ ID NO: 1405457 - RNA, 19 nt, Homo sapiens
gcagggaacagaacaguga

SEQ ID NO: 1405458 - RNA, 19 nt, Homo sapiens
ucacuuacccuaugaguug

SEQ ID NO: 1405459 - RNA, 19 nt, Homo sapiens
gcagaggccggugaacuua

SEQ ID NO: 1405460 - RNA, 19 nt, Homo sapiens
cuacagauguugcaguuca

SEQ ID NO: 1405461 - RNA, 19 nt, Homo sapiens
gaacauuccaggccaacuu

SEQ ID NO: 1405462 - RNA, 19 nt, Homo sapiens
gagagaaugugaccuuguc

SEQ ID NO: 1405463 - RNA, 19 nt, Homo sapiens
gaacucacaauuccaaaca

SEQ ID NO: 1405464 - RNA, 19 nt, Homo sapiens
aaacacacuccuuugcuua

SEQ ID NO: 1405465 - RNA, 19 nt, Homo sapiens
gcccaccucuccaaccuaa

SEQ ID NO: 1405466 - RNA, 19 nt, Homo sapiens
gacaacaugugacucuuca

SEQ ID NO: 1405467 - RNA, 19 nt, Homo sapiens
ggacaagcccuuccucucu

SEQ ID NO: 1405468 - RNA, 19 nt, Homo sapiens
ucacgggaguccacagaaa

SEQ ID NO: 1405469 - RNA, 19 nt, Homo sapiens
cagugucgcucucaucuug

SEQ ID NO: 1405470 - RNA, 19 nt, Homo sapiens
ugggaaaccuucucucuca

SEQ ID NO: 1405471 - RNA, 19 nt, Homo sapiens
acucacaauuccaaacaua

SEQ ID NO: 1405472 - RNA, 19 nt, Homo sapiens
gauccaaaguugucuucug

SEQ ID NO: 1405473 - RNA, 19 nt, Homo sapiens
gaacagggaggacucugau

SEQ ID NO: 1405474 - RNA, 19 nt, Homo sapiens
ucacagguaacuccagaua

SEQ ID NO: 1405475 - RNA, 19 nt, Homo sapiens
ggcgugagucugcaucuua

SEQ ID NO: 1405476 - RNA, 19 nt, Homo sapiens
gagcuuguuugacauuuac

SEQ ID NO: 1405477 - RNA, 19 nt, Homo sapiens
ucacucacuuacccuauga

SEQ ID NO: 1405478 - RNA, 19 nt, Homo sapiens
guucccaggucaacuauuc

SEQ ID NO: 1405479 - RNA, 19 nt, Homo sapiens
caauagcccugucucaaaa

SEQ ID NO: 1405480 - RNA, 19 nt, Homo sapiens
acaauagcccugucucaaa

SEQ ID NO: 1405481 - RNA, 19 nt, Homo sapiens
ggacaacaugugacucuuc

SEQ ID NO: 1405482 - RNA, 19 nt, Homo sapiens
agaaugcuguuguaaugga

SEQ ID NO: 1405483 - RNA, 19 nt, Homo sapiens
uacaugcuauuccaccuuu

SEQ ID NO: 1405484 - RNA, 19 nt, Homo sapiens
gcagggaccuacagaugcu

SEQ ID NO: 1405485 - RNA, 19 nt, Homo sapiens
ccucuuaacacggcacuua

SEQ ID NO: 1405486 - RNA, 19 nt, Homo sapiens
gcccacaauucuccauuuc

SEQ ID NO: 1405487 - RNA, 19 nt, Homo sapiens
ggacucugaugaacaagac

SEQ ID NO: 1405488 - RNA, 19 nt, Homo sapiens
uaacacggcacuuagauac

SEQ ID NO: 1405489 - RNA, 19 nt, Homo sapiens
ucccggagcuuguuugaca

SEQ ID NO: 1405490 - RNA, 19 nt, Homo sapiens
ccugagcucuacaacagaa

SEQ ID NO: 1405491 - RNA, 19 nt, Homo sapiens
cagcaacccuguggugauc

SEQ ID NO: 1405492 - RNA, 19 nt, Homo sapiens
caacaugugacucuucagu

SEQ ID NO: 1405493 - RNA, 19 nt, Homo sapiens
gcgcagauccaaaguuguc

SEQ ID NO: 1405494 - RNA, 19 nt, Homo sapiens
acaugugacucuucagugu

SEQ ID NO: 1405495 - RNA, 19 nt, Homo sapiens
ggacaucguggucguaggu

SEQ ID NO: 1405496 - RNA, 19 nt, Homo sapiens
caugacaccugcccuugca

SEQ ID NO: 1405497 - RNA, 19 nt, Homo sapiens
gcucuacaacagaauauuc

SEQ ID NO: 1405498 - RNA, 19 nt, Homo sapiens
uuagauacaugcuauucca

SEQ ID NO: 1405499 - RNA, 19 nt, Homo sapiens
ccacaauucuccauuucac

SEQ ID NO: 1405500 - RNA, 19 nt, Homo sapiens
gaauucagucuguccaaag

SEQ ID NO: 1405501 - RNA, 19 nt, Homo sapiens
ugaacaugccucucucuug

SEQ ID NO: 1405502 - RNA, 19 nt, Homo sapiens
ucgcuggugugccaacaaa

SEQ ID NO: 1405503 - RNA, 19 nt, Homo sapiens
ggagagaaugugaccuugu

SEQ ID NO: 1405504 - RNA, 19 nt, Homo sapiens
ggcagaggccggugaacuu

SEQ ID NO: 1405505 - RNA, 19 nt, Homo sapiens
gcgugagucugcaucuuag

SEQ ID NO: 1405506 - RNA, 19 nt, Homo sapiens
gaucuucuagggagacaau

SEQ ID NO: 1405507 - RNA, 19 nt, Homo sapiens
ccacugcccguuucuguca

SEQ ID NO: 1405508 - RNA, 19 nt, Homo sapiens
acagaugcuucggcucuuu

SEQ ID NO: 1405509 - RNA, 19 nt, Homo sapiens
acacggcacuuagauacau

SEQ ID NO: 1405510 - RNA, 19 nt, Homo sapiens
uggcuuacuuccuagucua

SEQ ID NO: 1405511 - RNA, 19 nt, Homo sapiens
gugcugagggucaauggaa

SEQ ID NO: 1405512 - RNA, 19 nt, Homo sapiens
uuaacacggcacuuagaua

SEQ ID NO: 1405513 - RNA, 19 nt, Homo sapiens
ccucacaccacgagucuga

SEQ ID NO: 1405514 - RNA, 19 nt, Homo sapiens
acagggaggacucugauga

SEQ ID NO: 1405515 - RNA, 19 nt, Homo sapiens
gcacaugcagggaccuaca

SEQ ID NO: 1405516 - RNA, 19 nt, Homo sapiens
ucccugagcucuacaacag

SEQ ID NO: 1405517 - RNA, 19 nt, Homo sapiens
uuggucagaugucagguuu

SEQ ID NO: 1405518 - RNA, 19 nt, Homo sapiens
caauguuggucagauguca

SEQ ID NO: 1405519 - RNA, 19 nt, Homo sapiens
caggagagaaugugaccuu

SEQ ID NO: 1405520 - RNA, 19 nt, Homo sapiens
gcaacccuguggugaucau

SEQ ID NO: 1405521 - RNA, 19 nt, Homo sapiens
gcugagcgcagauccaaag

SEQ ID NO: 1405522 - RNA, 19 nt, Homo sapiens
aauucagucuguccaaaga

SEQ ID NO: 1405523 - RNA, 19 nt, Homo sapiens
gcuauccuccucuucuuuc

SEQ ID NO: 1405524 - RNA, 19 nt, Homo sapiens
cuacagaugcuuugguucu

SEQ ID NO: 1405525 - RNA, 19 nt, Homo sapiens
agacggucauccugcaaug

SEQ ID NO: 1405526 - RNA, 19 nt, Homo sapiens
acaauucuccauuucacuu

SEQ ID NO: 1405527 - RNA, 19 nt, Homo sapiens
gagcucuacaacagaauau

SEQ ID NO: 1405528 - RNA, 19 nt, Homo sapiens
guuugacauuuaccaucua

SEQ ID NO: 1405529 - RNA, 19 nt, Homo sapiens
gccucucucuugcuuacaa

SEQ ID NO: 1405530 - RNA, 19 nt, Homo sapiens
gucacucacuuacccuaug

SEQ ID NO: 1405531 - RNA, 19 nt, Homo sapiens
ugagcucuacaacagaaua

SEQ ID NO: 1405532 - RNA, 19 nt, Homo sapiens
auccaaaguugucuucugu

SEQ ID NO: 1405533 - RNA, 19 nt, Homo sapiens
cagggaggacucugaugaa

SEQ ID NO: 1405534 - RNA, 19 nt, Homo sapiens
ugaacagggaggacucuga

SEQ ID NO: 1405535 - RNA, 19 nt, Homo sapiens
gggaggacucugaugaaca

SEQ ID NO: 1405536 - RNA, 19 nt, Homo sapiens
ggucacgggaguccacaga

SEQ ID NO: 1405537 - RNA, 19 nt, Homo sapiens
gcagcaccaugucgcucau

SEQ ID NO: 1405538 - RNA, 19 nt, Homo sapiens
gagaaaacacacuccuuug

SEQ ID NO: 1405539 - RNA, 19 nt, Homo sapiens
cugcaauguuggucagaug

SEQ ID NO: 1405540 - RNA, 19 nt, Homo sapiens
gcagauccaaaguugucuu

SEQ ID NO: 1405541 - RNA, 19 nt, Homo sapiens
ucugaaggacaacauguga

SEQ ID NO: 1405542 - RNA, 19 nt, Homo sapiens
agcccacaauucuccauuu

SEQ ID NO: 1405543 - RNA, 19 nt, Homo sapiens
gagacggucauccugcaau

SEQ ID NO: 1405544 - RNA, 19 nt, Homo sapiens
uugcuuagcccacaauucu

SEQ ID NO: 1405545 - RNA, 19 nt, Homo sapiens
aaaacacacuccuuugcuu

SEQ ID NO: 1405546 - RNA, 19 nt, Homo sapiens
caucguggucguaggucua

SEQ ID NO: 1405547 - RNA, 19 nt, Homo sapiens
ggaagaaacugcaauuuua

SEQ ID NO: 1405548 - RNA, 19 nt, Homo sapiens
gaaaaucacuugacaauga

SEQ ID NO: 1405549 - RNA, 19 nt, Homo sapiens
gaagaaggauggugguuug

SEQ ID NO: 1405550 - RNA, 19 nt, Homo sapiens
guagaaagcuccaagcaau

SEQ ID NO: 1405551 - RNA, 19 nt, Homo sapiens
aaacaagacucugaacaua

SEQ ID NO: 1405552 - RNA, 19 nt, Homo sapiens
gcaauaacuuaaaccagua

SEQ ID NO: 1405553 - RNA, 19 nt, Homo sapiens
gaaauuagcuaugccaaag

SEQ ID NO: 1405554 - RNA, 19 nt, Homo sapiens
gaaagacacagcagcguua

SEQ ID NO: 1405555 - RNA, 19 nt, Homo sapiens
gggcaaaccuggaaauuag

SEQ ID NO: 1405556 - RNA, 19 nt, Homo sapiens
cagcaaaucuugucauuag

SEQ ID NO: 1405557 - RNA, 19 nt, Homo sapiens
caagaaacaugaagcacuu

SEQ ID NO: 1405558 - RNA, 19 nt, Homo sapiens
gcaaagagccagaaagaca

SEQ ID NO: 1405559 - RNA, 19 nt, Homo sapiens
caaacugucaucaauguua

SEQ ID NO: 1405560 - RNA, 19 nt, Homo sapiens
caacuggaaucagcaaauu

SEQ ID NO: 1405561 - RNA, 19 nt, Homo sapiens
gagaacaauuugaaacuag

SEQ ID NO: 1405562 - RNA, 19 nt, Homo sapiens
gaagcgaacuccuacaaac

SEQ ID NO: 1405563 - RNA, 19 nt, Homo sapiens
ccaaaggacuucagaaacu

SEQ ID NO: 1405564 - RNA, 19 nt, Homo sapiens
ugaagaagauccuaacagu

SEQ ID NO: 1405565 - RNA, 19 nt, Homo sapiens
ucagcaagauugacauuga

SEQ ID NO: 1405566 - RNA, 19 nt, Homo sapiens
ggaguuaccuucaaaugcu

SEQ ID NO: 1405567 - RNA, 19 nt, Homo sapiens
uagcagaacuugagcaaag

SEQ ID NO: 1405568 - RNA, 19 nt, Homo sapiens
ccagacacauuucaacaug

SEQ ID NO: 1405569 - RNA, 19 nt, Homo sapiens
gaaggauggugguuuggau

SEQ ID NO: 1405570 - RNA, 19 nt, Homo sapiens
guuaacggauuacuuugaa

SEQ ID NO: 1405571 - RNA, 19 nt, Homo sapiens
gaugaugaguugaauuugg

SEQ ID NO: 1405572 - RNA, 19 nt, Homo sapiens
agcggaagcuccucaauaa

SEQ ID NO: 1405573 - RNA, 19 nt, Homo sapiens
gagcaaagcauuacagaac

SEQ ID NO: 1405574 - RNA, 19 nt, Homo sapiens
gcaagaugaugaguugaau

SEQ ID NO: 1405575 - RNA, 19 nt, Homo sapiens
gccaaacccugaccacaug

SEQ ID NO: 1405576 - RNA, 19 nt, Homo sapiens
gauggugguuuggaucuuu

SEQ ID NO: 1405577 - RNA, 19 nt, Homo sapiens
ggaaauuagcuaugccaaa

SEQ ID NO: 1405578 - RNA, 19 nt, Homo sapiens
caggcaagaugaugaguug

SEQ ID NO: 1405579 - RNA, 19 nt, Homo sapiens
caaaucugaguuccuguua

SEQ ID NO: 1405580 - RNA, 19 nt, Homo sapiens
caaauuaaggccaagaaga

SEQ ID NO: 1405581 - RNA, 19 nt, Homo sapiens
uagagaauauugugagcaa

SEQ ID NO: 1405582 - RNA, 19 nt, Homo sapiens
ggagcauacucauagcuau

SEQ ID NO: 1405583 - RNA, 19 nt, Homo sapiens
caacccagccauccuugua

SEQ ID NO: 1405584 - RNA, 19 nt, Homo sapiens
cagcagcguuaauggauga

SEQ ID NO: 1405585 - RNA, 19 nt, Homo sapiens
caguacagccaacauauuu

SEQ ID NO: 1405586 - RNA, 19 nt, Homo sapiens
ggaaaagggugacauugug

SEQ ID NO: 1405587 - RNA, 19 nt, Homo sapiens
gaaaaggagcauacucaua

SEQ ID NO: 1405588 - RNA, 19 nt, Homo sapiens
ccuacaaacugucaucaau

SEQ ID NO: 1405589 - RNA, 19 nt, Homo sapiens
cagcaagauugacauugaa

SEQ ID NO: 1405590 - RNA, 19 nt, Homo sapiens
gaaggaaagaauucaacuu

SEQ ID NO: 1405591 - RNA, 19 nt, Homo sapiens
guuaauggaugagaacaau

SEQ ID NO: 1405592 - RNA, 19 nt, Homo sapiens
ggaagcuccucaauaaacu

SEQ ID NO: 1405593 - RNA, 19 nt, Homo sapiens
gcagagcaauccagguucu

SEQ ID NO: 1405594 - RNA, 19 nt, Homo sapiens
uacaaacugucaucaaugu

SEQ ID NO: 1405595 - RNA, 19 nt, Homo sapiens
ggaagcgaacuccuacaaa

SEQ ID NO: 1405596 - RNA, 19 nt, Homo sapiens
ggauuacuuugaagaagau

SEQ ID NO: 1405597 - RNA, 19 nt, Homo sapiens
aaagauauccaggcuguaa

SEQ ID NO: 1405598 - RNA, 19 nt, Homo sapiens
aaauuaaggccaagaagaa

SEQ ID NO: 1405599 - RNA, 19 nt, Homo sapiens
cagcucagcagcagacuuu

SEQ ID NO: 1405600 - RNA, 19 nt, Homo sapiens
acagugcaauggauaaaga

SEQ ID NO: 1405601 - RNA, 19 nt, Homo sapiens
gggcagagcaauccagguu

SEQ ID NO: 1405602 - RNA, 19 nt, Homo sapiens
caaaggacuucagaaacug

SEQ ID NO: 1405603 - RNA, 19 nt, Homo sapiens
gaaacuagaccuuuuggaa

SEQ ID NO: 1405604 - RNA, 19 nt, Homo sapiens
cggauuacuuugaagaaga

SEQ ID NO: 1405605 - RNA, 19 nt, Homo sapiens
ccgcuuauguggaggaguu

SEQ ID NO: 1405606 - RNA, 19 nt, Homo sapiens
gagauuagagaauauugug

SEQ ID NO: 1405607 - RNA, 19 nt, Homo sapiens
gggacccacugacagauug

SEQ ID NO: 1405608 - RNA, 19 nt, Homo sapiens
caaaucuugucauuagcaa

SEQ ID NO: 1405609 - RNA, 19 nt, Homo sapiens
uacaagagaagaagagaaa

SEQ ID NO: 1405610 - RNA, 19 nt, Homo sapiens
caagcugagcaaagcauua

SEQ ID NO: 1405611 - RNA, 19 nt, Homo sapiens
gauaaagagagacgaaagu

SEQ ID NO: 1405612 - RNA, 19 nt, Homo sapiens
ccuguuaacggauuacuuu

SEQ ID NO: 1405613 - RNA, 19 nt, Homo sapiens
gaacuccuacaaacuguca

SEQ ID NO: 1405614 - RNA, 19 nt, Homo sapiens
cagauucacugugccauca

SEQ ID NO: 1405615 - RNA, 19 nt, Homo sapiens
caagcaagcugagcaaagc

SEQ ID NO: 1405616 - RNA, 19 nt, Homo sapiens
aaacauggcggguuauucu

SEQ ID NO: 1405617 - RNA, 19 nt, Homo sapiens
cagugugguucaaauaaga

SEQ ID NO: 1405618 - RNA, 19 nt, Homo sapiens
uggaggaguuaccuucaaa

SEQ ID NO: 1405619 - RNA, 19 nt, Homo sapiens
cagacacauuucaacauga

SEQ ID NO: 1405620 - RNA, 19 nt, Homo sapiens
ggagaaggaaagaauucaa

SEQ ID NO: 1405621 - RNA, 19 nt, Homo sapiens
ggaaaaggaagaugaaaau

SEQ ID NO: 1405622 - RNA, 19 nt, Homo sapiens
aagcggaagcuccucaaua

SEQ ID NO: 1405623 - RNA, 19 nt, Homo sapiens
gcaacuggaaucagcaaau

SEQ ID NO: 1405624 - RNA, 19 nt, Homo sapiens
gcaaaucuugucauuagca

SEQ ID NO: 1405625 - RNA, 19 nt, Homo sapiens
cagcggaccugcaucaaaa

SEQ ID NO: 1405626 - RNA, 19 nt, Homo sapiens
acaagacucugaacauacu

SEQ ID NO: 1405627 - RNA, 19 nt, Homo sapiens
ggaugagaacaauuugaaa

SEQ ID NO: 1405628 - RNA, 19 nt, Homo sapiens
uaacggauuacuuugaaga

SEQ ID NO: 1405629 - RNA, 19 nt, Homo sapiens
guaaucaacaauacagugu

SEQ ID NO: 1405630 - RNA, 19 nt, Homo sapiens
gcaaagcauuacagaacac

SEQ ID NO: 1405631 - RNA, 19 nt, Homo sapiens
gaggaguuaccuucaaaug

SEQ ID NO: 1405632 - RNA, 19 nt, Homo sapiens
gcaagcaagcugagcaaag

SEQ ID NO: 1405633 - RNA, 19 nt, Homo sapiens
gacaaaagccagacacauu

SEQ ID NO: 1405634 - RNA, 19 nt, Homo sapiens
ggccuggaacgaaugcuua

SEQ ID NO: 1405635 - RNA, 19 nt, Homo sapiens
aaaucugaguuccuguuaa

SEQ ID NO: 1405636 - RNA, 19 nt, Homo sapiens
ccaagcaaucuaugacuga

SEQ ID NO: 1405637 - RNA, 19 nt, Homo sapiens
cuuaucaaguccuaaaugu

SEQ ID NO: 1405638 - RNA, 19 nt, Homo sapiens
cgggcaaaccuggaaauua

SEQ ID NO: 1405639 - RNA, 19 nt, Homo sapiens
aaacuuggcaaagcaauug

SEQ ID NO: 1405640 - RNA, 19 nt, Homo sapiens
aaacugucaucaauguuag

SEQ ID NO: 1405641 - RNA, 19 nt, Homo sapiens
cagcguuaauggaugagaa

SEQ ID NO: 1405642 - RNA, 19 nt, Homo sapiens
uaucaaguccuaaauguac

SEQ ID NO: 1405643 - RNA, 19 nt, Homo sapiens
gcgaacuccuacaaacugu

SEQ ID NO: 1405644 - RNA, 19 nt, Homo sapiens
ccaguacagccaacauauu

SEQ ID NO: 1405645 - RNA, 19 nt, Homo sapiens
gagaaaaucacuugacaau

SEQ ID NO: 1405646 - RNA, 19 nt, Homo sapiens
guacaagagaagaagagaa

SEQ ID NO: 1405647 - RNA, 19 nt, Homo sapiens
gcaacaagcugaagauuau

SEQ ID NO: 1405648 - RNA, 19 nt, Homo sapiens
gaaauuugcucuguagaua

SEQ ID NO: 1405649 - RNA, 19 nt, Homo sapiens
caacauaccugacaauuuc

SEQ ID NO: 1405650 - RNA, 19 nt, Homo sapiens
aggaagagcuccaguauua

SEQ ID NO: 1405651 - RNA, 19 nt, Homo sapiens
ggacaaagcagaauugauu

SEQ ID NO: 1405652 - RNA, 19 nt, Homo sapiens
gaacucagccuuucuuaaa

SEQ ID NO: 1405653 - RNA, 19 nt, Homo sapiens
gcgaagaccuuggcauuua

SEQ ID NO: 1405654 - RNA, 19 nt, Homo sapiens
ggaagagucuaaagaauau

SEQ ID NO: 1405655 - RNA, 19 nt, Homo sapiens
agacagagauggcaacaua

SEQ ID NO: 1405656 - RNA, 19 nt, Homo sapiens
ggagaaggcaugcaaguua

SEQ ID NO: 1405657 - RNA, 19 nt, Homo sapiens
gaacaauccuuuagugcaa

SEQ ID NO: 1405658 - RNA, 19 nt, Homo sapiens
aaacagaaaucacgaauuc

SEQ ID NO: 1405659 - RNA, 19 nt, Homo sapiens
uaaaggaugugaagagauu

SEQ ID NO: 1405660 - RNA, 19 nt, Homo sapiens
aaacacagcuccuuucuuc

SEQ ID NO: 1405661 - RNA, 19 nt, Homo sapiens
gcaagagaaugugcuauuu

SEQ ID NO: 1405662 - RNA, 19 nt, Homo sapiens
ggaaggcuuuggagaagua

SEQ ID NO: 1405663 - RNA, 19 nt, Homo sapiens
ggagaggguuucugcagua

SEQ ID NO: 1405664 - RNA, 19 nt, Homo sapiens
gagaaggcaugcaaguuaa

SEQ ID NO: 1405665 - RNA, 19 nt, Homo sapiens
gaauauagaccuggaaauu

SEQ ID NO: 1405666 - RNA, 19 nt, Homo sapiens
caacuccacuguuuccuuu

SEQ ID NO: 1405667 - RNA, 19 nt, Homo sapiens
cgaaggcggugaaagaauu

SEQ ID NO: 1405668 - RNA, 19 nt, Homo sapiens
ggagaagccaacaacauua

SEQ ID NO: 1405669 - RNA, 19 nt, Homo sapiens
caacagccaguuacaauuu

SEQ ID NO: 1405670 - RNA, 19 nt, Homo sapiens
caacaacauuaacugcuaa

SEQ ID NO: 1405671 - RNA, 19 nt, Homo sapiens
caaacucgcugcccaggaa

SEQ ID NO: 1405672 - RNA, 19 nt, Homo sapiens
caagaaagaggaagugaaa

SEQ ID NO: 1405673 - RNA, 19 nt, Homo sapiens
caagaaauuugcucuguag

SEQ ID NO: 1405674 - RNA, 19 nt, Homo sapiens
ggaucacacugccuucuuu

SEQ ID NO: 1405675 - RNA, 19 nt, Homo sapiens
gaggguuucugcaguaauu

SEQ ID NO: 1405676 - RNA, 19 nt, Homo sapiens
gacaggccauucuuuauau

SEQ ID NO: 1405677 - RNA, 19 nt, Homo sapiens
ggagcugauuggagaauuu

SEQ ID NO: 1405678 - RNA, 19 nt, Homo sapiens
ugaacacucuggaaaugua

SEQ ID NO: 1405679 - RNA, 19 nt, Homo sapiens
gaaggaagagcuccaguau

SEQ ID NO: 1405680 - RNA, 19 nt, Homo sapiens
ccaacaacauuaacugcua

SEQ ID NO: 1405681 - RNA, 19 nt, Homo sapiens
gcaacauaccugacaauuu

SEQ ID NO: 1405682 - RNA, 19 nt, Homo sapiens
aaaggcaacuguuccauga

SEQ ID NO: 1405683 - RNA, 19 nt, Homo sapiens
aaauagaggugcuucaaau

SEQ ID NO: 1405684 - RNA, 19 nt, Homo sapiens
ugaagagaauuuccaagaa

SEQ ID NO: 1405685 - RNA, 19 nt, Homo sapiens
gauaaccugucuggagaua

SEQ ID NO: 1405686 - RNA, 19 nt, Homo sapiens
ccucaugccugucuucaaa

SEQ ID NO: 1405687 - RNA, 19 nt, Homo sapiens
uaccauagauucucuuguu

SEQ ID NO: 1405688 - RNA, 19 nt, Homo sapiens
ggacagagaagcagugugu

SEQ ID NO: 1405689 - RNA, 19 nt, Homo sapiens
caaacucuaugacaguaaa

SEQ ID NO: 1405690 - RNA, 19 nt, Homo sapiens
cagaggaggucaagaggaa

SEQ ID NO: 1405691 - RNA, 19 nt, Homo sapiens
ucaagaaauuugcucugua

SEQ ID NO: 1405692 - RNA, 19 nt, Homo sapiens
gcagccagaugccagcuuu

SEQ ID NO: 1405693 - RNA, 19 nt, Homo sapiens
gcgccaagaugcuucuaaa

SEQ ID NO: 1405694 - RNA, 19 nt, Homo sapiens
agaaguaccugagaucauu

SEQ ID NO: 1405695 - RNA, 19 nt, Homo sapiens
ccagaaagcgucaguaugu

SEQ ID NO: 1405696 - RNA, 19 nt, Homo sapiens
ccaaguggauguagcauag

SEQ ID NO: 1405697 - RNA, 19 nt, Homo sapiens
gaaaaggaguuaucuguca

SEQ ID NO: 1405698 - RNA, 19 nt, Homo sapiens
gcaccugauuuccaacaaa

SEQ ID NO: 1405699 - RNA, 19 nt, Homo sapiens
gggaagaccuaaaauauga

SEQ ID NO: 1405700 - RNA, 19 nt, Homo sapiens
gaagccauuucccaucauu

SEQ ID NO: 1405701 - RNA, 19 nt, Homo sapiens
gaccuucauugaucaguuu

SEQ ID NO: 1405702 - RNA, 19 nt, Homo sapiens
ggacagagcagacuuuagg

SEQ ID NO: 1405703 - RNA, 19 nt, Homo sapiens
ggccaugccugugugcuua

SEQ ID NO: 1405704 - RNA, 19 nt, Homo sapiens
aaaagugacugcugaauuu

SEQ ID NO: 1405705 - RNA, 19 nt, Homo sapiens
gagcagacuuuaggagcua

SEQ ID NO: 1405706 - RNA, 19 nt, Homo sapiens
cagagagacuguuaccauu

SEQ ID NO: 1405707 - RNA, 19 nt, Homo sapiens
gagaagccaacaacauuaa

SEQ ID NO: 1405708 - RNA, 19 nt, Homo sapiens
gggagaagccaacaacauu

SEQ ID NO: 1405709 - RNA, 19 nt, Homo sapiens
ggcaacaagcugaagauua

SEQ ID NO: 1405710 - RNA, 19 nt, Homo sapiens
gaaacaucauuaucacaca

SEQ ID NO: 1405711 - RNA, 19 nt, Homo sapiens
caaacucgaaacaucauua

SEQ ID NO: 1405712 - RNA, 19 nt, Homo sapiens
gaacgugaguuagagaaag

SEQ ID NO: 1405713 - RNA, 19 nt, Homo sapiens
gaaaauagaaucagcagaa

SEQ ID NO: 1405714 - RNA, 19 nt, Homo sapiens
gagcagagcaucucagaag

SEQ ID NO: 1405715 - RNA, 19 nt, Homo sapiens
ugucuucacucaaaugauu

SEQ ID NO: 1405716 - RNA, 19 nt, Homo sapiens
cagcugaaguucucaaaca

SEQ ID NO: 1405717 - RNA, 19 nt, Homo sapiens
gaaggcaugcaaguuaaua

SEQ ID NO: 1405718 - RNA, 19 nt, Homo sapiens
ggaaaccuuugcccucuuc

SEQ ID NO: 1405719 - RNA, 19 nt, Homo sapiens
caaauaccuugcuguguca

SEQ ID NO: 1405720 - RNA, 19 nt, Homo sapiens
ccaaagaaggcaacacaaa

SEQ ID NO: 1405721 - RNA, 19 nt, Homo sapiens
caaagaaggcaacacaaau

SEQ ID NO: 1405722 - RNA, 19 nt, Homo sapiens
agacaggccauucuuuaua

SEQ ID NO: 1405723 - RNA, 19 nt, Homo sapiens
ccugagaucauuccuauuu

SEQ ID NO: 1405724 - RNA, 19 nt, Homo sapiens
cacgacaacugacaaauuc

SEQ ID NO: 1405725 - RNA, 19 nt, Homo sapiens
uggaagagucuaaagaaua

SEQ ID NO: 1405726 - RNA, 19 nt, Homo sapiens
acauuuagcugagggagua

SEQ ID NO: 1405727 - RNA, 19 nt, Homo sapiens
caguauguguuuccuguuu

SEQ ID NO: 1405728 - RNA, 19 nt, Homo sapiens
ccaauuuccuucccaagug

SEQ ID NO: 1405729 - RNA, 19 nt, Homo sapiens
ugagaacaauccuuuagug

SEQ ID NO: 1405730 - RNA, 19 nt, Homo sapiens
aaagaaggcaacacaaauu

SEQ ID NO: 1405731 - RNA, 19 nt, Homo sapiens
gguauuaugccaagaucua

SEQ ID NO: 1405732 - RNA, 19 nt, Homo sapiens
uagcauaggccaaauacaa

SEQ ID NO: 1405733 - RNA, 19 nt, Homo sapiens
agauaagugugauagagua

SEQ ID NO: 1405734 - RNA, 19 nt, Homo sapiens
gaucacacugccuucuuua

SEQ ID NO: 1405735 - RNA, 19 nt, Homo sapiens
ggaaugcuauguucaaaau

SEQ ID NO: 1405736 - RNA, 19 nt, Homo sapiens
cgaagaccuuggcauuuau

SEQ ID NO: 1405737 - RNA, 19 nt, Homo sapiens
cuaguugucuuccaauaau

SEQ ID NO: 1405738 - RNA, 19 nt, Homo sapiens
gaaacuggagggaaggaaa

SEQ ID NO: 1405739 - RNA, 19 nt, Homo sapiens
ccacgacaacugacaaauu

SEQ ID NO: 1405740 - RNA, 19 nt, Homo sapiens
gaaagaggaagugaaacaa

SEQ ID NO: 1405741 - RNA, 19 nt, Homo sapiens
gagaggguuucugcaguaa

SEQ ID NO: 1405742 - RNA, 19 nt, Homo sapiens
gaugaaacacagcuccuuu

SEQ ID NO: 1405743 - RNA, 19 nt, Homo sapiens
uaccugagaucauuccuau

SEQ ID NO: 1405744 - RNA, 19 nt, Homo sapiens
agagaaagccccuaaguua

SEQ ID NO: 1405745 - RNA, 19 nt, Homo sapiens
acacacagcuagugaaggu

SEQ ID NO: 1405746 - RNA, 19 nt, Homo sapiens
gagugauccuccucaggua

SEQ ID NO: 1405747 - RNA, 19 nt, Homo sapiens
gagagaaccuguacuauga

SEQ ID NO: 1405748 - RNA, 19 nt, Homo sapiens
ggauggagcuggacaauca

SEQ ID NO: 1405749 - RNA, 19 nt, Homo sapiens
cagaugagcuguccuuuga

SEQ ID NO: 1405750 - RNA, 19 nt, Homo sapiens
gaggaggcgucacucaaua

SEQ ID NO: 1405751 - RNA, 19 nt, Homo sapiens
uaaaccaucugacaacauu

SEQ ID NO: 1405752 - RNA, 19 nt, Homo sapiens
ggagagaaccuguacuaug

SEQ ID NO: 1405753 - RNA, 19 nt, Homo sapiens
caggguaucucgucucuga

SEQ ID NO: 1405754 - RNA, 19 nt, Homo sapiens
ccaaccaaaucccuuguuu

SEQ ID NO: 1405755 - RNA, 19 nt, Homo sapiens
gugggucccuaaccuauaa

SEQ ID NO: 1405756 - RNA, 19 nt, Homo sapiens
gcuggucccuccacucuga

SEQ ID NO: 1405757 - RNA, 19 nt, Homo sapiens
guaacuugcuucugaugug

SEQ ID NO: 1405758 - RNA, 19 nt, Homo sapiens
ccagguuucuaacuuugua

SEQ ID NO: 1405759 - RNA, 19 nt, Homo sapiens
gagaaccuguacuaugaga

SEQ ID NO: 1405760 - RNA, 19 nt, Homo sapiens
gaacccagcacgccucaug

SEQ ID NO: 1405761 - RNA, 19 nt, Homo sapiens
ccauggagcuggagucagu

SEQ ID NO: 1405762 - RNA, 19 nt, Homo sapiens
caucugacaacauuaauga

SEQ ID NO: 1405763 - RNA, 19 nt, Homo sapiens
gaggguccuuguacagaaa

SEQ ID NO: 1405764 - RNA, 19 nt, Homo sapiens
ggacaacuccuacccuucu

SEQ ID NO: 1405765 - RNA, 19 nt, Homo sapiens
acacugagaucugccaaga

SEQ ID NO: 1405766 - RNA, 19 nt, Homo sapiens
ggcacgaguuugacaguga

SEQ ID NO: 1405767 - RNA, 19 nt, Homo sapiens
gaaccuguacuaugagauc

SEQ ID NO: 1405768 - RNA, 19 nt, Homo sapiens
ccacuaaaccaucugacaa

SEQ ID NO: 1405769 - RNA, 19 nt, Homo sapiens
cgaggguccuuguacagaa

SEQ ID NO: 1405770 - RNA, 19 nt, Homo sapiens
cgaacccucugcucaccua

SEQ ID NO: 1405771 - RNA, 19 nt, Homo sapiens
cuuuguaacuugcuucuga

SEQ ID NO: 1405772 - RNA, 19 nt, Homo sapiens
cuacgagaacguugacuuu

SEQ ID NO: 1405773 - RNA, 19 nt, Homo sapiens
ucccuaaccuauaaucuca

SEQ ID NO: 1405774 - RNA, 19 nt, Homo sapiens
caugugaucaaacgguaua

SEQ ID NO: 1405775 - RNA, 19 nt, Homo sapiens
cggcaugcuuggccaauca

SEQ ID NO: 1405776 - RNA, 19 nt, Homo sapiens
gagcgaggagucucuguca

SEQ ID NO: 1405777 - RNA, 19 nt, Homo sapiens
gagagaaugagcugguguu

SEQ ID NO: 1405778 - RNA, 19 nt, Homo sapiens
gaugugggucccuaaccua

SEQ ID NO: 1405779 - RNA, 19 nt, Homo sapiens
guguuuggcugcgaucuug

SEQ ID NO: 1405780 - RNA, 19 nt, Homo sapiens
ccagaugagcuguccuuug

SEQ ID NO: 1405781 - RNA, 19 nt, Homo sapiens
ggccugugcucaccuggau

SEQ ID NO: 1405782 - RNA, 19 nt, Homo sapiens
uaaccuauaaucucagcuu

SEQ ID NO: 1405783 - RNA, 19 nt, Homo sapiens
gcgaggagucucugucauc

SEQ ID NO: 1405784 - RNA, 19 nt, Homo sapiens
gacaacuccuacccuucuu

SEQ ID NO: 1405785 - RNA, 19 nt, Homo sapiens
uaccaaggcaacaaaguga

SEQ ID NO: 1405786 - RNA, 19 nt, Homo sapiens
ucucaggcgugucuuccaa

SEQ ID NO: 1405787 - RNA, 19 nt, Homo sapiens
caacuccuacccuucuuuc

SEQ ID NO: 1405788 - RNA, 19 nt, Homo sapiens
ucagugaggccaugucagu

SEQ ID NO: 1405789 - RNA, 19 nt, Homo sapiens
ccaaggcaacaaagugaug

SEQ ID NO: 1405790 - RNA, 19 nt, Homo sapiens
caacucaggccaggaugug

SEQ ID NO: 1405791 - RNA, 19 nt, Homo sapiens
ugacuuucguucccuggau

SEQ ID NO: 1405792 - RNA, 19 nt, Homo sapiens
gcgagcaccucagcaacuc

SEQ ID NO: 1405793 - RNA, 19 nt, Homo sapiens
cuccaccggugcauauuug

SEQ ID NO: 1405794 - RNA, 19 nt, Homo sapiens
ugaccaccuuggcuacuca

SEQ ID NO: 1405795 - RNA, 19 nt, Homo sapiens
ggaguuacgaugacuuucg

SEQ ID NO: 1405796 - RNA, 19 nt, Homo sapiens
cagugucccucgaaagaag

SEQ ID NO: 1405797 - RNA, 19 nt, Homo sapiens
ucaccuaccagcucuaugg

SEQ ID NO: 1405798 - RNA, 19 nt, Homo sapiens
aggcgugucuuccaacauc

SEQ ID NO: 1405799 - RNA, 19 nt, Homo sapiens
aaccaucugacaacauuaa

SEQ ID NO: 1405800 - RNA, 19 nt, Homo sapiens
ccgacuuccugcucagcua

SEQ ID NO: 1405801 - RNA, 19 nt, Homo sapiens
ggcccacucgguccugaua

SEQ ID NO: 1405802 - RNA, 19 nt, Homo sapiens
acgagaacguugacuuugg

SEQ ID NO: 1405803 - RNA, 19 nt, Homo sapiens
gcaacucaggccaggaugu

SEQ ID NO: 1405804 - RNA, 19 nt, Homo sapiens
ggaggcgucacucaauauc

SEQ ID NO: 1405805 - RNA, 19 nt, Homo sapiens
caccgaggguccuuguaca

SEQ ID NO: 1405806 - RNA, 19 nt, Homo sapiens
ggugguggaugggaucuac

SEQ ID NO: 1405807 - RNA, 19 nt, Homo sapiens
agaaauggagggcaaagag

SEQ ID NO: 1405808 - RNA, 19 nt, Homo sapiens
cuacgucaaccuagcucua

SEQ ID NO: 1405809 - RNA, 19 nt, Homo sapiens
gggagagaaccuguacuau

SEQ ID NO: 1405810 - RNA, 19 nt, Homo sapiens
ucuaugggaaguucaguga

SEQ ID NO: 1405811 - RNA, 19 nt, Homo sapiens
ccauguggacguccuguuc

SEQ ID NO: 1405812 - RNA, 19 nt, Homo sapiens
gcgcccauuuccacuacga

SEQ ID NO: 1405813 - RNA, 19 nt, Homo sapiens
ggggagagaaccuguacua

SEQ ID NO: 1405814 - RNA, 19 nt, Homo sapiens
uuaccaaggcaacaaagug

SEQ ID NO: 1405815 - RNA, 19 nt, Homo sapiens
cccagugucccucgaaaga

SEQ ID NO: 1405816 - RNA, 19 nt, Homo sapiens
ccagcucuaugggaaguuc

SEQ ID NO: 1405817 - RNA, 19 nt, Homo sapiens
cagcaacucaggccaggau

SEQ ID NO: 1405818 - RNA, 19 nt, Homo sapiens
ccggaguuacgaugacuuu

SEQ ID NO: 1405819 - RNA, 19 nt, Homo sapiens
ugcaguaccuggagacacu

SEQ ID NO: 1405820 - RNA, 19 nt, Homo sapiens
cccacucgguccugauaug

SEQ ID NO: 1405821 - RNA, 19 nt, Homo sapiens
cgacaccgucacacugaga

SEQ ID NO: 1405822 - RNA, 19 nt, Homo sapiens
ucaggcgugucuuccaaca

SEQ ID NO: 1405823 - RNA, 19 nt, Homo sapiens
ggacaagguucucgacaug

SEQ ID NO: 1405824 - RNA, 19 nt, Homo sapiens
ugaagaggcuggagaagga

SEQ ID NO: 1405825 - RNA, 19 nt, Homo sapiens
gaggaggccuucugugugu

SEQ ID NO: 1405826 - RNA, 19 nt, Homo sapiens
gggaugaagugacccuuga

SEQ ID NO: 1405827 - RNA, 19 nt, Homo sapiens
gggaagugcucaggaggua

SEQ ID NO: 1405828 - RNA, 19 nt, Homo sapiens
cuacuucccuuucuucaug

SEQ ID NO: 1405829 - RNA, 19 nt, Homo sapiens
cuuccuagcugcccacuuu

SEQ ID NO: 1405830 - RNA, 19 nt, Homo sapiens
gaggagaacuacgucauca

SEQ ID NO: 1405831 - RNA, 19 nt, Homo sapiens
aggagaagcugcucaagga

SEQ ID NO: 1405832 - RNA, 19 nt, Homo sapiens
gcaucuaucaguucgagua

SEQ ID NO: 1405833 - RNA, 19 nt, Homo sapiens
gguccucggucuccaucua

SEQ ID NO: 1405834 - RNA, 19 nt, Homo sapiens
gcugacugcucucuuaaca

SEQ ID NO: 1405835 - RNA, 19 nt, Homo sapiens
ggauugaaacccuagagaa

SEQ ID NO: 1405836 - RNA, 19 nt, Homo sapiens
ggacaugcccgucaagaac

SEQ ID NO: 1405837 - RNA, 19 nt, Homo sapiens
guaccuggcugcacagaac

SEQ ID NO: 1405838 - RNA, 19 nt, Homo sapiens
gaaggcauacucgcuggua

SEQ ID NO: 1405839 - RNA, 19 nt, Homo sapiens
ggaaggagaagcugcucaa

SEQ ID NO: 1405840 - RNA, 19 nt, Homo sapiens
caacacuccucgggaugaa

SEQ ID NO: 1405841 - RNA, 19 nt, Homo sapiens
ggagaacuacgucaucaag

SEQ ID NO: 1405842 - RNA, 19 nt, Homo sapiens
ugaugcagcuggacaugga

SEQ ID NO: 1405843 - RNA, 19 nt, Homo sapiens
ucccaaagcuuccacacau

SEQ ID NO: 1405844 - RNA, 19 nt, Homo sapiens
ggagaugcaggacaagguu

SEQ ID NO: 1405845 - RNA, 19 nt, Homo sapiens
ucaacgucaugaaggcaua

SEQ ID NO: 1405846 - RNA, 19 nt, Homo sapiens
gcucugggcuggacaucag

SEQ ID NO: 1405847 - RNA, 19 nt, Homo sapiens
ggaguacgcagccaugaag

SEQ ID NO: 1405848 - RNA, 19 nt, Homo sapiens
gaaccaggcggagcugaug

SEQ ID NO: 1405849 - RNA, 19 nt, Homo sapiens
gcacacugccuguucacau

SEQ ID NO: 1405850 - RNA, 19 nt, Homo sapiens
ugaagugacccuugacuag

SEQ ID NO: 1405851 - RNA, 19 nt, Homo sapiens
gauugaaacccuagagaag

SEQ ID NO: 1405852 - RNA, 19 nt, Homo sapiens
agaaccggcuccugaaaca

SEQ ID NO: 1405853 - RNA, 19 nt, Homo sapiens
ccuaccaggucaaguacaa

SEQ ID NO: 1405854 - RNA, 19 nt, Homo sapiens
cguugucucugcugaauca

SEQ ID NO: 1405855 - RNA, 19 nt, Homo sapiens
acaagguucucgacaugga

SEQ ID NO: 1405856 - RNA, 19 nt, Homo sapiens
ugaaacagcggauugaaac

SEQ ID NO: 1405857 - RNA, 19 nt, Homo sapiens
cacacugccuguucacaug

SEQ ID NO: 1405858 - RNA, 19 nt, Homo sapiens
uagaguagcgucacaagca

SEQ ID NO: 1405859 - RNA, 19 nt, Homo sapiens
ggggcugacugcucucuua

SEQ ID NO: 1405860 - RNA, 19 nt, Homo sapiens
ggaggagaacuacgucauc

SEQ ID NO: 1405861 - RNA, 19 nt, Homo sapiens
ccagaggucccagcacuga

SEQ ID NO: 1405862 - RNA, 19 nt, Homo sapiens
agacgcagcucagcgaaag

SEQ ID NO: 1405863 - RNA, 19 nt, Homo sapiens
caaccccgcucacggcuaa

SEQ ID NO: 1405864 - RNA, 19 nt, Homo sapiens
aagccuaccaggucaagua

SEQ ID NO: 1405865 - RNA, 19 nt, Homo sapiens
ccacuuccguucccaaagc

SEQ ID NO: 1405866 - RNA, 19 nt, Homo sapiens
uuacccaucuuggucugua

SEQ ID NO: 1405867 - RNA, 19 nt, Homo sapiens
ccacauccaccgcaaccuu

SEQ ID NO: 1405868 - RNA, 19 nt, Homo sapiens
gggcugacugcucucuuaa

SEQ ID NO: 1405869 - RNA, 19 nt, Homo sapiens
ucgaggacccgcuggcuuu

SEQ ID NO: 1405870 - RNA, 19 nt, Homo sapiens
ggacucaucgcaguacauc

SEQ ID NO: 1405871 - RNA, 19 nt, Homo sapiens
gagcaaggaggaggugaug

SEQ ID NO: 1405872 - RNA, 19 nt, Homo sapiens
cagcaguguuuacccaucu

SEQ ID NO: 1405873 - RNA, 19 nt, Homo sapiens
agaguagcgucacaagcaa

SEQ ID NO: 1405874 - RNA, 19 nt, Homo sapiens
uacaggagcagcaggagaa

SEQ ID NO: 1405875 - RNA, 19 nt, Homo sapiens
ccaguagaguagcgucaca

SEQ ID NO: 1405876 - RNA, 19 nt, Homo sapiens
ugagaacggugccaaaauc

SEQ ID NO: 1405877 - RNA, 19 nt, Homo sapiens
uaacaagcccacccaccau

SEQ ID NO: 1405878 - RNA, 19 nt, Homo sapiens
aggagaagcugcaguaccu

SEQ ID NO: 1405879 - RNA, 19 nt, Homo sapiens
cugaaacagcggauugaaa

SEQ ID NO: 1405880 - RNA, 19 nt, Homo sapiens
gagaaccggcuccugaaac

SEQ ID NO: 1405881 - RNA, 19 nt, Homo sapiens
ggagauggaggagcagauc

SEQ ID NO: 1405882 - RNA, 19 nt, Homo sapiens
ucuaucaguucgaguacau

SEQ ID NO: 1405883 - RNA, 19 nt, Homo sapiens
gcucugcaucuaucaguuc

SEQ ID NO: 1405884 - RNA, 19 nt, Homo sapiens
ccaucuacuucccuuucuu

SEQ ID NO: 1405885 - RNA, 19 nt, Homo sapiens
acgcagccaugaagagcaa

SEQ ID NO: 1405886 - RNA, 19 nt, Homo sapiens
ggucuuugacaucuucaug

SEQ ID NO: 1405887 - RNA, 19 nt, Homo sapiens
caaccucugacuccgagaa

SEQ ID NO: 1405888 - RNA, 19 nt, Homo sapiens
gaacggugccaaaauccaa

SEQ ID NO: 1405889 - RNA, 19 nt, Homo sapiens
ugccgcacuugacaaacua

SEQ ID NO: 1405890 - RNA, 19 nt, Homo sapiens
cacauccaccgcaaccuuu

SEQ ID NO: 1405891 - RNA, 19 nt, Homo sapiens
ccacccgggucuuugacau

SEQ ID NO: 1405892 - RNA, 19 nt, Homo sapiens
gcucgggcucugcaucuau

SEQ ID NO: 1405893 - RNA, 19 nt, Homo sapiens
caucuacuucccuuucuuc

SEQ ID NO: 1405894 - RNA, 19 nt, Homo sapiens
gcaguguuuacccaucuug

SEQ ID NO: 1405895 - RNA, 19 nt, Homo sapiens
uggaggagcagaucgagau

SEQ ID NO: 1405896 - RNA, 19 nt, Homo sapiens
ccaugaagagcaaggagau

SEQ ID NO: 1405897 - RNA, 19 nt, Homo sapiens
gcacggagccggaaguguu

SEQ ID NO: 1405898 - RNA, 19 nt, Homo sapiens
gcacucaguugaccuuauc

SEQ ID NO: 1405899 - RNA, 19 nt, Homo sapiens
ccuaugugaucaccucuua

SEQ ID NO: 1405900 - RNA, 19 nt, Homo sapiens
gcacgcagauccucuacuc

SEQ ID NO: 1405901 - RNA, 19 nt, Homo sapiens
ggacagugccuaugugauc

SEQ ID NO: 1405902 - RNA, 19 nt, Homo sapiens
acgaggagcugaucaagga

SEQ ID NO: 1405903 - RNA, 19 nt, Homo sapiens
gugaugagcaauaaacgua

SEQ ID NO: 1405904 - RNA, 19 nt, Homo sapiens
ggccuugagugcuaugcua

SEQ ID NO: 1405905 - RNA, 19 nt, Homo sapiens
ccacagacaucgcccucau

SEQ ID NO: 1405906 - RNA, 19 nt, Homo sapiens
ugugagugaugagcaauaa

SEQ ID NO: 1405907 - RNA, 19 nt, Homo sapiens
uaugugaucaccucuuaaa

SEQ ID NO: 1405908 - RNA, 19 nt, Homo sapiens
cgagguggcuggguguaug

SEQ ID NO: 1405909 - RNA, 19 nt, Homo sapiens
gacagugccuaugugauca

SEQ ID NO: 1405910 - RNA, 19 nt, Homo sapiens
ccaugagcuucguggcaua

SEQ ID NO: 1405911 - RNA, 19 nt, Homo sapiens
gccaucauccgcaccauug

SEQ ID NO: 1405912 - RNA, 19 nt, Homo sapiens
gaaggagcagugccugugu

SEQ ID NO: 1405913 - RNA, 19 nt, Homo sapiens
ccuccuggcugaugucaca

SEQ ID NO: 1405914 - RNA, 19 nt, Homo sapiens
uaccugaccuuggccagaa

SEQ ID NO: 1405915 - RNA, 19 nt, Homo sapiens
ggcacucaguugaccuuau

SEQ ID NO: 1405916 - RNA, 19 nt, Homo sapiens
ccagggacagugccuaugu

SEQ ID NO: 1405917 - RNA, 19 nt, Homo sapiens
gcgcuucugcuccuucuca

SEQ ID NO: 1405918 - RNA, 19 nt, Homo sapiens
ccagacauuagcaccauga

SEQ ID NO: 1405919 - RNA, 19 nt, Homo sapiens
gugagucccggaacuaugu

SEQ ID NO: 1405920 - RNA, 19 nt, Homo sapiens
cagggacagugccuaugug

SEQ ID NO: 1405921 - RNA, 19 nt, Homo sapiens
acagacaucgcccucauca

SEQ ID NO: 1405922 - RNA, 19 nt, Homo sapiens
gcaggcaaccaggcaagug

SEQ ID NO: 1405923 - RNA, 19 nt, Homo sapiens
ggaggugacccugcucucu

SEQ ID NO: 1405924 - RNA, 19 nt, Homo sapiens
cauacgaggagcugaucaa

SEQ ID NO: 1405925 - RNA, 19 nt, Homo sapiens
gaacagggauuucuaucaa

SEQ ID NO: 1405926 - RNA, 19 nt, Homo sapiens
cuacagcugucauaaauua

SEQ ID NO: 1405927 - RNA, 19 nt, Homo sapiens
gagcugagcccuacucuug

SEQ ID NO: 1405928 - RNA, 19 nt, Homo sapiens
aagaugagcugcuggagaa

SEQ ID NO: 1405929 - RNA, 19 nt, Homo sapiens
gaagguagaauguaagaag

SEQ ID NO: 1405930 - RNA, 19 nt, Homo sapiens
gagcgacucucgggcaauu

SEQ ID NO: 1405931 - RNA, 19 nt, Homo sapiens
gacgagaucuaugagcuuu

SEQ ID NO: 1405932 - RNA, 19 nt, Homo sapiens
ucuaugagcuuucuuaugc

SEQ ID NO: 1405933 - RNA, 19 nt, Homo sapiens
caagaauuaugacccugaa

SEQ ID NO: 1405934 - RNA, 19 nt, Homo sapiens
agucuguguucaagaauua

SEQ ID NO: 1405935 - RNA, 19 nt, Homo sapiens
gagaccaggugaagguaga

SEQ ID NO: 1405936 - RNA, 19 nt, Homo sapiens
gaagaagucauaggucguu

SEQ ID NO: 1405937 - RNA, 19 nt, Homo sapiens
uccaccagcugcagaauuu

SEQ ID NO: 1405938 - RNA, 19 nt, Homo sapiens
cccaagcccucaacuguga

SEQ ID NO: 1405939 - RNA, 19 nt, Homo sapiens
caacucagcccagagaaga

SEQ ID NO: 1405940 - RNA, 19 nt, Homo sapiens
ccagcuagaagaagucaua

SEQ ID NO: 1405941 - RNA, 19 nt, Homo sapiens
gcagagaccaggugaaggu

SEQ ID NO: 1405942 - RNA, 19 nt, Homo sapiens
ggaagucccaccaggaaug

SEQ ID NO: 1405943 - RNA, 19 nt, Homo sapiens
gaggaagucccaccaggaa

SEQ ID NO: 1405944 - RNA, 19 nt, Homo sapiens
caagcuggauuccuagaca

SEQ ID NO: 1405945 - RNA, 19 nt, Homo sapiens
cacaggugcuggacaaguu

SEQ ID NO: 1405946 - RNA, 19 nt, Homo sapiens
agaaaugcauccaguccuu

SEQ ID NO: 1405947 - RNA, 19 nt, Homo sapiens
gaaaagacaguaagaggaa

SEQ ID NO: 1405948 - RNA, 19 nt, Homo sapiens
gguaggcgccugacagaug

SEQ ID NO: 1405949 - RNA, 19 nt, Homo sapiens
gagucuguguucaagaauu

SEQ ID NO: 1405950 - RNA, 19 nt, Homo sapiens
gcgggaagcaugaacagaa

SEQ ID NO: 1405951 - RNA, 19 nt, Homo sapiens
cgggaagcaugaacagaaa

SEQ ID NO: 1405952 - RNA, 19 nt, Homo sapiens
gagccgcguugucccaaga

SEQ ID NO: 1405953 - RNA, 19 nt, Homo sapiens
acagggauuucuaucaaug

SEQ ID NO: 1405954 - RNA, 19 nt, Homo sapiens
cggaagacgagaucuauga

SEQ ID NO: 1405955 - RNA, 19 nt, Homo sapiens
uggagucuguguucaagaa

SEQ ID NO: 1405956 - RNA, 19 nt, Homo sapiens
agacucuucugaccuguga

SEQ ID NO: 1405957 - RNA, 19 nt, Homo sapiens
uccuacagcugucauaaau

SEQ ID NO: 1405958 - RNA, 19 nt, Homo sapiens
ugagacggcugcagaucug

SEQ ID NO: 1405959 - RNA, 19 nt, Homo sapiens
ggauuucuaucaaugucau

SEQ ID NO: 1405960 - RNA, 19 nt, Homo sapiens
gcuagaagaagucauaggu

SEQ ID NO: 1405961 - RNA, 19 nt, Homo sapiens
aggugaagguagaauguaa

SEQ ID NO: 1405962 - RNA, 19 nt, Homo sapiens
gaggauccuucagcagaga

SEQ ID NO: 1405963 - RNA, 19 nt, Homo sapiens
gaucuaugagcuuucuuau

SEQ ID NO: 1405964 - RNA, 19 nt, Homo sapiens
ggaaaucagcaaggucaug

SEQ ID NO: 1405965 - RNA, 19 nt, Homo sapiens
gcuauagggcaaagaacuu

SEQ ID NO: 1405966 - RNA, 19 nt, Homo sapiens
aagguagaauguaagaaga

SEQ ID NO: 1405967 - RNA, 19 nt, Homo sapiens
acugugagccacuccaaua

SEQ ID NO: 1405968 - RNA, 19 nt, Homo sapiens
gcaccaggauccccagcua

SEQ ID NO: 1405969 - RNA, 19 nt, Homo sapiens
gaaggccgaggaacaaucu

SEQ ID NO: 1405970 - RNA, 19 nt, Homo sapiens
ucugccaucucccucuaua

SEQ ID NO: 1405971 - RNA, 19 nt, Homo sapiens
gaagucauaggucguuucu

SEQ ID NO: 1405972 - RNA, 19 nt, Homo sapiens
ccacggcacaggauagaug

SEQ ID NO: 1405973 - RNA, 19 nt, Homo sapiens
gaccugcggagcuacguuu

SEQ ID NO: 1405974 - RNA, 19 nt, Homo sapiens
gcugagcccuacucuugca

SEQ ID NO: 1405975 - RNA, 19 nt, Homo sapiens
cgagaucuaugagcuuucu

SEQ ID NO: 1405976 - RNA, 19 nt, Homo sapiens
gggcaguuccucuuuccuu

SEQ ID NO: 1405977 - RNA, 19 nt, Homo sapiens
agaucuaugagcuuucuua

SEQ ID NO: 1405978 - RNA, 19 nt, Homo sapiens
gguggagucuguguucaag

SEQ ID NO: 1405979 - RNA, 19 nt, Homo sapiens
gaacagaaaagacaguaag

SEQ ID NO: 1405980 - RNA, 19 nt, Homo sapiens
acacggaagacgagaucua

SEQ ID NO: 1405981 - RNA, 19 nt, Homo sapiens
gagaagacugggagacucu

SEQ ID NO: 1405982 - RNA, 19 nt, Homo sapiens
gguccuacagcugucauaa

SEQ ID NO: 1405983 - RNA, 19 nt, Homo sapiens
gaaccugggccugcugagu

SEQ ID NO: 1405984 - RNA, 19 nt, Homo sapiens
gugaagguagaauguaaga

SEQ ID NO: 1405985 - RNA, 19 nt, Homo sapiens
ccucuuuccuucccaagca

SEQ ID NO: 1405986 - RNA, 19 nt, Homo sapiens
ggaagacgagaucuaugag

SEQ ID NO: 1405987 - RNA, 19 nt, Homo sapiens
gcaacucagcccagagaag

SEQ ID NO: 1405988 - RNA, 19 nt, Homo sapiens
cauccaguccuucgauuca

SEQ ID NO: 1405989 - RNA, 19 nt, Homo sapiens
augccugaaugucuccuua

SEQ ID NO: 1405990 - RNA, 19 nt, Homo sapiens
aggcacagcccgacagguu

SEQ ID NO: 1405991 - RNA, 19 nt, Homo sapiens
caacugugagccacuccaa

SEQ ID NO: 1405992 - RNA, 19 nt, Homo sapiens
ccaggugaagguagaaugu

SEQ ID NO: 1405993 - RNA, 19 nt, Homo sapiens
gaugagcugcuggagaaau

SEQ ID NO: 1405994 - RNA, 19 nt, Homo sapiens
uacccaagcugaacaaccu

SEQ ID NO: 1405995 - RNA, 19 nt, Homo sapiens
gaggaccacaugcucaaca

SEQ ID NO: 1405996 - RNA, 19 nt, Homo sapiens
guccuacagcugucauaaa

SEQ ID NO: 1405997 - RNA, 19 nt, Homo sapiens
gacccaccaucaacugcau

SEQ ID NO: 1405998 - RNA, 19 nt, Homo sapiens
gcugguggagucuguguuc

SEQ ID NO: 1405999 - RNA, 19 nt, Homo sapiens
gcauccaguccuucgauuc

SEQ ID NO: 1406000 - RNA, 19 nt, Homo sapiens
gaauuucaacacgcugaug

SEQ ID NO: 1406001 - RNA, 19 nt, Homo sapiens
uggcucagcaccucaccua

SEQ ID NO: 1406002 - RNA, 19 nt, Homo sapiens
aaucacuccuacacgcuau

SEQ ID NO: 1406003 - RNA, 19 nt, Homo sapiens
caggugaagguagaaugua

SEQ ID NO: 1406004 - RNA, 19 nt, Homo sapiens
ggacacccaggagcugaga

SEQ ID NO: 1406005 - RNA, 19 nt, Homo sapiens
gaacagggauuucuaucaa

SEQ ID NO: 1406006 - RNA, 19 nt, Homo sapiens
cuacagcugucauaaauua

SEQ ID NO: 1406007 - RNA, 19 nt, Homo sapiens
gagcugagcccuacucuug

SEQ ID NO: 1406008 - RNA, 19 nt, Homo sapiens
aagaugagcugcuggagaa

SEQ ID NO: 1406009 - RNA, 19 nt, Homo sapiens
gaagguagaauguaagaag

SEQ ID NO: 1406010 - RNA, 19 nt, Homo sapiens
gagcgacucucgggcaauu

SEQ ID NO: 1406011 - RNA, 19 nt, Homo sapiens
gacgagaucuaugagcuuu

SEQ ID NO: 1406012 - RNA, 19 nt, Homo sapiens
ucuaugagcuuucuuaugc

SEQ ID NO: 1406013 - RNA, 19 nt, Homo sapiens
caagaauuaugacccugaa

SEQ ID NO: 1406014 - RNA, 19 nt, Homo sapiens
agucuguguucaagaauua

SEQ ID NO: 1406015 - RNA, 19 nt, Homo sapiens
gagaccaggugaagguaga

SEQ ID NO: 1406016 - RNA, 19 nt, Homo sapiens
gaagaagucauaggucguu

SEQ ID NO: 1406017 - RNA, 19 nt, Homo sapiens
uccaccagcugcagaauuu

SEQ ID NO: 1406018 - RNA, 19 nt, Homo sapiens
caacucagcccagagaaga

SEQ ID NO: 1406019 - RNA, 19 nt, Homo sapiens
ccagcuagaagaagucaua

SEQ ID NO: 1406020 - RNA, 19 nt, Homo sapiens
gcagagaccaggugaaggu

SEQ ID NO: 1406021 - RNA, 19 nt, Homo sapiens
ggaagucccaccaggaaug

SEQ ID NO: 1406022 - RNA, 19 nt, Homo sapiens
gaggaagucccaccaggaa

SEQ ID NO: 1406023 - RNA, 19 nt, Homo sapiens
caagcuggauuccuagaca

SEQ ID NO: 1406024 - RNA, 19 nt, Homo sapiens
cacaggugcuggacaaguu

SEQ ID NO: 1406025 - RNA, 19 nt, Homo sapiens
agaaaugcauccaguccuu

SEQ ID NO: 1406026 - RNA, 19 nt, Homo sapiens
gaaaagacaguaagaggaa

SEQ ID NO: 1406027 - RNA, 19 nt, Homo sapiens
gguaggcgccugacagaug

SEQ ID NO: 1406028 - RNA, 19 nt, Homo sapiens
gagucuguguucaagaauu

SEQ ID NO: 1406029 - RNA, 19 nt, Homo sapiens
cgggaagcaugaacagaaa

SEQ ID NO: 1406030 - RNA, 19 nt, Homo sapiens
gcgggaagcaugaacagaa

SEQ ID NO: 1406031 - RNA, 19 nt, Homo sapiens
gagccgcguugucccaaga

SEQ ID NO: 1406032 - RNA, 19 nt, Homo sapiens
acagggauuucuaucaaug

SEQ ID NO: 1406033 - RNA, 19 nt, Homo sapiens
cggaagacgagaucuauga

SEQ ID NO: 1406034 - RNA, 19 nt, Homo sapiens
uggagucuguguucaagaa

SEQ ID NO: 1406035 - RNA, 19 nt, Homo sapiens
uccuacagcugucauaaau

SEQ ID NO: 1406036 - RNA, 19 nt, Homo sapiens
ugagacggcugcagaucug

SEQ ID NO: 1406037 - RNA, 19 nt, Homo sapiens
ggauuucuaucaaugucau

SEQ ID NO: 1406038 - RNA, 19 nt, Homo sapiens
gcuagaagaagucauaggu

SEQ ID NO: 1406039 - RNA, 19 nt, Homo sapiens
aggugaagguagaauguaa

SEQ ID NO: 1406040 - RNA, 19 nt, Homo sapiens
gaggauccuucagcagaga

SEQ ID NO: 1406041 - RNA, 19 nt, Homo sapiens
gaucuaugagcuuucuuau

SEQ ID NO: 1406042 - RNA, 19 nt, Homo sapiens
ggaaaucagcaaggucaug

SEQ ID NO: 1406043 - RNA, 19 nt, Homo sapiens
gcuauagggcaaagaacuu

SEQ ID NO: 1406044 - RNA, 19 nt, Homo sapiens
aagguagaauguaagaaga

SEQ ID NO: 1406045 - RNA, 19 nt, Homo sapiens
gcaccaggauccccagcua

SEQ ID NO: 1406046 - RNA, 19 nt, Homo sapiens
gaaggccgaggaacaaucu

SEQ ID NO: 1406047 - RNA, 19 nt, Homo sapiens
gaagucauaggucguuucu

SEQ ID NO: 1406048 - RNA, 19 nt, Homo sapiens
ccacggcacaggauagaug

SEQ ID NO: 1406049 - RNA, 19 nt, Homo sapiens
gaccugcggagcuacguuu

SEQ ID NO: 1406050 - RNA, 19 nt, Homo sapiens
gcugagcccuacucuugca

SEQ ID NO: 1406051 - RNA, 19 nt, Homo sapiens
cgagaucuaugagcuuucu

SEQ ID NO: 1406052 - RNA, 19 nt, Homo sapiens
gggcaguuccucuuuccuu

SEQ ID NO: 1406053 - RNA, 19 nt, Homo sapiens
agaucuaugagcuuucuua

SEQ ID NO: 1406054 - RNA, 19 nt, Homo sapiens
gguggagucuguguucaag

SEQ ID NO: 1406055 - RNA, 19 nt, Homo sapiens
gaacagaaaagacaguaag

SEQ ID NO: 1406056 - RNA, 19 nt, Homo sapiens
acacggaagacgagaucua

SEQ ID NO: 1406057 - RNA, 19 nt, Homo sapiens
gagaagacugggagacucu

SEQ ID NO: 1406058 - RNA, 19 nt, Homo sapiens
gguccuacagcugucauaa

SEQ ID NO: 1406059 - RNA, 19 nt, Homo sapiens
gugaagguagaauguaaga

SEQ ID NO: 1406060 - RNA, 19 nt, Homo sapiens
gaaccugggccugcugagu

SEQ ID NO: 1406061 - RNA, 19 nt, Homo sapiens
ccucuuuccuucccaagca

SEQ ID NO: 1406062 - RNA, 19 nt, Homo sapiens
ggaagacgagaucuaugag

SEQ ID NO: 1406063 - RNA, 19 nt, Homo sapiens
gcaacucagcccagagaag

SEQ ID NO: 1406064 - RNA, 19 nt, Homo sapiens
cauccaguccuucgauuca

SEQ ID NO: 1406065 - RNA, 19 nt, Homo sapiens
augccugaaugucuccuua

SEQ ID NO: 1406066 - RNA, 19 nt, Homo sapiens
aggcacagcccgacagguu

SEQ ID NO: 1406067 - RNA, 19 nt, Homo sapiens
gaugagcugcuggagaaau

SEQ ID NO: 1406068 - RNA, 19 nt, Homo sapiens
ccaggugaagguagaaugu

SEQ ID NO: 1406069 - RNA, 19 nt, Homo sapiens
uacccaagcugaacaaccu

SEQ ID NO: 1406070 - RNA, 19 nt, Homo sapiens
gaggaccacaugcucaaca

SEQ ID NO: 1406071 - RNA, 19 nt, Homo sapiens
guccuacagcugucauaaa

SEQ ID NO: 1406072 - RNA, 19 nt, Homo sapiens
gacccaccaucaacugcau

SEQ ID NO: 1406073 - RNA, 19 nt, Homo sapiens
gcugguggagucuguguuc

SEQ ID NO: 1406074 - RNA, 19 nt, Homo sapiens
gaauuucaacacgcugaug

SEQ ID NO: 1406075 - RNA, 19 nt, Homo sapiens
gcauccaguccuucgauuc

SEQ ID NO: 1406076 - RNA, 19 nt, Homo sapiens
uggcucagcaccucaccua

SEQ ID NO: 1406077 - RNA, 19 nt, Homo sapiens
aaucacuccuacacgcuau

SEQ ID NO: 1406078 - RNA, 19 nt, Homo sapiens
caggugaagguagaaugua

SEQ ID NO: 1406079 - RNA, 19 nt, Homo sapiens
ggacacccaggagcugaga

SEQ ID NO: 1406080 - RNA, 19 nt, Homo sapiens
gaacagggauuucuaucaa

SEQ ID NO: 1406081 - RNA, 19 nt, Homo sapiens
cuacagcugucauaaauua

SEQ ID NO: 1406082 - RNA, 19 nt, Homo sapiens
gagcugagcccuacucuug

SEQ ID NO: 1406083 - RNA, 19 nt, Homo sapiens
aagaugagcugcuggagaa

SEQ ID NO: 1406084 - RNA, 19 nt, Homo sapiens
gaagguagaauguaagaag

SEQ ID NO: 1406085 - RNA, 19 nt, Homo sapiens
gagcgacucucgggcaauu

SEQ ID NO: 1406086 - RNA, 19 nt, Homo sapiens
gacgagaucuaugagcuuu

SEQ ID NO: 1406087 - RNA, 19 nt, Homo sapiens
ucuaugagcuuucuuaugc

SEQ ID NO: 1406088 - RNA, 19 nt, Homo sapiens
caagaauuaugacccugaa

SEQ ID NO: 1406089 - RNA, 19 nt, Homo sapiens
agucuguguucaagaauua

SEQ ID NO: 1406090 - RNA, 19 nt, Homo sapiens
gagaccaggugaagguaga

SEQ ID NO: 1406091 - RNA, 19 nt, Homo sapiens
gaagaagucauaggucguu

SEQ ID NO: 1406092 - RNA, 19 nt, Homo sapiens
uccaccagcugcagaauuu

SEQ ID NO: 1406093 - RNA, 19 nt, Homo sapiens
caacucagcccagagaaga

SEQ ID NO: 1406094 - RNA, 19 nt, Homo sapiens
ccagcuagaagaagucaua

SEQ ID NO: 1406095 - RNA, 19 nt, Homo sapiens
gcagagaccaggugaaggu

SEQ ID NO: 1406096 - RNA, 19 nt, Homo sapiens
ggaagucccaccaggaaug

SEQ ID NO: 1406097 - RNA, 19 nt, Homo sapiens
gaggaagucccaccaggaa

SEQ ID NO: 1406098 - RNA, 19 nt, Homo sapiens
caagcuggauuccuagaca

SEQ ID NO: 1406099 - RNA, 19 nt, Homo sapiens
cacaggugcuggacaaguu

SEQ ID NO: 1406100 - RNA, 19 nt, Homo sapiens
agaaaugcauccaguccuu

SEQ ID NO: 1406101 - RNA, 19 nt, Homo sapiens
gaaaagacaguaagaggaa

SEQ ID NO: 1406102 - RNA, 19 nt, Homo sapiens
gguaggcgccugacagaug

SEQ ID NO: 1406103 - RNA, 19 nt, Homo sapiens
gagucuguguucaagaauu

SEQ ID NO: 1406104 - RNA, 19 nt, Homo sapiens
cgggaagcaugaacagaaa

SEQ ID NO: 1406105 - RNA, 19 nt, Homo sapiens
gcgggaagcaugaacagaa

SEQ ID NO: 1406106 - RNA, 19 nt, Homo sapiens
gagccgcguugucccaaga

SEQ ID NO: 1406107 - RNA, 19 nt, Homo sapiens
acagggauuucuaucaaug

SEQ ID NO: 1406108 - RNA, 19 nt, Homo sapiens
cggaagacgagaucuauga

SEQ ID NO: 1406109 - RNA, 19 nt, Homo sapiens
uggagucuguguucaagaa

SEQ ID NO: 1406110 - RNA, 19 nt, Homo sapiens
uccuacagcugucauaaau

SEQ ID NO: 1406111 - RNA, 19 nt, Homo sapiens
ugagacggcugcagaucug

SEQ ID NO: 1406112 - RNA, 19 nt, Homo sapiens
ggauuucuaucaaugucau

SEQ ID NO: 1406113 - RNA, 19 nt, Homo sapiens
gcuagaagaagucauaggu

SEQ ID NO: 1406114 - RNA, 19 nt, Homo sapiens
aggugaagguagaauguaa

SEQ ID NO: 1406115 - RNA, 19 nt, Homo sapiens
gaggauccuucagcagaga

SEQ ID NO: 1406116 - RNA, 19 nt, Homo sapiens
gaucuaugagcuuucuuau

SEQ ID NO: 1406117 - RNA, 19 nt, Homo sapiens
ggaaaucagcaaggucaug

SEQ ID NO: 1406118 - RNA, 19 nt, Homo sapiens
gcuauagggcaaagaacuu

SEQ ID NO: 1406119 - RNA, 19 nt, Homo sapiens
aagguagaauguaagaaga

SEQ ID NO: 1406120 - RNA, 19 nt, Homo sapiens
gcaccaggauccccagcua

SEQ ID NO: 1406121 - RNA, 19 nt, Homo sapiens
gaaggccgaggaacaaucu

SEQ ID NO: 1406122 - RNA, 19 nt, Homo sapiens
gaagucauaggucguuucu

SEQ ID NO: 1406123 - RNA, 19 nt, Homo sapiens
ccacggcacaggauagaug

SEQ ID NO: 1406124 - RNA, 19 nt, Homo sapiens
gaccugcggagcuacguuu

SEQ ID NO: 1406125 - RNA, 19 nt, Homo sapiens
gcugagcccuacucuugca

SEQ ID NO: 1406126 - RNA, 19 nt, Homo sapiens
cgagaucuaugagcuuucu

SEQ ID NO: 1406127 - RNA, 19 nt, Homo sapiens
gggcaguuccucuuuccuu

SEQ ID NO: 1406128 - RNA, 19 nt, Homo sapiens
agaucuaugagcuuucuua

SEQ ID NO: 1406129 - RNA, 19 nt, Homo sapiens
gguggagucuguguucaag

SEQ ID NO: 1406130 - RNA, 19 nt, Homo sapiens
gaacagaaaagacaguaag

SEQ ID NO: 1406131 - RNA, 19 nt, Homo sapiens
acacggaagacgagaucua

SEQ ID NO: 1406132 - RNA, 19 nt, Homo sapiens
gagaagacugggagacucu

SEQ ID NO: 1406133 - RNA, 19 nt, Homo sapiens
gguccuacagcugucauaa

SEQ ID NO: 1406134 - RNA, 19 nt, Homo sapiens
gugaagguagaauguaaga

SEQ ID NO: 1406135 - RNA, 19 nt, Homo sapiens
gaaccugggccugcugagu

SEQ ID NO: 1406136 - RNA, 19 nt, Homo sapiens
ccucuuuccuucccaagca

SEQ ID NO: 1406137 - RNA, 19 nt, Homo sapiens
ggaagacgagaucuaugag

SEQ ID NO: 1406138 - RNA, 19 nt, Homo sapiens
gcaacucagcccagagaag

SEQ ID NO: 1406139 - RNA, 19 nt, Homo sapiens
cauccaguccuucgauuca

SEQ ID NO: 1406140 - RNA, 19 nt, Homo sapiens
augccugaaugucuccuua

SEQ ID NO: 1406141 - RNA, 19 nt, Homo sapiens
aggcacagcccgacagguu

SEQ ID NO: 1406142 - RNA, 19 nt, Homo sapiens
gaugagcugcuggagaaau

SEQ ID NO: 1406143 - RNA, 19 nt, Homo sapiens
ccaggugaagguagaaugu

SEQ ID NO: 1406144 - RNA, 19 nt, Homo sapiens
uacccaagcugaacaaccu

SEQ ID NO: 1406145 - RNA, 19 nt, Homo sapiens
gaggaccacaugcucaaca

SEQ ID NO: 1406146 - RNA, 19 nt, Homo sapiens
guccuacagcugucauaaa

SEQ ID NO: 1406147 - RNA, 19 nt, Homo sapiens
gacccaccaucaacugcau

SEQ ID NO: 1406148 - RNA, 19 nt, Homo sapiens
gcugguggagucuguguuc

SEQ ID NO: 1406149 - RNA, 19 nt, Homo sapiens
gaauuucaacacgcugaug

SEQ ID NO: 1406150 - RNA, 19 nt, Homo sapiens
gcauccaguccuucgauuc

SEQ ID NO: 1406151 - RNA, 19 nt, Homo sapiens
uggcucagcaccucaccua

SEQ ID NO: 1406152 - RNA, 19 nt, Homo sapiens
aaucacuccuacacgcuau

SEQ ID NO: 1406153 - RNA, 19 nt, Homo sapiens
caggugaagguagaaugua

SEQ ID NO: 1406154 - RNA, 19 nt, Homo sapiens
ggacacccaggagcugaga

SEQ ID NO: 1406155 - RNA, 19 nt, Homo sapiens
gagcugagcccuacucuug

SEQ ID NO: 1406156 - RNA, 19 nt, Homo sapiens
aagaugagcugcuggagaa

SEQ ID NO: 1406157 - RNA, 19 nt, Homo sapiens
gaagguagaauguaagaag

SEQ ID NO: 1406158 - RNA, 19 nt, Homo sapiens
gagcgacucucgggcaauu

SEQ ID NO: 1406159 - RNA, 19 nt, Homo sapiens
gacgagaucuaugagcuuu

SEQ ID NO: 1406160 - RNA, 19 nt, Homo sapiens
ucuaugagcuuucuuaugc

SEQ ID NO: 1406161 - RNA, 19 nt, Homo sapiens
caagaauuaugacccugaa

SEQ ID NO: 1406162 - RNA, 19 nt, Homo sapiens
agucuguguucaagaauua

SEQ ID NO: 1406163 - RNA, 19 nt, Homo sapiens
gagaccaggugaagguaga

SEQ ID NO: 1406164 - RNA, 19 nt, Homo sapiens
gaagaagucauaggucguu

SEQ ID NO: 1406165 - RNA, 19 nt, Homo sapiens
uccaccagcugcagaauuu

SEQ ID NO: 1406166 - RNA, 19 nt, Homo sapiens
caacucagcccagagaaga

SEQ ID NO: 1406167 - RNA, 19 nt, Homo sapiens
ccagcuagaagaagucaua

SEQ ID NO: 1406168 - RNA, 19 nt, Homo sapiens
gcagagaccaggugaaggu

SEQ ID NO: 1406169 - RNA, 19 nt, Homo sapiens
ggaagucccaccaggaaug

SEQ ID NO: 1406170 - RNA, 19 nt, Homo sapiens
gaggaagucccaccaggaa

SEQ ID NO: 1406171 - RNA, 19 nt, Homo sapiens
caagcuggauuccuagaca

SEQ ID NO: 1406172 - RNA, 19 nt, Homo sapiens
cacaggugcuggacaaguu

SEQ ID NO: 1406173 - RNA, 19 nt, Homo sapiens
agaaaugcauccaguccuu

SEQ ID NO: 1406174 - RNA, 19 nt, Homo sapiens
gaaaagacaguaagaggaa

SEQ ID NO: 1406175 - RNA, 19 nt, Homo sapiens
gagucuguguucaagaauu

SEQ ID NO: 1406176 - RNA, 19 nt, Homo sapiens
cgggaagcaugaacagaaa

SEQ ID NO: 1406177 - RNA, 19 nt, Homo sapiens
gcgggaagcaugaacagaa

SEQ ID NO: 1406178 - RNA, 19 nt, Homo sapiens
gagccgcguugucccaaga

SEQ ID NO: 1406179 - RNA, 19 nt, Homo sapiens
cggaagacgagaucuauga

SEQ ID NO: 1406180 - RNA, 19 nt, Homo sapiens
uggagucuguguucaagaa

SEQ ID NO: 1406181 - RNA, 19 nt, Homo sapiens
ugagacggcugcagaucug

SEQ ID NO: 1406182 - RNA, 19 nt, Homo sapiens
gcuagaagaagucauaggu

SEQ ID NO: 1406183 - RNA, 19 nt, Homo sapiens
cauccacacugccuuuagu

SEQ ID NO: 1406184 - RNA, 19 nt, Homo sapiens
aggugaagguagaauguaa

SEQ ID NO: 1406185 - RNA, 19 nt, Homo sapiens
gaggauccuucagcagaga

SEQ ID NO: 1406186 - RNA, 19 nt, Homo sapiens
gaucuaugagcuuucuuau

SEQ ID NO: 1406187 - RNA, 19 nt, Homo sapiens
ggaaaucagcaaggucaug

SEQ ID NO: 1406188 - RNA, 19 nt, Homo sapiens
aagguagaauguaagaaga

SEQ ID NO: 1406189 - RNA, 19 nt, Homo sapiens
gcaccaggauccccagcua

SEQ ID NO: 1406190 - RNA, 19 nt, Homo sapiens
gaaggccgaggaacaaucu

SEQ ID NO: 1406191 - RNA, 19 nt, Homo sapiens
gaagucauaggucguuucu

SEQ ID NO: 1406192 - RNA, 19 nt, Homo sapiens
gcugagcccuacucuugca

SEQ ID NO: 1406193 - RNA, 19 nt, Homo sapiens
gaccugcggagcuacguuu

SEQ ID NO: 1406194 - RNA, 19 nt, Homo sapiens
cgagaucuaugagcuuucu

SEQ ID NO: 1406195 - RNA, 19 nt, Homo sapiens
gggcaguuccucuuuccuu

SEQ ID NO: 1406196 - RNA, 19 nt, Homo sapiens
agaucuaugagcuuucuua

SEQ ID NO: 1406197 - RNA, 19 nt, Homo sapiens
gguggagucuguguucaag

SEQ ID NO: 1406198 - RNA, 19 nt, Homo sapiens
acacggaagacgagaucua

SEQ ID NO: 1406199 - RNA, 19 nt, Homo sapiens
gagaagacugggagacucu

SEQ ID NO: 1406200 - RNA, 19 nt, Homo sapiens
gaacagaaaagacaguaag

SEQ ID NO: 1406201 - RNA, 19 nt, Homo sapiens
gugaagguagaauguaaga

SEQ ID NO: 1406202 - RNA, 19 nt, Homo sapiens
ccucuuuccuucccaagca

SEQ ID NO: 1406203 - RNA, 19 nt, Homo sapiens
ggaagacgagaucuaugag

SEQ ID NO: 1406204 - RNA, 19 nt, Homo sapiens
gcaacucagcccagagaag

SEQ ID NO: 1406205 - RNA, 19 nt, Homo sapiens
cauccaguccuucgauuca

SEQ ID NO: 1406206 - RNA, 19 nt, Homo sapiens
gaaccugggccugcugagu

SEQ ID NO: 1406207 - RNA, 19 nt, Homo sapiens
aggcacagcccgacagguu

SEQ ID NO: 1406208 - RNA, 19 nt, Homo sapiens
ccaggugaagguagaaugu

SEQ ID NO: 1406209 - RNA, 19 nt, Homo sapiens
gaugagcugcuggagaaau

SEQ ID NO: 1406210 - RNA, 19 nt, Homo sapiens
uacccaagcugaacaaccu

SEQ ID NO: 1406211 - RNA, 19 nt, Homo sapiens
gaggaccacaugcucaaca

SEQ ID NO: 1406212 - RNA, 19 nt, Homo sapiens
gacccaccaucaacugcau

SEQ ID NO: 1406213 - RNA, 19 nt, Homo sapiens
gcugguggagucuguguuc

SEQ ID NO: 1406214 - RNA, 19 nt, Homo sapiens
gaauuucaacacgcugaug

SEQ ID NO: 1406215 - RNA, 19 nt, Homo sapiens
uggcucagcaccucaccua

SEQ ID NO: 1406216 - RNA, 19 nt, Homo sapiens
gcauccaguccuucgauuc

SEQ ID NO: 1406217 - RNA, 19 nt, Homo sapiens
aaucacuccuacacgcuau

SEQ ID NO: 1406218 - RNA, 19 nt, Homo sapiens
caggugaagguagaaugua

SEQ ID NO: 1406219 - RNA, 19 nt, Homo sapiens
ggacacccaggagcugaga

SEQ ID NO: 1406220 - RNA, 19 nt, Homo sapiens
ggaaaguuguucaagauua

SEQ ID NO: 1406221 - RNA, 19 nt, Homo sapiens
caacaaagaucuugaggaa

SEQ ID NO: 1406222 - RNA, 19 nt, Homo sapiens
gaacaagggccaccacuua

SEQ ID NO: 1406223 - RNA, 19 nt, Homo sapiens
acaaagaucuugaggaauu

SEQ ID NO: 1406224 - RNA, 19 nt, Homo sapiens
gaaggaguauucgugauua

SEQ ID NO: 1406225 - RNA, 19 nt, Homo sapiens
caacaucuguguauccaaa

SEQ ID NO: 1406226 - RNA, 19 nt, Homo sapiens
ccacuuuacuucuccaaua

SEQ ID NO: 1406227 - RNA, 19 nt, Homo sapiens
cuagugaugugacucauua

SEQ ID NO: 1406228 - RNA, 19 nt, Homo sapiens
gaaacccagucucuacuaa

SEQ ID NO: 1406229 - RNA, 19 nt, Homo sapiens
ggaccuagcucuccuggau

SEQ ID NO: 1406230 - RNA, 19 nt, Homo sapiens
guacaccgcuuguuaaugg

SEQ ID NO: 1406231 - RNA, 19 nt, Homo sapiens
gcaccaaauucuuacauug

SEQ ID NO: 1406232 - RNA, 19 nt, Homo sapiens
uaaaggugcugcuuaucua

SEQ ID NO: 1406233 - RNA, 19 nt, Homo sapiens
cgaaaccgcucaauucaug

SEQ ID NO: 1406234 - RNA, 19 nt, Homo sapiens
ggaaugugcuaaagccaaa

SEQ ID NO: 1406235 - RNA, 19 nt, Homo sapiens
acuaagagcugucauaugu

SEQ ID NO: 1406236 - RNA, 19 nt, Homo sapiens
gauuaaaggugcugcuuau

SEQ ID NO: 1406237 - RNA, 19 nt, Homo sapiens
cagaagaacuggcgggauu

SEQ ID NO: 1406238 - RNA, 19 nt, Homo sapiens
acacagagcccaaauagaa

SEQ ID NO: 1406239 - RNA, 19 nt, Homo sapiens
gggaaacucuugucuagug

SEQ ID NO: 1406240 - RNA, 19 nt, Homo sapiens
uaagagcugucauauguga

SEQ ID NO: 1406241 - RNA, 19 nt, Homo sapiens
ucauuacggucuugcauua

SEQ ID NO: 1406242 - RNA, 19 nt, Homo sapiens
guuagaagcugggauuaaa

SEQ ID NO: 1406243 - RNA, 19 nt, Homo sapiens
caaauggugugcuucuauu

SEQ ID NO: 1406244 - RNA, 19 nt, Homo sapiens
gacaggaugccaauuguua

SEQ ID NO: 1406245 - RNA, 19 nt, Homo sapiens
caaagaucuugaggaauua

SEQ ID NO: 1406246 - RNA, 19 nt, Homo sapiens
gaaauuaagggaaaucugu

SEQ ID NO: 1406247 - RNA, 19 nt, Homo sapiens
gccaaaggcuucuucauag

SEQ ID NO: 1406248 - RNA, 19 nt, Homo sapiens
gucagaaccuuaaauaaug

SEQ ID NO: 1406249 - RNA, 19 nt, Homo sapiens
gaucaggacuggguagcua

SEQ ID NO: 1406250 - RNA, 19 nt, Homo sapiens
gaggaggaguuccaucauu

SEQ ID NO: 1406251 - RNA, 19 nt, Homo sapiens
caagggccaccacuuauua

SEQ ID NO: 1406252 - RNA, 19 nt, Homo sapiens
gcaguaaagauucagauuu

SEQ ID NO: 1406253 - RNA, 19 nt, Homo sapiens
gacaauuucuggccugauu

SEQ ID NO: 1406254 - RNA, 19 nt, Homo sapiens
gaaaagccaucucguauuc

SEQ ID NO: 1406255 - RNA, 19 nt, Homo sapiens
ucaaagacuuggaugagaa

SEQ ID NO: 1406256 - RNA, 19 nt, Homo sapiens
ucaagaauaucgccaaaca

SEQ ID NO: 1406257 - RNA, 19 nt, Homo sapiens
ccauguaaccguaagaaua

SEQ ID NO: 1406258 - RNA, 19 nt, Homo sapiens
aggaggaguuccaucauua

SEQ ID NO: 1406259 - RNA, 19 nt, Homo sapiens
aagaagagguccaaucuca

SEQ ID NO: 1406260 - RNA, 19 nt, Homo sapiens
guagcuauuucgcauauau

SEQ ID NO: 1406261 - RNA, 19 nt, Homo sapiens
gauacaaucagacuugaaa

SEQ ID NO: 1406262 - RNA, 19 nt, Homo sapiens
ugaagcagcccaagaacua

SEQ ID NO: 1406263 - RNA, 19 nt, Homo sapiens
ggaaacucuugucuaguga

SEQ ID NO: 1406264 - RNA, 19 nt, Homo sapiens
guauggaagugaaacagaa

SEQ ID NO: 1406265 - RNA, 19 nt, Homo sapiens
aaaggcuucuucauagaua

SEQ ID NO: 1406266 - RNA, 19 nt, Homo sapiens
ccaaaggcuucuucauaga

SEQ ID NO: 1406267 - RNA, 19 nt, Homo sapiens
ggccaccacuuauuaucua

SEQ ID NO: 1406268 - RNA, 19 nt, Homo sapiens
gaaggugaguccugaagag

SEQ ID NO: 1406269 - RNA, 19 nt, Homo sapiens
gcucgaaaccgcucaauuc

SEQ ID NO: 1406270 - RNA, 19 nt, Homo sapiens
gagaguccauggagaagug

SEQ ID NO: 1406271 - RNA, 19 nt, Homo sapiens
caagauaccaaauacagaa

SEQ ID NO: 1406272 - RNA, 19 nt, Homo sapiens
caggaucccuucaacgauu

SEQ ID NO: 1406273 - RNA, 19 nt, Homo sapiens
ggauuaaaggugcugcuua

SEQ ID NO: 1406274 - RNA, 19 nt, Homo sapiens
gcagacauaucaacaacag

SEQ ID NO: 1406275 - RNA, 19 nt, Homo sapiens
guugauagguaugcuguaa

SEQ ID NO: 1406276 - RNA, 19 nt, Homo sapiens
gcuaaugaauuccagcaau

SEQ ID NO: 1406277 - RNA, 19 nt, Homo sapiens
ugacggaguuauuuauuca

SEQ ID NO: 1406278 - RNA, 19 nt, Homo sapiens
cagaaacccuccaggacuu

SEQ ID NO: 1406279 - RNA, 19 nt, Homo sapiens
auaauuaggucacuaugga

SEQ ID NO: 1406280 - RNA, 19 nt, Homo sapiens
gaacaaauggugugcuucu

SEQ ID NO: 1406281 - RNA, 19 nt, Homo sapiens
gcauguacuucaaagacaa

SEQ ID NO: 1406282 - RNA, 19 nt, Homo sapiens
gaguugaagggaauuauuu

SEQ ID NO: 1406283 - RNA, 19 nt, Homo sapiens
guaguacaccgcuuguuaa

SEQ ID NO: 1406284 - RNA, 19 nt, Homo sapiens
acuacuggauggaaacuua

SEQ ID NO: 1406285 - RNA, 19 nt, Homo sapiens
ucagucagaaccuuaaaua

SEQ ID NO: 1406286 - RNA, 19 nt, Homo sapiens
gcagauggccccuuucuaa

SEQ ID NO: 1406287 - RNA, 19 nt, Homo sapiens
aguaaugaguggacaguaa

SEQ ID NO: 1406288 - RNA, 19 nt, Homo sapiens
gaaggagccuauacacacu

SEQ ID NO: 1406289 - RNA, 19 nt, Homo sapiens
gaauaucgccaaacaaagg

SEQ ID NO: 1406290 - RNA, 19 nt, Homo sapiens
caaagaagagguccaaucu

SEQ ID NO: 1406291 - RNA, 19 nt, Homo sapiens
gaagucaaaguaaacauca

SEQ ID NO: 1406292 - RNA, 19 nt, Homo sapiens
cccaagaagucaaaguaaa

SEQ ID NO: 1406293 - RNA, 19 nt, Homo sapiens
uugcauaucugacggaguu

SEQ ID NO: 1406294 - RNA, 19 nt, Homo sapiens
ggagucaacaucuguguau

SEQ ID NO: 1406295 - RNA, 19 nt, Homo sapiens
caaacacagagcccaaaua

SEQ ID NO: 1406296 - RNA, 19 nt, Homo sapiens
cuaaugaauuccagcaaug

SEQ ID NO: 1406297 - RNA, 19 nt, Homo sapiens
aagaauaucgccaaacaaa

SEQ ID NO: 1406298 - RNA, 19 nt, Homo sapiens
ccaguaaacacaccagaaa

SEQ ID NO: 1406299 - RNA, 19 nt, Homo sapiens
gaaugacugugacgacaag

SEQ ID NO: 1406300 - RNA, 19 nt, Homo sapiens
ggagccagcaguaaagauu

SEQ ID NO: 1406301 - RNA, 19 nt, Homo sapiens
gagcccaaauagaagcuuu

SEQ ID NO: 1406302 - RNA, 19 nt, Homo sapiens
cauacaagauaccaaauac

SEQ ID NO: 1406303 - RNA, 19 nt, Homo sapiens
ccauacaagauaccaaaua

SEQ ID NO: 1406304 - RNA, 19 nt, Homo sapiens
cauguaaccguaagaauau

SEQ ID NO: 1406305 - RNA, 19 nt, Homo sapiens
ggucuugcauuagauaaau

SEQ ID NO: 1406306 - RNA, 19 nt, Homo sapiens
aagccaagcuggaggaguu

SEQ ID NO: 1406307 - RNA, 19 nt, Homo sapiens
ucaaggagccagcaguaaa

SEQ ID NO: 1406308 - RNA, 19 nt, Homo sapiens
ugaaacagaaggaguauuc

SEQ ID NO: 1406309 - RNA, 19 nt, Homo sapiens
gaggagaguccauggagaa

SEQ ID NO: 1406310 - RNA, 19 nt, Homo sapiens
ggguagcuauuucgcauau

SEQ ID NO: 1406311 - RNA, 19 nt, Homo sapiens
uaacuaaaucuguggaaga

SEQ ID NO: 1406312 - RNA, 19 nt, Homo sapiens
gauaccaaauacagaacuu

SEQ ID NO: 1406313 - RNA, 19 nt, Homo sapiens
gauacacgguccaauaaaa

SEQ ID NO: 1406314 - RNA, 19 nt, Homo sapiens
uagauacacgguccaauaa

SEQ ID NO: 1406315 - RNA, 19 nt, Homo sapiens
gaacauucacgaccucauc

SEQ ID NO: 1406316 - RNA, 19 nt, Homo sapiens
gcaggagacaguauaacaa

SEQ ID NO: 1406317 - RNA, 19 nt, Homo sapiens
ucacguugccauucugaua

SEQ ID NO: 1406318 - RNA, 19 nt, Homo sapiens
cacuuuacuucuccaauaa

SEQ ID NO: 1406319 - RNA, 19 nt, Homo sapiens
caaagguugugaagaugug

SEQ ID NO: 1406320 - RNA, 19 nt, Homo sapiens
gcacauaucuuucguuaaa

SEQ ID NO: 1406321 - RNA, 19 nt, Homo sapiens
gcacagaguuauaaaguaa

SEQ ID NO: 1406322 - RNA, 19 nt, Homo sapiens
gcacagauauccucgugua

SEQ ID NO: 1406323 - RNA, 19 nt, Homo sapiens
ggaaggagauccagaacuu

SEQ ID NO: 1406324 - RNA, 19 nt, Homo sapiens
acacugagcuuucgaauau

SEQ ID NO: 1406325 - RNA, 19 nt, Homo sapiens
gaagagggcucaagauuuu

SEQ ID NO: 1406326 - RNA, 19 nt, Homo sapiens
caacaacccugccggauau

SEQ ID NO: 1406327 - RNA, 19 nt, Homo sapiens
gaagggagguguaagaaag

SEQ ID NO: 1406328 - RNA, 19 nt, Homo sapiens
gcaagaggcuggaaguuca

SEQ ID NO: 1406329 - RNA, 19 nt, Homo sapiens
ggauauauuuguuggcuuu

SEQ ID NO: 1406330 - RNA, 19 nt, Homo sapiens
gacccugucucaauaauaa

SEQ ID NO: 1406331 - RNA, 19 nt, Homo sapiens
gguuauagcugcuuucaga

SEQ ID NO: 1406332 - RNA, 19 nt, Homo sapiens
ggaaagagguuuuaaaauc

SEQ ID NO: 1406333 - RNA, 19 nt, Homo sapiens
gaagagagaugagaaaauu

SEQ ID NO: 1406334 - RNA, 19 nt, Homo sapiens
ugaagcaccugaaauuauu

SEQ ID NO: 1406335 - RNA, 19 nt, Homo sapiens
uagcacauaucuuucguua

SEQ ID NO: 1406336 - RNA, 19 nt, Homo sapiens
gaaaugagaucuguuuagg

SEQ ID NO: 1406337 - RNA, 19 nt, Homo sapiens
ucucacagcugcagucuaa

SEQ ID NO: 1406338 - RNA, 19 nt, Homo sapiens
ggagagccuucuaauaaga

SEQ ID NO: 1406339 - RNA, 19 nt, Homo sapiens
gcaaguggccuauauuuag

SEQ ID NO: 1406340 - RNA, 19 nt, Homo sapiens
gggcaagguuguuugaauu

SEQ ID NO: 1406341 - RNA, 19 nt, Homo sapiens
gaggugaaauaaagagaaa

SEQ ID NO: 1406342 - RNA, 19 nt, Homo sapiens
gaaacaggcugagucuaga

SEQ ID NO: 1406343 - RNA, 19 nt, Homo sapiens
gcagaaagcagcuccauag

SEQ ID NO: 1406344 - RNA, 19 nt, Homo sapiens
gcaagaccacgcuccuuua

SEQ ID NO: 1406345 - RNA, 19 nt, Homo sapiens
cagcugcagucuaauagua

SEQ ID NO: 1406346 - RNA, 19 nt, Homo sapiens
gcaacuguuuauucuguuu

SEQ ID NO: 1406347 - RNA, 19 nt, Homo sapiens
gaccuaaauucucaaauag

SEQ ID NO: 1406348 - RNA, 19 nt, Homo sapiens
cuugagaaauuuacgcuua

SEQ ID NO: 1406349 - RNA, 19 nt, Homo sapiens
caacagaggcuugggauga

SEQ ID NO: 1406350 - RNA, 19 nt, Homo sapiens
guggguacguguuugguua

SEQ ID NO: 1406351 - RNA, 19 nt, Homo sapiens
aaaggaagguugaccauag

SEQ ID NO: 1406352 - RNA, 19 nt, Homo sapiens
gguuaggcaugcuugguua

SEQ ID NO: 1406353 - RNA, 19 nt, Homo sapiens
uuuaauagcucguuaccaa

SEQ ID NO: 1406354 - RNA, 19 nt, Homo sapiens
ggaggcaccugaugcacuu

SEQ ID NO: 1406355 - RNA, 19 nt, Homo sapiens
ucacagaaguccugaacga

SEQ ID NO: 1406356 - RNA, 19 nt, Homo sapiens
gcaaagaugaaugagauaa

SEQ ID NO: 1406357 - RNA, 19 nt, Homo sapiens
guugagagaggaagaauuu

SEQ ID NO: 1406358 - RNA, 19 nt, Homo sapiens
gcaggaaaccggcuagaug

SEQ ID NO: 1406359 - RNA, 19 nt, Homo sapiens
gggaagagacugcuuggaa

SEQ ID NO: 1406360 - RNA, 19 nt, Homo sapiens
gcacuguggucuugguguu

SEQ ID NO: 1406361 - RNA, 19 nt, Homo sapiens
uaaagacauuacucccaua

SEQ ID NO: 1406362 - RNA, 19 nt, Homo sapiens
gaaguucacaccauccaaa

SEQ ID NO: 1406363 - RNA, 19 nt, Homo sapiens
ccauuuaggaggauaauuu

SEQ ID NO: 1406364 - RNA, 19 nt, Homo sapiens
cagcaacuguuuauucugu

SEQ ID NO: 1406365 - RNA, 19 nt, Homo sapiens
gaggagggcagauuacuug

SEQ ID NO: 1406366 - RNA, 19 nt, Homo sapiens
gaaauuuacgcuuagucua

SEQ ID NO: 1406367 - RNA, 19 nt, Homo sapiens
gaaggugagcgcugaagaa

SEQ ID NO: 1406368 - RNA, 19 nt, Homo sapiens
ggcacagaguuauaaagua

SEQ ID NO: 1406369 - RNA, 19 nt, Homo sapiens
ucacaacucugcaaaauau

SEQ ID NO: 1406370 - RNA, 19 nt, Homo sapiens
gccacugguugcauaauaa

SEQ ID NO: 1406371 - RNA, 19 nt, Homo sapiens
gcacuuccgcugcuuaaga

SEQ ID NO: 1406372 - RNA, 19 nt, Homo sapiens
ugaagagggcucaagauuu

SEQ ID NO: 1406373 - RNA, 19 nt, Homo sapiens
ggagguguaagaaagauaa

SEQ ID NO: 1406374 - RNA, 19 nt, Homo sapiens
caucaugccucuagaaggu

SEQ ID NO: 1406375 - RNA, 19 nt, Homo sapiens
ggaguaaugcaguauaaau

SEQ ID NO: 1406376 - RNA, 19 nt, Homo sapiens
ggcaaguggccuauauuua

SEQ ID NO: 1406377 - RNA, 19 nt, Homo sapiens
ccaugaagcaccugaaauu

SEQ ID NO: 1406378 - RNA, 19 nt, Homo sapiens
gcugauccuugagaaauuu

SEQ ID NO: 1406379 - RNA, 19 nt, Homo sapiens
gaaguugacaucacgauag

SEQ ID NO: 1406380 - RNA, 19 nt, Homo sapiens
ggggagagccuucuaauaa

SEQ ID NO: 1406381 - RNA, 19 nt, Homo sapiens
cauggaaggugagacagua

SEQ ID NO: 1406382 - RNA, 19 nt, Homo sapiens
ucacagcugcagucuaaua

SEQ ID NO: 1406383 - RNA, 19 nt, Homo sapiens
gcagaagaaucgcuugaac

SEQ ID NO: 1406384 - RNA, 19 nt, Homo sapiens
agaaccagcugauccuuga

SEQ ID NO: 1406385 - RNA, 19 nt, Homo sapiens
ccaacaacccugccggaua

SEQ ID NO: 1406386 - RNA, 19 nt, Homo sapiens
gggagagccuucuaauaag

SEQ ID NO: 1406387 - RNA, 19 nt, Homo sapiens
uaauuagccucucccgauu

SEQ ID NO: 1406388 - RNA, 19 nt, Homo sapiens
agaccacgcuccuuuacaa

SEQ ID NO: 1406389 - RNA, 19 nt, Homo sapiens
ggugagcgcugaagaacca

SEQ ID NO: 1406390 - RNA, 19 nt, Homo sapiens
gguguaagaaagauaagua

SEQ ID NO: 1406391 - RNA, 19 nt, Homo sapiens
ucacugaugugguuguugu

SEQ ID NO: 1406392 - RNA, 19 nt, Homo sapiens
gcauaauaauagagaccua

SEQ ID NO: 1406393 - RNA, 19 nt, Homo sapiens
cggcugagcucacagaagu

SEQ ID NO: 1406394 - RNA, 19 nt, Homo sapiens
gccaugaacuggagaaggu

SEQ ID NO: 1406395 - RNA, 19 nt, Homo sapiens
ggacuggaaugccaugaac

SEQ ID NO: 1406396 - RNA, 19 nt, Homo sapiens
gaccauagcauccuagaag

SEQ ID NO: 1406397 - RNA, 19 nt, Homo sapiens
gcuuucagauuguuccauu

SEQ ID NO: 1406398 - RNA, 19 nt, Homo sapiens
uauagcugcuuucagauug

SEQ ID NO: 1406399 - RNA, 19 nt, Homo sapiens
gcaagguuguuugaauuuc

SEQ ID NO: 1406400 - RNA, 19 nt, Homo sapiens
gagucaacauguuucaaga

SEQ ID NO: 1406401 - RNA, 19 nt, Homo sapiens
caacguggagccucugaaa

SEQ ID NO: 1406402 - RNA, 19 nt, Homo sapiens
guaaugcaguauaaauugg

SEQ ID NO: 1406403 - RNA, 19 nt, Homo sapiens
caugaagcaccugaaauua

SEQ ID NO: 1406404 - RNA, 19 nt, Homo sapiens
caccauggguucugugaau

SEQ ID NO: 1406405 - RNA, 19 nt, Homo sapiens
gcauaucuuugcucauaca

SEQ ID NO: 1406406 - RNA, 19 nt, Homo sapiens
gagagaggaagaauuugaa

SEQ ID NO: 1406407 - RNA, 19 nt, Homo sapiens
uaugacaucuuguguugau

SEQ ID NO: 1406408 - RNA, 19 nt, Homo sapiens
agacagagcagcauaucuu

SEQ ID NO: 1406409 - RNA, 19 nt, Homo sapiens
guaguguggaggugaaaua

SEQ ID NO: 1406410 - RNA, 19 nt, Homo sapiens
caccuguucucauguuaaa

SEQ ID NO: 1406411 - RNA, 19 nt, Homo sapiens
guugugaauucugaagaua

SEQ ID NO: 1406412 - RNA, 19 nt, Homo sapiens
gcagugagccgagauugug

SEQ ID NO: 1406413 - RNA, 19 nt, Homo sapiens
caacaucaugccucuagaa

SEQ ID NO: 1406414 - RNA, 19 nt, Homo sapiens
uuuaugacaucuuguguug

SEQ ID NO: 1406415 - RNA, 19 nt, Homo sapiens
caggaaaccggcuagauga

SEQ ID NO: 1406416 - RNA, 19 nt, Homo sapiens
gaaggagauccagaacuuu

SEQ ID NO: 1406417 - RNA, 19 nt, Homo sapiens
ggcaagaccacgcuccuuu

SEQ ID NO: 1406418 - RNA, 19 nt, Homo sapiens
ugaaucaugugcuuuaggu

SEQ ID NO: 1406419 - RNA, 19 nt, Homo sapiens
ucaaauagggaaagagguu

SEQ ID NO: 1406420 - RNA, 19 nt, Homo sapiens
uggaguagauucugucuuu

SEQ ID NO: 1406421 - RNA, 19 nt, Homo sapiens
acaaaggacuggucaggaa

SEQ ID NO: 1406422 - RNA, 19 nt, Homo sapiens
guaaaggguccucauuuga

SEQ ID NO: 1406423 - RNA, 19 nt, Homo sapiens
gaccgggacuuucagaguu

SEQ ID NO: 1406424 - RNA, 19 nt, Homo sapiens
gagcaccaguggcccauug

SEQ ID NO: 1406425 - RNA, 19 nt, Homo sapiens
gcucuauccucuugcugua

SEQ ID NO: 1406426 - RNA, 19 nt, Homo sapiens
uggagugagucccaaguua

SEQ ID NO: 1406427 - RNA, 19 nt, Homo sapiens
gaccucagcugcacuuugg

SEQ ID NO: 1406428 - RNA, 19 nt, Homo sapiens
ccacauacuuaccaagcaa

SEQ ID NO: 1406429 - RNA, 19 nt, Homo sapiens
ucaguucucuccacacuuc

SEQ ID NO: 1406430 - RNA, 19 nt, Homo sapiens
aguaaaggguccucauuug

SEQ ID NO: 1406431 - RNA, 19 nt, Homo sapiens
ggaugagaguuuccaaugg

SEQ ID NO: 1406432 - RNA, 19 nt, Homo sapiens
ucuccacacuucccacaua

SEQ ID NO: 1406433 - RNA, 19 nt, Homo sapiens
caaguaaaggguccucauu

SEQ ID NO: 1406434 - RNA, 19 nt, Homo sapiens
aaacagaugcugcgcucua

SEQ ID NO: 1406435 - RNA, 19 nt, Homo sapiens
caaguuacccugccacaca

SEQ ID NO: 1406436 - RNA, 19 nt, Homo sapiens
gaucuccguuuacaguuca

SEQ ID NO: 1406437 - RNA, 19 nt, Homo sapiens
cucagcagcuaaacacuaa

SEQ ID NO: 1406438 - RNA, 19 nt, Homo sapiens
uaaaggguccucauuugau

SEQ ID NO: 1406439 - RNA, 19 nt, Homo sapiens
gacugucaauggcaggaua

SEQ ID NO: 1406440 - RNA, 19 nt, Homo sapiens
ggaucuccguuuacaguuc

SEQ ID NO: 1406441 - RNA, 19 nt, Homo sapiens
ggaguagauucugucuuug

SEQ ID NO: 1406442 - RNA, 19 nt, Homo sapiens
uugcagcacuccaaguaaa

SEQ ID NO: 1406443 - RNA, 19 nt, Homo sapiens
gacagucacuaugugcaaa

SEQ ID NO: 1406444 - RNA, 19 nt, Homo sapiens
gaagugcagcugugcuuuc

SEQ ID NO: 1406445 - RNA, 19 nt, Homo sapiens
gaaggagccucagauucag

SEQ ID NO: 1406446 - RNA, 19 nt, Homo sapiens
gauagcaggaagacauuau

SEQ ID NO: 1406447 - RNA, 19 nt, Homo sapiens
aaaggguccucauuugauc

SEQ ID NO: 1406448 - RNA, 19 nt, Homo sapiens
ucacagcucagccaccaaa

SEQ ID NO: 1406449 - RNA, 19 nt, Homo sapiens
ccuggaaucuggagugagu

SEQ ID NO: 1406450 - RNA, 19 nt, Homo sapiens
gcugcgcucuauccucuug

SEQ ID NO: 1406451 - RNA, 19 nt, Homo sapiens
caucagaguugcgcacgau

SEQ ID NO: 1406452 - RNA, 19 nt, Homo sapiens
gugcagcugugcuuucaag

SEQ ID NO: 1406453 - RNA, 19 nt, Homo sapiens
gcagcagccucugauagca

SEQ ID NO: 1406454 - RNA, 19 nt, Homo sapiens
gucacuaugugcaaacaga

SEQ ID NO: 1406455 - RNA, 19 nt, Homo sapiens
ggaccucagcugcacuuug

SEQ ID NO: 1406456 - RNA, 19 nt, Homo sapiens
ggaccgggacuuucagagu

SEQ ID NO: 1406457 - RNA, 19 nt, Homo sapiens
aaguaaaggguccucauuu

SEQ ID NO: 1406458 - RNA, 19 nt, Homo sapiens
uuucagaguuucagacaag

SEQ ID NO: 1406459 - RNA, 19 nt, Homo sapiens
ggagugagucccaaguuac

SEQ ID NO: 1406460 - RNA, 19 nt, Homo sapiens
ccacacuucccacauacuu

SEQ ID NO: 1406461 - RNA, 19 nt, Homo sapiens
gagccucagauucagauga

SEQ ID NO: 1406462 - RNA, 19 nt, Homo sapiens
caagucagccuuuugcaaa

SEQ ID NO: 1406463 - RNA, 19 nt, Homo sapiens
cagcucagccaccaaagug

SEQ ID NO: 1406464 - RNA, 19 nt, Homo sapiens
ucaguggaguagauucugu

SEQ ID NO: 1406465 - RNA, 19 nt, Homo sapiens
gcacgaugaacaacaaagg

SEQ ID NO: 1406466 - RNA, 19 nt, Homo sapiens
gugauucucagcagcuaaa

SEQ ID NO: 1406467 - RNA, 19 nt, Homo sapiens
ucuauccucuugcuguaug

SEQ ID NO: 1406468 - RNA, 19 nt, Homo sapiens
ucucagcagcuaaacacua

SEQ ID NO: 1406469 - RNA, 19 nt, Homo sapiens
ggacuuucagaguuucaga

SEQ ID NO: 1406470 - RNA, 19 nt, Homo sapiens
gaguagauucugucuuugg

SEQ ID NO: 1406471 - RNA, 19 nt, Homo sapiens
gaguugcgcacgaugaaca

SEQ ID NO: 1406472 - RNA, 19 nt, Homo sapiens
cagaguugcgcacgaugaa

SEQ ID NO: 1406473 - RNA, 19 nt, Homo sapiens
cacacuucccacauacuua

SEQ ID NO: 1406474 - RNA, 19 nt, Homo sapiens
ucagaguugcgcacgauga

SEQ ID NO: 1406475 - RNA, 19 nt, Homo sapiens
acacacaccguccgaccuu

SEQ ID NO: 1406476 - RNA, 19 nt, Homo sapiens
caacuacaccgugauucuc

SEQ ID NO: 1406477 - RNA, 19 nt, Homo sapiens
accgggacuuucagaguuu

SEQ ID NO: 1406478 - RNA, 19 nt, Homo sapiens
gcagcugugcuuucaagag

SEQ ID NO: 1406479 - RNA, 19 nt, Homo sapiens
ucaacuacaccgugauucu

SEQ ID NO: 1406480 - RNA, 19 nt, Homo sapiens
cccucgggaucuccguuua

SEQ ID NO: 1406481 - RNA, 19 nt, Homo sapiens
aacagaugcugcgcucuau

SEQ ID NO: 1406482 - RNA, 19 nt, Homo sapiens
ccuccaagcacccauucaa

SEQ ID NO: 1406483 - RNA, 19 nt, Homo sapiens
caagauggcuuuagacauu

SEQ ID NO: 1406484 - RNA, 19 nt, Homo sapiens
gaaagaggcugaggaggaa

SEQ ID NO: 1406485 - RNA, 19 nt, Homo sapiens
gcacuaaauucacggcuuu

SEQ ID NO: 1406486 - RNA, 19 nt, Homo sapiens
ccauagagcugcagaaauc

SEQ ID NO: 1406487 - RNA, 19 nt, Homo sapiens
gaacguccuuagacucuug

SEQ ID NO: 1406488 - RNA, 19 nt, Homo sapiens
ugauagagcuccgugguuu

SEQ ID NO: 1406489 - RNA, 19 nt, Homo sapiens
ggaccaaacucaccaccau

SEQ ID NO: 1406490 - RNA, 19 nt, Homo sapiens
gcccaguucuuacaggaua

SEQ ID NO: 1406491 - RNA, 19 nt, Homo sapiens
gaauagggccaaagacaga

SEQ ID NO: 1406492 - RNA, 19 nt, Homo sapiens
gugcagaagcccagaauuu

SEQ ID NO: 1406493 - RNA, 19 nt, Homo sapiens
gauaucaguagacagaaua

SEQ ID NO: 1406494 - RNA, 19 nt, Homo sapiens
gcagaaauccagccucuca

SEQ ID NO: 1406495 - RNA, 19 nt, Homo sapiens
gagaucaacuccaagaaaa

SEQ ID NO: 1406496 - RNA, 19 nt, Homo sapiens
gagauuggcggguaaccua

SEQ ID NO: 1406497 - RNA, 19 nt, Homo sapiens
ggauaucaguagacagaau

SEQ ID NO: 1406498 - RNA, 19 nt, Homo sapiens
caaagacagacccaucuaa

SEQ ID NO: 1406499 - RNA, 19 nt, Homo sapiens
gcaaagcaaaggacaagga

SEQ ID NO: 1406500 - RNA, 19 nt, Homo sapiens
auucacggcuuucauguuu

SEQ ID NO: 1406501 - RNA, 19 nt, Homo sapiens
gggaagagcgggagaucaa

SEQ ID NO: 1406502 - RNA, 19 nt, Homo sapiens
gcuccgugguuuccuguuu

SEQ ID NO: 1406503 - RNA, 19 nt, Homo sapiens
ugaccuugcugucguaugu

SEQ ID NO: 1406504 - RNA, 19 nt, Homo sapiens
ggagauggugcgcauggua

SEQ ID NO: 1406505 - RNA, 19 nt, Homo sapiens
gcagaagcccagaauuuua

SEQ ID NO: 1406506 - RNA, 19 nt, Homo sapiens
ucaaagacuccaccaagaa

SEQ ID NO: 1406507 - RNA, 19 nt, Homo sapiens
gaagggcaagggcaagaaa

SEQ ID NO: 1406508 - RNA, 19 nt, Homo sapiens
uaaauucacggcuuucaug

SEQ ID NO: 1406509 - RNA, 19 nt, Homo sapiens
ggaauuggcggagagaaug

SEQ ID NO: 1406510 - RNA, 19 nt, Homo sapiens
ucaguagacagaauaguaa

SEQ ID NO: 1406511 - RNA, 19 nt, Homo sapiens
ccaagaacguccuuagacu

SEQ ID NO: 1406512 - RNA, 19 nt, Homo sapiens
aaagacagacccaucuaaa

SEQ ID NO: 1406513 - RNA, 19 nt, Homo sapiens
acagagggcugcucacaag

SEQ ID NO: 1406514 - RNA, 19 nt, Homo sapiens
gcucagagaccgccuccuu

SEQ ID NO: 1406515 - RNA, 19 nt, Homo sapiens
gagggcugcucacaagaug

SEQ ID NO: 1406516 - RNA, 19 nt, Homo sapiens
caggauaucaguagacaga

SEQ ID NO: 1406517 - RNA, 19 nt, Homo sapiens
uccagccucucaccacuua

SEQ ID NO: 1406518 - RNA, 19 nt, Homo sapiens
gggauaaggcccaguucuu

SEQ ID NO: 1406519 - RNA, 19 nt, Homo sapiens
ccagagaccaggccaggaa

SEQ ID NO: 1406520 - RNA, 19 nt, Homo sapiens
ggagaagggcaagcagaaa

SEQ ID NO: 1406521 - RNA, 19 nt, Homo sapiens
ggaaugcagaggaggaguu

SEQ ID NO: 1406522 - RNA, 19 nt, Homo sapiens
gcacagagggcugcucaca

SEQ ID NO: 1406523 - RNA, 19 nt, Homo sapiens
ccaaagacagacccaucua

SEQ ID NO: 1406524 - RNA, 19 nt, Homo sapiens
ugagagagcaugaggaucu

SEQ ID NO: 1406525 - RNA, 19 nt, Homo sapiens
gagauggagagcacuaaau

SEQ ID NO: 1406526 - RNA, 19 nt, Homo sapiens
gggcaagggcaagaaauga

SEQ ID NO: 1406527 - RNA, 19 nt, Homo sapiens
gagaagggcaagcagaaag

SEQ ID NO: 1406528 - RNA, 19 nt, Homo sapiens
gaauuggcggagagaauga

SEQ ID NO: 1406529 - RNA, 19 nt, Homo sapiens
cagaauagggccaaagaca

SEQ ID NO: 1406530 - RNA, 19 nt, Homo sapiens
acccuuaucuucccagaga

SEQ ID NO: 1406531 - RNA, 19 nt, Homo sapiens
cugcucagauccaagaaga

SEQ ID NO: 1406532 - RNA, 19 nt, Homo sapiens
gcaauugcaggagcagaaa

SEQ ID NO: 1406533 - RNA, 19 nt, Homo sapiens
aagcaaaggacaaggagaa

SEQ ID NO: 1406534 - RNA, 19 nt, Homo sapiens
gcggagagaaugaagaaca

SEQ ID NO: 1406535 - RNA, 19 nt, Homo sapiens
ggauggccagagacaauaa

SEQ ID NO: 1406536 - RNA, 19 nt, Homo sapiens
ccacuuaugcagcagauca

SEQ ID NO: 1406537 - RNA, 19 nt, Homo sapiens
aaggccagcugauccacua

SEQ ID NO: 1406538 - RNA, 19 nt, Homo sapiens
agauggagagcacuaaauu

SEQ ID NO: 1406539 - RNA, 19 nt, Homo sapiens
guauguggcauccaacaga

SEQ ID NO: 1406540 - RNA, 19 nt, Homo sapiens
ugucguauguggcauccaa

SEQ ID NO: 1406541 - RNA, 19 nt, Homo sapiens
gcagaaaggcaaggagaag

SEQ ID NO: 1406542 - RNA, 19 nt, Homo sapiens
gauggagagcacuaaauuc

SEQ ID NO: 1406543 - RNA, 19 nt, Homo sapiens
gaaugcagaggaggaguug

SEQ ID NO: 1406544 - RNA, 19 nt, Homo sapiens
ggaggaaggguggcucaga

SEQ ID NO: 1406545 - RNA, 19 nt, Homo sapiens
caggaaggcccgagaugga

SEQ ID NO: 1406546 - RNA, 19 nt, Homo sapiens
gcuccugacccuuaucuuc

SEQ ID NO: 1406547 - RNA, 19 nt, Homo sapiens
gagaagggcaagggcaaga

SEQ ID NO: 1406548 - RNA, 19 nt, Homo sapiens
gcaagggcaaagcaaagga

SEQ ID NO: 1406549 - RNA, 19 nt, Homo sapiens
gaaugaagaacaggaaugc

SEQ ID NO: 1406550 - RNA, 19 nt, Homo sapiens
gaagugcagaagcccagaa

SEQ ID NO: 1406551 - RNA, 19 nt, Homo sapiens
gcagacacaggguagaagu

SEQ ID NO: 1406552 - RNA, 19 nt, Homo sapiens
uggaugaggcgaucuacaa

SEQ ID NO: 1406553 - RNA, 19 nt, Homo sapiens
gaccaaacucaccaccauu

SEQ ID NO: 1406554 - RNA, 19 nt, Homo sapiens
caggauggccagagacaau

SEQ ID NO: 1406555 - RNA, 19 nt, Homo sapiens
ucagagaccgccuccuuuc

SEQ ID NO: 1406556 - RNA, 19 nt, Homo sapiens
ccaaacucaccaccauuga

SEQ ID NO: 1406557 - RNA, 19 nt, Homo sapiens
cucacaagauggcuuuaga

SEQ ID NO: 1406558 - RNA, 19 nt, Homo sapiens
gcucagauccaagaagaag

SEQ ID NO: 1406559 - RNA, 19 nt, Homo sapiens
gaagagcgggagaucaacu

SEQ ID NO: 1406560 - RNA, 19 nt, Homo sapiens
agagcaggauggccagaga

SEQ ID NO: 1406561 - RNA, 19 nt, Homo sapiens
caaagacuccaccaagaac

SEQ ID NO: 1406562 - RNA, 19 nt, Homo sapiens
gagaccgccuccuuuccau

SEQ ID NO: 1406563 - RNA, 19 nt, Homo sapiens
ggcaauugcaggagcagaa

SEQ ID NO: 1406564 - RNA, 19 nt, Homo sapiens
agagaaagaaaggcaauug

SEQ ID NO: 1406565 - RNA, 19 nt, Homo sapiens
ccaaaaggaucauguccau

SEQ ID NO: 1406566 - RNA, 19 nt, Homo sapiens
guauuugaagccacauuga

SEQ ID NO: 1406567 - RNA, 19 nt, Homo sapiens
cgagauggagagcacuaaa

SEQ ID NO: 1406568 - RNA, 19 nt, Homo sapiens
ugggagaguuugcgcagau

SEQ ID NO: 1406569 - RNA, 19 nt, Homo sapiens
gagaaugaagaacaggaau

SEQ ID NO: 1406570 - RNA, 19 nt, Homo sapiens
gacagaauaguaauaacca

SEQ ID NO: 1406571 - RNA, 19 nt, Homo sapiens
aucaaagacuccaccaaga

SEQ ID NO: 1406572 - RNA, 19 nt, Homo sapiens
gagaaagaaaggcaauugc

SEQ ID NO: 1406573 - RNA, 19 nt, Homo sapiens
gcaagcagaaaggcaagga

SEQ ID NO: 1406574 - RNA, 19 nt, Homo sapiens
gggcaaagcaaaggacaag

SEQ ID NO: 1406575 - RNA, 19 nt, Homo sapiens
ccauggaagcgagggauaa

SEQ ID NO: 1406576 - RNA, 19 nt, Homo sapiens
gggcaagggcaaagcaaag

SEQ ID NO: 1406577 - RNA, 19 nt, Homo sapiens
caccaagaacguccuuaga

SEQ ID NO: 1406578 - RNA, 19 nt, Homo sapiens
uuaugcagcagaucaaaga

SEQ ID NO: 1406579 - RNA, 19 nt, Homo sapiens
agaaagaaaggcaauugca

SEQ ID NO: 1406580 - RNA, 19 nt, Homo sapiens
ugccagguccuccuugaaa

SEQ ID NO: 1406581 - RNA, 19 nt, Homo sapiens
cgagggauaaggcccaguu

SEQ ID NO: 1406582 - RNA, 19 nt, Homo sapiens
gauggccagagacaauaaa

SEQ ID NO: 1406583 - RNA, 19 nt, Homo sapiens
gcaaaugugugguggcuuu

SEQ ID NO: 1406584 - RNA, 19 nt, Homo sapiens
agacagaacugcugaagga

SEQ ID NO: 1406585 - RNA, 19 nt, Homo sapiens
gcgccuaggucccuucuuu

SEQ ID NO: 1406586 - RNA, 19 nt, Homo sapiens
cagcagccuuucuuguuua

SEQ ID NO: 1406587 - RNA, 19 nt, Homo sapiens
gcccuaaccugccuccuuu

SEQ ID NO: 1406588 - RNA, 19 nt, Homo sapiens
gcaagggcgucuagaugug

SEQ ID NO: 1406589 - RNA, 19 nt, Homo sapiens
ucagaggguuguaguaguu

SEQ ID NO: 1406590 - RNA, 19 nt, Homo sapiens
gagaagcccucugcugugu

SEQ ID NO: 1406591 - RNA, 19 nt, Homo sapiens
caagcuggcugcugacugu

SEQ ID NO: 1406592 - RNA, 19 nt, Homo sapiens
caaaucagccuucucaucu

SEQ ID NO: 1406593 - RNA, 19 nt, Homo sapiens
ugaaggagcauauggcaaa

SEQ ID NO: 1406594 - RNA, 19 nt, Homo sapiens
gaagcccucugcugugugu

SEQ ID NO: 1406595 - RNA, 19 nt, Homo sapiens
ggacacccuucgcguuguu

SEQ ID NO: 1406596 - RNA, 19 nt, Homo sapiens
acagcagccuuucuuguuu

SEQ ID NO: 1406597 - RNA, 19 nt, Homo sapiens
ggcaacagaucccaauauc

SEQ ID NO: 1406598 - RNA, 19 nt, Homo sapiens
agaauugaguggcaaaugu

SEQ ID NO: 1406599 - RNA, 19 nt, Homo sapiens
caacaacgucggacucaga

SEQ ID NO: 1406600 - RNA, 19 nt, Homo sapiens
uagaugugcuggucaacaa

SEQ ID NO: 1406601 - RNA, 19 nt, Homo sapiens
gggaugauaucaacaacgu

SEQ ID NO: 1406602 - RNA, 19 nt, Homo sapiens
ggucaacaaugcuuaugca

SEQ ID NO: 1406603 - RNA, 19 nt, Homo sapiens
gaagugcgaagccuguuug

SEQ ID NO: 1406604 - RNA, 19 nt, Homo sapiens
aauaaggcauucugggaaa

SEQ ID NO: 1406605 - RNA, 19 nt, Homo sapiens
caaagcaggcgccacaguu

SEQ ID NO: 1406606 - RNA, 19 nt, Homo sapiens
cugcuugucuucucauuug

SEQ ID NO: 1406607 - RNA, 19 nt, Homo sapiens
acucagaggccacuacuuu

SEQ ID NO: 1406608 - RNA, 19 nt, Homo sapiens
gugcccaaguggauuauug

SEQ ID NO: 1406609 - RNA, 19 nt, Homo sapiens
guucaaaucagccuucuca

SEQ ID NO: 1406610 - RNA, 19 nt, Homo sapiens
caacagaucccaauauccu

SEQ ID NO: 1406611 - RNA, 19 nt, Homo sapiens
ugcaguauauguucaaugu

SEQ ID NO: 1406612 - RNA, 19 nt, Homo sapiens
cuacgucucugcuugucuu

SEQ ID NO: 1406613 - RNA, 19 nt, Homo sapiens
gcuauggccuucgggaugu

SEQ ID NO: 1406614 - RNA, 19 nt, Homo sapiens
ugaccuugcucgacgcuau

SEQ ID NO: 1406615 - RNA, 19 nt, Homo sapiens
gguauuggccguggcauug

SEQ ID NO: 1406616 - RNA, 19 nt, Homo sapiens
gaauugaguggcaaaugug

SEQ ID NO: 1406617 - RNA, 19 nt, Homo sapiens
ccucuacacuagcaaguuc

SEQ ID NO: 1406618 - RNA, 19 nt, Homo sapiens
gaaggagcauauggcaaag

SEQ ID NO: 1406619 - RNA, 19 nt, Homo sapiens
gcaaagcugcgugugacaa

SEQ ID NO: 1406620 - RNA, 19 nt, Homo sapiens
aagcaggcgccacaguuua

SEQ ID NO: 1406621 - RNA, 19 nt, Homo sapiens
aaagcaggcgccacaguuu

SEQ ID NO: 1406622 - RNA, 19 nt, Homo sapiens
ggaagccugcaguauaugu

SEQ ID NO: 1406623 - RNA, 19 nt, Homo sapiens
ucaaaucagccuucucauc

SEQ ID NO: 1406624 - RNA, 19 nt, Homo sapiens
aaacagcagccuuucuugu

SEQ ID NO: 1406625 - RNA, 19 nt, Homo sapiens
ccuccuaccugcccuccuu

SEQ ID NO: 1406626 - RNA, 19 nt, Homo sapiens
gaagccugcaguauauguu

SEQ ID NO: 1406627 - RNA, 19 nt, Homo sapiens
caugugggaugauaucaac

SEQ ID NO: 1406628 - RNA, 19 nt, Homo sapiens
gcaaagcaggcgccacagu

SEQ ID NO: 1406629 - RNA, 19 nt, Homo sapiens
uaccuuggcuccuccucuu

SEQ ID NO: 1406630 - RNA, 19 nt, Homo sapiens
uuauugcccucuacacuag

SEQ ID NO: 1406631 - RNA, 19 nt, Homo sapiens
ccaggcagccacacucaga

SEQ ID NO: 1406632 - RNA, 19 nt, Homo sapiens
ggucugacacuacgucucu

SEQ ID NO: 1406633 - RNA, 19 nt, Homo sapiens
gaagccuguuugagcaagu

SEQ ID NO: 1406634 - RNA, 19 nt, Homo sapiens
cagugaaacagcagccuuu

SEQ ID NO: 1406635 - RNA, 19 nt, Homo sapiens
ggugguucguccugucuca

SEQ ID NO: 1406636 - RNA, 19 nt, Homo sapiens
aggagcauauggcaaagga

SEQ ID NO: 1406637 - RNA, 19 nt, Homo sapiens
gaugugcuggucaacaaug

SEQ ID NO: 1406638 - RNA, 19 nt, Homo sapiens
uaacccuccuggucugaca

SEQ ID NO: 1406639 - RNA, 19 nt, Homo sapiens
gauuauugcccucuacacu

SEQ ID NO: 1406640 - RNA, 19 nt, Homo sapiens
cgugugcccaaguggauua

SEQ ID NO: 1406641 - RNA, 19 nt, Homo sapiens
ugaagugcgaagccuguuu

SEQ ID NO: 1406642 - RNA, 19 nt, Homo sapiens
ugacuccucuccccucaaa

SEQ ID NO: 1406643 - RNA, 19 nt, Homo sapiens
auccugagccugaguggua

SEQ ID NO: 1406644 - RNA, 19 nt, Homo sapiens
uggcaacagaucccaauau

SEQ ID NO: 1406645 - RNA, 19 nt, Homo sapiens
aaaucagccuucucaucug

SEQ ID NO: 1406646 - RNA, 19 nt, Homo sapiens
caaagcugcgugugacaag

SEQ ID NO: 1406647 - RNA, 19 nt, Homo sapiens
caugaauggccaagugugu

SEQ ID NO: 1406648 - RNA, 19 nt, Homo sapiens
ggacucagaggccacuacu

SEQ ID NO: 1406649 - RNA, 19 nt, Homo sapiens
ucuuugagcucuguucucu

SEQ ID NO: 1406650 - RNA, 19 nt, Homo sapiens
ccaaguguguguggugacu

SEQ ID NO: 1406651 - RNA, 19 nt, Homo sapiens
caagaugacuccugugaaa

SEQ ID NO: 1406652 - RNA, 19 nt, Homo sapiens
uaaagacccugaaugaauu

SEQ ID NO: 1406653 - RNA, 19 nt, Homo sapiens
gaacugacaagguuauuaa

SEQ ID NO: 1406654 - RNA, 19 nt, Homo sapiens
gcagacaugugagaaguaa

SEQ ID NO: 1406655 - RNA, 19 nt, Homo sapiens
gguacaaucucagaguuua

SEQ ID NO: 1406656 - RNA, 19 nt, Homo sapiens
guuauuaaguugugggaua

SEQ ID NO: 1406657 - RNA, 19 nt, Homo sapiens
gagagacaguggacaguau

SEQ ID NO: 1406658 - RNA, 19 nt, Homo sapiens
ugacaagguuauuaaguug

SEQ ID NO: 1406659 - RNA, 19 nt, Homo sapiens
ccucaggccugcaauuuga

SEQ ID NO: 1406660 - RNA, 19 nt, Homo sapiens
gcaaugccuucuccauguu

SEQ ID NO: 1406661 - RNA, 19 nt, Homo sapiens
gaaugaauuugcagauuac

SEQ ID NO: 1406662 - RNA, 19 nt, Homo sapiens
gacaguucguguuugguua

SEQ ID NO: 1406663 - RNA, 19 nt, Homo sapiens
ggacaggacaagcaauuug

SEQ ID NO: 1406664 - RNA, 19 nt, Homo sapiens
guccauaggucuagacaau

SEQ ID NO: 1406665 - RNA, 19 nt, Homo sapiens
caagaagacuguccauagg

SEQ ID NO: 1406666 - RNA, 19 nt, Homo sapiens
cuaaagacccugaaugaau

SEQ ID NO: 1406667 - RNA, 19 nt, Homo sapiens
ggaacugacaagguuauua

SEQ ID NO: 1406668 - RNA, 19 nt, Homo sapiens
ggaaucagaaagauaguau

SEQ ID NO: 1406669 - RNA, 19 nt, Homo sapiens
cccaggagguggugaauau

SEQ ID NO: 1406670 - RNA, 19 nt, Homo sapiens
gaagugagggucugugaca

SEQ ID NO: 1406671 - RNA, 19 nt, Homo sapiens
gcacagcacacgcgacaau

SEQ ID NO: 1406672 - RNA, 19 nt, Homo sapiens
ccaaguaacaauccucaaa

SEQ ID NO: 1406673 - RNA, 19 nt, Homo sapiens
gaguuuauauugucagaag

SEQ ID NO: 1406674 - RNA, 19 nt, Homo sapiens
ggacaggacaguucguguu

SEQ ID NO: 1406675 - RNA, 19 nt, Homo sapiens
cugacaagguuauuaaguu

SEQ ID NO: 1406676 - RNA, 19 nt, Homo sapiens
gaggaugguuacugacuuc

SEQ ID NO: 1406677 - RNA, 19 nt, Homo sapiens
aagcaaaugugggacagua

SEQ ID NO: 1406678 - RNA, 19 nt, Homo sapiens
gcacccuggucacaacauu

SEQ ID NO: 1406679 - RNA, 19 nt, Homo sapiens
ggacaguucguguuugguu

SEQ ID NO: 1406680 - RNA, 19 nt, Homo sapiens
gucagaagauuauaacaag

SEQ ID NO: 1406681 - RNA, 19 nt, Homo sapiens
gacaguaaacauaacauug

SEQ ID NO: 1406682 - RNA, 19 nt, Homo sapiens
ggacaucggugggagaaaa

SEQ ID NO: 1406683 - RNA, 19 nt, Homo sapiens
gcaauuugauguugaaacc

SEQ ID NO: 1406684 - RNA, 19 nt, Homo sapiens
gcacaggacaggacaagca

SEQ ID NO: 1406685 - RNA, 19 nt, Homo sapiens
ccacagccaccuuccauga

SEQ ID NO: 1406686 - RNA, 19 nt, Homo sapiens
gacaggacaguucguguuu

SEQ ID NO: 1406687 - RNA, 19 nt, Homo sapiens
guucguguuugguuaaaga

SEQ ID NO: 1406688 - RNA, 19 nt, Homo sapiens
ugacgaugauccuguuugu

SEQ ID NO: 1406689 - RNA, 19 nt, Homo sapiens
gagugacgaugauccuguu

SEQ ID NO: 1406690 - RNA, 19 nt, Homo sapiens
gaaacuaaagacccugaau

SEQ ID NO: 1406691 - RNA, 19 nt, Homo sapiens
guaaagcagacaugugaga

SEQ ID NO: 1406692 - RNA, 19 nt, Homo sapiens
ucucagaguuuauauuguc

SEQ ID NO: 1406693 - RNA, 19 nt, Homo sapiens
gacagugauuccugccaaa

SEQ ID NO: 1406694 - RNA, 19 nt, Homo sapiens
cugaaugguuggacaguga

SEQ ID NO: 1406695 - RNA, 19 nt, Homo sapiens
agacaaugguacaaucuca

SEQ ID NO: 1406696 - RNA, 19 nt, Homo sapiens
acaagaagacuguccauag

SEQ ID NO: 1406697 - RNA, 19 nt, Homo sapiens
guucaugcaugucuuuuaa

SEQ ID NO: 1406698 - RNA, 19 nt, Homo sapiens
ccaggaaucagaaagauag

SEQ ID NO: 1406699 - RNA, 19 nt, Homo sapiens
ccacucaggccaaguaaca

SEQ ID NO: 1406700 - RNA, 19 nt, Homo sapiens
guuuaucggugaccacuca

SEQ ID NO: 1406701 - RNA, 19 nt, Homo sapiens
aaacuaaagacccugaaug

SEQ ID NO: 1406702 - RNA, 19 nt, Homo sapiens
caccuuccaugacaguaaa

SEQ ID NO: 1406703 - RNA, 19 nt, Homo sapiens
cagcacacgcgacaauuga

SEQ ID NO: 1406704 - RNA, 19 nt, Homo sapiens
caguaaacauaacauugug

SEQ ID NO: 1406705 - RNA, 19 nt, Homo sapiens
ccugaugggcuucgaguuu

SEQ ID NO: 1406706 - RNA, 19 nt, Homo sapiens
guugaaacccggcaugugu

SEQ ID NO: 1406707 - RNA, 19 nt, Homo sapiens
ugcaaugccuucuccaugu

SEQ ID NO: 1406708 - RNA, 19 nt, Homo sapiens
cugaaugaauuugcagauu

SEQ ID NO: 1406709 - RNA, 19 nt, Homo sapiens
agacaugugagaaguaaga

SEQ ID NO: 1406710 - RNA, 19 nt, Homo sapiens
cagcaccacugccgcaagu

SEQ ID NO: 1406711 - RNA, 19 nt, Homo sapiens
ugaccacucaggccaagua

SEQ ID NO: 1406712 - RNA, 19 nt, Homo sapiens
ggccugcaauuugauguug

SEQ ID NO: 1406713 - RNA, 19 nt, Homo sapiens
gcaaaugugggacaguaag

SEQ ID NO: 1406714 - RNA, 19 nt, Homo sapiens
ccaaggacacaacgacaga

SEQ ID NO: 1406715 - RNA, 19 nt, Homo sapiens
gcgcaucagagcagaguga

SEQ ID NO: 1406716 - RNA, 19 nt, Homo sapiens
aggcuaugcucgccgguuu

SEQ ID NO: 1406717 - RNA, 19 nt, Homo sapiens
ugguaaagcagacauguga

SEQ ID NO: 1406718 - RNA, 19 nt, Homo sapiens
caaaugugggacaguaaga

SEQ ID NO: 1406719 - RNA, 19 nt, Homo sapiens
cagaguuuauauugucaga

SEQ ID NO: 1406720 - RNA, 19 nt, Homo sapiens
aacuaaagacccugaauga

SEQ ID NO: 1406721 - RNA, 19 nt, Homo sapiens
ugugagaaguaagaaagaa

SEQ ID NO: 1406722 - RNA, 19 nt, Homo sapiens
caggacaguucguguuugg

SEQ ID NO: 1406723 - RNA, 19 nt, Homo sapiens
caaagaggagggcgucauc

SEQ ID NO: 1406724 - RNA, 19 nt, Homo sapiens
caggacaggacaagcaauu

SEQ ID NO: 1406725 - RNA, 19 nt, Homo sapiens
cagagcagagugacgauga

SEQ ID NO: 1406726 - RNA, 19 nt, Homo sapiens
ugaugacucucccaggaau

SEQ ID NO: 1406727 - RNA, 19 nt, Homo sapiens
ggacucuuccaacuuguuc

SEQ ID NO: 1406728 - RNA, 19 nt, Homo sapiens
ccaccuuccaugacaguaa

SEQ ID NO: 1406729 - RNA, 19 nt, Homo sapiens
ccacgaggccaucacagau

SEQ ID NO: 1406730 - RNA, 19 nt, Homo sapiens
gcacacgcgacaauugauc

SEQ ID NO: 1406731 - RNA, 19 nt, Homo sapiens
gugagaaguaagaaagaaa

SEQ ID NO: 1406732 - RNA, 19 nt, Homo sapiens
aagcagacaugugagaagu

SEQ ID NO: 1406733 - RNA, 19 nt, Homo sapiens
uaaagcagacaugugagaa

SEQ ID NO: 1406734 - RNA, 19 nt, Homo sapiens
cugaugggcuucgaguuug

SEQ ID NO: 1406735 - RNA, 19 nt, Homo sapiens
ccaagcguauaccaugcaa

SEQ ID NO: 1406736 - RNA, 19 nt, Homo sapiens
cggagucguucccgagaga

SEQ ID NO: 1406737 - RNA, 19 nt, Homo sapiens
ucuagacaaugguacaauc

SEQ ID NO: 1406738 - RNA, 19 nt, Homo sapiens
gacccugaaugaauuugca

SEQ ID NO: 1406739 - RNA, 19 nt, Homo sapiens
ugaugggcuucgaguuuga

SEQ ID NO: 1406740 - RNA, 19 nt, Homo sapiens
gugaucagccuuucuucug

SEQ ID NO: 1406741 - RNA, 19 nt, Homo sapiens
agaucacucugucaucaug

SEQ ID NO: 1406742 - RNA, 19 nt, Homo sapiens
guacaaucucagaguuuau

SEQ ID NO: 1406743 - RNA, 19 nt, Homo sapiens
agaggaugguuacugacuu

SEQ ID NO: 1406744 - RNA, 19 nt, Homo sapiens
gaucuccuguggcggugau

SEQ ID NO: 1406745 - RNA, 19 nt, Homo sapiens
gccuggcacugcucugaga

SEQ ID NO: 1406746 - RNA, 19 nt, Homo sapiens
aagcguauaccaugcaaug

SEQ ID NO: 1406747 - RNA, 19 nt, Homo sapiens
guuacugacuucuggaacu

SEQ ID NO: 1406748 - RNA, 19 nt, Homo sapiens
uccaugacaguaaacauaa

SEQ ID NO: 1406749 - RNA, 19 nt, Homo sapiens
uuccaugacaguaaacaua

SEQ ID NO: 1406750 - RNA, 19 nt, Homo sapiens
caaguaacaauccucaaac

SEQ ID NO: 1406751 - RNA, 19 nt, Homo sapiens
gaacaagugugacauggaa

SEQ ID NO: 1406752 - RNA, 19 nt, Homo sapiens
gagaacagcuuggguuuga

SEQ ID NO: 1406753 - RNA, 19 nt, Homo sapiens
gagcuuuccuguuuaauau

SEQ ID NO: 1406754 - RNA, 19 nt, Homo sapiens
ugagcgaggucaacauuua

SEQ ID NO: 1406755 - RNA, 19 nt, Homo sapiens
ggacaaugcccaaguuauu

SEQ ID NO: 1406756 - RNA, 19 nt, Homo sapiens
caagauuggucaacucaaa

SEQ ID NO: 1406757 - RNA, 19 nt, Homo sapiens
gcagaugacuccuuuacau

SEQ ID NO: 1406758 - RNA, 19 nt, Homo sapiens
gaaaggacauuugccaaca

SEQ ID NO: 1406759 - RNA, 19 nt, Homo sapiens
uaaggacuauccaucuaua

SEQ ID NO: 1406760 - RNA, 19 nt, Homo sapiens
uggcaaauaugugaucuua

SEQ ID NO: 1406761 - RNA, 19 nt, Homo sapiens
gaucagaacuuugacuaca

SEQ ID NO: 1406762 - RNA, 19 nt, Homo sapiens
ggacacagcaggccaggaa

SEQ ID NO: 1406763 - RNA, 19 nt, Homo sapiens
ugggaucgauuucaaagua

SEQ ID NO: 1406764 - RNA, 19 nt, Homo sapiens
ggagcuuuccuguuuaaua

SEQ ID NO: 1406765 - RNA, 19 nt, Homo sapiens
cuugggagcuuuccuguuu

SEQ ID NO: 1406766 - RNA, 19 nt, Homo sapiens
caggaaagauacaggacua

SEQ ID NO: 1406767 - RNA, 19 nt, Homo sapiens
uauaaggacuauccaucua

SEQ ID NO: 1406768 - RNA, 19 nt, Homo sapiens
gggaucgauuucaaaguaa

SEQ ID NO: 1406769 - RNA, 19 nt, Homo sapiens
ggaucgauuucaaaguaaa

SEQ ID NO: 1406770 - RNA, 19 nt, Homo sapiens
gcacaguugggaucgauuu

SEQ ID NO: 1406771 - RNA, 19 nt, Homo sapiens
gccaugggcuuuauuuuaa

SEQ ID NO: 1406772 - RNA, 19 nt, Homo sapiens
cagcaggccaggaaagaua

SEQ ID NO: 1406773 - RNA, 19 nt, Homo sapiens
gaacacgagacucaaggaa

SEQ ID NO: 1406774 - RNA, 19 nt, Homo sapiens
gacuauccaucuauaaaca

SEQ ID NO: 1406775 - RNA, 19 nt, Homo sapiens
gguccuagccagagagaaa

SEQ ID NO: 1406776 - RNA, 19 nt, Homo sapiens
guacaagauuggucaacuc

SEQ ID NO: 1406777 - RNA, 19 nt, Homo sapiens
caacugugccugcuagugu

SEQ ID NO: 1406778 - RNA, 19 nt, Homo sapiens
gaaagacuccucugaucag

SEQ ID NO: 1406779 - RNA, 19 nt, Homo sapiens
ucagaacuuugacuacaug

SEQ ID NO: 1406780 - RNA, 19 nt, Homo sapiens
cagagaguuuggagacuga

SEQ ID NO: 1406781 - RNA, 19 nt, Homo sapiens
gauggccucugcccaagau

SEQ ID NO: 1406782 - RNA, 19 nt, Homo sapiens
ggauaucaucugcgacaaa

SEQ ID NO: 1406783 - RNA, 19 nt, Homo sapiens
uuaugcagaugacuccuuu

SEQ ID NO: 1406784 - RNA, 19 nt, Homo sapiens
gauaucaucugcgacaaaa

SEQ ID NO: 1406785 - RNA, 19 nt, Homo sapiens
gaacagcuuggguuugagu

SEQ ID NO: 1406786 - RNA, 19 nt, Homo sapiens
gcucguacgcauucaauuc

SEQ ID NO: 1406787 - RNA, 19 nt, Homo sapiens
aaaggacauuugccaacaa

SEQ ID NO: 1406788 - RNA, 19 nt, Homo sapiens
gugccaaggacaacauuaa

SEQ ID NO: 1406789 - RNA, 19 nt, Homo sapiens
uuggucaacucaaaucaaa

SEQ ID NO: 1406790 - RNA, 19 nt, Homo sapiens
ccagagagaaaggacauuu

SEQ ID NO: 1406791 - RNA, 19 nt, Homo sapiens
gacuacauguucaaauuac

SEQ ID NO: 1406792 - RNA, 19 nt, Homo sapiens
ugggagcuuuccuguuuaa

SEQ ID NO: 1406793 - RNA, 19 nt, Homo sapiens
gaaggaauaaauugauguc

SEQ ID NO: 1406794 - RNA, 19 nt, Homo sapiens
ggaacaagugugacaugga

SEQ ID NO: 1406795 - RNA, 19 nt, Homo sapiens
ggacuauccaucuauaaac

SEQ ID NO: 1406796 - RNA, 19 nt, Homo sapiens
gcuuuccuguuuaauaugu

SEQ ID NO: 1406797 - RNA, 19 nt, Homo sapiens
acacgagacucaaggaaac

SEQ ID NO: 1406798 - RNA, 19 nt, Homo sapiens
aaacaagugccaaggacaa

SEQ ID NO: 1406799 - RNA, 19 nt, Homo sapiens
cauuuauacugccuaacaa

SEQ ID NO: 1406800 - RNA, 19 nt, Homo sapiens
gacaaugcccaaguuauuc

SEQ ID NO: 1406801 - RNA, 19 nt, Homo sapiens
ggagaacagcuuggguuug

SEQ ID NO: 1406802 - RNA, 19 nt, Homo sapiens
agaaagacuccucugauca

SEQ ID NO: 1406803 - RNA, 19 nt, Homo sapiens
ggucuauuagccuucauuu

SEQ ID NO: 1406804 - RNA, 19 nt, Homo sapiens
aagcagaacacgagacuca

SEQ ID NO: 1406805 - RNA, 19 nt, Homo sapiens
gccaaggacaacauuaaug

SEQ ID NO: 1406806 - RNA, 19 nt, Homo sapiens
caguugggaucgauuucaa

SEQ ID NO: 1406807 - RNA, 19 nt, Homo sapiens
gccuaacaauuauuugaag

SEQ ID NO: 1406808 - RNA, 19 nt, Homo sapiens
gcagaacacgagacucaag

SEQ ID NO: 1406809 - RNA, 19 nt, Homo sapiens
ccagguacggccagaaaga

SEQ ID NO: 1406810 - RNA, 19 nt, Homo sapiens
caacugagcgaggucaaca

SEQ ID NO: 1406811 - RNA, 19 nt, Homo sapiens
caucuuuucuauuccguua

SEQ ID NO: 1406812 - RNA, 19 nt, Homo sapiens
gagcgggucaucucaacug

SEQ ID NO: 1406813 - RNA, 19 nt, Homo sapiens
cuucauuuauacugccuaa

SEQ ID NO: 1406814 - RNA, 19 nt, Homo sapiens
uuacucaucaucggcaaua

SEQ ID NO: 1406815 - RNA, 19 nt, Homo sapiens
gggacaaugcccaaguuau

SEQ ID NO: 1406816 - RNA, 19 nt, Homo sapiens
gcauucgucagcacaguug

SEQ ID NO: 1406817 - RNA, 19 nt, Homo sapiens
aaacaucugguaccugcaa

SEQ ID NO: 1406818 - RNA, 19 nt, Homo sapiens
cguacgcauucaauucuug

SEQ ID NO: 1406819 - RNA, 19 nt, Homo sapiens
ucauuuauacugccuaaca

SEQ ID NO: 1406820 - RNA, 19 nt, Homo sapiens
gagcgaggucaacauuuag

SEQ ID NO: 1406821 - RNA, 19 nt, Homo sapiens
uaucaccacagccuauuau

SEQ ID NO: 1406822 - RNA, 19 nt, Homo sapiens
ugccaucacugcugcaaag

SEQ ID NO: 1406823 - RNA, 19 nt, Homo sapiens
aaacauacucuugggacaa

SEQ ID NO: 1406824 - RNA, 19 nt, Homo sapiens
cagagagaaaggacauuug

SEQ ID NO: 1406825 - RNA, 19 nt, Homo sapiens
cagcacaguugggaucgau

SEQ ID NO: 1406826 - RNA, 19 nt, Homo sapiens
ucuauuccguuaugcagau

SEQ ID NO: 1406827 - RNA, 19 nt, Homo sapiens
caucuauaaacaucuggua

SEQ ID NO: 1406828 - RNA, 19 nt, Homo sapiens
aaggacauuugccaacaau

SEQ ID NO: 1406829 - RNA, 19 nt, Homo sapiens
caaagcagaacacgagacu

SEQ ID NO: 1406830 - RNA, 19 nt, Homo sapiens
guucaaauuacucaucauc

SEQ ID NO: 1406831 - RNA, 19 nt, Homo sapiens
uugagcgccuuguggauau

SEQ ID NO: 1406832 - RNA, 19 nt, Homo sapiens
ggucaacauuuaggagaac

SEQ ID NO: 1406833 - RNA, 19 nt, Homo sapiens
gugcgguccuagccagaga

SEQ ID NO: 1406834 - RNA, 19 nt, Homo sapiens
uugggagcuuuccuguuua

SEQ ID NO: 1406835 - RNA, 19 nt, Homo sapiens
gucuauuagccuucauuua

SEQ ID NO: 1406836 - RNA, 19 nt, Homo sapiens
ggaagacgagcgggucauc

SEQ ID NO: 1406837 - RNA, 19 nt, Homo sapiens
aagagaaucaagcuucaga

SEQ ID NO: 1406838 - RNA, 19 nt, Homo sapiens
aggacuauccaucuauaaa

SEQ ID NO: 1406839 - RNA, 19 nt, Homo sapiens
aacauacucuugggacaau

SEQ ID NO: 1406840 - RNA, 19 nt, Homo sapiens
aaaagagaaucaagcuuca

SEQ ID NO: 1406841 - RNA, 19 nt, Homo sapiens
caccacagccuauuaucgu

SEQ ID NO: 1406842 - RNA, 19 nt, Homo sapiens
cuaucaccacagccuauua

SEQ ID NO: 1406843 - RNA, 19 nt, Homo sapiens
cuauccaucuauaaacauc

SEQ ID NO: 1406844 - RNA, 19 nt, Homo sapiens
cagcuuggguuugaguuuu

SEQ ID NO: 1406845 - RNA, 19 nt, Homo sapiens
gacuaucaccacagccuau

SEQ ID NO: 1406846 - RNA, 19 nt, Homo sapiens
ucaaggacaugccaaagaa

SEQ ID NO: 1406847 - RNA, 19 nt, Homo sapiens
uggcuuagcuacccugaaa

SEQ ID NO: 1406848 - RNA, 19 nt, Homo sapiens
gcccagagguucgagauca

SEQ ID NO: 1406849 - RNA, 19 nt, Homo sapiens
ucacagaugaguucuaugu

SEQ ID NO: 1406850 - RNA, 19 nt, Homo sapiens
acagaugaguucuauguac

SEQ ID NO: 1406851 - RNA, 19 nt, Homo sapiens
gagaucaaccugggcaaga

SEQ ID NO: 1406852 - RNA, 19 nt, Homo sapiens
cagaugaguucuauguacu

SEQ ID NO: 1406853 - RNA, 19 nt, Homo sapiens
ggacaugccaaagaaaugg

SEQ ID NO: 1406854 - RNA, 19 nt, Homo sapiens
uaccauggccucccuguuc

SEQ ID NO: 1406855 - RNA, 19 nt, Homo sapiens
gaucaaccugggcaagaga

SEQ ID NO: 1406856 - RNA, 19 nt, Homo sapiens
caaggacaugccaaagaaa

SEQ ID NO: 1406857 - RNA, 19 nt, Homo sapiens
gacccugacucuacgaaaa

SEQ ID NO: 1406858 - RNA, 19 nt, Homo sapiens
auccugauccgcaacaaua

SEQ ID NO: 1406859 - RNA, 19 nt, Homo sapiens
ggagugggguuuguugaug

SEQ ID NO: 1406860 - RNA, 19 nt, Homo sapiens
ucgugcggcucacagauga

SEQ ID NO: 1406861 - RNA, 19 nt, Homo sapiens
gcgcaccuguggcuuagcu

SEQ ID NO: 1406862 - RNA, 19 nt, Homo sapiens
ccuguaaucccagcacuug

SEQ ID NO: 1406863 - RNA, 19 nt, Homo sapiens
cacagaugaguucuaugua

SEQ ID NO: 1406864 - RNA, 19 nt, Homo sapiens
gagugggguuuguugauga

SEQ ID NO: 1406865 - RNA, 19 nt, Homo sapiens
acaaagaugcguucaaaua

SEQ ID NO: 1406866 - RNA, 19 nt, Homo sapiens
ggaaggacuuugugaagga

SEQ ID NO: 1406867 - RNA, 19 nt, Homo sapiens
caaggaagcccugaaauga

SEQ ID NO: 1406868 - RNA, 19 nt, Homo sapiens
uuacaaagaugcguucaaa

SEQ ID NO: 1406869 - RNA, 19 nt, Homo sapiens
gaauauuguuguggucuuu

SEQ ID NO: 1406870 - RNA, 19 nt, Homo sapiens
cacauucucucaaccuaua

SEQ ID NO: 1406871 - RNA, 19 nt, Homo sapiens
uggcauagaucuugggaaa

SEQ ID NO: 1406872 - RNA, 19 nt, Homo sapiens
aggaauuggugcuggauua

SEQ ID NO: 1406873 - RNA, 19 nt, Homo sapiens
gaaugguucacuuaaauga

SEQ ID NO: 1406874 - RNA, 19 nt, Homo sapiens
caaagaugcguucaaauag

SEQ ID NO: 1406875 - RNA, 19 nt, Homo sapiens
gccagacgcugaccacguu

SEQ ID NO: 1406876 - RNA, 19 nt, Homo sapiens
ggaccuguauaauggaaug

SEQ ID NO: 1406877 - RNA, 19 nt, Homo sapiens
ggagaugcuucuacuggau

SEQ ID NO: 1406878 - RNA, 19 nt, Homo sapiens
gaaggacuuugugaaggaa

SEQ ID NO: 1406879 - RNA, 19 nt, Homo sapiens
ggaauauuguuguggucuu

SEQ ID NO: 1406880 - RNA, 19 nt, Homo sapiens
caggaccucuucccauuga

SEQ ID NO: 1406881 - RNA, 19 nt, Homo sapiens
uggaaugguucacuuaaau

SEQ ID NO: 1406882 - RNA, 19 nt, Homo sapiens
ccaaggaagcccugaaaug

SEQ ID NO: 1406883 - RNA, 19 nt, Homo sapiens
aaagaugcguucaaauagu

SEQ ID NO: 1406884 - RNA, 19 nt, Homo sapiens
cuaccaaucuuuguacaau

SEQ ID NO: 1406885 - RNA, 19 nt, Homo sapiens
gcauagaucuugggaaaau

SEQ ID NO: 1406886 - RNA, 19 nt, Homo sapiens
ggaaugguucacuuaaaug

SEQ ID NO: 1406887 - RNA, 19 nt, Homo sapiens
gggaaugucugagggaaag

SEQ ID NO: 1406888 - RNA, 19 nt, Homo sapiens
gaccaaggaagcccugaaa

SEQ ID NO: 1406889 - RNA, 19 nt, Homo sapiens
aggaagcccugaaaugaau

SEQ ID NO: 1406890 - RNA, 19 nt, Homo sapiens
ugucagcguugguauuuca

SEQ ID NO: 1406891 - RNA, 19 nt, Homo sapiens
aagaugcguucaaauagug

SEQ ID NO: 1406892 - RNA, 19 nt, Homo sapiens
ucucucaaccuauaauuug

SEQ ID NO: 1406893 - RNA, 19 nt, Homo sapiens
gcguugguauuucacauuc

SEQ ID NO: 1406894 - RNA, 19 nt, Homo sapiens
guugguauuucacauucaa

SEQ ID NO: 1406895 - RNA, 19 nt, Homo sapiens
gcagaaaugcaugcuguca

SEQ ID NO: 1406896 - RNA, 19 nt, Homo sapiens
ucgcaucauuauugaagaa

SEQ ID NO: 1406897 - RNA, 19 nt, Homo sapiens
gguuggcacuuguucagau

SEQ ID NO: 1406898 - RNA, 19 nt, Homo sapiens
guuggcacuuguucagauu

SEQ ID NO: 1406899 - RNA, 19 nt, Homo sapiens
uacaagcaguguucaugga

SEQ ID NO: 1406900 - RNA, 19 nt, Homo sapiens
agaccaaagugugauuuca

SEQ ID NO: 1406901 - RNA, 19 nt, Homo sapiens
ucaauggagcugaauguuc

SEQ ID NO: 1406902 - RNA, 19 nt, Homo sapiens
uuggaaugguucacuuaaa

SEQ ID NO: 1406903 - RNA, 19 nt, Homo sapiens
gugguggaccuguauaaug

SEQ ID NO: 1406904 - RNA, 19 nt, Homo sapiens
aagcaguguucauggaguu

SEQ ID NO: 1406905 - RNA, 19 nt, Homo sapiens
aauggaaugugcuuacaag

SEQ ID NO: 1406906 - RNA, 19 nt, Homo sapiens
gaaugaaaagcaaagcuaa

SEQ ID NO: 1406907 - RNA, 19 nt, Homo sapiens
ucaguuucucgcaucauua

SEQ ID NO: 1406908 - RNA, 19 nt, Homo sapiens
ugguggaccuguauaaugg

SEQ ID NO: 1406909 - RNA, 19 nt, Homo sapiens
uucaggaccucuucccauu

SEQ ID NO: 1406910 - RNA, 19 nt, Homo sapiens
ggaccaaggaagcccugaa

SEQ ID NO: 1406911 - RNA, 19 nt, Homo sapiens
ggacacccaacuacaagca

SEQ ID NO: 1406912 - RNA, 19 nt, Homo sapiens
ggauggauucaaaggagaa

SEQ ID NO: 1406913 - RNA, 19 nt, Homo sapiens
uaucuggguuggcacuugu

SEQ ID NO: 1406914 - RNA, 19 nt, Homo sapiens
ucgcacuucuucuguggaa

SEQ ID NO: 1406915 - RNA, 19 nt, Homo sapiens
cccauugaagcuauaauuu

SEQ ID NO: 1406916 - RNA, 19 nt, Homo sapiens
ccaacuacaagcaguguuc

SEQ ID NO: 1406917 - RNA, 19 nt, Homo sapiens
gucacauucucucaaccua

SEQ ID NO: 1406918 - RNA, 19 nt, Homo sapiens
aaggaagcccugaaaugaa

SEQ ID NO: 1406919 - RNA, 19 nt, Homo sapiens
cggcuaaaaugcagaaaug

SEQ ID NO: 1406920 - RNA, 19 nt, Homo sapiens
uuucucgcaucauuauuga

SEQ ID NO: 1406921 - RNA, 19 nt, Homo sapiens
aauuggugcuggauuagug

SEQ ID NO: 1406922 - RNA, 19 nt, Homo sapiens
ggaauuggugcuggauuag

SEQ ID NO: 1406923 - RNA, 19 nt, Homo sapiens
guggaccuguauaauggaa

SEQ ID NO: 1406924 - RNA, 19 nt, Homo sapiens
guuucucgcaucauuauug

SEQ ID NO: 1406925 - RNA, 19 nt, Homo sapiens
uaauauucaucgcacuucu

SEQ ID NO: 1406926 - RNA, 19 nt, Homo sapiens
gcguucaaauagugcucua

SEQ ID NO: 1406927 - RNA, 19 nt, Homo sapiens
auugcggaguguacauuua

SEQ ID NO: 1406928 - RNA, 19 nt, Homo sapiens
uggauggaauucaguuucu

SEQ ID NO: 1406929 - RNA, 19 nt, Homo sapiens
ggacuuugugaaggaauug

SEQ ID NO: 1406930 - RNA, 19 nt, Homo sapiens
ggaagcccugaaaugaauu

SEQ ID NO: 1406931 - RNA, 19 nt, Homo sapiens
gauuaguggauguugcuau

SEQ ID NO: 1406932 - RNA, 19 nt, Homo sapiens
cauagucacauucucucaa

SEQ ID NO: 1406933 - RNA, 19 nt, Homo sapiens
ggauggaauucaguuucuc

SEQ ID NO: 1406934 - RNA, 19 nt, Homo sapiens
guggaaggacuuugugaag

SEQ ID NO: 1406935 - RNA, 19 nt, Homo sapiens
gaagcccugaaaugaauuc

SEQ ID NO: 1406936 - RNA, 19 nt, Homo sapiens
guauaauggaaugugcuua

SEQ ID NO: 1406937 - RNA, 19 nt, Homo sapiens
gaauguucaggaccucuuc

SEQ ID NO: 1406938 - RNA, 19 nt, Homo sapiens
uucaaauagugcucuaaga

SEQ ID NO: 1406939 - RNA, 19 nt, Homo sapiens
guucaaauagugcucuaag

SEQ ID NO: 1406940 - RNA, 19 nt, Homo sapiens
uaauggaaugugcuuacaa

SEQ ID NO: 1406941 - RNA, 19 nt, Homo sapiens
gcuaccaaucuuuguacaa

SEQ ID NO: 1406942 - RNA, 19 nt, Homo sapiens
gaauacuuucuucauaguc

SEQ ID NO: 1406943 - RNA, 19 nt, Homo sapiens
ccuuggaaugguucacuua

SEQ ID NO: 1406944 - RNA, 19 nt, Homo sapiens
gcaucauuauugaagaacu

SEQ ID NO: 1406945 - RNA, 19 nt, Homo sapiens
uucaguuucucgcaucauu

SEQ ID NO: 1406946 - RNA, 19 nt, Homo sapiens
gaaggaauuggugcuggau

SEQ ID NO: 1406947 - RNA, 19 nt, Homo sapiens
ucacauucucucaaccuau

SEQ ID NO: 1406948 - RNA, 19 nt, Homo sapiens
uauaauggaaugugcuuac

SEQ ID NO: 1406949 - RNA, 19 nt, Homo sapiens
uuuauuaugccuuggaaug

SEQ ID NO: 1406950 - RNA, 19 nt, Homo sapiens
caguuucucgcaucauuau

SEQ ID NO: 1406951 - RNA, 19 nt, Homo sapiens
aaaaggagaugcuucuacu

SEQ ID NO: 1406952 - RNA, 19 nt, Homo sapiens
uaguggauguugcuaucug

SEQ ID NO: 1406953 - RNA, 19 nt, Homo sapiens
gugcuggauuaguggaugu

SEQ ID NO: 1406954 - RNA, 19 nt, Homo sapiens
gaauuggugcuggauuagu

SEQ ID NO: 1406955 - RNA, 19 nt, Homo sapiens
caagauccguucccagaaa

SEQ ID NO: 1406956 - RNA, 19 nt, Homo sapiens
gcucaaggccuaucuaaug

SEQ ID NO: 1406957 - RNA, 19 nt, Homo sapiens
ccucagaguugcgcaauaa

SEQ ID NO: 1406958 - RNA, 19 nt, Homo sapiens
agaagaaacuggagaacga

SEQ ID NO: 1406959 - RNA, 19 nt, Homo sapiens
caagggagaugagaaagug

SEQ ID NO: 1406960 - RNA, 19 nt, Homo sapiens
gagaagccauaccugaaga

SEQ ID NO: 1406961 - RNA, 19 nt, Homo sapiens
ggaagugggagaagccaua

SEQ ID NO: 1406962 - RNA, 19 nt, Homo sapiens
cuaaggcacuggaacuaaa

SEQ ID NO: 1406963 - RNA, 19 nt, Homo sapiens
ccaagaaccagcugcagua

SEQ ID NO: 1406964 - RNA, 19 nt, Homo sapiens
agggaaggcugcccgaaua

SEQ ID NO: 1406965 - RNA, 19 nt, Homo sapiens
ggacgagagccucaacuug

SEQ ID NO: 1406966 - RNA, 19 nt, Homo sapiens
gauccguucccagaaauua

SEQ ID NO: 1406967 - RNA, 19 nt, Homo sapiens
ucccagaaauuaaucgaaa

SEQ ID NO: 1406968 - RNA, 19 nt, Homo sapiens
gccagacguucccacagua

SEQ ID NO: 1406969 - RNA, 19 nt, Homo sapiens
ggaggaggacaacgaggua

SEQ ID NO: 1406970 - RNA, 19 nt, Homo sapiens
gaaggcugcccgaauacaa

SEQ ID NO: 1406971 - RNA, 19 nt, Homo sapiens
gcaggagcgucucaagaag

SEQ ID NO: 1406972 - RNA, 19 nt, Homo sapiens
gcaggaggccgagcacauu

SEQ ID NO: 1406973 - RNA, 19 nt, Homo sapiens
uggaagaccucaaguacuc

SEQ ID NO: 1406974 - RNA, 19 nt, Homo sapiens
cgggaacgcuacauaagug

SEQ ID NO: 1406975 - RNA, 19 nt, Homo sapiens
gggagaagccauaccugaa

SEQ ID NO: 1406976 - RNA, 19 nt, Homo sapiens
ucagucagcuccgcaagga

SEQ ID NO: 1406977 - RNA, 19 nt, Homo sapiens
ggccagacguucccacagu

SEQ ID NO: 1406978 - RNA, 19 nt, Homo sapiens
ggagaaggcccagaugaag

SEQ ID NO: 1406979 - RNA, 19 nt, Homo sapiens
cgagggagaccaucaguca

SEQ ID NO: 1406980 - RNA, 19 nt, Homo sapiens
ggagaagccauaccugaag

SEQ ID NO: 1406981 - RNA, 19 nt, Homo sapiens
uaaauguuaccgaccauga

SEQ ID NO: 1406982 - RNA, 19 nt, Homo sapiens
ccaggcagauaacuaugug

SEQ ID NO: 1406983 - RNA, 19 nt, Homo sapiens
aaucgaaagucacaagaag

SEQ ID NO: 1406984 - RNA, 19 nt, Homo sapiens
caggaggccgagcacauua

SEQ ID NO: 1406985 - RNA, 19 nt, Homo sapiens
gcguguaccugcagcucaa

SEQ ID NO: 1406986 - RNA, 19 nt, Homo sapiens
cagaguugcgcaauaaaug

SEQ ID NO: 1406987 - RNA, 19 nt, Homo sapiens
gcacauuaccagcguguac

SEQ ID NO: 1406988 - RNA, 19 nt, Homo sapiens
acacggagguggccaagac

SEQ ID NO: 1406989 - RNA, 19 nt, Homo sapiens
gagggaaggcugcccgaau

SEQ ID NO: 1406990 - RNA, 19 nt, Homo sapiens
gcgcaggagcgucucaaga

SEQ ID NO: 1406991 - RNA, 19 nt, Homo sapiens
cgaugcaaguggccaagga

SEQ ID NO: 1406992 - RNA, 19 nt, Homo sapiens
gaacgcuacauaagugagu

SEQ ID NO: 1406993 - RNA, 19 nt, Homo sapiens
cagcucaaggccuaucuaa

SEQ ID NO: 1406994 - RNA, 19 nt, Homo sapiens
cgcaggagcgucucaagaa

SEQ ID NO: 1406995 - RNA, 19 nt, Homo sapiens
gcuggaagaccucaaguac

SEQ ID NO: 1406996 - RNA, 19 nt, Homo sapiens
cccgggacauugccaagaa

SEQ ID NO: 1406997 - RNA, 19 nt, Homo sapiens
gaguugcgcaauaaauguu

SEQ ID NO: 1406998 - RNA, 19 nt, Homo sapiens
gacuaaggcacuggaacua

SEQ ID NO: 1406999 - RNA, 19 nt, Homo sapiens
gccucagaguugcgcaaua

SEQ ID NO: 1407000 - RNA, 19 nt, Homo sapiens
ccagacguucccacaguaa

SEQ ID NO: 1407001 - RNA, 19 nt, Homo sapiens
gcgggaacgcuacauaagu

SEQ ID NO: 1407002 - RNA, 19 nt, Homo sapiens
uaaucgaaagucacaagaa

SEQ ID NO: 1407003 - RNA, 19 nt, Homo sapiens
uggagaaggcccagaugaa

SEQ ID NO: 1407004 - RNA, 19 nt, Homo sapiens
agccauaccugaagaacag

SEQ ID NO: 1407005 - RNA, 19 nt, Homo sapiens
acgagagccucaacuugga

SEQ ID NO: 1407006 - RNA, 19 nt, Homo sapiens
ucagaguugcgcaauaaau

SEQ ID NO: 1407007 - RNA, 19 nt, Homo sapiens
gaggacaacgagguaguga

SEQ ID NO: 1407008 - RNA, 19 nt, Homo sapiens
cagauaacuaugugccaaa

SEQ ID NO: 1407009 - RNA, 19 nt, Homo sapiens
gcaggagaagcaacaacug

SEQ ID NO: 1407010 - RNA, 19 nt, Homo sapiens
gcagcucaaggccuaucua

SEQ ID NO: 1407011 - RNA, 19 nt, Homo sapiens
gcgaauggaagugggagaa

SEQ ID NO: 1407012 - RNA, 19 nt, Homo sapiens
ccagaaauuaaucgaaagu

SEQ ID NO: 1407013 - RNA, 19 nt, Homo sapiens
ggaggacaacgagguagug

SEQ ID NO: 1407014 - RNA, 19 nt, Homo sapiens
aggagcgucucaagaagga

SEQ ID NO: 1407015 - RNA, 19 nt, Homo sapiens
agaaccagcugcaguaccu

SEQ ID NO: 1407016 - RNA, 19 nt, Homo sapiens
ggaaggcugcccgaauaca

SEQ ID NO: 1407017 - RNA, 19 nt, Homo sapiens
aggaaaagcugcugaaacu

SEQ ID NO: 1407018 - RNA, 19 nt, Homo sapiens
cucaaggccuaucuaaugg

SEQ ID NO: 1407019 - RNA, 19 nt, Homo sapiens
aauguuaccgaccaugaaa

SEQ ID NO: 1407020 - RNA, 19 nt, Homo sapiens
aagauccguucccagaaau

SEQ ID NO: 1407021 - RNA, 19 nt, Homo sapiens
ucaagauccguucccagaa

SEQ ID NO: 1407022 - RNA, 19 nt, Homo sapiens
ugaagcaggagaagcaaca

SEQ ID NO: 1407023 - RNA, 19 nt, Homo sapiens
gggaacgcuacauaaguga

SEQ ID NO: 1407024 - RNA, 19 nt, Homo sapiens
gugaggaggaggacaacga

SEQ ID NO: 1407025 - RNA, 19 nt, Homo sapiens
ugagggagaaggugaagca

SEQ ID NO: 1407026 - RNA, 19 nt, Homo sapiens
uggagaaccgccuggagaa

SEQ ID NO: 1407027 - RNA, 19 nt, Homo sapiens
ucaagggagaugagaaagu

SEQ ID NO: 1407028 - RNA, 19 nt, Homo sapiens
ggagacuaaggcacuggaa

SEQ ID NO: 1407029 - RNA, 19 nt, Homo sapiens
gaaccagcugcaguaccua

SEQ ID NO: 1407030 - RNA, 19 nt, Homo sapiens
gaccugugcuugcuaaaga

SEQ ID NO: 1407031 - RNA, 19 nt, Homo sapiens
gcagcgggcucaucacuca

SEQ ID NO: 1407032 - RNA, 19 nt, Homo sapiens
gagagcagagugagauuaa

SEQ ID NO: 1407033 - RNA, 19 nt, Homo sapiens
gaggaccugugcuugcuaa

SEQ ID NO: 1407034 - RNA, 19 nt, Homo sapiens
gaaaggaaagaccaaagug

SEQ ID NO: 1407035 - RNA, 19 nt, Homo sapiens
ugacccaccugaccacuga

SEQ ID NO: 1407036 - RNA, 19 nt, Homo sapiens
uaaagaaggaggagaagga

SEQ ID NO: 1407037 - RNA, 19 nt, Homo sapiens
ccaaggagccugagaagag

SEQ ID NO: 1407038 - RNA, 19 nt, Homo sapiens
ggaaaggaaagaccaaagu

SEQ ID NO: 1407039 - RNA, 19 nt, Homo sapiens
gcaucgagaccaagaaaga

SEQ ID NO: 1407040 - RNA, 19 nt, Homo sapiens
gaggugcccugugccauga

SEQ ID NO: 1407041 - RNA, 19 nt, Homo sapiens
gagauuaaagagcgagaaa

SEQ ID NO: 1407042 - RNA, 19 nt, Homo sapiens
ucgcucaacuggcacauga

SEQ ID NO: 1407043 - RNA, 19 nt, Homo sapiens
ugaagaacguggugaucug

SEQ ID NO: 1407044 - RNA, 19 nt, Homo sapiens
ggagaaggaggagccagua

SEQ ID NO: 1407045 - RNA, 19 nt, Homo sapiens
ccagcgcccucuuugagaa

SEQ ID NO: 1407046 - RNA, 19 nt, Homo sapiens
caagagagcagagugagau

SEQ ID NO: 1407047 - RNA, 19 nt, Homo sapiens
gcacaugaucauccauuca

SEQ ID NO: 1407048 - RNA, 19 nt, Homo sapiens
ggacggcagcgacauguca

SEQ ID NO: 1407049 - RNA, 19 nt, Homo sapiens
gagcagagugagauuaaag

SEQ ID NO: 1407050 - RNA, 19 nt, Homo sapiens
ucaacuggcacaugaagaa

SEQ ID NO: 1407051 - RNA, 19 nt, Homo sapiens
agaacguggugaucuggua

SEQ ID NO: 1407052 - RNA, 19 nt, Homo sapiens
uuaaagagcgagaaagcaa

SEQ ID NO: 1407053 - RNA, 19 nt, Homo sapiens
ccacgucaaucuugugcau

SEQ ID NO: 1407054 - RNA, 19 nt, Homo sapiens
gcaacaacggugccugaga

SEQ ID NO: 1407055 - RNA, 19 nt, Homo sapiens
gcgugcacauucccuuuga

SEQ ID NO: 1407056 - RNA, 19 nt, Homo sapiens
uagcaggcaucgagaccaa

SEQ ID NO: 1407057 - RNA, 19 nt, Homo sapiens
cauccuggcuguggcaaga

SEQ ID NO: 1407058 - RNA, 19 nt, Homo sapiens
cgacaugucagccaucauc

SEQ ID NO: 1407059 - RNA, 19 nt, Homo sapiens
aacgugaacugccugaaga

SEQ ID NO: 1407060 - RNA, 19 nt, Homo sapiens
gaggguagccagccuagca

SEQ ID NO: 1407061 - RNA, 19 nt, Homo sapiens
uaaagagcgagaaagcaaa

SEQ ID NO: 1407062 - RNA, 19 nt, Homo sapiens
gaggugcaguacaacuuca

SEQ ID NO: 1407063 - RNA, 19 nt, Homo sapiens
cagaaccacgucaaucuug

SEQ ID NO: 1407064 - RNA, 19 nt, Homo sapiens
caugucagccaucaucuau

SEQ ID NO: 1407065 - RNA, 19 nt, Homo sapiens
ggaggugcaguacaacuuc

SEQ ID NO: 1407066 - RNA, 19 nt, Homo sapiens
gaaccacgucaaucuugug

SEQ ID NO: 1407067 - RNA, 19 nt, Homo sapiens
ugaacugccugaagaacgu

SEQ ID NO: 1407068 - RNA, 19 nt, Homo sapiens
caacgugaacugccugaag

SEQ ID NO: 1407069 - RNA, 19 nt, Homo sapiens
gcaggcaucgagaccaaga

SEQ ID NO: 1407070 - RNA, 19 nt, Homo sapiens
ccgccuaccucaucucucu

SEQ ID NO: 1407071 - RNA, 19 nt, Homo sapiens
cauggacgccaccgcagua

SEQ ID NO: 1407072 - RNA, 19 nt, Homo sapiens
ggcacaugaucauccauuc

SEQ ID NO: 1407073 - RNA, 19 nt, Homo sapiens
cugaagcccuggagacagu

SEQ ID NO: 1407074 - RNA, 19 nt, Homo sapiens
caggagggcgugcacauuc

SEQ ID NO: 1407075 - RNA, 19 nt, Homo sapiens
cuuccggucuggcuccuaa

SEQ ID NO: 1407076 - RNA, 19 nt, Homo sapiens
gauuaaagagcgagaaagc

SEQ ID NO: 1407077 - RNA, 19 nt, Homo sapiens
ccagaaccacgucaaucuu

SEQ ID NO: 1407078 - RNA, 19 nt, Homo sapiens
agagagcagagugagauua

SEQ ID NO: 1407079 - RNA, 19 nt, Homo sapiens
cuggaacugugucaagaga

SEQ ID NO: 1407080 - RNA, 19 nt, Homo sapiens
aaaggaaagaccaaagugu

SEQ ID NO: 1407081 - RNA, 19 nt, Homo sapiens
gggcauucaccucaacaug

SEQ ID NO: 1407082 - RNA, 19 nt, Homo sapiens
gcucugccucugacucuga

SEQ ID NO: 1407083 - RNA, 19 nt, Homo sapiens
ggagcuagaccccacuuuu

SEQ ID NO: 1407084 - RNA, 19 nt, Homo sapiens
gagcuagaccccacuuuug

SEQ ID NO: 1407085 - RNA, 19 nt, Homo sapiens
agaaccacgucaaucuugu

SEQ ID NO: 1407086 - RNA, 19 nt, Homo sapiens
ggaggaccugugcuugcua

SEQ ID NO: 1407087 - RNA, 19 nt, Homo sapiens
gggcgugcacauucccuuu

SEQ ID NO: 1407088 - RNA, 19 nt, Homo sapiens
gcagagugagauuaaagag

SEQ ID NO: 1407089 - RNA, 19 nt, Homo sapiens
agaaggaggaccugugcuu

SEQ ID NO: 1407090 - RNA, 19 nt, Homo sapiens
gcucuggcucugccucuga

SEQ ID NO: 1407091 - RNA, 19 nt, Homo sapiens
agagcagagugagauuaaa

SEQ ID NO: 1407092 - RNA, 19 nt, Homo sapiens
gagaaggaggagccaguag

SEQ ID NO: 1407093 - RNA, 19 nt, Homo sapiens
gugacaaagugggcaaugg

SEQ ID NO: 1407094 - RNA, 19 nt, Homo sapiens
cagccuacacccagacaga

SEQ ID NO: 1407095 - RNA, 19 nt, Homo sapiens
ucaagagagcagagugaga

SEQ ID NO: 1407096 - RNA, 19 nt, Homo sapiens
gcucaacuggcacaugaag

SEQ ID NO: 1407097 - RNA, 19 nt, Homo sapiens
gauguuccacugcccauac

SEQ ID NO: 1407098 - RNA, 19 nt, Homo sapiens
ggaccugugcuugcuaaag

SEQ ID NO: 1407099 - RNA, 19 nt, Homo sapiens
caaguuccacacgcucaaa

SEQ ID NO: 1407100 - RNA, 19 nt, Homo sapiens
gguacgaggaccacaagca

SEQ ID NO: 1407101 - RNA, 19 nt, Homo sapiens
ucgagucccggaagaggua

SEQ ID NO: 1407102 - RNA, 19 nt, Homo sapiens
ggacaccacucaaacauuu

SEQ ID NO: 1407103 - RNA, 19 nt, Homo sapiens
gaaaguaugugauggugau

SEQ ID NO: 1407104 - RNA, 19 nt, Homo sapiens
ugacaugguuguagacuuu

SEQ ID NO: 1407105 - RNA, 19 nt, Homo sapiens
ggaguuagauuguguucug

SEQ ID NO: 1407106 - RNA, 19 nt, Homo sapiens
acacagaagucucauguug

SEQ ID NO: 1407107 - RNA, 19 nt, Homo sapiens
gaagucucauguugcauuu

SEQ ID NO: 1407108 - RNA, 19 nt, Homo sapiens
caaaggaguuagauugugu

SEQ ID NO: 1407109 - RNA, 19 nt, Homo sapiens
gauaaucccauccaugaaa

SEQ ID NO: 1407110 - RNA, 19 nt, Homo sapiens
ggugaugccuucuuccauu

SEQ ID NO: 1407111 - RNA, 19 nt, Homo sapiens
gaagauuuacacaggaaua

SEQ ID NO: 1407112 - RNA, 19 nt, Homo sapiens
ucagagauguugagacguu

SEQ ID NO: 1407113 - RNA, 19 nt, Homo sapiens
gacaacagcucccuuucug

SEQ ID NO: 1407114 - RNA, 19 nt, Homo sapiens
ucaccuggauuauugauau

SEQ ID NO: 1407115 - RNA, 19 nt, Homo sapiens
gugaugccuucuuccauua

SEQ ID NO: 1407116 - RNA, 19 nt, Homo sapiens
uagcuaaacuuccacuuca

SEQ ID NO: 1407117 - RNA, 19 nt, Homo sapiens
gcuaaacuuccacuucaua

SEQ ID NO: 1407118 - RNA, 19 nt, Homo sapiens
gaauauuccuuagaguaug

SEQ ID NO: 1407119 - RNA, 19 nt, Homo sapiens
uaucaaaggaguuagauug

SEQ ID NO: 1407120 - RNA, 19 nt, Homo sapiens
gaagaugacagaccuuucu

SEQ ID NO: 1407121 - RNA, 19 nt, Homo sapiens
gguuucugcugucugcuua

SEQ ID NO: 1407122 - RNA, 19 nt, Homo sapiens
guagaguucuuuugucuuu

SEQ ID NO: 1407123 - RNA, 19 nt, Homo sapiens
guucugacaugguuguaga

SEQ ID NO: 1407124 - RNA, 19 nt, Homo sapiens
uagaagauuuacacaggaa

SEQ ID NO: 1407125 - RNA, 19 nt, Homo sapiens
gaacuggagguagaagauu

SEQ ID NO: 1407126 - RNA, 19 nt, Homo sapiens
uguuggaacugucguuaaa

SEQ ID NO: 1407127 - RNA, 19 nt, Homo sapiens
uagauuguguucugacaug

SEQ ID NO: 1407128 - RNA, 19 nt, Homo sapiens
cauccuggcuccucaucuu

SEQ ID NO: 1407129 - RNA, 19 nt, Homo sapiens
ggcauuagcuaaacuucca

SEQ ID NO: 1407130 - RNA, 19 nt, Homo sapiens
ucaaaggaguuagauugug

SEQ ID NO: 1407131 - RNA, 19 nt, Homo sapiens
acagaagucucauguugca

SEQ ID NO: 1407132 - RNA, 19 nt, Homo sapiens
gauuuacacaggaauauuc

SEQ ID NO: 1407133 - RNA, 19 nt, Homo sapiens
cugauaaucccauccauga

SEQ ID NO: 1407134 - RNA, 19 nt, Homo sapiens
ggaacuggagguagaagau

SEQ ID NO: 1407135 - RNA, 19 nt, Homo sapiens
uagaguauguuggaacugu

SEQ ID NO: 1407136 - RNA, 19 nt, Homo sapiens
acuuucaccuggauuauug

SEQ ID NO: 1407137 - RNA, 19 nt, Homo sapiens
cagagagccuugcuuuggu

SEQ ID NO: 1407138 - RNA, 19 nt, Homo sapiens
cuaaacuuccacuucauaa

SEQ ID NO: 1407139 - RNA, 19 nt, Homo sapiens
ugauuaaagugugguuaug

SEQ ID NO: 1407140 - RNA, 19 nt, Homo sapiens
ggauguaggaauguuuaaa

SEQ ID NO: 1407141 - RNA, 19 nt, Homo sapiens
ugugggaacuggagguaga

SEQ ID NO: 1407142 - RNA, 19 nt, Homo sapiens
gaguuagauuguguucuga

SEQ ID NO: 1407143 - RNA, 19 nt, Homo sapiens
agagagccuugcuuugguu

SEQ ID NO: 1407144 - RNA, 19 nt, Homo sapiens
gcagaugcuuguguuucau

SEQ ID NO: 1407145 - RNA, 19 nt, Homo sapiens
ucagagagccuugcuuugg

SEQ ID NO: 1407146 - RNA, 19 nt, Homo sapiens
ccgaaacuauuuagaagcu

SEQ ID NO: 1407147 - RNA, 19 nt, Homo sapiens
ggagguagaagauuuacac

SEQ ID NO: 1407148 - RNA, 19 nt, Homo sapiens
aacuggagguagaagauuu

SEQ ID NO: 1407149 - RNA, 19 nt, Homo sapiens
gacaccacucaaacauuua

SEQ ID NO: 1407150 - RNA, 19 nt, Homo sapiens
agaagucucauguugcauu

SEQ ID NO: 1407151 - RNA, 19 nt, Homo sapiens
gaccaaggaguccggaugu

SEQ ID NO: 1407152 - RNA, 19 nt, Homo sapiens
caccuggauuauugauauu

SEQ ID NO: 1407153 - RNA, 19 nt, Homo sapiens
ccggauguaggaauguuua

SEQ ID NO: 1407154 - RNA, 19 nt, Homo sapiens
uagacuuucaccuggauua

SEQ ID NO: 1407155 - RNA, 19 nt, Homo sapiens
cagagauguugagacguuu

SEQ ID NO: 1407156 - RNA, 19 nt, Homo sapiens
cuccucaucuucuucauca

SEQ ID NO: 1407157 - RNA, 19 nt, Homo sapiens
gugauuaaagugugguuau

SEQ ID NO: 1407158 - RNA, 19 nt, Homo sapiens
gaguccggauguaggaaug

SEQ ID NO: 1407159 - RNA, 19 nt, Homo sapiens
guuagauuguguucugaca

SEQ ID NO: 1407160 - RNA, 19 nt, Homo sapiens
uaguacccaugccugaauu

SEQ ID NO: 1407161 - RNA, 19 nt, Homo sapiens
aaacuuccacuucauaacu

SEQ ID NO: 1407162 - RNA, 19 nt, Homo sapiens
gugaagaugacagaccuuu

SEQ ID NO: 1407163 - RNA, 19 nt, Homo sapiens
ugagacguuuucagaauuu

SEQ ID NO: 1407164 - RNA, 19 nt, Homo sapiens
ucccgaaacuauuuagaag

SEQ ID NO: 1407165 - RNA, 19 nt, Homo sapiens
gcagggcaggguagugaug

SEQ ID NO: 1407166 - RNA, 19 nt, Homo sapiens
ucccauccaugaaaguaug

SEQ ID NO: 1407167 - RNA, 19 nt, Homo sapiens
agaugcuuguguuucauuu

SEQ ID NO: 1407168 - RNA, 19 nt, Homo sapiens
guugagacguuuucagaau

SEQ ID NO: 1407169 - RNA, 19 nt, Homo sapiens
auaaccaguuugcgaguca

SEQ ID NO: 1407170 - RNA, 19 nt, Homo sapiens
ccaaggaguccggauguag

SEQ ID NO: 1407171 - RNA, 19 nt, Homo sapiens
caaccaaaaucccgaaacu

SEQ ID NO: 1407172 - RNA, 19 nt, Homo sapiens
uuuccuagcuagagaaggu

SEQ ID NO: 1407173 - RNA, 19 nt, Homo sapiens
gauuaaagugugguuaugg

SEQ ID NO: 1407174 - RNA, 19 nt, Homo sapiens
ggugauuaaagugugguua

SEQ ID NO: 1407175 - RNA, 19 nt, Homo sapiens
gacuuucaccuggauuauu

SEQ ID NO: 1407176 - RNA, 19 nt, Homo sapiens
uggugagccuccuggugua

SEQ ID NO: 1407177 - RNA, 19 nt, Homo sapiens
cagaugcuuguguuucauu

SEQ ID NO: 1407178 - RNA, 19 nt, Homo sapiens
uauguuggaacugucguua

SEQ ID NO: 1407179 - RNA, 19 nt, Homo sapiens
ggaguccggauguaggaau

SEQ ID NO: 1407180 - RNA, 19 nt, Homo sapiens
cgaaacuauuuagaagcuu

SEQ ID NO: 1407181 - RNA, 19 nt, Homo sapiens
ccugcaggcugugaagaug

SEQ ID NO: 1407182 - RNA, 19 nt, Homo sapiens
ucuagucccaggaaaguau

SEQ ID NO: 1407183 - RNA, 19 nt, Homo sapiens
caucagcaacuaccauaac

SEQ ID NO: 1407184 - RNA, 19 nt, Homo sapiens
guuuguguguguuaauucu

SEQ ID NO: 1407185 - RNA, 19 nt, Homo sapiens
ugguuuguguguguuaauu

SEQ ID NO: 1407186 - RNA, 19 nt, Homo sapiens
cuacaucccuucacaaaga

SEQ ID NO: 1407187 - RNA, 19 nt, Homo sapiens
gaucacagauacauccauu

SEQ ID NO: 1407188 - RNA, 19 nt, Homo sapiens
gcuaguuucuuguagauau

SEQ ID NO: 1407189 - RNA, 19 nt, Homo sapiens
gcagacacuuuaccaaauc

SEQ ID NO: 1407190 - RNA, 19 nt, Homo sapiens
ucacaaagaguauaugcua

SEQ ID NO: 1407191 - RNA, 19 nt, Homo sapiens
ggacugagaacuguagaaa

SEQ ID NO: 1407192 - RNA, 19 nt, Homo sapiens
uaaauugacuccggacaga

SEQ ID NO: 1407193 - RNA, 19 nt, Homo sapiens
ucacaaaacuuuacacaug

SEQ ID NO: 1407194 - RNA, 19 nt, Homo sapiens
cgcugcagcucaccaauua

SEQ ID NO: 1407195 - RNA, 19 nt, Homo sapiens
auacauccauuccaaagaa

SEQ ID NO: 1407196 - RNA, 19 nt, Homo sapiens
caaagaguauaugcuaguu

SEQ ID NO: 1407197 - RNA, 19 nt, Homo sapiens
gcaaaguguucaggcgaaa

SEQ ID NO: 1407198 - RNA, 19 nt, Homo sapiens
ucaaugaccuuuccaagcu

SEQ ID NO: 1407199 - RNA, 19 nt, Homo sapiens
uuagagcucuguacauaau

SEQ ID NO: 1407200 - RNA, 19 nt, Homo sapiens
acagauacauccauuccaa

SEQ ID NO: 1407201 - RNA, 19 nt, Homo sapiens
ggcagacacuuuaccaaau

SEQ ID NO: 1407202 - RNA, 19 nt, Homo sapiens
gaguuuaucugcaaguuuu

SEQ ID NO: 1407203 - RNA, 19 nt, Homo sapiens
gcacuuagauauggaaaau

SEQ ID NO: 1407204 - RNA, 19 nt, Homo sapiens
uggaucugcucucgcuuua

SEQ ID NO: 1407205 - RNA, 19 nt, Homo sapiens
aagaguauaugcuaguuuc

SEQ ID NO: 1407206 - RNA, 19 nt, Homo sapiens
gaucugcucucgcuuuagc

SEQ ID NO: 1407207 - RNA, 19 nt, Homo sapiens
gaaaggauuuugucagucu

SEQ ID NO: 1407208 - RNA, 19 nt, Homo sapiens
gaaagccacacacuacuac

SEQ ID NO: 1407209 - RNA, 19 nt, Homo sapiens
gagcagugcggcaaagugu

SEQ ID NO: 1407210 - RNA, 19 nt, Homo sapiens
ucucgggccucaguaaauu

SEQ ID NO: 1407211 - RNA, 19 nt, Homo sapiens
aguauaugcuaguuucuug

SEQ ID NO: 1407212 - RNA, 19 nt, Homo sapiens
gcuuugggaucuuguugga

SEQ ID NO: 1407213 - RNA, 19 nt, Homo sapiens
cggcagacacuuuaccaaa

SEQ ID NO: 1407214 - RNA, 19 nt, Homo sapiens
gcagugcggcaaaguguuc

SEQ ID NO: 1407215 - RNA, 19 nt, Homo sapiens
ggagugugggaaaggauuu

SEQ ID NO: 1407216 - RNA, 19 nt, Homo sapiens
gauauucacagcucauuuu

SEQ ID NO: 1407217 - RNA, 19 nt, Homo sapiens
agaaagccacacacuacua

SEQ ID NO: 1407218 - RNA, 19 nt, Homo sapiens
gauacauccauuccaaaga

SEQ ID NO: 1407219 - RNA, 19 nt, Homo sapiens
uaugcuaguuucuuguaga

SEQ ID NO: 1407220 - RNA, 19 nt, Homo sapiens
gggaaaggauuuugucagu

SEQ ID NO: 1407221 - RNA, 19 nt, Homo sapiens
acugagaacuguagaaagc

SEQ ID NO: 1407222 - RNA, 19 nt, Homo sapiens
ucccagcccugcacaagga

SEQ ID NO: 1407223 - RNA, 19 nt, Homo sapiens
ggaugcacuuagauaugga

SEQ ID NO: 1407224 - RNA, 19 nt, Homo sapiens
cuuguuggaugcacuuaga

SEQ ID NO: 1407225 - RNA, 19 nt, Homo sapiens
cuucaaaugucaggagugu

SEQ ID NO: 1407226 - RNA, 19 nt, Homo sapiens
cggcacagccugacucaca

SEQ ID NO: 1407227 - RNA, 19 nt, Homo sapiens
gaguauaugcuaguuucuu

SEQ ID NO: 1407228 - RNA, 19 nt, Homo sapiens
uguagaaagccacacacua

SEQ ID NO: 1407229 - RNA, 19 nt, Homo sapiens
uggaugcacuuagauaugg

SEQ ID NO: 1407230 - RNA, 19 nt, Homo sapiens
ucuacgugcuguugucuca

SEQ ID NO: 1407231 - RNA, 19 nt, Homo sapiens
guggaucugcucucgcuuu

SEQ ID NO: 1407232 - RNA, 19 nt, Homo sapiens
ggaaaauggaagccaaauu

SEQ ID NO: 1407233 - RNA, 19 nt, Homo sapiens
ucgcaucccuagcccuuca

SEQ ID NO: 1407234 - RNA, 19 nt, Homo sapiens
gcagacaucaagcccuaca

SEQ ID NO: 1407235 - RNA, 19 nt, Homo sapiens
uacauccauuccaaagaaa

SEQ ID NO: 1407236 - RNA, 19 nt, Homo sapiens
acaaagaguauaugcuagu

SEQ ID NO: 1407237 - RNA, 19 nt, Homo sapiens
ucaggagugugggaaagga

SEQ ID NO: 1407238 - RNA, 19 nt, Homo sapiens
cagauacauccauuccaaa

SEQ ID NO: 1407239 - RNA, 19 nt, Homo sapiens
uacuacaucccuucacaaa

SEQ ID NO: 1407240 - RNA, 19 nt, Homo sapiens
ggucucagcgcgguacaga

SEQ ID NO: 1407241 - RNA, 19 nt, Homo sapiens
guuggaugcacuuagauau

SEQ ID NO: 1407242 - RNA, 19 nt, Homo sapiens
cauaauguugugggucuuu

SEQ ID NO: 1407243 - RNA, 19 nt, Homo sapiens
caucucgggccucaguaaa

SEQ ID NO: 1407244 - RNA, 19 nt, Homo sapiens
guuuugacuuugccaauuu

SEQ ID NO: 1407245 - RNA, 19 nt, Homo sapiens
uuuuagagcucuguacaua

SEQ ID NO: 1407246 - RNA, 19 nt, Homo sapiens
aagaguuuaucugcaaguu

SEQ ID NO: 1407247 - RNA, 19 nt, Homo sapiens
gggagggcuuucucuacgu

SEQ ID NO: 1407248 - RNA, 19 nt, Homo sapiens
gaucuuguuggaugcacuu

SEQ ID NO: 1407249 - RNA, 19 nt, Homo sapiens
auucacagcucauuuuaga

SEQ ID NO: 1407250 - RNA, 19 nt, Homo sapiens
cuagagaagcccaggaucu

SEQ ID NO: 1407251 - RNA, 19 nt, Homo sapiens
acuacuacaucccuucaca

SEQ ID NO: 1407252 - RNA, 19 nt, Homo sapiens
gcggcaggacuucuagaga

SEQ ID NO: 1407253 - RNA, 19 nt, Homo sapiens
gacacuuuaccaaauccua

SEQ ID NO: 1407254 - RNA, 19 nt, Homo sapiens
gcacaaaccugcucucuca

SEQ ID NO: 1407255 - RNA, 19 nt, Homo sapiens
ggaaggcccuguugggauu

SEQ ID NO: 1407256 - RNA, 19 nt, Homo sapiens
gagauuaucacuccacuuu

SEQ ID NO: 1407257 - RNA, 19 nt, Homo sapiens
gagaaacccuggcucuuca

SEQ ID NO: 1407258 - RNA, 19 nt, Homo sapiens
ucacacacauguaaaugaa

SEQ ID NO: 1407259 - RNA, 19 nt, Homo sapiens
acacaggccuggaauucua

SEQ ID NO: 1407260 - RNA, 19 nt, Homo sapiens
ggaagcagaguucauguga

SEQ ID NO: 1407261 - RNA, 19 nt, Homo sapiens
ccauucaucucauaaacaa

SEQ ID NO: 1407262 - RNA, 19 nt, Homo sapiens
gaagagccauucaucucau

SEQ ID NO: 1407263 - RNA, 19 nt, Homo sapiens
gcaagagaauaggugguuu

SEQ ID NO: 1407264 - RNA, 19 nt, Homo sapiens
caauggugguggcaucuuu

SEQ ID NO: 1407265 - RNA, 19 nt, Homo sapiens
caagaaagaaggcgagaga

SEQ ID NO: 1407266 - RNA, 19 nt, Homo sapiens
gcccugaaguggacucuug

SEQ ID NO: 1407267 - RNA, 19 nt, Homo sapiens
ugacaugguugcugaaugg

SEQ ID NO: 1407268 - RNA, 19 nt, Homo sapiens
cuaagcaguucccucauug

SEQ ID NO: 1407269 - RNA, 19 nt, Homo sapiens
ccuaagcaguucccucauu

SEQ ID NO: 1407270 - RNA, 19 nt, Homo sapiens
gaaggacccugugcaaggu

SEQ ID NO: 1407271 - RNA, 19 nt, Homo sapiens
gcauaucccaggugagaaa

SEQ ID NO: 1407272 - RNA, 19 nt, Homo sapiens
uccaggcuguucccaaaua

SEQ ID NO: 1407273 - RNA, 19 nt, Homo sapiens
gcucagggaagccaaguga

SEQ ID NO: 1407274 - RNA, 19 nt, Homo sapiens
ggaagagcagggcccauga

SEQ ID NO: 1407275 - RNA, 19 nt, Homo sapiens
gggcugaaauccuggaaac

SEQ ID NO: 1407276 - RNA, 19 nt, Homo sapiens
uaagcaaucuaggacagaa

SEQ ID NO: 1407277 - RNA, 19 nt, Homo sapiens
cagcacgagucucuggaaa

SEQ ID NO: 1407278 - RNA, 19 nt, Homo sapiens
gagacuugguaggugguua

SEQ ID NO: 1407279 - RNA, 19 nt, Homo sapiens
acacacuccuggauacaga

SEQ ID NO: 1407280 - RNA, 19 nt, Homo sapiens
aaaggaagaggaaagaaug

SEQ ID NO: 1407281 - RNA, 19 nt, Homo sapiens
ugucaccaccaauaucuua

SEQ ID NO: 1407282 - RNA, 19 nt, Homo sapiens
gcucuccucugcucaaguc

SEQ ID NO: 1407283 - RNA, 19 nt, Homo sapiens
cuugguaggugguuaugaa

SEQ ID NO: 1407284 - RNA, 19 nt, Homo sapiens
gggcuuuaaccugcaauua

SEQ ID NO: 1407285 - RNA, 19 nt, Homo sapiens
gcagaagagccauucaucu

SEQ ID NO: 1407286 - RNA, 19 nt, Homo sapiens
caagagaauaggugguuug

SEQ ID NO: 1407287 - RNA, 19 nt, Homo sapiens
guaaaacaauccccugaau

SEQ ID NO: 1407288 - RNA, 19 nt, Homo sapiens
gaggaaggacccugugcaa

SEQ ID NO: 1407289 - RNA, 19 nt, Homo sapiens
gccaagaagcugaaacugu

SEQ ID NO: 1407290 - RNA, 19 nt, Homo sapiens
ggguagaggccaagcagaa

SEQ ID NO: 1407291 - RNA, 19 nt, Homo sapiens
ccaaggucacgaagacuuu

SEQ ID NO: 1407292 - RNA, 19 nt, Homo sapiens
guccacagccucaugauuc

SEQ ID NO: 1407293 - RNA, 19 nt, Homo sapiens
aagagccauucaucucaua

SEQ ID NO: 1407294 - RNA, 19 nt, Homo sapiens
caaaagggcaguggcaaua

SEQ ID NO: 1407295 - RNA, 19 nt, Homo sapiens
augaagggcuggccagaga

SEQ ID NO: 1407296 - RNA, 19 nt, Homo sapiens
cuaacacacuccuggauac

SEQ ID NO: 1407297 - RNA, 19 nt, Homo sapiens
ggcaauaagcaaucuagga

SEQ ID NO: 1407298 - RNA, 19 nt, Homo sapiens
gugcauaucccaggugaga

SEQ ID NO: 1407299 - RNA, 19 nt, Homo sapiens
guugggauuugcacagaga

SEQ ID NO: 1407300 - RNA, 19 nt, Homo sapiens
ggacaggggagacuuggua

SEQ ID NO: 1407301 - RNA, 19 nt, Homo sapiens
agaaagaaggcgagagaga

SEQ ID NO: 1407302 - RNA, 19 nt, Homo sapiens
gcagaggaaacaggaaaug

SEQ ID NO: 1407303 - RNA, 19 nt, Homo sapiens
ucuaacacacuccuggaua

SEQ ID NO: 1407304 - RNA, 19 nt, Homo sapiens
gagccauucaucucauaaa

SEQ ID NO: 1407305 - RNA, 19 nt, Homo sapiens
cagaagagccauucaucuc

SEQ ID NO: 1407306 - RNA, 19 nt, Homo sapiens
agaggaccaucugggauuu

SEQ ID NO: 1407307 - RNA, 19 nt, Homo sapiens
ccagagaguggccaagaga

SEQ ID NO: 1407308 - RNA, 19 nt, Homo sapiens
ccacuacacaggccuggaa

SEQ ID NO: 1407309 - RNA, 19 nt, Homo sapiens
ggauacagaacacaagucu

SEQ ID NO: 1407310 - RNA, 19 nt, Homo sapiens
acacacauguaaaugaaac

SEQ ID NO: 1407311 - RNA, 19 nt, Homo sapiens
gggcuggugugagaagguu

SEQ ID NO: 1407312 - RNA, 19 nt, Homo sapiens
aaagggcaguggcaauaag

SEQ ID NO: 1407313 - RNA, 19 nt, Homo sapiens
aggcagggaugggcuugua

SEQ ID NO: 1407314 - RNA, 19 nt, Homo sapiens
ucaggaagcagccuuagca

SEQ ID NO: 1407315 - RNA, 19 nt, Homo sapiens
guuggaggcccgugcauau

SEQ ID NO: 1407316 - RNA, 19 nt, Homo sapiens
cuacacaggccuggaauuc

SEQ ID NO: 1407317 - RNA, 19 nt, Homo sapiens
uuuccaggcuguucccaaa

SEQ ID NO: 1407318 - RNA, 19 nt, Homo sapiens
gcagagcagggagcacaaa

SEQ ID NO: 1407319 - RNA, 19 nt, Homo sapiens
gcagcacgagucucuggaa

SEQ ID NO: 1407320 - RNA, 19 nt, Homo sapiens
gcaaucuaggacagaauga

SEQ ID NO: 1407321 - RNA, 19 nt, Homo sapiens
caagaagcugaaacuguga

SEQ ID NO: 1407322 - RNA, 19 nt, Homo sapiens
aagcagaagcccugaagug

SEQ ID NO: 1407323 - RNA, 19 nt, Homo sapiens
acaguugaccugagaaauc

SEQ ID NO: 1407324 - RNA, 19 nt, Homo sapiens
gcaguggcaauaagcaauc

SEQ ID NO: 1407325 - RNA, 19 nt, Homo sapiens
ucauugcucuuuggacuag

SEQ ID NO: 1407326 - RNA, 19 nt, Homo sapiens
agaagagccauucaucuca

SEQ ID NO: 1407327 - RNA, 19 nt, Homo sapiens
caaggcuucugggagauuc

SEQ ID NO: 1407328 - RNA, 19 nt, Homo sapiens
gggcagguccagaguccaa

SEQ ID NO: 1407329 - RNA, 19 nt, Homo sapiens
caagugacaaguccaaggu

SEQ ID NO: 1407330 - RNA, 19 nt, Homo sapiens
ggcaagagaauaggugguu

SEQ ID NO: 1407331 - RNA, 19 nt, Homo sapiens
gagcugcagccacuacaca

SEQ ID NO: 1407332 - RNA, 19 nt, Homo sapiens
uuuggugucugcuucaaga

SEQ ID NO: 1407333 - RNA, 19 nt, Homo sapiens
ucacaguugaccugagaaa

SEQ ID NO: 1407334 - RNA, 19 nt, Homo sapiens
ggcccugucaccaccaaua

SEQ ID NO: 1407335 - RNA, 19 nt, Homo sapiens
aaaggaagccaccacugau

SEQ ID NO: 1407336 - RNA, 19 nt, Homo sapiens
ggccucuccucccucacua

SEQ ID NO: 1407337 - RNA, 19 nt, Homo sapiens
gguccacagccucaugauu

SEQ ID NO: 1407338 - RNA, 19 nt, Homo sapiens
ggaaauaaaguguuuugca

SEQ ID NO: 1407339 - RNA, 19 nt, Homo sapiens
gacagaaugacaucaaggu

SEQ ID NO: 1407340 - RNA, 19 nt, Homo sapiens
gcucuucacccagguuuca

SEQ ID NO: 1407341 - RNA, 19 nt, Homo sapiens
ccaggcuguucccaaauag

SEQ ID NO: 1407342 - RNA, 19 nt, Homo sapiens
aagaggaccaucugggauu

SEQ ID NO: 1407343 - RNA, 19 nt, Homo sapiens
gagccaugcagucccagaa

SEQ ID NO: 1407344 - RNA, 19 nt, Homo sapiens
ugcaauuaaugacaugguu

SEQ ID NO: 1407345 - RNA, 19 nt, Homo sapiens
cuaaagccacagcagaaga

SEQ ID NO: 1407346 - RNA, 19 nt, Homo sapiens
gaagggcuggccagagagu

SEQ ID NO: 1407347 - RNA, 19 nt, Homo sapiens
agaggaaacaggaaaugug

SEQ ID NO: 1407348 - RNA, 19 nt, Homo sapiens
ggaagccaagugacaaguc

SEQ ID NO: 1407349 - RNA, 19 nt, Homo sapiens
gggaagcagaguucaugug

SEQ ID NO: 1407350 - RNA, 19 nt, Homo sapiens
aggaaagaaugaggaagga

SEQ ID NO: 1407351 - RNA, 19 nt, Homo sapiens
ccacagcagaagagccauu

SEQ ID NO: 1407352 - RNA, 19 nt, Homo sapiens
caguugaccugagaaaucg

SEQ ID NO: 1407353 - RNA, 19 nt, Homo sapiens
gguuggaggcccgugcaua

SEQ ID NO: 1407354 - RNA, 19 nt, Homo sapiens
ccaaggaaaugauugcuaa

SEQ ID NO: 1407355 - RNA, 19 nt, Homo sapiens
gcaaagaccuccauuucca

SEQ ID NO: 1407356 - RNA, 19 nt, Homo sapiens
gcaggcagaugaccagaga

SEQ ID NO: 1407357 - RNA, 19 nt, Homo sapiens
caacgcggguuaaacuuug

SEQ ID NO: 1407358 - RNA, 19 nt, Homo sapiens
ggaaaugauugcuaaacuc

SEQ ID NO: 1407359 - RNA, 19 nt, Homo sapiens
uaaacucgauuccauaagu

SEQ ID NO: 1407360 - RNA, 19 nt, Homo sapiens
ggaccuguaucuccacguu

SEQ ID NO: 1407361 - RNA, 19 nt, Homo sapiens
ugucaccggucacacuuua

SEQ ID NO: 1407362 - RNA, 19 nt, Homo sapiens
gcuaaacucgauuccauaa

SEQ ID NO: 1407363 - RNA, 19 nt, Homo sapiens
gcgagggauugaauaaaga

SEQ ID NO: 1407364 - RNA, 19 nt, Homo sapiens
guaaagaaggcaacacaug

SEQ ID NO: 1407365 - RNA, 19 nt, Homo sapiens
gaaaaggacaguuugauug

SEQ ID NO: 1407366 - RNA, 19 nt, Homo sapiens
gaaccaggcaguaaagaag

SEQ ID NO: 1407367 - RNA, 19 nt, Homo sapiens
gggauugaauaaagaaaca

SEQ ID NO: 1407368 - RNA, 19 nt, Homo sapiens
guuaaacuuugaccaagga

SEQ ID NO: 1407369 - RNA, 19 nt, Homo sapiens
ggagaaggcaggaggaaag

SEQ ID NO: 1407370 - RNA, 19 nt, Homo sapiens
ggggaacucuguccuaaaa

SEQ ID NO: 1407371 - RNA, 19 nt, Homo sapiens
gaaagcaaagaccuccauu

SEQ ID NO: 1407372 - RNA, 19 nt, Homo sapiens
aagcaaagaccuccauuuc

SEQ ID NO: 1407373 - RNA, 19 nt, Homo sapiens
gaaggcaggaggaaagcaa

SEQ ID NO: 1407374 - RNA, 19 nt, Homo sapiens
aguggaaccucguguguga

SEQ ID NO: 1407375 - RNA, 19 nt, Homo sapiens
ucaccugcaucaccaucua

SEQ ID NO: 1407376 - RNA, 19 nt, Homo sapiens
cacuuuaauuccagucuaa

SEQ ID NO: 1407377 - RNA, 19 nt, Homo sapiens
ggaaaaggacaguuugauu

SEQ ID NO: 1407378 - RNA, 19 nt, Homo sapiens
gucaagaccucuccuagcu

SEQ ID NO: 1407379 - RNA, 19 nt, Homo sapiens
gugcagaaccaggcaguaa

SEQ ID NO: 1407380 - RNA, 19 nt, Homo sapiens
gcccgacccuuggugauga

SEQ ID NO: 1407381 - RNA, 19 nt, Homo sapiens
ucuccuagcuccacacaag

SEQ ID NO: 1407382 - RNA, 19 nt, Homo sapiens
aaacucgauuccauaagug

SEQ ID NO: 1407383 - RNA, 19 nt, Homo sapiens
ggugcgagggauugaauaa

SEQ ID NO: 1407384 - RNA, 19 nt, Homo sapiens
ucaacgcggguuaaacuuu

SEQ ID NO: 1407385 - RNA, 19 nt, Homo sapiens
gcagaaccaggcaguaaag

SEQ ID NO: 1407386 - RNA, 19 nt, Homo sapiens
acacuuuaauuccagucua

SEQ ID NO: 1407387 - RNA, 19 nt, Homo sapiens
ggccagccuuugugaagug

SEQ ID NO: 1407388 - RNA, 19 nt, Homo sapiens
ccacaggcaggcuggauug

SEQ ID NO: 1407389 - RNA, 19 nt, Homo sapiens
guggauggcugggucuaug

SEQ ID NO: 1407390 - RNA, 19 nt, Homo sapiens
ccguugcccuggccucuuu

SEQ ID NO: 1407391 - RNA, 19 nt, Homo sapiens
gacaccagcaggcagauga

SEQ ID NO: 1407392 - RNA, 19 nt, Homo sapiens
aaagcaaagaccuccauuu

SEQ ID NO: 1407393 - RNA, 19 nt, Homo sapiens
ggaaagcaaagaccuccau

SEQ ID NO: 1407394 - RNA, 19 nt, Homo sapiens
aaacuuugaccaaggaaau

SEQ ID NO: 1407395 - RNA, 19 nt, Homo sapiens
cacauucccuacuuuccaa

SEQ ID NO: 1407396 - RNA, 19 nt, Homo sapiens
agucuucagucuccacauu

SEQ ID NO: 1407397 - RNA, 19 nt, Homo sapiens
cacaagcaguagagucuca

SEQ ID NO: 1407398 - RNA, 19 nt, Homo sapiens
ggaacucuguccuaaaauc

SEQ ID NO: 1407399 - RNA, 19 nt, Homo sapiens
ccacagcuuuacccagaag

SEQ ID NO: 1407400 - RNA, 19 nt, Homo sapiens
agagcaugcuggagaacuu

SEQ ID NO: 1407401 - RNA, 19 nt, Homo sapiens
gaugggacggucagaggaa

SEQ ID NO: 1407402 - RNA, 19 nt, Homo sapiens
caaguggaaccucgugugu

SEQ ID NO: 1407403 - RNA, 19 nt, Homo sapiens
caucuucaccuccacaauc

SEQ ID NO: 1407404 - RNA, 19 nt, Homo sapiens
cacgggcacucuccugaug

SEQ ID NO: 1407405 - RNA, 19 nt, Homo sapiens
aaugauugcuaaacucgau

SEQ ID NO: 1407406 - RNA, 19 nt, Homo sapiens
uugcuaaacucgauuccau

SEQ ID NO: 1407407 - RNA, 19 nt, Homo sapiens
ugcgagggauugaauaaag

SEQ ID NO: 1407408 - RNA, 19 nt, Homo sapiens
caaggaaaugauugcuaaa

SEQ ID NO: 1407409 - RNA, 19 nt, Homo sapiens
ccacagccgccaggagaaa

SEQ ID NO: 1407410 - RNA, 19 nt, Homo sapiens
gacccuuggugaugaccuu

SEQ ID NO: 1407411 - RNA, 19 nt, Homo sapiens
ucuccacauucccuacuuu

SEQ ID NO: 1407412 - RNA, 19 nt, Homo sapiens
ccuaaaauccacacaguuu

SEQ ID NO: 1407413 - RNA, 19 nt, Homo sapiens
gaaccucgugugugacucu

SEQ ID NO: 1407414 - RNA, 19 nt, Homo sapiens
ugaaacuccuacccacagu

SEQ ID NO: 1407415 - RNA, 19 nt, Homo sapiens
aggaaaugauugcuaaacu

SEQ ID NO: 1407416 - RNA, 19 nt, Homo sapiens
cgagggauugaauaaagaa

SEQ ID NO: 1407417 - RNA, 19 nt, Homo sapiens
uccaucauguggcugugua

SEQ ID NO: 1407418 - RNA, 19 nt, Homo sapiens
uccaagaugugcagaacca

SEQ ID NO: 1407419 - RNA, 19 nt, Homo sapiens
caacaucuuccugcuccaa

SEQ ID NO: 1407420 - RNA, 19 nt, Homo sapiens
gggccagccuuugugaagu

SEQ ID NO: 1407421 - RNA, 19 nt, Homo sapiens
uagcuccacacaagcagua

SEQ ID NO: 1407422 - RNA, 19 nt, Homo sapiens
agaaccaggcaguaaagaa

SEQ ID NO: 1407423 - RNA, 19 nt, Homo sapiens
ccucaacgcggguuaaacu

SEQ ID NO: 1407424 - RNA, 19 nt, Homo sapiens
gccuuuggcuucaccuucu

SEQ ID NO: 1407425 - RNA, 19 nt, Homo sapiens
gaguagguuccauggcauu

SEQ ID NO: 1407426 - RNA, 19 nt, Homo sapiens
agccugagaugcccgugaa

SEQ ID NO: 1407427 - RNA, 19 nt, Homo sapiens
ccugaccgacuccacuuaa

SEQ ID NO: 1407428 - RNA, 19 nt, Homo sapiens
caguaaagaaggcaacaca

SEQ ID NO: 1407429 - RNA, 19 nt, Homo sapiens
ccacauucccuacuuucca

SEQ ID NO: 1407430 - RNA, 19 nt, Homo sapiens
gcauuggugcgagggauug

SEQ ID NO: 1407431 - RNA, 19 nt, Homo sapiens
uaaccuggagcuaccuuca

SEQ ID NO: 1407432 - RNA, 19 nt, Homo sapiens
cuaccuggcugggauucug

SEQ ID NO: 1407433 - RNA, 19 nt, Homo sapiens
ccacccugccagccuauga

SEQ ID NO: 1407434 - RNA, 19 nt, Homo sapiens
ccacugugcucaggaugac

SEQ ID NO: 1407435 - RNA, 19 nt, Homo sapiens
ucaccggucacacuuuaau

SEQ ID NO: 1407436 - RNA, 19 nt, Homo sapiens
ccaaggaaaugauugcuaa

SEQ ID NO: 1407437 - RNA, 19 nt, Homo sapiens
gcaaagaccuccauuucca

SEQ ID NO: 1407438 - RNA, 19 nt, Homo sapiens
gaagcaugcuggagaacuu

SEQ ID NO: 1407439 - RNA, 19 nt, Homo sapiens
gcaggcagaugaccagaga

SEQ ID NO: 1407440 - RNA, 19 nt, Homo sapiens
caacgcggguuaaacuuug

SEQ ID NO: 1407441 - RNA, 19 nt, Homo sapiens
ggaaaugauugcuaaacuc

SEQ ID NO: 1407442 - RNA, 19 nt, Homo sapiens
uaaacucgauuccauaagu

SEQ ID NO: 1407443 - RNA, 19 nt, Homo sapiens
ggaccuguaucuccacguu

SEQ ID NO: 1407444 - RNA, 19 nt, Homo sapiens
ugucaccggucacacuuua

SEQ ID NO: 1407445 - RNA, 19 nt, Homo sapiens
gcuaaacucgauuccauaa

SEQ ID NO: 1407446 - RNA, 19 nt, Homo sapiens
gcgagggauugaauaaaga

SEQ ID NO: 1407447 - RNA, 19 nt, Homo sapiens
guaaagaaggcaacacaug

SEQ ID NO: 1407448 - RNA, 19 nt, Homo sapiens
gaaaaggacaguuugauug

SEQ ID NO: 1407449 - RNA, 19 nt, Homo sapiens
gaaccaggcaguaaagaag

SEQ ID NO: 1407450 - RNA, 19 nt, Homo sapiens
gggauugaauaaagaaaca

SEQ ID NO: 1407451 - RNA, 19 nt, Homo sapiens
guuaaacuuugaccaagga

SEQ ID NO: 1407452 - RNA, 19 nt, Homo sapiens
ggagaaggcaggaggaaag

SEQ ID NO: 1407453 - RNA, 19 nt, Homo sapiens
ggggaacucuguccuaaaa

SEQ ID NO: 1407454 - RNA, 19 nt, Homo sapiens
gaaagcaaagaccuccauu

SEQ ID NO: 1407455 - RNA, 19 nt, Homo sapiens
aagcaaagaccuccauuuc

SEQ ID NO: 1407456 - RNA, 19 nt, Homo sapiens
gaaggcaggaggaaagcaa

SEQ ID NO: 1407457 - RNA, 19 nt, Homo sapiens
aguggaaccucguguguga

SEQ ID NO: 1407458 - RNA, 19 nt, Homo sapiens
ucaccugcaucaccaucua

SEQ ID NO: 1407459 - RNA, 19 nt, Homo sapiens
cacuuuaauuccagucuaa

SEQ ID NO: 1407460 - RNA, 19 nt, Homo sapiens
ggaaaaggacaguuugauu

SEQ ID NO: 1407461 - RNA, 19 nt, Homo sapiens
gucaagaccucuccuagcu

SEQ ID NO: 1407462 - RNA, 19 nt, Homo sapiens
gugcagaaccaggcaguaa

SEQ ID NO: 1407463 - RNA, 19 nt, Homo sapiens
gcccgacccuuggugauga

SEQ ID NO: 1407464 - RNA, 19 nt, Homo sapiens
ucuccuagcuccacacaag

SEQ ID NO: 1407465 - RNA, 19 nt, Homo sapiens
aaacucgauuccauaagug

SEQ ID NO: 1407466 - RNA, 19 nt, Homo sapiens
ggugcgagggauugaauaa

SEQ ID NO: 1407467 - RNA, 19 nt, Homo sapiens
gcagaaccaggcaguaaag

SEQ ID NO: 1407468 - RNA, 19 nt, Homo sapiens
ucaacgcggguuaaacuuu

SEQ ID NO: 1407469 - RNA, 19 nt, Homo sapiens
acacuuuaauuccagucua

SEQ ID NO: 1407470 - RNA, 19 nt, Homo sapiens
ggccagccuuugugaagug

SEQ ID NO: 1407471 - RNA, 19 nt, Homo sapiens
ccacaggcaggcuggauug

SEQ ID NO: 1407472 - RNA, 19 nt, Homo sapiens
guggauggcugggucuaug

SEQ ID NO: 1407473 - RNA, 19 nt, Homo sapiens
ccguugcccuggccucuuu

SEQ ID NO: 1407474 - RNA, 19 nt, Homo sapiens
gacaccagcaggcagauga

SEQ ID NO: 1407475 - RNA, 19 nt, Homo sapiens
aaagcaaagaccuccauuu

SEQ ID NO: 1407476 - RNA, 19 nt, Homo sapiens
ggaaagcaaagaccuccau

SEQ ID NO: 1407477 - RNA, 19 nt, Homo sapiens
aaacuuugaccaaggaaau

SEQ ID NO: 1407478 - RNA, 19 nt, Homo sapiens
cacauucccuacuuuccaa

SEQ ID NO: 1407479 - RNA, 19 nt, Homo sapiens
agucuucagucuccacauu

SEQ ID NO: 1407480 - RNA, 19 nt, Homo sapiens
cacaagcaguagagucuca

SEQ ID NO: 1407481 - RNA, 19 nt, Homo sapiens
ggaacucuguccuaaaauc

SEQ ID NO: 1407482 - RNA, 19 nt, Homo sapiens
ccacagcuuuacccagaag

SEQ ID NO: 1407483 - RNA, 19 nt, Homo sapiens
gaugggacggucagaggaa

SEQ ID NO: 1407484 - RNA, 19 nt, Homo sapiens
caaguggaaccucgugugu

SEQ ID NO: 1407485 - RNA, 19 nt, Homo sapiens
caucuucaccuccacaauc

SEQ ID NO: 1407486 - RNA, 19 nt, Homo sapiens
aaugauugcuaaacucgau

SEQ ID NO: 1407487 - RNA, 19 nt, Homo sapiens
uugcuaaacucgauuccau

SEQ ID NO: 1407488 - RNA, 19 nt, Homo sapiens
ccacagccgccaggagaaa

SEQ ID NO: 1407489 - RNA, 19 nt, Homo sapiens
ugcgagggauugaauaaag

SEQ ID NO: 1407490 - RNA, 19 nt, Homo sapiens
caaggaaaugauugcuaaa

SEQ ID NO: 1407491 - RNA, 19 nt, Homo sapiens
gacccuuggugaugaccuu

SEQ ID NO: 1407492 - RNA, 19 nt, Homo sapiens
cuugaagcaugcuggagaa

SEQ ID NO: 1407493 - RNA, 19 nt, Homo sapiens
ucuccacauucccuacuuu

SEQ ID NO: 1407494 - RNA, 19 nt, Homo sapiens
ccuaaaauccacacaguuu

SEQ ID NO: 1407495 - RNA, 19 nt, Homo sapiens
gaaccucgugugugacucu

SEQ ID NO: 1407496 - RNA, 19 nt, Homo sapiens
ugaaacuccuacccacagu

SEQ ID NO: 1407497 - RNA, 19 nt, Homo sapiens
aggaaaugauugcuaaacu

SEQ ID NO: 1407498 - RNA, 19 nt, Homo sapiens
cgagggauugaauaaagaa

SEQ ID NO: 1407499 - RNA, 19 nt, Homo sapiens
uccaagaugugcagaacca

SEQ ID NO: 1407500 - RNA, 19 nt, Homo sapiens
caacaucuuccugcuccaa

SEQ ID NO: 1407501 - RNA, 19 nt, Homo sapiens
gggccagccuuugugaagu

SEQ ID NO: 1407502 - RNA, 19 nt, Homo sapiens
uagcuccacacaagcagua

SEQ ID NO: 1407503 - RNA, 19 nt, Homo sapiens
ccucaacgcggguuaaacu

SEQ ID NO: 1407504 - RNA, 19 nt, Homo sapiens
agaaccaggcaguaaagaa

SEQ ID NO: 1407505 - RNA, 19 nt, Homo sapiens
gccuuuggcuucaccuucu

SEQ ID NO: 1407506 - RNA, 19 nt, Homo sapiens
agccugagaugcccgugaa

SEQ ID NO: 1407507 - RNA, 19 nt, Homo sapiens
ccugaccgacuccacuuaa

SEQ ID NO: 1407508 - RNA, 19 nt, Homo sapiens
caguaaagaaggcaacaca

SEQ ID NO: 1407509 - RNA, 19 nt, Homo sapiens
ccacauucccuacuuucca

SEQ ID NO: 1407510 - RNA, 19 nt, Homo sapiens
gcauuggugcgagggauug

SEQ ID NO: 1407511 - RNA, 19 nt, Homo sapiens
cuaccuggcugggauucug

SEQ ID NO: 1407512 - RNA, 19 nt, Homo sapiens
ccacccugccagccuauga

SEQ ID NO: 1407513 - RNA, 19 nt, Homo sapiens
ccacugugcucaggaugac

SEQ ID NO: 1407514 - RNA, 19 nt, Homo sapiens
ucaccggucacacuuuaau

SEQ ID NO: 1407515 - RNA, 19 nt, Homo sapiens
gaaugaaucuaccaccuuu

SEQ ID NO: 1407516 - RNA, 19 nt, Homo sapiens
gaaaguauauggagacacu

SEQ ID NO: 1407517 - RNA, 19 nt, Homo sapiens
gagaagaugagaaaguaua

SEQ ID NO: 1407518 - RNA, 19 nt, Homo sapiens
ggacccagcucgccugaau

SEQ ID NO: 1407519 - RNA, 19 nt, Homo sapiens
gaagcuagaggaauugaaa

SEQ ID NO: 1407520 - RNA, 19 nt, Homo sapiens
gcaugugguucuauauuug

SEQ ID NO: 1407521 - RNA, 19 nt, Homo sapiens
gaggaugccuggaucugaa

SEQ ID NO: 1407522 - RNA, 19 nt, Homo sapiens
ccacaccucuuuaaguaug

SEQ ID NO: 1407523 - RNA, 19 nt, Homo sapiens
gaggaagaaucuacaucaa

SEQ ID NO: 1407524 - RNA, 19 nt, Homo sapiens
gcucacagaugacaacaag

SEQ ID NO: 1407525 - RNA, 19 nt, Homo sapiens
uggagaagaugagaaagua

SEQ ID NO: 1407526 - RNA, 19 nt, Homo sapiens
gacaacaaguuucacagau

SEQ ID NO: 1407527 - RNA, 19 nt, Homo sapiens
acccacaccucuuuaagua

SEQ ID NO: 1407528 - RNA, 19 nt, Homo sapiens
acaaguacaugaaguucuu

SEQ ID NO: 1407529 - RNA, 19 nt, Homo sapiens
ucacagaugacaacaaguu

SEQ ID NO: 1407530 - RNA, 19 nt, Homo sapiens
aaaguaauacccagauuga

SEQ ID NO: 1407531 - RNA, 19 nt, Homo sapiens
gaacgugcgagacaauguu

SEQ ID NO: 1407532 - RNA, 19 nt, Homo sapiens
ggaacauaaugauaaagca

SEQ ID NO: 1407533 - RNA, 19 nt, Homo sapiens
ggccagugaugauuacaga

SEQ ID NO: 1407534 - RNA, 19 nt, Homo sapiens
uacgaacccuuggaacaua

SEQ ID NO: 1407535 - RNA, 19 nt, Homo sapiens
gaaucuaccaccuuugugu

SEQ ID NO: 1407536 - RNA, 19 nt, Homo sapiens
gagaaaguauauggagaca

SEQ ID NO: 1407537 - RNA, 19 nt, Homo sapiens
acaacaaguuucacagauc

SEQ ID NO: 1407538 - RNA, 19 nt, Homo sapiens
acuagcaugugguucuaua

SEQ ID NO: 1407539 - RNA, 19 nt, Homo sapiens
gaaugugcccaucgaggaa

SEQ ID NO: 1407540 - RNA, 19 nt, Homo sapiens
agcaugugguucuauauuu

SEQ ID NO: 1407541 - RNA, 19 nt, Homo sapiens
agaagaaugugcccaucga

SEQ ID NO: 1407542 - RNA, 19 nt, Homo sapiens
caagcacccacaccucuuu

SEQ ID NO: 1407543 - RNA, 19 nt, Homo sapiens
aaacugcucuuuucagaug

SEQ ID NO: 1407544 - RNA, 19 nt, Homo sapiens
acgaggagauccagacugu

SEQ ID NO: 1407545 - RNA, 19 nt, Homo sapiens
gccuggaucugaagcuaga

SEQ ID NO: 1407546 - RNA, 19 nt, Homo sapiens
cagcucgccugaaugaauc

SEQ ID NO: 1407547 - RNA, 19 nt, Homo sapiens
ugacaacaaguuucacaga

SEQ ID NO: 1407548 - RNA, 19 nt, Homo sapiens
ggacugcuccuagauggau

SEQ ID NO: 1407549 - RNA, 19 nt, Homo sapiens
ccuuggaacauaaugauaa

SEQ ID NO: 1407550 - RNA, 19 nt, Homo sapiens
ucaacaaguacaugaaguu

SEQ ID NO: 1407551 - RNA, 19 nt, Homo sapiens
agacuagcaugugguucua

SEQ ID NO: 1407552 - RNA, 19 nt, Homo sapiens
gaagaugagaaaguauaug

SEQ ID NO: 1407553 - RNA, 19 nt, Homo sapiens
ggaauugaaauccuuuguc

SEQ ID NO: 1407554 - RNA, 19 nt, Homo sapiens
caacaaguacaugaaguuc

SEQ ID NO: 1407555 - RNA, 19 nt, Homo sapiens
uagcaugugguucuauauu

SEQ ID NO: 1407556 - RNA, 19 nt, Homo sapiens
gaucucagcggcauuaagc

SEQ ID NO: 1407557 - RNA, 19 nt, Homo sapiens
ggagaagaugagaaaguau

SEQ ID NO: 1407558 - RNA, 19 nt, Homo sapiens
gagcgaguuuguagugacu

SEQ ID NO: 1407559 - RNA, 19 nt, Homo sapiens
gaugacaacaaguuucaca

SEQ ID NO: 1407560 - RNA, 19 nt, Homo sapiens
cagaugacaacaaguuuca

SEQ ID NO: 1407561 - RNA, 19 nt, Homo sapiens
ccagcucgccugaaugaau

SEQ ID NO: 1407562 - RNA, 19 nt, Homo sapiens
uggcagcccuccuccaaag

SEQ ID NO: 1407563 - RNA, 19 nt, Homo sapiens
gaucugaagcuagaggaau

SEQ ID NO: 1407564 - RNA, 19 nt, Homo sapiens
acgaacccuuggaacauaa

SEQ ID NO: 1407565 - RNA, 19 nt, Homo sapiens
agaggaagaaucuacauca

SEQ ID NO: 1407566 - RNA, 19 nt, Homo sapiens
cagauugacccaugagcuu

SEQ ID NO: 1407567 - RNA, 19 nt, Homo sapiens
gagacacuacggacagaga

SEQ ID NO: 1407568 - RNA, 19 nt, Homo sapiens
ugaaugaaucuaccaccuu

SEQ ID NO: 1407569 - RNA, 19 nt, Homo sapiens
auugaaauccuuuguccua

SEQ ID NO: 1407570 - RNA, 19 nt, Homo sapiens
ggcagcugguucuuacgaa

SEQ ID NO: 1407571 - RNA, 19 nt, Homo sapiens
gcacccacaccucuuuaag

SEQ ID NO: 1407572 - RNA, 19 nt, Homo sapiens
gaagaaucuacaucaagca

SEQ ID NO: 1407573 - RNA, 19 nt, Homo sapiens
ucaggcagaagaagaaugu

SEQ ID NO: 1407574 - RNA, 19 nt, Homo sapiens
cuaaacugcucuuuucaga

SEQ ID NO: 1407575 - RNA, 19 nt, Homo sapiens
uuacagaggaugccuggau

SEQ ID NO: 1407576 - RNA, 19 nt, Homo sapiens
gacagaguccagcggaguu

SEQ ID NO: 1407577 - RNA, 19 nt, Homo sapiens
aaaauccugugaaccaauu

SEQ ID NO: 1407578 - RNA, 19 nt, Homo sapiens
ccagaaggcagcacugaac

SEQ ID NO: 1407579 - RNA, 19 nt, Homo sapiens
guggagaagaugagaaagu

SEQ ID NO: 1407580 - RNA, 19 nt, Homo sapiens
uggccuaccuccucaucga

SEQ ID NO: 1407581 - RNA, 19 nt, Homo sapiens
cacagaugacaacaaguuu

SEQ ID NO: 1407582 - RNA, 19 nt, Homo sapiens
ggacgcagagcagcugauc

SEQ ID NO: 1407583 - RNA, 19 nt, Homo sapiens
gggcagcugguucuuacga

SEQ ID NO: 1407584 - RNA, 19 nt, Homo sapiens
guugaagcaccuccacaga

SEQ ID NO: 1407585 - RNA, 19 nt, Homo sapiens
aagaugagaaaguauaugg

SEQ ID NO: 1407586 - RNA, 19 nt, Homo sapiens
ccuggaugguggagaagau

SEQ ID NO: 1407587 - RNA, 19 nt, Homo sapiens
gaagauggcuggaguagaa

SEQ ID NO: 1407588 - RNA, 19 nt, Homo sapiens
cacaauaucugauggauua

SEQ ID NO: 1407589 - RNA, 19 nt, Homo sapiens
gaaacaagguaguuacguu

SEQ ID NO: 1407590 - RNA, 19 nt, Homo sapiens
cuaaauaccuuccaagaug

SEQ ID NO: 1407591 - RNA, 19 nt, Homo sapiens
gcccaaaucuuauggcaaa

SEQ ID NO: 1407592 - RNA, 19 nt, Homo sapiens
gaauuucucuccacaagug

SEQ ID NO: 1407593 - RNA, 19 nt, Homo sapiens
gauagacccugcaucaguu

SEQ ID NO: 1407594 - RNA, 19 nt, Homo sapiens
ucagguagaucuuuauaga

SEQ ID NO: 1407595 - RNA, 19 nt, Homo sapiens
gcuaaagugucuuaacuca

SEQ ID NO: 1407596 - RNA, 19 nt, Homo sapiens
ccagucaugcuucuuauua

SEQ ID NO: 1407597 - RNA, 19 nt, Homo sapiens
gacaauauaugcuguagag

SEQ ID NO: 1407598 - RNA, 19 nt, Homo sapiens
caaaucuuauggcaaauug

SEQ ID NO: 1407599 - RNA, 19 nt, Homo sapiens
gaguuucucuugcccuuaa

SEQ ID NO: 1407600 - RNA, 19 nt, Homo sapiens
gaacugaagacaauaucaa

SEQ ID NO: 1407601 - RNA, 19 nt, Homo sapiens
agaagccuguuuccuguua

SEQ ID NO: 1407602 - RNA, 19 nt, Homo sapiens
guauagagguccagaaugc

SEQ ID NO: 1407603 - RNA, 19 nt, Homo sapiens
aaacaagguaguuacguua

SEQ ID NO: 1407604 - RNA, 19 nt, Homo sapiens
ggucugaauugaauacugu

SEQ ID NO: 1407605 - RNA, 19 nt, Homo sapiens
ccuuaacuguucugaauuu

SEQ ID NO: 1407606 - RNA, 19 nt, Homo sapiens
gaucaacuuucuucuaggu

SEQ ID NO: 1407607 - RNA, 19 nt, Homo sapiens
gugagucaauuaagccuuu

SEQ ID NO: 1407608 - RNA, 19 nt, Homo sapiens
uaaauaccuuccaagaugu

SEQ ID NO: 1407609 - RNA, 19 nt, Homo sapiens
aaagauagacccugcauca

SEQ ID NO: 1407610 - RNA, 19 nt, Homo sapiens
ucaagaaacaagguaguua

SEQ ID NO: 1407611 - RNA, 19 nt, Homo sapiens
acugaggaauguaaucaua

SEQ ID NO: 1407612 - RNA, 19 nt, Homo sapiens
gacccugcaucaguuguua

SEQ ID NO: 1407613 - RNA, 19 nt, Homo sapiens
ccacaaacacaauaucuuc

SEQ ID NO: 1407614 - RNA, 19 nt, Homo sapiens
uagauaaguccauuccaua

SEQ ID NO: 1407615 - RNA, 19 nt, Homo sapiens
cagucaugcuucuuauuaa

SEQ ID NO: 1407616 - RNA, 19 nt, Homo sapiens
guagaucuuuauagagugu

SEQ ID NO: 1407617 - RNA, 19 nt, Homo sapiens
agucucagguagaucuuua

SEQ ID NO: 1407618 - RNA, 19 nt, Homo sapiens
uuauuaagccuguggaauu

SEQ ID NO: 1407619 - RNA, 19 nt, Homo sapiens
cugcucaucucccuuuauu

SEQ ID NO: 1407620 - RNA, 19 nt, Homo sapiens
ggaagcaagaagccuguuu

SEQ ID NO: 1407621 - RNA, 19 nt, Homo sapiens
caaacacaauaucuuccuu

SEQ ID NO: 1407622 - RNA, 19 nt, Homo sapiens
uauuaagccuguggaauug

SEQ ID NO: 1407623 - RNA, 19 nt, Homo sapiens
gaucauaggagcggauuuc

SEQ ID NO: 1407624 - RNA, 19 nt, Homo sapiens
ugaaaagguuggguaaaua

SEQ ID NO: 1407625 - RNA, 19 nt, Homo sapiens
guauaacugaggaauguaa

SEQ ID NO: 1407626 - RNA, 19 nt, Homo sapiens
gaagcaagaagccuguuuc

SEQ ID NO: 1407627 - RNA, 19 nt, Homo sapiens
caugugaaguuccuugcuu

SEQ ID NO: 1407628 - RNA, 19 nt, Homo sapiens
uacguuagccugcauuaaa

SEQ ID NO: 1407629 - RNA, 19 nt, Homo sapiens
gauaaguccauuccauaau

SEQ ID NO: 1407630 - RNA, 19 nt, Homo sapiens
ucagacacaugcuuuuaua

SEQ ID NO: 1407631 - RNA, 19 nt, Homo sapiens
cugaagacaauaucaagua

SEQ ID NO: 1407632 - RNA, 19 nt, Homo sapiens
gaaauuucaguaagaccaa

SEQ ID NO: 1407633 - RNA, 19 nt, Homo sapiens
caauaacgauuuuccuuga

SEQ ID NO: 1407634 - RNA, 19 nt, Homo sapiens
ugaauacugugaggcuaaa

SEQ ID NO: 1407635 - RNA, 19 nt, Homo sapiens
guagaacugaagacaauau

SEQ ID NO: 1407636 - RNA, 19 nt, Homo sapiens
cuccuuaacuguucugaau

SEQ ID NO: 1407637 - RNA, 19 nt, Homo sapiens
uuagauaaguccauuccau

SEQ ID NO: 1407638 - RNA, 19 nt, Homo sapiens
cgauuuuccuugauucuua

SEQ ID NO: 1407639 - RNA, 19 nt, Homo sapiens
caucucccuuuauucguuu

SEQ ID NO: 1407640 - RNA, 19 nt, Homo sapiens
gcuguucucaugauaguga

SEQ ID NO: 1407641 - RNA, 19 nt, Homo sapiens
aagguuggguaaauauuug

SEQ ID NO: 1407642 - RNA, 19 nt, Homo sapiens
gaaaagguuggguaaauau

SEQ ID NO: 1407643 - RNA, 19 nt, Homo sapiens
aggaucaacuuucuucuag

SEQ ID NO: 1407644 - RNA, 19 nt, Homo sapiens
gauacgguuuggauuugug

SEQ ID NO: 1407645 - RNA, 19 nt, Homo sapiens
uaacugaggaauguaauca

SEQ ID NO: 1407646 - RNA, 19 nt, Homo sapiens
agauaaguccauuccauaa

SEQ ID NO: 1407647 - RNA, 19 nt, Homo sapiens
ucaucucccuuuauucguu

SEQ ID NO: 1407648 - RNA, 19 nt, Homo sapiens
ccacccacccugacaaaug

SEQ ID NO: 1407649 - RNA, 19 nt, Homo sapiens
caaguaacccucaaaaugu

SEQ ID NO: 1407650 - RNA, 19 nt, Homo sapiens
uccauaauguacuccuuaa

SEQ ID NO: 1407651 - RNA, 19 nt, Homo sapiens
caucucagacacaugcuuu

SEQ ID NO: 1407652 - RNA, 19 nt, Homo sapiens
ccagaaugcucaaaauugu

SEQ ID NO: 1407653 - RNA, 19 nt, Homo sapiens
agguagaucuuuauagagu

SEQ ID NO: 1407654 - RNA, 19 nt, Homo sapiens
caagaaacaagguaguuac

SEQ ID NO: 1407655 - RNA, 19 nt, Homo sapiens
ccaaaucuuauggcaaauu

SEQ ID NO: 1407656 - RNA, 19 nt, Homo sapiens
gcucaucucccuuuauucg

SEQ ID NO: 1407657 - RNA, 19 nt, Homo sapiens
cugccaugauuguaaguuu

SEQ ID NO: 1407658 - RNA, 19 nt, Homo sapiens
gugaaaagguuggguaaau

SEQ ID NO: 1407659 - RNA, 19 nt, Homo sapiens
ucaaguaacccucaaaaug

SEQ ID NO: 1407660 - RNA, 19 nt, Homo sapiens
auaauguacuccuuaacug

SEQ ID NO: 1407661 - RNA, 19 nt, Homo sapiens
ugcaucaguuguuaagcua

SEQ ID NO: 1407662 - RNA, 19 nt, Homo sapiens
cauaauguacuccuuaacu

SEQ ID NO: 1407663 - RNA, 19 nt, Homo sapiens
agccuuaccuaauuacaau

SEQ ID NO: 1407664 - RNA, 19 nt, Homo sapiens
gugaggcuaaagugucuua

SEQ ID NO: 1407665 - RNA, 19 nt, Homo sapiens
ccacagaccacggaagcaa

SEQ ID NO: 1407666 - RNA, 19 nt, Homo sapiens
gaccacccacccugacaaa

SEQ ID NO: 1407667 - RNA, 19 nt, Homo sapiens
ccuguggaauugugaguca

SEQ ID NO: 1407668 - RNA, 19 nt, Homo sapiens
uaagcuaacacaucuuucu

SEQ ID NO: 1407669 - RNA, 19 nt, Homo sapiens
gacugacuuucaucuagga

SEQ ID NO: 1407670 - RNA, 19 nt, Homo sapiens
aaagugucuuaacucauug

SEQ ID NO: 1407671 - RNA, 19 nt, Homo sapiens
aggcuaaagugucuuaacu

SEQ ID NO: 1407672 - RNA, 19 nt, Homo sapiens
caucacugcccaccacaga

SEQ ID NO: 1407673 - RNA, 19 nt, Homo sapiens
ucucagguagaucuuuaua

SEQ ID NO: 1407674 - RNA, 19 nt, Homo sapiens
gauggcuggaguagaaauu

SEQ ID NO: 1407675 - RNA, 19 nt, Homo sapiens
uugauacgguuuggauuug

SEQ ID NO: 1407676 - RNA, 19 nt, Homo sapiens
gaagacaauaucaaguaac

SEQ ID NO: 1407677 - RNA, 19 nt, Homo sapiens
uaauguacuccuuaacugu

SEQ ID NO: 1407678 - RNA, 19 nt, Homo sapiens
ucacaauaucugauggauu

SEQ ID NO: 1407679 - RNA, 19 nt, Homo sapiens
ucaguaagaccaaaacauu

SEQ ID NO: 1407680 - RNA, 19 nt, Homo sapiens
acacaucuuucuccucacu

SEQ ID NO: 1407681 - RNA, 19 nt, Homo sapiens
aaggaucaacuuucuucua

SEQ ID NO: 1407682 - RNA, 19 nt, Homo sapiens
uauccagucucagguagau

SEQ ID NO: 1407683 - RNA, 19 nt, Homo sapiens
agucuuacuuuccacuuuc

SEQ ID NO: 1407684 - RNA, 19 nt, Homo sapiens
ucucaucaccagaaggaaa

SEQ ID NO: 1407685 - RNA, 19 nt, Homo sapiens
agauagacccugcaucagu

SEQ ID NO: 1407686 - RNA, 19 nt, Homo sapiens
uuaagccuguggaauugug

SEQ ID NO: 1407687 - RNA, 19 nt, Homo sapiens
gcagacaaguuuacaaaua

SEQ ID NO: 1407688 - RNA, 19 nt, Homo sapiens
ccacacagaucccuacuua

SEQ ID NO: 1407689 - RNA, 19 nt, Homo sapiens
ggacaucucuggaaauuuc

SEQ ID NO: 1407690 - RNA, 19 nt, Homo sapiens
gaugauaauucgcuucuaa

SEQ ID NO: 1407691 - RNA, 19 nt, Homo sapiens
ggaagucuguaguaguuaa

SEQ ID NO: 1407692 - RNA, 19 nt, Homo sapiens
gagccaauauaucuacuuu

SEQ ID NO: 1407693 - RNA, 19 nt, Homo sapiens
gaagagggauucugguuac

SEQ ID NO: 1407694 - RNA, 19 nt, Homo sapiens
gagagaaggagccaauaua

SEQ ID NO: 1407695 - RNA, 19 nt, Homo sapiens
guaaguugcuguggaauga

SEQ ID NO: 1407696 - RNA, 19 nt, Homo sapiens
cgaccacuguguaguauuu

SEQ ID NO: 1407697 - RNA, 19 nt, Homo sapiens
ugucauagaugcagccuuu

SEQ ID NO: 1407698 - RNA, 19 nt, Homo sapiens
ccaaggagaugaugugcuu

SEQ ID NO: 1407699 - RNA, 19 nt, Homo sapiens
gccaauauaucuacuuuca

SEQ ID NO: 1407700 - RNA, 19 nt, Homo sapiens
agaagcagguguuaaugua

SEQ ID NO: 1407701 - RNA, 19 nt, Homo sapiens
gagcccaccugcuuugaaa

SEQ ID NO: 1407702 - RNA, 19 nt, Homo sapiens
ucagaaacauguaaacuag

SEQ ID NO: 1407703 - RNA, 19 nt, Homo sapiens
aaacagauuugaccaguag

SEQ ID NO: 1407704 - RNA, 19 nt, Homo sapiens
guggaagucuguaguaguu

SEQ ID NO: 1407705 - RNA, 19 nt, Homo sapiens
gcacaacuccaaacucaug

SEQ ID NO: 1407706 - RNA, 19 nt, Homo sapiens
ggacacuaauccugaacaa

SEQ ID NO: 1407707 - RNA, 19 nt, Homo sapiens
gaagagagaaggagccaau

SEQ ID NO: 1407708 - RNA, 19 nt, Homo sapiens
gaauagaagcacagaacaa

SEQ ID NO: 1407709 - RNA, 19 nt, Homo sapiens
gaaggcuguuauuuccaua

SEQ ID NO: 1407710 - RNA, 19 nt, Homo sapiens
ugaggaagcacccagauuu

SEQ ID NO: 1407711 - RNA, 19 nt, Homo sapiens
gggcagcucuggucaagca

SEQ ID NO: 1407712 - RNA, 19 nt, Homo sapiens
cauguaaacuagugaauac

SEQ ID NO: 1407713 - RNA, 19 nt, Homo sapiens
gaagcagguguuaauguaa

SEQ ID NO: 1407714 - RNA, 19 nt, Homo sapiens
gaaaaugccuaguaucuac

SEQ ID NO: 1407715 - RNA, 19 nt, Homo sapiens
gaaauuugaaggcuguuau

SEQ ID NO: 1407716 - RNA, 19 nt, Homo sapiens
agacugaagugcaaagugu

SEQ ID NO: 1407717 - RNA, 19 nt, Homo sapiens
gaaggagccaauauaucua

SEQ ID NO: 1407718 - RNA, 19 nt, Homo sapiens
gagggauucugguuacguu

SEQ ID NO: 1407719 - RNA, 19 nt, Homo sapiens
ugaagagggauucugguua

SEQ ID NO: 1407720 - RNA, 19 nt, Homo sapiens
gaaauucuggaguggauau

SEQ ID NO: 1407721 - RNA, 19 nt, Homo sapiens
acuuuggccuccugaauua

SEQ ID NO: 1407722 - RNA, 19 nt, Homo sapiens
ggauuuccuucuuuccaaa

SEQ ID NO: 1407723 - RNA, 19 nt, Homo sapiens
agaaacauguaaacuagug

SEQ ID NO: 1407724 - RNA, 19 nt, Homo sapiens
gcacagaacaaggacuauu

SEQ ID NO: 1407725 - RNA, 19 nt, Homo sapiens
acaaaucugugaccaucaa

SEQ ID NO: 1407726 - RNA, 19 nt, Homo sapiens
gauuggagcuggaauuagc

SEQ ID NO: 1407727 - RNA, 19 nt, Homo sapiens
uguuaaaucugcauaaugg

SEQ ID NO: 1407728 - RNA, 19 nt, Homo sapiens
ggacuauuguauauaagag

SEQ ID NO: 1407729 - RNA, 19 nt, Homo sapiens
guaccuacaaucaaacaaa

SEQ ID NO: 1407730 - RNA, 19 nt, Homo sapiens
gagaagcagguguuaaugu

SEQ ID NO: 1407731 - RNA, 19 nt, Homo sapiens
gauguaugccacacacuuu

SEQ ID NO: 1407732 - RNA, 19 nt, Homo sapiens
guuuguaucuuugguuuga

SEQ ID NO: 1407733 - RNA, 19 nt, Homo sapiens
caguuaagcaggacacuaa

SEQ ID NO: 1407734 - RNA, 19 nt, Homo sapiens
gaaugacuguuuucaagaa

SEQ ID NO: 1407735 - RNA, 19 nt, Homo sapiens
gaagagaaacaagagacuu

SEQ ID NO: 1407736 - RNA, 19 nt, Homo sapiens
gagaaggagccaauauauc

SEQ ID NO: 1407737 - RNA, 19 nt, Homo sapiens
acacuaauccugaacaauc

SEQ ID NO: 1407738 - RNA, 19 nt, Homo sapiens
ucccaggcauugagaaauu

SEQ ID NO: 1407739 - RNA, 19 nt, Homo sapiens
uguggagacugaagagaaa

SEQ ID NO: 1407740 - RNA, 19 nt, Homo sapiens
ccaaacucauggacuacuu

SEQ ID NO: 1407741 - RNA, 19 nt, Homo sapiens
agaaggagccaauauaucu

SEQ ID NO: 1407742 - RNA, 19 nt, Homo sapiens
gugauuggagcuggaauua

SEQ ID NO: 1407743 - RNA, 19 nt, Homo sapiens
aauguaaguugcuguggaa

SEQ ID NO: 1407744 - RNA, 19 nt, Homo sapiens
gaucggcauuggaaauucu

SEQ ID NO: 1407745 - RNA, 19 nt, Homo sapiens
ccaacuacaugcacaacuc

SEQ ID NO: 1407746 - RNA, 19 nt, Homo sapiens
gcauggcgaccacugugua

SEQ ID NO: 1407747 - RNA, 19 nt, Homo sapiens
gcaaaaguaccuacaauca

SEQ ID NO: 1407748 - RNA, 19 nt, Homo sapiens
ccuaguaucuacaaaucug

SEQ ID NO: 1407749 - RNA, 19 nt, Homo sapiens
agagaaggagccaauauau

SEQ ID NO: 1407750 - RNA, 19 nt, Homo sapiens
gaucccuacuuaccacuuc

SEQ ID NO: 1407751 - RNA, 19 nt, Homo sapiens
ugacuucccugucccugau

SEQ ID NO: 1407752 - RNA, 19 nt, Homo sapiens
ggagcucagucguguagca

SEQ ID NO: 1407753 - RNA, 19 nt, Homo sapiens
ugaaggcuguuauuuccau

SEQ ID NO: 1407754 - RNA, 19 nt, Homo sapiens
aagagaaacaagagacuuu

SEQ ID NO: 1407755 - RNA, 19 nt, Homo sapiens
uauuggacaucucuggaaa

SEQ ID NO: 1407756 - RNA, 19 nt, Homo sapiens
auggguagcauaugaauaa

SEQ ID NO: 1407757 - RNA, 19 nt, Homo sapiens
caauagaguggaagucugu

SEQ ID NO: 1407758 - RNA, 19 nt, Homo sapiens
cagcaugcagacaaguuua

SEQ ID NO: 1407759 - RNA, 19 nt, Homo sapiens
ggauguaugccacacacuu

SEQ ID NO: 1407760 - RNA, 19 nt, Homo sapiens
uauaagagaagcagguguu

SEQ ID NO: 1407761 - RNA, 19 nt, Homo sapiens
uaagagaagcagguguuaa

SEQ ID NO: 1407762 - RNA, 19 nt, Homo sapiens
aagagaagcagguguuaau

SEQ ID NO: 1407763 - RNA, 19 nt, Homo sapiens
gaaacauguaaacuaguga

SEQ ID NO: 1407764 - RNA, 19 nt, Homo sapiens
gaguggaagucuguaguag

SEQ ID NO: 1407765 - RNA, 19 nt, Homo sapiens
gggaaaagaaucauaguga

SEQ ID NO: 1407766 - RNA, 19 nt, Homo sapiens
augcacaacuccaaacuca

SEQ ID NO: 1407767 - RNA, 19 nt, Homo sapiens
cagagaaaaugccuaguau

SEQ ID NO: 1407768 - RNA, 19 nt, Homo sapiens
uuggacaucucuggaaauu

SEQ ID NO: 1407769 - RNA, 19 nt, Homo sapiens
ccccaagacugcaaaagua

SEQ ID NO: 1407770 - RNA, 19 nt, Homo sapiens
cacagaacaaggacuauug

SEQ ID NO: 1407771 - RNA, 19 nt, Homo sapiens
uagaagcacagaacaagga

SEQ ID NO: 1407772 - RNA, 19 nt, Homo sapiens
ccugaacaaucugauguau

SEQ ID NO: 1407773 - RNA, 19 nt, Homo sapiens
agacugaagagaaacaaga

SEQ ID NO: 1407774 - RNA, 19 nt, Homo sapiens
ggacuacuucgggauguau

SEQ ID NO: 1407775 - RNA, 19 nt, Homo sapiens
aguaggaacugagauucaa

SEQ ID NO: 1407776 - RNA, 19 nt, Homo sapiens
ggaaauucuggaguggaua

SEQ ID NO: 1407777 - RNA, 19 nt, Homo sapiens
uggaaauucuggaguggau

SEQ ID NO: 1407778 - RNA, 19 nt, Homo sapiens
cagaauagaagcacagaac

SEQ ID NO: 1407779 - RNA, 19 nt, Homo sapiens
ggcgaccacuguguaguau

SEQ ID NO: 1407780 - RNA, 19 nt, Homo sapiens
aagcagguguuaauguaag

SEQ ID NO: 1407781 - RNA, 19 nt, Homo sapiens
ggaucagcaugcagacaag

SEQ ID NO: 1407782 - RNA, 19 nt, Homo sapiens
ggucuuugauggggucuua

SEQ ID NO: 1407783 - RNA, 19 nt, Homo sapiens
gagaaaaugccuaguaucu

SEQ ID NO: 1407784 - RNA, 19 nt, Homo sapiens
aagcacagaacaaggacua

SEQ ID NO: 1407785 - RNA, 19 nt, Homo sapiens
ggagcccaccugcuuugaa

SEQ ID NO: 1407786 - RNA, 19 nt, Homo sapiens
ucauagaugcagccuuuau

SEQ ID NO: 1407787 - RNA, 19 nt, Homo sapiens
ggacagggcuggaaccuuu

SEQ ID NO: 1407788 - RNA, 19 nt, Homo sapiens
ggaaugggcucgugauuau

SEQ ID NO: 1407789 - RNA, 19 nt, Homo sapiens
ggaaauaccuagagaucuu

SEQ ID NO: 1407790 - RNA, 19 nt, Homo sapiens
ggagacaccucgaauacuu

SEQ ID NO: 1407791 - RNA, 19 nt, Homo sapiens
ggaaagaaauaaugaagag

SEQ ID NO: 1407792 - RNA, 19 nt, Homo sapiens
caacgacgcugaccuuugu

SEQ ID NO: 1407793 - RNA, 19 nt, Homo sapiens
gcauugaguuuaucgauga

SEQ ID NO: 1407794 - RNA, 19 nt, Homo sapiens
ucacaucuauucccaauga

SEQ ID NO: 1407795 - RNA, 19 nt, Homo sapiens
gaaaguaguuugcgauugc

SEQ ID NO: 1407796 - RNA, 19 nt, Homo sapiens
gaaagcagaugaaccugau

SEQ ID NO: 1407797 - RNA, 19 nt, Homo sapiens
gcaaggaaagaaauaauga

SEQ ID NO: 1407798 - RNA, 19 nt, Homo sapiens
gaucacaucuauucccaau

SEQ ID NO: 1407799 - RNA, 19 nt, Homo sapiens
gguauaguguccaaacuga

SEQ ID NO: 1407800 - RNA, 19 nt, Homo sapiens
gcaagaaggaaaucaauag

SEQ ID NO: 1407801 - RNA, 19 nt, Homo sapiens
agaugaaccugaugauauu

SEQ ID NO: 1407802 - RNA, 19 nt, Homo sapiens
uguguuagcugcagccuuu

SEQ ID NO: 1407803 - RNA, 19 nt, Homo sapiens
aaacguccguguuggauga

SEQ ID NO: 1407804 - RNA, 19 nt, Homo sapiens
ggaccuccaucaacugaga

SEQ ID NO: 1407805 - RNA, 19 nt, Homo sapiens
agaaggaaaucaauagugu

SEQ ID NO: 1407806 - RNA, 19 nt, Homo sapiens
gcagaugaaccugaugaua

SEQ ID NO: 1407807 - RNA, 19 nt, Homo sapiens
gaagaaagcagaugaaccu

SEQ ID NO: 1407808 - RNA, 19 nt, Homo sapiens
cagaugaaccugaugauau

SEQ ID NO: 1407809 - RNA, 19 nt, Homo sapiens
ucaaggaaauaccuagaga

SEQ ID NO: 1407810 - RNA, 19 nt, Homo sapiens
gcacugcgacuguacucua

SEQ ID NO: 1407811 - RNA, 19 nt, Homo sapiens
gaaacacgcaagaaggaaa

SEQ ID NO: 1407812 - RNA, 19 nt, Homo sapiens
gaacauuaguuagauccau

SEQ ID NO: 1407813 - RNA, 19 nt, Homo sapiens
caaugcaaaucucaaggaa

SEQ ID NO: 1407814 - RNA, 19 nt, Homo sapiens
gauauuagcacugugguau

SEQ ID NO: 1407815 - RNA, 19 nt, Homo sapiens
cccaagggcugucuuuguu

SEQ ID NO: 1407816 - RNA, 19 nt, Homo sapiens
gaaauaaugaagagacaca

SEQ ID NO: 1407817 - RNA, 19 nt, Homo sapiens
ggugaucucauauguggua

SEQ ID NO: 1407818 - RNA, 19 nt, Homo sapiens
gcuacuauuugaacauuag

SEQ ID NO: 1407819 - RNA, 19 nt, Homo sapiens
augcaaaucucaaggaaau

SEQ ID NO: 1407820 - RNA, 19 nt, Homo sapiens
ccaagcaaggaaagaaaua

SEQ ID NO: 1407821 - RNA, 19 nt, Homo sapiens
gcaaugcaaaucucaagga

SEQ ID NO: 1407822 - RNA, 19 nt, Homo sapiens
gcagaagaaagcagaugaa

SEQ ID NO: 1407823 - RNA, 19 nt, Homo sapiens
cgaugagcaugccuucaaa

SEQ ID NO: 1407824 - RNA, 19 nt, Homo sapiens
guuuaaaugucaccuguag

SEQ ID NO: 1407825 - RNA, 19 nt, Homo sapiens
uuaaggaccuccaucaacu

SEQ ID NO: 1407826 - RNA, 19 nt, Homo sapiens
cccacaacgugaucuguaa

SEQ ID NO: 1407827 - RNA, 19 nt, Homo sapiens
gauucaaagugugcacaaa

SEQ ID NO: 1407828 - RNA, 19 nt, Homo sapiens
caagcaaggaaagaaauaa

SEQ ID NO: 1407829 - RNA, 19 nt, Homo sapiens
gcaguagaaauaagugguu

SEQ ID NO: 1407830 - RNA, 19 nt, Homo sapiens
gagcauggcguccaaucau

SEQ ID NO: 1407831 - RNA, 19 nt, Homo sapiens
guaagcuacuauuugaaca

SEQ ID NO: 1407832 - RNA, 19 nt, Homo sapiens
uuacuucucccauccauug

SEQ ID NO: 1407833 - RNA, 19 nt, Homo sapiens
gaugaaccugaugauauua

SEQ ID NO: 1407834 - RNA, 19 nt, Homo sapiens
gggccagaauugccaacaa

SEQ ID NO: 1407835 - RNA, 19 nt, Homo sapiens
gcaaaucucaaggaaauac

SEQ ID NO: 1407836 - RNA, 19 nt, Homo sapiens
ggacuccaaucagaucaca

SEQ ID NO: 1407837 - RNA, 19 nt, Homo sapiens
aaugucaccuguagcaaug

SEQ ID NO: 1407838 - RNA, 19 nt, Homo sapiens
caguagaaauaagugguuu

SEQ ID NO: 1407839 - RNA, 19 nt, Homo sapiens
gcgauugcaguagaaauaa

SEQ ID NO: 1407840 - RNA, 19 nt, Homo sapiens
agaaaguaguuugcgauug

SEQ ID NO: 1407841 - RNA, 19 nt, Homo sapiens
gaauuaugccacugcugaa

SEQ ID NO: 1407842 - RNA, 19 nt, Homo sapiens
guaguuugcgauugcagua

SEQ ID NO: 1407843 - RNA, 19 nt, Homo sapiens
caagggcugucuuuguucu

SEQ ID NO: 1407844 - RNA, 19 nt, Homo sapiens
uaacuuugaaccauggaaa

SEQ ID NO: 1407845 - RNA, 19 nt, Homo sapiens
ugagaaagaaagaaaguag

SEQ ID NO: 1407846 - RNA, 19 nt, Homo sapiens
gcccacaacgugaucugua

SEQ ID NO: 1407847 - RNA, 19 nt, Homo sapiens
uauuagcacugugguauag

SEQ ID NO: 1407848 - RNA, 19 nt, Homo sapiens
cugcugaacuuuuaacaaa

SEQ ID NO: 1407849 - RNA, 19 nt, Homo sapiens
cuucucccauccauuguaa

SEQ ID NO: 1407850 - RNA, 19 nt, Homo sapiens
uugccucucuccugucuuu

SEQ ID NO: 1407851 - RNA, 19 nt, Homo sapiens
gaaauaccuagagaucuuc

SEQ ID NO: 1407852 - RNA, 19 nt, Homo sapiens
gaggaaugggcucgugauu

SEQ ID NO: 1407853 - RNA, 19 nt, Homo sapiens
gagaaagaaagaaaguagu

SEQ ID NO: 1407854 - RNA, 19 nt, Homo sapiens
ucaaaggaguagcugaaac

SEQ ID NO: 1407855 - RNA, 19 nt, Homo sapiens
caagaaggaaaucaauagu

SEQ ID NO: 1407856 - RNA, 19 nt, Homo sapiens
aggaaugggcucgugauua

SEQ ID NO: 1407857 - RNA, 19 nt, Homo sapiens
uggaguagaugaggaaugg

SEQ ID NO: 1407858 - RNA, 19 nt, Homo sapiens
cgcaagaaggaaaucaaua

SEQ ID NO: 1407859 - RNA, 19 nt, Homo sapiens
ggcagaagaaagcagauga

SEQ ID NO: 1407860 - RNA, 19 nt, Homo sapiens
ggccagaauugccaacaac

SEQ ID NO: 1407861 - RNA, 19 nt, Homo sapiens
auacugugcuuucauucug

SEQ ID NO: 1407862 - RNA, 19 nt, Homo sapiens
ccaacgacgcugaccuuug

SEQ ID NO: 1407863 - RNA, 19 nt, Homo sapiens
gaacaugcuggcagaccau

SEQ ID NO: 1407864 - RNA, 19 nt, Homo sapiens
caucuauucccaaugaaau

SEQ ID NO: 1407865 - RNA, 19 nt, Homo sapiens
ccaugugucuccuccuaca

SEQ ID NO: 1407866 - RNA, 19 nt, Homo sapiens
gcccaagcaaggaaagaaa

SEQ ID NO: 1407867 - RNA, 19 nt, Homo sapiens
ugcgauugcaguagaaaua

SEQ ID NO: 1407868 - RNA, 19 nt, Homo sapiens
gagacaccucgaauacuug

SEQ ID NO: 1407869 - RNA, 19 nt, Homo sapiens
ccacaacgugaucuguaaa

SEQ ID NO: 1407870 - RNA, 19 nt, Homo sapiens
ggagcauggcguccaauca

SEQ ID NO: 1407871 - RNA, 19 nt, Homo sapiens
uaccacgcuuguuggagua

SEQ ID NO: 1407872 - RNA, 19 nt, Homo sapiens
cauccauuguaaacauuug

SEQ ID NO: 1407873 - RNA, 19 nt, Homo sapiens
gacagggcuggaaccuuua

SEQ ID NO: 1407874 - RNA, 19 nt, Homo sapiens
ugaggagcauggcguccaa

SEQ ID NO: 1407875 - RNA, 19 nt, Homo sapiens
gggcacaccccuaagcaua

SEQ ID NO: 1407876 - RNA, 19 nt, Homo sapiens
gaaccuuuaccacgcuugu

SEQ ID NO: 1407877 - RNA, 19 nt, Homo sapiens
uggcagaccauuccucaau

SEQ ID NO: 1407878 - RNA, 19 nt, Homo sapiens
acaccucgaauacuugaaa

SEQ ID NO: 1407879 - RNA, 19 nt, Homo sapiens
uuaaaugucaccuguagca

SEQ ID NO: 1407880 - RNA, 19 nt, Homo sapiens
ucugguagaccugugguua

SEQ ID NO: 1407881 - RNA, 19 nt, Homo sapiens
gauccaccccuuaauugua

SEQ ID NO: 1407882 - RNA, 19 nt, Homo sapiens
guagaaauaagugguuuac

SEQ ID NO: 1407883 - RNA, 19 nt, Homo sapiens
cugaugauauuagcacugu

SEQ ID NO: 1407884 - RNA, 19 nt, Homo sapiens
ucgaugagcaugccuucaa

SEQ ID NO: 1407885 - RNA, 19 nt, Homo sapiens
cuccaugugucuccuccua

SEQ ID NO: 1407886 - RNA, 19 nt, Homo sapiens
agagaucuuccuccugaaa

SEQ ID NO: 1407887 - RNA, 19 nt, Homo sapiens
gaaaggaguugcagcuguu

SEQ ID NO: 1407888 - RNA, 19 nt, Homo sapiens
ggagaugaauuugaccuua

SEQ ID NO: 1407889 - RNA, 19 nt, Homo sapiens
gagaugaauuugaccuuau

SEQ ID NO: 1407890 - RNA, 19 nt, Homo sapiens
caugaccucuggaaguuua

SEQ ID NO: 1407891 - RNA, 19 nt, Homo sapiens
acaaugagauuuacugcaa

SEQ ID NO: 1407892 - RNA, 19 nt, Homo sapiens
ggcaagaucauguacauuu

SEQ ID NO: 1407893 - RNA, 19 nt, Homo sapiens
gacauggacucuuaucugu

SEQ ID NO: 1407894 - RNA, 19 nt, Homo sapiens
guacaucuuuggugguuau

SEQ ID NO: 1407895 - RNA, 19 nt, Homo sapiens
caaccgcauucgagucuuu

SEQ ID NO: 1407896 - RNA, 19 nt, Homo sapiens
gcugggaagucacauguau

SEQ ID NO: 1407897 - RNA, 19 nt, Homo sapiens
gaauuugaccuuauagauc

SEQ ID NO: 1407898 - RNA, 19 nt, Homo sapiens
ccacaaugcugggaaguca

SEQ ID NO: 1407899 - RNA, 19 nt, Homo sapiens
cauucugacuuacacauuu

SEQ ID NO: 1407900 - RNA, 19 nt, Homo sapiens
cgccagugcugcuguauug

SEQ ID NO: 1407901 - RNA, 19 nt, Homo sapiens
gcaagaucauguacauuuu

SEQ ID NO: 1407902 - RNA, 19 nt, Homo sapiens
gcaguguccuugcguugga

SEQ ID NO: 1407903 - RNA, 19 nt, Homo sapiens
ggacucuuaucuguacaaa

SEQ ID NO: 1407904 - RNA, 19 nt, Homo sapiens
ugggcaagcuccuguggua

SEQ ID NO: 1407905 - RNA, 19 nt, Homo sapiens
gguguucucugugcuguga

SEQ ID NO: 1407906 - RNA, 19 nt, Homo sapiens
caucuuuggugguuauaau

SEQ ID NO: 1407907 - RNA, 19 nt, Homo sapiens
gacauucacaagcuagaua

SEQ ID NO: 1407908 - RNA, 19 nt, Homo sapiens
cuagauaccagcaccauga

SEQ ID NO: 1407909 - RNA, 19 nt, Homo sapiens
ucacccaccugcuccuuug

SEQ ID NO: 1407910 - RNA, 19 nt, Homo sapiens
ucaauacgcacaagugguu

SEQ ID NO: 1407911 - RNA, 19 nt, Homo sapiens
ugaaugccaugaccaccaa

SEQ ID NO: 1407912 - RNA, 19 nt, Homo sapiens
gcaaacuggccgugauuca

SEQ ID NO: 1407913 - RNA, 19 nt, Homo sapiens
gccauuccauuccaacaau

SEQ ID NO: 1407914 - RNA, 19 nt, Homo sapiens
acucuuaucuguacaaagg

SEQ ID NO: 1407915 - RNA, 19 nt, Homo sapiens
cauggacucuuaucuguac

SEQ ID NO: 1407916 - RNA, 19 nt, Homo sapiens
uggccgugauucaguauaa

SEQ ID NO: 1407917 - RNA, 19 nt, Homo sapiens
gaggaaggccugggagaug

SEQ ID NO: 1407918 - RNA, 19 nt, Homo sapiens
guucagccagcucagauuu

SEQ ID NO: 1407919 - RNA, 19 nt, Homo sapiens
gaaguucagccagcucaga

SEQ ID NO: 1407920 - RNA, 19 nt, Homo sapiens
ugaagacucugugcaaacu

SEQ ID NO: 1407921 - RNA, 19 nt, Homo sapiens
ugacauggacucuuaucug

SEQ ID NO: 1407922 - RNA, 19 nt, Homo sapiens
uaggcaagaucauguacau

SEQ ID NO: 1407923 - RNA, 19 nt, Homo sapiens
uccuugagcugucgcugua

SEQ ID NO: 1407924 - RNA, 19 nt, Homo sapiens
ucagccagcucagauuuua

SEQ ID NO: 1407925 - RNA, 19 nt, Homo sapiens
cagugcugcuguauuguug

SEQ ID NO: 1407926 - RNA, 19 nt, Homo sapiens
ucugaagacucugugcaaa

SEQ ID NO: 1407927 - RNA, 19 nt, Homo sapiens
aggaaggccugggagauga

SEQ ID NO: 1407928 - RNA, 19 nt, Homo sapiens
uuacugcucuggugaagac

SEQ ID NO: 1407929 - RNA, 19 nt, Homo sapiens
uaugagacacugcgucaga

SEQ ID NO: 1407930 - RNA, 19 nt, Homo sapiens
guuuaauccuguguccuuu

SEQ ID NO: 1407931 - RNA, 19 nt, Homo sapiens
ugagacacugcgucagaua

SEQ ID NO: 1407932 - RNA, 19 nt, Homo sapiens
acauucagccuguguccua

SEQ ID NO: 1407933 - RNA, 19 nt, Homo sapiens
ggaaggccugggagaugaa

SEQ ID NO: 1407934 - RNA, 19 nt, Homo sapiens
gcucuggugaagacuauga

SEQ ID NO: 1407935 - RNA, 19 nt, Homo sapiens
ggccugcaaugugcucuau

SEQ ID NO: 1407936 - RNA, 19 nt, Homo sapiens
cgacacaguccuccuuugg

SEQ ID NO: 1407937 - RNA, 19 nt, Homo sapiens
ggagaagcaagcagugucu

SEQ ID NO: 1407938 - RNA, 19 nt, Homo sapiens
ccagugcugcuguauuguu

SEQ ID NO: 1407939 - RNA, 19 nt, Homo sapiens
caaugugcucuaugccuuu

SEQ ID NO: 1407940 - RNA, 19 nt, Homo sapiens
gacgacacaguccuccuuu

SEQ ID NO: 1407941 - RNA, 19 nt, Homo sapiens
gugcaaacuggccgugauu

SEQ ID NO: 1407942 - RNA, 19 nt, Homo sapiens
ccaacaaugagauuuacug

SEQ ID NO: 1407943 - RNA, 19 nt, Homo sapiens
gagacacugcgucagauag

SEQ ID NO: 1407944 - RNA, 19 nt, Homo sapiens
ucucugugcugugaauuca

SEQ ID NO: 1407945 - RNA, 19 nt, Homo sapiens
ggacuugguauaccuccau

SEQ ID NO: 1407946 - RNA, 19 nt, Homo sapiens
ugagccugcugucaucuuc

SEQ ID NO: 1407947 - RNA, 19 nt, Homo sapiens
ugaaccggcacuuccauga

SEQ ID NO: 1407948 - RNA, 19 nt, Homo sapiens
gauaccagcaccaugacau

SEQ ID NO: 1407949 - RNA, 19 nt, Homo sapiens
cgacgacacaguccuccuu

SEQ ID NO: 1407950 - RNA, 19 nt, Homo sapiens
acacucaaccguccucauc

SEQ ID NO: 1407951 - RNA, 19 nt, Homo sapiens
ccuguuugccucaugauau

SEQ ID NO: 1407952 - RNA, 19 nt, Homo sapiens
ccugggagaugaauuugac

SEQ ID NO: 1407953 - RNA, 19 nt, Homo sapiens
caugcgcuauggacacuca

SEQ ID NO: 1407954 - RNA, 19 nt, Homo sapiens
gacacugcgucagauagau

SEQ ID NO: 1407955 - RNA, 19 nt, Homo sapiens
uuaauccuguguccuuuac

SEQ ID NO: 1407956 - RNA, 19 nt, Homo sapiens
gcuuugggccauuccauuc

SEQ ID NO: 1407957 - RNA, 19 nt, Homo sapiens
agacacugcgucagauaga

SEQ ID NO: 1407958 - RNA, 19 nt, Homo sapiens
agcugucgcuguacucuga

SEQ ID NO: 1407959 - RNA, 19 nt, Homo sapiens
uggcuguguuuaucucguu

SEQ ID NO: 1407960 - RNA, 19 nt, Homo sapiens
agaagcaagcagugucuga

SEQ ID NO: 1407961 - RNA, 19 nt, Homo sapiens
ggcaucggguauacuccuu

SEQ ID NO: 1407962 - RNA, 19 nt, Homo sapiens
ggccauuccauuccaacaa

SEQ ID NO: 1407963 - RNA, 19 nt, Homo sapiens
gaaccggcacuuccaugac

SEQ ID NO: 1407964 - RNA, 19 nt, Homo sapiens
gcaaccgcauucgagucuu

SEQ ID NO: 1407965 - RNA, 19 nt, Homo sapiens
gaaauuggcugcaccaugu

SEQ ID NO: 1407966 - RNA, 19 nt, Homo sapiens
ggauuuggcugaugauaaa

SEQ ID NO: 1407967 - RNA, 19 nt, Homo sapiens
gaggaacacucacacaauu

SEQ ID NO: 1407968 - RNA, 19 nt, Homo sapiens
ccacaucucuggaaggaaa

SEQ ID NO: 1407969 - RNA, 19 nt, Homo sapiens
gcucauaaaucuacugugu

SEQ ID NO: 1407970 - RNA, 19 nt, Homo sapiens
ggaacacucacacaauuua

SEQ ID NO: 1407971 - RNA, 19 nt, Homo sapiens
gaacacagcauccaaccaa

SEQ ID NO: 1407972 - RNA, 19 nt, Homo sapiens
cagcagagauauuuagcua

SEQ ID NO: 1407973 - RNA, 19 nt, Homo sapiens
guaaagggccauaaagaaa

SEQ ID NO: 1407974 - RNA, 19 nt, Homo sapiens
ggaaucauuucauuugguu

SEQ ID NO: 1407975 - RNA, 19 nt, Homo sapiens
ggccaaaccuauuaaaugu

SEQ ID NO: 1407976 - RNA, 19 nt, Homo sapiens
guggaaaccuucauauaug

SEQ ID NO: 1407977 - RNA, 19 nt, Homo sapiens
gaaaaggccaaaccuauua

SEQ ID NO: 1407978 - RNA, 19 nt, Homo sapiens
gguggaaaccuucauauau

SEQ ID NO: 1407979 - RNA, 19 nt, Homo sapiens
gcagagauauuuagcuacu

SEQ ID NO: 1407980 - RNA, 19 nt, Homo sapiens
agaaggagcaccugaaauu

SEQ ID NO: 1407981 - RNA, 19 nt, Homo sapiens
gaacacucacacaauuuaa

SEQ ID NO: 1407982 - RNA, 19 nt, Homo sapiens
ucucagaaauauggcauua

SEQ ID NO: 1407983 - RNA, 19 nt, Homo sapiens
ggagaaggagcaccugaaa

SEQ ID NO: 1407984 - RNA, 19 nt, Homo sapiens
ucccugaaguuccauauuu

SEQ ID NO: 1407985 - RNA, 19 nt, Homo sapiens
uauggaaccuguacaagga

SEQ ID NO: 1407986 - RNA, 19 nt, Homo sapiens
uggcauagguggacuagga

SEQ ID NO: 1407987 - RNA, 19 nt, Homo sapiens
gcuuggaguuugacagaaa

SEQ ID NO: 1407988 - RNA, 19 nt, Homo sapiens
agaagaacguguuguuugu

SEQ ID NO: 1407989 - RNA, 19 nt, Homo sapiens
gccaguauauucuguaaag

SEQ ID NO: 1407990 - RNA, 19 nt, Homo sapiens
gcgggcaucuguaguccua

SEQ ID NO: 1407991 - RNA, 19 nt, Homo sapiens
aaagggccauaaagaaauu

SEQ ID NO: 1407992 - RNA, 19 nt, Homo sapiens
cuccagagaugccaguaua

SEQ ID NO: 1407993 - RNA, 19 nt, Homo sapiens
uuuagaagcuccagagaug

SEQ ID NO: 1407994 - RNA, 19 nt, Homo sapiens
gaacagggagcucuuucug

SEQ ID NO: 1407995 - RNA, 19 nt, Homo sapiens
gaguacugaucguuacaaa

SEQ ID NO: 1407996 - RNA, 19 nt, Homo sapiens
gaaggagcaccugaaauug

SEQ ID NO: 1407997 - RNA, 19 nt, Homo sapiens
caagaagaacguguuguuu

SEQ ID NO: 1407998 - RNA, 19 nt, Homo sapiens
caaaacccgucucuacuaa

SEQ ID NO: 1407999 - RNA, 19 nt, Homo sapiens
uggcaaugcuuauaaucaa

SEQ ID NO: 1408000 - RNA, 19 nt, Homo sapiens
aagaugauccuguugcuaa

SEQ ID NO: 1408001 - RNA, 19 nt, Homo sapiens
uaucagaagcaccaaguaa

SEQ ID NO: 1408002 - RNA, 19 nt, Homo sapiens
gggcuuguuugcugacuug

SEQ ID NO: 1408003 - RNA, 19 nt, Homo sapiens
gcagugagccgagauugug

SEQ ID NO: 1408004 - RNA, 19 nt, Homo sapiens
gcaggagaaucacuugaac

SEQ ID NO: 1408005 - RNA, 19 nt, Homo sapiens
uaaaagaguuugccuugga

SEQ ID NO: 1408006 - RNA, 19 nt, Homo sapiens
ucaagaagaacguguuguu

SEQ ID NO: 1408007 - RNA, 19 nt, Homo sapiens
uaaagggccauaaagaaau

SEQ ID NO: 1408008 - RNA, 19 nt, Homo sapiens
gugagaguacugaucguua

SEQ ID NO: 1408009 - RNA, 19 nt, Homo sapiens
gaaaugggagucgcagguu

SEQ ID NO: 1408010 - RNA, 19 nt, Homo sapiens
agaaaaggcucauaaaucu

SEQ ID NO: 1408011 - RNA, 19 nt, Homo sapiens
gcaaugcuuauaaucaaga

SEQ ID NO: 1408012 - RNA, 19 nt, Homo sapiens
ucauucagcuguacgagau

SEQ ID NO: 1408013 - RNA, 19 nt, Homo sapiens
gaacauuuggugcaacauc

SEQ ID NO: 1408014 - RNA, 19 nt, Homo sapiens
gaaaccccgucucuacuaa

SEQ ID NO: 1408015 - RNA, 19 nt, Homo sapiens
gggagucgcagguucugua

SEQ ID NO: 1408016 - RNA, 19 nt, Homo sapiens
cgagaagccucagaucauc

SEQ ID NO: 1408017 - RNA, 19 nt, Homo sapiens
gagauuucagugugaguaa

SEQ ID NO: 1408018 - RNA, 19 nt, Homo sapiens
gaagcaccaaguaaacuau

SEQ ID NO: 1408019 - RNA, 19 nt, Homo sapiens
gaucagaaggucaggagau

SEQ ID NO: 1408020 - RNA, 19 nt, Homo sapiens
uguaaagggccauaaagaa

SEQ ID NO: 1408021 - RNA, 19 nt, Homo sapiens
gggaaucauuucauuuggu

SEQ ID NO: 1408022 - RNA, 19 nt, Homo sapiens
cuaagucaauaguugucua

SEQ ID NO: 1408023 - RNA, 19 nt, Homo sapiens
aagaagaacguguuguuug

SEQ ID NO: 1408024 - RNA, 19 nt, Homo sapiens
ccagagaugccaguauauu

SEQ ID NO: 1408025 - RNA, 19 nt, Homo sapiens
ucacacaauuuaagauagg

SEQ ID NO: 1408026 - RNA, 19 nt, Homo sapiens
gcaggagaauggcgugaac

SEQ ID NO: 1408027 - RNA, 19 nt, Homo sapiens
guacugaucguuacaaagc

SEQ ID NO: 1408028 - RNA, 19 nt, Homo sapiens
gcagaacagggagcucuuu

SEQ ID NO: 1408029 - RNA, 19 nt, Homo sapiens
guguguagcuuggaguuug

SEQ ID NO: 1408030 - RNA, 19 nt, Homo sapiens
gaugauccuguugcuaaua

SEQ ID NO: 1408031 - RNA, 19 nt, Homo sapiens
gaaaccuucauauauggaa

SEQ ID NO: 1408032 - RNA, 19 nt, Homo sapiens
gugggaaucauuucauuug

SEQ ID NO: 1408033 - RNA, 19 nt, Homo sapiens
cgaggcggguggaucagaa

SEQ ID NO: 1408034 - RNA, 19 nt, Homo sapiens
gcauuacggugggagacaa

SEQ ID NO: 1408035 - RNA, 19 nt, Homo sapiens
ucagaaauauggcauuacg

SEQ ID NO: 1408036 - RNA, 19 nt, Homo sapiens
guagcucacgccuguaauu

SEQ ID NO: 1408037 - RNA, 19 nt, Homo sapiens
gcucacgccuguaauucca

SEQ ID NO: 1408038 - RNA, 19 nt, Homo sapiens
gauuucagugugaguaauu

SEQ ID NO: 1408039 - RNA, 19 nt, Homo sapiens
gcccugcagcgccaaauuu

SEQ ID NO: 1408040 - RNA, 19 nt, Homo sapiens
ggagucgcagguucuguaa

SEQ ID NO: 1408041 - RNA, 19 nt, Homo sapiens
uaauauggaaccuguacaa

SEQ ID NO: 1408042 - RNA, 19 nt, Homo sapiens
ggugggaaucauuucauuu

SEQ ID NO: 1408043 - RNA, 19 nt, Homo sapiens
ucgagaccauccuggcuaa

SEQ ID NO: 1408044 - RNA, 19 nt, Homo sapiens
gaaccuguacaaggagaaa

SEQ ID NO: 1408045 - RNA, 19 nt, Homo sapiens
gagaaggagcaccugaaau

SEQ ID NO: 1408046 - RNA, 19 nt, Homo sapiens
gaacccaggagguggagau

SEQ ID NO: 1408047 - RNA, 19 nt, Homo sapiens
ggcaggagaaucacuugaa

SEQ ID NO: 1408048 - RNA, 19 nt, Homo sapiens
ggaguccucugacccucau

SEQ ID NO: 1408049 - RNA, 19 nt, Homo sapiens
ugagaguacugaucguuac

SEQ ID NO: 1408050 - RNA, 19 nt, Homo sapiens
gaagaacguguuguuugug

SEQ ID NO: 1408051 - RNA, 19 nt, Homo sapiens
cagagaugccaguauauuc

SEQ ID NO: 1408052 - RNA, 19 nt, Homo sapiens
cagaggaacacucacacaa

SEQ ID NO: 1408053 - RNA, 19 nt, Homo sapiens
cugcgucuguaguucauuu

SEQ ID NO: 1408054 - RNA, 19 nt, Homo sapiens
auauuuagcuacuggagau

SEQ ID NO: 1408055 - RNA, 19 nt, Homo sapiens
ccucagaucaucgcccaua

SEQ ID NO: 1408056 - RNA, 19 nt, Homo sapiens
uggaaaccuucauauaugg

SEQ ID NO: 1408057 - RNA, 19 nt, Homo sapiens
aaaauuagcugggcuuagu

SEQ ID NO: 1408058 - RNA, 19 nt, Homo sapiens
agaagcaccaaguaaacua

SEQ ID NO: 1408059 - RNA, 19 nt, Homo sapiens
gagauggaacugugaaggu

SEQ ID NO: 1408060 - RNA, 19 nt, Homo sapiens
aaacccgucucuacuaaaa

SEQ ID NO: 1408061 - RNA, 19 nt, Homo sapiens
gucaggagaucgagaccau

SEQ ID NO: 1408062 - RNA, 19 nt, Homo sapiens
ccuguaaucccagcacuuu

SEQ ID NO: 1408063 - RNA, 19 nt, Homo sapiens
guggcucacuccuguaauc

SEQ ID NO: 1408064 - RNA, 19 nt, Homo sapiens
cccagcccauuucaaguuu

SEQ ID NO: 1408065 - RNA, 19 nt, Homo sapiens
gaacugaaaugucacacuu

SEQ ID NO: 1408066 - RNA, 19 nt, Homo sapiens
gaagagggccugauuagaa

SEQ ID NO: 1408067 - RNA, 19 nt, Homo sapiens
gggaauaccuaucuucaga

SEQ ID NO: 1408068 - RNA, 19 nt, Homo sapiens
ggucauugguugcauaauu

SEQ ID NO: 1408069 - RNA, 19 nt, Homo sapiens
gagcagcacugguucuguu

SEQ ID NO: 1408070 - RNA, 19 nt, Homo sapiens
ggaaauacauagaccuaca

SEQ ID NO: 1408071 - RNA, 19 nt, Homo sapiens
ccaagugacucugauguuu

SEQ ID NO: 1408072 - RNA, 19 nt, Homo sapiens
gugggcaucuccuacauua

SEQ ID NO: 1408073 - RNA, 19 nt, Homo sapiens
ggaguggaguucuguguug

SEQ ID NO: 1408074 - RNA, 19 nt, Homo sapiens
gaauggagcaguuuaauac

SEQ ID NO: 1408075 - RNA, 19 nt, Homo sapiens
uuacugaacugaagcauuc

SEQ ID NO: 1408076 - RNA, 19 nt, Homo sapiens
ggagaagagggccugauua

SEQ ID NO: 1408077 - RNA, 19 nt, Homo sapiens
cugaagcuaugaagaauaa

SEQ ID NO: 1408078 - RNA, 19 nt, Homo sapiens
gaaagcauggucuacaauu

SEQ ID NO: 1408079 - RNA, 19 nt, Homo sapiens
aaagaagacuggauuugga

SEQ ID NO: 1408080 - RNA, 19 nt, Homo sapiens
caguaaauccugaugguua

SEQ ID NO: 1408081 - RNA, 19 nt, Homo sapiens
gaagucugguauucuggua

SEQ ID NO: 1408082 - RNA, 19 nt, Homo sapiens
caagugacucugauguuua

SEQ ID NO: 1408083 - RNA, 19 nt, Homo sapiens
guucaguccuucuuaguga

SEQ ID NO: 1408084 - RNA, 19 nt, Homo sapiens
gucauugguugcauaauuu

SEQ ID NO: 1408085 - RNA, 19 nt, Homo sapiens
gaagcauucugaguugaaa

SEQ ID NO: 1408086 - RNA, 19 nt, Homo sapiens
gaacuucugggccuagauu

SEQ ID NO: 1408087 - RNA, 19 nt, Homo sapiens
ggaaaguaguggucauugg

SEQ ID NO: 1408088 - RNA, 19 nt, Homo sapiens
aaaguaaccuguuccucuu

SEQ ID NO: 1408089 - RNA, 19 nt, Homo sapiens
ccagauugauggaugaaau

SEQ ID NO: 1408090 - RNA, 19 nt, Homo sapiens
gagaagagggccugauuag

SEQ ID NO: 1408091 - RNA, 19 nt, Homo sapiens
gaagcugccugugcauaug

SEQ ID NO: 1408092 - RNA, 19 nt, Homo sapiens
gaacugaagcauucugagu

SEQ ID NO: 1408093 - RNA, 19 nt, Homo sapiens
ucaaaugguuguccugauc

SEQ ID NO: 1408094 - RNA, 19 nt, Homo sapiens
gaaaccccauuuaugauuu

SEQ ID NO: 1408095 - RNA, 19 nt, Homo sapiens
guuaaauucugaagcuaug

SEQ ID NO: 1408096 - RNA, 19 nt, Homo sapiens
acugaaaugucacacuuaa

SEQ ID NO: 1408097 - RNA, 19 nt, Homo sapiens
gaaauacauagaccuacaa

SEQ ID NO: 1408098 - RNA, 19 nt, Homo sapiens
acauagaccuacaacuuug

SEQ ID NO: 1408099 - RNA, 19 nt, Homo sapiens
aaagcauggucuacaauug

SEQ ID NO: 1408100 - RNA, 19 nt, Homo sapiens
cagcacugguucuguuauu

SEQ ID NO: 1408101 - RNA, 19 nt, Homo sapiens
uuuaggaacugaaauguca

SEQ ID NO: 1408102 - RNA, 19 nt, Homo sapiens
uacuagaucucagaaguuu

SEQ ID NO: 1408103 - RNA, 19 nt, Homo sapiens
gagcagagggaauaccuau

SEQ ID NO: 1408104 - RNA, 19 nt, Homo sapiens
auacauagaccuacaacuu

SEQ ID NO: 1408105 - RNA, 19 nt, Homo sapiens
ggagaaggaaauacauaga

SEQ ID NO: 1408106 - RNA, 19 nt, Homo sapiens
gaaaguaguggucauuggu

SEQ ID NO: 1408107 - RNA, 19 nt, Homo sapiens
guucugaagucugguauuc

SEQ ID NO: 1408108 - RNA, 19 nt, Homo sapiens
gaacagcgucugggaaagu

SEQ ID NO: 1408109 - RNA, 19 nt, Homo sapiens
caucaguuaugaggacuuu

SEQ ID NO: 1408110 - RNA, 19 nt, Homo sapiens
agaauggagcaguuuaaua

SEQ ID NO: 1408111 - RNA, 19 nt, Homo sapiens
cauauuauacccaaaguuc

SEQ ID NO: 1408112 - RNA, 19 nt, Homo sapiens
gcagagggaauaccuaucu

SEQ ID NO: 1408113 - RNA, 19 nt, Homo sapiens
gggagaagagggccugauu

SEQ ID NO: 1408114 - RNA, 19 nt, Homo sapiens
ugaaaugucacacuuaaag

SEQ ID NO: 1408115 - RNA, 19 nt, Homo sapiens
ucucugcccuucgucaaua

SEQ ID NO: 1408116 - RNA, 19 nt, Homo sapiens
uagcaaagaagacuggauu

SEQ ID NO: 1408117 - RNA, 19 nt, Homo sapiens
gagaagcugccugugcaua

SEQ ID NO: 1408118 - RNA, 19 nt, Homo sapiens
gaguguugcucugguauuc

SEQ ID NO: 1408119 - RNA, 19 nt, Homo sapiens
gaguguugcucugguauuc

SEQ ID NO: 1408120 - RNA, 19 nt, Homo sapiens
uacauagaccuacaacuuu

SEQ ID NO: 1408121 - RNA, 19 nt, Homo sapiens
ggaaagcauggucuacaau

SEQ ID NO: 1408122 - RNA, 19 nt, Homo sapiens
uggaaagcauggucuacaa

SEQ ID NO: 1408123 - RNA, 19 nt, Homo sapiens
acagagagcagcacugguu

SEQ ID NO: 1408124 - RNA, 19 nt, Homo sapiens
gggccuagauuguucaaaa

SEQ ID NO: 1408125 - RNA, 19 nt, Homo sapiens
aauacuagaucucagaagu

SEQ ID NO: 1408126 - RNA, 19 nt, Homo sapiens
agaaaacccuuaucaacaa

SEQ ID NO: 1408127 - RNA, 19 nt, Homo sapiens
gugaacagcgucugggaaa

SEQ ID NO: 1408128 - RNA, 19 nt, Homo sapiens
cuucagagcagagggaaua

SEQ ID NO: 1408129 - RNA, 19 nt, Homo sapiens
ucagauauccguccauuuu

SEQ ID NO: 1408130 - RNA, 19 nt, Homo sapiens
gagggaauaccuaucuuca

SEQ ID NO: 1408131 - RNA, 19 nt, Homo sapiens
ccaccaagguauuuucaaa

SEQ ID NO: 1408132 - RNA, 19 nt, Homo sapiens
gcaguuuaauacuagaucu

SEQ ID NO: 1408133 - RNA, 19 nt, Homo sapiens
uugauagacugcuuucaga

SEQ ID NO: 1408134 - RNA, 19 nt, Homo sapiens
aaacauuugagggaaguua

SEQ ID NO: 1408135 - RNA, 19 nt, Homo sapiens
uaacuccuacuacauugaa

SEQ ID NO: 1408136 - RNA, 19 nt, Homo sapiens
gcaccuaugaaacccugua

SEQ ID NO: 1408137 - RNA, 19 nt, Homo sapiens
aauaacuccuacuacauug

SEQ ID NO: 1408138 - RNA, 19 nt, Homo sapiens
cccagcuacuucccuauuu

SEQ ID NO: 1408139 - RNA, 19 nt, Homo sapiens
gacaaagaugaucaaguuu

SEQ ID NO: 1408140 - RNA, 19 nt, Homo sapiens
acugaagcauucugaguug

SEQ ID NO: 1408141 - RNA, 19 nt, Homo sapiens
uaugaaaccccauuuauga

SEQ ID NO: 1408142 - RNA, 19 nt, Homo sapiens
guuguuaaauucugaagcu

SEQ ID NO: 1408143 - RNA, 19 nt, Homo sapiens
ggagcaguuuaauacuaga

SEQ ID NO: 1408144 - RNA, 19 nt, Homo sapiens
uggagcaguuuaauacuag

SEQ ID NO: 1408145 - RNA, 19 nt, Homo sapiens
cuucagauauccguccauu

SEQ ID NO: 1408146 - RNA, 19 nt, Homo sapiens
auggagcaguuuaauacua

SEQ ID NO: 1408147 - RNA, 19 nt, Homo sapiens
gaaguuaccaaggcagcuu

SEQ ID NO: 1408148 - RNA, 19 nt, Homo sapiens
gcucacauguuaaaaucuu

SEQ ID NO: 1408149 - RNA, 19 nt, Homo sapiens
cagauugacugagauuguc

SEQ ID NO: 1408150 - RNA, 19 nt, Homo sapiens
gaagacuggauuuggaaag

SEQ ID NO: 1408151 - RNA, 19 nt, Homo sapiens
cagauugauggaugaaauu

SEQ ID NO: 1408152 - RNA, 19 nt, Homo sapiens
gcacugguucuguuauuuu

SEQ ID NO: 1408153 - RNA, 19 nt, Homo sapiens
ucugaagucugguauucug

SEQ ID NO: 1408154 - RNA, 19 nt, Homo sapiens
cagagggaauaccuaucuu

SEQ ID NO: 1408155 - RNA, 19 nt, Homo sapiens
cuuagugaccaaacuuuaa

SEQ ID NO: 1408156 - RNA, 19 nt, Homo sapiens
ucuggguucugaagauuau

SEQ ID NO: 1408157 - RNA, 19 nt, Homo sapiens
agucugguauucugguauu

SEQ ID NO: 1408158 - RNA, 19 nt, Homo sapiens
gagaaggaaauacauagac

SEQ ID NO: 1408159 - RNA, 19 nt, Homo sapiens
cauaugggccuggugauca

SEQ ID NO: 1408160 - RNA, 19 nt, Homo sapiens
uuagaauggagcaguuuaa

SEQ ID NO: 1408161 - RNA, 19 nt, Homo sapiens
gaagauggaaaagcagaua

SEQ ID NO: 1408162 - RNA, 19 nt, Homo sapiens
gucaauaugcagccuguga

SEQ ID NO: 1408163 - RNA, 19 nt, Homo sapiens
gaucucagaaguuuugaaa

SEQ ID NO: 1408164 - RNA, 19 nt, Homo sapiens
gcccagcuacuucccuauu

SEQ ID NO: 1408165 - RNA, 19 nt, Homo sapiens
gaacuaagcauuaugugaa

SEQ ID NO: 1408166 - RNA, 19 nt, Homo sapiens
gaacgccuguguuuacauu

SEQ ID NO: 1408167 - RNA, 19 nt, Homo sapiens
cagcguagauccaaacuga

SEQ ID NO: 1408168 - RNA, 19 nt, Homo sapiens
gcuauguucucauggauaa

SEQ ID NO: 1408169 - RNA, 19 nt, Homo sapiens
ccacuaacauauccaagaa

SEQ ID NO: 1408170 - RNA, 19 nt, Homo sapiens
gggcuuaaaucucaaacuu

SEQ ID NO: 1408171 - RNA, 19 nt, Homo sapiens
ccauuuaugucccuaguaa

SEQ ID NO: 1408172 - RNA, 19 nt, Homo sapiens
gcacauuggaaucucauua

SEQ ID NO: 1408173 - RNA, 19 nt, Homo sapiens
gagauuagcuaagaguaga

SEQ ID NO: 1408174 - RNA, 19 nt, Homo sapiens
ccagugagaaucagcauua

SEQ ID NO: 1408175 - RNA, 19 nt, Homo sapiens
gcagagaucagguuguuga

SEQ ID NO: 1408176 - RNA, 19 nt, Homo sapiens
caaaauagccuacaaaugu

SEQ ID NO: 1408177 - RNA, 19 nt, Homo sapiens
gaguagaaauucgagcaua

SEQ ID NO: 1408178 - RNA, 19 nt, Homo sapiens
ggaguugcauuuaucuuuc

SEQ ID NO: 1408179 - RNA, 19 nt, Homo sapiens
ucacguaguugaaggaguu

SEQ ID NO: 1408180 - RNA, 19 nt, Homo sapiens
ggaauucggauaccacaaa

SEQ ID NO: 1408181 - RNA, 19 nt, Homo sapiens
caaaggaucagggaacuaa

SEQ ID NO: 1408182 - RNA, 19 nt, Homo sapiens
gcauuacgcuagucucugu

SEQ ID NO: 1408183 - RNA, 19 nt, Homo sapiens
gcaggcgauugaaguaauu

SEQ ID NO: 1408184 - RNA, 19 nt, Homo sapiens
cuaagacaaucucagcuuu

SEQ ID NO: 1408185 - RNA, 19 nt, Homo sapiens
uuauggaacuagcagaaua

SEQ ID NO: 1408186 - RNA, 19 nt, Homo sapiens
ugaaggaguugcauuuauc

SEQ ID NO: 1408187 - RNA, 19 nt, Homo sapiens
gcaguggcaucgcuugguu

SEQ ID NO: 1408188 - RNA, 19 nt, Homo sapiens
cgucauuugucucuguuua

SEQ ID NO: 1408189 - RNA, 19 nt, Homo sapiens
ggaacuaagcauuauguga

SEQ ID NO: 1408190 - RNA, 19 nt, Homo sapiens
gaaggcaaccaugagauaa

SEQ ID NO: 1408191 - RNA, 19 nt, Homo sapiens
ccacaaggcuaaauaaaau

SEQ ID NO: 1408192 - RNA, 19 nt, Homo sapiens
gaucagggaacuaagcauu

SEQ ID NO: 1408193 - RNA, 19 nt, Homo sapiens
cagcuacccaugucaguua

SEQ ID NO: 1408194 - RNA, 19 nt, Homo sapiens
ggagcaggcgauugaagua

SEQ ID NO: 1408195 - RNA, 19 nt, Homo sapiens
caugacagguguaauuagu

SEQ ID NO: 1408196 - RNA, 19 nt, Homo sapiens
gcuaauugcuauguucuca

SEQ ID NO: 1408197 - RNA, 19 nt, Homo sapiens
caucuuguguuuaaagcaa

SEQ ID NO: 1408198 - RNA, 19 nt, Homo sapiens
ccagaauugucaugauguu

SEQ ID NO: 1408199 - RNA, 19 nt, Homo sapiens
gcaagucacagcaacugaa

SEQ ID NO: 1408200 - RNA, 19 nt, Homo sapiens
aggcaaccaugagauaaua

SEQ ID NO: 1408201 - RNA, 19 nt, Homo sapiens
ucagcugccuacaguuuaa

SEQ ID NO: 1408202 - RNA, 19 nt, Homo sapiens
uaauugcuauguucucaug

SEQ ID NO: 1408203 - RNA, 19 nt, Homo sapiens
gagaugccucacaccauua

SEQ ID NO: 1408204 - RNA, 19 nt, Homo sapiens
ugucaguuaucuccacuaa

SEQ ID NO: 1408205 - RNA, 19 nt, Homo sapiens
uaacuggccauccugguuu

SEQ ID NO: 1408206 - RNA, 19 nt, Homo sapiens
gaauugucaugauguuuac

SEQ ID NO: 1408207 - RNA, 19 nt, Homo sapiens
gacaaucuucuaucucaaa

SEQ ID NO: 1408208 - RNA, 19 nt, Homo sapiens
gcugaaacucggauuuaaa

SEQ ID NO: 1408209 - RNA, 19 nt, Homo sapiens
ucagggaacuaagcauuau

SEQ ID NO: 1408210 - RNA, 19 nt, Homo sapiens
gcugagcgggcaagcaaua

SEQ ID NO: 1408211 - RNA, 19 nt, Homo sapiens
ggacagaacagaguauuuu

SEQ ID NO: 1408212 - RNA, 19 nt, Homo sapiens
gcaaagcaagucacagcaa

SEQ ID NO: 1408213 - RNA, 19 nt, Homo sapiens
gaauauucauagcacuugu

SEQ ID NO: 1408214 - RNA, 19 nt, Homo sapiens
acaaacagcuaagacaauc

SEQ ID NO: 1408215 - RNA, 19 nt, Homo sapiens
gggcuuguauauauaaucu

SEQ ID NO: 1408216 - RNA, 19 nt, Homo sapiens
gaaacucggauuuaaagag

SEQ ID NO: 1408217 - RNA, 19 nt, Homo sapiens
gaaaauaaccggagaagac

SEQ ID NO: 1408218 - RNA, 19 nt, Homo sapiens
ucaagaguauggcacuguu

SEQ ID NO: 1408219 - RNA, 19 nt, Homo sapiens
gucaugauguuuacacugu

SEQ ID NO: 1408220 - RNA, 19 nt, Homo sapiens
gaauucaccagcaagaugu

SEQ ID NO: 1408221 - RNA, 19 nt, Homo sapiens
aaacugauggugaaaccua

SEQ ID NO: 1408222 - RNA, 19 nt, Homo sapiens
gcaaggucuuucagguaga

SEQ ID NO: 1408223 - RNA, 19 nt, Homo sapiens
augaagggcauauguguua

SEQ ID NO: 1408224 - RNA, 19 nt, Homo sapiens
agaaggcaaccaugagaua

SEQ ID NO: 1408225 - RNA, 19 nt, Homo sapiens
ccacaaacagcuaagacaa

SEQ ID NO: 1408226 - RNA, 19 nt, Homo sapiens
gcgagggucuguggguaaa

SEQ ID NO: 1408227 - RNA, 19 nt, Homo sapiens
caaggucuuucagguagaa

SEQ ID NO: 1408228 - RNA, 19 nt, Homo sapiens
guugacaguuccugguuga

SEQ ID NO: 1408229 - RNA, 19 nt, Homo sapiens
ucaccagucugcccuguca

SEQ ID NO: 1408230 - RNA, 19 nt, Homo sapiens
gcauauguguuagagagau

SEQ ID NO: 1408231 - RNA, 19 nt, Homo sapiens
gaucuaauuccaaggacuu

SEQ ID NO: 1408232 - RNA, 19 nt, Homo sapiens
gagcaggcgauugaaguaa

SEQ ID NO: 1408233 - RNA, 19 nt, Homo sapiens
ugagccagcuuuacccaau

SEQ ID NO: 1408234 - RNA, 19 nt, Homo sapiens
ugacagguguaauuagucu

SEQ ID NO: 1408235 - RNA, 19 nt, Homo sapiens
cagggagaggcuuguauua

SEQ ID NO: 1408236 - RNA, 19 nt, Homo sapiens
ggaauauucauagcacuug

SEQ ID NO: 1408237 - RNA, 19 nt, Homo sapiens
gacauucauuacauugguu

SEQ ID NO: 1408238 - RNA, 19 nt, Homo sapiens
guugucagcugccuacagu

SEQ ID NO: 1408239 - RNA, 19 nt, Homo sapiens
ccagcaagauguacagaac

SEQ ID NO: 1408240 - RNA, 19 nt, Homo sapiens
gcccuugauugucagauau

SEQ ID NO: 1408241 - RNA, 19 nt, Homo sapiens
uugaaggaguugcauuuau

SEQ ID NO: 1408242 - RNA, 19 nt, Homo sapiens
guugaaggaguugcauuua

SEQ ID NO: 1408243 - RNA, 19 nt, Homo sapiens
cacugaggcuucguccuua

SEQ ID NO: 1408244 - RNA, 19 nt, Homo sapiens
cacauuggaaucucauuaa

SEQ ID NO: 1408245 - RNA, 19 nt, Homo sapiens
gagagauuagcuaagagua

SEQ ID NO: 1408246 - RNA, 19 nt, Homo sapiens
cauauguguuagagagauu

SEQ ID NO: 1408247 - RNA, 19 nt, Homo sapiens
gagccagcuuuacccaaug

SEQ ID NO: 1408248 - RNA, 19 nt, Homo sapiens
gcuaagacaaucucagcuu

SEQ ID NO: 1408249 - RNA, 19 nt, Homo sapiens
ccagugcuacaauuaauga

SEQ ID NO: 1408250 - RNA, 19 nt, Homo sapiens
uacaugauuuggauugguu

SEQ ID NO: 1408251 - RNA, 19 nt, Homo sapiens
caagucacagcaacugaaa

SEQ ID NO: 1408252 - RNA, 19 nt, Homo sapiens
gagaagacaaggaggucaa

SEQ ID NO: 1408253 - RNA, 19 nt, Homo sapiens
gccagucucccauuuaugu

SEQ ID NO: 1408254 - RNA, 19 nt, Homo sapiens
gggcauauuuuacaugguu

SEQ ID NO: 1408255 - RNA, 19 nt, Homo sapiens
caaugaagggcauaugugu

SEQ ID NO: 1408256 - RNA, 19 nt, Homo sapiens
aaauagaaggcaaccauga

SEQ ID NO: 1408257 - RNA, 19 nt, Homo sapiens
gcugccagugcuacaauua

SEQ ID NO: 1408258 - RNA, 19 nt, Homo sapiens
aaaccuuaaugaacucuuc

SEQ ID NO: 1408259 - RNA, 19 nt, Homo sapiens
accauuaggugaugcuuug

SEQ ID NO: 1408260 - RNA, 19 nt, Homo sapiens
gagaacugaauaaaccauu

SEQ ID NO: 1408261 - RNA, 19 nt, Homo sapiens
gaagggcauauguguuaga

SEQ ID NO: 1408262 - RNA, 19 nt, Homo sapiens
ugacauucauuacauuggu

SEQ ID NO: 1408263 - RNA, 19 nt, Homo sapiens
gaaucagcauuacgcuagu

SEQ ID NO: 1408264 - RNA, 19 nt, Homo sapiens
gaacagaguauuuucaucu

SEQ ID NO: 1408265 - RNA, 19 nt, Homo sapiens
caacauaacucuaucagaa

SEQ ID NO: 1408266 - RNA, 19 nt, Homo sapiens
gagaggagcucaucaagaa

SEQ ID NO: 1408267 - RNA, 19 nt, Homo sapiens
gaagagaaaucaagcaaag

SEQ ID NO: 1408268 - RNA, 19 nt, Homo sapiens
ccaaagaccugccguggaa

SEQ ID NO: 1408269 - RNA, 19 nt, Homo sapiens
aagcaaagauugacaagaa

SEQ ID NO: 1408270 - RNA, 19 nt, Homo sapiens
cagaaggacugaugaagaa

SEQ ID NO: 1408271 - RNA, 19 nt, Homo sapiens
gaucauaaauucugaacuc

SEQ ID NO: 1408272 - RNA, 19 nt, Homo sapiens
gaagaaagaagagaaauca

SEQ ID NO: 1408273 - RNA, 19 nt, Homo sapiens
ggaggaggcuuggagcuuu

SEQ ID NO: 1408274 - RNA, 19 nt, Homo sapiens
acacacaggugcaaucuug

SEQ ID NO: 1408275 - RNA, 19 nt, Homo sapiens
cgucagcgcuggagaagaa

SEQ ID NO: 1408276 - RNA, 19 nt, Homo sapiens
acagugucauucaguauua

SEQ ID NO: 1408277 - RNA, 19 nt, Homo sapiens
guaaugaaauggagguaca

SEQ ID NO: 1408278 - RNA, 19 nt, Homo sapiens
cugaacgacuccauuauuu

SEQ ID NO: 1408279 - RNA, 19 nt, Homo sapiens
caaagaagcggcuggaugu

SEQ ID NO: 1408280 - RNA, 19 nt, Homo sapiens
uaaagggucuccaaagaag

SEQ ID NO: 1408281 - RNA, 19 nt, Homo sapiens
gaaguucagcucaagacua

SEQ ID NO: 1408282 - RNA, 19 nt, Homo sapiens
gagcuggagagaagaaaua

SEQ ID NO: 1408283 - RNA, 19 nt, Homo sapiens
guaaagggucuccaaagaa

SEQ ID NO: 1408284 - RNA, 19 nt, Homo sapiens
gaaaguaaagggucuccaa

SEQ ID NO: 1408285 - RNA, 19 nt, Homo sapiens
gcgcugaacgacuccauua

SEQ ID NO: 1408286 - RNA, 19 nt, Homo sapiens
aggagaaccugaucauaaa

SEQ ID NO: 1408287 - RNA, 19 nt, Homo sapiens
gauaaggcagcaauucgua

SEQ ID NO: 1408288 - RNA, 19 nt, Homo sapiens
uggaagagcuggagagaag

SEQ ID NO: 1408289 - RNA, 19 nt, Homo sapiens
aaggagaaccugaucauaa

SEQ ID NO: 1408290 - RNA, 19 nt, Homo sapiens
gcaaacaggaacuagaaga

SEQ ID NO: 1408291 - RNA, 19 nt, Homo sapiens
gaacgacuccauuauuucu

SEQ ID NO: 1408292 - RNA, 19 nt, Homo sapiens
uacccuaccugcuguguuu

SEQ ID NO: 1408293 - RNA, 19 nt, Homo sapiens
cuagaagaccggaacauuu

SEQ ID NO: 1408294 - RNA, 19 nt, Homo sapiens
gagacccacuguugaugaa

SEQ ID NO: 1408295 - RNA, 19 nt, Homo sapiens
gagaaccugaucauaaauu

SEQ ID NO: 1408296 - RNA, 19 nt, Homo sapiens
gaacaaggagaaccugauc

SEQ ID NO: 1408297 - RNA, 19 nt, Homo sapiens
aguaaagggucuccaaaga

SEQ ID NO: 1408298 - RNA, 19 nt, Homo sapiens
gcugaacgacuccauuauu

SEQ ID NO: 1408299 - RNA, 19 nt, Homo sapiens
ggagaacccagaugagaug

SEQ ID NO: 1408300 - RNA, 19 nt, Homo sapiens
gacccacuguugaugaauu

SEQ ID NO: 1408301 - RNA, 19 nt, Homo sapiens
gaacugccgcuaaggaauc

SEQ ID NO: 1408302 - RNA, 19 nt, Homo sapiens
guccucagcugcccacuug

SEQ ID NO: 1408303 - RNA, 19 nt, Homo sapiens
acaaaggaaugaucagaca

SEQ ID NO: 1408304 - RNA, 19 nt, Homo sapiens
gaagagcuggagagaagaa

SEQ ID NO: 1408305 - RNA, 19 nt, Homo sapiens
ggcagcagaucgagaugaa

SEQ ID NO: 1408306 - RNA, 19 nt, Homo sapiens
caguuaagacccaacauaa

SEQ ID NO: 1408307 - RNA, 19 nt, Homo sapiens
ugaggagugugaacuguug

SEQ ID NO: 1408308 - RNA, 19 nt, Homo sapiens
gcaaucuugaccacacuua

SEQ ID NO: 1408309 - RNA, 19 nt, Homo sapiens
caaaagcgcaggacuauga

SEQ ID NO: 1408310 - RNA, 19 nt, Homo sapiens
aaucagagacccacuguug

SEQ ID NO: 1408311 - RNA, 19 nt, Homo sapiens
ggaagaaagaagagaaauc

SEQ ID NO: 1408312 - RNA, 19 nt, Homo sapiens
gcaggaagaaagaagagaa

SEQ ID NO: 1408313 - RNA, 19 nt, Homo sapiens
cagaugagauggaccaaac

SEQ ID NO: 1408314 - RNA, 19 nt, Homo sapiens
ccagaaggacugaugaaga

SEQ ID NO: 1408315 - RNA, 19 nt, Homo sapiens
ucaguuaagacccaacaua

SEQ ID NO: 1408316 - RNA, 19 nt, Homo sapiens
ccacaggccauagagauuu

SEQ ID NO: 1408317 - RNA, 19 nt, Homo sapiens
gcagauaaggcagcaauuc

SEQ ID NO: 1408318 - RNA, 19 nt, Homo sapiens
gaggaggcuuggagcuuug

SEQ ID NO: 1408319 - RNA, 19 nt, Homo sapiens
gaacauucaucagggaacu

SEQ ID NO: 1408320 - RNA, 19 nt, Homo sapiens
gaacacugccacggaaaug

SEQ ID NO: 1408321 - RNA, 19 nt, Homo sapiens
ggacgaugcagccaagaug

SEQ ID NO: 1408322 - RNA, 19 nt, Homo sapiens
acauaacucuaucagaaga

SEQ ID NO: 1408323 - RNA, 19 nt, Homo sapiens
ugaccacacuuaccugcaa

SEQ ID NO: 1408324 - RNA, 19 nt, Homo sapiens
ggcagcaauucguaaagaa

SEQ ID NO: 1408325 - RNA, 19 nt, Homo sapiens
acaagaaagcuuaaucaga

SEQ ID NO: 1408326 - RNA, 19 nt, Homo sapiens
guugaugaauuaagagaca

SEQ ID NO: 1408327 - RNA, 19 nt, Homo sapiens
ugacaagaaagcuuaauca

SEQ ID NO: 1408328 - RNA, 19 nt, Homo sapiens
agacagagcaggaagaaag

SEQ ID NO: 1408329 - RNA, 19 nt, Homo sapiens
caaggagaaccugaucaua

SEQ ID NO: 1408330 - RNA, 19 nt, Homo sapiens
uaaggaaucugaggagaac

SEQ ID NO: 1408331 - RNA, 19 nt, Homo sapiens
cacacuuccuuccuucuuu

SEQ ID NO: 1408332 - RNA, 19 nt, Homo sapiens
cugagaagaauuuguguuu

SEQ ID NO: 1408333 - RNA, 19 nt, Homo sapiens
caacgucagcgcuggagaa

SEQ ID NO: 1408334 - RNA, 19 nt, Homo sapiens
caaggaagagaaaguaaag

SEQ ID NO: 1408335 - RNA, 19 nt, Homo sapiens
ucaaggaagagaaaguaaa

SEQ ID NO: 1408336 - RNA, 19 nt, Homo sapiens
ugauacgauucagugauua

SEQ ID NO: 1408337 - RNA, 19 nt, Homo sapiens
gcaaagauugacaagaaag

SEQ ID NO: 1408338 - RNA, 19 nt, Homo sapiens
agaugaagcuuuccaaacg

SEQ ID NO: 1408339 - RNA, 19 nt, Homo sapiens
gaaauggagguacaugcau

SEQ ID NO: 1408340 - RNA, 19 nt, Homo sapiens
ugaaacaaaggaaugauca

SEQ ID NO: 1408341 - RNA, 19 nt, Homo sapiens
gagaugaagcuuuccaaac

SEQ ID NO: 1408342 - RNA, 19 nt, Homo sapiens
ggacugaugaagaaagaca

SEQ ID NO: 1408343 - RNA, 19 nt, Homo sapiens
ugagcucucccaagccuua

SEQ ID NO: 1408344 - RNA, 19 nt, Homo sapiens
acacuuccuuccuucuuug

SEQ ID NO: 1408345 - RNA, 19 nt, Homo sapiens
uaaggcagcaauucguaaa

SEQ ID NO: 1408346 - RNA, 19 nt, Homo sapiens
acccacuguugaugaauua

SEQ ID NO: 1408347 - RNA, 19 nt, Homo sapiens
aagcaaacaggaacuagaa

SEQ ID NO: 1408348 - RNA, 19 nt, Homo sapiens
gaucuucaaacccuggaaa

SEQ ID NO: 1408349 - RNA, 19 nt, Homo sapiens
aaacaaaggaaugaucaga

SEQ ID NO: 1408350 - RNA, 19 nt, Homo sapiens
uaucuggucucagggauuc

SEQ ID NO: 1408351 - RNA, 19 nt, Homo sapiens
gaaccacccacucccaagu

SEQ ID NO: 1408352 - RNA, 19 nt, Homo sapiens
gaaggacugaugaagaaag

SEQ ID NO: 1408353 - RNA, 19 nt, Homo sapiens
caagcaaacaggaacuaga

SEQ ID NO: 1408354 - RNA, 19 nt, Homo sapiens
cgagaggagcucaucaaga

SEQ ID NO: 1408355 - RNA, 19 nt, Homo sapiens
ggaacacugccacggaaau

SEQ ID NO: 1408356 - RNA, 19 nt, Homo sapiens
agaaccugaucauaaauuc

SEQ ID NO: 1408357 - RNA, 19 nt, Homo sapiens
gcgaacugccgcuaaggaa

SEQ ID NO: 1408358 - RNA, 19 nt, Homo sapiens
ugacaggagggcagacaaa

SEQ ID NO: 1408359 - RNA, 19 nt, Homo sapiens
agauugacaagaaagcuua

SEQ ID NO: 1408360 - RNA, 19 nt, Homo sapiens
gaacuagaagaccggaaca

SEQ ID NO: 1408361 - RNA, 19 nt, Homo sapiens
uaaggaaccggccaagcaa

SEQ ID NO: 1408362 - RNA, 19 nt, Homo sapiens
uuccaagccuccagcauga

SEQ ID NO: 1408363 - RNA, 19 nt, Homo sapiens
gcucaagacuacccuaccu

SEQ ID NO: 1408364 - RNA, 19 nt, Homo sapiens
cgagaugaagcuuuccaaa

SEQ ID NO: 1408365 - RNA, 19 nt, Homo sapiens
ggaaagaucagcagaaaua

SEQ ID NO: 1408366 - RNA, 19 nt, Homo sapiens
ugagugaccuuaacauuua

SEQ ID NO: 1408367 - RNA, 19 nt, Homo sapiens
ggaagcaacuuuauucuau

SEQ ID NO: 1408368 - RNA, 19 nt, Homo sapiens
gcaaagcauucaagaguuu

SEQ ID NO: 1408369 - RNA, 19 nt, Homo sapiens
gcuaggagauauaggauuu

SEQ ID NO: 1408370 - RNA, 19 nt, Homo sapiens
ggaauacugugcagacuug

SEQ ID NO: 1408371 - RNA, 19 nt, Homo sapiens
gcaaggaaauaaucuaucu

SEQ ID NO: 1408372 - RNA, 19 nt, Homo sapiens
ugagaaugcugaauacaaa

SEQ ID NO: 1408373 - RNA, 19 nt, Homo sapiens
gaacagaacaugugccaau

SEQ ID NO: 1408374 - RNA, 19 nt, Homo sapiens
ugaagugccuaccuuuaua

SEQ ID NO: 1408375 - RNA, 19 nt, Homo sapiens
ucucagaacuugaccauga

SEQ ID NO: 1408376 - RNA, 19 nt, Homo sapiens
gaaccacgcccuacuguug

SEQ ID NO: 1408377 - RNA, 19 nt, Homo sapiens
gaacuugaccaugaagaua

SEQ ID NO: 1408378 - RNA, 19 nt, Homo sapiens
gugccuaccuuuauaugua

SEQ ID NO: 1408379 - RNA, 19 nt, Homo sapiens
gauauaggauuucuacucu

SEQ ID NO: 1408380 - RNA, 19 nt, Homo sapiens
aaagagcaaugacuagauu

SEQ ID NO: 1408381 - RNA, 19 nt, Homo sapiens
caagaaagagcaaugacua

SEQ ID NO: 1408382 - RNA, 19 nt, Homo sapiens
ggugugaagugaauuucua

SEQ ID NO: 1408383 - RNA, 19 nt, Homo sapiens
gaacauuggaaauagauga

SEQ ID NO: 1408384 - RNA, 19 nt, Homo sapiens
gaauacaacagaaagaguu

SEQ ID NO: 1408385 - RNA, 19 nt, Homo sapiens
gaucuugccuggaauaaaa

SEQ ID NO: 1408386 - RNA, 19 nt, Homo sapiens
caaggaagcaacuuuauuc

SEQ ID NO: 1408387 - RNA, 19 nt, Homo sapiens
gaaacaggcaggaaagaau

SEQ ID NO: 1408388 - RNA, 19 nt, Homo sapiens
ggaagaguaauguaauuga

SEQ ID NO: 1408389 - RNA, 19 nt, Homo sapiens
gauaaugugucagguggaa

SEQ ID NO: 1408390 - RNA, 19 nt, Homo sapiens
ccaauuacacuguggcuaa

SEQ ID NO: 1408391 - RNA, 19 nt, Homo sapiens
caauuaagauacugacauc

SEQ ID NO: 1408392 - RNA, 19 nt, Homo sapiens
gaaagaauugcuccaagga

SEQ ID NO: 1408393 - RNA, 19 nt, Homo sapiens
ggaguucacugauuguuuu

SEQ ID NO: 1408394 - RNA, 19 nt, Homo sapiens
gcagacacuucacuuccaa

SEQ ID NO: 1408395 - RNA, 19 nt, Homo sapiens
guaucaaguuccacaggua

SEQ ID NO: 1408396 - RNA, 19 nt, Homo sapiens
ccuaagaguuuacuaugug

SEQ ID NO: 1408397 - RNA, 19 nt, Homo sapiens
acacaaggaagcaacuuua

SEQ ID NO: 1408398 - RNA, 19 nt, Homo sapiens
ugaguuccuugaucuuuaa

SEQ ID NO: 1408399 - RNA, 19 nt, Homo sapiens
ugacuagauugcuuuguga

SEQ ID NO: 1408400 - RNA, 19 nt, Homo sapiens
ugaaugaguuccuugaucu

SEQ ID NO: 1408401 - RNA, 19 nt, Homo sapiens
gaaacaaucaaacaaagca

SEQ ID NO: 1408402 - RNA, 19 nt, Homo sapiens
gugagugaccuuaacauuu

SEQ ID NO: 1408403 - RNA, 19 nt, Homo sapiens
aauaguagauggguucauu

SEQ ID NO: 1408404 - RNA, 19 nt, Homo sapiens
gaaagagcaaugacuagau

SEQ ID NO: 1408405 - RNA, 19 nt, Homo sapiens
uaaaaugccucuacucaga

SEQ ID NO: 1408406 - RNA, 19 nt, Homo sapiens
agucagaacuagaauuguu

SEQ ID NO: 1408407 - RNA, 19 nt, Homo sapiens
gaagaguaauguaauugac

SEQ ID NO: 1408408 - RNA, 19 nt, Homo sapiens
gaccccaucuggaguauua

SEQ ID NO: 1408409 - RNA, 19 nt, Homo sapiens
aaggaaagaucagcagaaa

SEQ ID NO: 1408410 - RNA, 19 nt, Homo sapiens
uaaccuaccugccaguaag

SEQ ID NO: 1408411 - RNA, 19 nt, Homo sapiens
gcacauucagggaagagua

SEQ ID NO: 1408412 - RNA, 19 nt, Homo sapiens
aauaaucuaucucccagaa

SEQ ID NO: 1408413 - RNA, 19 nt, Homo sapiens
gaaguugguccugcucuuu

SEQ ID NO: 1408414 - RNA, 19 nt, Homo sapiens
ccaaauagaagccaguuca

SEQ ID NO: 1408415 - RNA, 19 nt, Homo sapiens
uugcguaccuccuauauuc

SEQ ID NO: 1408416 - RNA, 19 nt, Homo sapiens
ggagauauaggauuucuac

SEQ ID NO: 1408417 - RNA, 19 nt, Homo sapiens
ccauaagccuacaauagau

SEQ ID NO: 1408418 - RNA, 19 nt, Homo sapiens
gauauugaucugacugaaa

SEQ ID NO: 1408419 - RNA, 19 nt, Homo sapiens
gaagugccuaccuuuauau

SEQ ID NO: 1408420 - RNA, 19 nt, Homo sapiens
ggagugaauacaacagaaa

SEQ ID NO: 1408421 - RNA, 19 nt, Homo sapiens
guagagacacgcuccagaa

SEQ ID NO: 1408422 - RNA, 19 nt, Homo sapiens
caccaucucuucuuugagu

SEQ ID NO: 1408423 - RNA, 19 nt, Homo sapiens
uaccuguacuugcagauaa

SEQ ID NO: 1408424 - RNA, 19 nt, Homo sapiens
uaaucuaucucccagaaca

SEQ ID NO: 1408425 - RNA, 19 nt, Homo sapiens
cacaccaucucuucuuuga

SEQ ID NO: 1408426 - RNA, 19 nt, Homo sapiens
uaaguaggaugggagaaug

SEQ ID NO: 1408427 - RNA, 19 nt, Homo sapiens
gaaacgcaaggaaauaauc

SEQ ID NO: 1408428 - RNA, 19 nt, Homo sapiens
guacaagaaagagcaauga

SEQ ID NO: 1408429 - RNA, 19 nt, Homo sapiens
aaagucagaacuagaauug

SEQ ID NO: 1408430 - RNA, 19 nt, Homo sapiens
uaaugugucagguggaaua

SEQ ID NO: 1408431 - RNA, 19 nt, Homo sapiens
aagaauugcuccaaggaau

SEQ ID NO: 1408432 - RNA, 19 nt, Homo sapiens
ggcuaagacucucaaagug

SEQ ID NO: 1408433 - RNA, 19 nt, Homo sapiens
caucuggaguauuaauguu

SEQ ID NO: 1408434 - RNA, 19 nt, Homo sapiens
aaacaggcaggaaagaauu

SEQ ID NO: 1408435 - RNA, 19 nt, Homo sapiens
caucuucaccaucaauaaa

SEQ ID NO: 1408436 - RNA, 19 nt, Homo sapiens
uaugaagugccuaccuuua

SEQ ID NO: 1408437 - RNA, 19 nt, Homo sapiens
uaaagugggaaaugaaguu

SEQ ID NO: 1408438 - RNA, 19 nt, Homo sapiens
ucagggaagaguaauguaa

SEQ ID NO: 1408439 - RNA, 19 nt, Homo sapiens
aguauagacuguuggaguu

SEQ ID NO: 1408440 - RNA, 19 nt, Homo sapiens
cccauaagccuacaauaga

SEQ ID NO: 1408441 - RNA, 19 nt, Homo sapiens
gccuaagaguuuacuaugu

SEQ ID NO: 1408442 - RNA, 19 nt, Homo sapiens
ggaaacgcaaggaaauaau

SEQ ID NO: 1408443 - RNA, 19 nt, Homo sapiens
agacuugccuccuccauac

SEQ ID NO: 1408444 - RNA, 19 nt, Homo sapiens
ccuccuauauucugcaaau

SEQ ID NO: 1408445 - RNA, 19 nt, Homo sapiens
ucaacaccgucuccuccua

SEQ ID NO: 1408446 - RNA, 19 nt, Homo sapiens
aaacggaaaggaaagauca

SEQ ID NO: 1408447 - RNA, 19 nt, Homo sapiens
gcaaaucuuacugcuguga

SEQ ID NO: 1408448 - RNA, 19 nt, Homo sapiens
augaguuccuugaucuuua

SEQ ID NO: 1408449 - RNA, 19 nt, Homo sapiens
gauacugacaucaaauugu

SEQ ID NO: 1408450 - RNA, 19 nt, Homo sapiens
uggaucagaauaaagguua

SEQ ID NO: 1408451 - RNA, 19 nt, Homo sapiens
uaggaugggagaaugauuu

SEQ ID NO: 1408452 - RNA, 19 nt, Homo sapiens
caaagcauuuuaaggugua

SEQ ID NO: 1408453 - RNA, 19 nt, Homo sapiens
ucauugggccucagaaguu

SEQ ID NO: 1408454 - RNA, 19 nt, Homo sapiens
acaaggaagcaacuuuauu

SEQ ID NO: 1408455 - RNA, 19 nt, Homo sapiens
gggaagaguaauguaauug

SEQ ID NO: 1408456 - RNA, 19 nt, Homo sapiens
ggaaccacauuuuaagaga

SEQ ID NO: 1408457 - RNA, 19 nt, Homo sapiens
agaauugcuccaaggaaua

SEQ ID NO: 1408458 - RNA, 19 nt, Homo sapiens
caacaccgucuccuccuau

SEQ ID NO: 1408459 - RNA, 19 nt, Homo sapiens
aagaagaucuaaguaggau

SEQ ID NO: 1408460 - RNA, 19 nt, Homo sapiens
aaaugccucuacucagaaa

SEQ ID NO: 1408461 - RNA, 19 nt, Homo sapiens
uuucucaucuucaccauca

SEQ ID NO: 1408462 - RNA, 19 nt, Homo sapiens
gaucuuuaagcacugauga

SEQ ID NO: 1408463 - RNA, 19 nt, Homo sapiens
caagaauuuugcugaauga

SEQ ID NO: 1408464 - RNA, 19 nt, Homo sapiens
agggaagaguaauguaauu

SEQ ID NO: 1408465 - RNA, 19 nt, Homo sapiens
acaaaugucuucaggcuua

SEQ ID NO: 1408466 - RNA, 19 nt, Homo sapiens
cuaagucauucccaaauua

SEQ ID NO: 1408467 - RNA, 19 nt, Homo sapiens
ggauguggcuucucaugaa

SEQ ID NO: 1408468 - RNA, 19 nt, Homo sapiens
ggacggagcugccauugcu

SEQ ID NO: 1408469 - RNA, 19 nt, Homo sapiens
gagcugccauugcugcuuu

SEQ ID NO: 1408470 - RNA, 19 nt, Homo sapiens
cauccugguuuccaucuuu

SEQ ID NO: 1408471 - RNA, 19 nt, Homo sapiens
ucuaagucauucccaaauu

SEQ ID NO: 1408472 - RNA, 19 nt, Homo sapiens
cugcuucacuuucagguuu

SEQ ID NO: 1408473 - RNA, 19 nt, Homo sapiens
cuacuggaguucuucauca

SEQ ID NO: 1408474 - RNA, 19 nt, Homo sapiens
uaugaugccuucaagaucu

SEQ ID NO: 1408475 - RNA, 19 nt, Homo sapiens
ucagugccaucaucaucuu

SEQ ID NO: 1408476 - RNA, 19 nt, Homo sapiens
gaaucuggaccucuaaguc

SEQ ID NO: 1408477 - RNA, 19 nt, Homo sapiens
cuccaucucugccuacaug

SEQ ID NO: 1408478 - RNA, 19 nt, Homo sapiens
agacgucacuggggacuua

SEQ ID NO: 1408479 - RNA, 19 nt, Homo sapiens
acagcagucuggccugaga

SEQ ID NO: 1408480 - RNA, 19 nt, Homo sapiens
ggacaguggagcccagaca

SEQ ID NO: 1408481 - RNA, 19 nt, Homo sapiens
gaugcucagugcucgagau

SEQ ID NO: 1408482 - RNA, 19 nt, Homo sapiens
ucccagcuccucccaguuu

SEQ ID NO: 1408483 - RNA, 19 nt, Homo sapiens
ccuaugaugccuucaagau

SEQ ID NO: 1408484 - RNA, 19 nt, Homo sapiens
aaucuggaccucuaaguca

SEQ ID NO: 1408485 - RNA, 19 nt, Homo sapiens
uccaggauguggcuucuca

SEQ ID NO: 1408486 - RNA, 19 nt, Homo sapiens
gcccugacccucaucaucu

SEQ ID NO: 1408487 - RNA, 19 nt, Homo sapiens
ggaaucuggaccucuaagu

SEQ ID NO: 1408488 - RNA, 19 nt, Homo sapiens
gcaucauccugguuuccau

SEQ ID NO: 1408489 - RNA, 19 nt, Homo sapiens
ccucuaagucauucccaaa

SEQ ID NO: 1408490 - RNA, 19 nt, Homo sapiens
gaauuaacuggcccugucu

SEQ ID NO: 1408491 - RNA, 19 nt, Homo sapiens
ggugggcccuacgaagaug

SEQ ID NO: 1408492 - RNA, 19 nt, Homo sapiens
caaaugucuucaggcuuag

SEQ ID NO: 1408493 - RNA, 19 nt, Homo sapiens
ucuaugccacccaguacua

SEQ ID NO: 1408494 - RNA, 19 nt, Homo sapiens
uuucagguuucucgaagug

SEQ ID NO: 1408495 - RNA, 19 nt, Homo sapiens
ggaguucuucaucacacuu

SEQ ID NO: 1408496 - RNA, 19 nt, Homo sapiens
ggagagagcugucuucaug

SEQ ID NO: 1408497 - RNA, 19 nt, Homo sapiens
gaaugaagcucuguuagaa

SEQ ID NO: 1408498 - RNA, 19 nt, Homo sapiens
ggaaggagaucagcacuaa

SEQ ID NO: 1408499 - RNA, 19 nt, Homo sapiens
ggacacacccuccaaauuc

SEQ ID NO: 1408500 - RNA, 19 nt, Homo sapiens
ggaacgacgugguguaugu

SEQ ID NO: 1408501 - RNA, 19 nt, Homo sapiens
gagauuauggcuuuguuua

SEQ ID NO: 1408502 - RNA, 19 nt, Homo sapiens
gcugggaacuuucauccua

SEQ ID NO: 1408503 - RNA, 19 nt, Homo sapiens
uuacaagggucaugaaaga

SEQ ID NO: 1408504 - RNA, 19 nt, Homo sapiens
gaagagacaauaaagaugu

SEQ ID NO: 1408505 - RNA, 19 nt, Homo sapiens
gcaacgaggucaaggagau

SEQ ID NO: 1408506 - RNA, 19 nt, Homo sapiens
gaaggaagcggccucauca

SEQ ID NO: 1408507 - RNA, 19 nt, Homo sapiens
gaagcggccucaucaaugg

SEQ ID NO: 1408508 - RNA, 19 nt, Homo sapiens
gagaugcugucaacucaga

SEQ ID NO: 1408509 - RNA, 19 nt, Homo sapiens
ggaugaaccuggacuuugg

SEQ ID NO: 1408510 - RNA, 19 nt, Homo sapiens
gcuuugagauccugaacaa

SEQ ID NO: 1408511 - RNA, 19 nt, Homo sapiens
caucauagacaucugcuuu

SEQ ID NO: 1408512 - RNA, 19 nt, Homo sapiens
gaagaggacaucauagaca

SEQ ID NO: 1408513 - RNA, 19 nt, Homo sapiens
gauuauggcuuuguuuaca

SEQ ID NO: 1408514 - RNA, 19 nt, Homo sapiens
caugcgagauuauggcuuu

SEQ ID NO: 1408515 - RNA, 19 nt, Homo sapiens
gaacgaccacaucaccuuu

SEQ ID NO: 1408516 - RNA, 19 nt, Homo sapiens
ggaagcggccucaucaaug

SEQ ID NO: 1408517 - RNA, 19 nt, Homo sapiens
caacguggauaggaacuug

SEQ ID NO: 1408518 - RNA, 19 nt, Homo sapiens
gaguauaucaugcgagauu

SEQ ID NO: 1408519 - RNA, 19 nt, Homo sapiens
caagagccuguaucacuua

SEQ ID NO: 1408520 - RNA, 19 nt, Homo sapiens
gcgggcagccugugaagua

SEQ ID NO: 1408521 - RNA, 19 nt, Homo sapiens
gggaagagacaauaaagau

SEQ ID NO: 1408522 - RNA, 19 nt, Homo sapiens
caacagcaacgaugacaau

SEQ ID NO: 1408523 - RNA, 19 nt, Homo sapiens
gaacuuucauccuacuuuu

SEQ ID NO: 1408524 - RNA, 19 nt, Homo sapiens
cugcagagcuccaggaaca

SEQ ID NO: 1408525 - RNA, 19 nt, Homo sapiens
ggaacuuucauccuacuuu

SEQ ID NO: 1408526 - RNA, 19 nt, Homo sapiens
ggaagagacaauaaagaug

SEQ ID NO: 1408527 - RNA, 19 nt, Homo sapiens
ccaccuggcuccuuucuac

SEQ ID NO: 1408528 - RNA, 19 nt, Homo sapiens
gacacacccuccaaauuca

SEQ ID NO: 1408529 - RNA, 19 nt, Homo sapiens
gaccaucgauacguacuau

SEQ ID NO: 1408530 - RNA, 19 nt, Homo sapiens
ggucuucgccucuguuaug

SEQ ID NO: 1408531 - RNA, 19 nt, Homo sapiens
gagccuguaucacuuaaag

SEQ ID NO: 1408532 - RNA, 19 nt, Homo sapiens
acaagagccuguaucacuu

SEQ ID NO: 1408533 - RNA, 19 nt, Homo sapiens
auagacaucugcuuugaga

SEQ ID NO: 1408534 - RNA, 19 nt, Homo sapiens
ccucaucaaugggcagaua

SEQ ID NO: 1408535 - RNA, 19 nt, Homo sapiens
gguccaugcugguccuaaa

SEQ ID NO: 1408536 - RNA, 19 nt, Homo sapiens
ucauagacaucugcuuuga

SEQ ID NO: 1408537 - RNA, 19 nt, Homo sapiens
aaauucaacuggaccucua

SEQ ID NO: 1408538 - RNA, 19 nt, Homo sapiens
uggaaugagugcuggauga

SEQ ID NO: 1408539 - RNA, 19 nt, Homo sapiens
caagggucaugaaagauuc

SEQ ID NO: 1408540 - RNA, 19 nt, Homo sapiens
ugaaugaagcucuguuaga

SEQ ID NO: 1408541 - RNA, 19 nt, Homo sapiens
ggaaggaagcggccucauc

SEQ ID NO: 1408542 - RNA, 19 nt, Homo sapiens
agagagcugucuucaugaa

SEQ ID NO: 1408543 - RNA, 19 nt, Homo sapiens
ugaccgaaaugccgagaug

SEQ ID NO: 1408544 - RNA, 19 nt, Homo sapiens
ucaaugggcagauagcaaa

SEQ ID NO: 1408545 - RNA, 19 nt, Homo sapiens
ucuguuaugugcaccguaa

SEQ ID NO: 1408546 - RNA, 19 nt, Homo sapiens
cuggagcgcuucugauuuc

SEQ ID NO: 1408547 - RNA, 19 nt, Homo sapiens
gcgagauuauggcuuuguu

SEQ ID NO: 1408548 - RNA, 19 nt, Homo sapiens
cuacagcaauuacagaaac

SEQ ID NO: 1408549 - RNA, 19 nt, Homo sapiens
ggagaucagcacuaagaug

SEQ ID NO: 1408550 - RNA, 19 nt, Homo sapiens
ccgagaugcugucaacuca

SEQ ID NO: 1408551 - RNA, 19 nt, Homo sapiens
caaaggcuacaaggacaua

SEQ ID NO: 1408552 - RNA, 19 nt, Homo sapiens
cuucugauuucaccauuga

SEQ ID NO: 1408553 - RNA, 19 nt, Homo sapiens
ggugaacgccgaugaaguc

SEQ ID NO: 1408554 - RNA, 19 nt, Homo sapiens
gaccagcgccagagcauca

SEQ ID NO: 1408555 - RNA, 19 nt, Homo sapiens
ucaguccucuggaguggaa

SEQ ID NO: 1408556 - RNA, 19 nt, Homo sapiens
ugaacaagagccuguauca

SEQ ID NO: 1408557 - RNA, 19 nt, Homo sapiens
guuugaagaggacaucaua

SEQ ID NO: 1408558 - RNA, 19 nt, Homo sapiens
gcgcugagaguccauguca

SEQ ID NO: 1408559 - RNA, 19 nt, Homo sapiens
gggcgaggacuacuccaaa

SEQ ID NO: 1408560 - RNA, 19 nt, Homo sapiens
acaagggucaugaaagauu

SEQ ID NO: 1408561 - RNA, 19 nt, Homo sapiens
ccauuacacucugaaaaua

SEQ ID NO: 1408562 - RNA, 19 nt, Homo sapiens
gacccgagccacauucuuc

SEQ ID NO: 1408563 - RNA, 19 nt, Homo sapiens
aaggagaucagcacuaaga

SEQ ID NO: 1408564 - RNA, 19 nt, Homo sapiens
gcugucaacucagaaacga

SEQ ID NO: 1408565 - RNA, 19 nt, Homo sapiens
ccaucgauacguacuauga

SEQ ID NO: 1408566 - RNA, 19 nt, Homo sapiens
aaugaaugaagcucuguua

SEQ ID NO: 1408567 - RNA, 19 nt, Homo sapiens
cuacaaguacccagaagga

SEQ ID NO: 1408568 - RNA, 19 nt, Homo sapiens
gaacuugaccaucgauacg

SEQ ID NO: 1408569 - RNA, 19 nt, Homo sapiens
gggaaggagaucagcacua

SEQ ID NO: 1408570 - RNA, 19 nt, Homo sapiens
cuaccugccaagugaaaua

SEQ ID NO: 1408571 - RNA, 19 nt, Homo sapiens
ggagaucaaaggcuacaag

SEQ ID NO: 1408572 - RNA, 19 nt, Homo sapiens
gagagagcugucuucauga

SEQ ID NO: 1408573 - RNA, 19 nt, Homo sapiens
aaagaucucccaccaggau

SEQ ID NO: 1408574 - RNA, 19 nt, Homo sapiens
ucagaaacgagacaaaaua

SEQ ID NO: 1408575 - RNA, 19 nt, Homo sapiens
gaaugaaugaagcucuguu

SEQ ID NO: 1408576 - RNA, 19 nt, Homo sapiens
gaaacgagacaaaauaugg

SEQ ID NO: 1408577 - RNA, 19 nt, Homo sapiens
gguggugagugccaugauc

SEQ ID NO: 1408578 - RNA, 19 nt, Homo sapiens
aagaggacaucauagacau

SEQ ID NO: 1408579 - RNA, 19 nt, Homo sapiens
aguauaucaugcgagauua

SEQ ID NO: 1408580 - RNA, 19 nt, Homo sapiens
gcaauuacagaaacaagcu

SEQ ID NO: 1408581 - RNA, 19 nt, Homo sapiens
gaaauccuggcccacaaca

SEQ ID NO: 1408582 - RNA, 19 nt, Homo sapiens
gcaguuauuggccauuaca

SEQ ID NO: 1408583 - RNA, 19 nt, Homo sapiens
gccuguaucacuuaaagaa

SEQ ID NO: 1408584 - RNA, 19 nt, Homo sapiens
gcagcaacgaggucaagga

SEQ ID NO: 1408585 - RNA, 19 nt, Homo sapiens
gcggaugaaccuggacuuu

SEQ ID NO: 1408586 - RNA, 19 nt, Homo sapiens
cccguguuguuuccaauuu

SEQ ID NO: 1408587 - RNA, 19 nt, Homo sapiens
cggacacacccuccaaauu

SEQ ID NO: 1408588 - RNA, 19 nt, Homo sapiens
ggaaugagugcuggaugau

SEQ ID NO: 1408589 - RNA, 19 nt, Homo sapiens
ggaacuugaccaucgauac

SEQ ID NO: 1408590 - RNA, 19 nt, Homo sapiens
uuugagauccugaacaaga

SEQ ID NO: 1408591 - RNA, 19 nt, Homo sapiens
ccaccucuguccucucucu

SEQ ID NO: 1408592 - RNA, 19 nt, Homo sapiens
gaggagagagcugucuuca

SEQ ID NO: 1408593 - RNA, 19 nt, Homo sapiens
ucaccagcuccuacaagua

SEQ ID NO: 1408594 - RNA, 19 nt, Homo sapiens
gcaccguaaugagaugcuu

SEQ ID NO: 1408595 - RNA, 19 nt, Homo sapiens
ggcgaggacuacuccaaag

SEQ ID NO: 1408596 - RNA, 19 nt, Homo sapiens
gaagaaaugccucagcuua

SEQ ID NO: 1408597 - RNA, 19 nt, Homo sapiens
ucaaagaccugcauaguag

SEQ ID NO: 1408598 - RNA, 19 nt, Homo sapiens
gacacaagcuuggaaauau

SEQ ID NO: 1408599 - RNA, 19 nt, Homo sapiens
gcagaaccuucacuugcaa

SEQ ID NO: 1408600 - RNA, 19 nt, Homo sapiens
gaugucaccuaccuguuga

SEQ ID NO: 1408601 - RNA, 19 nt, Homo sapiens
agauacggcugcuucagua

SEQ ID NO: 1408602 - RNA, 19 nt, Homo sapiens
ggcaaaugcugaauauucu

SEQ ID NO: 1408603 - RNA, 19 nt, Homo sapiens
ggaugucaccuaccuguug

SEQ ID NO: 1408604 - RNA, 19 nt, Homo sapiens
guaggaauuaucuguauga

SEQ ID NO: 1408605 - RNA, 19 nt, Homo sapiens
acacaagcuuggaaauaug

SEQ ID NO: 1408606 - RNA, 19 nt, Homo sapiens
agacacaagcuuggaaaua

SEQ ID NO: 1408607 - RNA, 19 nt, Homo sapiens
ggcagaaccuucacuugca

SEQ ID NO: 1408608 - RNA, 19 nt, Homo sapiens
gaaaugccucagcuuacaa

SEQ ID NO: 1408609 - RNA, 19 nt, Homo sapiens
caucaucggcugucuugaa

SEQ ID NO: 1408610 - RNA, 19 nt, Homo sapiens
gcccugauuugcuuuguca

SEQ ID NO: 1408611 - RNA, 19 nt, Homo sapiens
caacguggcacuccuccuu

SEQ ID NO: 1408612 - RNA, 19 nt, Homo sapiens
agaaaugccucagcuuaca

SEQ ID NO: 1408613 - RNA, 19 nt, Homo sapiens
uggcaaaugcugaauauuc

SEQ ID NO: 1408614 - RNA, 19 nt, Homo sapiens
ggagcccucugcagcuguu

SEQ ID NO: 1408615 - RNA, 19 nt, Homo sapiens
gagauacggcugcuucagu

SEQ ID NO: 1408616 - RNA, 19 nt, Homo sapiens
cagcuauccucaucuccuu

SEQ ID NO: 1408617 - RNA, 19 nt, Homo sapiens
ggaacuggcaaaugcugaa

SEQ ID NO: 1408618 - RNA, 19 nt, Homo sapiens
ggcccucugugguuaaaga

SEQ ID NO: 1408619 - RNA, 19 nt, Homo sapiens
gguacucacugcagcuauc

SEQ ID NO: 1408620 - RNA, 19 nt, Homo sapiens
gcacuccuccuuccuaacu

SEQ ID NO: 1408621 - RNA, 19 nt, Homo sapiens
guucaggcccucugugguu

SEQ ID NO: 1408622 - RNA, 19 nt, Homo sapiens
uuacuuggagcccugauuu

SEQ ID NO: 1408623 - RNA, 19 nt, Homo sapiens
gguggucguucaugucauc

SEQ ID NO: 1408624 - RNA, 19 nt, Homo sapiens
ggaguugcucugaaagaug

SEQ ID NO: 1408625 - RNA, 19 nt, Homo sapiens
ccggcaagcucacggacuu

SEQ ID NO: 1408626 - RNA, 19 nt, Homo sapiens
aggaggaacuggcaaaugc

SEQ ID NO: 1408627 - RNA, 19 nt, Homo sapiens
gguucugucucucccauuc

SEQ ID NO: 1408628 - RNA, 19 nt, Homo sapiens
cauaguaggaauuaucugu

SEQ ID NO: 1408629 - RNA, 19 nt, Homo sapiens
uucaaagaccugcauagua

SEQ ID NO: 1408630 - RNA, 19 nt, Homo sapiens
uggcacuccuccuuccuaa

SEQ ID NO: 1408631 - RNA, 19 nt, Homo sapiens
acuggcaaaugcugaauau

SEQ ID NO: 1408632 - RNA, 19 nt, Homo sapiens
gguuaaagacuguauccau

SEQ ID NO: 1408633 - RNA, 19 nt, Homo sapiens
uggccuggcuuuacuugga

SEQ ID NO: 1408634 - RNA, 19 nt, Homo sapiens
ucaaggaggaacuggcaaa

SEQ ID NO: 1408635 - RNA, 19 nt, Homo sapiens
aagcuuggaaauaugguua

SEQ ID NO: 1408636 - RNA, 19 nt, Homo sapiens
gauacggcugcuucaguaa

SEQ ID NO: 1408637 - RNA, 19 nt, Homo sapiens
ugauuugcuuugucacuuc

SEQ ID NO: 1408638 - RNA, 19 nt, Homo sapiens
uaaagacuguauccaugcu

SEQ ID NO: 1408639 - RNA, 19 nt, Homo sapiens
ugucuugaauccuuucuac

SEQ ID NO: 1408640 - RNA, 19 nt, Homo sapiens
gcuauccucaucuccuuga

SEQ ID NO: 1408641 - RNA, 19 nt, Homo sapiens
gaacuggcaaaugcugaau

SEQ ID NO: 1408642 - RNA, 19 nt, Homo sapiens
ggacugcagcccuguuugc

SEQ ID NO: 1408643 - RNA, 19 nt, Homo sapiens
uugcauguuugauguuuca

SEQ ID NO: 1408644 - RNA, 19 nt, Homo sapiens
gcuuacugcucuguuguca

SEQ ID NO: 1408645 - RNA, 19 nt, Homo sapiens
uacggcugcuucaguaaga

SEQ ID NO: 1408646 - RNA, 19 nt, Homo sapiens
gaagugacaggcagaaccu

SEQ ID NO: 1408647 - RNA, 19 nt, Homo sapiens
ucagacacaagcuuggaaa

SEQ ID NO: 1408648 - RNA, 19 nt, Homo sapiens
ucuugaauccuuucuacaa

SEQ ID NO: 1408649 - RNA, 19 nt, Homo sapiens
cggcugucuugaauccuuu

SEQ ID NO: 1408650 - RNA, 19 nt, Homo sapiens
caucggcugucuugaaucc

SEQ ID NO: 1408651 - RNA, 19 nt, Homo sapiens
ggucguucaugucaucaac

SEQ ID NO: 1408652 - RNA, 19 nt, Homo sapiens
uggaguugcucugaaagau

SEQ ID NO: 1408653 - RNA, 19 nt, Homo sapiens
uuggagcccugauuugcuu

SEQ ID NO: 1408654 - RNA, 19 nt, Homo sapiens
gaccugcauaguaggaauu

SEQ ID NO: 1408655 - RNA, 19 nt, Homo sapiens
cuuugucacuucuggaguu

SEQ ID NO: 1408656 - RNA, 19 nt, Homo sapiens
cuuccuaacugggauguca

SEQ ID NO: 1408657 - RNA, 19 nt, Homo sapiens
cgugcuuacugcucuguug

SEQ ID NO: 1408658 - RNA, 19 nt, Homo sapiens
uucaggcccucugugguua

SEQ ID NO: 1408659 - RNA, 19 nt, Homo sapiens
cuucuggaguugcucugaa

SEQ ID NO: 1408660 - RNA, 19 nt, Homo sapiens
gauuugcuuugucacuucu

SEQ ID NO: 1408661 - RNA, 19 nt, Homo sapiens
aaccuucacuugcaagcau

SEQ ID NO: 1408662 - RNA, 19 nt, Homo sapiens
guuucauccuucaaucaga

SEQ ID NO: 1408663 - RNA, 19 nt, Homo sapiens
cugauuugcuuugucacuu

SEQ ID NO: 1408664 - RNA, 19 nt, Homo sapiens
gagcccugauuugcuuugu

SEQ ID NO: 1408665 - RNA, 19 nt, Homo sapiens
cuaacugggaugucaccua

SEQ ID NO: 1408666 - RNA, 19 nt, Homo sapiens
gaaauucccugaaaugaug

SEQ ID NO: 1408667 - RNA, 19 nt, Homo sapiens
gagagagaauaaucuaguu

SEQ ID NO: 1408668 - RNA, 19 nt, Homo sapiens
acacugaacuuugucaauu

SEQ ID NO: 1408669 - RNA, 19 nt, Homo sapiens
ccaacaugcuuucuucuga

SEQ ID NO: 1408670 - RNA, 19 nt, Homo sapiens
ggagagagagaauaaucua

SEQ ID NO: 1408671 - RNA, 19 nt, Homo sapiens
guugaagcauacaucuuua

SEQ ID NO: 1408672 - RNA, 19 nt, Homo sapiens
cacugaacuuugucaauua

SEQ ID NO: 1408673 - RNA, 19 nt, Homo sapiens
gaauugggaagcaguguuu

SEQ ID NO: 1408674 - RNA, 19 nt, Homo sapiens
gaggcuauuuccuauuuga

SEQ ID NO: 1408675 - RNA, 19 nt, Homo sapiens
gaagagggcauggacuuga

SEQ ID NO: 1408676 - RNA, 19 nt, Homo sapiens
cgacauggcucaggagaag

SEQ ID NO: 1408677 - RNA, 19 nt, Homo sapiens
auaaguguguugaagcaua

SEQ ID NO: 1408678 - RNA, 19 nt, Homo sapiens
caauaaguguguugaagca

SEQ ID NO: 1408679 - RNA, 19 nt, Homo sapiens
ucaccaacaugcuuucuuc

SEQ ID NO: 1408680 - RNA, 19 nt, Homo sapiens
aaugugaaauggaaacuga

SEQ ID NO: 1408681 - RNA, 19 nt, Homo sapiens
cggauacccuugauggaaa

SEQ ID NO: 1408682 - RNA, 19 nt, Homo sapiens
cauauguuaucccuugauu

SEQ ID NO: 1408683 - RNA, 19 nt, Homo sapiens
uugaggcuauuuccuauuu

SEQ ID NO: 1408684 - RNA, 19 nt, Homo sapiens
gaauaucagccaaagagau

SEQ ID NO: 1408685 - RNA, 19 nt, Homo sapiens
ucccugaaaugauguuauu

SEQ ID NO: 1408686 - RNA, 19 nt, Homo sapiens
gcagaccgcaaugcagaua

SEQ ID NO: 1408687 - RNA, 19 nt, Homo sapiens
acaacgacguggagaaauc

SEQ ID NO: 1408688 - RNA, 19 nt, Homo sapiens
caccgacucuccuguguca

SEQ ID NO: 1408689 - RNA, 19 nt, Homo sapiens
cgccauccuugcaaaguuu

SEQ ID NO: 1408690 - RNA, 19 nt, Homo sapiens
ugacaacgacguggagaaa

SEQ ID NO: 1408691 - RNA, 19 nt, Homo sapiens
aauaucagccaaagagauu

SEQ ID NO: 1408692 - RNA, 19 nt, Homo sapiens
ucuuuacgcugcuaauaug

SEQ ID NO: 1408693 - RNA, 19 nt, Homo sapiens
gcaguggagagagagaaua

SEQ ID NO: 1408694 - RNA, 19 nt, Homo sapiens
aggagaagauggagcuaga

SEQ ID NO: 1408695 - RNA, 19 nt, Homo sapiens
gaaauggaaacugaauauc

SEQ ID NO: 1408696 - RNA, 19 nt, Homo sapiens
uguugaagcauacaucuuu

SEQ ID NO: 1408697 - RNA, 19 nt, Homo sapiens
uaugucagguuccuuugga

SEQ ID NO: 1408698 - RNA, 19 nt, Homo sapiens
gcgcaucgauuucauuccu

SEQ ID NO: 1408699 - RNA, 19 nt, Homo sapiens
ggauacccuugaauucagu

SEQ ID NO: 1408700 - RNA, 19 nt, Homo sapiens
ugaaauucccugaaaugau

SEQ ID NO: 1408701 - RNA, 19 nt, Homo sapiens
gugaaauggaaacugaaua

SEQ ID NO: 1408702 - RNA, 19 nt, Homo sapiens
ggaauugggaagcaguguu

SEQ ID NO: 1408703 - RNA, 19 nt, Homo sapiens
caucuuuacgcugcuaaua

SEQ ID NO: 1408704 - RNA, 19 nt, Homo sapiens
uaaguguguugaagcauac

SEQ ID NO: 1408705 - RNA, 19 nt, Homo sapiens
gcaccagaucaaacaagaa

SEQ ID NO: 1408706 - RNA, 19 nt, Homo sapiens
caguggagagagagaauaa

SEQ ID NO: 1408707 - RNA, 19 nt, Homo sapiens
cagcagcagugccggaucu

SEQ ID NO: 1408708 - RNA, 19 nt, Homo sapiens
cgauuucauuccuguguca

SEQ ID NO: 1408709 - RNA, 19 nt, Homo sapiens
caugcuuucuucugacguu

SEQ ID NO: 1408710 - RNA, 19 nt, Homo sapiens
ccaacgacccgauuuacca

SEQ ID NO: 1408711 - RNA, 19 nt, Homo sapiens
cagcgaaagucagcacuac

SEQ ID NO: 1408712 - RNA, 19 nt, Homo sapiens
cggaucuucuuguaacuca

SEQ ID NO: 1408713 - RNA, 19 nt, Homo sapiens
cgauuuaccacccggagaa

SEQ ID NO: 1408714 - RNA, 19 nt, Homo sapiens
aauuugaggcuauuuccua

SEQ ID NO: 1408715 - RNA, 19 nt, Homo sapiens
guaacucaccagcgaaagu

SEQ ID NO: 1408716 - RNA, 19 nt, Homo sapiens
ccaagcgcaucgauuucau

SEQ ID NO: 1408717 - RNA, 19 nt, Homo sapiens
gcagugccggaucuucuug

SEQ ID NO: 1408718 - RNA, 19 nt, Homo sapiens
gauccugguguguguguau

SEQ ID NO: 1408719 - RNA, 19 nt, Homo sapiens
caagcgcaucgauuucauu

SEQ ID NO: 1408720 - RNA, 19 nt, Homo sapiens
aagaagagggcauggacuu

SEQ ID NO: 1408721 - RNA, 19 nt, Homo sapiens
agagagagaauaaucuagu

SEQ ID NO: 1408722 - RNA, 19 nt, Homo sapiens
gagagagagaauaaucuag

SEQ ID NO: 1408723 - RNA, 19 nt, Homo sapiens
guggagagagagaauaauc

SEQ ID NO: 1408724 - RNA, 19 nt, Homo sapiens
ccauuuauuccacuagaug

SEQ ID NO: 1408725 - RNA, 19 nt, Homo sapiens
gcgaaagucagcacuacca

SEQ ID NO: 1408726 - RNA, 19 nt, Homo sapiens
ucgccauccuugcaaaguu

SEQ ID NO: 1408727 - RNA, 19 nt, Homo sapiens
cccaauaaguguguugaag

SEQ ID NO: 1408728 - RNA, 19 nt, Homo sapiens
ugucagguuccuuuggaua

SEQ ID NO: 1408729 - RNA, 19 nt, Homo sapiens
ggauacccuugauggaaac

SEQ ID NO: 1408730 - RNA, 19 nt, Homo sapiens
gucagauccuggugugugu

SEQ ID NO: 1408731 - RNA, 19 nt, Homo sapiens
ugcauuagaccaaguguuc

SEQ ID NO: 1408732 - RNA, 19 nt, Homo sapiens
ugcaccagaucaaacaaga

SEQ ID NO: 1408733 - RNA, 19 nt, Homo sapiens
ucagacguuuccccaauaa

SEQ ID NO: 1408734 - RNA, 19 nt, Homo sapiens
caauugcauuagaccaagu

SEQ ID NO: 1408735 - RNA, 19 nt, Homo sapiens
ugaggcuauuuccuauuug

SEQ ID NO: 1408736 - RNA, 19 nt, Homo sapiens
agagagaauaaucuaguug

SEQ ID NO: 1408737 - RNA, 19 nt, Homo sapiens
ccagcgaaagucagcacua

SEQ ID NO: 1408738 - RNA, 19 nt, Homo sapiens
aagagggcauggacuugau

SEQ ID NO: 1408739 - RNA, 19 nt, Homo sapiens
agaccgcaaugcagauaag

SEQ ID NO: 1408740 - RNA, 19 nt, Homo sapiens
uggauacccuugaauucag

SEQ ID NO: 1408741 - RNA, 19 nt, Homo sapiens
ccagaucaaacaagaagag

SEQ ID NO: 1408742 - RNA, 19 nt, Homo sapiens
uuacgcugcuaauaugucu

SEQ ID NO: 1408743 - RNA, 19 nt, Homo sapiens
caccagaucaaacaagaag

SEQ ID NO: 1408744 - RNA, 19 nt, Homo sapiens
ucggauacccuugauggaa

SEQ ID NO: 1408745 - RNA, 19 nt, Homo sapiens
ggacgguucucauuauuua

SEQ ID NO: 1408746 - RNA, 19 nt, Homo sapiens
gaaauggugcuaagauauu

SEQ ID NO: 1408747 - RNA, 19 nt, Homo sapiens
ggaaguggaugcagaugga

SEQ ID NO: 1408748 - RNA, 19 nt, Homo sapiens
gcacagugauugagaagca

SEQ ID NO: 1408749 - RNA, 19 nt, Homo sapiens
ggguagaaauuacaaauag

SEQ ID NO: 1408750 - RNA, 19 nt, Homo sapiens
gauauuugccuaugccuuu

SEQ ID NO: 1408751 - RNA, 19 nt, Homo sapiens
ggaaauggugcuaagauau

SEQ ID NO: 1408752 - RNA, 19 nt, Homo sapiens
gagacagacuggugguuga

SEQ ID NO: 1408753 - RNA, 19 nt, Homo sapiens
ccaggacgguucucauuau

SEQ ID NO: 1408754 - RNA, 19 nt, Homo sapiens
cuacagacccuauagaaga

SEQ ID NO: 1408755 - RNA, 19 nt, Homo sapiens
uggaaauggugcuaagaua

SEQ ID NO: 1408756 - RNA, 19 nt, Homo sapiens
caggacagcugccgugaga

SEQ ID NO: 1408757 - RNA, 19 nt, Homo sapiens
uaaaugugacccgguauua

SEQ ID NO: 1408758 - RNA, 19 nt, Homo sapiens
gcuaagauauuugccuaug

SEQ ID NO: 1408759 - RNA, 19 nt, Homo sapiens
aauacacgcugaucgauga

SEQ ID NO: 1408760 - RNA, 19 nt, Homo sapiens
aaugugacccgguauuaua

SEQ ID NO: 1408761 - RNA, 19 nt, Homo sapiens
ggccaugaccgacuucaaa

SEQ ID NO: 1408762 - RNA, 19 nt, Homo sapiens
gcaaugggaaggguagaaa

SEQ ID NO: 1408763 - RNA, 19 nt, Homo sapiens
ggaugcagauggaaauggu

SEQ ID NO: 1408764 - RNA, 19 nt, Homo sapiens
caggacgguucucauuauu

SEQ ID NO: 1408765 - RNA, 19 nt, Homo sapiens
uacagacccuauagaagaa

SEQ ID NO: 1408766 - RNA, 19 nt, Homo sapiens
ccaaauacacgcugaucga

SEQ ID NO: 1408767 - RNA, 19 nt, Homo sapiens
caugaccgacuucaaauug

SEQ ID NO: 1408768 - RNA, 19 nt, Homo sapiens
caacggggauguaguggaa

SEQ ID NO: 1408769 - RNA, 19 nt, Homo sapiens
ggaaggguagaaauuacaa

SEQ ID NO: 1408770 - RNA, 19 nt, Homo sapiens
caggcagucugugugguua

SEQ ID NO: 1408771 - RNA, 19 nt, Homo sapiens
gggagcaaagcuuguauug

SEQ ID NO: 1408772 - RNA, 19 nt, Homo sapiens
ccuaugccuuugacaagaa

SEQ ID NO: 1408773 - RNA, 19 nt, Homo sapiens
gaaggguagaaauuacaaa

SEQ ID NO: 1408774 - RNA, 19 nt, Homo sapiens
gcaagcagagggagcaaag

SEQ ID NO: 1408775 - RNA, 19 nt, Homo sapiens
gaacucuugcaccuacuau

SEQ ID NO: 1408776 - RNA, 19 nt, Homo sapiens
ggacagcugccgugagacu

SEQ ID NO: 1408777 - RNA, 19 nt, Homo sapiens
uacccucccugcacaguga

SEQ ID NO: 1408778 - RNA, 19 nt, Homo sapiens
gcagauggaaauggugcua

SEQ ID NO: 1408779 - RNA, 19 nt, Homo sapiens
caccaggacgguucucauu

SEQ ID NO: 1408780 - RNA, 19 nt, Homo sapiens
gccuaugccuuugacaaga

SEQ ID NO: 1408781 - RNA, 19 nt, Homo sapiens
gugacccgguauuauaaug

SEQ ID NO: 1408782 - RNA, 19 nt, Homo sapiens
gccuacagacccuauagaa

SEQ ID NO: 1408783 - RNA, 19 nt, Homo sapiens
cccuauagaagaacaguuu

SEQ ID NO: 1408784 - RNA, 19 nt, Homo sapiens
gggaaggguagaaauuaca

SEQ ID NO: 1408785 - RNA, 19 nt, Homo sapiens
caaauacacgcugaucgau

SEQ ID NO: 1408786 - RNA, 19 nt, Homo sapiens
cuaaaugugacccgguauu

SEQ ID NO: 1408787 - RNA, 19 nt, Homo sapiens
aaugggaaggguagaaauu

SEQ ID NO: 1408788 - RNA, 19 nt, Homo sapiens
cugaagagaccuccagcaa

SEQ ID NO: 1408789 - RNA, 19 nt, Homo sapiens
ccaugaccgacuucaaauu

SEQ ID NO: 1408790 - RNA, 19 nt, Homo sapiens
gauggaaauggugcuaaga

SEQ ID NO: 1408791 - RNA, 19 nt, Homo sapiens
gccgugagacucccgaugu

SEQ ID NO: 1408792 - RNA, 19 nt, Homo sapiens
gccaugaccgacuucaaau

SEQ ID NO: 1408793 - RNA, 19 nt, Homo sapiens
acucuugcaccuacuauga

SEQ ID NO: 1408794 - RNA, 19 nt, Homo sapiens
agagggagcaaagcuugua

SEQ ID NO: 1408795 - RNA, 19 nt, Homo sapiens
ugggaaggguagaaauuac

SEQ ID NO: 1408796 - RNA, 19 nt, Homo sapiens
accaggacgguucucauua

SEQ ID NO: 1408797 - RNA, 19 nt, Homo sapiens
gaaguggaugcagauggaa

SEQ ID NO: 1408798 - RNA, 19 nt, Homo sapiens
ccugcacagugauugagaa

SEQ ID NO: 1408799 - RNA, 19 nt, Homo sapiens
agauggaaauggugcuaag

SEQ ID NO: 1408800 - RNA, 19 nt, Homo sapiens
augggaaggguagaaauua

SEQ ID NO: 1408801 - RNA, 19 nt, Homo sapiens
cuaagauauuugccuaugc

SEQ ID NO: 1408802 - RNA, 19 nt, Homo sapiens
ggagcaaagcuuguauugg

SEQ ID NO: 1408803 - RNA, 19 nt, Homo sapiens
gcagacuccugacauguua

SEQ ID NO: 1408804 - RNA, 19 nt, Homo sapiens
gggaauaccuuguccauca

SEQ ID NO: 1408805 - RNA, 19 nt, Homo sapiens
agaaacagcuucauaugga

SEQ ID NO: 1408806 - RNA, 19 nt, Homo sapiens
ccaagaagcaacacaaaga

SEQ ID NO: 1408807 - RNA, 19 nt, Homo sapiens
gagacggcguggucacuuu

SEQ ID NO: 1408808 - RNA, 19 nt, Homo sapiens
gcuauuugcucguuugcuu

SEQ ID NO: 1408809 - RNA, 19 nt, Homo sapiens
caucuccucuaccggguua

SEQ ID NO: 1408810 - RNA, 19 nt, Homo sapiens
gcaccuuccugcuggguau

SEQ ID NO: 1408811 - RNA, 19 nt, Homo sapiens
ggccaugggugccuucuuc

SEQ ID NO: 1408812 - RNA, 19 nt, Homo sapiens
gcacagagccugggacaac

SEQ ID NO: 1408813 - RNA, 19 nt, Homo sapiens
ggccagaaacagcuucaua

SEQ ID NO: 1408814 - RNA, 19 nt, Homo sapiens
caacaucuuccucaccauu

SEQ ID NO: 1408815 - RNA, 19 nt, Homo sapiens
uaacacuacugguggaagu

SEQ ID NO: 1408816 - RNA, 19 nt, Homo sapiens
aggccuaccucacccauuu

SEQ ID NO: 1408817 - RNA, 19 nt, Homo sapiens
ggucauguacuuucucuuc

SEQ ID NO: 1408818 - RNA, 19 nt, Homo sapiens
ccucacccauuucuucuug

SEQ ID NO: 1408819 - RNA, 19 nt, Homo sapiens
gccagaaacagcuucauau

SEQ ID NO: 1408820 - RNA, 19 nt, Homo sapiens
gaaccuggucauguacuuu

SEQ ID NO: 1408821 - RNA, 19 nt, Homo sapiens
ccagaaacagcuucauaug

SEQ ID NO: 1408822 - RNA, 19 nt, Homo sapiens
aaacggacaaggccagaaa

SEQ ID NO: 1408823 - RNA, 19 nt, Homo sapiens
ucuaccggguuaacaagua

SEQ ID NO: 1408824 - RNA, 19 nt, Homo sapiens
gcaacacaaagacaaguuc

SEQ ID NO: 1408825 - RNA, 19 nt, Homo sapiens
cagaaacagcuucauaugg

SEQ ID NO: 1408826 - RNA, 19 nt, Homo sapiens
gaagcaacacaaagacaag

SEQ ID NO: 1408827 - RNA, 19 nt, Homo sapiens
aagccuggguguccucuga

SEQ ID NO: 1408828 - RNA, 19 nt, Homo sapiens
cuccuucgcucacuccauu

SEQ ID NO: 1408829 - RNA, 19 nt, Homo sapiens
ggacagacgcgagccucuu

SEQ ID NO: 1408830 - RNA, 19 nt, Homo sapiens
gggcacugcuguguguaug

SEQ ID NO: 1408831 - RNA, 19 nt, Homo sapiens
cuucuucuccggcaucuuu

SEQ ID NO: 1408832 - RNA, 19 nt, Homo sapiens
gacagacgcgagccucuug

SEQ ID NO: 1408833 - RNA, 19 nt, Homo sapiens
ggcagacuccugacauguu

SEQ ID NO: 1408834 - RNA, 19 nt, Homo sapiens
cuaccggguuaacaaguau

SEQ ID NO: 1408835 - RNA, 19 nt, Homo sapiens
guaaugcccaggaucaucu

SEQ ID NO: 1408836 - RNA, 19 nt, Homo sapiens
ucaguaaugcccaggauca

SEQ ID NO: 1408837 - RNA, 19 nt, Homo sapiens
ccauucgcaugaugaugaa

SEQ ID NO: 1408838 - RNA, 19 nt, Homo sapiens
ggaauaccuuguccaucac

SEQ ID NO: 1408839 - RNA, 19 nt, Homo sapiens
augugaaccuggucaugua

SEQ ID NO: 1408840 - RNA, 19 nt, Homo sapiens
gaucugggcacugcugugu

SEQ ID NO: 1408841 - RNA, 19 nt, Homo sapiens
gcgagccucuugggaauac

SEQ ID NO: 1408842 - RNA, 19 nt, Homo sapiens
gucacuuucuggcuauuug

SEQ ID NO: 1408843 - RNA, 19 nt, Homo sapiens
cccauuucuucuugcguua

SEQ ID NO: 1408844 - RNA, 19 nt, Homo sapiens
ugaaccuggucauguacuu

SEQ ID NO: 1408845 - RNA, 19 nt, Homo sapiens
ggguauuucauccacgaua

SEQ ID NO: 1408846 - RNA, 19 nt, Homo sapiens
cuaccucacccauuucuuc

SEQ ID NO: 1408847 - RNA, 19 nt, Homo sapiens
gagccugcgcccacacuau

SEQ ID NO: 1408848 - RNA, 19 nt, Homo sapiens
acauguuaguggagauuga

SEQ ID NO: 1408849 - RNA, 19 nt, Homo sapiens
agaagcaacacaaagacaa

SEQ ID NO: 1408850 - RNA, 19 nt, Homo sapiens
ucugggcacugcugugugu

SEQ ID NO: 1408851 - RNA, 19 nt, Homo sapiens
cggguuaacaaguauguga

SEQ ID NO: 1408852 - RNA, 19 nt, Homo sapiens
ccucaccauucgcaugaug

SEQ ID NO: 1408853 - RNA, 19 nt, Homo sapiens
gcaacaucuuccucaccau

SEQ ID NO: 1408854 - RNA, 19 nt, Homo sapiens
caacacaaagacaaguucu

SEQ ID NO: 1408855 - RNA, 19 nt, Homo sapiens
caagaagcaacacaaagac

SEQ ID NO: 1408856 - RNA, 19 nt, Homo sapiens
cauuucuucuugcguuaug

SEQ ID NO: 1408857 - RNA, 19 nt, Homo sapiens
aaucaguaaugcccaggau

SEQ ID NO: 1408858 - RNA, 19 nt, Homo sapiens
guggucacuuucuggcuau

SEQ ID NO: 1408859 - RNA, 19 nt, Homo sapiens
acaaccugcucgucuccuu

SEQ ID NO: 1408860 - RNA, 19 nt, Homo sapiens
cagccucuccaccuucuga

SEQ ID NO: 1408861 - RNA, 19 nt, Homo sapiens
ucccagaacagaccuagga

SEQ ID NO: 1408862 - RNA, 19 nt, Homo sapiens
acgcgagccucuugggaau

SEQ ID NO: 1408863 - RNA, 19 nt, Homo sapiens
gaaaagagcugaaaaccuu

SEQ ID NO: 1408864 - RNA, 19 nt, Homo sapiens
uaacuacacugaaagauga

SEQ ID NO: 1408865 - RNA, 19 nt, Homo sapiens
ggaaaccacuguagaugaa

SEQ ID NO: 1408866 - RNA, 19 nt, Homo sapiens
ugacagcuaucaacuuaua

SEQ ID NO: 1408867 - RNA, 19 nt, Homo sapiens
cgaauaagcugucagacuu

SEQ ID NO: 1408868 - RNA, 19 nt, Homo sapiens
caaaggaauucuucaguug

SEQ ID NO: 1408869 - RNA, 19 nt, Homo sapiens
gcaaaccacuagccaguau

SEQ ID NO: 1408870 - RNA, 19 nt, Homo sapiens
gaaaacaaguucagcaaaa

SEQ ID NO: 1408871 - RNA, 19 nt, Homo sapiens
ugugacagcuaucaacuua

SEQ ID NO: 1408872 - RNA, 19 nt, Homo sapiens
gagcagagccgccaucuuc

SEQ ID NO: 1408873 - RNA, 19 nt, Homo sapiens
gaaaagaucuguguagguu

SEQ ID NO: 1408874 - RNA, 19 nt, Homo sapiens
caaauuugccacuugaaua

SEQ ID NO: 1408875 - RNA, 19 nt, Homo sapiens
gccaguaucuuaucaggaa

SEQ ID NO: 1408876 - RNA, 19 nt, Homo sapiens
gagccgccaucuucauaua

SEQ ID NO: 1408877 - RNA, 19 nt, Homo sapiens
ggauaaaguggacgucaua

SEQ ID NO: 1408878 - RNA, 19 nt, Homo sapiens
gcaacuaauugucauucaa

SEQ ID NO: 1408879 - RNA, 19 nt, Homo sapiens
ggacagguguauguaaaug

SEQ ID NO: 1408880 - RNA, 19 nt, Homo sapiens
caacuuauauccagauggu

SEQ ID NO: 1408881 - RNA, 19 nt, Homo sapiens
cauauaagguaauguguca

SEQ ID NO: 1408882 - RNA, 19 nt, Homo sapiens
acaaaggaauucuucaguu

SEQ ID NO: 1408883 - RNA, 19 nt, Homo sapiens
gaaagcaugcucuacucua

SEQ ID NO: 1408884 - RNA, 19 nt, Homo sapiens
ggaugucacugaaauugau

SEQ ID NO: 1408885 - RNA, 19 nt, Homo sapiens
caggacggcaucagaauua

SEQ ID NO: 1408886 - RNA, 19 nt, Homo sapiens
gguaauaaccaucuuaaag

SEQ ID NO: 1408887 - RNA, 19 nt, Homo sapiens
gaagaaagcaugcucuacu

SEQ ID NO: 1408888 - RNA, 19 nt, Homo sapiens
uaguagagauugauggaaa

SEQ ID NO: 1408889 - RNA, 19 nt, Homo sapiens
uaucauggacuccgaagua

SEQ ID NO: 1408890 - RNA, 19 nt, Homo sapiens
caaacuauacccucccuuu

SEQ ID NO: 1408891 - RNA, 19 nt, Homo sapiens
acucagacauucaaacuau

SEQ ID NO: 1408892 - RNA, 19 nt, Homo sapiens
gcaaaaggaugucacugaa

SEQ ID NO: 1408893 - RNA, 19 nt, Homo sapiens
aggagcagcugugguaaua

SEQ ID NO: 1408894 - RNA, 19 nt, Homo sapiens
ugucagacuuugauaguga

SEQ ID NO: 1408895 - RNA, 19 nt, Homo sapiens
guggacagguguauguaaa

SEQ ID NO: 1408896 - RNA, 19 nt, Homo sapiens
guaauaaccaucuuaaagg

SEQ ID NO: 1408897 - RNA, 19 nt, Homo sapiens
gaaagaugauggggacaua

SEQ ID NO: 1408898 - RNA, 19 nt, Homo sapiens
gaauaagcugucagacuuu

SEQ ID NO: 1408899 - RNA, 19 nt, Homo sapiens
gagcagcugugguaauaac

SEQ ID NO: 1408900 - RNA, 19 nt, Homo sapiens
ggaauucuucaguuggaua

SEQ ID NO: 1408901 - RNA, 19 nt, Homo sapiens
gagcaacguuuucccagua

SEQ ID NO: 1408902 - RNA, 19 nt, Homo sapiens
aaagcaugcucuacucuau

SEQ ID NO: 1408903 - RNA, 19 nt, Homo sapiens
cugaaaaccuugaagauaa

SEQ ID NO: 1408904 - RNA, 19 nt, Homo sapiens
gaagagguaguagagauug

SEQ ID NO: 1408905 - RNA, 19 nt, Homo sapiens
ggcaucagaauuaauguaa

SEQ ID NO: 1408906 - RNA, 19 nt, Homo sapiens
ccuguugccuccaaauuug

SEQ ID NO: 1408907 - RNA, 19 nt, Homo sapiens
guaacuacacugaaagaug

SEQ ID NO: 1408908 - RNA, 19 nt, Homo sapiens
aagaagagguaguagagau

SEQ ID NO: 1408909 - RNA, 19 nt, Homo sapiens
agacuuugauagugaagaa

SEQ ID NO: 1408910 - RNA, 19 nt, Homo sapiens
gaauucuucaguuggauaa

SEQ ID NO: 1408911 - RNA, 19 nt, Homo sapiens
ggaauugucaguguaagga

SEQ ID NO: 1408912 - RNA, 19 nt, Homo sapiens
ccacaggacggcaucagaa

SEQ ID NO: 1408913 - RNA, 19 nt, Homo sapiens
cacuguagaugaagauguu

SEQ ID NO: 1408914 - RNA, 19 nt, Homo sapiens
ggaguacucagacauucaa

SEQ ID NO: 1408915 - RNA, 19 nt, Homo sapiens
cagagccgccaucuucaua

SEQ ID NO: 1408916 - RNA, 19 nt, Homo sapiens
agcaugcucuacucuauuu

SEQ ID NO: 1408917 - RNA, 19 nt, Homo sapiens
cccaguuucugaauacaaa

SEQ ID NO: 1408918 - RNA, 19 nt, Homo sapiens
aaagaucuguguagguucu

SEQ ID NO: 1408919 - RNA, 19 nt, Homo sapiens
aaaccacuguagaugaaga

SEQ ID NO: 1408920 - RNA, 19 nt, Homo sapiens
ccacuagccaguaucuuau

SEQ ID NO: 1408921 - RNA, 19 nt, Homo sapiens
ccuggcaaguuaccugaaa

SEQ ID NO: 1408922 - RNA, 19 nt, Homo sapiens
caacuaauugucauucaag

SEQ ID NO: 1408923 - RNA, 19 nt, Homo sapiens
ccuccaaauuugccacuug

SEQ ID NO: 1408924 - RNA, 19 nt, Homo sapiens
caucauggugguuggaauu

SEQ ID NO: 1408925 - RNA, 19 nt, Homo sapiens
aaaaggaugucacugaaau

SEQ ID NO: 1408926 - RNA, 19 nt, Homo sapiens
ccaaauuugccacuugaau

SEQ ID NO: 1408927 - RNA, 19 nt, Homo sapiens
gacggcaucagaauuaaug

SEQ ID NO: 1408928 - RNA, 19 nt, Homo sapiens
gcugaaaaccuugaagaua

SEQ ID NO: 1408929 - RNA, 19 nt, Homo sapiens
uguuuuaccuggcaaguua

SEQ ID NO: 1408930 - RNA, 19 nt, Homo sapiens
aaacuauacccucccuuug

SEQ ID NO: 1408931 - RNA, 19 nt, Homo sapiens
ucaagaagagguaguagag

SEQ ID NO: 1408932 - RNA, 19 nt, Homo sapiens
gccuguugccuccaaauuu

SEQ ID NO: 1408933 - RNA, 19 nt, Homo sapiens
accacuagccaguaucuua

SEQ ID NO: 1408934 - RNA, 19 nt, Homo sapiens
guacucagacauucaaacu

SEQ ID NO: 1408935 - RNA, 19 nt, Homo sapiens
gaugucacugaaauugaua

SEQ ID NO: 1408936 - RNA, 19 nt, Homo sapiens
aauaagcugucagacuuug

SEQ ID NO: 1408937 - RNA, 19 nt, Homo sapiens
aaggaauucuucaguugga

SEQ ID NO: 1408938 - RNA, 19 nt, Homo sapiens
cauggugguuggaauuaca

SEQ ID NO: 1408939 - RNA, 19 nt, Homo sapiens
ccaguauucuuucaguuuu

SEQ ID NO: 1408940 - RNA, 19 nt, Homo sapiens
gguaguagagauugaugga

SEQ ID NO: 1408941 - RNA, 19 nt, Homo sapiens
gaacaucauggugguugga

SEQ ID NO: 1408942 - RNA, 19 nt, Homo sapiens
uggaaaccacuguagauga

SEQ ID NO: 1408943 - RNA, 19 nt, Homo sapiens
gacagguguauguaaauga

SEQ ID NO: 1408944 - RNA, 19 nt, Homo sapiens
ggacggcaucagaauuaau

SEQ ID NO: 1408945 - RNA, 19 nt, Homo sapiens
cuccaaauuugccacuuga

SEQ ID NO: 1408946 - RNA, 19 nt, Homo sapiens
ucgagacagugacauuuua

SEQ ID NO: 1408947 - RNA, 19 nt, Homo sapiens
aagaaagcaugcucuacuc

SEQ ID NO: 1408948 - RNA, 19 nt, Homo sapiens
acuauacccucccuuugga

SEQ ID NO: 1408949 - RNA, 19 nt, Homo sapiens
cccaguauucuuucaguuu

SEQ ID NO: 1408950 - RNA, 19 nt, Homo sapiens
ggaaaacaaguucagcaaa

SEQ ID NO: 1408951 - RNA, 19 nt, Homo sapiens
gguguauguaaaugacuua

SEQ ID NO: 1408952 - RNA, 19 nt, Homo sapiens
gcagagccgccaucuucau

SEQ ID NO: 1408953 - RNA, 19 nt, Homo sapiens
gcaucagaauuaauguaac

SEQ ID NO: 1408954 - RNA, 19 nt, Homo sapiens
gguguaacccgaauaagcu

SEQ ID NO: 1408955 - RNA, 19 nt, Homo sapiens
ggaagaaagcaugcucuac

SEQ ID NO: 1408956 - RNA, 19 nt, Homo sapiens
uaucuaaacagcagguugu

SEQ ID NO: 1408957 - RNA, 19 nt, Homo sapiens
gcugucagacuuugauagu

SEQ ID NO: 1408958 - RNA, 19 nt, Homo sapiens
cucagacauucaaacuaua

SEQ ID NO: 1408959 - RNA, 19 nt, Homo sapiens
agaagagguaguagagauu

SEQ ID NO: 1408960 - RNA, 19 nt, Homo sapiens
caagaagagguaguagaga

SEQ ID NO: 1408961 - RNA, 19 nt, Homo sapiens
cuaauugucauucaagaag

SEQ ID NO: 1408962 - RNA, 19 nt, Homo sapiens
guaaggauuuuaguucaug

SEQ ID NO: 1408963 - RNA, 19 nt, Homo sapiens
ggaaacaucucugucauug

SEQ ID NO: 1408964 - RNA, 19 nt, Homo sapiens
gagaauaugugaugagugu

SEQ ID NO: 1408965 - RNA, 19 nt, Homo sapiens
ggaaacacuuuaaggacua

SEQ ID NO: 1408966 - RNA, 19 nt, Homo sapiens
gcacgagacucuuguuuua

SEQ ID NO: 1408967 - RNA, 19 nt, Homo sapiens
ccugaaggaucauggauua

SEQ ID NO: 1408968 - RNA, 19 nt, Homo sapiens
ggaaagccauccacacugu

SEQ ID NO: 1408969 - RNA, 19 nt, Homo sapiens
gaaggaucauggauuagaa

SEQ ID NO: 1408970 - RNA, 19 nt, Homo sapiens
gaacuuaggaaauuguuug

SEQ ID NO: 1408971 - RNA, 19 nt, Homo sapiens
agaauaaacugcagaagau

SEQ ID NO: 1408972 - RNA, 19 nt, Homo sapiens
ggagggagguggaaacauc

SEQ ID NO: 1408973 - RNA, 19 nt, Homo sapiens
gaucauggauuagaacugu

SEQ ID NO: 1408974 - RNA, 19 nt, Homo sapiens
ugacaacccugaaggauca

SEQ ID NO: 1408975 - RNA, 19 nt, Homo sapiens
gaucauacacaacuauuug

SEQ ID NO: 1408976 - RNA, 19 nt, Homo sapiens
ugauguggcuuuacuuuga

SEQ ID NO: 1408977 - RNA, 19 nt, Homo sapiens
aaacaucucugucauuguc

SEQ ID NO: 1408978 - RNA, 19 nt, Homo sapiens
gaacacaaaggaaaguaug

SEQ ID NO: 1408979 - RNA, 19 nt, Homo sapiens
ggaguuacaucagaccuau

SEQ ID NO: 1408980 - RNA, 19 nt, Homo sapiens
ggaggaacuuaggaaauug

SEQ ID NO: 1408981 - RNA, 19 nt, Homo sapiens
uggaggaacuuaggaaauu

SEQ ID NO: 1408982 - RNA, 19 nt, Homo sapiens
gcggaaaggauuuguuaaa

SEQ ID NO: 1408983 - RNA, 19 nt, Homo sapiens
cagcggaaaggauuuguua

SEQ ID NO: 1408984 - RNA, 19 nt, Homo sapiens
ggaccuguuuccuggcuuu

SEQ ID NO: 1408985 - RNA, 19 nt, Homo sapiens
guucugguguccugucuuu

SEQ ID NO: 1408986 - RNA, 19 nt, Homo sapiens
ggagcagauugaggaguua

SEQ ID NO: 1408987 - RNA, 19 nt, Homo sapiens
gaauaugugaugaguguug

SEQ ID NO: 1408988 - RNA, 19 nt, Homo sapiens
aaauuggacucuuuggaaa

SEQ ID NO: 1408989 - RNA, 19 nt, Homo sapiens
caaaggaaaguauggcauu

SEQ ID NO: 1408990 - RNA, 19 nt, Homo sapiens
cuaaugaccuauaggaaag

SEQ ID NO: 1408991 - RNA, 19 nt, Homo sapiens
cagaauaaacugcagaaga

SEQ ID NO: 1408992 - RNA, 19 nt, Homo sapiens
ggauccaagucacaacuau

SEQ ID NO: 1408993 - RNA, 19 nt, Homo sapiens
gauccaagucacaacuaua

SEQ ID NO: 1408994 - RNA, 19 nt, Homo sapiens
gaaacacuuuaaggacuau

SEQ ID NO: 1408995 - RNA, 19 nt, Homo sapiens
ccaagucacaacuauauau

SEQ ID NO: 1408996 - RNA, 19 nt, Homo sapiens
ggaaaguucacucuguuca

SEQ ID NO: 1408997 - RNA, 19 nt, Homo sapiens
gagcacgagacucuuguuu

SEQ ID NO: 1408998 - RNA, 19 nt, Homo sapiens
ugcaguggguccuuucuuu

SEQ ID NO: 1408999 - RNA, 19 nt, Homo sapiens
ggaacacaaaggaaaguau

SEQ ID NO: 1409000 - RNA, 19 nt, Homo sapiens
uccuuuacaucccuuauuu

SEQ ID NO: 1409001 - RNA, 19 nt, Homo sapiens
aaaguucacucuguucauc

SEQ ID NO: 1409002 - RNA, 19 nt, Homo sapiens
ugacuucaaggaccuguuu

SEQ ID NO: 1409003 - RNA, 19 nt, Homo sapiens
ggccaugaagguagaguuu

SEQ ID NO: 1409004 - RNA, 19 nt, Homo sapiens
ccuggaaaguucacucugu

SEQ ID NO: 1409005 - RNA, 19 nt, Homo sapiens
gguggaaacaucucuguca

SEQ ID NO: 1409006 - RNA, 19 nt, Homo sapiens
guuggagccuuugggaauu

SEQ ID NO: 1409007 - RNA, 19 nt, Homo sapiens
gaaaguucacucuguucau

SEQ ID NO: 1409008 - RNA, 19 nt, Homo sapiens
cuuauuugauguggcuuua

SEQ ID NO: 1409009 - RNA, 19 nt, Homo sapiens
aaaggaaaguauggcauuc

SEQ ID NO: 1409010 - RNA, 19 nt, Homo sapiens
ggaacuuaggaaauuguuu

SEQ ID NO: 1409011 - RNA, 19 nt, Homo sapiens
aggagcagauugaggaguu

SEQ ID NO: 1409012 - RNA, 19 nt, Homo sapiens
gaaagccauccacacuguu

SEQ ID NO: 1409013 - RNA, 19 nt, Homo sapiens
ugaaggaucauggauuaga

SEQ ID NO: 1409014 - RNA, 19 nt, Homo sapiens
gcaaggagggagguggaaa

SEQ ID NO: 1409015 - RNA, 19 nt, Homo sapiens
cggaaaggauuuguuaaaa

SEQ ID NO: 1409016 - RNA, 19 nt, Homo sapiens
cuggaaaguucacucuguu

SEQ ID NO: 1409017 - RNA, 19 nt, Homo sapiens
gaugaguguugggcugguu

SEQ ID NO: 1409018 - RNA, 19 nt, Homo sapiens
ggcuuuacuucauaucuuc

SEQ ID NO: 1409019 - RNA, 19 nt, Homo sapiens
aauggcaguuggagccuuu

SEQ ID NO: 1409020 - RNA, 19 nt, Homo sapiens
gaaacaucucugucauugu

SEQ ID NO: 1409021 - RNA, 19 nt, Homo sapiens
gccaggccaugaagguaga

SEQ ID NO: 1409022 - RNA, 19 nt, Homo sapiens
guggaaacaucucugucau

SEQ ID NO: 1409023 - RNA, 19 nt, Homo sapiens
guguugggcugguuucagu

SEQ ID NO: 1409024 - RNA, 19 nt, Homo sapiens
uguccugucuuucgagaau

SEQ ID NO: 1409025 - RNA, 19 nt, Homo sapiens
uggcuuuacuucauaucuu

SEQ ID NO: 1409026 - RNA, 19 nt, Homo sapiens
ccaugaagguagaguuugc

SEQ ID NO: 1409027 - RNA, 19 nt, Homo sapiens
gugcugcaguggguccuuu

SEQ ID NO: 1409028 - RNA, 19 nt, Homo sapiens
guacaauuuuggccuaaug

SEQ ID NO: 1409029 - RNA, 19 nt, Homo sapiens
cgacccaggagcagauuga

SEQ ID NO: 1409030 - RNA, 19 nt, Homo sapiens
gaauaaacugcagaagauc

SEQ ID NO: 1409031 - RNA, 19 nt, Homo sapiens
uguccuacaugguaagcaa

SEQ ID NO: 1409032 - RNA, 19 nt, Homo sapiens
agaccuauauggaggaacu

SEQ ID NO: 1409033 - RNA, 19 nt, Homo sapiens
uuacagggccgauguccau

SEQ ID NO: 1409034 - RNA, 19 nt, Homo sapiens
gaggaacuuaggaaauugu

SEQ ID NO: 1409035 - RNA, 19 nt, Homo sapiens
ugguuucaguuuccaagaa

SEQ ID NO: 1409036 - RNA, 19 nt, Homo sapiens
cuuuacaucccuuauuuga

SEQ ID NO: 1409037 - RNA, 19 nt, Homo sapiens
gcugaucauacacaacuau

SEQ ID NO: 1409038 - RNA, 19 nt, Homo sapiens
gagcgaggaggcaggagau

SEQ ID NO: 1409039 - RNA, 19 nt, Homo sapiens
uuccuggcuuuacuucaua

SEQ ID NO: 1409040 - RNA, 19 nt, Homo sapiens
uaggaaauuguuugaggaa

SEQ ID NO: 1409041 - RNA, 19 nt, Homo sapiens
uggaaacaucucugucauu

SEQ ID NO: 1409042 - RNA, 19 nt, Homo sapiens
ucgagaauaugugaugagu

SEQ ID NO: 1409043 - RNA, 19 nt, Homo sapiens
gauguggcuuuacuuugac

SEQ ID NO: 1409044 - RNA, 19 nt, Homo sapiens
aaagccauccacacuguug

SEQ ID NO: 1409045 - RNA, 19 nt, Homo sapiens
gagguggaaacaucucugu

SEQ ID NO: 1409046 - RNA, 19 nt, Homo sapiens
acgagacucuuguuuuaaa

SEQ ID NO: 1409047 - RNA, 19 nt, Homo sapiens
aaaauuggacucuuuggaa

SEQ ID NO: 1409048 - RNA, 19 nt, Homo sapiens
uuacaucagaccuauaugg

SEQ ID NO: 1409049 - RNA, 19 nt, Homo sapiens
gaguuacaucagaccuaua

SEQ ID NO: 1409050 - RNA, 19 nt, Homo sapiens
auugaggaguuacaucaga

SEQ ID NO: 1409051 - RNA, 19 nt, Homo sapiens
agauugaggaguuacauca

SEQ ID NO: 1409052 - RNA, 19 nt, Homo sapiens
uaggaaagccauccacacu

SEQ ID NO: 1409053 - RNA, 19 nt, Homo sapiens
gaucaugggguuugcuuug

SEQ ID NO: 1409054 - RNA, 19 nt, Homo sapiens
aaguguguccuacauggua

SEQ ID NO: 1409055 - RNA, 19 nt, Homo sapiens
gaaaaguguguccuacaug

SEQ ID NO: 1409056 - RNA, 19 nt, Homo sapiens
uugaggaacacaaaggaaa

SEQ ID NO: 1409057 - RNA, 19 nt, Homo sapiens
aauaaacugcagaagauca

SEQ ID NO: 1409058 - RNA, 19 nt, Homo sapiens
gcaguggguccuuucuuuu

SEQ ID NO: 1409059 - RNA, 19 nt, Homo sapiens
uauuugauguggcuuuacu

SEQ ID NO: 1409060 - RNA, 19 nt, Homo sapiens
guugggcugguuucaguuu

SEQ ID NO: 1409061 - RNA, 19 nt, Homo sapiens
gcaaaucccuggccacuuu

SEQ ID NO: 1409062 - RNA, 19 nt, Homo sapiens
gaagacagcuaaaguggaa

SEQ ID NO: 1409063 - RNA, 19 nt, Homo sapiens
gaagagggcuacauuuguu

SEQ ID NO: 1409064 - RNA, 19 nt, Homo sapiens
gaggaaagauggaugaaga

SEQ ID NO: 1409065 - RNA, 19 nt, Homo sapiens
gaacagggaucaucuucau

SEQ ID NO: 1409066 - RNA, 19 nt, Homo sapiens
ggacgggccuucugcucua

SEQ ID NO: 1409067 - RNA, 19 nt, Homo sapiens
caaguuauguacuggacua

SEQ ID NO: 1409068 - RNA, 19 nt, Homo sapiens
ccaaagacauucucuaucg

SEQ ID NO: 1409069 - RNA, 19 nt, Homo sapiens
caagauggaaugacuauga

SEQ ID NO: 1409070 - RNA, 19 nt, Homo sapiens
gcauugagaguguugauuu

SEQ ID NO: 1409071 - RNA, 19 nt, Homo sapiens
gaaggccacuccacccuau

SEQ ID NO: 1409072 - RNA, 19 nt, Homo sapiens
caaggaacguggaguuugu

SEQ ID NO: 1409073 - RNA, 19 nt, Homo sapiens
uaacacagaaggaaacauu

SEQ ID NO: 1409074 - RNA, 19 nt, Homo sapiens
caagagagguccaaaucca

SEQ ID NO: 1409075 - RNA, 19 nt, Homo sapiens
gaacguggaguuugucuca

SEQ ID NO: 1409076 - RNA, 19 nt, Homo sapiens
ggagacuggucagauguaa

SEQ ID NO: 1409077 - RNA, 19 nt, Homo sapiens
gaaacgggacuaauuugug

SEQ ID NO: 1409078 - RNA, 19 nt, Homo sapiens
cgacuacaguugucuaaag

SEQ ID NO: 1409079 - RNA, 19 nt, Homo sapiens
aaaggagacuggucagaug

SEQ ID NO: 1409080 - RNA, 19 nt, Homo sapiens
gaaggaaacauuggcauca

SEQ ID NO: 1409081 - RNA, 19 nt, Homo sapiens
aaccaucacuggcaagauu

SEQ ID NO: 1409082 - RNA, 19 nt, Homo sapiens
ggaugaagagggcuacauu

SEQ ID NO: 1409083 - RNA, 19 nt, Homo sapiens
ugaaguaccggaggaauuu

SEQ ID NO: 1409084 - RNA, 19 nt, Homo sapiens
gaugaagagggcuacauuu

SEQ ID NO: 1409085 - RNA, 19 nt, Homo sapiens
gaucaagccggguuucaug

SEQ ID NO: 1409086 - RNA, 19 nt, Homo sapiens
gguaucaucuauauaucga

SEQ ID NO: 1409087 - RNA, 19 nt, Homo sapiens
gccaacgucuucacacaga

SEQ ID NO: 1409088 - RNA, 19 nt, Homo sapiens
uaucaggagugccauaauc

SEQ ID NO: 1409089 - RNA, 19 nt, Homo sapiens
gcagcagcaugucaaguca

SEQ ID NO: 1409090 - RNA, 19 nt, Homo sapiens
ggaaacgggacuaauuugu

SEQ ID NO: 1409091 - RNA, 19 nt, Homo sapiens
ccacaaauccuuccacaac

SEQ ID NO: 1409092 - RNA, 19 nt, Homo sapiens
gaacgcacugcacaccuaa

SEQ ID NO: 1409093 - RNA, 19 nt, Homo sapiens
caucgggccugcagagguu

SEQ ID NO: 1409094 - RNA, 19 nt, Homo sapiens
uagaugcccuugccucaga

SEQ ID NO: 1409095 - RNA, 19 nt, Homo sapiens
caaagacauucucuaucga

SEQ ID NO: 1409096 - RNA, 19 nt, Homo sapiens
gagaccaucuggccuugau

SEQ ID NO: 1409097 - RNA, 19 nt, Homo sapiens
ggagaaggagggcaagaga

SEQ ID NO: 1409098 - RNA, 19 nt, Homo sapiens
ggaaacauuggcaucagaa

SEQ ID NO: 1409099 - RNA, 19 nt, Homo sapiens
cccaggaaguaggaaauua

SEQ ID NO: 1409100 - RNA, 19 nt, Homo sapiens
gacuuccgaucgcugguua

SEQ ID NO: 1409101 - RNA, 19 nt, Homo sapiens
ccaagcuccuggugucuga

SEQ ID NO: 1409102 - RNA, 19 nt, Homo sapiens
ggccaaagacauucucuau

SEQ ID NO: 1409103 - RNA, 19 nt, Homo sapiens
acaccaaggucaucauaca

SEQ ID NO: 1409104 - RNA, 19 nt, Homo sapiens
aaguggagcuucagagaga

SEQ ID NO: 1409105 - RNA, 19 nt, Homo sapiens
gaaguaccggaggaauuua

SEQ ID NO: 1409106 - RNA, 19 nt, Homo sapiens
agaacgcacugcacaccua

SEQ ID NO: 1409107 - RNA, 19 nt, Homo sapiens
gacauucucuaucgacuac

SEQ ID NO: 1409108 - RNA, 19 nt, Homo sapiens
ggaggaauuuaacuuugca

SEQ ID NO: 1409109 - RNA, 19 nt, Homo sapiens
caagggcauugugaccaua

SEQ ID NO: 1409110 - RNA, 19 nt, Homo sapiens
aggaucagcugaccaagga

SEQ ID NO: 1409111 - RNA, 19 nt, Homo sapiens
gauuguggcuaccauuugg

SEQ ID NO: 1409112 - RNA, 19 nt, Homo sapiens
uaaaguggagcuucagaga

SEQ ID NO: 1409113 - RNA, 19 nt, Homo sapiens
gaaauuacggagccugaag

SEQ ID NO: 1409114 - RNA, 19 nt, Homo sapiens
guugaaggccaaagacauu

SEQ ID NO: 1409115 - RNA, 19 nt, Homo sapiens
aagauggaaugacuaugaa

SEQ ID NO: 1409116 - RNA, 19 nt, Homo sapiens
ccggaggaauuuaacuuug

SEQ ID NO: 1409117 - RNA, 19 nt, Homo sapiens
cauugagaguguugauuug

SEQ ID NO: 1409118 - RNA, 19 nt, Homo sapiens
ggugaaggccuuuauuguc

SEQ ID NO: 1409119 - RNA, 19 nt, Homo sapiens
agaacucugugccugguuu

SEQ ID NO: 1409120 - RNA, 19 nt, Homo sapiens
caucauacagacauuguug

SEQ ID NO: 1409121 - RNA, 19 nt, Homo sapiens
uccgaucgcugguuaaauc

SEQ ID NO: 1409122 - RNA, 19 nt, Homo sapiens
ggcaagagagguccaaauc

SEQ ID NO: 1409123 - RNA, 19 nt, Homo sapiens
gguggugacuugagaacuc

SEQ ID NO: 1409124 - RNA, 19 nt, Homo sapiens
ugaagagggcuacauuugu

SEQ ID NO: 1409125 - RNA, 19 nt, Homo sapiens
cacaaauccuuccacaaca

SEQ ID NO: 1409126 - RNA, 19 nt, Homo sapiens
ccauacaaguacccaagga

SEQ ID NO: 1409127 - RNA, 19 nt, Homo sapiens
acaaauccuuccacaacau

SEQ ID NO: 1409128 - RNA, 19 nt, Homo sapiens
ggauuguggcuaccauuug

SEQ ID NO: 1409129 - RNA, 19 nt, Homo sapiens
guuauguacuggacuacug

SEQ ID NO: 1409130 - RNA, 19 nt, Homo sapiens
ggacagaggaaagauggau

SEQ ID NO: 1409131 - RNA, 19 nt, Homo sapiens
ucggaaacgggacuaauuu

SEQ ID NO: 1409132 - RNA, 19 nt, Homo sapiens
ccaagggcauugugaccau

SEQ ID NO: 1409133 - RNA, 19 nt, Homo sapiens
caaaucccuggccacuuua

SEQ ID NO: 1409134 - RNA, 19 nt, Homo sapiens
cagcaugucaagucaguga

SEQ ID NO: 1409135 - RNA, 19 nt, Homo sapiens
cagagaagacagcuaaagu

SEQ ID NO: 1409136 - RNA, 19 nt, Homo sapiens
ccugugagccucuucaugu

SEQ ID NO: 1409137 - RNA, 19 nt, Homo sapiens
ggcagguggugacuugaga

SEQ ID NO: 1409138 - RNA, 19 nt, Homo sapiens
guguugauuugggaaagua

SEQ ID NO: 1409139 - RNA, 19 nt, Homo sapiens
aaucggcagugaacucaga

SEQ ID NO: 1409140 - RNA, 19 nt, Homo sapiens
ccaauggucaucuucuuca

SEQ ID NO: 1409141 - RNA, 19 nt, Homo sapiens
ccaaggaacguggaguuug

SEQ ID NO: 1409142 - RNA, 19 nt, Homo sapiens
gaaacauuggcaucagaau

SEQ ID NO: 1409143 - RNA, 19 nt, Homo sapiens
uuacggagccugaagacau

SEQ ID NO: 1409144 - RNA, 19 nt, Homo sapiens
gauggaaugacuaugaagu

SEQ ID NO: 1409145 - RNA, 19 nt, Homo sapiens
ggacagcggguuguacagu

SEQ ID NO: 1409146 - RNA, 19 nt, Homo sapiens
ggaaauuacggagccugaa

SEQ ID NO: 1409147 - RNA, 19 nt, Homo sapiens
ugcaguggcuaaugagguu

SEQ ID NO: 1409148 - RNA, 19 nt, Homo sapiens
acagggaucaucuucauuc

SEQ ID NO: 1409149 - RNA, 19 nt, Homo sapiens
uagccaacgucuucacaca

SEQ ID NO: 1409150 - RNA, 19 nt, Homo sapiens
ccaaggggaugaaguaaag

SEQ ID NO: 1409151 - RNA, 19 nt, Homo sapiens
gauguaaucggcagugaac

SEQ ID NO: 1409152 - RNA, 19 nt, Homo sapiens
acaaggaucagcugaccaa

SEQ ID NO: 1409153 - RNA, 19 nt, Homo sapiens
guggugaaggccuuuauug

SEQ ID NO: 1409154 - RNA, 19 nt, Homo sapiens
gucggaaacgggacuaauu

SEQ ID NO: 1409155 - RNA, 19 nt, Homo sapiens
gcgaacagggaucaucuuc

SEQ ID NO: 1409156 - RNA, 19 nt, Homo sapiens
accaugcaguggcuaauga

SEQ ID NO: 1409157 - RNA, 19 nt, Homo sapiens
agagaagacagcuaaagug

SEQ ID NO: 1409158 - RNA, 19 nt, Homo sapiens
cugccggucuuuaucagaa

SEQ ID NO: 1409159 - RNA, 19 nt, Homo sapiens
cagauguaaucggcaguga

SEQ ID NO: 1409160 - RNA, 19 nt, Homo sapiens
agacuggucagauguaauc

SEQ ID NO: 1409161 - RNA, 19 nt, Homo sapiens
gaaauuagcuguuugguau

SEQ ID NO: 1409162 - RNA, 19 nt, Homo sapiens
ggaagaagaugaauccuua

SEQ ID NO: 1409163 - RNA, 19 nt, Homo sapiens
ggacagcaguuucuuauau

SEQ ID NO: 1409164 - RNA, 19 nt, Homo sapiens
gagaaagcaucuaaacuaa

SEQ ID NO: 1409165 - RNA, 19 nt, Homo sapiens
gcaaugcucucucaagauu

SEQ ID NO: 1409166 - RNA, 19 nt, Homo sapiens
ggaggagggugacgaauuu

SEQ ID NO: 1409167 - RNA, 19 nt, Homo sapiens
ggaguuaguugcuguauau

SEQ ID NO: 1409168 - RNA, 19 nt, Homo sapiens
gaaagcaucuaaacuaaca

SEQ ID NO: 1409169 - RNA, 19 nt, Homo sapiens
ugauaaaccuuggcaauua

SEQ ID NO: 1409170 - RNA, 19 nt, Homo sapiens
gaacaucauucaaggcaaa

SEQ ID NO: 1409171 - RNA, 19 nt, Homo sapiens
ggaaagcccuugagaaucu

SEQ ID NO: 1409172 - RNA, 19 nt, Homo sapiens
gaugaaaugugacugauau

SEQ ID NO: 1409173 - RNA, 19 nt, Homo sapiens
gauaaaccuuggcaauuaa

SEQ ID NO: 1409174 - RNA, 19 nt, Homo sapiens
gcaauuaaaugcaaagaag

SEQ ID NO: 1409175 - RNA, 19 nt, Homo sapiens
uaagguagauggugaaguu

SEQ ID NO: 1409176 - RNA, 19 nt, Homo sapiens
ccaacaagaugaaauguga

SEQ ID NO: 1409177 - RNA, 19 nt, Homo sapiens
gcaaaucaauaaggaauga

SEQ ID NO: 1409178 - RNA, 19 nt, Homo sapiens
ucacauugcucaacucaaa

SEQ ID NO: 1409179 - RNA, 19 nt, Homo sapiens
ggagagagauaacaaacug

SEQ ID NO: 1409180 - RNA, 19 nt, Homo sapiens
gacagcaguuucuuauaua

SEQ ID NO: 1409181 - RNA, 19 nt, Homo sapiens
ccacugcucuuucucauga

SEQ ID NO: 1409182 - RNA, 19 nt, Homo sapiens
uggaggaucuuaaugauuu

SEQ ID NO: 1409183 - RNA, 19 nt, Homo sapiens
gcuuaaagauggagccuaa

SEQ ID NO: 1409184 - RNA, 19 nt, Homo sapiens
ggucuacucugguuuguga

SEQ ID NO: 1409185 - RNA, 19 nt, Homo sapiens
cagaugaacucgauaagga

SEQ ID NO: 1409186 - RNA, 19 nt, Homo sapiens
gaagaaggaaggacacgua

SEQ ID NO: 1409187 - RNA, 19 nt, Homo sapiens
gaauauaaauggugcacau

SEQ ID NO: 1409188 - RNA, 19 nt, Homo sapiens
ugagaaagcaucuaaacua

SEQ ID NO: 1409189 - RNA, 19 nt, Homo sapiens
gaacacuaauccuggcaaa

SEQ ID NO: 1409190 - RNA, 19 nt, Homo sapiens
gugaauggaucuaaguaaa

SEQ ID NO: 1409191 - RNA, 19 nt, Homo sapiens
gcauugauguuaagugaau

SEQ ID NO: 1409192 - RNA, 19 nt, Homo sapiens
gaagaugaauccuuaaagc

SEQ ID NO: 1409193 - RNA, 19 nt, Homo sapiens
gagaauggauugguagaga

SEQ ID NO: 1409194 - RNA, 19 nt, Homo sapiens
ggaauuaaugaccaaguua

SEQ ID NO: 1409195 - RNA, 19 nt, Homo sapiens
caauaagggauucuaguua

SEQ ID NO: 1409196 - RNA, 19 nt, Homo sapiens
uaaugaagaugaugcaaug

SEQ ID NO: 1409197 - RNA, 19 nt, Homo sapiens
gaaucucucucgaaguauu

SEQ ID NO: 1409198 - RNA, 19 nt, Homo sapiens
gaauggaucuaaguaaauc

SEQ ID NO: 1409199 - RNA, 19 nt, Homo sapiens
gcacauaaguucacaaacc

SEQ ID NO: 1409200 - RNA, 19 nt, Homo sapiens
gaaaugugacugauaugaa

SEQ ID NO: 1409201 - RNA, 19 nt, Homo sapiens
gcaaugaacagacuagaau

SEQ ID NO: 1409202 - RNA, 19 nt, Homo sapiens
gaagggauuucagaagcua

SEQ ID NO: 1409203 - RNA, 19 nt, Homo sapiens
ggaggaucuuaaugauuua

SEQ ID NO: 1409204 - RNA, 19 nt, Homo sapiens
uaaagcaguuagaccagua

SEQ ID NO: 1409205 - RNA, 19 nt, Homo sapiens
gaacacugccucucacaga

SEQ ID NO: 1409206 - RNA, 19 nt, Homo sapiens
ccaaguauguaaucagaga

SEQ ID NO: 1409207 - RNA, 19 nt, Homo sapiens
gaacucacauugcucaacu

SEQ ID NO: 1409208 - RNA, 19 nt, Homo sapiens
gcaguuauucaaauccuua

SEQ ID NO: 1409209 - RNA, 19 nt, Homo sapiens
gcaagugguccuuaaagaa

SEQ ID NO: 1409210 - RNA, 19 nt, Homo sapiens
ggaagcagaacaagagaaa

SEQ ID NO: 1409211 - RNA, 19 nt, Homo sapiens
gagacaaccuggaagaaag

SEQ ID NO: 1409212 - RNA, 19 nt, Homo sapiens
caagugguccuuaaagaaa

SEQ ID NO: 1409213 - RNA, 19 nt, Homo sapiens
gaaggaaggacacguaaca

SEQ ID NO: 1409214 - RNA, 19 nt, Homo sapiens
ggaaacagaccaccaccaa

SEQ ID NO: 1409215 - RNA, 19 nt, Homo sapiens
aagcaaacauugauugguu

SEQ ID NO: 1409216 - RNA, 19 nt, Homo sapiens
uuaggucucugcagaaauu

SEQ ID NO: 1409217 - RNA, 19 nt, Homo sapiens
ccgcugaucuucuucuuug

SEQ ID NO: 1409218 - RNA, 19 nt, Homo sapiens
gaugaauccuuaaagcaau

SEQ ID NO: 1409219 - RNA, 19 nt, Homo sapiens
guauugcaauuucagauga

SEQ ID NO: 1409220 - RNA, 19 nt, Homo sapiens
ugacagcuguucauauuag

SEQ ID NO: 1409221 - RNA, 19 nt, Homo sapiens
gcagguaguucaucaacca

SEQ ID NO: 1409222 - RNA, 19 nt, Homo sapiens
cuaaguaagugcuugcuau

SEQ ID NO: 1409223 - RNA, 19 nt, Homo sapiens
gucugugacuuauuacuua

SEQ ID NO: 1409224 - RNA, 19 nt, Homo sapiens
cuugacagcuguucauauu

SEQ ID NO: 1409225 - RNA, 19 nt, Homo sapiens
gccaagaugugccauuuag

SEQ ID NO: 1409226 - RNA, 19 nt, Homo sapiens
ggagacaaccuggaagaaa

SEQ ID NO: 1409227 - RNA, 19 nt, Homo sapiens
gauuucagcccaacuuaaa

SEQ ID NO: 1409228 - RNA, 19 nt, Homo sapiens
gaauuuccaguaacacuuu

SEQ ID NO: 1409229 - RNA, 19 nt, Homo sapiens
gcccaaguauguaaucaga

SEQ ID NO: 1409230 - RNA, 19 nt, Homo sapiens
gaagauaguggcucuaguc

SEQ ID NO: 1409231 - RNA, 19 nt, Homo sapiens
aggaaacagugacauuuaa

SEQ ID NO: 1409232 - RNA, 19 nt, Homo sapiens
gguaaccucuuguagaagu

SEQ ID NO: 1409233 - RNA, 19 nt, Homo sapiens
uaauauuucuccaccauca

SEQ ID NO: 1409234 - RNA, 19 nt, Homo sapiens
aaacagaauucgguauuuc

SEQ ID NO: 1409235 - RNA, 19 nt, Homo sapiens
gaaacagagagaagaaguu

SEQ ID NO: 1409236 - RNA, 19 nt, Homo sapiens
ugaagaugaugcaauggaa

SEQ ID NO: 1409237 - RNA, 19 nt, Homo sapiens
ccgcaaugcucucucaaga

SEQ ID NO: 1409238 - RNA, 19 nt, Homo sapiens
ucacagaauccuagcuuaa

SEQ ID NO: 1409239 - RNA, 19 nt, Homo sapiens
ugaauugaaucacauccuu

SEQ ID NO: 1409240 - RNA, 19 nt, Homo sapiens
gaccaguaccugacaauau

SEQ ID NO: 1409241 - RNA, 19 nt, Homo sapiens
ucuaauggacuacauauug

SEQ ID NO: 1409242 - RNA, 19 nt, Homo sapiens
cugcagaaauuagcuguuu

SEQ ID NO: 1409243 - RNA, 19 nt, Homo sapiens
gugccaagaugugccauuu

SEQ ID NO: 1409244 - RNA, 19 nt, Homo sapiens
uagcaugucugagcacuau

SEQ ID NO: 1409245 - RNA, 19 nt, Homo sapiens
gauggagccuaagaacaaa

SEQ ID NO: 1409246 - RNA, 19 nt, Homo sapiens
uaaggaaacagugacauuu

SEQ ID NO: 1409247 - RNA, 19 nt, Homo sapiens
gauuucagaagcuaugaua

SEQ ID NO: 1409248 - RNA, 19 nt, Homo sapiens
caagaugaaaugugacuga

SEQ ID NO: 1409249 - RNA, 19 nt, Homo sapiens
gaagaagaugaauccuuaa

SEQ ID NO: 1409250 - RNA, 19 nt, Homo sapiens
agaagagucacuaccaaua

SEQ ID NO: 1409251 - RNA, 19 nt, Homo sapiens
gaagaaaggacagaagagu

SEQ ID NO: 1409252 - RNA, 19 nt, Homo sapiens
gguagauggugaaguuuag

SEQ ID NO: 1409253 - RNA, 19 nt, Homo sapiens
caagugacacagaaaguga

SEQ ID NO: 1409254 - RNA, 19 nt, Homo sapiens
guaaagccauguuuuccua

SEQ ID NO: 1409255 - RNA, 19 nt, Homo sapiens
aaggaaacagugacauuua

SEQ ID NO: 1409256 - RNA, 19 nt, Homo sapiens
gaaugagggcaguaacuug

SEQ ID NO: 1409257 - RNA, 19 nt, Homo sapiens
gagacuacuuuaagacagu

SEQ ID NO: 1409258 - RNA, 19 nt, Homo sapiens
aggguaaccucuuguagaa

SEQ ID NO: 1409259 - RNA, 19 nt, Homo sapiens
uaaauacugugaggaagau

SEQ ID NO: 1409260 - RNA, 19 nt, Homo sapiens
ccaauuaagaugauccauu

SEQ ID NO: 1409261 - RNA, 19 nt, Homo sapiens
gaaauacagucuagacaug

SEQ ID NO: 1409262 - RNA, 19 nt, Homo sapiens
cauaagacaugcacacuaa

SEQ ID NO: 1409263 - RNA, 19 nt, Homo sapiens
ggagaaggcucggaaagaa

SEQ ID NO: 1409264 - RNA, 19 nt, Homo sapiens
gaacacccauaguuaagaa

SEQ ID NO: 1409265 - RNA, 19 nt, Homo sapiens
gaauucagcugcuccauca

SEQ ID NO: 1409266 - RNA, 19 nt, Homo sapiens
ucucugagcucaucucuuu

SEQ ID NO: 1409267 - RNA, 19 nt, Homo sapiens
gaacuggacaaaucuuaua

SEQ ID NO: 1409268 - RNA, 19 nt, Homo sapiens
agacagggcugcuaaguga

SEQ ID NO: 1409269 - RNA, 19 nt, Homo sapiens
gcacaauauugacacagua

SEQ ID NO: 1409270 - RNA, 19 nt, Homo sapiens
cauauugguuccagugaua

SEQ ID NO: 1409271 - RNA, 19 nt, Homo sapiens
gaugaacacccauaguuaa

SEQ ID NO: 1409272 - RNA, 19 nt, Homo sapiens
ggaaauaaaugugaaagcu

SEQ ID NO: 1409273 - RNA, 19 nt, Homo sapiens
gaucugcuguucaucauca

SEQ ID NO: 1409274 - RNA, 19 nt, Homo sapiens
gaacgcacauucagcuuac

SEQ ID NO: 1409275 - RNA, 19 nt, Homo sapiens
cugcuaagcuuggauuuaa

SEQ ID NO: 1409276 - RNA, 19 nt, Homo sapiens
uaagacaugcacacuaaua

SEQ ID NO: 1409277 - RNA, 19 nt, Homo sapiens
ucaaugaccucaaugugau

SEQ ID NO: 1409278 - RNA, 19 nt, Homo sapiens
ccaaacaccucaccaacuc

SEQ ID NO: 1409279 - RNA, 19 nt, Homo sapiens
uaacaucucugagcucauc

SEQ ID NO: 1409280 - RNA, 19 nt, Homo sapiens
acacacagcugcagaguac

SEQ ID NO: 1409281 - RNA, 19 nt, Homo sapiens
gaaagucucucuccuuccu

SEQ ID NO: 1409282 - RNA, 19 nt, Homo sapiens
uaaccaagacauggaaaua

SEQ ID NO: 1409283 - RNA, 19 nt, Homo sapiens
gagaagacauaaccaagac

SEQ ID NO: 1409284 - RNA, 19 nt, Homo sapiens
gcaauuccauauccuuucu

SEQ ID NO: 1409285 - RNA, 19 nt, Homo sapiens
uuuauuggcuggcuuagaa

SEQ ID NO: 1409286 - RNA, 19 nt, Homo sapiens
guaagcagcguucacauuc

SEQ ID NO: 1409287 - RNA, 19 nt, Homo sapiens
ugaugaacacccauaguua

SEQ ID NO: 1409288 - RNA, 19 nt, Homo sapiens
gauaauauacaaccucaca

SEQ ID NO: 1409289 - RNA, 19 nt, Homo sapiens
ucagcgaacuggacaaauc

SEQ ID NO: 1409290 - RNA, 19 nt, Homo sapiens
gaagcacaauauugacaca

SEQ ID NO: 1409291 - RNA, 19 nt, Homo sapiens
accaagacauggaaauaaa

SEQ ID NO: 1409292 - RNA, 19 nt, Homo sapiens
gaaagcuuguggaaagucu

SEQ ID NO: 1409293 - RNA, 19 nt, Homo sapiens
acucacugcuucaccauaa

SEQ ID NO: 1409294 - RNA, 19 nt, Homo sapiens
gcgaacuggacaaaucuua

SEQ ID NO: 1409295 - RNA, 19 nt, Homo sapiens
caacucggcaugugaugaa

SEQ ID NO: 1409296 - RNA, 19 nt, Homo sapiens
aagcuuggauuuaacugaa

SEQ ID NO: 1409297 - RNA, 19 nt, Homo sapiens
aagaaaccauggagcaaga

SEQ ID NO: 1409298 - RNA, 19 nt, Homo sapiens
ccucuccaguguagcaaua

SEQ ID NO: 1409299 - RNA, 19 nt, Homo sapiens
ggaacucccucuugcucau

SEQ ID NO: 1409300 - RNA, 19 nt, Homo sapiens
gcacacuaauacacauaca

SEQ ID NO: 1409301 - RNA, 19 nt, Homo sapiens
gugaugaacacccauaguu

SEQ ID NO: 1409302 - RNA, 19 nt, Homo sapiens
gaacgauacuuugaauucc

SEQ ID NO: 1409303 - RNA, 19 nt, Homo sapiens
gcuccgaucugcuguucau

SEQ ID NO: 1409304 - RNA, 19 nt, Homo sapiens
caagacauggaaauaaaug

SEQ ID NO: 1409305 - RNA, 19 nt, Homo sapiens
gaaaccauggagcaagaaa

SEQ ID NO: 1409306 - RNA, 19 nt, Homo sapiens
gcccuggccuugcucaugu

SEQ ID NO: 1409307 - RNA, 19 nt, Homo sapiens
gaggcaaucuggcaaaaga

SEQ ID NO: 1409308 - RNA, 19 nt, Homo sapiens
uagacaugcugcaaggaaa

SEQ ID NO: 1409309 - RNA, 19 nt, Homo sapiens
gaucuccucagcagaaaga

SEQ ID NO: 1409310 - RNA, 19 nt, Homo sapiens
gaagacauaaccaagacau

SEQ ID NO: 1409311 - RNA, 19 nt, Homo sapiens
uaauacacauacacaccaa

SEQ ID NO: 1409312 - RNA, 19 nt, Homo sapiens
cccagaagcacaauauuga

SEQ ID NO: 1409313 - RNA, 19 nt, Homo sapiens
uuauguguguugaaggaua

SEQ ID NO: 1409314 - RNA, 19 nt, Homo sapiens
ugagaagacauaaccaaga

SEQ ID NO: 1409315 - RNA, 19 nt, Homo sapiens
agcgguaccuggcauguaa

SEQ ID NO: 1409316 - RNA, 19 nt, Homo sapiens
ugaauucccuuugcuagag

SEQ ID NO: 1409317 - RNA, 19 nt, Homo sapiens
agaacgauacuuugaauuc

SEQ ID NO: 1409318 - RNA, 19 nt, Homo sapiens
cugagugucuuaugugugu

SEQ ID NO: 1409319 - RNA, 19 nt, Homo sapiens
gagagcaagugaggcaauc

SEQ ID NO: 1409320 - RNA, 19 nt, Homo sapiens
ucucucuccuuccucauaa

SEQ ID NO: 1409321 - RNA, 19 nt, Homo sapiens
caauauugacacaguaguu

SEQ ID NO: 1409322 - RNA, 19 nt, Homo sapiens
guuagccucuccaguguag

SEQ ID NO: 1409323 - RNA, 19 nt, Homo sapiens
caaaggacugcgucuggaa

SEQ ID NO: 1409324 - RNA, 19 nt, Homo sapiens
ccacccagaagcacaauau

SEQ ID NO: 1409325 - RNA, 19 nt, Homo sapiens
gaagagucaaagagcuaaa

SEQ ID NO: 1409326 - RNA, 19 nt, Homo sapiens
cugaagauccggcagaaga

SEQ ID NO: 1409327 - RNA, 19 nt, Homo sapiens
cuggacaaaucuuauaauc

SEQ ID NO: 1409328 - RNA, 19 nt, Homo sapiens
ccuccgagcuaacaucucu

SEQ ID NO: 1409329 - RNA, 19 nt, Homo sapiens
ucuccaguguagcaauaua

SEQ ID NO: 1409330 - RNA, 19 nt, Homo sapiens
ucauaagacaugcacacua

SEQ ID NO: 1409331 - RNA, 19 nt, Homo sapiens
gaguacaugcucucagaug

SEQ ID NO: 1409332 - RNA, 19 nt, Homo sapiens
ccgaagagucaaagagcua

SEQ ID NO: 1409333 - RNA, 19 nt, Homo sapiens
ccaagacauggaaauaaau

SEQ ID NO: 1409334 - RNA, 19 nt, Homo sapiens
gacauaaccaagacaugga

SEQ ID NO: 1409335 - RNA, 19 nt, Homo sapiens
ucaaugugauccuucuuuu

SEQ ID NO: 1409336 - RNA, 19 nt, Homo sapiens
ggacaaacgacuuuuaucu

SEQ ID NO: 1409337 - RNA, 19 nt, Homo sapiens
uaagugaugagacccaugu

SEQ ID NO: 1409338 - RNA, 19 nt, Homo sapiens
ccuauaccuuggucauuuc

SEQ ID NO: 1409339 - RNA, 19 nt, Homo sapiens
accuauaccuuggucauuu

SEQ ID NO: 1409340 - RNA, 19 nt, Homo sapiens
gagcgguaccuggcaugua

SEQ ID NO: 1409341 - RNA, 19 nt, Homo sapiens
ggauacaaccacccagaag

SEQ ID NO: 1409342 - RNA, 19 nt, Homo sapiens
uuccauauccuuucuugaa

SEQ ID NO: 1409343 - RNA, 19 nt, Homo sapiens
aaccaagacauggaaauaa

SEQ ID NO: 1409344 - RNA, 19 nt, Homo sapiens
aaacugcuaagcuuggauu

SEQ ID NO: 1409345 - RNA, 19 nt, Homo sapiens
augagaugcucccagcuuu

SEQ ID NO: 1409346 - RNA, 19 nt, Homo sapiens
ccauauugguuccagugau

SEQ ID NO: 1409347 - RNA, 19 nt, Homo sapiens
uguaagcagcguucacauu

SEQ ID NO: 1409348 - RNA, 19 nt, Homo sapiens
ccuauguguucuggaauga

SEQ ID NO: 1409349 - RNA, 19 nt, Homo sapiens
gacuuuauuggcuggcuua

SEQ ID NO: 1409350 - RNA, 19 nt, Homo sapiens
caaccacccagaagcacaa

SEQ ID NO: 1409351 - RNA, 19 nt, Homo sapiens
ucuuauguguguugaagga

SEQ ID NO: 1409352 - RNA, 19 nt, Homo sapiens
caucaaugaccucaaugug

SEQ ID NO: 1409353 - RNA, 19 nt, Homo sapiens
ucccaucaaugaccucaau

SEQ ID NO: 1409354 - RNA, 19 nt, Homo sapiens
acaaacgacuuuuaucugu

SEQ ID NO: 1409355 - RNA, 19 nt, Homo sapiens
ugguuccagugauaauaua

SEQ ID NO: 1409356 - RNA, 19 nt, Homo sapiens
cgaacuggacaaaucuuau

SEQ ID NO: 1409357 - RNA, 19 nt, Homo sapiens
caucagcgaacuggacaaa

SEQ ID NO: 1409358 - RNA, 19 nt, Homo sapiens
cuagacaugcugcaaggaa

SEQ ID NO: 1409359 - RNA, 19 nt, Homo sapiens
cauguuauccuaaaaguga

SEQ ID NO: 1409360 - RNA, 19 nt, Homo sapiens
agaaauacagucuagacau

SEQ ID NO: 1409361 - RNA, 19 nt, Homo sapiens
gaacagacguuuaucuauc

SEQ ID NO: 1409362 - RNA, 19 nt, Homo sapiens
ggaacuacuuugugaaauu

SEQ ID NO: 1409363 - RNA, 19 nt, Homo sapiens
gagaagaauuugaugaaga

SEQ ID NO: 1409364 - RNA, 19 nt, Homo sapiens
caauaaaccuguccacaau

SEQ ID NO: 1409365 - RNA, 19 nt, Homo sapiens
gcagcuuuaugccaaauua

SEQ ID NO: 1409366 - RNA, 19 nt, Homo sapiens
gaagucaucuagauuaugg

SEQ ID NO: 1409367 - RNA, 19 nt, Homo sapiens
cuaaggaacuacuuuguga

SEQ ID NO: 1409368 - RNA, 19 nt, Homo sapiens
ggucaagugugcaaacaga

SEQ ID NO: 1409369 - RNA, 19 nt, Homo sapiens
gaaagugauugagcagaau

SEQ ID NO: 1409370 - RNA, 19 nt, Homo sapiens
aaacugcucagcuucaaua

SEQ ID NO: 1409371 - RNA, 19 nt, Homo sapiens
ggaaacugcucagcuucaa

SEQ ID NO: 1409372 - RNA, 19 nt, Homo sapiens
agaaagugauugagcagaa

SEQ ID NO: 1409373 - RNA, 19 nt, Homo sapiens
ggcccuagguauugacuuu

SEQ ID NO: 1409374 - RNA, 19 nt, Homo sapiens
ggagaagaauuugaugaag

SEQ ID NO: 1409375 - RNA, 19 nt, Homo sapiens
ucaauaaaccuguccacaa

SEQ ID NO: 1409376 - RNA, 19 nt, Homo sapiens
ccugaagucaucuagauua

SEQ ID NO: 1409377 - RNA, 19 nt, Homo sapiens
gcaagaguuugguuaucug

SEQ ID NO: 1409378 - RNA, 19 nt, Homo sapiens
auaaaccuguccacaauga

SEQ ID NO: 1409379 - RNA, 19 nt, Homo sapiens
cguguaaccugaagucauc

SEQ ID NO: 1409380 - RNA, 19 nt, Homo sapiens
agacugaacagacguuuau

SEQ ID NO: 1409381 - RNA, 19 nt, Homo sapiens
acuuguggcugcagcuuua

SEQ ID NO: 1409382 - RNA, 19 nt, Homo sapiens
ggaaauguucugugaaggu

SEQ ID NO: 1409383 - RNA, 19 nt, Homo sapiens
caacuucgagggcuacaug

SEQ ID NO: 1409384 - RNA, 19 nt, Homo sapiens
caaacagacauuccagaga

SEQ ID NO: 1409385 - RNA, 19 nt, Homo sapiens
acguuuaucuaucccauuu

SEQ ID NO: 1409386 - RNA, 19 nt, Homo sapiens
aacagaggcuggacccauu

SEQ ID NO: 1409387 - RNA, 19 nt, Homo sapiens
cugcucagcuucaauaaac

SEQ ID NO: 1409388 - RNA, 19 nt, Homo sapiens
gaucgaaggagacaaacuc

SEQ ID NO: 1409389 - RNA, 19 nt, Homo sapiens
cagagagccugauccacau

SEQ ID NO: 1409390 - RNA, 19 nt, Homo sapiens
aaaccuguccacaaugaaa

SEQ ID NO: 1409391 - RNA, 19 nt, Homo sapiens
gcucagcagcgacaacuuc

SEQ ID NO: 1409392 - RNA, 19 nt, Homo sapiens
aaccugaagucaucuagau

SEQ ID NO: 1409393 - RNA, 19 nt, Homo sapiens
ugaacagacguuuaucuau

SEQ ID NO: 1409394 - RNA, 19 nt, Homo sapiens
cugaagucaucuagauuau

SEQ ID NO: 1409395 - RNA, 19 nt, Homo sapiens
cugaacagacguuuaucua

SEQ ID NO: 1409396 - RNA, 19 nt, Homo sapiens
gaagccacagaaagugauu

SEQ ID NO: 1409397 - RNA, 19 nt, Homo sapiens
aaaugcaagaguuugguua

SEQ ID NO: 1409398 - RNA, 19 nt, Homo sapiens
gaccucagcgguacuugga

SEQ ID NO: 1409399 - RNA, 19 nt, Homo sapiens
gggaaacugcucagcuuca

SEQ ID NO: 1409400 - RNA, 19 nt, Homo sapiens
ugacuuugccacucguaaa

SEQ ID NO: 1409401 - RNA, 19 nt, Homo sapiens
acagaggccuggacaacag

SEQ ID NO: 1409402 - RNA, 19 nt, Homo sapiens
uaacagaggccuggacaac

SEQ ID NO: 1409403 - RNA, 19 nt, Homo sapiens
uggagaagaauuugaugaa

SEQ ID NO: 1409404 - RNA, 19 nt, Homo sapiens
gaaacugcucagcuucaau

SEQ ID NO: 1409405 - RNA, 19 nt, Homo sapiens
cuggaaauguucugugaag

SEQ ID NO: 1409406 - RNA, 19 nt, Homo sapiens
aaggaacuacuuugugaaa

SEQ ID NO: 1409407 - RNA, 19 nt, Homo sapiens
guuuaucuaucccauuugg

SEQ ID NO: 1409408 - RNA, 19 nt, Homo sapiens
gcucaccuguauccagaag

SEQ ID NO: 1409409 - RNA, 19 nt, Homo sapiens
cagacugaacagacguuua

SEQ ID NO: 1409410 - RNA, 19 nt, Homo sapiens
gcugcagcuuuaugccaaa

SEQ ID NO: 1409411 - RNA, 19 nt, Homo sapiens
gaaggucaagugugcaaac

SEQ ID NO: 1409412 - RNA, 19 nt, Homo sapiens
caugcuggcccuagguauu

SEQ ID NO: 1409413 - RNA, 19 nt, Homo sapiens
ugcaagaguuugguuaucu

SEQ ID NO: 1409414 - RNA, 19 nt, Homo sapiens
uaaggaacuacuuugugaa

SEQ ID NO: 1409415 - RNA, 19 nt, Homo sapiens
cagccuaaggaacuacuuu

SEQ ID NO: 1409416 - RNA, 19 nt, Homo sapiens
cagcagcagagcccacuug

SEQ ID NO: 1409417 - RNA, 19 nt, Homo sapiens
cacacgaacagcagccuaa

SEQ ID NO: 1409418 - RNA, 19 nt, Homo sapiens
gcagacugaacagacguuu

SEQ ID NO: 1409419 - RNA, 19 nt, Homo sapiens
ccuaaggaacuacuuugug

SEQ ID NO: 1409420 - RNA, 19 nt, Homo sapiens
acgaacagcagccuaagga

SEQ ID NO: 1409421 - RNA, 19 nt, Homo sapiens
uugguuaucugggacaaug

SEQ ID NO: 1409422 - RNA, 19 nt, Homo sapiens
acagcagccuaaggaacua

SEQ ID NO: 1409423 - RNA, 19 nt, Homo sapiens
uaaccugaagucaucuaga

SEQ ID NO: 1409424 - RNA, 19 nt, Homo sapiens
caacagaaaaugcaagagu

SEQ ID NO: 1409425 - RNA, 19 nt, Homo sapiens
ggagaucacucaucccuua

SEQ ID NO: 1409426 - RNA, 19 nt, Homo sapiens
ggauaaaucuggaggaaga

SEQ ID NO: 1409427 - RNA, 19 nt, Homo sapiens
ccuaauaacucaucaagaa

SEQ ID NO: 1409428 - RNA, 19 nt, Homo sapiens
gaagaugucuaggagauga

SEQ ID NO: 1409429 - RNA, 19 nt, Homo sapiens
ggaaagauuugcagguguu

SEQ ID NO: 1409430 - RNA, 19 nt, Homo sapiens
gaaaccagccagacgcuua

SEQ ID NO: 1409431 - RNA, 19 nt, Homo sapiens
ccaaagagaugaagcucaa

SEQ ID NO: 1409432 - RNA, 19 nt, Homo sapiens
ugagaggaaugauuucuuu

SEQ ID NO: 1409433 - RNA, 19 nt, Homo sapiens
uuucagaucuuguguguuu

SEQ ID NO: 1409434 - RNA, 19 nt, Homo sapiens
gcucugcgcugggaucaua

SEQ ID NO: 1409435 - RNA, 19 nt, Homo sapiens
gagaugaacuagaaauaag

SEQ ID NO: 1409436 - RNA, 19 nt, Homo sapiens
caauaugacugugcucuuu

SEQ ID NO: 1409437 - RNA, 19 nt, Homo sapiens
gagaugaagcucaaauaaa

SEQ ID NO: 1409438 - RNA, 19 nt, Homo sapiens
ggagaugaacuagaaauaa

SEQ ID NO: 1409439 - RNA, 19 nt, Homo sapiens
gaccaucucuaacuuaauc

SEQ ID NO: 1409440 - RNA, 19 nt, Homo sapiens
ccagcugacuuucaucuuu

SEQ ID NO: 1409441 - RNA, 19 nt, Homo sapiens
aaguuuggcuuccuaauaa

SEQ ID NO: 1409442 - RNA, 19 nt, Homo sapiens
gaccuagacuggauacgaa

SEQ ID NO: 1409443 - RNA, 19 nt, Homo sapiens
gaauggauguguauguauc

SEQ ID NO: 1409444 - RNA, 19 nt, Homo sapiens
cauaggcuccucugaguua

SEQ ID NO: 1409445 - RNA, 19 nt, Homo sapiens
gaaauaaggggucagauaa

SEQ ID NO: 1409446 - RNA, 19 nt, Homo sapiens
caacagcaaugaagauguc

SEQ ID NO: 1409447 - RNA, 19 nt, Homo sapiens
caugauuccuuauagcuuu

SEQ ID NO: 1409448 - RNA, 19 nt, Homo sapiens
uagaauggauguguaugua

SEQ ID NO: 1409449 - RNA, 19 nt, Homo sapiens
cagaccaucucuaacuuaa

SEQ ID NO: 1409450 - RNA, 19 nt, Homo sapiens
gauaugcaaugccuuucaa

SEQ ID NO: 1409451 - RNA, 19 nt, Homo sapiens
caccagcauucuaguauuu

SEQ ID NO: 1409452 - RNA, 19 nt, Homo sapiens
agacuuacuugcugguaua

SEQ ID NO: 1409453 - RNA, 19 nt, Homo sapiens
uuacaagccuucuccuuau

SEQ ID NO: 1409454 - RNA, 19 nt, Homo sapiens
ggauguguauguaucgauu

SEQ ID NO: 1409455 - RNA, 19 nt, Homo sapiens
gaucaacguucugaaagug

SEQ ID NO: 1409456 - RNA, 19 nt, Homo sapiens
gcaaugaagaugucuagga

SEQ ID NO: 1409457 - RNA, 19 nt, Homo sapiens
gccaagagcucacacuuuu

SEQ ID NO: 1409458 - RNA, 19 nt, Homo sapiens
uugccagucuucacaauua

SEQ ID NO: 1409459 - RNA, 19 nt, Homo sapiens
gaacaugaacaucaacauc

SEQ ID NO: 1409460 - RNA, 19 nt, Homo sapiens
cgggaaaccuacucagaaa

SEQ ID NO: 1409461 - RNA, 19 nt, Homo sapiens
gcagcucaauuacauuugu

SEQ ID NO: 1409462 - RNA, 19 nt, Homo sapiens
ggaggcaggaccaauauga

SEQ ID NO: 1409463 - RNA, 19 nt, Homo sapiens
caacaucaccaccuucaga

SEQ ID NO: 1409464 - RNA, 19 nt, Homo sapiens
ccacaucucugggcuuugu

SEQ ID NO: 1409465 - RNA, 19 nt, Homo sapiens
cuacaaggaggaaagauuu

SEQ ID NO: 1409466 - RNA, 19 nt, Homo sapiens
ggacuggacauuggacuaa

SEQ ID NO: 1409467 - RNA, 19 nt, Homo sapiens
ggaggaagacaacaguuug

SEQ ID NO: 1409468 - RNA, 19 nt, Homo sapiens
ggagaccuuucaacaggaa

SEQ ID NO: 1409469 - RNA, 19 nt, Homo sapiens
gcaaauccuccuacccaaa

SEQ ID NO: 1409470 - RNA, 19 nt, Homo sapiens
ccuaaagcauaagcuguua

SEQ ID NO: 1409471 - RNA, 19 nt, Homo sapiens
gcuauugcuaggacuauua

SEQ ID NO: 1409472 - RNA, 19 nt, Homo sapiens
ggaaaccuacucagaaaca

SEQ ID NO: 1409473 - RNA, 19 nt, Homo sapiens
ccaggauucuuuacacaga

SEQ ID NO: 1409474 - RNA, 19 nt, Homo sapiens
ugacaccaaucuacaagga

SEQ ID NO: 1409475 - RNA, 19 nt, Homo sapiens
gaauuuccuucuucacaca

SEQ ID NO: 1409476 - RNA, 19 nt, Homo sapiens
ggaucauacucccaaauca

SEQ ID NO: 1409477 - RNA, 19 nt, Homo sapiens
ccaagugccauacacagua

SEQ ID NO: 1409478 - RNA, 19 nt, Homo sapiens
ugguaaaggugccucuuaa

SEQ ID NO: 1409479 - RNA, 19 nt, Homo sapiens
gacaacaguuugcaucucu

SEQ ID NO: 1409480 - RNA, 19 nt, Homo sapiens
gcuccuuucugcucauauu

SEQ ID NO: 1409481 - RNA, 19 nt, Homo sapiens
cagcugacuuucaucuuug

SEQ ID NO: 1409482 - RNA, 19 nt, Homo sapiens
guucuucgguaaucuaugu

SEQ ID NO: 1409483 - RNA, 19 nt, Homo sapiens
gagacuuacuugcugguau

SEQ ID NO: 1409484 - RNA, 19 nt, Homo sapiens
cagcauauauucuagucau

SEQ ID NO: 1409485 - RNA, 19 nt, Homo sapiens
cccgaagcauccuccauua

SEQ ID NO: 1409486 - RNA, 19 nt, Homo sapiens
gacauucucaucuucaauu

SEQ ID NO: 1409487 - RNA, 19 nt, Homo sapiens
caugggaucuuucgucaag

SEQ ID NO: 1409488 - RNA, 19 nt, Homo sapiens
aaagugagcccauucaaca

SEQ ID NO: 1409489 - RNA, 19 nt, Homo sapiens
cauuucaccuucagcauau

SEQ ID NO: 1409490 - RNA, 19 nt, Homo sapiens
guacuuccuuccugacugu

SEQ ID NO: 1409491 - RNA, 19 nt, Homo sapiens
gaacuagcaguacuuccuu

SEQ ID NO: 1409492 - RNA, 19 nt, Homo sapiens
uaaacuggaucccgaagca

SEQ ID NO: 1409493 - RNA, 19 nt, Homo sapiens
guaaaggugccucuuaaag

SEQ ID NO: 1409494 - RNA, 19 nt, Homo sapiens
caacgucauucccuaccuu

SEQ ID NO: 1409495 - RNA, 19 nt, Homo sapiens
ccaccagcauucuaguauu

SEQ ID NO: 1409496 - RNA, 19 nt, Homo sapiens
cugauucacugcucacauu

SEQ ID NO: 1409497 - RNA, 19 nt, Homo sapiens
caucaccacuguucguuca

SEQ ID NO: 1409498 - RNA, 19 nt, Homo sapiens
ggacuaauuaucucaguag

SEQ ID NO: 1409499 - RNA, 19 nt, Homo sapiens
gcauauauucuagucauga

SEQ ID NO: 1409500 - RNA, 19 nt, Homo sapiens
cagaaacagacaagaauga

SEQ ID NO: 1409501 - RNA, 19 nt, Homo sapiens
uaaaagagguugauauggu

SEQ ID NO: 1409502 - RNA, 19 nt, Homo sapiens
ggacauuggacuaauuauc

SEQ ID NO: 1409503 - RNA, 19 nt, Homo sapiens
caggauaaaucuggaggaa

SEQ ID NO: 1409504 - RNA, 19 nt, Homo sapiens
gccagacgcuuauugacau

SEQ ID NO: 1409505 - RNA, 19 nt, Homo sapiens
gaugcgugcuuacaaucuu

SEQ ID NO: 1409506 - RNA, 19 nt, Homo sapiens
agagaugaagcucaaauaa

SEQ ID NO: 1409507 - RNA, 19 nt, Homo sapiens
ccagaccaucucuaacuua

SEQ ID NO: 1409508 - RNA, 19 nt, Homo sapiens
ucccaaaucacauuacuaa

SEQ ID NO: 1409509 - RNA, 19 nt, Homo sapiens
cagcguuacuggccuaugu

SEQ ID NO: 1409510 - RNA, 19 nt, Homo sapiens
agacugagccugagaugga

SEQ ID NO: 1409511 - RNA, 19 nt, Homo sapiens
uuuacaagccuucuccuua

SEQ ID NO: 1409512 - RNA, 19 nt, Homo sapiens
ugagugcucugcugaucaa

SEQ ID NO: 1409513 - RNA, 19 nt, Homo sapiens
caacugauuccuccucuca

SEQ ID NO: 1409514 - RNA, 19 nt, Homo sapiens
aaacagacaagaaugacaa

SEQ ID NO: 1409515 - RNA, 19 nt, Homo sapiens
ccuaacaccaacauuuaua

SEQ ID NO: 1409516 - RNA, 19 nt, Homo sapiens
gacauuggacuaauuaucu

SEQ ID NO: 1409517 - RNA, 19 nt, Homo sapiens
gcugaucaacguucugaaa

SEQ ID NO: 1409518 - RNA, 19 nt, Homo sapiens
ggaauggcacaacuagaga

SEQ ID NO: 1409519 - RNA, 19 nt, Homo sapiens
ugccaacaauuaucucuga

SEQ ID NO: 1409520 - RNA, 19 nt, Homo sapiens
gguaaaggugccucuuaaa

SEQ ID NO: 1409521 - RNA, 19 nt, Homo sapiens
gucauucccuaccuugaaa

SEQ ID NO: 1409522 - RNA, 19 nt, Homo sapiens
cgaaucaacaaauguauca

SEQ ID NO: 1409523 - RNA, 19 nt, Homo sapiens
gaaagugagcccauucaac

SEQ ID NO: 1409524 - RNA, 19 nt, Homo sapiens
gccagaccaucucuaacuu

SEQ ID NO: 1409525 - RNA, 19 nt, Homo sapiens
ggagaucacucaucccuua

SEQ ID NO: 1409526 - RNA, 19 nt, Homo sapiens
ggauaaaucuggaggaaga

SEQ ID NO: 1409527 - RNA, 19 nt, Homo sapiens
ccuaauaacucaucaagaa

SEQ ID NO: 1409528 - RNA, 19 nt, Homo sapiens
gaagaugucuaggagauga

SEQ ID NO: 1409529 - RNA, 19 nt, Homo sapiens
ggaaagauuugcagguguu

SEQ ID NO: 1409530 - RNA, 19 nt, Homo sapiens
gaaaccagccagacgcuua

SEQ ID NO: 1409531 - RNA, 19 nt, Homo sapiens
ccaaagagaugaagcucaa

SEQ ID NO: 1409532 - RNA, 19 nt, Homo sapiens
ugagaggaaugauuucuuu

SEQ ID NO: 1409533 - RNA, 19 nt, Homo sapiens
uuucagaucuuguguguuu

SEQ ID NO: 1409534 - RNA, 19 nt, Homo sapiens
gcucugcgcugggaucaua

SEQ ID NO: 1409535 - RNA, 19 nt, Homo sapiens
gagaugaacuagaaauaag

SEQ ID NO: 1409536 - RNA, 19 nt, Homo sapiens
caauaugacugugcucuuu

SEQ ID NO: 1409537 - RNA, 19 nt, Homo sapiens
gagaugaagcucaaauaaa

SEQ ID NO: 1409538 - RNA, 19 nt, Homo sapiens
ggagaugaacuagaaauaa

SEQ ID NO: 1409539 - RNA, 19 nt, Homo sapiens
gaccaucucuaacuuaauc

SEQ ID NO: 1409540 - RNA, 19 nt, Homo sapiens
ccugggagcuuaucucuga

SEQ ID NO: 1409541 - RNA, 19 nt, Homo sapiens
aaguuuggcuuccuaauaa

SEQ ID NO: 1409542 - RNA, 19 nt, Homo sapiens
gaccuagacuggauacgaa

SEQ ID NO: 1409543 - RNA, 19 nt, Homo sapiens
gaauggauguguauguauc

SEQ ID NO: 1409544 - RNA, 19 nt, Homo sapiens
cauaggcuccucugaguua

SEQ ID NO: 1409545 - RNA, 19 nt, Homo sapiens
gaaauaaggggucagauaa

SEQ ID NO: 1409546 - RNA, 19 nt, Homo sapiens
caacagcaaugaagauguc

SEQ ID NO: 1409547 - RNA, 19 nt, Homo sapiens
caugauuccuuauagcuuu

SEQ ID NO: 1409548 - RNA, 19 nt, Homo sapiens
uagaauggauguguaugua

SEQ ID NO: 1409549 - RNA, 19 nt, Homo sapiens
gagcuuaucucugaggaau

SEQ ID NO: 1409550 - RNA, 19 nt, Homo sapiens
cagaccaucucuaacuuaa

SEQ ID NO: 1409551 - RNA, 19 nt, Homo sapiens
gauaugcaaugccuuucaa

SEQ ID NO: 1409552 - RNA, 19 nt, Homo sapiens
agacuuacuugcugguaua

SEQ ID NO: 1409553 - RNA, 19 nt, Homo sapiens
uuacaagccuucuccuuau

SEQ ID NO: 1409554 - RNA, 19 nt, Homo sapiens
ggauguguauguaucgauu

SEQ ID NO: 1409555 - RNA, 19 nt, Homo sapiens
gaucaacguucugaaagug

SEQ ID NO: 1409556 - RNA, 19 nt, Homo sapiens
gcaaugaagaugucuagga

SEQ ID NO: 1409557 - RNA, 19 nt, Homo sapiens
gccaagagcucacacuuuu

SEQ ID NO: 1409558 - RNA, 19 nt, Homo sapiens
uugccagucuucacaauua

SEQ ID NO: 1409559 - RNA, 19 nt, Homo sapiens
gaacaugaacaucaacauc

SEQ ID NO: 1409560 - RNA, 19 nt, Homo sapiens
gucaguaucuguggaauga

SEQ ID NO: 1409561 - RNA, 19 nt, Homo sapiens
cgggaaaccuacucagaaa

SEQ ID NO: 1409562 - RNA, 19 nt, Homo sapiens
gcagcucaauuacauuugu

SEQ ID NO: 1409563 - RNA, 19 nt, Homo sapiens
ggaggcaggaccaauauga

SEQ ID NO: 1409564 - RNA, 19 nt, Homo sapiens
caacaucaccaccuucaga

SEQ ID NO: 1409565 - RNA, 19 nt, Homo sapiens
ccacaucucugggcuuugu

SEQ ID NO: 1409566 - RNA, 19 nt, Homo sapiens
cuacaaggaggaaagauuu

SEQ ID NO: 1409567 - RNA, 19 nt, Homo sapiens
ggacuggacauuggacuaa

SEQ ID NO: 1409568 - RNA, 19 nt, Homo sapiens
ugacugggauuauucagau

SEQ ID NO: 1409569 - RNA, 19 nt, Homo sapiens
ggaggaagacaacaguuug

SEQ ID NO: 1409570 - RNA, 19 nt, Homo sapiens
ggagaccuuucaacaggaa

SEQ ID NO: 1409571 - RNA, 19 nt, Homo sapiens
gcaaauccuccuacccaaa

SEQ ID NO: 1409572 - RNA, 19 nt, Homo sapiens
ccuaaagcauaagcuguua

SEQ ID NO: 1409573 - RNA, 19 nt, Homo sapiens
gcuauugcuaggacuauua

SEQ ID NO: 1409574 - RNA, 19 nt, Homo sapiens
ggaaaccuacucagaaaca

SEQ ID NO: 1409575 - RNA, 19 nt, Homo sapiens
ccaggauucuuuacacaga

SEQ ID NO: 1409576 - RNA, 19 nt, Homo sapiens
ugacaccaaucuacaagga

SEQ ID NO: 1409577 - RNA, 19 nt, Homo sapiens
gaauuuccuucuucacaca

SEQ ID NO: 1409578 - RNA, 19 nt, Homo sapiens
ggaucauacucccaaauca

SEQ ID NO: 1409579 - RNA, 19 nt, Homo sapiens
ccaagugccauacacagua

SEQ ID NO: 1409580 - RNA, 19 nt, Homo sapiens
ugguaaaggugccucuuaa

SEQ ID NO: 1409581 - RNA, 19 nt, Homo sapiens
gacaacaguuugcaucucu

SEQ ID NO: 1409582 - RNA, 19 nt, Homo sapiens
gcuccuuucugcucauauu

SEQ ID NO: 1409583 - RNA, 19 nt, Homo sapiens
guucuucgguaaucuaugu

SEQ ID NO: 1409584 - RNA, 19 nt, Homo sapiens
gagacuuacuugcugguau

SEQ ID NO: 1409585 - RNA, 19 nt, Homo sapiens
cagcauauauucuagucau

SEQ ID NO: 1409586 - RNA, 19 nt, Homo sapiens
cccgaagcauccuccauua

SEQ ID NO: 1409587 - RNA, 19 nt, Homo sapiens
gacauucucaucuucaauu

SEQ ID NO: 1409588 - RNA, 19 nt, Homo sapiens
caugggaucuuucgucaag

SEQ ID NO: 1409589 - RNA, 19 nt, Homo sapiens
aaagugagcccauucaaca

SEQ ID NO: 1409590 - RNA, 19 nt, Homo sapiens
gaugcaugcuuacaaucuu

SEQ ID NO: 1409591 - RNA, 19 nt, Homo sapiens
cauuucaccuucagcauau

SEQ ID NO: 1409592 - RNA, 19 nt, Homo sapiens
guacuuccuuccugacugu

SEQ ID NO: 1409593 - RNA, 19 nt, Homo sapiens
gaacuagcaguacuuccuu

SEQ ID NO: 1409594 - RNA, 19 nt, Homo sapiens
uaaacuggaucccgaagca

SEQ ID NO: 1409595 - RNA, 19 nt, Homo sapiens
guaaaggugccucuuaaag

SEQ ID NO: 1409596 - RNA, 19 nt, Homo sapiens
caacgucauucccuaccuu

SEQ ID NO: 1409597 - RNA, 19 nt, Homo sapiens
cugauucacugcucacauu

SEQ ID NO: 1409598 - RNA, 19 nt, Homo sapiens
caucaccacuguucguuca

SEQ ID NO: 1409599 - RNA, 19 nt, Homo sapiens
ggacuaauuaucucaguag

SEQ ID NO: 1409600 - RNA, 19 nt, Homo sapiens
gggauuauucagauuauug

SEQ ID NO: 1409601 - RNA, 19 nt, Homo sapiens
gcauauauucuagucauga

SEQ ID NO: 1409602 - RNA, 19 nt, Homo sapiens
cagaaacagacaagaauga

SEQ ID NO: 1409603 - RNA, 19 nt, Homo sapiens
uaaaagagguugauauggu

SEQ ID NO: 1409604 - RNA, 19 nt, Homo sapiens
ggacauuggacuaauuauc

SEQ ID NO: 1409605 - RNA, 19 nt, Homo sapiens
caggauaaaucuggaggaa

SEQ ID NO: 1409606 - RNA, 19 nt, Homo sapiens
gccagacgcuuauugacau

SEQ ID NO: 1409607 - RNA, 19 nt, Homo sapiens
agagaugaagcucaaauaa

SEQ ID NO: 1409608 - RNA, 19 nt, Homo sapiens
ccagaccaucucuaacuua

SEQ ID NO: 1409609 - RNA, 19 nt, Homo sapiens
ucccaaaucacauuacuaa

SEQ ID NO: 1409610 - RNA, 19 nt, Homo sapiens
cagcguuacuggccuaugu

SEQ ID NO: 1409611 - RNA, 19 nt, Homo sapiens
agacugagccugagaugga

SEQ ID NO: 1409612 - RNA, 19 nt, Homo sapiens
uuuacaagccuucuccuua

SEQ ID NO: 1409613 - RNA, 19 nt, Homo sapiens
ugagugcucugcugaucaa

SEQ ID NO: 1409614 - RNA, 19 nt, Homo sapiens
caacugauuccuccucuca

SEQ ID NO: 1409615 - RNA, 19 nt, Homo sapiens
aaacagacaagaaugacaa

SEQ ID NO: 1409616 - RNA, 19 nt, Homo sapiens
ccuaacaccaacauuuaua

SEQ ID NO: 1409617 - RNA, 19 nt, Homo sapiens
gacauuggacuaauuaucu

SEQ ID NO: 1409618 - RNA, 19 nt, Homo sapiens
gcugaucaacguucugaaa

SEQ ID NO: 1409619 - RNA, 19 nt, Homo sapiens
ugccaacaauuaucucuga

SEQ ID NO: 1409620 - RNA, 19 nt, Homo sapiens
gguaaaggugccucuuaaa

SEQ ID NO: 1409621 - RNA, 19 nt, Homo sapiens
gucauucccuaccuugaaa

SEQ ID NO: 1409622 - RNA, 19 nt, Homo sapiens
gaaagugagcccauucaac

SEQ ID NO: 1409623 - RNA, 19 nt, Homo sapiens
ggaauggcacaacuagaga

SEQ ID NO: 1409624 - RNA, 19 nt, Homo sapiens
gccagaccaucucuaacuu

SEQ ID NO: 1409625 - RNA, 19 nt, Homo sapiens
ggaaggagguggagugaaa

SEQ ID NO: 1409626 - RNA, 19 nt, Homo sapiens
gcacacugcugaagcugaa

SEQ ID NO: 1409627 - RNA, 19 nt, Homo sapiens
gggaguccguguucucuuu

SEQ ID NO: 1409628 - RNA, 19 nt, Homo sapiens
ugaaagagcucgguaaagc

SEQ ID NO: 1409629 - RNA, 19 nt, Homo sapiens
gcaaagugccgggaucaug

SEQ ID NO: 1409630 - RNA, 19 nt, Homo sapiens
gugaagaauuccagcugaa

SEQ ID NO: 1409631 - RNA, 19 nt, Homo sapiens
caaguccugugcaucauca

SEQ ID NO: 1409632 - RNA, 19 nt, Homo sapiens
cauccuguuccucaaauua

SEQ ID NO: 1409633 - RNA, 19 nt, Homo sapiens
gaagugauggagcaaagug

SEQ ID NO: 1409634 - RNA, 19 nt, Homo sapiens
gaagaauuccagcugaaca

SEQ ID NO: 1409635 - RNA, 19 nt, Homo sapiens
cuaccagugugaagaauuc

SEQ ID NO: 1409636 - RNA, 19 nt, Homo sapiens
gaaagagcucgguaaagca

SEQ ID NO: 1409637 - RNA, 19 nt, Homo sapiens
ggagguggagugaaaguuc

SEQ ID NO: 1409638 - RNA, 19 nt, Homo sapiens
caaagugccgggaucaugu

SEQ ID NO: 1409639 - RNA, 19 nt, Homo sapiens
guucuugcuuccaggcuuu

SEQ ID NO: 1409640 - RNA, 19 nt, Homo sapiens
gcaccugcggcuccucuaa

SEQ ID NO: 1409641 - RNA, 19 nt, Homo sapiens
gaacguucaagacaugugu

SEQ ID NO: 1409642 - RNA, 19 nt, Homo sapiens
ccaccucccugagugaguu

SEQ ID NO: 1409643 - RNA, 19 nt, Homo sapiens
gcaacaccccucuuuguaa

SEQ ID NO: 1409644 - RNA, 19 nt, Homo sapiens
gcugucgccuccucugaug

SEQ ID NO: 1409645 - RNA, 19 nt, Homo sapiens
uaaugaaagagcucgguaa

SEQ ID NO: 1409646 - RNA, 19 nt, Homo sapiens
gaaagaagugauggagcaa

SEQ ID NO: 1409647 - RNA, 19 nt, Homo sapiens
aaugaaagagcucgguaaa

SEQ ID NO: 1409648 - RNA, 19 nt, Homo sapiens
ccgcaaguccugugcauca

SEQ ID NO: 1409649 - RNA, 19 nt, Homo sapiens
gagcaaagugccgggauca

SEQ ID NO: 1409650 - RNA, 19 nt, Homo sapiens
aagaagugauggagcaaag

SEQ ID NO: 1409651 - RNA, 19 nt, Homo sapiens
gaauugcacggugaacguu

SEQ ID NO: 1409652 - RNA, 19 nt, Homo sapiens
gggaucauguaccgcaagu

SEQ ID NO: 1409653 - RNA, 19 nt, Homo sapiens
ccaccauccuguuccucaa

SEQ ID NO: 1409654 - RNA, 19 nt, Homo sapiens
aaagugccgggaucaugua

SEQ ID NO: 1409655 - RNA, 19 nt, Homo sapiens
gcaaguccugugcaucauc

SEQ ID NO: 1409656 - RNA, 19 nt, Homo sapiens
gcuaccagugugaagaauu

SEQ ID NO: 1409657 - RNA, 19 nt, Homo sapiens
agagcucgguaaagcauuc

SEQ ID NO: 1409658 - RNA, 19 nt, Homo sapiens
guuccugugcaaauaauga

SEQ ID NO: 1409659 - RNA, 19 nt, Homo sapiens
ugcugaagcugaaggagau

SEQ ID NO: 1409660 - RNA, 19 nt, Homo sapiens
gcaccaccauccuguuccu

SEQ ID NO: 1409661 - RNA, 19 nt, Homo sapiens
gugcuaccagugugaagaa

SEQ ID NO: 1409662 - RNA, 19 nt, Homo sapiens
aauuccagcugaacaacga

SEQ ID NO: 1409663 - RNA, 19 nt, Homo sapiens
gcucgguaaagcauucuga

SEQ ID NO: 1409664 - RNA, 19 nt, Homo sapiens
aaagagcucgguaaagcau

SEQ ID NO: 1409665 - RNA, 19 nt, Homo sapiens
ccauccuguuccucaaauu

SEQ ID NO: 1409666 - RNA, 19 nt, Homo sapiens
gcagaacauuggcuaaaua

SEQ ID NO: 1409667 - RNA, 19 nt, Homo sapiens
guagaaaucuggugaccua

SEQ ID NO: 1409668 - RNA, 19 nt, Homo sapiens
gaagagagauguguggaaa

SEQ ID NO: 1409669 - RNA, 19 nt, Homo sapiens
gcacauuucuuguaacuuc

SEQ ID NO: 1409670 - RNA, 19 nt, Homo sapiens
gaaaauugcuccaaaguug

SEQ ID NO: 1409671 - RNA, 19 nt, Homo sapiens
gaauauaacccaagucaau

SEQ ID NO: 1409672 - RNA, 19 nt, Homo sapiens
ccugaagccugacuuaaua

SEQ ID NO: 1409673 - RNA, 19 nt, Homo sapiens
gagaacauuuguacaauuc

SEQ ID NO: 1409674 - RNA, 19 nt, Homo sapiens
gaggcuaagucuucauaua

SEQ ID NO: 1409675 - RNA, 19 nt, Homo sapiens
guacaauugucccucauuu

SEQ ID NO: 1409676 - RNA, 19 nt, Homo sapiens
ucacagagcgguugaaauu

SEQ ID NO: 1409677 - RNA, 19 nt, Homo sapiens
gaagaaaggaaaccucauu

SEQ ID NO: 1409678 - RNA, 19 nt, Homo sapiens
cagcaucuguuuccucuuu

SEQ ID NO: 1409679 - RNA, 19 nt, Homo sapiens
uguaguggcugaaauauau

SEQ ID NO: 1409680 - RNA, 19 nt, Homo sapiens
gcuccaaauuuaccauaua

SEQ ID NO: 1409681 - RNA, 19 nt, Homo sapiens
gaacauuggcuaaauaugg

SEQ ID NO: 1409682 - RNA, 19 nt, Homo sapiens
caugaaugaugguuuauug

SEQ ID NO: 1409683 - RNA, 19 nt, Homo sapiens
caggaugacucguguuuga

SEQ ID NO: 1409684 - RNA, 19 nt, Homo sapiens
uaacaaccaaggaauagua

SEQ ID NO: 1409685 - RNA, 19 nt, Homo sapiens
ucagagaagugaagagaga

SEQ ID NO: 1409686 - RNA, 19 nt, Homo sapiens
acagagcgguugaaauuga

SEQ ID NO: 1409687 - RNA, 19 nt, Homo sapiens
ggcagcacauuucuuguaa

SEQ ID NO: 1409688 - RNA, 19 nt, Homo sapiens
caacagcagugucuauuuu

SEQ ID NO: 1409689 - RNA, 19 nt, Homo sapiens
agcaagagcuagagaauug

SEQ ID NO: 1409690 - RNA, 19 nt, Homo sapiens
gcuccaaaguugauaacaa

SEQ ID NO: 1409691 - RNA, 19 nt, Homo sapiens
aaggaaaccucauuacuca

SEQ ID NO: 1409692 - RNA, 19 nt, Homo sapiens
gaagaagucagagaaguga

SEQ ID NO: 1409693 - RNA, 19 nt, Homo sapiens
gcaaaauacucuauggaaa

SEQ ID NO: 1409694 - RNA, 19 nt, Homo sapiens
ugacaaagaagaaaggaaa

SEQ ID NO: 1409695 - RNA, 19 nt, Homo sapiens
uaacaucccuaauaacaac

SEQ ID NO: 1409696 - RNA, 19 nt, Homo sapiens
ucuccaugcuccaaauuua

SEQ ID NO: 1409697 - RNA, 19 nt, Homo sapiens
gcugggagcuacucagaau

SEQ ID NO: 1409698 - RNA, 19 nt, Homo sapiens
gaaaagcucucaccagaag

SEQ ID NO: 1409699 - RNA, 19 nt, Homo sapiens
gaacucagucaacgcauga

SEQ ID NO: 1409700 - RNA, 19 nt, Homo sapiens
acaauugucccucauuuaa

SEQ ID NO: 1409701 - RNA, 19 nt, Homo sapiens
agagagauguguggaaauu

SEQ ID NO: 1409702 - RNA, 19 nt, Homo sapiens
caauggcucuuuguuggua

SEQ ID NO: 1409703 - RNA, 19 nt, Homo sapiens
gaaaucuggugaccuaagg

SEQ ID NO: 1409704 - RNA, 19 nt, Homo sapiens
gaaaggaaaccucauuacu

SEQ ID NO: 1409705 - RNA, 19 nt, Homo sapiens
ccaagucaauggcucuuug

SEQ ID NO: 1409706 - RNA, 19 nt, Homo sapiens
gcaacagcagugucuauuu

SEQ ID NO: 1409707 - RNA, 19 nt, Homo sapiens
gcaaguacucagugauaaa

SEQ ID NO: 1409708 - RNA, 19 nt, Homo sapiens
gaacucucuugugaccuua

SEQ ID NO: 1409709 - RNA, 19 nt, Homo sapiens
agagggcgaugaauuaaga

SEQ ID NO: 1409710 - RNA, 19 nt, Homo sapiens
ggaaaccucauuacucaau

SEQ ID NO: 1409711 - RNA, 19 nt, Homo sapiens
gaagucugcucuguacaau

SEQ ID NO: 1409712 - RNA, 19 nt, Homo sapiens
guaaagaugaggcagagaa

SEQ ID NO: 1409713 - RNA, 19 nt, Homo sapiens
gaacacugguugccugaac

SEQ ID NO: 1409714 - RNA, 19 nt, Homo sapiens
ggagagggcgaugaauuaa

SEQ ID NO: 1409715 - RNA, 19 nt, Homo sapiens
acagagaacucagcuugaa

SEQ ID NO: 1409716 - RNA, 19 nt, Homo sapiens
gaagauuacuaugaacuac

SEQ ID NO: 1409717 - RNA, 19 nt, Homo sapiens
gcuaagucuucauauaugu

SEQ ID NO: 1409718 - RNA, 19 nt, Homo sapiens
agucugcucuguacaauug

SEQ ID NO: 1409719 - RNA, 19 nt, Homo sapiens
ggaagucugcucuguacaa

SEQ ID NO: 1409720 - RNA, 19 nt, Homo sapiens
auaacaaccuucauucuuc

SEQ ID NO: 1409721 - RNA, 19 nt, Homo sapiens
gccuaaacauugcuuucua

SEQ ID NO: 1409722 - RNA, 19 nt, Homo sapiens
caaccaugaugccuaaaca

SEQ ID NO: 1409723 - RNA, 19 nt, Homo sapiens
uggagagggcgaugaauua

SEQ ID NO: 1409724 - RNA, 19 nt, Homo sapiens
ucagagaacauuuguacaa

SEQ ID NO: 1409725 - RNA, 19 nt, Homo sapiens
caaggaagucugcucugua

SEQ ID NO: 1409726 - RNA, 19 nt, Homo sapiens
aagguugucuuucuaguga

SEQ ID NO: 1409727 - RNA, 19 nt, Homo sapiens
cagugaaaccucagacaua

SEQ ID NO: 1409728 - RNA, 19 nt, Homo sapiens
ggcuaagucuucauauaug

SEQ ID NO: 1409729 - RNA, 19 nt, Homo sapiens
auagagcccuggucaaguu

SEQ ID NO: 1409730 - RNA, 19 nt, Homo sapiens
cuucuucacuugaggcuaa

SEQ ID NO: 1409731 - RNA, 19 nt, Homo sapiens
agacaaagcccuccaaacu

SEQ ID NO: 1409732 - RNA, 19 nt, Homo sapiens
aagaugaggcagagaauaa

SEQ ID NO: 1409733 - RNA, 19 nt, Homo sapiens
ggacagagacaauggaaaa

SEQ ID NO: 1409734 - RNA, 19 nt, Homo sapiens
ucaguguggucaacagaaa

SEQ ID NO: 1409735 - RNA, 19 nt, Homo sapiens
cuugugaccuuaccaguga

SEQ ID NO: 1409736 - RNA, 19 nt, Homo sapiens
gcauagacgcagagacuga

SEQ ID NO: 1409737 - RNA, 19 nt, Homo sapiens
gagcauagacgcagagacu

SEQ ID NO: 1409738 - RNA, 19 nt, Homo sapiens
cagagaacauuuguacaau

SEQ ID NO: 1409739 - RNA, 19 nt, Homo sapiens
ggcuaaauauggacagaga

SEQ ID NO: 1409740 - RNA, 19 nt, Homo sapiens
gggauauauugucacauga

SEQ ID NO: 1409741 - RNA, 19 nt, Homo sapiens
gacuauagagcuagacaaa

SEQ ID NO: 1409742 - RNA, 19 nt, Homo sapiens
gaaaccucauuacucaauc

SEQ ID NO: 1409743 - RNA, 19 nt, Homo sapiens
uaacaaccuucauucuucu

SEQ ID NO: 1409744 - RNA, 19 nt, Homo sapiens
ggacuucuuuguuuaucca

SEQ ID NO: 1409745 - RNA, 19 nt, Homo sapiens
gacagaagaagucagagaa

SEQ ID NO: 1409746 - RNA, 19 nt, Homo sapiens
uauaucagcccauguuaga

SEQ ID NO: 1409747 - RNA, 19 nt, Homo sapiens
cuagagaauugguuuccuu

SEQ ID NO: 1409748 - RNA, 19 nt, Homo sapiens
gagcaagagcuagagaauu

SEQ ID NO: 1409749 - RNA, 19 nt, Homo sapiens
aagaaaggaaaccucauua

SEQ ID NO: 1409750 - RNA, 19 nt, Homo sapiens
guuuaagguugucuuucua

SEQ ID NO: 1409751 - RNA, 19 nt, Homo sapiens
gaggaucccaugaaugaug

SEQ ID NO: 1409752 - RNA, 19 nt, Homo sapiens
ccuaauaacaaccuucauu

SEQ ID NO: 1409753 - RNA, 19 nt, Homo sapiens
gauccuccagucaugaaua

SEQ ID NO: 1409754 - RNA, 19 nt, Homo sapiens
cauaagaggauuaacaaag

SEQ ID NO: 1409755 - RNA, 19 nt, Homo sapiens
ggcgaugaauuaagaguag

SEQ ID NO: 1409756 - RNA, 19 nt, Homo sapiens
gagaauugguuuccuugcu

SEQ ID NO: 1409757 - RNA, 19 nt, Homo sapiens
cagaagaagucagagaagu

SEQ ID NO: 1409758 - RNA, 19 nt, Homo sapiens
ucaguuucuucaucuguaa

SEQ ID NO: 1409759 - RNA, 19 nt, Homo sapiens
acauacaggaaccuuauua

SEQ ID NO: 1409760 - RNA, 19 nt, Homo sapiens
agaauugguuuccuugcuu

SEQ ID NO: 1409761 - RNA, 19 nt, Homo sapiens
gcgccuuccucaucucuau

SEQ ID NO: 1409762 - RNA, 19 nt, Homo sapiens
auaccaaucuccuagacuu

SEQ ID NO: 1409763 - RNA, 19 nt, Homo sapiens
aaauauaucagcccauguu

SEQ ID NO: 1409764 - RNA, 19 nt, Homo sapiens
uaacaccacacuccagcua

SEQ ID NO: 1409765 - RNA, 19 nt, Homo sapiens
ccucaucaguuucuuccuu

SEQ ID NO: 1409766 - RNA, 19 nt, Homo sapiens
gcaauaaacucaccaacua

SEQ ID NO: 1409767 - RNA, 19 nt, Homo sapiens
agagaaaccuuuaugcaaa

SEQ ID NO: 1409768 - RNA, 19 nt, Homo sapiens
gaggaaggauuaaguaaag

SEQ ID NO: 1409769 - RNA, 19 nt, Homo sapiens
ggaaucauuugaauaagga

SEQ ID NO: 1409770 - RNA, 19 nt, Homo sapiens
gagaaaccuuuaugcaaau

SEQ ID NO: 1409771 - RNA, 19 nt, Homo sapiens
ggccaucuaucuaaauauu

SEQ ID NO: 1409772 - RNA, 19 nt, Homo sapiens
ccaacuacgugugguauuu

SEQ ID NO: 1409773 - RNA, 19 nt, Homo sapiens
aaacucagaggaaggauua

SEQ ID NO: 1409774 - RNA, 19 nt, Homo sapiens
gagagaaaccuuuaugcaa

SEQ ID NO: 1409775 - RNA, 19 nt, Homo sapiens
gauggugcuuucugcauuu

SEQ ID NO: 1409776 - RNA, 19 nt, Homo sapiens
uaucaacuguguagacuug

SEQ ID NO: 1409777 - RNA, 19 nt, Homo sapiens
ggacguuuccuuacagauu

SEQ ID NO: 1409778 - RNA, 19 nt, Homo sapiens
gaauaugagagaaaccuuu

SEQ ID NO: 1409779 - RNA, 19 nt, Homo sapiens
gaaauacuucugcccuuug

SEQ ID NO: 1409780 - RNA, 19 nt, Homo sapiens
uguggaagcuauucaguga

SEQ ID NO: 1409781 - RNA, 19 nt, Homo sapiens
ccuuacagauucuagcaua

SEQ ID NO: 1409782 - RNA, 19 nt, Homo sapiens
cuagggaaguaaauaagaa

SEQ ID NO: 1409783 - RNA, 19 nt, Homo sapiens
ccuggaaucauuugaauaa

SEQ ID NO: 1409784 - RNA, 19 nt, Homo sapiens
gacauggccaucuaucuaa

SEQ ID NO: 1409785 - RNA, 19 nt, Homo sapiens
gauacuguguggaagcuau

SEQ ID NO: 1409786 - RNA, 19 nt, Homo sapiens
caucagaaacuucagaaau

SEQ ID NO: 1409787 - RNA, 19 nt, Homo sapiens
uauaccacccuuccauuua

SEQ ID NO: 1409788 - RNA, 19 nt, Homo sapiens
guauaccacccuuccauuu

SEQ ID NO: 1409789 - RNA, 19 nt, Homo sapiens
agacauggccaucuaucua

SEQ ID NO: 1409790 - RNA, 19 nt, Homo sapiens
caacaguucuucugguacu

SEQ ID NO: 1409791 - RNA, 19 nt, Homo sapiens
aacaacaguucuucuggua

SEQ ID NO: 1409792 - RNA, 19 nt, Homo sapiens
ccuggaaccugcacauguu

SEQ ID NO: 1409793 - RNA, 19 nt, Homo sapiens
gggcaauauugaaaugaug

SEQ ID NO: 1409794 - RNA, 19 nt, Homo sapiens
ggaguauaaucgugaacau

SEQ ID NO: 1409795 - RNA, 19 nt, Homo sapiens
ucagaggaaggauuaagua

SEQ ID NO: 1409796 - RNA, 19 nt, Homo sapiens
gacguuuccuuacagauuc

SEQ ID NO: 1409797 - RNA, 19 nt, Homo sapiens
gggcaaacuuccuaugcau

SEQ ID NO: 1409798 - RNA, 19 nt, Homo sapiens
gaguauaaucgugaacaua

SEQ ID NO: 1409799 - RNA, 19 nt, Homo sapiens
ucagugggcuucaagugau

SEQ ID NO: 1409800 - RNA, 19 nt, Homo sapiens
aaauacuucugcccuuuga

SEQ ID NO: 1409801 - RNA, 19 nt, Homo sapiens
ugagggcaauauugaaaug

SEQ ID NO: 1409802 - RNA, 19 nt, Homo sapiens
acacugcugucaauuaucu

SEQ ID NO: 1409803 - RNA, 19 nt, Homo sapiens
ugauggugcuuucugcauu

SEQ ID NO: 1409804 - RNA, 19 nt, Homo sapiens
cgaaugggcaaacuuccua

SEQ ID NO: 1409805 - RNA, 19 nt, Homo sapiens
aaagagugguacauacugu

SEQ ID NO: 1409806 - RNA, 19 nt, Homo sapiens
ucagaaacuucagaaauac

SEQ ID NO: 1409807 - RNA, 19 nt, Homo sapiens
gauucuagcauauggauuc

SEQ ID NO: 1409808 - RNA, 19 nt, Homo sapiens
cuauaaauguugccagagu

SEQ ID NO: 1409809 - RNA, 19 nt, Homo sapiens
ugauuccgcuugcacuuug

SEQ ID NO: 1409810 - RNA, 19 nt, Homo sapiens
cagaggaaggauuaaguaa

SEQ ID NO: 1409811 - RNA, 19 nt, Homo sapiens
cuaaguuguuugcugauuc

SEQ ID NO: 1409812 - RNA, 19 nt, Homo sapiens
gauacugccuggucaucuc

SEQ ID NO: 1409813 - RNA, 19 nt, Homo sapiens
guaaagagugguacauacu

SEQ ID NO: 1409814 - RNA, 19 nt, Homo sapiens
guaauaugcaucagaaacu

SEQ ID NO: 1409815 - RNA, 19 nt, Homo sapiens
ugaaggaaucuguuucuca

SEQ ID NO: 1409816 - RNA, 19 nt, Homo sapiens
uccaaacaguaaaccagua

SEQ ID NO: 1409817 - RNA, 19 nt, Homo sapiens
gggauugucuauuguucuc

SEQ ID NO: 1409818 - RNA, 19 nt, Homo sapiens
agaggaaggauuaaguaaa

SEQ ID NO: 1409819 - RNA, 19 nt, Homo sapiens
ccaaacaguaaaccaguau

SEQ ID NO: 1409820 - RNA, 19 nt, Homo sapiens
gacuugagggcaauauuga

SEQ ID NO: 1409821 - RNA, 19 nt, Homo sapiens
uggaagcuauucagugauc

SEQ ID NO: 1409822 - RNA, 19 nt, Homo sapiens
acaguaaaccaguauuuca

SEQ ID NO: 1409823 - RNA, 19 nt, Homo sapiens
gcuauucagugaucuucca

SEQ ID NO: 1409824 - RNA, 19 nt, Homo sapiens
ucaugcaacuauccaagau

SEQ ID NO: 1409825 - RNA, 19 nt, Homo sapiens
caugaugcuuauaguaaca

SEQ ID NO: 1409826 - RNA, 19 nt, Homo sapiens
gauuaaguaaagaguggua

SEQ ID NO: 1409827 - RNA, 19 nt, Homo sapiens
ccaaaauucuaaacucaga

SEQ ID NO: 1409828 - RNA, 19 nt, Homo sapiens
ugcauuugguguuuauuug

SEQ ID NO: 1409829 - RNA, 19 nt, Homo sapiens
caucagaguagucaugcaa

SEQ ID NO: 1409830 - RNA, 19 nt, Homo sapiens
ggaguggaacaucauuuua

SEQ ID NO: 1409831 - RNA, 19 nt, Homo sapiens
guuguggaguggaacauca

SEQ ID NO: 1409832 - RNA, 19 nt, Homo sapiens
auaccacccuuccauuuag

SEQ ID NO: 1409833 - RNA, 19 nt, Homo sapiens
agacuugagggcaauauug

SEQ ID NO: 1409834 - RNA, 19 nt, Homo sapiens
ccuaaguuguuugcugauu

SEQ ID NO: 1409835 - RNA, 19 nt, Homo sapiens
ggaaacaccccaaaauucu

SEQ ID NO: 1409836 - RNA, 19 nt, Homo sapiens
ugagagaaaccuuuaugca

SEQ ID NO: 1409837 - RNA, 19 nt, Homo sapiens
gcauuugguguuuauuugu

SEQ ID NO: 1409838 - RNA, 19 nt, Homo sapiens
acauggccaucuaucuaaa

SEQ ID NO: 1409839 - RNA, 19 nt, Homo sapiens
gaagcuauucagugaucuu

SEQ ID NO: 1409840 - RNA, 19 nt, Homo sapiens
uccuaugcauccagcaaua

SEQ ID NO: 1409841 - RNA, 19 nt, Homo sapiens
gcacuuuggaguauaaucg

SEQ ID NO: 1409842 - RNA, 19 nt, Homo sapiens
gaaggauuaaguaaagagu

SEQ ID NO: 1409843 - RNA, 19 nt, Homo sapiens
ggaaggauuaaguaaagag

SEQ ID NO: 1409844 - RNA, 19 nt, Homo sapiens
gaaacaccccaaaauucua

SEQ ID NO: 1409845 - RNA, 19 nt, Homo sapiens
uaaagagugguacauacug

SEQ ID NO: 1409846 - RNA, 19 nt, Homo sapiens
aguaaagagugguacauac

SEQ ID NO: 1409847 - RNA, 19 nt, Homo sapiens
gcggguauauuccaauucc

SEQ ID NO: 1409848 - RNA, 19 nt, Homo sapiens
gaaacuucagaaauacuuc

SEQ ID NO: 1409849 - RNA, 19 nt, Homo sapiens
auggccaucuaucuaaaua

SEQ ID NO: 1409850 - RNA, 19 nt, Homo sapiens
uggaaucauuugaauaagg

SEQ ID NO: 1409851 - RNA, 19 nt, Homo sapiens
agugaaaacugcagcaaaa

SEQ ID NO: 1409852 - RNA, 19 nt, Homo sapiens
guacuggagaauaauaaca

SEQ ID NO: 1409853 - RNA, 19 nt, Homo sapiens
uaugagagaaaccuuuaug

SEQ ID NO: 1409854 - RNA, 19 nt, Homo sapiens
gcaucagaaacuucagaaa

SEQ ID NO: 1409855 - RNA, 19 nt, Homo sapiens
aucaagacauggccaucua

SEQ ID NO: 1409856 - RNA, 19 nt, Homo sapiens
cauauugccgcacccuuga

SEQ ID NO: 1409857 - RNA, 19 nt, Homo sapiens
aaguaaagagugguacaua

SEQ ID NO: 1409858 - RNA, 19 nt, Homo sapiens
ucuagcauauggauucagu

SEQ ID NO: 1409859 - RNA, 19 nt, Homo sapiens
ccgcuugcacuuuggagua

SEQ ID NO: 1409860 - RNA, 19 nt, Homo sapiens
gcauccagcaauaaacuca

SEQ ID NO: 1409861 - RNA, 19 nt, Homo sapiens
cuugcacuuuggaguauaa

SEQ ID NO: 1409862 - RNA, 19 nt, Homo sapiens
cugcggguauauuccaauu

SEQ ID NO: 1409863 - RNA, 19 nt, Homo sapiens
uauaucaacuguguagacu

SEQ ID NO: 1409864 - RNA, 19 nt, Homo sapiens
uaaacucagaggaaggauu

SEQ ID NO: 1409865 - RNA, 19 nt, Homo sapiens
gcuugcacuuuggaguaua

SEQ ID NO: 1409866 - RNA, 19 nt, Homo sapiens
gaagagaggugaugcuuua

SEQ ID NO: 1409867 - RNA, 19 nt, Homo sapiens
caacugcuauacugaauua

SEQ ID NO: 1409868 - RNA, 19 nt, Homo sapiens
ggacaacuguuccuuggua

SEQ ID NO: 1409869 - RNA, 19 nt, Homo sapiens
gaggugaugcuuuaaauua

SEQ ID NO: 1409870 - RNA, 19 nt, Homo sapiens
ucacagaccugacaagaga

SEQ ID NO: 1409871 - RNA, 19 nt, Homo sapiens
gcaaauuacccuauaacua

SEQ ID NO: 1409872 - RNA, 19 nt, Homo sapiens
caagagggcuuuaaacaag

SEQ ID NO: 1409873 - RNA, 19 nt, Homo sapiens
gauuacaacucagcuauaa

SEQ ID NO: 1409874 - RNA, 19 nt, Homo sapiens
uggauuagauugucucaua

SEQ ID NO: 1409875 - RNA, 19 nt, Homo sapiens
gaaacuggcugcugcauac

SEQ ID NO: 1409876 - RNA, 19 nt, Homo sapiens
gaacugaucaucuucucua

SEQ ID NO: 1409877 - RNA, 19 nt, Homo sapiens
caagugaacugaucaucuu

SEQ ID NO: 1409878 - RNA, 19 nt, Homo sapiens
gaccgaaucugaaacuuug

SEQ ID NO: 1409879 - RNA, 19 nt, Homo sapiens
cagaagagguugucaaauc

SEQ ID NO: 1409880 - RNA, 19 nt, Homo sapiens
gcacuguaaugaaauguga

SEQ ID NO: 1409881 - RNA, 19 nt, Homo sapiens
gggaaggaaucaaagguaa

SEQ ID NO: 1409882 - RNA, 19 nt, Homo sapiens
gggaagagauaugacuaua

SEQ ID NO: 1409883 - RNA, 19 nt, Homo sapiens
caaauuacccuauaacuag

SEQ ID NO: 1409884 - RNA, 19 nt, Homo sapiens
gagaauacccugcaccaaa

SEQ ID NO: 1409885 - RNA, 19 nt, Homo sapiens
gaagcuaagucccaggaaa

SEQ ID NO: 1409886 - RNA, 19 nt, Homo sapiens
ggacugaauugcugacaug

SEQ ID NO: 1409887 - RNA, 19 nt, Homo sapiens
gugaauaauugcacaacua

SEQ ID NO: 1409888 - RNA, 19 nt, Homo sapiens
gaauguccaugagugguua

SEQ ID NO: 1409889 - RNA, 19 nt, Homo sapiens
gagaggugaugcuuuaaau

SEQ ID NO: 1409890 - RNA, 19 nt, Homo sapiens
gcugucagaugaauaaaug

SEQ ID NO: 1409891 - RNA, 19 nt, Homo sapiens
gcaaucgacacaguuauua

SEQ ID NO: 1409892 - RNA, 19 nt, Homo sapiens
ggugaagaguggauuugua

SEQ ID NO: 1409893 - RNA, 19 nt, Homo sapiens
gaacacccuugugauagaa

SEQ ID NO: 1409894 - RNA, 19 nt, Homo sapiens
caaaugugguucacucuuc

SEQ ID NO: 1409895 - RNA, 19 nt, Homo sapiens
guucagcccuaccaaauug

SEQ ID NO: 1409896 - RNA, 19 nt, Homo sapiens
ggaagagauaugacuauaa

SEQ ID NO: 1409897 - RNA, 19 nt, Homo sapiens
uauuugagcucacuuauag

SEQ ID NO: 1409898 - RNA, 19 nt, Homo sapiens
ggucuucucuuauuugaca

SEQ ID NO: 1409899 - RNA, 19 nt, Homo sapiens
cacaagagcuggcuuaggu

SEQ ID NO: 1409900 - RNA, 19 nt, Homo sapiens
gaacucaaccuccauuugg

SEQ ID NO: 1409901 - RNA, 19 nt, Homo sapiens
caagagagguucagaucca

SEQ ID NO: 1409902 - RNA, 19 nt, Homo sapiens
acaaacagcuuacaguuac

SEQ ID NO: 1409903 - RNA, 19 nt, Homo sapiens
aaacaaaacuucccuacaa

SEQ ID NO: 1409904 - RNA, 19 nt, Homo sapiens
gcuugaaguuuccauuauu

SEQ ID NO: 1409905 - RNA, 19 nt, Homo sapiens
uaacaggccuacgagguuu

SEQ ID NO: 1409906 - RNA, 19 nt, Homo sapiens
guugugcacuguaaugaaa

SEQ ID NO: 1409907 - RNA, 19 nt, Homo sapiens
caaauugucccaugcaaau

SEQ ID NO: 1409908 - RNA, 19 nt, Homo sapiens
ggaaggcaaucgacacagu

SEQ ID NO: 1409909 - RNA, 19 nt, Homo sapiens
uggcugagcuuaauugcuu

SEQ ID NO: 1409910 - RNA, 19 nt, Homo sapiens
ccaagagagucagcccuua

SEQ ID NO: 1409911 - RNA, 19 nt, Homo sapiens
ggauuagauugucucauau

SEQ ID NO: 1409912 - RNA, 19 nt, Homo sapiens
gcaucaagcuccagaucug

SEQ ID NO: 1409913 - RNA, 19 nt, Homo sapiens
gaucaucuucucuauauuc

SEQ ID NO: 1409914 - RNA, 19 nt, Homo sapiens
cugaucaucuucucuauau

SEQ ID NO: 1409915 - RNA, 19 nt, Homo sapiens
uuacuugggcuacuuauuu

SEQ ID NO: 1409916 - RNA, 19 nt, Homo sapiens
agaauuaccagcuguauga

SEQ ID NO: 1409917 - RNA, 19 nt, Homo sapiens
ggucugguguucaaguaaa

SEQ ID NO: 1409918 - RNA, 19 nt, Homo sapiens
ggcaugaaguacauugaaa

SEQ ID NO: 1409919 - RNA, 19 nt, Homo sapiens
caacuguuccuugguauuu

SEQ ID NO: 1409920 - RNA, 19 nt, Homo sapiens
ggagugggauagggauaaa

SEQ ID NO: 1409921 - RNA, 19 nt, Homo sapiens
ccaugcaaauuacccuaua

SEQ ID NO: 1409922 - RNA, 19 nt, Homo sapiens
guuauuagcacauuucaga

SEQ ID NO: 1409923 - RNA, 19 nt, Homo sapiens
uauaggccaugaacauaaa

SEQ ID NO: 1409924 - RNA, 19 nt, Homo sapiens
agaagagguugucaaauca

SEQ ID NO: 1409925 - RNA, 19 nt, Homo sapiens
gcagguccuuccagaaugu

SEQ ID NO: 1409926 - RNA, 19 nt, Homo sapiens
agagucagguuucucauau

SEQ ID NO: 1409927 - RNA, 19 nt, Homo sapiens
ugaacacccuugugauaga

SEQ ID NO: 1409928 - RNA, 19 nt, Homo sapiens
agacauauaugagcugguu

SEQ ID NO: 1409929 - RNA, 19 nt, Homo sapiens
uagguggucuucucuuauu

SEQ ID NO: 1409930 - RNA, 19 nt, Homo sapiens
caagagagucagcccuuaa

SEQ ID NO: 1409931 - RNA, 19 nt, Homo sapiens
gacaagagggcuuuaaaca

SEQ ID NO: 1409932 - RNA, 19 nt, Homo sapiens
ugacaagagacauauauga

SEQ ID NO: 1409933 - RNA, 19 nt, Homo sapiens
uacaaacagcuuacaguua

SEQ ID NO: 1409934 - RNA, 19 nt, Homo sapiens
gaaugugaccgaaucugaa

SEQ ID NO: 1409935 - RNA, 19 nt, Homo sapiens
ccaccugucugccauauac

SEQ ID NO: 1409936 - RNA, 19 nt, Homo sapiens
uaaagcccauucaggcauu

SEQ ID NO: 1409937 - RNA, 19 nt, Homo sapiens
uaggaaagagacacuauaa

SEQ ID NO: 1409938 - RNA, 19 nt, Homo sapiens
aaacuauucugacuagagu

SEQ ID NO: 1409939 - RNA, 19 nt, Homo sapiens
aguagguggucuucucuua

SEQ ID NO: 1409940 - RNA, 19 nt, Homo sapiens
ggaaggaaucaaagguaaa

SEQ ID NO: 1409941 - RNA, 19 nt, Homo sapiens
caaaaggucugguguucaa

SEQ ID NO: 1409942 - RNA, 19 nt, Homo sapiens
guaugaaugugaccgaauc

SEQ ID NO: 1409943 - RNA, 19 nt, Homo sapiens
gagagucagcccuuaauuc

SEQ ID NO: 1409944 - RNA, 19 nt, Homo sapiens
ggaaccacguacagcaaug

SEQ ID NO: 1409945 - RNA, 19 nt, Homo sapiens
ggaaguaaacagucugcuu

SEQ ID NO: 1409946 - RNA, 19 nt, Homo sapiens
caugcaaauuacccuauaa

SEQ ID NO: 1409947 - RNA, 19 nt, Homo sapiens
aaugaacacccuugugaua

SEQ ID NO: 1409948 - RNA, 19 nt, Homo sapiens
guauuugagcucacuuaua

SEQ ID NO: 1409949 - RNA, 19 nt, Homo sapiens
gagggaacaugggaaggaa

SEQ ID NO: 1409950 - RNA, 19 nt, Homo sapiens
guuagaagagaccaaagua

SEQ ID NO: 1409951 - RNA, 19 nt, Homo sapiens
ugaaaagaaucagguguua

SEQ ID NO: 1409952 - RNA, 19 nt, Homo sapiens
ucugaaacuuugggaauuu

SEQ ID NO: 1409953 - RNA, 19 nt, Homo sapiens
uggaauggcuggcuugaag

SEQ ID NO: 1409954 - RNA, 19 nt, Homo sapiens
agucagcccuuaauucuca

SEQ ID NO: 1409955 - RNA, 19 nt, Homo sapiens
ggaaagagacacuauaacc

SEQ ID NO: 1409956 - RNA, 19 nt, Homo sapiens
gaucaguucacagcauuaa

SEQ ID NO: 1409957 - RNA, 19 nt, Homo sapiens
gaauuugcuuuagccagaa

SEQ ID NO: 1409958 - RNA, 19 nt, Homo sapiens
uaaacuaagagccaugaaa

SEQ ID NO: 1409959 - RNA, 19 nt, Homo sapiens
guaaacagucugcuugcuu

SEQ ID NO: 1409960 - RNA, 19 nt, Homo sapiens
guagaauucaguaccauug

SEQ ID NO: 1409961 - RNA, 19 nt, Homo sapiens
ggauauguuuuccuuauug

SEQ ID NO: 1409962 - RNA, 19 nt, Homo sapiens
ccugcaaucuggaaguaaa

SEQ ID NO: 1409963 - RNA, 19 nt, Homo sapiens
gauagaauuaccagcugua

SEQ ID NO: 1409964 - RNA, 19 nt, Homo sapiens
aaagguguuugcuggguuu

SEQ ID NO: 1409965 - RNA, 19 nt, Homo sapiens
agaauacccugcaccaaag

SEQ ID NO: 1409966 - RNA, 19 nt, Homo sapiens
ggacaagacuuccuuauuu

SEQ ID NO: 1409967 - RNA, 19 nt, Homo sapiens
ggaaauacaucuuuaguga

SEQ ID NO: 1409968 - RNA, 19 nt, Homo sapiens
gaagaacgauccagagaaa

SEQ ID NO: 1409969 - RNA, 19 nt, Homo sapiens
gaacggaaaugcugucuug

SEQ ID NO: 1409970 - RNA, 19 nt, Homo sapiens
gauaacaccuagugauuaa

SEQ ID NO: 1409971 - RNA, 19 nt, Homo sapiens
gacaagacuuccuuauuua

SEQ ID NO: 1409972 - RNA, 19 nt, Homo sapiens
aaacggagcuggaggagua

SEQ ID NO: 1409973 - RNA, 19 nt, Homo sapiens
acaaagcccuucuggauua

SEQ ID NO: 1409974 - RNA, 19 nt, Homo sapiens
gcacaucacugccgucuuc

SEQ ID NO: 1409975 - RNA, 19 nt, Homo sapiens
ucacauggguuuauggaua

SEQ ID NO: 1409976 - RNA, 19 nt, Homo sapiens
ggagaagcaugaagagaaa

SEQ ID NO: 1409977 - RNA, 19 nt, Homo sapiens
gcucagaaaccuacuguua

SEQ ID NO: 1409978 - RNA, 19 nt, Homo sapiens
cgacggaaauacaucuuua

SEQ ID NO: 1409979 - RNA, 19 nt, Homo sapiens
gaagaucuaugaagagcuu

SEQ ID NO: 1409980 - RNA, 19 nt, Homo sapiens
ggacaaagcccuucuggau

SEQ ID NO: 1409981 - RNA, 19 nt, Homo sapiens
cagaagacaugaacuuuga

SEQ ID NO: 1409982 - RNA, 19 nt, Homo sapiens
gaaagauugucauggacua

SEQ ID NO: 1409983 - RNA, 19 nt, Homo sapiens
caaaguagaugaccaaugc

SEQ ID NO: 1409984 - RNA, 19 nt, Homo sapiens
ugggagggcucuaaaguua

SEQ ID NO: 1409985 - RNA, 19 nt, Homo sapiens
gccaagcacuuuccucuuu

SEQ ID NO: 1409986 - RNA, 19 nt, Homo sapiens
gcacacaucugcugacucu

SEQ ID NO: 1409987 - RNA, 19 nt, Homo sapiens
ggagccaggugauagauuu

SEQ ID NO: 1409988 - RNA, 19 nt, Homo sapiens
ggagggaggcucagagaua

SEQ ID NO: 1409989 - RNA, 19 nt, Homo sapiens
gaaagcagacucccuaaau

SEQ ID NO: 1409990 - RNA, 19 nt, Homo sapiens
caagggagguagaugauga

SEQ ID NO: 1409991 - RNA, 19 nt, Homo sapiens
ccacauggauggauuagau

SEQ ID NO: 1409992 - RNA, 19 nt, Homo sapiens
gcacaaacccuaucaagag

SEQ ID NO: 1409993 - RNA, 19 nt, Homo sapiens
gaaaggcaauuuggcuaaa

SEQ ID NO: 1409994 - RNA, 19 nt, Homo sapiens
aaacuuggcugcugucaug

SEQ ID NO: 1409995 - RNA, 19 nt, Homo sapiens
caaccugucuuuggaagua

SEQ ID NO: 1409996 - RNA, 19 nt, Homo sapiens
uugagaagcuggcuguuua

SEQ ID NO: 1409997 - RNA, 19 nt, Homo sapiens
gcacaggaagcacaugaua

SEQ ID NO: 1409998 - RNA, 19 nt, Homo sapiens
uaacucagcucauauucug

SEQ ID NO: 1409999 - RNA, 19 nt, Homo sapiens
uaacuaagcaucuccacua

SEQ ID NO: 1410000 - RNA, 19 nt, Homo sapiens
ucccagagaugcaugaaua

SEQ ID NO: 1410001 - RNA, 19 nt, Homo sapiens
gugagaagaucuaugaaga

SEQ ID NO: 1410002 - RNA, 19 nt, Homo sapiens
cauccugacuguuuaguaa

SEQ ID NO: 1410003 - RNA, 19 nt, Homo sapiens
gaaauuacaacccaguuug

SEQ ID NO: 1410004 - RNA, 19 nt, Homo sapiens
ggaagcacaugauaaagca

SEQ ID NO: 1410005 - RNA, 19 nt, Homo sapiens
gaauaugggucaguucuca

SEQ ID NO: 1410006 - RNA, 19 nt, Homo sapiens
gagauuacacagagcaaua

SEQ ID NO: 1410007 - RNA, 19 nt, Homo sapiens
agacaaaguuucccagaga

SEQ ID NO: 1410008 - RNA, 19 nt, Homo sapiens
cagaggagcuggaacagau

SEQ ID NO: 1410009 - RNA, 19 nt, Homo sapiens
gagcaguggugaucacaug

SEQ ID NO: 1410010 - RNA, 19 nt, Homo sapiens
gagguuaucuaggguugua

SEQ ID NO: 1410011 - RNA, 19 nt, Homo sapiens
gcacuaccaacaagagaua

SEQ ID NO: 1410012 - RNA, 19 nt, Homo sapiens
ugaagagcuuucuggaaua

SEQ ID NO: 1410013 - RNA, 19 nt, Homo sapiens
ggaagaguccauuugguuu

SEQ ID NO: 1410014 - RNA, 19 nt, Homo sapiens
gagagggacugcccacaug

SEQ ID NO: 1410015 - RNA, 19 nt, Homo sapiens
cggaaaugcugucuuguga

SEQ ID NO: 1410016 - RNA, 19 nt, Homo sapiens
cauaauugcuuguggugaa

SEQ ID NO: 1410017 - RNA, 19 nt, Homo sapiens
gaaacaccauucuggaagu

SEQ ID NO: 1410018 - RNA, 19 nt, Homo sapiens
ggucaguucucaaauguca

SEQ ID NO: 1410019 - RNA, 19 nt, Homo sapiens
ucauaaacgucaaggauug

SEQ ID NO: 1410020 - RNA, 19 nt, Homo sapiens
caacauauccgagcuaauc

SEQ ID NO: 1410021 - RNA, 19 nt, Homo sapiens
gaagccauuugccauagaa

SEQ ID NO: 1410022 - RNA, 19 nt, Homo sapiens
gaaacuagacgccuucauc

SEQ ID NO: 1410023 - RNA, 19 nt, Homo sapiens
guaacagacuucucagugu

SEQ ID NO: 1410024 - RNA, 19 nt, Homo sapiens
guucucaaaugucaaugua

SEQ ID NO: 1410025 - RNA, 19 nt, Homo sapiens
gaggagcuaugaacugguu

SEQ ID NO: 1410026 - RNA, 19 nt, Homo sapiens
uaucuaggguuguagcuuu

SEQ ID NO: 1410027 - RNA, 19 nt, Homo sapiens
ccacccaacucuccauuga

SEQ ID NO: 1410028 - RNA, 19 nt, Homo sapiens
gcagaacaguggccaucaa

SEQ ID NO: 1410029 - RNA, 19 nt, Homo sapiens
gcacuuugcauaucuguau

SEQ ID NO: 1410030 - RNA, 19 nt, Homo sapiens
ggaccuggaauaucccuua

SEQ ID NO: 1410031 - RNA, 19 nt, Homo sapiens
cgaucuagauuuauuccua

SEQ ID NO: 1410032 - RNA, 19 nt, Homo sapiens
cagcuuaccguauggaaua

SEQ ID NO: 1410033 - RNA, 19 nt, Homo sapiens
gagaggaaguagcgagaga

SEQ ID NO: 1410034 - RNA, 19 nt, Homo sapiens
caaagacugauacaaguaa

SEQ ID NO: 1410035 - RNA, 19 nt, Homo sapiens
aaagauagcagaagacaug

SEQ ID NO: 1410036 - RNA, 19 nt, Homo sapiens
gcauggagguggaaacuac

SEQ ID NO: 1410037 - RNA, 19 nt, Homo sapiens
gaaaccuacuguuaaccaa

SEQ ID NO: 1410038 - RNA, 19 nt, Homo sapiens
gaagugcugcuauggauau

SEQ ID NO: 1410039 - RNA, 19 nt, Homo sapiens
ucuggaaucuucaacauga

SEQ ID NO: 1410040 - RNA, 19 nt, Homo sapiens
gaagaguauuugcauugug

SEQ ID NO: 1410041 - RNA, 19 nt, Homo sapiens
gcuaaucagucaauacaag

SEQ ID NO: 1410042 - RNA, 19 nt, Homo sapiens
gcagaagacaugaacuuug

SEQ ID NO: 1410043 - RNA, 19 nt, Homo sapiens
gagagugguuacccugauu

SEQ ID NO: 1410044 - RNA, 19 nt, Homo sapiens
ggacaauauuuaucaaggu

SEQ ID NO: 1410045 - RNA, 19 nt, Homo sapiens
caccuaaacuauccaucua

SEQ ID NO: 1410046 - RNA, 19 nt, Homo sapiens
gauagagggugguauucug

SEQ ID NO: 1410047 - RNA, 19 nt, Homo sapiens
uaagaaugcuggagacucu

SEQ ID NO: 1410048 - RNA, 19 nt, Homo sapiens
acuggaagguuucuaauga

SEQ ID NO: 1410049 - RNA, 19 nt, Homo sapiens
caggaagacuggaacauca

SEQ ID NO: 1410050 - RNA, 19 nt, Homo sapiens
gaccuuaucaucuggguaa

SEQ ID NO: 1410051 - RNA, 19 nt, Homo sapiens
ugaaaugccucuauguucu

SEQ ID NO: 1410052 - RNA, 19 nt, Homo sapiens
gaagagcuuucuggaauac

SEQ ID NO: 1410053 - RNA, 19 nt, Homo sapiens
gcagugacccuuucuccuu

SEQ ID NO: 1410054 - RNA, 19 nt, Homo sapiens
cagccaugcuccuaaugua

SEQ ID NO: 1410055 - RNA, 19 nt, Homo sapiens
gcaacugccuuuggaagau

SEQ ID NO: 1410056 - RNA, 19 nt, Homo sapiens
gaugcugacugcaaacuuc

SEQ ID NO: 1410057 - RNA, 19 nt, Homo sapiens
ggaguggaguaucugaaga

SEQ ID NO: 1410058 - RNA, 19 nt, Homo sapiens
ccacauacacggcaaacuu

SEQ ID NO: 1410059 - RNA, 19 nt, Homo sapiens
caucaaaccuccaaaaugu

SEQ ID NO: 1410060 - RNA, 19 nt, Homo sapiens
gcauugaucugcuggaaaa

SEQ ID NO: 1410061 - RNA, 19 nt, Homo sapiens
guaaugaggagacugaguu

SEQ ID NO: 1410062 - RNA, 19 nt, Homo sapiens
gugaaacaguguauugugu

SEQ ID NO: 1410063 - RNA, 19 nt, Homo sapiens
gauaagagucaucuaguag

SEQ ID NO: 1410064 - RNA, 19 nt, Homo sapiens
cuaagcaucuccacuaugg

SEQ ID NO: 1410065 - RNA, 19 nt, Homo sapiens
aaagcagacucccuaaaug

SEQ ID NO: 1410066 - RNA, 19 nt, Homo sapiens
ucacggagauccacagaua

SEQ ID NO: 1410067 - RNA, 19 nt, Homo sapiens
ggagacagcuggagcacaa

SEQ ID NO: 1410068 - RNA, 19 nt, Homo sapiens
gauguuagaucaugaauac

SEQ ID NO: 1410069 - RNA, 19 nt, Homo sapiens
gaucaugaauacacaacaa

SEQ ID NO: 1410070 - RNA, 19 nt, Homo sapiens
gaacuuacagcucuuuaug

SEQ ID NO: 1410071 - RNA, 19 nt, Homo sapiens
ggaguguccuggagaagaa

SEQ ID NO: 1410072 - RNA, 19 nt, Homo sapiens
gaguucggcuacuguauuu

SEQ ID NO: 1410073 - RNA, 19 nt, Homo sapiens
gagaagaucuacagcaaaa

SEQ ID NO: 1410074 - RNA, 19 nt, Homo sapiens
agacgaagauccaggcaaa

SEQ ID NO: 1410075 - RNA, 19 nt, Homo sapiens
ggagacagcuuggcagaag

SEQ ID NO: 1410076 - RNA, 19 nt, Homo sapiens
cggaggaggucgccacuuu

SEQ ID NO: 1410077 - RNA, 19 nt, Homo sapiens
ucaaguacaucaugcugaa

SEQ ID NO: 1410078 - RNA, 19 nt, Homo sapiens
ggagauccacagauacuuu

SEQ ID NO: 1410079 - RNA, 19 nt, Homo sapiens
ucaagagccuggacaagug

SEQ ID NO: 1410080 - RNA, 19 nt, Homo sapiens
ggagugcguuucuucuaug

SEQ ID NO: 1410081 - RNA, 19 nt, Homo sapiens
ggaagucucgggaaaugaa

SEQ ID NO: 1410082 - RNA, 19 nt, Homo sapiens
gccaacacgugguggaauu

SEQ ID NO: 1410083 - RNA, 19 nt, Homo sapiens
gcacugagagcaggaaaug

SEQ ID NO: 1410084 - RNA, 19 nt, Homo sapiens
cagaggaugugguuaucaa

SEQ ID NO: 1410085 - RNA, 19 nt, Homo sapiens
ggaggauguuagaucauga

SEQ ID NO: 1410086 - RNA, 19 nt, Homo sapiens
gaggugcgcuccgauaaca

SEQ ID NO: 1410087 - RNA, 19 nt, Homo sapiens
gcacguccaagcucaacua

SEQ ID NO: 1410088 - RNA, 19 nt, Homo sapiens
gaggagaagcagaagcuaa

SEQ ID NO: 1410089 - RNA, 19 nt, Homo sapiens
aaacacagcgggagagguu

SEQ ID NO: 1410090 - RNA, 19 nt, Homo sapiens
agaagucgaugcagaaucu

SEQ ID NO: 1410091 - RNA, 19 nt, Homo sapiens
agaagccgguguacaagaa

SEQ ID NO: 1410092 - RNA, 19 nt, Homo sapiens
gcagggaggagaagcagaa

SEQ ID NO: 1410093 - RNA, 19 nt, Homo sapiens
gggaggauguuagaucaug

SEQ ID NO: 1410094 - RNA, 19 nt, Homo sapiens
ggaccgagagcguucagaa

SEQ ID NO: 1410095 - RNA, 19 nt, Homo sapiens
auaggcaacuucaagauug

SEQ ID NO: 1410096 - RNA, 19 nt, Homo sapiens
ggagaagaucuacagcaaa

SEQ ID NO: 1410097 - RNA, 19 nt, Homo sapiens
uggagaagaucuacagcaa

SEQ ID NO: 1410098 - RNA, 19 nt, Homo sapiens
ggcgagggcugagcacaaa

SEQ ID NO: 1410099 - RNA, 19 nt, Homo sapiens
gaagagagggaagucauca

SEQ ID NO: 1410100 - RNA, 19 nt, Homo sapiens
cagcuuggcagaaguuuga

SEQ ID NO: 1410101 - RNA, 19 nt, Homo sapiens
gaaggaaggccugugagau

SEQ ID NO: 1410102 - RNA, 19 nt, Homo sapiens
ugcagaaucuccagacgaa

SEQ ID NO: 1410103 - RNA, 19 nt, Homo sapiens
cgaccagccugaacaagca

SEQ ID NO: 1410104 - RNA, 19 nt, Homo sapiens
gaagauccaggcaaagaag

SEQ ID NO: 1410105 - RNA, 19 nt, Homo sapiens
gagcaggaaaugagaagga

SEQ ID NO: 1410106 - RNA, 19 nt, Homo sapiens
ggaaauggcgguggaagag

SEQ ID NO: 1410107 - RNA, 19 nt, Homo sapiens
cggagugcguuucuucuau

SEQ ID NO: 1410108 - RNA, 19 nt, Homo sapiens
gagugcguuucuucuauga

SEQ ID NO: 1410109 - RNA, 19 nt, Homo sapiens
caggagaagacuuugaauu

SEQ ID NO: 1410110 - RNA, 19 nt, Homo sapiens
aaggaaggccugugagauu

SEQ ID NO: 1410111 - RNA, 19 nt, Homo sapiens
gagaagccgguguacaaga

SEQ ID NO: 1410112 - RNA, 19 nt, Homo sapiens
caagaguucggcuacugua

SEQ ID NO: 1410113 - RNA, 19 nt, Homo sapiens
uggagaagccgguguacaa

SEQ ID NO: 1410114 - RNA, 19 nt, Homo sapiens
ggauguuagaucaugaaua

SEQ ID NO: 1410115 - RNA, 19 nt, Homo sapiens
ggaaggccugugagauuga

SEQ ID NO: 1410116 - RNA, 19 nt, Homo sapiens
ccaguacguucgagaaguc

SEQ ID NO: 1410117 - RNA, 19 nt, Homo sapiens
aggagaagacuuugaauuc

SEQ ID NO: 1410118 - RNA, 19 nt, Homo sapiens
cagaaucuccagacgaaga

SEQ ID NO: 1410119 - RNA, 19 nt, Homo sapiens
gcaagaguucggcuacugu

SEQ ID NO: 1410120 - RNA, 19 nt, Homo sapiens
gagauccacagauacuuug

SEQ ID NO: 1410121 - RNA, 19 nt, Homo sapiens
gcccuguauuucaucgaua

SEQ ID NO: 1410122 - RNA, 19 nt, Homo sapiens
gaaauggcgguggaagaga

SEQ ID NO: 1410123 - RNA, 19 nt, Homo sapiens
gacgagccguguugaaacu

SEQ ID NO: 1410124 - RNA, 19 nt, Homo sapiens
agaaggagaagcacgaaga

SEQ ID NO: 1410125 - RNA, 19 nt, Homo sapiens
acuuacagcucuuuaugga

SEQ ID NO: 1410126 - RNA, 19 nt, Homo sapiens
agagggaagucaucaagag

SEQ ID NO: 1410127 - RNA, 19 nt, Homo sapiens
gagagggaagucaucaaga

SEQ ID NO: 1410128 - RNA, 19 nt, Homo sapiens
ggcaggagaagacuuugaa

SEQ ID NO: 1410129 - RNA, 19 nt, Homo sapiens
ggacaaggaggagaacaag

SEQ ID NO: 1410130 - RNA, 19 nt, Homo sapiens
aggaaggccugugagauug

SEQ ID NO: 1410131 - RNA, 19 nt, Homo sapiens
cgaagauccaggcaaagaa

SEQ ID NO: 1410132 - RNA, 19 nt, Homo sapiens
ggaagagagggaagucauc

SEQ ID NO: 1410133 - RNA, 19 nt, Homo sapiens
cgacggagugcguuucuuc

SEQ ID NO: 1410134 - RNA, 19 nt, Homo sapiens
ccacggacaaggaggagaa

SEQ ID NO: 1410135 - RNA, 19 nt, Homo sapiens
uaaaagaagaggcagaaaa

SEQ ID NO: 1410136 - RNA, 19 nt, Homo sapiens
cauggcaggagaagacuuu

SEQ ID NO: 1410137 - RNA, 19 nt, Homo sapiens
cuacaacgccuccaucacu

SEQ ID NO: 1410138 - RNA, 19 nt, Homo sapiens
ggggaauuuuguacaauaa

SEQ ID NO: 1410139 - RNA, 19 nt, Homo sapiens
guuagaucaugaauacaca

SEQ ID NO: 1410140 - RNA, 19 nt, Homo sapiens
cccuguauuucaucgauaa

SEQ ID NO: 1410141 - RNA, 19 nt, Homo sapiens
gaggauguuagaucaugaa

SEQ ID NO: 1410142 - RNA, 19 nt, Homo sapiens
ugaaggaaggccugugaga

SEQ ID NO: 1410143 - RNA, 19 nt, Homo sapiens
aggagaagcagaagcuaaa

SEQ ID NO: 1410144 - RNA, 19 nt, Homo sapiens
cguccaagcucaacuaccu

SEQ ID NO: 1410145 - RNA, 19 nt, Homo sapiens
gcgguggcccuguauuuca

SEQ ID NO: 1410146 - RNA, 19 nt, Homo sapiens
gagacagcuuggcagaagu

SEQ ID NO: 1410147 - RNA, 19 nt, Homo sapiens
aauaggcaacuucaagauu

SEQ ID NO: 1410148 - RNA, 19 nt, Homo sapiens
agaacuccaucaaguacau

SEQ ID NO: 1410149 - RNA, 19 nt, Homo sapiens
uaugaaggaaggccuguga

SEQ ID NO: 1410150 - RNA, 19 nt, Homo sapiens
ggagaaggagaagcacgaa

SEQ ID NO: 1410151 - RNA, 19 nt, Homo sapiens
acagagugccgguggagaa

SEQ ID NO: 1410152 - RNA, 19 nt, Homo sapiens
ggacugcauccgcuacuac

SEQ ID NO: 1410153 - RNA, 19 nt, Homo sapiens
caacacgugguggaauuug

SEQ ID NO: 1410154 - RNA, 19 nt, Homo sapiens
cuggaagucucgggaaaug

SEQ ID NO: 1410155 - RNA, 19 nt, Homo sapiens
gaaggccugugagauugag

SEQ ID NO: 1410156 - RNA, 19 nt, Homo sapiens
gccagaggaugugguuauc

SEQ ID NO: 1410157 - RNA, 19 nt, Homo sapiens
agaguucggcuacuguauu

SEQ ID NO: 1410158 - RNA, 19 nt, Homo sapiens
acaaggaggagaacaagca

SEQ ID NO: 1410159 - RNA, 19 nt, Homo sapiens
cgagccguguugaaacuuc

SEQ ID NO: 1410160 - RNA, 19 nt, Homo sapiens
gcaggagaagacuuugaau

SEQ ID NO: 1410161 - RNA, 19 nt, Homo sapiens
caaccgagucguggccauu

SEQ ID NO: 1410162 - RNA, 19 nt, Homo sapiens
ggagaagccgguguacaag

SEQ ID NO: 1410163 - RNA, 19 nt, Homo sapiens
ggaucacgccagaggaugu

SEQ ID NO: 1410164 - RNA, 19 nt, Homo sapiens
gaagaucuacagcaaaaca

SEQ ID NO: 1410165 - RNA, 19 nt, Homo sapiens
ccaggugggagaaggagaa

SEQ ID NO: 1410166 - RNA, 19 nt, Homo sapiens
gcacaaagauguuccaagu

SEQ ID NO: 1410167 - RNA, 19 nt, Homo sapiens
gaaggcaucucgaaaguug

SEQ ID NO: 1410168 - RNA, 19 nt, Homo sapiens
guuaaugucucucaaauug

SEQ ID NO: 1410169 - RNA, 19 nt, Homo sapiens
ggaauuagauauaggagau

SEQ ID NO: 1410170 - RNA, 19 nt, Homo sapiens
gaaauaggguugacguaca

SEQ ID NO: 1410171 - RNA, 19 nt, Homo sapiens
acaaagauguuccaaguga

SEQ ID NO: 1410172 - RNA, 19 nt, Homo sapiens
gcaaggugauccagauuug

SEQ ID NO: 1410173 - RNA, 19 nt, Homo sapiens
gaaguaaacuguguaggau

SEQ ID NO: 1410174 - RNA, 19 nt, Homo sapiens
uuacaaauguggugccaua

SEQ ID NO: 1410175 - RNA, 19 nt, Homo sapiens
ggagucugauucuacaaua

SEQ ID NO: 1410176 - RNA, 19 nt, Homo sapiens
caaauguggugccauaguu

SEQ ID NO: 1410177 - RNA, 19 nt, Homo sapiens
uaacagaccaagcauauga

SEQ ID NO: 1410178 - RNA, 19 nt, Homo sapiens
aaucauggcugaaauaaca

SEQ ID NO: 1410179 - RNA, 19 nt, Homo sapiens
ugucaacacugcuguauga

SEQ ID NO: 1410180 - RNA, 19 nt, Homo sapiens
cagagugugucuuaaguaa

SEQ ID NO: 1410181 - RNA, 19 nt, Homo sapiens
aguaaacuguguaggauua

SEQ ID NO: 1410182 - RNA, 19 nt, Homo sapiens
ggagaugccacccaaguuu

SEQ ID NO: 1410183 - RNA, 19 nt, Homo sapiens
gggagagaaucaaccguaa

SEQ ID NO: 1410184 - RNA, 19 nt, Homo sapiens
cagcucaucugccuuguug

SEQ ID NO: 1410185 - RNA, 19 nt, Homo sapiens
ggccagaaaguaacuauuu

SEQ ID NO: 1410186 - RNA, 19 nt, Homo sapiens
gagaugccacccaaguuua

SEQ ID NO: 1410187 - RNA, 19 nt, Homo sapiens
gaaaauggaugacuuuguc

SEQ ID NO: 1410188 - RNA, 19 nt, Homo sapiens
gguaaagauuggcaaacuu

SEQ ID NO: 1410189 - RNA, 19 nt, Homo sapiens
cauacaagauuggauuuga

SEQ ID NO: 1410190 - RNA, 19 nt, Homo sapiens
gcacucacccuaaguaucu

SEQ ID NO: 1410191 - RNA, 19 nt, Homo sapiens
cauguuaccuacaagaguu

SEQ ID NO: 1410192 - RNA, 19 nt, Homo sapiens
ggaaauagucaauaaacag

SEQ ID NO: 1410193 - RNA, 19 nt, Homo sapiens
auaaagggccagaaaguaa

SEQ ID NO: 1410194 - RNA, 19 nt, Homo sapiens
cagauuugccgaugucuuu

SEQ ID NO: 1410195 - RNA, 19 nt, Homo sapiens
agaccaagcauaugauaaa

SEQ ID NO: 1410196 - RNA, 19 nt, Homo sapiens
agagacauguuaccuacaa

SEQ ID NO: 1410197 - RNA, 19 nt, Homo sapiens
ugaaauaacagaccaagca

SEQ ID NO: 1410198 - RNA, 19 nt, Homo sapiens
guaaucauggcugaaauaa

SEQ ID NO: 1410199 - RNA, 19 nt, Homo sapiens
auaaguggguguaaucaug

SEQ ID NO: 1410200 - RNA, 19 nt, Homo sapiens
gagugugucuuaaguaacu

SEQ ID NO: 1410201 - RNA, 19 nt, Homo sapiens
ccucagccauaacaggaua

SEQ ID NO: 1410202 - RNA, 19 nt, Homo sapiens
ugaaguaaacuguguagga

SEQ ID NO: 1410203 - RNA, 19 nt, Homo sapiens
uauaaagggccagaaagua

SEQ ID NO: 1410204 - RNA, 19 nt, Homo sapiens
ggagagaaucaaccguaaa

SEQ ID NO: 1410205 - RNA, 19 nt, Homo sapiens
ggucuucccauugcaguua

SEQ ID NO: 1410206 - RNA, 19 nt, Homo sapiens
ucacauaucauagcuugaa

SEQ ID NO: 1410207 - RNA, 19 nt, Homo sapiens
gccagacccucagaauauu

SEQ ID NO: 1410208 - RNA, 19 nt, Homo sapiens
ggauaagggagaucuugaa

SEQ ID NO: 1410209 - RNA, 19 nt, Homo sapiens
uauguagcguucuugguuu

SEQ ID NO: 1410210 - RNA, 19 nt, Homo sapiens
gcuugaauauuacaacagu

SEQ ID NO: 1410211 - RNA, 19 nt, Homo sapiens
aauaacagaccaagcauau

SEQ ID NO: 1410212 - RNA, 19 nt, Homo sapiens
ggguugacguacauaguga

SEQ ID NO: 1410213 - RNA, 19 nt, Homo sapiens
ggcaugaaguaaacugugu

SEQ ID NO: 1410214 - RNA, 19 nt, Homo sapiens
ugucauaacuugucaacac

SEQ ID NO: 1410215 - RNA, 19 nt, Homo sapiens
ccuacugucucugucauaa

SEQ ID NO: 1410216 - RNA, 19 nt, Homo sapiens
gaaauaacagaccaagcau

SEQ ID NO: 1410217 - RNA, 19 nt, Homo sapiens
gaugggcacucacccuaag

SEQ ID NO: 1410218 - RNA, 19 nt, Homo sapiens
ccuaggauguauucagaug

SEQ ID NO: 1410219 - RNA, 19 nt, Homo sapiens
ugccagacccucagaauau

SEQ ID NO: 1410220 - RNA, 19 nt, Homo sapiens
cacccuaaguaucuagaaa

SEQ ID NO: 1410221 - RNA, 19 nt, Homo sapiens
gauccagauuugccgaugu

SEQ ID NO: 1410222 - RNA, 19 nt, Homo sapiens
ggguaaagauuggcaaacu

SEQ ID NO: 1410223 - RNA, 19 nt, Homo sapiens
gcuauccuuuucauucuua

SEQ ID NO: 1410224 - RNA, 19 nt, Homo sapiens
ccagagugugucuuaagua

SEQ ID NO: 1410225 - RNA, 19 nt, Homo sapiens
gauggaauuagauauagga

SEQ ID NO: 1410226 - RNA, 19 nt, Homo sapiens
agccauagacaauacauaa

SEQ ID NO: 1410227 - RNA, 19 nt, Homo sapiens
aaauaggguugacguacau

SEQ ID NO: 1410228 - RNA, 19 nt, Homo sapiens
ggaugggcacucacccuaa

SEQ ID NO: 1410229 - RNA, 19 nt, Homo sapiens
uguaaucauggcugaaaua

SEQ ID NO: 1410230 - RNA, 19 nt, Homo sapiens
caaaagcuggcaugaagua

SEQ ID NO: 1410231 - RNA, 19 nt, Homo sapiens
agagacaguuuaauuacag

SEQ ID NO: 1410232 - RNA, 19 nt, Homo sapiens
cugcuucccucagccauaa

SEQ ID NO: 1410233 - RNA, 19 nt, Homo sapiens
gcaugaaguaaacugugua

SEQ ID NO: 1410234 - RNA, 19 nt, Homo sapiens
gcagaaaauggaugacuuu

SEQ ID NO: 1410235 - RNA, 19 nt, Homo sapiens
gguguaaucauggcugaaa

SEQ ID NO: 1410236 - RNA, 19 nt, Homo sapiens
gcguggcuuuguuccagua

SEQ ID NO: 1410237 - RNA, 19 nt, Homo sapiens
gccagaaaguaacuauuuu

SEQ ID NO: 1410238 - RNA, 19 nt, Homo sapiens
ggaccugugugcugcuuuu

SEQ ID NO: 1410239 - RNA, 19 nt, Homo sapiens
ugccuaggauguauucaga

SEQ ID NO: 1410240 - RNA, 19 nt, Homo sapiens
gauaagggagaucuugaag

SEQ ID NO: 1410241 - RNA, 19 nt, Homo sapiens
uaccagaacuccagcucau

SEQ ID NO: 1410242 - RNA, 19 nt, Homo sapiens
aaauaacagaccaagcaua

SEQ ID NO: 1410243 - RNA, 19 nt, Homo sapiens
gagagaaucaaccguaaaa

SEQ ID NO: 1410244 - RNA, 19 nt, Homo sapiens
uacaagaguucugggcuau

SEQ ID NO: 1410245 - RNA, 19 nt, Homo sapiens
gagucugauucuacaauag

SEQ ID NO: 1410246 - RNA, 19 nt, Homo sapiens
guugcaaggugauccagau

SEQ ID NO: 1410247 - RNA, 19 nt, Homo sapiens
uaauuagacccaguuauuc

SEQ ID NO: 1410248 - RNA, 19 nt, Homo sapiens
cauccagagugugucuuaa

SEQ ID NO: 1410249 - RNA, 19 nt, Homo sapiens
cauaagguuuucauucuga

SEQ ID NO: 1410250 - RNA, 19 nt, Homo sapiens
gccauagacaauacauaaa

SEQ ID NO: 1410251 - RNA, 19 nt, Homo sapiens
acccacuucuguuuacuuu

SEQ ID NO: 1410252 - RNA, 19 nt, Homo sapiens
gagacaguuuaauuacagu

SEQ ID NO: 1410253 - RNA, 19 nt, Homo sapiens
aaagcuggcaugaaguaaa

SEQ ID NO: 1410254 - RNA, 19 nt, Homo sapiens
aagcagccauagacaauac

SEQ ID NO: 1410255 - RNA, 19 nt, Homo sapiens
gcacaaaagcagccauaga

SEQ ID NO: 1410256 - RNA, 19 nt, Homo sapiens
ucucucaaauuguacaaag

SEQ ID NO: 1410257 - RNA, 19 nt, Homo sapiens
cccuaaguaucuagaaaug

SEQ ID NO: 1410258 - RNA, 19 nt, Homo sapiens
ucauccagagugugucuua

SEQ ID NO: 1410259 - RNA, 19 nt, Homo sapiens
ugucacccacuucuguuua

SEQ ID NO: 1410260 - RNA, 19 nt, Homo sapiens
cauguuuccugaugcuugu

SEQ ID NO: 1410261 - RNA, 19 nt, Homo sapiens
ccagacccucagaauauuu

SEQ ID NO: 1410262 - RNA, 19 nt, Homo sapiens
acagaccaagcauaugaua

SEQ ID NO: 1410263 - RNA, 19 nt, Homo sapiens
uuauguagcguucuugguu

SEQ ID NO: 1410264 - RNA, 19 nt, Homo sapiens
acaauacgggcguggcuuu

SEQ ID NO: 1410265 - RNA, 19 nt, Homo sapiens
caacagugugggagagaau

SEQ ID NO: 1410266 - RNA, 19 nt, Homo sapiens
gaaggaaguuugcucuuaa

SEQ ID NO: 1410267 - RNA, 19 nt, Homo sapiens
aaccagagcuucagaaaua

SEQ ID NO: 1410268 - RNA, 19 nt, Homo sapiens
gaaaguguguccagcuuaa

SEQ ID NO: 1410269 - RNA, 19 nt, Homo sapiens
gaaguuugcucuuaauuuc

SEQ ID NO: 1410270 - RNA, 19 nt, Homo sapiens
caauuuggcugaagucuuu

SEQ ID NO: 1410271 - RNA, 19 nt, Homo sapiens
aaaggaagcugcuaucuug

SEQ ID NO: 1410272 - RNA, 19 nt, Homo sapiens
cgaaggaaguuugcucuua

SEQ ID NO: 1410273 - RNA, 19 nt, Homo sapiens
agacagaccugcugccuaa

SEQ ID NO: 1410274 - RNA, 19 nt, Homo sapiens
gagauacguuguaguuaaa

SEQ ID NO: 1410275 - RNA, 19 nt, Homo sapiens
ggacugagcaggugauuau

SEQ ID NO: 1410276 - RNA, 19 nt, Homo sapiens
gaagaagaaugacagaaag

SEQ ID NO: 1410277 - RNA, 19 nt, Homo sapiens
ggaagaagaaugacagaaa

SEQ ID NO: 1410278 - RNA, 19 nt, Homo sapiens
cugaaagcauuccaaauua

SEQ ID NO: 1410279 - RNA, 19 nt, Homo sapiens
gcaaauguauacuguaagu

SEQ ID NO: 1410280 - RNA, 19 nt, Homo sapiens
gcaagagggcugcaccuua

SEQ ID NO: 1410281 - RNA, 19 nt, Homo sapiens
caggagagcuucugccauu

SEQ ID NO: 1410282 - RNA, 19 nt, Homo sapiens
aagcagagcuaucacaauu

SEQ ID NO: 1410283 - RNA, 19 nt, Homo sapiens
ggagaggccugcacacuca

SEQ ID NO: 1410284 - RNA, 19 nt, Homo sapiens
ggagaacacucagcccuuu

SEQ ID NO: 1410285 - RNA, 19 nt, Homo sapiens
caucagagcuggaguuugg

SEQ ID NO: 1410286 - RNA, 19 nt, Homo sapiens
ugaagcagaugacauuuga

SEQ ID NO: 1410287 - RNA, 19 nt, Homo sapiens
ggagagauacguuguaguu

SEQ ID NO: 1410288 - RNA, 19 nt, Homo sapiens
caaagacaauggcauacuu

SEQ ID NO: 1410289 - RNA, 19 nt, Homo sapiens
ggagagcuaugagaauaaa

SEQ ID NO: 1410290 - RNA, 19 nt, Homo sapiens
agagauacguuguaguuaa

SEQ ID NO: 1410291 - RNA, 19 nt, Homo sapiens
gaagagaacauaugccaau

SEQ ID NO: 1410292 - RNA, 19 nt, Homo sapiens
ggagugaaagggacaauuu

SEQ ID NO: 1410293 - RNA, 19 nt, Homo sapiens
caagagggcugcaccuuag

SEQ ID NO: 1410294 - RNA, 19 nt, Homo sapiens
guggagagcuaugagaaua

SEQ ID NO: 1410295 - RNA, 19 nt, Homo sapiens
ggaaguuugcucuuaauuu

SEQ ID NO: 1410296 - RNA, 19 nt, Homo sapiens
caaauuaggcuuagacugu

SEQ ID NO: 1410297 - RNA, 19 nt, Homo sapiens
gaaugcaaauguauacugu

SEQ ID NO: 1410298 - RNA, 19 nt, Homo sapiens
gaacagcaaagagauuuaa

SEQ ID NO: 1410299 - RNA, 19 nt, Homo sapiens
agaaagaggugaaugaagu

SEQ ID NO: 1410300 - RNA, 19 nt, Homo sapiens
acacaaagaugacgugaag

SEQ ID NO: 1410301 - RNA, 19 nt, Homo sapiens
cgacaacugugaagaaagu

SEQ ID NO: 1410302 - RNA, 19 nt, Homo sapiens
ggacucugcuccagugaug

SEQ ID NO: 1410303 - RNA, 19 nt, Homo sapiens
ucaggcaucucaaucauga

SEQ ID NO: 1410304 - RNA, 19 nt, Homo sapiens
cccaauagauucaagagaa

SEQ ID NO: 1410305 - RNA, 19 nt, Homo sapiens
caugcaagcuguuaccaaa

SEQ ID NO: 1410306 - RNA, 19 nt, Homo sapiens
gaagauggaaccuuguuau

SEQ ID NO: 1410307 - RNA, 19 nt, Homo sapiens
gcuccuaaaugucgaauuc

SEQ ID NO: 1410308 - RNA, 19 nt, Homo sapiens
uaaagaggccuaucagaga

SEQ ID NO: 1410309 - RNA, 19 nt, Homo sapiens
gcugaagucuuucucugaa

SEQ ID NO: 1410310 - RNA, 19 nt, Homo sapiens
ugaaggcgcucagaaaguu

SEQ ID NO: 1410311 - RNA, 19 nt, Homo sapiens
ccaaggaauucccagugua

SEQ ID NO: 1410312 - RNA, 19 nt, Homo sapiens
gagaacauaugccaauuuu

SEQ ID NO: 1410313 - RNA, 19 nt, Homo sapiens
ccaauaugauucacguuga

SEQ ID NO: 1410314 - RNA, 19 nt, Homo sapiens
gauggaaccuuguuauacu

SEQ ID NO: 1410315 - RNA, 19 nt, Homo sapiens
ggagaagggucacuauggu

SEQ ID NO: 1410316 - RNA, 19 nt, Homo sapiens
gcagagcuaucacaauuuu

SEQ ID NO: 1410317 - RNA, 19 nt, Homo sapiens
gcaaucacgugcgcacuga

SEQ ID NO: 1410318 - RNA, 19 nt, Homo sapiens
ggguaagacugaaagcauu

SEQ ID NO: 1410319 - RNA, 19 nt, Homo sapiens
gaugaaacucugaaaguga

SEQ ID NO: 1410320 - RNA, 19 nt, Homo sapiens
gcaucaaguuucagaagga

SEQ ID NO: 1410321 - RNA, 19 nt, Homo sapiens
ccucagaagaugaauauaa

SEQ ID NO: 1410322 - RNA, 19 nt, Homo sapiens
guguugggcuuaguaauaa

SEQ ID NO: 1410323 - RNA, 19 nt, Homo sapiens
gcaaucuucuugugcacuu

SEQ ID NO: 1410324 - RNA, 19 nt, Homo sapiens
uuacaaagacaauggcaua

SEQ ID NO: 1410325 - RNA, 19 nt, Homo sapiens
ccagugagcucgggauuca

SEQ ID NO: 1410326 - RNA, 19 nt, Homo sapiens
ugaguaaccuggugaugga

SEQ ID NO: 1410327 - RNA, 19 nt, Homo sapiens
gaaggagagauacguugua

SEQ ID NO: 1410328 - RNA, 19 nt, Homo sapiens
gaaauccagauccugagua

SEQ ID NO: 1410329 - RNA, 19 nt, Homo sapiens
caaauaguccugguucauu

SEQ ID NO: 1410330 - RNA, 19 nt, Homo sapiens
ugaaagcauuccaaauuag

SEQ ID NO: 1410331 - RNA, 19 nt, Homo sapiens
ucaaguuucagaaggauua

SEQ ID NO: 1410332 - RNA, 19 nt, Homo sapiens
gaggguaggucaugaacag

SEQ ID NO: 1410333 - RNA, 19 nt, Homo sapiens
gacaugaauuguucuacga

SEQ ID NO: 1410334 - RNA, 19 nt, Homo sapiens
ccaagaaaaugaagaagaa

SEQ ID NO: 1410335 - RNA, 19 nt, Homo sapiens
gaaccuuguuauacuaaag

SEQ ID NO: 1410336 - RNA, 19 nt, Homo sapiens
caucuagaccggcuuauga

SEQ ID NO: 1410337 - RNA, 19 nt, Homo sapiens
aaauccagauccugaguaa

SEQ ID NO: 1410338 - RNA, 19 nt, Homo sapiens
aaagauaagugcuuguucu

SEQ ID NO: 1410339 - RNA, 19 nt, Homo sapiens
gcuuaaaacccgucaauua

SEQ ID NO: 1410340 - RNA, 19 nt, Homo sapiens
gcaaucaugcccaauagau

SEQ ID NO: 1410341 - RNA, 19 nt, Homo sapiens
ucccagagcugcccucaga

SEQ ID NO: 1410342 - RNA, 19 nt, Homo sapiens
gcaggugauuauuucaaga

SEQ ID NO: 1410343 - RNA, 19 nt, Homo sapiens
gugcaaagggcuuagcuaa

SEQ ID NO: 1410344 - RNA, 19 nt, Homo sapiens
caagguagcccguauucau

SEQ ID NO: 1410345 - RNA, 19 nt, Homo sapiens
gagccagguuucugaggaa

SEQ ID NO: 1410346 - RNA, 19 nt, Homo sapiens
ggaagcugcuaucuugaag

SEQ ID NO: 1410347 - RNA, 19 nt, Homo sapiens
ugaaugaagucagccagaa

SEQ ID NO: 1410348 - RNA, 19 nt, Homo sapiens
gagagauacguuguaguua

SEQ ID NO: 1410349 - RNA, 19 nt, Homo sapiens
acugaaagcauuccaaauu

SEQ ID NO: 1410350 - RNA, 19 nt, Homo sapiens
gacccucaguaacgaagua

SEQ ID NO: 1410351 - RNA, 19 nt, Homo sapiens
ggaaccuuguuauacuaaa

SEQ ID NO: 1410352 - RNA, 19 nt, Homo sapiens
ugacauggaucagauugug

SEQ ID NO: 1410353 - RNA, 19 nt, Homo sapiens
uuuagaagcugugcaauuc

SEQ ID NO: 1410354 - RNA, 19 nt, Homo sapiens
uacuguaagucuaccuuua

SEQ ID NO: 1410355 - RNA, 19 nt, Homo sapiens
gcacuggcguccacaugca

SEQ ID NO: 1410356 - RNA, 19 nt, Homo sapiens
gagcaucuagaccggcuua

SEQ ID NO: 1410357 - RNA, 19 nt, Homo sapiens
aaauaguccugguucauuc

SEQ ID NO: 1410358 - RNA, 19 nt, Homo sapiens
gaagcuaagcggaaaugga

SEQ ID NO: 1410359 - RNA, 19 nt, Homo sapiens
gaagagaugggagggcaaa

SEQ ID NO: 1410360 - RNA, 19 nt, Homo sapiens
gggcaaguguaccgaggaa

SEQ ID NO: 1410361 - RNA, 19 nt, Homo sapiens
uaaaggaagcugcuaucuu

SEQ ID NO: 1410362 - RNA, 19 nt, Homo sapiens
caaaccagagcuucagaaa

SEQ ID NO: 1410363 - RNA, 19 nt, Homo sapiens
gaagaccaagccaccauug

SEQ ID NO: 1410364 - RNA, 19 nt, Homo sapiens
uuagugcccuccugaguga

SEQ ID NO: 1410365 - RNA, 19 nt, Homo sapiens
gguguuaaccucagaagau

SEQ ID NO: 1410366 - RNA, 19 nt, Homo sapiens
ggacaucauugacuuaaua

SEQ ID NO: 1410367 - RNA, 19 nt, Homo sapiens
ccaaguggcuccucucuua

SEQ ID NO: 1410368 - RNA, 19 nt, Homo sapiens
gaaggaaguuugcucuuaa

SEQ ID NO: 1410369 - RNA, 19 nt, Homo sapiens
gaucaucacuaucgaguaa

SEQ ID NO: 1410370 - RNA, 19 nt, Homo sapiens
aaccagagcuucagaaaua

SEQ ID NO: 1410371 - RNA, 19 nt, Homo sapiens
caucagaucucaacauauu

SEQ ID NO: 1410372 - RNA, 19 nt, Homo sapiens
gaaaguguguccagcuuaa

SEQ ID NO: 1410373 - RNA, 19 nt, Homo sapiens
gaaguuugcucuuaauuuc

SEQ ID NO: 1410374 - RNA, 19 nt, Homo sapiens
caauuuggcugaagucuuu

SEQ ID NO: 1410375 - RNA, 19 nt, Homo sapiens
gaaacuagagugcauuuaa

SEQ ID NO: 1410376 - RNA, 19 nt, Homo sapiens
aaaggaagcugcuaucuug

SEQ ID NO: 1410377 - RNA, 19 nt, Homo sapiens
gcaggaugauuguuuaauu

SEQ ID NO: 1410378 - RNA, 19 nt, Homo sapiens
ccaaguagcuggaauuaca

SEQ ID NO: 1410379 - RNA, 19 nt, Homo sapiens
cgaaggaaguuugcucuua

SEQ ID NO: 1410380 - RNA, 19 nt, Homo sapiens
ggaaggacaucauugacuu

SEQ ID NO: 1410381 - RNA, 19 nt, Homo sapiens
agacagaccugcugccuaa

SEQ ID NO: 1410382 - RNA, 19 nt, Homo sapiens
gagauacguuguaguuaaa

SEQ ID NO: 1410383 - RNA, 19 nt, Homo sapiens
ggacugagcaggugauuau

SEQ ID NO: 1410384 - RNA, 19 nt, Homo sapiens
gaagaagaaugacagaaag

SEQ ID NO: 1410385 - RNA, 19 nt, Homo sapiens
ggaagaagaaugacagaaa

SEQ ID NO: 1410386 - RNA, 19 nt, Homo sapiens
uaagcaggaugauuguuua

SEQ ID NO: 1410387 - RNA, 19 nt, Homo sapiens
gaacaucagugcccuaacu

SEQ ID NO: 1410388 - RNA, 19 nt, Homo sapiens
cugaaagcauuccaaauua

SEQ ID NO: 1410389 - RNA, 19 nt, Homo sapiens
gcaaauguauacuguaagu

SEQ ID NO: 1410390 - RNA, 19 nt, Homo sapiens
gcaagagggcugcaccuua

SEQ ID NO: 1410391 - RNA, 19 nt, Homo sapiens
caggagagcuucugccauu

SEQ ID NO: 1410392 - RNA, 19 nt, Homo sapiens
aagcagagcuaucacaauu

SEQ ID NO: 1410393 - RNA, 19 nt, Homo sapiens
ggagaggccugcacacuca

SEQ ID NO: 1410394 - RNA, 19 nt, Homo sapiens
ggagaacacucagcccuuu

SEQ ID NO: 1410395 - RNA, 19 nt, Homo sapiens
caucagagcuggaguuugg

SEQ ID NO: 1410396 - RNA, 19 nt, Homo sapiens
ugaagcagaugacauuuga

SEQ ID NO: 1410397 - RNA, 19 nt, Homo sapiens
ggagagauacguuguaguu

SEQ ID NO: 1410398 - RNA, 19 nt, Homo sapiens
acacacaguucaaccauuu

SEQ ID NO: 1410399 - RNA, 19 nt, Homo sapiens
caaagacaauggcauacuu

SEQ ID NO: 1410400 - RNA, 19 nt, Homo sapiens
ggagagcuaugagaauaaa

SEQ ID NO: 1410401 - RNA, 19 nt, Homo sapiens
agagauacguuguaguuaa

SEQ ID NO: 1410402 - RNA, 19 nt, Homo sapiens
gaacuuguuuagaucauca

SEQ ID NO: 1410403 - RNA, 19 nt, Homo sapiens
guugagaacuuguuuagau

SEQ ID NO: 1410404 - RNA, 19 nt, Homo sapiens
gaagagaacauaugccaau

SEQ ID NO: 1410405 - RNA, 19 nt, Homo sapiens
ggagugaaagggacaauuu

SEQ ID NO: 1410406 - RNA, 19 nt, Homo sapiens
caagagggcugcaccuuag

SEQ ID NO: 1410407 - RNA, 19 nt, Homo sapiens
guggagagcuaugagaaua

SEQ ID NO: 1410408 - RNA, 19 nt, Homo sapiens
ggaaguuugcucuuaauuu

SEQ ID NO: 1410409 - RNA, 19 nt, Homo sapiens
caaauuaggcuuagacugu

SEQ ID NO: 1410410 - RNA, 19 nt, Homo sapiens
gaaugcaaauguauacugu

SEQ ID NO: 1410411 - RNA, 19 nt, Homo sapiens
gaacagcaaagagauuuaa

SEQ ID NO: 1410412 - RNA, 19 nt, Homo sapiens
agaaagaggugaaugaagu

SEQ ID NO: 1410413 - RNA, 19 nt, Homo sapiens
gauguacuccagaauauaa

SEQ ID NO: 1410414 - RNA, 19 nt, Homo sapiens
gaaggacaucauugacuua

SEQ ID NO: 1410415 - RNA, 19 nt, Homo sapiens
caucagugcccuaacuuua

SEQ ID NO: 1410416 - RNA, 19 nt, Homo sapiens
ggucucaacuccugauuuc

SEQ ID NO: 1410417 - RNA, 19 nt, Homo sapiens
ccaaagauguuaucaaagc

SEQ ID NO: 1410418 - RNA, 19 nt, Homo sapiens
acacaaagaugacgugaag

SEQ ID NO: 1410419 - RNA, 19 nt, Homo sapiens
cgacaacugugaagaaagu

SEQ ID NO: 1410420 - RNA, 19 nt, Homo sapiens
ggacucugcuccagugaug

SEQ ID NO: 1410421 - RNA, 19 nt, Homo sapiens
ucaggcaucucaaucauga

SEQ ID NO: 1410422 - RNA, 19 nt, Homo sapiens
gcagugaacuaugauuuua

SEQ ID NO: 1410423 - RNA, 19 nt, Homo sapiens
cccaauagauucaagagaa

SEQ ID NO: 1410424 - RNA, 19 nt, Homo sapiens
caugcaagcuguuaccaaa

SEQ ID NO: 1410425 - RNA, 19 nt, Homo sapiens
gaagauggaaccuuguuau

SEQ ID NO: 1410426 - RNA, 19 nt, Homo sapiens
gcuccuaaaugucgaauuc

SEQ ID NO: 1410427 - RNA, 19 nt, Homo sapiens
uaaagaggccuaucagaga

SEQ ID NO: 1410428 - RNA, 19 nt, Homo sapiens
ugucagagcuagugauuuc

SEQ ID NO: 1410429 - RNA, 19 nt, Homo sapiens
gcuaauugagucucuguua

SEQ ID NO: 1410430 - RNA, 19 nt, Homo sapiens
gcugaagucuuucucugaa

SEQ ID NO: 1410431 - RNA, 19 nt, Homo sapiens
ugaaggcgcucagaaaguu

SEQ ID NO: 1410432 - RNA, 19 nt, Homo sapiens
ccaaggaauucccagugua

SEQ ID NO: 1410433 - RNA, 19 nt, Homo sapiens
gagaacauaugccaauuuu

SEQ ID NO: 1410434 - RNA, 19 nt, Homo sapiens
ccaauaugauucacguuga

SEQ ID NO: 1410435 - RNA, 19 nt, Homo sapiens
gauggaaccuuguuauacu

SEQ ID NO: 1410436 - RNA, 19 nt, Homo sapiens
ggagaagggucacuauggu

SEQ ID NO: 1410437 - RNA, 19 nt, Homo sapiens
uuucuggccuuacauauuu

SEQ ID NO: 1410438 - RNA, 19 nt, Homo sapiens
aaacugggcuugucauuuu

SEQ ID NO: 1410439 - RNA, 19 nt, Homo sapiens
ugaauggaauaacugcaua

SEQ ID NO: 1410440 - RNA, 19 nt, Homo sapiens
gcaaucacgugcgcacuga

SEQ ID NO: 1410441 - RNA, 19 nt, Homo sapiens
gcagagcuaucacaauuuu

SEQ ID NO: 1410442 - RNA, 19 nt, Homo sapiens
agaauaagcaggaugauug

SEQ ID NO: 1410443 - RNA, 19 nt, Homo sapiens
uaauaucccuggugcauag

SEQ ID NO: 1410444 - RNA, 19 nt, Homo sapiens
aacaucagaucucaacaua

SEQ ID NO: 1410445 - RNA, 19 nt, Homo sapiens
ggguaagacugaaagcauu

SEQ ID NO: 1410446 - RNA, 19 nt, Homo sapiens
gaugaaacucugaaaguga

SEQ ID NO: 1410447 - RNA, 19 nt, Homo sapiens
gcaucaaguuucagaagga

SEQ ID NO: 1410448 - RNA, 19 nt, Homo sapiens
ccucagaagaugaauauaa

SEQ ID NO: 1410449 - RNA, 19 nt, Homo sapiens
guguugggcuuaguaauaa

SEQ ID NO: 1410450 - RNA, 19 nt, Homo sapiens
gcaaucuucuugugcacuu

SEQ ID NO: 1410451 - RNA, 19 nt, Homo sapiens
uuacaaagacaauggcaua

SEQ ID NO: 1410452 - RNA, 19 nt, Homo sapiens
ccagugagcucgggauuca

SEQ ID NO: 1410453 - RNA, 19 nt, Homo sapiens
ugaguaaccuggugaugga

SEQ ID NO: 1410454 - RNA, 19 nt, Homo sapiens
gaaggagagauacguugua

SEQ ID NO: 1410455 - RNA, 19 nt, Homo sapiens
ggagcgagguuauucugau

SEQ ID NO: 1410456 - RNA, 19 nt, Homo sapiens
gaaauccagauccugagua

SEQ ID NO: 1410457 - RNA, 19 nt, Homo sapiens
caaauaguccugguucauu

SEQ ID NO: 1410458 - RNA, 19 nt, Homo sapiens
caagaucucauccuuacaa

SEQ ID NO: 1410459 - RNA, 19 nt, Homo sapiens
ugugguagcuuacaccuau

SEQ ID NO: 1410460 - RNA, 19 nt, Homo sapiens
agaaagacguuuugaauug

SEQ ID NO: 1410461 - RNA, 19 nt, Homo sapiens
uaacggauggugaccuaua

SEQ ID NO: 1410462 - RNA, 19 nt, Homo sapiens
gguguaugcucucaaguuc

SEQ ID NO: 1410463 - RNA, 19 nt, Homo sapiens
ugaaagcauuccaaauuag

SEQ ID NO: 1410464 - RNA, 19 nt, Homo sapiens
ucaaguuucagaaggauua

SEQ ID NO: 1410465 - RNA, 19 nt, Homo sapiens
aagguuaagugauauguga

SEQ ID NO: 1410466 - RNA, 19 nt, Homo sapiens
aaaggcaugugucauauuu

SEQ ID NO: 1410467 - RNA, 19 nt, Homo sapiens
gcgccaacccuaucauuua

SEQ ID NO: 1410468 - RNA, 19 nt, Homo sapiens
acagauaucucucucaugu

SEQ ID NO: 1410469 - RNA, 19 nt, Homo sapiens
ccaacccuaucauuuauuu

SEQ ID NO: 1410470 - RNA, 19 nt, Homo sapiens
guaaaggcaugugucauau

SEQ ID NO: 1410471 - RNA, 19 nt, Homo sapiens
gcaugugucauauuucuaa

SEQ ID NO: 1410472 - RNA, 19 nt, Homo sapiens
cgaaugaaaccauacauau

SEQ ID NO: 1410473 - RNA, 19 nt, Homo sapiens
gcccugcccuugaauauca

SEQ ID NO: 1410474 - RNA, 19 nt, Homo sapiens
ugagacgaaugaaaccaua

SEQ ID NO: 1410475 - RNA, 19 nt, Homo sapiens
ccucauaacagauuucaaa

SEQ ID NO: 1410476 - RNA, 19 nt, Homo sapiens
uguaaaggcaugugucaua

SEQ ID NO: 1410477 - RNA, 19 nt, Homo sapiens
gucaccaccuccuauuuaa

SEQ ID NO: 1410478 - RNA, 19 nt, Homo sapiens
ucacagauaucucucucau

SEQ ID NO: 1410479 - RNA, 19 nt, Homo sapiens
ugacucugcuaacuuauca

SEQ ID NO: 1410480 - RNA, 19 nt, Homo sapiens
ugucaccaccuccuauuua

SEQ ID NO: 1410481 - RNA, 19 nt, Homo sapiens
agauaucucucucauguag

SEQ ID NO: 1410482 - RNA, 19 nt, Homo sapiens
gcucuuccaugcuauccuu

SEQ ID NO: 1410483 - RNA, 19 nt, Homo sapiens
aggugacucugcuaacuua

SEQ ID NO: 1410484 - RNA, 19 nt, Homo sapiens
caccaccuccuauuuaauu

SEQ ID NO: 1410485 - RNA, 19 nt, Homo sapiens
acccaaaccugguaucuca

SEQ ID NO: 1410486 - RNA, 19 nt, Homo sapiens
cgccaacccuaucauuuau

SEQ ID NO: 1410487 - RNA, 19 nt, Homo sapiens
gacaguguuugcugaguca

SEQ ID NO: 1410488 - RNA, 19 nt, Homo sapiens
ucagcucuguggcgucuuu

SEQ ID NO: 1410489 - RNA, 19 nt, Homo sapiens
caugcuauccuuucacuug

SEQ ID NO: 1410490 - RNA, 19 nt, Homo sapiens
cuaacuuacuggaaacaug

SEQ ID NO: 1410491 - RNA, 19 nt, Homo sapiens
cuacucagcauguggagaa

SEQ ID NO: 1410492 - RNA, 19 nt, Homo sapiens
ccacgaaucccuacauggu

SEQ ID NO: 1410493 - RNA, 19 nt, Homo sapiens
agaaaaggcugaaggaauc

SEQ ID NO: 1410494 - RNA, 19 nt, Homo sapiens
uaacuuacuggaaacaugu

SEQ ID NO: 1410495 - RNA, 19 nt, Homo sapiens
gaaagaaaaggcugaagga

SEQ ID NO: 1410496 - RNA, 19 nt, Homo sapiens
ucugggcucuuccaugcua

SEQ ID NO: 1410497 - RNA, 19 nt, Homo sapiens
uaaaggcaugugucauauu

SEQ ID NO: 1410498 - RNA, 19 nt, Homo sapiens
ggucgcugcugacgugauc

SEQ ID NO: 1410499 - RNA, 19 nt, Homo sapiens
ggccacgaaucccuacaug

SEQ ID NO: 1410500 - RNA, 19 nt, Homo sapiens
ccuuguuccucauuauaaa

SEQ ID NO: 1410501 - RNA, 19 nt, Homo sapiens
cugauuuccuggccauauu

SEQ ID NO: 1410502 - RNA, 19 nt, Homo sapiens
ucugcuaacuuaucaugga

SEQ ID NO: 1410503 - RNA, 19 nt, Homo sapiens
acgaaucccuacaugguau

SEQ ID NO: 1410504 - RNA, 19 nt, Homo sapiens
uguggcgucuuucuucaaa

SEQ ID NO: 1410505 - RNA, 19 nt, Homo sapiens
gagcguggcaccccucaua

SEQ ID NO: 1410506 - RNA, 19 nt, Homo sapiens
gacgugaucuaucuuugcu

SEQ ID NO: 1410507 - RNA, 19 nt, Homo sapiens
gcugacgugaucuaucuuu

SEQ ID NO: 1410508 - RNA, 19 nt, Homo sapiens
cugcugacgugaucuaucu

SEQ ID NO: 1410509 - RNA, 19 nt, Homo sapiens
acgaaugaaaccauacaua

SEQ ID NO: 1410510 - RNA, 19 nt, Homo sapiens
ccugguaucucagcucugu

SEQ ID NO: 1410511 - RNA, 19 nt, Homo sapiens
cagcuggcaucgacccaau

SEQ ID NO: 1410512 - RNA, 19 nt, Homo sapiens
gaacccaaaccugguaucu

SEQ ID NO: 1410513 - RNA, 19 nt, Homo sapiens
caaaaugagacgaaugaaa

SEQ ID NO: 1410514 - RNA, 19 nt, Homo sapiens
uuacaggugacucugcuaa

SEQ ID NO: 1410515 - RNA, 19 nt, Homo sapiens
cagggucgauguggaaaca

SEQ ID NO: 1410516 - RNA, 19 nt, Homo sapiens
ucuaugcgguggugcagau

SEQ ID NO: 1410517 - RNA, 19 nt, Homo sapiens
gggaaaauuugcugguuca

SEQ ID NO: 1410518 - RNA, 19 nt, Homo sapiens
acagaacccaaaccuggua

SEQ ID NO: 1410519 - RNA, 19 nt, Homo sapiens
cacgaaucccuacauggua

SEQ ID NO: 1410520 - RNA, 19 nt, Homo sapiens
aggcaugugucauauuucu

SEQ ID NO: 1410521 - RNA, 19 nt, Homo sapiens
gagcaaccacacucuacuc

SEQ ID NO: 1410522 - RNA, 19 nt, Homo sapiens
cagauaucucucucaugua

SEQ ID NO: 1410523 - RNA, 19 nt, Homo sapiens
cagcagcgccaacccuauc

SEQ ID NO: 1410524 - RNA, 19 nt, Homo sapiens
cgaaucccuacaugguaua

SEQ ID NO: 1410525 - RNA, 19 nt, Homo sapiens
ccuccuauuuaauuuccuu

SEQ ID NO: 1410526 - RNA, 19 nt, Homo sapiens
gcaucaacauaguaaaauc

SEQ ID NO: 1410527 - RNA, 19 nt, Homo sapiens
guguguguguguccucuuc

SEQ ID NO: 1410528 - RNA, 19 nt, Homo sapiens
ucucucauguagccuuugu

SEQ ID NO: 1410529 - RNA, 19 nt, Homo sapiens
cagcgccaacccuaucauu

SEQ ID NO: 1410530 - RNA, 19 nt, Homo sapiens
gcucuguggcgucuuucuu

SEQ ID NO: 1410531 - RNA, 19 nt, Homo sapiens
ccaaaauacacaucuaaug

SEQ ID NO: 1410532 - RNA, 19 nt, Homo sapiens
ugacauagcucuacaccua

SEQ ID NO: 1410533 - RNA, 19 nt, Homo sapiens
gagcaagaccucaacaaua

SEQ ID NO: 1410534 - RNA, 19 nt, Homo sapiens
ggacgaggcuugggcuuug

SEQ ID NO: 1410535 - RNA, 19 nt, Homo sapiens
gaagggagaaagagaauau

SEQ ID NO: 1410536 - RNA, 19 nt, Homo sapiens
ugggaaugcucaugaguua

SEQ ID NO: 1410537 - RNA, 19 nt, Homo sapiens
ggagaaagagaauaucaug

SEQ ID NO: 1410538 - RNA, 19 nt, Homo sapiens
agcaagaccucaacaauau

SEQ ID NO: 1410539 - RNA, 19 nt, Homo sapiens
ggaaaggcuucugggacua

SEQ ID NO: 1410540 - RNA, 19 nt, Homo sapiens
ggaauagaagggagaaaga

SEQ ID NO: 1410541 - RNA, 19 nt, Homo sapiens
gaaagacagccuugagcaa

SEQ ID NO: 1410542 - RNA, 19 nt, Homo sapiens
ggacagggaggccaccaaa

SEQ ID NO: 1410543 - RNA, 19 nt, Homo sapiens
cgaaaggugugggcuguga

SEQ ID NO: 1410544 - RNA, 19 nt, Homo sapiens
ggacaccuaccugcagaua

SEQ ID NO: 1410545 - RNA, 19 nt, Homo sapiens
ggacugaacccucccaacu

SEQ ID NO: 1410546 - RNA, 19 nt, Homo sapiens
gcaugugggugauuaucug

SEQ ID NO: 1410547 - RNA, 19 nt, Homo sapiens
ccaugcaugugggugauua

SEQ ID NO: 1410548 - RNA, 19 nt, Homo sapiens
caagaccucaacaauauga

SEQ ID NO: 1410549 - RNA, 19 nt, Homo sapiens
ggugugggcugugauagga

SEQ ID NO: 1410550 - RNA, 19 nt, Homo sapiens
gcugcugucuccugcauau

SEQ ID NO: 1410551 - RNA, 19 nt, Homo sapiens
gccagcgacuucaggcuuu

SEQ ID NO: 1410552 - RNA, 19 nt, Homo sapiens
gaguuuggcucuagucacu

SEQ ID NO: 1410553 - RNA, 19 nt, Homo sapiens
gcagauccaucagcagaag

SEQ ID NO: 1410554 - RNA, 19 nt, Homo sapiens
ccacagagaggagcacuug

SEQ ID NO: 1410555 - RNA, 19 nt, Homo sapiens
ggagaggcaccaugcaugu

SEQ ID NO: 1410556 - RNA, 19 nt, Homo sapiens
acauagcucuacaccuaaa

SEQ ID NO: 1410557 - RNA, 19 nt, Homo sapiens
gagcccauguuuccugaca

SEQ ID NO: 1410558 - RNA, 19 nt, Homo sapiens
gccacuacauccuggaguu

SEQ ID NO: 1410559 - RNA, 19 nt, Homo sapiens
ggaagccugugccacuaca

SEQ ID NO: 1410560 - RNA, 19 nt, Homo sapiens
caaucuggaugcauuacau

SEQ ID NO: 1410561 - RNA, 19 nt, Homo sapiens
gcucaaaugaaauagaugu

SEQ ID NO: 1410562 - RNA, 19 nt, Homo sapiens
caacugugggagcuccuua

SEQ ID NO: 1410563 - RNA, 19 nt, Homo sapiens
gcucuacaccuaaauaagg

SEQ ID NO: 1410564 - RNA, 19 nt, Homo sapiens
ggaaugcucaugaguuacu

SEQ ID NO: 1410565 - RNA, 19 nt, Homo sapiens
uggcucaaaugaaauagau

SEQ ID NO: 1410566 - RNA, 19 nt, Homo sapiens
uggaugaccugugggaaga

SEQ ID NO: 1410567 - RNA, 19 nt, Homo sapiens
gcaagaccucaacaauaug

SEQ ID NO: 1410568 - RNA, 19 nt, Homo sapiens
gacauagcucuacaccuaa

SEQ ID NO: 1410569 - RNA, 19 nt, Homo sapiens
ccuugaaaguggccuguug

SEQ ID NO: 1410570 - RNA, 19 nt, Homo sapiens
gcaagguucugagcaagcu

SEQ ID NO: 1410571 - RNA, 19 nt, Homo sapiens
guggcaagguucugagcaa

SEQ ID NO: 1410572 - RNA, 19 nt, Homo sapiens
gagcuggugggcuggaauu

SEQ ID NO: 1410573 - RNA, 19 nt, Homo sapiens
gaaaagcugaggccucuga

SEQ ID NO: 1410574 - RNA, 19 nt, Homo sapiens
agacuucuggcucaaauga

SEQ ID NO: 1410575 - RNA, 19 nt, Homo sapiens
cuagacuucuggcucaaau

SEQ ID NO: 1410576 - RNA, 19 nt, Homo sapiens
aaaggugugggcugugaua

SEQ ID NO: 1410577 - RNA, 19 nt, Homo sapiens
aacaugugaugguguguga

SEQ ID NO: 1410578 - RNA, 19 nt, Homo sapiens
gaauagaagggagaaagag

SEQ ID NO: 1410579 - RNA, 19 nt, Homo sapiens
acuucuggcucaaaugaaa

SEQ ID NO: 1410580 - RNA, 19 nt, Homo sapiens
acugaacccucccaacugu

SEQ ID NO: 1410581 - RNA, 19 nt, Homo sapiens
ggcucuggcucuucuuuca

SEQ ID NO: 1410582 - RNA, 19 nt, Homo sapiens
ucacucacagccuucauga

SEQ ID NO: 1410583 - RNA, 19 nt, Homo sapiens
uagcucuacaccuaaauaa

SEQ ID NO: 1410584 - RNA, 19 nt, Homo sapiens
gggaauagaagggagaaag

SEQ ID NO: 1410585 - RNA, 19 nt, Homo sapiens
auucaagggugagggagua

SEQ ID NO: 1410586 - RNA, 19 nt, Homo sapiens
cccggaagcucacgcucaa

SEQ ID NO: 1410587 - RNA, 19 nt, Homo sapiens
ccacuacauccuggaguuu

SEQ ID NO: 1410588 - RNA, 19 nt, Homo sapiens
gggcugcugucuccugcau

SEQ ID NO: 1410589 - RNA, 19 nt, Homo sapiens
acaccuaccugcagauagc

SEQ ID NO: 1410590 - RNA, 19 nt, Homo sapiens
gaugaccugugggaagaca

SEQ ID NO: 1410591 - RNA, 19 nt, Homo sapiens
guuuggcucuagucacuuc

SEQ ID NO: 1410592 - RNA, 19 nt, Homo sapiens
ugugggagcuccuuaaacc

SEQ ID NO: 1410593 - RNA, 19 nt, Homo sapiens
gaaaggcuucugggacuac

SEQ ID NO: 1410594 - RNA, 19 nt, Homo sapiens
gacaguggcaagguucuga

SEQ ID NO: 1410595 - RNA, 19 nt, Homo sapiens
gugauggugugugaauauc

SEQ ID NO: 1410596 - RNA, 19 nt, Homo sapiens
gggagaaagagaauaucau

SEQ ID NO: 1410597 - RNA, 19 nt, Homo sapiens
cuggugggcuggaauuugg

SEQ ID NO: 1410598 - RNA, 19 nt, Homo sapiens
aacagacaguggcaagguu

SEQ ID NO: 1410599 - RNA, 19 nt, Homo sapiens
ccaucgaccaggagacuga

SEQ ID NO: 1410600 - RNA, 19 nt, Homo sapiens
gacugaacccucccaacug

SEQ ID NO: 1410601 - RNA, 19 nt, Homo sapiens
gagaauaucauggggagaa

SEQ ID NO: 1410602 - RNA, 19 nt, Homo sapiens
aauagaagggagaaagaga

SEQ ID NO: 1410603 - RNA, 19 nt, Homo sapiens
gaccucaacaauaugaaca

SEQ ID NO: 1410604 - RNA, 19 nt, Homo sapiens
cuggaagccugugccacua

SEQ ID NO: 1410605 - RNA, 19 nt, Homo sapiens
uagaagggagaaagagaau

SEQ ID NO: 1410606 - RNA, 19 nt, Homo sapiens
ccagugcucauuugggaau

SEQ ID NO: 1410607 - RNA, 19 nt, Homo sapiens
gcuggugggcuggaauuug

SEQ ID NO: 1410608 - RNA, 19 nt, Homo sapiens
ccuacacgauggaucugau

SEQ ID NO: 1410609 - RNA, 19 nt, Homo sapiens
gaaaggugugggcugugau

SEQ ID NO: 1410610 - RNA, 19 nt, Homo sapiens
caugugauggugugugaau

SEQ ID NO: 1410611 - RNA, 19 nt, Homo sapiens
auagaagggagaaagagaa

SEQ ID NO: 1410612 - RNA, 19 nt, Homo sapiens
ggaagucuaucccgcagaa

SEQ ID NO: 1410613 - RNA, 19 nt, Homo sapiens
gaguuucacuuaaucauuc

SEQ ID NO: 1410614 - RNA, 19 nt, Homo sapiens
ccaaagagaccaacaagau

SEQ ID NO: 1410615 - RNA, 19 nt, Homo sapiens
gagaagguccgcuccacua

SEQ ID NO: 1410616 - RNA, 19 nt, Homo sapiens
caaagagaccaacaagaug

SEQ ID NO: 1410617 - RNA, 19 nt, Homo sapiens
aaagagaccaacaagauga

SEQ ID NO: 1410618 - RNA, 19 nt, Homo sapiens
ucaaacagguucggguuca

SEQ ID NO: 1410619 - RNA, 19 nt, Homo sapiens
gaagaguuucacuuaauca

SEQ ID NO: 1410620 - RNA, 19 nt, Homo sapiens
gagaccaacaagaugauuu

SEQ ID NO: 1410621 - RNA, 19 nt, Homo sapiens
agacgggcaucgccugauu

SEQ ID NO: 1410622 - RNA, 19 nt, Homo sapiens
agaagaguuucacuuaauc

SEQ ID NO: 1410623 - RNA, 19 nt, Homo sapiens
ucucaccgcucuggaaaug

SEQ ID NO: 1410624 - RNA, 19 nt, Homo sapiens
gaagguccgcuccacuaau

SEQ ID NO: 1410625 - RNA, 19 nt, Homo sapiens
gcagaagcgcagccauuca

SEQ ID NO: 1410626 - RNA, 19 nt, Homo sapiens
gacgggcaucgccugauua

SEQ ID NO: 1410627 - RNA, 19 nt, Homo sapiens
ucacggagcgcaaaauaaa

SEQ ID NO: 1410628 - RNA, 19 nt, Homo sapiens
aagguccgcuccacuaauc

SEQ ID NO: 1410629 - RNA, 19 nt, Homo sapiens
gcguggacuaggacacuua

SEQ ID NO: 1410630 - RNA, 19 nt, Homo sapiens
ccgcagaagcgcagccauu

SEQ ID NO: 1410631 - RNA, 19 nt, Homo sapiens
caucucaccgcucuggaaa

SEQ ID NO: 1410632 - RNA, 19 nt, Homo sapiens
ccuaagaagaguuucacuu

SEQ ID NO: 1410633 - RNA, 19 nt, Homo sapiens
ucauucaaaucacuaucug

SEQ ID NO: 1410634 - RNA, 19 nt, Homo sapiens
uaaccuaagaagaguuuca

SEQ ID NO: 1410635 - RNA, 19 nt, Homo sapiens
agaagguccgcuccacuaa

SEQ ID NO: 1410636 - RNA, 19 nt, Homo sapiens
ggacuaggacacuuaaccu

SEQ ID NO: 1410637 - RNA, 19 nt, Homo sapiens
gccaaagagaccaacaaga

SEQ ID NO: 1410638 - RNA, 19 nt, Homo sapiens
ggucacggagcgcaaaaua

SEQ ID NO: 1410639 - RNA, 19 nt, Homo sapiens
gcgccaaagagaccaacaa

SEQ ID NO: 1410640 - RNA, 19 nt, Homo sapiens
ucaccgcucuggaaaugcu

SEQ ID NO: 1410641 - RNA, 19 nt, Homo sapiens
gaauggcuguucgagauga

SEQ ID NO: 1410642 - RNA, 19 nt, Homo sapiens
gaaaccggaugcugaguac

SEQ ID NO: 1410643 - RNA, 19 nt, Homo sapiens
ccaagaaaccaguuaugaa

SEQ ID NO: 1410644 - RNA, 19 nt, Homo sapiens
caagaaaccaguuaugaag

SEQ ID NO: 1410645 - RNA, 19 nt, Homo sapiens
cugaauggcuguucgagau

SEQ ID NO: 1410646 - RNA, 19 nt, Homo sapiens
gccaagaaaccaguuauga

SEQ ID NO: 1410647 - RNA, 19 nt, Homo sapiens
caaggaagggcaggaugua

SEQ ID NO: 1410648 - RNA, 19 nt, Homo sapiens
ugaaaccggaugcugagua

SEQ ID NO: 1410649 - RNA, 19 nt, Homo sapiens
ccaugggcgucaacaucua

SEQ ID NO: 1410650 - RNA, 19 nt, Homo sapiens
ggaggccaauaaagagcuu

SEQ ID NO: 1410651 - RNA, 19 nt, Homo sapiens
gcgucaacaucuacaagga

SEQ ID NO: 1410652 - RNA, 19 nt, Homo sapiens
cuguccagcucaccacaua

SEQ ID NO: 1410653 - RNA, 19 nt, Homo sapiens
cagccuggguuuccaugug

SEQ ID NO: 1410654 - RNA, 19 nt, Homo sapiens
gccgagggcuugccguuuu

SEQ ID NO: 1410655 - RNA, 19 nt, Homo sapiens
gaugcugaguacccugaau

SEQ ID NO: 1410656 - RNA, 19 nt, Homo sapiens
cggcugagcaagaacaaga

SEQ ID NO: 1410657 - RNA, 19 nt, Homo sapiens
gacguggacuuuugugaga

SEQ ID NO: 1410658 - RNA, 19 nt, Homo sapiens
ugagcaagaacaagagguu

SEQ ID NO: 1410659 - RNA, 19 nt, Homo sapiens
ccgggauuaugccaagaaa

SEQ ID NO: 1410660 - RNA, 19 nt, Homo sapiens
cgucaacaucuacaaggaa

SEQ ID NO: 1410661 - RNA, 19 nt, Homo sapiens
agccuggguuuccauguga

SEQ ID NO: 1410662 - RNA, 19 nt, Homo sapiens
acaaggaagggcaggaugu

SEQ ID NO: 1410663 - RNA, 19 nt, Homo sapiens
gaaccaagcugggucuaua

SEQ ID NO: 1410664 - RNA, 19 nt, Homo sapiens
gaugaaaccugguaguaaa

SEQ ID NO: 1410665 - RNA, 19 nt, Homo sapiens
uaggguggauucaguaaua

SEQ ID NO: 1410666 - RNA, 19 nt, Homo sapiens
gagagaagcaagcaucuuu

SEQ ID NO: 1410667 - RNA, 19 nt, Homo sapiens
ugagauggcacacauauuu

SEQ ID NO: 1410668 - RNA, 19 nt, Homo sapiens
uauaaggaauugcacauga

SEQ ID NO: 1410669 - RNA, 19 nt, Homo sapiens
gagauggcacacauauuua

SEQ ID NO: 1410670 - RNA, 19 nt, Homo sapiens
caaguucacgaucaucuua

SEQ ID NO: 1410671 - RNA, 19 nt, Homo sapiens
caagcugggucuauaagga

SEQ ID NO: 1410672 - RNA, 19 nt, Homo sapiens
gaucgagauuugcguccua

SEQ ID NO: 1410673 - RNA, 19 nt, Homo sapiens
ucacgaucaucuuacgaua

SEQ ID NO: 1410674 - RNA, 19 nt, Homo sapiens
uguaugcucugugcuagua

SEQ ID NO: 1410675 - RNA, 19 nt, Homo sapiens
aguaggaaauucagacuug

SEQ ID NO: 1410676 - RNA, 19 nt, Homo sapiens
guaggaaauucagacuuga

SEQ ID NO: 1410677 - RNA, 19 nt, Homo sapiens
cagaugaaaccugguagua

SEQ ID NO: 1410678 - RNA, 19 nt, Homo sapiens
caagcaucuuugccucuuu

SEQ ID NO: 1410679 - RNA, 19 nt, Homo sapiens
cacaugagauggcacacau

SEQ ID NO: 1410680 - RNA, 19 nt, Homo sapiens
cuaguaggguggauucagu

SEQ ID NO: 1410681 - RNA, 19 nt, Homo sapiens
uguaucaaguucacgauca

SEQ ID NO: 1410682 - RNA, 19 nt, Homo sapiens
ggugugugguugacucugu

SEQ ID NO: 1410683 - RNA, 19 nt, Homo sapiens
ccuugcagaucgagauuug

SEQ ID NO: 1410684 - RNA, 19 nt, Homo sapiens
caugagauggcacacauau

SEQ ID NO: 1410685 - RNA, 19 nt, Homo sapiens
aagcaucuuugccucuuug

SEQ ID NO: 1410686 - RNA, 19 nt, Homo sapiens
gaucaucuuacgauaucaa

SEQ ID NO: 1410687 - RNA, 19 nt, Homo sapiens
acgaucaucuuacgauauc

SEQ ID NO: 1410688 - RNA, 19 nt, Homo sapiens
cgccaugucuucucacaag

SEQ ID NO: 1410689 - RNA, 19 nt, Homo sapiens
agaugaaaccugguaguaa

SEQ ID NO: 1410690 - RNA, 19 nt, Homo sapiens
gagauuugcguccuagagu

SEQ ID NO: 1410691 - RNA, 19 nt, Homo sapiens
gacaguugcacauguuuua

SEQ ID NO: 1410692 - RNA, 19 nt, Homo sapiens
accacuaccuggacaguug

SEQ ID NO: 1410693 - RNA, 19 nt, Homo sapiens
guaucaaguucacgaucau

SEQ ID NO: 1410694 - RNA, 19 nt, Homo sapiens
uaaggaauugcacaugaga

SEQ ID NO: 1410695 - RNA, 19 nt, Homo sapiens
ggagagaagcaagcaucuu

SEQ ID NO: 1410696 - RNA, 19 nt, Homo sapiens
gguggauucaguaauaaau

SEQ ID NO: 1410697 - RNA, 19 nt, Homo sapiens
cuuacgauaucaagcugaa

SEQ ID NO: 1410698 - RNA, 19 nt, Homo sapiens
guaguaaaaucagguacaa

SEQ ID NO: 1410699 - RNA, 19 nt, Homo sapiens
cuggacaguugcacauguu

SEQ ID NO: 1410700 - RNA, 19 nt, Homo sapiens
gcacaugagauggcacaca

SEQ ID NO: 1410701 - RNA, 19 nt, Homo sapiens
ccaagaaacaaaagcaaaa

SEQ ID NO: 1410702 - RNA, 19 nt, Homo sapiens
ccuggacaguugcacaugu

SEQ ID NO: 1410703 - RNA, 19 nt, Homo sapiens
gauaucaagcugaaaaugu

SEQ ID NO: 1410704 - RNA, 19 nt, Homo sapiens
aggaggcauuggagaagaa

SEQ ID NO: 1410705 - RNA, 19 nt, Homo sapiens
auaaggaauugcacaugag

SEQ ID NO: 1410706 - RNA, 19 nt, Homo sapiens
gaguaggaaauucagacuu

SEQ ID NO: 1410707 - RNA, 19 nt, Homo sapiens
gaaaccugguaguaaaauc

SEQ ID NO: 1410708 - RNA, 19 nt, Homo sapiens
gcgauuccuggccaagaaa

SEQ ID NO: 1410709 - RNA, 19 nt, Homo sapiens
aggguggauucaguaauaa

SEQ ID NO: 1410710 - RNA, 19 nt, Homo sapiens
aaggaggcauuggagaaga

SEQ ID NO: 1410711 - RNA, 19 nt, Homo sapiens
ccacggaucucaccuugaa

SEQ ID NO: 1410712 - RNA, 19 nt, Homo sapiens
gcccugaggugacaauaaa

SEQ ID NO: 1410713 - RNA, 19 nt, Homo sapiens
caaauaugacugugaauug

SEQ ID NO: 1410714 - RNA, 19 nt, Homo sapiens
gaaggaagaacgcaacaga

SEQ ID NO: 1410715 - RNA, 19 nt, Homo sapiens
ggacugaacggguaagaga

SEQ ID NO: 1410716 - RNA, 19 nt, Homo sapiens
gcccaucgcugccagagaa

SEQ ID NO: 1410717 - RNA, 19 nt, Homo sapiens
caggaaagcugcggcauug

SEQ ID NO: 1410718 - RNA, 19 nt, Homo sapiens
gagacuggcuuugggauug

SEQ ID NO: 1410719 - RNA, 19 nt, Homo sapiens
gaagaguccuggucugaac

SEQ ID NO: 1410720 - RNA, 19 nt, Homo sapiens
gcauuucuuucgagacaaa

SEQ ID NO: 1410721 - RNA, 19 nt, Homo sapiens
gagaagagguuugcaagac

SEQ ID NO: 1410722 - RNA, 19 nt, Homo sapiens
ggucccagcucugcuauug

SEQ ID NO: 1410723 - RNA, 19 nt, Homo sapiens
ggaaacagccagccaagca

SEQ ID NO: 1410724 - RNA, 19 nt, Homo sapiens
gucaggcacuucccucuaa

SEQ ID NO: 1410725 - RNA, 19 nt, Homo sapiens
ggaagaacgcaacagaaga

SEQ ID NO: 1410726 - RNA, 19 nt, Homo sapiens
ccuaaagugugaaauguca

SEQ ID NO: 1410727 - RNA, 19 nt, Homo sapiens
gaagaacgcaacagaagag

SEQ ID NO: 1410728 - RNA, 19 nt, Homo sapiens
aaggucagcuuaugaagga

SEQ ID NO: 1410729 - RNA, 19 nt, Homo sapiens
gcugaccacccaaauauga

SEQ ID NO: 1410730 - RNA, 19 nt, Homo sapiens
ggagagcugugggcagaga

SEQ ID NO: 1410731 - RNA, 19 nt, Homo sapiens
cuaccuggcuggacuagug

SEQ ID NO: 1410732 - RNA, 19 nt, Homo sapiens
uggcuaugcuuucagcuuu

SEQ ID NO: 1410733 - RNA, 19 nt, Homo sapiens
ggaggugggaacauuauug

SEQ ID NO: 1410734 - RNA, 19 nt, Homo sapiens
ggaaagggcaguagaucuc

SEQ ID NO: 1410735 - RNA, 19 nt, Homo sapiens
ccaaauaugacugugaauu

SEQ ID NO: 1410736 - RNA, 19 nt, Homo sapiens
cgacuuucuuuccaacuga

SEQ ID NO: 1410737 - RNA, 19 nt, Homo sapiens
ucaguuuccuaaaguguga

SEQ ID NO: 1410738 - RNA, 19 nt, Homo sapiens
uagcauuucuuucgagaca

SEQ ID NO: 1410739 - RNA, 19 nt, Homo sapiens
gugcugaccacccaaauau

SEQ ID NO: 1410740 - RNA, 19 nt, Homo sapiens
gggacuggcucuacuucga

SEQ ID NO: 1410741 - RNA, 19 nt, Homo sapiens
ggccucaguuuccuaaagu

SEQ ID NO: 1410742 - RNA, 19 nt, Homo sapiens
gguaugccuuuaggacauu

SEQ ID NO: 1410743 - RNA, 19 nt, Homo sapiens
uaagagaagagguuugcaa

SEQ ID NO: 1410744 - RNA, 19 nt, Homo sapiens
gcuagaggcaguaaaugga

SEQ ID NO: 1410745 - RNA, 19 nt, Homo sapiens
gcucaugggccucaguuuc

SEQ ID NO: 1410746 - RNA, 19 nt, Homo sapiens
agaagagguuugcaagaca

SEQ ID NO: 1410747 - RNA, 19 nt, Homo sapiens
gggccucaguuuccuaaag

SEQ ID NO: 1410748 - RNA, 19 nt, Homo sapiens
gaggguagcauuucuuucg

SEQ ID NO: 1410749 - RNA, 19 nt, Homo sapiens
uagaggcaguaaauggaaa

SEQ ID NO: 1410750 - RNA, 19 nt, Homo sapiens
gcgcguccaucgacuuucu

SEQ ID NO: 1410751 - RNA, 19 nt, Homo sapiens
uucgagaaguucaagauga

SEQ ID NO: 1410752 - RNA, 19 nt, Homo sapiens
gaggugggaacauuauugu

SEQ ID NO: 1410753 - RNA, 19 nt, Homo sapiens
acccaaauaugacugugaa

SEQ ID NO: 1410754 - RNA, 19 nt, Homo sapiens
ugaagggacccgccaagga

SEQ ID NO: 1410755 - RNA, 19 nt, Homo sapiens
ccaggaaagcugcggcauu

SEQ ID NO: 1410756 - RNA, 19 nt, Homo sapiens
cuucaucgccaccuucaaa

SEQ ID NO: 1410757 - RNA, 19 nt, Homo sapiens
ugagagcccugaggugaca

SEQ ID NO: 1410758 - RNA, 19 nt, Homo sapiens
gaucauccagcacauagag

SEQ ID NO: 1410759 - RNA, 19 nt, Homo sapiens
ccagcuagaggcaguaaau

SEQ ID NO: 1410760 - RNA, 19 nt, Homo sapiens
ccuuuaggacauucucuua

SEQ ID NO: 1410761 - RNA, 19 nt, Homo sapiens
ggugguggccauugacuuc

SEQ ID NO: 1410762 - RNA, 19 nt, Homo sapiens
ugaagcugcuguuccuagu

SEQ ID NO: 1410763 - RNA, 19 nt, Homo sapiens
gcaggagcagcgugaacuu

SEQ ID NO: 1410764 - RNA, 19 nt, Homo sapiens
gcaggaggaaggagguugu

SEQ ID NO: 1410765 - RNA, 19 nt, Homo sapiens
gauaaggucaugggagagu

SEQ ID NO: 1410766 - RNA, 19 nt, Homo sapiens
gggaugcuccgaaugucuu

SEQ ID NO: 1410767 - RNA, 19 nt, Homo sapiens
ucgcugcccuucuccuuca

SEQ ID NO: 1410768 - RNA, 19 nt, Homo sapiens
ucuaguggcuaugcuuuca

SEQ ID NO: 1410769 - RNA, 19 nt, Homo sapiens
gaaagggcaguagaucucu

SEQ ID NO: 1410770 - RNA, 19 nt, Homo sapiens
gacugugaauuguggaaag

SEQ ID NO: 1410771 - RNA, 19 nt, Homo sapiens
ccaucgacuuucuuuccaa

SEQ ID NO: 1410772 - RNA, 19 nt, Homo sapiens
gggccucaccauccucaaa

SEQ ID NO: 1410773 - RNA, 19 nt, Homo sapiens
gcaauuaugaggguagcau

SEQ ID NO: 1410774 - RNA, 19 nt, Homo sapiens
ccaaggacugaacggguaa

SEQ ID NO: 1410775 - RNA, 19 nt, Homo sapiens
gcguacucaucaaccugua

SEQ ID NO: 1410776 - RNA, 19 nt, Homo sapiens
ggcuaugcuuucagcuuug

SEQ ID NO: 1410777 - RNA, 19 nt, Homo sapiens
gaccugcagggcugaaguu

SEQ ID NO: 1410778 - RNA, 19 nt, Homo sapiens
ugugaaaugucaggcacuu

SEQ ID NO: 1410779 - RNA, 19 nt, Homo sapiens
gguggucccagcucugcua

SEQ ID NO: 1410780 - RNA, 19 nt, Homo sapiens
gucugaacuuggccgagua

SEQ ID NO: 1410781 - RNA, 19 nt, Homo sapiens
ccugaggccauccacauga

SEQ ID NO: 1410782 - RNA, 19 nt, Homo sapiens
ggagcagcgugaacuucgu

SEQ ID NO: 1410783 - RNA, 19 nt, Homo sapiens
cgguaugccuuuaggacau

SEQ ID NO: 1410784 - RNA, 19 nt, Homo sapiens
caauuaugaggguagcauu

SEQ ID NO: 1410785 - RNA, 19 nt, Homo sapiens
cguaggaaagugacuggaa

SEQ ID NO: 1410786 - RNA, 19 nt, Homo sapiens
gaagcugcuguuccuagug

SEQ ID NO: 1410787 - RNA, 19 nt, Homo sapiens
cuagaggcaguaaauggaa

SEQ ID NO: 1410788 - RNA, 19 nt, Homo sapiens
gugguggaggcaauuauga

SEQ ID NO: 1410789 - RNA, 19 nt, Homo sapiens
gguaagagaagagguuugc

SEQ ID NO: 1410790 - RNA, 19 nt, Homo sapiens
gaggugacaauaaaacauu

SEQ ID NO: 1410791 - RNA, 19 nt, Homo sapiens
uguggaggugggaacauua

SEQ ID NO: 1410792 - RNA, 19 nt, Homo sapiens
agagaagagguuugcaaga

SEQ ID NO: 1410793 - RNA, 19 nt, Homo sapiens
gguggagucaggcguagga

SEQ ID NO: 1410794 - RNA, 19 nt, Homo sapiens
gaacagagucucacguuaa

SEQ ID NO: 1410795 - RNA, 19 nt, Homo sapiens
gaaagaagggauacugaua

SEQ ID NO: 1410796 - RNA, 19 nt, Homo sapiens
gcaagaagauggagcuguu

SEQ ID NO: 1410797 - RNA, 19 nt, Homo sapiens
ccacucaccuuacgaaauu

SEQ ID NO: 1410798 - RNA, 19 nt, Homo sapiens
gggaaaugcuggcuucaaa

SEQ ID NO: 1410799 - RNA, 19 nt, Homo sapiens
gcacagguuugaaagagaa

SEQ ID NO: 1410800 - RNA, 19 nt, Homo sapiens
ugacagcacuggagagauu

SEQ ID NO: 1410801 - RNA, 19 nt, Homo sapiens
gaagugcaguucagcaaga

SEQ ID NO: 1410802 - RNA, 19 nt, Homo sapiens
gaacuggaaucuccugcuu

SEQ ID NO: 1410803 - RNA, 19 nt, Homo sapiens
gaaauuagcaugacugcau

SEQ ID NO: 1410804 - RNA, 19 nt, Homo sapiens
gcacaaagucggcguagga

SEQ ID NO: 1410805 - RNA, 19 nt, Homo sapiens
gcagauacccaggaacuaa

SEQ ID NO: 1410806 - RNA, 19 nt, Homo sapiens
gaaauguggucuucagcau

SEQ ID NO: 1410807 - RNA, 19 nt, Homo sapiens
agauggagcuguuagaaga

SEQ ID NO: 1410808 - RNA, 19 nt, Homo sapiens
gacauggccuaucguuuga

SEQ ID NO: 1410809 - RNA, 19 nt, Homo sapiens
gagaagacguggacgacau

SEQ ID NO: 1410810 - RNA, 19 nt, Homo sapiens
gaagauggagcuguuagaa

SEQ ID NO: 1410811 - RNA, 19 nt, Homo sapiens
aaacaaagcccagggaaga

SEQ ID NO: 1410812 - RNA, 19 nt, Homo sapiens
aagaagggauacugauaaa

SEQ ID NO: 1410813 - RNA, 19 nt, Homo sapiens
aaagaagggauacugauaa

SEQ ID NO: 1410814 - RNA, 19 nt, Homo sapiens
gcacacagacccaggaaca

SEQ ID NO: 1410815 - RNA, 19 nt, Homo sapiens
uagcaugacugcaucuuuc

SEQ ID NO: 1410816 - RNA, 19 nt, Homo sapiens
agagugagcuggagagaca

SEQ ID NO: 1410817 - RNA, 19 nt, Homo sapiens
agaacagagucucacguua

SEQ ID NO: 1410818 - RNA, 19 nt, Homo sapiens
gaccaguugugaacccuuu

SEQ ID NO: 1410819 - RNA, 19 nt, Homo sapiens
ggagguggcggacagauug

SEQ ID NO: 1410820 - RNA, 19 nt, Homo sapiens
ugagaggccuggacaagau

SEQ ID NO: 1410821 - RNA, 19 nt, Homo sapiens
gagagauucuggucagcuu

SEQ ID NO: 1410822 - RNA, 19 nt, Homo sapiens
caaagucggcguaggagaa

SEQ ID NO: 1410823 - RNA, 19 nt, Homo sapiens
agacauggccuaucguuug

SEQ ID NO: 1410824 - RNA, 19 nt, Homo sapiens
gacugcaucuuucaaacaa

SEQ ID NO: 1410825 - RNA, 19 nt, Homo sapiens
auacaugacuccaguucuu

SEQ ID NO: 1410826 - RNA, 19 nt, Homo sapiens
ggaaagaagggauacugau

SEQ ID NO: 1410827 - RNA, 19 nt, Homo sapiens
ggaugaagaggcugaccua

SEQ ID NO: 1410828 - RNA, 19 nt, Homo sapiens
gcuguuagaagaugcauug

SEQ ID NO: 1410829 - RNA, 19 nt, Homo sapiens
aacagagucucacguuaaa

SEQ ID NO: 1410830 - RNA, 19 nt, Homo sapiens
gggaagaugucuccaugac

SEQ ID NO: 1410831 - RNA, 19 nt, Homo sapiens
acacccaacuguucuuuua

SEQ ID NO: 1410832 - RNA, 19 nt, Homo sapiens
ucacuuagccagcucacuu

SEQ ID NO: 1410833 - RNA, 19 nt, Homo sapiens
gccaagaugccagagguua

SEQ ID NO: 1410834 - RNA, 19 nt, Homo sapiens
cgccagcgguuuauuggaa

SEQ ID NO: 1410835 - RNA, 19 nt, Homo sapiens
gaagacaccaccggaaaca

SEQ ID NO: 1410836 - RNA, 19 nt, Homo sapiens
gggaaagaagggauacuga

SEQ ID NO: 1410837 - RNA, 19 nt, Homo sapiens
ggacccuccuccucacuuc

SEQ ID NO: 1410838 - RNA, 19 nt, Homo sapiens
caagaagauggagcuguua

SEQ ID NO: 1410839 - RNA, 19 nt, Homo sapiens
uggacaagauggagucaga

SEQ ID NO: 1410840 - RNA, 19 nt, Homo sapiens
gggagcugcugcugucuca

SEQ ID NO: 1410841 - RNA, 19 nt, Homo sapiens
agacaccaccggaaacaaa

SEQ ID NO: 1410842 - RNA, 19 nt, Homo sapiens
ggacagauugcugacagaa

SEQ ID NO: 1410843 - RNA, 19 nt, Homo sapiens
gaaauacaugacuccaguu

SEQ ID NO: 1410844 - RNA, 19 nt, Homo sapiens
ugaggcagauacccaggaa

SEQ ID NO: 1410845 - RNA, 19 nt, Homo sapiens
aauguggucuucagcauca

SEQ ID NO: 1410846 - RNA, 19 nt, Homo sapiens
ccguuuccauccagacaua

SEQ ID NO: 1410847 - RNA, 19 nt, Homo sapiens
gcuguacuauaaauuugug

SEQ ID NO: 1410848 - RNA, 19 nt, Homo sapiens
cagaacagagucucacguu

SEQ ID NO: 1410849 - RNA, 19 nt, Homo sapiens
acagauugcugacagaacu

SEQ ID NO: 1410850 - RNA, 19 nt, Homo sapiens
ucagcaucaucgagcauuu

SEQ ID NO: 1410851 - RNA, 19 nt, Homo sapiens
gccagcgguuuauuggaaa

SEQ ID NO: 1410852 - RNA, 19 nt, Homo sapiens
gggcaaccuugaccaucga

SEQ ID NO: 1410853 - RNA, 19 nt, Homo sapiens
cgacaucaagguccacuca

SEQ ID NO: 1410854 - RNA, 19 nt, Homo sapiens
cacaacaggcggaugaaga

SEQ ID NO: 1410855 - RNA, 19 nt, Homo sapiens
ccuauaaacacccaacugu

SEQ ID NO: 1410856 - RNA, 19 nt, Homo sapiens
ggaccuuggcgcacacaga

SEQ ID NO: 1410857 - RNA, 19 nt, Homo sapiens
cguagcagguggucgaagu

SEQ ID NO: 1410858 - RNA, 19 nt, Homo sapiens
ccaagaugccagagguuau

SEQ ID NO: 1410859 - RNA, 19 nt, Homo sapiens
ggaagacaccaccggaaac

SEQ ID NO: 1410860 - RNA, 19 nt, Homo sapiens
caugacugcaucuuucaaa

SEQ ID NO: 1410861 - RNA, 19 nt, Homo sapiens
aagcacaacaggcggauga

SEQ ID NO: 1410862 - RNA, 19 nt, Homo sapiens
uggaagacaccaccggaaa

SEQ ID NO: 1410863 - RNA, 19 nt, Homo sapiens
ccugcuugguggcccuuua

SEQ ID NO: 1410864 - RNA, 19 nt, Homo sapiens
ggagcugacgggacucaug

SEQ ID NO: 1410865 - RNA, 19 nt, Homo sapiens
acacagacccaggaacaga

SEQ ID NO: 1410866 - RNA, 19 nt, Homo sapiens
cagaagaggccuggaccuu

SEQ ID NO: 1410867 - RNA, 19 nt, Homo sapiens
caaccuugaccaucgacaa

SEQ ID NO: 1410868 - RNA, 19 nt, Homo sapiens
cccaggaacuaacccagau

SEQ ID NO: 1410869 - RNA, 19 nt, Homo sapiens
ccagacauggccuaucguu

SEQ ID NO: 1410870 - RNA, 19 nt, Homo sapiens
ccaucaccauccuggagaa

SEQ ID NO: 1410871 - RNA, 19 nt, Homo sapiens
ugacugcaucuuucaaaca

SEQ ID NO: 1410872 - RNA, 19 nt, Homo sapiens
caagaugccagagguuauc

SEQ ID NO: 1410873 - RNA, 19 nt, Homo sapiens
ugucuggguuggaaauaca

SEQ ID NO: 1410874 - RNA, 19 nt, Homo sapiens
aaagugaaauuagcaugac

SEQ ID NO: 1410875 - RNA, 19 nt, Homo sapiens
uuugagggcauccuauaaa

SEQ ID NO: 1410876 - RNA, 19 nt, Homo sapiens
uagaagugcaguucagcaa

SEQ ID NO: 1410877 - RNA, 19 nt, Homo sapiens
gagguuauccccauuuuag

SEQ ID NO: 1410878 - RNA, 19 nt, Homo sapiens
gguccacucaccuuacgaa

SEQ ID NO: 1410879 - RNA, 19 nt, Homo sapiens
ccaguucuuugcucaugca

SEQ ID NO: 1410880 - RNA, 19 nt, Homo sapiens
ggaaaugcuggcuucaaaa

SEQ ID NO: 1410881 - RNA, 19 nt, Homo sapiens
ucacuuugagggcauccua

SEQ ID NO: 1410882 - RNA, 19 nt, Homo sapiens
aaggaggcuucacauuuua

SEQ ID NO: 1410883 - RNA, 19 nt, Homo sapiens
gcacaacaggcggaugaag

SEQ ID NO: 1410884 - RNA, 19 nt, Homo sapiens
gugcaguucagcaagaaga

SEQ ID NO: 1410885 - RNA, 19 nt, Homo sapiens
gcggccaagucgaaaugug

SEQ ID NO: 1410886 - RNA, 19 nt, Homo sapiens
gagggcauccuauaaacac

SEQ ID NO: 1410887 - RNA, 19 nt, Homo sapiens
cagacauggccuaucguuu

SEQ ID NO: 1410888 - RNA, 19 nt, Homo sapiens
caaagcccagggaagaugu

SEQ ID NO: 1410889 - RNA, 19 nt, Homo sapiens
gcaugacugcaucuuucaa

SEQ ID NO: 1410890 - RNA, 19 nt, Homo sapiens
ugucucggcucccuuucau

SEQ ID NO: 1410891 - RNA, 19 nt, Homo sapiens
gcagguugggcagcaagaa

SEQ ID NO: 1410892 - RNA, 19 nt, Homo sapiens
gcaguucagcaagaagaug

SEQ ID NO: 1410893 - RNA, 19 nt, Homo sapiens
cguuugauaucugccaaga

SEQ ID NO: 1410894 - RNA, 19 nt, Homo sapiens
gaagaaagcccauaauuca

SEQ ID NO: 1410895 - RNA, 19 nt, Homo sapiens
gaugagggaucaguaaaua

SEQ ID NO: 1410896 - RNA, 19 nt, Homo sapiens
gaucagugcuucuuuccua

SEQ ID NO: 1410897 - RNA, 19 nt, Homo sapiens
gaagggcagugcugacuuu

SEQ ID NO: 1410898 - RNA, 19 nt, Homo sapiens
ggagguaucucaucccuau

SEQ ID NO: 1410899 - RNA, 19 nt, Homo sapiens
gugaagcaaucuuguauuu

SEQ ID NO: 1410900 - RNA, 19 nt, Homo sapiens
gaucuaaaguccaaucaau

SEQ ID NO: 1410901 - RNA, 19 nt, Homo sapiens
gaagugaguucggcaaaga

SEQ ID NO: 1410902 - RNA, 19 nt, Homo sapiens
gauaaagaggugcagauua

SEQ ID NO: 1410903 - RNA, 19 nt, Homo sapiens
ggaagaaagcccauaauuc

SEQ ID NO: 1410904 - RNA, 19 nt, Homo sapiens
gauguacgcuuuaaauugg

SEQ ID NO: 1410905 - RNA, 19 nt, Homo sapiens
gggccaacauuauuucuga

SEQ ID NO: 1410906 - RNA, 19 nt, Homo sapiens
ccaaauacccaaccuguga

SEQ ID NO: 1410907 - RNA, 19 nt, Homo sapiens
ucacaaggcuaugcagaaa

SEQ ID NO: 1410908 - RNA, 19 nt, Homo sapiens
gcccauaauucaaggcuuu

SEQ ID NO: 1410909 - RNA, 19 nt, Homo sapiens
caaucaaucuccuuacuca

SEQ ID NO: 1410910 - RNA, 19 nt, Homo sapiens
cgacaaugcuccguucuau

SEQ ID NO: 1410911 - RNA, 19 nt, Homo sapiens
auaaagaggugcagauuag

SEQ ID NO: 1410912 - RNA, 19 nt, Homo sapiens
gcagguucuuauccaaaua

SEQ ID NO: 1410913 - RNA, 19 nt, Homo sapiens
gcagauguacgcuuuaaau

SEQ ID NO: 1410914 - RNA, 19 nt, Homo sapiens
gggaagaaagcccauaauu

SEQ ID NO: 1410915 - RNA, 19 nt, Homo sapiens
gaagcauccucccacagaa

SEQ ID NO: 1410916 - RNA, 19 nt, Homo sapiens
gaagagguauuagccaagu

SEQ ID NO: 1410917 - RNA, 19 nt, Homo sapiens
guacauaccagggaaagaa

SEQ ID NO: 1410918 - RNA, 19 nt, Homo sapiens
ugaccucccucaaugguuu

SEQ ID NO: 1410919 - RNA, 19 nt, Homo sapiens
ggucacauccugcccaauu

SEQ ID NO: 1410920 - RNA, 19 nt, Homo sapiens
gaguugaugucagucuaua

SEQ ID NO: 1410921 - RNA, 19 nt, Homo sapiens
auagaaauguggcuaguug

SEQ ID NO: 1410922 - RNA, 19 nt, Homo sapiens
gcaggaggccagacuuuga

SEQ ID NO: 1410923 - RNA, 19 nt, Homo sapiens
aaaagacgcuguuccuuaa

SEQ ID NO: 1410924 - RNA, 19 nt, Homo sapiens
gcaacacaaucacucaaag

SEQ ID NO: 1410925 - RNA, 19 nt, Homo sapiens
gaauagaaauguggcuagu

SEQ ID NO: 1410926 - RNA, 19 nt, Homo sapiens
gauggaugcuuugggcuuu

SEQ ID NO: 1410927 - RNA, 19 nt, Homo sapiens
gcagaaagaauuuguuguc

SEQ ID NO: 1410928 - RNA, 19 nt, Homo sapiens
gcgcaucuccuccacguuu

SEQ ID NO: 1410929 - RNA, 19 nt, Homo sapiens
guugauauauggauaagca

SEQ ID NO: 1410930 - RNA, 19 nt, Homo sapiens
gcucugagguccaucaaac

SEQ ID NO: 1410931 - RNA, 19 nt, Homo sapiens
cgguagacauuaacuuauu

SEQ ID NO: 1410932 - RNA, 19 nt, Homo sapiens
caagcucucccucugauuu

SEQ ID NO: 1410933 - RNA, 19 nt, Homo sapiens
gcuuugggcuuuggaggua

SEQ ID NO: 1410934 - RNA, 19 nt, Homo sapiens
uuaaacugauggaugcuuu

SEQ ID NO: 1410935 - RNA, 19 nt, Homo sapiens
gaaaggggccaacauuauu

SEQ ID NO: 1410936 - RNA, 19 nt, Homo sapiens
gauuuaggagaucuuguua

SEQ ID NO: 1410937 - RNA, 19 nt, Homo sapiens
ggucauaggaagaucuaaa

SEQ ID NO: 1410938 - RNA, 19 nt, Homo sapiens
aagcauaacuaaacuuguc

SEQ ID NO: 1410939 - RNA, 19 nt, Homo sapiens
ggauaagcauaacuaaacu

SEQ ID NO: 1410940 - RNA, 19 nt, Homo sapiens
cauaacuacccaucguuua

SEQ ID NO: 1410941 - RNA, 19 nt, Homo sapiens
acucagaauucacagcuuu

SEQ ID NO: 1410942 - RNA, 19 nt, Homo sapiens
ucacugagcuauuuuggaa

SEQ ID NO: 1410943 - RNA, 19 nt, Homo sapiens
cuuguuaccuccucaucua

SEQ ID NO: 1410944 - RNA, 19 nt, Homo sapiens
ggccagacuuugaacuuuc

SEQ ID NO: 1410945 - RNA, 19 nt, Homo sapiens
ucaaucuccuuacucagaa

SEQ ID NO: 1410946 - RNA, 19 nt, Homo sapiens
caagauguggcaccucaaa

SEQ ID NO: 1410947 - RNA, 19 nt, Homo sapiens
ccaacauuauuucugaaga

SEQ ID NO: 1410948 - RNA, 19 nt, Homo sapiens
aggaagaucuaaaguccaa

SEQ ID NO: 1410949 - RNA, 19 nt, Homo sapiens
ccagaugagggaucaguaa

SEQ ID NO: 1410950 - RNA, 19 nt, Homo sapiens
ggaauucuaugggagugau

SEQ ID NO: 1410951 - RNA, 19 nt, Homo sapiens
caacauuauuucugaagac

SEQ ID NO: 1410952 - RNA, 19 nt, Homo sapiens
ucacgaguacccauaacua

SEQ ID NO: 1410953 - RNA, 19 nt, Homo sapiens
ccaugucauuucacgagua

SEQ ID NO: 1410954 - RNA, 19 nt, Homo sapiens
caagcagguucuuauccaa

SEQ ID NO: 1410955 - RNA, 19 nt, Homo sapiens
caguaacaaugcaagaguu

SEQ ID NO: 1410956 - RNA, 19 nt, Homo sapiens
gggaugauucugaguguau

SEQ ID NO: 1410957 - RNA, 19 nt, Homo sapiens
gugcaguccucaugaucuu

SEQ ID NO: 1410958 - RNA, 19 nt, Homo sapiens
gcacauuccuccgguagac

SEQ ID NO: 1410959 - RNA, 19 nt, Homo sapiens
gcccaggaaugauguacau

SEQ ID NO: 1410960 - RNA, 19 nt, Homo sapiens
gaacugucccuggcuuuca

SEQ ID NO: 1410961 - RNA, 19 nt, Homo sapiens
guugaugucagucuauaaa

SEQ ID NO: 1410962 - RNA, 19 nt, Homo sapiens
ccacagcugggucuucauu

SEQ ID NO: 1410963 - RNA, 19 nt, Homo sapiens
gaagaucuaaaguccaauc

SEQ ID NO: 1410964 - RNA, 19 nt, Homo sapiens
cagauguacgcuuuaaauu

SEQ ID NO: 1410965 - RNA, 19 nt, Homo sapiens
ugaagcauccucccacaga

SEQ ID NO: 1410966 - RNA, 19 nt, Homo sapiens
caaauaagucucacaucca

SEQ ID NO: 1410967 - RNA, 19 nt, Homo sapiens
uuaauacagucacuacaca

SEQ ID NO: 1410968 - RNA, 19 nt, Homo sapiens
agauguacgcuuuaaauug

SEQ ID NO: 1410969 - RNA, 19 nt, Homo sapiens
aaauacaacgugccugaaa

SEQ ID NO: 1410970 - RNA, 19 nt, Homo sapiens
gggcaggaggccagacuuu

SEQ ID NO: 1410971 - RNA, 19 nt, Homo sapiens
gaaaggccccacucaacua

SEQ ID NO: 1410972 - RNA, 19 nt, Homo sapiens
caauucaccugugguccaa

SEQ ID NO: 1410973 - RNA, 19 nt, Homo sapiens
ccauaacuacccaucguuu

SEQ ID NO: 1410974 - RNA, 19 nt, Homo sapiens
cagaaagaauuuguugucu

SEQ ID NO: 1410975 - RNA, 19 nt, Homo sapiens
gaguguaucacaaggcuau

SEQ ID NO: 1410976 - RNA, 19 nt, Homo sapiens
caacacaaucacucaaagu

SEQ ID NO: 1410977 - RNA, 19 nt, Homo sapiens
ugccugaccucccucaaug

SEQ ID NO: 1410978 - RNA, 19 nt, Homo sapiens
gagauaaagaggugcagau

SEQ ID NO: 1410979 - RNA, 19 nt, Homo sapiens
aggcagauguacgcuuuaa

SEQ ID NO: 1410980 - RNA, 19 nt, Homo sapiens
agaaggccacggagaauga

SEQ ID NO: 1410981 - RNA, 19 nt, Homo sapiens
ucaccugugguccaaauaa

SEQ ID NO: 1410982 - RNA, 19 nt, Homo sapiens
cacaagcucucccucugau

SEQ ID NO: 1410983 - RNA, 19 nt, Homo sapiens
caaauacccaaccugugaa

SEQ ID NO: 1410984 - RNA, 19 nt, Homo sapiens
gcagcaguuccuacuuaaa

SEQ ID NO: 1410985 - RNA, 19 nt, Homo sapiens
uggucuccauuucuucuua

SEQ ID NO: 1410986 - RNA, 19 nt, Homo sapiens
gauucugaguguaucacaa

SEQ ID NO: 1410987 - RNA, 19 nt, Homo sapiens
ggcaagaagcucccucugu

SEQ ID NO: 1410988 - RNA, 19 nt, Homo sapiens
gauguggcaccucaaacuu

SEQ ID NO: 1410989 - RNA, 19 nt, Homo sapiens
aagaguugaugucagucua

SEQ ID NO: 1410990 - RNA, 19 nt, Homo sapiens
uaacaaugcaagaguugau

SEQ ID NO: 1410991 - RNA, 19 nt, Homo sapiens
uccgguagacauuaacuua

SEQ ID NO: 1410992 - RNA, 19 nt, Homo sapiens
ucacucaaaguccagauga

SEQ ID NO: 1410993 - RNA, 19 nt, Homo sapiens
cuaagcaaguggacgaucu

SEQ ID NO: 1410994 - RNA, 19 nt, Homo sapiens
gaacuacucucuugccuaa

SEQ ID NO: 1410995 - RNA, 19 nt, Homo sapiens
ggaaauggcuucugguguu

SEQ ID NO: 1410996 - RNA, 19 nt, Homo sapiens
gaagagggauuaaguacau

SEQ ID NO: 1410997 - RNA, 19 nt, Homo sapiens
gauacaagguugagaaaug

SEQ ID NO: 1410998 - RNA, 19 nt, Homo sapiens
ggaacgaacuacucucuug

SEQ ID NO: 1410999 - RNA, 19 nt, Homo sapiens
gucccaaucuugcauauua

SEQ ID NO: 1411000 - RNA, 19 nt, Homo sapiens
ugaccaaacuuguccuuaa

SEQ ID NO: 1411001 - RNA, 19 nt, Homo sapiens
ggacuuguaucaggucuuu

SEQ ID NO: 1411002 - RNA, 19 nt, Homo sapiens
gaccaaacuuguccuuaaa

SEQ ID NO: 1411003 - RNA, 19 nt, Homo sapiens
gaaauggcuucugguguuu

SEQ ID NO: 1411004 - RNA, 19 nt, Homo sapiens
ugaagcagcuauauuugaa

SEQ ID NO: 1411005 - RNA, 19 nt, Homo sapiens
ggagccagcaauacaauua

SEQ ID NO: 1411006 - RNA, 19 nt, Homo sapiens
uaacguggcuacgguauug

SEQ ID NO: 1411007 - RNA, 19 nt, Homo sapiens
guucuuauuuccucuguuu

SEQ ID NO: 1411008 - RNA, 19 nt, Homo sapiens
gguaugaucuuuggauguu

SEQ ID NO: 1411009 - RNA, 19 nt, Homo sapiens
uaaccuacguucacuuaug

SEQ ID NO: 1411010 - RNA, 19 nt, Homo sapiens
gugcugauauuaguuguaa

SEQ ID NO: 1411011 - RNA, 19 nt, Homo sapiens
gaugugcuauucuauacuu

SEQ ID NO: 1411012 - RNA, 19 nt, Homo sapiens
gaagggagccagcaauaca

SEQ ID NO: 1411013 - RNA, 19 nt, Homo sapiens
gaccaacgcuggguggauu

SEQ ID NO: 1411014 - RNA, 19 nt, Homo sapiens
gaaugcuccuggccuuaaa

SEQ ID NO: 1411015 - RNA, 19 nt, Homo sapiens
gauaaaaggccaccucuaa

SEQ ID NO: 1411016 - RNA, 19 nt, Homo sapiens
ccaaacuuguccuuaaaga

SEQ ID NO: 1411017 - RNA, 19 nt, Homo sapiens
ccagaugggccaguauuua

SEQ ID NO: 1411018 - RNA, 19 nt, Homo sapiens
gaguauaauuccaacuuuc

SEQ ID NO: 1411019 - RNA, 19 nt, Homo sapiens
ucuggaaacugaucgcuuu

SEQ ID NO: 1411020 - RNA, 19 nt, Homo sapiens
ucacuuaugaucuggauuu

SEQ ID NO: 1411021 - RNA, 19 nt, Homo sapiens
gcgaaugcuuguuuuguua

SEQ ID NO: 1411022 - RNA, 19 nt, Homo sapiens
aaacuuguccuuaaagaug

SEQ ID NO: 1411023 - RNA, 19 nt, Homo sapiens
acaauucucuuugguguau

SEQ ID NO: 1411024 - RNA, 19 nt, Homo sapiens
gaaaagcuguccugcugaa

SEQ ID NO: 1411025 - RNA, 19 nt, Homo sapiens
ugaaugggcagcagcuaua

SEQ ID NO: 1411026 - RNA, 19 nt, Homo sapiens
gaacacucauucuggaaac

SEQ ID NO: 1411027 - RNA, 19 nt, Homo sapiens
ggaguuacaauucucuuug

SEQ ID NO: 1411028 - RNA, 19 nt, Homo sapiens
gaaauugugauguugaagu

SEQ ID NO: 1411029 - RNA, 19 nt, Homo sapiens
gggccaguauuuauugcua

SEQ ID NO: 1411030 - RNA, 19 nt, Homo sapiens
cagggaaagaaaugaauua

SEQ ID NO: 1411031 - RNA, 19 nt, Homo sapiens
auacaagguugagaaauga

SEQ ID NO: 1411032 - RNA, 19 nt, Homo sapiens
acugaucgcuuuacccaaa

SEQ ID NO: 1411033 - RNA, 19 nt, Homo sapiens
aauacuagguccuccugua

SEQ ID NO: 1411034 - RNA, 19 nt, Homo sapiens
guacugauaucggcagcuu

SEQ ID NO: 1411035 - RNA, 19 nt, Homo sapiens
guacuuacugugauacuga

SEQ ID NO: 1411036 - RNA, 19 nt, Homo sapiens
caauuuaccagcuggauau

SEQ ID NO: 1411037 - RNA, 19 nt, Homo sapiens
gaugguaccacucaauaug

SEQ ID NO: 1411038 - RNA, 19 nt, Homo sapiens
gugaaauugugauguugaa

SEQ ID NO: 1411039 - RNA, 19 nt, Homo sapiens
caaagaggcugaaaagaag

SEQ ID NO: 1411040 - RNA, 19 nt, Homo sapiens
gauauacuuucucuuuguc

SEQ ID NO: 1411041 - RNA, 19 nt, Homo sapiens
caaggucuaugggcucuga

SEQ ID NO: 1411042 - RNA, 19 nt, Homo sapiens
caugaugugcuauucuaua

SEQ ID NO: 1411043 - RNA, 19 nt, Homo sapiens
uauuuggucuccuaaguga

SEQ ID NO: 1411044 - RNA, 19 nt, Homo sapiens
cgugugaaauugugauguu

SEQ ID NO: 1411045 - RNA, 19 nt, Homo sapiens
cuaaugcgaaugcuuguuu

SEQ ID NO: 1411046 - RNA, 19 nt, Homo sapiens
uaacagggaaagaaaugaa

SEQ ID NO: 1411047 - RNA, 19 nt, Homo sapiens
guauugggcuguacuuacu

SEQ ID NO: 1411048 - RNA, 19 nt, Homo sapiens
ucacucagcucguguuuug

SEQ ID NO: 1411049 - RNA, 19 nt, Homo sapiens
guuuguagcaggaauguuu

SEQ ID NO: 1411050 - RNA, 19 nt, Homo sapiens
ugccaucucuucaccacua

SEQ ID NO: 1411051 - RNA, 19 nt, Homo sapiens
ccaaagaggcugaaaagaa

SEQ ID NO: 1411052 - RNA, 19 nt, Homo sapiens
aaccuacguucacuuauga

SEQ ID NO: 1411053 - RNA, 19 nt, Homo sapiens
ccggguggcuuucgagaga

SEQ ID NO: 1411054 - RNA, 19 nt, Homo sapiens
guaccacucaauauguaua

SEQ ID NO: 1411055 - RNA, 19 nt, Homo sapiens
gaugggccaguauuuauug

SEQ ID NO: 1411056 - RNA, 19 nt, Homo sapiens
cagaugggccaguauuuau

SEQ ID NO: 1411057 - RNA, 19 nt, Homo sapiens
gcuggcauccuugguauuu

SEQ ID NO: 1411058 - RNA, 19 nt, Homo sapiens
gauccuguauugggcugua

SEQ ID NO: 1411059 - RNA, 19 nt, Homo sapiens
ucugguguuuggcaacuua

SEQ ID NO: 1411060 - RNA, 19 nt, Homo sapiens
guucugggaugcgucguuu

SEQ ID NO: 1411061 - RNA, 19 nt, Homo sapiens
gcuaugaagugccuuuuau

SEQ ID NO: 1411062 - RNA, 19 nt, Homo sapiens
ggaaacuaucuuguacaua

SEQ ID NO: 1411063 - RNA, 19 nt, Homo sapiens
uguaaccuacguucacuua

SEQ ID NO: 1411064 - RNA, 19 nt, Homo sapiens
uccaugaugugcuauucua

SEQ ID NO: 1411065 - RNA, 19 nt, Homo sapiens
gaagcagcuauauuugaaa

SEQ ID NO: 1411066 - RNA, 19 nt, Homo sapiens
aagaagggagccagcaaua

SEQ ID NO: 1411067 - RNA, 19 nt, Homo sapiens
ggcagcagcuauacaaggu

SEQ ID NO: 1411068 - RNA, 19 nt, Homo sapiens
guauggcacuguccuaugc

SEQ ID NO: 1411069 - RNA, 19 nt, Homo sapiens
ggauaugugggacuaguau

SEQ ID NO: 1411070 - RNA, 19 nt, Homo sapiens
gcaaugacugcaucuucuu

SEQ ID NO: 1411071 - RNA, 19 nt, Homo sapiens
aaauugugauguugaagug

SEQ ID NO: 1411072 - RNA, 19 nt, Homo sapiens
caacuucgugugaaauugu

SEQ ID NO: 1411073 - RNA, 19 nt, Homo sapiens
cuaaguacacugauucugu

SEQ ID NO: 1411074 - RNA, 19 nt, Homo sapiens
gaguuacaauucucuuugg

SEQ ID NO: 1411075 - RNA, 19 nt, Homo sapiens
acauaaaggugcuucaaaa

SEQ ID NO: 1411076 - RNA, 19 nt, Homo sapiens
cgaguuaguucuuauuucc

SEQ ID NO: 1411077 - RNA, 19 nt, Homo sapiens
ucccggaaauucucaguug

SEQ ID NO: 1411078 - RNA, 19 nt, Homo sapiens
ugguaccacucaauaugua

SEQ ID NO: 1411079 - RNA, 19 nt, Homo sapiens
gaagugccuuuuauuguuc

SEQ ID NO: 1411080 - RNA, 19 nt, Homo sapiens
ugaagugccuuuuauuguu

SEQ ID NO: 1411081 - RNA, 19 nt, Homo sapiens
gagaguaauggaugcaguu

SEQ ID NO: 1411082 - RNA, 19 nt, Homo sapiens
uagguuccaugaugugcua

SEQ ID NO: 1411083 - RNA, 19 nt, Homo sapiens
ggucuaugggcucugauaa

SEQ ID NO: 1411084 - RNA, 19 nt, Homo sapiens
guaucaauccuuuggcuau

SEQ ID NO: 1411085 - RNA, 19 nt, Homo sapiens
uggaaacuaucuuguacau

SEQ ID NO: 1411086 - RNA, 19 nt, Homo sapiens
ccaacuucgugugaaauug

SEQ ID NO: 1411087 - RNA, 19 nt, Homo sapiens
ccuccaacuucgugugaaa

SEQ ID NO: 1411088 - RNA, 19 nt, Homo sapiens
ggcuguacuuacugugaua

SEQ ID NO: 1411089 - RNA, 19 nt, Homo sapiens
ucuaugggcucugauaagu

SEQ ID NO: 1411090 - RNA, 19 nt, Homo sapiens
ucaauuuaccagcuggaua

SEQ ID NO: 1411091 - RNA, 19 nt, Homo sapiens
ucaauccuuuggcuaugaa

SEQ ID NO: 1411092 - RNA, 19 nt, Homo sapiens
caggaggaguuacaauucu

SEQ ID NO: 1411093 - RNA, 19 nt, Homo sapiens
gggcuguacuuacugugau

SEQ ID NO: 1411094 - RNA, 19 nt, Homo sapiens
gcaacccgcuuaacaaaua

SEQ ID NO: 1411095 - RNA, 19 nt, Homo sapiens
ccucuaagcuccaagaauu

SEQ ID NO: 1411096 - RNA, 19 nt, Homo sapiens
gaaacccugucucuacuaa

SEQ ID NO: 1411097 - RNA, 19 nt, Homo sapiens
caaauaauccugccuuuua

SEQ ID NO: 1411098 - RNA, 19 nt, Homo sapiens
gagcuaccauguccucuug

SEQ ID NO: 1411099 - RNA, 19 nt, Homo sapiens
gaaagccucucgcccgaau

SEQ ID NO: 1411100 - RNA, 19 nt, Homo sapiens
gaacacugcaacccgcuua

SEQ ID NO: 1411101 - RNA, 19 nt, Homo sapiens
caacccgcuuaacaaauaa

SEQ ID NO: 1411102 - RNA, 19 nt, Homo sapiens
gaaccugagcgaccucuau

SEQ ID NO: 1411103 - RNA, 19 nt, Homo sapiens
gagaccaucuuggcuaaca

SEQ ID NO: 1411104 - RNA, 19 nt, Homo sapiens
ucaaccaccugccgaaauc

SEQ ID NO: 1411105 - RNA, 19 nt, Homo sapiens
gcagcuccaucuccuguca

SEQ ID NO: 1411106 - RNA, 19 nt, Homo sapiens
caacaaauugcaaguacug

SEQ ID NO: 1411107 - RNA, 19 nt, Homo sapiens
gcaccuggccguggaauuc

SEQ ID NO: 1411108 - RNA, 19 nt, Homo sapiens
ggugaaacccugucucuac

SEQ ID NO: 1411109 - RNA, 19 nt, Homo sapiens
ggaccucuccaauaacuca

SEQ ID NO: 1411110 - RNA, 19 nt, Homo sapiens
gaaugccguucccuguuuc

SEQ ID NO: 1411111 - RNA, 19 nt, Homo sapiens
gcaggagaauggcgugaac

SEQ ID NO: 1411112 - RNA, 19 nt, Homo sapiens
ucuagaaggcaacaaauug

SEQ ID NO: 1411113 - RNA, 19 nt, Homo sapiens
gaacggcuacaucuagaag

SEQ ID NO: 1411114 - RNA, 19 nt, Homo sapiens
gcaauuagaacggcuacau

SEQ ID NO: 1411115 - RNA, 19 nt, Homo sapiens
ggacacccugguauugaaa

SEQ ID NO: 1411116 - RNA, 19 nt, Homo sapiens
ggagaauggcgugaacuug

SEQ ID NO: 1411117 - RNA, 19 nt, Homo sapiens
ucgagaccaucuuggcuaa

SEQ ID NO: 1411118 - RNA, 19 nt, Homo sapiens
ucccagaucucuugaacuc

SEQ ID NO: 1411119 - RNA, 19 nt, Homo sapiens
gaacacacgaugggcuuuc

SEQ ID NO: 1411120 - RNA, 19 nt, Homo sapiens
aacaaauaauccugccuuu

SEQ ID NO: 1411121 - RNA, 19 nt, Homo sapiens
gugaaacccugucucuacu

SEQ ID NO: 1411122 - RNA, 19 nt, Homo sapiens
aacaaauaauccugccuuu

SEQ ID NO: 1411123 - RNA, 19 nt, Homo sapiens
gcuaccauguccucuugga

SEQ ID NO: 1411124 - RNA, 19 nt, Homo sapiens
ggaccugcgcuaccucuuc

SEQ ID NO: 1411125 - RNA, 19 nt, Homo sapiens
uggacacccugguauugaa

SEQ ID NO: 1411126 - RNA, 19 nt, Homo sapiens
acacgaugggcuuuccuua

SEQ ID NO: 1411127 - RNA, 19 nt, Homo sapiens
gucaggagaucgagaccau

SEQ ID NO: 1411128 - RNA, 19 nt, Homo sapiens
ccuguaaucccagcacuuu

SEQ ID NO: 1411129 - RNA, 19 nt, Homo sapiens
gaugcugagucccacuuag

SEQ ID NO: 1411130 - RNA, 19 nt, Homo sapiens
ccaaagacugccagguguu

SEQ ID NO: 1411131 - RNA, 19 nt, Homo sapiens
caaagacugccagguguuc

SEQ ID NO: 1411132 - RNA, 19 nt, Homo sapiens
acccugguauugaaagaaa

SEQ ID NO: 1411133 - RNA, 19 nt, Homo sapiens
cauccaugcuuccuagaac

SEQ ID NO: 1411134 - RNA, 19 nt, Homo sapiens
caagauguuuucccagaau

SEQ ID NO: 1411135 - RNA, 19 nt, Homo sapiens
gagcagacagcgaccaaaa

SEQ ID NO: 1411136 - RNA, 19 nt, Homo sapiens
cugcaacccgcuuaacaaa

SEQ ID NO: 1411137 - RNA, 19 nt, Homo sapiens
agaaccaguuggagaccuu

SEQ ID NO: 1411138 - RNA, 19 nt, Homo sapiens
ggaaccgccuccggaaacu

SEQ ID NO: 1411139 - RNA, 19 nt, Homo sapiens
aaauaacccuugaaaacug

SEQ ID NO: 1411140 - RNA, 19 nt, Homo sapiens
ugaaacccugucucuacua

SEQ ID NO: 1411141 - RNA, 19 nt, Homo sapiens
gaccaucuuggcuaacaug

SEQ ID NO: 1411142 - RNA, 19 nt, Homo sapiens
caggugggcggaucacgaa

SEQ ID NO: 1411143 - RNA, 19 nt, Homo sapiens
caauuagaacggcuacauc

SEQ ID NO: 1411144 - RNA, 19 nt, Homo sapiens
gcaccuguagucccagcaa

SEQ ID NO: 1411145 - RNA, 19 nt, Homo sapiens
gaucacgaagucaggagau

SEQ ID NO: 1411146 - RNA, 19 nt, Homo sapiens
ugagggugcuggaucuaac

SEQ ID NO: 1411147 - RNA, 19 nt, Homo sapiens
caucuagaaggcaacaaau

SEQ ID NO: 1411148 - RNA, 19 nt, Homo sapiens
acacccugguauugaaaga

SEQ ID NO: 1411149 - RNA, 19 nt, Homo sapiens
cauagaaacugccaauuua

SEQ ID NO: 1411150 - RNA, 19 nt, Homo sapiens
ugacaaaguucgacaguua

SEQ ID NO: 1411151 - RNA, 19 nt, Homo sapiens
gcaauacacucaugaaugu

SEQ ID NO: 1411152 - RNA, 19 nt, Homo sapiens
ggauuugacucuauagaua

SEQ ID NO: 1411153 - RNA, 19 nt, Homo sapiens
ggaccaggcugcucucuuu

SEQ ID NO: 1411154 - RNA, 19 nt, Homo sapiens
gaacaagcgugcauacaug

SEQ ID NO: 1411155 - RNA, 19 nt, Homo sapiens
uaacaucucuccagaauca

SEQ ID NO: 1411156 - RNA, 19 nt, Homo sapiens
gcaauacaguuacuaaaug

SEQ ID NO: 1411157 - RNA, 19 nt, Homo sapiens
gaacaucaacggacuaauu

SEQ ID NO: 1411158 - RNA, 19 nt, Homo sapiens
gaaguucgguggucauuug

SEQ ID NO: 1411159 - RNA, 19 nt, Homo sapiens
ugaagaagauuaccaaaga

SEQ ID NO: 1411160 - RNA, 19 nt, Homo sapiens
gcagaagaaugucaguuaa

SEQ ID NO: 1411161 - RNA, 19 nt, Homo sapiens
caucaaagauuggagcuua

SEQ ID NO: 1411162 - RNA, 19 nt, Homo sapiens
ugaaagaacugcaguggaa

SEQ ID NO: 1411163 - RNA, 19 nt, Homo sapiens
gaagaacgauaccaagaug

SEQ ID NO: 1411164 - RNA, 19 nt, Homo sapiens
caacguggcugaucaagau

SEQ ID NO: 1411165 - RNA, 19 nt, Homo sapiens
gaauucaccuuuaaaguag

SEQ ID NO: 1411166 - RNA, 19 nt, Homo sapiens
gagaagacaugacguuuua

SEQ ID NO: 1411167 - RNA, 19 nt, Homo sapiens
gaaugucaguuaauuguga

SEQ ID NO: 1411168 - RNA, 19 nt, Homo sapiens
guaauuaacccaucaaaga

SEQ ID NO: 1411169 - RNA, 19 nt, Homo sapiens
ccacagggcuauacaaugu

SEQ ID NO: 1411170 - RNA, 19 nt, Homo sapiens
gcacuucccucucuucuag

SEQ ID NO: 1411171 - RNA, 19 nt, Homo sapiens
gaagaaaccacaaguuaau

SEQ ID NO: 1411172 - RNA, 19 nt, Homo sapiens
gaacaaacaggagacauuu

SEQ ID NO: 1411173 - RNA, 19 nt, Homo sapiens
gcacaauccuucucuaugg

SEQ ID NO: 1411174 - RNA, 19 nt, Homo sapiens
gauaauuauuggcugguua

SEQ ID NO: 1411175 - RNA, 19 nt, Homo sapiens
ucaaguaugugguaauuug

SEQ ID NO: 1411176 - RNA, 19 nt, Homo sapiens
gacaagcgaucagaaagua

SEQ ID NO: 1411177 - RNA, 19 nt, Homo sapiens
gaacacggcuuucaaucag

SEQ ID NO: 1411178 - RNA, 19 nt, Homo sapiens
ggaaucguccaacuauuua

SEQ ID NO: 1411179 - RNA, 19 nt, Homo sapiens
gaaggaagcgcaagacgaa

SEQ ID NO: 1411180 - RNA, 19 nt, Homo sapiens
agaauacgcuagauaugua

SEQ ID NO: 1411181 - RNA, 19 nt, Homo sapiens
gcagagagauguggugaau

SEQ ID NO: 1411182 - RNA, 19 nt, Homo sapiens
gauuguugcuuaguacuua

SEQ ID NO: 1411183 - RNA, 19 nt, Homo sapiens
ggacacagaugccuuugca

SEQ ID NO: 1411184 - RNA, 19 nt, Homo sapiens
gagaaguugugguuugauu

SEQ ID NO: 1411185 - RNA, 19 nt, Homo sapiens
ggagaccucuucaguagug

SEQ ID NO: 1411186 - RNA, 19 nt, Homo sapiens
gaaagauuauguacagaca

SEQ ID NO: 1411187 - RNA, 19 nt, Homo sapiens
aaucagaagucuuagauga

SEQ ID NO: 1411188 - RNA, 19 nt, Homo sapiens
gcacacuaacaaugaauua

SEQ ID NO: 1411189 - RNA, 19 nt, Homo sapiens
aaacaaagauaaccaagag

SEQ ID NO: 1411190 - RNA, 19 nt, Homo sapiens
aaaucuagcucaagaguug

SEQ ID NO: 1411191 - RNA, 19 nt, Homo sapiens
gacgaaaucuagcucaaga

SEQ ID NO: 1411192 - RNA, 19 nt, Homo sapiens
ggaaagggacagacagaaa

SEQ ID NO: 1411193 - RNA, 19 nt, Homo sapiens
gaagaggcaagcagaaauu

SEQ ID NO: 1411194 - RNA, 19 nt, Homo sapiens
ugaaguagaacaacagaua

SEQ ID NO: 1411195 - RNA, 19 nt, Homo sapiens
gaaagacucagacagauuc

SEQ ID NO: 1411196 - RNA, 19 nt, Homo sapiens
ggacagcacuuggguucuu

SEQ ID NO: 1411197 - RNA, 19 nt, Homo sapiens
gaagaagauuaccaaagau

SEQ ID NO: 1411198 - RNA, 19 nt, Homo sapiens
gaaguagaacaacagauaa

SEQ ID NO: 1411199 - RNA, 19 nt, Homo sapiens
ggcaaggauuuaugaagua

SEQ ID NO: 1411200 - RNA, 19 nt, Homo sapiens
ggaugaugaucuucuuaaa

SEQ ID NO: 1411201 - RNA, 19 nt, Homo sapiens
aagaagaaaccacaaguua

SEQ ID NO: 1411202 - RNA, 19 nt, Homo sapiens
gcugagaaacugaagcuua

SEQ ID NO: 1411203 - RNA, 19 nt, Homo sapiens
gcggaaaccuguuagaagu

SEQ ID NO: 1411204 - RNA, 19 nt, Homo sapiens
gaaggaggaugaacuuacu

SEQ ID NO: 1411205 - RNA, 19 nt, Homo sapiens
uaaaugaacugaguguugu

SEQ ID NO: 1411206 - RNA, 19 nt, Homo sapiens
gggcaaggauuuaugaagu

SEQ ID NO: 1411207 - RNA, 19 nt, Homo sapiens
ccaaacaacucgaguaucg

SEQ ID NO: 1411208 - RNA, 19 nt, Homo sapiens
ggacagacagaaacagaaa

SEQ ID NO: 1411209 - RNA, 19 nt, Homo sapiens
ccauagaaacugccaauuu

SEQ ID NO: 1411210 - RNA, 19 nt, Homo sapiens
uaccaaagauauccugaaa

SEQ ID NO: 1411211 - RNA, 19 nt, Homo sapiens
gagauguggugaaucagaa

SEQ ID NO: 1411212 - RNA, 19 nt, Homo sapiens
ugacaugguuuccagagaa

SEQ ID NO: 1411213 - RNA, 19 nt, Homo sapiens
uugcaucgcucuaauuuga

SEQ ID NO: 1411214 - RNA, 19 nt, Homo sapiens
gaaagaauggauuaugaug

SEQ ID NO: 1411215 - RNA, 19 nt, Homo sapiens
gagcccacaucuccaguuu

SEQ ID NO: 1411216 - RNA, 19 nt, Homo sapiens
uacugcagcuuaucuguua

SEQ ID NO: 1411217 - RNA, 19 nt, Homo sapiens
ugacuucgcaauacaguua

SEQ ID NO: 1411218 - RNA, 19 nt, Homo sapiens
ggcagaagaaugucaguua

SEQ ID NO: 1411219 - RNA, 19 nt, Homo sapiens
agagagauguggugaauca

SEQ ID NO: 1411220 - RNA, 19 nt, Homo sapiens
cugagaaacugaagcuuaa

SEQ ID NO: 1411221 - RNA, 19 nt, Homo sapiens
cauauuagcugagaaacug

SEQ ID NO: 1411222 - RNA, 19 nt, Homo sapiens
ggaaagacucagacagauu

SEQ ID NO: 1411223 - RNA, 19 nt, Homo sapiens
gaaguccgcugagcuguca

SEQ ID NO: 1411224 - RNA, 19 nt, Homo sapiens
gaaccugaaagauuaugua

SEQ ID NO: 1411225 - RNA, 19 nt, Homo sapiens
gcacuguucuuaguucaga

SEQ ID NO: 1411226 - RNA, 19 nt, Homo sapiens
gaagaaugucaguuaauug

SEQ ID NO: 1411227 - RNA, 19 nt, Homo sapiens
cagcuggccuucucagauu

SEQ ID NO: 1411228 - RNA, 19 nt, Homo sapiens
guaggacucuucuuugcuu

SEQ ID NO: 1411229 - RNA, 19 nt, Homo sapiens
gugaaacggacauuuauuu

SEQ ID NO: 1411230 - RNA, 19 nt, Homo sapiens
uagcagaccuuuugaaauu

SEQ ID NO: 1411231 - RNA, 19 nt, Homo sapiens
gaagaacccagcuccuuug

SEQ ID NO: 1411232 - RNA, 19 nt, Homo sapiens
cagaaaguauugacaaagu

SEQ ID NO: 1411233 - RNA, 19 nt, Homo sapiens
ggagacaagcgaucagaaa

SEQ ID NO: 1411234 - RNA, 19 nt, Homo sapiens
gggaaggccuccuaacauc

SEQ ID NO: 1411235 - RNA, 19 nt, Homo sapiens
ggcaucagcugaagaagau

SEQ ID NO: 1411236 - RNA, 19 nt, Homo sapiens
gaugagaaggagucuauuu

SEQ ID NO: 1411237 - RNA, 19 nt, Homo sapiens
gaaacaaaauugcuggauu

SEQ ID NO: 1411238 - RNA, 19 nt, Homo sapiens
gugcauacaugaauuuagu

SEQ ID NO: 1411239 - RNA, 19 nt, Homo sapiens
cugcagaccuaaauaauuc

SEQ ID NO: 1411240 - RNA, 19 nt, Homo sapiens
aaugaugacuucaccauga

SEQ ID NO: 1411241 - RNA, 19 nt, Homo sapiens
gccaaucgcuacagcuuug

SEQ ID NO: 1411242 - RNA, 19 nt, Homo sapiens
ucacaguugucuaaucuug

SEQ ID NO: 1411243 - RNA, 19 nt, Homo sapiens
acauucagcucaucuuuga

SEQ ID NO: 1411244 - RNA, 19 nt, Homo sapiens
ggccaagauuucugacuuu

SEQ ID NO: 1411245 - RNA, 19 nt, Homo sapiens
guucaaguaugugguaauu

SEQ ID NO: 1411246 - RNA, 19 nt, Homo sapiens
gcaucgcucuaauuugaaa

SEQ ID NO: 1411247 - RNA, 19 nt, Homo sapiens
cuucagaaccaaucucuua

SEQ ID NO: 1411248 - RNA, 19 nt, Homo sapiens
aacugaagcuuaacacuuu

SEQ ID NO: 1411249 - RNA, 19 nt, Homo sapiens
gaggagagcugaccaauua

SEQ ID NO: 1411250 - RNA, 19 nt, Homo sapiens
gaaaugaguugcugauauu

SEQ ID NO: 1411251 - RNA, 19 nt, Homo sapiens
gaacaacaccuauugauaa

SEQ ID NO: 1411252 - RNA, 19 nt, Homo sapiens
gaaggaagcugcugaaauc

SEQ ID NO: 1411253 - RNA, 19 nt, Homo sapiens
gaacuugguugcugugaua

SEQ ID NO: 1411254 - RNA, 19 nt, Homo sapiens
guaaagugcuacacaaaua

SEQ ID NO: 1411255 - RNA, 19 nt, Homo sapiens
gaucaaaucuuccaaguca

SEQ ID NO: 1411256 - RNA, 19 nt, Homo sapiens
gaacacugauuaugcuaua

SEQ ID NO: 1411257 - RNA, 19 nt, Homo sapiens
guaaagaacuggcagaaug

SEQ ID NO: 1411258 - RNA, 19 nt, Homo sapiens
guacacaagucagcuauua

SEQ ID NO: 1411259 - RNA, 19 nt, Homo sapiens
ggaagaauguaugcaguua

SEQ ID NO: 1411260 - RNA, 19 nt, Homo sapiens
gcaaacaugucccagguaa

SEQ ID NO: 1411261 - RNA, 19 nt, Homo sapiens
gguaaagugucaagagaua

SEQ ID NO: 1411262 - RNA, 19 nt, Homo sapiens
uaaaggagcuucauauucu

SEQ ID NO: 1411263 - RNA, 19 nt, Homo sapiens
cuacugagcuauauucgua

SEQ ID NO: 1411264 - RNA, 19 nt, Homo sapiens
gcaaaaguguuucauguua

SEQ ID NO: 1411265 - RNA, 19 nt, Homo sapiens
ccacuaugccuuagaauua

SEQ ID NO: 1411266 - RNA, 19 nt, Homo sapiens
gggcaaaggugaauccauu

SEQ ID NO: 1411267 - RNA, 19 nt, Homo sapiens
gcaaguggcaguacugaua

SEQ ID NO: 1411268 - RNA, 19 nt, Homo sapiens
gaacuuguguggauacugu

SEQ ID NO: 1411269 - RNA, 19 nt, Homo sapiens
gcacagugaucuucaacuu

SEQ ID NO: 1411270 - RNA, 19 nt, Homo sapiens
acacuuacguucuccuuua

SEQ ID NO: 1411271 - RNA, 19 nt, Homo sapiens
gaauacgacucaauccauu

SEQ ID NO: 1411272 - RNA, 19 nt, Homo sapiens
ggaguuggacuuuaugaua

SEQ ID NO: 1411273 - RNA, 19 nt, Homo sapiens
ggagacagguuugcauauu

SEQ ID NO: 1411274 - RNA, 19 nt, Homo sapiens
cgaaaugaguugcugauau

SEQ ID NO: 1411275 - RNA, 19 nt, Homo sapiens
gcacaaagucaguaaagaa

SEQ ID NO: 1411276 - RNA, 19 nt, Homo sapiens
gaacuacugcaaaggaaua

SEQ ID NO: 1411277 - RNA, 19 nt, Homo sapiens
acagugaucuucaacuuaa

SEQ ID NO: 1411278 - RNA, 19 nt, Homo sapiens
gaaggaacuuguguggaua

SEQ ID NO: 1411279 - RNA, 19 nt, Homo sapiens
gauggaagucuaucaauuu

SEQ ID NO: 1411280 - RNA, 19 nt, Homo sapiens
ggaaggaggaaacauuuaa

SEQ ID NO: 1411281 - RNA, 19 nt, Homo sapiens
gcgagaaagugcaugauga

SEQ ID NO: 1411282 - RNA, 19 nt, Homo sapiens
uggcaguacugauaauuua

SEQ ID NO: 1411283 - RNA, 19 nt, Homo sapiens
gaugauuccugauaaugaa

SEQ ID NO: 1411284 - RNA, 19 nt, Homo sapiens
ccaauugccuugauuaaag

SEQ ID NO: 1411285 - RNA, 19 nt, Homo sapiens
gugagacucuggucauuaa

SEQ ID NO: 1411286 - RNA, 19 nt, Homo sapiens
gcagauguauaugguuuaa

SEQ ID NO: 1411287 - RNA, 19 nt, Homo sapiens
gcaaaggaauaaugcacuu

SEQ ID NO: 1411288 - RNA, 19 nt, Homo sapiens
gaugguuucuguauuauuc

SEQ ID NO: 1411289 - RNA, 19 nt, Homo sapiens
ggauuucacugcuuacaug

SEQ ID NO: 1411290 - RNA, 19 nt, Homo sapiens
gagacagguuugcauauug

SEQ ID NO: 1411291 - RNA, 19 nt, Homo sapiens
gagauacugugaacuuaug

SEQ ID NO: 1411292 - RNA, 19 nt, Homo sapiens
gaguuggacuuuaugauau

SEQ ID NO: 1411293 - RNA, 19 nt, Homo sapiens
uuagaagacucuccguaua

SEQ ID NO: 1411294 - RNA, 19 nt, Homo sapiens
guacugaagagauaaauga

SEQ ID NO: 1411295 - RNA, 19 nt, Homo sapiens
caaggaagacuuuaaugaa

SEQ ID NO: 1411296 - RNA, 19 nt, Homo sapiens
uaggacaaauucagagaua

SEQ ID NO: 1411297 - RNA, 19 nt, Homo sapiens
gucaagaugucuaaauuug

SEQ ID NO: 1411298 - RNA, 19 nt, Homo sapiens
ggaauucuuugcagugguu

SEQ ID NO: 1411299 - RNA, 19 nt, Homo sapiens
caacaccuauugauaaucu

SEQ ID NO: 1411300 - RNA, 19 nt, Homo sapiens
gaaucacuuucuugcauaa

SEQ ID NO: 1411301 - RNA, 19 nt, Homo sapiens
gaauagugcuagacauaca

SEQ ID NO: 1411302 - RNA, 19 nt, Homo sapiens
agugaugguuucuguauua

SEQ ID NO: 1411303 - RNA, 19 nt, Homo sapiens
ccaggugguuuaaauugua

SEQ ID NO: 1411304 - RNA, 19 nt, Homo sapiens
ggaauucgccugguagauu

SEQ ID NO: 1411305 - RNA, 19 nt, Homo sapiens
gugcagauguauaugguuu

SEQ ID NO: 1411306 - RNA, 19 nt, Homo sapiens
ggacuuuggauaccauaua

SEQ ID NO: 1411307 - RNA, 19 nt, Homo sapiens
uaaauuugguggugguauu

SEQ ID NO: 1411308 - RNA, 19 nt, Homo sapiens
ggauuaauguggaauacug

SEQ ID NO: 1411309 - RNA, 19 nt, Homo sapiens
cagcucagaucaaccauug

SEQ ID NO: 1411310 - RNA, 19 nt, Homo sapiens
auaggugccuccuuuauaa

SEQ ID NO: 1411311 - RNA, 19 nt, Homo sapiens
gaaauacuggaagaaguua

SEQ ID NO: 1411312 - RNA, 19 nt, Homo sapiens
gaacuuaugguugaacuug

SEQ ID NO: 1411313 - RNA, 19 nt, Homo sapiens
cagagauacugugaacuua

SEQ ID NO: 1411314 - RNA, 19 nt, Homo sapiens
uaacagcaguguacacauc

SEQ ID NO: 1411315 - RNA, 19 nt, Homo sapiens
guacuuaauucuccuccaa

SEQ ID NO: 1411316 - RNA, 19 nt, Homo sapiens
gcaagaugauugguaugaa

SEQ ID NO: 1411317 - RNA, 19 nt, Homo sapiens
ugaaucacuuucuugcaua

SEQ ID NO: 1411318 - RNA, 19 nt, Homo sapiens
gcagaugacaauauauuug

SEQ ID NO: 1411319 - RNA, 19 nt, Homo sapiens
uagaauuacuggcgagaaa

SEQ ID NO: 1411320 - RNA, 19 nt, Homo sapiens
uuaaugaacuccugcacaa

SEQ ID NO: 1411321 - RNA, 19 nt, Homo sapiens
gcaucaauauucuuaaugg

SEQ ID NO: 1411322 - RNA, 19 nt, Homo sapiens
gcauggaacaaauggaaua

SEQ ID NO: 1411323 - RNA, 19 nt, Homo sapiens
gacccuggcuaucuauauu

SEQ ID NO: 1411324 - RNA, 19 nt, Homo sapiens
cagucaagaugucuaaauu

SEQ ID NO: 1411325 - RNA, 19 nt, Homo sapiens
guuaaauggucuccucuga

SEQ ID NO: 1411326 - RNA, 19 nt, Homo sapiens
cauagcuucuugucugaua

SEQ ID NO: 1411327 - RNA, 19 nt, Homo sapiens
gaaggaggaaacauuuaaa

SEQ ID NO: 1411328 - RNA, 19 nt, Homo sapiens
ggaauuauuggaccagauu

SEQ ID NO: 1411329 - RNA, 19 nt, Homo sapiens
ucaagauggucgagcagua

SEQ ID NO: 1411330 - RNA, 19 nt, Homo sapiens
caagaggucagcuuaaaga

SEQ ID NO: 1411331 - RNA, 19 nt, Homo sapiens
caagaugucuaaauuuggu

SEQ ID NO: 1411332 - RNA, 19 nt, Homo sapiens
uaacaacagucaagauguc

SEQ ID NO: 1411333 - RNA, 19 nt, Homo sapiens
agaaggaacuuguguggau

SEQ ID NO: 1411334 - RNA, 19 nt, Homo sapiens
uagaauagugcuagacaua

SEQ ID NO: 1411335 - RNA, 19 nt, Homo sapiens
ggaaaucugcuaucuccuu

SEQ ID NO: 1411336 - RNA, 19 nt, Homo sapiens
gaauaaugcacuugaaaca

SEQ ID NO: 1411337 - RNA, 19 nt, Homo sapiens
gaagugggauuuucuuaga

SEQ ID NO: 1411338 - RNA, 19 nt, Homo sapiens
gcacuugaaacaucugauu

SEQ ID NO: 1411339 - RNA, 19 nt, Homo sapiens
gaacaaauggaauauucug

SEQ ID NO: 1411340 - RNA, 19 nt, Homo sapiens
gcaacagcuucauuugaug

SEQ ID NO: 1411341 - RNA, 19 nt, Homo sapiens
uaacacagaaucaagcauu

SEQ ID NO: 1411342 - RNA, 19 nt, Homo sapiens
cauuauacauccucaacaa

SEQ ID NO: 1411343 - RNA, 19 nt, Homo sapiens
aaaguuguguuuggucaua

SEQ ID NO: 1411344 - RNA, 19 nt, Homo sapiens
ucacugaaaggaauuauug

SEQ ID NO: 1411345 - RNA, 19 nt, Homo sapiens
caacagaucauuagaagac

SEQ ID NO: 1411346 - RNA, 19 nt, Homo sapiens
guacugaagcucgaaauga

SEQ ID NO: 1411347 - RNA, 19 nt, Homo sapiens
gucaagaggucagcuuaaa

SEQ ID NO: 1411348 - RNA, 19 nt, Homo sapiens
gaacuaacaacagucaaga

SEQ ID NO: 1411349 - RNA, 19 nt, Homo sapiens
ugagguagcuacgugauua

SEQ ID NO: 1411350 - RNA, 19 nt, Homo sapiens
aaucagaccuguagccauu

SEQ ID NO: 1411351 - RNA, 19 nt, Homo sapiens
guagcuacgugauuaaaug

SEQ ID NO: 1411352 - RNA, 19 nt, Homo sapiens
ccagacaccuuugacgaua

SEQ ID NO: 1411353 - RNA, 19 nt, Homo sapiens
ucaaggcccugcauuucua

SEQ ID NO: 1411354 - RNA, 19 nt, Homo sapiens
cagaggagauggaggagaa

SEQ ID NO: 1411355 - RNA, 19 nt, Homo sapiens
gcuacgugauuaaauggua

SEQ ID NO: 1411356 - RNA, 19 nt, Homo sapiens
gaacgggugaccuucauau

SEQ ID NO: 1411357 - RNA, 19 nt, Homo sapiens
gugacucucuggagcuaua

SEQ ID NO: 1411358 - RNA, 19 nt, Homo sapiens
gcccacagauuugguaaug

SEQ ID NO: 1411359 - RNA, 19 nt, Homo sapiens
guacugaggcagccacuug

SEQ ID NO: 1411360 - RNA, 19 nt, Homo sapiens
ugagggaacucugcuaugu

SEQ ID NO: 1411361 - RNA, 19 nt, Homo sapiens
guggagacauggaguuuua

SEQ ID NO: 1411362 - RNA, 19 nt, Homo sapiens
gugauuaaaugguauugca

SEQ ID NO: 1411363 - RNA, 19 nt, Homo sapiens
gcuauaaucagaccuguag

SEQ ID NO: 1411364 - RNA, 19 nt, Homo sapiens
gggcagccuucgcuuugaa

SEQ ID NO: 1411365 - RNA, 19 nt, Homo sapiens
gccacccucuucucucuaa

SEQ ID NO: 1411366 - RNA, 19 nt, Homo sapiens
agggaacucugcuauguga

SEQ ID NO: 1411367 - RNA, 19 nt, Homo sapiens
ggaacucugcuaugugaug

SEQ ID NO: 1411368 - RNA, 19 nt, Homo sapiens
ggacaagcaaggaaaguac

SEQ ID NO: 1411369 - RNA, 19 nt, Homo sapiens
gagacaggguccagaucug

SEQ ID NO: 1411370 - RNA, 19 nt, Homo sapiens
gggacaagcaaggaaagua

SEQ ID NO: 1411371 - RNA, 19 nt, Homo sapiens
ggaacgggugaccuucaua

SEQ ID NO: 1411372 - RNA, 19 nt, Homo sapiens
cagauucucucaggaugga

SEQ ID NO: 1411373 - RNA, 19 nt, Homo sapiens
caaagcccagaauggaaua

SEQ ID NO: 1411374 - RNA, 19 nt, Homo sapiens
ugaggcagccacuugauug

SEQ ID NO: 1411375 - RNA, 19 nt, Homo sapiens
gggaacgggugaccuucau

SEQ ID NO: 1411376 - RNA, 19 nt, Homo sapiens
ggagacaggguccagaucu

SEQ ID NO: 1411377 - RNA, 19 nt, Homo sapiens
gagaagcaagaacaugguu

SEQ ID NO: 1411378 - RNA, 19 nt, Homo sapiens
ccagcagccuugagaagca

SEQ ID NO: 1411379 - RNA, 19 nt, Homo sapiens
ccucuucucucuaacaacu

SEQ ID NO: 1411380 - RNA, 19 nt, Homo sapiens
ucaaagcccagaauggaau

SEQ ID NO: 1411381 - RNA, 19 nt, Homo sapiens
cuacgugauuaaaugguau

SEQ ID NO: 1411382 - RNA, 19 nt, Homo sapiens
gagguagcuacgugauuaa

SEQ ID NO: 1411383 - RNA, 19 nt, Homo sapiens
ugaacgguguugcaaugug

SEQ ID NO: 1411384 - RNA, 19 nt, Homo sapiens
gcaguguggagacauggaa

SEQ ID NO: 1411385 - RNA, 19 nt, Homo sapiens
gaggcagccacuugauuga

SEQ ID NO: 1411386 - RNA, 19 nt, Homo sapiens
caucgaacaccuuguacug

SEQ ID NO: 1411387 - RNA, 19 nt, Homo sapiens
gcuggcggcuuugaugauc

SEQ ID NO: 1411388 - RNA, 19 nt, Homo sapiens
gcugagggaacucugcuau

SEQ ID NO: 1411389 - RNA, 19 nt, Homo sapiens
gacuggaggcucugaggaa

SEQ ID NO: 1411390 - RNA, 19 nt, Homo sapiens
acucaucgaacaccuugua

SEQ ID NO: 1411391 - RNA, 19 nt, Homo sapiens
gugggcagccuucgcuuug

SEQ ID NO: 1411392 - RNA, 19 nt, Homo sapiens
cuucaaagcccagaaugga

SEQ ID NO: 1411393 - RNA, 19 nt, Homo sapiens
gagggaacucugcuaugug

SEQ ID NO: 1411394 - RNA, 19 nt, Homo sapiens
gcgcuggcggcuuugauga

SEQ ID NO: 1411395 - RNA, 19 nt, Homo sapiens
ugaggcacuuucccuucaa

SEQ ID NO: 1411396 - RNA, 19 nt, Homo sapiens
uacaccaacucaucgaaca

SEQ ID NO: 1411397 - RNA, 19 nt, Homo sapiens
ggcagccacuugauugaac

SEQ ID NO: 1411398 - RNA, 19 nt, Homo sapiens
caagcaaggaaaguacuga

SEQ ID NO: 1411399 - RNA, 19 nt, Homo sapiens
cgggugaccuucauaugac

SEQ ID NO: 1411400 - RNA, 19 nt, Homo sapiens
cccgggagcucuacaugag

SEQ ID NO: 1411401 - RNA, 19 nt, Homo sapiens
gguagcuacgugauuaaau

SEQ ID NO: 1411402 - RNA, 19 nt, Homo sapiens
acgggugaccuucauauga

SEQ ID NO: 1411403 - RNA, 19 nt, Homo sapiens
cagcagccuugagaagcaa

SEQ ID NO: 1411404 - RNA, 19 nt, Homo sapiens
gguaaugccacccucuucu

SEQ ID NO: 1411405 - RNA, 19 nt, Homo sapiens
ggacuuccugggacaagca

SEQ ID NO: 1411406 - RNA, 19 nt, Homo sapiens
gaggcacuuucccuucaag

SEQ ID NO: 1411407 - RNA, 19 nt, Homo sapiens
guauugcaguguggagaca

SEQ ID NO: 1411408 - RNA, 19 nt, Homo sapiens
ccucucaggcggagccaaa

SEQ ID NO: 1411409 - RNA, 19 nt, Homo sapiens
cagcaacgcuuucaagaca

SEQ ID NO: 1411410 - RNA, 19 nt, Homo sapiens
gcagguguauccaggaguu

SEQ ID NO: 1411411 - RNA, 19 nt, Homo sapiens
uacaggagguggugaacua

SEQ ID NO: 1411412 - RNA, 19 nt, Homo sapiens
gagcggacgugaaccaaag

SEQ ID NO: 1411413 - RNA, 19 nt, Homo sapiens
cggaaugucugcagagguu

SEQ ID NO: 1411414 - RNA, 19 nt, Homo sapiens
gaucgacucugcgguggaa

SEQ ID NO: 1411415 - RNA, 19 nt, Homo sapiens
ugcuaaagcugauguguga

SEQ ID NO: 1411416 - RNA, 19 nt, Homo sapiens
gcaacgcuuucaagacaug

SEQ ID NO: 1411417 - RNA, 19 nt, Homo sapiens
acaaauacguggaaaagaa

SEQ ID NO: 1411418 - RNA, 19 nt, Homo sapiens
gcuccuugaucgucuguga

SEQ ID NO: 1411419 - RNA, 19 nt, Homo sapiens
gcuggagggugcagaagug

SEQ ID NO: 1411420 - RNA, 19 nt, Homo sapiens
gcgagagcccugacaguug

SEQ ID NO: 1411421 - RNA, 19 nt, Homo sapiens
ggacuucuccuacgaugag

SEQ ID NO: 1411422 - RNA, 19 nt, Homo sapiens
ccaagaagaaguuugagau

SEQ ID NO: 1411423 - RNA, 19 nt, Homo sapiens
uggacucgcucuucuccua

SEQ ID NO: 1411424 - RNA, 19 nt, Homo sapiens
ggaaguucaaggagacaaa

SEQ ID NO: 1411425 - RNA, 19 nt, Homo sapiens
gugcugcucugcauugagu

SEQ ID NO: 1411426 - RNA, 19 nt, Homo sapiens
gcgcauggcggaggaaaug

SEQ ID NO: 1411427 - RNA, 19 nt, Homo sapiens
ucuaugaggcccaguguga

SEQ ID NO: 1411428 - RNA, 19 nt, Homo sapiens
caagaagaaguuugagauc

SEQ ID NO: 1411429 - RNA, 19 nt, Homo sapiens
agaagcaguuugacaaggu

SEQ ID NO: 1411430 - RNA, 19 nt, Homo sapiens
ggagacaaagaagcaguuu

SEQ ID NO: 1411431 - RNA, 19 nt, Homo sapiens
aagaggaugugcggaaguu

SEQ ID NO: 1411432 - RNA, 19 nt, Homo sapiens
ucaaggagacaaagaagca

SEQ ID NO: 1411433 - RNA, 19 nt, Homo sapiens
ggagcggacgugaaccaaa

SEQ ID NO: 1411434 - RNA, 19 nt, Homo sapiens
cacccuggaucguaaguuc

SEQ ID NO: 1411435 - RNA, 19 nt, Homo sapiens
caaggacaaauacguggaa

SEQ ID NO: 1411436 - RNA, 19 nt, Homo sapiens
aaacggagcggacgugaac

SEQ ID NO: 1411437 - RNA, 19 nt, Homo sapiens
gaggaugugcggaaguuca

SEQ ID NO: 1411438 - RNA, 19 nt, Homo sapiens
gcugaugugugagcuugga

SEQ ID NO: 1411439 - RNA, 19 nt, Homo sapiens
acuaugugcuccagaucaa

SEQ ID NO: 1411440 - RNA, 19 nt, Homo sapiens
gacgugaaccaaagagaca

SEQ ID NO: 1411441 - RNA, 19 nt, Homo sapiens
caaggaggccuggaucaag

SEQ ID NO: 1411442 - RNA, 19 nt, Homo sapiens
gccaagaagaaguuugaga

SEQ ID NO: 1411443 - RNA, 19 nt, Homo sapiens
ggugaacuaccacaugauc

SEQ ID NO: 1411444 - RNA, 19 nt, Homo sapiens
cugcagagguucgcugaca

SEQ ID NO: 1411445 - RNA, 19 nt, Homo sapiens
ugggcacccuggaucguaa

SEQ ID NO: 1411446 - RNA, 19 nt, Homo sapiens
gugggagccugagcugcua

SEQ ID NO: 1411447 - RNA, 19 nt, Homo sapiens
agaagaaguuugagauccu

SEQ ID NO: 1411448 - RNA, 19 nt, Homo sapiens
ggacaaauacguggaaaag

SEQ ID NO: 1411449 - RNA, 19 nt, Homo sapiens
gacaaggaggccuggauca

SEQ ID NO: 1411450 - RNA, 19 nt, Homo sapiens
gaucuaugaggcccagugu

SEQ ID NO: 1411451 - RNA, 19 nt, Homo sapiens
gcgcugugaaucagaucua

SEQ ID NO: 1411452 - RNA, 19 nt, Homo sapiens
gccagcaacgcuuucaaga

SEQ ID NO: 1411453 - RNA, 19 nt, Homo sapiens
uugagauccuggacucuau

SEQ ID NO: 1411454 - RNA, 19 nt, Homo sapiens
gaagccgugugaggacauc

SEQ ID NO: 1411455 - RNA, 19 nt, Homo sapiens
gcucugugaagccguguga

SEQ ID NO: 1411456 - RNA, 19 nt, Homo sapiens
agcgugagauggagcgaaa

SEQ ID NO: 1411457 - RNA, 19 nt, Homo sapiens
gaaguucaaggagacaaag

SEQ ID NO: 1411458 - RNA, 19 nt, Homo sapiens
cugugaaucagaucuauga

SEQ ID NO: 1411459 - RNA, 19 nt, Homo sapiens
ugugugagcuuggaaacag

SEQ ID NO: 1411460 - RNA, 19 nt, Homo sapiens
ggacuaugugcuccagauc

SEQ ID NO: 1411461 - RNA, 19 nt, Homo sapiens
ccgagacucccucuucugu

SEQ ID NO: 1411462 - RNA, 19 nt, Homo sapiens
gacuaugugcuccagauca

SEQ ID NO: 1411463 - RNA, 19 nt, Homo sapiens
ccaccuggcacuggacuau

SEQ ID NO: 1411464 - RNA, 19 nt, Homo sapiens
ggaucaaggacaaauacgu

SEQ ID NO: 1411465 - RNA, 19 nt, Homo sapiens
gcgugcugcucugcauuga

SEQ ID NO: 1411466 - RNA, 19 nt, Homo sapiens
aaagaagcaguuugacaag

SEQ ID NO: 1411467 - RNA, 19 nt, Homo sapiens
gcaagaagcuuuaaauuga

SEQ ID NO: 1411468 - RNA, 19 nt, Homo sapiens
gaacccgacuguaguauua

SEQ ID NO: 1411469 - RNA, 19 nt, Homo sapiens
gcagaaaucucaaacugua

SEQ ID NO: 1411470 - RNA, 19 nt, Homo sapiens
gaccagaacuugucaauga

SEQ ID NO: 1411471 - RNA, 19 nt, Homo sapiens
gaacagcuguauagcauuu

SEQ ID NO: 1411472 - RNA, 19 nt, Homo sapiens
gcaaauuugucuaugcuua

SEQ ID NO: 1411473 - RNA, 19 nt, Homo sapiens
gaauucaucuuccaucuuu

SEQ ID NO: 1411474 - RNA, 19 nt, Homo sapiens
gcauagaacuuuccaauuc

SEQ ID NO: 1411475 - RNA, 19 nt, Homo sapiens
gaagaaugcuuucagaguu

SEQ ID NO: 1411476 - RNA, 19 nt, Homo sapiens
gauggaagcagaagaauua

SEQ ID NO: 1411477 - RNA, 19 nt, Homo sapiens
ggacucugaucauaaguua

SEQ ID NO: 1411478 - RNA, 19 nt, Homo sapiens
guaaaugacuuguauguuc

SEQ ID NO: 1411479 - RNA, 19 nt, Homo sapiens
gaaggacugugcagcaaua

SEQ ID NO: 1411480 - RNA, 19 nt, Homo sapiens
gcacuagccacucuuauua

SEQ ID NO: 1411481 - RNA, 19 nt, Homo sapiens
cuaaggagcucuacccaua

SEQ ID NO: 1411482 - RNA, 19 nt, Homo sapiens
caaagaggacuucuauuua

SEQ ID NO: 1411483 - RNA, 19 nt, Homo sapiens
uaacucagcuuaguaauga

SEQ ID NO: 1411484 - RNA, 19 nt, Homo sapiens
gaggauacuuaaacaguua

SEQ ID NO: 1411485 - RNA, 19 nt, Homo sapiens
gagcuaagauucauucuag

SEQ ID NO: 1411486 - RNA, 19 nt, Homo sapiens
gaucauaaguuaccaucaa

SEQ ID NO: 1411487 - RNA, 19 nt, Homo sapiens
caggacaguuuaugaaaua

SEQ ID NO: 1411488 - RNA, 19 nt, Homo sapiens
gaaaccggauguucuagaa

SEQ ID NO: 1411489 - RNA, 19 nt, Homo sapiens
cauaagaauuugccuauug

SEQ ID NO: 1411490 - RNA, 19 nt, Homo sapiens
ugaaguagcugagaagauu

SEQ ID NO: 1411491 - RNA, 19 nt, Homo sapiens
gaagcgaucuauaaagaau

SEQ ID NO: 1411492 - RNA, 19 nt, Homo sapiens
gaaaccacuuguuaagaaa

SEQ ID NO: 1411493 - RNA, 19 nt, Homo sapiens
gaaggaaucuugaaaauca

SEQ ID NO: 1411494 - RNA, 19 nt, Homo sapiens
uaacagaagcugacuauga

SEQ ID NO: 1411495 - RNA, 19 nt, Homo sapiens
caagaaagcugggcaaagu

SEQ ID NO: 1411496 - RNA, 19 nt, Homo sapiens
gagaagauuugguucaaug

SEQ ID NO: 1411497 - RNA, 19 nt, Homo sapiens
gaacaacugucuccauuuu

SEQ ID NO: 1411498 - RNA, 19 nt, Homo sapiens
gagcagaaaucucaaacug

SEQ ID NO: 1411499 - RNA, 19 nt, Homo sapiens
ggagauagaaugcacuuaa

SEQ ID NO: 1411500 - RNA, 19 nt, Homo sapiens
gcuaagacaucgaccugua

SEQ ID NO: 1411501 - RNA, 19 nt, Homo sapiens
gaauuuggguucuuugaau

SEQ ID NO: 1411502 - RNA, 19 nt, Homo sapiens
guaagaagacauuggguua

SEQ ID NO: 1411503 - RNA, 19 nt, Homo sapiens
gaagacauuggguuacuua

SEQ ID NO: 1411504 - RNA, 19 nt, Homo sapiens
guucagaaaugcucagaaa

SEQ ID NO: 1411505 - RNA, 19 nt, Homo sapiens
gauaaacucucuccucaag

SEQ ID NO: 1411506 - RNA, 19 nt, Homo sapiens
gauaagcugucuccuccua

SEQ ID NO: 1411507 - RNA, 19 nt, Homo sapiens
ggaaaaguaucuagaguuu

SEQ ID NO: 1411508 - RNA, 19 nt, Homo sapiens
gacagacaaugcuaucuaa

SEQ ID NO: 1411509 - RNA, 19 nt, Homo sapiens
gcacaaggacgauaaacuu

SEQ ID NO: 1411510 - RNA, 19 nt, Homo sapiens
gaaacucucucugauuaug

SEQ ID NO: 1411511 - RNA, 19 nt, Homo sapiens
gguggaagauauuuggaua

SEQ ID NO: 1411512 - RNA, 19 nt, Homo sapiens
gcauuaauuuggagcagua

SEQ ID NO: 1411513 - RNA, 19 nt, Homo sapiens
ggaguuaaauguccugcaa

SEQ ID NO: 1411514 - RNA, 19 nt, Homo sapiens
cuaaagacauugaggaaga

SEQ ID NO: 1411515 - RNA, 19 nt, Homo sapiens
ggugauccuuugcauauaa

SEQ ID NO: 1411516 - RNA, 19 nt, Homo sapiens
acaaagaggacuucuauuu

SEQ ID NO: 1411517 - RNA, 19 nt, Homo sapiens
caucuuccaucuuuccuua

SEQ ID NO: 1411518 - RNA, 19 nt, Homo sapiens
guauauaugugacugaaug

SEQ ID NO: 1411519 - RNA, 19 nt, Homo sapiens
gguuuaggaugcaaauaua

SEQ ID NO: 1411520 - RNA, 19 nt, Homo sapiens
gaauuucucuaccauaaca

SEQ ID NO: 1411521 - RNA, 19 nt, Homo sapiens
uaaaugcacugaaaucaca

SEQ ID NO: 1411522 - RNA, 19 nt, Homo sapiens
agaaggagauguauucgaa

SEQ ID NO: 1411523 - RNA, 19 nt, Homo sapiens
ucaaaggcaucuaaaucua

SEQ ID NO: 1411524 - RNA, 19 nt, Homo sapiens
gauagacacugcuucugaa

SEQ ID NO: 1411525 - RNA, 19 nt, Homo sapiens
guaaagguguggucucuuc

SEQ ID NO: 1411526 - RNA, 19 nt, Homo sapiens
agaaaccacuuguuaagaa

SEQ ID NO: 1411527 - RNA, 19 nt, Homo sapiens
gaagaucaagucaaacaaa

SEQ ID NO: 1411528 - RNA, 19 nt, Homo sapiens
cauauuggaucucugcuuu

SEQ ID NO: 1411529 - RNA, 19 nt, Homo sapiens
ggaccgaacugugaaacaa

SEQ ID NO: 1411530 - RNA, 19 nt, Homo sapiens
ggaggauacuuaaacaguu

SEQ ID NO: 1411531 - RNA, 19 nt, Homo sapiens
agagguauguggaaauuaa

SEQ ID NO: 1411532 - RNA, 19 nt, Homo sapiens
gaaaugcucagaaaucaau

SEQ ID NO: 1411533 - RNA, 19 nt, Homo sapiens
gaugaagaauuacauaugg

SEQ ID NO: 1411534 - RNA, 19 nt, Homo sapiens
ucaaggagacaacaaauuu

SEQ ID NO: 1411535 - RNA, 19 nt, Homo sapiens
guagaagaaugcuuucaga

SEQ ID NO: 1411536 - RNA, 19 nt, Homo sapiens
gaauucuucuugaaacuug

SEQ ID NO: 1411537 - RNA, 19 nt, Homo sapiens
ucaaacaaauggacauaga

SEQ ID NO: 1411538 - RNA, 19 nt, Homo sapiens
aaacaagacuggauugaag

SEQ ID NO: 1411539 - RNA, 19 nt, Homo sapiens
gcaacaaacucuuuuauca

SEQ ID NO: 1411540 - RNA, 19 nt, Homo sapiens
aagaagcgaucuauaaaga

SEQ ID NO: 1411541 - RNA, 19 nt, Homo sapiens
gaaauggaacaaaugguuu

SEQ ID NO: 1411542 - RNA, 19 nt, Homo sapiens
ggaaauggaacaaaugguu

SEQ ID NO: 1411543 - RNA, 19 nt, Homo sapiens
gaagaacaacaaacagaaa

SEQ ID NO: 1411544 - RNA, 19 nt, Homo sapiens
caaagaagacuguggauca

SEQ ID NO: 1411545 - RNA, 19 nt, Homo sapiens
gcaggacaguuuaugaaau

SEQ ID NO: 1411546 - RNA, 19 nt, Homo sapiens
gaagugagcuaagauucau

SEQ ID NO: 1411547 - RNA, 19 nt, Homo sapiens
gugacugaauguaagauua

SEQ ID NO: 1411548 - RNA, 19 nt, Homo sapiens
ggucaacucuucuacaaag

SEQ ID NO: 1411549 - RNA, 19 nt, Homo sapiens
agagaugggugaaauuuga

SEQ ID NO: 1411550 - RNA, 19 nt, Homo sapiens
gccaacagauguaaauaau

SEQ ID NO: 1411551 - RNA, 19 nt, Homo sapiens
ggaaggaacccgacuguag

SEQ ID NO: 1411552 - RNA, 19 nt, Homo sapiens
gggacaaacuagugaagaa

SEQ ID NO: 1411553 - RNA, 19 nt, Homo sapiens
guacagaugguaaugcuuu

SEQ ID NO: 1411554 - RNA, 19 nt, Homo sapiens
ggugguagaugcuaugaau

SEQ ID NO: 1411555 - RNA, 19 nt, Homo sapiens
acaaugcuaucuaaccaua

SEQ ID NO: 1411556 - RNA, 19 nt, Homo sapiens
gaugacaaggaaagaauua

SEQ ID NO: 1411557 - RNA, 19 nt, Homo sapiens
cuacaggaguuucagcuuu

SEQ ID NO: 1411558 - RNA, 19 nt, Homo sapiens
gaaauaaucacucccuaca

SEQ ID NO: 1411559 - RNA, 19 nt, Homo sapiens
ucacacaguugaagaacaa

SEQ ID NO: 1411560 - RNA, 19 nt, Homo sapiens
guacagugaugugguggua

SEQ ID NO: 1411561 - RNA, 19 nt, Homo sapiens
caaagaagaaccauccaaa

SEQ ID NO: 1411562 - RNA, 19 nt, Homo sapiens
uacaggaguuucagcuuua

SEQ ID NO: 1411563 - RNA, 19 nt, Homo sapiens
gaagcaaggaguuaaaugu

SEQ ID NO: 1411564 - RNA, 19 nt, Homo sapiens
gaaagggaaguaaauugaa

SEQ ID NO: 1411565 - RNA, 19 nt, Homo sapiens
gaagcugacuaugauuuga

SEQ ID NO: 1411566 - RNA, 19 nt, Homo sapiens
ugaaacaucucaagcucaa

SEQ ID NO: 1411567 - RNA, 19 nt, Homo sapiens
gcaagaagcuuuaaauuga

SEQ ID NO: 1411568 - RNA, 19 nt, Homo sapiens
gaacccgacuguaguauua

SEQ ID NO: 1411569 - RNA, 19 nt, Homo sapiens
gcagaaaucucaaacugua

SEQ ID NO: 1411570 - RNA, 19 nt, Homo sapiens
gaccagaacuugucaauga

SEQ ID NO: 1411571 - RNA, 19 nt, Homo sapiens
gaacagcuguauagcauuu

SEQ ID NO: 1411572 - RNA, 19 nt, Homo sapiens
gcaaauuugucuaugcuua

SEQ ID NO: 1411573 - RNA, 19 nt, Homo sapiens
gauggaagcagaagaauua

SEQ ID NO: 1411574 - RNA, 19 nt, Homo sapiens
ggucuuggguuguaauuua

SEQ ID NO: 1411575 - RNA, 19 nt, Homo sapiens
ggacucugaucauaaguua

SEQ ID NO: 1411576 - RNA, 19 nt, Homo sapiens
gcacuagccacucuuauua

SEQ ID NO: 1411577 - RNA, 19 nt, Homo sapiens
cuaaggagcucuacccaua

SEQ ID NO: 1411578 - RNA, 19 nt, Homo sapiens
caaagaggacuucuauuua

SEQ ID NO: 1411579 - RNA, 19 nt, Homo sapiens
gagcuaagauucauucuag

SEQ ID NO: 1411580 - RNA, 19 nt, Homo sapiens
gaucauaaguuaccaucaa

SEQ ID NO: 1411581 - RNA, 19 nt, Homo sapiens
caggacaguuuaugaaaua

SEQ ID NO: 1411582 - RNA, 19 nt, Homo sapiens
gaaaccggauguucuagaa

SEQ ID NO: 1411583 - RNA, 19 nt, Homo sapiens
cauaagaauuugccuauug

SEQ ID NO: 1411584 - RNA, 19 nt, Homo sapiens
gaaaccacuuguuaagaaa

SEQ ID NO: 1411585 - RNA, 19 nt, Homo sapiens
gaaggaaucuugaaaauca

SEQ ID NO: 1411586 - RNA, 19 nt, Homo sapiens
uaacagaagcugacuauga

SEQ ID NO: 1411587 - RNA, 19 nt, Homo sapiens
caagaaagcugggcaaagu

SEQ ID NO: 1411588 - RNA, 19 nt, Homo sapiens
gaacaacugucuccauuuu

SEQ ID NO: 1411589 - RNA, 19 nt, Homo sapiens
gagcagaaaucucaaacug

SEQ ID NO: 1411590 - RNA, 19 nt, Homo sapiens
ggagauagaaugcacuuaa

SEQ ID NO: 1411591 - RNA, 19 nt, Homo sapiens
guaagaagacauuggguua

SEQ ID NO: 1411592 - RNA, 19 nt, Homo sapiens
gaagacauuggguuacuua

SEQ ID NO: 1411593 - RNA, 19 nt, Homo sapiens
guucagaaaugcucagaaa

SEQ ID NO: 1411594 - RNA, 19 nt, Homo sapiens
ggaaaaguaucuagaguuu

SEQ ID NO: 1411595 - RNA, 19 nt, Homo sapiens
gacagacaaugcuaucuaa

SEQ ID NO: 1411596 - RNA, 19 nt, Homo sapiens
gcacaaggacgauaaacuu

SEQ ID NO: 1411597 - RNA, 19 nt, Homo sapiens
ggaguuaaauguccugcaa

SEQ ID NO: 1411598 - RNA, 19 nt, Homo sapiens
cuaaagacauugaggaaga

SEQ ID NO: 1411599 - RNA, 19 nt, Homo sapiens
ggugauccuuugcauauaa

SEQ ID NO: 1411600 - RNA, 19 nt, Homo sapiens
acaaagaggacuucuauuu

SEQ ID NO: 1411601 - RNA, 19 nt, Homo sapiens
guauauaugugacugaaug

SEQ ID NO: 1411602 - RNA, 19 nt, Homo sapiens
gguuuaggaugcaaauaua

SEQ ID NO: 1411603 - RNA, 19 nt, Homo sapiens
gaauuucucuaccauaaca

SEQ ID NO: 1411604 - RNA, 19 nt, Homo sapiens
guaaagguguggucucuuc

SEQ ID NO: 1411605 - RNA, 19 nt, Homo sapiens
agaaaccacuuguuaagaa

SEQ ID NO: 1411606 - RNA, 19 nt, Homo sapiens
gaagaucaagucaaacaaa

SEQ ID NO: 1411607 - RNA, 19 nt, Homo sapiens
cauauuggaucucugcuuu

SEQ ID NO: 1411608 - RNA, 19 nt, Homo sapiens
agagguauguggaaauuaa

SEQ ID NO: 1411609 - RNA, 19 nt, Homo sapiens
gaaaugcucagaaaucaau

SEQ ID NO: 1411610 - RNA, 19 nt, Homo sapiens
gaauucuucuugaaacuug

SEQ ID NO: 1411611 - RNA, 19 nt, Homo sapiens
ucaaacaaauggacauaga

SEQ ID NO: 1411612 - RNA, 19 nt, Homo sapiens
gcaggacaguuuaugaaau

SEQ ID NO: 1411613 - RNA, 19 nt, Homo sapiens
gaagugagcuaagauucau

SEQ ID NO: 1411614 - RNA, 19 nt, Homo sapiens
gugacugaauguaagauua

SEQ ID NO: 1411615 - RNA, 19 nt, Homo sapiens
ggucaacucuucuacaaag

SEQ ID NO: 1411616 - RNA, 19 nt, Homo sapiens
gccaacagauguaaauaau

SEQ ID NO: 1411617 - RNA, 19 nt, Homo sapiens
ggaaggaacccgacuguag

SEQ ID NO: 1411618 - RNA, 19 nt, Homo sapiens
gggacaaacuagugaagaa

SEQ ID NO: 1411619 - RNA, 19 nt, Homo sapiens
guacagaugguaaugcuuu

SEQ ID NO: 1411620 - RNA, 19 nt, Homo sapiens
ggugguagaugcuaugaau

SEQ ID NO: 1411621 - RNA, 19 nt, Homo sapiens
acaaugcuaucuaaccaua

SEQ ID NO: 1411622 - RNA, 19 nt, Homo sapiens
gaugacaaggaaagaauua

SEQ ID NO: 1411623 - RNA, 19 nt, Homo sapiens
uaucagacuuucacucauu

SEQ ID NO: 1411624 - RNA, 19 nt, Homo sapiens
guacagugaugugguggua

SEQ ID NO: 1411625 - RNA, 19 nt, Homo sapiens
caaagaagaaccauccaaa

SEQ ID NO: 1411626 - RNA, 19 nt, Homo sapiens
gaagcaaggaguuaaaugu

SEQ ID NO: 1411627 - RNA, 19 nt, Homo sapiens
gaaagggaaguaaauugaa

SEQ ID NO: 1411628 - RNA, 19 nt, Homo sapiens
auacagacuuuaucccaua

SEQ ID NO: 1411629 - RNA, 19 nt, Homo sapiens
gaagcugacuaugauuuga

SEQ ID NO: 1411630 - RNA, 19 nt, Homo sapiens
ugaaacaucucaagcucaa

SEQ ID NO: 1411631 - RNA, 19 nt, Homo sapiens
uggaauuucucuaccauaa

SEQ ID NO: 1411632 - RNA, 19 nt, Homo sapiens
ccuaagaaacuaucuguaa

SEQ ID NO: 1411633 - RNA, 19 nt, Homo sapiens
gcucagaaaucaaucacau

SEQ ID NO: 1411634 - RNA, 19 nt, Homo sapiens
cagaaaugcucagaaauca

SEQ ID NO: 1411635 - RNA, 19 nt, Homo sapiens
gauaagggcuaaugaugac

SEQ ID NO: 1411636 - RNA, 19 nt, Homo sapiens
aaagagguauguggaaauu

SEQ ID NO: 1411637 - RNA, 19 nt, Homo sapiens
uggauugucuggugaguuu

SEQ ID NO: 1411638 - RNA, 19 nt, Homo sapiens
ggaagaauacaauauaugg

SEQ ID NO: 1411639 - RNA, 19 nt, Homo sapiens
gaaauaacuggaagaauac

SEQ ID NO: 1411640 - RNA, 19 nt, Homo sapiens
ugauugcacugucauugua

SEQ ID NO: 1411641 - RNA, 19 nt, Homo sapiens
ugaaguauauguagaaagg

SEQ ID NO: 1411642 - RNA, 19 nt, Homo sapiens
ggagauuuguuaauugaag

SEQ ID NO: 1411643 - RNA, 19 nt, Homo sapiens
gaauguaauugaggaccua

SEQ ID NO: 1411644 - RNA, 19 nt, Homo sapiens
gugaagaagugaauguaau

SEQ ID NO: 1411645 - RNA, 19 nt, Homo sapiens
ucacaugaaugcccauaau

SEQ ID NO: 1411646 - RNA, 19 nt, Homo sapiens
gauagaaugcacuuaagaa

SEQ ID NO: 1411647 - RNA, 19 nt, Homo sapiens
aaugagaaaccacuuguua

SEQ ID NO: 1411648 - RNA, 19 nt, Homo sapiens
gcaagaaguucagggagau

SEQ ID NO: 1411649 - RNA, 19 nt, Homo sapiens
gagauaagggcuaaugaug

SEQ ID NO: 1411650 - RNA, 19 nt, Homo sapiens
gcacugucauuguaugcaa

SEQ ID NO: 1411651 - RNA, 19 nt, Homo sapiens
auaaaggccuaaagacauu

SEQ ID NO: 1411652 - RNA, 19 nt, Homo sapiens
gugaacagcuguauagcau

SEQ ID NO: 1411653 - RNA, 19 nt, Homo sapiens
gagauagaaugcacuuaag

SEQ ID NO: 1411654 - RNA, 19 nt, Homo sapiens
ggcaaagucugcaaaugga

SEQ ID NO: 1411655 - RNA, 19 nt, Homo sapiens
caagaacccuuccaaaaga

SEQ ID NO: 1411656 - RNA, 19 nt, Homo sapiens
gaugaccaguaucuuuauu

SEQ ID NO: 1411657 - RNA, 19 nt, Homo sapiens
gcuggagauuuguuaauug

SEQ ID NO: 1411658 - RNA, 19 nt, Homo sapiens
gaugaugcacugcuuacua

SEQ ID NO: 1411659 - RNA, 19 nt, Homo sapiens
uagcauuuguuacacagua

SEQ ID NO: 1411660 - RNA, 19 nt, Homo sapiens
cuucuaaacucucuucaga

SEQ ID NO: 1411661 - RNA, 19 nt, Homo sapiens
caaacuguacuguauugua

SEQ ID NO: 1411662 - RNA, 19 nt, Homo sapiens
guauuaacguguguaagaa

SEQ ID NO: 1411663 - RNA, 19 nt, Homo sapiens
cuuaaccgcugacacaauu

SEQ ID NO: 1411664 - RNA, 19 nt, Homo sapiens
ggacaaauccagcuugcau

SEQ ID NO: 1411665 - RNA, 19 nt, Homo sapiens
gggcccaucuuuaucuuug

SEQ ID NO: 1411666 - RNA, 19 nt, Homo sapiens
gaaucuuccuuuaaagcaa

SEQ ID NO: 1411667 - RNA, 19 nt, Homo sapiens
gagaaggaguggccuauua

SEQ ID NO: 1411668 - RNA, 19 nt, Homo sapiens
gcagggaucuuacaucuau

SEQ ID NO: 1411669 - RNA, 19 nt, Homo sapiens
gaucuuacaucuaucagaa

SEQ ID NO: 1411670 - RNA, 19 nt, Homo sapiens
gcagaaagcgggugcugua

SEQ ID NO: 1411671 - RNA, 19 nt, Homo sapiens
ggagaucacugccauugug

SEQ ID NO: 1411672 - RNA, 19 nt, Homo sapiens
acaagaaucuagaggagua

SEQ ID NO: 1411673 - RNA, 19 nt, Homo sapiens
gagaacggcuguaccuguu

SEQ ID NO: 1411674 - RNA, 19 nt, Homo sapiens
gaaaagcacuacucaguug

SEQ ID NO: 1411675 - RNA, 19 nt, Homo sapiens
cuucguggcuucaagaaua

SEQ ID NO: 1411676 - RNA, 19 nt, Homo sapiens
gaacggcuguaccuguuug

SEQ ID NO: 1411677 - RNA, 19 nt, Homo sapiens
gaccagaaguuugaaguga

SEQ ID NO: 1411678 - RNA, 19 nt, Homo sapiens
gaaagcgggugcuguagag

SEQ ID NO: 1411679 - RNA, 19 nt, Homo sapiens
gcaggaaccucucccaacu

SEQ ID NO: 1411680 - RNA, 19 nt, Homo sapiens
gaaccucucccaacucugu

SEQ ID NO: 1411681 - RNA, 19 nt, Homo sapiens
uuaagagucucaaagucua

SEQ ID NO: 1411682 - RNA, 19 nt, Homo sapiens
ggaguggccuauuaagagu

SEQ ID NO: 1411683 - RNA, 19 nt, Homo sapiens
acucagagcuagagaagga

SEQ ID NO: 1411684 - RNA, 19 nt, Homo sapiens
caguguaucuggaagagaa

SEQ ID NO: 1411685 - RNA, 19 nt, Homo sapiens
guccugagcuacuuugaga

SEQ ID NO: 1411686 - RNA, 19 nt, Homo sapiens
ggucaggagucacguguag

SEQ ID NO: 1411687 - RNA, 19 nt, Homo sapiens
caaccuggcaauuguguuu

SEQ ID NO: 1411688 - RNA, 19 nt, Homo sapiens
ugagcuacuuugagaauga

SEQ ID NO: 1411689 - RNA, 19 nt, Homo sapiens
gcacguggaugauguuucc

SEQ ID NO: 1411690 - RNA, 19 nt, Homo sapiens
acaaggacgcuuacucuaa

SEQ ID NO: 1411691 - RNA, 19 nt, Homo sapiens
gggugagacuggauacuga

SEQ ID NO: 1411692 - RNA, 19 nt, Homo sapiens
gcugagagcugcgcuuugg

SEQ ID NO: 1411693 - RNA, 19 nt, Homo sapiens
ccaacaaacuccagaacag

SEQ ID NO: 1411694 - RNA, 19 nt, Homo sapiens
guucagugcuucucagaca

SEQ ID NO: 1411695 - RNA, 19 nt, Homo sapiens
ggaacaaccggaccacaga

SEQ ID NO: 1411696 - RNA, 19 nt, Homo sapiens
ggacagaaacacuuaucga

SEQ ID NO: 1411697 - RNA, 19 nt, Homo sapiens
ggugugaucuguggcuuga

SEQ ID NO: 1411698 - RNA, 19 nt, Homo sapiens
gggcugggaucaacugcuu

SEQ ID NO: 1411699 - RNA, 19 nt, Homo sapiens
uggaagaccucauuaacca

SEQ ID NO: 1411700 - RNA, 19 nt, Homo sapiens
gggacaaagugcagcucua

SEQ ID NO: 1411701 - RNA, 19 nt, Homo sapiens
gcuggaggccucagagauu

SEQ ID NO: 1411702 - RNA, 19 nt, Homo sapiens
uaacaaggacgcuuacucu

SEQ ID NO: 1411703 - RNA, 19 nt, Homo sapiens
ucagggagaaggacuauug

SEQ ID NO: 1411704 - RNA, 19 nt, Homo sapiens
ggaagcagcgggaggagau

SEQ ID NO: 1411705 - RNA, 19 nt, Homo sapiens
aagugcagcucuacaagaa

SEQ ID NO: 1411706 - RNA, 19 nt, Homo sapiens
gggaggaccaccacccuuu

SEQ ID NO: 1411707 - RNA, 19 nt, Homo sapiens
ggagagaugggcauaaguc

SEQ ID NO: 1411708 - RNA, 19 nt, Homo sapiens
gaggagaucacugccauug

SEQ ID NO: 1411709 - RNA, 19 nt, Homo sapiens
gcgagcagcacguggauga

SEQ ID NO: 1411710 - RNA, 19 nt, Homo sapiens
gaagagccgcugcaacuac

SEQ ID NO: 1411711 - RNA, 19 nt, Homo sapiens
gcgaagagccgcugcaacu

SEQ ID NO: 1411712 - RNA, 19 nt, Homo sapiens
ggagcuccgugcugucuuc

SEQ ID NO: 1411713 - RNA, 19 nt, Homo sapiens
gcuuugagcacaccuuuga

SEQ ID NO: 1411714 - RNA, 19 nt, Homo sapiens
gugcagcucuacaagaauc

SEQ ID NO: 1411715 - RNA, 19 nt, Homo sapiens
gcagagacugagcagcaua

SEQ ID NO: 1411716 - RNA, 19 nt, Homo sapiens
gagcgaaggaggacacugu

SEQ ID NO: 1411717 - RNA, 19 nt, Homo sapiens
ccagaaguuugaagugauc

SEQ ID NO: 1411718 - RNA, 19 nt, Homo sapiens
agaaggaguggccuauuaa

SEQ ID NO: 1411719 - RNA, 19 nt, Homo sapiens
agacugagcagcauaucaa

SEQ ID NO: 1411720 - RNA, 19 nt, Homo sapiens
agaagaaggcagagacuga

SEQ ID NO: 1411721 - RNA, 19 nt, Homo sapiens
gacuucaucugcacagugu

SEQ ID NO: 1411722 - RNA, 19 nt, Homo sapiens
gggagugguucgcuaccuu

SEQ ID NO: 1411723 - RNA, 19 nt, Homo sapiens
gcacaguguaucuggaaga

SEQ ID NO: 1411724 - RNA, 19 nt, Homo sapiens
gaaggaggacacuguacau

SEQ ID NO: 1411725 - RNA, 19 nt, Homo sapiens
aggaagguguggacagaaa

SEQ ID NO: 1411726 - RNA, 19 nt, Homo sapiens
gaucaccugcgauacuuug

SEQ ID NO: 1411727 - RNA, 19 nt, Homo sapiens
ccgcagggaucuuacaucu

SEQ ID NO: 1411728 - RNA, 19 nt, Homo sapiens
ggagugguucgcuaccuuu

SEQ ID NO: 1411729 - RNA, 19 nt, Homo sapiens
agacagagaaacaugagaa

SEQ ID NO: 1411730 - RNA, 19 nt, Homo sapiens
gcaugccggugacuucauc

SEQ ID NO: 1411731 - RNA, 19 nt, Homo sapiens
cggagugucugucucuguu

SEQ ID NO: 1411732 - RNA, 19 nt, Homo sapiens
auacugaucaccugcgaua

SEQ ID NO: 1411733 - RNA, 19 nt, Homo sapiens
gggaugaggaagaggauga

SEQ ID NO: 1411734 - RNA, 19 nt, Homo sapiens
gaagagaagaaggcagaga

SEQ ID NO: 1411735 - RNA, 19 nt, Homo sapiens
aggaagagcucaggaagca

SEQ ID NO: 1411736 - RNA, 19 nt, Homo sapiens
gugcacaaccuggcaauug

SEQ ID NO: 1411737 - RNA, 19 nt, Homo sapiens
gagggcaucuaccgcaagu

SEQ ID NO: 1411738 - RNA, 19 nt, Homo sapiens
gagaaugagcgggcaguga

SEQ ID NO: 1411739 - RNA, 19 nt, Homo sapiens
cacaguggcuuccucuaca

SEQ ID NO: 1411740 - RNA, 19 nt, Homo sapiens
acaggaagguguggacaga

SEQ ID NO: 1411741 - RNA, 19 nt, Homo sapiens
acaguaacaaggacgcuua

SEQ ID NO: 1411742 - RNA, 19 nt, Homo sapiens
ggaccaccacccuuucaga

SEQ ID NO: 1411743 - RNA, 19 nt, Homo sapiens
ggucaaguguauugcuaag

SEQ ID NO: 1411744 - RNA, 19 nt, Homo sapiens
uuaucgagcucuucuuaca

SEQ ID NO: 1411745 - RNA, 19 nt, Homo sapiens
ccaacucuguccagguguu

SEQ ID NO: 1411746 - RNA, 19 nt, Homo sapiens
ucagccaccuguacugugu

SEQ ID NO: 1411747 - RNA, 19 nt, Homo sapiens
gagugucugucucuguuuc

SEQ ID NO: 1411748 - RNA, 19 nt, Homo sapiens
ggaaacagaacuaaaagug

SEQ ID NO: 1411749 - RNA, 19 nt, Homo sapiens
cagaugggcaggacuacaa

SEQ ID NO: 1411750 - RNA, 19 nt, Homo sapiens
agacagaugggcaggacua

SEQ ID NO: 1411751 - RNA, 19 nt, Homo sapiens
gcauuggcaucaccuucau

SEQ ID NO: 1411752 - RNA, 19 nt, Homo sapiens
ggacaaagugcagcucuac

SEQ ID NO: 1411753 - RNA, 19 nt, Homo sapiens
cacaaacaaccgaaccuuu

SEQ ID NO: 1411754 - RNA, 19 nt, Homo sapiens
uuacaucuaucagaaacga

SEQ ID NO: 1411755 - RNA, 19 nt, Homo sapiens
cagagaaacaugagaagca

SEQ ID NO: 1411756 - RNA, 19 nt, Homo sapiens
gcucaugagugggucaagu

SEQ ID NO: 1411757 - RNA, 19 nt, Homo sapiens
acaaagugcagcucuacaa

SEQ ID NO: 1411758 - RNA, 19 nt, Homo sapiens
gagagugggcagccauuuc

SEQ ID NO: 1411759 - RNA, 19 nt, Homo sapiens
uugaagugaucacaaacaa

SEQ ID NO: 1411760 - RNA, 19 nt, Homo sapiens
ggaccagaaguuugaagug

SEQ ID NO: 1411761 - RNA, 19 nt, Homo sapiens
ggagugugaggaaacagaa

SEQ ID NO: 1411762 - RNA, 19 nt, Homo sapiens
cccaauggcggauggcaua

SEQ ID NO: 1411763 - RNA, 19 nt, Homo sapiens
gaaggaguggccuauuaag

SEQ ID NO: 1411764 - RNA, 19 nt, Homo sapiens
gagcagcacguggaugaug

SEQ ID NO: 1411765 - RNA, 19 nt, Homo sapiens
gggcaucuaccgcaagugu

SEQ ID NO: 1411766 - RNA, 19 nt, Homo sapiens
gagggcugguucucucuca

SEQ ID NO: 1411767 - RNA, 19 nt, Homo sapiens
gagaaggaguggccuauua

SEQ ID NO: 1411768 - RNA, 19 nt, Homo sapiens
gcagggaucuuacaucuau

SEQ ID NO: 1411769 - RNA, 19 nt, Homo sapiens
ggacagauccacaguuaua

SEQ ID NO: 1411770 - RNA, 19 nt, Homo sapiens
gaucuuacaucuaucagaa

SEQ ID NO: 1411771 - RNA, 19 nt, Homo sapiens
gcagaaagcgggugcugua

SEQ ID NO: 1411772 - RNA, 19 nt, Homo sapiens
ggagaucacugccauugug

SEQ ID NO: 1411773 - RNA, 19 nt, Homo sapiens
acaagaaucuagaggagua

SEQ ID NO: 1411774 - RNA, 19 nt, Homo sapiens
gagaacggcuguaccuguu

SEQ ID NO: 1411775 - RNA, 19 nt, Homo sapiens
gaaaagcacuacucaguug

SEQ ID NO: 1411776 - RNA, 19 nt, Homo sapiens
cuucguggcuucaagaaua

SEQ ID NO: 1411777 - RNA, 19 nt, Homo sapiens
gaacggcuguaccuguuug

SEQ ID NO: 1411778 - RNA, 19 nt, Homo sapiens
gaccagaaguuugaaguga

SEQ ID NO: 1411779 - RNA, 19 nt, Homo sapiens
gaaagcgggugcuguagag

SEQ ID NO: 1411780 - RNA, 19 nt, Homo sapiens
ccagagugaugaccaagaa

SEQ ID NO: 1411781 - RNA, 19 nt, Homo sapiens
gcaggaaccucucccaacu

SEQ ID NO: 1411782 - RNA, 19 nt, Homo sapiens
gaaccucucccaacucugu

SEQ ID NO: 1411783 - RNA, 19 nt, Homo sapiens
uuaagagucucaaagucua

SEQ ID NO: 1411784 - RNA, 19 nt, Homo sapiens
agacauacacacacacaua

SEQ ID NO: 1411785 - RNA, 19 nt, Homo sapiens
ccacaguuauacacagaaa

SEQ ID NO: 1411786 - RNA, 19 nt, Homo sapiens
ggaguggccuauuaagagu

SEQ ID NO: 1411787 - RNA, 19 nt, Homo sapiens
acucagagcuagagaagga

SEQ ID NO: 1411788 - RNA, 19 nt, Homo sapiens
caguguaucuggaagagaa

SEQ ID NO: 1411789 - RNA, 19 nt, Homo sapiens
guccugagcuacuuugaga

SEQ ID NO: 1411790 - RNA, 19 nt, Homo sapiens
caaccuggcaauuguguuu

SEQ ID NO: 1411791 - RNA, 19 nt, Homo sapiens
ugagcuacuuugagaauga

SEQ ID NO: 1411792 - RNA, 19 nt, Homo sapiens
gcacguggaugauguuucc

SEQ ID NO: 1411793 - RNA, 19 nt, Homo sapiens
acaaggacgcuuacucuaa

SEQ ID NO: 1411794 - RNA, 19 nt, Homo sapiens
gggugagacuggauacuga

SEQ ID NO: 1411795 - RNA, 19 nt, Homo sapiens
gcugagagcugcgcuuugg

SEQ ID NO: 1411796 - RNA, 19 nt, Homo sapiens
ccaacaaacuccagaacag

SEQ ID NO: 1411797 - RNA, 19 nt, Homo sapiens
guucagugcuucucagaca

SEQ ID NO: 1411798 - RNA, 19 nt, Homo sapiens
ggaacaaccggaccacaga

SEQ ID NO: 1411799 - RNA, 19 nt, Homo sapiens
ggacagaaacacuuaucga

SEQ ID NO: 1411800 - RNA, 19 nt, Homo sapiens
agucauugcugccaucauu

SEQ ID NO: 1411801 - RNA, 19 nt, Homo sapiens
ucugaggccugcccacuaa

SEQ ID NO: 1411802 - RNA, 19 nt, Homo sapiens
gggcugggaucaacugcuu

SEQ ID NO: 1411803 - RNA, 19 nt, Homo sapiens
ucacaaacacuuaaagaca

SEQ ID NO: 1411804 - RNA, 19 nt, Homo sapiens
uggaagaccucauuaacca

SEQ ID NO: 1411805 - RNA, 19 nt, Homo sapiens
agagcugggugcagacaua

SEQ ID NO: 1411806 - RNA, 19 nt, Homo sapiens
gggacaaagugcagcucua

SEQ ID NO: 1411807 - RNA, 19 nt, Homo sapiens
cacaaacacuuaaagacau

SEQ ID NO: 1411808 - RNA, 19 nt, Homo sapiens
gcuggaggccucagagauu

SEQ ID NO: 1411809 - RNA, 19 nt, Homo sapiens
uaacaaggacgcuuacucu

SEQ ID NO: 1411810 - RNA, 19 nt, Homo sapiens
gcagguacacgacauucuu

SEQ ID NO: 1411811 - RNA, 19 nt, Homo sapiens
ucagggagaaggacuauug

SEQ ID NO: 1411812 - RNA, 19 nt, Homo sapiens
ggaagcagcgggaggagau

SEQ ID NO: 1411813 - RNA, 19 nt, Homo sapiens
aagugcagcucuacaagaa

SEQ ID NO: 1411814 - RNA, 19 nt, Homo sapiens
acacacacauacacacaga

SEQ ID NO: 1411815 - RNA, 19 nt, Homo sapiens
gggaggaccaccacccuuu

SEQ ID NO: 1411816 - RNA, 19 nt, Homo sapiens
ggagagaugggcauaaguc

SEQ ID NO: 1411817 - RNA, 19 nt, Homo sapiens
gaggagaucacugccauug

SEQ ID NO: 1411818 - RNA, 19 nt, Homo sapiens
gcgagcagcacguggauga

SEQ ID NO: 1411819 - RNA, 19 nt, Homo sapiens
gaagagccgcugcaacuac

SEQ ID NO: 1411820 - RNA, 19 nt, Homo sapiens
gcgaagagccgcugcaacu

SEQ ID NO: 1411821 - RNA, 19 nt, Homo sapiens
ggagcuccgugcugucuuc

SEQ ID NO: 1411822 - RNA, 19 nt, Homo sapiens
gcuuugagcacaccuuuga

SEQ ID NO: 1411823 - RNA, 19 nt, Homo sapiens
gugcagcucuacaagaauc

SEQ ID NO: 1411824 - RNA, 19 nt, Homo sapiens
gcagagacugagcagcaua

SEQ ID NO: 1411825 - RNA, 19 nt, Homo sapiens
gagcgaaggaggacacugu

SEQ ID NO: 1411826 - RNA, 19 nt, Homo sapiens
ccagaaguuugaagugauc

SEQ ID NO: 1411827 - RNA, 19 nt, Homo sapiens
agaaggaguggccuauuaa

SEQ ID NO: 1411828 - RNA, 19 nt, Homo sapiens
gugcagacauacacacaca

SEQ ID NO: 1411829 - RNA, 19 nt, Homo sapiens
cuaaggaggaggagucauu

SEQ ID NO: 1411830 - RNA, 19 nt, Homo sapiens
agacugagcagcauaucaa

SEQ ID NO: 1411831 - RNA, 19 nt, Homo sapiens
agaagaaggcagagacuga

SEQ ID NO: 1411832 - RNA, 19 nt, Homo sapiens
gacuucaucugcacagugu

SEQ ID NO: 1411833 - RNA, 19 nt, Homo sapiens
gggagugguucgcuaccuu

SEQ ID NO: 1411834 - RNA, 19 nt, Homo sapiens
gcacaguguaucuggaaga

SEQ ID NO: 1411835 - RNA, 19 nt, Homo sapiens
gaaggaggacacuguacau

SEQ ID NO: 1411836 - RNA, 19 nt, Homo sapiens
aggaagguguggacagaaa

SEQ ID NO: 1411837 - RNA, 19 nt, Homo sapiens
gaucaccugcgauacuuug

SEQ ID NO: 1411838 - RNA, 19 nt, Homo sapiens
ccgcagggaucuuacaucu

SEQ ID NO: 1411839 - RNA, 19 nt, Homo sapiens
ggagugguucgcuaccuuu

SEQ ID NO: 1411840 - RNA, 19 nt, Homo sapiens
agacagagaaacaugagaa

SEQ ID NO: 1411841 - RNA, 19 nt, Homo sapiens
gcaugccggugacuucauc

SEQ ID NO: 1411842 - RNA, 19 nt, Homo sapiens
auacugaucaccugcgaua

SEQ ID NO: 1411843 - RNA, 19 nt, Homo sapiens
gggaugaggaagaggauga

SEQ ID NO: 1411844 - RNA, 19 nt, Homo sapiens
gcacguagagaagugauuc

SEQ ID NO: 1411845 - RNA, 19 nt, Homo sapiens
cgaugacucugacuacgau

SEQ ID NO: 1411846 - RNA, 19 nt, Homo sapiens
gaagagaagaaggcagaga

SEQ ID NO: 1411847 - RNA, 19 nt, Homo sapiens
aggaagagcucaggaagca

SEQ ID NO: 1411848 - RNA, 19 nt, Homo sapiens
gugcacaaccuggcaauug

SEQ ID NO: 1411849 - RNA, 19 nt, Homo sapiens
gagggcaucuaccgcaagu

SEQ ID NO: 1411850 - RNA, 19 nt, Homo sapiens
gagaaugagcgggcaguga

SEQ ID NO: 1411851 - RNA, 19 nt, Homo sapiens
cacaguggcuuccucuaca

SEQ ID NO: 1411852 - RNA, 19 nt, Homo sapiens
acaggaagguguggacaga

SEQ ID NO: 1411853 - RNA, 19 nt, Homo sapiens
acaguaacaaggacgcuua

SEQ ID NO: 1411854 - RNA, 19 nt, Homo sapiens
ggaccaccacccuuucaga

SEQ ID NO: 1411855 - RNA, 19 nt, Homo sapiens
ggucaaguguauugcuaag

SEQ ID NO: 1411856 - RNA, 19 nt, Homo sapiens
uuaucgagcucuucuuaca

SEQ ID NO: 1411857 - RNA, 19 nt, Homo sapiens
ccaacucuguccagguguu

SEQ ID NO: 1411858 - RNA, 19 nt, Homo sapiens
ucagccaccuguacugugu

SEQ ID NO: 1411859 - RNA, 19 nt, Homo sapiens
cagaugggcaggacuacaa

SEQ ID NO: 1411860 - RNA, 19 nt, Homo sapiens
agacagaugggcaggacua

SEQ ID NO: 1411861 - RNA, 19 nt, Homo sapiens
gcauuggcaucaccuucau

SEQ ID NO: 1411862 - RNA, 19 nt, Homo sapiens
ggacaaagugcagcucuac

SEQ ID NO: 1411863 - RNA, 19 nt, Homo sapiens
cacaaacaaccgaaccuuu

SEQ ID NO: 1411864 - RNA, 19 nt, Homo sapiens
uuacaucuaucagaaacga

SEQ ID NO: 1411865 - RNA, 19 nt, Homo sapiens
aaacacacacgcacguaga

SEQ ID NO: 1411866 - RNA, 19 nt, Homo sapiens
cagagaaacaugagaagca

SEQ ID NO: 1411867 - RNA, 19 nt, Homo sapiens
aaacagagcuuccuacuaa

SEQ ID NO: 1411868 - RNA, 19 nt, Homo sapiens
gcaauuccuugaacaaaga

SEQ ID NO: 1411869 - RNA, 19 nt, Homo sapiens
ggucagacguggcacuuug

SEQ ID NO: 1411870 - RNA, 19 nt, Homo sapiens
gagaaacgaagcuuggaua

SEQ ID NO: 1411871 - RNA, 19 nt, Homo sapiens
gagaggcugugaucaauag

SEQ ID NO: 1411872 - RNA, 19 nt, Homo sapiens
aaacgaagcuuggauaguc

SEQ ID NO: 1411873 - RNA, 19 nt, Homo sapiens
gcaaaggaccagguaauug

SEQ ID NO: 1411874 - RNA, 19 nt, Homo sapiens
gaacaaagaauggaagaag

SEQ ID NO: 1411875 - RNA, 19 nt, Homo sapiens
guacaagaaagaaauguug

SEQ ID NO: 1411876 - RNA, 19 nt, Homo sapiens
gacaugagguggccaagca

SEQ ID NO: 1411877 - RNA, 19 nt, Homo sapiens
caugagcacuguccagaug

SEQ ID NO: 1411878 - RNA, 19 nt, Homo sapiens
guaauggcuuucuacucua

SEQ ID NO: 1411879 - RNA, 19 nt, Homo sapiens
ggccagaggugguuguuag

SEQ ID NO: 1411880 - RNA, 19 nt, Homo sapiens
agacacaucuggugcuaau

SEQ ID NO: 1411881 - RNA, 19 nt, Homo sapiens
agacagagagugagcagua

SEQ ID NO: 1411882 - RNA, 19 nt, Homo sapiens
ccagagggaggguuuagua

SEQ ID NO: 1411883 - RNA, 19 nt, Homo sapiens
gagggaggguuuaguacau

SEQ ID NO: 1411884 - RNA, 19 nt, Homo sapiens
ggacguggcuaccguucuc

SEQ ID NO: 1411885 - RNA, 19 nt, Homo sapiens
gcagaagucagacgacaug

SEQ ID NO: 1411886 - RNA, 19 nt, Homo sapiens
ggacagacgcacccacuca

SEQ ID NO: 1411887 - RNA, 19 nt, Homo sapiens
caaacagagcuuccuacua

SEQ ID NO: 1411888 - RNA, 19 nt, Homo sapiens
cguuguagcugcagugaga

SEQ ID NO: 1411889 - RNA, 19 nt, Homo sapiens
caaaggaccagguaauugg

SEQ ID NO: 1411890 - RNA, 19 nt, Homo sapiens
uauguaacccuguccagua

SEQ ID NO: 1411891 - RNA, 19 nt, Homo sapiens
agagugagcaguacaagaa

SEQ ID NO: 1411892 - RNA, 19 nt, Homo sapiens
uuaacgggcucgucaagga

SEQ ID NO: 1411893 - RNA, 19 nt, Homo sapiens
guaacccuguccaguaaug

SEQ ID NO: 1411894 - RNA, 19 nt, Homo sapiens
gaaguggcaauuccuugaa

SEQ ID NO: 1411895 - RNA, 19 nt, Homo sapiens
gcaauuaaagaggaaguga

SEQ ID NO: 1411896 - RNA, 19 nt, Homo sapiens
gcaguggugugaaucuucu

SEQ ID NO: 1411897 - RNA, 19 nt, Homo sapiens
gcugugaucuucgucuuca

SEQ ID NO: 1411898 - RNA, 19 nt, Homo sapiens
gcucucggguugugucugu

SEQ ID NO: 1411899 - RNA, 19 nt, Homo sapiens
cgguugcgcugguauaguu

SEQ ID NO: 1411900 - RNA, 19 nt, Homo sapiens
gauccuagccagucugcaa

SEQ ID NO: 1411901 - RNA, 19 nt, Homo sapiens
ggcaauuccuugaacaaag

SEQ ID NO: 1411902 - RNA, 19 nt, Homo sapiens
gaaacgcugcagcuacuau

SEQ ID NO: 1411903 - RNA, 19 nt, Homo sapiens
gagcaguacaagaaagaaa

SEQ ID NO: 1411904 - RNA, 19 nt, Homo sapiens
gagcgcgagucguggauuc

SEQ ID NO: 1411905 - RNA, 19 nt, Homo sapiens
caacaccauccaagacuga

SEQ ID NO: 1411906 - RNA, 19 nt, Homo sapiens
ucaaggacaugagcacugu

SEQ ID NO: 1411907 - RNA, 19 nt, Homo sapiens
ugaaagggaccgugaguag

SEQ ID NO: 1411908 - RNA, 19 nt, Homo sapiens
gaauggaagaagaaauaug

SEQ ID NO: 1411909 - RNA, 19 nt, Homo sapiens
acaaagaauggaagaagaa

SEQ ID NO: 1411910 - RNA, 19 nt, Homo sapiens
aacaaagaauggaagaaga

SEQ ID NO: 1411911 - RNA, 19 nt, Homo sapiens
gaagccagaccggaauuug

SEQ ID NO: 1411912 - RNA, 19 nt, Homo sapiens
caaccuaugggcucaaugu

SEQ ID NO: 1411913 - RNA, 19 nt, Homo sapiens
cgcaacugcugcuguggua

SEQ ID NO: 1411914 - RNA, 19 nt, Homo sapiens
caaagaauggaagaagaaa

SEQ ID NO: 1411915 - RNA, 19 nt, Homo sapiens
cgaaguggcaauuccuuga

SEQ ID NO: 1411916 - RNA, 19 nt, Homo sapiens
ugaagaagcagaggaggaa

SEQ ID NO: 1411917 - RNA, 19 nt, Homo sapiens
gaaacgaagcuuggauagu

SEQ ID NO: 1411918 - RNA, 19 nt, Homo sapiens
caauguggaucgggucuuc

SEQ ID NO: 1411919 - RNA, 19 nt, Homo sapiens
caagacaggaucagugcuu

SEQ ID NO: 1411920 - RNA, 19 nt, Homo sapiens
gcaguacaagaaagaaaug

SEQ ID NO: 1411921 - RNA, 19 nt, Homo sapiens
gaaagggaccgugaguagu

SEQ ID NO: 1411922 - RNA, 19 nt, Homo sapiens
gcgaacaacagucaaaguc

SEQ ID NO: 1411923 - RNA, 19 nt, Homo sapiens
ggaagaagaaauauguaac

SEQ ID NO: 1411924 - RNA, 19 nt, Homo sapiens
gcagugagagcagaaguca

SEQ ID NO: 1411925 - RNA, 19 nt, Homo sapiens
cgagaggcugugaucaaua

SEQ ID NO: 1411926 - RNA, 19 nt, Homo sapiens
caucgagagucagauccua

SEQ ID NO: 1411927 - RNA, 19 nt, Homo sapiens
ccagaggcaguucguugua

SEQ ID NO: 1411928 - RNA, 19 nt, Homo sapiens
gaaagaaauguugguggau

SEQ ID NO: 1411929 - RNA, 19 nt, Homo sapiens
gagcaggagcgggcuaaga

SEQ ID NO: 1411930 - RNA, 19 nt, Homo sapiens
aaagggaccgugaguagug

SEQ ID NO: 1411931 - RNA, 19 nt, Homo sapiens
guccaguaauggcuuucua

SEQ ID NO: 1411932 - RNA, 19 nt, Homo sapiens
gaagaagaaauauguaacc

SEQ ID NO: 1411933 - RNA, 19 nt, Homo sapiens
caucaaacagagcuuccua

SEQ ID NO: 1411934 - RNA, 19 nt, Homo sapiens
ucgagaggcugugaucaau

SEQ ID NO: 1411935 - RNA, 19 nt, Homo sapiens
gcagcuacuaugagacuug

SEQ ID NO: 1411936 - RNA, 19 nt, Homo sapiens
gagagugagcaguacaaga

SEQ ID NO: 1411937 - RNA, 19 nt, Homo sapiens
auguaacccuguccaguaa

SEQ ID NO: 1411938 - RNA, 19 nt, Homo sapiens
uccaggagguggcccagaa

SEQ ID NO: 1411939 - RNA, 19 nt, Homo sapiens
guugguggauggacagaca

SEQ ID NO: 1411940 - RNA, 19 nt, Homo sapiens
ucagugguuuccggucuuu

SEQ ID NO: 1411941 - RNA, 19 nt, Homo sapiens
ucccaacccuuuccgugaa

SEQ ID NO: 1411942 - RNA, 19 nt, Homo sapiens
caccagaucagacauccaa

SEQ ID NO: 1411943 - RNA, 19 nt, Homo sapiens
gaaucuucuucaacagcaa

SEQ ID NO: 1411944 - RNA, 19 nt, Homo sapiens
agccaggaauggacuuuga

SEQ ID NO: 1411945 - RNA, 19 nt, Homo sapiens
gcugugcgccgacauccuu

SEQ ID NO: 1411946 - RNA, 19 nt, Homo sapiens
guacgagcagcuacuguuc

SEQ ID NO: 1411947 - RNA, 19 nt, Homo sapiens
gguagugacuccgagaaac

SEQ ID NO: 1411948 - RNA, 19 nt, Homo sapiens
gaagaagcagaggaggaaa

SEQ ID NO: 1411949 - RNA, 19 nt, Homo sapiens
uggaggaugagaacaguuu

SEQ ID NO: 1411950 - RNA, 19 nt, Homo sapiens
uggagaagacagagaguga

SEQ ID NO: 1411951 - RNA, 19 nt, Homo sapiens
ugggcaggcugaagaggaa

SEQ ID NO: 1411952 - RNA, 19 nt, Homo sapiens
cagcauccaggccucauug

SEQ ID NO: 1411953 - RNA, 19 nt, Homo sapiens
acgauuacauccacaguac

SEQ ID NO: 1411954 - RNA, 19 nt, Homo sapiens
agugagagcagaagucaga

SEQ ID NO: 1411955 - RNA, 19 nt, Homo sapiens
cagaucagacauccaaaca

SEQ ID NO: 1411956 - RNA, 19 nt, Homo sapiens
ugagacuugugcaaccuau

SEQ ID NO: 1411957 - RNA, 19 nt, Homo sapiens
cagaggcaguucguuguag

SEQ ID NO: 1411958 - RNA, 19 nt, Homo sapiens
gccaaccgcgugugggaaa

SEQ ID NO: 1411959 - RNA, 19 nt, Homo sapiens
ugacggcuauuggcaacga

SEQ ID NO: 1411960 - RNA, 19 nt, Homo sapiens
agucugcaaugcugugaga

SEQ ID NO: 1411961 - RNA, 19 nt, Homo sapiens
uaauggcuuucuacucuac

SEQ ID NO: 1411962 - RNA, 19 nt, Homo sapiens
gagugagcaguacaagaaa

SEQ ID NO: 1411963 - RNA, 19 nt, Homo sapiens
gugaaagggaccgugagua

SEQ ID NO: 1411964 - RNA, 19 nt, Homo sapiens
ugugaucaauagccaggaa

SEQ ID NO: 1411965 - RNA, 19 nt, Homo sapiens
gcugcgaacaacagucaaa

SEQ ID NO: 1411966 - RNA, 19 nt, Homo sapiens
ggguagugacuccgagaaa

SEQ ID NO: 1411967 - RNA, 19 nt, Homo sapiens
gcaaaucguugaauaaaga

SEQ ID NO: 1411968 - RNA, 19 nt, Homo sapiens
gcacagaguuugucagguu

SEQ ID NO: 1411969 - RNA, 19 nt, Homo sapiens
gcaagucgcuaccuaauuc

SEQ ID NO: 1411970 - RNA, 19 nt, Homo sapiens
gguggacgcuguuauauuu

SEQ ID NO: 1411971 - RNA, 19 nt, Homo sapiens
ggagaauacuggcuucauu

SEQ ID NO: 1411972 - RNA, 19 nt, Homo sapiens
agaaagagauugucguuga

SEQ ID NO: 1411973 - RNA, 19 nt, Homo sapiens
ucaaaucaguuguagcuaa

SEQ ID NO: 1411974 - RNA, 19 nt, Homo sapiens
gagaauacuggcuucauua

SEQ ID NO: 1411975 - RNA, 19 nt, Homo sapiens
uuacacaucucacccaauu

SEQ ID NO: 1411976 - RNA, 19 nt, Homo sapiens
cgaggaagcucuccaacga

SEQ ID NO: 1411977 - RNA, 19 nt, Homo sapiens
ccacaaauucagcuaauaa

SEQ ID NO: 1411978 - RNA, 19 nt, Homo sapiens
ccaaggacaugagcaguuu

SEQ ID NO: 1411979 - RNA, 19 nt, Homo sapiens
gaaagagauugucguugau

SEQ ID NO: 1411980 - RNA, 19 nt, Homo sapiens
uaauggaggugggaguuua

SEQ ID NO: 1411981 - RNA, 19 nt, Homo sapiens
ucacugucaucauuuagua

SEQ ID NO: 1411982 - RNA, 19 nt, Homo sapiens
caaaucaguuguagcuaau

SEQ ID NO: 1411983 - RNA, 19 nt, Homo sapiens
ccgcauuacugcuguuuaa

SEQ ID NO: 1411984 - RNA, 19 nt, Homo sapiens
gauggugugugucaaauca

SEQ ID NO: 1411985 - RNA, 19 nt, Homo sapiens
gaaaagcacuagcaacuuc

SEQ ID NO: 1411986 - RNA, 19 nt, Homo sapiens
gaagguggcagguucaaga

SEQ ID NO: 1411987 - RNA, 19 nt, Homo sapiens
gaccuaucaucccaguuua

SEQ ID NO: 1411988 - RNA, 19 nt, Homo sapiens
ggaacgagcuagccaacag

SEQ ID NO: 1411989 - RNA, 19 nt, Homo sapiens
caaucgagcucaucaaggu

SEQ ID NO: 1411990 - RNA, 19 nt, Homo sapiens
gaagcgaaguggcaaaucg

SEQ ID NO: 1411991 - RNA, 19 nt, Homo sapiens
ccgagaagaaagcauauua

SEQ ID NO: 1411992 - RNA, 19 nt, Homo sapiens
gauuccaucucuucucuga

SEQ ID NO: 1411993 - RNA, 19 nt, Homo sapiens
ccaauggccuauccaagga

SEQ ID NO: 1411994 - RNA, 19 nt, Homo sapiens
cauauuagccgaggaggua

SEQ ID NO: 1411995 - RNA, 19 nt, Homo sapiens
ggacgaaaccaucgguaga

SEQ ID NO: 1411996 - RNA, 19 nt, Homo sapiens
gaacuugggagcccucaug

SEQ ID NO: 1411997 - RNA, 19 nt, Homo sapiens
cagcuuggaggaugaaaua

SEQ ID NO: 1411998 - RNA, 19 nt, Homo sapiens
gcuucuguguuauguauuu

SEQ ID NO: 1411999 - RNA, 19 nt, Homo sapiens
gccgagccaucccaauuaa

SEQ ID NO: 1412000 - RNA, 19 nt, Homo sapiens
ggagcccucucuaaauuca

SEQ ID NO: 1412001 - RNA, 19 nt, Homo sapiens
gaagaaaggccuggagagu

SEQ ID NO: 1412002 - RNA, 19 nt, Homo sapiens
caagaaagagauugucguu

SEQ ID NO: 1412003 - RNA, 19 nt, Homo sapiens
aauagaacgugauuaguca

SEQ ID NO: 1412004 - RNA, 19 nt, Homo sapiens
ggagauugaccuucugaga

SEQ ID NO: 1412005 - RNA, 19 nt, Homo sapiens
ggccgagccaucccaauua

SEQ ID NO: 1412006 - RNA, 19 nt, Homo sapiens
ccaaagagaggaaaucagu

SEQ ID NO: 1412007 - RNA, 19 nt, Homo sapiens
ccagacauguucuuucaag

SEQ ID NO: 1412008 - RNA, 19 nt, Homo sapiens
gaagcaagcacagaguuug

SEQ ID NO: 1412009 - RNA, 19 nt, Homo sapiens
ccucggcccuuugaugaua

SEQ ID NO: 1412010 - RNA, 19 nt, Homo sapiens
cugcagaaguggcuccuuu

SEQ ID NO: 1412011 - RNA, 19 nt, Homo sapiens
gagaaccacugugaaaguc

SEQ ID NO: 1412012 - RNA, 19 nt, Homo sapiens
ggacguugcccagaagauu

SEQ ID NO: 1412013 - RNA, 19 nt, Homo sapiens
gagcgagauuccucugguu

SEQ ID NO: 1412014 - RNA, 19 nt, Homo sapiens
gaauaacucagaaacucaa

SEQ ID NO: 1412015 - RNA, 19 nt, Homo sapiens
gacaugagcaguuuacaca

SEQ ID NO: 1412016 - RNA, 19 nt, Homo sapiens
caucccaguuuacaugauu

SEQ ID NO: 1412017 - RNA, 19 nt, Homo sapiens
ugaccuaucaucccaguuu

SEQ ID NO: 1412018 - RNA, 19 nt, Homo sapiens
aaacggaacacuuggauuc

SEQ ID NO: 1412019 - RNA, 19 nt, Homo sapiens
agagauauuugauguccuu

SEQ ID NO: 1412020 - RNA, 19 nt, Homo sapiens
uuggagcccucucuaaauu

SEQ ID NO: 1412021 - RNA, 19 nt, Homo sapiens
caacaucuacuccaucuac

SEQ ID NO: 1412022 - RNA, 19 nt, Homo sapiens
ggagcgacccagacaaaga

SEQ ID NO: 1412023 - RNA, 19 nt, Homo sapiens
ggaccacguugcccaaguc

SEQ ID NO: 1412024 - RNA, 19 nt, Homo sapiens
gggcaacuuuccuuaacug

SEQ ID NO: 1412025 - RNA, 19 nt, Homo sapiens
gcagaauguucaugguaag

SEQ ID NO: 1412026 - RNA, 19 nt, Homo sapiens
ugcagaauguucaugguaa

SEQ ID NO: 1412027 - RNA, 19 nt, Homo sapiens
guccggcacugcugaagaa

SEQ ID NO: 1412028 - RNA, 19 nt, Homo sapiens
acaauggcgugcugaccua

SEQ ID NO: 1412029 - RNA, 19 nt, Homo sapiens
cacaucagccagacaagua

SEQ ID NO: 1412030 - RNA, 19 nt, Homo sapiens
gauauuugauguccuuuug

SEQ ID NO: 1412031 - RNA, 19 nt, Homo sapiens
aagaauaacucagaaacuc

SEQ ID NO: 1412032 - RNA, 19 nt, Homo sapiens
gaaacaauaaccggaacaa

SEQ ID NO: 1412033 - RNA, 19 nt, Homo sapiens
uaaguuuccagaccguuua

SEQ ID NO: 1412034 - RNA, 19 nt, Homo sapiens
aaaggaaaccacaaauuca

SEQ ID NO: 1412035 - RNA, 19 nt, Homo sapiens
ggagcucgacggcauaaau

SEQ ID NO: 1412036 - RNA, 19 nt, Homo sapiens
caugagcaguuuacacauc

SEQ ID NO: 1412037 - RNA, 19 nt, Homo sapiens
gcuguuauauuugucuuca

SEQ ID NO: 1412038 - RNA, 19 nt, Homo sapiens
gaaaccacaaauucagcua

SEQ ID NO: 1412039 - RNA, 19 nt, Homo sapiens
ucuuagaagcaccauauua

SEQ ID NO: 1412040 - RNA, 19 nt, Homo sapiens
cggcacugcugaagaacaa

SEQ ID NO: 1412041 - RNA, 19 nt, Homo sapiens
ggcaaaucguugaauaaag

SEQ ID NO: 1412042 - RNA, 19 nt, Homo sapiens
gguggcagguucaagaaag

SEQ ID NO: 1412043 - RNA, 19 nt, Homo sapiens
ucccagacauguucuuuca

SEQ ID NO: 1412044 - RNA, 19 nt, Homo sapiens
cuuagaagcaccauauuau

SEQ ID NO: 1412045 - RNA, 19 nt, Homo sapiens
gauuagucaucgccgagaa

SEQ ID NO: 1412046 - RNA, 19 nt, Homo sapiens
aguggcaaaucguugaaua

SEQ ID NO: 1412047 - RNA, 19 nt, Homo sapiens
ucgaguauauuucguaaac

SEQ ID NO: 1412048 - RNA, 19 nt, Homo sapiens
cggcauaaaucagaagcaa

SEQ ID NO: 1412049 - RNA, 19 nt, Homo sapiens
gaauggacgcugagucgau

SEQ ID NO: 1412050 - RNA, 19 nt, Homo sapiens
cgaaguggcaaaucguuga

SEQ ID NO: 1412051 - RNA, 19 nt, Homo sapiens
ccgaguucuucccgcauua

SEQ ID NO: 1412052 - RNA, 19 nt, Homo sapiens
gaaauaugucacccugugu

SEQ ID NO: 1412053 - RNA, 19 nt, Homo sapiens
gcacgucaucgccaucgaa

SEQ ID NO: 1412054 - RNA, 19 nt, Homo sapiens
cauauuaucccagacaugu

SEQ ID NO: 1412055 - RNA, 19 nt, Homo sapiens
cacagaguuugucagguuu

SEQ ID NO: 1412056 - RNA, 19 nt, Homo sapiens
gcucaaagugggaauugug

SEQ ID NO: 1412057 - RNA, 19 nt, Homo sapiens
guggguggacgcuguuaua

SEQ ID NO: 1412058 - RNA, 19 nt, Homo sapiens
gccgaguucuucccgcauu

SEQ ID NO: 1412059 - RNA, 19 nt, Homo sapiens
cuaccaaacggaacacuug

SEQ ID NO: 1412060 - RNA, 19 nt, Homo sapiens
gggauccaccggaaucuug

SEQ ID NO: 1412061 - RNA, 19 nt, Homo sapiens
uaucaucccaguuuacaug

SEQ ID NO: 1412062 - RNA, 19 nt, Homo sapiens
gcggcugccugggcuuuaa

SEQ ID NO: 1412063 - RNA, 19 nt, Homo sapiens
gaaguggcaaaucguugaa

SEQ ID NO: 1412064 - RNA, 19 nt, Homo sapiens
gaacccaggaugccauaag

SEQ ID NO: 1412065 - RNA, 19 nt, Homo sapiens
caaaaggaaaccacaaauu

SEQ ID NO: 1412066 - RNA, 19 nt, Homo sapiens
acacaucucacccaauuca

SEQ ID NO: 1412067 - RNA, 19 nt, Homo sapiens
gcaagucccugaacaagga

SEQ ID NO: 1412068 - RNA, 19 nt, Homo sapiens
gcgcaucccugcacucuga

SEQ ID NO: 1412069 - RNA, 19 nt, Homo sapiens
ggacgaagccaaggaaauu

SEQ ID NO: 1412070 - RNA, 19 nt, Homo sapiens
ccaaagaggaggugaauga

SEQ ID NO: 1412071 - RNA, 19 nt, Homo sapiens
gaaccugggugcccugaug

SEQ ID NO: 1412072 - RNA, 19 nt, Homo sapiens
gcagaggagucguuugaau

SEQ ID NO: 1412073 - RNA, 19 nt, Homo sapiens
guaguggccuugcgaaaga

SEQ ID NO: 1412074 - RNA, 19 nt, Homo sapiens
acacagagauggagaagca

SEQ ID NO: 1412075 - RNA, 19 nt, Homo sapiens
gaacagacacagagaugga

SEQ ID NO: 1412076 - RNA, 19 nt, Homo sapiens
gcaagucacugcccaacuc

SEQ ID NO: 1412077 - RNA, 19 nt, Homo sapiens
ggagaaggaacgcuggaua

SEQ ID NO: 1412078 - RNA, 19 nt, Homo sapiens
ggacguggcccagaaggua

SEQ ID NO: 1412079 - RNA, 19 nt, Homo sapiens
gcccuaaggugccauugaa

SEQ ID NO: 1412080 - RNA, 19 nt, Homo sapiens
gcaaugcccucgccaacag

SEQ ID NO: 1412081 - RNA, 19 nt, Homo sapiens
ggaagaagcaccggaggaa

SEQ ID NO: 1412082 - RNA, 19 nt, Homo sapiens
agagagggaugagggauuu

SEQ ID NO: 1412083 - RNA, 19 nt, Homo sapiens
gagcugcaccguaguccua

SEQ ID NO: 1412084 - RNA, 19 nt, Homo sapiens
caacagagagccugccaau

SEQ ID NO: 1412085 - RNA, 19 nt, Homo sapiens
acaacgggcugcucaccua

SEQ ID NO: 1412086 - RNA, 19 nt, Homo sapiens
ugagucccauguaaacuuu

SEQ ID NO: 1412087 - RNA, 19 nt, Homo sapiens
ucacgcagcugcucaucug

SEQ ID NO: 1412088 - RNA, 19 nt, Homo sapiens
cgacugcgaugcacccaau

SEQ ID NO: 1412089 - RNA, 19 nt, Homo sapiens
ccaauaaaccagacugugu

SEQ ID NO: 1412090 - RNA, 19 nt, Homo sapiens
gaagaggacggcaccaagu

SEQ ID NO: 1412091 - RNA, 19 nt, Homo sapiens
ggagugugcagacaucuug

SEQ ID NO: 1412092 - RNA, 19 nt, Homo sapiens
cagaggagucguuugaauu

SEQ ID NO: 1412093 - RNA, 19 nt, Homo sapiens
acagagagccugccaaugg

SEQ ID NO: 1412094 - RNA, 19 nt, Homo sapiens
gaacaaggaguggaagaag

SEQ ID NO: 1412095 - RNA, 19 nt, Homo sapiens
gaggagucguuugaauuug

SEQ ID NO: 1412096 - RNA, 19 nt, Homo sapiens
agaggagucguuugaauuu

SEQ ID NO: 1412097 - RNA, 19 nt, Homo sapiens
gaagaagcaccggaggaaa

SEQ ID NO: 1412098 - RNA, 19 nt, Homo sapiens
gacgaagccaaggaaauua

SEQ ID NO: 1412099 - RNA, 19 nt, Homo sapiens
gaucugugagucccaugua

SEQ ID NO: 1412100 - RNA, 19 nt, Homo sapiens
ggccaaguaugaacagaag

SEQ ID NO: 1412101 - RNA, 19 nt, Homo sapiens
gcagugguguuuguguuca

SEQ ID NO: 1412102 - RNA, 19 nt, Homo sapiens
gcccugaugugcauugagu

SEQ ID NO: 1412103 - RNA, 19 nt, Homo sapiens
ggagucguuugaauuugug

SEQ ID NO: 1412104 - RNA, 19 nt, Homo sapiens
uccagacgguguacaacua

SEQ ID NO: 1412105 - RNA, 19 nt, Homo sapiens
gggccgugguggaagauga

SEQ ID NO: 1412106 - RNA, 19 nt, Homo sapiens
agaguuaccugcugcugau

SEQ ID NO: 1412107 - RNA, 19 nt, Homo sapiens
gggaacagacacagagaug

SEQ ID NO: 1412108 - RNA, 19 nt, Homo sapiens
gugcagacaucuugaucca

SEQ ID NO: 1412109 - RNA, 19 nt, Homo sapiens
gaaggagauugugguggau

SEQ ID NO: 1412110 - RNA, 19 nt, Homo sapiens
ugacuccacuggcauaugc

SEQ ID NO: 1412111 - RNA, 19 nt, Homo sapiens
gagaaggaacgcuggauac

SEQ ID NO: 1412112 - RNA, 19 nt, Homo sapiens
ccuauaaggcccaggaaga

SEQ ID NO: 1412113 - RNA, 19 nt, Homo sapiens
acaaggaguggaagaagaa

SEQ ID NO: 1412114 - RNA, 19 nt, Homo sapiens
ccaggagugugcagacauc

SEQ ID NO: 1412115 - RNA, 19 nt, Homo sapiens
aacaaggaguggaagaaga

SEQ ID NO: 1412116 - RNA, 19 nt, Homo sapiens
cgcaagcucuccacagauc

SEQ ID NO: 1412117 - RNA, 19 nt, Homo sapiens
gcggacggcucuacaucuc

SEQ ID NO: 1412118 - RNA, 19 nt, Homo sapiens
cagcgcuccugcuccguuu

SEQ ID NO: 1412119 - RNA, 19 nt, Homo sapiens
gaagcggugcaccuacuau

SEQ ID NO: 1412120 - RNA, 19 nt, Homo sapiens
cccgcaagcucuccacaga

SEQ ID NO: 1412121 - RNA, 19 nt, Homo sapiens
cgcagcugcucaucuggua

SEQ ID NO: 1412122 - RNA, 19 nt, Homo sapiens
uauuugaugugugugugua

SEQ ID NO: 1412123 - RNA, 19 nt, Homo sapiens
guccuagccuccuauaagg

SEQ ID NO: 1412124 - RNA, 19 nt, Homo sapiens
aagaugaccugcggcuguu

SEQ ID NO: 1412125 - RNA, 19 nt, Homo sapiens
gcugcuggcugucaugacu

SEQ ID NO: 1412126 - RNA, 19 nt, Homo sapiens
uguguaugaugagccaaua

SEQ ID NO: 1412127 - RNA, 19 nt, Homo sapiens
ggcaacagcuuuuguaucg

SEQ ID NO: 1412128 - RNA, 19 nt, Homo sapiens
ccuggaggaugaaaucagu

SEQ ID NO: 1412129 - RNA, 19 nt, Homo sapiens
uguaugaugagccaauaaa

SEQ ID NO: 1412130 - RNA, 19 nt, Homo sapiens
caauaucuacgccaucuac

SEQ ID NO: 1412131 - RNA, 19 nt, Homo sapiens
gagaggacgaagccaagga

SEQ ID NO: 1412132 - RNA, 19 nt, Homo sapiens
gguuuaagaaggagauugu

SEQ ID NO: 1412133 - RNA, 19 nt, Homo sapiens
aaagaggaggugaaugaga

SEQ ID NO: 1412134 - RNA, 19 nt, Homo sapiens
gcuggauacgggccaagua

SEQ ID NO: 1412135 - RNA, 19 nt, Homo sapiens
aggcagaggagucguuuga

SEQ ID NO: 1412136 - RNA, 19 nt, Homo sapiens
gugagucccauguaaacuu

SEQ ID NO: 1412137 - RNA, 19 nt, Homo sapiens
aggagucguuugaauuugu

SEQ ID NO: 1412138 - RNA, 19 nt, Homo sapiens
gagcuuaaagugggcauag

SEQ ID NO: 1412139 - RNA, 19 nt, Homo sapiens
uggaugcagugguguuugu

SEQ ID NO: 1412140 - RNA, 19 nt, Homo sapiens
ggacuccauggcccaaaga

SEQ ID NO: 1412141 - RNA, 19 nt, Homo sapiens
gggccaaguaugaacagaa

SEQ ID NO: 1412142 - RNA, 19 nt, Homo sapiens
gcuuaaagugggcauagug

SEQ ID NO: 1412143 - RNA, 19 nt, Homo sapiens
aggaguggaagaagaagua

SEQ ID NO: 1412144 - RNA, 19 nt, Homo sapiens
ugaacaaggaguggaagaa

SEQ ID NO: 1412145 - RNA, 19 nt, Homo sapiens
ccacacccauccgaaagca

SEQ ID NO: 1412146 - RNA, 19 nt, Homo sapiens
cgaccuacgggcucaaugu

SEQ ID NO: 1412147 - RNA, 19 nt, Homo sapiens
caaggagaguuggggauuu

SEQ ID NO: 1412148 - RNA, 19 nt, Homo sapiens
guaguccuagccuccuaua

SEQ ID NO: 1412149 - RNA, 19 nt, Homo sapiens
ccuggcacauggcuccaaa

SEQ ID NO: 1412150 - RNA, 19 nt, Homo sapiens
uggaagaagaaguauguga

SEQ ID NO: 1412151 - RNA, 19 nt, Homo sapiens
gcagcgccuucagcgacua

SEQ ID NO: 1412152 - RNA, 19 nt, Homo sapiens
caauguggagcgugucuuc

SEQ ID NO: 1412153 - RNA, 19 nt, Homo sapiens
gagagggaugagggauuua

SEQ ID NO: 1412154 - RNA, 19 nt, Homo sapiens
cagagagggaugagggauu

SEQ ID NO: 1412155 - RNA, 19 nt, Homo sapiens
gguaguggccuugcgaaag

SEQ ID NO: 1412156 - RNA, 19 nt, Homo sapiens
gcugauccgagaugaagga

SEQ ID NO: 1412157 - RNA, 19 nt, Homo sapiens
uccaggacguggcccagaa

SEQ ID NO: 1412158 - RNA, 19 nt, Homo sapiens
gaggacgaagccaaggaaa

SEQ ID NO: 1412159 - RNA, 19 nt, Homo sapiens
ccagugccauggccaacgu

SEQ ID NO: 1412160 - RNA, 19 nt, Homo sapiens
ccacugccaagcucagaug

SEQ ID NO: 1412161 - RNA, 19 nt, Homo sapiens
gagcugcuggcugucauga

SEQ ID NO: 1412162 - RNA, 19 nt, Homo sapiens
augauuacaugcagaacau

SEQ ID NO: 1412163 - RNA, 19 nt, Homo sapiens
uggaggaugaaaucaguuu

SEQ ID NO: 1412164 - RNA, 19 nt, Homo sapiens
cccaauaucuacgccaucu

SEQ ID NO: 1412165 - RNA, 19 nt, Homo sapiens
gaccuggaccgggagaaga

SEQ ID NO: 1412166 - RNA, 19 nt, Homo sapiens
gguggaugcagugguguuu

SEQ ID NO: 1412167 - RNA, 19 nt, Homo sapiens
gaauggagauauuuaggua

SEQ ID NO: 1412168 - RNA, 19 nt, Homo sapiens
aaggaaagcuuaucgguua

SEQ ID NO: 1412169 - RNA, 19 nt, Homo sapiens
gagaaucaccuuaaagaua

SEQ ID NO: 1412170 - RNA, 19 nt, Homo sapiens
gaagugcucuguguacuaa

SEQ ID NO: 1412171 - RNA, 19 nt, Homo sapiens
gaagucaucccuacacaua

SEQ ID NO: 1412172 - RNA, 19 nt, Homo sapiens
gaugacgacuugaaacuuu

SEQ ID NO: 1412173 - RNA, 19 nt, Homo sapiens
gggauaguguugauagaua

SEQ ID NO: 1412174 - RNA, 19 nt, Homo sapiens
uaacaaaccuacuuaagag

SEQ ID NO: 1412175 - RNA, 19 nt, Homo sapiens
gggacaacgugaaacaaua

SEQ ID NO: 1412176 - RNA, 19 nt, Homo sapiens
ucagauaccuccuuuagug

SEQ ID NO: 1412177 - RNA, 19 nt, Homo sapiens
ucaccgaauucauugauua

SEQ ID NO: 1412178 - RNA, 19 nt, Homo sapiens
gaaugauagugacugcuua

SEQ ID NO: 1412179 - RNA, 19 nt, Homo sapiens
gaagggagaaugauaguga

SEQ ID NO: 1412180 - RNA, 19 nt, Homo sapiens
ggauaguguugauagauaa

SEQ ID NO: 1412181 - RNA, 19 nt, Homo sapiens
gauauaugcuugguaauuc

SEQ ID NO: 1412182 - RNA, 19 nt, Homo sapiens
caaaccuacuuaagagaua

SEQ ID NO: 1412183 - RNA, 19 nt, Homo sapiens
cgucagaaauuugaucaua

SEQ ID NO: 1412184 - RNA, 19 nt, Homo sapiens
uauauaaccuuuccuaugg

SEQ ID NO: 1412185 - RNA, 19 nt, Homo sapiens
guaccuauuucuaccguuu

SEQ ID NO: 1412186 - RNA, 19 nt, Homo sapiens
cgaauucauugauuacuga

SEQ ID NO: 1412187 - RNA, 19 nt, Homo sapiens
caggaaauaugacuuggaa

SEQ ID NO: 1412188 - RNA, 19 nt, Homo sapiens
ccugagaaauuuaucacua

SEQ ID NO: 1412189 - RNA, 19 nt, Homo sapiens
caaagaagcuguuuuaacu

SEQ ID NO: 1412190 - RNA, 19 nt, Homo sapiens
agaauaguguaguagcuua

SEQ ID NO: 1412191 - RNA, 19 nt, Homo sapiens
ggauauaugcuugguaauu

SEQ ID NO: 1412192 - RNA, 19 nt, Homo sapiens
gaaauccugugccuggaau

SEQ ID NO: 1412193 - RNA, 19 nt, Homo sapiens
gaaaggaucaucacgaaac

SEQ ID NO: 1412194 - RNA, 19 nt, Homo sapiens
ucuaugcucuuaacauuga

SEQ ID NO: 1412195 - RNA, 19 nt, Homo sapiens
gauagugacugcuuaugag

SEQ ID NO: 1412196 - RNA, 19 nt, Homo sapiens
gugaaagucuaaauaaugg

SEQ ID NO: 1412197 - RNA, 19 nt, Homo sapiens
ucagugacaucauacauuc

SEQ ID NO: 1412198 - RNA, 19 nt, Homo sapiens
ggaucuguguauuugauuu

SEQ ID NO: 1412199 - RNA, 19 nt, Homo sapiens
guaaugacccauaucucua

SEQ ID NO: 1412200 - RNA, 19 nt, Homo sapiens
ucgauaguguuacugauaa

SEQ ID NO: 1412201 - RNA, 19 nt, Homo sapiens
ugucuaugcucuuaacauu

SEQ ID NO: 1412202 - RNA, 19 nt, Homo sapiens
gaagaauaguguaguagcu

SEQ ID NO: 1412203 - RNA, 19 nt, Homo sapiens
ggaagugcucuguguacua

SEQ ID NO: 1412204 - RNA, 19 nt, Homo sapiens
augaagagcugcagcaaga

SEQ ID NO: 1412205 - RNA, 19 nt, Homo sapiens
ggagcaggcacuaaugaaa

SEQ ID NO: 1412206 - RNA, 19 nt, Homo sapiens
gcugaaguguauaguguau

SEQ ID NO: 1412207 - RNA, 19 nt, Homo sapiens
gcuuaucgguuacgagaug

SEQ ID NO: 1412208 - RNA, 19 nt, Homo sapiens
gaaacuuuguucccacaca

SEQ ID NO: 1412209 - RNA, 19 nt, Homo sapiens
cacuauaacuccacaggaa

SEQ ID NO: 1412210 - RNA, 19 nt, Homo sapiens
ccugaagaauaguguagua

SEQ ID NO: 1412211 - RNA, 19 nt, Homo sapiens
agccauaccugaagaauag

SEQ ID NO: 1412212 - RNA, 19 nt, Homo sapiens
gagcaggcacuaaugaaau

SEQ ID NO: 1412213 - RNA, 19 nt, Homo sapiens
gauaacaaaccuacuuaag

SEQ ID NO: 1412214 - RNA, 19 nt, Homo sapiens
caggauaucuguguguuca

SEQ ID NO: 1412215 - RNA, 19 nt, Homo sapiens
gcaauggcgaccuuuguga

SEQ ID NO: 1412216 - RNA, 19 nt, Homo sapiens
uuggauauaugcuugguaa

SEQ ID NO: 1412217 - RNA, 19 nt, Homo sapiens
aagaggaguuugaccuuga

SEQ ID NO: 1412218 - RNA, 19 nt, Homo sapiens
gcaguuucuucgguuaauu

SEQ ID NO: 1412219 - RNA, 19 nt, Homo sapiens
ccacaggaaauaugacuug

SEQ ID NO: 1412220 - RNA, 19 nt, Homo sapiens
uguguucagugacaucaua

SEQ ID NO: 1412221 - RNA, 19 nt, Homo sapiens
ccuugaagcucauagacuu

SEQ ID NO: 1412222 - RNA, 19 nt, Homo sapiens
guaauucuccaguuucuag

SEQ ID NO: 1412223 - RNA, 19 nt, Homo sapiens
gugggacccucaccgaauu

SEQ ID NO: 1412224 - RNA, 19 nt, Homo sapiens
gugaacauguacgaucuuu

SEQ ID NO: 1412225 - RNA, 19 nt, Homo sapiens
ucaguugugucaagaagga

SEQ ID NO: 1412226 - RNA, 19 nt, Homo sapiens
uagauagguuugugaaagu

SEQ ID NO: 1412227 - RNA, 19 nt, Homo sapiens
uuagugaccaguucaaauu

SEQ ID NO: 1412228 - RNA, 19 nt, Homo sapiens
gguaaugacccauaucucu

SEQ ID NO: 1412229 - RNA, 19 nt, Homo sapiens
uugaaaggaucaucacgaa

SEQ ID NO: 1412230 - RNA, 19 nt, Homo sapiens
caaaggauccccaagauga

SEQ ID NO: 1412231 - RNA, 19 nt, Homo sapiens
gaauguauagauagguuug

SEQ ID NO: 1412232 - RNA, 19 nt, Homo sapiens
cuacuuaagagauauguug

SEQ ID NO: 1412233 - RNA, 19 nt, Homo sapiens
guugugaagccauuaauau

SEQ ID NO: 1412234 - RNA, 19 nt, Homo sapiens
gaucagcaaagaggaguuu

SEQ ID NO: 1412235 - RNA, 19 nt, Homo sapiens
ggagaaucaccuuaaagau

SEQ ID NO: 1412236 - RNA, 19 nt, Homo sapiens
uguuucagcuguugucuau

SEQ ID NO: 1412237 - RNA, 19 nt, Homo sapiens
ggacaacgugaaacaauac

SEQ ID NO: 1412238 - RNA, 19 nt, Homo sapiens
auacugggcuaaccuaaag

SEQ ID NO: 1412239 - RNA, 19 nt, Homo sapiens
gaaacucuggcauccaaau

SEQ ID NO: 1412240 - RNA, 19 nt, Homo sapiens
gagcaauggcgaccuuugu

SEQ ID NO: 1412241 - RNA, 19 nt, Homo sapiens
agacuucucacacaggaua

SEQ ID NO: 1412242 - RNA, 19 nt, Homo sapiens
ggauaucuguguguucagu

SEQ ID NO: 1412243 - RNA, 19 nt, Homo sapiens
gaaagcuuaucgguuacga

SEQ ID NO: 1412244 - RNA, 19 nt, Homo sapiens
cuugguaauucuccaguuu

SEQ ID NO: 1412245 - RNA, 19 nt, Homo sapiens
caguuucuucgguuaauua

SEQ ID NO: 1412246 - RNA, 19 nt, Homo sapiens
ggaauggagauauuuaggu

SEQ ID NO: 1412247 - RNA, 19 nt, Homo sapiens
gacccucaccgaauucauu

SEQ ID NO: 1412248 - RNA, 19 nt, Homo sapiens
gaagagcugcagcaagaca

SEQ ID NO: 1412249 - RNA, 19 nt, Homo sapiens
gcucuuaacauugaaagga

SEQ ID NO: 1412250 - RNA, 19 nt, Homo sapiens
guuacgagauggucauuuu

SEQ ID NO: 1412251 - RNA, 19 nt, Homo sapiens
ucuaugcuguggagaauca

SEQ ID NO: 1412252 - RNA, 19 nt, Homo sapiens
gagcaugggcuggacaaug

SEQ ID NO: 1412253 - RNA, 19 nt, Homo sapiens
gucagaaauuugaucauag

SEQ ID NO: 1412254 - RNA, 19 nt, Homo sapiens
acgaaacucuggcauccaa

SEQ ID NO: 1412255 - RNA, 19 nt, Homo sapiens
gcggagcaauggcgaccuu

SEQ ID NO: 1412256 - RNA, 19 nt, Homo sapiens
uggagaaucaccuuaaaga

SEQ ID NO: 1412257 - RNA, 19 nt, Homo sapiens
ugauagugacugcuuauga

SEQ ID NO: 1412258 - RNA, 19 nt, Homo sapiens
gcuugaagggagaaugaua

SEQ ID NO: 1412259 - RNA, 19 nt, Homo sapiens
auagauagguuugugaaag

SEQ ID NO: 1412260 - RNA, 19 nt, Homo sapiens
guauagauagguuugugaa

SEQ ID NO: 1412261 - RNA, 19 nt, Homo sapiens
aaaaucagauaccuccuuu

SEQ ID NO: 1412262 - RNA, 19 nt, Homo sapiens
gcauccaaaucaugaagag

SEQ ID NO: 1412263 - RNA, 19 nt, Homo sapiens
cagccauaccugaagaaua

SEQ ID NO: 1412264 - RNA, 19 nt, Homo sapiens
ugucaagaaggaaagcuua

SEQ ID NO: 1412265 - RNA, 19 nt, Homo sapiens
uaagggauaguguugauag

SEQ ID NO: 1412266 - RNA, 19 nt, Homo sapiens
ucucacgcguugucagauu

SEQ ID NO: 1412267 - RNA, 19 nt, Homo sapiens
gcagagcucuccaccauua

SEQ ID NO: 1412268 - RNA, 19 nt, Homo sapiens
ccaaagagguggcgaguga

SEQ ID NO: 1412269 - RNA, 19 nt, Homo sapiens
gcgcguaucauuccaguua

SEQ ID NO: 1412270 - RNA, 19 nt, Homo sapiens
caaagaagaagggcaauuu

SEQ ID NO: 1412271 - RNA, 19 nt, Homo sapiens
gagaauuuaucccacuauu

SEQ ID NO: 1412272 - RNA, 19 nt, Homo sapiens
aagagaagcugcuggaaga

SEQ ID NO: 1412273 - RNA, 19 nt, Homo sapiens
gaagaagggcaauuucaga

SEQ ID NO: 1412274 - RNA, 19 nt, Homo sapiens
cagcagagcucuccaccau

SEQ ID NO: 1412275 - RNA, 19 nt, Homo sapiens
uaacgcagauagguucuuu

SEQ ID NO: 1412276 - RNA, 19 nt, Homo sapiens
ggaacaauuuggacuucuu

SEQ ID NO: 1412277 - RNA, 19 nt, Homo sapiens
ugaagcggcucaucgagaa

SEQ ID NO: 1412278 - RNA, 19 nt, Homo sapiens
aagcuaaccuuccucauuc

SEQ ID NO: 1412279 - RNA, 19 nt, Homo sapiens
cagaucugcuggaaugauu

SEQ ID NO: 1412280 - RNA, 19 nt, Homo sapiens
gaagggacacucuaccaau

SEQ ID NO: 1412281 - RNA, 19 nt, Homo sapiens
caauuuggacuucuucauu

SEQ ID NO: 1412282 - RNA, 19 nt, Homo sapiens
ggugaggacuaccaugaug

SEQ ID NO: 1412283 - RNA, 19 nt, Homo sapiens
caggauaucuccaccaaac

SEQ ID NO: 1412284 - RNA, 19 nt, Homo sapiens
cagcgaggcuucccaccuu

SEQ ID NO: 1412285 - RNA, 19 nt, Homo sapiens
ccucauaauuuacaucauc

SEQ ID NO: 1412286 - RNA, 19 nt, Homo sapiens
acaauccgcucacguguca

SEQ ID NO: 1412287 - RNA, 19 nt, Homo sapiens
gacccaaucccuacaguga

SEQ ID NO: 1412288 - RNA, 19 nt, Homo sapiens
agacggcgcuguucaaagg

SEQ ID NO: 1412289 - RNA, 19 nt, Homo sapiens
aaagcuaaccuuccucauu

SEQ ID NO: 1412290 - RNA, 19 nt, Homo sapiens
gcacuucccaacucucuau

SEQ ID NO: 1412291 - RNA, 19 nt, Homo sapiens
ccagagcacuucccaacuc

SEQ ID NO: 1412292 - RNA, 19 nt, Homo sapiens
gcaaagaagaagggcaauu

SEQ ID NO: 1412293 - RNA, 19 nt, Homo sapiens
gaacaauuuggacuucuuc

SEQ ID NO: 1412294 - RNA, 19 nt, Homo sapiens
ccaacacagucauggauca

SEQ ID NO: 1412295 - RNA, 19 nt, Homo sapiens
caucauucccauccucaua

SEQ ID NO: 1412296 - RNA, 19 nt, Homo sapiens
ggaggacaccagauacaga

SEQ ID NO: 1412297 - RNA, 19 nt, Homo sapiens
uggaagcccugcucaagau

SEQ ID NO: 1412298 - RNA, 19 nt, Homo sapiens
ccaccaaacauucagaaga

SEQ ID NO: 1412299 - RNA, 19 nt, Homo sapiens
gugagaauuuaucccacua

SEQ ID NO: 1412300 - RNA, 19 nt, Homo sapiens
gaaugaggcagacaccaau

SEQ ID NO: 1412301 - RNA, 19 nt, Homo sapiens
cccaagcgcuuccagaaca

SEQ ID NO: 1412302 - RNA, 19 nt, Homo sapiens
gcccaggucuugagcucuu

SEQ ID NO: 1412303 - RNA, 19 nt, Homo sapiens
cauggaaagucuccucauc

SEQ ID NO: 1412304 - RNA, 19 nt, Homo sapiens
gacaccagauacagacuuc

SEQ ID NO: 1412305 - RNA, 19 nt, Homo sapiens
gcaagaagggacacucuac

SEQ ID NO: 1412306 - RNA, 19 nt, Homo sapiens
caccaaacauucagaagac

SEQ ID NO: 1412307 - RNA, 19 nt, Homo sapiens
gaugagcuccaacgugaug

SEQ ID NO: 1412308 - RNA, 19 nt, Homo sapiens
ccaauaacgcagauagguu

SEQ ID NO: 1412309 - RNA, 19 nt, Homo sapiens
gggccucucguacuucuuu

SEQ ID NO: 1412310 - RNA, 19 nt, Homo sapiens
aagaggacuucaggaauug

SEQ ID NO: 1412311 - RNA, 19 nt, Homo sapiens
ggauaucuccaccaaacau

SEQ ID NO: 1412312 - RNA, 19 nt, Homo sapiens
gcucacgugucacccagau

SEQ ID NO: 1412313 - RNA, 19 nt, Homo sapiens
ggacaccagauacagacuu

SEQ ID NO: 1412314 - RNA, 19 nt, Homo sapiens
gagcugcagagcccaaaga

SEQ ID NO: 1412315 - RNA, 19 nt, Homo sapiens
gcucaggaaagaagggaaa

SEQ ID NO: 1412316 - RNA, 19 nt, Homo sapiens
uuacuguccugguggauag

SEQ ID NO: 1412317 - RNA, 19 nt, Homo sapiens
gcacuguuccgcaaaucug

SEQ ID NO: 1412318 - RNA, 19 nt, Homo sapiens
gauaucuccaccaaacauu

SEQ ID NO: 1412319 - RNA, 19 nt, Homo sapiens
uucccauccucauaauuua

SEQ ID NO: 1412320 - RNA, 19 nt, Homo sapiens
ucucguacuucuuugacuu

SEQ ID NO: 1412321 - RNA, 19 nt, Homo sapiens
gcaccgagacuaccaucag

SEQ ID NO: 1412322 - RNA, 19 nt, Homo sapiens
ccaccagcauggaaagucu

SEQ ID NO: 1412323 - RNA, 19 nt, Homo sapiens
cauggcaggucccgucauc

SEQ ID NO: 1412324 - RNA, 19 nt, Homo sapiens
cccaggaggacaccagaua

SEQ ID NO: 1412325 - RNA, 19 nt, Homo sapiens
ccaggcagccgucaucgau

SEQ ID NO: 1412326 - RNA, 19 nt, Homo sapiens
aagaagggcaauuucagaa

SEQ ID NO: 1412327 - RNA, 19 nt, Homo sapiens
ucacagcgaguaccaccaa

SEQ ID NO: 1412328 - RNA, 19 nt, Homo sapiens
guggaagcccugcucaaga

SEQ ID NO: 1412329 - RNA, 19 nt, Homo sapiens
aagggacacucuaccaauc

SEQ ID NO: 1412330 - RNA, 19 nt, Homo sapiens
aaagaagaagggcaauuuc

SEQ ID NO: 1412331 - RNA, 19 nt, Homo sapiens
cccaggauaucuccaccaa

SEQ ID NO: 1412332 - RNA, 19 nt, Homo sapiens
caucacggagagaccauuu

SEQ ID NO: 1412333 - RNA, 19 nt, Homo sapiens
ggaccaugacugagaagca

SEQ ID NO: 1412334 - RNA, 19 nt, Homo sapiens
ugacuggucccucaucuac

SEQ ID NO: 1412335 - RNA, 19 nt, Homo sapiens
caucuucaccaccaucuuc

SEQ ID NO: 1412336 - RNA, 19 nt, Homo sapiens
gaagcccugcucaagauca

SEQ ID NO: 1412337 - RNA, 19 nt, Homo sapiens
aagaagaagggcaauuuca

SEQ ID NO: 1412338 - RNA, 19 nt, Homo sapiens
ucuccaccauuacgaguug

SEQ ID NO: 1412339 - RNA, 19 nt, Homo sapiens
gaagcccaccagcauggaa

SEQ ID NO: 1412340 - RNA, 19 nt, Homo sapiens
gaagcggcucaucgagaaa

SEQ ID NO: 1412341 - RNA, 19 nt, Homo sapiens
agaaugaggcagacaccaa

SEQ ID NO: 1412342 - RNA, 19 nt, Homo sapiens
ccuuggccuuugaaacuuu

SEQ ID NO: 1412343 - RNA, 19 nt, Homo sapiens
ucaccacccuccggaguuc

SEQ ID NO: 1412344 - RNA, 19 nt, Homo sapiens
ccacagcgaggcacggaau

SEQ ID NO: 1412345 - RNA, 19 nt, Homo sapiens
ccagacggcgcuguucaaa

SEQ ID NO: 1412346 - RNA, 19 nt, Homo sapiens
ucaaccuggugauuacugu

SEQ ID NO: 1412347 - RNA, 19 nt, Homo sapiens
ucacgugucacccagaugu

SEQ ID NO: 1412348 - RNA, 19 nt, Homo sapiens
uuaccugccucuuccucuu

SEQ ID NO: 1412349 - RNA, 19 nt, Homo sapiens
caacacagucauggaucaa

SEQ ID NO: 1412350 - RNA, 19 nt, Homo sapiens
acacacagcaccacuacca

SEQ ID NO: 1412351 - RNA, 19 nt, Homo sapiens
ccaauacaguggguuccau

SEQ ID NO: 1412352 - RNA, 19 nt, Homo sapiens
gagcaggagcagcagaagu

SEQ ID NO: 1412353 - RNA, 19 nt, Homo sapiens
auucccauccucauaauuu

SEQ ID NO: 1412354 - RNA, 19 nt, Homo sapiens
cauccucauccucauguuu

SEQ ID NO: 1412355 - RNA, 19 nt, Homo sapiens
caucgcagccauccucauc

SEQ ID NO: 1412356 - RNA, 19 nt, Homo sapiens
ugacuucuggaacaauuug

SEQ ID NO: 1412357 - RNA, 19 nt, Homo sapiens
uuugacuucuggaacaauu

SEQ ID NO: 1412358 - RNA, 19 nt, Homo sapiens
aaacuuucaucuucuucgu

SEQ ID NO: 1412359 - RNA, 19 nt, Homo sapiens
agacaccaauaacgcagau

SEQ ID NO: 1412360 - RNA, 19 nt, Homo sapiens
gagcacuucccaacucucu

SEQ ID NO: 1412361 - RNA, 19 nt, Homo sapiens
cuccagaguucccaacaca

SEQ ID NO: 1412362 - RNA, 19 nt, Homo sapiens
cccaaucccuacagugagu

SEQ ID NO: 1412363 - RNA, 19 nt, Homo sapiens
gaucugcuggaaugauugu

SEQ ID NO: 1412364 - RNA, 19 nt, Homo sapiens
caucauccaguacuucauc

SEQ ID NO: 1412365 - RNA, 19 nt, Homo sapiens
ccagaguucccaacacagu

SEQ ID NO: 1412366 - RNA, 19 nt, Homo sapiens
ccaagcgcuuccagaacau

SEQ ID NO: 1412367 - RNA, 19 nt, Homo sapiens
gaaacuccgucucuacuaa

SEQ ID NO: 1412368 - RNA, 19 nt, Homo sapiens
cgaaacagccuucugaaua

SEQ ID NO: 1412369 - RNA, 19 nt, Homo sapiens
ggaaacguuugccuucaua

SEQ ID NO: 1412370 - RNA, 19 nt, Homo sapiens
gaaacagccuucugaauac

SEQ ID NO: 1412371 - RNA, 19 nt, Homo sapiens
ccucaaaucuguugucuga

SEQ ID NO: 1412372 - RNA, 19 nt, Homo sapiens
gaaagaagaacaaauguca

SEQ ID NO: 1412373 - RNA, 19 nt, Homo sapiens
aaaccaagcaugaagaaua

SEQ ID NO: 1412374 - RNA, 19 nt, Homo sapiens
auaaagagcugcuggugaa

SEQ ID NO: 1412375 - RNA, 19 nt, Homo sapiens
gaacccaucucaaacaaac

SEQ ID NO: 1412376 - RNA, 19 nt, Homo sapiens
ggagaagccugccaacagu

SEQ ID NO: 1412377 - RNA, 19 nt, Homo sapiens
acccaaagcuuaugaaaga

SEQ ID NO: 1412378 - RNA, 19 nt, Homo sapiens
ucaaaucuguugucugaga

SEQ ID NO: 1412379 - RNA, 19 nt, Homo sapiens
aaggaugguuugcuuauuu

SEQ ID NO: 1412380 - RNA, 19 nt, Homo sapiens
aaccaagcaugaagaauaa

SEQ ID NO: 1412381 - RNA, 19 nt, Homo sapiens
gcucaggaguucaagauca

SEQ ID NO: 1412382 - RNA, 19 nt, Homo sapiens
gaacaagaacccaucucaa

SEQ ID NO: 1412383 - RNA, 19 nt, Homo sapiens
ggaaggaccaccuggauuc

SEQ ID NO: 1412384 - RNA, 19 nt, Homo sapiens
auaaauacauggcgggaaa

SEQ ID NO: 1412385 - RNA, 19 nt, Homo sapiens
gcccagcucuucaccagaa

SEQ ID NO: 1412386 - RNA, 19 nt, Homo sapiens
ggauucaguuuccaucuuc

SEQ ID NO: 1412387 - RNA, 19 nt, Homo sapiens
gaaugaauaccucaaaucu

SEQ ID NO: 1412388 - RNA, 19 nt, Homo sapiens
ccaccuggauucauucaug

SEQ ID NO: 1412389 - RNA, 19 nt, Homo sapiens
acagugaccuuccgaaaca

SEQ ID NO: 1412390 - RNA, 19 nt, Homo sapiens
uuaaaccacugugccauuu

SEQ ID NO: 1412391 - RNA, 19 nt, Homo sapiens
caaagcuuaugaaagaaga

SEQ ID NO: 1412392 - RNA, 19 nt, Homo sapiens
caacagugaccuuccgaaa

SEQ ID NO: 1412393 - RNA, 19 nt, Homo sapiens
gaggcgacaagcuuauuua

SEQ ID NO: 1412394 - RNA, 19 nt, Homo sapiens
cugaggaagucauucuuaa

SEQ ID NO: 1412395 - RNA, 19 nt, Homo sapiens
caaagaggauucaguuucc

SEQ ID NO: 1412396 - RNA, 19 nt, Homo sapiens
uugaauacgugauguucua

SEQ ID NO: 1412397 - RNA, 19 nt, Homo sapiens
augaauaccucaaaucugu

SEQ ID NO: 1412398 - RNA, 19 nt, Homo sapiens
ggaaugaauaccucaaauc

SEQ ID NO: 1412399 - RNA, 19 nt, Homo sapiens
caagaacccaucucaaaca

SEQ ID NO: 1412400 - RNA, 19 nt, Homo sapiens
agaagacccuauacucaga

SEQ ID NO: 1412401 - RNA, 19 nt, Homo sapiens
gcagugagccaagaucaug

SEQ ID NO: 1412402 - RNA, 19 nt, Homo sapiens
guugguaugugugcaauga

SEQ ID NO: 1412403 - RNA, 19 nt, Homo sapiens
ugucugagauucuagagau

SEQ ID NO: 1412404 - RNA, 19 nt, Homo sapiens
aacaagaacccaucucaaa

SEQ ID NO: 1412405 - RNA, 19 nt, Homo sapiens
gcaggagaauugcuugaac

SEQ ID NO: 1412406 - RNA, 19 nt, Homo sapiens
ggcgacaagcuuauuuaua

SEQ ID NO: 1412407 - RNA, 19 nt, Homo sapiens
gaauaccucaaaucuguug

SEQ ID NO: 1412408 - RNA, 19 nt, Homo sapiens
ccaaucucaacaucaauua

SEQ ID NO: 1412409 - RNA, 19 nt, Homo sapiens
gaaaaggaugguuugcuua

SEQ ID NO: 1412410 - RNA, 19 nt, Homo sapiens
gagcugaggucauuuucuu

SEQ ID NO: 1412411 - RNA, 19 nt, Homo sapiens
aaacguuugccuucauaua

SEQ ID NO: 1412412 - RNA, 19 nt, Homo sapiens
aaacguacaccuacugaau

SEQ ID NO: 1412413 - RNA, 19 nt, Homo sapiens
ccaagaucaugccacauca

SEQ ID NO: 1412414 - RNA, 19 nt, Homo sapiens
ucauauaaacguacaccua

SEQ ID NO: 1412415 - RNA, 19 nt, Homo sapiens
gcacagccagauccuauag

SEQ ID NO: 1412416 - RNA, 19 nt, Homo sapiens
cgaugaaacuccgucucua

SEQ ID NO: 1412417 - RNA, 19 nt, Homo sapiens
ccuauaaucccagcacuuu

SEQ ID NO: 1412418 - RNA, 19 nt, Homo sapiens
caugauugaugcuacuguu

SEQ ID NO: 1412419 - RNA, 19 nt, Homo sapiens
gaugauggccugggcuuug

SEQ ID NO: 1412420 - RNA, 19 nt, Homo sapiens
acaaagaggauucaguuuc

SEQ ID NO: 1412421 - RNA, 19 nt, Homo sapiens
auacaaagaggauucaguu

SEQ ID NO: 1412422 - RNA, 19 nt, Homo sapiens
ccuguaauguucagagugu

SEQ ID NO: 1412423 - RNA, 19 nt, Homo sapiens
aaaggaugguuugcuuauu

SEQ ID NO: 1412424 - RNA, 19 nt, Homo sapiens
cuaaaagucugacauaaag

SEQ ID NO: 1412425 - RNA, 19 nt, Homo sapiens
aaagcugaauccugcuaaa

SEQ ID NO: 1412426 - RNA, 19 nt, Homo sapiens
cugagauucuagagauuaa

SEQ ID NO: 1412427 - RNA, 19 nt, Homo sapiens
gagcucaggaguucaagau

SEQ ID NO: 1412428 - RNA, 19 nt, Homo sapiens
gggagaagccugccaacag

SEQ ID NO: 1412429 - RNA, 19 nt, Homo sapiens
acugcagacuagagaaaua

SEQ ID NO: 1412430 - RNA, 19 nt, Homo sapiens
aagaacccaucucaaacaa

SEQ ID NO: 1412431 - RNA, 19 nt, Homo sapiens
gaggaagucauucuuaagg

SEQ ID NO: 1412432 - RNA, 19 nt, Homo sapiens
gcuaaaagucugacauaaa

SEQ ID NO: 1412433 - RNA, 19 nt, Homo sapiens
agaccuaucccucuuuguu

SEQ ID NO: 1412434 - RNA, 19 nt, Homo sapiens
uacgugauguucuacaaug

SEQ ID NO: 1412435 - RNA, 19 nt, Homo sapiens
ucugaacacaugaaucuuu

SEQ ID NO: 1412436 - RNA, 19 nt, Homo sapiens
gcgagcauaucgacaacuc

SEQ ID NO: 1412437 - RNA, 19 nt, Homo sapiens
uaaaguugaaggaaggaaa

SEQ ID NO: 1412438 - RNA, 19 nt, Homo sapiens
gauaaauagccaacuugau

SEQ ID NO: 1412439 - RNA, 19 nt, Homo sapiens
gccaaucucaacaucaauu

SEQ ID NO: 1412440 - RNA, 19 nt, Homo sapiens
uuucuugacccaaagcuua

SEQ ID NO: 1412441 - RNA, 19 nt, Homo sapiens
uaucugaacacaugaaucu

SEQ ID NO: 1412442 - RNA, 19 nt, Homo sapiens
ccacugcagacuagagaaa

SEQ ID NO: 1412443 - RNA, 19 nt, Homo sapiens
ggugaacuccaucucauuc

SEQ ID NO: 1412444 - RNA, 19 nt, Homo sapiens
gccaagaucaugccacauc

SEQ ID NO: 1412445 - RNA, 19 nt, Homo sapiens
cugccaaucucaacaucaa

SEQ ID NO: 1412446 - RNA, 19 nt, Homo sapiens
ucugaggaagucauucuua

SEQ ID NO: 1412447 - RNA, 19 nt, Homo sapiens
accagaagcuuugaugaug

SEQ ID NO: 1412448 - RNA, 19 nt, Homo sapiens
gaaaaccaagcaugaagaa

SEQ ID NO: 1412449 - RNA, 19 nt, Homo sapiens
cagacuagagaaauaaaug

SEQ ID NO: 1412450 - RNA, 19 nt, Homo sapiens
ggaacaaggaccuaagacu

SEQ ID NO: 1412451 - RNA, 19 nt, Homo sapiens
gaugaaacuccgucucuac

SEQ ID NO: 1412452 - RNA, 19 nt, Homo sapiens
acguuugccuucauauaaa

SEQ ID NO: 1412453 - RNA, 19 nt, Homo sapiens
aaacagccuucugaauaca

SEQ ID NO: 1412454 - RNA, 19 nt, Homo sapiens
cgucaugacugccaaucuc

SEQ ID NO: 1412455 - RNA, 19 nt, Homo sapiens
gaggugccauugcaaccau

SEQ ID NO: 1412456 - RNA, 19 nt, Homo sapiens
gaaggaccaccuggauuca

SEQ ID NO: 1412457 - RNA, 19 nt, Homo sapiens
aacguuugccuucauauaa

SEQ ID NO: 1412458 - RNA, 19 nt, Homo sapiens
ucugagauucuagagauua

SEQ ID NO: 1412459 - RNA, 19 nt, Homo sapiens
gcagacuagagaaauaaau

SEQ ID NO: 1412460 - RNA, 19 nt, Homo sapiens
ugaaacuccgucucuacua

SEQ ID NO: 1412461 - RNA, 19 nt, Homo sapiens
uauaaucccagcacuuuag

SEQ ID NO: 1412462 - RNA, 19 nt, Homo sapiens
ugauaaauagccaacuuga

SEQ ID NO: 1412463 - RNA, 19 nt, Homo sapiens
aggaccaccuggauucauu

SEQ ID NO: 1412464 - RNA, 19 nt, Homo sapiens
guacaccuacugaauggau

SEQ ID NO: 1412465 - RNA, 19 nt, Homo sapiens
aggaggcccuuaccuggaa

SEQ ID NO: 1412466 - RNA, 19 nt, Homo sapiens
uagcuuuguuguaucugaa

SEQ ID NO: 1412467 - RNA, 19 nt, Homo sapiens
gagaagagauaucuguuua

SEQ ID NO: 1412468 - RNA, 19 nt, Homo sapiens
gaaaggaguuuggauauuu

SEQ ID NO: 1412469 - RNA, 19 nt, Homo sapiens
ugaagaaacuggagaauuu

SEQ ID NO: 1412470 - RNA, 19 nt, Homo sapiens
agacgaaucugauacuaua

SEQ ID NO: 1412471 - RNA, 19 nt, Homo sapiens
gaagagauaucuguuuaug

SEQ ID NO: 1412472 - RNA, 19 nt, Homo sapiens
gaacaugaacauccucuaa

SEQ ID NO: 1412473 - RNA, 19 nt, Homo sapiens
guucauaucugaggaaauu

SEQ ID NO: 1412474 - RNA, 19 nt, Homo sapiens
ggauacagggcuugaauua

SEQ ID NO: 1412475 - RNA, 19 nt, Homo sapiens
ggaaaggaguuuggauauu

SEQ ID NO: 1412476 - RNA, 19 nt, Homo sapiens
ggaaugugaagcuuuaaua

SEQ ID NO: 1412477 - RNA, 19 nt, Homo sapiens
agaccaaguuccagcauua

SEQ ID NO: 1412478 - RNA, 19 nt, Homo sapiens
gaacuucacuaagggagaa

SEQ ID NO: 1412479 - RNA, 19 nt, Homo sapiens
gaagagguguucauaucug

SEQ ID NO: 1412480 - RNA, 19 nt, Homo sapiens
gagaugcaguccagauuga

SEQ ID NO: 1412481 - RNA, 19 nt, Homo sapiens
agaaugaccuagaggaauu

SEQ ID NO: 1412482 - RNA, 19 nt, Homo sapiens
ccaaacagauacuggauca

SEQ ID NO: 1412483 - RNA, 19 nt, Homo sapiens
ggaaacagaauugccauuu

SEQ ID NO: 1412484 - RNA, 19 nt, Homo sapiens
gggaagaaguaguuguuga

SEQ ID NO: 1412485 - RNA, 19 nt, Homo sapiens
caaagugucuggagaguac

SEQ ID NO: 1412486 - RNA, 19 nt, Homo sapiens
auacagggcuugaauuaau

SEQ ID NO: 1412487 - RNA, 19 nt, Homo sapiens
guggaggauuuacaaguua

SEQ ID NO: 1412488 - RNA, 19 nt, Homo sapiens
gguggaggauuuacaaguu

SEQ ID NO: 1412489 - RNA, 19 nt, Homo sapiens
gauagaaccuggauuuuau

SEQ ID NO: 1412490 - RNA, 19 nt, Homo sapiens
gaacauccucuaacaagug

SEQ ID NO: 1412491 - RNA, 19 nt, Homo sapiens
ggagaagagauaucuguuu

SEQ ID NO: 1412492 - RNA, 19 nt, Homo sapiens
caagaaaccagucucagaa

SEQ ID NO: 1412493 - RNA, 19 nt, Homo sapiens
gaagauaucggaaguacca

SEQ ID NO: 1412494 - RNA, 19 nt, Homo sapiens
uauguuagaugacaggaaa

SEQ ID NO: 1412495 - RNA, 19 nt, Homo sapiens
ccaauuccauaucaucuga

SEQ ID NO: 1412496 - RNA, 19 nt, Homo sapiens
ucaauccacugguugguuu

SEQ ID NO: 1412497 - RNA, 19 nt, Homo sapiens
aaacagaacaucagcaaga

SEQ ID NO: 1412498 - RNA, 19 nt, Homo sapiens
ggaagaaguaguuguugaa

SEQ ID NO: 1412499 - RNA, 19 nt, Homo sapiens
ucagauagaaccuggauuu

SEQ ID NO: 1412500 - RNA, 19 nt, Homo sapiens
agaaagcaauccaccacua

SEQ ID NO: 1412501 - RNA, 19 nt, Homo sapiens
uauugaaccuguacaagaa

SEQ ID NO: 1412502 - RNA, 19 nt, Homo sapiens
agaaguaguuguugaaagu

SEQ ID NO: 1412503 - RNA, 19 nt, Homo sapiens
gaaguaccagugaaucaaa

SEQ ID NO: 1412504 - RNA, 19 nt, Homo sapiens
agaacaagcugaagagaag

SEQ ID NO: 1412505 - RNA, 19 nt, Homo sapiens
aaauagcaguggaagauga

SEQ ID NO: 1412506 - RNA, 19 nt, Homo sapiens
ugacaacccuuggaacuuc

SEQ ID NO: 1412507 - RNA, 19 nt, Homo sapiens
gagaacaagcugaagagaa

SEQ ID NO: 1412508 - RNA, 19 nt, Homo sapiens
gaagaaguaguuguugaaa

SEQ ID NO: 1412509 - RNA, 19 nt, Homo sapiens
gaaucugacuuucuuuguc

SEQ ID NO: 1412510 - RNA, 19 nt, Homo sapiens
gaagauuugugggcaggaa

SEQ ID NO: 1412511 - RNA, 19 nt, Homo sapiens
aaacagauacuggaucaaa

SEQ ID NO: 1412512 - RNA, 19 nt, Homo sapiens
uacagggcuugaauuaaua

SEQ ID NO: 1412513 - RNA, 19 nt, Homo sapiens
cuuggaaugugaagcuuua

SEQ ID NO: 1412514 - RNA, 19 nt, Homo sapiens
aaauucagaugucaacgaa

SEQ ID NO: 1412515 - RNA, 19 nt, Homo sapiens
gaaauucagaugucaacga

SEQ ID NO: 1412516 - RNA, 19 nt, Homo sapiens
gaauuaaacggugauuaug

SEQ ID NO: 1412517 - RNA, 19 nt, Homo sapiens
gaacaagaaauagaaacga

SEQ ID NO: 1412518 - RNA, 19 nt, Homo sapiens
acaguuccauguacagaaa

SEQ ID NO: 1412519 - RNA, 19 nt, Homo sapiens
gaaccuggauuuuaugcaa

SEQ ID NO: 1412520 - RNA, 19 nt, Homo sapiens
aaacggugauuauggugaa

SEQ ID NO: 1412521 - RNA, 19 nt, Homo sapiens
gaauugccauuucccaaac

SEQ ID NO: 1412522 - RNA, 19 nt, Homo sapiens
gaagaucaaauagacaaga

SEQ ID NO: 1412523 - RNA, 19 nt, Homo sapiens
agucugaacuagcaucuga

SEQ ID NO: 1412524 - RNA, 19 nt, Homo sapiens
gaaguaguuguugaaagua

SEQ ID NO: 1412525 - RNA, 19 nt, Homo sapiens
ggagaauuuuccauugaua

SEQ ID NO: 1412526 - RNA, 19 nt, Homo sapiens
aagacacaaucacuaauga

SEQ ID NO: 1412527 - RNA, 19 nt, Homo sapiens
gauacagggcuugaauuaa

SEQ ID NO: 1412528 - RNA, 19 nt, Homo sapiens
gaccuagaggaauuaaaua

SEQ ID NO: 1412529 - RNA, 19 nt, Homo sapiens
gaaugaccuagaggaauua

SEQ ID NO: 1412530 - RNA, 19 nt, Homo sapiens
ggaaguaccagugaaucaa

SEQ ID NO: 1412531 - RNA, 19 nt, Homo sapiens
gauaaagaagccacaguuc

SEQ ID NO: 1412532 - RNA, 19 nt, Homo sapiens
gaggagaacaagcugaaga

SEQ ID NO: 1412533 - RNA, 19 nt, Homo sapiens
caggagaaagggaagauuu

SEQ ID NO: 1412534 - RNA, 19 nt, Homo sapiens
gaaacagaagaucaaauag

SEQ ID NO: 1412535 - RNA, 19 nt, Homo sapiens
gaagccacaguuccaugua

SEQ ID NO: 1412536 - RNA, 19 nt, Homo sapiens
gcaauccaccacuacaaga

SEQ ID NO: 1412537 - RNA, 19 nt, Homo sapiens
auuaauagcugaagaaagc

SEQ ID NO: 1412538 - RNA, 19 nt, Homo sapiens
cuauuucucugacaaagug

SEQ ID NO: 1412539 - RNA, 19 nt, Homo sapiens
gacacagucugaacuagca

SEQ ID NO: 1412540 - RNA, 19 nt, Homo sapiens
agagaaggcuuuugaauca

SEQ ID NO: 1412541 - RNA, 19 nt, Homo sapiens
auacuaggcuuugcauaug

SEQ ID NO: 1412542 - RNA, 19 nt, Homo sapiens
ugaacuagcaucugaguca

SEQ ID NO: 1412543 - RNA, 19 nt, Homo sapiens
guggugacuuggaauguga

SEQ ID NO: 1412544 - RNA, 19 nt, Homo sapiens
ugaccuagaggaauuaaau

SEQ ID NO: 1412545 - RNA, 19 nt, Homo sapiens
gaagauagugaauuaaacg

SEQ ID NO: 1412546 - RNA, 19 nt, Homo sapiens
uauacuaggcuuugcauau

SEQ ID NO: 1412547 - RNA, 19 nt, Homo sapiens
gaaagcaauccaccacuac

SEQ ID NO: 1412548 - RNA, 19 nt, Homo sapiens
aaggaaaggaguuuggaua

SEQ ID NO: 1412549 - RNA, 19 nt, Homo sapiens
aaacagaauugccauuucc

SEQ ID NO: 1412550 - RNA, 19 nt, Homo sapiens
cagaagaucaaauagacaa

SEQ ID NO: 1412551 - RNA, 19 nt, Homo sapiens
gcauaugccaaggaagaua

SEQ ID NO: 1412552 - RNA, 19 nt, Homo sapiens
gaauccuucuucuggcuau

SEQ ID NO: 1412553 - RNA, 19 nt, Homo sapiens
gaggauacagggcuugaau

SEQ ID NO: 1412554 - RNA, 19 nt, Homo sapiens
gagaaugaccuagaggaau

SEQ ID NO: 1412555 - RNA, 19 nt, Homo sapiens
acaagaaaccagucucaga

SEQ ID NO: 1412556 - RNA, 19 nt, Homo sapiens
acaugaacauccucuaaca

SEQ ID NO: 1412557 - RNA, 19 nt, Homo sapiens
uaaagaagccacaguucca

SEQ ID NO: 1412558 - RNA, 19 nt, Homo sapiens
ggagaaagggaagauuugu

SEQ ID NO: 1412559 - RNA, 19 nt, Homo sapiens
cauaugccaaggaagauaa

SEQ ID NO: 1412560 - RNA, 19 nt, Homo sapiens
aaagacacaaucacuaaug

SEQ ID NO: 1412561 - RNA, 19 nt, Homo sapiens
ucaaacagaacaucagcaa

SEQ ID NO: 1412562 - RNA, 19 nt, Homo sapiens
ggaagaugagaaugaccua

SEQ ID NO: 1412563 - RNA, 19 nt, Homo sapiens
uagaggcuccugaagauau

SEQ ID NO: 1412564 - RNA, 19 nt, Homo sapiens
cauuagaggcuccugaaga

SEQ ID NO: 1412565 - RNA, 19 nt, Homo sapiens
gacuuucuuugucuucuug

SEQ ID NO: 1412566 - RNA, 19 nt, Homo sapiens
gagaaagggaagauuugug

SEQ ID NO: 1412567 - RNA, 19 nt, Homo sapiens
gcaggaagccuuggaauuu

SEQ ID NO: 1412568 - RNA, 19 nt, Homo sapiens
guaaaccgcugcaaacuca

SEQ ID NO: 1412569 - RNA, 19 nt, Homo sapiens
guuagagacuagaaaguua

SEQ ID NO: 1412570 - RNA, 19 nt, Homo sapiens
gauguaaacuuuguucuug

SEQ ID NO: 1412571 - RNA, 19 nt, Homo sapiens
gcaaugauguaaacuuugu

SEQ ID NO: 1412572 - RNA, 19 nt, Homo sapiens
gcugguaccucuguuauaa

SEQ ID NO: 1412573 - RNA, 19 nt, Homo sapiens
gaucugccauuuaugauga

SEQ ID NO: 1412574 - RNA, 19 nt, Homo sapiens
ugaaggagcuauuuaaucu

SEQ ID NO: 1412575 - RNA, 19 nt, Homo sapiens
uaacacagguggaagugaa

SEQ ID NO: 1412576 - RNA, 19 nt, Homo sapiens
aaguacaccuucuuuguua

SEQ ID NO: 1412577 - RNA, 19 nt, Homo sapiens
ggaaagaauggaagaggua

SEQ ID NO: 1412578 - RNA, 19 nt, Homo sapiens
gaagcagauucaacaagaa

SEQ ID NO: 1412579 - RNA, 19 nt, Homo sapiens
cagcuuaccuccugcauca

SEQ ID NO: 1412580 - RNA, 19 nt, Homo sapiens
gaaacuuuguucaccgauu

SEQ ID NO: 1412581 - RNA, 19 nt, Homo sapiens
gaucaauaguuucgugguu

SEQ ID NO: 1412582 - RNA, 19 nt, Homo sapiens
gaucaucauuuggaaagaa

SEQ ID NO: 1412583 - RNA, 19 nt, Homo sapiens
ugaaccaucucaauacuau

SEQ ID NO: 1412584 - RNA, 19 nt, Homo sapiens
agaagcagauucaacaaga

SEQ ID NO: 1412585 - RNA, 19 nt, Homo sapiens
gacuggaucugccauuuau

SEQ ID NO: 1412586 - RNA, 19 nt, Homo sapiens
ccgcaagucuuugaucuuu

SEQ ID NO: 1412587 - RNA, 19 nt, Homo sapiens
gagaaaaccuugaaagaca

SEQ ID NO: 1412588 - RNA, 19 nt, Homo sapiens
agaugaagcuuauggcuau

SEQ ID NO: 1412589 - RNA, 19 nt, Homo sapiens
gcaaacucaucaccaggaa

SEQ ID NO: 1412590 - RNA, 19 nt, Homo sapiens
ugaagagacuggauauauc

SEQ ID NO: 1412591 - RNA, 19 nt, Homo sapiens
guaccucuguuauaaagga

SEQ ID NO: 1412592 - RNA, 19 nt, Homo sapiens
ggagcuauuuaaucuaugu

SEQ ID NO: 1412593 - RNA, 19 nt, Homo sapiens
uaaaugaagaugcuuguga

SEQ ID NO: 1412594 - RNA, 19 nt, Homo sapiens
gaagagguaccaguucaaa

SEQ ID NO: 1412595 - RNA, 19 nt, Homo sapiens
ucaauaguuucgugguuaa

SEQ ID NO: 1412596 - RNA, 19 nt, Homo sapiens
uugcuaaacuucagcguaa

SEQ ID NO: 1412597 - RNA, 19 nt, Homo sapiens
ccagugaucucugcaacuu

SEQ ID NO: 1412598 - RNA, 19 nt, Homo sapiens
aagaaacgcguguacauuu

SEQ ID NO: 1412599 - RNA, 19 nt, Homo sapiens
cuucaaagcagaacuacua

SEQ ID NO: 1412600 - RNA, 19 nt, Homo sapiens
aagcagaacuacuaugcaa

SEQ ID NO: 1412601 - RNA, 19 nt, Homo sapiens
aaacuuuguucaccgauug

SEQ ID NO: 1412602 - RNA, 19 nt, Homo sapiens
ggaauuccagauauugaaa

SEQ ID NO: 1412603 - RNA, 19 nt, Homo sapiens
ccuaauggcuaaaguaacu

SEQ ID NO: 1412604 - RNA, 19 nt, Homo sapiens
caggaagccuuggaauuug

SEQ ID NO: 1412605 - RNA, 19 nt, Homo sapiens
gagagagaaauuagagaaa

SEQ ID NO: 1412606 - RNA, 19 nt, Homo sapiens
ccaguucaaauuccaauaa

SEQ ID NO: 1412607 - RNA, 19 nt, Homo sapiens
uaagaugcagucuccauuu

SEQ ID NO: 1412608 - RNA, 19 nt, Homo sapiens
gguccucgcuggcuuuaca

SEQ ID NO: 1412609 - RNA, 19 nt, Homo sapiens
agaggcaaaugacaagaaa

SEQ ID NO: 1412610 - RNA, 19 nt, Homo sapiens
gauuccaguuuaucucuga

SEQ ID NO: 1412611 - RNA, 19 nt, Homo sapiens
gaaggagcuauuuaaucua

SEQ ID NO: 1412612 - RNA, 19 nt, Homo sapiens
caaugggacuccucaugau

SEQ ID NO: 1412613 - RNA, 19 nt, Homo sapiens
agagguaccaguucaaauu

SEQ ID NO: 1412614 - RNA, 19 nt, Homo sapiens
guacaccuucuuuguuaaa

SEQ ID NO: 1412615 - RNA, 19 nt, Homo sapiens
gaccauauuugaugcuuuu

SEQ ID NO: 1412616 - RNA, 19 nt, Homo sapiens
aaaaugcaguaguguguua

SEQ ID NO: 1412617 - RNA, 19 nt, Homo sapiens
guaacuugaccauauuuga

SEQ ID NO: 1412618 - RNA, 19 nt, Homo sapiens
aaaugaagaugcuugugau

SEQ ID NO: 1412619 - RNA, 19 nt, Homo sapiens
acaccaagcugaagagacu

SEQ ID NO: 1412620 - RNA, 19 nt, Homo sapiens
uuacugaaggagcuauuua

SEQ ID NO: 1412621 - RNA, 19 nt, Homo sapiens
gacaguggccugaggaugu

SEQ ID NO: 1412622 - RNA, 19 nt, Homo sapiens
ggaagaggcaaaugacaag

SEQ ID NO: 1412623 - RNA, 19 nt, Homo sapiens
aagaugcagucuccauuug

SEQ ID NO: 1412624 - RNA, 19 nt, Homo sapiens
agaaggaagaggcaaauga

SEQ ID NO: 1412625 - RNA, 19 nt, Homo sapiens
aaaccuaauggcuaaagua

SEQ ID NO: 1412626 - RNA, 19 nt, Homo sapiens
gaaacgcguguacauuuua

SEQ ID NO: 1412627 - RNA, 19 nt, Homo sapiens
acaaugggacuccucauga

SEQ ID NO: 1412628 - RNA, 19 nt, Homo sapiens
agacuggaucugccauuua

SEQ ID NO: 1412629 - RNA, 19 nt, Homo sapiens
gaacacucuucagggaaau

SEQ ID NO: 1412630 - RNA, 19 nt, Homo sapiens
gagacuagaaaguuauaug

SEQ ID NO: 1412631 - RNA, 19 nt, Homo sapiens
aaagaaacgcguguacauu

SEQ ID NO: 1412632 - RNA, 19 nt, Homo sapiens
guuuagaaauggcacaaca

SEQ ID NO: 1412633 - RNA, 19 nt, Homo sapiens
cgucuuacuccuaauauga

SEQ ID NO: 1412634 - RNA, 19 nt, Homo sapiens
uggaagagguaccaguuca

SEQ ID NO: 1412635 - RNA, 19 nt, Homo sapiens
uagacuggaucugccauuu

SEQ ID NO: 1412636 - RNA, 19 nt, Homo sapiens
uggauucccuggaccauuc

SEQ ID NO: 1412637 - RNA, 19 nt, Homo sapiens
ggaaauggaagccaaaaug

SEQ ID NO: 1412638 - RNA, 19 nt, Homo sapiens
cuccuaauaugaucaauag

SEQ ID NO: 1412639 - RNA, 19 nt, Homo sapiens
gaaggaagaggcaaaugac

SEQ ID NO: 1412640 - RNA, 19 nt, Homo sapiens
ugcaaggagguaacuauua

SEQ ID NO: 1412641 - RNA, 19 nt, Homo sapiens
caaagcagaacuacuaugc

SEQ ID NO: 1412642 - RNA, 19 nt, Homo sapiens
cuauagagagagagaaauu

SEQ ID NO: 1412643 - RNA, 19 nt, Homo sapiens
gagcugguaccucuguuau

SEQ ID NO: 1412644 - RNA, 19 nt, Homo sapiens
agaaccaccugcuaaccaa

SEQ ID NO: 1412645 - RNA, 19 nt, Homo sapiens
ugguuucccuguucuacua

SEQ ID NO: 1412646 - RNA, 19 nt, Homo sapiens
gaagaugcuugugauucca

SEQ ID NO: 1412647 - RNA, 19 nt, Homo sapiens
ggagaagcagauucaacaa

SEQ ID NO: 1412648 - RNA, 19 nt, Homo sapiens
caacauggaguuauuucag

SEQ ID NO: 1412649 - RNA, 19 nt, Homo sapiens
ggagcaggcacuuaagcaa

SEQ ID NO: 1412650 - RNA, 19 nt, Homo sapiens
cugaagagacuggauauau

SEQ ID NO: 1412651 - RNA, 19 nt, Homo sapiens
uggagacucuguugaccaa

SEQ ID NO: 1412652 - RNA, 19 nt, Homo sapiens
ggaagagguaccaguucaa

SEQ ID NO: 1412653 - RNA, 19 nt, Homo sapiens
gauaagaugcagucuccau

SEQ ID NO: 1412654 - RNA, 19 nt, Homo sapiens
gcaccaaugccagaaggaa

SEQ ID NO: 1412655 - RNA, 19 nt, Homo sapiens
caggaaagacuucgaaacu

SEQ ID NO: 1412656 - RNA, 19 nt, Homo sapiens
gcagaacuacuaugcaaaa

SEQ ID NO: 1412657 - RNA, 19 nt, Homo sapiens
aucaauaguuucgugguua

SEQ ID NO: 1412658 - RNA, 19 nt, Homo sapiens
ugaagucacccuuggacaa

SEQ ID NO: 1412659 - RNA, 19 nt, Homo sapiens
gagguaccaguucaaauuc

SEQ ID NO: 1412660 - RNA, 19 nt, Homo sapiens
aggaaagacuucgaaacuu

SEQ ID NO: 1412661 - RNA, 19 nt, Homo sapiens
ccuguucuacuauacauaa

SEQ ID NO: 1412662 - RNA, 19 nt, Homo sapiens
ugaccauauuugaugcuuu

SEQ ID NO: 1412663 - RNA, 19 nt, Homo sapiens
acauggaguuauuucaguu

SEQ ID NO: 1412664 - RNA, 19 nt, Homo sapiens
gcuugugauuccaguuuau

SEQ ID NO: 1412665 - RNA, 19 nt, Homo sapiens
ugaagaugcuugugauucc

SEQ ID NO: 1412666 - RNA, 19 nt, Homo sapiens
aggaagccuuggaauuuga

SEQ ID NO: 1412667 - RNA, 19 nt, Homo sapiens
gcucaaagcugacauguuc

SEQ ID NO: 1412668 - RNA, 19 nt, Homo sapiens
gcacugacgucaagccaua

SEQ ID NO: 1412669 - RNA, 19 nt, Homo sapiens
gaaauagaauugcuggaau

SEQ ID NO: 1412670 - RNA, 19 nt, Homo sapiens
gaagacaaguaaagcaaug

SEQ ID NO: 1412671 - RNA, 19 nt, Homo sapiens
gcugagacauggccgcuua

SEQ ID NO: 1412672 - RNA, 19 nt, Homo sapiens
gaagggaauuguuggaaau

SEQ ID NO: 1412673 - RNA, 19 nt, Homo sapiens
gagacucacucuuccgaua

SEQ ID NO: 1412674 - RNA, 19 nt, Homo sapiens
uccauuaucuuucgaagua

SEQ ID NO: 1412675 - RNA, 19 nt, Homo sapiens
cagaggagcuagucaacaa

SEQ ID NO: 1412676 - RNA, 19 nt, Homo sapiens
gcuagugcguuucucuaua

SEQ ID NO: 1412677 - RNA, 19 nt, Homo sapiens
gagcaugaccuuccucuug

SEQ ID NO: 1412678 - RNA, 19 nt, Homo sapiens
cagaagagaccuugucaaa

SEQ ID NO: 1412679 - RNA, 19 nt, Homo sapiens
cuagugcguuucucuauaa

SEQ ID NO: 1412680 - RNA, 19 nt, Homo sapiens
gauacuuucucucucauug

SEQ ID NO: 1412681 - RNA, 19 nt, Homo sapiens
gaaugucuuugacuuuguu

SEQ ID NO: 1412682 - RNA, 19 nt, Homo sapiens
ucaaacuccuugcacaauu

SEQ ID NO: 1412683 - RNA, 19 nt, Homo sapiens
cgaauucccugguaacagu

SEQ ID NO: 1412684 - RNA, 19 nt, Homo sapiens
ugaagggaauuguuggaaa

SEQ ID NO: 1412685 - RNA, 19 nt, Homo sapiens
ggagguggcagcuugguuu

SEQ ID NO: 1412686 - RNA, 19 nt, Homo sapiens
gggaauuguuggaaauaga

SEQ ID NO: 1412687 - RNA, 19 nt, Homo sapiens
gcaauggauggcuucaaua

SEQ ID NO: 1412688 - RNA, 19 nt, Homo sapiens
ggacagaggagcuagucaa

SEQ ID NO: 1412689 - RNA, 19 nt, Homo sapiens
caaacuccuugcacaauuc

SEQ ID NO: 1412690 - RNA, 19 nt, Homo sapiens
ccacaaauaccaaacuaug

SEQ ID NO: 1412691 - RNA, 19 nt, Homo sapiens
cagcaucuauuucauccuu

SEQ ID NO: 1412692 - RNA, 19 nt, Homo sapiens
caugugcgcugcagucaga

SEQ ID NO: 1412693 - RNA, 19 nt, Homo sapiens
gaaccugggcugagacaug

SEQ ID NO: 1412694 - RNA, 19 nt, Homo sapiens
ggaaugucuuugacuuugu

SEQ ID NO: 1412695 - RNA, 19 nt, Homo sapiens
cauugaagcugaccuugga

SEQ ID NO: 1412696 - RNA, 19 nt, Homo sapiens
agaggaacguaagaaguua

SEQ ID NO: 1412697 - RNA, 19 nt, Homo sapiens
gauaaugaagggaauuguu

SEQ ID NO: 1412698 - RNA, 19 nt, Homo sapiens
ggaaauggaucaggaugac

SEQ ID NO: 1412699 - RNA, 19 nt, Homo sapiens
gcaucuauuucauccuuug

SEQ ID NO: 1412700 - RNA, 19 nt, Homo sapiens
ugaguguccucucuucaaa

SEQ ID NO: 1412701 - RNA, 19 nt, Homo sapiens
gcccugagcucgucuugca

SEQ ID NO: 1412702 - RNA, 19 nt, Homo sapiens
ggaguaccauguguucuuc

SEQ ID NO: 1412703 - RNA, 19 nt, Homo sapiens
agaagugucugaaguagag

SEQ ID NO: 1412704 - RNA, 19 nt, Homo sapiens
ccagaagaaacuuguauug

SEQ ID NO: 1412705 - RNA, 19 nt, Homo sapiens
cuauaaagccucagcguau

SEQ ID NO: 1412706 - RNA, 19 nt, Homo sapiens
uagaggaacguaagaaguu

SEQ ID NO: 1412707 - RNA, 19 nt, Homo sapiens
caccuuggaucauugguau

SEQ ID NO: 1412708 - RNA, 19 nt, Homo sapiens
gcucaucuucuucuacauu

SEQ ID NO: 1412709 - RNA, 19 nt, Homo sapiens
cauggccgcuuaccaacaa

SEQ ID NO: 1412710 - RNA, 19 nt, Homo sapiens
caauggauggcuucaauau

SEQ ID NO: 1412711 - RNA, 19 nt, Homo sapiens
gucuuugacuuuguuguua

SEQ ID NO: 1412712 - RNA, 19 nt, Homo sapiens
aaauagaauugcuggaauc

SEQ ID NO: 1412713 - RNA, 19 nt, Homo sapiens
ugaaauagaauugcuggaa

SEQ ID NO: 1412714 - RNA, 19 nt, Homo sapiens
guauagaacagauuucaca

SEQ ID NO: 1412715 - RNA, 19 nt, Homo sapiens
agacauggccgcuuaccaa

SEQ ID NO: 1412716 - RNA, 19 nt, Homo sapiens
gacucacucuuccgauauu

SEQ ID NO: 1412717 - RNA, 19 nt, Homo sapiens
ggaucaggaugaccguguu

SEQ ID NO: 1412718 - RNA, 19 nt, Homo sapiens
ccacauccucuuccuauuc

SEQ ID NO: 1412719 - RNA, 19 nt, Homo sapiens
cacugaagaggauuuaaua

SEQ ID NO: 1412720 - RNA, 19 nt, Homo sapiens
uggaaugucuuugacuuug

SEQ ID NO: 1412721 - RNA, 19 nt, Homo sapiens
ggccaccucuuucuuugug

SEQ ID NO: 1412722 - RNA, 19 nt, Homo sapiens
ggaauccacaaauaccaaa

SEQ ID NO: 1412723 - RNA, 19 nt, Homo sapiens
guucacgucucaucgauac

SEQ ID NO: 1412724 - RNA, 19 nt, Homo sapiens
ggaagacaaguaaagcaau

SEQ ID NO: 1412725 - RNA, 19 nt, Homo sapiens
gcggaagcgugaaauaagg

SEQ ID NO: 1412726 - RNA, 19 nt, Homo sapiens
ugaccuuccucuugauguu

SEQ ID NO: 1412727 - RNA, 19 nt, Homo sapiens
gguggcagcuugguuuauc

SEQ ID NO: 1412728 - RNA, 19 nt, Homo sapiens
gagguggcagcuugguuua

SEQ ID NO: 1412729 - RNA, 19 nt, Homo sapiens
gccauucguucacgucuca

SEQ ID NO: 1412730 - RNA, 19 nt, Homo sapiens
ccacugaagaggauuuaau

SEQ ID NO: 1412731 - RNA, 19 nt, Homo sapiens
cuaauuauggugccacuga

SEQ ID NO: 1412732 - RNA, 19 nt, Homo sapiens
ggaagagugccuggaaugu

SEQ ID NO: 1412733 - RNA, 19 nt, Homo sapiens
ggacugagugggcaaagag

SEQ ID NO: 1412734 - RNA, 19 nt, Homo sapiens
aagagaaccugggcugaga

SEQ ID NO: 1412735 - RNA, 19 nt, Homo sapiens
cagcguauagaacagauuu

SEQ ID NO: 1412736 - RNA, 19 nt, Homo sapiens
uugcuuggcuccauuaucu

SEQ ID NO: 1412737 - RNA, 19 nt, Homo sapiens
agcaugaccuuccucuuga

SEQ ID NO: 1412738 - RNA, 19 nt, Homo sapiens
gaagagugccuggaauguc

SEQ ID NO: 1412739 - RNA, 19 nt, Homo sapiens
gaucaggaugaccguguuu

SEQ ID NO: 1412740 - RNA, 19 nt, Homo sapiens
uaauuauggugccacugaa

SEQ ID NO: 1412741 - RNA, 19 nt, Homo sapiens
gaggcggaagcgugaaaua

SEQ ID NO: 1412742 - RNA, 19 nt, Homo sapiens
ccuggaaugucuuugacuu

SEQ ID NO: 1412743 - RNA, 19 nt, Homo sapiens
aaacuuguauugggagauc

SEQ ID NO: 1412744 - RNA, 19 nt, Homo sapiens
uguuggaaauagagaauug

SEQ ID NO: 1412745 - RNA, 19 nt, Homo sapiens
gaccuggaguaccaugugu

SEQ ID NO: 1412746 - RNA, 19 nt, Homo sapiens
ugacuggugucuacgucuu

SEQ ID NO: 1412747 - RNA, 19 nt, Homo sapiens
cugaaucuauuggucguuu

SEQ ID NO: 1412748 - RNA, 19 nt, Homo sapiens
aaagagagaguaccagucu

SEQ ID NO: 1412749 - RNA, 19 nt, Homo sapiens
gaugguugaaauagaauug

SEQ ID NO: 1412750 - RNA, 19 nt, Homo sapiens
gcuuggcuccauuaucuuu

SEQ ID NO: 1412751 - RNA, 19 nt, Homo sapiens
gcaugaccuuccucuugau

SEQ ID NO: 1412752 - RNA, 19 nt, Homo sapiens
uggagauccuucuuaagug

SEQ ID NO: 1412753 - RNA, 19 nt, Homo sapiens
accaaacuauggccauuga

SEQ ID NO: 1412754 - RNA, 19 nt, Homo sapiens
ugaugaacuuggaagacaa

SEQ ID NO: 1412755 - RNA, 19 nt, Homo sapiens
ucucaucgauacuuucucu

SEQ ID NO: 1412756 - RNA, 19 nt, Homo sapiens
gucaacaaagggaaaguuu

SEQ ID NO: 1412757 - RNA, 19 nt, Homo sapiens
aagagugccuggaaugucu

SEQ ID NO: 1412758 - RNA, 19 nt, Homo sapiens
uccuggagauccuucuuaa

SEQ ID NO: 1412759 - RNA, 19 nt, Homo sapiens
ggaauuguuggaaauagag

SEQ ID NO: 1412760 - RNA, 19 nt, Homo sapiens
auaaugaagggaauuguug

SEQ ID NO: 1412761 - RNA, 19 nt, Homo sapiens
agcaauggauggcuucaau

SEQ ID NO: 1412762 - RNA, 19 nt, Homo sapiens
ugcaggcacugaugaacuu

SEQ ID NO: 1412763 - RNA, 19 nt, Homo sapiens
gaaguuacaagaguuugca

SEQ ID NO: 1412764 - RNA, 19 nt, Homo sapiens
ggacugggagacucuugug

SEQ ID NO: 1412765 - RNA, 19 nt, Homo sapiens
aaacagaagagaccuuguc

SEQ ID NO: 1412766 - RNA, 19 nt, Homo sapiens
ggaccuggaguaccaugug

SEQ ID NO: 1412767 - RNA, 19 nt, Homo sapiens
gcucaaagcugacauguuc

SEQ ID NO: 1412768 - RNA, 19 nt, Homo sapiens
gcacugacgucaagccaua

SEQ ID NO: 1412769 - RNA, 19 nt, Homo sapiens
gaaauagaauugcuggaau

SEQ ID NO: 1412770 - RNA, 19 nt, Homo sapiens
gaagacaaguaaagcaaug

SEQ ID NO: 1412771 - RNA, 19 nt, Homo sapiens
gcugagacauggccgcuua

SEQ ID NO: 1412772 - RNA, 19 nt, Homo sapiens
gaagggaauuguuggaaau

SEQ ID NO: 1412773 - RNA, 19 nt, Homo sapiens
gagacucacucuuccgaua

SEQ ID NO: 1412774 - RNA, 19 nt, Homo sapiens
uccauuaucuuucgaagua

SEQ ID NO: 1412775 - RNA, 19 nt, Homo sapiens
gcuagugcguuucucuaua

SEQ ID NO: 1412776 - RNA, 19 nt, Homo sapiens
gagcaugaccuuccucuug

SEQ ID NO: 1412777 - RNA, 19 nt, Homo sapiens
cagaagagaccuugucaaa

SEQ ID NO: 1412778 - RNA, 19 nt, Homo sapiens
cuagugcguuucucuauaa

SEQ ID NO: 1412779 - RNA, 19 nt, Homo sapiens
gauacuuucucucucauug

SEQ ID NO: 1412780 - RNA, 19 nt, Homo sapiens
gaaugucuuugacuuuguu

SEQ ID NO: 1412781 - RNA, 19 nt, Homo sapiens
ucaaacuccuugcacaauu

SEQ ID NO: 1412782 - RNA, 19 nt, Homo sapiens
cgaauucccugguaacagu

SEQ ID NO: 1412783 - RNA, 19 nt, Homo sapiens
ugaagggaauuguuggaaa

SEQ ID NO: 1412784 - RNA, 19 nt, Homo sapiens
aagaggagcuagucaacaa

SEQ ID NO: 1412785 - RNA, 19 nt, Homo sapiens
ggagguggcagcuugguuu

SEQ ID NO: 1412786 - RNA, 19 nt, Homo sapiens
gggaauuguuggaaauaga

SEQ ID NO: 1412787 - RNA, 19 nt, Homo sapiens
gcaauggauggcuucaaua

SEQ ID NO: 1412788 - RNA, 19 nt, Homo sapiens
caaacuccuugcacaauuc

SEQ ID NO: 1412789 - RNA, 19 nt, Homo sapiens
ccacaaauaccaaacuaug

SEQ ID NO: 1412790 - RNA, 19 nt, Homo sapiens
cagcaucuauuucauccuu

SEQ ID NO: 1412791 - RNA, 19 nt, Homo sapiens
caugugcgcugcagucaga

SEQ ID NO: 1412792 - RNA, 19 nt, Homo sapiens
gaaccugggcugagacaug

SEQ ID NO: 1412793 - RNA, 19 nt, Homo sapiens
ggaaugucuuugacuuugu

SEQ ID NO: 1412794 - RNA, 19 nt, Homo sapiens
cauugaagcugaccuugga

SEQ ID NO: 1412795 - RNA, 19 nt, Homo sapiens
agaggaacguaagaaguua

SEQ ID NO: 1412796 - RNA, 19 nt, Homo sapiens
gauaaugaagggaauuguu

SEQ ID NO: 1412797 - RNA, 19 nt, Homo sapiens
ggaaauggaucaggaugac

SEQ ID NO: 1412798 - RNA, 19 nt, Homo sapiens
gcaucuauuucauccuuug

SEQ ID NO: 1412799 - RNA, 19 nt, Homo sapiens
ugaguguccucucuucaaa

SEQ ID NO: 1412800 - RNA, 19 nt, Homo sapiens
gcccugagcucgucuugca

SEQ ID NO: 1412801 - RNA, 19 nt, Homo sapiens
ggaguaccauguguucuuc

SEQ ID NO: 1412802 - RNA, 19 nt, Homo sapiens
agaagugucugaaguagag

SEQ ID NO: 1412803 - RNA, 19 nt, Homo sapiens
ccagaagaaacuuguauug

SEQ ID NO: 1412804 - RNA, 19 nt, Homo sapiens
cuauaaagccucagcguau

SEQ ID NO: 1412805 - RNA, 19 nt, Homo sapiens
uagaggaacguaagaaguu

SEQ ID NO: 1412806 - RNA, 19 nt, Homo sapiens
cauggccgcuuaccaacaa

SEQ ID NO: 1412807 - RNA, 19 nt, Homo sapiens
caccuuggaucauugguau

SEQ ID NO: 1412808 - RNA, 19 nt, Homo sapiens
gcucaucuucuucuacauu

SEQ ID NO: 1412809 - RNA, 19 nt, Homo sapiens
caauggauggcuucaauau

SEQ ID NO: 1412810 - RNA, 19 nt, Homo sapiens
gucuuugacuuuguuguua

SEQ ID NO: 1412811 - RNA, 19 nt, Homo sapiens
aaauagaauugcuggaauc

SEQ ID NO: 1412812 - RNA, 19 nt, Homo sapiens
ugaaauagaauugcuggaa

SEQ ID NO: 1412813 - RNA, 19 nt, Homo sapiens
guauagaacagauuucaca

SEQ ID NO: 1412814 - RNA, 19 nt, Homo sapiens
agacauggccgcuuaccaa

SEQ ID NO: 1412815 - RNA, 19 nt, Homo sapiens
gacucacucuuccgauauu

SEQ ID NO: 1412816 - RNA, 19 nt, Homo sapiens
ggaucaggaugaccguguu

SEQ ID NO: 1412817 - RNA, 19 nt, Homo sapiens
ccacauccucuuccuauuc

SEQ ID NO: 1412818 - RNA, 19 nt, Homo sapiens
cacugaagaggauuuaaua

SEQ ID NO: 1412819 - RNA, 19 nt, Homo sapiens
uggaaugucuuugacuuug

SEQ ID NO: 1412820 - RNA, 19 nt, Homo sapiens
ggccaccucuuucuuugug

SEQ ID NO: 1412821 - RNA, 19 nt, Homo sapiens
ggaauccacaaauaccaaa

SEQ ID NO: 1412822 - RNA, 19 nt, Homo sapiens
guucacgucucaucgauac

SEQ ID NO: 1412823 - RNA, 19 nt, Homo sapiens
ggaagacaaguaaagcaau

SEQ ID NO: 1412824 - RNA, 19 nt, Homo sapiens
ugaccuuccucuugauguu

SEQ ID NO: 1412825 - RNA, 19 nt, Homo sapiens
gguggcagcuugguuuauc

SEQ ID NO: 1412826 - RNA, 19 nt, Homo sapiens
gagguggcagcuugguuua

SEQ ID NO: 1412827 - RNA, 19 nt, Homo sapiens
gcggaagcgugaaauaagg

SEQ ID NO: 1412828 - RNA, 19 nt, Homo sapiens
gccauucguucacgucuca

SEQ ID NO: 1412829 - RNA, 19 nt, Homo sapiens
ccacugaagaggauuuaau

SEQ ID NO: 1412830 - RNA, 19 nt, Homo sapiens
cuaauuauggugccacuga

SEQ ID NO: 1412831 - RNA, 19 nt, Homo sapiens
aagagaaccugggcugaga

SEQ ID NO: 1412832 - RNA, 19 nt, Homo sapiens
ggaagagugccuggaaugu

SEQ ID NO: 1412833 - RNA, 19 nt, Homo sapiens
ggacugagugggcaaagag

SEQ ID NO: 1412834 - RNA, 19 nt, Homo sapiens
cagcguauagaacagauuu

SEQ ID NO: 1412835 - RNA, 19 nt, Homo sapiens
uugcuuggcuccauuaucu

SEQ ID NO: 1412836 - RNA, 19 nt, Homo sapiens
agcaugaccuuccucuuga

SEQ ID NO: 1412837 - RNA, 19 nt, Homo sapiens
gaagagugccuggaauguc

SEQ ID NO: 1412838 - RNA, 19 nt, Homo sapiens
gaucaggaugaccguguuu

SEQ ID NO: 1412839 - RNA, 19 nt, Homo sapiens
uaauuauggugccacugaa

SEQ ID NO: 1412840 - RNA, 19 nt, Homo sapiens
ccuggaaugucuuugacuu

SEQ ID NO: 1412841 - RNA, 19 nt, Homo sapiens
gaggcggaagcgugaaaua

SEQ ID NO: 1412842 - RNA, 19 nt, Homo sapiens
aaacuuguauugggagauc

SEQ ID NO: 1412843 - RNA, 19 nt, Homo sapiens
uguuggaaauagagaauug

SEQ ID NO: 1412844 - RNA, 19 nt, Homo sapiens
gaccuggaguaccaugugu

SEQ ID NO: 1412845 - RNA, 19 nt, Homo sapiens
ugacuggugucuacgucuu

SEQ ID NO: 1412846 - RNA, 19 nt, Homo sapiens
cugaaucuauuggucguuu

SEQ ID NO: 1412847 - RNA, 19 nt, Homo sapiens
aaagagagaguaccagucu

SEQ ID NO: 1412848 - RNA, 19 nt, Homo sapiens
gaugguugaaauagaauug

SEQ ID NO: 1412849 - RNA, 19 nt, Homo sapiens
gcuuggcuccauuaucuuu

SEQ ID NO: 1412850 - RNA, 19 nt, Homo sapiens
gcaugaccuuccucuugau

SEQ ID NO: 1412851 - RNA, 19 nt, Homo sapiens
uggagauccuucuuaagug

SEQ ID NO: 1412852 - RNA, 19 nt, Homo sapiens
accaaacuauggccauuga

SEQ ID NO: 1412853 - RNA, 19 nt, Homo sapiens
ugaugaacuuggaagacaa

SEQ ID NO: 1412854 - RNA, 19 nt, Homo sapiens
gucaacaaagggaaaguuu

SEQ ID NO: 1412855 - RNA, 19 nt, Homo sapiens
caaaauagaggacaguuca

SEQ ID NO: 1412856 - RNA, 19 nt, Homo sapiens
ucucaucgauacuuucucu

SEQ ID NO: 1412857 - RNA, 19 nt, Homo sapiens
aagagugccuggaaugucu

SEQ ID NO: 1412858 - RNA, 19 nt, Homo sapiens
uccuggagauccuucuuaa

SEQ ID NO: 1412859 - RNA, 19 nt, Homo sapiens
ggaauuguuggaaauagag

SEQ ID NO: 1412860 - RNA, 19 nt, Homo sapiens
auaaugaagggaauuguug

SEQ ID NO: 1412861 - RNA, 19 nt, Homo sapiens
agcaauggauggcuucaau

SEQ ID NO: 1412862 - RNA, 19 nt, Homo sapiens
ugcaggcacugaugaacuu

SEQ ID NO: 1412863 - RNA, 19 nt, Homo sapiens
gaaguuacaagaguuugca

SEQ ID NO: 1412864 - RNA, 19 nt, Homo sapiens
ggacugggagacucuugug

SEQ ID NO: 1412865 - RNA, 19 nt, Homo sapiens
aaacagaagagaccuuguc

SEQ ID NO: 1412866 - RNA, 19 nt, Homo sapiens
ggaccuggaguaccaugug

SEQ ID NO: 1412867 - RNA, 19 nt, Homo sapiens
gcucaaagcugacauguuc

SEQ ID NO: 1412868 - RNA, 19 nt, Homo sapiens
gcacugacgucaagccaua

SEQ ID NO: 1412869 - RNA, 19 nt, Homo sapiens
gaaauagaauugcuggaau

SEQ ID NO: 1412870 - RNA, 19 nt, Homo sapiens
gaagacaaguaaagcaaug

SEQ ID NO: 1412871 - RNA, 19 nt, Homo sapiens
gcugagacauggccgcuua

SEQ ID NO: 1412872 - RNA, 19 nt, Homo sapiens
gaagggaauuguuggaaau

SEQ ID NO: 1412873 - RNA, 19 nt, Homo sapiens
gagacucacucuuccgaua

SEQ ID NO: 1412874 - RNA, 19 nt, Homo sapiens
uccauuaucuuucgaagua

SEQ ID NO: 1412875 - RNA, 19 nt, Homo sapiens
gcuagugcguuucucuaua

SEQ ID NO: 1412876 - RNA, 19 nt, Homo sapiens
gagcaugaccuuccucuug

SEQ ID NO: 1412877 - RNA, 19 nt, Homo sapiens
cuagugcguuucucuauaa

SEQ ID NO: 1412878 - RNA, 19 nt, Homo sapiens
gauacuuucucucucauug

SEQ ID NO: 1412879 - RNA, 19 nt, Homo sapiens
gaaugucuuugacuuuguu

SEQ ID NO: 1412880 - RNA, 19 nt, Homo sapiens
ucaaacuccuugcacaauu

SEQ ID NO: 1412881 - RNA, 19 nt, Homo sapiens
cgaauucccugguaacagu

SEQ ID NO: 1412882 - RNA, 19 nt, Homo sapiens
ugaagggaauuguuggaaa

SEQ ID NO: 1412883 - RNA, 19 nt, Homo sapiens
ggagguggcagcuugguuu

SEQ ID NO: 1412884 - RNA, 19 nt, Homo sapiens
gggaauuguuggaaauaga

SEQ ID NO: 1412885 - RNA, 19 nt, Homo sapiens
gcaauggauggcuucaaua

SEQ ID NO: 1412886 - RNA, 19 nt, Homo sapiens
caaacuccuugcacaauuc

SEQ ID NO: 1412887 - RNA, 19 nt, Homo sapiens
ccacaaauaccaaacuaug

SEQ ID NO: 1412888 - RNA, 19 nt, Homo sapiens
cagcaucuauuucauccuu

SEQ ID NO: 1412889 - RNA, 19 nt, Homo sapiens
caugugcgcugcagucaga

SEQ ID NO: 1412890 - RNA, 19 nt, Homo sapiens
gaaccugggcugagacaug

SEQ ID NO: 1412891 - RNA, 19 nt, Homo sapiens
ggaaugucuuugacuuugu

SEQ ID NO: 1412892 - RNA, 19 nt, Homo sapiens
cauugaagcugaccuugga

SEQ ID NO: 1412893 - RNA, 19 nt, Homo sapiens
agaggaacguaagaaguua

SEQ ID NO: 1412894 - RNA, 19 nt, Homo sapiens
gauaaugaagggaauuguu

SEQ ID NO: 1412895 - RNA, 19 nt, Homo sapiens
ggaaauggaucaggaugac

SEQ ID NO: 1412896 - RNA, 19 nt, Homo sapiens
gcaucuauuucauccuuug

SEQ ID NO: 1412897 - RNA, 19 nt, Homo sapiens
ugaguguccucucuucaaa

SEQ ID NO: 1412898 - RNA, 19 nt, Homo sapiens
gcccugagcucgucuugca

SEQ ID NO: 1412899 - RNA, 19 nt, Homo sapiens
ggaguaccauguguucuuc

SEQ ID NO: 1412900 - RNA, 19 nt, Homo sapiens
ccagaagaaacuuguauug

SEQ ID NO: 1412901 - RNA, 19 nt, Homo sapiens
cuauaaagccucagcguau

SEQ ID NO: 1412902 - RNA, 19 nt, Homo sapiens
uagaggaacguaagaaguu

SEQ ID NO: 1412903 - RNA, 19 nt, Homo sapiens
caccuuggaucauugguau

SEQ ID NO: 1412904 - RNA, 19 nt, Homo sapiens
gcucaucuucuucuacauu

SEQ ID NO: 1412905 - RNA, 19 nt, Homo sapiens
cauggccgcuuaccaacaa

SEQ ID NO: 1412906 - RNA, 19 nt, Homo sapiens
caauggauggcuucaauau

SEQ ID NO: 1412907 - RNA, 19 nt, Homo sapiens
gucuuugacuuuguuguua

SEQ ID NO: 1412908 - RNA, 19 nt, Homo sapiens
aaauagaauugcuggaauc

SEQ ID NO: 1412909 - RNA, 19 nt, Homo sapiens
ugaaauagaauugcuggaa

SEQ ID NO: 1412910 - RNA, 19 nt, Homo sapiens
guauagaacagauuucaca

SEQ ID NO: 1412911 - RNA, 19 nt, Homo sapiens
agacauggccgcuuaccaa

SEQ ID NO: 1412912 - RNA, 19 nt, Homo sapiens
gacucacucuuccgauauu

SEQ ID NO: 1412913 - RNA, 19 nt, Homo sapiens
ggaucaggaugaccguguu

SEQ ID NO: 1412914 - RNA, 19 nt, Homo sapiens
uggaaugucuuugacuuug

SEQ ID NO: 1412915 - RNA, 19 nt, Homo sapiens
ggccaccucuuucuuugug

SEQ ID NO: 1412916 - RNA, 19 nt, Homo sapiens
ggaauccacaaauaccaaa

SEQ ID NO: 1412917 - RNA, 19 nt, Homo sapiens
guucacgucucaucgauac

SEQ ID NO: 1412918 - RNA, 19 nt, Homo sapiens
ggaagacaaguaaagcaau

SEQ ID NO: 1412919 - RNA, 19 nt, Homo sapiens
ugaccuuccucuugauguu

SEQ ID NO: 1412920 - RNA, 19 nt, Homo sapiens
gguggcagcuugguuuauc

SEQ ID NO: 1412921 - RNA, 19 nt, Homo sapiens
gagguggcagcuugguuua

SEQ ID NO: 1412922 - RNA, 19 nt, Homo sapiens
gcggaagcgugaaauaagg

SEQ ID NO: 1412923 - RNA, 19 nt, Homo sapiens
gccauucguucacgucuca

SEQ ID NO: 1412924 - RNA, 19 nt, Homo sapiens
ggacugagugggcaaagag

SEQ ID NO: 1412925 - RNA, 19 nt, Homo sapiens
aagagaaccugggcugaga

SEQ ID NO: 1412926 - RNA, 19 nt, Homo sapiens
ggaagagugccuggaaugu

SEQ ID NO: 1412927 - RNA, 19 nt, Homo sapiens
cagcguauagaacagauuu

SEQ ID NO: 1412928 - RNA, 19 nt, Homo sapiens
uugcuuggcuccauuaucu

SEQ ID NO: 1412929 - RNA, 19 nt, Homo sapiens
agcaugaccuuccucuuga

SEQ ID NO: 1412930 - RNA, 19 nt, Homo sapiens
gaagagugccuggaauguc

SEQ ID NO: 1412931 - RNA, 19 nt, Homo sapiens
gaucaggaugaccguguuu

SEQ ID NO: 1412932 - RNA, 19 nt, Homo sapiens
ccuggaaugucuuugacuu

SEQ ID NO: 1412933 - RNA, 19 nt, Homo sapiens
gaggcggaagcgugaaaua

SEQ ID NO: 1412934 - RNA, 19 nt, Homo sapiens
aaacuuguauugggagauc

SEQ ID NO: 1412935 - RNA, 19 nt, Homo sapiens
uguuggaaauagagaauug

SEQ ID NO: 1412936 - RNA, 19 nt, Homo sapiens
gaccuggaguaccaugugu

SEQ ID NO: 1412937 - RNA, 19 nt, Homo sapiens
ugacuggugucuacgucuu

SEQ ID NO: 1412938 - RNA, 19 nt, Homo sapiens
gaugguugaaauagaauug

SEQ ID NO: 1412939 - RNA, 19 nt, Homo sapiens
gcuuggcuccauuaucuuu

SEQ ID NO: 1412940 - RNA, 19 nt, Homo sapiens
gcaugaccuuccucuugau

SEQ ID NO: 1412941 - RNA, 19 nt, Homo sapiens
uggagauccuucuuaagug

SEQ ID NO: 1412942 - RNA, 19 nt, Homo sapiens
accaaacuauggccauuga

SEQ ID NO: 1412943 - RNA, 19 nt, Homo sapiens
ugaugaacuuggaagacaa

SEQ ID NO: 1412944 - RNA, 19 nt, Homo sapiens
ucucaucgauacuuucucu

SEQ ID NO: 1412945 - RNA, 19 nt, Homo sapiens
aagagugccuggaaugucu

SEQ ID NO: 1412946 - RNA, 19 nt, Homo sapiens
uccuggagauccuucuuaa

SEQ ID NO: 1412947 - RNA, 19 nt, Homo sapiens
ggaauuguuggaaauagag

SEQ ID NO: 1412948 - RNA, 19 nt, Homo sapiens
auaaugaagggaauuguug

SEQ ID NO: 1412949 - RNA, 19 nt, Homo sapiens
agcaauggauggcuucaau

SEQ ID NO: 1412950 - RNA, 19 nt, Homo sapiens
ugcaggcacugaugaacuu

SEQ ID NO: 1412951 - RNA, 19 nt, Homo sapiens
gaaguuacaagaguuugca

SEQ ID NO: 1412952 - RNA, 19 nt, Homo sapiens
ggacugggagacucuugug

SEQ ID NO: 1412953 - RNA, 19 nt, Homo sapiens
ggaccuggaguaccaugug

SEQ ID NO: 1412954 - RNA, 19 nt, Homo sapiens
caaacuauggccauugaag

SEQ ID NO: 1412955 - RNA, 19 nt, Homo sapiens
ccugagcucgucuugcaua

SEQ ID NO: 1412956 - RNA, 19 nt, Homo sapiens
aacaccagcuagugcguuu

SEQ ID NO: 1412957 - RNA, 19 nt, Homo sapiens
cugaugaacuuggaagaca

SEQ ID NO: 1412958 - RNA, 19 nt, Homo sapiens
gucaagccauagcaaaaua

SEQ ID NO: 1412959 - RNA, 19 nt, Homo sapiens
cagaucauccagaggagaa

SEQ ID NO: 1412960 - RNA, 19 nt, Homo sapiens
gcacacuaucagggaguua

SEQ ID NO: 1412961 - RNA, 19 nt, Homo sapiens
ucuggaaggugccugaagu

SEQ ID NO: 1412962 - RNA, 19 nt, Homo sapiens
gccagaagaaacuuguauu

SEQ ID NO: 1412963 - RNA, 19 nt, Homo sapiens
ucagggcccucaagagcau

SEQ ID NO: 1412964 - RNA, 19 nt, Homo sapiens
ucaaagcugacauguucaa

SEQ ID NO: 1412965 - RNA, 19 nt, Homo sapiens
ucuauuucauccuuugguu

SEQ ID NO: 1412966 - RNA, 19 nt, Homo sapiens
cucaucuucuucuacauuu

SEQ ID NO: 1412967 - RNA, 19 nt, Homo sapiens
uagaaaggcugaauaguaa

SEQ ID NO: 1412968 - RNA, 19 nt, Homo sapiens
gaaauagaauugcuggaau

SEQ ID NO: 1412969 - RNA, 19 nt, Homo sapiens
gaaacccugucucuacuaa

SEQ ID NO: 1412970 - RNA, 19 nt, Homo sapiens
gcugagacauggccgcuua

SEQ ID NO: 1412971 - RNA, 19 nt, Homo sapiens
gaaagaacaaguuaacaug

SEQ ID NO: 1412972 - RNA, 19 nt, Homo sapiens
gagcaaaguagacuaacua

SEQ ID NO: 1412973 - RNA, 19 nt, Homo sapiens
gcuagugcguuucucuaua

SEQ ID NO: 1412974 - RNA, 19 nt, Homo sapiens
caacaucaaugccaacaag

SEQ ID NO: 1412975 - RNA, 19 nt, Homo sapiens
cuagugcguuucucuauaa

SEQ ID NO: 1412976 - RNA, 19 nt, Homo sapiens
gauacuuucucucucauug

SEQ ID NO: 1412977 - RNA, 19 nt, Homo sapiens
gaaugucuuugacuuuguu

SEQ ID NO: 1412978 - RNA, 19 nt, Homo sapiens
ucaaacuccuugcacaauu

SEQ ID NO: 1412979 - RNA, 19 nt, Homo sapiens
auagaaaggcugaauagua

SEQ ID NO: 1412980 - RNA, 19 nt, Homo sapiens
caaggugauuugacuguug

SEQ ID NO: 1412981 - RNA, 19 nt, Homo sapiens
gaaucgaaagaacaaguua

SEQ ID NO: 1412982 - RNA, 19 nt, Homo sapiens
ggagguggcagcuugguuu

SEQ ID NO: 1412983 - RNA, 19 nt, Homo sapiens
ugugagggcuuaacauaga

SEQ ID NO: 1412984 - RNA, 19 nt, Homo sapiens
caaacuccuugcacaauuc

SEQ ID NO: 1412985 - RNA, 19 nt, Homo sapiens
ccacaaauaccaaacuaug

SEQ ID NO: 1412986 - RNA, 19 nt, Homo sapiens
agauaaaugugagggcuua

SEQ ID NO: 1412987 - RNA, 19 nt, Homo sapiens
ggaacaaugaagaggauaa

SEQ ID NO: 1412988 - RNA, 19 nt, Homo sapiens
caugugcgcugcagucaga

SEQ ID NO: 1412989 - RNA, 19 nt, Homo sapiens
gaaccugggcugagacaug

SEQ ID NO: 1412990 - RNA, 19 nt, Homo sapiens
gugccuaggugaaucgaaa

SEQ ID NO: 1412991 - RNA, 19 nt, Homo sapiens
ggaaugucuuugacuuugu

SEQ ID NO: 1412992 - RNA, 19 nt, Homo sapiens
cauugaagcugaccuugga

SEQ ID NO: 1412993 - RNA, 19 nt, Homo sapiens
caagagcaucugccgguua

SEQ ID NO: 1412994 - RNA, 19 nt, Homo sapiens
ugaguguccucucuucaaa

SEQ ID NO: 1412995 - RNA, 19 nt, Homo sapiens
gcccugagcucgucuugca

SEQ ID NO: 1412996 - RNA, 19 nt, Homo sapiens
uaagugccaagcauuauuu

SEQ ID NO: 1412997 - RNA, 19 nt, Homo sapiens
uagacuaacuacaacauca

SEQ ID NO: 1412998 - RNA, 19 nt, Homo sapiens
uuagugggaugaagaaugu

SEQ ID NO: 1412999 - RNA, 19 nt, Homo sapiens
ccagaagaaacuuguauug

SEQ ID NO: 1413000 - RNA, 19 nt, Homo sapiens
gcaggaguuguugguauua

SEQ ID NO: 1413001 - RNA, 19 nt, Homo sapiens
cuauaaagccucagcguau

SEQ ID NO: 1413002 - RNA, 19 nt, Homo sapiens
gcaagguagauaaauguga

SEQ ID NO: 1413003 - RNA, 19 nt, Homo sapiens
cauggccgcuuaccaacaa

SEQ ID NO: 1413004 - RNA, 19 nt, Homo sapiens
cgaaagaacaaguuaacau

SEQ ID NO: 1413005 - RNA, 19 nt, Homo sapiens
caaugaagaggauaagaug

SEQ ID NO: 1413006 - RNA, 19 nt, Homo sapiens
gguauuaggagcaaaguag

SEQ ID NO: 1413007 - RNA, 19 nt, Homo sapiens
gucuuugacuuuguuguua

SEQ ID NO: 1413008 - RNA, 19 nt, Homo sapiens
aaauagaauugcuggaauc

SEQ ID NO: 1413009 - RNA, 19 nt, Homo sapiens
ugaaauagaauugcuggaa

SEQ ID NO: 1413010 - RNA, 19 nt, Homo sapiens
guauagaacagauuucaca

SEQ ID NO: 1413011 - RNA, 19 nt, Homo sapiens
ggagcaaaguagacuaacu

SEQ ID NO: 1413012 - RNA, 19 nt, Homo sapiens
agacauggccgcuuaccaa

SEQ ID NO: 1413013 - RNA, 19 nt, Homo sapiens
ggugaaacccugucucuac

SEQ ID NO: 1413014 - RNA, 19 nt, Homo sapiens
cauuuaugcuccacaacaa

SEQ ID NO: 1413015 - RNA, 19 nt, Homo sapiens
uggaaugucuuugacuuug

SEQ ID NO: 1413016 - RNA, 19 nt, Homo sapiens
ggccaccucuuucuuugug

SEQ ID NO: 1413017 - RNA, 19 nt, Homo sapiens
gccgguuacugagcacuua

SEQ ID NO: 1413018 - RNA, 19 nt, Homo sapiens
gaaugugccuaggugaauc

SEQ ID NO: 1413019 - RNA, 19 nt, Homo sapiens
gauccugaggguucguuua

SEQ ID NO: 1413020 - RNA, 19 nt, Homo sapiens
ggaauccacaaauaccaaa

SEQ ID NO: 1413021 - RNA, 19 nt, Homo sapiens
guucacgucucaucgauac

SEQ ID NO: 1413022 - RNA, 19 nt, Homo sapiens
gcggaagcgugaaauaagg

SEQ ID NO: 1413023 - RNA, 19 nt, Homo sapiens
gguggcagcuugguuuauc

SEQ ID NO: 1413024 - RNA, 19 nt, Homo sapiens
gagguggcagcuugguuua

SEQ ID NO: 1413025 - RNA, 19 nt, Homo sapiens
gggcaagguagauaaaugu

SEQ ID NO: 1413026 - RNA, 19 nt, Homo sapiens
acuuauaaccuguguguuu

SEQ ID NO: 1413027 - RNA, 19 nt, Homo sapiens
gaagaggauaagaugaaga

SEQ ID NO: 1413028 - RNA, 19 nt, Homo sapiens
gccauucguucacgucuca

SEQ ID NO: 1413029 - RNA, 19 nt, Homo sapiens
gagaccagccugaccaaca

SEQ ID NO: 1413030 - RNA, 19 nt, Homo sapiens
gcaacuuaauauagaaagg

SEQ ID NO: 1413031 - RNA, 19 nt, Homo sapiens
aagagaaccugggcugaga

SEQ ID NO: 1413032 - RNA, 19 nt, Homo sapiens
ggaagagugccuggaaugu

SEQ ID NO: 1413033 - RNA, 19 nt, Homo sapiens
ggacugagugggcaaagag

SEQ ID NO: 1413034 - RNA, 19 nt, Homo sapiens
cagcguauagaacagauuu

SEQ ID NO: 1413035 - RNA, 19 nt, Homo sapiens
gaacaaugaagaggauaag

SEQ ID NO: 1413036 - RNA, 19 nt, Homo sapiens
gaagagugccuggaauguc

SEQ ID NO: 1413037 - RNA, 19 nt, Homo sapiens
ccuggaaugucuuugacuu

SEQ ID NO: 1413038 - RNA, 19 nt, Homo sapiens
gaggcggaagcgugaaaua

SEQ ID NO: 1413039 - RNA, 19 nt, Homo sapiens
aaacuuguauugggagauc

SEQ ID NO: 1413040 - RNA, 19 nt, Homo sapiens
gugaaacccugucucuacu

SEQ ID NO: 1413041 - RNA, 19 nt, Homo sapiens
gaauaguaagcacuucuca

SEQ ID NO: 1413042 - RNA, 19 nt, Homo sapiens
ccugaggguucguuuagug

SEQ ID NO: 1413043 - RNA, 19 nt, Homo sapiens
gucaugaggucaggaguuc

SEQ ID NO: 1413044 - RNA, 19 nt, Homo sapiens
ggauaacgcccagggaaca

SEQ ID NO: 1413045 - RNA, 19 nt, Homo sapiens
gaugguugaaauagaauug

SEQ ID NO: 1413046 - RNA, 19 nt, Homo sapiens
gugagggcuuaacauagaa

SEQ ID NO: 1413047 - RNA, 19 nt, Homo sapiens
auaguaagcacuucucaga

SEQ ID NO: 1413048 - RNA, 19 nt, Homo sapiens
ugcaggaguuguugguauu

SEQ ID NO: 1413049 - RNA, 19 nt, Homo sapiens
uggagauccuucuuaagug

SEQ ID NO: 1413050 - RNA, 19 nt, Homo sapiens
accaaacuauggccauuga

SEQ ID NO: 1413051 - RNA, 19 nt, Homo sapiens
ucucaucgauacuuucucu

SEQ ID NO: 1413052 - RNA, 19 nt, Homo sapiens
aagagugccuggaaugucu

SEQ ID NO: 1413053 - RNA, 19 nt, Homo sapiens
uccuggagauccuucuuaa

SEQ ID NO: 1413054 - RNA, 19 nt, Homo sapiens
ggucaugaggucaggaguu

SEQ ID NO: 1413055 - RNA, 19 nt, Homo sapiens
ccuguaaucccagcacuuu

SEQ ID NO: 1413056 - RNA, 19 nt, Homo sapiens
uaaaugugagggcuuaaca

SEQ ID NO: 1413057 - RNA, 19 nt, Homo sapiens
aggauaagaugaagaagcu

SEQ ID NO: 1413058 - RNA, 19 nt, Homo sapiens
aagaggauaagaugaagaa

SEQ ID NO: 1413059 - RNA, 19 nt, Homo sapiens
uaggagcaaaguagacuaa

SEQ ID NO: 1413060 - RNA, 19 nt, Homo sapiens
ggaguuguugguauuagga

SEQ ID NO: 1413061 - RNA, 19 nt, Homo sapiens
ccugagcucgucuugcaua

SEQ ID NO: 1413062 - RNA, 19 nt, Homo sapiens
agaccagccugaccaacau

SEQ ID NO: 1413063 - RNA, 19 nt, Homo sapiens
ugaagaggauaagaugaag

SEQ ID NO: 1413064 - RNA, 19 nt, Homo sapiens
acaaugaagaggauaagau

SEQ ID NO: 1413065 - RNA, 19 nt, Homo sapiens
gcccagggaacaaugaaga

SEQ ID NO: 1413066 - RNA, 19 nt, Homo sapiens
uacuaagugccaagcauua

SEQ ID NO: 1413067 - RNA, 19 nt, Homo sapiens
ggacaacauucuucccuuu

SEQ ID NO: 1413068 - RNA, 19 nt, Homo sapiens
ucaugaagcugguaacuau

SEQ ID NO: 1413069 - RNA, 19 nt, Homo sapiens
ccagauaacugucaugaag

SEQ ID NO: 1413070 - RNA, 19 nt, Homo sapiens
cauuaaagcuucuucugaa

SEQ ID NO: 1413071 - RNA, 19 nt, Homo sapiens
ggugugacaucaagauaaa

SEQ ID NO: 1413072 - RNA, 19 nt, Homo sapiens
ggacaaauaaagcaaugaa

SEQ ID NO: 1413073 - RNA, 19 nt, Homo sapiens
gaaaccuguucuaccaauu

SEQ ID NO: 1413074 - RNA, 19 nt, Homo sapiens
caacauucuucccuuuaug

SEQ ID NO: 1413075 - RNA, 19 nt, Homo sapiens
uaaggaaguguguaaauga

SEQ ID NO: 1413076 - RNA, 19 nt, Homo sapiens
ggaagaugaugcuccuauc

SEQ ID NO: 1413077 - RNA, 19 nt, Homo sapiens
gacaacauucuucccuuua

SEQ ID NO: 1413078 - RNA, 19 nt, Homo sapiens
cuaaggaaguguguaaaug

SEQ ID NO: 1413079 - RNA, 19 nt, Homo sapiens
aaaccuguucuaccaauua

SEQ ID NO: 1413080 - RNA, 19 nt, Homo sapiens
ccaucagccuuuguaguua

SEQ ID NO: 1413081 - RNA, 19 nt, Homo sapiens
gcuacugccuuccucauca

SEQ ID NO: 1413082 - RNA, 19 nt, Homo sapiens
gggcuaaggaaguguguaa

SEQ ID NO: 1413083 - RNA, 19 nt, Homo sapiens
ccugaaaccuguucuacca

SEQ ID NO: 1413084 - RNA, 19 nt, Homo sapiens
ugaaaccuguucuaccaau

SEQ ID NO: 1413085 - RNA, 19 nt, Homo sapiens
ccauuaaagcuucuucuga

SEQ ID NO: 1413086 - RNA, 19 nt, Homo sapiens
acaacauucuucccuuuau

SEQ ID NO: 1413087 - RNA, 19 nt, Homo sapiens
gaucaaaugcccuaaaaug

SEQ ID NO: 1413088 - RNA, 19 nt, Homo sapiens
gcuaaggaaguguguaaau

SEQ ID NO: 1413089 - RNA, 19 nt, Homo sapiens
ugacaaguuggcaccuuua

SEQ ID NO: 1413090 - RNA, 19 nt, Homo sapiens
caaaugcccuaaaauguag

SEQ ID NO: 1413091 - RNA, 19 nt, Homo sapiens
ucaaaugcccuaaaaugua

SEQ ID NO: 1413092 - RNA, 19 nt, Homo sapiens
ggauggggauggaagauga

SEQ ID NO: 1413093 - RNA, 19 nt, Homo sapiens
aaggacaaauaaagcaaug

SEQ ID NO: 1413094 - RNA, 19 nt, Homo sapiens
gaaaaggacaaauaaagca

SEQ ID NO: 1413095 - RNA, 19 nt, Homo sapiens
uagaucaaaugcccuaaaa

SEQ ID NO: 1413096 - RNA, 19 nt, Homo sapiens
uggaggcgcuaucacacuu

SEQ ID NO: 1413097 - RNA, 19 nt, Homo sapiens
caucagccuuuguaguuac

SEQ ID NO: 1413098 - RNA, 19 nt, Homo sapiens
uugacaaguuggcaccuuu

SEQ ID NO: 1413099 - RNA, 19 nt, Homo sapiens
cuacugccuuccucaucaa

SEQ ID NO: 1413100 - RNA, 19 nt, Homo sapiens
ccaauuauagaucaaaugc

SEQ ID NO: 1413101 - RNA, 19 nt, Homo sapiens
gugaccaucagccuuugua

SEQ ID NO: 1413102 - RNA, 19 nt, Homo sapiens
cugaagcugugaagaaacu

SEQ ID NO: 1413103 - RNA, 19 nt, Homo sapiens
accaucagccuuuguaguu

SEQ ID NO: 1413104 - RNA, 19 nt, Homo sapiens
gaagaugaugcuccuaucc

SEQ ID NO: 1413105 - RNA, 19 nt, Homo sapiens
ugaagcugguaacuaucuu

SEQ ID NO: 1413106 - RNA, 19 nt, Homo sapiens
acucugggcauuucuguug

SEQ ID NO: 1413107 - RNA, 19 nt, Homo sapiens
gaccaucagccuuuguagu

SEQ ID NO: 1413108 - RNA, 19 nt, Homo sapiens
aaccuguucuaccaauuau

SEQ ID NO: 1413109 - RNA, 19 nt, Homo sapiens
aaggaaguguguaaaugag

SEQ ID NO: 1413110 - RNA, 19 nt, Homo sapiens
gucaugaagcugguaacua

SEQ ID NO: 1413111 - RNA, 19 nt, Homo sapiens
caaguuggcaccuuuaccu

SEQ ID NO: 1413112 - RNA, 19 nt, Homo sapiens
uggaagaugaugcuccuau

SEQ ID NO: 1413113 - RNA, 19 nt, Homo sapiens
guugacaaguuggcaccuu

SEQ ID NO: 1413114 - RNA, 19 nt, Homo sapiens
ccuguucuaccaauuauag

SEQ ID NO: 1413115 - RNA, 19 nt, Homo sapiens
agauaacugucaugaagcu

SEQ ID NO: 1413116 - RNA, 19 nt, Homo sapiens
uauccucccugccugaaac

SEQ ID NO: 1413117 - RNA, 19 nt, Homo sapiens
ugugacaucaagauaaaga

SEQ ID NO: 1413118 - RNA, 19 nt, Homo sapiens
gaacugaucuccaaauuug

SEQ ID NO: 1413119 - RNA, 19 nt, Homo sapiens
ggacuuaucuucagaguuu

SEQ ID NO: 1413120 - RNA, 19 nt, Homo sapiens
caacugaagucuuguauau

SEQ ID NO: 1413121 - RNA, 19 nt, Homo sapiens
uaaaggaacugaucuccaa

SEQ ID NO: 1413122 - RNA, 19 nt, Homo sapiens
caauaccuaugcucauuua

SEQ ID NO: 1413123 - RNA, 19 nt, Homo sapiens
ucaauacccucuccaguuu

SEQ ID NO: 1413124 - RNA, 19 nt, Homo sapiens
ggacaaagcaaguugaaga

SEQ ID NO: 1413125 - RNA, 19 nt, Homo sapiens
ggaccuugauucuucuaua

SEQ ID NO: 1413126 - RNA, 19 nt, Homo sapiens
gagagaaacacggguauua

SEQ ID NO: 1413127 - RNA, 19 nt, Homo sapiens
ugucuucacuccauuauaa

SEQ ID NO: 1413128 - RNA, 19 nt, Homo sapiens
ccucagagcugucccuuga

SEQ ID NO: 1413129 - RNA, 19 nt, Homo sapiens
gcaugaaugugguucugua

SEQ ID NO: 1413130 - RNA, 19 nt, Homo sapiens
uaacagcgauuauguggau

SEQ ID NO: 1413131 - RNA, 19 nt, Homo sapiens
gagguaauaugaacagaug

SEQ ID NO: 1413132 - RNA, 19 nt, Homo sapiens
gaggagcucucgacuuaga

SEQ ID NO: 1413133 - RNA, 19 nt, Homo sapiens
ccauggaucugccuuacua

SEQ ID NO: 1413134 - RNA, 19 nt, Homo sapiens
cgacuuagagguaauauga

SEQ ID NO: 1413135 - RNA, 19 nt, Homo sapiens
ggagaggauugaaauuaga

SEQ ID NO: 1413136 - RNA, 19 nt, Homo sapiens
gaagagaugaguaacaguu

SEQ ID NO: 1413137 - RNA, 19 nt, Homo sapiens
gaucagcaccuucucugua

SEQ ID NO: 1413138 - RNA, 19 nt, Homo sapiens
gaaauuagaguuggaaaca

SEQ ID NO: 1413139 - RNA, 19 nt, Homo sapiens
gagggagguuuguugaauu

SEQ ID NO: 1413140 - RNA, 19 nt, Homo sapiens
uuacacaucucuccucaga

SEQ ID NO: 1413141 - RNA, 19 nt, Homo sapiens
gaccuugauucuucuauau

SEQ ID NO: 1413142 - RNA, 19 nt, Homo sapiens
caaagcaaguugaagagau

SEQ ID NO: 1413143 - RNA, 19 nt, Homo sapiens
guaaauaggagagaacuga

SEQ ID NO: 1413144 - RNA, 19 nt, Homo sapiens
ucucuuaccuaucaucaaa

SEQ ID NO: 1413145 - RNA, 19 nt, Homo sapiens
ggaacugaucuccaaauuu

SEQ ID NO: 1413146 - RNA, 19 nt, Homo sapiens
gagauagucacauuccuuu

SEQ ID NO: 1413147 - RNA, 19 nt, Homo sapiens
caaauucuaugcccuuucu

SEQ ID NO: 1413148 - RNA, 19 nt, Homo sapiens
ggucuuaguuucuuugucu

SEQ ID NO: 1413149 - RNA, 19 nt, Homo sapiens
acacggguauuacaggaua

SEQ ID NO: 1413150 - RNA, 19 nt, Homo sapiens
gauggcaacuuucuuuuaa

SEQ ID NO: 1413151 - RNA, 19 nt, Homo sapiens
ucauggaccuugauucuuc

SEQ ID NO: 1413152 - RNA, 19 nt, Homo sapiens
caagagcguucuccaugga

SEQ ID NO: 1413153 - RNA, 19 nt, Homo sapiens
ugauggagaugcauacaga

SEQ ID NO: 1413154 - RNA, 19 nt, Homo sapiens
uaccgaaucuucagagaga

SEQ ID NO: 1413155 - RNA, 19 nt, Homo sapiens
gcaauaccuaugcucauuu

SEQ ID NO: 1413156 - RNA, 19 nt, Homo sapiens
gagcugugccuaguucaua

SEQ ID NO: 1413157 - RNA, 19 nt, Homo sapiens
guggaugucuugccuugaa

SEQ ID NO: 1413158 - RNA, 19 nt, Homo sapiens
gcgauuauguggaugucuu

SEQ ID NO: 1413159 - RNA, 19 nt, Homo sapiens
gauacagacugcagaaggu

SEQ ID NO: 1413160 - RNA, 19 nt, Homo sapiens
gauagugaguauucuuaca

SEQ ID NO: 1413161 - RNA, 19 nt, Homo sapiens
gguuagggccuccuguaua

SEQ ID NO: 1413162 - RNA, 19 nt, Homo sapiens
cucauuagaucuacuaguu

SEQ ID NO: 1413163 - RNA, 19 nt, Homo sapiens
acugaagucuuguauauuc

SEQ ID NO: 1413164 - RNA, 19 nt, Homo sapiens
ccagagcugugccuaguuc

SEQ ID NO: 1413165 - RNA, 19 nt, Homo sapiens
gauaugguguuggugaaau

SEQ ID NO: 1413166 - RNA, 19 nt, Homo sapiens
gcauacagaucagcaccuu

SEQ ID NO: 1413167 - RNA, 19 nt, Homo sapiens
aaagcaaguugaagagaug

SEQ ID NO: 1413168 - RNA, 19 nt, Homo sapiens
gcccuuucauggagucaua

SEQ ID NO: 1413169 - RNA, 19 nt, Homo sapiens
uaauuccacuuaugcauca

SEQ ID NO: 1413170 - RNA, 19 nt, Homo sapiens
gaucgggagugauggagau

SEQ ID NO: 1413171 - RNA, 19 nt, Homo sapiens
agggaaugcuuagaaauuu

SEQ ID NO: 1413172 - RNA, 19 nt, Homo sapiens
cagggaaugcuuagaaauu

SEQ ID NO: 1413173 - RNA, 19 nt, Homo sapiens
gagguuuguugaauugguu

SEQ ID NO: 1413174 - RNA, 19 nt, Homo sapiens
ugauuucuguucccaacua

SEQ ID NO: 1413175 - RNA, 19 nt, Homo sapiens
ggagugauggagaugcaua

SEQ ID NO: 1413176 - RNA, 19 nt, Homo sapiens
ggugagggaucgggaguga

SEQ ID NO: 1413177 - RNA, 19 nt, Homo sapiens
gagaaacacggguauuaca

SEQ ID NO: 1413178 - RNA, 19 nt, Homo sapiens
guuagggccuccuguauac

SEQ ID NO: 1413179 - RNA, 19 nt, Homo sapiens
gguugggucucccuuguau

SEQ ID NO: 1413180 - RNA, 19 nt, Homo sapiens
ugauguauguggagauuuc

SEQ ID NO: 1413181 - RNA, 19 nt, Homo sapiens
gaagucuuguauauucugu

SEQ ID NO: 1413182 - RNA, 19 nt, Homo sapiens
gauguuuucucaugcauaa

SEQ ID NO: 1413183 - RNA, 19 nt, Homo sapiens
ugagggagguuuguugaau

SEQ ID NO: 1413184 - RNA, 19 nt, Homo sapiens
gguucuaagugccaucaaa

SEQ ID NO: 1413185 - RNA, 19 nt, Homo sapiens
ugggacagccugaacauuu

SEQ ID NO: 1413186 - RNA, 19 nt, Homo sapiens
ucacucuucuuucuuggaa

SEQ ID NO: 1413187 - RNA, 19 nt, Homo sapiens
ucuacuaguuuaccuguug

SEQ ID NO: 1413188 - RNA, 19 nt, Homo sapiens
caauuuauggcuacuauuc

SEQ ID NO: 1413189 - RNA, 19 nt, Homo sapiens
cuggucaguuugaaauaua

SEQ ID NO: 1413190 - RNA, 19 nt, Homo sapiens
agauaaggcugccggacaa

SEQ ID NO: 1413191 - RNA, 19 nt, Homo sapiens
cuaauaggauaugguguug

SEQ ID NO: 1413192 - RNA, 19 nt, Homo sapiens
gaacagaugaacagacacu

SEQ ID NO: 1413193 - RNA, 19 nt, Homo sapiens
ccacuggacuuaucuucag

SEQ ID NO: 1413194 - RNA, 19 nt, Homo sapiens
cugguucuuucuaaucuua

SEQ ID NO: 1413195 - RNA, 19 nt, Homo sapiens
gugguugggugggaugaua

SEQ ID NO: 1413196 - RNA, 19 nt, Homo sapiens
acacuugucugugaguuug

SEQ ID NO: 1413197 - RNA, 19 nt, Homo sapiens
guuggaaacauuugugaaa

SEQ ID NO: 1413198 - RNA, 19 nt, Homo sapiens
gagauggagaggauugaaa

SEQ ID NO: 1413199 - RNA, 19 nt, Homo sapiens
uacagggaaugcuuagaaa

SEQ ID NO: 1413200 - RNA, 19 nt, Homo sapiens
ugaguauucuuacacuguu

SEQ ID NO: 1413201 - RNA, 19 nt, Homo sapiens
gguaauaugaacagaugaa

SEQ ID NO: 1413202 - RNA, 19 nt, Homo sapiens
uggagaggauugaaauuag

SEQ ID NO: 1413203 - RNA, 19 nt, Homo sapiens
caaauguccucuuuuacuu

SEQ ID NO: 1413204 - RNA, 19 nt, Homo sapiens
gcccagagcugugccuagu

SEQ ID NO: 1413205 - RNA, 19 nt, Homo sapiens
ccagagcaccaaacuucua

SEQ ID NO: 1413206 - RNA, 19 nt, Homo sapiens
ucacuccauuauaaaggua

SEQ ID NO: 1413207 - RNA, 19 nt, Homo sapiens
uuacagggaaugcuuagaa

SEQ ID NO: 1413208 - RNA, 19 nt, Homo sapiens
ugguguuggugaaauguua

SEQ ID NO: 1413209 - RNA, 19 nt, Homo sapiens
cccaaaguguggagcauug

SEQ ID NO: 1413210 - RNA, 19 nt, Homo sapiens
gaaugugguucuguacagu

SEQ ID NO: 1413211 - RNA, 19 nt, Homo sapiens
guggauggcaacuuucuuu

SEQ ID NO: 1413212 - RNA, 19 nt, Homo sapiens
ccaaacuucuaguggacaa

SEQ ID NO: 1413213 - RNA, 19 nt, Homo sapiens
guauuacagggaaugcuua

SEQ ID NO: 1413214 - RNA, 19 nt, Homo sapiens
ggccuccuguauacauuaa

SEQ ID NO: 1413215 - RNA, 19 nt, Homo sapiens
ugaccaagcaagacuguga

SEQ ID NO: 1413216 - RNA, 19 nt, Homo sapiens
guccagagcaccaaacuuc

SEQ ID NO: 1413217 - RNA, 19 nt, Homo sapiens
uauguuuacccauugguua

SEQ ID NO: 1413218 - RNA, 19 nt, Homo sapiens
gagaagcugagaaaugaua

SEQ ID NO: 1413219 - RNA, 19 nt, Homo sapiens
guaaggagaagcugagaaa

SEQ ID NO: 1413220 - RNA, 19 nt, Homo sapiens
guucaugacucuccucuuc

SEQ ID NO: 1413221 - RNA, 19 nt, Homo sapiens
aggagaagcugagaaauga

SEQ ID NO: 1413222 - RNA, 19 nt, Homo sapiens
cccaagaucuccaaggauu

SEQ ID NO: 1413223 - RNA, 19 nt, Homo sapiens
gcagcaggcuuuacgucuu

SEQ ID NO: 1413224 - RNA, 19 nt, Homo sapiens
guaaaggagccguccauga

SEQ ID NO: 1413225 - RNA, 19 nt, Homo sapiens
agacguccuugacucagua

SEQ ID NO: 1413226 - RNA, 19 nt, Homo sapiens
cagcaggcuuuacgucuuc

SEQ ID NO: 1413227 - RNA, 19 nt, Homo sapiens
gaaaagaugcagucgaaga

SEQ ID NO: 1413228 - RNA, 19 nt, Homo sapiens
uaaaggagccguccaugac

SEQ ID NO: 1413229 - RNA, 19 nt, Homo sapiens
caagaucuccaaggauuug

SEQ ID NO: 1413230 - RNA, 19 nt, Homo sapiens
uaaagacguccuugacuca

SEQ ID NO: 1413231 - RNA, 19 nt, Homo sapiens
guccuugacucaguacuau

SEQ ID NO: 1413232 - RNA, 19 nt, Homo sapiens
aaggagaagcugagaaaug

SEQ ID NO: 1413233 - RNA, 19 nt, Homo sapiens
ccaagaucuccaaggauuu

SEQ ID NO: 1413234 - RNA, 19 nt, Homo sapiens
acucaguacuauagcugua

SEQ ID NO: 1413235 - RNA, 19 nt, Homo sapiens
cacagaagcaugagguuca

SEQ ID NO: 1413236 - RNA, 19 nt, Homo sapiens
cuagaaagcguggguaaag

SEQ ID NO: 1413237 - RNA, 19 nt, Homo sapiens
agucgaagaucuagaaagc

SEQ ID NO: 1413238 - RNA, 19 nt, Homo sapiens
cuuuacgucuucagccuaa

SEQ ID NO: 1413239 - RNA, 19 nt, Homo sapiens
cccaggagcagcaggcuuu

SEQ ID NO: 1413240 - RNA, 19 nt, Homo sapiens
ggaaaacuaggaaaagaug

SEQ ID NO: 1413241 - RNA, 19 nt, Homo sapiens
ggggaacccuugccaugaa

SEQ ID NO: 1413242 - RNA, 19 nt, Homo sapiens
ccagcacacagaagcauga

SEQ ID NO: 1413243 - RNA, 19 nt, Homo sapiens
gcagucgaagaucuagaaa

SEQ ID NO: 1413244 - RNA, 19 nt, Homo sapiens
aggaaaagaugcagucgaa

SEQ ID NO: 1413245 - RNA, 19 nt, Homo sapiens
gggaacccuugccaugaag

SEQ ID NO: 1413246 - RNA, 19 nt, Homo sapiens
agaaagcguggguaaagga

SEQ ID NO: 1413247 - RNA, 19 nt, Homo sapiens
gcccuggucugugccuaug

SEQ ID NO: 1413248 - RNA, 19 nt, Homo sapiens
uagaaagcguggguaaagg

SEQ ID NO: 1413249 - RNA, 19 nt, Homo sapiens
aaaggaaaaugcaggugaa

SEQ ID NO: 1413250 - RNA, 19 nt, Homo sapiens
ucaguacuauagcuguaag

SEQ ID NO: 1413251 - RNA, 19 nt, Homo sapiens
caccaaagccaaggaagca

SEQ ID NO: 1413252 - RNA, 19 nt, Homo sapiens
gcucaaggaugacaagaug

SEQ ID NO: 1413253 - RNA, 19 nt, Homo sapiens
gagaagcgcgucaagaaga

SEQ ID NO: 1413254 - RNA, 19 nt, Homo sapiens
gcugagaagugcugcauca

SEQ ID NO: 1413255 - RNA, 19 nt, Homo sapiens
gcgagaagcgcgucaagaa

SEQ ID NO: 1413256 - RNA, 19 nt, Homo sapiens
caagaugggccucaaguuc

SEQ ID NO: 1413257 - RNA, 19 nt, Homo sapiens
uacaaccgcugcuauaugg

SEQ ID NO: 1413258 - RNA, 19 nt, Homo sapiens
ucuuggagcugcuggagaa

SEQ ID NO: 1413259 - RNA, 19 nt, Homo sapiens
cggacggccucaccuacua

SEQ ID NO: 1413260 - RNA, 19 nt, Homo sapiens
ucgaggacgugcucaagga

SEQ ID NO: 1413261 - RNA, 19 nt, Homo sapiens
gggcaacggcaacaacuuc

SEQ ID NO: 1413262 - RNA, 19 nt, Homo sapiens
caugcgcccugaucagaug

SEQ ID NO: 1413263 - RNA, 19 nt, Homo sapiens
cuacaaccgcugcuauaug

SEQ ID NO: 1413264 - RNA, 19 nt, Homo sapiens
ucgggcagcuggugcucua

SEQ ID NO: 1413265 - RNA, 19 nt, Homo sapiens
gcccugaucagauguaugg

SEQ ID NO: 1413266 - RNA, 19 nt, Homo sapiens
agaagcgcgucaagaagau

SEQ ID NO: 1413267 - RNA, 19 nt, Homo sapiens
gacaagaugggccucaagu

SEQ ID NO: 1413268 - RNA, 19 nt, Homo sapiens
agaugggccucaaguucuu

SEQ ID NO: 1413269 - RNA, 19 nt, Homo sapiens
aggacgugcucaaggauga

SEQ ID NO: 1413270 - RNA, 19 nt, Homo sapiens
ggcagcuggugcucuacaa

SEQ ID NO: 1413271 - RNA, 19 nt, Homo sapiens
uacuacaaccgcugcuaua

SEQ ID NO: 1413272 - RNA, 19 nt, Homo sapiens
cagagucaccagcgagaga

SEQ ID NO: 1413273 - RNA, 19 nt, Homo sapiens
cuacuacaaccgcugcuau

SEQ ID NO: 1413274 - RNA, 19 nt, Homo sapiens
ucaaccgcuuccaggacua

SEQ ID NO: 1413275 - RNA, 19 nt, Homo sapiens
cgagaagcgcgucaagaag

SEQ ID NO: 1413276 - RNA, 19 nt, Homo sapiens
ccugugagcgcgaguguag

SEQ ID NO: 1413277 - RNA, 19 nt, Homo sapiens
gugagaaggagcccagcuu

SEQ ID NO: 1413278 - RNA, 19 nt, Homo sapiens
gaaguaccaugauuucuuu

SEQ ID NO: 1413279 - RNA, 19 nt, Homo sapiens
ggagugagccuaagacuuu

SEQ ID NO: 1413280 - RNA, 19 nt, Homo sapiens
gcaaaugcauuagauguuu

SEQ ID NO: 1413281 - RNA, 19 nt, Homo sapiens
caagaaaggacaacuauaa

SEQ ID NO: 1413282 - RNA, 19 nt, Homo sapiens
aguaucagcuuucauguua

SEQ ID NO: 1413283 - RNA, 19 nt, Homo sapiens
uggcaaagcuggguuauuu

SEQ ID NO: 1413284 - RNA, 19 nt, Homo sapiens
gcggaaauaucuaguauca

SEQ ID NO: 1413285 - RNA, 19 nt, Homo sapiens
aaagggcuaugaacgauua

SEQ ID NO: 1413286 - RNA, 19 nt, Homo sapiens
ugaaguagcugcauugaag

SEQ ID NO: 1413287 - RNA, 19 nt, Homo sapiens
gaaagcuucugcaguugaa

SEQ ID NO: 1413288 - RNA, 19 nt, Homo sapiens
gcaaagaggcugacuuauc

SEQ ID NO: 1413289 - RNA, 19 nt, Homo sapiens
acucacagcuagucuauuu

SEQ ID NO: 1413290 - RNA, 19 nt, Homo sapiens
gaacacacuaugaagaauu

SEQ ID NO: 1413291 - RNA, 19 nt, Homo sapiens
caaagaggcugacuuaucc

SEQ ID NO: 1413292 - RNA, 19 nt, Homo sapiens
uuacgaagcccaucuguuu

SEQ ID NO: 1413293 - RNA, 19 nt, Homo sapiens
ugugaaagcuucugcaguu

SEQ ID NO: 1413294 - RNA, 19 nt, Homo sapiens
caggaucacuucuguaugu

SEQ ID NO: 1413295 - RNA, 19 nt, Homo sapiens
caaauugcucuaagaagua

SEQ ID NO: 1413296 - RNA, 19 nt, Homo sapiens
ccagugggauuacaaccua

SEQ ID NO: 1413297 - RNA, 19 nt, Homo sapiens
caacuauaaugcagagaga

SEQ ID NO: 1413298 - RNA, 19 nt, Homo sapiens
aaagcuggguuauuucaaa

SEQ ID NO: 1413299 - RNA, 19 nt, Homo sapiens
gaacucacagcuagucuau

SEQ ID NO: 1413300 - RNA, 19 nt, Homo sapiens
gccacacccuucagcuuua

SEQ ID NO: 1413301 - RNA, 19 nt, Homo sapiens
gaaaggacaacuauaaugc

SEQ ID NO: 1413302 - RNA, 19 nt, Homo sapiens
ucuaugcuguguuugcuua

SEQ ID NO: 1413303 - RNA, 19 nt, Homo sapiens
gcucuaagaaguaccauga

SEQ ID NO: 1413304 - RNA, 19 nt, Homo sapiens
ggauguugaucagauguuu

SEQ ID NO: 1413305 - RNA, 19 nt, Homo sapiens
ucuaagaaguaccaugauu

SEQ ID NO: 1413306 - RNA, 19 nt, Homo sapiens
gcagauacaggaucacuuc

SEQ ID NO: 1413307 - RNA, 19 nt, Homo sapiens
ugaguuggcuucagcuguu

SEQ ID NO: 1413308 - RNA, 19 nt, Homo sapiens
cagacuaccucaccaagug

SEQ ID NO: 1413309 - RNA, 19 nt, Homo sapiens
gcaaagcuggguuauuuca

SEQ ID NO: 1413310 - RNA, 19 nt, Homo sapiens
gauagucugucucguuuac

SEQ ID NO: 1413311 - RNA, 19 nt, Homo sapiens
aaacugaucuaugcugugu

SEQ ID NO: 1413312 - RNA, 19 nt, Homo sapiens
gcaggauguugaucagaug

SEQ ID NO: 1413313 - RNA, 19 nt, Homo sapiens
cugcaaagaggcugacuua

SEQ ID NO: 1413314 - RNA, 19 nt, Homo sapiens
caucaggaccucaguguga

SEQ ID NO: 1413315 - RNA, 19 nt, Homo sapiens
gugcggaaauaucuaguau

SEQ ID NO: 1413316 - RNA, 19 nt, Homo sapiens
ggacucaagcaacuauuau

SEQ ID NO: 1413317 - RNA, 19 nt, Homo sapiens
cuaagaaguaccaugauuu

SEQ ID NO: 1413318 - RNA, 19 nt, Homo sapiens
gggacucaagcaacuauua

SEQ ID NO: 1413319 - RNA, 19 nt, Homo sapiens
acacuuguauuguccaguu

SEQ ID NO: 1413320 - RNA, 19 nt, Homo sapiens
gagagaagcaaauaucaag

SEQ ID NO: 1413321 - RNA, 19 nt, Homo sapiens
cagaguaaguccuguaaac

SEQ ID NO: 1413322 - RNA, 19 nt, Homo sapiens
cagguuaucuuaugaugag

SEQ ID NO: 1413323 - RNA, 19 nt, Homo sapiens
ggacaggaauuggaagaac

SEQ ID NO: 1413324 - RNA, 19 nt, Homo sapiens
cugauagucugucucguuu

SEQ ID NO: 1413325 - RNA, 19 nt, Homo sapiens
cagcuggauuaacuaaauu

SEQ ID NO: 1413326 - RNA, 19 nt, Homo sapiens
gcugacuuauccuuguaua

SEQ ID NO: 1413327 - RNA, 19 nt, Homo sapiens
ggaauuggaagaacucaca

SEQ ID NO: 1413328 - RNA, 19 nt, Homo sapiens
caaaugcauuagauguuuc

SEQ ID NO: 1413329 - RNA, 19 nt, Homo sapiens
ccaggcaaaugcauuagau

SEQ ID NO: 1413330 - RNA, 19 nt, Homo sapiens
uaagaaguaccaugauuuc

SEQ ID NO: 1413331 - RNA, 19 nt, Homo sapiens
ggaaggaugagcccacaau

SEQ ID NO: 1413332 - RNA, 19 nt, Homo sapiens
gaaaagggcuaugaacgau

SEQ ID NO: 1413333 - RNA, 19 nt, Homo sapiens
cgauggcagugaugauauu

SEQ ID NO: 1413334 - RNA, 19 nt, Homo sapiens
gcauugaaccagugggauu

SEQ ID NO: 1413335 - RNA, 19 nt, Homo sapiens
uuacagggugcuacuauaa

SEQ ID NO: 1413336 - RNA, 19 nt, Homo sapiens
acagcuggauuaacuaaau

SEQ ID NO: 1413337 - RNA, 19 nt, Homo sapiens
acugaucuaugcuguguuu

SEQ ID NO: 1413338 - RNA, 19 nt, Homo sapiens
gaggcugacuuauccuugu

SEQ ID NO: 1413339 - RNA, 19 nt, Homo sapiens
gcauugaagacacuuguau

SEQ ID NO: 1413340 - RNA, 19 nt, Homo sapiens
ggccacacccuucagcuuu

SEQ ID NO: 1413341 - RNA, 19 nt, Homo sapiens
ucacagcuagucuauuuga

SEQ ID NO: 1413342 - RNA, 19 nt, Homo sapiens
ggaccuucuugguguguau

SEQ ID NO: 1413343 - RNA, 19 nt, Homo sapiens
agucacagcuggauuaacu

SEQ ID NO: 1413344 - RNA, 19 nt, Homo sapiens
ugcauuagauguuucugaa

SEQ ID NO: 1413345 - RNA, 19 nt, Homo sapiens
gaagaacucacagcuaguc

SEQ ID NO: 1413346 - RNA, 19 nt, Homo sapiens
cuacaagaaaggacaacua

SEQ ID NO: 1413347 - RNA, 19 nt, Homo sapiens
uauccaggcaaaugcauua

SEQ ID NO: 1413348 - RNA, 19 nt, Homo sapiens
gaacucaagagcagacuac

SEQ ID NO: 1413349 - RNA, 19 nt, Homo sapiens
gaucacuucuguauguaac

SEQ ID NO: 1413350 - RNA, 19 nt, Homo sapiens
gguggguucuucagguuau

SEQ ID NO: 1413351 - RNA, 19 nt, Homo sapiens
gaagaaugugagaggcuuu

SEQ ID NO: 1413352 - RNA, 19 nt, Homo sapiens
ucacagcuggauuaacuaa

SEQ ID NO: 1413353 - RNA, 19 nt, Homo sapiens
gaaguagcugcauugaaga

SEQ ID NO: 1413354 - RNA, 19 nt, Homo sapiens
gcgguggguucuucagguu

SEQ ID NO: 1413355 - RNA, 19 nt, Homo sapiens
aaaagaagcacaaggaaaa

SEQ ID NO: 1413356 - RNA, 19 nt, Homo sapiens
gagaagcaaauaucaagca

SEQ ID NO: 1413357 - RNA, 19 nt, Homo sapiens
ggugagagaagcaaauauc

SEQ ID NO: 1413358 - RNA, 19 nt, Homo sapiens
agaaaggacaacuauaaug

SEQ ID NO: 1413359 - RNA, 19 nt, Homo sapiens
uaaauugugcggaaauauc

SEQ ID NO: 1413360 - RNA, 19 nt, Homo sapiens
uuucugaacuuccuacaca

SEQ ID NO: 1413361 - RNA, 19 nt, Homo sapiens
gguguacuagugaauguaa

SEQ ID NO: 1413362 - RNA, 19 nt, Homo sapiens
gagguuaugcaguugagaa

SEQ ID NO: 1413363 - RNA, 19 nt, Homo sapiens
gaaggaugagcccacaaug

SEQ ID NO: 1413364 - RNA, 19 nt, Homo sapiens
guccaguucuccaacauca

SEQ ID NO: 1413365 - RNA, 19 nt, Homo sapiens
uggagucacagcuggauua

SEQ ID NO: 1413366 - RNA, 19 nt, Homo sapiens
uaucagcuuucauguuaca

SEQ ID NO: 1413367 - RNA, 19 nt, Homo sapiens
uaucuuaugaugaggcuuu

SEQ ID NO: 1413368 - RNA, 19 nt, Homo sapiens
gacaggaauuggaagaacu

SEQ ID NO: 1413369 - RNA, 19 nt, Homo sapiens
cauuagauguuucugaacu

SEQ ID NO: 1413370 - RNA, 19 nt, Homo sapiens
ggcaaaugcauuagauguu

SEQ ID NO: 1413371 - RNA, 19 nt, Homo sapiens
ggaucacuucuguauguaa

SEQ ID NO: 1413372 - RNA, 19 nt, Homo sapiens
guauaaugaauuccgauug

SEQ ID NO: 1413373 - RNA, 19 nt, Homo sapiens
gggcauacaagaaauaaaa

SEQ ID NO: 1413374 - RNA, 19 nt, Homo sapiens
uuuacagggugcuacuaua

SEQ ID NO: 1413375 - RNA, 19 nt, Homo sapiens
acaagaaaggacaacuaua

SEQ ID NO: 1413376 - RNA, 19 nt, Homo sapiens
ggagucacagcuggauuaa

SEQ ID NO: 1413377 - RNA, 19 nt, Homo sapiens
uuugggagguuaugcaguu

SEQ ID NO: 1413378 - RNA, 19 nt, Homo sapiens
gaauauaacugcugaagaa

SEQ ID NO: 1413379 - RNA, 19 nt, Homo sapiens
gaagaaaccuagagaaaga

SEQ ID NO: 1413380 - RNA, 19 nt, Homo sapiens
guacagaucuucaaaguau

SEQ ID NO: 1413381 - RNA, 19 nt, Homo sapiens
gauaagugcuuucuuguuu

SEQ ID NO: 1413382 - RNA, 19 nt, Homo sapiens
gaaauacacugaugaaaca

SEQ ID NO: 1413383 - RNA, 19 nt, Homo sapiens
ggaaagagacagacaguua

SEQ ID NO: 1413384 - RNA, 19 nt, Homo sapiens
gcaaagcaguguaggauuu

SEQ ID NO: 1413385 - RNA, 19 nt, Homo sapiens
gaaagaaacagcagaguaa

SEQ ID NO: 1413386 - RNA, 19 nt, Homo sapiens
gaaaagagcgugaauauaa

SEQ ID NO: 1413387 - RNA, 19 nt, Homo sapiens
ucaagagcguguauuauua

SEQ ID NO: 1413388 - RNA, 19 nt, Homo sapiens
ugacggagaugccuacaua

SEQ ID NO: 1413389 - RNA, 19 nt, Homo sapiens
gcaagacccugcugugauu

SEQ ID NO: 1413390 - RNA, 19 nt, Homo sapiens
caaagcgaguucuauauuu

SEQ ID NO: 1413391 - RNA, 19 nt, Homo sapiens
gaaacagggugugucauaa

SEQ ID NO: 1413392 - RNA, 19 nt, Homo sapiens
gaacuaagcagagagagua

SEQ ID NO: 1413393 - RNA, 19 nt, Homo sapiens
aaagaaagauuccuugaga

SEQ ID NO: 1413394 - RNA, 19 nt, Homo sapiens
gauauuggaugauagaaga

SEQ ID NO: 1413395 - RNA, 19 nt, Homo sapiens
cagaguaucucauaucuug

SEQ ID NO: 1413396 - RNA, 19 nt, Homo sapiens
ugauaccacuucacuauua

SEQ ID NO: 1413397 - RNA, 19 nt, Homo sapiens
ggucacuucuuuacuauuu

SEQ ID NO: 1413398 - RNA, 19 nt, Homo sapiens
gaaaauagcuauggacauu

SEQ ID NO: 1413399 - RNA, 19 nt, Homo sapiens
uaacaaagcgaguucuaua

SEQ ID NO: 1413400 - RNA, 19 nt, Homo sapiens
gaaaggcauuugaagaaga

SEQ ID NO: 1413401 - RNA, 19 nt, Homo sapiens
uaaccaaguuucaaaggua

SEQ ID NO: 1413402 - RNA, 19 nt, Homo sapiens
gaaggaacgucuacaucaa

SEQ ID NO: 1413403 - RNA, 19 nt, Homo sapiens
gcacagaagauaauauuga

SEQ ID NO: 1413404 - RNA, 19 nt, Homo sapiens
caagauggguaccaguaua

SEQ ID NO: 1413405 - RNA, 19 nt, Homo sapiens
guacauagauacacaugau

SEQ ID NO: 1413406 - RNA, 19 nt, Homo sapiens
gcaaaacuaucucucaaua

SEQ ID NO: 1413407 - RNA, 19 nt, Homo sapiens
gagaaaggcauuugaagaa

SEQ ID NO: 1413408 - RNA, 19 nt, Homo sapiens
gaucaggaauugacuacuu

SEQ ID NO: 1413409 - RNA, 19 nt, Homo sapiens
gagcguguauuauuaucua

SEQ ID NO: 1413410 - RNA, 19 nt, Homo sapiens
uaauacaucugggcaauaa

SEQ ID NO: 1413411 - RNA, 19 nt, Homo sapiens
aagcagcaguuucuaaaua

SEQ ID NO: 1413412 - RNA, 19 nt, Homo sapiens
agaaagagccaguugguua

SEQ ID NO: 1413413 - RNA, 19 nt, Homo sapiens
gaaagagccaguugguuaa

SEQ ID NO: 1413414 - RNA, 19 nt, Homo sapiens
gcagcuagacuaaauguuu

SEQ ID NO: 1413415 - RNA, 19 nt, Homo sapiens
ggaaugaagaugaaaugua

SEQ ID NO: 1413416 - RNA, 19 nt, Homo sapiens
ggaaugaugucuguuggaa

SEQ ID NO: 1413417 - RNA, 19 nt, Homo sapiens
aaagaugacuuaccuuaga

SEQ ID NO: 1413418 - RNA, 19 nt, Homo sapiens
gaaguacuauguaacagau

SEQ ID NO: 1413419 - RNA, 19 nt, Homo sapiens
ccaugaagcugaguucuuu

SEQ ID NO: 1413420 - RNA, 19 nt, Homo sapiens
gaacuguuauuuccgaugu

SEQ ID NO: 1413421 - RNA, 19 nt, Homo sapiens
cuacagagcugcuacucaa

SEQ ID NO: 1413422 - RNA, 19 nt, Homo sapiens
caauauaccucagaaacaa

SEQ ID NO: 1413423 - RNA, 19 nt, Homo sapiens
gaaauacauguaccuagua

SEQ ID NO: 1413424 - RNA, 19 nt, Homo sapiens
caagaaauaagcacucuaa

SEQ ID NO: 1413425 - RNA, 19 nt, Homo sapiens
aagcugaguucuuuagaua

SEQ ID NO: 1413426 - RNA, 19 nt, Homo sapiens
uuaaguaccugcuguaugu

SEQ ID NO: 1413427 - RNA, 19 nt, Homo sapiens
caucaaguuucacaucuaa

SEQ ID NO: 1413428 - RNA, 19 nt, Homo sapiens
gaugagaaauacacugaug

SEQ ID NO: 1413429 - RNA, 19 nt, Homo sapiens
aaagauuccuugagacgua

SEQ ID NO: 1413430 - RNA, 19 nt, Homo sapiens
gguuugaaauuaccucuuu

SEQ ID NO: 1413431 - RNA, 19 nt, Homo sapiens
gauguaaucucacgacaag

SEQ ID NO: 1413432 - RNA, 19 nt, Homo sapiens
gaacagaguaucucauauc

SEQ ID NO: 1413433 - RNA, 19 nt, Homo sapiens
ggagauuggaugacuguua

SEQ ID NO: 1413434 - RNA, 19 nt, Homo sapiens
gacagcagcuagacuaaau

SEQ ID NO: 1413435 - RNA, 19 nt, Homo sapiens
uaacuagggcuuuguauug

SEQ ID NO: 1413436 - RNA, 19 nt, Homo sapiens
ggucugaguuguuuguuug

SEQ ID NO: 1413437 - RNA, 19 nt, Homo sapiens
agacgaagcuuuacagaag

SEQ ID NO: 1413438 - RNA, 19 nt, Homo sapiens
aaaggaacgucucaaagaa

SEQ ID NO: 1413439 - RNA, 19 nt, Homo sapiens
ccaccucauucauauauuu

SEQ ID NO: 1413440 - RNA, 19 nt, Homo sapiens
cauggucacuucuuuacua

SEQ ID NO: 1413441 - RNA, 19 nt, Homo sapiens
guaaagagacaaagagaga

SEQ ID NO: 1413442 - RNA, 19 nt, Homo sapiens
gaugauuguuugcuagauu

SEQ ID NO: 1413443 - RNA, 19 nt, Homo sapiens
ccagacacguuccugcaua

SEQ ID NO: 1413444 - RNA, 19 nt, Homo sapiens
ucuaaugggucuccaguuu

SEQ ID NO: 1413445 - RNA, 19 nt, Homo sapiens
gagagcagcuuacaaacag

SEQ ID NO: 1413446 - RNA, 19 nt, Homo sapiens
gagaguaugugggaccuuu

SEQ ID NO: 1413447 - RNA, 19 nt, Homo sapiens
ugaaauugcucacucuaau

SEQ ID NO: 1413448 - RNA, 19 nt, Homo sapiens
cugcauagauccagaaguu

SEQ ID NO: 1413449 - RNA, 19 nt, Homo sapiens
gaagcugaguucuuuagau

SEQ ID NO: 1413450 - RNA, 19 nt, Homo sapiens
gaugauaccacuucacuau

SEQ ID NO: 1413451 - RNA, 19 nt, Homo sapiens
gaauuugcaucagcuacua

SEQ ID NO: 1413452 - RNA, 19 nt, Homo sapiens
ggagaugccuacauagaag

SEQ ID NO: 1413453 - RNA, 19 nt, Homo sapiens
gaagguugcuauaguggau

SEQ ID NO: 1413454 - RNA, 19 nt, Homo sapiens
gagaaagaguagaugauag

SEQ ID NO: 1413455 - RNA, 19 nt, Homo sapiens
gaugaugguucuagagugu

SEQ ID NO: 1413456 - RNA, 19 nt, Homo sapiens
gguuuaagauauuggauga

SEQ ID NO: 1413457 - RNA, 19 nt, Homo sapiens
ugagagagcagcuuacaaa

SEQ ID NO: 1413458 - RNA, 19 nt, Homo sapiens
gaaacaaauccuaauggaa

SEQ ID NO: 1413459 - RNA, 19 nt, Homo sapiens
gcagauaaggauaaugaaa

SEQ ID NO: 1413460 - RNA, 19 nt, Homo sapiens
gaguguacuuccauuugua

SEQ ID NO: 1413461 - RNA, 19 nt, Homo sapiens
ucagaaugcuggaaugaug

SEQ ID NO: 1413462 - RNA, 19 nt, Homo sapiens
gaacgucuacaucaacuug

SEQ ID NO: 1413463 - RNA, 19 nt, Homo sapiens
guaccuaguauaaugcuua

SEQ ID NO: 1413464 - RNA, 19 nt, Homo sapiens
auaugaagcuccugauaaa

SEQ ID NO: 1413465 - RNA, 19 nt, Homo sapiens
guucauagacuugugauaa

SEQ ID NO: 1413466 - RNA, 19 nt, Homo sapiens
guaacuauguaacucuuug

SEQ ID NO: 1413467 - RNA, 19 nt, Homo sapiens
uagacugaguuuccucuua

SEQ ID NO: 1413468 - RNA, 19 nt, Homo sapiens
ugaaacagggugugucaua

SEQ ID NO: 1413469 - RNA, 19 nt, Homo sapiens
ugacuuaccuuagacaugu

SEQ ID NO: 1413470 - RNA, 19 nt, Homo sapiens
uaugaagaauccaaaggua

SEQ ID NO: 1413471 - RNA, 19 nt, Homo sapiens
uagaguggguggauauuga

SEQ ID NO: 1413472 - RNA, 19 nt, Homo sapiens
guucacagcaaauuguuua

SEQ ID NO: 1413473 - RNA, 19 nt, Homo sapiens
ccugauaagugcuuucuug

SEQ ID NO: 1413474 - RNA, 19 nt, Homo sapiens
uaauacagcugugcuaauc

SEQ ID NO: 1413475 - RNA, 19 nt, Homo sapiens
ucacacaaccauaaguaua

SEQ ID NO: 1413476 - RNA, 19 nt, Homo sapiens
uaaagcagcaguuucuaaa

SEQ ID NO: 1413477 - RNA, 19 nt, Homo sapiens
uauccuggcucuagagauu

SEQ ID NO: 1413478 - RNA, 19 nt, Homo sapiens
gaaggauucugaugucuua

SEQ ID NO: 1413479 - RNA, 19 nt, Homo sapiens
guacaacagugaauggaaa

SEQ ID NO: 1413480 - RNA, 19 nt, Homo sapiens
ggauucugaugucuuauuu

SEQ ID NO: 1413481 - RNA, 19 nt, Homo sapiens
gaacagaaaguacaacagu

SEQ ID NO: 1413482 - RNA, 19 nt, Homo sapiens
ggacauugcugagguggau

SEQ ID NO: 1413483 - RNA, 19 nt, Homo sapiens
gcuuccagauuauaaauug

SEQ ID NO: 1413484 - RNA, 19 nt, Homo sapiens
gaaaguacaacagugaaug

SEQ ID NO: 1413485 - RNA, 19 nt, Homo sapiens
ucagugguuccuaauauua

SEQ ID NO: 1413486 - RNA, 19 nt, Homo sapiens
guuguccugucaucucuua

SEQ ID NO: 1413487 - RNA, 19 nt, Homo sapiens
ggcauucagugguuccuaa

SEQ ID NO: 1413488 - RNA, 19 nt, Homo sapiens
caauuucccuagcuucuuc

SEQ ID NO: 1413489 - RNA, 19 nt, Homo sapiens
gagaagcagucugguguag

SEQ ID NO: 1413490 - RNA, 19 nt, Homo sapiens
ucaguaacuucuucuguuc

SEQ ID NO: 1413491 - RNA, 19 nt, Homo sapiens
uuauggaucuggaaggauu

SEQ ID NO: 1413492 - RNA, 19 nt, Homo sapiens
caacagugaauggaaauga

SEQ ID NO: 1413493 - RNA, 19 nt, Homo sapiens
ggaacgccuucucugucua

SEQ ID NO: 1413494 - RNA, 19 nt, Homo sapiens
guucuguggcuucuuauuu

SEQ ID NO: 1413495 - RNA, 19 nt, Homo sapiens
uaaauugccugguguaccu

SEQ ID NO: 1413496 - RNA, 19 nt, Homo sapiens
gcaggaacgccuucucugu

SEQ ID NO: 1413497 - RNA, 19 nt, Homo sapiens
uucuguggcuucuuauuua

SEQ ID NO: 1413498 - RNA, 19 nt, Homo sapiens
guaccucaguaacuucuuc

SEQ ID NO: 1413499 - RNA, 19 nt, Homo sapiens
gaaaugaccaagcccuucu

SEQ ID NO: 1413500 - RNA, 19 nt, Homo sapiens
ggaaggauucugaugucuu

SEQ ID NO: 1413501 - RNA, 19 nt, Homo sapiens
ucagacauuugauuucauc

SEQ ID NO: 1413502 - RNA, 19 nt, Homo sapiens
gaugaccugugccuaccuu

SEQ ID NO: 1413503 - RNA, 19 nt, Homo sapiens
acagaaaguacaacaguga

SEQ ID NO: 1413504 - RNA, 19 nt, Homo sapiens
ugucagcggucgugugugu

SEQ ID NO: 1413505 - RNA, 19 nt, Homo sapiens
auucagugguuccuaauau

SEQ ID NO: 1413506 - RNA, 19 nt, Homo sapiens
cucaguaacuucuucuguu

SEQ ID NO: 1413507 - RNA, 19 nt, Homo sapiens
ccggagaugucgagaagca

SEQ ID NO: 1413508 - RNA, 19 nt, Homo sapiens
ucauauucauccaguuuca

SEQ ID NO: 1413509 - RNA, 19 nt, Homo sapiens
ugucauauucauccaguuu

SEQ ID NO: 1413510 - RNA, 19 nt, Homo sapiens
ugaccaagcccuucuucug

SEQ ID NO: 1413511 - RNA, 19 nt, Homo sapiens
ggaucuggaaggauucuga

SEQ ID NO: 1413512 - RNA, 19 nt, Homo sapiens
uauuauggaucuggaagga

SEQ ID NO: 1413513 - RNA, 19 nt, Homo sapiens
cgagaagcagucuggugua

SEQ ID NO: 1413514 - RNA, 19 nt, Homo sapiens
gauggugacucugguuggu

SEQ ID NO: 1413515 - RNA, 19 nt, Homo sapiens
ucacagugcugguguuccu

SEQ ID NO: 1413516 - RNA, 19 nt, Homo sapiens
gaacgccuucucugucuac

SEQ ID NO: 1413517 - RNA, 19 nt, Homo sapiens
gugccaaccccaucauuua

SEQ ID NO: 1413518 - RNA, 19 nt, Homo sapiens
gggaacagaaaguacaaca

SEQ ID NO: 1413519 - RNA, 19 nt, Homo sapiens
uguuccaucuccaucaauu

SEQ ID NO: 1413520 - RNA, 19 nt, Homo sapiens
ugaccauccugcucacagu

SEQ ID NO: 1413521 - RNA, 19 nt, Homo sapiens
ccaucaauuucccuagcuu

SEQ ID NO: 1413522 - RNA, 19 nt, Homo sapiens
cagaaaguacaacagugaa

SEQ ID NO: 1413523 - RNA, 19 nt, Homo sapiens
uucagugguuccuaauauu

SEQ ID NO: 1413524 - RNA, 19 nt, Homo sapiens
cuggaaggauucugauguc

SEQ ID NO: 1413525 - RNA, 19 nt, Homo sapiens
ugguguaccucaguaacuu

SEQ ID NO: 1413526 - RNA, 19 nt, Homo sapiens
guccugucaucucuuaaca

SEQ ID NO: 1413527 - RNA, 19 nt, Homo sapiens
gcgcaggaacgccuucucu

SEQ ID NO: 1413528 - RNA, 19 nt, Homo sapiens
gaucuggaaggauucugau

SEQ ID NO: 1413529 - RNA, 19 nt, Homo sapiens
cauucagugguuccuaaua

SEQ ID NO: 1413530 - RNA, 19 nt, Homo sapiens
ccuuuggcauucagugguu

SEQ ID NO: 1413531 - RNA, 19 nt, Homo sapiens
guacagaacugacaccaau

SEQ ID NO: 1413532 - RNA, 19 nt, Homo sapiens
gggcugacgugcaucguuu

SEQ ID NO: 1413533 - RNA, 19 nt, Homo sapiens
ggaacgcugucuccaucua

SEQ ID NO: 1413534 - RNA, 19 nt, Homo sapiens
gaugaccuuucccuacuuu

SEQ ID NO: 1413535 - RNA, 19 nt, Homo sapiens
cauuauauguucgccguua

SEQ ID NO: 1413536 - RNA, 19 nt, Homo sapiens
ggauuggaaagucuuauuu

SEQ ID NO: 1413537 - RNA, 19 nt, Homo sapiens
gaccuuucccuacuuuaua

SEQ ID NO: 1413538 - RNA, 19 nt, Homo sapiens
cgucagauuucauuacaau

SEQ ID NO: 1413539 - RNA, 19 nt, Homo sapiens
ggugugaaacgucagauuu

SEQ ID NO: 1413540 - RNA, 19 nt, Homo sapiens
uggaguggauguucuguga

SEQ ID NO: 1413541 - RNA, 19 nt, Homo sapiens
ggacacgccugagguggau

SEQ ID NO: 1413542 - RNA, 19 nt, Homo sapiens
ugucaucggucaugugugu

SEQ ID NO: 1413543 - RNA, 19 nt, Homo sapiens
gugcaucuaguuuccauuu

SEQ ID NO: 1413544 - RNA, 19 nt, Homo sapiens
cguuacgccucaucaauau

SEQ ID NO: 1413545 - RNA, 19 nt, Homo sapiens
ccguuacgccucaucaaua

SEQ ID NO: 1413546 - RNA, 19 nt, Homo sapiens
acaaucgcguggcugguuu

SEQ ID NO: 1413547 - RNA, 19 nt, Homo sapiens
gugaugaccuuucccuacu

SEQ ID NO: 1413548 - RNA, 19 nt, Homo sapiens
uuccuuagcggccacauua

SEQ ID NO: 1413549 - RNA, 19 nt, Homo sapiens
guucugugacuuccuguuu

SEQ ID NO: 1413550 - RNA, 19 nt, Homo sapiens
caacggacgugaggagacu

SEQ ID NO: 1413551 - RNA, 19 nt, Homo sapiens
gaguggauguucugugacu

SEQ ID NO: 1413552 - RNA, 19 nt, Homo sapiens
ccuuagcggccacauuaua

SEQ ID NO: 1413553 - RNA, 19 nt, Homo sapiens
gugcaucguuucccuuguc

SEQ ID NO: 1413554 - RNA, 19 nt, Homo sapiens
ccaccuggauuggaaaguc

SEQ ID NO: 1413555 - RNA, 19 nt, Homo sapiens
gcaggaacgcugucuccau

SEQ ID NO: 1413556 - RNA, 19 nt, Homo sapiens
ugucaugugcaucuaguuu

SEQ ID NO: 1413557 - RNA, 19 nt, Homo sapiens
ucacagugcuggucuuccu

SEQ ID NO: 1413558 - RNA, 19 nt, Homo sapiens
gcaucuaguuuccauuuuc

SEQ ID NO: 1413559 - RNA, 19 nt, Homo sapiens
gccgacuuccucuuccuua

SEQ ID NO: 1413560 - RNA, 19 nt, Homo sapiens
gugccaaccccaucauuua

SEQ ID NO: 1413561 - RNA, 19 nt, Homo sapiens
ugaccuuucccuacuuuau

SEQ ID NO: 1413562 - RNA, 19 nt, Homo sapiens
ggaaagucuuauuuuguca

SEQ ID NO: 1413563 - RNA, 19 nt, Homo sapiens
uucugugacuuccuguuua

SEQ ID NO: 1413564 - RNA, 19 nt, Homo sapiens
gaacgcugucuccaucuac

SEQ ID NO: 1413565 - RNA, 19 nt, Homo sapiens
ugaccauccuccucacagu

SEQ ID NO: 1413566 - RNA, 19 nt, Homo sapiens
aacgucagauuucauuaca

SEQ ID NO: 1413567 - RNA, 19 nt, Homo sapiens
ugaugaccuuucccuacuu

SEQ ID NO: 1413568 - RNA, 19 nt, Homo sapiens
ucaguccugugaugaccuu

SEQ ID NO: 1413569 - RNA, 19 nt, Homo sapiens
ucugugacuuccuguuuag

SEQ ID NO: 1413570 - RNA, 19 nt, Homo sapiens
acagaacugacaccaauca

SEQ ID NO: 1413571 - RNA, 19 nt, Homo sapiens
aauccucaguccugugaug

SEQ ID NO: 1413572 - RNA, 19 nt, Homo sapiens
aaacgucagauuucauuac

SEQ ID NO: 1413573 - RNA, 19 nt, Homo sapiens
cuuagcggccacauuauau

SEQ ID NO: 1413574 - RNA, 19 nt, Homo sapiens
gauuauacguucgccauua

SEQ ID NO: 1413575 - RNA, 19 nt, Homo sapiens
gugcugacgugcaucauuu

SEQ ID NO: 1413576 - RNA, 19 nt, Homo sapiens
ggaacgcugucuccaucua

SEQ ID NO: 1413577 - RNA, 19 nt, Homo sapiens
ggacaagccugagguggau

SEQ ID NO: 1413578 - RNA, 19 nt, Homo sapiens
ccauuacgccucaucaaua

SEQ ID NO: 1413579 - RNA, 19 nt, Homo sapiens
ggaugcaccugaauuugga

SEQ ID NO: 1413580 - RNA, 19 nt, Homo sapiens
gaugaccuuucccuacuuu

SEQ ID NO: 1413581 - RNA, 19 nt, Homo sapiens
uuccucagcuuccagauua

SEQ ID NO: 1413582 - RNA, 19 nt, Homo sapiens
gauucuaguuggugugaaa

SEQ ID NO: 1413583 - RNA, 19 nt, Homo sapiens
guacaaaacugacaccaau

SEQ ID NO: 1413584 - RNA, 19 nt, Homo sapiens
ggugugaaacgucagauuu

SEQ ID NO: 1413585 - RNA, 19 nt, Homo sapiens
cauuacgccucaucaauau

SEQ ID NO: 1413586 - RNA, 19 nt, Homo sapiens
gaagucuuauauugucaug

SEQ ID NO: 1413587 - RNA, 19 nt, Homo sapiens
gcaaaauccucguuucugu

SEQ ID NO: 1413588 - RNA, 19 nt, Homo sapiens
gcaugucccuguccucucu

SEQ ID NO: 1413589 - RNA, 19 nt, Homo sapiens
ccagucgcguggcugauuu

SEQ ID NO: 1413590 - RNA, 19 nt, Homo sapiens
gcaccugaauuuggaaguc

SEQ ID NO: 1413591 - RNA, 19 nt, Homo sapiens
gaguggagguucugugacu

SEQ ID NO: 1413592 - RNA, 19 nt, Homo sapiens
ugucagcggucgugugugu

SEQ ID NO: 1413593 - RNA, 19 nt, Homo sapiens
ugagguggauaaaggugaa

SEQ ID NO: 1413594 - RNA, 19 nt, Homo sapiens
gugaugaccuuucccuacu

SEQ ID NO: 1413595 - RNA, 19 nt, Homo sapiens
ugucauguuuaucugguuu

SEQ ID NO: 1413596 - RNA, 19 nt, Homo sapiens
guucugugacuuccuguuu

SEQ ID NO: 1413597 - RNA, 19 nt, Homo sapiens
gagacuccuugcuacaauc

SEQ ID NO: 1413598 - RNA, 19 nt, Homo sapiens
caacggacgugaggagacu

SEQ ID NO: 1413599 - RNA, 19 nt, Homo sapiens
ggccugucccugcuguuua

SEQ ID NO: 1413600 - RNA, 19 nt, Homo sapiens
gagcgcugccugucuguuc

SEQ ID NO: 1413601 - RNA, 19 nt, Homo sapiens
caauaucagccaucucauc

SEQ ID NO: 1413602 - RNA, 19 nt, Homo sapiens
gcaggaacgcugucuccau

SEQ ID NO: 1413603 - RNA, 19 nt, Homo sapiens
gccauuacgccucaucaau

SEQ ID NO: 1413604 - RNA, 19 nt, Homo sapiens
ucacagugcuggucuuccu

SEQ ID NO: 1413605 - RNA, 19 nt, Homo sapiens
uaugugugguucucugugu

SEQ ID NO: 1413606 - RNA, 19 nt, Homo sapiens
gugccaaccccaucauuua

SEQ ID NO: 1413607 - RNA, 19 nt, Homo sapiens
gugcaucauuucccuuguc

SEQ ID NO: 1413608 - RNA, 19 nt, Homo sapiens
gauccaaccgucccagucu

SEQ ID NO: 1413609 - RNA, 19 nt, Homo sapiens
uuggaagucuuauauuguc

SEQ ID NO: 1413610 - RNA, 19 nt, Homo sapiens
uucugugacuuccuguuua

SEQ ID NO: 1413611 - RNA, 19 nt, Homo sapiens
gccugucccugcuguuuag

SEQ ID NO: 1413612 - RNA, 19 nt, Homo sapiens
aauccucguuucugugaug

SEQ ID NO: 1413613 - RNA, 19 nt, Homo sapiens
ugaccauccugcucacagu

SEQ ID NO: 1413614 - RNA, 19 nt, Homo sapiens
ugucccugcuguuuaguau

SEQ ID NO: 1413615 - RNA, 19 nt, Homo sapiens
gaacgcugucuccaucuac

SEQ ID NO: 1413616 - RNA, 19 nt, Homo sapiens
gggccugucccugcuguuu

SEQ ID NO: 1413617 - RNA, 19 nt, Homo sapiens
gaccuuucccuacuuuaca

SEQ ID NO: 1413618 - RNA, 19 nt, Homo sapiens
ugaugaccuuucccuacuu

SEQ ID NO: 1413619 - RNA, 19 nt, Homo sapiens
ucugugacuuccuguuuag

SEQ ID NO: 1413620 - RNA, 19 nt, Homo sapiens
ccucagcuuccagauuaua

SEQ ID NO: 1413621 - RNA, 19 nt, Homo sapiens
uguccucucuaaacaguag

SEQ ID NO: 1413622 - RNA, 19 nt, Homo sapiens
ggugcugacgugcaucauu

SEQ ID NO: 1413623 - RNA, 19 nt, Homo sapiens
uuacgccucaucaauauca

SEQ ID NO: 1413624 - RNA, 19 nt, Homo sapiens
gacaggaaacgcgguagug

SEQ ID NO: 1413625 - RNA, 19 nt, Homo sapiens
agccugagguggauaaagg

SEQ ID NO: 1413626 - RNA, 19 nt, Homo sapiens
ccugaauuuggaagucuua

SEQ ID NO: 1413627 - RNA, 19 nt, Homo sapiens
ucaacaagaucgugcagua

SEQ ID NO: 1413628 - RNA, 19 nt, Homo sapiens
cagcauuacuuccaucuuu

SEQ ID NO: 1413629 - RNA, 19 nt, Homo sapiens
gaaggucaauaacaagcua

SEQ ID NO: 1413630 - RNA, 19 nt, Homo sapiens
gcacugggccaucuaugua

SEQ ID NO: 1413631 - RNA, 19 nt, Homo sapiens
gaaugaaggcaaguuaaua

SEQ ID NO: 1413632 - RNA, 19 nt, Homo sapiens
ccaauuacccuuccagaaa

SEQ ID NO: 1413633 - RNA, 19 nt, Homo sapiens
gcauaaagcccaaaccaau

SEQ ID NO: 1413634 - RNA, 19 nt, Homo sapiens
ggagaaggcuguaguuagc

SEQ ID NO: 1413635 - RNA, 19 nt, Homo sapiens
gaaggcaaguuaauaaagc

SEQ ID NO: 1413636 - RNA, 19 nt, Homo sapiens
caauuacccuuccagaaau

SEQ ID NO: 1413637 - RNA, 19 nt, Homo sapiens
cauaaagcccaaaccaaua

SEQ ID NO: 1413638 - RNA, 19 nt, Homo sapiens
ccagaaauacauccaauau

SEQ ID NO: 1413639 - RNA, 19 nt, Homo sapiens
gagaaugaaggcaaguuaa

SEQ ID NO: 1413640 - RNA, 19 nt, Homo sapiens
ccagcuagaggaagaguua

SEQ ID NO: 1413641 - RNA, 19 nt, Homo sapiens
ccuggaaggucaauaacaa

SEQ ID NO: 1413642 - RNA, 19 nt, Homo sapiens
gcaagcagcugagggaaaa

SEQ ID NO: 1413643 - RNA, 19 nt, Homo sapiens
gcaguuauuucagcuguag

SEQ ID NO: 1413644 - RNA, 19 nt, Homo sapiens
gaugaaaacuccagcuaga

SEQ ID NO: 1413645 - RNA, 19 nt, Homo sapiens
caauggcuccgauuaagaa

SEQ ID NO: 1413646 - RNA, 19 nt, Homo sapiens
ugagaaugaaggcaaguua

SEQ ID NO: 1413647 - RNA, 19 nt, Homo sapiens
gaaagcagacuggaguuca

SEQ ID NO: 1413648 - RNA, 19 nt, Homo sapiens
uuccaaagccugagaauga

SEQ ID NO: 1413649 - RNA, 19 nt, Homo sapiens
gcuccuggaaggucaauaa

SEQ ID NO: 1413650 - RNA, 19 nt, Homo sapiens
ucaauggccucagauaugg

SEQ ID NO: 1413651 - RNA, 19 nt, Homo sapiens
auaaagcccaaaccaauaa

SEQ ID NO: 1413652 - RNA, 19 nt, Homo sapiens
agcauuacuuccaucuuua

SEQ ID NO: 1413653 - RNA, 19 nt, Homo sapiens
gaccacacccagccagaaa

SEQ ID NO: 1413654 - RNA, 19 nt, Homo sapiens
gaagaguuacugacacaag

SEQ ID NO: 1413655 - RNA, 19 nt, Homo sapiens
ccacucaggucuaaauagc

SEQ ID NO: 1413656 - RNA, 19 nt, Homo sapiens
uuacuuccaucuuuagcaa

SEQ ID NO: 1413657 - RNA, 19 nt, Homo sapiens
gaggugggcagcauuacuu

SEQ ID NO: 1413658 - RNA, 19 nt, Homo sapiens
gucaauggccucagauaug

SEQ ID NO: 1413659 - RNA, 19 nt, Homo sapiens
aaagcagacuggaguucaa

SEQ ID NO: 1413660 - RNA, 19 nt, Homo sapiens
gggagaaggcuguaguuag

SEQ ID NO: 1413661 - RNA, 19 nt, Homo sapiens
cuggagaccugauugagau

SEQ ID NO: 1413662 - RNA, 19 nt, Homo sapiens
uauuucagcuguaguggau

SEQ ID NO: 1413663 - RNA, 19 nt, Homo sapiens
aauuacccuuccagaaaua

SEQ ID NO: 1413664 - RNA, 19 nt, Homo sapiens
cuggaagaaucuacaaugu

SEQ ID NO: 1413665 - RNA, 19 nt, Homo sapiens
gcagacuggaguucaauuc

SEQ ID NO: 1413666 - RNA, 19 nt, Homo sapiens
gaacugugagcacuuuguc

SEQ ID NO: 1413667 - RNA, 19 nt, Homo sapiens
ggagaccugauugagauuu

SEQ ID NO: 1413668 - RNA, 19 nt, Homo sapiens
ucucaauggcuccgauuaa

SEQ ID NO: 1413669 - RNA, 19 nt, Homo sapiens
uguaguggauagcauaaag

SEQ ID NO: 1413670 - RNA, 19 nt, Homo sapiens
ucaauggcuccgauuaaga

SEQ ID NO: 1413671 - RNA, 19 nt, Homo sapiens
ugugagcacuuugucaaug

SEQ ID NO: 1413672 - RNA, 19 nt, Homo sapiens
gggcagaagcauccagcaa

SEQ ID NO: 1413673 - RNA, 19 nt, Homo sapiens
gugagcacuuugucaaugg

SEQ ID NO: 1413674 - RNA, 19 nt, Homo sapiens
gcaguacagccugauugaa

SEQ ID NO: 1413675 - RNA, 19 nt, Homo sapiens
acagucgucuggaggaugu

SEQ ID NO: 1413676 - RNA, 19 nt, Homo sapiens
agaaugaaggcaaguuaau

SEQ ID NO: 1413677 - RNA, 19 nt, Homo sapiens
ggaacugugagcacuuugu

SEQ ID NO: 1413678 - RNA, 19 nt, Homo sapiens
gucaauaacaagcuagaug

SEQ ID NO: 1413679 - RNA, 19 nt, Homo sapiens
uccaaagccugagaaugaa

SEQ ID NO: 1413680 - RNA, 19 nt, Homo sapiens
agaaggcuguaguuagcuu

SEQ ID NO: 1413681 - RNA, 19 nt, Homo sapiens
ucccuugccuucucucaau

SEQ ID NO: 1413682 - RNA, 19 nt, Homo sapiens
aggaagaguuacugacaca

SEQ ID NO: 1413683 - RNA, 19 nt, Homo sapiens
caguacagccugauugaag

SEQ ID NO: 1413684 - RNA, 19 nt, Homo sapiens
gcauuacuuccaucuuuag

SEQ ID NO: 1413685 - RNA, 19 nt, Homo sapiens
gaccuggagaccugauuga

SEQ ID NO: 1413686 - RNA, 19 nt, Homo sapiens
ugaaggcaaguuaauaaag

SEQ ID NO: 1413687 - RNA, 19 nt, Homo sapiens
gagaccugauugagauuuu

SEQ ID NO: 1413688 - RNA, 19 nt, Homo sapiens
gcuguaguggauagcauaa

SEQ ID NO: 1413689 - RNA, 19 nt, Homo sapiens
gguagagcacgcccugaug

SEQ ID NO: 1413690 - RNA, 19 nt, Homo sapiens
ugauugaagggaacuguga

SEQ ID NO: 1413691 - RNA, 19 nt, Homo sapiens
gugcaguacagccugauug

SEQ ID NO: 1413692 - RNA, 19 nt, Homo sapiens
agggaacugugagcacuuu

SEQ ID NO: 1413693 - RNA, 19 nt, Homo sapiens
ugucaauggccucagauau

SEQ ID NO: 1413694 - RNA, 19 nt, Homo sapiens
aaaagauggucaacaagau

SEQ ID NO: 1413695 - RNA, 19 nt, Homo sapiens
acucaggucuaaauagcau

SEQ ID NO: 1413696 - RNA, 19 nt, Homo sapiens
agaggaagaguuacugaca

SEQ ID NO: 1413697 - RNA, 19 nt, Homo sapiens
gaucauccagcguacaaaa

SEQ ID NO: 1413698 - RNA, 19 nt, Homo sapiens
aaagauggucaacaagauc

SEQ ID NO: 1413699 - RNA, 19 nt, Homo sapiens
uaugagcacugggccaucu

SEQ ID NO: 1413700 - RNA, 19 nt, Homo sapiens
uccagaaauacauccaaua

SEQ ID NO: 1413701 - RNA, 19 nt, Homo sapiens
ucuggaagaaucuacaaug

SEQ ID NO: 1413702 - RNA, 19 nt, Homo sapiens
cucaauggcuccgauuaag

SEQ ID NO: 1413703 - RNA, 19 nt, Homo sapiens
ccaauaacugccugaaggu

SEQ ID NO: 1413704 - RNA, 19 nt, Homo sapiens
caacaagaucgugcaguac

SEQ ID NO: 1413705 - RNA, 19 nt, Homo sapiens
ccuggagaccugauugaga

SEQ ID NO: 1413706 - RNA, 19 nt, Homo sapiens
agaaggagguggagcauua

SEQ ID NO: 1413707 - RNA, 19 nt, Homo sapiens
agagagaccucauagauaa

SEQ ID NO: 1413708 - RNA, 19 nt, Homo sapiens
ccaagaagcugaaagaaca

SEQ ID NO: 1413709 - RNA, 19 nt, Homo sapiens
gagcucaggucgcuacuaa

SEQ ID NO: 1413710 - RNA, 19 nt, Homo sapiens
gaacaaaacuucggcgaua

SEQ ID NO: 1413711 - RNA, 19 nt, Homo sapiens
ccacaaagcagcccucuaa

SEQ ID NO: 1413712 - RNA, 19 nt, Homo sapiens
caucacagcugucugaaga

SEQ ID NO: 1413713 - RNA, 19 nt, Homo sapiens
acacaucucuggauaguga

SEQ ID NO: 1413714 - RNA, 19 nt, Homo sapiens
cuacuaaacuggagaacaa

SEQ ID NO: 1413715 - RNA, 19 nt, Homo sapiens
gcagagaucuuuguagucu

SEQ ID NO: 1413716 - RNA, 19 nt, Homo sapiens
gaaagcggcucugggucua

SEQ ID NO: 1413717 - RNA, 19 nt, Homo sapiens
ggacgacggugaugacaca

SEQ ID NO: 1413718 - RNA, 19 nt, Homo sapiens
gccaagggaugauaucuau

SEQ ID NO: 1413719 - RNA, 19 nt, Homo sapiens
gccaaaggcugaaggcuau

SEQ ID NO: 1413720 - RNA, 19 nt, Homo sapiens
caagagagaccucauagau

SEQ ID NO: 1413721 - RNA, 19 nt, Homo sapiens
caaagcagcccucuaagga

SEQ ID NO: 1413722 - RNA, 19 nt, Homo sapiens
ugacaagguugacaguaaa

SEQ ID NO: 1413723 - RNA, 19 nt, Homo sapiens
uuacugaagugcaagauga

SEQ ID NO: 1413724 - RNA, 19 nt, Homo sapiens
gguagaugaugaagaguug

SEQ ID NO: 1413725 - RNA, 19 nt, Homo sapiens
gaacacaguggacaucuca

SEQ ID NO: 1413726 - RNA, 19 nt, Homo sapiens
cggaaacgcuggcgggaaa

SEQ ID NO: 1413727 - RNA, 19 nt, Homo sapiens
ggcgauauguggccaagaa

SEQ ID NO: 1413728 - RNA, 19 nt, Homo sapiens
cuaagaccguuacugaauu

SEQ ID NO: 1413729 - RNA, 19 nt, Homo sapiens
uaagaccguuacugaauug

SEQ ID NO: 1413730 - RNA, 19 nt, Homo sapiens
gguggcagcuucaucacaa

SEQ ID NO: 1413731 - RNA, 19 nt, Homo sapiens
gggucuagauugagggaua

SEQ ID NO: 1413732 - RNA, 19 nt, Homo sapiens
gaagguggcugaggcuaag

SEQ ID NO: 1413733 - RNA, 19 nt, Homo sapiens
gcuaagaccguuacugaau

SEQ ID NO: 1413734 - RNA, 19 nt, Homo sapiens
cugaaggucucccaugaaa

SEQ ID NO: 1413735 - RNA, 19 nt, Homo sapiens
ggcuaaggcuagaaagaaa

SEQ ID NO: 1413736 - RNA, 19 nt, Homo sapiens
gaccguuacugaauugguu

SEQ ID NO: 1413737 - RNA, 19 nt, Homo sapiens
cugacaagguugacaguaa

SEQ ID NO: 1413738 - RNA, 19 nt, Homo sapiens
gcccagcuguuauuugaga

SEQ ID NO: 1413739 - RNA, 19 nt, Homo sapiens
ccaagccucucgccaugaa

SEQ ID NO: 1413740 - RNA, 19 nt, Homo sapiens
gugguggacucaaggauga

SEQ ID NO: 1413741 - RNA, 19 nt, Homo sapiens
caugguagaugaugaagag

SEQ ID NO: 1413742 - RNA, 19 nt, Homo sapiens
ucacaucacagcugucuga

SEQ ID NO: 1413743 - RNA, 19 nt, Homo sapiens
aagagagaccucauagaua

SEQ ID NO: 1413744 - RNA, 19 nt, Homo sapiens
gagugcagcagacacauuu

SEQ ID NO: 1413745 - RNA, 19 nt, Homo sapiens
caaaggcacuggacaucag

SEQ ID NO: 1413746 - RNA, 19 nt, Homo sapiens
cugaauugguuacuaagaa

SEQ ID NO: 1413747 - RNA, 19 nt, Homo sapiens
ggaccugguuccaaucaag

SEQ ID NO: 1413748 - RNA, 19 nt, Homo sapiens
gauacucaauguagucagu

SEQ ID NO: 1413749 - RNA, 19 nt, Homo sapiens
caagggaugauaucuaugu

SEQ ID NO: 1413750 - RNA, 19 nt, Homo sapiens
gguugacaguaaauucuuu

SEQ ID NO: 1413751 - RNA, 19 nt, Homo sapiens
gagcgauacucaauguagu

SEQ ID NO: 1413752 - RNA, 19 nt, Homo sapiens
aaagggaaguucgguguug

SEQ ID NO: 1413753 - RNA, 19 nt, Homo sapiens
gccugaaggucucccauga

SEQ ID NO: 1413754 - RNA, 19 nt, Homo sapiens
caaagagcacagcaacgua

SEQ ID NO: 1413755 - RNA, 19 nt, Homo sapiens
acucaaggaugaagaagga

SEQ ID NO: 1413756 - RNA, 19 nt, Homo sapiens
gaugaugacggguuugaga

SEQ ID NO: 1413757 - RNA, 19 nt, Homo sapiens
ugacacaucucuggauagu

SEQ ID NO: 1413758 - RNA, 19 nt, Homo sapiens
aaagagcacagcaacguaa

SEQ ID NO: 1413759 - RNA, 19 nt, Homo sapiens
agucagaggucauuucaag

SEQ ID NO: 1413760 - RNA, 19 nt, Homo sapiens
guguggagcugaagaugga

SEQ ID NO: 1413761 - RNA, 19 nt, Homo sapiens
aaccagaccuuggcagaaa

SEQ ID NO: 1413762 - RNA, 19 nt, Homo sapiens
gaaccagaccuuggcagaa

SEQ ID NO: 1413763 - RNA, 19 nt, Homo sapiens
ggcaagagccgacgagaca

SEQ ID NO: 1413764 - RNA, 19 nt, Homo sapiens
acugauggcucuacguuug

SEQ ID NO: 1413765 - RNA, 19 nt, Homo sapiens
gaugaagaaggaccaaaga

SEQ ID NO: 1413766 - RNA, 19 nt, Homo sapiens
cccaggagguggcggaauu

SEQ ID NO: 1413767 - RNA, 19 nt, Homo sapiens
ucaggucgcuacuaaacug

SEQ ID NO: 1413768 - RNA, 19 nt, Homo sapiens
ggagucagaggucauuuca

SEQ ID NO: 1413769 - RNA, 19 nt, Homo sapiens
gguggagcauuaccggaaa

SEQ ID NO: 1413770 - RNA, 19 nt, Homo sapiens
gaugacggguuugagauag

SEQ ID NO: 1413771 - RNA, 19 nt, Homo sapiens
gagccgacgagacaaguuu

SEQ ID NO: 1413772 - RNA, 19 nt, Homo sapiens
acguuuggcuugugacuuu

SEQ ID NO: 1413773 - RNA, 19 nt, Homo sapiens
ccaugaugcuuacucacaa

SEQ ID NO: 1413774 - RNA, 19 nt, Homo sapiens
ugcgaagucucuacaagaa

SEQ ID NO: 1413775 - RNA, 19 nt, Homo sapiens
gcacagcugcgaagucucu

SEQ ID NO: 1413776 - RNA, 19 nt, Homo sapiens
aaaggaggaugcugaagag

SEQ ID NO: 1413777 - RNA, 19 nt, Homo sapiens
aggcccagcuguuauuuga

SEQ ID NO: 1413778 - RNA, 19 nt, Homo sapiens
caacagcuggaaccacaaa

SEQ ID NO: 1413779 - RNA, 19 nt, Homo sapiens
gcaaaggcacuggacauca

SEQ ID NO: 1413780 - RNA, 19 nt, Homo sapiens
ccagcgaaaucaugguaga

SEQ ID NO: 1413781 - RNA, 19 nt, Homo sapiens
ggagcgauacucaauguag

SEQ ID NO: 1413782 - RNA, 19 nt, Homo sapiens
caaaagcguaugcgacuua

SEQ ID NO: 1413783 - RNA, 19 nt, Homo sapiens
acacauuucuguccgaucu

SEQ ID NO: 1413784 - RNA, 19 nt, Homo sapiens
ccaugucaccuacguugua

SEQ ID NO: 1413785 - RNA, 19 nt, Homo sapiens
gauaaugucuccccuguac

SEQ ID NO: 1413786 - RNA, 19 nt, Homo sapiens
ggagguggcggaauugaag

SEQ ID NO: 1413787 - RNA, 19 nt, Homo sapiens
agaggaagaugaaggugau

SEQ ID NO: 1413788 - RNA, 19 nt, Homo sapiens
cugcagagaucuuuguagu

SEQ ID NO: 1413789 - RNA, 19 nt, Homo sapiens
ccagcucaaucgccgcuuu

SEQ ID NO: 1413790 - RNA, 19 nt, Homo sapiens
uuacuaagaagaagccaaa

SEQ ID NO: 1413791 - RNA, 19 nt, Homo sapiens
gguccaugaugcuuacuca

SEQ ID NO: 1413792 - RNA, 19 nt, Homo sapiens
ccuggaagguugauguugu

SEQ ID NO: 1413793 - RNA, 19 nt, Homo sapiens
guucgguguuggagcgaua

SEQ ID NO: 1413794 - RNA, 19 nt, Homo sapiens
ggcaagaagggcaaaguug

SEQ ID NO: 1413795 - RNA, 19 nt, Homo sapiens
ugaauugguuacuaagaag

SEQ ID NO: 1413796 - RNA, 19 nt, Homo sapiens
ggccaagagagaccucaua

SEQ ID NO: 1413797 - RNA, 19 nt, Homo sapiens
gcugaaagaacaagcaaag

SEQ ID NO: 1413798 - RNA, 19 nt, Homo sapiens
gggcaagaagggcaaaguu

SEQ ID NO: 1413799 - RNA, 19 nt, Homo sapiens
guuacugaauugguuacua

SEQ ID NO: 1413800 - RNA, 19 nt, Homo sapiens
gauguugugcucaaugaug

SEQ ID NO: 1413801 - RNA, 19 nt, Homo sapiens
cggagugguuugugcaaga

SEQ ID NO: 1413802 - RNA, 19 nt, Homo sapiens
uucaaccgguacacauuua

SEQ ID NO: 1413803 - RNA, 19 nt, Homo sapiens
aggaggacaucacaacaga

SEQ ID NO: 1413804 - RNA, 19 nt, Homo sapiens
guuauugccucuuccaaaa

SEQ ID NO: 1413805 - RNA, 19 nt, Homo sapiens
gggccuaagucagaugaug

SEQ ID NO: 1413806 - RNA, 19 nt, Homo sapiens
gaaagaaucugacucuauu

SEQ ID NO: 1413807 - RNA, 19 nt, Homo sapiens
ggaaauagaacccuuauca

SEQ ID NO: 1413808 - RNA, 19 nt, Homo sapiens
gaagguuuaucuacaggua

SEQ ID NO: 1413809 - RNA, 19 nt, Homo sapiens
caaagacgaugacaagaug

SEQ ID NO: 1413810 - RNA, 19 nt, Homo sapiens
aaacugggcuccuaugaug

SEQ ID NO: 1413811 - RNA, 19 nt, Homo sapiens
ggucugauguccaugauga

SEQ ID NO: 1413812 - RNA, 19 nt, Homo sapiens
ugaaugaucuuuagcuugu

SEQ ID NO: 1413813 - RNA, 19 nt, Homo sapiens
gaagaagguuuaucuacag

SEQ ID NO: 1413814 - RNA, 19 nt, Homo sapiens
gcaaagagagaucaguaaa

SEQ ID NO: 1413815 - RNA, 19 nt, Homo sapiens
ucccauagccuuugaguua

SEQ ID NO: 1413816 - RNA, 19 nt, Homo sapiens
gaggugcugugcuuuguuu

SEQ ID NO: 1413817 - RNA, 19 nt, Homo sapiens
uaaagagguuguucucaug

SEQ ID NO: 1413818 - RNA, 19 nt, Homo sapiens
ucacaauccugcugccuuu

SEQ ID NO: 1413819 - RNA, 19 nt, Homo sapiens
ugaagaagguuuaucuaca

SEQ ID NO: 1413820 - RNA, 19 nt, Homo sapiens
caucuggaauguucaagaa

SEQ ID NO: 1413821 - RNA, 19 nt, Homo sapiens
uuaaugaugucuucaguuc

SEQ ID NO: 1413822 - RNA, 19 nt, Homo sapiens
caaguuuccuuuccuuuua

SEQ ID NO: 1413823 - RNA, 19 nt, Homo sapiens
gguuaggaguggaaauauu

SEQ ID NO: 1413824 - RNA, 19 nt, Homo sapiens
ccuaugauguggcauucua

SEQ ID NO: 1413825 - RNA, 19 nt, Homo sapiens
ggaauaccacuugcacuuu

SEQ ID NO: 1413826 - RNA, 19 nt, Homo sapiens
guuaggaguggaaauauuu

SEQ ID NO: 1413827 - RNA, 19 nt, Homo sapiens
caucaugggucucuucgau

SEQ ID NO: 1413828 - RNA, 19 nt, Homo sapiens
uaaaaccacuggaaaagaa

SEQ ID NO: 1413829 - RNA, 19 nt, Homo sapiens
gaauaccacuugcacuuuu

SEQ ID NO: 1413830 - RNA, 19 nt, Homo sapiens
ggaugucucccaagcaauu

SEQ ID NO: 1413831 - RNA, 19 nt, Homo sapiens
gcaguuggaauaccacuug

SEQ ID NO: 1413832 - RNA, 19 nt, Homo sapiens
uagcggauccucccucuuu

SEQ ID NO: 1413833 - RNA, 19 nt, Homo sapiens
caagaaagaaucugacucu

SEQ ID NO: 1413834 - RNA, 19 nt, Homo sapiens
gaaaagaaaagauggagaa

SEQ ID NO: 1413835 - RNA, 19 nt, Homo sapiens
gcagcagugucuucacaau

SEQ ID NO: 1413836 - RNA, 19 nt, Homo sapiens
aauagaacccuuaucacua

SEQ ID NO: 1413837 - RNA, 19 nt, Homo sapiens
caggaugucucccaagcaa

SEQ ID NO: 1413838 - RNA, 19 nt, Homo sapiens
gauacuuugugccuuaugu

SEQ ID NO: 1413839 - RNA, 19 nt, Homo sapiens
cuucauguuuguucucuuu

SEQ ID NO: 1413840 - RNA, 19 nt, Homo sapiens
ugaaaggguugcaguuugg

SEQ ID NO: 1413841 - RNA, 19 nt, Homo sapiens
auagaacccuuaucacuag

SEQ ID NO: 1413842 - RNA, 19 nt, Homo sapiens
ccaaagacgaugacaagau

SEQ ID NO: 1413843 - RNA, 19 nt, Homo sapiens
gaaugaucuuuagcuugua

SEQ ID NO: 1413844 - RNA, 19 nt, Homo sapiens
agaaagaaucugacucuau

SEQ ID NO: 1413845 - RNA, 19 nt, Homo sapiens
uuggauacuuugugccuua

SEQ ID NO: 1413846 - RNA, 19 nt, Homo sapiens
uaccaaagauaaagagagu

SEQ ID NO: 1413847 - RNA, 19 nt, Homo sapiens
gcucuuaaggguucugauu

SEQ ID NO: 1413848 - RNA, 19 nt, Homo sapiens
cugaaaggguugcaguuug

SEQ ID NO: 1413849 - RNA, 19 nt, Homo sapiens
ucccguggauccauaguaa

SEQ ID NO: 1413850 - RNA, 19 nt, Homo sapiens
ggaugcuucauuuccauua

SEQ ID NO: 1413851 - RNA, 19 nt, Homo sapiens
auaaagagguuguucucau

SEQ ID NO: 1413852 - RNA, 19 nt, Homo sapiens
gucugaaagucacauauug

SEQ ID NO: 1413853 - RNA, 19 nt, Homo sapiens
ucuucaaggugacagcuua

SEQ ID NO: 1413854 - RNA, 19 nt, Homo sapiens
ucuuaaggguucugauuga

SEQ ID NO: 1413855 - RNA, 19 nt, Homo sapiens
gggugcugcuguuggauuu

SEQ ID NO: 1413856 - RNA, 19 nt, Homo sapiens
gaaaacaugucugaaaguc

SEQ ID NO: 1413857 - RNA, 19 nt, Homo sapiens
cacuaaauaucucugaugu

SEQ ID NO: 1413858 - RNA, 19 nt, Homo sapiens
gaaaagauggagaaaaugu

SEQ ID NO: 1413859 - RNA, 19 nt, Homo sapiens
gaugcuucauuuccauuau

SEQ ID NO: 1413860 - RNA, 19 nt, Homo sapiens
gggcucauguccaguucuu

SEQ ID NO: 1413861 - RNA, 19 nt, Homo sapiens
gauaaagagaguggaggua

SEQ ID NO: 1413862 - RNA, 19 nt, Homo sapiens
gcucugcaucuucauguuu

SEQ ID NO: 1413863 - RNA, 19 nt, Homo sapiens
gaacccuuaucacuagaag

SEQ ID NO: 1413864 - RNA, 19 nt, Homo sapiens
aagcaaagagagaucagua

SEQ ID NO: 1413865 - RNA, 19 nt, Homo sapiens
gugacaaacugggcuccua

SEQ ID NO: 1413866 - RNA, 19 nt, Homo sapiens
gaaacugugaaugaucuuu

SEQ ID NO: 1413867 - RNA, 19 nt, Homo sapiens
ccuauuugguugucggaaa

SEQ ID NO: 1413868 - RNA, 19 nt, Homo sapiens
ggaaaccuucggcuccaaa

SEQ ID NO: 1413869 - RNA, 19 nt, Homo sapiens
uggcgucacuucaggaguu

SEQ ID NO: 1413870 - RNA, 19 nt, Homo sapiens
uucgauggaugcuucauuu

SEQ ID NO: 1413871 - RNA, 19 nt, Homo sapiens
ccugcugccuuugcucuua

SEQ ID NO: 1413872 - RNA, 19 nt, Homo sapiens
uugaagcuaucucaguaaa

SEQ ID NO: 1413873 - RNA, 19 nt, Homo sapiens
gagacucugguauaugaaa

SEQ ID NO: 1413874 - RNA, 19 nt, Homo sapiens
ccuaggaauagcacaauaa

SEQ ID NO: 1413875 - RNA, 19 nt, Homo sapiens
uuaaucacauccuaggaau

SEQ ID NO: 1413876 - RNA, 19 nt, Homo sapiens
ggaauguucaagaaagaau

SEQ ID NO: 1413877 - RNA, 19 nt, Homo sapiens
caugaugauuccucugugu

SEQ ID NO: 1413878 - RNA, 19 nt, Homo sapiens
ugacagcgugggccucuuu

SEQ ID NO: 1413879 - RNA, 19 nt, Homo sapiens
uaccuuaccuauggaauca

SEQ ID NO: 1413880 - RNA, 19 nt, Homo sapiens
aaugaugucuucaguucug

SEQ ID NO: 1413881 - RNA, 19 nt, Homo sapiens
auuugaagcuaucucagua

SEQ ID NO: 1413882 - RNA, 19 nt, Homo sapiens
cuaccaguaccaaagauaa

SEQ ID NO: 1413883 - RNA, 19 nt, Homo sapiens
gggacacuauuucaagaag

SEQ ID NO: 1413884 - RNA, 19 nt, Homo sapiens
gauguuuccaugagucuga

SEQ ID NO: 1413885 - RNA, 19 nt, Homo sapiens
aaauaucucugauguuucc

SEQ ID NO: 1413886 - RNA, 19 nt, Homo sapiens
ccacuaaauaucucugaug

SEQ ID NO: 1413887 - RNA, 19 nt, Homo sapiens
gaaauagaacccuuaucac

SEQ ID NO: 1413888 - RNA, 19 nt, Homo sapiens
gcuaccaguaccaaagaua

SEQ ID NO: 1413889 - RNA, 19 nt, Homo sapiens
agaacucucugcugucaag

SEQ ID NO: 1413890 - RNA, 19 nt, Homo sapiens
guaagaagcaaagagagau

SEQ ID NO: 1413891 - RNA, 19 nt, Homo sapiens
uggaaacugugaaugaucu

SEQ ID NO: 1413892 - RNA, 19 nt, Homo sapiens
aaauagaacccuuaucacu

SEQ ID NO: 1413893 - RNA, 19 nt, Homo sapiens
gcaaguuuccuuuccuuuu

SEQ ID NO: 1413894 - RNA, 19 nt, Homo sapiens
aagaaagaaucugacucua

SEQ ID NO: 1413895 - RNA, 19 nt, Homo sapiens
uauuggaggugcugugcuu

SEQ ID NO: 1413896 - RNA, 19 nt, Homo sapiens
caaacugggcuccuaugau

SEQ ID NO: 1413897 - RNA, 19 nt, Homo sapiens
caucgagccucuguaccuu

SEQ ID NO: 1413898 - RNA, 19 nt, Homo sapiens
gaucuuuagcuuguacaaa

SEQ ID NO: 1413899 - RNA, 19 nt, Homo sapiens
aaguucaucuggaauguuc

SEQ ID NO: 1413900 - RNA, 19 nt, Homo sapiens
ucaaguucaucuggaaugu

SEQ ID NO: 1413901 - RNA, 19 nt, Homo sapiens
aagcaaguuuccuuuccuu

SEQ ID NO: 1413902 - RNA, 19 nt, Homo sapiens
ugugaaugaucuuuagcuu

SEQ ID NO: 1413903 - RNA, 19 nt, Homo sapiens
uugcauaccagccuucauu

SEQ ID NO: 1413904 - RNA, 19 nt, Homo sapiens
ucuggaauguucaagaaag

SEQ ID NO: 1413905 - RNA, 19 nt, Homo sapiens
ccauagccuuugaguuagu

SEQ ID NO: 1413906 - RNA, 19 nt, Homo sapiens
gaaaggagguuuaggauug

SEQ ID NO: 1413907 - RNA, 19 nt, Homo sapiens
uaacuuggauugucuguuu

SEQ ID NO: 1413908 - RNA, 19 nt, Homo sapiens
ggacagacauuacuuccaa

SEQ ID NO: 1413909 - RNA, 19 nt, Homo sapiens
gagcugagaucaugccauu

SEQ ID NO: 1413910 - RNA, 19 nt, Homo sapiens
ggaaggagauucacuuugg

SEQ ID NO: 1413911 - RNA, 19 nt, Homo sapiens
ggagaaagcuaacuugaac

SEQ ID NO: 1413912 - RNA, 19 nt, Homo sapiens
gcagugagcugagaucaug

SEQ ID NO: 1413913 - RNA, 19 nt, Homo sapiens
caaauggccuuaacuugga

SEQ ID NO: 1413914 - RNA, 19 nt, Homo sapiens
guagagaauuuccuuccua

SEQ ID NO: 1413915 - RNA, 19 nt, Homo sapiens
aaagcuaacuugaacauga

SEQ ID NO: 1413916 - RNA, 19 nt, Homo sapiens
ggaaagggagcuacagaaa

SEQ ID NO: 1413917 - RNA, 19 nt, Homo sapiens
gaucaaugcuguggaugaa

SEQ ID NO: 1413918 - RNA, 19 nt, Homo sapiens
uuaaagaaauccacucaga

SEQ ID NO: 1413919 - RNA, 19 nt, Homo sapiens
gaaaccuucuacaagcaua

SEQ ID NO: 1413920 - RNA, 19 nt, Homo sapiens
ugcaaucgauuucucuuua

SEQ ID NO: 1413921 - RNA, 19 nt, Homo sapiens
gaugaacgaugaaugucaa

SEQ ID NO: 1413922 - RNA, 19 nt, Homo sapiens
ccagaggccuucuccuuga

SEQ ID NO: 1413923 - RNA, 19 nt, Homo sapiens
acaaagguguucacaguug

SEQ ID NO: 1413924 - RNA, 19 nt, Homo sapiens
agaaguaccagcacaauuu

SEQ ID NO: 1413925 - RNA, 19 nt, Homo sapiens
ggaggugucugaagaagag

SEQ ID NO: 1413926 - RNA, 19 nt, Homo sapiens
gcguaugacucucuuaugu

SEQ ID NO: 1413927 - RNA, 19 nt, Homo sapiens
aaacuuggguccugugguu

SEQ ID NO: 1413928 - RNA, 19 nt, Homo sapiens
gaaggcaauuaaagaaauc

SEQ ID NO: 1413929 - RNA, 19 nt, Homo sapiens
ugaauuggguuuauuagca

SEQ ID NO: 1413930 - RNA, 19 nt, Homo sapiens
gcucuucucuaacuugguu

SEQ ID NO: 1413931 - RNA, 19 nt, Homo sapiens
ccacugagcacuuaacaau

SEQ ID NO: 1413932 - RNA, 19 nt, Homo sapiens
gaacgaugaaugucaaugu

SEQ ID NO: 1413933 - RNA, 19 nt, Homo sapiens
caaagguguucacaguuga

SEQ ID NO: 1413934 - RNA, 19 nt, Homo sapiens
agaauuuccuuccuacuga

SEQ ID NO: 1413935 - RNA, 19 nt, Homo sapiens
cgauuucucuuuagucguu

SEQ ID NO: 1413936 - RNA, 19 nt, Homo sapiens
ugcccuagcucuucucuaa

SEQ ID NO: 1413937 - RNA, 19 nt, Homo sapiens
gagaauuuccaccauugua

SEQ ID NO: 1413938 - RNA, 19 nt, Homo sapiens
guucauuuguugagccaua

SEQ ID NO: 1413939 - RNA, 19 nt, Homo sapiens
acugagcacuuaacaauug

SEQ ID NO: 1413940 - RNA, 19 nt, Homo sapiens
gcaaucgauuucucuuuag

SEQ ID NO: 1413941 - RNA, 19 nt, Homo sapiens
gagugaagcagauguaaug

SEQ ID NO: 1413942 - RNA, 19 nt, Homo sapiens
gaaguaccagcacaauuug

SEQ ID NO: 1413943 - RNA, 19 nt, Homo sapiens
gaagaugcaagagcacuuu

SEQ ID NO: 1413944 - RNA, 19 nt, Homo sapiens
aaagggagcuacagaaagg

SEQ ID NO: 1413945 - RNA, 19 nt, Homo sapiens
gcacuuaacaauugcuuuc

SEQ ID NO: 1413946 - RNA, 19 nt, Homo sapiens
gagcauucccauuaacaaa

SEQ ID NO: 1413947 - RNA, 19 nt, Homo sapiens
ggacacaucuaccaaaauc

SEQ ID NO: 1413948 - RNA, 19 nt, Homo sapiens
gcucaugccuguaauucca

SEQ ID NO: 1413949 - RNA, 19 nt, Homo sapiens
aauuugagcauucccauua

SEQ ID NO: 1413950 - RNA, 19 nt, Homo sapiens
gaaagggagcuacagaaag

SEQ ID NO: 1413951 - RNA, 19 nt, Homo sapiens
aaagaaauccacucagaga

SEQ ID NO: 1413952 - RNA, 19 nt, Homo sapiens
ccaccauuguagagaauuu

SEQ ID NO: 1413953 - RNA, 19 nt, Homo sapiens
gaagccagacugcauggaa

SEQ ID NO: 1413954 - RNA, 19 nt, Homo sapiens
gugauugacuggaagacuu

SEQ ID NO: 1413955 - RNA, 19 nt, Homo sapiens
caacucaagucugcucuca

SEQ ID NO: 1413956 - RNA, 19 nt, Homo sapiens
ggaugagggugaagaguac

SEQ ID NO: 1413957 - RNA, 19 nt, Homo sapiens
cagcacaauuugagcauuc

SEQ ID NO: 1413958 - RNA, 19 nt, Homo sapiens
ccauaaccauaaccagauu

SEQ ID NO: 1413959 - RNA, 19 nt, Homo sapiens
gguuuaggauugcagagaa

SEQ ID NO: 1413960 - RNA, 19 nt, Homo sapiens
gcaccuccaggauacauaa

SEQ ID NO: 1413961 - RNA, 19 nt, Homo sapiens
agaaacaccugagcagaau

SEQ ID NO: 1413962 - RNA, 19 nt, Homo sapiens
gcaggaaggagauucacuu

SEQ ID NO: 1413963 - RNA, 19 nt, Homo sapiens
gggagaaagcuaacuugaa

SEQ ID NO: 1413964 - RNA, 19 nt, Homo sapiens
ucagaaggcaauuaaagaa

SEQ ID NO: 1413965 - RNA, 19 nt, Homo sapiens
ccagaucaaugcuguggau

SEQ ID NO: 1413966 - RNA, 19 nt, Homo sapiens
caaggaggcaggauaagga

SEQ ID NO: 1413967 - RNA, 19 nt, Homo sapiens
gagaauuuccuuccuacug

SEQ ID NO: 1413968 - RNA, 19 nt, Homo sapiens
ccuccaggauacauaaauu

SEQ ID NO: 1413969 - RNA, 19 nt, Homo sapiens
cauggaagcuguggugcaa

SEQ ID NO: 1413970 - RNA, 19 nt, Homo sapiens
caagagaucuaggaaaaga

SEQ ID NO: 1413971 - RNA, 19 nt, Homo sapiens
caaccuauuuauacaaagg

SEQ ID NO: 1413972 - RNA, 19 nt, Homo sapiens
cugagaaucuaccucuauu

SEQ ID NO: 1413973 - RNA, 19 nt, Homo sapiens
ucaugaagcugauccuuuu

SEQ ID NO: 1413974 - RNA, 19 nt, Homo sapiens
gagaggugguggccaugga

SEQ ID NO: 1413975 - RNA, 19 nt, Homo sapiens
uagaugugauugacuggaa

SEQ ID NO: 1413976 - RNA, 19 nt, Homo sapiens
ugacaggagccgaguggua

SEQ ID NO: 1413977 - RNA, 19 nt, Homo sapiens
gaauuuccaccauuguaga

SEQ ID NO: 1413978 - RNA, 19 nt, Homo sapiens
cagaaggcaauuaaagaaa

SEQ ID NO: 1413979 - RNA, 19 nt, Homo sapiens
gagcaggugauucuucaga

SEQ ID NO: 1413980 - RNA, 19 nt, Homo sapiens
gagcguaugacucucuuau

SEQ ID NO: 1413981 - RNA, 19 nt, Homo sapiens
ccaaaacacuggagcguau

SEQ ID NO: 1413982 - RNA, 19 nt, Homo sapiens
gaagcuguggugcaagaaa

SEQ ID NO: 1413983 - RNA, 19 nt, Homo sapiens
gcaaggacaacucaagucu

SEQ ID NO: 1413984 - RNA, 19 nt, Homo sapiens
gaagaaggaaagggagcua

SEQ ID NO: 1413985 - RNA, 19 nt, Homo sapiens
ggccaaccaugaaaauuaa

SEQ ID NO: 1413986 - RNA, 19 nt, Homo sapiens
aaauccagcuccaagugaa

SEQ ID NO: 1413987 - RNA, 19 nt, Homo sapiens
ccaggagaaugggaugauu

SEQ ID NO: 1413988 - RNA, 19 nt, Homo sapiens
gaacccaggcccaguuucu

SEQ ID NO: 1413989 - RNA, 19 nt, Homo sapiens
gggaugugcucgucuucau

SEQ ID NO: 1413990 - RNA, 19 nt, Homo sapiens
guaaagggagggaagcaau

SEQ ID NO: 1413991 - RNA, 19 nt, Homo sapiens
ggcaaguucuagcaacaug

SEQ ID NO: 1413992 - RNA, 19 nt, Homo sapiens
uaaagggagggaagcaauu

SEQ ID NO: 1413993 - RNA, 19 nt, Homo sapiens
gacagacauuacuuccaaa

SEQ ID NO: 1413994 - RNA, 19 nt, Homo sapiens
gacaggagccgagugguau

SEQ ID NO: 1413995 - RNA, 19 nt, Homo sapiens
agucugcucucagcgaaua

SEQ ID NO: 1413996 - RNA, 19 nt, Homo sapiens
gguguucacaguugagaaa

SEQ ID NO: 1413997 - RNA, 19 nt, Homo sapiens
acagaaaggagguuuagga

SEQ ID NO: 1413998 - RNA, 19 nt, Homo sapiens
aagaaacaccugagcagaa

SEQ ID NO: 1413999 - RNA, 19 nt, Homo sapiens
ggaugaacgaugaauguca

SEQ ID NO: 1414000 - RNA, 19 nt, Homo sapiens
uggaagcuguggugcaaga

SEQ ID NO: 1414001 - RNA, 19 nt, Homo sapiens
gcucugugguggcucuguu

SEQ ID NO: 1414002 - RNA, 19 nt, Homo sapiens
ggugauagaugugauugac

SEQ ID NO: 1414003 - RNA, 19 nt, Homo sapiens
gcauucccauuaacaaagg

SEQ ID NO: 1414004 - RNA, 19 nt, Homo sapiens
aaagagugaagcagaugua

SEQ ID NO: 1414005 - RNA, 19 nt, Homo sapiens
ggccuuaacuuggauuguc

SEQ ID NO: 1414006 - RNA, 19 nt, Homo sapiens
gagauacguuacccaauua

SEQ ID NO: 1414007 - RNA, 19 nt, Homo sapiens
gagcagagguucuaugaau

SEQ ID NO: 1414008 - RNA, 19 nt, Homo sapiens
gaacagacagccaggauaa

SEQ ID NO: 1414009 - RNA, 19 nt, Homo sapiens
gggcuuaucuggauucuuc

SEQ ID NO: 1414010 - RNA, 19 nt, Homo sapiens
ggaaugagcacaccaccua

SEQ ID NO: 1414011 - RNA, 19 nt, Homo sapiens
ugagauacguuacccaauu

SEQ ID NO: 1414012 - RNA, 19 nt, Homo sapiens
ggaauaagaacaaacaguu

SEQ ID NO: 1414013 - RNA, 19 nt, Homo sapiens
gacaagcccucuaucaguu

SEQ ID NO: 1414014 - RNA, 19 nt, Homo sapiens
ggacaaguguaaauaugga

SEQ ID NO: 1414015 - RNA, 19 nt, Homo sapiens
gaaguacuuucucugcaaa

SEQ ID NO: 1414016 - RNA, 19 nt, Homo sapiens
gagcugcccuuucuacuuc

SEQ ID NO: 1414017 - RNA, 19 nt, Homo sapiens
gaggacaacugcgcuauga

SEQ ID NO: 1414018 - RNA, 19 nt, Homo sapiens
gcagaaaacuugacuugaa

SEQ ID NO: 1414019 - RNA, 19 nt, Homo sapiens
gcaguacggaaaccuauua

SEQ ID NO: 1414020 - RNA, 19 nt, Homo sapiens
gcccuccucuccaucauua

SEQ ID NO: 1414021 - RNA, 19 nt, Homo sapiens
gcaaagacaaguacuaugg

SEQ ID NO: 1414022 - RNA, 19 nt, Homo sapiens
gcucaugaaugccucuuau

SEQ ID NO: 1414023 - RNA, 19 nt, Homo sapiens
gcaggaaccaccagaaaga

SEQ ID NO: 1414024 - RNA, 19 nt, Homo sapiens
caauaaaggccaagaagga

SEQ ID NO: 1414025 - RNA, 19 nt, Homo sapiens
guacggaaaccuauuacaa

SEQ ID NO: 1414026 - RNA, 19 nt, Homo sapiens
ccacugacguccugcucua

SEQ ID NO: 1414027 - RNA, 19 nt, Homo sapiens
acucucugcuuucuauuua

SEQ ID NO: 1414028 - RNA, 19 nt, Homo sapiens
uuacaagacugguggacaa

SEQ ID NO: 1414029 - RNA, 19 nt, Homo sapiens
ucuaucaguuccuacauaa

SEQ ID NO: 1414030 - RNA, 19 nt, Homo sapiens
gcacugagagacaagauuc

SEQ ID NO: 1414031 - RNA, 19 nt, Homo sapiens
guucauaccgcuucuauuc

SEQ ID NO: 1414032 - RNA, 19 nt, Homo sapiens
gacacaggaugaagcagaa

SEQ ID NO: 1414033 - RNA, 19 nt, Homo sapiens
aaagacaaguacuauggaa

SEQ ID NO: 1414034 - RNA, 19 nt, Homo sapiens
ccaagaaggagaaaguuga

SEQ ID NO: 1414035 - RNA, 19 nt, Homo sapiens
aggcagagcucaugaaugc

SEQ ID NO: 1414036 - RNA, 19 nt, Homo sapiens
gcacaccaccuacgaugga

SEQ ID NO: 1414037 - RNA, 19 nt, Homo sapiens
gcacaggccaucucagcuu

SEQ ID NO: 1414038 - RNA, 19 nt, Homo sapiens
ggacaacugcgcuaugaca

SEQ ID NO: 1414039 - RNA, 19 nt, Homo sapiens
caagacugguggacaagug

SEQ ID NO: 1414040 - RNA, 19 nt, Homo sapiens
ggaugaagcagaagagauc

SEQ ID NO: 1414041 - RNA, 19 nt, Homo sapiens
caaguuagaggccagcauu

SEQ ID NO: 1414042 - RNA, 19 nt, Homo sapiens
guggacaaguguaaauaug

SEQ ID NO: 1414043 - RNA, 19 nt, Homo sapiens
uacaagggcuacuggaaug

SEQ ID NO: 1414044 - RNA, 19 nt, Homo sapiens
gacaaguacuauggaagaa

SEQ ID NO: 1414045 - RNA, 19 nt, Homo sapiens
gaugaaguaugacgagcau

SEQ ID NO: 1414046 - RNA, 19 nt, Homo sapiens
caugagcucuggcaaagca

SEQ ID NO: 1414047 - RNA, 19 nt, Homo sapiens
gaaacuuccugggcuuauc

SEQ ID NO: 1414048 - RNA, 19 nt, Homo sapiens
gggagcagagguucuauga

SEQ ID NO: 1414049 - RNA, 19 nt, Homo sapiens
gcucucuccuugucaucua

SEQ ID NO: 1414050 - RNA, 19 nt, Homo sapiens
ugagcgugaugaaguauga

SEQ ID NO: 1414051 - RNA, 19 nt, Homo sapiens
acaugagcgugaugaagua

SEQ ID NO: 1414052 - RNA, 19 nt, Homo sapiens
guugggagcugcccuuucu

SEQ ID NO: 1414053 - RNA, 19 nt, Homo sapiens
ggcaugagcucuggcaaag

SEQ ID NO: 1414054 - RNA, 19 nt, Homo sapiens
gggcaggaaccaccagaaa

SEQ ID NO: 1414055 - RNA, 19 nt, Homo sapiens
acggaaaccuauuacaaug

SEQ ID NO: 1414056 - RNA, 19 nt, Homo sapiens
cccaaaaucucuuaaaaug

SEQ ID NO: 1414057 - RNA, 19 nt, Homo sapiens
ccuuagaugucuucauaau

SEQ ID NO: 1414058 - RNA, 19 nt, Homo sapiens
gggcuauagaucucaaaua

SEQ ID NO: 1414059 - RNA, 19 nt, Homo sapiens
uaucaguuccuacauaaug

SEQ ID NO: 1414060 - RNA, 19 nt, Homo sapiens
caaguacuauggaagaaaa

SEQ ID NO: 1414061 - RNA, 19 nt, Homo sapiens
ucuacucucugcuuucuau

SEQ ID NO: 1414062 - RNA, 19 nt, Homo sapiens
guugacauccgcaugauug

SEQ ID NO: 1414063 - RNA, 19 nt, Homo sapiens
ucaaacagauaagaaguac

SEQ ID NO: 1414064 - RNA, 19 nt, Homo sapiens
ggagcugcccuuucuacuu

SEQ ID NO: 1414065 - RNA, 19 nt, Homo sapiens
aagcagccuugaagaguga

SEQ ID NO: 1414066 - RNA, 19 nt, Homo sapiens
gugcaccucuggaaagaca

SEQ ID NO: 1414067 - RNA, 19 nt, Homo sapiens
caagcacugagauacguua

SEQ ID NO: 1414068 - RNA, 19 nt, Homo sapiens
augaaugccucuuaucuuc

SEQ ID NO: 1414069 - RNA, 19 nt, Homo sapiens
aguccuaucuaccuucaaa

SEQ ID NO: 1414070 - RNA, 19 nt, Homo sapiens
agacaaguacuauggaaga

SEQ ID NO: 1414071 - RNA, 19 nt, Homo sapiens
gcaggcagagcucaugaau

SEQ ID NO: 1414072 - RNA, 19 nt, Homo sapiens
uauccaagagggagaauga

SEQ ID NO: 1414073 - RNA, 19 nt, Homo sapiens
uuacaaugcccuugaguca

SEQ ID NO: 1414074 - RNA, 19 nt, Homo sapiens
gcucuacucucugcuuucu

SEQ ID NO: 1414075 - RNA, 19 nt, Homo sapiens
ccccuuagaugucuucaua

SEQ ID NO: 1414076 - RNA, 19 nt, Homo sapiens
caaagacaaguacuaugga

SEQ ID NO: 1414077 - RNA, 19 nt, Homo sapiens
aguggcaccuucuggagua

SEQ ID NO: 1414078 - RNA, 19 nt, Homo sapiens
gagaacagacagccaggau

SEQ ID NO: 1414079 - RNA, 19 nt, Homo sapiens
ucagacaagcccucuauca

SEQ ID NO: 1414080 - RNA, 19 nt, Homo sapiens
guucagacaagcccucuau

SEQ ID NO: 1414081 - RNA, 19 nt, Homo sapiens
ucacagugcaccucuggaa

SEQ ID NO: 1414082 - RNA, 19 nt, Homo sapiens
gacgggccauugccugaug

SEQ ID NO: 1414083 - RNA, 19 nt, Homo sapiens
gcagaccaccggcagcaau

SEQ ID NO: 1414084 - RNA, 19 nt, Homo sapiens
gguggacaaguguaaauau

SEQ ID NO: 1414085 - RNA, 19 nt, Homo sapiens
gggcaauguuuacaagacu

SEQ ID NO: 1414086 - RNA, 19 nt, Homo sapiens
gaaucucuuagcagacuuu

SEQ ID NO: 1414087 - RNA, 19 nt, Homo sapiens
gaccccagauucuccauuu

SEQ ID NO: 1414088 - RNA, 19 nt, Homo sapiens
caugaaugccucuuaucuu

SEQ ID NO: 1414089 - RNA, 19 nt, Homo sapiens
uaaaggccaagaaggagaa

SEQ ID NO: 1414090 - RNA, 19 nt, Homo sapiens
aaauagagaccuguugguu

SEQ ID NO: 1414091 - RNA, 19 nt, Homo sapiens
agacaagcccucuaucagu

SEQ ID NO: 1414092 - RNA, 19 nt, Homo sapiens
ggaagacaccaacggaaac

SEQ ID NO: 1414093 - RNA, 19 nt, Homo sapiens
gcacaugagcgugaugaag

SEQ ID NO: 1414094 - RNA, 19 nt, Homo sapiens
ugagucaagcacugagaua

SEQ ID NO: 1414095 - RNA, 19 nt, Homo sapiens
gaaugccucuuaucuuccu

SEQ ID NO: 1414096 - RNA, 19 nt, Homo sapiens
gcucuaaugcugcuuaucg

SEQ ID NO: 1414097 - RNA, 19 nt, Homo sapiens
gccaagaaggagaaaguug

SEQ ID NO: 1414098 - RNA, 19 nt, Homo sapiens
aaugaggaaucucuuagca

SEQ ID NO: 1414099 - RNA, 19 nt, Homo sapiens
ucuggaauauuugcaucua

SEQ ID NO: 1414100 - RNA, 19 nt, Homo sapiens
ggauucuucugggcuauag

SEQ ID NO: 1414101 - RNA, 19 nt, Homo sapiens
ggaggacaacugcgcuaug

SEQ ID NO: 1414102 - RNA, 19 nt, Homo sapiens
uggaagacaccaacggaaa

SEQ ID NO: 1414103 - RNA, 19 nt, Homo sapiens
ucucuuagcagacuuugga

SEQ ID NO: 1414104 - RNA, 19 nt, Homo sapiens
gcgcuaugacagcaauaaa

SEQ ID NO: 1414105 - RNA, 19 nt, Homo sapiens
ggugggcacugagagacaa

SEQ ID NO: 1414106 - RNA, 19 nt, Homo sapiens
caccauagcucaugacuuc

SEQ ID NO: 1414107 - RNA, 19 nt, Homo sapiens
agaaagauaugguugaaga

SEQ ID NO: 1414108 - RNA, 19 nt, Homo sapiens
agaaacagcuguguaaaga

SEQ ID NO: 1414109 - RNA, 19 nt, Homo sapiens
ccaccaauauguaauucua

SEQ ID NO: 1414110 - RNA, 19 nt, Homo sapiens
caagaaagauaugguugaa

SEQ ID NO: 1414111 - RNA, 19 nt, Homo sapiens
gaaguaagcagcaagaaag

SEQ ID NO: 1414112 - RNA, 19 nt, Homo sapiens
guaagcagcaagaaagaua

SEQ ID NO: 1414113 - RNA, 19 nt, Homo sapiens
ggagaagcagugaaagaua

SEQ ID NO: 1414114 - RNA, 19 nt, Homo sapiens
gagaagcagugaaagauac

SEQ ID NO: 1414115 - RNA, 19 nt, Homo sapiens
gcaagaaagauaugguuga

SEQ ID NO: 1414116 - RNA, 19 nt, Homo sapiens
caccaggaauuauugauga

SEQ ID NO: 1414117 - RNA, 19 nt, Homo sapiens
aaacagcuguguaaagaag

SEQ ID NO: 1414118 - RNA, 19 nt, Homo sapiens
caagugaucccagccuaua

SEQ ID NO: 1414119 - RNA, 19 nt, Homo sapiens
cuaagucacauacagauaa

SEQ ID NO: 1414120 - RNA, 19 nt, Homo sapiens
agaccucucuuccaaaugu

SEQ ID NO: 1414121 - RNA, 19 nt, Homo sapiens
gaaacaaugcaaagaugga

SEQ ID NO: 1414122 - RNA, 19 nt, Homo sapiens
aauagaaacagcuguguaa

SEQ ID NO: 1414123 - RNA, 19 nt, Homo sapiens
uaaacuaagucacauacag

SEQ ID NO: 1414124 - RNA, 19 nt, Homo sapiens
gaaacagcuguguaaagaa

SEQ ID NO: 1414125 - RNA, 19 nt, Homo sapiens
gaagaccacaggcgaguuc

SEQ ID NO: 1414126 - RNA, 19 nt, Homo sapiens
agugaaagauacaugcaaa

SEQ ID NO: 1414127 - RNA, 19 nt, Homo sapiens
ugaaguaagcagcaagaaa

SEQ ID NO: 1414128 - RNA, 19 nt, Homo sapiens
aaacuaagucacauacaga

SEQ ID NO: 1414129 - RNA, 19 nt, Homo sapiens
gcaggaaacaaugcaaaga

SEQ ID NO: 1414130 - RNA, 19 nt, Homo sapiens
gaucagggcacugcaggaa

SEQ ID NO: 1414131 - RNA, 19 nt, Homo sapiens
gcugcuggcucuuccuaug

SEQ ID NO: 1414132 - RNA, 19 nt, Homo sapiens
uaauagaaacagcugugua

SEQ ID NO: 1414133 - RNA, 19 nt, Homo sapiens
ucagagugauaaacuaagu

SEQ ID NO: 1414134 - RNA, 19 nt, Homo sapiens
ugacucaacaccaggaauu

SEQ ID NO: 1414135 - RNA, 19 nt, Homo sapiens
gauaaacuaagucacauac

SEQ ID NO: 1414136 - RNA, 19 nt, Homo sapiens
ccucagagugauaaacuaa

SEQ ID NO: 1414137 - RNA, 19 nt, Homo sapiens
guucacgacagacuacuuu

SEQ ID NO: 1414138 - RNA, 19 nt, Homo sapiens
aggaaacaaugcaaagaug

SEQ ID NO: 1414139 - RNA, 19 nt, Homo sapiens
caacaccaggaauuauuga

SEQ ID NO: 1414140 - RNA, 19 nt, Homo sapiens
caguaagguucacgacaga

SEQ ID NO: 1414141 - RNA, 19 nt, Homo sapiens
augcaaagauggagaagca

SEQ ID NO: 1414142 - RNA, 19 nt, Homo sapiens
ccaggaauuauugaugaua

SEQ ID NO: 1414143 - RNA, 19 nt, Homo sapiens
gacucaacaccaggaauua

SEQ ID NO: 1414144 - RNA, 19 nt, Homo sapiens
ucuucgagcuugcugcauu

SEQ ID NO: 1414145 - RNA, 19 nt, Homo sapiens
cagcaagaaagauaugguu

SEQ ID NO: 1414146 - RNA, 19 nt, Homo sapiens
uuccaaauguucaccauag

SEQ ID NO: 1414147 - RNA, 19 nt, Homo sapiens
ucacgacagacuacuuuga

SEQ ID NO: 1414148 - RNA, 19 nt, Homo sapiens
ucaacaccaggaauuauug

SEQ ID NO: 1414149 - RNA, 19 nt, Homo sapiens
uagaaacagcuguguaaag

SEQ ID NO: 1414150 - RNA, 19 nt, Homo sapiens
caggaaacaaugcaaagau

SEQ ID NO: 1414151 - RNA, 19 nt, Homo sapiens
cacgacagacuacuuugaa

SEQ ID NO: 1414152 - RNA, 19 nt, Homo sapiens
ucagggcacugcaggaaac

SEQ ID NO: 1414153 - RNA, 19 nt, Homo sapiens
agauaugguugaagagucu

SEQ ID NO: 1414154 - RNA, 19 nt, Homo sapiens
gaaagauaugguugaagag

SEQ ID NO: 1414155 - RNA, 19 nt, Homo sapiens
cgagcuugcugcauuccau

SEQ ID NO: 1414156 - RNA, 19 nt, Homo sapiens
agauggagaagcagugaaa

SEQ ID NO: 1414157 - RNA, 19 nt, Homo sapiens
gcuguguaaagaagucuaa

SEQ ID NO: 1414158 - RNA, 19 nt, Homo sapiens
uaagguucacgacagacua

SEQ ID NO: 1414159 - RNA, 19 nt, Homo sapiens
gggcacugcaggaaacaau

SEQ ID NO: 1414160 - RNA, 19 nt, Homo sapiens
gcagugaaagauacaugca

SEQ ID NO: 1414161 - RNA, 19 nt, Homo sapiens
uaagcagcaagaaagauau

SEQ ID NO: 1414162 - RNA, 19 nt, Homo sapiens
gacuuccucucggcuauca

SEQ ID NO: 1414163 - RNA, 19 nt, Homo sapiens
gaccucucuuccaaauguu

SEQ ID NO: 1414164 - RNA, 19 nt, Homo sapiens
ccaagugaucccagccuau

SEQ ID NO: 1414165 - RNA, 19 nt, Homo sapiens
acaaugcaaagauggagaa

SEQ ID NO: 1414166 - RNA, 19 nt, Homo sapiens
gcacugcaggaaacaaugc

SEQ ID NO: 1414167 - RNA, 19 nt, Homo sapiens
acucuucagugcucuucuu

SEQ ID NO: 1414168 - RNA, 19 nt, Homo sapiens
gcagcaagaaagauauggu

SEQ ID NO: 1414169 - RNA, 19 nt, Homo sapiens
acaccaggaauuauugaug

SEQ ID NO: 1414170 - RNA, 19 nt, Homo sapiens
gcgaguuccugcgacaucu

SEQ ID NO: 1414171 - RNA, 19 nt, Homo sapiens
aaagauggagaagcaguga

SEQ ID NO: 1414172 - RNA, 19 nt, Homo sapiens
uaacaacgacgacuacauu

SEQ ID NO: 1414173 - RNA, 19 nt, Homo sapiens
gugagaaggugcuggauga

SEQ ID NO: 1414174 - RNA, 19 nt, Homo sapiens
gaagauuuccagaacauga

SEQ ID NO: 1414175 - RNA, 19 nt, Homo sapiens
caacgacgacuacauuugu

SEQ ID NO: 1414176 - RNA, 19 nt, Homo sapiens
ccagaggauugcccaggua

SEQ ID NO: 1414177 - RNA, 19 nt, Homo sapiens
ccacagaggagccgagcua

SEQ ID NO: 1414178 - RNA, 19 nt, Homo sapiens
gaucaugaggcucuucuau

SEQ ID NO: 1414179 - RNA, 19 nt, Homo sapiens
ggcugucccuggaagauuu

SEQ ID NO: 1414180 - RNA, 19 nt, Homo sapiens
uaucaggacugcacauuuu

SEQ ID NO: 1414181 - RNA, 19 nt, Homo sapiens
uguggacucugguuucuga

SEQ ID NO: 1414182 - RNA, 19 nt, Homo sapiens
cagaggagccgagcuauag

SEQ ID NO: 1414183 - RNA, 19 nt, Homo sapiens
ccucaaggcuuacuaugcu

SEQ ID NO: 1414184 - RNA, 19 nt, Homo sapiens
cccgcgaccucaaggcuua

SEQ ID NO: 1414185 - RNA, 19 nt, Homo sapiens
ggacauguuuuccgugaug

SEQ ID NO: 1414186 - RNA, 19 nt, Homo sapiens
gaggauugcccagguauuc

SEQ ID NO: 1414187 - RNA, 19 nt, Homo sapiens
ucaugaggcucuucuaucg

SEQ ID NO: 1414188 - RNA, 19 nt, Homo sapiens
guaucaggacugcacauuu

SEQ ID NO: 1414189 - RNA, 19 nt, Homo sapiens
gaggugagccugguaugug

SEQ ID NO: 1414190 - RNA, 19 nt, Homo sapiens
acaugacccuggacaacuu

SEQ ID NO: 1414191 - RNA, 19 nt, Homo sapiens
acagaggagccgagcuaua

SEQ ID NO: 1414192 - RNA, 19 nt, Homo sapiens
caaggaaggagaucaugag

SEQ ID NO: 1414193 - RNA, 19 nt, Homo sapiens
gagcagacggugaccaaac

SEQ ID NO: 1414194 - RNA, 19 nt, Homo sapiens
ugcccgagcugaaggacaa

SEQ ID NO: 1414195 - RNA, 19 nt, Homo sapiens
gaggagccgagcuauagga

SEQ ID NO: 1414196 - RNA, 19 nt, Homo sapiens
ggaggugagccugguaugu

SEQ ID NO: 1414197 - RNA, 19 nt, Homo sapiens
acaaggaaggagaucauga

SEQ ID NO: 1414198 - RNA, 19 nt, Homo sapiens
gcuguggacucugguuucu

SEQ ID NO: 1414199 - RNA, 19 nt, Homo sapiens
ccucagcaccuuccacauc

SEQ ID NO: 1414200 - RNA, 19 nt, Homo sapiens
ucaaggcuuacuaugcuuu

SEQ ID NO: 1414201 - RNA, 19 nt, Homo sapiens
gaggaggugagccugguau

SEQ ID NO: 1414202 - RNA, 19 nt, Homo sapiens
acaacgacgacuacauuug

SEQ ID NO: 1414203 - RNA, 19 nt, Homo sapiens
aggugagccugguauguga

SEQ ID NO: 1414204 - RNA, 19 nt, Homo sapiens
ucacaaggaaggagaucau

SEQ ID NO: 1414205 - RNA, 19 nt, Homo sapiens
ggauggggauggccacaug

SEQ ID NO: 1414206 - RNA, 19 nt, Homo sapiens
cgaccucaaggcuuacuau

SEQ ID NO: 1414207 - RNA, 19 nt, Homo sapiens
ccagguauucucugaggau

SEQ ID NO: 1414208 - RNA, 19 nt, Homo sapiens
gaucagcccuugucaauua

SEQ ID NO: 1414209 - RNA, 19 nt, Homo sapiens
ggaaagcccuccucaguga

SEQ ID NO: 1414210 - RNA, 19 nt, Homo sapiens
ugaauaagcuccuugagaa

SEQ ID NO: 1414211 - RNA, 19 nt, Homo sapiens
guaaagaacugccuguaga

SEQ ID NO: 1414212 - RNA, 19 nt, Homo sapiens
ugaaacagguugcagauaa

SEQ ID NO: 1414213 - RNA, 19 nt, Homo sapiens
gguauaaguuuacuccaua

SEQ ID NO: 1414214 - RNA, 19 nt, Homo sapiens
caaaggaugucuaauaauc

SEQ ID NO: 1414215 - RNA, 19 nt, Homo sapiens
gccaaagaaucguauauuu

SEQ ID NO: 1414216 - RNA, 19 nt, Homo sapiens
uauaagcagucuugcaaua

SEQ ID NO: 1414217 - RNA, 19 nt, Homo sapiens
caacgacccugauguggaa

SEQ ID NO: 1414218 - RNA, 19 nt, Homo sapiens
gaccagagccugucauuug

SEQ ID NO: 1414219 - RNA, 19 nt, Homo sapiens
gcagagaguuaugcuguuu

SEQ ID NO: 1414220 - RNA, 19 nt, Homo sapiens
gugcaaaggaugucuaaua

SEQ ID NO: 1414221 - RNA, 19 nt, Homo sapiens
ugaagacacugguggaauu

SEQ ID NO: 1414222 - RNA, 19 nt, Homo sapiens
acacuaaacgccaauaaua

SEQ ID NO: 1414223 - RNA, 19 nt, Homo sapiens
ugcaaaggaugucuaauaa

SEQ ID NO: 1414224 - RNA, 19 nt, Homo sapiens
agaaggaccugaacaacaa

SEQ ID NO: 1414225 - RNA, 19 nt, Homo sapiens
caacguguccuuucaauca

SEQ ID NO: 1414226 - RNA, 19 nt, Homo sapiens
guagaggacucaagacaca

SEQ ID NO: 1414227 - RNA, 19 nt, Homo sapiens
gguaggcucucguuuggaa

SEQ ID NO: 1414228 - RNA, 19 nt, Homo sapiens
uggaauuccucauugauaa

SEQ ID NO: 1414229 - RNA, 19 nt, Homo sapiens
gaaacagguugcagauaag

SEQ ID NO: 1414230 - RNA, 19 nt, Homo sapiens
uaacucaucuauagcacuu

SEQ ID NO: 1414231 - RNA, 19 nt, Homo sapiens
ggaauaagcgggacugucu

SEQ ID NO: 1414232 - RNA, 19 nt, Homo sapiens
gaaguuaagaagagaaaga

SEQ ID NO: 1414233 - RNA, 19 nt, Homo sapiens
gaaagcaucgcuauuugau

SEQ ID NO: 1414234 - RNA, 19 nt, Homo sapiens
gagagcagccaacgagaaa

SEQ ID NO: 1414235 - RNA, 19 nt, Homo sapiens
aagcaucgcuauuugauca

SEQ ID NO: 1414236 - RNA, 19 nt, Homo sapiens
aauaaucccugcacacguu

SEQ ID NO: 1414237 - RNA, 19 nt, Homo sapiens
ggccauggcgcaucagaua

SEQ ID NO: 1414238 - RNA, 19 nt, Homo sapiens
ccuauaauguggagguaaa

SEQ ID NO: 1414239 - RNA, 19 nt, Homo sapiens
gguguuaggugcaaaggau

SEQ ID NO: 1414240 - RNA, 19 nt, Homo sapiens
gaauaagcuccuugagaaa

SEQ ID NO: 1414241 - RNA, 19 nt, Homo sapiens
gaagcccacccucuuauga

SEQ ID NO: 1414242 - RNA, 19 nt, Homo sapiens
uaacuaaucaccaccauag

SEQ ID NO: 1414243 - RNA, 19 nt, Homo sapiens
ggaaaucgcaagacuuuac

SEQ ID NO: 1414244 - RNA, 19 nt, Homo sapiens
ugucgacccugcagaauga

SEQ ID NO: 1414245 - RNA, 19 nt, Homo sapiens
ccaauaauauggagacacu

SEQ ID NO: 1414246 - RNA, 19 nt, Homo sapiens
ccaauuaaauguggguaga

SEQ ID NO: 1414247 - RNA, 19 nt, Homo sapiens
gauaagguguuaggugcaa

SEQ ID NO: 1414248 - RNA, 19 nt, Homo sapiens
ucaauuaucugcggugaca

SEQ ID NO: 1414249 - RNA, 19 nt, Homo sapiens
ggagucaucaaaggcauua

SEQ ID NO: 1414250 - RNA, 19 nt, Homo sapiens
ggaacagaguugagugucu

SEQ ID NO: 1414251 - RNA, 19 nt, Homo sapiens
ccucaaaugucaugccaau

SEQ ID NO: 1414252 - RNA, 19 nt, Homo sapiens
gaaguacacugcuguuccu

SEQ ID NO: 1414253 - RNA, 19 nt, Homo sapiens
gagagugaagacaguauuu

SEQ ID NO: 1414254 - RNA, 19 nt, Homo sapiens
gagacagacuugaaagcau

SEQ ID NO: 1414255 - RNA, 19 nt, Homo sapiens
aaauguggguagauuaaug

SEQ ID NO: 1414256 - RNA, 19 nt, Homo sapiens
gcaaaggaugucuaauaau

SEQ ID NO: 1414257 - RNA, 19 nt, Homo sapiens
ggauuugugcaauauguaa

SEQ ID NO: 1414258 - RNA, 19 nt, Homo sapiens
gcaagaacucugaggugaa

SEQ ID NO: 1414259 - RNA, 19 nt, Homo sapiens
ggagagcagccaacgagaa

SEQ ID NO: 1414260 - RNA, 19 nt, Homo sapiens
ccacguagaggacucaaga

SEQ ID NO: 1414261 - RNA, 19 nt, Homo sapiens
cuccaugucuuucaccuuu

SEQ ID NO: 1414262 - RNA, 19 nt, Homo sapiens
ccucauugauaacugcuuu

SEQ ID NO: 1414263 - RNA, 19 nt, Homo sapiens
gaaucgaggcccugaaaca

SEQ ID NO: 1414264 - RNA, 19 nt, Homo sapiens
gacauucucacuauucuau

SEQ ID NO: 1414265 - RNA, 19 nt, Homo sapiens
agaaacagacugcaaggaa

SEQ ID NO: 1414266 - RNA, 19 nt, Homo sapiens
gcugaccaauuccaauaug

SEQ ID NO: 1414267 - RNA, 19 nt, Homo sapiens
ccugagcgauggaaacaga

SEQ ID NO: 1414268 - RNA, 19 nt, Homo sapiens
ggagaacauuccagugcau

SEQ ID NO: 1414269 - RNA, 19 nt, Homo sapiens
guggaauuccucauugaua

SEQ ID NO: 1414270 - RNA, 19 nt, Homo sapiens
uagaaggagcagagaguua

SEQ ID NO: 1414271 - RNA, 19 nt, Homo sapiens
uauauaagcagucuugcaa

SEQ ID NO: 1414272 - RNA, 19 nt, Homo sapiens
guagccagccggucuuuga

SEQ ID NO: 1414273 - RNA, 19 nt, Homo sapiens
ccacaaagacagagaaagg

SEQ ID NO: 1414274 - RNA, 19 nt, Homo sapiens
gugacaaaccaaacacuaa

SEQ ID NO: 1414275 - RNA, 19 nt, Homo sapiens
ccagugcauuccaguauca

SEQ ID NO: 1414276 - RNA, 19 nt, Homo sapiens
caagaacucugaggugaac

SEQ ID NO: 1414277 - RNA, 19 nt, Homo sapiens
gcacuuugaguaucuuugu

SEQ ID NO: 1414278 - RNA, 19 nt, Homo sapiens
agggagaaauguuuaaauc

SEQ ID NO: 1414279 - RNA, 19 nt, Homo sapiens
ucucuugguuaguguuuaa

SEQ ID NO: 1414280 - RNA, 19 nt, Homo sapiens
uaccuggauuugugcaaua

SEQ ID NO: 1414281 - RNA, 19 nt, Homo sapiens
agaacugccuguagauugu

SEQ ID NO: 1414282 - RNA, 19 nt, Homo sapiens
uaaaagaacucuggcuaga

SEQ ID NO: 1414283 - RNA, 19 nt, Homo sapiens
ugugcuaucuguaaauaug

SEQ ID NO: 1414284 - RNA, 19 nt, Homo sapiens
gaaauuucuucagcagaca

SEQ ID NO: 1414285 - RNA, 19 nt, Homo sapiens
gcucucguuuggaaaguga

SEQ ID NO: 1414286 - RNA, 19 nt, Homo sapiens
ugaaagcaucgcuauuuga

SEQ ID NO: 1414287 - RNA, 19 nt, Homo sapiens
ugggaaaucgcaagacuuu

SEQ ID NO: 1414288 - RNA, 19 nt, Homo sapiens
caaaccaaacacuaacaaa

SEQ ID NO: 1414289 - RNA, 19 nt, Homo sapiens
ggugacaaaccaaacacua

SEQ ID NO: 1414290 - RNA, 19 nt, Homo sapiens
gaacaacaaggugaagaca

SEQ ID NO: 1414291 - RNA, 19 nt, Homo sapiens
gaugggugcucuggagaug

SEQ ID NO: 1414292 - RNA, 19 nt, Homo sapiens
ccuccucgcuguggucuuu

SEQ ID NO: 1414293 - RNA, 19 nt, Homo sapiens
ccaggacauucucacuauu

SEQ ID NO: 1414294 - RNA, 19 nt, Homo sapiens
gcaaggaacagaguugagu

SEQ ID NO: 1414295 - RNA, 19 nt, Homo sapiens
gcuagagacccuccaagga

SEQ ID NO: 1414296 - RNA, 19 nt, Homo sapiens
aagcccagccgagaaauua

SEQ ID NO: 1414297 - RNA, 19 nt, Homo sapiens
cagaaucgaggcccugaaa

SEQ ID NO: 1414298 - RNA, 19 nt, Homo sapiens
ggacgaggaggacagaauc

SEQ ID NO: 1414299 - RNA, 19 nt, Homo sapiens
ucacuauucuaugccuuaa

SEQ ID NO: 1414300 - RNA, 19 nt, Homo sapiens
uugaaagcaucgcuauuug

SEQ ID NO: 1414301 - RNA, 19 nt, Homo sapiens
cuugaaagcaucgcuauuu

SEQ ID NO: 1414302 - RNA, 19 nt, Homo sapiens
ucauugaaguuaagaagag

SEQ ID NO: 1414303 - RNA, 19 nt, Homo sapiens
guggguagauuaaugaaaa

SEQ ID NO: 1414304 - RNA, 19 nt, Homo sapiens
ggagacagacuugaaagca

SEQ ID NO: 1414305 - RNA, 19 nt, Homo sapiens
uaagcagucuugcaauaac

SEQ ID NO: 1414306 - RNA, 19 nt, Homo sapiens
aauguggccucaaauguca

SEQ ID NO: 1414307 - RNA, 19 nt, Homo sapiens
aaacacuaaacgccaauaa

SEQ ID NO: 1414308 - RNA, 19 nt, Homo sapiens
gaucagcccuugucaauua

SEQ ID NO: 1414309 - RNA, 19 nt, Homo sapiens
ugaaacagguugcagauaa

SEQ ID NO: 1414310 - RNA, 19 nt, Homo sapiens
gaccagagccugucauuug

SEQ ID NO: 1414311 - RNA, 19 nt, Homo sapiens
gcagagaguuaugcuguuu

SEQ ID NO: 1414312 - RNA, 19 nt, Homo sapiens
acacuaaacgccaauaaua

SEQ ID NO: 1414313 - RNA, 19 nt, Homo sapiens
agaaggaccugaacaacaa

SEQ ID NO: 1414314 - RNA, 19 nt, Homo sapiens
gcaauaaaaugcuucagaa

SEQ ID NO: 1414315 - RNA, 19 nt, Homo sapiens
gaaacagguugcagauaag

SEQ ID NO: 1414316 - RNA, 19 nt, Homo sapiens
gaaguuaagaagagaaaga

SEQ ID NO: 1414317 - RNA, 19 nt, Homo sapiens
gaaagcaucgcuauuugau

SEQ ID NO: 1414318 - RNA, 19 nt, Homo sapiens
gagagcagccaacgagaaa

SEQ ID NO: 1414319 - RNA, 19 nt, Homo sapiens
aagcaucgcuauuugauca

SEQ ID NO: 1414320 - RNA, 19 nt, Homo sapiens
ccaauaauauggagacacu

SEQ ID NO: 1414321 - RNA, 19 nt, Homo sapiens
ucaauuaucugcggugaca

SEQ ID NO: 1414322 - RNA, 19 nt, Homo sapiens
gagagugaagacaguauuu

SEQ ID NO: 1414323 - RNA, 19 nt, Homo sapiens
gagacagacuugaaagcau

SEQ ID NO: 1414324 - RNA, 19 nt, Homo sapiens
gcaagaacucugaggugaa

SEQ ID NO: 1414325 - RNA, 19 nt, Homo sapiens
ggagagcagccaacgagaa

SEQ ID NO: 1414326 - RNA, 19 nt, Homo sapiens
gaaucgaggcccugaaaca

SEQ ID NO: 1414327 - RNA, 19 nt, Homo sapiens
gacauucucacuauucuau

SEQ ID NO: 1414328 - RNA, 19 nt, Homo sapiens
gguuuguucugcuuacuga

SEQ ID NO: 1414329 - RNA, 19 nt, Homo sapiens
uagaaggagcagagaguua

SEQ ID NO: 1414330 - RNA, 19 nt, Homo sapiens
gaauaaauccgugucuucu

SEQ ID NO: 1414331 - RNA, 19 nt, Homo sapiens
caagaacucugaggugaac

SEQ ID NO: 1414332 - RNA, 19 nt, Homo sapiens
auaaauccgugucuucugu

SEQ ID NO: 1414333 - RNA, 19 nt, Homo sapiens
gaugagaaauccccaacuu

SEQ ID NO: 1414334 - RNA, 19 nt, Homo sapiens
ugaaagcaucgcuauuuga

SEQ ID NO: 1414335 - RNA, 19 nt, Homo sapiens
uaaaagaacucuggcuaga

SEQ ID NO: 1414336 - RNA, 19 nt, Homo sapiens
gaugggugcucuggagaug

SEQ ID NO: 1414337 - RNA, 19 nt, Homo sapiens
ccuccucgcuguggucuuu

SEQ ID NO: 1414338 - RNA, 19 nt, Homo sapiens
ccaggacauucucacuauu

SEQ ID NO: 1414339 - RNA, 19 nt, Homo sapiens
ugucauaguuccacucucu

SEQ ID NO: 1414340 - RNA, 19 nt, Homo sapiens
cagaaucgaggcccugaaa

SEQ ID NO: 1414341 - RNA, 19 nt, Homo sapiens
ggacgaggaggacagaauc

SEQ ID NO: 1414342 - RNA, 19 nt, Homo sapiens
ucacuauucuaugccuuaa

SEQ ID NO: 1414343 - RNA, 19 nt, Homo sapiens
uugaaagcaucgcuauuug

SEQ ID NO: 1414344 - RNA, 19 nt, Homo sapiens
cuugaaagcaucgcuauuu

SEQ ID NO: 1414345 - RNA, 19 nt, Homo sapiens
ucauugaaguuaagaagag

SEQ ID NO: 1414346 - RNA, 19 nt, Homo sapiens
gcuagagacccuccaagga

SEQ ID NO: 1414347 - RNA, 19 nt, Homo sapiens
ggagacagacuugaaagca

SEQ ID NO: 1414348 - RNA, 19 nt, Homo sapiens
cagaaggaccugaacaaca

SEQ ID NO: 1414349 - RNA, 19 nt, Homo sapiens
gaaggaggagcucaacucu

SEQ ID NO: 1414350 - RNA, 19 nt, Homo sapiens
ggacauucucacuauucua

SEQ ID NO: 1414351 - RNA, 19 nt, Homo sapiens
aaacacuaaacgccaauaa

SEQ ID NO: 1414352 - RNA, 19 nt, Homo sapiens
ugaauaaauccgugucuuc

SEQ ID NO: 1414353 - RNA, 19 nt, Homo sapiens
cuuaugaucucaccaucug

SEQ ID NO: 1414354 - RNA, 19 nt, Homo sapiens
uccaggacauucucacuau

SEQ ID NO: 1414355 - RNA, 19 nt, Homo sapiens
caacuuaugaucucaccau

SEQ ID NO: 1414356 - RNA, 19 nt, Homo sapiens
guauuugccagcucauuga

SEQ ID NO: 1414357 - RNA, 19 nt, Homo sapiens
uggagacacuaaucgaaug

SEQ ID NO: 1414358 - RNA, 19 nt, Homo sapiens
cacuaaacgccaauaauau

SEQ ID NO: 1414359 - RNA, 19 nt, Homo sapiens
acucugaggugaacaggau

SEQ ID NO: 1414360 - RNA, 19 nt, Homo sapiens
guuccacucucucagauac

SEQ ID NO: 1414361 - RNA, 19 nt, Homo sapiens
gaaggagcagagaguuaug

SEQ ID NO: 1414362 - RNA, 19 nt, Homo sapiens
accagagccugucauuuga

SEQ ID NO: 1414363 - RNA, 19 nt, Homo sapiens
gacagcccaugauguucuu

SEQ ID NO: 1414364 - RNA, 19 nt, Homo sapiens
uccggucucuguaauauuc

SEQ ID NO: 1414365 - RNA, 19 nt, Homo sapiens
ccaacgagaaagcccguaa

SEQ ID NO: 1414366 - RNA, 19 nt, Homo sapiens
acacuaaucgaaugucaau

SEQ ID NO: 1414367 - RNA, 19 nt, Homo sapiens
acuaaacgccaauaauaug

SEQ ID NO: 1414368 - RNA, 19 nt, Homo sapiens
gcagccacaaugcuucaaa

SEQ ID NO: 1414369 - RNA, 19 nt, Homo sapiens
gccagcucauugaaguuaa

SEQ ID NO: 1414370 - RNA, 19 nt, Homo sapiens
ugugacagcccaugauguu

SEQ ID NO: 1414371 - RNA, 19 nt, Homo sapiens
caagguuuguucugcuuac

SEQ ID NO: 1414372 - RNA, 19 nt, Homo sapiens
acuauucuaugccuuaaag

SEQ ID NO: 1414373 - RNA, 19 nt, Homo sapiens
agaaggagcagagaguuau

SEQ ID NO: 1414374 - RNA, 19 nt, Homo sapiens
ggagacacuaaucgaaugu

SEQ ID NO: 1414375 - RNA, 19 nt, Homo sapiens
ucgcuguggucuuuaagga

SEQ ID NO: 1414376 - RNA, 19 nt, Homo sapiens
gccaaguccaggcaauaaa

SEQ ID NO: 1414377 - RNA, 19 nt, Homo sapiens
ggacuagaaggagcagaga

SEQ ID NO: 1414378 - RNA, 19 nt, Homo sapiens
acuaaucgaaugucaauca

SEQ ID NO: 1414379 - RNA, 19 nt, Homo sapiens
gaucucaccaucuguuugc

SEQ ID NO: 1414380 - RNA, 19 nt, Homo sapiens
caaucuggccaucugcauu

SEQ ID NO: 1414381 - RNA, 19 nt, Homo sapiens
cccggaagcuacuuucaag

SEQ ID NO: 1414382 - RNA, 19 nt, Homo sapiens
caggacauucucacuauuc

SEQ ID NO: 1414383 - RNA, 19 nt, Homo sapiens
uaauauggagacacuaauc

SEQ ID NO: 1414384 - RNA, 19 nt, Homo sapiens
cagagccugucauuugaag

SEQ ID NO: 1414385 - RNA, 19 nt, Homo sapiens
gcucauugaaguuaagaag

SEQ ID NO: 1414386 - RNA, 19 nt, Homo sapiens
agagggugauaucaaggaa

SEQ ID NO: 1414387 - RNA, 19 nt, Homo sapiens
cugagaagcagccacaaug

SEQ ID NO: 1414388 - RNA, 19 nt, Homo sapiens
ccgcaauacugaugaagcu

SEQ ID NO: 1414389 - RNA, 19 nt, Homo sapiens
cagccgcaauacugaugaa

SEQ ID NO: 1414390 - RNA, 19 nt, Homo sapiens
auccgugucuucugucaaa

SEQ ID NO: 1414391 - RNA, 19 nt, Homo sapiens
ucugcuuacugaugagaaa

SEQ ID NO: 1414392 - RNA, 19 nt, Homo sapiens
gugcuguccuggcccuuuc

SEQ ID NO: 1414393 - RNA, 19 nt, Homo sapiens
ugccagcucauugaaguua

SEQ ID NO: 1414394 - RNA, 19 nt, Homo sapiens
agagaguuaugcuguuucu

SEQ ID NO: 1414395 - RNA, 19 nt, Homo sapiens
cuguuucucccauucuuua

SEQ ID NO: 1414396 - RNA, 19 nt, Homo sapiens
cauugaaguuaagaagaga

SEQ ID NO: 1414397 - RNA, 19 nt, Homo sapiens
cugaauaaauccgugucuu

SEQ ID NO: 1414398 - RNA, 19 nt, Homo sapiens
agaaauccccaacuuauga

SEQ ID NO: 1414399 - RNA, 19 nt, Homo sapiens
ugagaaauccccaacuuau

SEQ ID NO: 1414400 - RNA, 19 nt, Homo sapiens
aaucuggccaucugcauug

SEQ ID NO: 1414401 - RNA, 19 nt, Homo sapiens
gcaggacgaggaggacaga

SEQ ID NO: 1414402 - RNA, 19 nt, Homo sapiens
ugaaggaggagcucaacuc

SEQ ID NO: 1414403 - RNA, 19 nt, Homo sapiens
caacggaagggauauucag

SEQ ID NO: 1414404 - RNA, 19 nt, Homo sapiens
ccagacccauccaggacau

SEQ ID NO: 1414405 - RNA, 19 nt, Homo sapiens
ugagagugaagacaguauu

SEQ ID NO: 1414406 - RNA, 19 nt, Homo sapiens
ggcaucaugugagagugaa

SEQ ID NO: 1414407 - RNA, 19 nt, Homo sapiens
uuuccggucucuguaauau

SEQ ID NO: 1414408 - RNA, 19 nt, Homo sapiens
ggaaagcccuccucaguga

SEQ ID NO: 1414409 - RNA, 19 nt, Homo sapiens
ugaauaagcuccuugagaa

SEQ ID NO: 1414410 - RNA, 19 nt, Homo sapiens
guaaagaacugccuguaga

SEQ ID NO: 1414411 - RNA, 19 nt, Homo sapiens
ugaaacagguugcagauaa

SEQ ID NO: 1414412 - RNA, 19 nt, Homo sapiens
gguauaaguuuacuccaua

SEQ ID NO: 1414413 - RNA, 19 nt, Homo sapiens
caaaggaugucuaauaauc

SEQ ID NO: 1414414 - RNA, 19 nt, Homo sapiens
gccaaagaaucguauauuu

SEQ ID NO: 1414415 - RNA, 19 nt, Homo sapiens
uauaagcagucuugcaaua

SEQ ID NO: 1414416 - RNA, 19 nt, Homo sapiens
caacgacccugauguggaa

SEQ ID NO: 1414417 - RNA, 19 nt, Homo sapiens
gaccagagccugucauuug

SEQ ID NO: 1414418 - RNA, 19 nt, Homo sapiens
gcagagaguuaugcuguuu

SEQ ID NO: 1414419 - RNA, 19 nt, Homo sapiens
gugcaaaggaugucuaaua

SEQ ID NO: 1414420 - RNA, 19 nt, Homo sapiens
ugaagacacugguggaauu

SEQ ID NO: 1414421 - RNA, 19 nt, Homo sapiens
acacuaaacgccaauaaua

SEQ ID NO: 1414422 - RNA, 19 nt, Homo sapiens
ugcaaaggaugucuaauaa

SEQ ID NO: 1414423 - RNA, 19 nt, Homo sapiens
agaaggaccugaacaacaa

SEQ ID NO: 1414424 - RNA, 19 nt, Homo sapiens
caacguguccuuucaauca

SEQ ID NO: 1414425 - RNA, 19 nt, Homo sapiens
guagaggacucaagacaca

SEQ ID NO: 1414426 - RNA, 19 nt, Homo sapiens
gguaggcucucguuuggaa

SEQ ID NO: 1414427 - RNA, 19 nt, Homo sapiens
uggaauuccucauugauaa

SEQ ID NO: 1414428 - RNA, 19 nt, Homo sapiens
gaaacagguugcagauaag

SEQ ID NO: 1414429 - RNA, 19 nt, Homo sapiens
uaacucaucuauagcacuu

SEQ ID NO: 1414430 - RNA, 19 nt, Homo sapiens
ggaauaagcgggacugucu

SEQ ID NO: 1414431 - RNA, 19 nt, Homo sapiens
gagagcagccaacgagaaa

SEQ ID NO: 1414432 - RNA, 19 nt, Homo sapiens
aauaaucccugcacacguu

SEQ ID NO: 1414433 - RNA, 19 nt, Homo sapiens
ggccauggcgcaucagaua

SEQ ID NO: 1414434 - RNA, 19 nt, Homo sapiens
ccuauaauguggagguaaa

SEQ ID NO: 1414435 - RNA, 19 nt, Homo sapiens
gguguuaggugcaaaggau

SEQ ID NO: 1414436 - RNA, 19 nt, Homo sapiens
gaauaagcuccuugagaaa

SEQ ID NO: 1414437 - RNA, 19 nt, Homo sapiens
gaagcccacccucuuauga

SEQ ID NO: 1414438 - RNA, 19 nt, Homo sapiens
uaacuaaucaccaccauag

SEQ ID NO: 1414439 - RNA, 19 nt, Homo sapiens
ggaaaucgcaagacuuuac

SEQ ID NO: 1414440 - RNA, 19 nt, Homo sapiens
ugucgacccugcagaauga

SEQ ID NO: 1414441 - RNA, 19 nt, Homo sapiens
ccaauaauauggagacacu

SEQ ID NO: 1414442 - RNA, 19 nt, Homo sapiens
ccaauuaaauguggguaga

SEQ ID NO: 1414443 - RNA, 19 nt, Homo sapiens
gauaagguguuaggugcaa

SEQ ID NO: 1414444 - RNA, 19 nt, Homo sapiens
ggagucaucaaaggcauua

SEQ ID NO: 1414445 - RNA, 19 nt, Homo sapiens
ggaacagaguugagugucu

SEQ ID NO: 1414446 - RNA, 19 nt, Homo sapiens
ccucaaaugucaugccaau

SEQ ID NO: 1414447 - RNA, 19 nt, Homo sapiens
gaaguacacugcuguuccu

SEQ ID NO: 1414448 - RNA, 19 nt, Homo sapiens
gagagugaagacaguauuu

SEQ ID NO: 1414449 - RNA, 19 nt, Homo sapiens
aaauguggguagauuaaug

SEQ ID NO: 1414450 - RNA, 19 nt, Homo sapiens
gcaaaggaugucuaauaau

SEQ ID NO: 1414451 - RNA, 19 nt, Homo sapiens
ggauuugugcaauauguaa

SEQ ID NO: 1414452 - RNA, 19 nt, Homo sapiens
gcaagaacucugaggugaa

SEQ ID NO: 1414453 - RNA, 19 nt, Homo sapiens
ggagagcagccaacgagaa

SEQ ID NO: 1414454 - RNA, 19 nt, Homo sapiens
cauuggacauucucacuau

SEQ ID NO: 1414455 - RNA, 19 nt, Homo sapiens
ccacguagaggacucaaga

SEQ ID NO: 1414456 - RNA, 19 nt, Homo sapiens
cuccaugucuuucaccuuu

SEQ ID NO: 1414457 - RNA, 19 nt, Homo sapiens
ccucauugauaacugcuuu

SEQ ID NO: 1414458 - RNA, 19 nt, Homo sapiens
gaaucgaggcccugaaaca

SEQ ID NO: 1414459 - RNA, 19 nt, Homo sapiens
gacauucucacuauucuau

SEQ ID NO: 1414460 - RNA, 19 nt, Homo sapiens
agaaacagacugcaaggaa

SEQ ID NO: 1414461 - RNA, 19 nt, Homo sapiens
gcugaccaauuccaauaug

SEQ ID NO: 1414462 - RNA, 19 nt, Homo sapiens
ccugagcgauggaaacaga

SEQ ID NO: 1414463 - RNA, 19 nt, Homo sapiens
ggagaacauuccagugcau

SEQ ID NO: 1414464 - RNA, 19 nt, Homo sapiens
guggaauuccucauugaua

SEQ ID NO: 1414465 - RNA, 19 nt, Homo sapiens
uagaaggagcagagaguua

SEQ ID NO: 1414466 - RNA, 19 nt, Homo sapiens
uauauaagcagucuugcaa

SEQ ID NO: 1414467 - RNA, 19 nt, Homo sapiens
guagccagccggucuuuga

SEQ ID NO: 1414468 - RNA, 19 nt, Homo sapiens
ccacaaagacagagaaagg

SEQ ID NO: 1414469 - RNA, 19 nt, Homo sapiens
gugacaaaccaaacacuaa

SEQ ID NO: 1414470 - RNA, 19 nt, Homo sapiens
ccagugcauuccaguauca

SEQ ID NO: 1414471 - RNA, 19 nt, Homo sapiens
caagaacucugaggugaac

SEQ ID NO: 1414472 - RNA, 19 nt, Homo sapiens
gcacuuugaguaucuuugu

SEQ ID NO: 1414473 - RNA, 19 nt, Homo sapiens
agggagaaauguuuaaauc

SEQ ID NO: 1414474 - RNA, 19 nt, Homo sapiens
ucucuugguuaguguuuaa

SEQ ID NO: 1414475 - RNA, 19 nt, Homo sapiens
uaccuggauuugugcaaua

SEQ ID NO: 1414476 - RNA, 19 nt, Homo sapiens
agaacugccuguagauugu

SEQ ID NO: 1414477 - RNA, 19 nt, Homo sapiens
ugugcuaucuguaaauaug

SEQ ID NO: 1414478 - RNA, 19 nt, Homo sapiens
gaaauuucuucagcagaca

SEQ ID NO: 1414479 - RNA, 19 nt, Homo sapiens
gcucucguuuggaaaguga

SEQ ID NO: 1414480 - RNA, 19 nt, Homo sapiens
uaaaagaacucuggcuaga

SEQ ID NO: 1414481 - RNA, 19 nt, Homo sapiens
ugggaaaucgcaagacuuu

SEQ ID NO: 1414482 - RNA, 19 nt, Homo sapiens
caaaccaaacacuaacaaa

SEQ ID NO: 1414483 - RNA, 19 nt, Homo sapiens
ggugacaaaccaaacacua

SEQ ID NO: 1414484 - RNA, 19 nt, Homo sapiens
gaacaacaaggugaagaca

SEQ ID NO: 1414485 - RNA, 19 nt, Homo sapiens
gaugggugcucuggagaug

SEQ ID NO: 1414486 - RNA, 19 nt, Homo sapiens
ccuccucgcuguggucuuu

SEQ ID NO: 1414487 - RNA, 19 nt, Homo sapiens
gcaaggaacagaguugagu

SEQ ID NO: 1414488 - RNA, 19 nt, Homo sapiens
gcuagagacccuccaagga

SEQ ID NO: 1414489 - RNA, 19 nt, Homo sapiens
aagcccagccgagaaauua

SEQ ID NO: 1414490 - RNA, 19 nt, Homo sapiens
cagaaucgaggcccugaaa

SEQ ID NO: 1414491 - RNA, 19 nt, Homo sapiens
ggacgaggaggacagaauc

SEQ ID NO: 1414492 - RNA, 19 nt, Homo sapiens
ucacuauucuaugccuuaa

SEQ ID NO: 1414493 - RNA, 19 nt, Homo sapiens
guggguagauuaaugaaaa

SEQ ID NO: 1414494 - RNA, 19 nt, Homo sapiens
uaagcagucuugcaauaac

SEQ ID NO: 1414495 - RNA, 19 nt, Homo sapiens
aauguggccucaaauguca

SEQ ID NO: 1414496 - RNA, 19 nt, Homo sapiens
guaccuggauuugugcaau

SEQ ID NO: 1414497 - RNA, 19 nt, Homo sapiens
uaaaaggucuugaauaagc

SEQ ID NO: 1414498 - RNA, 19 nt, Homo sapiens
aaccaaacacuaacaaaga

SEQ ID NO: 1414499 - RNA, 19 nt, Homo sapiens
cagaaggaccugaacaaca

SEQ ID NO: 1414500 - RNA, 19 nt, Homo sapiens
gaaggaggagcucaacucu

SEQ ID NO: 1414501 - RNA, 19 nt, Homo sapiens
ggacauucucacuauucua

SEQ ID NO: 1414502 - RNA, 19 nt, Homo sapiens
aaacacuaaacgccaauaa

SEQ ID NO: 1414503 - RNA, 19 nt, Homo sapiens
cauagaagaaagaaacaga

SEQ ID NO: 1414504 - RNA, 19 nt, Homo sapiens
cauaccagaguaaacuaua

SEQ ID NO: 1414505 - RNA, 19 nt, Homo sapiens
guggaaagcccuccucagu

SEQ ID NO: 1414506 - RNA, 19 nt, Homo sapiens
cuugugcuaucuguaaaua

SEQ ID NO: 1414507 - RNA, 19 nt, Homo sapiens
gcacagcccgauaggagau

SEQ ID NO: 1414508 - RNA, 19 nt, Homo sapiens
ccagagauguuaucaauga

SEQ ID NO: 1414509 - RNA, 19 nt, Homo sapiens
gaggaaagcucaagugaag

SEQ ID NO: 1414510 - RNA, 19 nt, Homo sapiens
gaccagagauguuaucaau

SEQ ID NO: 1414511 - RNA, 19 nt, Homo sapiens
uaaggaagcuaucacagaa

SEQ ID NO: 1414512 - RNA, 19 nt, Homo sapiens
ugacaacacuuucaauuuc

SEQ ID NO: 1414513 - RNA, 19 nt, Homo sapiens
gaagauaagcuaccucgaa

SEQ ID NO: 1414514 - RNA, 19 nt, Homo sapiens
caaauugaguuuagaagug

SEQ ID NO: 1414515 - RNA, 19 nt, Homo sapiens
aaucucagcucuacuguuu

SEQ ID NO: 1414516 - RNA, 19 nt, Homo sapiens
gagaggagcagaagaagaa

SEQ ID NO: 1414517 - RNA, 19 nt, Homo sapiens
gaugggaucuuacucuguu

SEQ ID NO: 1414518 - RNA, 19 nt, Homo sapiens
aagaggagguggaagauaa

SEQ ID NO: 1414519 - RNA, 19 nt, Homo sapiens
gaagcgaucccaggaauuu

SEQ ID NO: 1414520 - RNA, 19 nt, Homo sapiens
cuucaaagcuuccagauca

SEQ ID NO: 1414521 - RNA, 19 nt, Homo sapiens
cauggaagauggagaagaa

SEQ ID NO: 1414522 - RNA, 19 nt, Homo sapiens
gaagaggaauuggaaagau

SEQ ID NO: 1414523 - RNA, 19 nt, Homo sapiens
agagagagcuugagaccaa

SEQ ID NO: 1414524 - RNA, 19 nt, Homo sapiens
ggaagucccucuccaaacu

SEQ ID NO: 1414525 - RNA, 19 nt, Homo sapiens
ucaaugguuuggcacaaua

SEQ ID NO: 1414526 - RNA, 19 nt, Homo sapiens
ugaaacagcagacaacaaa

SEQ ID NO: 1414527 - RNA, 19 nt, Homo sapiens
gguugccgcucuccuauuu

SEQ ID NO: 1414528 - RNA, 19 nt, Homo sapiens
gcaacaagaaucuaaacuu

SEQ ID NO: 1414529 - RNA, 19 nt, Homo sapiens
gagauuaacaacaagauug

SEQ ID NO: 1414530 - RNA, 19 nt, Homo sapiens
caaacuagccagccacuga

SEQ ID NO: 1414531 - RNA, 19 nt, Homo sapiens
ggacuuggaguauggauau

SEQ ID NO: 1414532 - RNA, 19 nt, Homo sapiens
cuaguaaaggccaauauua

SEQ ID NO: 1414533 - RNA, 19 nt, Homo sapiens
uggaugagauuaacaacaa

SEQ ID NO: 1414534 - RNA, 19 nt, Homo sapiens
gaucggcaauccugaaaca

SEQ ID NO: 1414535 - RNA, 19 nt, Homo sapiens
gaugacaacacuuucaauu

SEQ ID NO: 1414536 - RNA, 19 nt, Homo sapiens
gaagaggagaagcuaguaa

SEQ ID NO: 1414537 - RNA, 19 nt, Homo sapiens
cagcagacaacaaauuuaa

SEQ ID NO: 1414538 - RNA, 19 nt, Homo sapiens
agaaauugaugaagaggaa

SEQ ID NO: 1414539 - RNA, 19 nt, Homo sapiens
ggaguggucuggugaaugc

SEQ ID NO: 1414540 - RNA, 19 nt, Homo sapiens
gacaacacuuucaauuuca

SEQ ID NO: 1414541 - RNA, 19 nt, Homo sapiens
aaacggaccagagauguua

SEQ ID NO: 1414542 - RNA, 19 nt, Homo sapiens
guucuacccuugauggauu

SEQ ID NO: 1414543 - RNA, 19 nt, Homo sapiens
aaacauuggugaugaugga

SEQ ID NO: 1414544 - RNA, 19 nt, Homo sapiens
gggauuaugugcauuggau

SEQ ID NO: 1414545 - RNA, 19 nt, Homo sapiens
caaugaggaugacccagaa

SEQ ID NO: 1414546 - RNA, 19 nt, Homo sapiens
gaucaaggccuacaaugca

SEQ ID NO: 1414547 - RNA, 19 nt, Homo sapiens
caauaugguucucuuuauc

SEQ ID NO: 1414548 - RNA, 19 nt, Homo sapiens
gaagaggagguggaagaua

SEQ ID NO: 1414549 - RNA, 19 nt, Homo sapiens
cagcgaaucuggaucucaa

SEQ ID NO: 1414550 - RNA, 19 nt, Homo sapiens
gcuccucaguggccucaua

SEQ ID NO: 1414551 - RNA, 19 nt, Homo sapiens
gagaggaggaggaggcuaa

SEQ ID NO: 1414552 - RNA, 19 nt, Homo sapiens
ggccaucuauuaucucaau

SEQ ID NO: 1414553 - RNA, 19 nt, Homo sapiens
guuaugugcugcaauguuc

SEQ ID NO: 1414554 - RNA, 19 nt, Homo sapiens
gaagcuaucacagaagaaa

SEQ ID NO: 1414555 - RNA, 19 nt, Homo sapiens
gaagaggcaucggcagcaa

SEQ ID NO: 1414556 - RNA, 19 nt, Homo sapiens
gacaaauaauugcuacugu

SEQ ID NO: 1414557 - RNA, 19 nt, Homo sapiens
ugaguguaauccagcaaua

SEQ ID NO: 1414558 - RNA, 19 nt, Homo sapiens
ggaccuugcugggaaacaa

SEQ ID NO: 1414559 - RNA, 19 nt, Homo sapiens
aaacagcagacaacaaauu

SEQ ID NO: 1414560 - RNA, 19 nt, Homo sapiens
aaagagaggagcagaagaa

SEQ ID NO: 1414561 - RNA, 19 nt, Homo sapiens
gaagaagaagaaauugaug

SEQ ID NO: 1414562 - RNA, 19 nt, Homo sapiens
gaguggauaccucaucuuu

SEQ ID NO: 1414563 - RNA, 19 nt, Homo sapiens
caugaaagaucacuguuuu

SEQ ID NO: 1414564 - RNA, 19 nt, Homo sapiens
gaaacggaccagagauguu

SEQ ID NO: 1414565 - RNA, 19 nt, Homo sapiens
gaacaagcacuguggaacu

SEQ ID NO: 1414566 - RNA, 19 nt, Homo sapiens
cacuuugccuugcuguuua

SEQ ID NO: 1414567 - RNA, 19 nt, Homo sapiens
gucaauaugguucucuuua

SEQ ID NO: 1414568 - RNA, 19 nt, Homo sapiens
aagaggaauuggaaagauu

SEQ ID NO: 1414569 - RNA, 19 nt, Homo sapiens
gaacugcuauuuuccuguu

SEQ ID NO: 1414570 - RNA, 19 nt, Homo sapiens
ggucauugcugucauuuug

SEQ ID NO: 1414571 - RNA, 19 nt, Homo sapiens
caagcuggauggcgaagau

SEQ ID NO: 1414572 - RNA, 19 nt, Homo sapiens
uggaugggcuccuucuuug

SEQ ID NO: 1414573 - RNA, 19 nt, Homo sapiens
gacagucucugauguucug

SEQ ID NO: 1414574 - RNA, 19 nt, Homo sapiens
ggagguggaagauaagcua

SEQ ID NO: 1414575 - RNA, 19 nt, Homo sapiens
gcuaguaaaggccaauauu

SEQ ID NO: 1414576 - RNA, 19 nt, Homo sapiens
gaagaaaacguccacuuga

SEQ ID NO: 1414577 - RNA, 19 nt, Homo sapiens
gugaagcgaucccaggaau

SEQ ID NO: 1414578 - RNA, 19 nt, Homo sapiens
caaauaauugcuacuguca

SEQ ID NO: 1414579 - RNA, 19 nt, Homo sapiens
uccaggaguugcugaaauu

SEQ ID NO: 1414580 - RNA, 19 nt, Homo sapiens
ucucaucgcuuugaaaugg

SEQ ID NO: 1414581 - RNA, 19 nt, Homo sapiens
ggagaugacaacacuuuca

SEQ ID NO: 1414582 - RNA, 19 nt, Homo sapiens
acaauauuccguucucuuu

SEQ ID NO: 1414583 - RNA, 19 nt, Homo sapiens
ccauauggcaguuuaccua

SEQ ID NO: 1414584 - RNA, 19 nt, Homo sapiens
ccacugagaccuucugaca

SEQ ID NO: 1414585 - RNA, 19 nt, Homo sapiens
ugguuuaguugguggguua

SEQ ID NO: 1414586 - RNA, 19 nt, Homo sapiens
gccagggucuucaaagcuu

SEQ ID NO: 1414587 - RNA, 19 nt, Homo sapiens
cauuuagccucaucauguu

SEQ ID NO: 1414588 - RNA, 19 nt, Homo sapiens
aaacaaggaaggcaagaga

SEQ ID NO: 1414589 - RNA, 19 nt, Homo sapiens
caggaguugcugaaauuua

SEQ ID NO: 1414590 - RNA, 19 nt, Homo sapiens
aguaauaaguauccugaga

SEQ ID NO: 1414591 - RNA, 19 nt, Homo sapiens
acagauagaccucgguuug

SEQ ID NO: 1414592 - RNA, 19 nt, Homo sapiens
agauagaccucgguuugaa

SEQ ID NO: 1414593 - RNA, 19 nt, Homo sapiens
agaagaaauugaugaagag

SEQ ID NO: 1414594 - RNA, 19 nt, Homo sapiens
gagcagaagaagaagaaau

SEQ ID NO: 1414595 - RNA, 19 nt, Homo sapiens
gaagucccucuccaaacua

SEQ ID NO: 1414596 - RNA, 19 nt, Homo sapiens
uuaguugguggguuaauua

SEQ ID NO: 1414597 - RNA, 19 nt, Homo sapiens
gcuggucauugcugucauu

SEQ ID NO: 1414598 - RNA, 19 nt, Homo sapiens
uggcgaagaucuugagaca

SEQ ID NO: 1414599 - RNA, 19 nt, Homo sapiens
gccguuaugugcugcaaug

SEQ ID NO: 1414600 - RNA, 19 nt, Homo sapiens
guggauaccucaucuuuug

SEQ ID NO: 1414601 - RNA, 19 nt, Homo sapiens
ugagguuucuggcuaacuu

SEQ ID NO: 1414602 - RNA, 19 nt, Homo sapiens
gagaugacaacacuuucaa

SEQ ID NO: 1414603 - RNA, 19 nt, Homo sapiens
ccucauacuuccucuucuu

SEQ ID NO: 1414604 - RNA, 19 nt, Homo sapiens
cagaagaagaagaaauuga

SEQ ID NO: 1414605 - RNA, 19 nt, Homo sapiens
ggaaagcucaagugaagag

SEQ ID NO: 1414606 - RNA, 19 nt, Homo sapiens
gaaauggggaaaucuaaaa

SEQ ID NO: 1414607 - RNA, 19 nt, Homo sapiens
gagaacaagcacuguggaa

SEQ ID NO: 1414608 - RNA, 19 nt, Homo sapiens
ggacucuguuuaacuauua

SEQ ID NO: 1414609 - RNA, 19 nt, Homo sapiens
ggaaguggguaccucauuu

SEQ ID NO: 1414610 - RNA, 19 nt, Homo sapiens
uaacugcccucccaaauau

SEQ ID NO: 1414611 - RNA, 19 nt, Homo sapiens
agagacagcugauaacaaa

SEQ ID NO: 1414612 - RNA, 19 nt, Homo sapiens
ggagacagcugugggcauu

SEQ ID NO: 1414613 - RNA, 19 nt, Homo sapiens
ucgcugcccuggagaauua

SEQ ID NO: 1414614 - RNA, 19 nt, Homo sapiens
gaaguggguaccucauuua

SEQ ID NO: 1414615 - RNA, 19 nt, Homo sapiens
caaguacucugcacucuuc

SEQ ID NO: 1414616 - RNA, 19 nt, Homo sapiens
gaaaggcaagcaacuauau

SEQ ID NO: 1414617 - RNA, 19 nt, Homo sapiens
gaaaugugcuggguuugau

SEQ ID NO: 1414618 - RNA, 19 nt, Homo sapiens
gcaacuauaugccuacaag

SEQ ID NO: 1414619 - RNA, 19 nt, Homo sapiens
ggaaaggcaagcaacuaua

SEQ ID NO: 1414620 - RNA, 19 nt, Homo sapiens
ggacuuggaggcuggauuu

SEQ ID NO: 1414621 - RNA, 19 nt, Homo sapiens
gaagagacaauaaagaaca

SEQ ID NO: 1414622 - RNA, 19 nt, Homo sapiens
ggagccaucucugcacuaa

SEQ ID NO: 1414623 - RNA, 19 nt, Homo sapiens
ggaguuaaccuuguccuuu

SEQ ID NO: 1414624 - RNA, 19 nt, Homo sapiens
gagagacuuugauaauuuc

SEQ ID NO: 1414625 - RNA, 19 nt, Homo sapiens
ggaaggaggagaagucgaa

SEQ ID NO: 1414626 - RNA, 19 nt, Homo sapiens
guggaaaugugcuggguuu

SEQ ID NO: 1414627 - RNA, 19 nt, Homo sapiens
ucacauacaugcucugucu

SEQ ID NO: 1414628 - RNA, 19 nt, Homo sapiens
aaugucagcugguaugaaa

SEQ ID NO: 1414629 - RNA, 19 nt, Homo sapiens
ggagaagggccuacauuuc

SEQ ID NO: 1414630 - RNA, 19 nt, Homo sapiens
guggguaccucauuuacuu

SEQ ID NO: 1414631 - RNA, 19 nt, Homo sapiens
ggaaugagguagagaucgu

SEQ ID NO: 1414632 - RNA, 19 nt, Homo sapiens
uaagcgaucucagcaauuc

SEQ ID NO: 1414633 - RNA, 19 nt, Homo sapiens
gaacaagagaguaacaaag

SEQ ID NO: 1414634 - RNA, 19 nt, Homo sapiens
agacagcugauaacaaaua

SEQ ID NO: 1414635 - RNA, 19 nt, Homo sapiens
gccuauggcuuacuuuaug

SEQ ID NO: 1414636 - RNA, 19 nt, Homo sapiens
gcaugaacuuugauuccuu

SEQ ID NO: 1414637 - RNA, 19 nt, Homo sapiens
ggaaaugugcuggguuuga

SEQ ID NO: 1414638 - RNA, 19 nt, Homo sapiens
caauaaagaacaucacuca

SEQ ID NO: 1414639 - RNA, 19 nt, Homo sapiens
gcuaaugaagagacaauaa

SEQ ID NO: 1414640 - RNA, 19 nt, Homo sapiens
ggacgcaucuuugcacucu

SEQ ID NO: 1414641 - RNA, 19 nt, Homo sapiens
gaucgggaauucagagaca

SEQ ID NO: 1414642 - RNA, 19 nt, Homo sapiens
gcuacagccugauuauugu

SEQ ID NO: 1414643 - RNA, 19 nt, Homo sapiens
guucuucaguggcaucgua

SEQ ID NO: 1414644 - RNA, 19 nt, Homo sapiens
uggaaugcaugaacuuuga

SEQ ID NO: 1414645 - RNA, 19 nt, Homo sapiens
guuaagcgaucucagcaau

SEQ ID NO: 1414646 - RNA, 19 nt, Homo sapiens
gaaaauauccaucugacaa

SEQ ID NO: 1414647 - RNA, 19 nt, Homo sapiens
ggcaucguauuucaucuuu

SEQ ID NO: 1414648 - RNA, 19 nt, Homo sapiens
gggaaccucuacacauuuc

SEQ ID NO: 1414649 - RNA, 19 nt, Homo sapiens
cgauggauguauggaguua

SEQ ID NO: 1414650 - RNA, 19 nt, Homo sapiens
cuaacugcccucccaaaua

SEQ ID NO: 1414651 - RNA, 19 nt, Homo sapiens
ugagaagagucacaaaucu

SEQ ID NO: 1414652 - RNA, 19 nt, Homo sapiens
uauuacaacucuucugguu

SEQ ID NO: 1414653 - RNA, 19 nt, Homo sapiens
acaagagaguaacaaagaa

SEQ ID NO: 1414654 - RNA, 19 nt, Homo sapiens
gaagagucacaaaucugua

SEQ ID NO: 1414655 - RNA, 19 nt, Homo sapiens
ccaagaaaugggucaaauu

SEQ ID NO: 1414656 - RNA, 19 nt, Homo sapiens
gggccuacauuucucaauc

SEQ ID NO: 1414657 - RNA, 19 nt, Homo sapiens
gagaguaacaaagaagaaa

SEQ ID NO: 1414658 - RNA, 19 nt, Homo sapiens
gacagcugauaacaaauau

SEQ ID NO: 1414659 - RNA, 19 nt, Homo sapiens
gaguuaaccuuguccuuuu

SEQ ID NO: 1414660 - RNA, 19 nt, Homo sapiens
gccaagaaaugggucaaau

SEQ ID NO: 1414661 - RNA, 19 nt, Homo sapiens
gggaaaggcaagcaacuau

SEQ ID NO: 1414662 - RNA, 19 nt, Homo sapiens
gcaaagccacagccagaga

SEQ ID NO: 1414663 - RNA, 19 nt, Homo sapiens
gaucuucaaccaaggaaug

SEQ ID NO: 1414664 - RNA, 19 nt, Homo sapiens
gaccaugagccaccaggua

SEQ ID NO: 1414665 - RNA, 19 nt, Homo sapiens
gccaggccauggacaagaa

SEQ ID NO: 1414666 - RNA, 19 nt, Homo sapiens
acuggacucuguuuaacua

SEQ ID NO: 1414667 - RNA, 19 nt, Homo sapiens
aaaugaagaucaaggacau

SEQ ID NO: 1414668 - RNA, 19 nt, Homo sapiens
aggaauuuguggagaagua

SEQ ID NO: 1414669 - RNA, 19 nt, Homo sapiens
caucguauuucaucuuucu

SEQ ID NO: 1414670 - RNA, 19 nt, Homo sapiens
cgaccuugccucccgauuu

SEQ ID NO: 1414671 - RNA, 19 nt, Homo sapiens
cagcuucaaggaaucaaua

SEQ ID NO: 1414672 - RNA, 19 nt, Homo sapiens
ucaguggcaucguauuuca

SEQ ID NO: 1414673 - RNA, 19 nt, Homo sapiens
gaccuugccucccgauuuu

SEQ ID NO: 1414674 - RNA, 19 nt, Homo sapiens
uggaugggcuccuucuaug

SEQ ID NO: 1414675 - RNA, 19 nt, Homo sapiens
agacagcugugggcauuga

SEQ ID NO: 1414676 - RNA, 19 nt, Homo sapiens
gcagcugggacgcaucuuu

SEQ ID NO: 1414677 - RNA, 19 nt, Homo sapiens
ucagggaggcccaggaauu

SEQ ID NO: 1414678 - RNA, 19 nt, Homo sapiens
ugaccacccucguagacuu

SEQ ID NO: 1414679 - RNA, 19 nt, Homo sapiens
uggcuucaccuguccuuua

SEQ ID NO: 1414680 - RNA, 19 nt, Homo sapiens
uggaaagagugcucagaga

SEQ ID NO: 1414681 - RNA, 19 nt, Homo sapiens
ccucaagcuugcuaaugaa

SEQ ID NO: 1414682 - RNA, 19 nt, Homo sapiens
gaucucagcaauucuccaa

SEQ ID NO: 1414683 - RNA, 19 nt, Homo sapiens
guaccucauuuacuuugug

SEQ ID NO: 1414684 - RNA, 19 nt, Homo sapiens
gagaagagucacaaaucug

SEQ ID NO: 1414685 - RNA, 19 nt, Homo sapiens
ugauguucuuggccauuua

SEQ ID NO: 1414686 - RNA, 19 nt, Homo sapiens
cuucauaugcugaguuuga

SEQ ID NO: 1414687 - RNA, 19 nt, Homo sapiens
cagcugguaugaaaggaau

SEQ ID NO: 1414688 - RNA, 19 nt, Homo sapiens
gaagaaaauauccaucuga

SEQ ID NO: 1414689 - RNA, 19 nt, Homo sapiens
aacaagagaguaacaaaga

SEQ ID NO: 1414690 - RNA, 19 nt, Homo sapiens
cagggaggcccaggaauuu

SEQ ID NO: 1414691 - RNA, 19 nt, Homo sapiens
gaaugcaugaacuuugauu

SEQ ID NO: 1414692 - RNA, 19 nt, Homo sapiens
caagugcuccgugaaguug

SEQ ID NO: 1414693 - RNA, 19 nt, Homo sapiens
aauaguggaugaacaagag

SEQ ID NO: 1414694 - RNA, 19 nt, Homo sapiens
cuuaauauuuggucuaguc

SEQ ID NO: 1414695 - RNA, 19 nt, Homo sapiens
uaacguacaucaccauccu

SEQ ID NO: 1414696 - RNA, 19 nt, Homo sapiens
caagcuugcuaaugaagag

SEQ ID NO: 1414697 - RNA, 19 nt, Homo sapiens
aaauauccaucugacaaga

SEQ ID NO: 1414698 - RNA, 19 nt, Homo sapiens
ugaacaagagaguaacaaa

SEQ ID NO: 1414699 - RNA, 19 nt, Homo sapiens
aggaaucaauaguggauga

SEQ ID NO: 1414700 - RNA, 19 nt, Homo sapiens
uggagaagggccuacauuu

SEQ ID NO: 1414701 - RNA, 19 nt, Homo sapiens
aggcuggauuuccuucaua

SEQ ID NO: 1414702 - RNA, 19 nt, Homo sapiens
cugacaugcugguaacgua

SEQ ID NO: 1414703 - RNA, 19 nt, Homo sapiens
ugaaaggaaugagguagag

SEQ ID NO: 1414704 - RNA, 19 nt, Homo sapiens
ggccagcaauacccaagga

SEQ ID NO: 1414705 - RNA, 19 nt, Homo sapiens
guacucugcacucuucuau

SEQ ID NO: 1414706 - RNA, 19 nt, Homo sapiens
ccugggaaaugaagaucaa

SEQ ID NO: 1414707 - RNA, 19 nt, Homo sapiens
ggccaugaccacccucgua

SEQ ID NO: 1414708 - RNA, 19 nt, Homo sapiens
ggaugcagaugcugaugaa

SEQ ID NO: 1414709 - RNA, 19 nt, Homo sapiens
cgacccagcuggcaaggaa

SEQ ID NO: 1414710 - RNA, 19 nt, Homo sapiens
gaauucauccgagcaguca

SEQ ID NO: 1414711 - RNA, 19 nt, Homo sapiens
ccacgaggcuaugggagau

SEQ ID NO: 1414712 - RNA, 19 nt, Homo sapiens
cauccgagcagucaucuuc

SEQ ID NO: 1414713 - RNA, 19 nt, Homo sapiens
ugaaaucaguagccuuugc

SEQ ID NO: 1414714 - RNA, 19 nt, Homo sapiens
agugaaaucaguagccuuu

SEQ ID NO: 1414715 - RNA, 19 nt, Homo sapiens
gaaaucaguagccuuugcu

SEQ ID NO: 1414716 - RNA, 19 nt, Homo sapiens
uagcaaaagugaaaucagu

SEQ ID NO: 1414717 - RNA, 19 nt, Homo sapiens
gcgacgagauggacaauaa

SEQ ID NO: 1414718 - RNA, 19 nt, Homo sapiens
gaaaugcauucuuguacaa

SEQ ID NO: 1414719 - RNA, 19 nt, Homo sapiens
gaccaaggcucucagaaga

SEQ ID NO: 1414720 - RNA, 19 nt, Homo sapiens
gaauuuguauuucccucua

SEQ ID NO: 1414721 - RNA, 19 nt, Homo sapiens
ggagguuuauucuuucuga

SEQ ID NO: 1414722 - RNA, 19 nt, Homo sapiens
guguauauguugcuuguuu

SEQ ID NO: 1414723 - RNA, 19 nt, Homo sapiens
guacaauucuguugaaacu

SEQ ID NO: 1414724 - RNA, 19 nt, Homo sapiens
gaacacauuuaugaggauu

SEQ ID NO: 1414725 - RNA, 19 nt, Homo sapiens
gcagugacaucggacagaa

SEQ ID NO: 1414726 - RNA, 19 nt, Homo sapiens
aauauucucuguucagugu

SEQ ID NO: 1414727 - RNA, 19 nt, Homo sapiens
ggaacacauuuaugaggau

SEQ ID NO: 1414728 - RNA, 19 nt, Homo sapiens
gagauggacaauaagauga

SEQ ID NO: 1414729 - RNA, 19 nt, Homo sapiens
gcaugauuguuucaaguca

SEQ ID NO: 1414730 - RNA, 19 nt, Homo sapiens
gcaagaagucgagcgaaga

SEQ ID NO: 1414731 - RNA, 19 nt, Homo sapiens
ggaccaaggcucucagaag

SEQ ID NO: 1414732 - RNA, 19 nt, Homo sapiens
ggucaucuuguuucuguuu

SEQ ID NO: 1414733 - RNA, 19 nt, Homo sapiens
ccgagccucugcaugauug

SEQ ID NO: 1414734 - RNA, 19 nt, Homo sapiens
acacauuuaugaggauuug

SEQ ID NO: 1414735 - RNA, 19 nt, Homo sapiens
cgagauggacaauaagaug

SEQ ID NO: 1414736 - RNA, 19 nt, Homo sapiens
gggaugcauucgagucugu

SEQ ID NO: 1414737 - RNA, 19 nt, Homo sapiens
gagguuuauucuuucugaa

SEQ ID NO: 1414738 - RNA, 19 nt, Homo sapiens
caguguauauguugcuugu

SEQ ID NO: 1414739 - RNA, 19 nt, Homo sapiens
agccuggaauucuuacuuu

SEQ ID NO: 1414740 - RNA, 19 nt, Homo sapiens
caagaagucgagcgaagau

SEQ ID NO: 1414741 - RNA, 19 nt, Homo sapiens
gacgagauggacaauaaga

SEQ ID NO: 1414742 - RNA, 19 nt, Homo sapiens
ucgagucuguaacuucuga

SEQ ID NO: 1414743 - RNA, 19 nt, Homo sapiens
ucuguucaguguauauguu

SEQ ID NO: 1414744 - RNA, 19 nt, Homo sapiens
ucuucugggucuuauguuu

SEQ ID NO: 1414745 - RNA, 19 nt, Homo sapiens
gcauucgagucuguaacuu

SEQ ID NO: 1414746 - RNA, 19 nt, Homo sapiens
caagucagccuggaauucu

SEQ ID NO: 1414747 - RNA, 19 nt, Homo sapiens
cugacaagcugagcaagau

SEQ ID NO: 1414748 - RNA, 19 nt, Homo sapiens
ugucauggucaucuuguuu

SEQ ID NO: 1414749 - RNA, 19 nt, Homo sapiens
ucugaaaccugaacaaccu

SEQ ID NO: 1414750 - RNA, 19 nt, Homo sapiens
uguauauguugcuuguuug

SEQ ID NO: 1414751 - RNA, 19 nt, Homo sapiens
cuuguacaauucuguugaa

SEQ ID NO: 1414752 - RNA, 19 nt, Homo sapiens
agauucaggaacacauuua

SEQ ID NO: 1414753 - RNA, 19 nt, Homo sapiens
ccaccagcgucgagagaag

SEQ ID NO: 1414754 - RNA, 19 nt, Homo sapiens
caaguggaauugggaugca

SEQ ID NO: 1414755 - RNA, 19 nt, Homo sapiens
gcacccagucgcucaacga

SEQ ID NO: 1414756 - RNA, 19 nt, Homo sapiens
uucaggaacacauuuauga

SEQ ID NO: 1414757 - RNA, 19 nt, Homo sapiens
gcaagauccagacgcucaa

SEQ ID NO: 1414758 - RNA, 19 nt, Homo sapiens
gauucaggaacacauuuau

SEQ ID NO: 1414759 - RNA, 19 nt, Homo sapiens
agucagccuggaauucuua

SEQ ID NO: 1414760 - RNA, 19 nt, Homo sapiens
uagauucaggaacacauuu

SEQ ID NO: 1414761 - RNA, 19 nt, Homo sapiens
uauucucuguucaguguau

SEQ ID NO: 1414762 - RNA, 19 nt, Homo sapiens
caucuuguuucuguuugga

SEQ ID NO: 1414763 - RNA, 19 nt, Homo sapiens
gccuggaauucuuacuuuc

SEQ ID NO: 1414764 - RNA, 19 nt, Homo sapiens
ucaagucagccuggaauuc

SEQ ID NO: 1414765 - RNA, 19 nt, Homo sapiens
cugcaugauuguuucaagu

SEQ ID NO: 1414766 - RNA, 19 nt, Homo sapiens
gaugcauucgagucuguaa

SEQ ID NO: 1414767 - RNA, 19 nt, Homo sapiens
ucuuguuucuguuuggauu

SEQ ID NO: 1414768 - RNA, 19 nt, Homo sapiens
ccacgcugcccucugacaa

SEQ ID NO: 1414769 - RNA, 19 nt, Homo sapiens
auggucaucuuguuucugu

SEQ ID NO: 1414770 - RNA, 19 nt, Homo sapiens
gaagggacagcagugacau

SEQ ID NO: 1414771 - RNA, 19 nt, Homo sapiens
gcaaugaaaucuccaagug

SEQ ID NO: 1414772 - RNA, 19 nt, Homo sapiens
gaaagaagaaagaggauaa

SEQ ID NO: 1414773 - RNA, 19 nt, Homo sapiens
gaagauucaucacuuagaa

SEQ ID NO: 1414774 - RNA, 19 nt, Homo sapiens
gaaaggcccugaaggacuu

SEQ ID NO: 1414775 - RNA, 19 nt, Homo sapiens
gauugggccucgaagauua

SEQ ID NO: 1414776 - RNA, 19 nt, Homo sapiens
gcaaaugucuuuagaucuc

SEQ ID NO: 1414777 - RNA, 19 nt, Homo sapiens
gcaaagaggagaaugaaga

SEQ ID NO: 1414778 - RNA, 19 nt, Homo sapiens
gaaugaagauccagaaagg

SEQ ID NO: 1414779 - RNA, 19 nt, Homo sapiens
gaacaaauccagagaaacu

SEQ ID NO: 1414780 - RNA, 19 nt, Homo sapiens
cggaaggucugucugauaa

SEQ ID NO: 1414781 - RNA, 19 nt, Homo sapiens
gggaacaaauccagagaaa

SEQ ID NO: 1414782 - RNA, 19 nt, Homo sapiens
ccaaggagcucugaauugu

SEQ ID NO: 1414783 - RNA, 19 nt, Homo sapiens
agacagaacuacuaacuuc

SEQ ID NO: 1414784 - RNA, 19 nt, Homo sapiens
gaaggucugucugauaaga

SEQ ID NO: 1414785 - RNA, 19 nt, Homo sapiens
caagaacaguggagauuuc

SEQ ID NO: 1414786 - RNA, 19 nt, Homo sapiens
gcacacaaccuccgcuuug

SEQ ID NO: 1414787 - RNA, 19 nt, Homo sapiens
gagcaaggccauccgagua

SEQ ID NO: 1414788 - RNA, 19 nt, Homo sapiens
cgaaagagaaggagaagaa

SEQ ID NO: 1414789 - RNA, 19 nt, Homo sapiens
gaaacaugguggccugaga

SEQ ID NO: 1414790 - RNA, 19 nt, Homo sapiens
aaagcaagguucacucauu

SEQ ID NO: 1414791 - RNA, 19 nt, Homo sapiens
gaagcuauggaaacacuua

SEQ ID NO: 1414792 - RNA, 19 nt, Homo sapiens
gaacuuggaagacagagaa

SEQ ID NO: 1414793 - RNA, 19 nt, Homo sapiens
gcacugaccguauccagaa

SEQ ID NO: 1414794 - RNA, 19 nt, Homo sapiens
cagcaaaugucuuuagauc

SEQ ID NO: 1414795 - RNA, 19 nt, Homo sapiens
gcaauuggaucaguguaug

SEQ ID NO: 1414796 - RNA, 19 nt, Homo sapiens
gaaagaagagcgugaaagg

SEQ ID NO: 1414797 - RNA, 19 nt, Homo sapiens
guacagacagaacuacuaa

SEQ ID NO: 1414798 - RNA, 19 nt, Homo sapiens
ccacgaagcuauggaaaca

SEQ ID NO: 1414799 - RNA, 19 nt, Homo sapiens
gaaagguacucugaaacau

SEQ ID NO: 1414800 - RNA, 19 nt, Homo sapiens
ggauccagaugaugucuug

SEQ ID NO: 1414801 - RNA, 19 nt, Homo sapiens
gaacagacuuggggauuuu

SEQ ID NO: 1414802 - RNA, 19 nt, Homo sapiens
uguaugauauggaugauga

SEQ ID NO: 1414803 - RNA, 19 nt, Homo sapiens
gaugaugucuuggcagaug

SEQ ID NO: 1414804 - RNA, 19 nt, Homo sapiens
gaaccacuccacaagauug

SEQ ID NO: 1414805 - RNA, 19 nt, Homo sapiens
ugauauggaugaugaugaa

SEQ ID NO: 1414806 - RNA, 19 nt, Homo sapiens
ggagaaggguccugguuac

SEQ ID NO: 1414807 - RNA, 19 nt, Homo sapiens
cagccugaaucaauuaauu

SEQ ID NO: 1414808 - RNA, 19 nt, Homo sapiens
gggagaaggguccugguua

SEQ ID NO: 1414809 - RNA, 19 nt, Homo sapiens
cagauguuguugaagauaa

SEQ ID NO: 1414810 - RNA, 19 nt, Homo sapiens
gcccagaccaguacccuua

SEQ ID NO: 1414811 - RNA, 19 nt, Homo sapiens
aaggacacauugagugaua

SEQ ID NO: 1414812 - RNA, 19 nt, Homo sapiens
gaacuaaggacacauugag

SEQ ID NO: 1414813 - RNA, 19 nt, Homo sapiens
cuacuaacuucgccaagaa

SEQ ID NO: 1414814 - RNA, 19 nt, Homo sapiens
aaggagcucugaauuguga

SEQ ID NO: 1414815 - RNA, 19 nt, Homo sapiens
ccaacuggcugcauuuaag

SEQ ID NO: 1414816 - RNA, 19 nt, Homo sapiens
gauaaagacaagcugauug

SEQ ID NO: 1414817 - RNA, 19 nt, Homo sapiens
ggaaagaagaaagaggaua

SEQ ID NO: 1414818 - RNA, 19 nt, Homo sapiens
uaacuucgccaagaacuaa

SEQ ID NO: 1414819 - RNA, 19 nt, Homo sapiens
uggcagauguuguugaaga

SEQ ID NO: 1414820 - RNA, 19 nt, Homo sapiens
ggaggauccugcagagugu

SEQ ID NO: 1414821 - RNA, 19 nt, Homo sapiens
gucauuggcucucuuaaca

SEQ ID NO: 1414822 - RNA, 19 nt, Homo sapiens
caagcugauugcuguguuu

SEQ ID NO: 1414823 - RNA, 19 nt, Homo sapiens
gagaagaagagcuggagaa

SEQ ID NO: 1414824 - RNA, 19 nt, Homo sapiens
uggaaaggcugagcagaaa

SEQ ID NO: 1414825 - RNA, 19 nt, Homo sapiens
ccaaagggagcagcaauaa

SEQ ID NO: 1414826 - RNA, 19 nt, Homo sapiens
aaagaaaggcccugaagga

SEQ ID NO: 1414827 - RNA, 19 nt, Homo sapiens
gaaagagaaggagaagaaa

SEQ ID NO: 1414828 - RNA, 19 nt, Homo sapiens
aagcaagguucacucauug

SEQ ID NO: 1414829 - RNA, 19 nt, Homo sapiens
gcacaucaacuucagaucu

SEQ ID NO: 1414830 - RNA, 19 nt, Homo sapiens
cauuggcucucuuaacauu

SEQ ID NO: 1414831 - RNA, 19 nt, Homo sapiens
gcugauugcuguguuugaa

SEQ ID NO: 1414832 - RNA, 19 nt, Homo sapiens
ggacagaauuuuggaggua

SEQ ID NO: 1414833 - RNA, 19 nt, Homo sapiens
ccgcagauccuguagacua

SEQ ID NO: 1414834 - RNA, 19 nt, Homo sapiens
gugaaaggauuggagcaaa

SEQ ID NO: 1414835 - RNA, 19 nt, Homo sapiens
gaagagcgugaaaggauug

SEQ ID NO: 1414836 - RNA, 19 nt, Homo sapiens
aagaagagcuggagaaaau

SEQ ID NO: 1414837 - RNA, 19 nt, Homo sapiens
ggagguaaaugggagagau

SEQ ID NO: 1414838 - RNA, 19 nt, Homo sapiens
uagaggacauggaaaauaa

SEQ ID NO: 1414839 - RNA, 19 nt, Homo sapiens
caagaacuaaggacacauu

SEQ ID NO: 1414840 - RNA, 19 nt, Homo sapiens
gcugagauuuggaaagaag

SEQ ID NO: 1414841 - RNA, 19 nt, Homo sapiens
gaucagcacaucaacuuca

SEQ ID NO: 1414842 - RNA, 19 nt, Homo sapiens
caauguccauggagggaaa

SEQ ID NO: 1414843 - RNA, 19 nt, Homo sapiens
caacaauguggaucucgua

SEQ ID NO: 1414844 - RNA, 19 nt, Homo sapiens
gacaagaacaguggagauu

SEQ ID NO: 1414845 - RNA, 19 nt, Homo sapiens
agaagagcgugaaaggauu

SEQ ID NO: 1414846 - RNA, 19 nt, Homo sapiens
acacuuaggcggucaaugu

SEQ ID NO: 1414847 - RNA, 19 nt, Homo sapiens
gggaaucucuuuugggaaa

SEQ ID NO: 1414848 - RNA, 19 nt, Homo sapiens
caagaaccacuccacaaga

SEQ ID NO: 1414849 - RNA, 19 nt, Homo sapiens
gguggcagaucuccgguau

SEQ ID NO: 1414850 - RNA, 19 nt, Homo sapiens
gagaaugaagauccagaaa

SEQ ID NO: 1414851 - RNA, 19 nt, Homo sapiens
caaacagaaaggucuauug

SEQ ID NO: 1414852 - RNA, 19 nt, Homo sapiens
gauggucgucugcgaauga

SEQ ID NO: 1414853 - RNA, 19 nt, Homo sapiens
gcaaggccauccgaguaug

SEQ ID NO: 1414854 - RNA, 19 nt, Homo sapiens
agaaagagaccacuuagag

SEQ ID NO: 1414855 - RNA, 19 nt, Homo sapiens
ggagaaugaagauccagaa

SEQ ID NO: 1414856 - RNA, 19 nt, Homo sapiens
caaagggagcagcaauaaa

SEQ ID NO: 1414857 - RNA, 19 nt, Homo sapiens
caagcgggagggacuauuu

SEQ ID NO: 1414858 - RNA, 19 nt, Homo sapiens
gcagauguuguugaagaua

SEQ ID NO: 1414859 - RNA, 19 nt, Homo sapiens
cauccacugucuccagaaa

SEQ ID NO: 1414860 - RNA, 19 nt, Homo sapiens
gaaccaugcacaucagcaa

SEQ ID NO: 1414861 - RNA, 19 nt, Homo sapiens
gaaauggaccccaauuaug

SEQ ID NO: 1414862 - RNA, 19 nt, Homo sapiens
uauggaugaugaugaaaug

SEQ ID NO: 1414863 - RNA, 19 nt, Homo sapiens
ggagcuagaggacauggaa

SEQ ID NO: 1414864 - RNA, 19 nt, Homo sapiens
cgaagagcauggaccuugu

SEQ ID NO: 1414865 - RNA, 19 nt, Homo sapiens
ggauugggccucgaagauu

SEQ ID NO: 1414866 - RNA, 19 nt, Homo sapiens
ugaaugguguacagacaga

SEQ ID NO: 1414867 - RNA, 19 nt, Homo sapiens
ggaaaagggcaaauugaaa

SEQ ID NO: 1414868 - RNA, 19 nt, Homo sapiens
gccaaggagcucugaauug

SEQ ID NO: 1414869 - RNA, 19 nt, Homo sapiens
aagaaccacuccacaagau

SEQ ID NO: 1414870 - RNA, 19 nt, Homo sapiens
gggaaaguccaaccacgaa

SEQ ID NO: 1414871 - RNA, 19 nt, Homo sapiens
cgauggaccugaagaaaua

SEQ ID NO: 1414872 - RNA, 19 nt, Homo sapiens
gcaaugaaaucuccaagug

SEQ ID NO: 1414873 - RNA, 19 nt, Homo sapiens
gaaagaagaaagaggauaa

SEQ ID NO: 1414874 - RNA, 19 nt, Homo sapiens
gaagauucaucacuuagaa

SEQ ID NO: 1414875 - RNA, 19 nt, Homo sapiens
gaaaggcccugaaggacuu

SEQ ID NO: 1414876 - RNA, 19 nt, Homo sapiens
gauugggccucgaagauua

SEQ ID NO: 1414877 - RNA, 19 nt, Homo sapiens
gcaaaugucuuuagaucuc

SEQ ID NO: 1414878 - RNA, 19 nt, Homo sapiens
gcaaagaggagaaugaaga

SEQ ID NO: 1414879 - RNA, 19 nt, Homo sapiens
gaaugaagauccagaaagg

SEQ ID NO: 1414880 - RNA, 19 nt, Homo sapiens
ccaaggagcucugaauugu

SEQ ID NO: 1414881 - RNA, 19 nt, Homo sapiens
gagcagccauugacaaauc

SEQ ID NO: 1414882 - RNA, 19 nt, Homo sapiens
agacagaacuacuaacuuc

SEQ ID NO: 1414883 - RNA, 19 nt, Homo sapiens
caagaacaguggagauuuc

SEQ ID NO: 1414884 - RNA, 19 nt, Homo sapiens
gcacacaaccuccgcuuug

SEQ ID NO: 1414885 - RNA, 19 nt, Homo sapiens
gagcaaggccauccgagua

SEQ ID NO: 1414886 - RNA, 19 nt, Homo sapiens
cgaaagagaaggagaagaa

SEQ ID NO: 1414887 - RNA, 19 nt, Homo sapiens
agaaugaccuucccuuuca

SEQ ID NO: 1414888 - RNA, 19 nt, Homo sapiens
gaaacaugguggccugaga

SEQ ID NO: 1414889 - RNA, 19 nt, Homo sapiens
aaagcaagguucacucauu

SEQ ID NO: 1414890 - RNA, 19 nt, Homo sapiens
gaagcuauggaaacacuua

SEQ ID NO: 1414891 - RNA, 19 nt, Homo sapiens
gaacuuggaagacagagaa

SEQ ID NO: 1414892 - RNA, 19 nt, Homo sapiens
gcacugaccguauccagaa

SEQ ID NO: 1414893 - RNA, 19 nt, Homo sapiens
cagcaaaugucuuuagauc

SEQ ID NO: 1414894 - RNA, 19 nt, Homo sapiens
gcaauuggaucaguguaug

SEQ ID NO: 1414895 - RNA, 19 nt, Homo sapiens
gaaagaagagcgugaaagg

SEQ ID NO: 1414896 - RNA, 19 nt, Homo sapiens
guacagacagaacuacuaa

SEQ ID NO: 1414897 - RNA, 19 nt, Homo sapiens
ccacgaagcuauggaaaca

SEQ ID NO: 1414898 - RNA, 19 nt, Homo sapiens
gaaagguacucugaaacau

SEQ ID NO: 1414899 - RNA, 19 nt, Homo sapiens
ggauccagaugaugucuug

SEQ ID NO: 1414900 - RNA, 19 nt, Homo sapiens
uguaugauauggaugauga

SEQ ID NO: 1414901 - RNA, 19 nt, Homo sapiens
gaugaugucuuggcagaug

SEQ ID NO: 1414902 - RNA, 19 nt, Homo sapiens
gaaccacuccacaagauug

SEQ ID NO: 1414903 - RNA, 19 nt, Homo sapiens
ugauauggaugaugaugaa

SEQ ID NO: 1414904 - RNA, 19 nt, Homo sapiens
gggagaaggguccugguua

SEQ ID NO: 1414905 - RNA, 19 nt, Homo sapiens
ggagaaggguccugguuac

SEQ ID NO: 1414906 - RNA, 19 nt, Homo sapiens
cagccugaaucaauuaauu

SEQ ID NO: 1414907 - RNA, 19 nt, Homo sapiens
cagauguuguugaagauaa

SEQ ID NO: 1414908 - RNA, 19 nt, Homo sapiens
gcccagaccaguacccuua

SEQ ID NO: 1414909 - RNA, 19 nt, Homo sapiens
ugacaaauccuacgaugga

SEQ ID NO: 1414910 - RNA, 19 nt, Homo sapiens
aaggacacauugagugaua

SEQ ID NO: 1414911 - RNA, 19 nt, Homo sapiens
gaacuaaggacacauugag

SEQ ID NO: 1414912 - RNA, 19 nt, Homo sapiens
cuacuaacuucgccaagaa

SEQ ID NO: 1414913 - RNA, 19 nt, Homo sapiens
aaggagcucugaauuguga

SEQ ID NO: 1414914 - RNA, 19 nt, Homo sapiens
ggccgaggcugcaaugaga

SEQ ID NO: 1414915 - RNA, 19 nt, Homo sapiens
ccaacuggcugcauuuaag

SEQ ID NO: 1414916 - RNA, 19 nt, Homo sapiens
gauaaagacaagcugauug

SEQ ID NO: 1414917 - RNA, 19 nt, Homo sapiens
ggaaagaagaaagaggaua

SEQ ID NO: 1414918 - RNA, 19 nt, Homo sapiens
uaacuucgccaagaacuaa

SEQ ID NO: 1414919 - RNA, 19 nt, Homo sapiens
ggaggauccugcagagugu

SEQ ID NO: 1414920 - RNA, 19 nt, Homo sapiens
gucauuggcucucuuaaca

SEQ ID NO: 1414921 - RNA, 19 nt, Homo sapiens
uggcagauguuguugaaga

SEQ ID NO: 1414922 - RNA, 19 nt, Homo sapiens
caagcugauugcuguguuu

SEQ ID NO: 1414923 - RNA, 19 nt, Homo sapiens
gagaagaagagcuggagaa

SEQ ID NO: 1414924 - RNA, 19 nt, Homo sapiens
uggaaaggcugagcagaaa

SEQ ID NO: 1414925 - RNA, 19 nt, Homo sapiens
ccaaagggagcagcaauaa

SEQ ID NO: 1414926 - RNA, 19 nt, Homo sapiens
aaagaaaggcccugaagga

SEQ ID NO: 1414927 - RNA, 19 nt, Homo sapiens
gaaagagaaggagaagaaa

SEQ ID NO: 1414928 - RNA, 19 nt, Homo sapiens
aagcaagguucacucauug

SEQ ID NO: 1414929 - RNA, 19 nt, Homo sapiens
gcacaucaacuucagaucu

SEQ ID NO: 1414930 - RNA, 19 nt, Homo sapiens
cauuggcucucuuaacauu

SEQ ID NO: 1414931 - RNA, 19 nt, Homo sapiens
gcugauugcuguguuugaa

SEQ ID NO: 1414932 - RNA, 19 nt, Homo sapiens
ggacagaauuuuggaggua

SEQ ID NO: 1414933 - RNA, 19 nt, Homo sapiens
ccgcagauccuguagacua

SEQ ID NO: 1414934 - RNA, 19 nt, Homo sapiens
gugaaaggauuggagcaaa

SEQ ID NO: 1414935 - RNA, 19 nt, Homo sapiens
gaagagcgugaaaggauug

SEQ ID NO: 1414936 - RNA, 19 nt, Homo sapiens
aagaagagcuggagaaaau

SEQ ID NO: 1414937 - RNA, 19 nt, Homo sapiens
ggagguaaaugggagagau

SEQ ID NO: 1414938 - RNA, 19 nt, Homo sapiens
uagaggacauggaaaauaa

SEQ ID NO: 1414939 - RNA, 19 nt, Homo sapiens
caagaacuaaggacacauu

SEQ ID NO: 1414940 - RNA, 19 nt, Homo sapiens
gcugagauuuggaaagaag

SEQ ID NO: 1414941 - RNA, 19 nt, Homo sapiens
gaucagcacaucaacuuca

SEQ ID NO: 1414942 - RNA, 19 nt, Homo sapiens
caauguccauggagggaaa

SEQ ID NO: 1414943 - RNA, 19 nt, Homo sapiens
caacaauguggaucucgua

SEQ ID NO: 1414944 - RNA, 19 nt, Homo sapiens
gacaagaacaguggagauu

SEQ ID NO: 1414945 - RNA, 19 nt, Homo sapiens
agaagagcgugaaaggauu

SEQ ID NO: 1414946 - RNA, 19 nt, Homo sapiens
acacuuaggcggucaaugu

SEQ ID NO: 1414947 - RNA, 19 nt, Homo sapiens
gggaaucucuuuugggaaa

SEQ ID NO: 1414948 - RNA, 19 nt, Homo sapiens
caagaaccacuccacaaga

SEQ ID NO: 1414949 - RNA, 19 nt, Homo sapiens
gguggcagaucuccgguau

SEQ ID NO: 1414950 - RNA, 19 nt, Homo sapiens
gagaaugaagauccagaaa

SEQ ID NO: 1414951 - RNA, 19 nt, Homo sapiens
caaacagaaaggucuauug

SEQ ID NO: 1414952 - RNA, 19 nt, Homo sapiens
gauggucgucugcgaauga

SEQ ID NO: 1414953 - RNA, 19 nt, Homo sapiens
gcaaggccauccgaguaug

SEQ ID NO: 1414954 - RNA, 19 nt, Homo sapiens
agaaagagaccacuuagag

SEQ ID NO: 1414955 - RNA, 19 nt, Homo sapiens
ggagaaugaagauccagaa

SEQ ID NO: 1414956 - RNA, 19 nt, Homo sapiens
caaagggagcagcaauaaa

SEQ ID NO: 1414957 - RNA, 19 nt, Homo sapiens
caagcgggagggacuauuu

SEQ ID NO: 1414958 - RNA, 19 nt, Homo sapiens
gcagauguuguugaagaua

SEQ ID NO: 1414959 - RNA, 19 nt, Homo sapiens
cauccacugucuccagaaa

SEQ ID NO: 1414960 - RNA, 19 nt, Homo sapiens
gaaccaugcacaucagcaa

SEQ ID NO: 1414961 - RNA, 19 nt, Homo sapiens
gaaauggaccccaauuaug

SEQ ID NO: 1414962 - RNA, 19 nt, Homo sapiens
uauggaugaugaugaaaug

SEQ ID NO: 1414963 - RNA, 19 nt, Homo sapiens
ggagcuagaggacauggaa

SEQ ID NO: 1414964 - RNA, 19 nt, Homo sapiens
cgaagagcauggaccuugu

SEQ ID NO: 1414965 - RNA, 19 nt, Homo sapiens
ggauugggccucgaagauu

SEQ ID NO: 1414966 - RNA, 19 nt, Homo sapiens
ugaaugguguacagacaga

SEQ ID NO: 1414967 - RNA, 19 nt, Homo sapiens
ggaaaagggcaaauugaaa

SEQ ID NO: 1414968 - RNA, 19 nt, Homo sapiens
gccaaggagcucugaauug

SEQ ID NO: 1414969 - RNA, 19 nt, Homo sapiens
cugacggucugucugauaa

SEQ ID NO: 1414970 - RNA, 19 nt, Homo sapiens
aagaaccacuccacaagau

SEQ ID NO: 1414971 - RNA, 19 nt, Homo sapiens
gaucuuggcucgcaacuuu

SEQ ID NO: 1414972 - RNA, 19 nt, Homo sapiens
gagaggagcucaugaagau

SEQ ID NO: 1414973 - RNA, 19 nt, Homo sapiens
gaacuuggguccugucuuc

SEQ ID NO: 1414974 - RNA, 19 nt, Homo sapiens
uaaagucucuugcuacauu

SEQ ID NO: 1414975 - RNA, 19 nt, Homo sapiens
ggugagaaaugaaauacaa

SEQ ID NO: 1414976 - RNA, 19 nt, Homo sapiens
ggagcaagcuaguagaaau

SEQ ID NO: 1414977 - RNA, 19 nt, Homo sapiens
gaggagaaccuguguaaga

SEQ ID NO: 1414978 - RNA, 19 nt, Homo sapiens
aaacuuaucuuuggugaga

SEQ ID NO: 1414979 - RNA, 19 nt, Homo sapiens
ugacaucucuaccgaaaug

SEQ ID NO: 1414980 - RNA, 19 nt, Homo sapiens
ccaguaaacuuaucuuugg

SEQ ID NO: 1414981 - RNA, 19 nt, Homo sapiens
caagcaagaugccauguca

SEQ ID NO: 1414982 - RNA, 19 nt, Homo sapiens
gagcaagcuaguagaaaua

SEQ ID NO: 1414983 - RNA, 19 nt, Homo sapiens
gcaagcgcaugaaugaaug

SEQ ID NO: 1414984 - RNA, 19 nt, Homo sapiens
caugacaucucuaccgaaa

SEQ ID NO: 1414985 - RNA, 19 nt, Homo sapiens
gcuaaagucucuugcuaca

SEQ ID NO: 1414986 - RNA, 19 nt, Homo sapiens
gaugguaacugaugaacag

SEQ ID NO: 1414987 - RNA, 19 nt, Homo sapiens
uacaagggcugcugugaga

SEQ ID NO: 1414988 - RNA, 19 nt, Homo sapiens
cagaguaccugcugaggau

SEQ ID NO: 1414989 - RNA, 19 nt, Homo sapiens
gcaagcuaguagaaauauu

SEQ ID NO: 1414990 - RNA, 19 nt, Homo sapiens
gggagaugcuugcccaugu

SEQ ID NO: 1414991 - RNA, 19 nt, Homo sapiens
gguaacugaugaacagaga

SEQ ID NO: 1414992 - RNA, 19 nt, Homo sapiens
ccagugggaacuuguauaa

SEQ ID NO: 1414993 - RNA, 19 nt, Homo sapiens
gcacauucggauuuaaauu

SEQ ID NO: 1414994 - RNA, 19 nt, Homo sapiens
gagugaugaugguaacuga

SEQ ID NO: 1414995 - RNA, 19 nt, Homo sapiens
gcccauguguuucaucaau

SEQ ID NO: 1414996 - RNA, 19 nt, Homo sapiens
acagagaacuuuccagaac

SEQ ID NO: 1414997 - RNA, 19 nt, Homo sapiens
caagcuaguagaaauauug

SEQ ID NO: 1414998 - RNA, 19 nt, Homo sapiens
gagaaccuguguaagaucu

SEQ ID NO: 1414999 - RNA, 19 nt, Homo sapiens
ugacugaccuggaggacau

SEQ ID NO: 1415000 - RNA, 19 nt, Homo sapiens
ggagaugcuugcccaugug

SEQ ID NO: 1415001 - RNA, 19 nt, Homo sapiens
guauaaaucacauggguau

SEQ ID NO: 1415002 - RNA, 19 nt, Homo sapiens
agugggaacuuguauaaau

SEQ ID NO: 1415003 - RNA, 19 nt, Homo sapiens
ggacucacccauugacugu

SEQ ID NO: 1415004 - RNA, 19 nt, Homo sapiens
ggagagcguggccagagua

SEQ ID NO: 1415005 - RNA, 19 nt, Homo sapiens
uaucuuuggugagaaauga

SEQ ID NO: 1415006 - RNA, 19 nt, Homo sapiens
gaugcuugcccauguguuu

SEQ ID NO: 1415007 - RNA, 19 nt, Homo sapiens
gcucaggguuggccagcuu

SEQ ID NO: 1415008 - RNA, 19 nt, Homo sapiens
gaagggccucucugucuga

SEQ ID NO: 1415009 - RNA, 19 nt, Homo sapiens
caucaggcuuggaggagaa

SEQ ID NO: 1415010 - RNA, 19 nt, Homo sapiens
gcagaggagcaagcuagua

SEQ ID NO: 1415011 - RNA, 19 nt, Homo sapiens
auacaaggaucagaaagga

SEQ ID NO: 1415012 - RNA, 19 nt, Homo sapiens
gaccaguaaacuuaucuuu

SEQ ID NO: 1415013 - RNA, 19 nt, Homo sapiens
gaggagcaagcuaguagaa

SEQ ID NO: 1415014 - RNA, 19 nt, Homo sapiens
gaaaugugccgggagaaag

SEQ ID NO: 1415015 - RNA, 19 nt, Homo sapiens
guuucgagcuacagccuuu

SEQ ID NO: 1415016 - RNA, 19 nt, Homo sapiens
uugcuaaagucucuugcua

SEQ ID NO: 1415017 - RNA, 19 nt, Homo sapiens
ccauguguuucaucaauca

SEQ ID NO: 1415018 - RNA, 19 nt, Homo sapiens
gugggaacuuguauaaauc

SEQ ID NO: 1415019 - RNA, 19 nt, Homo sapiens
cagcccagguucaggagaa

SEQ ID NO: 1415020 - RNA, 19 nt, Homo sapiens
ugaaggacuugagggacua

SEQ ID NO: 1415021 - RNA, 19 nt, Homo sapiens
agaugaaggugaaggacuu

SEQ ID NO: 1415022 - RNA, 19 nt, Homo sapiens
uacauugccuaaauccauu

SEQ ID NO: 1415023 - RNA, 19 nt, Homo sapiens
agagaacuuuccagaacuu

SEQ ID NO: 1415024 - RNA, 19 nt, Homo sapiens
gagcuugcaucgguuucuu

SEQ ID NO: 1415025 - RNA, 19 nt, Homo sapiens
ggcaagcgcaugaaugaau

SEQ ID NO: 1415026 - RNA, 19 nt, Homo sapiens
gcuauacaaggaucagaaa

SEQ ID NO: 1415027 - RNA, 19 nt, Homo sapiens
ugccaacgguuucgagcua

SEQ ID NO: 1415028 - RNA, 19 nt, Homo sapiens
gagcugauggagagaguga

SEQ ID NO: 1415029 - RNA, 19 nt, Homo sapiens
cagcacauucggauuuaaa

SEQ ID NO: 1415030 - RNA, 19 nt, Homo sapiens
guggcaagcgcaugaauga

SEQ ID NO: 1415031 - RNA, 19 nt, Homo sapiens
agaccugcuuggacuguaa

SEQ ID NO: 1415032 - RNA, 19 nt, Homo sapiens
ugacucagaggacagcuuu

SEQ ID NO: 1415033 - RNA, 19 nt, Homo sapiens
cccagcacauucggauuua

SEQ ID NO: 1415034 - RNA, 19 nt, Homo sapiens
ugacccggcuauacaagga

SEQ ID NO: 1415035 - RNA, 19 nt, Homo sapiens
ggacauugaaggccugaca

SEQ ID NO: 1415036 - RNA, 19 nt, Homo sapiens
uggaggagaaccuguguaa

SEQ ID NO: 1415037 - RNA, 19 nt, Homo sapiens
ccaauggccaugugucuca

SEQ ID NO: 1415038 - RNA, 19 nt, Homo sapiens
cgaaaugugccgggagaaa

SEQ ID NO: 1415039 - RNA, 19 nt, Homo sapiens
cgagaggagcucaugaaga

SEQ ID NO: 1415040 - RNA, 19 nt, Homo sapiens
cccugaaccuagacaguuu

SEQ ID NO: 1415041 - RNA, 19 nt, Homo sapiens
ggaugcaggccuauuccaa

SEQ ID NO: 1415042 - RNA, 19 nt, Homo sapiens
ucagugaucuuggagugau

SEQ ID NO: 1415043 - RNA, 19 nt, Homo sapiens
ugaugaugguaacugauga

SEQ ID NO: 1415044 - RNA, 19 nt, Homo sapiens
cagaggagcaagcuaguag

SEQ ID NO: 1415045 - RNA, 19 nt, Homo sapiens
ggucaguggugccgaagac

SEQ ID NO: 1415046 - RNA, 19 nt, Homo sapiens
uaucucagccuccaugaca

SEQ ID NO: 1415047 - RNA, 19 nt, Homo sapiens
cuacauugccuaaauccau

SEQ ID NO: 1415048 - RNA, 19 nt, Homo sapiens
ccagcacauucggauuuaa

SEQ ID NO: 1415049 - RNA, 19 nt, Homo sapiens
cagagaacuuuccagaacu

SEQ ID NO: 1415050 - RNA, 19 nt, Homo sapiens
gguauguucuugguucagu

SEQ ID NO: 1415051 - RNA, 19 nt, Homo sapiens
gaaauagccuggggugucu

SEQ ID NO: 1415052 - RNA, 19 nt, Homo sapiens
aggagaaccuguguaagau

SEQ ID NO: 1415053 - RNA, 19 nt, Homo sapiens
gcucgcaacuuugucaacu

SEQ ID NO: 1415054 - RNA, 19 nt, Homo sapiens
uugcaucgguuucuucagu

SEQ ID NO: 1415055 - RNA, 19 nt, Homo sapiens
gaugaugguaacugaugaa

SEQ ID NO: 1415056 - RNA, 19 nt, Homo sapiens
gagagugacccggcuauac

SEQ ID NO: 1415057 - RNA, 19 nt, Homo sapiens
agaaucagcaggccaaugg

SEQ ID NO: 1415058 - RNA, 19 nt, Homo sapiens
gugaugaugguaacugaug

SEQ ID NO: 1415059 - RNA, 19 nt, Homo sapiens
ggagaaccuguguaagauc

SEQ ID NO: 1415060 - RNA, 19 nt, Homo sapiens
ccaggaugcaggccuauuc

SEQ ID NO: 1415061 - RNA, 19 nt, Homo sapiens
ccaugugucucaggaucaa

SEQ ID NO: 1415062 - RNA, 19 nt, Homo sapiens
cuugcuacauugccuaaau

SEQ ID NO: 1415063 - RNA, 19 nt, Homo sapiens
gaccuguucgagccaagua

SEQ ID NO: 1415064 - RNA, 19 nt, Homo sapiens
cugcuuggacuguaagaaa

SEQ ID NO: 1415065 - RNA, 19 nt, Homo sapiens
gaguaccugcugaggauga

SEQ ID NO: 1415066 - RNA, 19 nt, Homo sapiens
ugacagugcggcagcugaa

SEQ ID NO: 1415067 - RNA, 19 nt, Homo sapiens
ccgaagggccucucugucu

SEQ ID NO: 1415068 - RNA, 19 nt, Homo sapiens
ggacucgugccuccaccuu

SEQ ID NO: 1415069 - RNA, 19 nt, Homo sapiens
aaagucucuugcuacauug

SEQ ID NO: 1415070 - RNA, 19 nt, Homo sapiens
cugaugaacagagaacuuu

SEQ ID NO: 1415071 - RNA, 19 nt, Homo sapiens
agacaaagcucaucacuua

SEQ ID NO: 1415072 - RNA, 19 nt, Homo sapiens
gaaagacccuauaagugua

SEQ ID NO: 1415073 - RNA, 19 nt, Homo sapiens
gagaaacccuauauaugua

SEQ ID NO: 1415074 - RNA, 19 nt, Homo sapiens
gaaagauccugcauauaug

SEQ ID NO: 1415075 - RNA, 19 nt, Homo sapiens
ggucaucccuuacuaauca

SEQ ID NO: 1415076 - RNA, 19 nt, Homo sapiens
gggaaagccuucagccaua

SEQ ID NO: 1415077 - RNA, 19 nt, Homo sapiens
caacagagauuugcuaaag

SEQ ID NO: 1415078 - RNA, 19 nt, Homo sapiens
gcacaucaaagaauucaua

SEQ ID NO: 1415079 - RNA, 19 nt, Homo sapiens
gagaaaugcuauaggugua

SEQ ID NO: 1415080 - RNA, 19 nt, Homo sapiens
ggagagaaacccuauauau

SEQ ID NO: 1415081 - RNA, 19 nt, Homo sapiens
ucagaaagauccugcauau

SEQ ID NO: 1415082 - RNA, 19 nt, Homo sapiens
gcuugagagugauuuauua

SEQ ID NO: 1415083 - RNA, 19 nt, Homo sapiens
ccaaaguucugcucuuauu

SEQ ID NO: 1415084 - RNA, 19 nt, Homo sapiens
gagaaacccuaugaaugua

SEQ ID NO: 1415085 - RNA, 19 nt, Homo sapiens
agaaagauccugcauauau

SEQ ID NO: 1415086 - RNA, 19 nt, Homo sapiens
ggagaaagacccuauaagu

SEQ ID NO: 1415087 - RNA, 19 nt, Homo sapiens
caacaucaaagaacucaua

SEQ ID NO: 1415088 - RNA, 19 nt, Homo sapiens
gagaaacgcuauaaaugca

SEQ ID NO: 1415089 - RNA, 19 nt, Homo sapiens
gcagagaaacgcuauaaau

SEQ ID NO: 1415090 - RNA, 19 nt, Homo sapiens
gugaaagccuuaaaccaaa

SEQ ID NO: 1415091 - RNA, 19 nt, Homo sapiens
gagagaaacccuauauaug

SEQ ID NO: 1415092 - RNA, 19 nt, Homo sapiens
caacaucagaggauucaua

SEQ ID NO: 1415093 - RNA, 19 nt, Homo sapiens
gagagaaacccuaugaaug

SEQ ID NO: 1415094 - RNA, 19 nt, Homo sapiens
gagaaaccauaucgauguu

SEQ ID NO: 1415095 - RNA, 19 nt, Homo sapiens
gagaaagacccuauaagug

SEQ ID NO: 1415096 - RNA, 19 nt, Homo sapiens
gguaaauccuucagucgaa

SEQ ID NO: 1415097 - RNA, 19 nt, Homo sapiens
gaaaugcuauagguguaaa

SEQ ID NO: 1415098 - RNA, 19 nt, Homo sapiens
ccaaagugcagcucuuaua

SEQ ID NO: 1415099 - RNA, 19 nt, Homo sapiens
gagaaugcauacuggagaa

SEQ ID NO: 1415100 - RNA, 19 nt, Homo sapiens
gcucaucccuucguuauca

SEQ ID NO: 1415101 - RNA, 19 nt, Homo sapiens
gaauguggcaacaccuuua

SEQ ID NO: 1415102 - RNA, 19 nt, Homo sapiens
ggcaacaccuuuaagucua

SEQ ID NO: 1415103 - RNA, 19 nt, Homo sapiens
ggagagaaacccuaugaau

SEQ ID NO: 1415104 - RNA, 19 nt, Homo sapiens
caaagcucaucacuuauug

SEQ ID NO: 1415105 - RNA, 19 nt, Homo sapiens
caacaucagagaaugcaua

SEQ ID NO: 1415106 - RNA, 19 nt, Homo sapiens
ggaaaagccuucagacaga

SEQ ID NO: 1415107 - RNA, 19 nt, Homo sapiens
cugcauauaugaagagaaa

SEQ ID NO: 1415108 - RNA, 19 nt, Homo sapiens
ccauaucgauguuuagaau

SEQ ID NO: 1415109 - RNA, 19 nt, Homo sapiens
ugaaugugguaaagccuua

SEQ ID NO: 1415110 - RNA, 19 nt, Homo sapiens
acagagauuugcuaaagaa

SEQ ID NO: 1415111 - RNA, 19 nt, Homo sapiens
cauagugcaucccuuugua

SEQ ID NO: 1415112 - RNA, 19 nt, Homo sapiens
gaaaucagucuucauuaag

SEQ ID NO: 1415113 - RNA, 19 nt, Homo sapiens
gaacuucauaucagaaaga

SEQ ID NO: 1415114 - RNA, 19 nt, Homo sapiens
agccagaggucaucccuua

SEQ ID NO: 1415115 - RNA, 19 nt, Homo sapiens
gaaacccuaugaauguaau

SEQ ID NO: 1415116 - RNA, 19 nt, Homo sapiens
uaaagaaugugguaaaucc

SEQ ID NO: 1415117 - RNA, 19 nt, Homo sapiens
agagaaacccuauauaugu

SEQ ID NO: 1415118 - RNA, 19 nt, Homo sapiens
gugcagcucuuauacaaca

SEQ ID NO: 1415119 - RNA, 19 nt, Homo sapiens
agaaagacccuauaagugu

SEQ ID NO: 1415120 - RNA, 19 nt, Homo sapiens
gauguaagagcacaccuaa

SEQ ID NO: 1415121 - RNA, 19 nt, Homo sapiens
ggagagaaaccauaucgau

SEQ ID NO: 1415122 - RNA, 19 nt, Homo sapiens
agagaaacccuaugaaugu

SEQ ID NO: 1415123 - RNA, 19 nt, Homo sapiens
cuuaauagacaccgaauaa

SEQ ID NO: 1415124 - RNA, 19 nt, Homo sapiens
gagagaagccuuuuaaaug

SEQ ID NO: 1415125 - RNA, 19 nt, Homo sapiens
ccacucaacacuuauuauu

SEQ ID NO: 1415126 - RNA, 19 nt, Homo sapiens
gagaaaagcccuauagaug

SEQ ID NO: 1415127 - RNA, 19 nt, Homo sapiens
gcaacaccuuuaagucuag

SEQ ID NO: 1415128 - RNA, 19 nt, Homo sapiens
cagagaaacgcuauaaaug

SEQ ID NO: 1415129 - RNA, 19 nt, Homo sapiens
guucugcucuuauucaaca

SEQ ID NO: 1415130 - RNA, 19 nt, Homo sapiens
acucaucgcuuaguaauca

SEQ ID NO: 1415131 - RNA, 19 nt, Homo sapiens
ggaaagccuucagccauag

SEQ ID NO: 1415132 - RNA, 19 nt, Homo sapiens
uaaaugcaguacaugugaa

SEQ ID NO: 1415133 - RNA, 19 nt, Homo sapiens
ccugggagguggagaaaga

SEQ ID NO: 1415134 - RNA, 19 nt, Homo sapiens
uaaagaaacagcaggacaa

SEQ ID NO: 1415135 - RNA, 19 nt, Homo sapiens
caaagucaacucaaacuca

SEQ ID NO: 1415136 - RNA, 19 nt, Homo sapiens
agguguaacucaucgcuua

SEQ ID NO: 1415137 - RNA, 19 nt, Homo sapiens
gacaaaacauucaggugua

SEQ ID NO: 1415138 - RNA, 19 nt, Homo sapiens
gagaagccuuuuaaaugua

SEQ ID NO: 1415139 - RNA, 19 nt, Homo sapiens
acaaagcucaucacuuauu

SEQ ID NO: 1415140 - RNA, 19 nt, Homo sapiens
gggaugugaugcuggagaa

SEQ ID NO: 1415141 - RNA, 19 nt, Homo sapiens
caacucaaacucaggauuc

SEQ ID NO: 1415142 - RNA, 19 nt, Homo sapiens
gauccugcauauaugaaga

SEQ ID NO: 1415143 - RNA, 19 nt, Homo sapiens
caucaaagaauucauacug

SEQ ID NO: 1415144 - RNA, 19 nt, Homo sapiens
uuacagcacuucccuuucu

SEQ ID NO: 1415145 - RNA, 19 nt, Homo sapiens
ucuuaguucucaucagaua

SEQ ID NO: 1415146 - RNA, 19 nt, Homo sapiens
gaaaagcccuauagaugca

SEQ ID NO: 1415147 - RNA, 19 nt, Homo sapiens
agccaaaguucugcucuua

SEQ ID NO: 1415148 - RNA, 19 nt, Homo sapiens
cacaauucaucccuucgua

SEQ ID NO: 1415149 - RNA, 19 nt, Homo sapiens
aauacaugcuugagaguga

SEQ ID NO: 1415150 - RNA, 19 nt, Homo sapiens
guggagaaaugcuauaggu

SEQ ID NO: 1415151 - RNA, 19 nt, Homo sapiens
caucagagaauacaugcuu

SEQ ID NO: 1415152 - RNA, 19 nt, Homo sapiens
cagaggucaucccuuacua

SEQ ID NO: 1415153 - RNA, 19 nt, Homo sapiens
gcaugugggaaacucuuua

SEQ ID NO: 1415154 - RNA, 19 nt, Homo sapiens
uaacgaaugugacaaaaca

SEQ ID NO: 1415155 - RNA, 19 nt, Homo sapiens
gaaaauucaucucagaaag

SEQ ID NO: 1415156 - RNA, 19 nt, Homo sapiens
ucaagaaaauccccauaaa

SEQ ID NO: 1415157 - RNA, 19 nt, Homo sapiens
caauucaucccuucguaaa

SEQ ID NO: 1415158 - RNA, 19 nt, Homo sapiens
cagcagagaaacgcuauaa

SEQ ID NO: 1415159 - RNA, 19 nt, Homo sapiens
gaggauucauacaggagaa

SEQ ID NO: 1415160 - RNA, 19 nt, Homo sapiens
gcgaauucauacuggagaa

SEQ ID NO: 1415161 - RNA, 19 nt, Homo sapiens
gaaagcuggcuccuucuca

SEQ ID NO: 1415162 - RNA, 19 nt, Homo sapiens
guagauagaagccauaaaa

SEQ ID NO: 1415163 - RNA, 19 nt, Homo sapiens
acucuuaguucucaucaga

SEQ ID NO: 1415164 - RNA, 19 nt, Homo sapiens
ugugaaagccuuaaaccaa

SEQ ID NO: 1415165 - RNA, 19 nt, Homo sapiens
guaacucaucgcuuaguaa

SEQ ID NO: 1415166 - RNA, 19 nt, Homo sapiens
gcucuuauacaacaucaga

SEQ ID NO: 1415167 - RNA, 19 nt, Homo sapiens
aagugcagcucuuauacaa

SEQ ID NO: 1415168 - RNA, 19 nt, Homo sapiens
ggccaaagugcagcucuua

SEQ ID NO: 1415169 - RNA, 19 nt, Homo sapiens
caucagagaaugcauacug

SEQ ID NO: 1415170 - RNA, 19 nt, Homo sapiens
gcucuuauucaacaucaaa

SEQ ID NO: 1415171 - RNA, 19 nt, Homo sapiens
gaaagaagcugcccugugu

SEQ ID NO: 1415172 - RNA, 19 nt, Homo sapiens
ggaaacaucuuagaaauca

SEQ ID NO: 1415173 - RNA, 19 nt, Homo sapiens
gaaagaaauuggccuguau

SEQ ID NO: 1415174 - RNA, 19 nt, Homo sapiens
guagagagcugacagaugu

SEQ ID NO: 1415175 - RNA, 19 nt, Homo sapiens
uaaagaagcugaagaacga

SEQ ID NO: 1415176 - RNA, 19 nt, Homo sapiens
gagaugugcucaauguaua

SEQ ID NO: 1415177 - RNA, 19 nt, Homo sapiens
guagagaggugcaauaugu

SEQ ID NO: 1415178 - RNA, 19 nt, Homo sapiens
cuacaaagcugagaaguau

SEQ ID NO: 1415179 - RNA, 19 nt, Homo sapiens
gauaauauguuggcucuau

SEQ ID NO: 1415180 - RNA, 19 nt, Homo sapiens
gaugauuucuuccagcuuu

SEQ ID NO: 1415181 - RNA, 19 nt, Homo sapiens
ggaccuacauucucuuuca

SEQ ID NO: 1415182 - RNA, 19 nt, Homo sapiens
cagaagcucucccuacaaa

SEQ ID NO: 1415183 - RNA, 19 nt, Homo sapiens
gcaggaaacaucuuagaaa

SEQ ID NO: 1415184 - RNA, 19 nt, Homo sapiens
gaaauuaagagguacaugu

SEQ ID NO: 1415185 - RNA, 19 nt, Homo sapiens
gaguagcaauagaacaaua

SEQ ID NO: 1415186 - RNA, 19 nt, Homo sapiens
ccacuacucuuuguccaua

SEQ ID NO: 1415187 - RNA, 19 nt, Homo sapiens
ccagacaguucuuucguuu

SEQ ID NO: 1415188 - RNA, 19 nt, Homo sapiens
caucuacacuuucucuaaa

SEQ ID NO: 1415189 - RNA, 19 nt, Homo sapiens
gugauuggguuacagcaua

SEQ ID NO: 1415190 - RNA, 19 nt, Homo sapiens
uacaaugacuucaccagua

SEQ ID NO: 1415191 - RNA, 19 nt, Homo sapiens
gagaguagcuacaaugacu

SEQ ID NO: 1415192 - RNA, 19 nt, Homo sapiens
uagaagaggcugagaauga

SEQ ID NO: 1415193 - RNA, 19 nt, Homo sapiens
gaaauauccuagacagagu

SEQ ID NO: 1415194 - RNA, 19 nt, Homo sapiens
ugaaagaaauuggccugua

SEQ ID NO: 1415195 - RNA, 19 nt, Homo sapiens
ccaaguagcugggauuaca

SEQ ID NO: 1415196 - RNA, 19 nt, Homo sapiens
ggacgcggcugcuucaagu

SEQ ID NO: 1415197 - RNA, 19 nt, Homo sapiens
aggaaguucugaucuguua

SEQ ID NO: 1415198 - RNA, 19 nt, Homo sapiens
uuaaucagcugcgaaauau

SEQ ID NO: 1415199 - RNA, 19 nt, Homo sapiens
uaaaggaagaggaugauuu

SEQ ID NO: 1415200 - RNA, 19 nt, Homo sapiens
caggaaacaucuuagaaau

SEQ ID NO: 1415201 - RNA, 19 nt, Homo sapiens
ggagugcacuggcgcaauc

SEQ ID NO: 1415202 - RNA, 19 nt, Homo sapiens
gcuaacagcuuuuaucaga

SEQ ID NO: 1415203 - RNA, 19 nt, Homo sapiens
cagcauaaccaugaauaua

SEQ ID NO: 1415204 - RNA, 19 nt, Homo sapiens
ggccacagauuccaggauu

SEQ ID NO: 1415205 - RNA, 19 nt, Homo sapiens
gcucagagagguaguguug

SEQ ID NO: 1415206 - RNA, 19 nt, Homo sapiens
ccacacacagcuaauuuaa

SEQ ID NO: 1415207 - RNA, 19 nt, Homo sapiens
gaagacauccuggaagaau

SEQ ID NO: 1415208 - RNA, 19 nt, Homo sapiens
gaucaaauuuaggaaguuc

SEQ ID NO: 1415209 - RNA, 19 nt, Homo sapiens
aagaagacauccuggaaga

SEQ ID NO: 1415210 - RNA, 19 nt, Homo sapiens
gcaacuguguaauuccuau

SEQ ID NO: 1415211 - RNA, 19 nt, Homo sapiens
uugcugaaauacaccauua

SEQ ID NO: 1415212 - RNA, 19 nt, Homo sapiens
ugagugagcugcuaugacu

SEQ ID NO: 1415213 - RNA, 19 nt, Homo sapiens
gccuuccucucuacauuua

SEQ ID NO: 1415214 - RNA, 19 nt, Homo sapiens
gccauuaagcauaguauuu

SEQ ID NO: 1415215 - RNA, 19 nt, Homo sapiens
agacaguucuuucguuuua

SEQ ID NO: 1415216 - RNA, 19 nt, Homo sapiens
ggaaaagcauuaugacugu

SEQ ID NO: 1415217 - RNA, 19 nt, Homo sapiens
gccagaagcucucccuaca

SEQ ID NO: 1415218 - RNA, 19 nt, Homo sapiens
caaugucuguugaguacuu

SEQ ID NO: 1415219 - RNA, 19 nt, Homo sapiens
cagcacuucuccucuggua

SEQ ID NO: 1415220 - RNA, 19 nt, Homo sapiens
ggcacuggcugucccauau

SEQ ID NO: 1415221 - RNA, 19 nt, Homo sapiens
aaucuucacuacaaccuuu

SEQ ID NO: 1415222 - RNA, 19 nt, Homo sapiens
uaccacaacuugcugaaau

SEQ ID NO: 1415223 - RNA, 19 nt, Homo sapiens
ccaccaccaugcccaacua

SEQ ID NO: 1415224 - RNA, 19 nt, Homo sapiens
gcauaaccaugaauauagg

SEQ ID NO: 1415225 - RNA, 19 nt, Homo sapiens
gaugcaggauccagacaga

SEQ ID NO: 1415226 - RNA, 19 nt, Homo sapiens
gccuggagcuccuaacaga

SEQ ID NO: 1415227 - RNA, 19 nt, Homo sapiens
gggaucaaauuuaggaagu

SEQ ID NO: 1415228 - RNA, 19 nt, Homo sapiens
ccaaagugcugggauuaca

SEQ ID NO: 1415229 - RNA, 19 nt, Homo sapiens
uaaaucuuguccuggcuaa

SEQ ID NO: 1415230 - RNA, 19 nt, Homo sapiens
uaaagcacuuaaaggaaga

SEQ ID NO: 1415231 - RNA, 19 nt, Homo sapiens
gugcugggauuacagaugu

SEQ ID NO: 1415232 - RNA, 19 nt, Homo sapiens
caccaugcccaacuaauuu

SEQ ID NO: 1415233 - RNA, 19 nt, Homo sapiens
uauguuggcucuauuggau

SEQ ID NO: 1415234 - RNA, 19 nt, Homo sapiens
guugaguacuucauacaug

SEQ ID NO: 1415235 - RNA, 19 nt, Homo sapiens
gcacuuaaaggaagaggau

SEQ ID NO: 1415236 - RNA, 19 nt, Homo sapiens
guauaggauugagcucuaa

SEQ ID NO: 1415237 - RNA, 19 nt, Homo sapiens
aaacucguauucuaccuau

SEQ ID NO: 1415238 - RNA, 19 nt, Homo sapiens
gaaguucugaucuguuaau

SEQ ID NO: 1415239 - RNA, 19 nt, Homo sapiens
ccaccaugcccaacuaauu

SEQ ID NO: 1415240 - RNA, 19 nt, Homo sapiens
guaagcaucuuugacugau

SEQ ID NO: 1415241 - RNA, 19 nt, Homo sapiens
gguacugucuccuuuuaua

SEQ ID NO: 1415242 - RNA, 19 nt, Homo sapiens
acuacaaucuucacuacaa

SEQ ID NO: 1415243 - RNA, 19 nt, Homo sapiens
ucacuacaaucuucacuac

SEQ ID NO: 1415244 - RNA, 19 nt, Homo sapiens
guaauaucuuugccagguu

SEQ ID NO: 1415245 - RNA, 19 nt, Homo sapiens
ggaucaaauuuaggaaguu

SEQ ID NO: 1415246 - RNA, 19 nt, Homo sapiens
gauaggguuucaccguguu

SEQ ID NO: 1415247 - RNA, 19 nt, Homo sapiens
gaagacugccuggauccua

SEQ ID NO: 1415248 - RNA, 19 nt, Homo sapiens
gaagaacgaggagcaggaa

SEQ ID NO: 1415249 - RNA, 19 nt, Homo sapiens
ucaggagucucuaaagaag

SEQ ID NO: 1415250 - RNA, 19 nt, Homo sapiens
uguuggcucuauuggauua

SEQ ID NO: 1415251 - RNA, 19 nt, Homo sapiens
gcuaugacuuugguagaga

SEQ ID NO: 1415252 - RNA, 19 nt, Homo sapiens
gagcugcuaugacuuuggu

SEQ ID NO: 1415253 - RNA, 19 nt, Homo sapiens
uuggguagcuucaaacuca

SEQ ID NO: 1415254 - RNA, 19 nt, Homo sapiens
guucucaucuauguuaaug

SEQ ID NO: 1415255 - RNA, 19 nt, Homo sapiens
ucuguguucucaauucuuu

SEQ ID NO: 1415256 - RNA, 19 nt, Homo sapiens
auacaugccuagucugaau

SEQ ID NO: 1415257 - RNA, 19 nt, Homo sapiens
uguauaggauugagcucua

SEQ ID NO: 1415258 - RNA, 19 nt, Homo sapiens
ccaagaagacugccuggau

SEQ ID NO: 1415259 - RNA, 19 nt, Homo sapiens
gcacuucuccucugguaag

SEQ ID NO: 1415260 - RNA, 19 nt, Homo sapiens
gcuaaaguaucuggaccuu

SEQ ID NO: 1415261 - RNA, 19 nt, Homo sapiens
cuguuaauguggcuuagua

SEQ ID NO: 1415262 - RNA, 19 nt, Homo sapiens
ggauugagcucuaaaacca

SEQ ID NO: 1415263 - RNA, 19 nt, Homo sapiens
ccauuaagcauaguauuug

SEQ ID NO: 1415264 - RNA, 19 nt, Homo sapiens
ggugagaguaagcaucuuu

SEQ ID NO: 1415265 - RNA, 19 nt, Homo sapiens
ugauuggguuacagcauaa

SEQ ID NO: 1415266 - RNA, 19 nt, Homo sapiens
gaccuacauucucuuucaa

SEQ ID NO: 1415267 - RNA, 19 nt, Homo sapiens
agaagaggcugagaaugau

SEQ ID NO: 1415268 - RNA, 19 nt, Homo sapiens
uuuaaucagcugcgaaaua

SEQ ID NO: 1415269 - RNA, 19 nt, Homo sapiens
uuucaggagucucuaaaga

SEQ ID NO: 1415270 - RNA, 19 nt, Homo sapiens
aaaggaagaggaugauuuc

SEQ ID NO: 1415271 - RNA, 19 nt, Homo sapiens
gaagagaacuguagacaug

SEQ ID NO: 1415272 - RNA, 19 nt, Homo sapiens
caccaaagauugacagaaa

SEQ ID NO: 1415273 - RNA, 19 nt, Homo sapiens
gaagaugaagguagaaauu

SEQ ID NO: 1415274 - RNA, 19 nt, Homo sapiens
gcaauacauuucuguuguu

SEQ ID NO: 1415275 - RNA, 19 nt, Homo sapiens
gcagccaucuuguggauau

SEQ ID NO: 1415276 - RNA, 19 nt, Homo sapiens
cagcagcacuggaauccua

SEQ ID NO: 1415277 - RNA, 19 nt, Homo sapiens
gcacuggaauccuaaugga

SEQ ID NO: 1415278 - RNA, 19 nt, Homo sapiens
ggacauaccggauaaaauu

SEQ ID NO: 1415279 - RNA, 19 nt, Homo sapiens
gaaugaaccagcuauggaa

SEQ ID NO: 1415280 - RNA, 19 nt, Homo sapiens
ccaaauagacuacaaaucg

SEQ ID NO: 1415281 - RNA, 19 nt, Homo sapiens
ccaaggaacaccaaagauu

SEQ ID NO: 1415282 - RNA, 19 nt, Homo sapiens
gaagaugucauuagucaag

SEQ ID NO: 1415283 - RNA, 19 nt, Homo sapiens
ggcaauacauuucuguugu

SEQ ID NO: 1415284 - RNA, 19 nt, Homo sapiens
caaggaacaccaaagauug

SEQ ID NO: 1415285 - RNA, 19 nt, Homo sapiens
uguauucucugacccagua

SEQ ID NO: 1415286 - RNA, 19 nt, Homo sapiens
cuaaacaacuuaugcacau

SEQ ID NO: 1415287 - RNA, 19 nt, Homo sapiens
gaguuaggguuguugaaga

SEQ ID NO: 1415288 - RNA, 19 nt, Homo sapiens
uaacaucuaccaaacaguu

SEQ ID NO: 1415289 - RNA, 19 nt, Homo sapiens
caaugugacuggugucugu

SEQ ID NO: 1415290 - RNA, 19 nt, Homo sapiens
gcuauggaauugucugugu

SEQ ID NO: 1415291 - RNA, 19 nt, Homo sapiens
gaacaccaugugaagauga

SEQ ID NO: 1415292 - RNA, 19 nt, Homo sapiens
ugaaccagcuauggaauug

SEQ ID NO: 1415293 - RNA, 19 nt, Homo sapiens
ggaagagccaaauagacua

SEQ ID NO: 1415294 - RNA, 19 nt, Homo sapiens
cuagaacugugaggcaaua

SEQ ID NO: 1415295 - RNA, 19 nt, Homo sapiens
gagaacaccaugugaagau

SEQ ID NO: 1415296 - RNA, 19 nt, Homo sapiens
ggaaauugccagucuuaag

SEQ ID NO: 1415297 - RNA, 19 nt, Homo sapiens
ggaagaagagaacuguaga

SEQ ID NO: 1415298 - RNA, 19 nt, Homo sapiens
ugaauggugucucccaaga

SEQ ID NO: 1415299 - RNA, 19 nt, Homo sapiens
gguagaaauuacagugaug

SEQ ID NO: 1415300 - RNA, 19 nt, Homo sapiens
ugagugagguggguuucua

SEQ ID NO: 1415301 - RNA, 19 nt, Homo sapiens
gaaauugccagucuuaagc

SEQ ID NO: 1415302 - RNA, 19 nt, Homo sapiens
ggacuuugagccucuagaa

SEQ ID NO: 1415303 - RNA, 19 nt, Homo sapiens
agagaggcaugaaacauuc

SEQ ID NO: 1415304 - RNA, 19 nt, Homo sapiens
uugaagaugucauuaguca

SEQ ID NO: 1415305 - RNA, 19 nt, Homo sapiens
gagggaagagccaaauaga

SEQ ID NO: 1415306 - RNA, 19 nt, Homo sapiens
gacacagguccacauauaa

SEQ ID NO: 1415307 - RNA, 19 nt, Homo sapiens
uggaugcuguauuagauaa

SEQ ID NO: 1415308 - RNA, 19 nt, Homo sapiens
gggaagagccaaauagacu

SEQ ID NO: 1415309 - RNA, 19 nt, Homo sapiens
uagagaggcaugaaacauu

SEQ ID NO: 1415310 - RNA, 19 nt, Homo sapiens
agauggacauaccggauaa

SEQ ID NO: 1415311 - RNA, 19 nt, Homo sapiens
gcaccuucaucuuggacuu

SEQ ID NO: 1415312 - RNA, 19 nt, Homo sapiens
cagcagccaucuuguggau

SEQ ID NO: 1415313 - RNA, 19 nt, Homo sapiens
gaacugugaggcaauacau

SEQ ID NO: 1415314 - RNA, 19 nt, Homo sapiens
cagauggacauaccggaua

SEQ ID NO: 1415315 - RNA, 19 nt, Homo sapiens
acaaaucgguuaaaacaga

SEQ ID NO: 1415316 - RNA, 19 nt, Homo sapiens
ggagaacaccaugugaaga

SEQ ID NO: 1415317 - RNA, 19 nt, Homo sapiens
uuguggagcuacugaauga

SEQ ID NO: 1415318 - RNA, 19 nt, Homo sapiens
ugaaugaaccagcuaugga

SEQ ID NO: 1415319 - RNA, 19 nt, Homo sapiens
aauggaugcuguauuagau

SEQ ID NO: 1415320 - RNA, 19 nt, Homo sapiens
acagugaugugucuacaag

SEQ ID NO: 1415321 - RNA, 19 nt, Homo sapiens
gagccaaauagacuacaaa

SEQ ID NO: 1415322 - RNA, 19 nt, Homo sapiens
gaauggugucucccaagaa

SEQ ID NO: 1415323 - RNA, 19 nt, Homo sapiens
gugacauuguuuggaguua

SEQ ID NO: 1415324 - RNA, 19 nt, Homo sapiens
gaagagccaaauagacuac

SEQ ID NO: 1415325 - RNA, 19 nt, Homo sapiens
ugaaacauucucccucaga

SEQ ID NO: 1415326 - RNA, 19 nt, Homo sapiens
gaugaagguagaaauuaca

SEQ ID NO: 1415327 - RNA, 19 nt, Homo sapiens
agaugaagguagaaauuac

SEQ ID NO: 1415328 - RNA, 19 nt, Homo sapiens
guaagaguguggggaaauu

SEQ ID NO: 1415329 - RNA, 19 nt, Homo sapiens
ggaguuaggguuguugaag

SEQ ID NO: 1415330 - RNA, 19 nt, Homo sapiens
uaaggagaacaccauguga

SEQ ID NO: 1415331 - RNA, 19 nt, Homo sapiens
gagguggguuucuaaucca

SEQ ID NO: 1415332 - RNA, 19 nt, Homo sapiens
ugagguggguuucuaaucc

SEQ ID NO: 1415333 - RNA, 19 nt, Homo sapiens
uguuuaagccacccaguuu

SEQ ID NO: 1415334 - RNA, 19 nt, Homo sapiens
gagugagguggguuucuaa

SEQ ID NO: 1415335 - RNA, 19 nt, Homo sapiens
uguugaagaugucauuagu

SEQ ID NO: 1415336 - RNA, 19 nt, Homo sapiens
aaauuacagugaugugucu

SEQ ID NO: 1415337 - RNA, 19 nt, Homo sapiens
caacgugacauuguuugga

SEQ ID NO: 1415338 - RNA, 19 nt, Homo sapiens
auaaaauucuggacuggua

SEQ ID NO: 1415339 - RNA, 19 nt, Homo sapiens
gcauucagauggacauacc

SEQ ID NO: 1415340 - RNA, 19 nt, Homo sapiens
ggaggugugaauugguaaa

SEQ ID NO: 1415341 - RNA, 19 nt, Homo sapiens
auggaggugugaauuggua

SEQ ID NO: 1415342 - RNA, 19 nt, Homo sapiens
gacauuguuuggaguuagg

SEQ ID NO: 1415343 - RNA, 19 nt, Homo sapiens
aaggaacaccaaagauuga

SEQ ID NO: 1415344 - RNA, 19 nt, Homo sapiens
gcugauggaggugugaauu

SEQ ID NO: 1415345 - RNA, 19 nt, Homo sapiens
gaagaagagaacuguagac

SEQ ID NO: 1415346 - RNA, 19 nt, Homo sapiens
ugacauuguuuggaguuag

SEQ ID NO: 1415347 - RNA, 19 nt, Homo sapiens
gguuucuaauccaauguga

SEQ ID NO: 1415348 - RNA, 19 nt, Homo sapiens
aauggugucucccaagaag

SEQ ID NO: 1415349 - RNA, 19 nt, Homo sapiens
guggguuucuaauccaaug

SEQ ID NO: 1415350 - RNA, 19 nt, Homo sapiens
ugauggaggugugaauugg

SEQ ID NO: 1415351 - RNA, 19 nt, Homo sapiens
gggaaauugccagucuuaa

SEQ ID NO: 1415352 - RNA, 19 nt, Homo sapiens
acagagaacuaaaauugug

SEQ ID NO: 1415353 - RNA, 19 nt, Homo sapiens
ugagggaagagccaaauag

SEQ ID NO: 1415354 - RNA, 19 nt, Homo sapiens
acugugaggcaauacauuu

SEQ ID NO: 1415355 - RNA, 19 nt, Homo sapiens
cauauaaggagaacaccau

SEQ ID NO: 1415356 - RNA, 19 nt, Homo sapiens
guagaaauuacagugaugu

SEQ ID NO: 1415357 - RNA, 19 nt, Homo sapiens
ccacauauaaggagaacac

SEQ ID NO: 1415358 - RNA, 19 nt, Homo sapiens
acacagguccacauauaag

SEQ ID NO: 1415359 - RNA, 19 nt, Homo sapiens
cuacaaaucgguuaaaaca

SEQ ID NO: 1415360 - RNA, 19 nt, Homo sapiens
gacagaaaaucaccagaag

SEQ ID NO: 1415361 - RNA, 19 nt, Homo sapiens
gaggcaauacauuucuguu

SEQ ID NO: 1415362 - RNA, 19 nt, Homo sapiens
ugaagaugaagguagaaau

SEQ ID NO: 1415363 - RNA, 19 nt, Homo sapiens
aaggagaacaccaugugaa

SEQ ID NO: 1415364 - RNA, 19 nt, Homo sapiens
gaugucauuagucaagaug

SEQ ID NO: 1415365 - RNA, 19 nt, Homo sapiens
agaacaccaugugaagaug

SEQ ID NO: 1415366 - RNA, 19 nt, Homo sapiens
ggggaaauugccagucuua

SEQ ID NO: 1415367 - RNA, 19 nt, Homo sapiens
agagccaaauagacuacaa

SEQ ID NO: 1415368 - RNA, 19 nt, Homo sapiens
acaugcagcagccaucuug

SEQ ID NO: 1415369 - RNA, 19 nt, Homo sapiens
agagaacuguagacaugca

SEQ ID NO: 1415370 - RNA, 19 nt, Homo sapiens
gugaggcaauacauuucug

SEQ ID NO: 1415371 - RNA, 19 nt, Homo sapiens
gaagguggcuauuaucaug

SEQ ID NO: 1415372 - RNA, 19 nt, Homo sapiens
gugcagaguuuagcauuua

SEQ ID NO: 1415373 - RNA, 19 nt, Homo sapiens
uauuagauguggucacuua

SEQ ID NO: 1415374 - RNA, 19 nt, Homo sapiens
uagcuuaucuuccguguug

SEQ ID NO: 1415375 - RNA, 19 nt, Homo sapiens
ccaccaggcuccuagguuu

SEQ ID NO: 1415376 - RNA, 19 nt, Homo sapiens
gcgcucaucuuucuucguu

SEQ ID NO: 1415377 - RNA, 19 nt, Homo sapiens
gcacaagacgaacucagua

SEQ ID NO: 1415378 - RNA, 19 nt, Homo sapiens
gaaacacauuccuucuaga

SEQ ID NO: 1415379 - RNA, 19 nt, Homo sapiens
ugaaacacauuccuucuag

SEQ ID NO: 1415380 - RNA, 19 nt, Homo sapiens
acaaauguguuuacaguca

SEQ ID NO: 1415381 - RNA, 19 nt, Homo sapiens
gguuuggucucagcauuua

SEQ ID NO: 1415382 - RNA, 19 nt, Homo sapiens
uaucuuccguguugucuuu

SEQ ID NO: 1415383 - RNA, 19 nt, Homo sapiens
ucagugaguugaaaggaaa

SEQ ID NO: 1415384 - RNA, 19 nt, Homo sapiens
gugcuggauuuguagcuua

SEQ ID NO: 1415385 - RNA, 19 nt, Homo sapiens
ggccuugugugcuggauuu

SEQ ID NO: 1415386 - RNA, 19 nt, Homo sapiens
gcgcuggccuucacaguag

SEQ ID NO: 1415387 - RNA, 19 nt, Homo sapiens
agacgcaccuuguccagaa

SEQ ID NO: 1415388 - RNA, 19 nt, Homo sapiens
ugaauuauuuccugaaguc

SEQ ID NO: 1415389 - RNA, 19 nt, Homo sapiens
gcccagagaugaccccuua

SEQ ID NO: 1415390 - RNA, 19 nt, Homo sapiens
uuaugaagguggcuauuau

SEQ ID NO: 1415391 - RNA, 19 nt, Homo sapiens
uagauguggucacuuagaa

SEQ ID NO: 1415392 - RNA, 19 nt, Homo sapiens
acagaaagcacaagacgaa

SEQ ID NO: 1415393 - RNA, 19 nt, Homo sapiens
aaacacauuccuucuagaa

SEQ ID NO: 1415394 - RNA, 19 nt, Homo sapiens
gagcaucgcgcaggaguga

SEQ ID NO: 1415395 - RNA, 19 nt, Homo sapiens
acacauuccuucuagaaag

SEQ ID NO: 1415396 - RNA, 19 nt, Homo sapiens
guugaaaggaaauguguuu

SEQ ID NO: 1415397 - RNA, 19 nt, Homo sapiens
cccaguaucuauaugauca

SEQ ID NO: 1415398 - RNA, 19 nt, Homo sapiens
ccagaagcccguccuccua

SEQ ID NO: 1415399 - RNA, 19 nt, Homo sapiens
guauagagacgucggacuu

SEQ ID NO: 1415400 - RNA, 19 nt, Homo sapiens
acuuagaaaugcaaacuug

SEQ ID NO: 1415401 - RNA, 19 nt, Homo sapiens
gcuccuagguuuagcuuuu

SEQ ID NO: 1415402 - RNA, 19 nt, Homo sapiens
cuugugugcuggauuugua

SEQ ID NO: 1415403 - RNA, 19 nt, Homo sapiens
aaaccucccaguaucuaua

SEQ ID NO: 1415404 - RNA, 19 nt, Homo sapiens
gauguggucacuuagaaau

SEQ ID NO: 1415405 - RNA, 19 nt, Homo sapiens
uuucaaaccucccaguauc

SEQ ID NO: 1415406 - RNA, 19 nt, Homo sapiens
gaaagcacaagacgaacuc

SEQ ID NO: 1415407 - RNA, 19 nt, Homo sapiens
uggaggagauuaaacaaaa

SEQ ID NO: 1415408 - RNA, 19 nt, Homo sapiens
gcucaucuuucuucguuuu

SEQ ID NO: 1415409 - RNA, 19 nt, Homo sapiens
gaccggagucccugcagaa

SEQ ID NO: 1415410 - RNA, 19 nt, Homo sapiens
gguuugcagccuuugcuua

SEQ ID NO: 1415411 - RNA, 19 nt, Homo sapiens
gaagucguggaggagauua

SEQ ID NO: 1415412 - RNA, 19 nt, Homo sapiens
gucuuucuaucacggauuu

SEQ ID NO: 1415413 - RNA, 19 nt, Homo sapiens
ggauuuguagcuuaucuuc

SEQ ID NO: 1415414 - RNA, 19 nt, Homo sapiens
cuuaugaagguggcuauua

SEQ ID NO: 1415415 - RNA, 19 nt, Homo sapiens
uugcuuacacggucaagua

SEQ ID NO: 1415416 - RNA, 19 nt, Homo sapiens
ucaaaccucccaguaucua

SEQ ID NO: 1415417 - RNA, 19 nt, Homo sapiens
caccaggcuccuagguuua

SEQ ID NO: 1415418 - RNA, 19 nt, Homo sapiens
cagaagcccguccuccuau

SEQ ID NO: 1415419 - RNA, 19 nt, Homo sapiens
cacauuccuucuagaaagu

SEQ ID NO: 1415420 - RNA, 19 nt, Homo sapiens
ggguuuggucucagcauuu

SEQ ID NO: 1415421 - RNA, 19 nt, Homo sapiens
gaguugaaaggaaaugugu

SEQ ID NO: 1415422 - RNA, 19 nt, Homo sapiens
gggcugcuccugcguucuu

SEQ ID NO: 1415423 - RNA, 19 nt, Homo sapiens
gugaauuauuuccugaagu

SEQ ID NO: 1415424 - RNA, 19 nt, Homo sapiens
guguuuacagucagaauga

SEQ ID NO: 1415425 - RNA, 19 nt, Homo sapiens
caagacgaacucaguagca

SEQ ID NO: 1415426 - RNA, 19 nt, Homo sapiens
guggaggagauuaaacaaa

SEQ ID NO: 1415427 - RNA, 19 nt, Homo sapiens
gcagaguuuagcauuuaau

SEQ ID NO: 1415428 - RNA, 19 nt, Homo sapiens
agugcagaguuuagcauuu

SEQ ID NO: 1415429 - RNA, 19 nt, Homo sapiens
uaaccuauucuuguggaaa

SEQ ID NO: 1415430 - RNA, 19 nt, Homo sapiens
ccaacgggagguuuaagug

SEQ ID NO: 1415431 - RNA, 19 nt, Homo sapiens
ucucugaauuccuuauguc

SEQ ID NO: 1415432 - RNA, 19 nt, Homo sapiens
aaauguguuuacagucaga

SEQ ID NO: 1415433 - RNA, 19 nt, Homo sapiens
ugcagaguuuagcauuuaa

SEQ ID NO: 1415434 - RNA, 19 nt, Homo sapiens
uuggguaccugcagagcuu

SEQ ID NO: 1415435 - RNA, 19 nt, Homo sapiens
cuuuggaccuguuuuagua

SEQ ID NO: 1415436 - RNA, 19 nt, Homo sapiens
gagaugaccccuuaugaag

SEQ ID NO: 1415437 - RNA, 19 nt, Homo sapiens
agacgucggacuucacgaa

SEQ ID NO: 1415438 - RNA, 19 nt, Homo sapiens
gacgucggacuucacgaaa

SEQ ID NO: 1415439 - RNA, 19 nt, Homo sapiens
agaagcccguccuccuaug

SEQ ID NO: 1415440 - RNA, 19 nt, Homo sapiens
caaaccucccaguaucuau

SEQ ID NO: 1415441 - RNA, 19 nt, Homo sapiens
auagagacgucggacuuca

SEQ ID NO: 1415442 - RNA, 19 nt, Homo sapiens
ugagcuucaugguggagaa

SEQ ID NO: 1415443 - RNA, 19 nt, Homo sapiens
gaugcgaugucaugucuuu

SEQ ID NO: 1415444 - RNA, 19 nt, Homo sapiens
ucaaggaggcuauuuauga

SEQ ID NO: 1415445 - RNA, 19 nt, Homo sapiens
aagcuuaucuggagugaaa

SEQ ID NO: 1415446 - RNA, 19 nt, Homo sapiens
ggaguccuguuaauacaaa

SEQ ID NO: 1415447 - RNA, 19 nt, Homo sapiens
uaaaugagaccaacagaga

SEQ ID NO: 1415448 - RNA, 19 nt, Homo sapiens
guaauaaucccucuguuuc

SEQ ID NO: 1415449 - RNA, 19 nt, Homo sapiens
ggaaaagggucacugaaau

SEQ ID NO: 1415450 - RNA, 19 nt, Homo sapiens
gaaugugaaagguauauga

SEQ ID NO: 1415451 - RNA, 19 nt, Homo sapiens
gaaagcuuaucuggaguga

SEQ ID NO: 1415452 - RNA, 19 nt, Homo sapiens
gcaacaugaagaaagcuua

SEQ ID NO: 1415453 - RNA, 19 nt, Homo sapiens
ggagugaaaguaaaugaga

SEQ ID NO: 1415454 - RNA, 19 nt, Homo sapiens
gagaaauccugguuacacu

SEQ ID NO: 1415455 - RNA, 19 nt, Homo sapiens
gaaaugggacgacaugaac

SEQ ID NO: 1415456 - RNA, 19 nt, Homo sapiens
aaagaaacuugacuaagag

SEQ ID NO: 1415457 - RNA, 19 nt, Homo sapiens
gaacucaaggaggcuauuu

SEQ ID NO: 1415458 - RNA, 19 nt, Homo sapiens
ucagagcgaugugcuguga

SEQ ID NO: 1415459 - RNA, 19 nt, Homo sapiens
uaucuggagugaaaguaaa

SEQ ID NO: 1415460 - RNA, 19 nt, Homo sapiens
gaugugcugugaaaucuac

SEQ ID NO: 1415461 - RNA, 19 nt, Homo sapiens
gaaacuugacuaagagaca

SEQ ID NO: 1415462 - RNA, 19 nt, Homo sapiens
caaggaggcuauuuaugac

SEQ ID NO: 1415463 - RNA, 19 nt, Homo sapiens
ugaaaucuacuaccguuug

SEQ ID NO: 1415464 - RNA, 19 nt, Homo sapiens
gaaaucuacuaccguuugc

SEQ ID NO: 1415465 - RNA, 19 nt, Homo sapiens
agagcgaugugcugugaaa

SEQ ID NO: 1415466 - RNA, 19 nt, Homo sapiens
aaacuugacuaagagacaa

SEQ ID NO: 1415467 - RNA, 19 nt, Homo sapiens
gcgaugugcugugaaaucu

SEQ ID NO: 1415468 - RNA, 19 nt, Homo sapiens
ugaaaugggacgacaugaa

SEQ ID NO: 1415469 - RNA, 19 nt, Homo sapiens
gugaggaacugagaaacau

SEQ ID NO: 1415470 - RNA, 19 nt, Homo sapiens
gagggaggcagaagaggaa

SEQ ID NO: 1415471 - RNA, 19 nt, Homo sapiens
caacaugaagaaagcuuau

SEQ ID NO: 1415472 - RNA, 19 nt, Homo sapiens
gggacgacaugaacucaag

SEQ ID NO: 1415473 - RNA, 19 nt, Homo sapiens
aauaaucccucuguuucuu

SEQ ID NO: 1415474 - RNA, 19 nt, Homo sapiens
aguaauaaucccucuguuu

SEQ ID NO: 1415475 - RNA, 19 nt, Homo sapiens
gaccaugucauuugcaaca

SEQ ID NO: 1415476 - RNA, 19 nt, Homo sapiens
gaaaagggucacugaaaug

SEQ ID NO: 1415477 - RNA, 19 nt, Homo sapiens
uaaucccucuguuucuuau

SEQ ID NO: 1415478 - RNA, 19 nt, Homo sapiens
ggagaaauccugguuacac

SEQ ID NO: 1415479 - RNA, 19 nt, Homo sapiens
auacuggaguccuguuaau

SEQ ID NO: 1415480 - RNA, 19 nt, Homo sapiens
ggcagaagaggaagucaga

SEQ ID NO: 1415481 - RNA, 19 nt, Homo sapiens
cuacuaccguuugcugguu

SEQ ID NO: 1415482 - RNA, 19 nt, Homo sapiens
gcgaugucaugucuuuuaa

SEQ ID NO: 1415483 - RNA, 19 nt, Homo sapiens
ccggagaaauccugguuac

SEQ ID NO: 1415484 - RNA, 19 nt, Homo sapiens
auaaucccucuguuucuua

SEQ ID NO: 1415485 - RNA, 19 nt, Homo sapiens
agagugaggaacugagaaa

SEQ ID NO: 1415486 - RNA, 19 nt, Homo sapiens
ugaauccugucaguccuau

SEQ ID NO: 1415487 - RNA, 19 nt, Homo sapiens
aaagagugaggaacugaga

SEQ ID NO: 1415488 - RNA, 19 nt, Homo sapiens
guauaugagucccuuuuca

SEQ ID NO: 1415489 - RNA, 19 nt, Homo sapiens
gggaaugugaaagguauau

SEQ ID NO: 1415490 - RNA, 19 nt, Homo sapiens
ccucuguuucuuauguuua

SEQ ID NO: 1415491 - RNA, 19 nt, Homo sapiens
gaggaagucagagcgaugu

SEQ ID NO: 1415492 - RNA, 19 nt, Homo sapiens
uauacuggaguccuguuaa

SEQ ID NO: 1415493 - RNA, 19 nt, Homo sapiens
uaauaaucccucuguuucu

SEQ ID NO: 1415494 - RNA, 19 nt, Homo sapiens
acucaaggaggcuauuuau

SEQ ID NO: 1415495 - RNA, 19 nt, Homo sapiens
acgaugcgaugucaugucu

SEQ ID NO: 1415496 - RNA, 19 nt, Homo sapiens
ggaaugugaaagguauaug

SEQ ID NO: 1415497 - RNA, 19 nt, Homo sapiens
cuauacuggaguccuguua

SEQ ID NO: 1415498 - RNA, 19 nt, Homo sapiens
cuggaguccuguuaauaca

SEQ ID NO: 1415499 - RNA, 19 nt, Homo sapiens
ugguuacacugcuugaauc

SEQ ID NO: 1415500 - RNA, 19 nt, Homo sapiens
ugaaaguaaaugagaccaa

SEQ ID NO: 1415501 - RNA, 19 nt, Homo sapiens
gcagacaccuugagacuaa

SEQ ID NO: 1415502 - RNA, 19 nt, Homo sapiens
gaagaacucugcauugaga

SEQ ID NO: 1415503 - RNA, 19 nt, Homo sapiens
gaaagagccuucaguagau

SEQ ID NO: 1415504 - RNA, 19 nt, Homo sapiens
gaaaggaaguuauuugagu

SEQ ID NO: 1415505 - RNA, 19 nt, Homo sapiens
caucauagguguucuaaug

SEQ ID NO: 1415506 - RNA, 19 nt, Homo sapiens
gaauuucucugggaguuua

SEQ ID NO: 1415507 - RNA, 19 nt, Homo sapiens
gagcuaaggucauaucauc

SEQ ID NO: 1415508 - RNA, 19 nt, Homo sapiens
gagccaagauggaugauau

SEQ ID NO: 1415509 - RNA, 19 nt, Homo sapiens
gaaucuaggucucuguauu

SEQ ID NO: 1415510 - RNA, 19 nt, Homo sapiens
ggaaggaaccuaaccaguu

SEQ ID NO: 1415511 - RNA, 19 nt, Homo sapiens
caagauggaugauauugug

SEQ ID NO: 1415512 - RNA, 19 nt, Homo sapiens
gagcagauccagaaaguga

SEQ ID NO: 1415513 - RNA, 19 nt, Homo sapiens
ucaguaggcugucugguuu

SEQ ID NO: 1415514 - RNA, 19 nt, Homo sapiens
uggaacgugugaauuauua

SEQ ID NO: 1415515 - RNA, 19 nt, Homo sapiens
gaaacucuguucagcuuca

SEQ ID NO: 1415516 - RNA, 19 nt, Homo sapiens
ccagaaugcuuugguuaaa

SEQ ID NO: 1415517 - RNA, 19 nt, Homo sapiens
ccacagacauuucuugaac

SEQ ID NO: 1415518 - RNA, 19 nt, Homo sapiens
gauaaccgguuuccuugau

SEQ ID NO: 1415519 - RNA, 19 nt, Homo sapiens
agaaagagccuucaguaga

SEQ ID NO: 1415520 - RNA, 19 nt, Homo sapiens
ccagaaagagccuucagua

SEQ ID NO: 1415521 - RNA, 19 nt, Homo sapiens
gcagacauaguuuagcuuu

SEQ ID NO: 1415522 - RNA, 19 nt, Homo sapiens
uagaaacucuguucagcuu

SEQ ID NO: 1415523 - RNA, 19 nt, Homo sapiens
cauuugauguguccaauau

SEQ ID NO: 1415524 - RNA, 19 nt, Homo sapiens
caacaaaagugcuuagugu

SEQ ID NO: 1415525 - RNA, 19 nt, Homo sapiens
ggagguguguuuucagaua

SEQ ID NO: 1415526 - RNA, 19 nt, Homo sapiens
gagcagaccuaggcagaca

SEQ ID NO: 1415527 - RNA, 19 nt, Homo sapiens
cccaacaaaugccaaauug

SEQ ID NO: 1415528 - RNA, 19 nt, Homo sapiens
cuaggucucuguauuguuc

SEQ ID NO: 1415529 - RNA, 19 nt, Homo sapiens
gugcagaggccguugcuuu

SEQ ID NO: 1415530 - RNA, 19 nt, Homo sapiens
ucaacgcccucaugaacuu

SEQ ID NO: 1415531 - RNA, 19 nt, Homo sapiens
uugaagaacucugcauuga

SEQ ID NO: 1415532 - RNA, 19 nt, Homo sapiens
ucaguagauucacaagauu

SEQ ID NO: 1415533 - RNA, 19 nt, Homo sapiens
gaacucugcauugagaauu

SEQ ID NO: 1415534 - RNA, 19 nt, Homo sapiens
guguggagcuaaggucaua

SEQ ID NO: 1415535 - RNA, 19 nt, Homo sapiens
ccuguacccuguucccuaa

SEQ ID NO: 1415536 - RNA, 19 nt, Homo sapiens
ccaaauagggccucuccuu

SEQ ID NO: 1415537 - RNA, 19 nt, Homo sapiens
gcuggaacgugugaauuau

SEQ ID NO: 1415538 - RNA, 19 nt, Homo sapiens
caagaucaccugcaucagu

SEQ ID NO: 1415539 - RNA, 19 nt, Homo sapiens
gauggaugauauugugguu

SEQ ID NO: 1415540 - RNA, 19 nt, Homo sapiens
cagguuaggugucccuuag

SEQ ID NO: 1415541 - RNA, 19 nt, Homo sapiens
gaagcucuguguucucaac

SEQ ID NO: 1415542 - RNA, 19 nt, Homo sapiens
gaguccggcuggcaugaaa

SEQ ID NO: 1415543 - RNA, 19 nt, Homo sapiens
ggaucugucuguagaaacu

SEQ ID NO: 1415544 - RNA, 19 nt, Homo sapiens
ugcaagagauuccaaccuu

SEQ ID NO: 1415545 - RNA, 19 nt, Homo sapiens
agacauaguuuagcuuucu

SEQ ID NO: 1415546 - RNA, 19 nt, Homo sapiens
cagcaacgaucccgauguc

SEQ ID NO: 1415547 - RNA, 19 nt, Homo sapiens
uuugauguguccaauauug

SEQ ID NO: 1415548 - RNA, 19 nt, Homo sapiens
caguagauucacaagauua

SEQ ID NO: 1415549 - RNA, 19 nt, Homo sapiens
cauagguguucuaauggaa

SEQ ID NO: 1415550 - RNA, 19 nt, Homo sapiens
ggaaaggaaguuauuugag

SEQ ID NO: 1415551 - RNA, 19 nt, Homo sapiens
guuaaacgaaucaaagaga

SEQ ID NO: 1415552 - RNA, 19 nt, Homo sapiens
aaagagccuucaguagauu

SEQ ID NO: 1415553 - RNA, 19 nt, Homo sapiens
ccucaggccuucauuucug

SEQ ID NO: 1415554 - RNA, 19 nt, Homo sapiens
cuggagcccuucagcauga

SEQ ID NO: 1415555 - RNA, 19 nt, Homo sapiens
ccgagcagauccagaaagu

SEQ ID NO: 1415556 - RNA, 19 nt, Homo sapiens
ucauagguguucuaaugga

SEQ ID NO: 1415557 - RNA, 19 nt, Homo sapiens
uaggcugucugguuuaugu

SEQ ID NO: 1415558 - RNA, 19 nt, Homo sapiens
uuacgaagcucuguguucu

SEQ ID NO: 1415559 - RNA, 19 nt, Homo sapiens
gaagcuggaacgugugaau

SEQ ID NO: 1415560 - RNA, 19 nt, Homo sapiens
gcauagagccaagauggau

SEQ ID NO: 1415561 - RNA, 19 nt, Homo sapiens
ugucguacuuuacacauca

SEQ ID NO: 1415562 - RNA, 19 nt, Homo sapiens
guuuauguguggucaacuu

SEQ ID NO: 1415563 - RNA, 19 nt, Homo sapiens
ugacuuugcccagcucuuu

SEQ ID NO: 1415564 - RNA, 19 nt, Homo sapiens
cuaaggucauaucaucuga

SEQ ID NO: 1415565 - RNA, 19 nt, Homo sapiens
uggaugauauugugguugu

SEQ ID NO: 1415566 - RNA, 19 nt, Homo sapiens
gacauuucuugaacccauu

SEQ ID NO: 1415567 - RNA, 19 nt, Homo sapiens
uaguuuagcuuucuuugac

SEQ ID NO: 1415568 - RNA, 19 nt, Homo sapiens
gucaucaaguugcaagaga

SEQ ID NO: 1415569 - RNA, 19 nt, Homo sapiens
gcaacgaucccgaugucau

SEQ ID NO: 1415570 - RNA, 19 nt, Homo sapiens
gaagcaaagaguggaaugu

SEQ ID NO: 1415571 - RNA, 19 nt, Homo sapiens
uaggaaaggaaguuauuug

SEQ ID NO: 1415572 - RNA, 19 nt, Homo sapiens
gcaaagccagugucaucug

SEQ ID NO: 1415573 - RNA, 19 nt, Homo sapiens
uucaguagauucacaagau

SEQ ID NO: 1415574 - RNA, 19 nt, Homo sapiens
guacccuguucccuaaguu

SEQ ID NO: 1415575 - RNA, 19 nt, Homo sapiens
agcaaagaguggaauguga

SEQ ID NO: 1415576 - RNA, 19 nt, Homo sapiens
ggaugauauugugguugua

SEQ ID NO: 1415577 - RNA, 19 nt, Homo sapiens
ggagaagcaaagaguggaa

SEQ ID NO: 1415578 - RNA, 19 nt, Homo sapiens
cggcaaagccagugucauc

SEQ ID NO: 1415579 - RNA, 19 nt, Homo sapiens
aacucugcauugagaauua

SEQ ID NO: 1415580 - RNA, 19 nt, Homo sapiens
ccaaguaugccgagcagau

SEQ ID NO: 1415581 - RNA, 19 nt, Homo sapiens
gacauaguuuagcuuucuu

SEQ ID NO: 1415582 - RNA, 19 nt, Homo sapiens
gguuaggugucccuuaguc

SEQ ID NO: 1415583 - RNA, 19 nt, Homo sapiens
aaucuaggucucuguauug

SEQ ID NO: 1415584 - RNA, 19 nt, Homo sapiens
aaccaguucucggugauaa

SEQ ID NO: 1415585 - RNA, 19 nt, Homo sapiens
gcuaaggucauaucaucug

SEQ ID NO: 1415586 - RNA, 19 nt, Homo sapiens
cagaaagagccuucaguag

SEQ ID NO: 1415587 - RNA, 19 nt, Homo sapiens
ggaagcaaggacuggagaa

SEQ ID NO: 1415588 - RNA, 19 nt, Homo sapiens
guuucuacccugacuguuu

SEQ ID NO: 1415589 - RNA, 19 nt, Homo sapiens
guucucaacgcccucauga

SEQ ID NO: 1415590 - RNA, 19 nt, Homo sapiens
caguccagguaccggaaua

SEQ ID NO: 1415591 - RNA, 19 nt, Homo sapiens
gcuauugaguggccagacu

SEQ ID NO: 1415592 - RNA, 19 nt, Homo sapiens
aggaaaggaaguuauuuga

SEQ ID NO: 1415593 - RNA, 19 nt, Homo sapiens
ugccagggauacaaauaug

SEQ ID NO: 1415594 - RNA, 19 nt, Homo sapiens
uuuccuugaugcagacaua

SEQ ID NO: 1415595 - RNA, 19 nt, Homo sapiens
gaacgugugaauuauuagg

SEQ ID NO: 1415596 - RNA, 19 nt, Homo sapiens
caucaaguugcaagagauu

SEQ ID NO: 1415597 - RNA, 19 nt, Homo sapiens
gcccagcucuuuuccuuga

SEQ ID NO: 1415598 - RNA, 19 nt, Homo sapiens
caauauugugccagggaua

SEQ ID NO: 1415599 - RNA, 19 nt, Homo sapiens
ucaucugccgguucucuua

SEQ ID NO: 1415600 - RNA, 19 nt, Homo sapiens
guggaacacuggcauuuug

SEQ ID NO: 1415601 - RNA, 19 nt, Homo sapiens
caaaugaucuagucacuuu

SEQ ID NO: 1415602 - RNA, 19 nt, Homo sapiens
gaacugguauagacaauga

SEQ ID NO: 1415603 - RNA, 19 nt, Homo sapiens
guacugaaauccuagaauu

SEQ ID NO: 1415604 - RNA, 19 nt, Homo sapiens
gaagaaccuuugccuacua

SEQ ID NO: 1415605 - RNA, 19 nt, Homo sapiens
gcaaagugguuauuaagga

SEQ ID NO: 1415606 - RNA, 19 nt, Homo sapiens
gaagauuccugaagaaaca

SEQ ID NO: 1415607 - RNA, 19 nt, Homo sapiens
gcacaaaggcuuaucaaau

SEQ ID NO: 1415608 - RNA, 19 nt, Homo sapiens
cuacagaacucuugauguu

SEQ ID NO: 1415609 - RNA, 19 nt, Homo sapiens
gacuaaagcuagcgaauga

SEQ ID NO: 1415610 - RNA, 19 nt, Homo sapiens
cgucgacgaugccaaauua

SEQ ID NO: 1415611 - RNA, 19 nt, Homo sapiens
gaacgggaguauucuguug

SEQ ID NO: 1415612 - RNA, 19 nt, Homo sapiens
cacaaaggcuuaucaaaug

SEQ ID NO: 1415613 - RNA, 19 nt, Homo sapiens
uaaaggaucuacugaggaa

SEQ ID NO: 1415614 - RNA, 19 nt, Homo sapiens
guaaaggcuuggaggauuu

SEQ ID NO: 1415615 - RNA, 19 nt, Homo sapiens
guccacacauucauaaaua

SEQ ID NO: 1415616 - RNA, 19 nt, Homo sapiens
gcaggaagaccaagaagaa

SEQ ID NO: 1415617 - RNA, 19 nt, Homo sapiens
gagcauccugguauaauua

SEQ ID NO: 1415618 - RNA, 19 nt, Homo sapiens
caacaaccaucacauugga

SEQ ID NO: 1415619 - RNA, 19 nt, Homo sapiens
ggagcauccugguauaauu

SEQ ID NO: 1415620 - RNA, 19 nt, Homo sapiens
guggaaaucugacaaagug

SEQ ID NO: 1415621 - RNA, 19 nt, Homo sapiens
gccauuaacuggagacaga

SEQ ID NO: 1415622 - RNA, 19 nt, Homo sapiens
gcugcaaagugguuauuaa

SEQ ID NO: 1415623 - RNA, 19 nt, Homo sapiens
guguacagcuuaauucuau

SEQ ID NO: 1415624 - RNA, 19 nt, Homo sapiens
cagauugucuuaaguggaa

SEQ ID NO: 1415625 - RNA, 19 nt, Homo sapiens
ggagugaaguggcaugauc

SEQ ID NO: 1415626 - RNA, 19 nt, Homo sapiens
cagcuuaauucuaugcuuu

SEQ ID NO: 1415627 - RNA, 19 nt, Homo sapiens
gcaccuauccugaauaaag

SEQ ID NO: 1415628 - RNA, 19 nt, Homo sapiens
gaucuagucacuuucgaua

SEQ ID NO: 1415629 - RNA, 19 nt, Homo sapiens
gcuagcgaaugaacaaauu

SEQ ID NO: 1415630 - RNA, 19 nt, Homo sapiens
ucaaagaacgggaguauuc

SEQ ID NO: 1415631 - RNA, 19 nt, Homo sapiens
gaugugaacugguauagac

SEQ ID NO: 1415632 - RNA, 19 nt, Homo sapiens
gcuuugaugugaacuggua

SEQ ID NO: 1415633 - RNA, 19 nt, Homo sapiens
agagaaagaggcaaagaua

SEQ ID NO: 1415634 - RNA, 19 nt, Homo sapiens
acaaaggcuuaucaaauga

SEQ ID NO: 1415635 - RNA, 19 nt, Homo sapiens
ggaauuucagauugucuua

SEQ ID NO: 1415636 - RNA, 19 nt, Homo sapiens
ggugaagauuccugaagaa

SEQ ID NO: 1415637 - RNA, 19 nt, Homo sapiens
ggaggaagaagaaccuuug

SEQ ID NO: 1415638 - RNA, 19 nt, Homo sapiens
caaagugguuauuaaggau

SEQ ID NO: 1415639 - RNA, 19 nt, Homo sapiens
acagaacucuugauguuuc

SEQ ID NO: 1415640 - RNA, 19 nt, Homo sapiens
gggaggaauuucagauugu

SEQ ID NO: 1415641 - RNA, 19 nt, Homo sapiens
gggcuaguguuuauugugu

SEQ ID NO: 1415642 - RNA, 19 nt, Homo sapiens
gccaucauaugcagagaaa

SEQ ID NO: 1415643 - RNA, 19 nt, Homo sapiens
ggagaaggcgaacauuuca

SEQ ID NO: 1415644 - RNA, 19 nt, Homo sapiens
gaaguggcaugaucugacu

SEQ ID NO: 1415645 - RNA, 19 nt, Homo sapiens
gaaaaccuccaguaucaua

SEQ ID NO: 1415646 - RNA, 19 nt, Homo sapiens
cgaguuccaucucaguaaa

SEQ ID NO: 1415647 - RNA, 19 nt, Homo sapiens
gaucgcagccaucauuguu

SEQ ID NO: 1415648 - RNA, 19 nt, Homo sapiens
gagaaagaggcaaagauau

SEQ ID NO: 1415649 - RNA, 19 nt, Homo sapiens
uuacacacacacacaaaua

SEQ ID NO: 1415650 - RNA, 19 nt, Homo sapiens
gggagaaggcgaacauuuc

SEQ ID NO: 1415651 - RNA, 19 nt, Homo sapiens
gaagcaggaagaccaagaa

SEQ ID NO: 1415652 - RNA, 19 nt, Homo sapiens
gcacagcuugaaagaauug

SEQ ID NO: 1415653 - RNA, 19 nt, Homo sapiens
uaucauaauugcucugaca

SEQ ID NO: 1415654 - RNA, 19 nt, Homo sapiens
uauauauccucuagcuuga

SEQ ID NO: 1415655 - RNA, 19 nt, Homo sapiens
gaagggagaaggcgaacau

SEQ ID NO: 1415656 - RNA, 19 nt, Homo sapiens
cugcaccuauccugaauaa

SEQ ID NO: 1415657 - RNA, 19 nt, Homo sapiens
uauacuagcucagucaugu

SEQ ID NO: 1415658 - RNA, 19 nt, Homo sapiens
caucauaugcagagaaaga

SEQ ID NO: 1415659 - RNA, 19 nt, Homo sapiens
ggacuaaagcuagcgaaug

SEQ ID NO: 1415660 - RNA, 19 nt, Homo sapiens
acacacacacacaaauaua

SEQ ID NO: 1415661 - RNA, 19 nt, Homo sapiens
gcagccaucauuguuauuu

SEQ ID NO: 1415662 - RNA, 19 nt, Homo sapiens
gcuaguguuuauuguguug

SEQ ID NO: 1415663 - RNA, 19 nt, Homo sapiens
uauauccucuagcuugaaa

SEQ ID NO: 1415664 - RNA, 19 nt, Homo sapiens
ccaagaggccuuacacaca

SEQ ID NO: 1415665 - RNA, 19 nt, Homo sapiens
ccaauuaagggucgucuug

SEQ ID NO: 1415666 - RNA, 19 nt, Homo sapiens
aaacauauacaacgagugu

SEQ ID NO: 1415667 - RNA, 19 nt, Homo sapiens
gaugcgaccucaggaagga

SEQ ID NO: 1415668 - RNA, 19 nt, Homo sapiens
ugugagcccugaaaugaga

SEQ ID NO: 1415669 - RNA, 19 nt, Homo sapiens
guucaacaaccaucacauu

SEQ ID NO: 1415670 - RNA, 19 nt, Homo sapiens
ugucauuucaggaucauua

SEQ ID NO: 1415671 - RNA, 19 nt, Homo sapiens
uccucuagcuugaaacuuu

SEQ ID NO: 1415672 - RNA, 19 nt, Homo sapiens
gauuggagcauccugguau

SEQ ID NO: 1415673 - RNA, 19 nt, Homo sapiens
aguaaaggcuuggaggauu

SEQ ID NO: 1415674 - RNA, 19 nt, Homo sapiens
aagaaccuuugccuacuaa

SEQ ID NO: 1415675 - RNA, 19 nt, Homo sapiens
agagacauauauccaugaa

SEQ ID NO: 1415676 - RNA, 19 nt, Homo sapiens
guacuucagaugcgaaaug

SEQ ID NO: 1415677 - RNA, 19 nt, Homo sapiens
cgacgaugccaaauuaugu

SEQ ID NO: 1415678 - RNA, 19 nt, Homo sapiens
gaaggugcaaggcuagaga

SEQ ID NO: 1415679 - RNA, 19 nt, Homo sapiens
gucauguacugaaauccua

SEQ ID NO: 1415680 - RNA, 19 nt, Homo sapiens
ggaagcaggaagaccaaga

SEQ ID NO: 1415681 - RNA, 19 nt, Homo sapiens
gugcaaggcuagagaaagc

SEQ ID NO: 1415682 - RNA, 19 nt, Homo sapiens
guguugguguccuugauuu

SEQ ID NO: 1415683 - RNA, 19 nt, Homo sapiens
ccaguaggagagacauaua

SEQ ID NO: 1415684 - RNA, 19 nt, Homo sapiens
ugaccggguuucuuugaug

SEQ ID NO: 1415685 - RNA, 19 nt, Homo sapiens
uguggaugcuuccuauuau

SEQ ID NO: 1415686 - RNA, 19 nt, Homo sapiens
ggaggaauuucagauuguc

SEQ ID NO: 1415687 - RNA, 19 nt, Homo sapiens
gaauugcagcccucaagug

SEQ ID NO: 1415688 - RNA, 19 nt, Homo sapiens
agaaagaggcaaagauauc

SEQ ID NO: 1415689 - RNA, 19 nt, Homo sapiens
caagauggaaagagcgauu

SEQ ID NO: 1415690 - RNA, 19 nt, Homo sapiens
gcuuaucaaaugacacuaa

SEQ ID NO: 1415691 - RNA, 19 nt, Homo sapiens
gagcacaaaggcuuaucaa

SEQ ID NO: 1415692 - RNA, 19 nt, Homo sapiens
uauguuagcgugagcagaa

SEQ ID NO: 1415693 - RNA, 19 nt, Homo sapiens
gagagacauauauccauga

SEQ ID NO: 1415694 - RNA, 19 nt, Homo sapiens
uagaccaccucgacccaaa

SEQ ID NO: 1415695 - RNA, 19 nt, Homo sapiens
ucgcagccaucauuguuau

SEQ ID NO: 1415696 - RNA, 19 nt, Homo sapiens
gcucaaguuuauuuauguc

SEQ ID NO: 1415697 - RNA, 19 nt, Homo sapiens
aagauaaguucaacaacca

SEQ ID NO: 1415698 - RNA, 19 nt, Homo sapiens
ucacgucgacgaugccaaa

SEQ ID NO: 1415699 - RNA, 19 nt, Homo sapiens
caacuguggaugcuuccua

SEQ ID NO: 1415700 - RNA, 19 nt, Homo sapiens
caaaagaggaggaagaaga

SEQ ID NO: 1415701 - RNA, 19 nt, Homo sapiens
ggaaucagcuugagucuuc

SEQ ID NO: 1415702 - RNA, 19 nt, Homo sapiens
guaaagacauuccaguuuu

SEQ ID NO: 1415703 - RNA, 19 nt, Homo sapiens
gauuucauccaacuacuua

SEQ ID NO: 1415704 - RNA, 19 nt, Homo sapiens
gcuugagucuucugcaauu

SEQ ID NO: 1415705 - RNA, 19 nt, Homo sapiens
guucuuagcaguccuggua

SEQ ID NO: 1415706 - RNA, 19 nt, Homo sapiens
cguaaagacauuccaguuu

SEQ ID NO: 1415707 - RNA, 19 nt, Homo sapiens
gcaauuggucacaacuauu

SEQ ID NO: 1415708 - RNA, 19 nt, Homo sapiens
cuugggaguuuccaucuuu

SEQ ID NO: 1415709 - RNA, 19 nt, Homo sapiens
cuacugguccugcugauga

SEQ ID NO: 1415710 - RNA, 19 nt, Homo sapiens
caauuggucacaacuauuc

SEQ ID NO: 1415711 - RNA, 19 nt, Homo sapiens
cagcuugagucuucugcaa

SEQ ID NO: 1415712 - RNA, 19 nt, Homo sapiens
ggucacaacuauucaugcu

SEQ ID NO: 1415713 - RNA, 19 nt, Homo sapiens
ugcaauuggucacaacuau

SEQ ID NO: 1415714 - RNA, 19 nt, Homo sapiens
ugagauggaaucagcuuga

SEQ ID NO: 1415715 - RNA, 19 nt, Homo sapiens
ucaccaccaugaaguucuu

SEQ ID NO: 1415716 - RNA, 19 nt, Homo sapiens
uagcaguccugguacucuu

SEQ ID NO: 1415717 - RNA, 19 nt, Homo sapiens
gagauggaaucagcuugag

SEQ ID NO: 1415718 - RNA, 19 nt, Homo sapiens
uagagugugucccugagau

SEQ ID NO: 1415719 - RNA, 19 nt, Homo sapiens
gcaaccaccgcugcuucua

SEQ ID NO: 1415720 - RNA, 19 nt, Homo sapiens
auucaugcuuccugugauu

SEQ ID NO: 1415721 - RNA, 19 nt, Homo sapiens
ugucugugcucccugaucu

SEQ ID NO: 1415722 - RNA, 19 nt, Homo sapiens
ccacugcucguaaagacau

SEQ ID NO: 1415723 - RNA, 19 nt, Homo sapiens
ucauccaacuacuuaccuu

SEQ ID NO: 1415724 - RNA, 19 nt, Homo sapiens
ugacacguauccagcuacu

SEQ ID NO: 1415725 - RNA, 19 nt, Homo sapiens
ggacaaagcuacugaaacu

SEQ ID NO: 1415726 - RNA, 19 nt, Homo sapiens
cagcauaggugguuuguga

SEQ ID NO: 1415727 - RNA, 19 nt, Homo sapiens
gaggacaggugauggaaau

SEQ ID NO: 1415728 - RNA, 19 nt, Homo sapiens
gaccucagcugcacccauu

SEQ ID NO: 1415729 - RNA, 19 nt, Homo sapiens
gggcaggugucacaaagaa

SEQ ID NO: 1415730 - RNA, 19 nt, Homo sapiens
ggagagacacucagaagga

SEQ ID NO: 1415731 - RNA, 19 nt, Homo sapiens
guaggaggcuggacgacuu

SEQ ID NO: 1415732 - RNA, 19 nt, Homo sapiens
uggaaauccugcagcuuua

SEQ ID NO: 1415733 - RNA, 19 nt, Homo sapiens
ccuaagggcucacaaccaa

SEQ ID NO: 1415734 - RNA, 19 nt, Homo sapiens
gcccacaacaccaguauuu

SEQ ID NO: 1415735 - RNA, 19 nt, Homo sapiens
caacaccaguauuucacaa

SEQ ID NO: 1415736 - RNA, 19 nt, Homo sapiens
ggagaaaggagggugguuu

SEQ ID NO: 1415737 - RNA, 19 nt, Homo sapiens
gagaaagacagcagacuca

SEQ ID NO: 1415738 - RNA, 19 nt, Homo sapiens
uaauugagguugguggauu

SEQ ID NO: 1415739 - RNA, 19 nt, Homo sapiens
caaggagagucuggacaaa

SEQ ID NO: 1415740 - RNA, 19 nt, Homo sapiens
ggaagaaccacuggagaga

SEQ ID NO: 1415741 - RNA, 19 nt, Homo sapiens
ccacaacaccaguauuuca

SEQ ID NO: 1415742 - RNA, 19 nt, Homo sapiens
gcaggugucacaaagaaga

SEQ ID NO: 1415743 - RNA, 19 nt, Homo sapiens
ggaaggggcugaggccuaa

SEQ ID NO: 1415744 - RNA, 19 nt, Homo sapiens
ggccucagcuuucccaucu

SEQ ID NO: 1415745 - RNA, 19 nt, Homo sapiens
gcauaggugguuugugaaa

SEQ ID NO: 1415746 - RNA, 19 nt, Homo sapiens
gaaagacagcagacucauc

SEQ ID NO: 1415747 - RNA, 19 nt, Homo sapiens
guugguggauucacacaug

SEQ ID NO: 1415748 - RNA, 19 nt, Homo sapiens
gcagaggacaggugaugga

SEQ ID NO: 1415749 - RNA, 19 nt, Homo sapiens
ccuggucgcugagaauauu

SEQ ID NO: 1415750 - RNA, 19 nt, Homo sapiens
gagcagaggacaggugaug

SEQ ID NO: 1415751 - RNA, 19 nt, Homo sapiens
ccaaggagagucuggacaa

SEQ ID NO: 1415752 - RNA, 19 nt, Homo sapiens
gauagccgccuuuccaucu

SEQ ID NO: 1415753 - RNA, 19 nt, Homo sapiens
caaagaagagggcccuaag

SEQ ID NO: 1415754 - RNA, 19 nt, Homo sapiens
aagaaccacuggagagaca

SEQ ID NO: 1415755 - RNA, 19 nt, Homo sapiens
ccaguuugguauuagaagu

SEQ ID NO: 1415756 - RNA, 19 nt, Homo sapiens
gagcccaaauggccaacuc

SEQ ID NO: 1415757 - RNA, 19 nt, Homo sapiens
ugagguugguggauucaca

SEQ ID NO: 1415758 - RNA, 19 nt, Homo sapiens
gggcugaggccuaauugag

SEQ ID NO: 1415759 - RNA, 19 nt, Homo sapiens
ggcaguaucuggguuacag

SEQ ID NO: 1415760 - RNA, 19 nt, Homo sapiens
gaugggcaggugucacaaa

SEQ ID NO: 1415761 - RNA, 19 nt, Homo sapiens
gcuccauucugccaucuac

SEQ ID NO: 1415762 - RNA, 19 nt, Homo sapiens
caccaguauuucacaacuu

SEQ ID NO: 1415763 - RNA, 19 nt, Homo sapiens
gagagucuggacaaagcua

SEQ ID NO: 1415764 - RNA, 19 nt, Homo sapiens
ccugcuggcugccuuaugg

SEQ ID NO: 1415765 - RNA, 19 nt, Homo sapiens
gagacacucagaaggacuu

SEQ ID NO: 1415766 - RNA, 19 nt, Homo sapiens
acaaagaagagggcccuaa

SEQ ID NO: 1415767 - RNA, 19 nt, Homo sapiens
auggaaauccugcagcuuu

SEQ ID NO: 1415768 - RNA, 19 nt, Homo sapiens
caguuugguauuagaagua

SEQ ID NO: 1415769 - RNA, 19 nt, Homo sapiens
gcucggacucucuggauag

SEQ ID NO: 1415770 - RNA, 19 nt, Homo sapiens
cagggcaguaucuggguua

SEQ ID NO: 1415771 - RNA, 19 nt, Homo sapiens
caaagugauccgccaagca

SEQ ID NO: 1415772 - RNA, 19 nt, Homo sapiens
ggaaauccugcagcuuuag

SEQ ID NO: 1415773 - RNA, 19 nt, Homo sapiens
caacacugcauagcacugu

SEQ ID NO: 1415774 - RNA, 19 nt, Homo sapiens
ucaccugggucgccuacuc

SEQ ID NO: 1415775 - RNA, 19 nt, Homo sapiens
uagccgccuuuccaucuug

SEQ ID NO: 1415776 - RNA, 19 nt, Homo sapiens
gaaauccugcagcuuuagg

SEQ ID NO: 1415777 - RNA, 19 nt, Homo sapiens
accaguauuucacaacuuc

SEQ ID NO: 1415778 - RNA, 19 nt, Homo sapiens
uaagggcucacaaccaaag

SEQ ID NO: 1415779 - RNA, 19 nt, Homo sapiens
gcacccugcagcaucucua

SEQ ID NO: 1415780 - RNA, 19 nt, Homo sapiens
acaccaguauuucacaacu

SEQ ID NO: 1415781 - RNA, 19 nt, Homo sapiens
gcucaugccugugcugaau

SEQ ID NO: 1415782 - RNA, 19 nt, Homo sapiens
ucaugccugugcugaauca

SEQ ID NO: 1415783 - RNA, 19 nt, Homo sapiens
caaggucccuaucaagaug

SEQ ID NO: 1415784 - RNA, 19 nt, Homo sapiens
gguugugggugaugccaaa

SEQ ID NO: 1415785 - RNA, 19 nt, Homo sapiens
gcuguucccuguccagaag

SEQ ID NO: 1415786 - RNA, 19 nt, Homo sapiens
cacccaaggucccuaucaa

SEQ ID NO: 1415787 - RNA, 19 nt, Homo sapiens
ccagaagccgaaacucuug

SEQ ID NO: 1415788 - RNA, 19 nt, Homo sapiens
ggaagaccaagaccacauc

SEQ ID NO: 1415789 - RNA, 19 nt, Homo sapiens
gcacccaaggucccuauca

SEQ ID NO: 1415790 - RNA, 19 nt, Homo sapiens
gagcaggacccagagaaca

SEQ ID NO: 1415791 - RNA, 19 nt, Homo sapiens
gcaccaaggccuggaugga

SEQ ID NO: 1415792 - RNA, 19 nt, Homo sapiens
ccaaggucccuaucaagau

SEQ ID NO: 1415793 - RNA, 19 nt, Homo sapiens
cuaucaagaugcaagucaa

SEQ ID NO: 1415794 - RNA, 19 nt, Homo sapiens
gaccggaggaagaccaaga

SEQ ID NO: 1415795 - RNA, 19 nt, Homo sapiens
uaucaagaugcaagucaaa

SEQ ID NO: 1415796 - RNA, 19 nt, Homo sapiens
cccaaggucccuaucaaga

SEQ ID NO: 1415797 - RNA, 19 nt, Homo sapiens
agaccaagaccacaucuac

SEQ ID NO: 1415798 - RNA, 19 nt, Homo sapiens
ucaagaugcaagucaaaca

SEQ ID NO: 1415799 - RNA, 19 nt, Homo sapiens
cagagcaggacccagagaa

SEQ ID NO: 1415800 - RNA, 19 nt, Homo sapiens
gaagaccaagaccacaucu

SEQ ID NO: 1415801 - RNA, 19 nt, Homo sapiens
guagaaggcugcacagaga

SEQ ID NO: 1415802 - RNA, 19 nt, Homo sapiens
gaaacgaccuggacacacu

SEQ ID NO: 1415803 - RNA, 19 nt, Homo sapiens
gcagagaccggaaggauca

SEQ ID NO: 1415804 - RNA, 19 nt, Homo sapiens
aggcggaucuacagacaua

SEQ ID NO: 1415805 - RNA, 19 nt, Homo sapiens
gcacagagaaguucaagac

SEQ ID NO: 1415806 - RNA, 19 nt, Homo sapiens
ggaaauguuugcuccuuuu

SEQ ID NO: 1415807 - RNA, 19 nt, Homo sapiens
gggugccgcucgaggauuu

SEQ ID NO: 1415808 - RNA, 19 nt, Homo sapiens
agaauacccucuaccaucu

SEQ ID NO: 1415809 - RNA, 19 nt, Homo sapiens
gugagggacccacagauuu

SEQ ID NO: 1415810 - RNA, 19 nt, Homo sapiens
cggaaauguuugcuccuuu

SEQ ID NO: 1415811 - RNA, 19 nt, Homo sapiens
ccauggaaaucugcucuga

SEQ ID NO: 1415812 - RNA, 19 nt, Homo sapiens
ucgaugcccuggacgacua

SEQ ID NO: 1415813 - RNA, 19 nt, Homo sapiens
auuagcagcugucaucaga

SEQ ID NO: 1415814 - RNA, 19 nt, Homo sapiens
uagcagcugucaucagaag

SEQ ID NO: 1415815 - RNA, 19 nt, Homo sapiens
gaagaaaaccaaacaaugc

SEQ ID NO: 1415816 - RNA, 19 nt, Homo sapiens
cgaccuggacacacuauug

SEQ ID NO: 1415817 - RNA, 19 nt, Homo sapiens
aaaccaaacaaugcugaua

SEQ ID NO: 1415818 - RNA, 19 nt, Homo sapiens
ggcauuagcagcugucauc

SEQ ID NO: 1415819 - RNA, 19 nt, Homo sapiens
acgauucgcucuuccagau

SEQ ID NO: 1415820 - RNA, 19 nt, Homo sapiens
uaucagugcuugguagaag

SEQ ID NO: 1415821 - RNA, 19 nt, Homo sapiens
gggaggccauggaaaucug

SEQ ID NO: 1415822 - RNA, 19 nt, Homo sapiens
ggacuuccgguuugauaag

SEQ ID NO: 1415823 - RNA, 19 nt, Homo sapiens
gggcccacccuaagaaugu

SEQ ID NO: 1415824 - RNA, 19 nt, Homo sapiens
caaacaaugcugauagacu

SEQ ID NO: 1415825 - RNA, 19 nt, Homo sapiens
ggugagaggcggaucuaca

SEQ ID NO: 1415826 - RNA, 19 nt, Homo sapiens
accaaacaaugcugauaga

SEQ ID NO: 1415827 - RNA, 19 nt, Homo sapiens
gacacacuauugggaagga

SEQ ID NO: 1415828 - RNA, 19 nt, Homo sapiens
gcauccgccuugggccuuu

SEQ ID NO: 1415829 - RNA, 19 nt, Homo sapiens
ggcccacccuaagaaugua

SEQ ID NO: 1415830 - RNA, 19 nt, Homo sapiens
gcucgaggauuuaaaagca

SEQ ID NO: 1415831 - RNA, 19 nt, Homo sapiens
cugagaggcaggacaugua

SEQ ID NO: 1415832 - RNA, 19 nt, Homo sapiens
ugagaggcaggacauguau

SEQ ID NO: 1415833 - RNA, 19 nt, Homo sapiens
cagcagagaccggaaggau

SEQ ID NO: 1415834 - RNA, 19 nt, Homo sapiens
cggagccacugccuguaga

SEQ ID NO: 1415835 - RNA, 19 nt, Homo sapiens
uggccgacgugccugagaa

SEQ ID NO: 1415836 - RNA, 19 nt, Homo sapiens
agaggcggaucuacagaca

SEQ ID NO: 1415837 - RNA, 19 nt, Homo sapiens
acgcugcacggaaauguuu

SEQ ID NO: 1415838 - RNA, 19 nt, Homo sapiens
gcaacaagaagaaaaccaa

SEQ ID NO: 1415839 - RNA, 19 nt, Homo sapiens
cgacuacgagcaccacuac

SEQ ID NO: 1415840 - RNA, 19 nt, Homo sapiens
gaccuggacacacuauugg

SEQ ID NO: 1415841 - RNA, 19 nt, Homo sapiens
agaggcaggacauguauca

SEQ ID NO: 1415842 - RNA, 19 nt, Homo sapiens
accacacgcugcacggaaa

SEQ ID NO: 1415843 - RNA, 19 nt, Homo sapiens
gcaccaguucuucgaggau

SEQ ID NO: 1415844 - RNA, 19 nt, Homo sapiens
gaaacugggucacaauaaa

SEQ ID NO: 1415845 - RNA, 19 nt, Homo sapiens
caacuacaaugcugaagua

SEQ ID NO: 1415846 - RNA, 19 nt, Homo sapiens
gaacgaaccauuagcuuug

SEQ ID NO: 1415847 - RNA, 19 nt, Homo sapiens
gaccauacauuucuugaug

SEQ ID NO: 1415848 - RNA, 19 nt, Homo sapiens
ggaaacaguuggcuuugga

SEQ ID NO: 1415849 - RNA, 19 nt, Homo sapiens
aaacagagacccauucauu

SEQ ID NO: 1415850 - RNA, 19 nt, Homo sapiens
ucaaggagauaccaacaaa

SEQ ID NO: 1415851 - RNA, 19 nt, Homo sapiens
gaagagaaagaguaugaaa

SEQ ID NO: 1415852 - RNA, 19 nt, Homo sapiens
gaaaguuggacggcaauua

SEQ ID NO: 1415853 - RNA, 19 nt, Homo sapiens
ggagauaccaacaaagaaa

SEQ ID NO: 1415854 - RNA, 19 nt, Homo sapiens
acagagacccauucauuua

SEQ ID NO: 1415855 - RNA, 19 nt, Homo sapiens
gaaagaagcaucaaaaugu

SEQ ID NO: 1415856 - RNA, 19 nt, Homo sapiens
gagaaacugggucacaaua

SEQ ID NO: 1415857 - RNA, 19 nt, Homo sapiens
cagaguugcuugcacauga

SEQ ID NO: 1415858 - RNA, 19 nt, Homo sapiens
ggagcugcauuaucuauuc

SEQ ID NO: 1415859 - RNA, 19 nt, Homo sapiens
ggaaccaacuaauguguag

SEQ ID NO: 1415860 - RNA, 19 nt, Homo sapiens
cuacaaugcugaaguaugg

SEQ ID NO: 1415861 - RNA, 19 nt, Homo sapiens
uuacuugguuguacuauga

SEQ ID NO: 1415862 - RNA, 19 nt, Homo sapiens
gagacccauucauuuauuu

SEQ ID NO: 1415863 - RNA, 19 nt, Homo sapiens
gcagucugauucacaagaa

SEQ ID NO: 1415864 - RNA, 19 nt, Homo sapiens
gcccaaacacacauucuua

SEQ ID NO: 1415865 - RNA, 19 nt, Homo sapiens
gaacaacuacaaugcugaa

SEQ ID NO: 1415866 - RNA, 19 nt, Homo sapiens
ggaauaccuucaacaagca

SEQ ID NO: 1415867 - RNA, 19 nt, Homo sapiens
gaagggccaucucuauuuu

SEQ ID NO: 1415868 - RNA, 19 nt, Homo sapiens
gaacccauuugacuacaca

SEQ ID NO: 1415869 - RNA, 19 nt, Homo sapiens
ugaagggccaucucuauuu

SEQ ID NO: 1415870 - RNA, 19 nt, Homo sapiens
ccuccaaacugcagucuga

SEQ ID NO: 1415871 - RNA, 19 nt, Homo sapiens
gaacuaugagcaagcagaa

SEQ ID NO: 1415872 - RNA, 19 nt, Homo sapiens
caaacacacauucuuaaga

SEQ ID NO: 1415873 - RNA, 19 nt, Homo sapiens
aagcugaaauugaaagaug

SEQ ID NO: 1415874 - RNA, 19 nt, Homo sapiens
gagcaggccuacaaguaca

SEQ ID NO: 1415875 - RNA, 19 nt, Homo sapiens
ucaaggcugugcaguaugu

SEQ ID NO: 1415876 - RNA, 19 nt, Homo sapiens
caaagaaagaagcaucaaa

SEQ ID NO: 1415877 - RNA, 19 nt, Homo sapiens
gcagagauccacacacuac

SEQ ID NO: 1415878 - RNA, 19 nt, Homo sapiens
ucaucuaucuggaagagaa

SEQ ID NO: 1415879 - RNA, 19 nt, Homo sapiens
ggagaacuaugagcaagca

SEQ ID NO: 1415880 - RNA, 19 nt, Homo sapiens
ggacuuuacuugguuguac

SEQ ID NO: 1415881 - RNA, 19 nt, Homo sapiens
gcucuggucugccugaaag

SEQ ID NO: 1415882 - RNA, 19 nt, Homo sapiens
agagacccauucauuuauu

SEQ ID NO: 1415883 - RNA, 19 nt, Homo sapiens
ugaagaauccuccaaacug

SEQ ID NO: 1415884 - RNA, 19 nt, Homo sapiens
ugaggaugcucuuucugaa

SEQ ID NO: 1415885 - RNA, 19 nt, Homo sapiens
uguaagagaucaccuucau

SEQ ID NO: 1415886 - RNA, 19 nt, Homo sapiens
ccauacauuucuugaugaa

SEQ ID NO: 1415887 - RNA, 19 nt, Homo sapiens
gcuugcacaugagcuguua

SEQ ID NO: 1415888 - RNA, 19 nt, Homo sapiens
acaagaacccauuugacua

SEQ ID NO: 1415889 - RNA, 19 nt, Homo sapiens
gcacuucaucuuccugaga

SEQ ID NO: 1415890 - RNA, 19 nt, Homo sapiens
ugaacgaaccauuagcuuu

SEQ ID NO: 1415891 - RNA, 19 nt, Homo sapiens
gcagaggaauaccuucaac

SEQ ID NO: 1415892 - RNA, 19 nt, Homo sapiens
cuagacaaauuucuugaag

SEQ ID NO: 1415893 - RNA, 19 nt, Homo sapiens
acaguuggcuuuggaaauc

SEQ ID NO: 1415894 - RNA, 19 nt, Homo sapiens
gcuguccuguggagaacua

SEQ ID NO: 1415895 - RNA, 19 nt, Homo sapiens
gaaagaugaggcucugcuu

SEQ ID NO: 1415896 - RNA, 19 nt, Homo sapiens
agucaaggcugugcaguau

SEQ ID NO: 1415897 - RNA, 19 nt, Homo sapiens
acaaugauauucgaaugga

SEQ ID NO: 1415898 - RNA, 19 nt, Homo sapiens
caaacuaccaccaucuuca

SEQ ID NO: 1415899 - RNA, 19 nt, Homo sapiens
gccuggagcuggagaacga

SEQ ID NO: 1415900 - RNA, 19 nt, Homo sapiens
acaaguacaugaucaagcu

SEQ ID NO: 1415901 - RNA, 19 nt, Homo sapiens
uggaagagaaagaguauga

SEQ ID NO: 1415902 - RNA, 19 nt, Homo sapiens
ggccaaggcaugcuaugaa

SEQ ID NO: 1415903 - RNA, 19 nt, Homo sapiens
gauccaaguauaagccaaa

SEQ ID NO: 1415904 - RNA, 19 nt, Homo sapiens
caagaacccauuugacuac

SEQ ID NO: 1415905 - RNA, 19 nt, Homo sapiens
cccuccagcugaacaauuu

SEQ ID NO: 1415906 - RNA, 19 nt, Homo sapiens
gggaaccaacuaaugugua

SEQ ID NO: 1415907 - RNA, 19 nt, Homo sapiens
accaggagcugcauuaucu

SEQ ID NO: 1415908 - RNA, 19 nt, Homo sapiens
acaggaaacaguuggcuuu

SEQ ID NO: 1415909 - RNA, 19 nt, Homo sapiens
ucaacaagcagcccagaug

SEQ ID NO: 1415910 - RNA, 19 nt, Homo sapiens
gcaucaaaaugucaagauu

SEQ ID NO: 1415911 - RNA, 19 nt, Homo sapiens
acacauuuaucaaggagau

SEQ ID NO: 1415912 - RNA, 19 nt, Homo sapiens
agaaacugggucacaauaa

SEQ ID NO: 1415913 - RNA, 19 nt, Homo sapiens
cagagacccauucauuuau

SEQ ID NO: 1415914 - RNA, 19 nt, Homo sapiens
gaaacaguuggcuuuggaa

SEQ ID NO: 1415915 - RNA, 19 nt, Homo sapiens
gcucaucuaucuggaagag

SEQ ID NO: 1415916 - RNA, 19 nt, Homo sapiens
aaggagauaccaacaaaga

SEQ ID NO: 1415917 - RNA, 19 nt, Homo sapiens
ccagagaguuuuaccguau

SEQ ID NO: 1415918 - RNA, 19 nt, Homo sapiens
gcaagccuguaagagauca

SEQ ID NO: 1415919 - RNA, 19 nt, Homo sapiens
uaugcaagccuguaagaga

SEQ ID NO: 1415920 - RNA, 19 nt, Homo sapiens
gcuaugaacgaaccauuag

SEQ ID NO: 1415921 - RNA, 19 nt, Homo sapiens
cuaacacauuuaucaagga

SEQ ID NO: 1415922 - RNA, 19 nt, Homo sapiens
gauccacacacuacaggaa

SEQ ID NO: 1415923 - RNA, 19 nt, Homo sapiens
ggaagagaaagaguaugaa

SEQ ID NO: 1415924 - RNA, 19 nt, Homo sapiens
caaugauauucgaauggaa

SEQ ID NO: 1415925 - RNA, 19 nt, Homo sapiens
ccaucuaacacauuuauca

SEQ ID NO: 1415926 - RNA, 19 nt, Homo sapiens
gagcugcauuaucuauucu

SEQ ID NO: 1415927 - RNA, 19 nt, Homo sapiens
aacagagacccauucauuu

SEQ ID NO: 1415928 - RNA, 19 nt, Homo sapiens
gaggaauaccuucaacaag

SEQ ID NO: 1415929 - RNA, 19 nt, Homo sapiens
ggagaccauacauuucuug

SEQ ID NO: 1415930 - RNA, 19 nt, Homo sapiens
ccaaacugcagucugauuc

SEQ ID NO: 1415931 - RNA, 19 nt, Homo sapiens
aaauccaucuuucugauac

SEQ ID NO: 1415932 - RNA, 19 nt, Homo sapiens
ggccaucucuauuuucuga

SEQ ID NO: 1415933 - RNA, 19 nt, Homo sapiens
aagcugagcaggccuacaa

SEQ ID NO: 1415934 - RNA, 19 nt, Homo sapiens
aaaguuggacggcaauuag

SEQ ID NO: 1415935 - RNA, 19 nt, Homo sapiens
gcuaugcgggaaccaacua

SEQ ID NO: 1415936 - RNA, 19 nt, Homo sapiens
agaggaauaccuucaacaa

SEQ ID NO: 1415937 - RNA, 19 nt, Homo sapiens
cccaaacacacauucuuaa

SEQ ID NO: 1415938 - RNA, 19 nt, Homo sapiens
gauauucgaauggaaaugg

SEQ ID NO: 1415939 - RNA, 19 nt, Homo sapiens
cugagcaggccuacaagua

SEQ ID NO: 1415940 - RNA, 19 nt, Homo sapiens
gacugggaaucgccugcua

SEQ ID NO: 1415941 - RNA, 19 nt, Homo sapiens
cuucugagaugcacuucau

SEQ ID NO: 1415942 - RNA, 19 nt, Homo sapiens
caaggcaugcuaugaacga

SEQ ID NO: 1415943 - RNA, 19 nt, Homo sapiens
gccaaggcaugcuaugaac

SEQ ID NO: 1415944 - RNA, 19 nt, Homo sapiens
gcacaaagcucggcuggaa

SEQ ID NO: 1415945 - RNA, 19 nt, Homo sapiens
gcaaagaggaucaucauuu

SEQ ID NO: 1415946 - RNA, 19 nt, Homo sapiens
uaaagggacucaaacauga

SEQ ID NO: 1415947 - RNA, 19 nt, Homo sapiens
caacugaacuacaagauuc

SEQ ID NO: 1415948 - RNA, 19 nt, Homo sapiens
ccagacagguuaugcauuu

SEQ ID NO: 1415949 - RNA, 19 nt, Homo sapiens
gauuugggcugcucuuuaa

SEQ ID NO: 1415950 - RNA, 19 nt, Homo sapiens
caaagaggaucaucauuuc

SEQ ID NO: 1415951 - RNA, 19 nt, Homo sapiens
ugagugagguggagauuaa

SEQ ID NO: 1415952 - RNA, 19 nt, Homo sapiens
gagcauagacuuugaggaa

SEQ ID NO: 1415953 - RNA, 19 nt, Homo sapiens
caaagcaccuuggcccaua

SEQ ID NO: 1415954 - RNA, 19 nt, Homo sapiens
caaaccagaucaagcagaa

SEQ ID NO: 1415955 - RNA, 19 nt, Homo sapiens
agaaguggcuggaaaugaa

SEQ ID NO: 1415956 - RNA, 19 nt, Homo sapiens
gaacaaggacauccaaagu

SEQ ID NO: 1415957 - RNA, 19 nt, Homo sapiens
uuuaagagcuuuccugaga

SEQ ID NO: 1415958 - RNA, 19 nt, Homo sapiens
ugaauuccaucuucugaaa

SEQ ID NO: 1415959 - RNA, 19 nt, Homo sapiens
ggacaaaccagaucaagca

SEQ ID NO: 1415960 - RNA, 19 nt, Homo sapiens
caagcaccaucaagaaauu

SEQ ID NO: 1415961 - RNA, 19 nt, Homo sapiens
gagcagaggcccugguuga

SEQ ID NO: 1415962 - RNA, 19 nt, Homo sapiens
cgaaaacgauugcucuaua

SEQ ID NO: 1415963 - RNA, 19 nt, Homo sapiens
ccaguucaguggccuguuu

SEQ ID NO: 1415964 - RNA, 19 nt, Homo sapiens
uaagauaaagggacucaaa

SEQ ID NO: 1415965 - RNA, 19 nt, Homo sapiens
gaaaacgauugcucuauau

SEQ ID NO: 1415966 - RNA, 19 nt, Homo sapiens
gcaauuccgacuuaugaaa

SEQ ID NO: 1415967 - RNA, 19 nt, Homo sapiens
gcagauccaccuccacaaa

SEQ ID NO: 1415968 - RNA, 19 nt, Homo sapiens
ugaagaaccucuacaugag

SEQ ID NO: 1415969 - RNA, 19 nt, Homo sapiens
gaucaucauuuccuugaag

SEQ ID NO: 1415970 - RNA, 19 nt, Homo sapiens
cggcacgccuggugaagua

SEQ ID NO: 1415971 - RNA, 19 nt, Homo sapiens
gcaacugaacuacaagauu

SEQ ID NO: 1415972 - RNA, 19 nt, Homo sapiens
gugcguggaugugaugaua

SEQ ID NO: 1415973 - RNA, 19 nt, Homo sapiens
cccagcaucuugacaguuu

SEQ ID NO: 1415974 - RNA, 19 nt, Homo sapiens
ccugagaacuguugcuuuc

SEQ ID NO: 1415975 - RNA, 19 nt, Homo sapiens
gaugauagccagacucaag

SEQ ID NO: 1415976 - RNA, 19 nt, Homo sapiens
cgacaugguccaccugaaa

SEQ ID NO: 1415977 - RNA, 19 nt, Homo sapiens
cugaagaaccucuacauga

SEQ ID NO: 1415978 - RNA, 19 nt, Homo sapiens
gcauucaucuucccagcau

SEQ ID NO: 1415979 - RNA, 19 nt, Homo sapiens
aacaugauacuaccucuua

SEQ ID NO: 1415980 - RNA, 19 nt, Homo sapiens
gagaaguggcuggaaauga

SEQ ID NO: 1415981 - RNA, 19 nt, Homo sapiens
gcacacagaccuggaaucu

SEQ ID NO: 1415982 - RNA, 19 nt, Homo sapiens
caaaagccauaccuugaaa

SEQ ID NO: 1415983 - RNA, 19 nt, Homo sapiens
gauaaagggacucaaacau

SEQ ID NO: 1415984 - RNA, 19 nt, Homo sapiens
cgauugcucuauauggauu

SEQ ID NO: 1415985 - RNA, 19 nt, Homo sapiens
cgagcucaaucaccuaaga

SEQ ID NO: 1415986 - RNA, 19 nt, Homo sapiens
ggaagcagaugugauucuc

SEQ ID NO: 1415987 - RNA, 19 nt, Homo sapiens
gggcaucccaaucuaugua

SEQ ID NO: 1415988 - RNA, 19 nt, Homo sapiens
caugauacuaccucuuaua

SEQ ID NO: 1415989 - RNA, 19 nt, Homo sapiens
ggacucaaacaugauacua

SEQ ID NO: 1415990 - RNA, 19 nt, Homo sapiens
gaagaaccucuacaugagu

SEQ ID NO: 1415991 - RNA, 19 nt, Homo sapiens
ggcaggaguucaggacaaa

SEQ ID NO: 1415992 - RNA, 19 nt, Homo sapiens
ggugaaguaugagaucaga

SEQ ID NO: 1415993 - RNA, 19 nt, Homo sapiens
gagcuuuccugagaacugu

SEQ ID NO: 1415994 - RNA, 19 nt, Homo sapiens
uuucacaaauccagaaguu

SEQ ID NO: 1415995 - RNA, 19 nt, Homo sapiens
gcaccuuggcccauaagaa

SEQ ID NO: 1415996 - RNA, 19 nt, Homo sapiens
cacccaggcugugagauuu

SEQ ID NO: 1415997 - RNA, 19 nt, Homo sapiens
cuacaagauucaggcaauu

SEQ ID NO: 1415998 - RNA, 19 nt, Homo sapiens
ucaguggccuguuucaaag

SEQ ID NO: 1415999 - RNA, 19 nt, Homo sapiens
uggccaagcucuaccugaa

SEQ ID NO: 1416000 - RNA, 19 nt, Homo sapiens
aagcagaaguuuggguuga

SEQ ID NO: 1416001 - RNA, 19 nt, Homo sapiens
ccuaagaagaccaaagaaa

SEQ ID NO: 1416002 - RNA, 19 nt, Homo sapiens
gcucucacuuucccagaug

SEQ ID NO: 1416003 - RNA, 19 nt, Homo sapiens
ccaggagaauacaacuuau

SEQ ID NO: 1416004 - RNA, 19 nt, Homo sapiens
gccaagcaccaucaagaaa

SEQ ID NO: 1416005 - RNA, 19 nt, Homo sapiens
guaauuuccacuuucauuc

SEQ ID NO: 1416006 - RNA, 19 nt, Homo sapiens
gacauaggacggagcuuga

SEQ ID NO: 1416007 - RNA, 19 nt, Homo sapiens
gccaagcucuaccugaaag

SEQ ID NO: 1416008 - RNA, 19 nt, Homo sapiens
ccaagcaccaucaagaaau

SEQ ID NO: 1416009 - RNA, 19 nt, Homo sapiens
aaagcaccuuggcccauaa

SEQ ID NO: 1416010 - RNA, 19 nt, Homo sapiens
ggaacgguugcuugucuuu

SEQ ID NO: 1416011 - RNA, 19 nt, Homo sapiens
uucaggcaauuccgacuua

SEQ ID NO: 1416012 - RNA, 19 nt, Homo sapiens
ggaucaucauuuccuugaa

SEQ ID NO: 1416013 - RNA, 19 nt, Homo sapiens
caccuaagaagaccaaaga

SEQ ID NO: 1416014 - RNA, 19 nt, Homo sapiens
auaaagggacucaaacaug

SEQ ID NO: 1416015 - RNA, 19 nt, Homo sapiens
accaggagaauacaacuua

SEQ ID NO: 1416016 - RNA, 19 nt, Homo sapiens
uuaagagcuuuccugagaa

SEQ ID NO: 1416017 - RNA, 19 nt, Homo sapiens
caaaggugcguggauguga

SEQ ID NO: 1416018 - RNA, 19 nt, Homo sapiens
gcaaaagccauaccuugaa

SEQ ID NO: 1416019 - RNA, 19 nt, Homo sapiens
agauuugggcugcucuuua

SEQ ID NO: 1416020 - RNA, 19 nt, Homo sapiens
caaccaaccgguggcguuu

SEQ ID NO: 1416021 - RNA, 19 nt, Homo sapiens
uaagagcuuuccugagaac

SEQ ID NO: 1416022 - RNA, 19 nt, Homo sapiens
augaaaccgugaugacauu

SEQ ID NO: 1416023 - RNA, 19 nt, Homo sapiens
uaacuuggaagaccuacug

SEQ ID NO: 1416024 - RNA, 19 nt, Homo sapiens
gcucaaucaccuaagaaga

SEQ ID NO: 1416025 - RNA, 19 nt, Homo sapiens
caagaacaaggacauccaa

SEQ ID NO: 1416026 - RNA, 19 nt, Homo sapiens
ucacaaauccagaaguuuu

SEQ ID NO: 1416027 - RNA, 19 nt, Homo sapiens
ccacuggucugcauaaaag

SEQ ID NO: 1416028 - RNA, 19 nt, Homo sapiens
gcaaguggcaggaguucag

SEQ ID NO: 1416029 - RNA, 19 nt, Homo sapiens
gagcucaaucaccuaagaa

SEQ ID NO: 1416030 - RNA, 19 nt, Homo sapiens
ccacggcccugaagaaccu

SEQ ID NO: 1416031 - RNA, 19 nt, Homo sapiens
cuugacaguuuccagaaga

SEQ ID NO: 1416032 - RNA, 19 nt, Homo sapiens
ccagaucaagcagaaguuu

SEQ ID NO: 1416033 - RNA, 19 nt, Homo sapiens
aacgauugcucuauaugga

SEQ ID NO: 1416034 - RNA, 19 nt, Homo sapiens
uaacuucuucccagaguca

SEQ ID NO: 1416035 - RNA, 19 nt, Homo sapiens
cguaauuuccacuuucauu

SEQ ID NO: 1416036 - RNA, 19 nt, Homo sapiens
cuaagaagaccaaagaaaa

SEQ ID NO: 1416037 - RNA, 19 nt, Homo sapiens
caucuucccagcaucuuga

SEQ ID NO: 1416038 - RNA, 19 nt, Homo sapiens
gaccacgucauccugcaaa

SEQ ID NO: 1416039 - RNA, 19 nt, Homo sapiens
uggcaggaguucaggacaa

SEQ ID NO: 1416040 - RNA, 19 nt, Homo sapiens
gagauuugggcugcucuuu

SEQ ID NO: 1416041 - RNA, 19 nt, Homo sapiens
aggcaauuccgacuuauga

SEQ ID NO: 1416042 - RNA, 19 nt, Homo sapiens
acuacaagauucaggcaau

SEQ ID NO: 1416043 - RNA, 19 nt, Homo sapiens
ucuugcaacugaacuacaa

SEQ ID NO: 1416044 - RNA, 19 nt, Homo sapiens
ggaagugacugauuuauug

SEQ ID NO: 1416045 - RNA, 19 nt, Homo sapiens
gagaugacauuuaagcaaa

SEQ ID NO: 1416046 - RNA, 19 nt, Homo sapiens
gcagaaagaccucauccua

SEQ ID NO: 1416047 - RNA, 19 nt, Homo sapiens
gaaauugcuucgacaggaa

SEQ ID NO: 1416048 - RNA, 19 nt, Homo sapiens
gcagcuaucuggaggauca

SEQ ID NO: 1416049 - RNA, 19 nt, Homo sapiens
ggacacagacagaauuauu

SEQ ID NO: 1416050 - RNA, 19 nt, Homo sapiens
ggagggugauucuauuuga

SEQ ID NO: 1416051 - RNA, 19 nt, Homo sapiens
uaccagaugucauuucuuu

SEQ ID NO: 1416052 - RNA, 19 nt, Homo sapiens
gcaaugaacacaucaagug

SEQ ID NO: 1416053 - RNA, 19 nt, Homo sapiens
gaacacaucaagugcagaa

SEQ ID NO: 1416054 - RNA, 19 nt, Homo sapiens
gaacacaacagccucacaa

SEQ ID NO: 1416055 - RNA, 19 nt, Homo sapiens
gaagauuaauccuaacucu

SEQ ID NO: 1416056 - RNA, 19 nt, Homo sapiens
aaagauugcuggagggaaa

SEQ ID NO: 1416057 - RNA, 19 nt, Homo sapiens
gaacaagugcuuccucaca

SEQ ID NO: 1416058 - RNA, 19 nt, Homo sapiens
gcgcaaagguuggcugguu

SEQ ID NO: 1416059 - RNA, 19 nt, Homo sapiens
gaucagacacuccgaagga

SEQ ID NO: 1416060 - RNA, 19 nt, Homo sapiens
ccuacuggcuggcaacuuu

SEQ ID NO: 1416061 - RNA, 19 nt, Homo sapiens
cagaaagaccucauccuaa

SEQ ID NO: 1416062 - RNA, 19 nt, Homo sapiens
gcagggagggugauucuau

SEQ ID NO: 1416063 - RNA, 19 nt, Homo sapiens
gaagccaugugggaagauu

SEQ ID NO: 1416064 - RNA, 19 nt, Homo sapiens
gacacagacagaauuauuu

SEQ ID NO: 1416065 - RNA, 19 nt, Homo sapiens
gaaauauucauugggcuuu

SEQ ID NO: 1416066 - RNA, 19 nt, Homo sapiens
gauauuuucugcagcauuu

SEQ ID NO: 1416067 - RNA, 19 nt, Homo sapiens
cacaacagccucacaauuc

SEQ ID NO: 1416068 - RNA, 19 nt, Homo sapiens
agaaagaccucauccuaac

SEQ ID NO: 1416069 - RNA, 19 nt, Homo sapiens
ccagcuggcucggaaauau

SEQ ID NO: 1416070 - RNA, 19 nt, Homo sapiens
gagggugauucuauuugaa

SEQ ID NO: 1416071 - RNA, 19 nt, Homo sapiens
gcaaaccauugacauacca

SEQ ID NO: 1416072 - RNA, 19 nt, Homo sapiens
gagcgaaccaugcagcuau

SEQ ID NO: 1416073 - RNA, 19 nt, Homo sapiens
gccuggaagugacugauuu

SEQ ID NO: 1416074 - RNA, 19 nt, Homo sapiens
uaugagauaugaagucuac

SEQ ID NO: 1416075 - RNA, 19 nt, Homo sapiens
cuugauggcugucauuaau

SEQ ID NO: 1416076 - RNA, 19 nt, Homo sapiens
gcaugaagaccgccgagaa

SEQ ID NO: 1416077 - RNA, 19 nt, Homo sapiens
caacgucucuuuugggauu

SEQ ID NO: 1416078 - RNA, 19 nt, Homo sapiens
ucagcaaaccauugacaua

SEQ ID NO: 1416079 - RNA, 19 nt, Homo sapiens
gcucggaaauauucauugg

SEQ ID NO: 1416080 - RNA, 19 nt, Homo sapiens
cagggagggugauucuauu

SEQ ID NO: 1416081 - RNA, 19 nt, Homo sapiens
gaggaucauucuaggcaau

SEQ ID NO: 1416082 - RNA, 19 nt, Homo sapiens
cagacagaauuauuuguuc

SEQ ID NO: 1416083 - RNA, 19 nt, Homo sapiens
gaugacauuuaagcaaaga

SEQ ID NO: 1416084 - RNA, 19 nt, Homo sapiens
cuugcuaccucuuaacaaa

SEQ ID NO: 1416085 - RNA, 19 nt, Homo sapiens
gaagaccgccgagaacauc

SEQ ID NO: 1416086 - RNA, 19 nt, Homo sapiens
gaaagaccucauccuaaca

SEQ ID NO: 1416087 - RNA, 19 nt, Homo sapiens
acacaacagccucacaauu

SEQ ID NO: 1416088 - RNA, 19 nt, Homo sapiens
guaccuggaauacuucuug

SEQ ID NO: 1416089 - RNA, 19 nt, Homo sapiens
cgccuucuauucuuugauu

SEQ ID NO: 1416090 - RNA, 19 nt, Homo sapiens
aagcaaagauggguaagag

SEQ ID NO: 1416091 - RNA, 19 nt, Homo sapiens
acacagacagaauuauuug

SEQ ID NO: 1416092 - RNA, 19 nt, Homo sapiens
cauaccagaugucauuucu

SEQ ID NO: 1416093 - RNA, 19 nt, Homo sapiens
gugcagaagcgcaaagguu

SEQ ID NO: 1416094 - RNA, 19 nt, Homo sapiens
aaaggacacagacagaauu

SEQ ID NO: 1416095 - RNA, 19 nt, Homo sapiens
aacaagugcuuccucacaa

SEQ ID NO: 1416096 - RNA, 19 nt, Homo sapiens
gguaagagcgaaccaugca

SEQ ID NO: 1416097 - RNA, 19 nt, Homo sapiens
gguuuuggaugacaauuuu

SEQ ID NO: 1416098 - RNA, 19 nt, Homo sapiens
cgaaggauuguaucucaga

SEQ ID NO: 1416099 - RNA, 19 nt, Homo sapiens
auuaaugggugucagaugu

SEQ ID NO: 1416100 - RNA, 19 nt, Homo sapiens
gccgagaacaucagaggaa

SEQ ID NO: 1416101 - RNA, 19 nt, Homo sapiens
aaacccagcuaggccaguu

SEQ ID NO: 1416102 - RNA, 19 nt, Homo sapiens
uaaccugcuuaaaggauca

SEQ ID NO: 1416103 - RNA, 19 nt, Homo sapiens
caacuugaagcuucuagca

SEQ ID NO: 1416104 - RNA, 19 nt, Homo sapiens
uccgaaggauuguaucuca

SEQ ID NO: 1416105 - RNA, 19 nt, Homo sapiens
cagacacuccgaaggauug

SEQ ID NO: 1416106 - RNA, 19 nt, Homo sapiens
aaggacacagacagaauua

SEQ ID NO: 1416107 - RNA, 19 nt, Homo sapiens
cauuugaggcccagucuug

SEQ ID NO: 1416108 - RNA, 19 nt, Homo sapiens
ggggugagaugaacaagug

SEQ ID NO: 1416109 - RNA, 19 nt, Homo sapiens
ucauaaaacugaucagaca

SEQ ID NO: 1416110 - RNA, 19 nt, Homo sapiens
uggaagugacugauuuauu

SEQ ID NO: 1416111 - RNA, 19 nt, Homo sapiens
ccagucuugcuaccucuua

SEQ ID NO: 1416112 - RNA, 19 nt, Homo sapiens
ugauggcugucauuaaugg

SEQ ID NO: 1416113 - RNA, 19 nt, Homo sapiens
gggugauucuauuugaaga

SEQ ID NO: 1416114 - RNA, 19 nt, Homo sapiens
gggagggugauucuauuug

SEQ ID NO: 1416115 - RNA, 19 nt, Homo sapiens
aaagaccucauccuaacaa

SEQ ID NO: 1416116 - RNA, 19 nt, Homo sapiens
agagaugacauuuaagcaa

SEQ ID NO: 1416117 - RNA, 19 nt, Homo sapiens
uaaaauaugcugaggacaa

SEQ ID NO: 1416118 - RNA, 19 nt, Homo sapiens
ccuggaagugacugauuua

SEQ ID NO: 1416119 - RNA, 19 nt, Homo sapiens
gaaucgagaagaggccauu

SEQ ID NO: 1416120 - RNA, 19 nt, Homo sapiens
gaaggaagcaaaagguaau

SEQ ID NO: 1416121 - RNA, 19 nt, Homo sapiens
auuuauugcucacugcuuu

SEQ ID NO: 1416122 - RNA, 19 nt, Homo sapiens
gaaaagcccaacccugaga

SEQ ID NO: 1416123 - RNA, 19 nt, Homo sapiens
caucgguguugucgcguau

SEQ ID NO: 1416124 - RNA, 19 nt, Homo sapiens
gcuuucagcaaaccauuga

SEQ ID NO: 1416125 - RNA, 19 nt, Homo sapiens
ucuaggcaaugaacacauc

SEQ ID NO: 1416126 - RNA, 19 nt, Homo sapiens
agacaaugaaggaagcaaa

SEQ ID NO: 1416127 - RNA, 19 nt, Homo sapiens
cagcaaaccauugacauac

SEQ ID NO: 1416128 - RNA, 19 nt, Homo sapiens
ggaaaggcucaacgucucu

SEQ ID NO: 1416129 - RNA, 19 nt, Homo sapiens
ugacauuuaagcaaagaug

SEQ ID NO: 1416130 - RNA, 19 nt, Homo sapiens
uaucucagacaaugaagga

SEQ ID NO: 1416131 - RNA, 19 nt, Homo sapiens
cagucuugcuaccucuuaa

SEQ ID NO: 1416132 - RNA, 19 nt, Homo sapiens
uaccuggaauacuucuuga

SEQ ID NO: 1416133 - RNA, 19 nt, Homo sapiens
gguguugucgcguaugaug

SEQ ID NO: 1416134 - RNA, 19 nt, Homo sapiens
gaacaaaaggacacagaca

SEQ ID NO: 1416135 - RNA, 19 nt, Homo sapiens
gaagugacugauuuauugc

SEQ ID NO: 1416136 - RNA, 19 nt, Homo sapiens
gaaaggcucaacgucucuu

SEQ ID NO: 1416137 - RNA, 19 nt, Homo sapiens
cagaguaugagauaugaag

SEQ ID NO: 1416138 - RNA, 19 nt, Homo sapiens
ccuggaauacuucuugaug

SEQ ID NO: 1416139 - RNA, 19 nt, Homo sapiens
ggagggaaaggcucaacgu

SEQ ID NO: 1416140 - RNA, 19 nt, Homo sapiens
guucaacuaacauucuuca

SEQ ID NO: 1416141 - RNA, 19 nt, Homo sapiens
gaggacaauauggaacaaa

SEQ ID NO: 1416142 - RNA, 19 nt, Homo sapiens
ugaggacaauauggaacaa

SEQ ID NO: 1416143 - RNA, 19 nt, Homo sapiens
cagcuggcucggaaauauu

SEQ ID NO: 1416144 - RNA, 19 nt, Homo sapiens
gaaaugaaguccugaaaua

SEQ ID NO: 1416145 - RNA, 19 nt, Homo sapiens
gaaaacagauggcgacuua

SEQ ID NO: 1416146 - RNA, 19 nt, Homo sapiens
ggcaagagcuguuuccuuu

SEQ ID NO: 1416147 - RNA, 19 nt, Homo sapiens
cauaagcacuggaagaaua

SEQ ID NO: 1416148 - RNA, 19 nt, Homo sapiens
gaauacagauguuauagug

SEQ ID NO: 1416149 - RNA, 19 nt, Homo sapiens
gaugaugucuguacuaguu

SEQ ID NO: 1416150 - RNA, 19 nt, Homo sapiens
cuacagaccucgcuuguug

SEQ ID NO: 1416151 - RNA, 19 nt, Homo sapiens
gcaaccaucuuucuguuug

SEQ ID NO: 1416152 - RNA, 19 nt, Homo sapiens
gaacagggcauggcauauu

SEQ ID NO: 1416153 - RNA, 19 nt, Homo sapiens
gcauauuguuggugcauaa

SEQ ID NO: 1416154 - RNA, 19 nt, Homo sapiens
auaaacagcucaggcauaa

SEQ ID NO: 1416155 - RNA, 19 nt, Homo sapiens
uauagugaguccuacaaua

SEQ ID NO: 1416156 - RNA, 19 nt, Homo sapiens
gaaaguguaacucagauga

SEQ ID NO: 1416157 - RNA, 19 nt, Homo sapiens
uaaagcaucugccuaaguc

SEQ ID NO: 1416158 - RNA, 19 nt, Homo sapiens
gcucaggcauaauuugaaa

SEQ ID NO: 1416159 - RNA, 19 nt, Homo sapiens
gauaaacagcucaggcaua

SEQ ID NO: 1416160 - RNA, 19 nt, Homo sapiens
uggcugcccuucacacuua

SEQ ID NO: 1416161 - RNA, 19 nt, Homo sapiens
acacaagccuggauucgaa

SEQ ID NO: 1416162 - RNA, 19 nt, Homo sapiens
gcaggugaccgcagaauga

SEQ ID NO: 1416163 - RNA, 19 nt, Homo sapiens
gagauugguuuguuuacug

SEQ ID NO: 1416164 - RNA, 19 nt, Homo sapiens
aaacagcucaggcauaauu

SEQ ID NO: 1416165 - RNA, 19 nt, Homo sapiens
gcagcaaagucuucucugu

SEQ ID NO: 1416166 - RNA, 19 nt, Homo sapiens
ucacggagcugccgaggau

SEQ ID NO: 1416167 - RNA, 19 nt, Homo sapiens
gcagagaggccugagcuaa

SEQ ID NO: 1416168 - RNA, 19 nt, Homo sapiens
ggaagaauacagauguuau

SEQ ID NO: 1416169 - RNA, 19 nt, Homo sapiens
ccaccuggcugcucugaug

SEQ ID NO: 1416170 - RNA, 19 nt, Homo sapiens
gacugcaccucuucuauug

SEQ ID NO: 1416171 - RNA, 19 nt, Homo sapiens
caggucagcuccuuagaga

SEQ ID NO: 1416172 - RNA, 19 nt, Homo sapiens
caugaaagguguguggaaa

SEQ ID NO: 1416173 - RNA, 19 nt, Homo sapiens
ggaaaugaaguccugaaau

SEQ ID NO: 1416174 - RNA, 19 nt, Homo sapiens
gaaaguggccagcauucug

SEQ ID NO: 1416175 - RNA, 19 nt, Homo sapiens
gcacugagucaacaagguu

SEQ ID NO: 1416176 - RNA, 19 nt, Homo sapiens
gcacgaagugagcaaagaa

SEQ ID NO: 1416177 - RNA, 19 nt, Homo sapiens
cagcaugucucaccaucug

SEQ ID NO: 1416178 - RNA, 19 nt, Homo sapiens
acaagucccugccucaugu

SEQ ID NO: 1416179 - RNA, 19 nt, Homo sapiens
gauaaucuucugaaagugu

SEQ ID NO: 1416180 - RNA, 19 nt, Homo sapiens
cagacaagcuaaagcaucu

SEQ ID NO: 1416181 - RNA, 19 nt, Homo sapiens
gugaugggcuuugcaaauc

SEQ ID NO: 1416182 - RNA, 19 nt, Homo sapiens
gcuguuuccuuuccauuuc

SEQ ID NO: 1416183 - RNA, 19 nt, Homo sapiens
gauguuauagugaguccua

SEQ ID NO: 1416184 - RNA, 19 nt, Homo sapiens
aagaagcgccuuuagcaaa

SEQ ID NO: 1416185 - RNA, 19 nt, Homo sapiens
gcacacaucaugggcuuug

SEQ ID NO: 1416186 - RNA, 19 nt, Homo sapiens
cagaacagggcauggcaua

SEQ ID NO: 1416187 - RNA, 19 nt, Homo sapiens
gcuccacucuguagcacuu

SEQ ID NO: 1416188 - RNA, 19 nt, Homo sapiens
acagagauugguuuguuua

SEQ ID NO: 1416189 - RNA, 19 nt, Homo sapiens
aauugcagaugaugcuaua

SEQ ID NO: 1416190 - RNA, 19 nt, Homo sapiens
ccugccagcugcuucauga

SEQ ID NO: 1416191 - RNA, 19 nt, Homo sapiens
acacacacacaaccagaua

SEQ ID NO: 1416192 - RNA, 19 nt, Homo sapiens
ugaaagguguguggaaagu

SEQ ID NO: 1416193 - RNA, 19 nt, Homo sapiens
aaauggagaugauaacacu

SEQ ID NO: 1416194 - RNA, 19 nt, Homo sapiens
aaucugggcucuuucacau

SEQ ID NO: 1416195 - RNA, 19 nt, Homo sapiens
caagagcuguuuccuuucc

SEQ ID NO: 1416196 - RNA, 19 nt, Homo sapiens
gaacaagucccugccucau

SEQ ID NO: 1416197 - RNA, 19 nt, Homo sapiens
gugaugaugucuguacuag

SEQ ID NO: 1416198 - RNA, 19 nt, Homo sapiens
guccugaaauaaagugaug

SEQ ID NO: 1416199 - RNA, 19 nt, Homo sapiens
agacugcaccucuucuauu

SEQ ID NO: 1416200 - RNA, 19 nt, Homo sapiens
ugucuuagguuggcauuca

SEQ ID NO: 1416201 - RNA, 19 nt, Homo sapiens
auucgaaucugggcucuuu

SEQ ID NO: 1416202 - RNA, 19 nt, Homo sapiens
cccaaagacugaugaaugc

SEQ ID NO: 1416203 - RNA, 19 nt, Homo sapiens
aacagggcauggcauauug

SEQ ID NO: 1416204 - RNA, 19 nt, Homo sapiens
cagcucaggcauaauuuga

SEQ ID NO: 1416205 - RNA, 19 nt, Homo sapiens
ggagcuggcacuguuggua

SEQ ID NO: 1416206 - RNA, 19 nt, Homo sapiens
uuugucgucuuguugauuu

SEQ ID NO: 1416207 - RNA, 19 nt, Homo sapiens
caaccaucuuucuguuugu

SEQ ID NO: 1416208 - RNA, 19 nt, Homo sapiens
ccaccucgcugcuguucca

SEQ ID NO: 1416209 - RNA, 19 nt, Homo sapiens
uguccucgcucccuccauu

SEQ ID NO: 1416210 - RNA, 19 nt, Homo sapiens
gggcugucaugguccuuug

SEQ ID NO: 1416211 - RNA, 19 nt, Homo sapiens
agcaaagucuucucugugu

SEQ ID NO: 1416212 - RNA, 19 nt, Homo sapiens
uaauugcaagcacucauuu

SEQ ID NO: 1416213 - RNA, 19 nt, Homo sapiens
caugcgaucccaccacaaa

SEQ ID NO: 1416214 - RNA, 19 nt, Homo sapiens
agaguggccaccuugcuua

SEQ ID NO: 1416215 - RNA, 19 nt, Homo sapiens
gggaacagagauugguuug

SEQ ID NO: 1416216 - RNA, 19 nt, Homo sapiens
cuaucuagcucuucauggu

SEQ ID NO: 1416217 - RNA, 19 nt, Homo sapiens
caagguuugugaugauguc

SEQ ID NO: 1416218 - RNA, 19 nt, Homo sapiens
gaaauggagaugauaacac

SEQ ID NO: 1416219 - RNA, 19 nt, Homo sapiens
gaaucugggcucuuucaca

SEQ ID NO: 1416220 - RNA, 19 nt, Homo sapiens
gggcuucauucaacauuuu

SEQ ID NO: 1416221 - RNA, 19 nt, Homo sapiens
uagcauaagcacuggaaga

SEQ ID NO: 1416222 - RNA, 19 nt, Homo sapiens
gguuugugaugaugucugu

SEQ ID NO: 1416223 - RNA, 19 nt, Homo sapiens
ggcauauuguuggugcaua

SEQ ID NO: 1416224 - RNA, 19 nt, Homo sapiens
cugcaaccaucuuucuguu

SEQ ID NO: 1416225 - RNA, 19 nt, Homo sapiens
uggaagaauacagauguua

SEQ ID NO: 1416226 - RNA, 19 nt, Homo sapiens
guacuaguuagcuauuguu

SEQ ID NO: 1416227 - RNA, 19 nt, Homo sapiens
gaugaugcuauaacacuuc

SEQ ID NO: 1416228 - RNA, 19 nt, Homo sapiens
gccagcugcuucaugaaca

SEQ ID NO: 1416229 - RNA, 19 nt, Homo sapiens
gcuaaagcaucugccuaag

SEQ ID NO: 1416230 - RNA, 19 nt, Homo sapiens
ugucuguacuaguuagcua

SEQ ID NO: 1416231 - RNA, 19 nt, Homo sapiens
aaccuguccuuucgccuaa

SEQ ID NO: 1416232 - RNA, 19 nt, Homo sapiens
ccagcugcuucaugaacaa

SEQ ID NO: 1416233 - RNA, 19 nt, Homo sapiens
gaaguccugaaauaaagug

SEQ ID NO: 1416234 - RNA, 19 nt, Homo sapiens
caaagugcaaccuguccuu

SEQ ID NO: 1416235 - RNA, 19 nt, Homo sapiens
gcaggucagcuccuuagag

SEQ ID NO: 1416236 - RNA, 19 nt, Homo sapiens
augagucaauugcagauga

SEQ ID NO: 1416237 - RNA, 19 nt, Homo sapiens
gcaagagcuguuuccuuuc

SEQ ID NO: 1416238 - RNA, 19 nt, Homo sapiens
gucccugccucauguuaau

SEQ ID NO: 1416239 - RNA, 19 nt, Homo sapiens
aaguguaacucagaugaug

SEQ ID NO: 1416240 - RNA, 19 nt, Homo sapiens
ucugugaaauggagaugau

SEQ ID NO: 1416241 - RNA, 19 nt, Homo sapiens
agccacaccugcaugaugu

SEQ ID NO: 1416242 - RNA, 19 nt, Homo sapiens
ggccugacccacauucuca

SEQ ID NO: 1416243 - RNA, 19 nt, Homo sapiens
agaagcgccuuuagcaaac

SEQ ID NO: 1416244 - RNA, 19 nt, Homo sapiens
gauauauucuggagacuua

SEQ ID NO: 1416245 - RNA, 19 nt, Homo sapiens
gaacguuucucugaagaua

SEQ ID NO: 1416246 - RNA, 19 nt, Homo sapiens
ccacagaccugcuuaugaa

SEQ ID NO: 1416247 - RNA, 19 nt, Homo sapiens
gaaccucacugccuuguug

SEQ ID NO: 1416248 - RNA, 19 nt, Homo sapiens
ccaaguauaucgaaccaua

SEQ ID NO: 1416249 - RNA, 19 nt, Homo sapiens
gcacuuggauuacagauuc

SEQ ID NO: 1416250 - RNA, 19 nt, Homo sapiens
gaugaagacuuaaucgaaa

SEQ ID NO: 1416251 - RNA, 19 nt, Homo sapiens
gcaguuauguuuccagaga

SEQ ID NO: 1416252 - RNA, 19 nt, Homo sapiens
gaaccaagacuauucaguu

SEQ ID NO: 1416253 - RNA, 19 nt, Homo sapiens
gggcuugccucgaagauuu

SEQ ID NO: 1416254 - RNA, 19 nt, Homo sapiens
ccaaaaggaugaagacuua

SEQ ID NO: 1416255 - RNA, 19 nt, Homo sapiens
gcucaagagucacauuaaa

SEQ ID NO: 1416256 - RNA, 19 nt, Homo sapiens
gaaaugcccagauguagaa

SEQ ID NO: 1416257 - RNA, 19 nt, Homo sapiens
gcaugagacuaccaaguuu

SEQ ID NO: 1416258 - RNA, 19 nt, Homo sapiens
gaagaccucuauguugaaa

SEQ ID NO: 1416259 - RNA, 19 nt, Homo sapiens
gaagauaugaugacaaauc

SEQ ID NO: 1416260 - RNA, 19 nt, Homo sapiens
caagaaaugcccagaugua

SEQ ID NO: 1416261 - RNA, 19 nt, Homo sapiens
ggaagaagaagauaugaug

SEQ ID NO: 1416262 - RNA, 19 nt, Homo sapiens
acacagagacccuugauaa

SEQ ID NO: 1416263 - RNA, 19 nt, Homo sapiens
cuaccaaguuuguuuguuu

SEQ ID NO: 1416264 - RNA, 19 nt, Homo sapiens
ggaagaagauguuuaucac

SEQ ID NO: 1416265 - RNA, 19 nt, Homo sapiens
ggacaacgaggauaaugaa

SEQ ID NO: 1416266 - RNA, 19 nt, Homo sapiens
gcaugacuguugaccuuaa

SEQ ID NO: 1416267 - RNA, 19 nt, Homo sapiens
gaaaccacugucuauguua

SEQ ID NO: 1416268 - RNA, 19 nt, Homo sapiens
aaacuccucuuauacagaa

SEQ ID NO: 1416269 - RNA, 19 nt, Homo sapiens
aguacaaacuccucuuaua

SEQ ID NO: 1416270 - RNA, 19 nt, Homo sapiens
ucgaaauacuuaccucuaa

SEQ ID NO: 1416271 - RNA, 19 nt, Homo sapiens
ugaccaaucuggagagaga

SEQ ID NO: 1416272 - RNA, 19 nt, Homo sapiens
ggacugcaccucuuuggaa

SEQ ID NO: 1416273 - RNA, 19 nt, Homo sapiens
ggaugaagacuuaaucgaa

SEQ ID NO: 1416274 - RNA, 19 nt, Homo sapiens
cugaagaccucuauguuga

SEQ ID NO: 1416275 - RNA, 19 nt, Homo sapiens
ucaaccagcuggaagaaga

SEQ ID NO: 1416276 - RNA, 19 nt, Homo sapiens
cagagaacaucuagaagug

SEQ ID NO: 1416277 - RNA, 19 nt, Homo sapiens
caacgaggauaaugaaguc

SEQ ID NO: 1416278 - RNA, 19 nt, Homo sapiens
gaucggaguccuuucguuu

SEQ ID NO: 1416279 - RNA, 19 nt, Homo sapiens
caacaagcauggccacuac

SEQ ID NO: 1416280 - RNA, 19 nt, Homo sapiens
gaagaagaagauaugauga

SEQ ID NO: 1416281 - RNA, 19 nt, Homo sapiens
ggagaucacggucccaauu

SEQ ID NO: 1416282 - RNA, 19 nt, Homo sapiens
aaacaaagagguuagucua

SEQ ID NO: 1416283 - RNA, 19 nt, Homo sapiens
gaucauaaauguacuucac

SEQ ID NO: 1416284 - RNA, 19 nt, Homo sapiens
ccgaaucccugaagaacaa

SEQ ID NO: 1416285 - RNA, 19 nt, Homo sapiens
gugaaaccguuaucagcua

SEQ ID NO: 1416286 - RNA, 19 nt, Homo sapiens
agaaaccacugucuauguu

SEQ ID NO: 1416287 - RNA, 19 nt, Homo sapiens
acaaagagguuagucuaga

SEQ ID NO: 1416288 - RNA, 19 nt, Homo sapiens
gaaacgaucggaguccuuu

SEQ ID NO: 1416289 - RNA, 19 nt, Homo sapiens
aagccaagguggagaauga

SEQ ID NO: 1416290 - RNA, 19 nt, Homo sapiens
uagcaugacuguugaccuu

SEQ ID NO: 1416291 - RNA, 19 nt, Homo sapiens
guuaucagcuauuauacug

SEQ ID NO: 1416292 - RNA, 19 nt, Homo sapiens
aaaccguuaucagcuauua

SEQ ID NO: 1416293 - RNA, 19 nt, Homo sapiens
gagacuaccaaguuuguuu

SEQ ID NO: 1416294 - RNA, 19 nt, Homo sapiens
cuagagggauuaguacaaa

SEQ ID NO: 1416295 - RNA, 19 nt, Homo sapiens
cgaaauacuuaccucuaau

SEQ ID NO: 1416296 - RNA, 19 nt, Homo sapiens
gcaaguagcccaaguaacc

SEQ ID NO: 1416297 - RNA, 19 nt, Homo sapiens
gaaagcagacagacuugga

SEQ ID NO: 1416298 - RNA, 19 nt, Homo sapiens
gcccagauguagaaauuca

SEQ ID NO: 1416299 - RNA, 19 nt, Homo sapiens
guacaaacuccucuuauac

SEQ ID NO: 1416300 - RNA, 19 nt, Homo sapiens
ggaugacgaugaggccuuu

SEQ ID NO: 1416301 - RNA, 19 nt, Homo sapiens
acgagaagguuguuuccua

SEQ ID NO: 1416302 - RNA, 19 nt, Homo sapiens
cuauuggucuuccagaauu

SEQ ID NO: 1416303 - RNA, 19 nt, Homo sapiens
ccucuaauuugccauauca

SEQ ID NO: 1416304 - RNA, 19 nt, Homo sapiens
gguuugggcuugccucgaa

SEQ ID NO: 1416305 - RNA, 19 nt, Homo sapiens
ugacaacgaaccauacauu

SEQ ID NO: 1416306 - RNA, 19 nt, Homo sapiens
caaaucagagggaugaaga

SEQ ID NO: 1416307 - RNA, 19 nt, Homo sapiens
ggcaugagacuaccaaguu

SEQ ID NO: 1416308 - RNA, 19 nt, Homo sapiens
gcaggguauuuaagugcua

SEQ ID NO: 1416309 - RNA, 19 nt, Homo sapiens
gacaacgaaccauacauuu

SEQ ID NO: 1416310 - RNA, 19 nt, Homo sapiens
ucaagagucacauuaaaga

SEQ ID NO: 1416311 - RNA, 19 nt, Homo sapiens
agaaauacagucagccuuu

SEQ ID NO: 1416312 - RNA, 19 nt, Homo sapiens
uuagugcucuauuuccuuu

SEQ ID NO: 1416313 - RNA, 19 nt, Homo sapiens
ucaguugguuaaacaaaga

SEQ ID NO: 1416314 - RNA, 19 nt, Homo sapiens
agaagagguuauaguguga

SEQ ID NO: 1416315 - RNA, 19 nt, Homo sapiens
aaacuaagggcuucauuca

SEQ ID NO: 1416316 - RNA, 19 nt, Homo sapiens
gcaugggaaugaccaaucu

SEQ ID NO: 1416317 - RNA, 19 nt, Homo sapiens
ugacaaaucagagggauga

SEQ ID NO: 1416318 - RNA, 19 nt, Homo sapiens
cagagacccuugauaaacu

SEQ ID NO: 1416319 - RNA, 19 nt, Homo sapiens
auacugacauggaagaaau

SEQ ID NO: 1416320 - RNA, 19 nt, Homo sapiens
gagacuuagugguguguga

SEQ ID NO: 1416321 - RNA, 19 nt, Homo sapiens
cauucuaggucaccacauu

SEQ ID NO: 1416322 - RNA, 19 nt, Homo sapiens
uaagauccauucucauugc

SEQ ID NO: 1416323 - RNA, 19 nt, Homo sapiens
aaaccacugucuauguuau

SEQ ID NO: 1416324 - RNA, 19 nt, Homo sapiens
gauaaacugcuaaccgaau

SEQ ID NO: 1416325 - RNA, 19 nt, Homo sapiens
gggcagaaaccacugucua

SEQ ID NO: 1416326 - RNA, 19 nt, Homo sapiens
aaccaagacuauucaguug

SEQ ID NO: 1416327 - RNA, 19 nt, Homo sapiens
auacuuaccucuaauuugc

SEQ ID NO: 1416328 - RNA, 19 nt, Homo sapiens
agaccucuauguugaaaug

SEQ ID NO: 1416329 - RNA, 19 nt, Homo sapiens
gaagaagauaugaugacaa

SEQ ID NO: 1416330 - RNA, 19 nt, Homo sapiens
gaaucaaccagcuggaaga

SEQ ID NO: 1416331 - RNA, 19 nt, Homo sapiens
gaguacaccauuucaguga

SEQ ID NO: 1416332 - RNA, 19 nt, Homo sapiens
gaaauucaucagugccuau

SEQ ID NO: 1416333 - RNA, 19 nt, Homo sapiens
ugugagacuuguaguauuc

SEQ ID NO: 1416334 - RNA, 19 nt, Homo sapiens
ccagcugccugacaacgaa

SEQ ID NO: 1416335 - RNA, 19 nt, Homo sapiens
gaagaagauguuuaucaca

SEQ ID NO: 1416336 - RNA, 19 nt, Homo sapiens
ccaacaccaucgcugagaa

SEQ ID NO: 1416337 - RNA, 19 nt, Homo sapiens
gcuauuauacugacaugga

SEQ ID NO: 1416338 - RNA, 19 nt, Homo sapiens
ucaaauccauggguucugu

SEQ ID NO: 1416339 - RNA, 19 nt, Homo sapiens
gcagaaaccacugucuaug

SEQ ID NO: 1416340 - RNA, 19 nt, Homo sapiens
gaagacagagagagaagca

SEQ ID NO: 1416341 - RNA, 19 nt, Homo sapiens
ucaggaagaagauguuuau

SEQ ID NO: 1416342 - RNA, 19 nt, Homo sapiens
cagaccugcuuaugaaaug

SEQ ID NO: 1416343 - RNA, 19 nt, Homo sapiens
ccgcgaauccuguggaauu

SEQ ID NO: 1416344 - RNA, 19 nt, Homo sapiens
gaagacaccucaauucaca

SEQ ID NO: 1416345 - RNA, 19 nt, Homo sapiens
gcacuuggaucacaacuuc

SEQ ID NO: 1416346 - RNA, 19 nt, Homo sapiens
gcaccaggaucucaucauu

SEQ ID NO: 1416347 - RNA, 19 nt, Homo sapiens
gaugaagaguuuaaagaug

SEQ ID NO: 1416348 - RNA, 19 nt, Homo sapiens
guucacuacuggacucuua

SEQ ID NO: 1416349 - RNA, 19 nt, Homo sapiens
ggcaauggcugcucucaau

SEQ ID NO: 1416350 - RNA, 19 nt, Homo sapiens
gggcaaauguggccugaau

SEQ ID NO: 1416351 - RNA, 19 nt, Homo sapiens
aggcggagcugcaguaauu

SEQ ID NO: 1416352 - RNA, 19 nt, Homo sapiens
gcagagaguucgccugucu

SEQ ID NO: 1416353 - RNA, 19 nt, Homo sapiens
ggaggacagucucaguuau

SEQ ID NO: 1416354 - RNA, 19 nt, Homo sapiens
gaccaugggugcuucuaga

SEQ ID NO: 1416355 - RNA, 19 nt, Homo sapiens
gcaggaagagcaugccuuu

SEQ ID NO: 1416356 - RNA, 19 nt, Homo sapiens
gagaggagaauguguauag

SEQ ID NO: 1416357 - RNA, 19 nt, Homo sapiens
guaggugcccugaugauuu

SEQ ID NO: 1416358 - RNA, 19 nt, Homo sapiens
guaaugggaugaggaggaa

SEQ ID NO: 1416359 - RNA, 19 nt, Homo sapiens
ugagccagaugaagaguuu

SEQ ID NO: 1416360 - RNA, 19 nt, Homo sapiens
acaagaggcuggagaucaa

SEQ ID NO: 1416361 - RNA, 19 nt, Homo sapiens
gacaggcuuugguaucgua

SEQ ID NO: 1416362 - RNA, 19 nt, Homo sapiens
ugaaugagggugcauggua

SEQ ID NO: 1416363 - RNA, 19 nt, Homo sapiens
ggaugcaggugaugguguu

SEQ ID NO: 1416364 - RNA, 19 nt, Homo sapiens
ggguugaaguucccagauu

SEQ ID NO: 1416365 - RNA, 19 nt, Homo sapiens
ggacugagcgaguggacuu

SEQ ID NO: 1416366 - RNA, 19 nt, Homo sapiens
ggaagagcaugccuuugag

SEQ ID NO: 1416367 - RNA, 19 nt, Homo sapiens
uggagggccuggcauguuu

SEQ ID NO: 1416368 - RNA, 19 nt, Homo sapiens
gcccugccuuucucaagua

SEQ ID NO: 1416369 - RNA, 19 nt, Homo sapiens
caucucugcugauugaaug

SEQ ID NO: 1416370 - RNA, 19 nt, Homo sapiens
gcagggcacuuggaucaca

SEQ ID NO: 1416371 - RNA, 19 nt, Homo sapiens
gguugaaguucccagauuc

SEQ ID NO: 1416372 - RNA, 19 nt, Homo sapiens
ggaaggauggucugaugga

SEQ ID NO: 1416373 - RNA, 19 nt, Homo sapiens
guggaguucuuccgaguug

SEQ ID NO: 1416374 - RNA, 19 nt, Homo sapiens
cagaugaagaguuuaaaga

SEQ ID NO: 1416375 - RNA, 19 nt, Homo sapiens
gaagagcaugccuuugaga

SEQ ID NO: 1416376 - RNA, 19 nt, Homo sapiens
ucaacuugguucucuccua

SEQ ID NO: 1416377 - RNA, 19 nt, Homo sapiens
gagcugcccugccuuucuc

SEQ ID NO: 1416378 - RNA, 19 nt, Homo sapiens
aggaagagcaugccuuuga

SEQ ID NO: 1416379 - RNA, 19 nt, Homo sapiens
cugccuuucucaaguauuu

SEQ ID NO: 1416380 - RNA, 19 nt, Homo sapiens
gaggacagucucaguuaug

SEQ ID NO: 1416381 - RNA, 19 nt, Homo sapiens
aaauguggccugaaugcua

SEQ ID NO: 1416382 - RNA, 19 nt, Homo sapiens
uaggugcccugaugauuuc

SEQ ID NO: 1416383 - RNA, 19 nt, Homo sapiens
gagggagacuguguuugug

SEQ ID NO: 1416384 - RNA, 19 nt, Homo sapiens
cagucugcaugcuguauuu

SEQ ID NO: 1416385 - RNA, 19 nt, Homo sapiens
uggcugaggugaagagcuu

SEQ ID NO: 1416386 - RNA, 19 nt, Homo sapiens
gcucaguaucucucccuua

SEQ ID NO: 1416387 - RNA, 19 nt, Homo sapiens
gaggagaauguguauagga

SEQ ID NO: 1416388 - RNA, 19 nt, Homo sapiens
guucccagauucccugaga

SEQ ID NO: 1416389 - RNA, 19 nt, Homo sapiens
gcaaauguggccugaaugc

SEQ ID NO: 1416390 - RNA, 19 nt, Homo sapiens
ggugugugcugggcaaaug

SEQ ID NO: 1416391 - RNA, 19 nt, Homo sapiens
uggaggacagucucaguua

SEQ ID NO: 1416392 - RNA, 19 nt, Homo sapiens
accaggaucucaucauuuc

SEQ ID NO: 1416393 - RNA, 19 nt, Homo sapiens
ccagagggagacuguguuu

SEQ ID NO: 1416394 - RNA, 19 nt, Homo sapiens
ggaucucugugucuaugga

SEQ ID NO: 1416395 - RNA, 19 nt, Homo sapiens
gguaucguaucgccucugu

SEQ ID NO: 1416396 - RNA, 19 nt, Homo sapiens
gagcugaugcggaggaagu

SEQ ID NO: 1416397 - RNA, 19 nt, Homo sapiens
gaacuaaaaggaucucugu

SEQ ID NO: 1416398 - RNA, 19 nt, Homo sapiens
ccauuucuuuccaacaguu

SEQ ID NO: 1416399 - RNA, 19 nt, Homo sapiens
gggccuggguaguguagga

SEQ ID NO: 1416400 - RNA, 19 nt, Homo sapiens
ccucgaagacaccucaauu

SEQ ID NO: 1416401 - RNA, 19 nt, Homo sapiens
gcuggauucuggagcuguu

SEQ ID NO: 1416402 - RNA, 19 nt, Homo sapiens
guaaccagaccuugagcaa

SEQ ID NO: 1416403 - RNA, 19 nt, Homo sapiens
uuaaacagcacgcucuuuc

SEQ ID NO: 1416404 - RNA, 19 nt, Homo sapiens
uaucgccucuguguccuuu

SEQ ID NO: 1416405 - RNA, 19 nt, Homo sapiens
ccugagaggagaaugugua

SEQ ID NO: 1416406 - RNA, 19 nt, Homo sapiens
ccucagagagccugcagaa

SEQ ID NO: 1416407 - RNA, 19 nt, Homo sapiens
ccacucugcuggguucuca

SEQ ID NO: 1416408 - RNA, 19 nt, Homo sapiens
caggugaugguguucgaua

SEQ ID NO: 1416409 - RNA, 19 nt, Homo sapiens
cagucucaguuaugggaua

SEQ ID NO: 1416410 - RNA, 19 nt, Homo sapiens
gcacuccaguuuccuuucc

SEQ ID NO: 1416411 - RNA, 19 nt, Homo sapiens
uagaaacaggguugaaguu

SEQ ID NO: 1416412 - RNA, 19 nt, Homo sapiens
caccaggaucucaucauuu

SEQ ID NO: 1416413 - RNA, 19 nt, Homo sapiens
aaaaggaucucugugucua

SEQ ID NO: 1416414 - RNA, 19 nt, Homo sapiens
ggucuccauuucuuuccaa

SEQ ID NO: 1416415 - RNA, 19 nt, Homo sapiens
ucgaagacaccucaauuca

SEQ ID NO: 1416416 - RNA, 19 nt, Homo sapiens
gaaggaugcaggugauggu

SEQ ID NO: 1416417 - RNA, 19 nt, Homo sapiens
agagggagacuguguuugu

SEQ ID NO: 1416418 - RNA, 19 nt, Homo sapiens
gugaugguguucgauacuu

SEQ ID NO: 1416419 - RNA, 19 nt, Homo sapiens
uaucguaucgccucugugu

SEQ ID NO: 1416420 - RNA, 19 nt, Homo sapiens
caaccaggcacccguccuu

SEQ ID NO: 1416421 - RNA, 19 nt, Homo sapiens
aggaggaccugcagagagu

SEQ ID NO: 1416422 - RNA, 19 nt, Homo sapiens
ccagacaggcuuugguauc

SEQ ID NO: 1416423 - RNA, 19 nt, Homo sapiens
ugaugguguucgauacuug

SEQ ID NO: 1416424 - RNA, 19 nt, Homo sapiens
caacuucugcacccucugu

SEQ ID NO: 1416425 - RNA, 19 nt, Homo sapiens
caugggugcuucuagaaac

SEQ ID NO: 1416426 - RNA, 19 nt, Homo sapiens
aaacagcacgcucuuucug

SEQ ID NO: 1416427 - RNA, 19 nt, Homo sapiens
ucuuuacacuggagaggaa

SEQ ID NO: 1416428 - RNA, 19 nt, Homo sapiens
cucaguaucucucccuuag

SEQ ID NO: 1416429 - RNA, 19 nt, Homo sapiens
ucaaggugcccaagucauc

SEQ ID NO: 1416430 - RNA, 19 nt, Homo sapiens
ucucgaugcugcuccuuca

SEQ ID NO: 1416431 - RNA, 19 nt, Homo sapiens
uaagagaggagaguucagu

SEQ ID NO: 1416432 - RNA, 19 nt, Homo sapiens
cagacaggcuuugguaucg

SEQ ID NO: 1416433 - RNA, 19 nt, Homo sapiens
gcccagcacuccaguuucc

SEQ ID NO: 1416434 - RNA, 19 nt, Homo sapiens
gaccugcgacuuccgaaca

SEQ ID NO: 1416435 - RNA, 19 nt, Homo sapiens
uugguucucuccuacaaga

SEQ ID NO: 1416436 - RNA, 19 nt, Homo sapiens
aaggaucucugugucuaug

SEQ ID NO: 1416437 - RNA, 19 nt, Homo sapiens
ccaugggugcuucuagaaa

SEQ ID NO: 1416438 - RNA, 19 nt, Homo sapiens
guuuaaagaugcgauugag

SEQ ID NO: 1416439 - RNA, 19 nt, Homo sapiens
ggggaaggauggucugaug

SEQ ID NO: 1416440 - RNA, 19 nt, Homo sapiens
gccucaagcuucaaaagaa

SEQ ID NO: 1416441 - RNA, 19 nt, Homo sapiens
cugugucuauggagaauug

SEQ ID NO: 1416442 - RNA, 19 nt, Homo sapiens
gcaauggcugcucucaauc

SEQ ID NO: 1416443 - RNA, 19 nt, Homo sapiens
agcagaggaugaacccaaa

SEQ ID NO: 1416444 - RNA, 19 nt, Homo sapiens
gcacauauuucuuccguaa

SEQ ID NO: 1416445 - RNA, 19 nt, Homo sapiens
caacagaaaucgaguacuu

SEQ ID NO: 1416446 - RNA, 19 nt, Homo sapiens
gcaaagagagaaaccaaua

SEQ ID NO: 1416447 - RNA, 19 nt, Homo sapiens
gcuaauggcuuauuuccaa

SEQ ID NO: 1416448 - RNA, 19 nt, Homo sapiens
gaaaagagaugaacguuau

SEQ ID NO: 1416449 - RNA, 19 nt, Homo sapiens
gaaaucgaguacuuaauuc

SEQ ID NO: 1416450 - RNA, 19 nt, Homo sapiens
gagaagugguuugauguuu

SEQ ID NO: 1416451 - RNA, 19 nt, Homo sapiens
guccauaucuccacacuga

SEQ ID NO: 1416452 - RNA, 19 nt, Homo sapiens
caaagaggauuacugaagu

SEQ ID NO: 1416453 - RNA, 19 nt, Homo sapiens
gaagguaguuaaugacaag

SEQ ID NO: 1416454 - RNA, 19 nt, Homo sapiens
gaaauauagauuccgcuua

SEQ ID NO: 1416455 - RNA, 19 nt, Homo sapiens
ggaaaucaauacuggagau

SEQ ID NO: 1416456 - RNA, 19 nt, Homo sapiens
gaagugguuugauguuugu

SEQ ID NO: 1416457 - RNA, 19 nt, Homo sapiens
gagaggugauggugagauu

SEQ ID NO: 1416458 - RNA, 19 nt, Homo sapiens
ucagagaagugguuugaug

SEQ ID NO: 1416459 - RNA, 19 nt, Homo sapiens
gaggugauggugagauuua

SEQ ID NO: 1416460 - RNA, 19 nt, Homo sapiens
ggucauaggacuucgcuaa

SEQ ID NO: 1416461 - RNA, 19 nt, Homo sapiens
ggaagguaguuaaugacaa

SEQ ID NO: 1416462 - RNA, 19 nt, Homo sapiens
cacagaagaugaacaagga

SEQ ID NO: 1416463 - RNA, 19 nt, Homo sapiens
guucacaucuggacaugga

SEQ ID NO: 1416464 - RNA, 19 nt, Homo sapiens
gcccaggccuucuccaaga

SEQ ID NO: 1416465 - RNA, 19 nt, Homo sapiens
gaaaucaauacuggagaua

SEQ ID NO: 1416466 - RNA, 19 nt, Homo sapiens
gaaauggagggucauagga

SEQ ID NO: 1416467 - RNA, 19 nt, Homo sapiens
ggugagauuuagcacauau

SEQ ID NO: 1416468 - RNA, 19 nt, Homo sapiens
ccacacugaacauguaaua

SEQ ID NO: 1416469 - RNA, 19 nt, Homo sapiens
gcgcuggccuucaggaugu

SEQ ID NO: 1416470 - RNA, 19 nt, Homo sapiens
ggacuggucagacaggaaa

SEQ ID NO: 1416471 - RNA, 19 nt, Homo sapiens
gaccgaagacagaaguuaa

SEQ ID NO: 1416472 - RNA, 19 nt, Homo sapiens
caagguggccguccaugaa

SEQ ID NO: 1416473 - RNA, 19 nt, Homo sapiens
agaagugguuugauguuug

SEQ ID NO: 1416474 - RNA, 19 nt, Homo sapiens
ccaaagaggauuacugaag

SEQ ID NO: 1416475 - RNA, 19 nt, Homo sapiens
gauaugacagugacaagga

SEQ ID NO: 1416476 - RNA, 19 nt, Homo sapiens
aaucaauacuggagauaug

SEQ ID NO: 1416477 - RNA, 19 nt, Homo sapiens
aauauggcacuguaaguua

SEQ ID NO: 1416478 - RNA, 19 nt, Homo sapiens
aaagaggauuacugaaguu

SEQ ID NO: 1416479 - RNA, 19 nt, Homo sapiens
gacaggaaagcaauucaaa

SEQ ID NO: 1416480 - RNA, 19 nt, Homo sapiens
acuggaagguaguuaauga

SEQ ID NO: 1416481 - RNA, 19 nt, Homo sapiens
cgaagacagaaguuaauuu

SEQ ID NO: 1416482 - RNA, 19 nt, Homo sapiens
gguacuggcuuuaugaaaa

SEQ ID NO: 1416483 - RNA, 19 nt, Homo sapiens
gauccauaaugcaaccaaa

SEQ ID NO: 1416484 - RNA, 19 nt, Homo sapiens
gggaaaagccuuaguugaa

SEQ ID NO: 1416485 - RNA, 19 nt, Homo sapiens
ucuccacacugaacaugua

SEQ ID NO: 1416486 - RNA, 19 nt, Homo sapiens
gaucaggcccucacagaag

SEQ ID NO: 1416487 - RNA, 19 nt, Homo sapiens
ggaaaagagaugaacguua

SEQ ID NO: 1416488 - RNA, 19 nt, Homo sapiens
cuacaggacgggauccaua

SEQ ID NO: 1416489 - RNA, 19 nt, Homo sapiens
cacugaacauguaauaaga

SEQ ID NO: 1416490 - RNA, 19 nt, Homo sapiens
caaagagagaaaccaauau

SEQ ID NO: 1416491 - RNA, 19 nt, Homo sapiens
cugauacuguuuacaaaga

SEQ ID NO: 1416492 - RNA, 19 nt, Homo sapiens
acagaaaucgaguacuuaa

SEQ ID NO: 1416493 - RNA, 19 nt, Homo sapiens
gaguuggacuggucagaca

SEQ ID NO: 1416494 - RNA, 19 nt, Homo sapiens
auauggcacuguaaguuaa

SEQ ID NO: 1416495 - RNA, 19 nt, Homo sapiens
ggaaauggagggucauagg

SEQ ID NO: 1416496 - RNA, 19 nt, Homo sapiens
ggacuucgcuaaaauucug

SEQ ID NO: 1416497 - RNA, 19 nt, Homo sapiens
aaagagagaaaccaauaug

SEQ ID NO: 1416498 - RNA, 19 nt, Homo sapiens
ggaucaggcccucacagaa

SEQ ID NO: 1416499 - RNA, 19 nt, Homo sapiens
acauauuucuuccguaaca

SEQ ID NO: 1416500 - RNA, 19 nt, Homo sapiens
gaaaaucgaaacaauagga

SEQ ID NO: 1416501 - RNA, 19 nt, Homo sapiens
cuaauggcuuauuuccaaa

SEQ ID NO: 1416502 - RNA, 19 nt, Homo sapiens
gacaaggacaaacaacaga

SEQ ID NO: 1416503 - RNA, 19 nt, Homo sapiens
guauuugcauuugauguca

SEQ ID NO: 1416504 - RNA, 19 nt, Homo sapiens
ggagauaugacagugacaa

SEQ ID NO: 1416505 - RNA, 19 nt, Homo sapiens
ggaaagcaauucaaaagcu

SEQ ID NO: 1416506 - RNA, 19 nt, Homo sapiens
guccugggcuugccucaca

SEQ ID NO: 1416507 - RNA, 19 nt, Homo sapiens
gcauacaacuccauuuucu

SEQ ID NO: 1416508 - RNA, 19 nt, Homo sapiens
aaauauggcacuguaaguu

SEQ ID NO: 1416509 - RNA, 19 nt, Homo sapiens
aagaaaauauggcacugua

SEQ ID NO: 1416510 - RNA, 19 nt, Homo sapiens
acacugaacauguaauaag

SEQ ID NO: 1416511 - RNA, 19 nt, Homo sapiens
ugaccgaagacagaaguua

SEQ ID NO: 1416512 - RNA, 19 nt, Homo sapiens
agagagaaaccaauaugga

SEQ ID NO: 1416513 - RNA, 19 nt, Homo sapiens
ggucagacaggaaagcaau

SEQ ID NO: 1416514 - RNA, 19 nt, Homo sapiens
aaagcuaucccaaauugau

SEQ ID NO: 1416515 - RNA, 19 nt, Homo sapiens
cagaagaugaacaaggaaa

SEQ ID NO: 1416516 - RNA, 19 nt, Homo sapiens
gcccugagcagccaacugu

SEQ ID NO: 1416517 - RNA, 19 nt, Homo sapiens
gcugguacuggcuuuauga

SEQ ID NO: 1416518 - RNA, 19 nt, Homo sapiens
ggagccugccuuugaguug

SEQ ID NO: 1416519 - RNA, 19 nt, Homo sapiens
ggaaaagccuuaguugaac

SEQ ID NO: 1416520 - RNA, 19 nt, Homo sapiens
auuccuggcuuccugcuaa

SEQ ID NO: 1416521 - RNA, 19 nt, Homo sapiens
guacuggcuuuaugaaaau

SEQ ID NO: 1416522 - RNA, 19 nt, Homo sapiens
cauuugauacugcguuuga

SEQ ID NO: 1416523 - RNA, 19 nt, Homo sapiens
gcuuccugcuaauggcuua

SEQ ID NO: 1416524 - RNA, 19 nt, Homo sapiens
gcuuauuacuccuaugcau

SEQ ID NO: 1416525 - RNA, 19 nt, Homo sapiens
caaggacaaacaacagaau

SEQ ID NO: 1416526 - RNA, 19 nt, Homo sapiens
cauacuggaagguaguuaa

SEQ ID NO: 1416527 - RNA, 19 nt, Homo sapiens
ccucacagaagaugaacaa

SEQ ID NO: 1416528 - RNA, 19 nt, Homo sapiens
ugacuggauucgcaaagag

SEQ ID NO: 1416529 - RNA, 19 nt, Homo sapiens
ucaagguggccguccauga

SEQ ID NO: 1416530 - RNA, 19 nt, Homo sapiens
gaaaauauggcacuguaag

SEQ ID NO: 1416531 - RNA, 19 nt, Homo sapiens
cagagaagugguuugaugu

SEQ ID NO: 1416532 - RNA, 19 nt, Homo sapiens
cuuauuacuccuaugcaua

SEQ ID NO: 1416533 - RNA, 19 nt, Homo sapiens
gcaguaauaccacaaaauc

SEQ ID NO: 1416534 - RNA, 19 nt, Homo sapiens
gacgggauccauaaugcaa

SEQ ID NO: 1416535 - RNA, 19 nt, Homo sapiens
ggagucccuuguauuugca

SEQ ID NO: 1416536 - RNA, 19 nt, Homo sapiens
aaucccaacacacaacaua

SEQ ID NO: 1416537 - RNA, 19 nt, Homo sapiens
ggccuggaaucccaacaca

SEQ ID NO: 1416538 - RNA, 19 nt, Homo sapiens
gagauuuagcacauauuuc

SEQ ID NO: 1416539 - RNA, 19 nt, Homo sapiens
uuaaugacaaggacaaaca

SEQ ID NO: 1416540 - RNA, 19 nt, Homo sapiens
caaugcauacuggaaggua

SEQ ID NO: 1416541 - RNA, 19 nt, Homo sapiens
auagaugccuuuguucaca

SEQ ID NO: 1416542 - RNA, 19 nt, Homo sapiens
acacaacauagaugccuuu

SEQ ID NO: 1416543 - RNA, 19 nt, Homo sapiens
uacaggacgggauccauaa

SEQ ID NO: 1416544 - RNA, 19 nt, Homo sapiens
gaauugacccugaguuuua

SEQ ID NO: 1416545 - RNA, 19 nt, Homo sapiens
gaacugcuccgccuacuac

SEQ ID NO: 1416546 - RNA, 19 nt, Homo sapiens
ggacucaccuuggccuuca

SEQ ID NO: 1416547 - RNA, 19 nt, Homo sapiens
gagugugugcgaaaccuaa

SEQ ID NO: 1416548 - RNA, 19 nt, Homo sapiens
ggacgucagggucuacauc

SEQ ID NO: 1416549 - RNA, 19 nt, Homo sapiens
cauccucgccguccucaga

SEQ ID NO: 1416550 - RNA, 19 nt, Homo sapiens
ggaauugacccugaguuuu

SEQ ID NO: 1416551 - RNA, 19 nt, Homo sapiens
aggaauugacccugaguuu

SEQ ID NO: 1416552 - RNA, 19 nt, Homo sapiens
gacccugaguuuuaaauuc

SEQ ID NO: 1416553 - RNA, 19 nt, Homo sapiens
gacgucagggucuacauca

SEQ ID NO: 1416554 - RNA, 19 nt, Homo sapiens
gagaacugcuccgccuacu

SEQ ID NO: 1416555 - RNA, 19 nt, Homo sapiens
ggauagagcuggacagauu

SEQ ID NO: 1416556 - RNA, 19 nt, Homo sapiens
gaagagaaaugcacuuguu

SEQ ID NO: 1416557 - RNA, 19 nt, Homo sapiens
gaagagacuugcuaagaaa

SEQ ID NO: 1416558 - RNA, 19 nt, Homo sapiens
uagcagaucucaguaaaua

SEQ ID NO: 1416559 - RNA, 19 nt, Homo sapiens
aaagaaggcuuaaagaguu

SEQ ID NO: 1416560 - RNA, 19 nt, Homo sapiens
gaauaagucucacaagauc

SEQ ID NO: 1416561 - RNA, 19 nt, Homo sapiens
gcagaucucaguaaauaua

SEQ ID NO: 1416562 - RNA, 19 nt, Homo sapiens
cggcagagauuaugcagua

SEQ ID NO: 1416563 - RNA, 19 nt, Homo sapiens
gcauguaucuugccucaga

SEQ ID NO: 1416564 - RNA, 19 nt, Homo sapiens
uuaaagaguugggaaguua

SEQ ID NO: 1416565 - RNA, 19 nt, Homo sapiens
ucucuugccuucauuauuu

SEQ ID NO: 1416566 - RNA, 19 nt, Homo sapiens
ggaacuguaaguccaauua

SEQ ID NO: 1416567 - RNA, 19 nt, Homo sapiens
ggaagaagcaagaaauaga

SEQ ID NO: 1416568 - RNA, 19 nt, Homo sapiens
gagauuaugcaguaagaua

SEQ ID NO: 1416569 - RNA, 19 nt, Homo sapiens
uaaaggacauucaucuuca

SEQ ID NO: 1416570 - RNA, 19 nt, Homo sapiens
gaagaggccuccaagaaaa

SEQ ID NO: 1416571 - RNA, 19 nt, Homo sapiens
agaagagacuugcuaagaa

SEQ ID NO: 1416572 - RNA, 19 nt, Homo sapiens
gaagaagcaagaaauagaa

SEQ ID NO: 1416573 - RNA, 19 nt, Homo sapiens
ggauuuagguggcgaguag

SEQ ID NO: 1416574 - RNA, 19 nt, Homo sapiens
ucaaagacauacaaaguuc

SEQ ID NO: 1416575 - RNA, 19 nt, Homo sapiens
uagaaacucugaugaggaa

SEQ ID NO: 1416576 - RNA, 19 nt, Homo sapiens
gagaagagacuugcuaaga

SEQ ID NO: 1416577 - RNA, 19 nt, Homo sapiens
gaagaagaauuugaugagu

SEQ ID NO: 1416578 - RNA, 19 nt, Homo sapiens
gagaaaugcacuuguuaaa

SEQ ID NO: 1416579 - RNA, 19 nt, Homo sapiens
uagaagguuucaucucaua

SEQ ID NO: 1416580 - RNA, 19 nt, Homo sapiens
uaaacaaguugcagcagaa

SEQ ID NO: 1416581 - RNA, 19 nt, Homo sapiens
ggacaugacuugggagaag

SEQ ID NO: 1416582 - RNA, 19 nt, Homo sapiens
gaugaacgcuguggagaau

SEQ ID NO: 1416583 - RNA, 19 nt, Homo sapiens
gaacuguaaguccaauuaa

SEQ ID NO: 1416584 - RNA, 19 nt, Homo sapiens
agacuuuccuguccuuuaa

SEQ ID NO: 1416585 - RNA, 19 nt, Homo sapiens
cauagcagaucucaguaaa

SEQ ID NO: 1416586 - RNA, 19 nt, Homo sapiens
aauagaagguuucaucuca

SEQ ID NO: 1416587 - RNA, 19 nt, Homo sapiens
agaaagugcuucagaaucu

SEQ ID NO: 1416588 - RNA, 19 nt, Homo sapiens
gaagagucaucacauaaaa

SEQ ID NO: 1416589 - RNA, 19 nt, Homo sapiens
cagaagaggccuccaagaa

SEQ ID NO: 1416590 - RNA, 19 nt, Homo sapiens
ggaaugaggaggacgaaau

SEQ ID NO: 1416591 - RNA, 19 nt, Homo sapiens
aaaggacaguugaagauga

SEQ ID NO: 1416592 - RNA, 19 nt, Homo sapiens
ucacugccuucauuaugua

SEQ ID NO: 1416593 - RNA, 19 nt, Homo sapiens
uaaacuggcacccuucuuu

SEQ ID NO: 1416594 - RNA, 19 nt, Homo sapiens
ucugaagauucucuacuua

SEQ ID NO: 1416595 - RNA, 19 nt, Homo sapiens
caaaguucguaaaugacua

SEQ ID NO: 1416596 - RNA, 19 nt, Homo sapiens
uauggaugcuuaucaaaga

SEQ ID NO: 1416597 - RNA, 19 nt, Homo sapiens
gaaagguggcccauaaaca

SEQ ID NO: 1416598 - RNA, 19 nt, Homo sapiens
caaaucucaucuugaaugu

SEQ ID NO: 1416599 - RNA, 19 nt, Homo sapiens
agacagacuuggauguuau

SEQ ID NO: 1416600 - RNA, 19 nt, Homo sapiens
ccaaaucucaucuugaaug

SEQ ID NO: 1416601 - RNA, 19 nt, Homo sapiens
ccacccaaaucucaucuug

SEQ ID NO: 1416602 - RNA, 19 nt, Homo sapiens
gagaagccuccgcuccuua

SEQ ID NO: 1416603 - RNA, 19 nt, Homo sapiens
cauuauguaucuucucuug

SEQ ID NO: 1416604 - RNA, 19 nt, Homo sapiens
agacuuggauguuauacga

SEQ ID NO: 1416605 - RNA, 19 nt, Homo sapiens
ccauauuguucuuguggua

SEQ ID NO: 1416606 - RNA, 19 nt, Homo sapiens
ggaagaagaauuugaugag

SEQ ID NO: 1416607 - RNA, 19 nt, Homo sapiens
agaagaggccuccaagaaa

SEQ ID NO: 1416608 - RNA, 19 nt, Homo sapiens
ggagggauccagugagaga

SEQ ID NO: 1416609 - RNA, 19 nt, Homo sapiens
aaucucaucuugaaugugu

SEQ ID NO: 1416610 - RNA, 19 nt, Homo sapiens
acccaaaucucaucuugaa

SEQ ID NO: 1416611 - RNA, 19 nt, Homo sapiens
cagauauacucaugcaaau

SEQ ID NO: 1416612 - RNA, 19 nt, Homo sapiens
ucagauauacucaugcaaa

SEQ ID NO: 1416613 - RNA, 19 nt, Homo sapiens
ccuagccuguggauaauuu

SEQ ID NO: 1416614 - RNA, 19 nt, Homo sapiens
ggaaguucauuaguucaau

SEQ ID NO: 1416615 - RNA, 19 nt, Homo sapiens
gacaguugaagaugacuua

SEQ ID NO: 1416616 - RNA, 19 nt, Homo sapiens
gauaaaggacauucaucuu

SEQ ID NO: 1416617 - RNA, 19 nt, Homo sapiens
gcauagcagaucucaguaa

SEQ ID NO: 1416618 - RNA, 19 nt, Homo sapiens
aagacagacuuggauguua

SEQ ID NO: 1416619 - RNA, 19 nt, Homo sapiens
ucccauaauucccacauuu

SEQ ID NO: 1416620 - RNA, 19 nt, Homo sapiens
gaaugaggaggacgaaaug

SEQ ID NO: 1416621 - RNA, 19 nt, Homo sapiens
gguuucaucucauagcuau

SEQ ID NO: 1416622 - RNA, 19 nt, Homo sapiens
caccaauacuggauuuguu

SEQ ID NO: 1416623 - RNA, 19 nt, Homo sapiens
cacaagaucugaugguuuu

SEQ ID NO: 1416624 - RNA, 19 nt, Homo sapiens
aaagguggcccauaaacaa

SEQ ID NO: 1416625 - RNA, 19 nt, Homo sapiens
cagagauuaugcaguaaga

SEQ ID NO: 1416626 - RNA, 19 nt, Homo sapiens
ugaagagucaucacauaaa

SEQ ID NO: 1416627 - RNA, 19 nt, Homo sapiens
cauacaaaguucguaaaug

SEQ ID NO: 1416628 - RNA, 19 nt, Homo sapiens
uaggagggauccagugaga

SEQ ID NO: 1416629 - RNA, 19 nt, Homo sapiens
caccaugcucugccaauua

SEQ ID NO: 1416630 - RNA, 19 nt, Homo sapiens
gagaagagaaaugcacuug

SEQ ID NO: 1416631 - RNA, 19 nt, Homo sapiens
ugaauaagucucacaagau

SEQ ID NO: 1416632 - RNA, 19 nt, Homo sapiens
aauguguacucccauaauu

SEQ ID NO: 1416633 - RNA, 19 nt, Homo sapiens
ucaaacuccuggccuuaug

SEQ ID NO: 1416634 - RNA, 19 nt, Homo sapiens
gaaacucugaugaggaaga

SEQ ID NO: 1416635 - RNA, 19 nt, Homo sapiens
ccagugaggucccaguagu

SEQ ID NO: 1416636 - RNA, 19 nt, Homo sapiens
gcucucccauuaccaccua

SEQ ID NO: 1416637 - RNA, 19 nt, Homo sapiens
gucagaggcuuuggaaguu

SEQ ID NO: 1416638 - RNA, 19 nt, Homo sapiens
gaggcuaugauucugauuu

SEQ ID NO: 1416639 - RNA, 19 nt, Homo sapiens
ccagugagagauaauuuga

SEQ ID NO: 1416640 - RNA, 19 nt, Homo sapiens
gggauccagugagagauaa

SEQ ID NO: 1416641 - RNA, 19 nt, Homo sapiens
ggauagggaagaagcaaga

SEQ ID NO: 1416642 - RNA, 19 nt, Homo sapiens
gaauguguacucccauaau

SEQ ID NO: 1416643 - RNA, 19 nt, Homo sapiens
ccaccaugcucugccaauu

SEQ ID NO: 1416644 - RNA, 19 nt, Homo sapiens
gggagaagagacuugcuaa

SEQ ID NO: 1416645 - RNA, 19 nt, Homo sapiens
ucacaagaucugaugguuu

SEQ ID NO: 1416646 - RNA, 19 nt, Homo sapiens
cuuccuagccuguggauaa

SEQ ID NO: 1416647 - RNA, 19 nt, Homo sapiens
ugguuugucuuuggaaaua

SEQ ID NO: 1416648 - RNA, 19 nt, Homo sapiens
uaaccucuaccacuuaaga

SEQ ID NO: 1416649 - RNA, 19 nt, Homo sapiens
gccuguggauaauuuacua

SEQ ID NO: 1416650 - RNA, 19 nt, Homo sapiens
agagaaaugcacuuguuaa

SEQ ID NO: 1416651 - RNA, 19 nt, Homo sapiens
aagagaaaugcacuuguua

SEQ ID NO: 1416652 - RNA, 19 nt, Homo sapiens
agacauacaaaguucguaa

SEQ ID NO: 1416653 - RNA, 19 nt, Homo sapiens
ccagccauguggaacugua

SEQ ID NO: 1416654 - RNA, 19 nt, Homo sapiens
agcaagaaauagaagguuu

SEQ ID NO: 1416655 - RNA, 19 nt, Homo sapiens
gaaguaagccugugaagga

SEQ ID NO: 1416656 - RNA, 19 nt, Homo sapiens
gcacggagauuaaaauuuu

SEQ ID NO: 1416657 - RNA, 19 nt, Homo sapiens
gaaugaggcucuuguacga

SEQ ID NO: 1416658 - RNA, 19 nt, Homo sapiens
agaaauaccuccagaagau

SEQ ID NO: 1416659 - RNA, 19 nt, Homo sapiens
ggaaagcauuguaauccuu

SEQ ID NO: 1416660 - RNA, 19 nt, Homo sapiens
gaaagaagacagcagcuau

SEQ ID NO: 1416661 - RNA, 19 nt, Homo sapiens
gaagaaaugcuaaugucaa

SEQ ID NO: 1416662 - RNA, 19 nt, Homo sapiens
gagaaucguuuccuuccuu

SEQ ID NO: 1416663 - RNA, 19 nt, Homo sapiens
gauauugcacggagauuaa

SEQ ID NO: 1416664 - RNA, 19 nt, Homo sapiens
guuaacgacuggauucuau

SEQ ID NO: 1416665 - RNA, 19 nt, Homo sapiens
gaaguuaaugcuacagauu

SEQ ID NO: 1416666 - RNA, 19 nt, Homo sapiens
uaaccuggaugccaccauu

SEQ ID NO: 1416667 - RNA, 19 nt, Homo sapiens
caaagacaaagcagaauga

SEQ ID NO: 1416668 - RNA, 19 nt, Homo sapiens
ggauauugcacggagauua

SEQ ID NO: 1416669 - RNA, 19 nt, Homo sapiens
guacgaaugcuacuugaug

SEQ ID NO: 1416670 - RNA, 19 nt, Homo sapiens
gcuaaggaaagcauuguaa

SEQ ID NO: 1416671 - RNA, 19 nt, Homo sapiens
ccaagcagccuaucagaau

SEQ ID NO: 1416672 - RNA, 19 nt, Homo sapiens
ccacaccgauggagauaca

SEQ ID NO: 1416673 - RNA, 19 nt, Homo sapiens
gaauuaaugcuaaggaaag

SEQ ID NO: 1416674 - RNA, 19 nt, Homo sapiens
gcagaaugaggcucuugua

SEQ ID NO: 1416675 - RNA, 19 nt, Homo sapiens
cagcagcuaugccaacguu

SEQ ID NO: 1416676 - RNA, 19 nt, Homo sapiens
gaaauaccuccagaagauu

SEQ ID NO: 1416677 - RNA, 19 nt, Homo sapiens
ggaaggauuuugauauuca

SEQ ID NO: 1416678 - RNA, 19 nt, Homo sapiens
ggauaaugaugcuuaccau

SEQ ID NO: 1416679 - RNA, 19 nt, Homo sapiens
uaucaaagacaaagcagaa

SEQ ID NO: 1416680 - RNA, 19 nt, Homo sapiens
caagcagccuaucagaaug

SEQ ID NO: 1416681 - RNA, 19 nt, Homo sapiens
aagaagaaaugcuaauguc

SEQ ID NO: 1416682 - RNA, 19 nt, Homo sapiens
gaagauucaaggagcugua

SEQ ID NO: 1416683 - RNA, 19 nt, Homo sapiens
uaagggaaacacuaaaguu

SEQ ID NO: 1416684 - RNA, 19 nt, Homo sapiens
cagaaugacuuuggacaag

SEQ ID NO: 1416685 - RNA, 19 nt, Homo sapiens
cgacuggauucuaucuuca

SEQ ID NO: 1416686 - RNA, 19 nt, Homo sapiens
cuuaaugccuguucugcuu

SEQ ID NO: 1416687 - RNA, 19 nt, Homo sapiens
ucuagggacuuuccucuca

SEQ ID NO: 1416688 - RNA, 19 nt, Homo sapiens
gguauuuccucaugguauc

SEQ ID NO: 1416689 - RNA, 19 nt, Homo sapiens
cgaaguuaaugcuacagau

SEQ ID NO: 1416690 - RNA, 19 nt, Homo sapiens
gggcaugugagaaucguuu

SEQ ID NO: 1416691 - RNA, 19 nt, Homo sapiens
caggaaggauuuugauauu

SEQ ID NO: 1416692 - RNA, 19 nt, Homo sapiens
ggcggugggugaaagaaga

SEQ ID NO: 1416693 - RNA, 19 nt, Homo sapiens
gcaugggaauccuauacuc

SEQ ID NO: 1416694 - RNA, 19 nt, Homo sapiens
uaaggaaagcauuguaauc

SEQ ID NO: 1416695 - RNA, 19 nt, Homo sapiens
ccagauugaauuaaugcua

SEQ ID NO: 1416696 - RNA, 19 nt, Homo sapiens
gagcuguagaggugaagua

SEQ ID NO: 1416697 - RNA, 19 nt, Homo sapiens
cagaaauaccuccagaaga

SEQ ID NO: 1416698 - RNA, 19 nt, Homo sapiens
uuauggcuguaccgcauua

SEQ ID NO: 1416699 - RNA, 19 nt, Homo sapiens
ccaccagcuuggacuucua

SEQ ID NO: 1416700 - RNA, 19 nt, Homo sapiens
agaaucguuuccuuccuuu

SEQ ID NO: 1416701 - RNA, 19 nt, Homo sapiens
gaggugggaggaucacuug

SEQ ID NO: 1416702 - RNA, 19 nt, Homo sapiens
uaaugaugcuuaccauggu

SEQ ID NO: 1416703 - RNA, 19 nt, Homo sapiens
gcgagacccugucccaaaa

SEQ ID NO: 1416704 - RNA, 19 nt, Homo sapiens
caccauggccguaauccuu

SEQ ID NO: 1416705 - RNA, 19 nt, Homo sapiens
ucaaagacaaagcagaaug

SEQ ID NO: 1416706 - RNA, 19 nt, Homo sapiens
caacguucaagauggcuuu

SEQ ID NO: 1416707 - RNA, 19 nt, Homo sapiens
ggugggaggaucacuugaa

SEQ ID NO: 1416708 - RNA, 19 nt, Homo sapiens
aaaguuaacgacuggauuc

SEQ ID NO: 1416709 - RNA, 19 nt, Homo sapiens
gaccacaccgauggagaua

SEQ ID NO: 1416710 - RNA, 19 nt, Homo sapiens
ucagaaauaccuccagaag

SEQ ID NO: 1416711 - RNA, 19 nt, Homo sapiens
gcagcuaugccaacguuca

SEQ ID NO: 1416712 - RNA, 19 nt, Homo sapiens
ugaaagaagacagcagcua

SEQ ID NO: 1416713 - RNA, 19 nt, Homo sapiens
aagggaaacacuaaaguug

SEQ ID NO: 1416714 - RNA, 19 nt, Homo sapiens
gaaggaccagcaugggaau

SEQ ID NO: 1416715 - RNA, 19 nt, Homo sapiens
uaaugccuguucugcuuau

SEQ ID NO: 1416716 - RNA, 19 nt, Homo sapiens
ugggaauccuauacucuga

SEQ ID NO: 1416717 - RNA, 19 nt, Homo sapiens
agaaccugcuugcaucaug

SEQ ID NO: 1416718 - RNA, 19 nt, Homo sapiens
gaaaugcuaaugucaaccu

SEQ ID NO: 1416719 - RNA, 19 nt, Homo sapiens
aagaaaugcuaaugucaac

SEQ ID NO: 1416720 - RNA, 19 nt, Homo sapiens
cguucaagauggcuuuaau

SEQ ID NO: 1416721 - RNA, 19 nt, Homo sapiens
gccaagcagccuaucagaa

SEQ ID NO: 1416722 - RNA, 19 nt, Homo sapiens
aaagaagacagcagcuaug

SEQ ID NO: 1416723 - RNA, 19 nt, Homo sapiens
gggaggaucacuugaacuc

SEQ ID NO: 1416724 - RNA, 19 nt, Homo sapiens
ucagcuaggcacaguggua

SEQ ID NO: 1416725 - RNA, 19 nt, Homo sapiens
cuucuaagggaaacacuaa

SEQ ID NO: 1416726 - RNA, 19 nt, Homo sapiens
agaaagagagaaccugcuu

SEQ ID NO: 1416727 - RNA, 19 nt, Homo sapiens
gugcagaccccacaauaaa

SEQ ID NO: 1416728 - RNA, 19 nt, Homo sapiens
agagagaaccugcuugcau

SEQ ID NO: 1416729 - RNA, 19 nt, Homo sapiens
agucuccacuucagucaga

SEQ ID NO: 1416730 - RNA, 19 nt, Homo sapiens
acgacuggauucuaucuuc

SEQ ID NO: 1416731 - RNA, 19 nt, Homo sapiens
uauuggguauuuccucaug

SEQ ID NO: 1416732 - RNA, 19 nt, Homo sapiens
ucagaaugacuuuggacaa

SEQ ID NO: 1416733 - RNA, 19 nt, Homo sapiens
ucaagauggcuuuaaugga

SEQ ID NO: 1416734 - RNA, 19 nt, Homo sapiens
cuaaggaaagcauuguaau

SEQ ID NO: 1416735 - RNA, 19 nt, Homo sapiens
uuaugccugugaaaugaaa

SEQ ID NO: 1416736 - RNA, 19 nt, Homo sapiens
gaugcuggugucgaaguua

SEQ ID NO: 1416737 - RNA, 19 nt, Homo sapiens
uuaaugccuguucugcuua

SEQ ID NO: 1416738 - RNA, 19 nt, Homo sapiens
gcgagggcaugugagaauc

SEQ ID NO: 1416739 - RNA, 19 nt, Homo sapiens
guucaagauggcuuuaaug

SEQ ID NO: 1416740 - RNA, 19 nt, Homo sapiens
gcuaugccaacguucaaga

SEQ ID NO: 1416741 - RNA, 19 nt, Homo sapiens
gagcagccagggcaacaca

SEQ ID NO: 1416742 - RNA, 19 nt, Homo sapiens
ucucagccaggaaggauuu

SEQ ID NO: 1416743 - RNA, 19 nt, Homo sapiens
ccacaauaaagaauaagca

SEQ ID NO: 1416744 - RNA, 19 nt, Homo sapiens
ucuuaucccucugcucuug

SEQ ID NO: 1416745 - RNA, 19 nt, Homo sapiens
cagccuaucagaaugacuu

SEQ ID NO: 1416746 - RNA, 19 nt, Homo sapiens
agaagaaaugcuaauguca

SEQ ID NO: 1416747 - RNA, 19 nt, Homo sapiens
ggcgagggcaugugagaau

SEQ ID NO: 1416748 - RNA, 19 nt, Homo sapiens
gaccagcaugggaauccua

SEQ ID NO: 1416749 - RNA, 19 nt, Homo sapiens
augcuggugucgaaguuaa

SEQ ID NO: 1416750 - RNA, 19 nt, Homo sapiens
ugaugcuggugucgaaguu

SEQ ID NO: 1416751 - RNA, 19 nt, Homo sapiens
gugggaggaucacuugaac

SEQ ID NO: 1416752 - RNA, 19 nt, Homo sapiens
gggauaaugaugcuuacca

SEQ ID NO: 1416753 - RNA, 19 nt, Homo sapiens
ggguauuuccucaugguau

SEQ ID NO: 1416754 - RNA, 19 nt, Homo sapiens
aaguuaaugcuacagauug

SEQ ID NO: 1416755 - RNA, 19 nt, Homo sapiens
gcacagccauccagcauua

SEQ ID NO: 1416756 - RNA, 19 nt, Homo sapiens
ggagaugccugaagcuuug

SEQ ID NO: 1416757 - RNA, 19 nt, Homo sapiens
acaaagagaugcagauaga

SEQ ID NO: 1416758 - RNA, 19 nt, Homo sapiens
gagcauaccugaugaacag

SEQ ID NO: 1416759 - RNA, 19 nt, Homo sapiens
gcaauggccuauccaagga

SEQ ID NO: 1416760 - RNA, 19 nt, Homo sapiens
ggaggugggaguuuaaaua

SEQ ID NO: 1416761 - RNA, 19 nt, Homo sapiens
ggaagguuaugucaucuau

SEQ ID NO: 1416762 - RNA, 19 nt, Homo sapiens
agaaacaccuaaagaagaa

SEQ ID NO: 1416763 - RNA, 19 nt, Homo sapiens
gcccauggcugcugcugua

SEQ ID NO: 1416764 - RNA, 19 nt, Homo sapiens
gaggaacucucaaacagau

SEQ ID NO: 1416765 - RNA, 19 nt, Homo sapiens
caauacagcuuguguucga

SEQ ID NO: 1416766 - RNA, 19 nt, Homo sapiens
ucagacaucuaccaucaaa

SEQ ID NO: 1416767 - RNA, 19 nt, Homo sapiens
aaacagggcaugcucuuaa

SEQ ID NO: 1416768 - RNA, 19 nt, Homo sapiens
gaggugggaguuuaaauaa

SEQ ID NO: 1416769 - RNA, 19 nt, Homo sapiens
ugaggugacuguugaaguu

SEQ ID NO: 1416770 - RNA, 19 nt, Homo sapiens
aagcuuaggugauuauaug

SEQ ID NO: 1416771 - RNA, 19 nt, Homo sapiens
gaaauaagaagaagcaacu

SEQ ID NO: 1416772 - RNA, 19 nt, Homo sapiens
ggagugacccagacaaaga

SEQ ID NO: 1416773 - RNA, 19 nt, Homo sapiens
ucaacgugcuucugcagua

SEQ ID NO: 1416774 - RNA, 19 nt, Homo sapiens
aaauggaggugggaguuua

SEQ ID NO: 1416775 - RNA, 19 nt, Homo sapiens
gaacaguuacacucauuug

SEQ ID NO: 1416776 - RNA, 19 nt, Homo sapiens
aagguuaugucaucuauug

SEQ ID NO: 1416777 - RNA, 19 nt, Homo sapiens
gguccaaccuguuuacauc

SEQ ID NO: 1416778 - RNA, 19 nt, Homo sapiens
cgacaauauuccuugauga

SEQ ID NO: 1416779 - RNA, 19 nt, Homo sapiens
ucaggaagguuaugucauc

SEQ ID NO: 1416780 - RNA, 19 nt, Homo sapiens
gaaaucacaaauucagcua

SEQ ID NO: 1416781 - RNA, 19 nt, Homo sapiens
gccugaagcuuuggaguuu

SEQ ID NO: 1416782 - RNA, 19 nt, Homo sapiens
cauaccugaugaacaguua

SEQ ID NO: 1416783 - RNA, 19 nt, Homo sapiens
caccuauuauucaagcuua

SEQ ID NO: 1416784 - RNA, 19 nt, Homo sapiens
gcagagccauccccauuaa

SEQ ID NO: 1416785 - RNA, 19 nt, Homo sapiens
gaaauggaggugggaguuu

SEQ ID NO: 1416786 - RNA, 19 nt, Homo sapiens
accaacaacuuuaugauug

SEQ ID NO: 1416787 - RNA, 19 nt, Homo sapiens
gaagaagcaacuguacaaa

SEQ ID NO: 1416788 - RNA, 19 nt, Homo sapiens
ggaguccucauguguauug

SEQ ID NO: 1416789 - RNA, 19 nt, Homo sapiens
aaggauaacucagaauuuc

SEQ ID NO: 1416790 - RNA, 19 nt, Homo sapiens
caagguggauuuguuaguc

SEQ ID NO: 1416791 - RNA, 19 nt, Homo sapiens
cuucagacaucuaccauca

SEQ ID NO: 1416792 - RNA, 19 nt, Homo sapiens
gaaauacgucacccugugu

SEQ ID NO: 1416793 - RNA, 19 nt, Homo sapiens
uaauaucugugaccuugga

SEQ ID NO: 1416794 - RNA, 19 nt, Homo sapiens
caaaccauguaucuacugu

SEQ ID NO: 1416795 - RNA, 19 nt, Homo sapiens
ggauaacucagaauuucaa

SEQ ID NO: 1416796 - RNA, 19 nt, Homo sapiens
gggagaugccugaagcuuu

SEQ ID NO: 1416797 - RNA, 19 nt, Homo sapiens
gggaagaccaucucugcaa

SEQ ID NO: 1416798 - RNA, 19 nt, Homo sapiens
cugaagcuuuggaguuuaa

SEQ ID NO: 1416799 - RNA, 19 nt, Homo sapiens
cugcugaggugacuguuga

SEQ ID NO: 1416800 - RNA, 19 nt, Homo sapiens
guugagcucaggaagguua

SEQ ID NO: 1416801 - RNA, 19 nt, Homo sapiens
aagaaacaccuaaagaaga

SEQ ID NO: 1416802 - RNA, 19 nt, Homo sapiens
uaacuauuccuccuccauu

SEQ ID NO: 1416803 - RNA, 19 nt, Homo sapiens
caucauaucacacaaagag

SEQ ID NO: 1416804 - RNA, 19 nt, Homo sapiens
guagaaauaagaagaagca

SEQ ID NO: 1416805 - RNA, 19 nt, Homo sapiens
ccacauugcccaagucaca

SEQ ID NO: 1416806 - RNA, 19 nt, Homo sapiens
agauugaccuucagacauc

SEQ ID NO: 1416807 - RNA, 19 nt, Homo sapiens
uauucaagcuuaggugauu

SEQ ID NO: 1416808 - RNA, 19 nt, Homo sapiens
gcgcugguccaaccuguuu

SEQ ID NO: 1416809 - RNA, 19 nt, Homo sapiens
acacaaagagaugcagaua

SEQ ID NO: 1416810 - RNA, 19 nt, Homo sapiens
aaagaaacaccuaaagaag

SEQ ID NO: 1416811 - RNA, 19 nt, Homo sapiens
agaagaagcaacuguacaa

SEQ ID NO: 1416812 - RNA, 19 nt, Homo sapiens
caccaacaacuuuaugauu

SEQ ID NO: 1416813 - RNA, 19 nt, Homo sapiens
uaaacagggcaugcucuua

SEQ ID NO: 1416814 - RNA, 19 nt, Homo sapiens
ccaucaaagucccaggaaa

SEQ ID NO: 1416815 - RNA, 19 nt, Homo sapiens
gagauugaccuucagacau

SEQ ID NO: 1416816 - RNA, 19 nt, Homo sapiens
guucgacaauauuccuuga

SEQ ID NO: 1416817 - RNA, 19 nt, Homo sapiens
gcccugcagucgauccaaa

SEQ ID NO: 1416818 - RNA, 19 nt, Homo sapiens
gcaccaacaacuuuaugau

SEQ ID NO: 1416819 - RNA, 19 nt, Homo sapiens
acacccaucuccagcucua

SEQ ID NO: 1416820 - RNA, 19 nt, Homo sapiens
gacccucaguucaguguuc

SEQ ID NO: 1416821 - RNA, 19 nt, Homo sapiens
gcgucagccucgaguuuga

SEQ ID NO: 1416822 - RNA, 19 nt, Homo sapiens
ucgacaauauuccuugaug

SEQ ID NO: 1416823 - RNA, 19 nt, Homo sapiens
ccagaggcaagcacaauau

SEQ ID NO: 1416824 - RNA, 19 nt, Homo sapiens
guuuaacccuucugccaau

SEQ ID NO: 1416825 - RNA, 19 nt, Homo sapiens
ggccaucccuagccacauc

SEQ ID NO: 1416826 - RNA, 19 nt, Homo sapiens
gauagaucuuugagcauac

SEQ ID NO: 1416827 - RNA, 19 nt, Homo sapiens
auaagaagaagcaacugua

SEQ ID NO: 1416828 - RNA, 19 nt, Homo sapiens
caucaaagucccaggaaag

SEQ ID NO: 1416829 - RNA, 19 nt, Homo sapiens
ccugaagcuuuggaguuua

SEQ ID NO: 1416830 - RNA, 19 nt, Homo sapiens
ccaaccuguuuacaucuga

SEQ ID NO: 1416831 - RNA, 19 nt, Homo sapiens
guccucauguguauugaau

SEQ ID NO: 1416832 - RNA, 19 nt, Homo sapiens
agacaucuaccaucaaagu

SEQ ID NO: 1416833 - RNA, 19 nt, Homo sapiens
uuggagauaccucaucaua

SEQ ID NO: 1416834 - RNA, 19 nt, Homo sapiens
gcguuucagucaacaauac

SEQ ID NO: 1416835 - RNA, 19 nt, Homo sapiens
ggaacucucaaacagaugu

SEQ ID NO: 1416836 - RNA, 19 nt, Homo sapiens
gcucaggaagguuauguca

SEQ ID NO: 1416837 - RNA, 19 nt, Homo sapiens
ugggaguccucauguguau

SEQ ID NO: 1416838 - RNA, 19 nt, Homo sapiens
cauccagcauuaucuuaca

SEQ ID NO: 1416839 - RNA, 19 nt, Homo sapiens
aacagggcaugcucuuaaa

SEQ ID NO: 1416840 - RNA, 19 nt, Homo sapiens
uuacacucauuugcaguuu

SEQ ID NO: 1416841 - RNA, 19 nt, Homo sapiens
gcaacuguacaaaccaugu

SEQ ID NO: 1416842 - RNA, 19 nt, Homo sapiens
uugccaagguggauuuguu

SEQ ID NO: 1416843 - RNA, 19 nt, Homo sapiens
gaagguuaugucaucuauu

SEQ ID NO: 1416844 - RNA, 19 nt, Homo sapiens
caguugagcucaggaaggu

SEQ ID NO: 1416845 - RNA, 19 nt, Homo sapiens
cgggcugggugacuccaua

SEQ ID NO: 1416846 - RNA, 19 nt, Homo sapiens
gaagaccaucucugcaagu

SEQ ID NO: 1416847 - RNA, 19 nt, Homo sapiens
agaagcaacuguacaaacc

SEQ ID NO: 1416848 - RNA, 19 nt, Homo sapiens
aaagagaugcagauagauc

SEQ ID NO: 1416849 - RNA, 19 nt, Homo sapiens
gccauccagcauuaucuua

SEQ ID NO: 1416850 - RNA, 19 nt, Homo sapiens
uagcgucagccucgaguuu

SEQ ID NO: 1416851 - RNA, 19 nt, Homo sapiens
ccauggcccugcagucgau

SEQ ID NO: 1416852 - RNA, 19 nt, Homo sapiens
ccgugcacauuaugaagaa

SEQ ID NO: 1416853 - RNA, 19 nt, Homo sapiens
ugccaagguggauuuguua

SEQ ID NO: 1416854 - RNA, 19 nt, Homo sapiens
ccucauguguauugaaugc

SEQ ID NO: 1416855 - RNA, 19 nt, Homo sapiens
gaaggcaguugaauuauua

SEQ ID NO: 1416856 - RNA, 19 nt, Homo sapiens
gaagauaguuuaaggaaga

SEQ ID NO: 1416857 - RNA, 19 nt, Homo sapiens
gcaagaagcuauucagaag

SEQ ID NO: 1416858 - RNA, 19 nt, Homo sapiens
agagaaaucugacauaaga

SEQ ID NO: 1416859 - RNA, 19 nt, Homo sapiens
ggagauacguguuuuauuu

SEQ ID NO: 1416860 - RNA, 19 nt, Homo sapiens
gauagcaaauuccuaaaug

SEQ ID NO: 1416861 - RNA, 19 nt, Homo sapiens
gcacucagaagauaguuua

SEQ ID NO: 1416862 - RNA, 19 nt, Homo sapiens
caacacaucuucaauacca

SEQ ID NO: 1416863 - RNA, 19 nt, Homo sapiens
uaaggaagauggcaauaau

SEQ ID NO: 1416864 - RNA, 19 nt, Homo sapiens
uaugaaggcaguugaauua

SEQ ID NO: 1416865 - RNA, 19 nt, Homo sapiens
gcaaauuccuaaaugaaca

SEQ ID NO: 1416866 - RNA, 19 nt, Homo sapiens
gaauaaagaggaaguaaca

SEQ ID NO: 1416867 - RNA, 19 nt, Homo sapiens
ugagagaaaucugacauaa

SEQ ID NO: 1416868 - RNA, 19 nt, Homo sapiens
acuaagagauugagagaaa

SEQ ID NO: 1416869 - RNA, 19 nt, Homo sapiens
gaagauggcaauaauaaca

SEQ ID NO: 1416870 - RNA, 19 nt, Homo sapiens
gaauuucuuuguugcugua

SEQ ID NO: 1416871 - RNA, 19 nt, Homo sapiens
gaaaugauggcgacuggaa

SEQ ID NO: 1416872 - RNA, 19 nt, Homo sapiens
ugaaggcaguugaauuauu

SEQ ID NO: 1416873 - RNA, 19 nt, Homo sapiens
ugacguuacugccaaauau

SEQ ID NO: 1416874 - RNA, 19 nt, Homo sapiens
gaacauuaggcaaguggua

SEQ ID NO: 1416875 - RNA, 19 nt, Homo sapiens
ccaugagucuguugucaaa

SEQ ID NO: 1416876 - RNA, 19 nt, Homo sapiens
ccaguugaaucaucuguug

SEQ ID NO: 1416877 - RNA, 19 nt, Homo sapiens
ucaggcagcucgaaacaug

SEQ ID NO: 1416878 - RNA, 19 nt, Homo sapiens
aagaagcuauucagaagaa

SEQ ID NO: 1416879 - RNA, 19 nt, Homo sapiens
gcaguugaauuauuaugag

SEQ ID NO: 1416880 - RNA, 19 nt, Homo sapiens
gcaauaauaacaacacauc

SEQ ID NO: 1416881 - RNA, 19 nt, Homo sapiens
gaaguaacagugaaugcaa

SEQ ID NO: 1416882 - RNA, 19 nt, Homo sapiens
gcaagugguaucauuauca

SEQ ID NO: 1416883 - RNA, 19 nt, Homo sapiens
gaacagucaucggaucuac

SEQ ID NO: 1416884 - RNA, 19 nt, Homo sapiens
gggacucuauauuguugua

SEQ ID NO: 1416885 - RNA, 19 nt, Homo sapiens
aaaugggacucuauauugu

SEQ ID NO: 1416886 - RNA, 19 nt, Homo sapiens
gccuugaccugcauuccua

SEQ ID NO: 1416887 - RNA, 19 nt, Homo sapiens
cagaagauaguuuaaggaa

SEQ ID NO: 1416888 - RNA, 19 nt, Homo sapiens
guucaggucuucauugacu

SEQ ID NO: 1416889 - RNA, 19 nt, Homo sapiens
aggaagauggcaauaauaa

SEQ ID NO: 1416890 - RNA, 19 nt, Homo sapiens
gacauuaccaugagucugu

SEQ ID NO: 1416891 - RNA, 19 nt, Homo sapiens
gcaugacguuacugccaaa

SEQ ID NO: 1416892 - RNA, 19 nt, Homo sapiens
gaccuugacuuucauuuug

SEQ ID NO: 1416893 - RNA, 19 nt, Homo sapiens
uaguucaggucuucauuga

SEQ ID NO: 1416894 - RNA, 19 nt, Homo sapiens
uuaggcaagugguaucauu

SEQ ID NO: 1416895 - RNA, 19 nt, Homo sapiens
caaauaugaaggcaguuga

SEQ ID NO: 1416896 - RNA, 19 nt, Homo sapiens
ugugauagcaaauuccuaa

SEQ ID NO: 1416897 - RNA, 19 nt, Homo sapiens
ggaaguaacagugaaugca

SEQ ID NO: 1416898 - RNA, 19 nt, Homo sapiens
aaagaggaaguaacaguga

SEQ ID NO: 1416899 - RNA, 19 nt, Homo sapiens
gagagaaaucugacauaag

SEQ ID NO: 1416900 - RNA, 19 nt, Homo sapiens
ugacuaagagauugagaga

SEQ ID NO: 1416901 - RNA, 19 nt, Homo sapiens
guucauuggauccaucuuu

SEQ ID NO: 1416902 - RNA, 19 nt, Homo sapiens
uaaucgcgcucaccaagca

SEQ ID NO: 1416903 - RNA, 19 nt, Homo sapiens
caagugguaucauuaucag

SEQ ID NO: 1416904 - RNA, 19 nt, Homo sapiens
ucagaggagauacguguuu

SEQ ID NO: 1416905 - RNA, 19 nt, Homo sapiens
gugcgcaaccguucgcuaa

SEQ ID NO: 1416906 - RNA, 19 nt, Homo sapiens
aacaacacaucuucaauac

SEQ ID NO: 1416907 - RNA, 19 nt, Homo sapiens
ggaauaaagaggaaguaac

SEQ ID NO: 1416908 - RNA, 19 nt, Homo sapiens
guaguucaggucuucauug

SEQ ID NO: 1416909 - RNA, 19 nt, Homo sapiens
aaacaugguacuccaggaa

SEQ ID NO: 1416910 - RNA, 19 nt, Homo sapiens
ggcaguugaauuauuauga

SEQ ID NO: 1416911 - RNA, 19 nt, Homo sapiens
uuaaggaagauggcaauaa

SEQ ID NO: 1416912 - RNA, 19 nt, Homo sapiens
cuaaucaucagcaaauuca

SEQ ID NO: 1416913 - RNA, 19 nt, Homo sapiens
gcuaaucaucagcaaauuc

SEQ ID NO: 1416914 - RNA, 19 nt, Homo sapiens
uaggcaagugguaucauua

SEQ ID NO: 1416915 - RNA, 19 nt, Homo sapiens
caagaagcuauucagaaga

SEQ ID NO: 1416916 - RNA, 19 nt, Homo sapiens
aaguaacagugaaugcaaa

SEQ ID NO: 1416917 - RNA, 19 nt, Homo sapiens
aagaggaaguaacagugaa

SEQ ID NO: 1416918 - RNA, 19 nt, Homo sapiens
aaaaugggacucuauauug

SEQ ID NO: 1416919 - RNA, 19 nt, Homo sapiens
ggcaagugguaucauuauc

SEQ ID NO: 1416920 - RNA, 19 nt, Homo sapiens
ccaaauaugaaggcaguug

SEQ ID NO: 1416921 - RNA, 19 nt, Homo sapiens
ucacuugcaugacguuacu

SEQ ID NO: 1416922 - RNA, 19 nt, Homo sapiens
guugaaucaucuguugaaa

SEQ ID NO: 1416923 - RNA, 19 nt, Homo sapiens
caccugugguacugacgua

SEQ ID NO: 1416924 - RNA, 19 nt, Homo sapiens
cagcaagaagcuauucaga

SEQ ID NO: 1416925 - RNA, 19 nt, Homo sapiens
uacaggaccaguugaauca

SEQ ID NO: 1416926 - RNA, 19 nt, Homo sapiens
ggaucuacaggaccaguug

SEQ ID NO: 1416927 - RNA, 19 nt, Homo sapiens
cugcaggaauaaagaggaa

SEQ ID NO: 1416928 - RNA, 19 nt, Homo sapiens
aaggaagauggcaauaaua

SEQ ID NO: 1416929 - RNA, 19 nt, Homo sapiens
caggaccaguugaaucauc

SEQ ID NO: 1416930 - RNA, 19 nt, Homo sapiens
gcaggaauaaagaggaagu

SEQ ID NO: 1416931 - RNA, 19 nt, Homo sapiens
cuucauugacuaagagauu

SEQ ID NO: 1416932 - RNA, 19 nt, Homo sapiens
gcaaccguucgcuaacuga

SEQ ID NO: 1416933 - RNA, 19 nt, Homo sapiens
cauuaacucagaggagaua

SEQ ID NO: 1416934 - RNA, 19 nt, Homo sapiens
cuacaggaccaguugaauc

SEQ ID NO: 1416935 - RNA, 19 nt, Homo sapiens
gcgcaaccguucgcuaacu

SEQ ID NO: 1416936 - RNA, 19 nt, Homo sapiens
gagaaaucugacauaagaa

SEQ ID NO: 1416937 - RNA, 19 nt, Homo sapiens
cuaagagauugagagaaau

SEQ ID NO: 1416938 - RNA, 19 nt, Homo sapiens
agucuguugucaaaccuaa

SEQ ID NO: 1416939 - RNA, 19 nt, Homo sapiens
ggaagauggcaauaauaac

SEQ ID NO: 1416940 - RNA, 19 nt, Homo sapiens
ggucaggcagcucgaaaca

SEQ ID NO: 1416941 - RNA, 19 nt, Homo sapiens
gacucuauauuguuguagu

SEQ ID NO: 1416942 - RNA, 19 nt, Homo sapiens
uaccaugagucuguuguca

SEQ ID NO: 1416943 - RNA, 19 nt, Homo sapiens
acaugguacuccaggaaga

SEQ ID NO: 1416944 - RNA, 19 nt, Homo sapiens
gaucuacaggaccaguuga

SEQ ID NO: 1416945 - RNA, 19 nt, Homo sapiens
ucaggucuucauugacuaa

SEQ ID NO: 1416946 - RNA, 19 nt, Homo sapiens
aaauaugaaggcaguugaa

SEQ ID NO: 1416947 - RNA, 19 nt, Homo sapiens
gaggaaguaacagugaaug

SEQ ID NO: 1416948 - RNA, 19 nt, Homo sapiens
caagcgcgguucggucagu

SEQ ID NO: 1416949 - RNA, 19 nt, Homo sapiens
cucagaagauaguuuaagg

SEQ ID NO: 1416950 - RNA, 19 nt, Homo sapiens
ucagaagauaguuuaagga

SEQ ID NO: 1416951 - RNA, 19 nt, Homo sapiens
agcaagaagcuauucagaa

SEQ ID NO: 1416952 - RNA, 19 nt, Homo sapiens
auaaagaggaaguaacagu

SEQ ID NO: 1416953 - RNA, 19 nt, Homo sapiens
augggacucuauauuguug

SEQ ID NO: 1416954 - RNA, 19 nt, Homo sapiens
caaccguucgcuaacugaa

SEQ ID NO: 1416955 - RNA, 19 nt, Homo sapiens
gaacuaccgugaugaaaua

SEQ ID NO: 1416956 - RNA, 19 nt, Homo sapiens
gcacauaacucccacuaaa

SEQ ID NO: 1416957 - RNA, 19 nt, Homo sapiens
gaaaugggaucacagaauu

SEQ ID NO: 1416958 - RNA, 19 nt, Homo sapiens
ggaaagaaaugcaggaguu

SEQ ID NO: 1416959 - RNA, 19 nt, Homo sapiens
gaaacgaggugcccacuga

SEQ ID NO: 1416960 - RNA, 19 nt, Homo sapiens
gaaggacuguggagaauag

SEQ ID NO: 1416961 - RNA, 19 nt, Homo sapiens
caugaacucuuuacagaaa

SEQ ID NO: 1416962 - RNA, 19 nt, Homo sapiens
gauaacugcuggauagaga

SEQ ID NO: 1416963 - RNA, 19 nt, Homo sapiens
acaaugacaucuuccuuaa

SEQ ID NO: 1416964 - RNA, 19 nt, Homo sapiens
gccaugaacucuuuacaga

SEQ ID NO: 1416965 - RNA, 19 nt, Homo sapiens
ccaaaggccuucaaaugau

SEQ ID NO: 1416966 - RNA, 19 nt, Homo sapiens
ccacaaggaucaagugcuu

SEQ ID NO: 1416967 - RNA, 19 nt, Homo sapiens
gccaaaggccuucaaauga

SEQ ID NO: 1416968 - RNA, 19 nt, Homo sapiens
ggguggacauuaaugauaa

SEQ ID NO: 1416969 - RNA, 19 nt, Homo sapiens
gccagccucucccaauuua

SEQ ID NO: 1416970 - RNA, 19 nt, Homo sapiens
acagauaacugcuggauag

SEQ ID NO: 1416971 - RNA, 19 nt, Homo sapiens
gagagaauuuggcgaggaa

SEQ ID NO: 1416972 - RNA, 19 nt, Homo sapiens
gaucaagaguggauaagag

SEQ ID NO: 1416973 - RNA, 19 nt, Homo sapiens
gaaaauuagugcuacauug

SEQ ID NO: 1416974 - RNA, 19 nt, Homo sapiens
gugugaaggcuuuguauua

SEQ ID NO: 1416975 - RNA, 19 nt, Homo sapiens
ggaaaugggaucacagaau

SEQ ID NO: 1416976 - RNA, 19 nt, Homo sapiens
ugugaaggcuuuguauuaa

SEQ ID NO: 1416977 - RNA, 19 nt, Homo sapiens
acagaaaucuaggaaagaa

SEQ ID NO: 1416978 - RNA, 19 nt, Homo sapiens
aaacuaacuuacacagcua

SEQ ID NO: 1416979 - RNA, 19 nt, Homo sapiens
uuacagaaaucuaggaaag

SEQ ID NO: 1416980 - RNA, 19 nt, Homo sapiens
gcugugaacuaccgugaug

SEQ ID NO: 1416981 - RNA, 19 nt, Homo sapiens
aaugacaucuuccuuaaca

SEQ ID NO: 1416982 - RNA, 19 nt, Homo sapiens
caaaggccuucaaaugauc

SEQ ID NO: 1416983 - RNA, 19 nt, Homo sapiens
ccacugaugugaggauaug

SEQ ID NO: 1416984 - RNA, 19 nt, Homo sapiens
cuacguggaugauucuaga

SEQ ID NO: 1416985 - RNA, 19 nt, Homo sapiens
ggucuuguauuccuuccuu

SEQ ID NO: 1416986 - RNA, 19 nt, Homo sapiens
gcgaaauuauccacccuau

SEQ ID NO: 1416987 - RNA, 19 nt, Homo sapiens
ggagagacaauugcacaaa

SEQ ID NO: 1416988 - RNA, 19 nt, Homo sapiens
gaaagaaaugcaggaguug

SEQ ID NO: 1416989 - RNA, 19 nt, Homo sapiens
aggaagccaugaacucuuu

SEQ ID NO: 1416990 - RNA, 19 nt, Homo sapiens
uaacaaccauagccucuac

SEQ ID NO: 1416991 - RNA, 19 nt, Homo sapiens
ggaaggacuguggagaaua

SEQ ID NO: 1416992 - RNA, 19 nt, Homo sapiens
ggaguuggagagacaauug

SEQ ID NO: 1416993 - RNA, 19 nt, Homo sapiens
gagagacaauugcacaaac

SEQ ID NO: 1416994 - RNA, 19 nt, Homo sapiens
uuacacagcuacugcucuu

SEQ ID NO: 1416995 - RNA, 19 nt, Homo sapiens
gaugaugccaagaaaguga

SEQ ID NO: 1416996 - RNA, 19 nt, Homo sapiens
gggaaaaguucaaucucua

SEQ ID NO: 1416997 - RNA, 19 nt, Homo sapiens
cuaccgugaugaaauaaug

SEQ ID NO: 1416998 - RNA, 19 nt, Homo sapiens
caaaugaucaagaguggau

SEQ ID NO: 1416999 - RNA, 19 nt, Homo sapiens
gcucuuuggagaauuguaa

SEQ ID NO: 1417000 - RNA, 19 nt, Homo sapiens
ccaaaacugugcuguguga

SEQ ID NO: 1417001 - RNA, 19 nt, Homo sapiens
aacaaugacaucuuccuua

SEQ ID NO: 1417002 - RNA, 19 nt, Homo sapiens
cuacugcucuuuggagaau

SEQ ID NO: 1417003 - RNA, 19 nt, Homo sapiens
gguggacauuaaugauaaa

SEQ ID NO: 1417004 - RNA, 19 nt, Homo sapiens
gcgaugaugccaagaaagu

SEQ ID NO: 1417005 - RNA, 19 nt, Homo sapiens
gauucuagaaacacagaua

SEQ ID NO: 1417006 - RNA, 19 nt, Homo sapiens
ggaugauucuagaaacaca

SEQ ID NO: 1417007 - RNA, 19 nt, Homo sapiens
caaccauagccucuacuuu

SEQ ID NO: 1417008 - RNA, 19 nt, Homo sapiens
ccuguuagaagaagaauau

SEQ ID NO: 1417009 - RNA, 19 nt, Homo sapiens
ucuggaagcuggcgaugau

SEQ ID NO: 1417010 - RNA, 19 nt, Homo sapiens
ccucuuuggugauuacuuc

SEQ ID NO: 1417011 - RNA, 19 nt, Homo sapiens
gugcuacauugaagagaga

SEQ ID NO: 1417012 - RNA, 19 nt, Homo sapiens
ccaauuuauucaacuugug

SEQ ID NO: 1417013 - RNA, 19 nt, Homo sapiens
guggaugauucuagaaaca

SEQ ID NO: 1417014 - RNA, 19 nt, Homo sapiens
ugaaggcuuuguauuaagg

SEQ ID NO: 1417015 - RNA, 19 nt, Homo sapiens
gugaaggcuuuguauuaag

SEQ ID NO: 1417016 - RNA, 19 nt, Homo sapiens
cagccucucccaauuuauu

SEQ ID NO: 1417017 - RNA, 19 nt, Homo sapiens
ggaagccaugaacucuuua

SEQ ID NO: 1417018 - RNA, 19 nt, Homo sapiens
ugaacuaccgugaugaaau

SEQ ID NO: 1417019 - RNA, 19 nt, Homo sapiens
gaaaucuaggaaagaaaug

SEQ ID NO: 1417020 - RNA, 19 nt, Homo sapiens
uggcuuuccuguuagaaga

SEQ ID NO: 1417021 - RNA, 19 nt, Homo sapiens
ggagagaaaauuagugcua

SEQ ID NO: 1417022 - RNA, 19 nt, Homo sapiens
uuuauguggucuuguauuc

SEQ ID NO: 1417023 - RNA, 19 nt, Homo sapiens
acacagcuacugcucuuug

SEQ ID NO: 1417024 - RNA, 19 nt, Homo sapiens
gcccacugaugugaggaua

SEQ ID NO: 1417025 - RNA, 19 nt, Homo sapiens
aggaucaagugcuuaugaa

SEQ ID NO: 1417026 - RNA, 19 nt, Homo sapiens
gguuuaaacuaacuuacac

SEQ ID NO: 1417027 - RNA, 19 nt, Homo sapiens
ugcacaaacuccucaguca

SEQ ID NO: 1417028 - RNA, 19 nt, Homo sapiens
aauguggcauaaucuaaug

SEQ ID NO: 1417029 - RNA, 19 nt, Homo sapiens
ccaguuugcauuugucaau

SEQ ID NO: 1417030 - RNA, 19 nt, Homo sapiens
ucagccaguuugcauuugu

SEQ ID NO: 1417031 - RNA, 19 nt, Homo sapiens
gaggaagccaugaacucuu

SEQ ID NO: 1417032 - RNA, 19 nt, Homo sapiens
cagcacauaacucccacua

SEQ ID NO: 1417033 - RNA, 19 nt, Homo sapiens
gagccaaaggccuucaaau

SEQ ID NO: 1417034 - RNA, 19 nt, Homo sapiens
caguuugcauuugucaauu

SEQ ID NO: 1417035 - RNA, 19 nt, Homo sapiens
aaacaaugacaucuuccuu

SEQ ID NO: 1417036 - RNA, 19 nt, Homo sapiens
gauccaggagagaaaauua

SEQ ID NO: 1417037 - RNA, 19 nt, Homo sapiens
acauaacucccacuaaaca

SEQ ID NO: 1417038 - RNA, 19 nt, Homo sapiens
cgaaauuauccacccuauu

SEQ ID NO: 1417039 - RNA, 19 nt, Homo sapiens
agccaaaggccuucaaaug

SEQ ID NO: 1417040 - RNA, 19 nt, Homo sapiens
uggguggacauuaaugaua

SEQ ID NO: 1417041 - RNA, 19 nt, Homo sapiens
acaaggaucaagugcuuau

SEQ ID NO: 1417042 - RNA, 19 nt, Homo sapiens
ugaacucuuuacagaaauc

SEQ ID NO: 1417043 - RNA, 19 nt, Homo sapiens
cuauaaaggcuacguggau

SEQ ID NO: 1417044 - RNA, 19 nt, Homo sapiens
gcauuugucaauucuucuu

SEQ ID NO: 1417045 - RNA, 19 nt, Homo sapiens
ccaugaacucuuuacagaa

SEQ ID NO: 1417046 - RNA, 19 nt, Homo sapiens
agagacaauugcacaaacu

SEQ ID NO: 1417047 - RNA, 19 nt, Homo sapiens
aaggaucaagugcuuauga

SEQ ID NO: 1417048 - RNA, 19 nt, Homo sapiens
aggaaggacuguggagaau

SEQ ID NO: 1417049 - RNA, 19 nt, Homo sapiens
uugcauuugucaauucuuc

SEQ ID NO: 1417050 - RNA, 19 nt, Homo sapiens
cuagaaacacagauaacug

SEQ ID NO: 1417051 - RNA, 19 nt, Homo sapiens
aaggcuacguggaugauuc

SEQ ID NO: 1417052 - RNA, 19 nt, Homo sapiens
guggcauaaucuaauguau

SEQ ID NO: 1417053 - RNA, 19 nt, Homo sapiens
aaccauagccucuacuuuu

SEQ ID NO: 1417054 - RNA, 19 nt, Homo sapiens
gcgaggaagccaugaacuc

SEQ ID NO: 1417055 - RNA, 19 nt, Homo sapiens
uaacagaagugaagaagaa

SEQ ID NO: 1417056 - RNA, 19 nt, Homo sapiens
ggugaaacgucuuaaagua

SEQ ID NO: 1417057 - RNA, 19 nt, Homo sapiens
gaagagaacaagaaacuaa

SEQ ID NO: 1417058 - RNA, 19 nt, Homo sapiens
guagccagcucuugcuuua

SEQ ID NO: 1417059 - RNA, 19 nt, Homo sapiens
gugagaagcuuccuaaaca

SEQ ID NO: 1417060 - RNA, 19 nt, Homo sapiens
cagaauaucuuugagaaug

SEQ ID NO: 1417061 - RNA, 19 nt, Homo sapiens
agaaugaucugucucaguu

SEQ ID NO: 1417062 - RNA, 19 nt, Homo sapiens
gaucagaccuuuucagaga

SEQ ID NO: 1417063 - RNA, 19 nt, Homo sapiens
gaagcuuccuaaacaaaga

SEQ ID NO: 1417064 - RNA, 19 nt, Homo sapiens
aaaccaagauuucacuuuc

SEQ ID NO: 1417065 - RNA, 19 nt, Homo sapiens
ugaaacgucuuaaaguaga

SEQ ID NO: 1417066 - RNA, 19 nt, Homo sapiens
caucaucucccuauacaaa

SEQ ID NO: 1417067 - RNA, 19 nt, Homo sapiens
cauccuggcuggaguguga

SEQ ID NO: 1417068 - RNA, 19 nt, Homo sapiens
gcagugcucuccaaaauga

SEQ ID NO: 1417069 - RNA, 19 nt, Homo sapiens
gugaaugucuaacccuaaa

SEQ ID NO: 1417070 - RNA, 19 nt, Homo sapiens
gaguuucgcucuugucauc

SEQ ID NO: 1417071 - RNA, 19 nt, Homo sapiens
gagaaugacaacuuaauca

SEQ ID NO: 1417072 - RNA, 19 nt, Homo sapiens
uaaaguagagagugaagaa

SEQ ID NO: 1417073 - RNA, 19 nt, Homo sapiens
ccacauauuuccaucugau

SEQ ID NO: 1417074 - RNA, 19 nt, Homo sapiens
gcucuugcuuuaugaguug

SEQ ID NO: 1417075 - RNA, 19 nt, Homo sapiens
gaagcagguucaggagaaa

SEQ ID NO: 1417076 - RNA, 19 nt, Homo sapiens
gagaagcuuccuaaacaaa

SEQ ID NO: 1417077 - RNA, 19 nt, Homo sapiens
ucaucucccuauacaaaua

SEQ ID NO: 1417078 - RNA, 19 nt, Homo sapiens
gacagugaauuugaagaaa

SEQ ID NO: 1417079 - RNA, 19 nt, Homo sapiens
aaacgacauuuaagucaug

SEQ ID NO: 1417080 - RNA, 19 nt, Homo sapiens
cagaagugaagaagaauuu

SEQ ID NO: 1417081 - RNA, 19 nt, Homo sapiens
caaagaaugaucugucuca

SEQ ID NO: 1417082 - RNA, 19 nt, Homo sapiens
gaaucucaaugucugugaa

SEQ ID NO: 1417083 - RNA, 19 nt, Homo sapiens
uguccaaucuggugaaugu

SEQ ID NO: 1417084 - RNA, 19 nt, Homo sapiens
aagccuuacucaauugaua

SEQ ID NO: 1417085 - RNA, 19 nt, Homo sapiens
aaaaugaguuugugaguga

SEQ ID NO: 1417086 - RNA, 19 nt, Homo sapiens
agacugaguuucgcucuug

SEQ ID NO: 1417087 - RNA, 19 nt, Homo sapiens
ugagaagcuuccuaaacaa

SEQ ID NO: 1417088 - RNA, 19 nt, Homo sapiens
ccgaguagcugagauuaca

SEQ ID NO: 1417089 - RNA, 19 nt, Homo sapiens
agauuucacuuucaagaug

SEQ ID NO: 1417090 - RNA, 19 nt, Homo sapiens
caagauuucacuuucaaga

SEQ ID NO: 1417091 - RNA, 19 nt, Homo sapiens
cacuauggguuagaugaua

SEQ ID NO: 1417092 - RNA, 19 nt, Homo sapiens
ccaaucuggugaaugucua

SEQ ID NO: 1417093 - RNA, 19 nt, Homo sapiens
gaaugaucugucucaguua

SEQ ID NO: 1417094 - RNA, 19 nt, Homo sapiens
ugagugagaagcuuccuaa

SEQ ID NO: 1417095 - RNA, 19 nt, Homo sapiens
cuuugagaaugacaacuua

SEQ ID NO: 1417096 - RNA, 19 nt, Homo sapiens
uaauuccucuuacaaugug

SEQ ID NO: 1417097 - RNA, 19 nt, Homo sapiens
uccagaauaucuuugagaa

SEQ ID NO: 1417098 - RNA, 19 nt, Homo sapiens
gugcaacacuuagagaaag

SEQ ID NO: 1417099 - RNA, 19 nt, Homo sapiens
acuauggguuagaugauaa

SEQ ID NO: 1417100 - RNA, 19 nt, Homo sapiens
cagagaaaccagcaucuuc

SEQ ID NO: 1417101 - RNA, 19 nt, Homo sapiens
gagacugaguuucgcucuu

SEQ ID NO: 1417102 - RNA, 19 nt, Homo sapiens
auaaagaaguggagaagcu

SEQ ID NO: 1417103 - RNA, 19 nt, Homo sapiens
agacagugaauuugaagaa

SEQ ID NO: 1417104 - RNA, 19 nt, Homo sapiens
gaaugucuaacccuaaagu

SEQ ID NO: 1417105 - RNA, 19 nt, Homo sapiens
ggugcgaucuugacucacu

SEQ ID NO: 1417106 - RNA, 19 nt, Homo sapiens
gaauccaucaucucccuau

SEQ ID NO: 1417107 - RNA, 19 nt, Homo sapiens
gaaacgucuuaaaguagag

SEQ ID NO: 1417108 - RNA, 19 nt, Homo sapiens
gugaaacgucuuaaaguag

SEQ ID NO: 1417109 - RNA, 19 nt, Homo sapiens
uuauguaccuuguuuccau

SEQ ID NO: 1417110 - RNA, 19 nt, Homo sapiens
ggugaaugucuaacccuaa

SEQ ID NO: 1417111 - RNA, 19 nt, Homo sapiens
agccagcucuugcuuuaug

SEQ ID NO: 1417112 - RNA, 19 nt, Homo sapiens
auacaaauaguucccgaaa

SEQ ID NO: 1417113 - RNA, 19 nt, Homo sapiens
cuaaguuuauguaccuugu

SEQ ID NO: 1417114 - RNA, 19 nt, Homo sapiens
gaagaaucucaaugucugu

SEQ ID NO: 1417115 - RNA, 19 nt, Homo sapiens
gaauaucuuugagaaugac

SEQ ID NO: 1417116 - RNA, 19 nt, Homo sapiens
cauauagacagugaauuug

SEQ ID NO: 1417117 - RNA, 19 nt, Homo sapiens
uaccacauauuuccaucug

SEQ ID NO: 1417118 - RNA, 19 nt, Homo sapiens
aaccaagauuucacuuuca

SEQ ID NO: 1417119 - RNA, 19 nt, Homo sapiens
caacacuuagagaaagauu

SEQ ID NO: 1417120 - RNA, 19 nt, Homo sapiens
gaccuucuucggaggcuaa

SEQ ID NO: 1417121 - RNA, 19 nt, Homo sapiens
gucuuaaaguagagaguga

SEQ ID NO: 1417122 - RNA, 19 nt, Homo sapiens
ccucaggccucugcgaauc

SEQ ID NO: 1417123 - RNA, 19 nt, Homo sapiens
aauccaucaucucccuaua

SEQ ID NO: 1417124 - RNA, 19 nt, Homo sapiens
ucuagcagguaauuaaacu

SEQ ID NO: 1417125 - RNA, 19 nt, Homo sapiens
uaccuuguuuccauccauu

SEQ ID NO: 1417126 - RNA, 19 nt, Homo sapiens
acaaauaguucccgaaaac

SEQ ID NO: 1417127 - RNA, 19 nt, Homo sapiens
ccauuagggcucagaggaa

SEQ ID NO: 1417128 - RNA, 19 nt, Homo sapiens
accaagauuucacuuucaa

SEQ ID NO: 1417129 - RNA, 19 nt, Homo sapiens
ugucugaagagaacaagaa

SEQ ID NO: 1417130 - RNA, 19 nt, Homo sapiens
gccagcucuugcuuuauga

SEQ ID NO: 1417131 - RNA, 19 nt, Homo sapiens
ugucucaguuacaguuguu

SEQ ID NO: 1417132 - RNA, 19 nt, Homo sapiens
uccaucaucucccuauaca

SEQ ID NO: 1417133 - RNA, 19 nt, Homo sapiens
uccauccauuuaccacaua

SEQ ID NO: 1417134 - RNA, 19 nt, Homo sapiens
ugagaaugacaacuuaauc

SEQ ID NO: 1417135 - RNA, 19 nt, Homo sapiens
ugaagagaacaagaaacua

SEQ ID NO: 1417136 - RNA, 19 nt, Homo sapiens
ggcuaaaacuagucaaaau

SEQ ID NO: 1417137 - RNA, 19 nt, Homo sapiens
guaccuuguuuccauccau

SEQ ID NO: 1417138 - RNA, 19 nt, Homo sapiens
ugccucagccucccgagua

SEQ ID NO: 1417139 - RNA, 19 nt, Homo sapiens
guggugaaacgucuuaaag

SEQ ID NO: 1417140 - RNA, 19 nt, Homo sapiens
aggcucagcugugguuuua

SEQ ID NO: 1417141 - RNA, 19 nt, Homo sapiens
ugcaacacuuagagaaaga

SEQ ID NO: 1417142 - RNA, 19 nt, Homo sapiens
aaagucauuugggcaguuc

SEQ ID NO: 1417143 - RNA, 19 nt, Homo sapiens
caaaacgacauuuaaguca

SEQ ID NO: 1417144 - RNA, 19 nt, Homo sapiens
gaguugcagucagcugugu

SEQ ID NO: 1417145 - RNA, 19 nt, Homo sapiens
uaauaaagaaguggagaag

SEQ ID NO: 1417146 - RNA, 19 nt, Homo sapiens
cacauauuuccaucugaua

SEQ ID NO: 1417147 - RNA, 19 nt, Homo sapiens
cucaauugauagaccacua

SEQ ID NO: 1417148 - RNA, 19 nt, Homo sapiens
aaugaucugucucaguuac

SEQ ID NO: 1417149 - RNA, 19 nt, Homo sapiens
aaacaaccuaugagugcaa

SEQ ID NO: 1417150 - RNA, 19 nt, Homo sapiens
cauuugggcaguucuggaa

SEQ ID NO: 1417151 - RNA, 19 nt, Homo sapiens
gacuggguuucaccacguu

SEQ ID NO: 1417152 - RNA, 19 nt, Homo sapiens
ccucucggguuccagcaau

SEQ ID NO: 1417153 - RNA, 19 nt, Homo sapiens
ucagagaaaccagcaucuu

SEQ ID NO: 1417154 - RNA, 19 nt, Homo sapiens
ccagaauaucuuugagaau

SEQ ID NO: 1417155 - RNA, 19 nt, Homo sapiens
guaauuugcucuauucuug

SEQ ID NO: 1417156 - RNA, 19 nt, Homo sapiens
ggagaguagugaagaauug

SEQ ID NO: 1417157 - RNA, 19 nt, Homo sapiens
ggaaaugaaugggaaaugu

SEQ ID NO: 1417158 - RNA, 19 nt, Homo sapiens
agagaaagccaauggaaua

SEQ ID NO: 1417159 - RNA, 19 nt, Homo sapiens
gaaagccaauggaauaugc

SEQ ID NO: 1417160 - RNA, 19 nt, Homo sapiens
cuaaauaccagacuucaaa

SEQ ID NO: 1417161 - RNA, 19 nt, Homo sapiens
ggacaauucagcaugguaa

SEQ ID NO: 1417162 - RNA, 19 nt, Homo sapiens
cucacgaucugaaauaaua

SEQ ID NO: 1417163 - RNA, 19 nt, Homo sapiens
gaagaguuguuccaaaugc

SEQ ID NO: 1417164 - RNA, 19 nt, Homo sapiens
uagcuucucuggacaauuc

SEQ ID NO: 1417165 - RNA, 19 nt, Homo sapiens
cugcugagcucuggguuua

SEQ ID NO: 1417166 - RNA, 19 nt, Homo sapiens
cagcauuuguguuucauga

SEQ ID NO: 1417167 - RNA, 19 nt, Homo sapiens
ggaagcaggagcagagaaa

SEQ ID NO: 1417168 - RNA, 19 nt, Homo sapiens
gcucuggguuuaccuucua

SEQ ID NO: 1417169 - RNA, 19 nt, Homo sapiens
gcagagaaagccaauggaa

SEQ ID NO: 1417170 - RNA, 19 nt, Homo sapiens
ccgaagaguuguuccaaau

SEQ ID NO: 1417171 - RNA, 19 nt, Homo sapiens
ccaaccaacucuccgaaga

SEQ ID NO: 1417172 - RNA, 19 nt, Homo sapiens
cagcaacccuuaccagaca

SEQ ID NO: 1417173 - RNA, 19 nt, Homo sapiens
ucaaagcaguaguaucaug

SEQ ID NO: 1417174 - RNA, 19 nt, Homo sapiens
gaacuuauuuuccugugaa

SEQ ID NO: 1417175 - RNA, 19 nt, Homo sapiens
ugacagcauuuguguuuca

SEQ ID NO: 1417176 - RNA, 19 nt, Homo sapiens
gcucgucauucuucuaaau

SEQ ID NO: 1417177 - RNA, 19 nt, Homo sapiens
ggucucacgaucugaaaua

SEQ ID NO: 1417178 - RNA, 19 nt, Homo sapiens
gcauuuguguuucaugaca

SEQ ID NO: 1417179 - RNA, 19 nt, Homo sapiens
ggguuuaccuucuacaaca

SEQ ID NO: 1417180 - RNA, 19 nt, Homo sapiens
gaaaaugccuaccacaaag

SEQ ID NO: 1417181 - RNA, 19 nt, Homo sapiens
caaagcaguaguaucauga

SEQ ID NO: 1417182 - RNA, 19 nt, Homo sapiens
aaaugucgcuggucugugu

SEQ ID NO: 1417183 - RNA, 19 nt, Homo sapiens
ccacaaagaagacauugau

SEQ ID NO: 1417184 - RNA, 19 nt, Homo sapiens
gguauucaaagcaguagua

SEQ ID NO: 1417185 - RNA, 19 nt, Homo sapiens
aaggaacgacccacaguua

SEQ ID NO: 1417186 - RNA, 19 nt, Homo sapiens
ccaguacgauugcuguuag

SEQ ID NO: 1417187 - RNA, 19 nt, Homo sapiens
gaaaugaaugggaaauguc

SEQ ID NO: 1417188 - RNA, 19 nt, Homo sapiens
gcaaccaccaguaaaggaa

SEQ ID NO: 1417189 - RNA, 19 nt, Homo sapiens
gagcagagaaagccaaugg

SEQ ID NO: 1417190 - RNA, 19 nt, Homo sapiens
ggaaaugucgcuggucugu

SEQ ID NO: 1417191 - RNA, 19 nt, Homo sapiens
guucuucauugaugcugua

SEQ ID NO: 1417192 - RNA, 19 nt, Homo sapiens
gagaaagccaauggaauau

SEQ ID NO: 1417193 - RNA, 19 nt, Homo sapiens
gguccuucauuguaauuug

SEQ ID NO: 1417194 - RNA, 19 nt, Homo sapiens
ugugacagcauuuguguuu

SEQ ID NO: 1417195 - RNA, 19 nt, Homo sapiens
gcucauacugcucgucauu

SEQ ID NO: 1417196 - RNA, 19 nt, Homo sapiens
gaacacgcaguccaaccaa

SEQ ID NO: 1417197 - RNA, 19 nt, Homo sapiens
ggacuugcagaaccaaaga

SEQ ID NO: 1417198 - RNA, 19 nt, Homo sapiens
aagcauggaucaccaguac

SEQ ID NO: 1417199 - RNA, 19 nt, Homo sapiens
auucaaagcaguaguauca

SEQ ID NO: 1417200 - RNA, 19 nt, Homo sapiens
ggaagagugagauuuuaua

SEQ ID NO: 1417201 - RNA, 19 nt, Homo sapiens
uuucaucacuuacggacuu

SEQ ID NO: 1417202 - RNA, 19 nt, Homo sapiens
gcauggaucaccaguacga

SEQ ID NO: 1417203 - RNA, 19 nt, Homo sapiens
uugcaucuauuguacauca

SEQ ID NO: 1417204 - RNA, 19 nt, Homo sapiens
gggagaguagugaagaauu

SEQ ID NO: 1417205 - RNA, 19 nt, Homo sapiens
cuuggguccuucauuguaa

SEQ ID NO: 1417206 - RNA, 19 nt, Homo sapiens
gcuggucugugugguauuc

SEQ ID NO: 1417207 - RNA, 19 nt, Homo sapiens
uaccagacuucaaaagaua

SEQ ID NO: 1417208 - RNA, 19 nt, Homo sapiens
gagaguagugaagaauuga

SEQ ID NO: 1417209 - RNA, 19 nt, Homo sapiens
guacgauugcuguuagaga

SEQ ID NO: 1417210 - RNA, 19 nt, Homo sapiens
gcuguacuccugaaaauuu

SEQ ID NO: 1417211 - RNA, 19 nt, Homo sapiens
gacaauaaaguguuagacu

SEQ ID NO: 1417212 - RNA, 19 nt, Homo sapiens
gauguucuuaucaagcuuu

SEQ ID NO: 1417213 - RNA, 19 nt, Homo sapiens
acuguaaccaucaucauuu

SEQ ID NO: 1417214 - RNA, 19 nt, Homo sapiens
ucacggacuugcagaacca

SEQ ID NO: 1417215 - RNA, 19 nt, Homo sapiens
ggagcauuuucaucacuua

SEQ ID NO: 1417216 - RNA, 19 nt, Homo sapiens
ggccuggucucacgaucug

SEQ ID NO: 1417217 - RNA, 19 nt, Homo sapiens
aagauaagguucaaaagug

SEQ ID NO: 1417218 - RNA, 19 nt, Homo sapiens
caggaagagugagauuuua

SEQ ID NO: 1417219 - RNA, 19 nt, Homo sapiens
uaaaggaacgacccacagu

SEQ ID NO: 1417220 - RNA, 19 nt, Homo sapiens
cagagaaagccaauggaau

SEQ ID NO: 1417221 - RNA, 19 nt, Homo sapiens
gcucuauucuugggacaca

SEQ ID NO: 1417222 - RNA, 19 nt, Homo sapiens
ugaaaaugccuaccacaaa

SEQ ID NO: 1417223 - RNA, 19 nt, Homo sapiens
uaaaguguuagacuccauu

SEQ ID NO: 1417224 - RNA, 19 nt, Homo sapiens
cgaagaguuguuccaaaug

SEQ ID NO: 1417225 - RNA, 19 nt, Homo sapiens
guagugaagaauugaguca

SEQ ID NO: 1417226 - RNA, 19 nt, Homo sapiens
gagacucugcuucaaaugg

SEQ ID NO: 1417227 - RNA, 19 nt, Homo sapiens
gacccacaguuacggauac

SEQ ID NO: 1417228 - RNA, 19 nt, Homo sapiens
ugaccaugauacuguuugu

SEQ ID NO: 1417229 - RNA, 19 nt, Homo sapiens
agccuuggguccuucauug

SEQ ID NO: 1417230 - RNA, 19 nt, Homo sapiens
gcuccaagggacggaauuu

SEQ ID NO: 1417231 - RNA, 19 nt, Homo sapiens
ucauacugcucgucauucu

SEQ ID NO: 1417232 - RNA, 19 nt, Homo sapiens
cgacccacaguuacggaua

SEQ ID NO: 1417233 - RNA, 19 nt, Homo sapiens
gcucggugcauccuucguu

SEQ ID NO: 1417234 - RNA, 19 nt, Homo sapiens
gaguuguuccaaaugcuuu

SEQ ID NO: 1417235 - RNA, 19 nt, Homo sapiens
caagcauggaucaccagua

SEQ ID NO: 1417236 - RNA, 19 nt, Homo sapiens
gucucacgaucugaaauaa

SEQ ID NO: 1417237 - RNA, 19 nt, Homo sapiens
gagcguaacgacccuucug

SEQ ID NO: 1417238 - RNA, 19 nt, Homo sapiens
aagcaguaguaucaugaug

SEQ ID NO: 1417239 - RNA, 19 nt, Homo sapiens
gggaaaugaaugggaaaug

SEQ ID NO: 1417240 - RNA, 19 nt, Homo sapiens
ggcguugcaucuauuguac

SEQ ID NO: 1417241 - RNA, 19 nt, Homo sapiens
aaaggaacgacccacaguu

SEQ ID NO: 1417242 - RNA, 19 nt, Homo sapiens
uccgaagaguuguuccaaa

SEQ ID NO: 1417243 - RNA, 19 nt, Homo sapiens
ggucugugugguauucaaa

SEQ ID NO: 1417244 - RNA, 19 nt, Homo sapiens
uggcguugcaucuauugua

SEQ ID NO: 1417245 - RNA, 19 nt, Homo sapiens
ccacaagguuggggaaaug

SEQ ID NO: 1417246 - RNA, 19 nt, Homo sapiens
ucaccagccuuggguccuu

SEQ ID NO: 1417247 - RNA, 19 nt, Homo sapiens
ucgcuggucugugugguau

SEQ ID NO: 1417248 - RNA, 19 nt, Homo sapiens
ccuuggguccuucauugua

SEQ ID NO: 1417249 - RNA, 19 nt, Homo sapiens
acuguguucuucauugaug

SEQ ID NO: 1417250 - RNA, 19 nt, Homo sapiens
cacuguaaccaucaucauu

SEQ ID NO: 1417251 - RNA, 19 nt, Homo sapiens
cuucauugaugcuguacuc

SEQ ID NO: 1417252 - RNA, 19 nt, Homo sapiens
ccagauaccagcggaagca

SEQ ID NO: 1417253 - RNA, 19 nt, Homo sapiens
ggaacgacccacaguuacg

SEQ ID NO: 1417254 - RNA, 19 nt, Homo sapiens
ggcaaccaccaguaaagga

SEQ ID NO: 1417255 - RNA, 19 nt, Homo sapiens
ggaaauggcugcuucauca

SEQ ID NO: 1417256 - RNA, 19 nt, Homo sapiens
caaaggagcuggagagaug

SEQ ID NO: 1417257 - RNA, 19 nt, Homo sapiens
gcaauucuguagcaaauaa

SEQ ID NO: 1417258 - RNA, 19 nt, Homo sapiens
cuacgucacugaauuguua

SEQ ID NO: 1417259 - RNA, 19 nt, Homo sapiens
uuaaacaggugaaacauga

SEQ ID NO: 1417260 - RNA, 19 nt, Homo sapiens
gcacauuuguacuugguuu

SEQ ID NO: 1417261 - RNA, 19 nt, Homo sapiens
ggagagauguuagaagaug

SEQ ID NO: 1417262 - RNA, 19 nt, Homo sapiens
guacuugguuucucuguau

SEQ ID NO: 1417263 - RNA, 19 nt, Homo sapiens
ggaaauauuuaccagucaa

SEQ ID NO: 1417264 - RNA, 19 nt, Homo sapiens
gacaaucaguuucagagaa

SEQ ID NO: 1417265 - RNA, 19 nt, Homo sapiens
acacagaaauccugaguuc

SEQ ID NO: 1417266 - RNA, 19 nt, Homo sapiens
gaaacaugaucagcaaguu

SEQ ID NO: 1417267 - RNA, 19 nt, Homo sapiens
ggauauggcagcacuugua

SEQ ID NO: 1417268 - RNA, 19 nt, Homo sapiens
gggacuuucucacagcuua

SEQ ID NO: 1417269 - RNA, 19 nt, Homo sapiens
ggugaaacaugaucagcaa

SEQ ID NO: 1417270 - RNA, 19 nt, Homo sapiens
ccaaguagggcauauauca

SEQ ID NO: 1417271 - RNA, 19 nt, Homo sapiens
gcugacgaguggcgguuua

SEQ ID NO: 1417272 - RNA, 19 nt, Homo sapiens
uauggugccuggaaauauu

SEQ ID NO: 1417273 - RNA, 19 nt, Homo sapiens
gauauggcagcacuuguaa

SEQ ID NO: 1417274 - RNA, 19 nt, Homo sapiens
uuacauagccauccagaga

SEQ ID NO: 1417275 - RNA, 19 nt, Homo sapiens
gggcauauaucagauuugg

SEQ ID NO: 1417276 - RNA, 19 nt, Homo sapiens
cuggagagauguuagaaga

SEQ ID NO: 1417277 - RNA, 19 nt, Homo sapiens
ggacucaagcaauucugua

SEQ ID NO: 1417278 - RNA, 19 nt, Homo sapiens
ggcaacaaauacuuauaug

SEQ ID NO: 1417279 - RNA, 19 nt, Homo sapiens
aauauagcauucugaccua

SEQ ID NO: 1417280 - RNA, 19 nt, Homo sapiens
aagcaauucuguagcaaau

SEQ ID NO: 1417281 - RNA, 19 nt, Homo sapiens
uaucagauuuggccaacug

SEQ ID NO: 1417282 - RNA, 19 nt, Homo sapiens
ucacugaauuguuaaugca

SEQ ID NO: 1417283 - RNA, 19 nt, Homo sapiens
acagcuacgucacugaauu

SEQ ID NO: 1417284 - RNA, 19 nt, Homo sapiens
uagggcauauaucagauuu

SEQ ID NO: 1417285 - RNA, 19 nt, Homo sapiens
uaaagccgcugagugaagu

SEQ ID NO: 1417286 - RNA, 19 nt, Homo sapiens
ggucagcaucugugguuaa

SEQ ID NO: 1417287 - RNA, 19 nt, Homo sapiens
ccaacugaauggcgucugu

SEQ ID NO: 1417288 - RNA, 19 nt, Homo sapiens
caacucaggaccuauccaa

SEQ ID NO: 1417289 - RNA, 19 nt, Homo sapiens
cauauggugccuggaaaua

SEQ ID NO: 1417290 - RNA, 19 nt, Homo sapiens
gcaguaagcaaaauccuuu

SEQ ID NO: 1417291 - RNA, 19 nt, Homo sapiens
gucagcaucugugguuaaa

SEQ ID NO: 1417292 - RNA, 19 nt, Homo sapiens
cacaggcaacaaauacuua

SEQ ID NO: 1417293 - RNA, 19 nt, Homo sapiens
ccacagcuacgucacugaa

SEQ ID NO: 1417294 - RNA, 19 nt, Homo sapiens
caagcaauucuguagcaaa

SEQ ID NO: 1417295 - RNA, 19 nt, Homo sapiens
auccagagauccacagcua

SEQ ID NO: 1417296 - RNA, 19 nt, Homo sapiens
uuauagacaugccaaaugc

SEQ ID NO: 1417297 - RNA, 19 nt, Homo sapiens
cucaggaccuauccaaaug

SEQ ID NO: 1417298 - RNA, 19 nt, Homo sapiens
gguuugggguuaagagaua

SEQ ID NO: 1417299 - RNA, 19 nt, Homo sapiens
ucacaggcaacaaauacuu

SEQ ID NO: 1417300 - RNA, 19 nt, Homo sapiens
uagcugguuugguagaaga

SEQ ID NO: 1417301 - RNA, 19 nt, Homo sapiens
aaacaugaucagcaaguug

SEQ ID NO: 1417302 - RNA, 19 nt, Homo sapiens
gagcuggagagauguuaga

SEQ ID NO: 1417303 - RNA, 19 nt, Homo sapiens
uugguggacucaagcaauu

SEQ ID NO: 1417304 - RNA, 19 nt, Homo sapiens
acaaucaguuucagagaac

SEQ ID NO: 1417305 - RNA, 19 nt, Homo sapiens
ugguuucucuguaucuauu

SEQ ID NO: 1417306 - RNA, 19 nt, Homo sapiens
ugaaguaagaacucugcua

SEQ ID NO: 1417307 - RNA, 19 nt, Homo sapiens
ggaucugguuucagugucu

SEQ ID NO: 1417308 - RNA, 19 nt, Homo sapiens
ggguuaagagauacucaaa

SEQ ID NO: 1417309 - RNA, 19 nt, Homo sapiens
cagcuacgucacugaauug

SEQ ID NO: 1417310 - RNA, 19 nt, Homo sapiens
gaaauauuuaccagucaag

SEQ ID NO: 1417311 - RNA, 19 nt, Homo sapiens
gccgcugagugaaguaaga

SEQ ID NO: 1417312 - RNA, 19 nt, Homo sapiens
uaagacaaucaguuucaga

SEQ ID NO: 1417313 - RNA, 19 nt, Homo sapiens
caaguugcucggauggaaa

SEQ ID NO: 1417314 - RNA, 19 nt, Homo sapiens
gaaauggcugcuucaucau

SEQ ID NO: 1417315 - RNA, 19 nt, Homo sapiens
uguacuugguuucucugua

SEQ ID NO: 1417316 - RNA, 19 nt, Homo sapiens
ugcuaaagccgcugaguga

SEQ ID NO: 1417317 - RNA, 19 nt, Homo sapiens
guagggcauauaucagauu

SEQ ID NO: 1417318 - RNA, 19 nt, Homo sapiens
ucuauucacaggcaacaaa

SEQ ID NO: 1417319 - RNA, 19 nt, Homo sapiens
ucaagcaauucuguagcaa

SEQ ID NO: 1417320 - RNA, 19 nt, Homo sapiens
ucucauugguggacucaag

SEQ ID NO: 1417321 - RNA, 19 nt, Homo sapiens
aaacacagaaauccugagu

SEQ ID NO: 1417322 - RNA, 19 nt, Homo sapiens
ggucaaggucagcaucugu

SEQ ID NO: 1417323 - RNA, 19 nt, Homo sapiens
uggaaauauuuaccaguca

SEQ ID NO: 1417324 - RNA, 19 nt, Homo sapiens
acauagccauccagagauc

SEQ ID NO: 1417325 - RNA, 19 nt, Homo sapiens
aauggcugcuucaucauca

SEQ ID NO: 1417326 - RNA, 19 nt, Homo sapiens
caagccaaguagggcauau

SEQ ID NO: 1417327 - RNA, 19 nt, Homo sapiens
caggcaacaaauacuuaua

SEQ ID NO: 1417328 - RNA, 19 nt, Homo sapiens
ugaaacaugaucagcaagu

SEQ ID NO: 1417329 - RNA, 19 nt, Homo sapiens
acucaggaccuauccaaau

SEQ ID NO: 1417330 - RNA, 19 nt, Homo sapiens
cagcuuacauagccaucca

SEQ ID NO: 1417331 - RNA, 19 nt, Homo sapiens
gaaauccugaguucuucuc

SEQ ID NO: 1417332 - RNA, 19 nt, Homo sapiens
cagauuuggccaacugaau

SEQ ID NO: 1417333 - RNA, 19 nt, Homo sapiens
cuuauagacaugccaaaug

SEQ ID NO: 1417334 - RNA, 19 nt, Homo sapiens
aauggcgucuguccuguca

SEQ ID NO: 1417335 - RNA, 19 nt, Homo sapiens
aaguagggcauauaucaga

SEQ ID NO: 1417336 - RNA, 19 nt, Homo sapiens
gcuaaagccgcugagugaa

SEQ ID NO: 1417337 - RNA, 19 nt, Homo sapiens
cuaaagccgcugagugaag

SEQ ID NO: 1417338 - RNA, 19 nt, Homo sapiens
ucaggaccuauccaaauga

SEQ ID NO: 1417339 - RNA, 19 nt, Homo sapiens
cucaagcaauucuguagca

SEQ ID NO: 1417340 - RNA, 19 nt, Homo sapiens
uauagcauucugaccuaaa

SEQ ID NO: 1417341 - RNA, 19 nt, Homo sapiens
aaacaggugaaacaugauc

SEQ ID NO: 1417342 - RNA, 19 nt, Homo sapiens
gcaaacauaugaugaagaa

SEQ ID NO: 1417343 - RNA, 19 nt, Homo sapiens
ggaugaagaucaauuaauc

SEQ ID NO: 1417344 - RNA, 19 nt, Homo sapiens
gaaugugucugugaauaaa

SEQ ID NO: 1417345 - RNA, 19 nt, Homo sapiens
gcaagcagcagaagagaaa

SEQ ID NO: 1417346 - RNA, 19 nt, Homo sapiens
ggacaccagcccagacuua

SEQ ID NO: 1417347 - RNA, 19 nt, Homo sapiens
ggaaugugucugugaauaa

SEQ ID NO: 1417348 - RNA, 19 nt, Homo sapiens
gaugcuaaccuccaaguuu

SEQ ID NO: 1417349 - RNA, 19 nt, Homo sapiens
gauuggaaauaauggauga

SEQ ID NO: 1417350 - RNA, 19 nt, Homo sapiens
gaagagauacuuggagaug

SEQ ID NO: 1417351 - RNA, 19 nt, Homo sapiens
ucaaagagcuaugcaagca

SEQ ID NO: 1417352 - RNA, 19 nt, Homo sapiens
augcuaaccuccaaguuua

SEQ ID NO: 1417353 - RNA, 19 nt, Homo sapiens
caaacagacggaagagaua

SEQ ID NO: 1417354 - RNA, 19 nt, Homo sapiens
ggaaauaauggaugaagau

SEQ ID NO: 1417355 - RNA, 19 nt, Homo sapiens
agagaaauccugugacuga

SEQ ID NO: 1417356 - RNA, 19 nt, Homo sapiens
gauguaagcaccagcauuc

SEQ ID NO: 1417357 - RNA, 19 nt, Homo sapiens
guuuaguccugcagagaua

SEQ ID NO: 1417358 - RNA, 19 nt, Homo sapiens
gagcaaacauaugaugaag

SEQ ID NO: 1417359 - RNA, 19 nt, Homo sapiens
agagauacuuggagaugaa

SEQ ID NO: 1417360 - RNA, 19 nt, Homo sapiens
uuggaaaucugucuuuguu

SEQ ID NO: 1417361 - RNA, 19 nt, Homo sapiens
aauaaagacuagccgaaga

SEQ ID NO: 1417362 - RNA, 19 nt, Homo sapiens
uggaaugugucugugaaua

SEQ ID NO: 1417363 - RNA, 19 nt, Homo sapiens
gcagagauagagaacauca

SEQ ID NO: 1417364 - RNA, 19 nt, Homo sapiens
aggaaugucugcccauaug

SEQ ID NO: 1417365 - RNA, 19 nt, Homo sapiens
gaaguggagcaggauguaa

SEQ ID NO: 1417366 - RNA, 19 nt, Homo sapiens
gcccagacuuagagaaauc

SEQ ID NO: 1417367 - RNA, 19 nt, Homo sapiens
agagauagagaacaucaaa

SEQ ID NO: 1417368 - RNA, 19 nt, Homo sapiens
ccugugaagugaagccaaa

SEQ ID NO: 1417369 - RNA, 19 nt, Homo sapiens
gagaaauccugugacugau

SEQ ID NO: 1417370 - RNA, 19 nt, Homo sapiens
agauagagaacaucaaaga

SEQ ID NO: 1417371 - RNA, 19 nt, Homo sapiens
ccuccuaccugugaaguga

SEQ ID NO: 1417372 - RNA, 19 nt, Homo sapiens
gaaauaauggaugaagauc

SEQ ID NO: 1417373 - RNA, 19 nt, Homo sapiens
uaaagacuagccgaagaua

SEQ ID NO: 1417374 - RNA, 19 nt, Homo sapiens
gccaaagcccaguguuaaa

SEQ ID NO: 1417375 - RNA, 19 nt, Homo sapiens
cagcauuccuuccuguauc

SEQ ID NO: 1417376 - RNA, 19 nt, Homo sapiens
gaacaucaaagagcuaugc

SEQ ID NO: 1417377 - RNA, 19 nt, Homo sapiens
aagccaaagcccaguguua

SEQ ID NO: 1417378 - RNA, 19 nt, Homo sapiens
uggaaauaauggaugaaga

SEQ ID NO: 1417379 - RNA, 19 nt, Homo sapiens
cugcagagauagagaacau

SEQ ID NO: 1417380 - RNA, 19 nt, Homo sapiens
guaagcaccagcauuccuu

SEQ ID NO: 1417381 - RNA, 19 nt, Homo sapiens
cgucuuggauaaauuccuu

SEQ ID NO: 1417382 - RNA, 19 nt, Homo sapiens
uuagagaaauccugugacu

SEQ ID NO: 1417383 - RNA, 19 nt, Homo sapiens
auaggaaugucugcccaua

SEQ ID NO: 1417384 - RNA, 19 nt, Homo sapiens
ccuggaaugugucugugaa

SEQ ID NO: 1417385 - RNA, 19 nt, Homo sapiens
acaaacagacggaagagau

SEQ ID NO: 1417386 - RNA, 19 nt, Homo sapiens
ggauguaagcaccagcauu

SEQ ID NO: 1417387 - RNA, 19 nt, Homo sapiens
ugucaggauuggaaauaau

SEQ ID NO: 1417388 - RNA, 19 nt, Homo sapiens
gcccauaugucaggauugg

SEQ ID NO: 1417389 - RNA, 19 nt, Homo sapiens
cagcccagacuuagagaaa

SEQ ID NO: 1417390 - RNA, 19 nt, Homo sapiens
aagauacuguggccucaug

SEQ ID NO: 1417391 - RNA, 19 nt, Homo sapiens
ugagcaaacauaugaugaa

SEQ ID NO: 1417392 - RNA, 19 nt, Homo sapiens
ccauaugucaggauuggaa

SEQ ID NO: 1417393 - RNA, 19 nt, Homo sapiens
aagagauacuuggagauga

SEQ ID NO: 1417394 - RNA, 19 nt, Homo sapiens
gagaaguggagcaggaugu

SEQ ID NO: 1417395 - RNA, 19 nt, Homo sapiens
uacuguggccucaugaaua

SEQ ID NO: 1417396 - RNA, 19 nt, Homo sapiens
acuguggccucaugaauag

SEQ ID NO: 1417397 - RNA, 19 nt, Homo sapiens
gagaacaucaaagagcuau

SEQ ID NO: 1417398 - RNA, 19 nt, Homo sapiens
uaugucaggauuggaaaua

SEQ ID NO: 1417399 - RNA, 19 nt, Homo sapiens
gauagagaacaucaaagag

SEQ ID NO: 1417400 - RNA, 19 nt, Homo sapiens
gaaugucugcccauauguc

SEQ ID NO: 1417401 - RNA, 19 nt, Homo sapiens
ggaagagauacuuggagau

SEQ ID NO: 1417402 - RNA, 19 nt, Homo sapiens
agccaaagcccaguguuaa

SEQ ID NO: 1417403 - RNA, 19 nt, Homo sapiens
ggaaugucugcccauaugu

SEQ ID NO: 1417404 - RNA, 19 nt, Homo sapiens
ggacaaacagacggaagag

SEQ ID NO: 1417405 - RNA, 19 nt, Homo sapiens
gauacuguggccucaugaa

SEQ ID NO: 1417406 - RNA, 19 nt, Homo sapiens
gaagccaaagcccaguguu

SEQ ID NO: 1417407 - RNA, 19 nt, Homo sapiens
caugagcaaacauaugaug

SEQ ID NO: 1417408 - RNA, 19 nt, Homo sapiens
ccagcauuccuuccuguau

SEQ ID NO: 1417409 - RNA, 19 nt, Homo sapiens
agaaguggagcaggaugua

SEQ ID NO: 1417410 - RNA, 19 nt, Homo sapiens
gcugcugcuuccaggagaa

SEQ ID NO: 1417411 - RNA, 19 nt, Homo sapiens
uaugacaaugugaugcuaa

SEQ ID NO: 1417412 - RNA, 19 nt, Homo sapiens
uaauugucaugagcaaaca

SEQ ID NO: 1417413 - RNA, 19 nt, Homo sapiens
agagagagcuuguuagaaa

SEQ ID NO: 1417414 - RNA, 19 nt, Homo sapiens
gaagagagagcuuguuaga

SEQ ID NO: 1417415 - RNA, 19 nt, Homo sapiens
caacaugcuuguaaacuuc

SEQ ID NO: 1417416 - RNA, 19 nt, Homo sapiens
ccacaguuguucucucauu

SEQ ID NO: 1417417 - RNA, 19 nt, Homo sapiens
ggaccauuaccuucauuua

SEQ ID NO: 1417418 - RNA, 19 nt, Homo sapiens
ccaacaugcuuguaaacuu

SEQ ID NO: 1417419 - RNA, 19 nt, Homo sapiens
gaaauacagucuccuaccu

SEQ ID NO: 1417420 - RNA, 19 nt, Homo sapiens
ugauuucgcucccuuacuu

SEQ ID NO: 1417421 - RNA, 19 nt, Homo sapiens
gaccaaaucaagucaauca

SEQ ID NO: 1417422 - RNA, 19 nt, Homo sapiens
ccaaaucaagucaaucauu

SEQ ID NO: 1417423 - RNA, 19 nt, Homo sapiens
gauccaauccuucgaguca

SEQ ID NO: 1417424 - RNA, 19 nt, Homo sapiens
gaccauuaccuucauuuau

SEQ ID NO: 1417425 - RNA, 19 nt, Homo sapiens
cuauugggcuuaacagaug

SEQ ID NO: 1417426 - RNA, 19 nt, Homo sapiens
agaacaagguggugucugu

SEQ ID NO: 1417427 - RNA, 19 nt, Homo sapiens
ugacauggccuauucaucu

SEQ ID NO: 1417428 - RNA, 19 nt, Homo sapiens
caacugaccagaacaaggu

SEQ ID NO: 1417429 - RNA, 19 nt, Homo sapiens
ucucauugcugucuccuau

SEQ ID NO: 1417430 - RNA, 19 nt, Homo sapiens
acaagucaguguccagcua

SEQ ID NO: 1417431 - RNA, 19 nt, Homo sapiens
gacauggccuauucaucuu

SEQ ID NO: 1417432 - RNA, 19 nt, Homo sapiens
uuuaugugaugcccaauuu

SEQ ID NO: 1417433 - RNA, 19 nt, Homo sapiens
gcacuucccaccucacugu

SEQ ID NO: 1417434 - RNA, 19 nt, Homo sapiens
cugaagagagagcuuguua

SEQ ID NO: 1417435 - RNA, 19 nt, Homo sapiens
accauuaccuucauuuaug

SEQ ID NO: 1417436 - RNA, 19 nt, Homo sapiens
cacaguuguucucucauuu

SEQ ID NO: 1417437 - RNA, 19 nt, Homo sapiens
cuuaacagaugauccaauc

SEQ ID NO: 1417438 - RNA, 19 nt, Homo sapiens
ucaggaacaaggagauuaa

SEQ ID NO: 1417439 - RNA, 19 nt, Homo sapiens
cuacaucuauauccucauc

SEQ ID NO: 1417440 - RNA, 19 nt, Homo sapiens
ccauuaccuucauuuaugu

SEQ ID NO: 1417441 - RNA, 19 nt, Homo sapiens
uccaucauccuauguauuu

SEQ ID NO: 1417442 - RNA, 19 nt, Homo sapiens
cuacucaacugaccagaac

SEQ ID NO: 1417443 - RNA, 19 nt, Homo sapiens
ucacugugguuacccuguu

SEQ ID NO: 1417444 - RNA, 19 nt, Homo sapiens
cacccaacaugcuuguaaa

SEQ ID NO: 1417445 - RNA, 19 nt, Homo sapiens
cauccuaucugguaaucuc

SEQ ID NO: 1417446 - RNA, 19 nt, Homo sapiens
cauccuauguauuucuuuc

SEQ ID NO: 1417447 - RNA, 19 nt, Homo sapiens
uaguuuacauagcugguuu

SEQ ID NO: 1417448 - RNA, 19 nt, Homo sapiens
gcuccaucauccuauguau

SEQ ID NO: 1417449 - RNA, 19 nt, Homo sapiens
cuauacuacuuccuucuau

SEQ ID NO: 1417450 - RNA, 19 nt, Homo sapiens
cuauucaucuucugucaca

SEQ ID NO: 1417451 - RNA, 19 nt, Homo sapiens
uugcugacauggccuauuc

SEQ ID NO: 1417452 - RNA, 19 nt, Homo sapiens
gagagagcuuguuagaaaa

SEQ ID NO: 1417453 - RNA, 19 nt, Homo sapiens
ugaagaugcgcuccacuga

SEQ ID NO: 1417454 - RNA, 19 nt, Homo sapiens
ccuauguauuucuuucuga

SEQ ID NO: 1417455 - RNA, 19 nt, Homo sapiens
caagguggugucuguguug

SEQ ID NO: 1417456 - RNA, 19 nt, Homo sapiens
acaagguggugucuguguu

SEQ ID NO: 1417457 - RNA, 19 nt, Homo sapiens
gccgucugcuacaucuaua

SEQ ID NO: 1417458 - RNA, 19 nt, Homo sapiens
acacccaacaugcuuguaa

SEQ ID NO: 1417459 - RNA, 19 nt, Homo sapiens
gggaaucacaccgcucuga

SEQ ID NO: 1417460 - RNA, 19 nt, Homo sapiens
cauggccuaugaccgcuuu

SEQ ID NO: 1417461 - RNA, 19 nt, Homo sapiens
uuacauagcugguuuucuc

SEQ ID NO: 1417462 - RNA, 19 nt, Homo sapiens
ucauugcugucuccuauac

SEQ ID NO: 1417463 - RNA, 19 nt, Homo sapiens
gguggugucuguguuguac

SEQ ID NO: 1417464 - RNA, 19 nt, Homo sapiens
uaccuucauuuaugugaug

SEQ ID NO: 1417465 - RNA, 19 nt, Homo sapiens
gugguuacccuguucuaug

SEQ ID NO: 1417466 - RNA, 19 nt, Homo sapiens
ggucacugugugugucaua

SEQ ID NO: 1417467 - RNA, 19 nt, Homo sapiens
caaccaaaauguccacaca

SEQ ID NO: 1417468 - RNA, 19 nt, Homo sapiens
ccuauacuacuuccuucua

SEQ ID NO: 1417469 - RNA, 19 nt, Homo sapiens
gaucauccuaucugguaau

SEQ ID NO: 1417470 - RNA, 19 nt, Homo sapiens
cuuaguaguuuacauagcu

SEQ ID NO: 1417471 - RNA, 19 nt, Homo sapiens
cugguaaucucagcauaau

SEQ ID NO: 1417472 - RNA, 19 nt, Homo sapiens
gcugucuccuauacuacuu

SEQ ID NO: 1417473 - RNA, 19 nt, Homo sapiens
uuucucaugaugcuuguua

SEQ ID NO: 1417474 - RNA, 19 nt, Homo sapiens
gcuacucaacugaccagaa

SEQ ID NO: 1417475 - RNA, 19 nt, Homo sapiens
ucugguaaucucagcauaa

SEQ ID NO: 1417476 - RNA, 19 nt, Homo sapiens
caguguccagcuacucuua

SEQ ID NO: 1417477 - RNA, 19 nt, Homo sapiens
ccacugcuuuauucaacca

SEQ ID NO: 1417478 - RNA, 19 nt, Homo sapiens
ucucagcuccaucauccua

SEQ ID NO: 1417479 - RNA, 19 nt, Homo sapiens
caguggugauucccauguu

SEQ ID NO: 1417480 - RNA, 19 nt, Homo sapiens
uaugugaugcccaauuuua

SEQ ID NO: 1417481 - RNA, 19 nt, Homo sapiens
ucagcuccaucauccuaug

SEQ ID NO: 1417482 - RNA, 19 nt, Homo sapiens
gggcuuaacagaugaucca

SEQ ID NO: 1417483 - RNA, 19 nt, Homo sapiens
cuccacaguuguucucuca

SEQ ID NO: 1417484 - RNA, 19 nt, Homo sapiens
acucuucuguggaccaaau

SEQ ID NO: 1417485 - RNA, 19 nt, Homo sapiens
ugaucauccuaucugguaa

SEQ ID NO: 1417486 - RNA, 19 nt, Homo sapiens
guccacugcuuuauucaac

SEQ ID NO: 1417487 - RNA, 19 nt, Homo sapiens
uggaccaaaucaagucaau

SEQ ID NO: 1417488 - RNA, 19 nt, Homo sapiens
auugcugucuccuauacua

SEQ ID NO: 1417489 - RNA, 19 nt, Homo sapiens
augaucauccuaucuggua

SEQ ID NO: 1417490 - RNA, 19 nt, Homo sapiens
gccuauucaucuucuguca

SEQ ID NO: 1417491 - RNA, 19 nt, Homo sapiens
cucaugaugcuuguuauuu

SEQ ID NO: 1417492 - RNA, 19 nt, Homo sapiens
gggaccauuaccuucauuu

SEQ ID NO: 1417493 - RNA, 19 nt, Homo sapiens
ucuucuggauccaucauug

SEQ ID NO: 1417494 - RNA, 19 nt, Homo sapiens
aucagugucuccacaguug

SEQ ID NO: 1417495 - RNA, 19 nt, Homo sapiens
ugaccgcuuuguggcaauu

SEQ ID NO: 1417496 - RNA, 19 nt, Homo sapiens
ccuauugggcuuaacagau

SEQ ID NO: 1417497 - RNA, 19 nt, Homo sapiens
ugguuacccuguucuaugg

SEQ ID NO: 1417498 - RNA, 19 nt, Homo sapiens
aaauacagucuccuaccuu

SEQ ID NO: 1417499 - RNA, 19 nt, Homo sapiens
guucauccuauugggcuua

SEQ ID NO: 1417500 - RNA, 19 nt, Homo sapiens
uaacagaugauccaauccu

SEQ ID NO: 1417501 - RNA, 19 nt, Homo sapiens
ucaucaccauccugaagau

SEQ ID NO: 1417502 - RNA, 19 nt, Homo sapiens
caaaauguccacacaaguc

SEQ ID NO: 1417503 - RNA, 19 nt, Homo sapiens
guucagcggcuuucuuugc

SEQ ID NO: 1417504 - RNA, 19 nt, Homo sapiens
gaagagagagcuuagaaua

SEQ ID NO: 1417505 - RNA, 19 nt, Homo sapiens
gguaauaucagcauaauug

SEQ ID NO: 1417506 - RNA, 19 nt, Homo sapiens
agagagagcuuagaauaaa

SEQ ID NO: 1417507 - RNA, 19 nt, Homo sapiens
gaauuuauguugucaccuu

SEQ ID NO: 1417508 - RNA, 19 nt, Homo sapiens
gacauucauuggcugcuua

SEQ ID NO: 1417509 - RNA, 19 nt, Homo sapiens
ggaccauuaccuucauuua

SEQ ID NO: 1417510 - RNA, 19 nt, Homo sapiens
cagcauaauuguauugauc

SEQ ID NO: 1417511 - RNA, 19 nt, Homo sapiens
ugaaauaauuccagcuauc

SEQ ID NO: 1417512 - RNA, 19 nt, Homo sapiens
gcccagcucuguucuguag

SEQ ID NO: 1417513 - RNA, 19 nt, Homo sapiens
uucauuggcugcuuauuaa

SEQ ID NO: 1417514 - RNA, 19 nt, Homo sapiens
gaccauuaccuucauuuau

SEQ ID NO: 1417515 - RNA, 19 nt, Homo sapiens
gaaauaauuccagcuaucu

SEQ ID NO: 1417516 - RNA, 19 nt, Homo sapiens
agaacaagguggugucugu

SEQ ID NO: 1417517 - RNA, 19 nt, Homo sapiens
gccauauccuacaucuaua

SEQ ID NO: 1417518 - RNA, 19 nt, Homo sapiens
caacugaccagaacaaggu

SEQ ID NO: 1417519 - RNA, 19 nt, Homo sapiens
ggacauucauuggcugcuu

SEQ ID NO: 1417520 - RNA, 19 nt, Homo sapiens
agaaaccucucucccuguu

SEQ ID NO: 1417521 - RNA, 19 nt, Homo sapiens
gauacuacaguuugugcua

SEQ ID NO: 1417522 - RNA, 19 nt, Homo sapiens
accauuaccuucauuuaug

SEQ ID NO: 1417523 - RNA, 19 nt, Homo sapiens
aagagagagcuuagaauaa

SEQ ID NO: 1417524 - RNA, 19 nt, Homo sapiens
ucaggaacaaggagauuaa

SEQ ID NO: 1417525 - RNA, 19 nt, Homo sapiens
ucacugcagucacucuguu

SEQ ID NO: 1417526 - RNA, 19 nt, Homo sapiens
cuacaucuauauccucauc

SEQ ID NO: 1417527 - RNA, 19 nt, Homo sapiens
ccauuaccuucauuuaugu

SEQ ID NO: 1417528 - RNA, 19 nt, Homo sapiens
cuacucaacugaccagaac

SEQ ID NO: 1417529 - RNA, 19 nt, Homo sapiens
auucauuggcugcuuauua

SEQ ID NO: 1417530 - RNA, 19 nt, Homo sapiens
ccaaauaaagucaaucacu

SEQ ID NO: 1417531 - RNA, 19 nt, Homo sapiens
ccagcucuguucuguagug

SEQ ID NO: 1417532 - RNA, 19 nt, Homo sapiens
gagagagcuuagaauaaaa

SEQ ID NO: 1417533 - RNA, 19 nt, Homo sapiens
agccauauccuacaucuau

SEQ ID NO: 1417534 - RNA, 19 nt, Homo sapiens
ggccaaauaaagucaauca

SEQ ID NO: 1417535 - RNA, 19 nt, Homo sapiens
guauugaucagaagaaguc

SEQ ID NO: 1417536 - RNA, 19 nt, Homo sapiens
acaagguggugucuguguu

SEQ ID NO: 1417537 - RNA, 19 nt, Homo sapiens
ugaggauacuacaguuugu

SEQ ID NO: 1417538 - RNA, 19 nt, Homo sapiens
ccaccucacugcagucacu

SEQ ID NO: 1417539 - RNA, 19 nt, Homo sapiens
uauuaagacuguccuucug

SEQ ID NO: 1417540 - RNA, 19 nt, Homo sapiens
ucaccuuaauggguaauau

SEQ ID NO: 1417541 - RNA, 19 nt, Homo sapiens
uuucuuguguuucuaggaa

SEQ ID NO: 1417542 - RNA, 19 nt, Homo sapiens
ggccuaugaucgcuaugug

SEQ ID NO: 1417543 - RNA, 19 nt, Homo sapiens
gguggugucuguguucuac

SEQ ID NO: 1417544 - RNA, 19 nt, Homo sapiens
uaccuucauuuaugugaug

SEQ ID NO: 1417545 - RNA, 19 nt, Homo sapiens
uggagucugcaucaucuua

SEQ ID NO: 1417546 - RNA, 19 nt, Homo sapiens
gaucagaagaagucaucau

SEQ ID NO: 1417547 - RNA, 19 nt, Homo sapiens
gcagucacucuguucuaug

SEQ ID NO: 1417548 - RNA, 19 nt, Homo sapiens
ggguacuccucaucaguca

SEQ ID NO: 1417549 - RNA, 19 nt, Homo sapiens
cugaagagagagcuuagaa

SEQ ID NO: 1417550 - RNA, 19 nt, Homo sapiens
ucuaggaauuuauguuguc

SEQ ID NO: 1417551 - RNA, 19 nt, Homo sapiens
uacuacaguuugugcuauu

SEQ ID NO: 1417552 - RNA, 19 nt, Homo sapiens
caagguggugucuguguuc

SEQ ID NO: 1417553 - RNA, 19 nt, Homo sapiens
gcccaaguccagcuacuca

SEQ ID NO: 1417554 - RNA, 19 nt, Homo sapiens
cagucacucuguucuaugg

SEQ ID NO: 1417555 - RNA, 19 nt, Homo sapiens
ccuggagucugcaucaucu

SEQ ID NO: 1417556 - RNA, 19 nt, Homo sapiens
gacauuggguacuccucau

SEQ ID NO: 1417557 - RNA, 19 nt, Homo sapiens
cguggugauucccauguug

SEQ ID NO: 1417558 - RNA, 19 nt, Homo sapiens
gcuacucaacugaccagaa

SEQ ID NO: 1417559 - RNA, 19 nt, Homo sapiens
ucuucuggaucuaucauug

SEQ ID NO: 1417560 - RNA, 19 nt, Homo sapiens
gagucugcaucaucuuagu

SEQ ID NO: 1417561 - RNA, 19 nt, Homo sapiens
cauggccuaugaucgcuau

SEQ ID NO: 1417562 - RNA, 19 nt, Homo sapiens
guacuccucaucagucaca

SEQ ID NO: 1417563 - RNA, 19 nt, Homo sapiens
ugcagucacucuguucuau

SEQ ID NO: 1417564 - RNA, 19 nt, Homo sapiens
ucauagccauauccuacau

SEQ ID NO: 1417565 - RNA, 19 nt, Homo sapiens
auacuacaguuugugcuau

SEQ ID NO: 1417566 - RNA, 19 nt, Homo sapiens
gcauaauuguauugaucag

SEQ ID NO: 1417567 - RNA, 19 nt, Homo sapiens
ugaagagagagcuuagaau

SEQ ID NO: 1417568 - RNA, 19 nt, Homo sapiens
uggguaauaucagcauaau

SEQ ID NO: 1417569 - RNA, 19 nt, Homo sapiens
ugaagaugcacuccaccaa

SEQ ID NO: 1417570 - RNA, 19 nt, Homo sapiens
ggagucugcaucaucuuag

SEQ ID NO: 1417571 - RNA, 19 nt, Homo sapiens
aauggguaauaucagcaua

SEQ ID NO: 1417572 - RNA, 19 nt, Homo sapiens
gaaaccucucucccuguug

SEQ ID NO: 1417573 - RNA, 19 nt, Homo sapiens
ucacaccugucaugcucau

SEQ ID NO: 1417574 - RNA, 19 nt, Homo sapiens
ccauuuggccuuuguagac

SEQ ID NO: 1417575 - RNA, 19 nt, Homo sapiens
gggaccauuaccuucauuu

SEQ ID NO: 1417576 - RNA, 19 nt, Homo sapiens
cuaggaauuuauguuguca

SEQ ID NO: 1417577 - RNA, 19 nt, Homo sapiens
cugaggauacuacaguuug

SEQ ID NO: 1417578 - RNA, 19 nt, Homo sapiens
acuacaguuugugcuauuu

SEQ ID NO: 1417579 - RNA, 19 nt, Homo sapiens
cauuuggccuuuguagaca

SEQ ID NO: 1417580 - RNA, 19 nt, Homo sapiens
ucaucaccauccugaagau

SEQ ID NO: 1417581 - RNA, 19 nt, Homo sapiens
uaucucuucuggaucuauc

SEQ ID NO: 1417582 - RNA, 19 nt, Homo sapiens
guucuguagugacguuugg

SEQ ID NO: 1417583 - RNA, 19 nt, Homo sapiens
gaacaagcauguggaauuc

SEQ ID NO: 1417584 - RNA, 19 nt, Homo sapiens
caaagaagcuucgggugaa

SEQ ID NO: 1417585 - RNA, 19 nt, Homo sapiens
cgccaucccugcuauuuaa

SEQ ID NO: 1417586 - RNA, 19 nt, Homo sapiens
gcacuacuccggccucuau

SEQ ID NO: 1417587 - RNA, 19 nt, Homo sapiens
ccuauucucucuacgacua

SEQ ID NO: 1417588 - RNA, 19 nt, Homo sapiens
ggacguggccuaccaugug

SEQ ID NO: 1417589 - RNA, 19 nt, Homo sapiens
gaagaacaagcauguggaa

SEQ ID NO: 1417590 - RNA, 19 nt, Homo sapiens
cuaaugcccugaugagugu

SEQ ID NO: 1417591 - RNA, 19 nt, Homo sapiens
ccaugagccuggccuugua

SEQ ID NO: 1417592 - RNA, 19 nt, Homo sapiens
ggucuaguccuguggcuaa

SEQ ID NO: 1417593 - RNA, 19 nt, Homo sapiens
ggaaugugcagcugucaga

SEQ ID NO: 1417594 - RNA, 19 nt, Homo sapiens
agaacaagcauguggaauu

SEQ ID NO: 1417595 - RNA, 19 nt, Homo sapiens
cacuggaacucaccaaaga

SEQ ID NO: 1417596 - RNA, 19 nt, Homo sapiens
caucccugcuauuuaaauu

SEQ ID NO: 1417597 - RNA, 19 nt, Homo sapiens
gagacgcucuuccacacau

SEQ ID NO: 1417598 - RNA, 19 nt, Homo sapiens
ccucacgccuuacgucuuc

SEQ ID NO: 1417599 - RNA, 19 nt, Homo sapiens
acaagcauguggaauucuu

SEQ ID NO: 1417600 - RNA, 19 nt, Homo sapiens
ucaacgcugugaucaagga

SEQ ID NO: 1417601 - RNA, 19 nt, Homo sapiens
ccgcuaugauccucgcuuu

SEQ ID NO: 1417602 - RNA, 19 nt, Homo sapiens
cgcagaagcucagcaguuc

SEQ ID NO: 1417603 - RNA, 19 nt, Homo sapiens
gcuaugauccucgcuuugu

SEQ ID NO: 1417604 - RNA, 19 nt, Homo sapiens
gaagaccccugcuuugagu

SEQ ID NO: 1417605 - RNA, 19 nt, Homo sapiens
ggaaccugcugcggagaga

SEQ ID NO: 1417606 - RNA, 19 nt, Homo sapiens
cgaucggucuuguggagaa

SEQ ID NO: 1417607 - RNA, 19 nt, Homo sapiens
caucuugaauuguuuaucc

SEQ ID NO: 1417608 - RNA, 19 nt, Homo sapiens
ccacgcacccacagacuau

SEQ ID NO: 1417609 - RNA, 19 nt, Homo sapiens
gaacucaccaaagaagcuu

SEQ ID NO: 1417610 - RNA, 19 nt, Homo sapiens
ggcccucuuugcucacuuu

SEQ ID NO: 1417611 - RNA, 19 nt, Homo sapiens
guaccugacagacgcagaa

SEQ ID NO: 1417612 - RNA, 19 nt, Homo sapiens
cuucaacgcugugaucaag

SEQ ID NO: 1417613 - RNA, 19 nt, Homo sapiens
gggcuucggcuggaacaaa

SEQ ID NO: 1417614 - RNA, 19 nt, Homo sapiens
ggagcucugggcccucuuu

SEQ ID NO: 1417615 - RNA, 19 nt, Homo sapiens
ugaccuuccuggaguacga

SEQ ID NO: 1417616 - RNA, 19 nt, Homo sapiens
ccgccaucccugcuauuua

SEQ ID NO: 1417617 - RNA, 19 nt, Homo sapiens
uggaugcccaggaauauga

SEQ ID NO: 1417618 - RNA, 19 nt, Homo sapiens
cgaauuccaccaggacuug

SEQ ID NO: 1417619 - RNA, 19 nt, Homo sapiens
uggcccagcuguccaugga

SEQ ID NO: 1417620 - RNA, 19 nt, Homo sapiens
ucaaccagcuucgcaacgu

SEQ ID NO: 1417621 - RNA, 19 nt, Homo sapiens
gcagcugucagaucacaca

SEQ ID NO: 1417622 - RNA, 19 nt, Homo sapiens
gugcagcugucagaucaca

SEQ ID NO: 1417623 - RNA, 19 nt, Homo sapiens
ucuaugggcuaaugaagcu

SEQ ID NO: 1417624 - RNA, 19 nt, Homo sapiens
uggaccggcugcagauguu

SEQ ID NO: 1417625 - RNA, 19 nt, Homo sapiens
ggaacucaccaaagaagcu

SEQ ID NO: 1417626 - RNA, 19 nt, Homo sapiens
ccacuggaacucaccaaag

SEQ ID NO: 1417627 - RNA, 19 nt, Homo sapiens
ugggcaaccucuggaagaa

SEQ ID NO: 1417628 - RNA, 19 nt, Homo sapiens
caccuucgccucugacauc

SEQ ID NO: 1417629 - RNA, 19 nt, Homo sapiens
ggcacucucuacaccuuca

SEQ ID NO: 1417630 - RNA, 19 nt, Homo sapiens
ucacuuuccugccccauga

SEQ ID NO: 1417631 - RNA, 19 nt, Homo sapiens
ggcagcagcagcucacugu

SEQ ID NO: 1417632 - RNA, 19 nt, Homo sapiens
cgugucagcuuuuaucaug

SEQ ID NO: 1417633 - RNA, 19 nt, Homo sapiens
gggugaagaacaagcaugu

SEQ ID NO: 1417634 - RNA, 19 nt, Homo sapiens
ucagugacauugacuuccu

SEQ ID NO: 1417635 - RNA, 19 nt, Homo sapiens
acgcagaagcucagcaguu

SEQ ID NO: 1417636 - RNA, 19 nt, Homo sapiens
gccacgcacccacagacua

SEQ ID NO: 1417637 - RNA, 19 nt, Homo sapiens
gggaagaccccugcuuuga

SEQ ID NO: 1417638 - RNA, 19 nt, Homo sapiens
caucuucaacgcugugauc

SEQ ID NO: 1417639 - RNA, 19 nt, Homo sapiens
gagaagaaguguugaccua

SEQ ID NO: 1417640 - RNA, 19 nt, Homo sapiens
gaaacaaguucaugaagga

SEQ ID NO: 1417641 - RNA, 19 nt, Homo sapiens
ggauauauaugcuuugcuu

SEQ ID NO: 1417642 - RNA, 19 nt, Homo sapiens
gaaaucaaaggcagcauaa

SEQ ID NO: 1417643 - RNA, 19 nt, Homo sapiens
ucauaacucuuuaccagua

SEQ ID NO: 1417644 - RNA, 19 nt, Homo sapiens
ggaagcaaaucugugaauu

SEQ ID NO: 1417645 - RNA, 19 nt, Homo sapiens
gacagggcguguuuguuua

SEQ ID NO: 1417646 - RNA, 19 nt, Homo sapiens
cgacagggcguguuuguuu

SEQ ID NO: 1417647 - RNA, 19 nt, Homo sapiens
caagauguaugguuauauc

SEQ ID NO: 1417648 - RNA, 19 nt, Homo sapiens
gaagaaguguugaccuaag

SEQ ID NO: 1417649 - RNA, 19 nt, Homo sapiens
caagagggcauuucauuug

SEQ ID NO: 1417650 - RNA, 19 nt, Homo sapiens
caucugguuugaaauagua

SEQ ID NO: 1417651 - RNA, 19 nt, Homo sapiens
ccaaucagccuuguguuua

SEQ ID NO: 1417652 - RNA, 19 nt, Homo sapiens
cuuaacaucugguuugaaa

SEQ ID NO: 1417653 - RNA, 19 nt, Homo sapiens
gaagugaguccuuggaguu

SEQ ID NO: 1417654 - RNA, 19 nt, Homo sapiens
ucaauucaguucuauguuc

SEQ ID NO: 1417655 - RNA, 19 nt, Homo sapiens
uuaaugaggcccuugauaa

SEQ ID NO: 1417656 - RNA, 19 nt, Homo sapiens
uaacacagcugggauucug

SEQ ID NO: 1417657 - RNA, 19 nt, Homo sapiens
guuguuggcuucuuauuag

SEQ ID NO: 1417658 - RNA, 19 nt, Homo sapiens
cauacuaaauggaagcaaa

SEQ ID NO: 1417659 - RNA, 19 nt, Homo sapiens
ccacaaccuuccaauagug

SEQ ID NO: 1417660 - RNA, 19 nt, Homo sapiens
caaucagccuuguguuuau

SEQ ID NO: 1417661 - RNA, 19 nt, Homo sapiens
ccaaugaugcuuuaaggaa

SEQ ID NO: 1417662 - RNA, 19 nt, Homo sapiens
ucagaagcauuaccaacuu

SEQ ID NO: 1417663 - RNA, 19 nt, Homo sapiens
aacauuagcuacuuuagga

SEQ ID NO: 1417664 - RNA, 19 nt, Homo sapiens
cagcugggauucuguagug

SEQ ID NO: 1417665 - RNA, 19 nt, Homo sapiens
uaaugaggcccuugauaaa

SEQ ID NO: 1417666 - RNA, 19 nt, Homo sapiens
gaauucaacaugcuuaaca

SEQ ID NO: 1417667 - RNA, 19 nt, Homo sapiens
gggauucuguaguguuuau

SEQ ID NO: 1417668 - RNA, 19 nt, Homo sapiens
guuuagacauugugauuuc

SEQ ID NO: 1417669 - RNA, 19 nt, Homo sapiens
caacauuagguuauaguga

SEQ ID NO: 1417670 - RNA, 19 nt, Homo sapiens
ggaauuauuucuguucacu

SEQ ID NO: 1417671 - RNA, 19 nt, Homo sapiens
ggaccaaucagccuugugu

SEQ ID NO: 1417672 - RNA, 19 nt, Homo sapiens
ucaagagggcauuucauuu

SEQ ID NO: 1417673 - RNA, 19 nt, Homo sapiens
ucaaagcguuucccucaag

SEQ ID NO: 1417674 - RNA, 19 nt, Homo sapiens
caaauaguaccaauucauc

SEQ ID NO: 1417675 - RNA, 19 nt, Homo sapiens
uggaguuguuggcuucuua

SEQ ID NO: 1417676 - RNA, 19 nt, Homo sapiens
ugaaaucaaaggcagcaua

SEQ ID NO: 1417677 - RNA, 19 nt, Homo sapiens
ccucccaucuuguuucuug

SEQ ID NO: 1417678 - RNA, 19 nt, Homo sapiens
ugaaagaaucaaagcguuu

SEQ ID NO: 1417679 - RNA, 19 nt, Homo sapiens
gcuuugcuuucuuccauuu

SEQ ID NO: 1417680 - RNA, 19 nt, Homo sapiens
gagcuuugcuauggaagug

SEQ ID NO: 1417681 - RNA, 19 nt, Homo sapiens
cagaagcauuaccaacuug

SEQ ID NO: 1417682 - RNA, 19 nt, Homo sapiens
cccaagauguaugguuaua

SEQ ID NO: 1417683 - RNA, 19 nt, Homo sapiens
guguugaccuaaggauaua

SEQ ID NO: 1417684 - RNA, 19 nt, Homo sapiens
aaucagccuuguguuuaua

SEQ ID NO: 1417685 - RNA, 19 nt, Homo sapiens
ccacagaguccuuuucuaa

SEQ ID NO: 1417686 - RNA, 19 nt, Homo sapiens
gaucacauccaaauuucau

SEQ ID NO: 1417687 - RNA, 19 nt, Homo sapiens
cuauauuccuuuggcauuu

SEQ ID NO: 1417688 - RNA, 19 nt, Homo sapiens
ggcugucagucuugugaua

SEQ ID NO: 1417689 - RNA, 19 nt, Homo sapiens
agagggcauuucauuugua

SEQ ID NO: 1417690 - RNA, 19 nt, Homo sapiens
uauuggaacuggccuuuua

SEQ ID NO: 1417691 - RNA, 19 nt, Homo sapiens
guuggcuucuuauuaggua

SEQ ID NO: 1417692 - RNA, 19 nt, Homo sapiens
caauucuuauuccucguuu

SEQ ID NO: 1417693 - RNA, 19 nt, Homo sapiens
gcaauucuuauuccucguu

SEQ ID NO: 1417694 - RNA, 19 nt, Homo sapiens
ucaacaugcuuaacaucug

SEQ ID NO: 1417695 - RNA, 19 nt, Homo sapiens
gauccuucuugguuaguau

SEQ ID NO: 1417696 - RNA, 19 nt, Homo sapiens
uauaugcuuugcuuucuuc

SEQ ID NO: 1417697 - RNA, 19 nt, Homo sapiens
ugaggcccuugauaaauga

SEQ ID NO: 1417698 - RNA, 19 nt, Homo sapiens
ggaaguaaucauaacucuu

SEQ ID NO: 1417699 - RNA, 19 nt, Homo sapiens
gaccuaaggauauauaugc

SEQ ID NO: 1417700 - RNA, 19 nt, Homo sapiens
gggcauuucauuuguacaa

SEQ ID NO: 1417701 - RNA, 19 nt, Homo sapiens
gcaagagcuucugccuguu

SEQ ID NO: 1417702 - RNA, 19 nt, Homo sapiens
ugaagaacaugagcaagag

SEQ ID NO: 1417703 - RNA, 19 nt, Homo sapiens
cauuagcuacuuuaggaua

SEQ ID NO: 1417704 - RNA, 19 nt, Homo sapiens
acaaguucaugaaggauuc

SEQ ID NO: 1417705 - RNA, 19 nt, Homo sapiens
gagggcauuucauuuguac

SEQ ID NO: 1417706 - RNA, 19 nt, Homo sapiens
uaaauggaagcaaaucugu

SEQ ID NO: 1417707 - RNA, 19 nt, Homo sapiens
ccuggagaguaaaguguuu

SEQ ID NO: 1417708 - RNA, 19 nt, Homo sapiens
acucuuaugcaccuucuua

SEQ ID NO: 1417709 - RNA, 19 nt, Homo sapiens
ggauuaaugaggcccuuga

SEQ ID NO: 1417710 - RNA, 19 nt, Homo sapiens
ccaaaugaaagaaucaaag

SEQ ID NO: 1417711 - RNA, 19 nt, Homo sapiens
gugauaauuuaccaguaug

SEQ ID NO: 1417712 - RNA, 19 nt, Homo sapiens
aagagggcauuucauuugu

SEQ ID NO: 1417713 - RNA, 19 nt, Homo sapiens
cugggauucuguaguguuu

SEQ ID NO: 1417714 - RNA, 19 nt, Homo sapiens
augaggcccuugauaaaug

SEQ ID NO: 1417715 - RNA, 19 nt, Homo sapiens
uauauguguuuccgugaug

SEQ ID NO: 1417716 - RNA, 19 nt, Homo sapiens
gcguguuuguuuacgguuu

SEQ ID NO: 1417717 - RNA, 19 nt, Homo sapiens
caagagcuucugccuguuc

SEQ ID NO: 1417718 - RNA, 19 nt, Homo sapiens
gcccuaauccugccaccuu

SEQ ID NO: 1417719 - RNA, 19 nt, Homo sapiens
ugugagagaagaaguguug

SEQ ID NO: 1417720 - RNA, 19 nt, Homo sapiens
ccagaaugaacaggagaua

SEQ ID NO: 1417721 - RNA, 19 nt, Homo sapiens
auauauggaugguccugaa

SEQ ID NO: 1417722 - RNA, 19 nt, Homo sapiens
aauggaagcaaaucuguga

SEQ ID NO: 1417723 - RNA, 19 nt, Homo sapiens
ccuuggaguugucuucaga

SEQ ID NO: 1417724 - RNA, 19 nt, Homo sapiens
gcagcacauuggcccuaau

SEQ ID NO: 1417725 - RNA, 19 nt, Homo sapiens
cugcuuuccucccaucuug

SEQ ID NO: 1417726 - RNA, 19 nt, Homo sapiens
uggaagaaauacccacucu

SEQ ID NO: 1417727 - RNA, 19 nt, Homo sapiens
acugugagcuuugcuaugg

SEQ ID NO: 1417728 - RNA, 19 nt, Homo sapiens
gaaucaugagucuucuauu

SEQ ID NO: 1417729 - RNA, 19 nt, Homo sapiens
guagcuggcacuccacaga

SEQ ID NO: 1417730 - RNA, 19 nt, Homo sapiens
gguuauaucaaucagugaa

SEQ ID NO: 1417731 - RNA, 19 nt, Homo sapiens
caaaugaaagaaucaaagc

SEQ ID NO: 1417732 - RNA, 19 nt, Homo sapiens
accaguauguugucaggaa

SEQ ID NO: 1417733 - RNA, 19 nt, Homo sapiens
gcugucagucuugugauaa

SEQ ID NO: 1417734 - RNA, 19 nt, Homo sapiens
guugaccuaaggauauaua

SEQ ID NO: 1417735 - RNA, 19 nt, Homo sapiens
cagaguccuuuucuaaauu

SEQ ID NO: 1417736 - RNA, 19 nt, Homo sapiens
agcauucacuggaguuguu

SEQ ID NO: 1417737 - RNA, 19 nt, Homo sapiens
cccacaaccuuccaauagu

SEQ ID NO: 1417738 - RNA, 19 nt, Homo sapiens
cuugauaaaugagcagaau

SEQ ID NO: 1417739 - RNA, 19 nt, Homo sapiens
gaauguagcuguuguuauu

SEQ ID NO: 1417740 - RNA, 19 nt, Homo sapiens
ccuccuaucugcugaauua

SEQ ID NO: 1417741 - RNA, 19 nt, Homo sapiens
gcugugaccuucugaauau

SEQ ID NO: 1417742 - RNA, 19 nt, Homo sapiens
gcagggccgugucauuuaa

SEQ ID NO: 1417743 - RNA, 19 nt, Homo sapiens
uuucuuaggugaacuguua

SEQ ID NO: 1417744 - RNA, 19 nt, Homo sapiens
gcacuugaagccauucuua

SEQ ID NO: 1417745 - RNA, 19 nt, Homo sapiens
gagaggccaucaacauauu

SEQ ID NO: 1417746 - RNA, 19 nt, Homo sapiens
gagagaggccaucaacaua

SEQ ID NO: 1417747 - RNA, 19 nt, Homo sapiens
gagaaggaauauuuaggaa

SEQ ID NO: 1417748 - RNA, 19 nt, Homo sapiens
gagcagaagcuuugaaugu

SEQ ID NO: 1417749 - RNA, 19 nt, Homo sapiens
ccacacacuugcauggaua

SEQ ID NO: 1417750 - RNA, 19 nt, Homo sapiens
gcauaugaauggacuggaa

SEQ ID NO: 1417751 - RNA, 19 nt, Homo sapiens
ugagagccauuauaaguga

SEQ ID NO: 1417752 - RNA, 19 nt, Homo sapiens
gaacaaggcccaguuagca

SEQ ID NO: 1417753 - RNA, 19 nt, Homo sapiens
gcagaagcuuugaauguag

SEQ ID NO: 1417754 - RNA, 19 nt, Homo sapiens
guacugagcagaagcuuug

SEQ ID NO: 1417755 - RNA, 19 nt, Homo sapiens
ugaauggacuggaaauugu

SEQ ID NO: 1417756 - RNA, 19 nt, Homo sapiens
caucuuauuucuccucauu

SEQ ID NO: 1417757 - RNA, 19 nt, Homo sapiens
gcucagcagacaauaaaua

SEQ ID NO: 1417758 - RNA, 19 nt, Homo sapiens
gaggauauguaaguacuug

SEQ ID NO: 1417759 - RNA, 19 nt, Homo sapiens
acacacacauuacuuuaga

SEQ ID NO: 1417760 - RNA, 19 nt, Homo sapiens
ucagugagagccauuauaa

SEQ ID NO: 1417761 - RNA, 19 nt, Homo sapiens
caucuucacuugcacauca

SEQ ID NO: 1417762 - RNA, 19 nt, Homo sapiens
ccacacacacauuacuuua

SEQ ID NO: 1417763 - RNA, 19 nt, Homo sapiens
ccuaucugcugaauuaauu

SEQ ID NO: 1417764 - RNA, 19 nt, Homo sapiens
ggagagaggccaucaacau

SEQ ID NO: 1417765 - RNA, 19 nt, Homo sapiens
uaaauauccuagaccuuga

SEQ ID NO: 1417766 - RNA, 19 nt, Homo sapiens
caaaauugguuucaaguga

SEQ ID NO: 1417767 - RNA, 19 nt, Homo sapiens
acacuugcauggauaagaa

SEQ ID NO: 1417768 - RNA, 19 nt, Homo sapiens
ggaagcgauuucugaacaa

SEQ ID NO: 1417769 - RNA, 19 nt, Homo sapiens
augcuucgcuuucuaauga

SEQ ID NO: 1417770 - RNA, 19 nt, Homo sapiens
gcaaaguacugagcagaag

SEQ ID NO: 1417771 - RNA, 19 nt, Homo sapiens
uauaagacccucuguacuu

SEQ ID NO: 1417772 - RNA, 19 nt, Homo sapiens
ccucauuucuuccuuaugu

SEQ ID NO: 1417773 - RNA, 19 nt, Homo sapiens
ggauauguaaguacuugua

SEQ ID NO: 1417774 - RNA, 19 nt, Homo sapiens
gaaauugcccacaagaucu

SEQ ID NO: 1417775 - RNA, 19 nt, Homo sapiens
uugaagccauucuuacuaa

SEQ ID NO: 1417776 - RNA, 19 nt, Homo sapiens
gaggagcacaugcauaaug

SEQ ID NO: 1417777 - RNA, 19 nt, Homo sapiens
cacaagaucuagccucauc

SEQ ID NO: 1417778 - RNA, 19 nt, Homo sapiens
gaucaacucacuuuaaacu

SEQ ID NO: 1417779 - RNA, 19 nt, Homo sapiens
aaacagaaucagaggcaua

SEQ ID NO: 1417780 - RNA, 19 nt, Homo sapiens
uugaaaggccucuugauuu

SEQ ID NO: 1417781 - RNA, 19 nt, Homo sapiens
gaauugaaaggccucuuga

SEQ ID NO: 1417782 - RNA, 19 nt, Homo sapiens
gauacuaccacacagagaa

SEQ ID NO: 1417783 - RNA, 19 nt, Homo sapiens
agcagaagcuuugaaugua

SEQ ID NO: 1417784 - RNA, 19 nt, Homo sapiens
aaaccauacuucagugaga

SEQ ID NO: 1417785 - RNA, 19 nt, Homo sapiens
ggucaaaccauacuucagu

SEQ ID NO: 1417786 - RNA, 19 nt, Homo sapiens
gauaugcaguugcucugau

SEQ ID NO: 1417787 - RNA, 19 nt, Homo sapiens
uaacuuaguguccugagaa

SEQ ID NO: 1417788 - RNA, 19 nt, Homo sapiens
guucauaugcuguuagaau

SEQ ID NO: 1417789 - RNA, 19 nt, Homo sapiens
caucuggaguugcuguuau

SEQ ID NO: 1417790 - RNA, 19 nt, Homo sapiens
guacuucccauggugauuu

SEQ ID NO: 1417791 - RNA, 19 nt, Homo sapiens
gcucaggugcuacuaaugu

SEQ ID NO: 1417792 - RNA, 19 nt, Homo sapiens
ucuaugauuuggaggauau

SEQ ID NO: 1417793 - RNA, 19 nt, Homo sapiens
gaagccauucuuacuaaau

SEQ ID NO: 1417794 - RNA, 19 nt, Homo sapiens
acacuggaacugacuagua

SEQ ID NO: 1417795 - RNA, 19 nt, Homo sapiens
ggcagggccgugucauuua

SEQ ID NO: 1417796 - RNA, 19 nt, Homo sapiens
cagcagacaauaaauacuu

SEQ ID NO: 1417797 - RNA, 19 nt, Homo sapiens
guacaugugcuuuaacucu

SEQ ID NO: 1417798 - RNA, 19 nt, Homo sapiens
cagaaucagaggcauauga

SEQ ID NO: 1417799 - RNA, 19 nt, Homo sapiens
ugaaauugcccacaagauc

SEQ ID NO: 1417800 - RNA, 19 nt, Homo sapiens
acuuuaaacuggucucuga

SEQ ID NO: 1417801 - RNA, 19 nt, Homo sapiens
gcucugauucugcagguuu

SEQ ID NO: 1417802 - RNA, 19 nt, Homo sapiens
aaaggccucuugauuucuu

SEQ ID NO: 1417803 - RNA, 19 nt, Homo sapiens
gaagcgauuucugaacaag

SEQ ID NO: 1417804 - RNA, 19 nt, Homo sapiens
gaguauaagacccucugua

SEQ ID NO: 1417805 - RNA, 19 nt, Homo sapiens
ugagaaggaauauuuagga

SEQ ID NO: 1417806 - RNA, 19 nt, Homo sapiens
gcucacggccacacacuug

SEQ ID NO: 1417807 - RNA, 19 nt, Homo sapiens
ugaagccauucuuacuaaa

SEQ ID NO: 1417808 - RNA, 19 nt, Homo sapiens
uugaggagcacaugcauaa

SEQ ID NO: 1417809 - RNA, 19 nt, Homo sapiens
uuaaacuggucucugauuc

SEQ ID NO: 1417810 - RNA, 19 nt, Homo sapiens
gcuaaaauguaagguguuu

SEQ ID NO: 1417811 - RNA, 19 nt, Homo sapiens
ccaguuagcacaaugucuu

SEQ ID NO: 1417812 - RNA, 19 nt, Homo sapiens
ccaccaccaguuauugaua

SEQ ID NO: 1417813 - RNA, 19 nt, Homo sapiens
gaguguucauaugcuguua

SEQ ID NO: 1417814 - RNA, 19 nt, Homo sapiens
aaucagaggcauaugaaug

SEQ ID NO: 1417815 - RNA, 19 nt, Homo sapiens
uagaagauaugcaguugcu

SEQ ID NO: 1417816 - RNA, 19 nt, Homo sapiens
aauccuagccugugguaaa

SEQ ID NO: 1417817 - RNA, 19 nt, Homo sapiens
aggaagcgauuucugaaca

SEQ ID NO: 1417818 - RNA, 19 nt, Homo sapiens
ugauuuggaggauauguaa

SEQ ID NO: 1417819 - RNA, 19 nt, Homo sapiens
ucuccucauuucuuccuua

SEQ ID NO: 1417820 - RNA, 19 nt, Homo sapiens
ggucagacuuuugcaaauu

SEQ ID NO: 1417821 - RNA, 19 nt, Homo sapiens
agacacauugggcaaagua

SEQ ID NO: 1417822 - RNA, 19 nt, Homo sapiens
caaccggugagucuuuaaa

SEQ ID NO: 1417823 - RNA, 19 nt, Homo sapiens
cccaaccggugagucuuua

SEQ ID NO: 1417824 - RNA, 19 nt, Homo sapiens
cuuaguguccugagaauug

SEQ ID NO: 1417825 - RNA, 19 nt, Homo sapiens
ggcugugaccuucugaaua

SEQ ID NO: 1417826 - RNA, 19 nt, Homo sapiens
uuaaugcuucgcuuucuaa

SEQ ID NO: 1417827 - RNA, 19 nt, Homo sapiens
ggcaaaguacugagcagaa

SEQ ID NO: 1417828 - RNA, 19 nt, Homo sapiens
aaugggaaguuugugauau

SEQ ID NO: 1417829 - RNA, 19 nt, Homo sapiens
aaauguaagguguuucuga

SEQ ID NO: 1417830 - RNA, 19 nt, Homo sapiens
ucuaggaagcgauuucuga

SEQ ID NO: 1417831 - RNA, 19 nt, Homo sapiens
gaacuuuguacguccuuag

SEQ ID NO: 1417832 - RNA, 19 nt, Homo sapiens
auaagacccucuguacuuc

SEQ ID NO: 1417833 - RNA, 19 nt, Homo sapiens
ucugauuccucaucuguca

SEQ ID NO: 1417834 - RNA, 19 nt, Homo sapiens
ucacacacaaacugagaaa

SEQ ID NO: 1417835 - RNA, 19 nt, Homo sapiens
agagaggccaucaacauau

SEQ ID NO: 1417836 - RNA, 19 nt, Homo sapiens
gucagacuuuugcaaauua

SEQ ID NO: 1417837 - RNA, 19 nt, Homo sapiens
gagagccauuauaagugaa

SEQ ID NO: 1417838 - RNA, 19 nt, Homo sapiens
aaaugggaaguuugugaua

SEQ ID NO: 1417839 - RNA, 19 nt, Homo sapiens
gacagugccuuuagaauua

SEQ ID NO: 1417840 - RNA, 19 nt, Homo sapiens
caggaaagcuguauaauga

SEQ ID NO: 1417841 - RNA, 19 nt, Homo sapiens
gaaguaaugccuauaagua

SEQ ID NO: 1417842 - RNA, 19 nt, Homo sapiens
gcaauaccacuguuuauaa

SEQ ID NO: 1417843 - RNA, 19 nt, Homo sapiens
caagagaaaucaagagaug

SEQ ID NO: 1417844 - RNA, 19 nt, Homo sapiens
uaauauggcugaaagcaaa

SEQ ID NO: 1417845 - RNA, 19 nt, Homo sapiens
ggaaagcuguauaaugaga

SEQ ID NO: 1417846 - RNA, 19 nt, Homo sapiens
uaaagucuguguugguaua

SEQ ID NO: 1417847 - RNA, 19 nt, Homo sapiens
guaguuacauccaguguga

SEQ ID NO: 1417848 - RNA, 19 nt, Homo sapiens
gcaaggaguuuacagucaa

SEQ ID NO: 1417849 - RNA, 19 nt, Homo sapiens
gaaccagucucaucauucu

SEQ ID NO: 1417850 - RNA, 19 nt, Homo sapiens
aagaagaucugacaggaaa

SEQ ID NO: 1417851 - RNA, 19 nt, Homo sapiens
gaucuuaagggucuauaua

SEQ ID NO: 1417852 - RNA, 19 nt, Homo sapiens
gagaaccacuggauaaagu

SEQ ID NO: 1417853 - RNA, 19 nt, Homo sapiens
ugaaguacccgcugaagua

SEQ ID NO: 1417854 - RNA, 19 nt, Homo sapiens
agacuuccuucaacaaaua

SEQ ID NO: 1417855 - RNA, 19 nt, Homo sapiens
gcagguacuuucuuauuag

SEQ ID NO: 1417856 - RNA, 19 nt, Homo sapiens
gcaaacagacuuccuucaa

SEQ ID NO: 1417857 - RNA, 19 nt, Homo sapiens
gcacugaaauggcuguaag

SEQ ID NO: 1417858 - RNA, 19 nt, Homo sapiens
uauaaagucuguguuggua

SEQ ID NO: 1417859 - RNA, 19 nt, Homo sapiens
cgacagugccuuuagaauu

SEQ ID NO: 1417860 - RNA, 19 nt, Homo sapiens
guuagaauguguaagcaaa

SEQ ID NO: 1417861 - RNA, 19 nt, Homo sapiens
ggagaaaucauuggaauuc

SEQ ID NO: 1417862 - RNA, 19 nt, Homo sapiens
gaaccacuggauaaaguua

SEQ ID NO: 1417863 - RNA, 19 nt, Homo sapiens
ggagagacaugccuguagu

SEQ ID NO: 1417864 - RNA, 19 nt, Homo sapiens
caacuauucucuuguuuac

SEQ ID NO: 1417865 - RNA, 19 nt, Homo sapiens
gaaaucaagagaugcuaaa

SEQ ID NO: 1417866 - RNA, 19 nt, Homo sapiens
gaaagcaaaggauaacgaa

SEQ ID NO: 1417867 - RNA, 19 nt, Homo sapiens
gaauucagaugacacuuac

SEQ ID NO: 1417868 - RNA, 19 nt, Homo sapiens
gaacagcccacuacauuac

SEQ ID NO: 1417869 - RNA, 19 nt, Homo sapiens
aaacagacuuccuucaaca

SEQ ID NO: 1417870 - RNA, 19 nt, Homo sapiens
ucaagaccauccuggcuaa

SEQ ID NO: 1417871 - RNA, 19 nt, Homo sapiens
gguuauggcuguggcagua

SEQ ID NO: 1417872 - RNA, 19 nt, Homo sapiens
ugagauauguguccagcaa

SEQ ID NO: 1417873 - RNA, 19 nt, Homo sapiens
gcaaacgacagugccuuua

SEQ ID NO: 1417874 - RNA, 19 nt, Homo sapiens
caugagaaccacuggauaa

SEQ ID NO: 1417875 - RNA, 19 nt, Homo sapiens
gcagugagcccagaucaug

SEQ ID NO: 1417876 - RNA, 19 nt, Homo sapiens
gcaagagaauggcaugaac

SEQ ID NO: 1417877 - RNA, 19 nt, Homo sapiens
aaacgacagugccuuuaga

SEQ ID NO: 1417878 - RNA, 19 nt, Homo sapiens
ugaauucagaugacacuua

SEQ ID NO: 1417879 - RNA, 19 nt, Homo sapiens
guuacuggcucuacugaga

SEQ ID NO: 1417880 - RNA, 19 nt, Homo sapiens
caauaccacuguuuauaag

SEQ ID NO: 1417881 - RNA, 19 nt, Homo sapiens
agcagguacuuucuuauua

SEQ ID NO: 1417882 - RNA, 19 nt, Homo sapiens
caauggaaguggccucaug

SEQ ID NO: 1417883 - RNA, 19 nt, Homo sapiens
gaaaucauuggaauucaga

SEQ ID NO: 1417884 - RNA, 19 nt, Homo sapiens
uaaaucaggaagcugguua

SEQ ID NO: 1417885 - RNA, 19 nt, Homo sapiens
gaaaucaggccuacagcau

SEQ ID NO: 1417886 - RNA, 19 nt, Homo sapiens
gggaguuucuuccugauca

SEQ ID NO: 1417887 - RNA, 19 nt, Homo sapiens
aagaacagcccacuacauu

SEQ ID NO: 1417888 - RNA, 19 nt, Homo sapiens
caaacagacuuccuucaac

SEQ ID NO: 1417889 - RNA, 19 nt, Homo sapiens
cugcacagcuggaaugaau

SEQ ID NO: 1417890 - RNA, 19 nt, Homo sapiens
cgucaacuauucucuuguu

SEQ ID NO: 1417891 - RNA, 19 nt, Homo sapiens
caaggaguuuacagucaaa

SEQ ID NO: 1417892 - RNA, 19 nt, Homo sapiens
uauggaaggcuuucaguuu

SEQ ID NO: 1417893 - RNA, 19 nt, Homo sapiens
gagaaaucauuggaauuca

SEQ ID NO: 1417894 - RNA, 19 nt, Homo sapiens
uuugguaacuuaucccuuu

SEQ ID NO: 1417895 - RNA, 19 nt, Homo sapiens
gaagaacagcccacuacau

SEQ ID NO: 1417896 - RNA, 19 nt, Homo sapiens
gcacagcaccauguaccua

SEQ ID NO: 1417897 - RNA, 19 nt, Homo sapiens
aagcaaaggauaacgaauu

SEQ ID NO: 1417898 - RNA, 19 nt, Homo sapiens
gcaauuaggacuuuguuuu

SEQ ID NO: 1417899 - RNA, 19 nt, Homo sapiens
guacugcaauaccacuguu

SEQ ID NO: 1417900 - RNA, 19 nt, Homo sapiens
acacagggcuggagguucu

SEQ ID NO: 1417901 - RNA, 19 nt, Homo sapiens
ccuauaauccuagcacuuu

SEQ ID NO: 1417902 - RNA, 19 nt, Homo sapiens
gaucgucgaagccgcaauu

SEQ ID NO: 1417903 - RNA, 19 nt, Homo sapiens
gcuguggucugaucuuaag

SEQ ID NO: 1417904 - RNA, 19 nt, Homo sapiens
gagcccugauguucugauu

SEQ ID NO: 1417905 - RNA, 19 nt, Homo sapiens
uucacaagcuuugguauuu

SEQ ID NO: 1417906 - RNA, 19 nt, Homo sapiens
caggagaacgugcugcuuu

SEQ ID NO: 1417907 - RNA, 19 nt, Homo sapiens
caccauguaccuauucuuu

SEQ ID NO: 1417908 - RNA, 19 nt, Homo sapiens
gggcuguguuggucaguga

SEQ ID NO: 1417909 - RNA, 19 nt, Homo sapiens
gccgucaacuauucucuug

SEQ ID NO: 1417910 - RNA, 19 nt, Homo sapiens
agaacagcccacuacauua

SEQ ID NO: 1417911 - RNA, 19 nt, Homo sapiens
ccgaaccagucucaucauu

SEQ ID NO: 1417912 - RNA, 19 nt, Homo sapiens
gauguucugauucuucaaa

SEQ ID NO: 1417913 - RNA, 19 nt, Homo sapiens
gcccugauguucugauucu

SEQ ID NO: 1417914 - RNA, 19 nt, Homo sapiens
ugacucggaugaagagaca

SEQ ID NO: 1417915 - RNA, 19 nt, Homo sapiens
aagguuuccucuucuacua

SEQ ID NO: 1417916 - RNA, 19 nt, Homo sapiens
caaagucacccuaaaagaa

SEQ ID NO: 1417917 - RNA, 19 nt, Homo sapiens
gauccuggcagagcaguuu

SEQ ID NO: 1417918 - RNA, 19 nt, Homo sapiens
cagguacuuucuuauuaga

SEQ ID NO: 1417919 - RNA, 19 nt, Homo sapiens
acuauucucuuguuuacug

SEQ ID NO: 1417920 - RNA, 19 nt, Homo sapiens
gcauuguggccgucaacua

SEQ ID NO: 1417921 - RNA, 19 nt, Homo sapiens
agagacaugccuguaguua

SEQ ID NO: 1417922 - RNA, 19 nt, Homo sapiens
cagacuuccuucaacaaau

SEQ ID NO: 1417923 - RNA, 19 nt, Homo sapiens
ggaaggcuuucaguuuuaa

SEQ ID NO: 1417924 - RNA, 19 nt, Homo sapiens
cacaagcuuugguauuuua

SEQ ID NO: 1417925 - RNA, 19 nt, Homo sapiens
gggagaaaucauuggaauu

SEQ ID NO: 1417926 - RNA, 19 nt, Homo sapiens
gaucuuccgggaccacauu

SEQ ID NO: 1417927 - RNA, 19 nt, Homo sapiens
caguauucauggaagguuu

SEQ ID NO: 1417928 - RNA, 19 nt, Homo sapiens
gcugagaggcaaguacaaa

SEQ ID NO: 1417929 - RNA, 19 nt, Homo sapiens
gcuucuggaucuguucuuu

SEQ ID NO: 1417930 - RNA, 19 nt, Homo sapiens
ggaagaacagcccacuaca

SEQ ID NO: 1417931 - RNA, 19 nt, Homo sapiens
aagcagguacuuucuuauu

SEQ ID NO: 1417932 - RNA, 19 nt, Homo sapiens
agucuguguugguauagua

SEQ ID NO: 1417933 - RNA, 19 nt, Homo sapiens
gcacagcuggaaugaaugg

SEQ ID NO: 1417934 - RNA, 19 nt, Homo sapiens
caagcaaacagacuuccuu

SEQ ID NO: 1417935 - RNA, 19 nt, Homo sapiens
gcccagaucaugccacugu

SEQ ID NO: 1417936 - RNA, 19 nt, Homo sapiens
gcuguauaaugagauagaa

SEQ ID NO: 1417937 - RNA, 19 nt, Homo sapiens
ccauguaccuauucuuugc

SEQ ID NO: 1417938 - RNA, 19 nt, Homo sapiens
gaaaccccgucucuacuga

SEQ ID NO: 1417939 - RNA, 19 nt, Homo sapiens
gcuaaagucaugugaauua

SEQ ID NO: 1417940 - RNA, 19 nt, Homo sapiens
ggacagauacgaagcagua

SEQ ID NO: 1417941 - RNA, 19 nt, Homo sapiens
ucacuuuccucaacuguua

SEQ ID NO: 1417942 - RNA, 19 nt, Homo sapiens
gaaagaagagcaucauaug

SEQ ID NO: 1417943 - RNA, 19 nt, Homo sapiens
gaagagauuuccaguacug

SEQ ID NO: 1417944 - RNA, 19 nt, Homo sapiens
gaaaugcauugaggagaaa

SEQ ID NO: 1417945 - RNA, 19 nt, Homo sapiens
gaggaugauuuauugauug

SEQ ID NO: 1417946 - RNA, 19 nt, Homo sapiens
gauaucagaugcuuacaca

SEQ ID NO: 1417947 - RNA, 19 nt, Homo sapiens
gaggagaaauuccaguuca

SEQ ID NO: 1417948 - RNA, 19 nt, Homo sapiens
agaagagcaucauauguuu

SEQ ID NO: 1417949 - RNA, 19 nt, Homo sapiens
ugaaaugcauugaggagaa

SEQ ID NO: 1417950 - RNA, 19 nt, Homo sapiens
gagagaagaggcuuaagaa

SEQ ID NO: 1417951 - RNA, 19 nt, Homo sapiens
gaagaugccagccuaugaa

SEQ ID NO: 1417952 - RNA, 19 nt, Homo sapiens
uagaagagauuuccaguac

SEQ ID NO: 1417953 - RNA, 19 nt, Homo sapiens
aaaggaagcauucaaagaa

SEQ ID NO: 1417954 - RNA, 19 nt, Homo sapiens
ucaaggaacugagagaaga

SEQ ID NO: 1417955 - RNA, 19 nt, Homo sapiens
caaacugauuccauagauu

SEQ ID NO: 1417956 - RNA, 19 nt, Homo sapiens
gaagauacaacugagauau

SEQ ID NO: 1417957 - RNA, 19 nt, Homo sapiens
caaagcagugugucugaua

SEQ ID NO: 1417958 - RNA, 19 nt, Homo sapiens
gagcaauccagaucacuuu

SEQ ID NO: 1417959 - RNA, 19 nt, Homo sapiens
ccacagcuuugucuacaga

SEQ ID NO: 1417960 - RNA, 19 nt, Homo sapiens
ucacacucuuaccauauua

SEQ ID NO: 1417961 - RNA, 19 nt, Homo sapiens
gugcuaaagucaugugaau

SEQ ID NO: 1417962 - RNA, 19 nt, Homo sapiens
gaugccagccuaugaacua

SEQ ID NO: 1417963 - RNA, 19 nt, Homo sapiens
auacgaagcaguacuauga

SEQ ID NO: 1417964 - RNA, 19 nt, Homo sapiens
ccaaacugauuccauagau

SEQ ID NO: 1417965 - RNA, 19 nt, Homo sapiens
gagaagaggcuuaagaaaa

SEQ ID NO: 1417966 - RNA, 19 nt, Homo sapiens
ugaaguaucugagaaguac

SEQ ID NO: 1417967 - RNA, 19 nt, Homo sapiens
aagaagagcaucauauguu

SEQ ID NO: 1417968 - RNA, 19 nt, Homo sapiens
ugaaagaagagcaucauau

SEQ ID NO: 1417969 - RNA, 19 nt, Homo sapiens
gaacuaacucuuggacaga

SEQ ID NO: 1417970 - RNA, 19 nt, Homo sapiens
ccaggauucugaaaccaaa

SEQ ID NO: 1417971 - RNA, 19 nt, Homo sapiens
gcuaugagaaguuuauuca

SEQ ID NO: 1417972 - RNA, 19 nt, Homo sapiens
caucauauguuuuggguuu

SEQ ID NO: 1417973 - RNA, 19 nt, Homo sapiens
ccagaucacuuuccucaac

SEQ ID NO: 1417974 - RNA, 19 nt, Homo sapiens
cuacaauccugauguucuu

SEQ ID NO: 1417975 - RNA, 19 nt, Homo sapiens
gcaaagcagugugucugau

SEQ ID NO: 1417976 - RNA, 19 nt, Homo sapiens
ugagaaaccucugaaaauu

SEQ ID NO: 1417977 - RNA, 19 nt, Homo sapiens
agaccaaguuucaggcaaa

SEQ ID NO: 1417978 - RNA, 19 nt, Homo sapiens
ucauugauguugccuacaa

SEQ ID NO: 1417979 - RNA, 19 nt, Homo sapiens
agaagaggcuuaagaaaau

SEQ ID NO: 1417980 - RNA, 19 nt, Homo sapiens
gaaaauuauucaccacuca

SEQ ID NO: 1417981 - RNA, 19 nt, Homo sapiens
uuuggaaccuccuagauga

SEQ ID NO: 1417982 - RNA, 19 nt, Homo sapiens
cagugugucugauagaaga

SEQ ID NO: 1417983 - RNA, 19 nt, Homo sapiens
ugagggcuaugagaaguuu

SEQ ID NO: 1417984 - RNA, 19 nt, Homo sapiens
ugaagaugccagccuauga

SEQ ID NO: 1417985 - RNA, 19 nt, Homo sapiens
ugaugggaauccaaacuga

SEQ ID NO: 1417986 - RNA, 19 nt, Homo sapiens
ugauugaaguaucugagaa

SEQ ID NO: 1417987 - RNA, 19 nt, Homo sapiens
ugagagaagaggcuuaaga

SEQ ID NO: 1417988 - RNA, 19 nt, Homo sapiens
ggucugcuuacccaaguua

SEQ ID NO: 1417989 - RNA, 19 nt, Homo sapiens
cagauacgaagcaguacua

SEQ ID NO: 1417990 - RNA, 19 nt, Homo sapiens
gaucccagcuccccaauca

SEQ ID NO: 1417991 - RNA, 19 nt, Homo sapiens
gaaccacagcuuugucuac

SEQ ID NO: 1417992 - RNA, 19 nt, Homo sapiens
gagaaguacagauuacauc

SEQ ID NO: 1417993 - RNA, 19 nt, Homo sapiens
gaagcaguacuaugagcaa

SEQ ID NO: 1417994 - RNA, 19 nt, Homo sapiens
gagaagggaacuaacucuu

SEQ ID NO: 1417995 - RNA, 19 nt, Homo sapiens
cauaagucauggagacauc

SEQ ID NO: 1417996 - RNA, 19 nt, Homo sapiens
agaaaccucugaaaauuga

SEQ ID NO: 1417997 - RNA, 19 nt, Homo sapiens
uacccaaguuacucaguuu

SEQ ID NO: 1417998 - RNA, 19 nt, Homo sapiens
gaaaaggaccaagugaaaa

SEQ ID NO: 1417999 - RNA, 19 nt, Homo sapiens
caaugccuuuggugugaaa

SEQ ID NO: 1418000 - RNA, 19 nt, Homo sapiens
gaagaggcuuaagaaaauu

SEQ ID NO: 1418001 - RNA, 19 nt, Homo sapiens
gugaaagaagagcaucaua

SEQ ID NO: 1418002 - RNA, 19 nt, Homo sapiens
gaaaugaccacagcaaaau

SEQ ID NO: 1418003 - RNA, 19 nt, Homo sapiens
guugaaaguugaauuaccu

SEQ ID NO: 1418004 - RNA, 19 nt, Homo sapiens
aaagaagagcaucauaugu

SEQ ID NO: 1418005 - RNA, 19 nt, Homo sapiens
uuacccaaguuacucaguu

SEQ ID NO: 1418006 - RNA, 19 nt, Homo sapiens
agaagggaacuaacucuug

SEQ ID NO: 1418007 - RNA, 19 nt, Homo sapiens
uaucagaugcuuacacagu

SEQ ID NO: 1418008 - RNA, 19 nt, Homo sapiens
ccacgcuaaucaucacaau

SEQ ID NO: 1418009 - RNA, 19 nt, Homo sapiens
aaagcagugugucugauag

SEQ ID NO: 1418010 - RNA, 19 nt, Homo sapiens
uuucagugcuaaagucaug

SEQ ID NO: 1418011 - RNA, 19 nt, Homo sapiens
ucagaugcuuacacaguca

SEQ ID NO: 1418012 - RNA, 19 nt, Homo sapiens
ucauggagacauccucaaa

SEQ ID NO: 1418013 - RNA, 19 nt, Homo sapiens
ugagauaucagaugcuuac

SEQ ID NO: 1418014 - RNA, 19 nt, Homo sapiens
cagaagauacaacugagau

SEQ ID NO: 1418015 - RNA, 19 nt, Homo sapiens
gagaaaccucugaaaauug

SEQ ID NO: 1418016 - RNA, 19 nt, Homo sapiens
gcaguacuaugagcaaucc

SEQ ID NO: 1418017 - RNA, 19 nt, Homo sapiens
agaagauacaacugagaua

SEQ ID NO: 1418018 - RNA, 19 nt, Homo sapiens
ggcaaagcagugugucuga

SEQ ID NO: 1418019 - RNA, 19 nt, Homo sapiens
ggucaaggaacugagagaa

SEQ ID NO: 1418020 - RNA, 19 nt, Homo sapiens
cucacacucuuaccauauu

SEQ ID NO: 1418021 - RNA, 19 nt, Homo sapiens
agagaagaggcuuaagaaa

SEQ ID NO: 1418022 - RNA, 19 nt, Homo sapiens
gauacgaagcaguacuaug

SEQ ID NO: 1418023 - RNA, 19 nt, Homo sapiens
auucaccacucauaaguca

SEQ ID NO: 1418024 - RNA, 19 nt, Homo sapiens
aaccagaagauacaacuga

SEQ ID NO: 1418025 - RNA, 19 nt, Homo sapiens
aucaaccacucauccagua

SEQ ID NO: 1418026 - RNA, 19 nt, Homo sapiens
gaagagcaucauauguuuu

SEQ ID NO: 1418027 - RNA, 19 nt, Homo sapiens
gcagcugaaagaagggaaa

SEQ ID NO: 1418028 - RNA, 19 nt, Homo sapiens
ucugugaccuuaguguuuc

SEQ ID NO: 1418029 - RNA, 19 nt, Homo sapiens
gaccaaguuucaggcaaag

SEQ ID NO: 1418030 - RNA, 19 nt, Homo sapiens
uggcaaaccagaagauaca

SEQ ID NO: 1418031 - RNA, 19 nt, Homo sapiens
ucaccacucauaagucaug

SEQ ID NO: 1418032 - RNA, 19 nt, Homo sapiens
aaccacagcuuugucuaca

SEQ ID NO: 1418033 - RNA, 19 nt, Homo sapiens
acuaacucuuggacagaua

SEQ ID NO: 1418034 - RNA, 19 nt, Homo sapiens
gcauugaggagaaauucca

SEQ ID NO: 1418035 - RNA, 19 nt, Homo sapiens
uuacacagucauugauguu

SEQ ID NO: 1418036 - RNA, 19 nt, Homo sapiens
auagaagagauuuccagua

SEQ ID NO: 1418037 - RNA, 19 nt, Homo sapiens
agaaaaggaccaagugaaa

SEQ ID NO: 1418038 - RNA, 19 nt, Homo sapiens
ggagacauccucaaaaggu

SEQ ID NO: 1418039 - RNA, 19 nt, Homo sapiens
gaaccaaucucugcacaua

SEQ ID NO: 1418040 - RNA, 19 nt, Homo sapiens
gaagagacaugccaaguug

SEQ ID NO: 1418041 - RNA, 19 nt, Homo sapiens
gaaagacuguuccuaagaa

SEQ ID NO: 1418042 - RNA, 19 nt, Homo sapiens
ccacauguauuguaaagua

SEQ ID NO: 1418043 - RNA, 19 nt, Homo sapiens
gaaccaaggcuaugauaaa

SEQ ID NO: 1418044 - RNA, 19 nt, Homo sapiens
uaagauaaauggcuguuug

SEQ ID NO: 1418045 - RNA, 19 nt, Homo sapiens
agagagguaucuuaucuua

SEQ ID NO: 1418046 - RNA, 19 nt, Homo sapiens
ucaugaaacuggaaucuuu

SEQ ID NO: 1418047 - RNA, 19 nt, Homo sapiens
ggaauagagagguaucuua

SEQ ID NO: 1418048 - RNA, 19 nt, Homo sapiens
gcuaagggauaaauacuau

SEQ ID NO: 1418049 - RNA, 19 nt, Homo sapiens
gaaaggugauggacuucaa

SEQ ID NO: 1418050 - RNA, 19 nt, Homo sapiens
gaacucagaauaaaggaaa

SEQ ID NO: 1418051 - RNA, 19 nt, Homo sapiens
gcaccuaccuggucagcuu

SEQ ID NO: 1418052 - RNA, 19 nt, Homo sapiens
gcucuaaacuuauccaucu

SEQ ID NO: 1418053 - RNA, 19 nt, Homo sapiens
ggacaaugacaacugauaa

SEQ ID NO: 1418054 - RNA, 19 nt, Homo sapiens
ggacaugaccauugcauau

SEQ ID NO: 1418055 - RNA, 19 nt, Homo sapiens
gaauguggccugacccuaa

SEQ ID NO: 1418056 - RNA, 19 nt, Homo sapiens
gaauagagagguaucuuau

SEQ ID NO: 1418057 - RNA, 19 nt, Homo sapiens
gaaagacacacucagauuc

SEQ ID NO: 1418058 - RNA, 19 nt, Homo sapiens
uaaggacaaugacaacuga

SEQ ID NO: 1418059 - RNA, 19 nt, Homo sapiens
gauaaauggcuguuugaaa

SEQ ID NO: 1418060 - RNA, 19 nt, Homo sapiens
gcagaaagacacacucaga

SEQ ID NO: 1418061 - RNA, 19 nt, Homo sapiens
gaaggaucguaaacacauu

SEQ ID NO: 1418062 - RNA, 19 nt, Homo sapiens
ucagggagaugcacauaga

SEQ ID NO: 1418063 - RNA, 19 nt, Homo sapiens
gaguugaaaugaugaagga

SEQ ID NO: 1418064 - RNA, 19 nt, Homo sapiens
acacucagauucaauggaa

SEQ ID NO: 1418065 - RNA, 19 nt, Homo sapiens
auaaauggcuguuugaaag

SEQ ID NO: 1418066 - RNA, 19 nt, Homo sapiens
ggacagaggaagcaauaug

SEQ ID NO: 1418067 - RNA, 19 nt, Homo sapiens
caaaguccuuauucccuaa

SEQ ID NO: 1418068 - RNA, 19 nt, Homo sapiens
gaggaaggcuauguaagga

SEQ ID NO: 1418069 - RNA, 19 nt, Homo sapiens
gauaggagagaucauuaaa

SEQ ID NO: 1418070 - RNA, 19 nt, Homo sapiens
caggaaaggugauggacuu

SEQ ID NO: 1418071 - RNA, 19 nt, Homo sapiens
agacuuccaugguuauauu

SEQ ID NO: 1418072 - RNA, 19 nt, Homo sapiens
cauaaucccacauguauug

SEQ ID NO: 1418073 - RNA, 19 nt, Homo sapiens
agagguaucuuaucuuaca

SEQ ID NO: 1418074 - RNA, 19 nt, Homo sapiens
gugauggacuucaacaaug

SEQ ID NO: 1418075 - RNA, 19 nt, Homo sapiens
gguuauacuuuacaaggaa

SEQ ID NO: 1418076 - RNA, 19 nt, Homo sapiens
gaaaugaugaaggaucgua

SEQ ID NO: 1418077 - RNA, 19 nt, Homo sapiens
caaagugggaguugaaaug

SEQ ID NO: 1418078 - RNA, 19 nt, Homo sapiens
uaagaagcccagccacuaa

SEQ ID NO: 1418079 - RNA, 19 nt, Homo sapiens
uaugaagccucaacacaug

SEQ ID NO: 1418080 - RNA, 19 nt, Homo sapiens
ugaaaggcaaacucauuua

SEQ ID NO: 1418081 - RNA, 19 nt, Homo sapiens
ggaaccaaggcuaugauaa

SEQ ID NO: 1418082 - RNA, 19 nt, Homo sapiens
ggaggaaggcuauguaagg

SEQ ID NO: 1418083 - RNA, 19 nt, Homo sapiens
gaugaaggaucguaaacac

SEQ ID NO: 1418084 - RNA, 19 nt, Homo sapiens
ggucugcucuaaacuuauc

SEQ ID NO: 1418085 - RNA, 19 nt, Homo sapiens
ggaaauugaccggcuauca

SEQ ID NO: 1418086 - RNA, 19 nt, Homo sapiens
cagauaggagagaucauua

SEQ ID NO: 1418087 - RNA, 19 nt, Homo sapiens
gaucguaaacacauugaug

SEQ ID NO: 1418088 - RNA, 19 nt, Homo sapiens
gaaaucauagagaaacuag

SEQ ID NO: 1418089 - RNA, 19 nt, Homo sapiens
gaaauugaccggcuaucag

SEQ ID NO: 1418090 - RNA, 19 nt, Homo sapiens
gcuaucccuucgucacuuu

SEQ ID NO: 1418091 - RNA, 19 nt, Homo sapiens
ccaaggcuaugauaaaauu

SEQ ID NO: 1418092 - RNA, 19 nt, Homo sapiens
ggaaaucauagagaaacua

SEQ ID NO: 1418093 - RNA, 19 nt, Homo sapiens
aaucccacauguauuguaa

SEQ ID NO: 1418094 - RNA, 19 nt, Homo sapiens
caugaaacuggaaucuuua

SEQ ID NO: 1418095 - RNA, 19 nt, Homo sapiens
gaaaggcaaacucauuuac

SEQ ID NO: 1418096 - RNA, 19 nt, Homo sapiens
ccugacaccuauuggcuuu

SEQ ID NO: 1418097 - RNA, 19 nt, Homo sapiens
ccucucaugucuucacuga

SEQ ID NO: 1418098 - RNA, 19 nt, Homo sapiens
caaggaaaauggauaacaa

SEQ ID NO: 1418099 - RNA, 19 nt, Homo sapiens
gcugaacucugugaauauc

SEQ ID NO: 1418100 - RNA, 19 nt, Homo sapiens
ccucaacccucgagauaca

SEQ ID NO: 1418101 - RNA, 19 nt, Homo sapiens
ccacccaccugaucaugug

SEQ ID NO: 1418102 - RNA, 19 nt, Homo sapiens
ugaaagacuguuccuaaga

SEQ ID NO: 1418103 - RNA, 19 nt, Homo sapiens
agaaagacacacucagauu

SEQ ID NO: 1418104 - RNA, 19 nt, Homo sapiens
auagagagguaucuuaucu

SEQ ID NO: 1418105 - RNA, 19 nt, Homo sapiens
augcugaacucugugaaua

SEQ ID NO: 1418106 - RNA, 19 nt, Homo sapiens
cauuaaagccacuaacaga

SEQ ID NO: 1418107 - RNA, 19 nt, Homo sapiens
gcauauggcacugacacua

SEQ ID NO: 1418108 - RNA, 19 nt, Homo sapiens
cuaagaagcccagccacua

SEQ ID NO: 1418109 - RNA, 19 nt, Homo sapiens
aaacacagccaucgucauc

SEQ ID NO: 1418110 - RNA, 19 nt, Homo sapiens
gucaguggaucuacuacuu

SEQ ID NO: 1418111 - RNA, 19 nt, Homo sapiens
aaacucaaaugcugaacuc

SEQ ID NO: 1418112 - RNA, 19 nt, Homo sapiens
uaaacuacauuugcuaagg

SEQ ID NO: 1418113 - RNA, 19 nt, Homo sapiens
cagagagguuuguagacuu

SEQ ID NO: 1418114 - RNA, 19 nt, Homo sapiens
ggccagcacuuuagaccau

SEQ ID NO: 1418115 - RNA, 19 nt, Homo sapiens
ccagauaggagagaucauu

SEQ ID NO: 1418116 - RNA, 19 nt, Homo sapiens
guuaauggcaccucucaug

SEQ ID NO: 1418117 - RNA, 19 nt, Homo sapiens
ggugauggacuucaacaau

SEQ ID NO: 1418118 - RNA, 19 nt, Homo sapiens
gcacagccaccauccucaa

SEQ ID NO: 1418119 - RNA, 19 nt, Homo sapiens
agacagagagguuuguaga

SEQ ID NO: 1418120 - RNA, 19 nt, Homo sapiens
uuggucugcucuaaacuua

SEQ ID NO: 1418121 - RNA, 19 nt, Homo sapiens
guucaguuagacacaauua

SEQ ID NO: 1418122 - RNA, 19 nt, Homo sapiens
caacuccgcaaaguccuua

SEQ ID NO: 1418123 - RNA, 19 nt, Homo sapiens
cuacauuugcuaagggaua

SEQ ID NO: 1418124 - RNA, 19 nt, Homo sapiens
uacaugaccacccggaaua

SEQ ID NO: 1418125 - RNA, 19 nt, Homo sapiens
gugaggcucugaccuacau

SEQ ID NO: 1418126 - RNA, 19 nt, Homo sapiens
guaugaagccucaacacau

SEQ ID NO: 1418127 - RNA, 19 nt, Homo sapiens
caaggaaccaaggcuauga

SEQ ID NO: 1418128 - RNA, 19 nt, Homo sapiens
gcaaggaaccaaggcuaug

SEQ ID NO: 1418129 - RNA, 19 nt, Homo sapiens
guaaggacaaugacaacug

SEQ ID NO: 1418130 - RNA, 19 nt, Homo sapiens
agagagguuuguagacuuc

SEQ ID NO: 1418131 - RNA, 19 nt, Homo sapiens
gguccaaagugggaguuga

SEQ ID NO: 1418132 - RNA, 19 nt, Homo sapiens
caaaugcugaacucuguga

SEQ ID NO: 1418133 - RNA, 19 nt, Homo sapiens
uggcaccucucaugucuuc

SEQ ID NO: 1418134 - RNA, 19 nt, Homo sapiens
gauaagggaugcaaaacca

SEQ ID NO: 1418135 - RNA, 19 nt, Homo sapiens
uacauuugcuaagggauaa

SEQ ID NO: 1418136 - RNA, 19 nt, Homo sapiens
ccagcucuacucucugaua

SEQ ID NO: 1418137 - RNA, 19 nt, Homo sapiens
aaagacacacucagauuca

SEQ ID NO: 1418138 - RNA, 19 nt, Homo sapiens
aauguggccugacccuaaa

SEQ ID NO: 1418139 - RNA, 19 nt, Homo sapiens
gaagacuaauccagagaua

SEQ ID NO: 1418140 - RNA, 19 nt, Homo sapiens
aagaagaccuguggaaaua

SEQ ID NO: 1418141 - RNA, 19 nt, Homo sapiens
ggacagcucuggaggaaca

SEQ ID NO: 1418142 - RNA, 19 nt, Homo sapiens
ggaaauaagaguucaguga

SEQ ID NO: 1418143 - RNA, 19 nt, Homo sapiens
gaagaagaaccaagugaaa

SEQ ID NO: 1418144 - RNA, 19 nt, Homo sapiens
gaggaaagcugugcucugu

SEQ ID NO: 1418145 - RNA, 19 nt, Homo sapiens
gaacugggcagcaucuaaa

SEQ ID NO: 1418146 - RNA, 19 nt, Homo sapiens
gaagaagaccuguggaaau

SEQ ID NO: 1418147 - RNA, 19 nt, Homo sapiens
gaaccuauaucugugaaau

SEQ ID NO: 1418148 - RNA, 19 nt, Homo sapiens
gcacagaagacaaauguau

SEQ ID NO: 1418149 - RNA, 19 nt, Homo sapiens
cugaaugacuugaauguuu

SEQ ID NO: 1418150 - RNA, 19 nt, Homo sapiens
cggaacaacucacuugaaa

SEQ ID NO: 1418151 - RNA, 19 nt, Homo sapiens
ggacgaauaugugcuauac

SEQ ID NO: 1418152 - RNA, 19 nt, Homo sapiens
cacugaagauggagaauuu

SEQ ID NO: 1418153 - RNA, 19 nt, Homo sapiens
acgaauaugugcuauacua

SEQ ID NO: 1418154 - RNA, 19 nt, Homo sapiens
gaagaccuguggaaauaag

SEQ ID NO: 1418155 - RNA, 19 nt, Homo sapiens
caagguagaauggauauuu

SEQ ID NO: 1418156 - RNA, 19 nt, Homo sapiens
ucaauacacugaagaugga

SEQ ID NO: 1418157 - RNA, 19 nt, Homo sapiens
gcugcucccuguucugaua

SEQ ID NO: 1418158 - RNA, 19 nt, Homo sapiens
caaaggaggagauuguauu

SEQ ID NO: 1418159 - RNA, 19 nt, Homo sapiens
gaaccaggcugagcugagu

SEQ ID NO: 1418160 - RNA, 19 nt, Homo sapiens
ggaagaagaaccaagugaa

SEQ ID NO: 1418161 - RNA, 19 nt, Homo sapiens
gcucugugguggccuaauu

SEQ ID NO: 1418162 - RNA, 19 nt, Homo sapiens
gcauagagcauaucuugug

SEQ ID NO: 1418163 - RNA, 19 nt, Homo sapiens
cuggaaagcugauggcaaa

SEQ ID NO: 1418164 - RNA, 19 nt, Homo sapiens
guagugaccgcucgaaauu

SEQ ID NO: 1418165 - RNA, 19 nt, Homo sapiens
gagcacagaagacaaaugu

SEQ ID NO: 1418166 - RNA, 19 nt, Homo sapiens
guucuuaguggaugaguua

SEQ ID NO: 1418167 - RNA, 19 nt, Homo sapiens
ggaaccagugggagacuua

SEQ ID NO: 1418168 - RNA, 19 nt, Homo sapiens
gcaucuaaauguaucuuuc

SEQ ID NO: 1418169 - RNA, 19 nt, Homo sapiens
gagcauaucuugugaaaac

SEQ ID NO: 1418170 - RNA, 19 nt, Homo sapiens
uagagcauaucuugugaaa

SEQ ID NO: 1418171 - RNA, 19 nt, Homo sapiens
ccauguggguggauugauu

SEQ ID NO: 1418172 - RNA, 19 nt, Homo sapiens
gcaaggaacaacccauuuc

SEQ ID NO: 1418173 - RNA, 19 nt, Homo sapiens
ugauauugaucgugaagaa

SEQ ID NO: 1418174 - RNA, 19 nt, Homo sapiens
gaaacuacaccugcaguau

SEQ ID NO: 1418175 - RNA, 19 nt, Homo sapiens
ggagucagauggaggaaac

SEQ ID NO: 1418176 - RNA, 19 nt, Homo sapiens
gcuauacuauuacuccaau

SEQ ID NO: 1418177 - RNA, 19 nt, Homo sapiens
ugaaugacuugaauguuuc

SEQ ID NO: 1418178 - RNA, 19 nt, Homo sapiens
uaugguaaguggagauuau

SEQ ID NO: 1418179 - RNA, 19 nt, Homo sapiens
gaucggaacaacucacuug

SEQ ID NO: 1418180 - RNA, 19 nt, Homo sapiens
ggaaacuacaccugcagua

SEQ ID NO: 1418181 - RNA, 19 nt, Homo sapiens
gauaugaacugggcagcau

SEQ ID NO: 1418182 - RNA, 19 nt, Homo sapiens
gcucuucucugauaugaac

SEQ ID NO: 1418183 - RNA, 19 nt, Homo sapiens
agacuaauccagagauaaa

SEQ ID NO: 1418184 - RNA, 19 nt, Homo sapiens
gagauuguauuucguuacu

SEQ ID NO: 1418185 - RNA, 19 nt, Homo sapiens
cauagagcauaucuuguga

SEQ ID NO: 1418186 - RNA, 19 nt, Homo sapiens
gagcaaggaacaacccauu

SEQ ID NO: 1418187 - RNA, 19 nt, Homo sapiens
gauaaacacaguggaaaug

SEQ ID NO: 1418188 - RNA, 19 nt, Homo sapiens
gcucugaugggauguguuu

SEQ ID NO: 1418189 - RNA, 19 nt, Homo sapiens
gcaaaggaggagauuguau

SEQ ID NO: 1418190 - RNA, 19 nt, Homo sapiens
gugaagaacacgaagaaga

SEQ ID NO: 1418191 - RNA, 19 nt, Homo sapiens
ugaaacacgugaccaaggu

SEQ ID NO: 1418192 - RNA, 19 nt, Homo sapiens
ccagggaaccuauaucugu

SEQ ID NO: 1418193 - RNA, 19 nt, Homo sapiens
gaaaagaggaaguaaacaa

SEQ ID NO: 1418194 - RNA, 19 nt, Homo sapiens
ccagagcacagaagugaaa

SEQ ID NO: 1418195 - RNA, 19 nt, Homo sapiens
ccagagcacagaagacaaa

SEQ ID NO: 1418196 - RNA, 19 nt, Homo sapiens
gaggauaaacacaguggaa

SEQ ID NO: 1418197 - RNA, 19 nt, Homo sapiens
gggaagaaucagagauaaa

SEQ ID NO: 1418198 - RNA, 19 nt, Homo sapiens
gggaggugaucgaggaaga

SEQ ID NO: 1418199 - RNA, 19 nt, Homo sapiens
gcgcaaaggaggagauugu

SEQ ID NO: 1418200 - RNA, 19 nt, Homo sapiens
gaccaagguagaauggaua

SEQ ID NO: 1418201 - RNA, 19 nt, Homo sapiens
cacagaagacaaauguaua

SEQ ID NO: 1418202 - RNA, 19 nt, Homo sapiens
guggguggauugauucaga

SEQ ID NO: 1418203 - RNA, 19 nt, Homo sapiens
caaggacgaauaugugcua

SEQ ID NO: 1418204 - RNA, 19 nt, Homo sapiens
aagauagacuggacucugu

SEQ ID NO: 1418205 - RNA, 19 nt, Homo sapiens
caacccauuucgucguuau

SEQ ID NO: 1418206 - RNA, 19 nt, Homo sapiens
ggauaaacacaguggaaau

SEQ ID NO: 1418207 - RNA, 19 nt, Homo sapiens
uuuguugucucuuugcaua

SEQ ID NO: 1418208 - RNA, 19 nt, Homo sapiens
gauuguauuucguuacuac

SEQ ID NO: 1418209 - RNA, 19 nt, Homo sapiens
aaaggaggagauuguauuu

SEQ ID NO: 1418210 - RNA, 19 nt, Homo sapiens
gaaacacgugaccaaggua

SEQ ID NO: 1418211 - RNA, 19 nt, Homo sapiens
gacaacuuaugcaaugaug

SEQ ID NO: 1418212 - RNA, 19 nt, Homo sapiens
ggaagaaucagagauaaaa

SEQ ID NO: 1418213 - RNA, 19 nt, Homo sapiens
cagcagcgguggagacucu

SEQ ID NO: 1418214 - RNA, 19 nt, Homo sapiens
ggugaucgaggaagaagaa

SEQ ID NO: 1418215 - RNA, 19 nt, Homo sapiens
gggagaggauaaacacagu

SEQ ID NO: 1418216 - RNA, 19 nt, Homo sapiens
gaggagauuguauuucguu

SEQ ID NO: 1418217 - RNA, 19 nt, Homo sapiens
ugaccaagguagaauggau

SEQ ID NO: 1418218 - RNA, 19 nt, Homo sapiens
agagccagguguucaagaa

SEQ ID NO: 1418219 - RNA, 19 nt, Homo sapiens
acaaggaccugcccuacag

SEQ ID NO: 1418220 - RNA, 19 nt, Homo sapiens
ccucuggucuuggguggua

SEQ ID NO: 1418221 - RNA, 19 nt, Homo sapiens
gcacgccaaggacgaauau

SEQ ID NO: 1418222 - RNA, 19 nt, Homo sapiens
caggagagcacgccaagga

SEQ ID NO: 1418223 - RNA, 19 nt, Homo sapiens
ccuccugucucauuguuug

SEQ ID NO: 1418224 - RNA, 19 nt, Homo sapiens
ugaagaagaccuguggaaa

SEQ ID NO: 1418225 - RNA, 19 nt, Homo sapiens
gggcagcaucuaaauguau

SEQ ID NO: 1418226 - RNA, 19 nt, Homo sapiens
ggugaucauugugggaauu

SEQ ID NO: 1418227 - RNA, 19 nt, Homo sapiens
ggagugagggagucagaug

SEQ ID NO: 1418228 - RNA, 19 nt, Homo sapiens
gggccugaaugacuugaau

SEQ ID NO: 1418229 - RNA, 19 nt, Homo sapiens
gugggagacuuaagagcaa

SEQ ID NO: 1418230 - RNA, 19 nt, Homo sapiens
cagcuguccuccugucuca

SEQ ID NO: 1418231 - RNA, 19 nt, Homo sapiens
ggucagaucggaacaacuc

SEQ ID NO: 1418232 - RNA, 19 nt, Homo sapiens
acuuggcucuucucugaua

SEQ ID NO: 1418233 - RNA, 19 nt, Homo sapiens
gggaaccuauaucugugaa

SEQ ID NO: 1418234 - RNA, 19 nt, Homo sapiens
uaaacacaguggaaaugca

SEQ ID NO: 1418235 - RNA, 19 nt, Homo sapiens
gaaccgcguacacuugaug

SEQ ID NO: 1418236 - RNA, 19 nt, Homo sapiens
ccagaaccgcguacacuug

SEQ ID NO: 1418237 - RNA, 19 nt, Homo sapiens
ugggaagaaucagagauaa

SEQ ID NO: 1418238 - RNA, 19 nt, Homo sapiens
ucagaggccaccuacauga

SEQ ID NO: 1418239 - RNA, 19 nt, Homo sapiens
uaacagauaugcuucauga

SEQ ID NO: 1418240 - RNA, 19 nt, Homo sapiens
cgaaagaacuggucaacaa

SEQ ID NO: 1418241 - RNA, 19 nt, Homo sapiens
uaaggaaacuguuguuguu

SEQ ID NO: 1418242 - RNA, 19 nt, Homo sapiens
gcacacagauaaucaaugg

SEQ ID NO: 1418243 - RNA, 19 nt, Homo sapiens
ugacagauuugaggauuua

SEQ ID NO: 1418244 - RNA, 19 nt, Homo sapiens
gaacuggaaugacacuuuc

SEQ ID NO: 1418245 - RNA, 19 nt, Homo sapiens
gaagaacugcuaaagcuuu

SEQ ID NO: 1418246 - RNA, 19 nt, Homo sapiens
ggaaacuguuguuguuaaa

SEQ ID NO: 1418247 - RNA, 19 nt, Homo sapiens
ccagucauguuauuucuuu

SEQ ID NO: 1418248 - RNA, 19 nt, Homo sapiens
cagauaugcuucaugauug

SEQ ID NO: 1418249 - RNA, 19 nt, Homo sapiens
caagaauugucaucaaaug

SEQ ID NO: 1418250 - RNA, 19 nt, Homo sapiens
caaagugguugcaauaaag

SEQ ID NO: 1418251 - RNA, 19 nt, Homo sapiens
gaaagaacuggucaacaaa

SEQ ID NO: 1418252 - RNA, 19 nt, Homo sapiens
guaauugacuuagaugaug

SEQ ID NO: 1418253 - RNA, 19 nt, Homo sapiens
gaagacugcuuaggauguu

SEQ ID NO: 1418254 - RNA, 19 nt, Homo sapiens
gaugaagacugcuuaggau

SEQ ID NO: 1418255 - RNA, 19 nt, Homo sapiens
ggaggagaaauaauucaua

SEQ ID NO: 1418256 - RNA, 19 nt, Homo sapiens
ugaaggaggagaaauaauu

SEQ ID NO: 1418257 - RNA, 19 nt, Homo sapiens
caacuuagaacuggaauga

SEQ ID NO: 1418258 - RNA, 19 nt, Homo sapiens
acaauuugcuuucaucaug

SEQ ID NO: 1418259 - RNA, 19 nt, Homo sapiens
gcauguaauugacuuagau

SEQ ID NO: 1418260 - RNA, 19 nt, Homo sapiens
uaaacaugcuggauaaucu

SEQ ID NO: 1418261 - RNA, 19 nt, Homo sapiens
guaccugguuggaagcuuu

SEQ ID NO: 1418262 - RNA, 19 nt, Homo sapiens
caaagaguaaggucuauga

SEQ ID NO: 1418263 - RNA, 19 nt, Homo sapiens
gcuuugaggucauuacaau

SEQ ID NO: 1418264 - RNA, 19 nt, Homo sapiens
gaacuggucaacaaagaug

SEQ ID NO: 1418265 - RNA, 19 nt, Homo sapiens
cagcagagcauguaguuau

SEQ ID NO: 1418266 - RNA, 19 nt, Homo sapiens
gcucuucagucuacaaauc

SEQ ID NO: 1418267 - RNA, 19 nt, Homo sapiens
gaaggaggagaaauaauuc

SEQ ID NO: 1418268 - RNA, 19 nt, Homo sapiens
uuacagaagucauguugug

SEQ ID NO: 1418269 - RNA, 19 nt, Homo sapiens
aagccugucuggaucaaua

SEQ ID NO: 1418270 - RNA, 19 nt, Homo sapiens
gauaaucugcgguaccaaa

SEQ ID NO: 1418271 - RNA, 19 nt, Homo sapiens
ggaugaagacugcuuagga

SEQ ID NO: 1418272 - RNA, 19 nt, Homo sapiens
caacacaaauaagcaaagu

SEQ ID NO: 1418273 - RNA, 19 nt, Homo sapiens
uguaggcaguccucuauuu

SEQ ID NO: 1418274 - RNA, 19 nt, Homo sapiens
gaucagcccaugaccuaaa

SEQ ID NO: 1418275 - RNA, 19 nt, Homo sapiens
aaagaaaacugguaaggaa

SEQ ID NO: 1418276 - RNA, 19 nt, Homo sapiens
gcaaacuuaccaacacaaa

SEQ ID NO: 1418277 - RNA, 19 nt, Homo sapiens
gaaauugaaggaggagaaa

SEQ ID NO: 1418278 - RNA, 19 nt, Homo sapiens
gacaagugauaccagcaaa

SEQ ID NO: 1418279 - RNA, 19 nt, Homo sapiens
ugaauuugcuccagaaacu

SEQ ID NO: 1418280 - RNA, 19 nt, Homo sapiens
gcaagaauugucaucaaau

SEQ ID NO: 1418281 - RNA, 19 nt, Homo sapiens
acagauaugcuucaugauu

SEQ ID NO: 1418282 - RNA, 19 nt, Homo sapiens
gcacauuguaacugaguaa

SEQ ID NO: 1418283 - RNA, 19 nt, Homo sapiens
aggaaacuguuguuguuaa

SEQ ID NO: 1418284 - RNA, 19 nt, Homo sapiens
gaaggcaaacuuaccaaca

SEQ ID NO: 1418285 - RNA, 19 nt, Homo sapiens
guaaggaaacuguuguugu

SEQ ID NO: 1418286 - RNA, 19 nt, Homo sapiens
ucagugaccuagauuuagu

SEQ ID NO: 1418287 - RNA, 19 nt, Homo sapiens
gaccuaaaccuccagacaa

SEQ ID NO: 1418288 - RNA, 19 nt, Homo sapiens
gugcaucuguuaauucagu

SEQ ID NO: 1418289 - RNA, 19 nt, Homo sapiens
caaacuauggagccuuuaa

SEQ ID NO: 1418290 - RNA, 19 nt, Homo sapiens
cagcaaagaguaaggucua

SEQ ID NO: 1418291 - RNA, 19 nt, Homo sapiens
ugcaagaauugucaucaaa

SEQ ID NO: 1418292 - RNA, 19 nt, Homo sapiens
gaaagugcagcaaagcaau

SEQ ID NO: 1418293 - RNA, 19 nt, Homo sapiens
aaucugcgguaccaaacua

SEQ ID NO: 1418294 - RNA, 19 nt, Homo sapiens
guguggauguugauacuga

SEQ ID NO: 1418295 - RNA, 19 nt, Homo sapiens
uggaagaacugcuaaagcu

SEQ ID NO: 1418296 - RNA, 19 nt, Homo sapiens
caauggaaguguggauguu

SEQ ID NO: 1418297 - RNA, 19 nt, Homo sapiens
gauuugaggauuuacagaa

SEQ ID NO: 1418298 - RNA, 19 nt, Homo sapiens
ggaacaauacaauuugcuu

SEQ ID NO: 1418299 - RNA, 19 nt, Homo sapiens
gugaucagcccaugaccua

SEQ ID NO: 1418300 - RNA, 19 nt, Homo sapiens
uugcuagaaucaagaauga

SEQ ID NO: 1418301 - RNA, 19 nt, Homo sapiens
uugcugcuguguauucaua

SEQ ID NO: 1418302 - RNA, 19 nt, Homo sapiens
acaaaugagugccauaaaa

SEQ ID NO: 1418303 - RNA, 19 nt, Homo sapiens
caagugauaccagcaaaga

SEQ ID NO: 1418304 - RNA, 19 nt, Homo sapiens
acacagauaaucaauggaa

SEQ ID NO: 1418305 - RNA, 19 nt, Homo sapiens
caauuugcuuucaucaugu

SEQ ID NO: 1418306 - RNA, 19 nt, Homo sapiens
ggagcuuagugaaggcaaa

SEQ ID NO: 1418307 - RNA, 19 nt, Homo sapiens
ucaaauucuuccagugguu

SEQ ID NO: 1418308 - RNA, 19 nt, Homo sapiens
aagaguaaggucuaugaua

SEQ ID NO: 1418309 - RNA, 19 nt, Homo sapiens
cuaaagcuuugaggucauu

SEQ ID NO: 1418310 - RNA, 19 nt, Homo sapiens
acaaauaagcaaagugguu

SEQ ID NO: 1418311 - RNA, 19 nt, Homo sapiens
cuacaaaugagugccauaa

SEQ ID NO: 1418312 - RNA, 19 nt, Homo sapiens
aagaacuggucaacaaaga

SEQ ID NO: 1418313 - RNA, 19 nt, Homo sapiens
ggucgaguguggccugugu

SEQ ID NO: 1418314 - RNA, 19 nt, Homo sapiens
ggaguccagcuucguacua

SEQ ID NO: 1418315 - RNA, 19 nt, Homo sapiens
gugacugccuggaugaaga

SEQ ID NO: 1418316 - RNA, 19 nt, Homo sapiens
ggaagaacugcuaaagcuu

SEQ ID NO: 1418317 - RNA, 19 nt, Homo sapiens
ccauuuaacauacacaaga

SEQ ID NO: 1418318 - RNA, 19 nt, Homo sapiens
gaccagucauguuauuucu

SEQ ID NO: 1418319 - RNA, 19 nt, Homo sapiens
ggaaguguggauguugaua

SEQ ID NO: 1418320 - RNA, 19 nt, Homo sapiens
guaggcaguccucuauuug

SEQ ID NO: 1418321 - RNA, 19 nt, Homo sapiens
cuacuauacucgucacaca

SEQ ID NO: 1418322 - RNA, 19 nt, Homo sapiens
uuucagugaccuagauuua

SEQ ID NO: 1418323 - RNA, 19 nt, Homo sapiens
aaauuucagugaccuagau

SEQ ID NO: 1418324 - RNA, 19 nt, Homo sapiens
aauugaaggaggagaaaua

SEQ ID NO: 1418325 - RNA, 19 nt, Homo sapiens
gaccgcaaguggcuguaug

SEQ ID NO: 1418326 - RNA, 19 nt, Homo sapiens
uguguggacucgcaucuug

SEQ ID NO: 1418327 - RNA, 19 nt, Homo sapiens
cuacuugacauucuauaga

SEQ ID NO: 1418328 - RNA, 19 nt, Homo sapiens
gguguaggcaguccucuau

SEQ ID NO: 1418329 - RNA, 19 nt, Homo sapiens
caggaaggcaaacugaauu

SEQ ID NO: 1418330 - RNA, 19 nt, Homo sapiens
ucagauggaagaacugcua

SEQ ID NO: 1418331 - RNA, 19 nt, Homo sapiens
accuaaaccuccagacaaa

SEQ ID NO: 1418332 - RNA, 19 nt, Homo sapiens
ggucaacaaagaugaaagu

SEQ ID NO: 1418333 - RNA, 19 nt, Homo sapiens
caaauucuuccagugguuu

SEQ ID NO: 1418334 - RNA, 19 nt, Homo sapiens
aaacuauggagccuuuaaa

SEQ ID NO: 1418335 - RNA, 19 nt, Homo sapiens
aagaacugcuaaagcuuug

SEQ ID NO: 1418336 - RNA, 19 nt, Homo sapiens
acacagguuuuaagacuuu

SEQ ID NO: 1418337 - RNA, 19 nt, Homo sapiens
acuuagaacuggaaugaca

SEQ ID NO: 1418338 - RNA, 19 nt, Homo sapiens
ugaaagugcagcaaagcaa

SEQ ID NO: 1418339 - RNA, 19 nt, Homo sapiens
gaggguaccugaagagaua

SEQ ID NO: 1418340 - RNA, 19 nt, Homo sapiens
gauuagagauucacaaguu

SEQ ID NO: 1418341 - RNA, 19 nt, Homo sapiens
caagaaauccuuacaggua

SEQ ID NO: 1418342 - RNA, 19 nt, Homo sapiens
cgacagaagucuccuuauu

SEQ ID NO: 1418343 - RNA, 19 nt, Homo sapiens
gaauuacgacggcuacuua

SEQ ID NO: 1418344 - RNA, 19 nt, Homo sapiens
ccaguuggcucuugagauu

SEQ ID NO: 1418345 - RNA, 19 nt, Homo sapiens
gcuaugggaugguauuauu

SEQ ID NO: 1418346 - RNA, 19 nt, Homo sapiens
gcaagccaaaucauuauua

SEQ ID NO: 1418347 - RNA, 19 nt, Homo sapiens
gaaggacaauucaguaucu

SEQ ID NO: 1418348 - RNA, 19 nt, Homo sapiens
ggaaagaauugaggaacuu

SEQ ID NO: 1418349 - RNA, 19 nt, Homo sapiens
gaacaaggcccugucucua

SEQ ID NO: 1418350 - RNA, 19 nt, Homo sapiens
gaagucuccuuauuuggaa

SEQ ID NO: 1418351 - RNA, 19 nt, Homo sapiens
gacagaagucuccuuauuu

SEQ ID NO: 1418352 - RNA, 19 nt, Homo sapiens
acagaagucuccuuauuug

SEQ ID NO: 1418353 - RNA, 19 nt, Homo sapiens
gaacuuauuccaagcuuau

SEQ ID NO: 1418354 - RNA, 19 nt, Homo sapiens
ggaacccugucucuacuaa

SEQ ID NO: 1418355 - RNA, 19 nt, Homo sapiens
uaagauugcuguugcugaa

SEQ ID NO: 1418356 - RNA, 19 nt, Homo sapiens
caacacaacuauaucuaag

SEQ ID NO: 1418357 - RNA, 19 nt, Homo sapiens
gcaacacaacuauaucuaa

SEQ ID NO: 1418358 - RNA, 19 nt, Homo sapiens
cagcugcaaugaacuguaa

SEQ ID NO: 1418359 - RNA, 19 nt, Homo sapiens
aauaacagcuacacaucua

SEQ ID NO: 1418360 - RNA, 19 nt, Homo sapiens
gaaagaauugaggaacuua

SEQ ID NO: 1418361 - RNA, 19 nt, Homo sapiens
caaaacacgugccuaagua

SEQ ID NO: 1418362 - RNA, 19 nt, Homo sapiens
uuaggauacuggagauuua

SEQ ID NO: 1418363 - RNA, 19 nt, Homo sapiens
ggagauuggugaggaaaga

SEQ ID NO: 1418364 - RNA, 19 nt, Homo sapiens
uauacuggauccuuucuuu

SEQ ID NO: 1418365 - RNA, 19 nt, Homo sapiens
uccagaagcuuugaauuaa

SEQ ID NO: 1418366 - RNA, 19 nt, Homo sapiens
gaagauguuuggaaagaac

SEQ ID NO: 1418367 - RNA, 19 nt, Homo sapiens
gcaucucucugaaacgaaa

SEQ ID NO: 1418368 - RNA, 19 nt, Homo sapiens
cagaaagucuuaauaccau

SEQ ID NO: 1418369 - RNA, 19 nt, Homo sapiens
gaaggaggcaucauuuaca

SEQ ID NO: 1418370 - RNA, 19 nt, Homo sapiens
gaagaucuuguuaucacua

SEQ ID NO: 1418371 - RNA, 19 nt, Homo sapiens
aaaugggaauccagcuuua

SEQ ID NO: 1418372 - RNA, 19 nt, Homo sapiens
gaaaagagcagaagcacuu

SEQ ID NO: 1418373 - RNA, 19 nt, Homo sapiens
ccagcuuuauguccaaaua

SEQ ID NO: 1418374 - RNA, 19 nt, Homo sapiens
guucuauacuggauccuuu

SEQ ID NO: 1418375 - RNA, 19 nt, Homo sapiens
acaaggcccugucucuauu

SEQ ID NO: 1418376 - RNA, 19 nt, Homo sapiens
acacauggcuuuacguuuu

SEQ ID NO: 1418377 - RNA, 19 nt, Homo sapiens
gaacaacuggucugguuuc

SEQ ID NO: 1418378 - RNA, 19 nt, Homo sapiens
aagaagauguuuggaaaga

SEQ ID NO: 1418379 - RNA, 19 nt, Homo sapiens
cagaagcuuugaauuaaca

SEQ ID NO: 1418380 - RNA, 19 nt, Homo sapiens
ugacauacaaggaguuuga

SEQ ID NO: 1418381 - RNA, 19 nt, Homo sapiens
agaggaagaucuuguuauc

SEQ ID NO: 1418382 - RNA, 19 nt, Homo sapiens
aaagaaggaggcaucauuu

SEQ ID NO: 1418383 - RNA, 19 nt, Homo sapiens
gcucuugagauuaauagua

SEQ ID NO: 1418384 - RNA, 19 nt, Homo sapiens
uaaaugggaauccagcuuu

SEQ ID NO: 1418385 - RNA, 19 nt, Homo sapiens
gccaaguucuaaugaauca

SEQ ID NO: 1418386 - RNA, 19 nt, Homo sapiens
ugaagcaacacaacuauau

SEQ ID NO: 1418387 - RNA, 19 nt, Homo sapiens
ccaaauaucacaguucaga

SEQ ID NO: 1418388 - RNA, 19 nt, Homo sapiens
gauccuuucuuucucuaau

SEQ ID NO: 1418389 - RNA, 19 nt, Homo sapiens
guccaaauaucacaguuca

SEQ ID NO: 1418390 - RNA, 19 nt, Homo sapiens
caagccaucucccuaccuu

SEQ ID NO: 1418391 - RNA, 19 nt, Homo sapiens
cuacacaucuacagcuuag

SEQ ID NO: 1418392 - RNA, 19 nt, Homo sapiens
gcugaacauuagagaagaa

SEQ ID NO: 1418393 - RNA, 19 nt, Homo sapiens
ggcaucauuuacagacaua

SEQ ID NO: 1418394 - RNA, 19 nt, Homo sapiens
gauacuggagauuuaauga

SEQ ID NO: 1418395 - RNA, 19 nt, Homo sapiens
gagaacuuauuccaagcuu

SEQ ID NO: 1418396 - RNA, 19 nt, Homo sapiens
gcaauaaaucaucuuacga

SEQ ID NO: 1418397 - RNA, 19 nt, Homo sapiens
gaaccaguaggaaugaaga

SEQ ID NO: 1418398 - RNA, 19 nt, Homo sapiens
cugaagagauaccgggaaa

SEQ ID NO: 1418399 - RNA, 19 nt, Homo sapiens
cagcaucucucugaaacga

SEQ ID NO: 1418400 - RNA, 19 nt, Homo sapiens
acucugagcucuucaaggu

SEQ ID NO: 1418401 - RNA, 19 nt, Homo sapiens
uacgacggcuacuuacuuu

SEQ ID NO: 1418402 - RNA, 19 nt, Homo sapiens
acacuugccuagacagaga

SEQ ID NO: 1418403 - RNA, 19 nt, Homo sapiens
agacauacaaagacuguuu

SEQ ID NO: 1418404 - RNA, 19 nt, Homo sapiens
gaacuguaaucccacuacu

SEQ ID NO: 1418405 - RNA, 19 nt, Homo sapiens
gggcugaacgggccaaguu

SEQ ID NO: 1418406 - RNA, 19 nt, Homo sapiens
guaccacucugagcucuuc

SEQ ID NO: 1418407 - RNA, 19 nt, Homo sapiens
gcccaaugccuacaaguug

SEQ ID NO: 1418408 - RNA, 19 nt, Homo sapiens
guucaucuuugccaaguuc

SEQ ID NO: 1418409 - RNA, 19 nt, Homo sapiens
gagcuuauggcgguucuuu

SEQ ID NO: 1418410 - RNA, 19 nt, Homo sapiens
gugacgcgauccugacuga

SEQ ID NO: 1418411 - RNA, 19 nt, Homo sapiens
ugaaaacucuugccaaauc

SEQ ID NO: 1418412 - RNA, 19 nt, Homo sapiens
aagcuuaugucuaccugaa

SEQ ID NO: 1418413 - RNA, 19 nt, Homo sapiens
aagaaggaggcaucauuua

SEQ ID NO: 1418414 - RNA, 19 nt, Homo sapiens
auccagaagcuuugaauua

SEQ ID NO: 1418415 - RNA, 19 nt, Homo sapiens
ggaaggacaauucaguauc

SEQ ID NO: 1418416 - RNA, 19 nt, Homo sapiens
gaaaauaacagcuacacau

SEQ ID NO: 1418417 - RNA, 19 nt, Homo sapiens
ucugagcucuucaagguau

SEQ ID NO: 1418418 - RNA, 19 nt, Homo sapiens
acauuagucucuacagguu

SEQ ID NO: 1418419 - RNA, 19 nt, Homo sapiens
uguaacaaguucuauacug

SEQ ID NO: 1418420 - RNA, 19 nt, Homo sapiens
ggacaauucaguaucuaca

SEQ ID NO: 1418421 - RNA, 19 nt, Homo sapiens
cagaagggaaggacaauuc

SEQ ID NO: 1418422 - RNA, 19 nt, Homo sapiens
ucacaguucagaaaccuuu

SEQ ID NO: 1418423 - RNA, 19 nt, Homo sapiens
gagaccaggauaugaaaug

SEQ ID NO: 1418424 - RNA, 19 nt, Homo sapiens
ggcaauaaaucaucuuacg

SEQ ID NO: 1418425 - RNA, 19 nt, Homo sapiens
gcgggaggauugcuuaaac

SEQ ID NO: 1418426 - RNA, 19 nt, Homo sapiens
gggaaggacaauucaguau

SEQ ID NO: 1418427 - RNA, 19 nt, Homo sapiens
uacuggagauuuaaugaga

SEQ ID NO: 1418428 - RNA, 19 nt, Homo sapiens
gaagcaacacaacuauauc

SEQ ID NO: 1418429 - RNA, 19 nt, Homo sapiens
aggaugcucuggucccuuu

SEQ ID NO: 1418430 - RNA, 19 nt, Homo sapiens
ugauucaccuuccauucuu

SEQ ID NO: 1418431 - RNA, 19 nt, Homo sapiens
uugaggaacuuauucauac

SEQ ID NO: 1418432 - RNA, 19 nt, Homo sapiens
accaggauaugaaaugauu

SEQ ID NO: 1418433 - RNA, 19 nt, Homo sapiens
ccauuuggauuagagauuc

SEQ ID NO: 1418434 - RNA, 19 nt, Homo sapiens
acacagaaagucuuaauac

SEQ ID NO: 1418435 - RNA, 19 nt, Homo sapiens
agaacuuauuccaagcuua

SEQ ID NO: 1418436 - RNA, 19 nt, Homo sapiens
gaagauuccaacauuaguc

SEQ ID NO: 1418437 - RNA, 19 nt, Homo sapiens
gauccugacugacuguaac

SEQ ID NO: 1418438 - RNA, 19 nt, Homo sapiens
ucuggucccuuucaagcua

SEQ ID NO: 1418439 - RNA, 19 nt, Homo sapiens
gaaagaaacuucaagaugu

SEQ ID NO: 1418440 - RNA, 19 nt, Homo sapiens
guacaucucugguauauau

SEQ ID NO: 1418441 - RNA, 19 nt, Homo sapiens
gcacagccaucgacauuaa

SEQ ID NO: 1418442 - RNA, 19 nt, Homo sapiens
gcaaagagaacacaguaua

SEQ ID NO: 1418443 - RNA, 19 nt, Homo sapiens
gagaaaagcugauaaauuc

SEQ ID NO: 1418444 - RNA, 19 nt, Homo sapiens
gcacaucucucgaguucuu

SEQ ID NO: 1418445 - RNA, 19 nt, Homo sapiens
gaacuaagccugguugaga

SEQ ID NO: 1418446 - RNA, 19 nt, Homo sapiens
ggugaaggaucaagaauau

SEQ ID NO: 1418447 - RNA, 19 nt, Homo sapiens
gcagaaagcaccugaucua

SEQ ID NO: 1418448 - RNA, 19 nt, Homo sapiens
ccaaagugcuggaauuaga

SEQ ID NO: 1418449 - RNA, 19 nt, Homo sapiens
caacauacccacucggaua

SEQ ID NO: 1418450 - RNA, 19 nt, Homo sapiens
acacauauguccucuuuga

SEQ ID NO: 1418451 - RNA, 19 nt, Homo sapiens
gauacagaaugcucuaauu

SEQ ID NO: 1418452 - RNA, 19 nt, Homo sapiens
ggaguacucuggugaagga

SEQ ID NO: 1418453 - RNA, 19 nt, Homo sapiens
gaaauaauaacaccucaga

SEQ ID NO: 1418454 - RNA, 19 nt, Homo sapiens
ccacacugauuacuacuaa

SEQ ID NO: 1418455 - RNA, 19 nt, Homo sapiens
gcugauaaauuccugagaa

SEQ ID NO: 1418456 - RNA, 19 nt, Homo sapiens
gcacagagcauugaaagga

SEQ ID NO: 1418457 - RNA, 19 nt, Homo sapiens
cuaaauauauguggcauga

SEQ ID NO: 1418458 - RNA, 19 nt, Homo sapiens
gugcuaaucuauccacaaa

SEQ ID NO: 1418459 - RNA, 19 nt, Homo sapiens
cacaacaccucuauaguga

SEQ ID NO: 1418460 - RNA, 19 nt, Homo sapiens
ucacaggccuuuauaucuu

SEQ ID NO: 1418461 - RNA, 19 nt, Homo sapiens
gaauaguguugcuuuacuu

SEQ ID NO: 1418462 - RNA, 19 nt, Homo sapiens
cauaccaccucccaaagua

SEQ ID NO: 1418463 - RNA, 19 nt, Homo sapiens
ggccauagaaauaguaaua

SEQ ID NO: 1418464 - RNA, 19 nt, Homo sapiens
ugacaaugaucaucuuaga

SEQ ID NO: 1418465 - RNA, 19 nt, Homo sapiens
ccacugcgguuaacuggaa

SEQ ID NO: 1418466 - RNA, 19 nt, Homo sapiens
gaagaucaaagaagcuaaa

SEQ ID NO: 1418467 - RNA, 19 nt, Homo sapiens
ggagaaagaaacuucaaga

SEQ ID NO: 1418468 - RNA, 19 nt, Homo sapiens
caacaccucuauagugaca

SEQ ID NO: 1418469 - RNA, 19 nt, Homo sapiens
gcacugcaaacacauauau

SEQ ID NO: 1418470 - RNA, 19 nt, Homo sapiens
ccaaauaucagucuuucuu

SEQ ID NO: 1418471 - RNA, 19 nt, Homo sapiens
ggagugauguccagagucu

SEQ ID NO: 1418472 - RNA, 19 nt, Homo sapiens
ggaauaguguugcuuuacu

SEQ ID NO: 1418473 - RNA, 19 nt, Homo sapiens
aaacauaccaccucccaaa

SEQ ID NO: 1418474 - RNA, 19 nt, Homo sapiens
ccacaacaccucuauagug

SEQ ID NO: 1418475 - RNA, 19 nt, Homo sapiens
gggauggcauugcugauau

SEQ ID NO: 1418476 - RNA, 19 nt, Homo sapiens
uauguggcaugauuuguaa

SEQ ID NO: 1418477 - RNA, 19 nt, Homo sapiens
agucacaguuggauuaauu

SEQ ID NO: 1418478 - RNA, 19 nt, Homo sapiens
gggcaaagagaacacagua

SEQ ID NO: 1418479 - RNA, 19 nt, Homo sapiens
cgacauuaaugcacugaau

SEQ ID NO: 1418480 - RNA, 19 nt, Homo sapiens
ugacgcacauuuagggaaa

SEQ ID NO: 1418481 - RNA, 19 nt, Homo sapiens
acaguuggauuaauucuuc

SEQ ID NO: 1418482 - RNA, 19 nt, Homo sapiens
ggguacaucucugguauau

SEQ ID NO: 1418483 - RNA, 19 nt, Homo sapiens
agagccauguucccauuua

SEQ ID NO: 1418484 - RNA, 19 nt, Homo sapiens
ggaagugacgcacauuuag

SEQ ID NO: 1418485 - RNA, 19 nt, Homo sapiens
agaaagaaacuucaagaug

SEQ ID NO: 1418486 - RNA, 19 nt, Homo sapiens
cauauguccucuuugaaug

SEQ ID NO: 1418487 - RNA, 19 nt, Homo sapiens
aaacuacucaccuuagaaa

SEQ ID NO: 1418488 - RNA, 19 nt, Homo sapiens
gagaacacaguauaguauu

SEQ ID NO: 1418489 - RNA, 19 nt, Homo sapiens
ggaaaagccauagaaaaua

SEQ ID NO: 1418490 - RNA, 19 nt, Homo sapiens
ugagagccauguucccauu

SEQ ID NO: 1418491 - RNA, 19 nt, Homo sapiens
caacagucacgcuggagua

SEQ ID NO: 1418492 - RNA, 19 nt, Homo sapiens
ucacaugagucgcuucaca

SEQ ID NO: 1418493 - RNA, 19 nt, Homo sapiens
caccugaaauggcuuuguu

SEQ ID NO: 1418494 - RNA, 19 nt, Homo sapiens
gagccuaucugcacaucuc

SEQ ID NO: 1418495 - RNA, 19 nt, Homo sapiens
cagcacagccaucgacauu

SEQ ID NO: 1418496 - RNA, 19 nt, Homo sapiens
gcauauagaauuccuguac

SEQ ID NO: 1418497 - RNA, 19 nt, Homo sapiens
caggaaagcaucaagguau

SEQ ID NO: 1418498 - RNA, 19 nt, Homo sapiens
ggcaugauuuguaaagugu

SEQ ID NO: 1418499 - RNA, 19 nt, Homo sapiens
aaggaauaguguugcuuua

SEQ ID NO: 1418500 - RNA, 19 nt, Homo sapiens
guacucuggugaaggauca

SEQ ID NO: 1418501 - RNA, 19 nt, Homo sapiens
ggucucagcucacuguaac

SEQ ID NO: 1418502 - RNA, 19 nt, Homo sapiens
gaggaagugacgcacauuu

SEQ ID NO: 1418503 - RNA, 19 nt, Homo sapiens
gcgguuaacuggaaaagaa

SEQ ID NO: 1418504 - RNA, 19 nt, Homo sapiens
gaacugaugagagcuguca

SEQ ID NO: 1418505 - RNA, 19 nt, Homo sapiens
gagaaagaaacuucaagau

SEQ ID NO: 1418506 - RNA, 19 nt, Homo sapiens
ccagagcacuaucacaucu

SEQ ID NO: 1418507 - RNA, 19 nt, Homo sapiens
ccaccacccugugaaguga

SEQ ID NO: 1418508 - RNA, 19 nt, Homo sapiens
gaaacuucaagauguagaa

SEQ ID NO: 1418509 - RNA, 19 nt, Homo sapiens
gagccauguucccauuuau

SEQ ID NO: 1418510 - RNA, 19 nt, Homo sapiens
caaagagaacacaguauag

SEQ ID NO: 1418511 - RNA, 19 nt, Homo sapiens
aaauaggaguggagugaug

SEQ ID NO: 1418512 - RNA, 19 nt, Homo sapiens
ugagagcugucauuuuaua

SEQ ID NO: 1418513 - RNA, 19 nt, Homo sapiens
cugauaaauuccugagaaa

SEQ ID NO: 1418514 - RNA, 19 nt, Homo sapiens
cauguucccauuuaucuuu

SEQ ID NO: 1418515 - RNA, 19 nt, Homo sapiens
cugcacaucucucgaguuc

SEQ ID NO: 1418516 - RNA, 19 nt, Homo sapiens
ggauggcauugcugauaug

SEQ ID NO: 1418517 - RNA, 19 nt, Homo sapiens
caacggaugcccagugcaa

SEQ ID NO: 1418518 - RNA, 19 nt, Homo sapiens
uaagaauucuaggucaaga

SEQ ID NO: 1418519 - RNA, 19 nt, Homo sapiens
cuccuggccugaaaucuuu

SEQ ID NO: 1418520 - RNA, 19 nt, Homo sapiens
uggauuaauucuucaguuc

SEQ ID NO: 1418521 - RNA, 19 nt, Homo sapiens
gaauuccuguacccacaug

SEQ ID NO: 1418522 - RNA, 19 nt, Homo sapiens
ucucuagccacacugauua

SEQ ID NO: 1418523 - RNA, 19 nt, Homo sapiens
guaaaguguuaugcauaug

SEQ ID NO: 1418524 - RNA, 19 nt, Homo sapiens
aagagaacacaguauagua

SEQ ID NO: 1418525 - RNA, 19 nt, Homo sapiens
ccaggaaagcaucaaggua

SEQ ID NO: 1418526 - RNA, 19 nt, Homo sapiens
gaacacauauuuucuaacc

SEQ ID NO: 1418527 - RNA, 19 nt, Homo sapiens
gggaaaagccauagaaaau

SEQ ID NO: 1418528 - RNA, 19 nt, Homo sapiens
uguggaggccauagaaaua

SEQ ID NO: 1418529 - RNA, 19 nt, Homo sapiens
ggccugaaaucuuuaaagc

SEQ ID NO: 1418530 - RNA, 19 nt, Homo sapiens
ugccucagcuucccgacua

SEQ ID NO: 1418531 - RNA, 19 nt, Homo sapiens
gcaucuaacaccaucauuc

SEQ ID NO: 1418532 - RNA, 19 nt, Homo sapiens
gcgaguaggaggagacaga

SEQ ID NO: 1418533 - RNA, 19 nt, Homo sapiens
gcagucacaguuggauuaa

SEQ ID NO: 1418534 - RNA, 19 nt, Homo sapiens
agagaacacaguauaguau

SEQ ID NO: 1418535 - RNA, 19 nt, Homo sapiens
cagcugcccuccucuuugg

SEQ ID NO: 1418536 - RNA, 19 nt, Homo sapiens
aggaagugacgcacauuua

SEQ ID NO: 1418537 - RNA, 19 nt, Homo sapiens
gcugauaugggcaaagaga

SEQ ID NO: 1418538 - RNA, 19 nt, Homo sapiens
acaaugaucaucuuagaca

SEQ ID NO: 1418539 - RNA, 19 nt, Homo sapiens
gaagagaguucacaagaca

SEQ ID NO: 1418540 - RNA, 19 nt, Homo sapiens
caaccuaaguccagaaaga

SEQ ID NO: 1418541 - RNA, 19 nt, Homo sapiens
acauuaagcuucccaauuc

SEQ ID NO: 1418542 - RNA, 19 nt, Homo sapiens
caucugaagucaccauaga

SEQ ID NO: 1418543 - RNA, 19 nt, Homo sapiens
agagaggagucccuuauug

SEQ ID NO: 1418544 - RNA, 19 nt, Homo sapiens
caaaagaaguggacaguuc

SEQ ID NO: 1418545 - RNA, 19 nt, Homo sapiens
caccauagauaacauuaag

SEQ ID NO: 1418546 - RNA, 19 nt, Homo sapiens
cagaagagaguucacaaga

SEQ ID NO: 1418547 - RNA, 19 nt, Homo sapiens
gaccuccacucuucaaaca

SEQ ID NO: 1418548 - RNA, 19 nt, Homo sapiens
gauguggcuuuguuugaga

SEQ ID NO: 1418549 - RNA, 19 nt, Homo sapiens
aaauggauguggcuuuguu

SEQ ID NO: 1418550 - RNA, 19 nt, Homo sapiens
ccuggucguuucaauauug

SEQ ID NO: 1418551 - RNA, 19 nt, Homo sapiens
ugaugggccucauaguaaa

SEQ ID NO: 1418552 - RNA, 19 nt, Homo sapiens
gaagucaccauagauaaca

SEQ ID NO: 1418553 - RNA, 19 nt, Homo sapiens
ucacaagacaguucagaga

SEQ ID NO: 1418554 - RNA, 19 nt, Homo sapiens
gaaguggacaguucagaag

SEQ ID NO: 1418555 - RNA, 19 nt, Homo sapiens
ccaccuggucguuucaaua

SEQ ID NO: 1418556 - RNA, 19 nt, Homo sapiens
agacauuucucccacagau

SEQ ID NO: 1418557 - RNA, 19 nt, Homo sapiens
ggauguggcuuuguuugag

SEQ ID NO: 1418558 - RNA, 19 nt, Homo sapiens
gauagagaggagucccuua

SEQ ID NO: 1418559 - RNA, 19 nt, Homo sapiens
ccagaaagaccuccacucu

SEQ ID NO: 1418560 - RNA, 19 nt, Homo sapiens
ggacaguucagaagagagu

SEQ ID NO: 1418561 - RNA, 19 nt, Homo sapiens
gagaggagucccuuauugg

SEQ ID NO: 1418562 - RNA, 19 nt, Homo sapiens
uugaugggccucauaguaa

SEQ ID NO: 1418563 - RNA, 19 nt, Homo sapiens
ucugaagucaccauagaua

SEQ ID NO: 1418564 - RNA, 19 nt, Homo sapiens
aaucagaagacgaagauga

SEQ ID NO: 1418565 - RNA, 19 nt, Homo sapiens
ugggacagguugcucauca

SEQ ID NO: 1418566 - RNA, 19 nt, Homo sapiens
ucaaacaguucggauagag

SEQ ID NO: 1418567 - RNA, 19 nt, Homo sapiens
gggacagguugcucaucaa

SEQ ID NO: 1418568 - RNA, 19 nt, Homo sapiens
gggccucauaguaaaguua

SEQ ID NO: 1418569 - RNA, 19 nt, Homo sapiens
cucaucaacucccaaccua

SEQ ID NO: 1418570 - RNA, 19 nt, Homo sapiens
caccuggucguuucaauau

SEQ ID NO: 1418571 - RNA, 19 nt, Homo sapiens
ggaccagguacagacauuu

SEQ ID NO: 1418572 - RNA, 19 nt, Homo sapiens
cacaagacaguucagagaa

SEQ ID NO: 1418573 - RNA, 19 nt, Homo sapiens
gacagcaucccaucugaag

SEQ ID NO: 1418574 - RNA, 19 nt, Homo sapiens
caaacaguucggauagaga

SEQ ID NO: 1418575 - RNA, 19 nt, Homo sapiens
aacauuaagcuucccaauu

SEQ ID NO: 1418576 - RNA, 19 nt, Homo sapiens
caucaacucccaaccuaag

SEQ ID NO: 1418577 - RNA, 19 nt, Homo sapiens
ccuccacucuucaaacagu

SEQ ID NO: 1418578 - RNA, 19 nt, Homo sapiens
agaagagaguucacaagac

SEQ ID NO: 1418579 - RNA, 19 nt, Homo sapiens
guggacaguucagaagaga

SEQ ID NO: 1418580 - RNA, 19 nt, Homo sapiens
gaccagguacagacauuuc

SEQ ID NO: 1418581 - RNA, 19 nt, Homo sapiens
uagagaggagucccuuauu

SEQ ID NO: 1418582 - RNA, 19 nt, Homo sapiens
cagcaucccaucugaaguc

SEQ ID NO: 1418583 - RNA, 19 nt, Homo sapiens
agaaguggacaguucagaa

SEQ ID NO: 1418584 - RNA, 19 nt, Homo sapiens
gcaaaugaaaagcuaagaa

SEQ ID NO: 1418585 - RNA, 19 nt, Homo sapiens
agaaucagaagacgaagau

SEQ ID NO: 1418586 - RNA, 19 nt, Homo sapiens
uggaccagguacagacauu

SEQ ID NO: 1418587 - RNA, 19 nt, Homo sapiens
gaaaaggcaagauugaagu

SEQ ID NO: 1418588 - RNA, 19 nt, Homo sapiens
uaacauuaagcuucccaau

SEQ ID NO: 1418589 - RNA, 19 nt, Homo sapiens
uggcuuuguuugagaugaa

SEQ ID NO: 1418590 - RNA, 19 nt, Homo sapiens
ggaaaaggcaagauugaag

SEQ ID NO: 1418591 - RNA, 19 nt, Homo sapiens
cugaagucaccauagauaa

SEQ ID NO: 1418592 - RNA, 19 nt, Homo sapiens
auugaugggccucauagua

SEQ ID NO: 1418593 - RNA, 19 nt, Homo sapiens
aaaggcaagauugaaguuu

SEQ ID NO: 1418594 - RNA, 19 nt, Homo sapiens
ugacagcaucccaucugaa

SEQ ID NO: 1418595 - RNA, 19 nt, Homo sapiens
ucagucggauucaaaagaa

SEQ ID NO: 1418596 - RNA, 19 nt, Homo sapiens
gauggcacgggcaaaugaa

SEQ ID NO: 1418597 - RNA, 19 nt, Homo sapiens
uuaagcuucccaauucuga

SEQ ID NO: 1418598 - RNA, 19 nt, Homo sapiens
auagagaggagucccuuau

SEQ ID NO: 1418599 - RNA, 19 nt, Homo sapiens
agaggagucccuuauugga

SEQ ID NO: 1418600 - RNA, 19 nt, Homo sapiens
aaacauugaugggccucau

SEQ ID NO: 1418601 - RNA, 19 nt, Homo sapiens
cauuaagcuucccaauucu

SEQ ID NO: 1418602 - RNA, 19 nt, Homo sapiens
cagaaucagaagacgaaga

SEQ ID NO: 1418603 - RNA, 19 nt, Homo sapiens
agauggcacgggcaaauga

SEQ ID NO: 1418604 - RNA, 19 nt, Homo sapiens
ucacagaccucucauuuau

SEQ ID NO: 1418605 - RNA, 19 nt, Homo sapiens
caucuauacugacaaguua

SEQ ID NO: 1418606 - RNA, 19 nt, Homo sapiens
gugaaagucugcaucauug

SEQ ID NO: 1418607 - RNA, 19 nt, Homo sapiens
ggccuucucugacagcaua

SEQ ID NO: 1418608 - RNA, 19 nt, Homo sapiens
ggcgugagcucuacuacuu

SEQ ID NO: 1418609 - RNA, 19 nt, Homo sapiens
gaccaaggaugacuuugug

SEQ ID NO: 1418610 - RNA, 19 nt, Homo sapiens
ggacaaagugggcgaacaa

SEQ ID NO: 1418611 - RNA, 19 nt, Homo sapiens
ggugaaagucugcaucauu

SEQ ID NO: 1418612 - RNA, 19 nt, Homo sapiens
acagaccucucauuuaugu

SEQ ID NO: 1418613 - RNA, 19 nt, Homo sapiens
acgaauggcugaccaagga

SEQ ID NO: 1418614 - RNA, 19 nt, Homo sapiens
ggaaccugcuggccaaaca

SEQ ID NO: 1418615 - RNA, 19 nt, Homo sapiens
ugugacagauuucauccua

SEQ ID NO: 1418616 - RNA, 19 nt, Homo sapiens
gauuauuuccgcaucuaua

SEQ ID NO: 1418617 - RNA, 19 nt, Homo sapiens
ccucacagaccucucauuu

SEQ ID NO: 1418618 - RNA, 19 nt, Homo sapiens
ugaaggugauuaaugugaa

SEQ ID NO: 1418619 - RNA, 19 nt, Homo sapiens
cuacaacccuggccuggau

SEQ ID NO: 1418620 - RNA, 19 nt, Homo sapiens
gcauaaggcgugagcucua

SEQ ID NO: 1418621 - RNA, 19 nt, Homo sapiens
ugacagauuucauccuaag

SEQ ID NO: 1418622 - RNA, 19 nt, Homo sapiens
ggagggaucccagaaacuu

SEQ ID NO: 1418623 - RNA, 19 nt, Homo sapiens
gaggagggaucccagaaac

SEQ ID NO: 1418624 - RNA, 19 nt, Homo sapiens
gcaucuauacugacaaguu

SEQ ID NO: 1418625 - RNA, 19 nt, Homo sapiens
gcuacugcgucuccaaguu

SEQ ID NO: 1418626 - RNA, 19 nt, Homo sapiens
ggacagcuacggagaggau

SEQ ID NO: 1418627 - RNA, 19 nt, Homo sapiens
guugaggccuucucugaca

SEQ ID NO: 1418628 - RNA, 19 nt, Homo sapiens
gaaggugauuaaugugaac

SEQ ID NO: 1418629 - RNA, 19 nt, Homo sapiens
gcccaguggucccaacgaa

SEQ ID NO: 1418630 - RNA, 19 nt, Homo sapiens
cuacggagaggauuauuuc

SEQ ID NO: 1418631 - RNA, 19 nt, Homo sapiens
cgugagcucuacuacuuug

SEQ ID NO: 1418632 - RNA, 19 nt, Homo sapiens
cuacugcgucuccaaguuu

SEQ ID NO: 1418633 - RNA, 19 nt, Homo sapiens
caagaacugcaaucugguu

SEQ ID NO: 1418634 - RNA, 19 nt, Homo sapiens
gugacagauuucauccuaa

SEQ ID NO: 1418635 - RNA, 19 nt, Homo sapiens
gcuacggagaggauuauuu

SEQ ID NO: 1418636 - RNA, 19 nt, Homo sapiens
ucacgcaugcgaaagcuuu

SEQ ID NO: 1418637 - RNA, 19 nt, Homo sapiens
gcguugaggccuucucuga

SEQ ID NO: 1418638 - RNA, 19 nt, Homo sapiens
gcagaccacccuacuggau

SEQ ID NO: 1418639 - RNA, 19 nt, Homo sapiens
gaaagucugcaucauugag

SEQ ID NO: 1418640 - RNA, 19 nt, Homo sapiens
gugaaggugauuaauguga

SEQ ID NO: 1418641 - RNA, 19 nt, Homo sapiens
ccaaggaugacuuugugaa

SEQ ID NO: 1418642 - RNA, 19 nt, Homo sapiens
ccaguggucccaacgaaug

SEQ ID NO: 1418643 - RNA, 19 nt, Homo sapiens
uugugaaggugauuaaugu

SEQ ID NO: 1418644 - RNA, 19 nt, Homo sapiens
gaggauuauuuccgcaucu

SEQ ID NO: 1418645 - RNA, 19 nt, Homo sapiens
cuacaucccucuggcuaag

SEQ ID NO: 1418646 - RNA, 19 nt, Homo sapiens
gaacuaucggacagccauu

SEQ ID NO: 1418647 - RNA, 19 nt, Homo sapiens
gaaccuggugggacugauc

SEQ ID NO: 1418648 - RNA, 19 nt, Homo sapiens
ugaccaaggaugacuuugu

SEQ ID NO: 1418649 - RNA, 19 nt, Homo sapiens
gcugaccaaggaugacuuu

SEQ ID NO: 1418650 - RNA, 19 nt, Homo sapiens
ucauugagccagggaacua

SEQ ID NO: 1418651 - RNA, 19 nt, Homo sapiens
auguaucgcugguucaaga

SEQ ID NO: 1418652 - RNA, 19 nt, Homo sapiens
agaccucucauuuauguau

SEQ ID NO: 1418653 - RNA, 19 nt, Homo sapiens
ucugggcccuggugaacaa

SEQ ID NO: 1418654 - RNA, 19 nt, Homo sapiens
agaccacccuacuggaugu

SEQ ID NO: 1418655 - RNA, 19 nt, Homo sapiens
gagcccagagucagagaug

SEQ ID NO: 1418656 - RNA, 19 nt, Homo sapiens
cagaaacuucagcgggaua

SEQ ID NO: 1418657 - RNA, 19 nt, Homo sapiens
cauaaggcgugagcucuac

SEQ ID NO: 1418658 - RNA, 19 nt, Homo sapiens
caaggaugacuuugugaag

SEQ ID NO: 1418659 - RNA, 19 nt, Homo sapiens
gaugucaccaagagcgaaa

SEQ ID NO: 1418660 - RNA, 19 nt, Homo sapiens
ccgcaucuauacugacaag

SEQ ID NO: 1418661 - RNA, 19 nt, Homo sapiens
ugaggagggaucccagaaa

SEQ ID NO: 1418662 - RNA, 19 nt, Homo sapiens
cuaagccgguaccuuccaa

SEQ ID NO: 1418663 - RNA, 19 nt, Homo sapiens
ggagcaugcuauuguuucc

SEQ ID NO: 1418664 - RNA, 19 nt, Homo sapiens
cucacagaccucucauuua

SEQ ID NO: 1418665 - RNA, 19 nt, Homo sapiens
gggacaaagugggcgaaca

SEQ ID NO: 1418666 - RNA, 19 nt, Homo sapiens
caagagcgaaagcaucaag

SEQ ID NO: 1418667 - RNA, 19 nt, Homo sapiens
ucagcgggauaccuccuau

SEQ ID NO: 1418668 - RNA, 19 nt, Homo sapiens
acaucccucuggcuaaguu

SEQ ID NO: 1418669 - RNA, 19 nt, Homo sapiens
ggauuauuuccgcaucuau

SEQ ID NO: 1418670 - RNA, 19 nt, Homo sapiens
acagcuacggagaggauua

SEQ ID NO: 1418671 - RNA, 19 nt, Homo sapiens
ugaaagucugcaucauuga

SEQ ID NO: 1418672 - RNA, 19 nt, Homo sapiens
aggauuauuuccgcaucua

SEQ ID NO: 1418673 - RNA, 19 nt, Homo sapiens
gaccucucauuuauguauc

SEQ ID NO: 1418674 - RNA, 19 nt, Homo sapiens
uaaggcgugagcucuacua

SEQ ID NO: 1418675 - RNA, 19 nt, Homo sapiens
gcgugagcucuacuacuuu

SEQ ID NO: 1418676 - RNA, 19 nt, Homo sapiens
gagggaucccagaaacuuc

SEQ ID NO: 1418677 - RNA, 19 nt, Homo sapiens
gaacggagcuucaguaaua

SEQ ID NO: 1418678 - RNA, 19 nt, Homo sapiens
cagcagauauuccuaguua

SEQ ID NO: 1418679 - RNA, 19 nt, Homo sapiens
ugaagaaacugcaacaauu

SEQ ID NO: 1418680 - RNA, 19 nt, Homo sapiens
gagagagaaucuuauguuu

SEQ ID NO: 1418681 - RNA, 19 nt, Homo sapiens
ggaaagaaaggacagauuu

SEQ ID NO: 1418682 - RNA, 19 nt, Homo sapiens
ugaaggaccuggaaugaaa

SEQ ID NO: 1418683 - RNA, 19 nt, Homo sapiens
uaaauaugcuucccucauu

SEQ ID NO: 1418684 - RNA, 19 nt, Homo sapiens
gaaacacagucggcaauaa

SEQ ID NO: 1418685 - RNA, 19 nt, Homo sapiens
ccacaggcccuauguauuu

SEQ ID NO: 1418686 - RNA, 19 nt, Homo sapiens
gaagaaacugcaacaauug

SEQ ID NO: 1418687 - RNA, 19 nt, Homo sapiens
guacgugucuucagaaagu

SEQ ID NO: 1418688 - RNA, 19 nt, Homo sapiens
gaacagugcaggaaguauu

SEQ ID NO: 1418689 - RNA, 19 nt, Homo sapiens
gaaauacacaugugagaug

SEQ ID NO: 1418690 - RNA, 19 nt, Homo sapiens
acaaugaacuacugcauga

SEQ ID NO: 1418691 - RNA, 19 nt, Homo sapiens
gcagauauuccuaguuauu

SEQ ID NO: 1418692 - RNA, 19 nt, Homo sapiens
gcaaucaugucuuuacaag

SEQ ID NO: 1418693 - RNA, 19 nt, Homo sapiens
aaacugaacuggaccaaag

SEQ ID NO: 1418694 - RNA, 19 nt, Homo sapiens
gaggaugacguguucuuua

SEQ ID NO: 1418695 - RNA, 19 nt, Homo sapiens
ggacucagaugucagugau

SEQ ID NO: 1418696 - RNA, 19 nt, Homo sapiens
caaagaugauagcccauug

SEQ ID NO: 1418697 - RNA, 19 nt, Homo sapiens
caggagaccucaccuagau

SEQ ID NO: 1418698 - RNA, 19 nt, Homo sapiens
ggaagcuacuuaacacuag

SEQ ID NO: 1418699 - RNA, 19 nt, Homo sapiens
ggacacauagacugaauga

SEQ ID NO: 1418700 - RNA, 19 nt, Homo sapiens
ucaccuagaugccuauuca

SEQ ID NO: 1418701 - RNA, 19 nt, Homo sapiens
cagugaagcugauguggaa

SEQ ID NO: 1418702 - RNA, 19 nt, Homo sapiens
uuucagagcuuuguaaaug

SEQ ID NO: 1418703 - RNA, 19 nt, Homo sapiens
acacauagacugaaugaga

SEQ ID NO: 1418704 - RNA, 19 nt, Homo sapiens
gagagacgcaugcauguga

SEQ ID NO: 1418705 - RNA, 19 nt, Homo sapiens
ugaaugagaccaaaggaaa

SEQ ID NO: 1418706 - RNA, 19 nt, Homo sapiens
aaacaaguccucuuuagau

SEQ ID NO: 1418707 - RNA, 19 nt, Homo sapiens
caacuugccagcagauauu

SEQ ID NO: 1418708 - RNA, 19 nt, Homo sapiens
ggacagauuuucaggaaga

SEQ ID NO: 1418709 - RNA, 19 nt, Homo sapiens
gaacuggaccaaagaugau

SEQ ID NO: 1418710 - RNA, 19 nt, Homo sapiens
caggaaguauuucagcaaa

SEQ ID NO: 1418711 - RNA, 19 nt, Homo sapiens
acaacgcaaucaugucuuu

SEQ ID NO: 1418712 - RNA, 19 nt, Homo sapiens
cuacaggacuccaaauuuu

SEQ ID NO: 1418713 - RNA, 19 nt, Homo sapiens
aaacacagucggcaauaaa

SEQ ID NO: 1418714 - RNA, 19 nt, Homo sapiens
aaacaacuuucagagcuuu

SEQ ID NO: 1418715 - RNA, 19 nt, Homo sapiens
gagcccaguuacauaaaga

SEQ ID NO: 1418716 - RNA, 19 nt, Homo sapiens
agaggaagaugggaaagaa

SEQ ID NO: 1418717 - RNA, 19 nt, Homo sapiens
ccaagagccuuuuauuuga

SEQ ID NO: 1418718 - RNA, 19 nt, Homo sapiens
ccuagaaacaccaucauuu

SEQ ID NO: 1418719 - RNA, 19 nt, Homo sapiens
gaaaaugaguuacuaaagc

SEQ ID NO: 1418720 - RNA, 19 nt, Homo sapiens
ggaaaagcuuaacauacua

SEQ ID NO: 1418721 - RNA, 19 nt, Homo sapiens
caaguccucuuuagauuuu

SEQ ID NO: 1418722 - RNA, 19 nt, Homo sapiens
agugggaccugccauauug

SEQ ID NO: 1418723 - RNA, 19 nt, Homo sapiens
guggcgaggugauggagua

SEQ ID NO: 1418724 - RNA, 19 nt, Homo sapiens
gaagauugcagcauuacca

SEQ ID NO: 1418725 - RNA, 19 nt, Homo sapiens
ucgguugccucgaguaauu

SEQ ID NO: 1418726 - RNA, 19 nt, Homo sapiens
caugugaggaagcuacuua

SEQ ID NO: 1418727 - RNA, 19 nt, Homo sapiens
cuaguuauuugucaucuca

SEQ ID NO: 1418728 - RNA, 19 nt, Homo sapiens
gaucauagccgugguuugc

SEQ ID NO: 1418729 - RNA, 19 nt, Homo sapiens
gcucauauaagaauaccuu

SEQ ID NO: 1418730 - RNA, 19 nt, Homo sapiens
aacaaguccucuuuagauu

SEQ ID NO: 1418731 - RNA, 19 nt, Homo sapiens
gagcuucaguaauauaucg

SEQ ID NO: 1418732 - RNA, 19 nt, Homo sapiens
gauagcccauuggugguaa

SEQ ID NO: 1418733 - RNA, 19 nt, Homo sapiens
caaaugcaacucugacugu

SEQ ID NO: 1418734 - RNA, 19 nt, Homo sapiens
cagauggcuuuguguguga

SEQ ID NO: 1418735 - RNA, 19 nt, Homo sapiens
uaacauacuaccucaagug

SEQ ID NO: 1418736 - RNA, 19 nt, Homo sapiens
gcgaacggagcuucaguaa

SEQ ID NO: 1418737 - RNA, 19 nt, Homo sapiens
ucagugaugcugggaaaua

SEQ ID NO: 1418738 - RNA, 19 nt, Homo sapiens
gggagaaacagccguccua

SEQ ID NO: 1418739 - RNA, 19 nt, Homo sapiens
cauacuaccucaagugaac

SEQ ID NO: 1418740 - RNA, 19 nt, Homo sapiens
gaaagaaaggacagauuuu

SEQ ID NO: 1418741 - RNA, 19 nt, Homo sapiens
aggaugacguguucuuuau

SEQ ID NO: 1418742 - RNA, 19 nt, Homo sapiens
gcccgaggaugacguguuc

SEQ ID NO: 1418743 - RNA, 19 nt, Homo sapiens
ucacugguuuggaugcauu

SEQ ID NO: 1418744 - RNA, 19 nt, Homo sapiens
gcgaggugauggaguauac

SEQ ID NO: 1418745 - RNA, 19 nt, Homo sapiens
gaucacgguucagccagaa

SEQ ID NO: 1418746 - RNA, 19 nt, Homo sapiens
agagagagaaucuuauguu

SEQ ID NO: 1418747 - RNA, 19 nt, Homo sapiens
gggaaagaaaggacagauu

SEQ ID NO: 1418748 - RNA, 19 nt, Homo sapiens
ggaaauacacaugugagau

SEQ ID NO: 1418749 - RNA, 19 nt, Homo sapiens
gcaggaaguauuucagcaa

SEQ ID NO: 1418750 - RNA, 19 nt, Homo sapiens
gaugacguguucuuuaucg

SEQ ID NO: 1418751 - RNA, 19 nt, Homo sapiens
gccaagagccuuuuauuug

SEQ ID NO: 1418752 - RNA, 19 nt, Homo sapiens
uaguuacucucacaaugaa

SEQ ID NO: 1418753 - RNA, 19 nt, Homo sapiens
gaagcuacuuaacacuagu

SEQ ID NO: 1418754 - RNA, 19 nt, Homo sapiens
acacaaggcggaggaauga

SEQ ID NO: 1418755 - RNA, 19 nt, Homo sapiens
gaaacgugcgccucagugu

SEQ ID NO: 1418756 - RNA, 19 nt, Homo sapiens
guaaauaugcuucccucau

SEQ ID NO: 1418757 - RNA, 19 nt, Homo sapiens
gaagaugggaaagaaagga

SEQ ID NO: 1418758 - RNA, 19 nt, Homo sapiens
ugaggaagcuacuuaacac

SEQ ID NO: 1418759 - RNA, 19 nt, Homo sapiens
caauagcagugaagcugau

SEQ ID NO: 1418760 - RNA, 19 nt, Homo sapiens
ggguacgugucuucagaaa

SEQ ID NO: 1418761 - RNA, 19 nt, Homo sapiens
ugaacuggaccaaagauga

SEQ ID NO: 1418762 - RNA, 19 nt, Homo sapiens
gaaacagccguccuacagu

SEQ ID NO: 1418763 - RNA, 19 nt, Homo sapiens
ugucaucuccaaucacuuu

SEQ ID NO: 1418764 - RNA, 19 nt, Homo sapiens
ggaaauaucagugugucau

SEQ ID NO: 1418765 - RNA, 19 nt, Homo sapiens
cuaguuacucucacaauga

SEQ ID NO: 1418766 - RNA, 19 nt, Homo sapiens
uguggguggucaucauaua

SEQ ID NO: 1418767 - RNA, 19 nt, Homo sapiens
ucagaacagugcaggaagu

SEQ ID NO: 1418768 - RNA, 19 nt, Homo sapiens
gaaauaucagugugucauc

SEQ ID NO: 1418769 - RNA, 19 nt, Homo sapiens
gcaauaaaagguuccaauu

SEQ ID NO: 1418770 - RNA, 19 nt, Homo sapiens
cuauguauuugaagggaaa

SEQ ID NO: 1418771 - RNA, 19 nt, Homo sapiens
ggaccugccauauugacaa

SEQ ID NO: 1418772 - RNA, 19 nt, Homo sapiens
gcugggaaauacacaugug

SEQ ID NO: 1418773 - RNA, 19 nt, Homo sapiens
gcucagaacagugcaggaa

SEQ ID NO: 1418774 - RNA, 19 nt, Homo sapiens
aaauaugcuucccucauuc

SEQ ID NO: 1418775 - RNA, 19 nt, Homo sapiens
acaaguccucuuuagauuu

SEQ ID NO: 1418776 - RNA, 19 nt, Homo sapiens
caaugaaggaccuggaaug

SEQ ID NO: 1418777 - RNA, 19 nt, Homo sapiens
gaggagagcugcagauuuc

SEQ ID NO: 1418778 - RNA, 19 nt, Homo sapiens
caaaggagcuugguaagug

SEQ ID NO: 1418779 - RNA, 19 nt, Homo sapiens
gcugcuauuugaacuauua

SEQ ID NO: 1418780 - RNA, 19 nt, Homo sapiens
gaaaguggaagaugugaaa

SEQ ID NO: 1418781 - RNA, 19 nt, Homo sapiens
gaacaggcaagacuuuaaa

SEQ ID NO: 1418782 - RNA, 19 nt, Homo sapiens
ucagagugcuuauauauag

SEQ ID NO: 1418783 - RNA, 19 nt, Homo sapiens
gcauaagagucauuugaga

SEQ ID NO: 1418784 - RNA, 19 nt, Homo sapiens
ugaaagcucuggucaagau

SEQ ID NO: 1418785 - RNA, 19 nt, Homo sapiens
caaauaguaucaccugcuu

SEQ ID NO: 1418786 - RNA, 19 nt, Homo sapiens
guaugucgcuugucauuca

SEQ ID NO: 1418787 - RNA, 19 nt, Homo sapiens
gaaccuuguuaaagagaaa

SEQ ID NO: 1418788 - RNA, 19 nt, Homo sapiens
ggagagcgccagaguaaug

SEQ ID NO: 1418789 - RNA, 19 nt, Homo sapiens
gcacuggugucuaucaaag

SEQ ID NO: 1418790 - RNA, 19 nt, Homo sapiens
ucagcaaucuucuaaacaa

SEQ ID NO: 1418791 - RNA, 19 nt, Homo sapiens
ggaagccacuaggagauuu

SEQ ID NO: 1418792 - RNA, 19 nt, Homo sapiens
gaucaugguuguauguaag

SEQ ID NO: 1418793 - RNA, 19 nt, Homo sapiens
gauugagacuaaagacuga

SEQ ID NO: 1418794 - RNA, 19 nt, Homo sapiens
cauguugccuggauugauu

SEQ ID NO: 1418795 - RNA, 19 nt, Homo sapiens
caggguacuucacaccuua

SEQ ID NO: 1418796 - RNA, 19 nt, Homo sapiens
acacagacuuugguaauau

SEQ ID NO: 1418797 - RNA, 19 nt, Homo sapiens
ggcugaaccuuguuaaaga

SEQ ID NO: 1418798 - RNA, 19 nt, Homo sapiens
ugaaggcauuggagucuuu

SEQ ID NO: 1418799 - RNA, 19 nt, Homo sapiens
gaccaugugucccaucuca

SEQ ID NO: 1418800 - RNA, 19 nt, Homo sapiens
gagaacaggcaagacuuua

SEQ ID NO: 1418801 - RNA, 19 nt, Homo sapiens
gcaaucuucuaaacaaagu

SEQ ID NO: 1418802 - RNA, 19 nt, Homo sapiens
ggaggagagcugcagauuu

SEQ ID NO: 1418803 - RNA, 19 nt, Homo sapiens
ggccuuugcugcaggaauu

SEQ ID NO: 1418804 - RNA, 19 nt, Homo sapiens
uacagaaacucacaaaugg

SEQ ID NO: 1418805 - RNA, 19 nt, Homo sapiens
uuacagagucuucauuuga

SEQ ID NO: 1418806 - RNA, 19 nt, Homo sapiens
guggagagcgccagaguaa

SEQ ID NO: 1418807 - RNA, 19 nt, Homo sapiens
gggcuucuccguuuguuaa

SEQ ID NO: 1418808 - RNA, 19 nt, Homo sapiens
uuacagaaacucacaaaug

SEQ ID NO: 1418809 - RNA, 19 nt, Homo sapiens
cacacagacuuugguaaua

SEQ ID NO: 1418810 - RNA, 19 nt, Homo sapiens
aaauggagauugcaaaguc

SEQ ID NO: 1418811 - RNA, 19 nt, Homo sapiens
gaagagaaaguggaagaug

SEQ ID NO: 1418812 - RNA, 19 nt, Homo sapiens
guacuucacaccuuaccua

SEQ ID NO: 1418813 - RNA, 19 nt, Homo sapiens
agccauaucucacuguaaa

SEQ ID NO: 1418814 - RNA, 19 nt, Homo sapiens
cacugaaacuugcauguug

SEQ ID NO: 1418815 - RNA, 19 nt, Homo sapiens
cauaaugggcuuguucuuu

SEQ ID NO: 1418816 - RNA, 19 nt, Homo sapiens
ccgcaguacuugcugauug

SEQ ID NO: 1418817 - RNA, 19 nt, Homo sapiens
cagcaaucuucuaaacaaa

SEQ ID NO: 1418818 - RNA, 19 nt, Homo sapiens
ucaccgacauguucaagau

SEQ ID NO: 1418819 - RNA, 19 nt, Homo sapiens
guaguaaacacauuucauc

SEQ ID NO: 1418820 - RNA, 19 nt, Homo sapiens
cuggauugauuucuucuuu

SEQ ID NO: 1418821 - RNA, 19 nt, Homo sapiens
gcacugagaacaggcaaga

SEQ ID NO: 1418822 - RNA, 19 nt, Homo sapiens
aagagaaaguggaagaugu

SEQ ID NO: 1418823 - RNA, 19 nt, Homo sapiens
aaugugaacuugagcuguu

SEQ ID NO: 1418824 - RNA, 19 nt, Homo sapiens
cguccaaccuggugcuauu

SEQ ID NO: 1418825 - RNA, 19 nt, Homo sapiens
gagcuacccuccugcuuuu

SEQ ID NO: 1418826 - RNA, 19 nt, Homo sapiens
auuaacggcugcuauuuga

SEQ ID NO: 1418827 - RNA, 19 nt, Homo sapiens
ggucaagauugucccuguu

SEQ ID NO: 1418828 - RNA, 19 nt, Homo sapiens
cagcagaacgucagcuuug

SEQ ID NO: 1418829 - RNA, 19 nt, Homo sapiens
gaguaugucgcuugucauu

SEQ ID NO: 1418830 - RNA, 19 nt, Homo sapiens
gagcugcagauuucgagua

SEQ ID NO: 1418831 - RNA, 19 nt, Homo sapiens
cugcagauuucgaguaugu

SEQ ID NO: 1418832 - RNA, 19 nt, Homo sapiens
ucacacagacuuugguaau

SEQ ID NO: 1418833 - RNA, 19 nt, Homo sapiens
agcgagaucuuugcaagua

SEQ ID NO: 1418834 - RNA, 19 nt, Homo sapiens
gagaaaaccauuaaucaga

SEQ ID NO: 1418835 - RNA, 19 nt, Homo sapiens
ugaucaugguuguauguaa

SEQ ID NO: 1418836 - RNA, 19 nt, Homo sapiens
gaacgucagcuuugucacu

SEQ ID NO: 1418837 - RNA, 19 nt, Homo sapiens
uugguacgauugagacuaa

SEQ ID NO: 1418838 - RNA, 19 nt, Homo sapiens
cacagacuuugguaauauu

SEQ ID NO: 1418839 - RNA, 19 nt, Homo sapiens
aaacuggucgaucccauuu

SEQ ID NO: 1418840 - RNA, 19 nt, Homo sapiens
caaaugcagacaacauaug

SEQ ID NO: 1418841 - RNA, 19 nt, Homo sapiens
gcuucuccguuuguuaaua

SEQ ID NO: 1418842 - RNA, 19 nt, Homo sapiens
ucagcuuugucacugguua

SEQ ID NO: 1418843 - RNA, 19 nt, Homo sapiens
gucagaugcugcaaggauu

SEQ ID NO: 1418844 - RNA, 19 nt, Homo sapiens
ucgaguaugucgcuuguca

SEQ ID NO: 1418845 - RNA, 19 nt, Homo sapiens
caggcaagacuuuaaauuc

SEQ ID NO: 1418846 - RNA, 19 nt, Homo sapiens
cuucacaccuuaccuaguc

SEQ ID NO: 1418847 - RNA, 19 nt, Homo sapiens
uaaggcaaggcaugcauaa

SEQ ID NO: 1418848 - RNA, 19 nt, Homo sapiens
ggucagaugcugcaaggau

SEQ ID NO: 1418849 - RNA, 19 nt, Homo sapiens
ggagcgauccugucguuag

SEQ ID NO: 1418850 - RNA, 19 nt, Homo sapiens
cagaagagaaaguggaaga

SEQ ID NO: 1418851 - RNA, 19 nt, Homo sapiens
gucagagugcuuauauaua

SEQ ID NO: 1418852 - RNA, 19 nt, Homo sapiens
ggcaaggcaugcauaagag

SEQ ID NO: 1418853 - RNA, 19 nt, Homo sapiens
uuaguuggcaucccaguuu

SEQ ID NO: 1418854 - RNA, 19 nt, Homo sapiens
gaaacucacaaauggagau

SEQ ID NO: 1418855 - RNA, 19 nt, Homo sapiens
ugagaacaggcaagacuuu

SEQ ID NO: 1418856 - RNA, 19 nt, Homo sapiens
gcgagaucuuugcaaguau

SEQ ID NO: 1418857 - RNA, 19 nt, Homo sapiens
caccuuaccuagucagagu

SEQ ID NO: 1418858 - RNA, 19 nt, Homo sapiens
gcgccgaccagguuaaaga

SEQ ID NO: 1418859 - RNA, 19 nt, Homo sapiens
ugauuuaggcugguaguaa

SEQ ID NO: 1418860 - RNA, 19 nt, Homo sapiens
cugcaaggauuuuacauaa

SEQ ID NO: 1418861 - RNA, 19 nt, Homo sapiens
gagcgauccugucguuagg

SEQ ID NO: 1418862 - RNA, 19 nt, Homo sapiens
auaaugggcuuguucuuuu

SEQ ID NO: 1418863 - RNA, 19 nt, Homo sapiens
gcugaaccuuguuaaagag

SEQ ID NO: 1418864 - RNA, 19 nt, Homo sapiens
ugugaaagcucuggucaag

SEQ ID NO: 1418865 - RNA, 19 nt, Homo sapiens
uagucagagugcuuauaua

SEQ ID NO: 1418866 - RNA, 19 nt, Homo sapiens
gagaccaugugucccaucu

SEQ ID NO: 1418867 - RNA, 19 nt, Homo sapiens
gcugguaguaaacacauuu

SEQ ID NO: 1418868 - RNA, 19 nt, Homo sapiens
gcucuugccauguucuuug

SEQ ID NO: 1418869 - RNA, 19 nt, Homo sapiens
uaaaaugucugacuucacu

SEQ ID NO: 1418870 - RNA, 19 nt, Homo sapiens
cgagaucuuugcaaguauc

SEQ ID NO: 1418871 - RNA, 19 nt, Homo sapiens
gaggauuccagaaauuuca

SEQ ID NO: 1418872 - RNA, 19 nt, Homo sapiens
ccaaaugcagacaacauau

SEQ ID NO: 1418873 - RNA, 19 nt, Homo sapiens
gauuucuucuuucccucua

SEQ ID NO: 1418874 - RNA, 19 nt, Homo sapiens
caaacuggucgaucccauu

SEQ ID NO: 1418875 - RNA, 19 nt, Homo sapiens
aaagacugaucaugguugu

SEQ ID NO: 1418876 - RNA, 19 nt, Homo sapiens
agucagagugcuuauauau

SEQ ID NO: 1418877 - RNA, 19 nt, Homo sapiens
gauagugacucuuggcaaa

SEQ ID NO: 1418878 - RNA, 19 nt, Homo sapiens
ggaugucaauguuuacaaa

SEQ ID NO: 1418879 - RNA, 19 nt, Homo sapiens
gaacaaggcagaucucucu

SEQ ID NO: 1418880 - RNA, 19 nt, Homo sapiens
gagaauacuuacagcaaga

SEQ ID NO: 1418881 - RNA, 19 nt, Homo sapiens
cugcauagcuuccaaguca

SEQ ID NO: 1418882 - RNA, 19 nt, Homo sapiens
guuaugugcuuguguauuc

SEQ ID NO: 1418883 - RNA, 19 nt, Homo sapiens
caaggcaucuucaccaaag

SEQ ID NO: 1418884 - RNA, 19 nt, Homo sapiens
gccuggaugucaauguuua

SEQ ID NO: 1418885 - RNA, 19 nt, Homo sapiens
ccucauguuugcacacuuu

SEQ ID NO: 1418886 - RNA, 19 nt, Homo sapiens
gagagaaucagcugacuca

SEQ ID NO: 1418887 - RNA, 19 nt, Homo sapiens
ggacuucacggguaugguu

SEQ ID NO: 1418888 - RNA, 19 nt, Homo sapiens
cuacaguggagaauacuua

SEQ ID NO: 1418889 - RNA, 19 nt, Homo sapiens
cagcagggcaggaugagua

SEQ ID NO: 1418890 - RNA, 19 nt, Homo sapiens
cgacauuuauggagucauc

SEQ ID NO: 1418891 - RNA, 19 nt, Homo sapiens
ucugucaccucucugcaua

SEQ ID NO: 1418892 - RNA, 19 nt, Homo sapiens
caaagaugaguuucaccua

SEQ ID NO: 1418893 - RNA, 19 nt, Homo sapiens
gaauacuuacagcaagaua

SEQ ID NO: 1418894 - RNA, 19 nt, Homo sapiens
agacaucuuuggcacauca

SEQ ID NO: 1418895 - RNA, 19 nt, Homo sapiens
gaugaauucuguuauaacc

SEQ ID NO: 1418896 - RNA, 19 nt, Homo sapiens
ggaaagaagcuggcagagu

SEQ ID NO: 1418897 - RNA, 19 nt, Homo sapiens
ucaccucucugcauagcuu

SEQ ID NO: 1418898 - RNA, 19 nt, Homo sapiens
ccaaagucauccaggagau

SEQ ID NO: 1418899 - RNA, 19 nt, Homo sapiens
cguuagacgugcuguguug

SEQ ID NO: 1418900 - RNA, 19 nt, Homo sapiens
gcauagcuuccaagucauu

SEQ ID NO: 1418901 - RNA, 19 nt, Homo sapiens
guacagcauucugcccuau

SEQ ID NO: 1418902 - RNA, 19 nt, Homo sapiens
gcauucugcccuauucauu

SEQ ID NO: 1418903 - RNA, 19 nt, Homo sapiens
gggugacaauguauauaug

SEQ ID NO: 1418904 - RNA, 19 nt, Homo sapiens
cauggacacuggccucuag

SEQ ID NO: 1418905 - RNA, 19 nt, Homo sapiens
gagaaucagcugacucaag

SEQ ID NO: 1418906 - RNA, 19 nt, Homo sapiens
gauccuacaguggagaaua

SEQ ID NO: 1418907 - RNA, 19 nt, Homo sapiens
gauaugaguccugggcauu

SEQ ID NO: 1418908 - RNA, 19 nt, Homo sapiens
ggacacagcagggcaggau

SEQ ID NO: 1418909 - RNA, 19 nt, Homo sapiens
ucgcugccaucucauguga

SEQ ID NO: 1418910 - RNA, 19 nt, Homo sapiens
caggaugaguacagcauuc

SEQ ID NO: 1418911 - RNA, 19 nt, Homo sapiens
gugcuuguguauucuguca

SEQ ID NO: 1418912 - RNA, 19 nt, Homo sapiens
aagaugaguuucaccuaca

SEQ ID NO: 1418913 - RNA, 19 nt, Homo sapiens
ggaaggcuacgauccuaca

SEQ ID NO: 1418914 - RNA, 19 nt, Homo sapiens
gacgugcuguguugugauc

SEQ ID NO: 1418915 - RNA, 19 nt, Homo sapiens
uacaggcaguugaaggaaa

SEQ ID NO: 1418916 - RNA, 19 nt, Homo sapiens
gguacaggcaguugaagga

SEQ ID NO: 1418917 - RNA, 19 nt, Homo sapiens
gguccaugguuaugugcuu

SEQ ID NO: 1418918 - RNA, 19 nt, Homo sapiens
gcaggaugaguacagcauu

SEQ ID NO: 1418919 - RNA, 19 nt, Homo sapiens
ggcaaggaccucucaugga

SEQ ID NO: 1418920 - RNA, 19 nt, Homo sapiens
caaagucauccaggagauu

SEQ ID NO: 1418921 - RNA, 19 nt, Homo sapiens
uagacgugcuguguuguga

SEQ ID NO: 1418922 - RNA, 19 nt, Homo sapiens
gagagguacaggcaguuga

SEQ ID NO: 1418923 - RNA, 19 nt, Homo sapiens
acagcauucugcccuauuc

SEQ ID NO: 1418924 - RNA, 19 nt, Homo sapiens
uaugaguccugggcauuau

SEQ ID NO: 1418925 - RNA, 19 nt, Homo sapiens
uggccuggaugucaauguu

SEQ ID NO: 1418926 - RNA, 19 nt, Homo sapiens
guacaggcaguugaaggaa

SEQ ID NO: 1418927 - RNA, 19 nt, Homo sapiens
ucauugggguccaugguua

SEQ ID NO: 1418928 - RNA, 19 nt, Homo sapiens
gaguuucaccuacauuugg

SEQ ID NO: 1418929 - RNA, 19 nt, Homo sapiens
ucggaaggcuacgauccua

SEQ ID NO: 1418930 - RNA, 19 nt, Homo sapiens
gaauuccuaugggcaagag

SEQ ID NO: 1418931 - RNA, 19 nt, Homo sapiens
ccucggauaccgcugugua

SEQ ID NO: 1418932 - RNA, 19 nt, Homo sapiens
gugacaauguauauaugca

SEQ ID NO: 1418933 - RNA, 19 nt, Homo sapiens
ugaguccugggcauuauuu

SEQ ID NO: 1418934 - RNA, 19 nt, Homo sapiens
caucuuuggcacaucaauu

SEQ ID NO: 1418935 - RNA, 19 nt, Homo sapiens
gucaucugcucgagagaau

SEQ ID NO: 1418936 - RNA, 19 nt, Homo sapiens
augguuaugugcuugugua

SEQ ID NO: 1418937 - RNA, 19 nt, Homo sapiens
gcccuauucauucaucauu

SEQ ID NO: 1418938 - RNA, 19 nt, Homo sapiens
acacagcagggcaggauga

SEQ ID NO: 1418939 - RNA, 19 nt, Homo sapiens
ucaaggcaucuucaccaaa

SEQ ID NO: 1418940 - RNA, 19 nt, Homo sapiens
caucugcucgagagaauca

SEQ ID NO: 1418941 - RNA, 19 nt, Homo sapiens
acaggcaguugaaggaaag

SEQ ID NO: 1418942 - RNA, 19 nt, Homo sapiens
ccuauucauucaucauugg

SEQ ID NO: 1418943 - RNA, 19 nt, Homo sapiens
acagcaagauagugacucu

SEQ ID NO: 1418944 - RNA, 19 nt, Homo sapiens
caucuucaccaaagucauc

SEQ ID NO: 1418945 - RNA, 19 nt, Homo sapiens
uugguuuccuucuaacuug

SEQ ID NO: 1418946 - RNA, 19 nt, Homo sapiens
gaugaguuucaccuacauu

SEQ ID NO: 1418947 - RNA, 19 nt, Homo sapiens
uguauucugucaccucucu

SEQ ID NO: 1418948 - RNA, 19 nt, Homo sapiens
ugaguuucaccuacauuug

SEQ ID NO: 1418949 - RNA, 19 nt, Homo sapiens
uggagaauacuuacagcaa

SEQ ID NO: 1418950 - RNA, 19 nt, Homo sapiens
aaagucauccaggagauug

SEQ ID NO: 1418951 - RNA, 19 nt, Homo sapiens
ggccuggaugucaauguuu

SEQ ID NO: 1418952 - RNA, 19 nt, Homo sapiens
gcaaacagcugaugaaaua

SEQ ID NO: 1418953 - RNA, 19 nt, Homo sapiens
gcaggaagaugcucggauu

SEQ ID NO: 1418954 - RNA, 19 nt, Homo sapiens
gaaaccaacugccaaagca

SEQ ID NO: 1418955 - RNA, 19 nt, Homo sapiens
gacccuaacucuacaauca

SEQ ID NO: 1418956 - RNA, 19 nt, Homo sapiens
uagcagacaucaucacuga

SEQ ID NO: 1418957 - RNA, 19 nt, Homo sapiens
gcagagaagcacauccaua

SEQ ID NO: 1418958 - RNA, 19 nt, Homo sapiens
gauauuagcagacaucauc

SEQ ID NO: 1418959 - RNA, 19 nt, Homo sapiens
gagaagcacauccauagaa

SEQ ID NO: 1418960 - RNA, 19 nt, Homo sapiens
gcauaaggccuccagauuc

SEQ ID NO: 1418961 - RNA, 19 nt, Homo sapiens
uuacuacccuggacccuaa

SEQ ID NO: 1418962 - RNA, 19 nt, Homo sapiens
gaaauaaaugugacguaga

SEQ ID NO: 1418963 - RNA, 19 nt, Homo sapiens
gggaagauauuagcagaca

SEQ ID NO: 1418964 - RNA, 19 nt, Homo sapiens
aaaaggagcugcaggaaga

SEQ ID NO: 1418965 - RNA, 19 nt, Homo sapiens
gaagauauuagcagacauc

SEQ ID NO: 1418966 - RNA, 19 nt, Homo sapiens
gaccaggugcugacaguuu

SEQ ID NO: 1418967 - RNA, 19 nt, Homo sapiens
ggaagaugcucggauucga

SEQ ID NO: 1418968 - RNA, 19 nt, Homo sapiens
gaacaaaagguagaaauga

SEQ ID NO: 1418969 - RNA, 19 nt, Homo sapiens
gcuccagaguccuugguuu

SEQ ID NO: 1418970 - RNA, 19 nt, Homo sapiens
acaaugagaccacaggaaa

SEQ ID NO: 1418971 - RNA, 19 nt, Homo sapiens
cagagaagcacauccauag

SEQ ID NO: 1418972 - RNA, 19 nt, Homo sapiens
gaaacugggaacuuggaaa

SEQ ID NO: 1418973 - RNA, 19 nt, Homo sapiens
gcugaugaaauaaauguga

SEQ ID NO: 1418974 - RNA, 19 nt, Homo sapiens
cagguaaccaucacugaaa

SEQ ID NO: 1418975 - RNA, 19 nt, Homo sapiens
guccuugguuucugucuga

SEQ ID NO: 1418976 - RNA, 19 nt, Homo sapiens
ucacugaacccagaagaga

SEQ ID NO: 1418977 - RNA, 19 nt, Homo sapiens
gcagacaucaucacugaac

SEQ ID NO: 1418978 - RNA, 19 nt, Homo sapiens
uugagaagauugcaguuca

SEQ ID NO: 1418979 - RNA, 19 nt, Homo sapiens
gaagcacauccauagaaga

SEQ ID NO: 1418980 - RNA, 19 nt, Homo sapiens
ggcugaaacugggaacuug

SEQ ID NO: 1418981 - RNA, 19 nt, Homo sapiens
cauaaggccuccagauucc

SEQ ID NO: 1418982 - RNA, 19 nt, Homo sapiens
agaagcacauccauagaag

SEQ ID NO: 1418983 - RNA, 19 nt, Homo sapiens
cauagaagagacaaugaga

SEQ ID NO: 1418984 - RNA, 19 nt, Homo sapiens
aaacugggaacuuggaaau

SEQ ID NO: 1418985 - RNA, 19 nt, Homo sapiens
gagaggguggugcccauga

SEQ ID NO: 1418986 - RNA, 19 nt, Homo sapiens
gggaccaggugcugacagu

SEQ ID NO: 1418987 - RNA, 19 nt, Homo sapiens
acugggaacuuggaaauca

SEQ ID NO: 1418988 - RNA, 19 nt, Homo sapiens
acucuacaaucaaggaaga

SEQ ID NO: 1418989 - RNA, 19 nt, Homo sapiens
gacaaugagaccacaggaa

SEQ ID NO: 1418990 - RNA, 19 nt, Homo sapiens
ggcaaacagcugaugaaau

SEQ ID NO: 1418991 - RNA, 19 nt, Homo sapiens
cagcugaugaaauaaaugu

SEQ ID NO: 1418992 - RNA, 19 nt, Homo sapiens
ggaaaccaacugccaaagc

SEQ ID NO: 1418993 - RNA, 19 nt, Homo sapiens
ggaagauauuagcagacau

SEQ ID NO: 1418994 - RNA, 19 nt, Homo sapiens
caacugccaaagcaaggaa

SEQ ID NO: 1418995 - RNA, 19 nt, Homo sapiens
ggagaugccagggucuaug

SEQ ID NO: 1418996 - RNA, 19 nt, Homo sapiens
ccuccagauuccuugauga

SEQ ID NO: 1418997 - RNA, 19 nt, Homo sapiens
ggaacaaaagguagaaaug

SEQ ID NO: 1418998 - RNA, 19 nt, Homo sapiens
caaggaagaaggacaucuc

SEQ ID NO: 1418999 - RNA, 19 nt, Homo sapiens
gagaugccagggucuaugg

SEQ ID NO: 1419000 - RNA, 19 nt, Homo sapiens
uccacaaccugaagacaca

SEQ ID NO: 1419001 - RNA, 19 nt, Homo sapiens
acagguaaccaucacugaa

SEQ ID NO: 1419002 - RNA, 19 nt, Homo sapiens
caaacagcugaugaaauaa

SEQ ID NO: 1419003 - RNA, 19 nt, Homo sapiens
gccuccagauuccuugaug

SEQ ID NO: 1419004 - RNA, 19 nt, Homo sapiens
agcauaaggccuccagauu

SEQ ID NO: 1419005 - RNA, 19 nt, Homo sapiens
aaggaaaccaacugccaaa

SEQ ID NO: 1419006 - RNA, 19 nt, Homo sapiens
caagcaaggaaaccaacug

SEQ ID NO: 1419007 - RNA, 19 nt, Homo sapiens
cagcagagaagcacaucca

SEQ ID NO: 1419008 - RNA, 19 nt, Homo sapiens
uagaaaugaccuccaagca

SEQ ID NO: 1419009 - RNA, 19 nt, Homo sapiens
aagaaggacaucucugcuu

SEQ ID NO: 1419010 - RNA, 19 nt, Homo sapiens
gaacaucugucuucugaaa

SEQ ID NO: 1419011 - RNA, 19 nt, Homo sapiens
ccacagaacuggugacuau

SEQ ID NO: 1419012 - RNA, 19 nt, Homo sapiens
ggacaugcuuucucaacua

SEQ ID NO: 1419013 - RNA, 19 nt, Homo sapiens
agagauggauucccuguua

SEQ ID NO: 1419014 - RNA, 19 nt, Homo sapiens
gaggacaggucacaauuug

SEQ ID NO: 1419015 - RNA, 19 nt, Homo sapiens
gaaaggccauuuuagaaua

SEQ ID NO: 1419016 - RNA, 19 nt, Homo sapiens
gugaauaucuuaggaaaug

SEQ ID NO: 1419017 - RNA, 19 nt, Homo sapiens
gagcauuucucaccaguuc

SEQ ID NO: 1419018 - RNA, 19 nt, Homo sapiens
gguuagggcuaccaccuua

SEQ ID NO: 1419019 - RNA, 19 nt, Homo sapiens
ggccagaccuuguucaugu

SEQ ID NO: 1419020 - RNA, 19 nt, Homo sapiens
guauauacaucaccucuca

SEQ ID NO: 1419021 - RNA, 19 nt, Homo sapiens
gaagagcggccauggagaa

SEQ ID NO: 1419022 - RNA, 19 nt, Homo sapiens
gagauggauucccuguuaa

SEQ ID NO: 1419023 - RNA, 19 nt, Homo sapiens
gauggcagcugcacuucuu

SEQ ID NO: 1419024 - RNA, 19 nt, Homo sapiens
gaaggcaaauccugcaaag

SEQ ID NO: 1419025 - RNA, 19 nt, Homo sapiens
gcgaagacaucaccucauc

SEQ ID NO: 1419026 - RNA, 19 nt, Homo sapiens
ggaaaugaaagcccuagaa

SEQ ID NO: 1419027 - RNA, 19 nt, Homo sapiens
cuacaaggcuaagagauga

SEQ ID NO: 1419028 - RNA, 19 nt, Homo sapiens
gaauaugucaugcaggaaa

SEQ ID NO: 1419029 - RNA, 19 nt, Homo sapiens
gcugagagaucacacuaca

SEQ ID NO: 1419030 - RNA, 19 nt, Homo sapiens
ucucaaaccugcuguguag

SEQ ID NO: 1419031 - RNA, 19 nt, Homo sapiens
gaaacacucuggugaacac

SEQ ID NO: 1419032 - RNA, 19 nt, Homo sapiens
ggaugggaaucaaugaaug

SEQ ID NO: 1419033 - RNA, 19 nt, Homo sapiens
aggaacaucugucuucuga

SEQ ID NO: 1419034 - RNA, 19 nt, Homo sapiens
ucaggaagauaguuucuca

SEQ ID NO: 1419035 - RNA, 19 nt, Homo sapiens
ggaaaacugugggauagua

SEQ ID NO: 1419036 - RNA, 19 nt, Homo sapiens
ggagagagcccuggcacaa

SEQ ID NO: 1419037 - RNA, 19 nt, Homo sapiens
uuaaggcaguguuuccuaa

SEQ ID NO: 1419038 - RNA, 19 nt, Homo sapiens
uggcugaaauccauucuga

SEQ ID NO: 1419039 - RNA, 19 nt, Homo sapiens
gaugagagcugggauucca

SEQ ID NO: 1419040 - RNA, 19 nt, Homo sapiens
gggaaucaaugaauguaca

SEQ ID NO: 1419041 - RNA, 19 nt, Homo sapiens
gcgugaauaucuuaggaaa

SEQ ID NO: 1419042 - RNA, 19 nt, Homo sapiens
gaaccucccagaauguuau

SEQ ID NO: 1419043 - RNA, 19 nt, Homo sapiens
gaaacaagagauagugauc

SEQ ID NO: 1419044 - RNA, 19 nt, Homo sapiens
acacuggguuagagaguaa

SEQ ID NO: 1419045 - RNA, 19 nt, Homo sapiens
gguaagaauuuccgaugca

SEQ ID NO: 1419046 - RNA, 19 nt, Homo sapiens
ggagauggcagcugcacuu

SEQ ID NO: 1419047 - RNA, 19 nt, Homo sapiens
cauccuacaugggcugaua

SEQ ID NO: 1419048 - RNA, 19 nt, Homo sapiens
cagcuauggucaagucuau

SEQ ID NO: 1419049 - RNA, 19 nt, Homo sapiens
gaaaugaaagcccuagaac

SEQ ID NO: 1419050 - RNA, 19 nt, Homo sapiens
gaggagagggacauucuga

SEQ ID NO: 1419051 - RNA, 19 nt, Homo sapiens
cucaguauccuuucuauuu

SEQ ID NO: 1419052 - RNA, 19 nt, Homo sapiens
gaagagcuuuggccgaaaa

SEQ ID NO: 1419053 - RNA, 19 nt, Homo sapiens
guaagaauuuccgaugcaa

SEQ ID NO: 1419054 - RNA, 19 nt, Homo sapiens
cuacagcuauggucaaguc

SEQ ID NO: 1419055 - RNA, 19 nt, Homo sapiens
ccaaucagcaguauauaca

SEQ ID NO: 1419056 - RNA, 19 nt, Homo sapiens
ccaguggccagaaucauaa

SEQ ID NO: 1419057 - RNA, 19 nt, Homo sapiens
cacagucccuucaggagaa

SEQ ID NO: 1419058 - RNA, 19 nt, Homo sapiens
cagaacuggugacuaugaa

SEQ ID NO: 1419059 - RNA, 19 nt, Homo sapiens
cuauuuacaucccacagaa

SEQ ID NO: 1419060 - RNA, 19 nt, Homo sapiens
cuacaugggcugauauuca

SEQ ID NO: 1419061 - RNA, 19 nt, Homo sapiens
gaagaccuuugggcgaaga

SEQ ID NO: 1419062 - RNA, 19 nt, Homo sapiens
gaucacacuacaaggcuaa

SEQ ID NO: 1419063 - RNA, 19 nt, Homo sapiens
gcagaaccucccagaaugu

SEQ ID NO: 1419064 - RNA, 19 nt, Homo sapiens
gcucugcgugaauaucuua

SEQ ID NO: 1419065 - RNA, 19 nt, Homo sapiens
aagaugaggucccagcaau

SEQ ID NO: 1419066 - RNA, 19 nt, Homo sapiens
uacaggagguggaagugaa

SEQ ID NO: 1419067 - RNA, 19 nt, Homo sapiens
gacaugcuuucucaacuag

SEQ ID NO: 1419068 - RNA, 19 nt, Homo sapiens
acagcugccucaaguguga

SEQ ID NO: 1419069 - RNA, 19 nt, Homo sapiens
ggaaacaagagauagugau

SEQ ID NO: 1419070 - RNA, 19 nt, Homo sapiens
ggcaguguuuccuaaaugu

SEQ ID NO: 1419071 - RNA, 19 nt, Homo sapiens
cccagcagcuccagaggaa

SEQ ID NO: 1419072 - RNA, 19 nt, Homo sapiens
aagauacuguucucuggaa

SEQ ID NO: 1419073 - RNA, 19 nt, Homo sapiens
gaagcagaaccucccagaa

SEQ ID NO: 1419074 - RNA, 19 nt, Homo sapiens
ggacaggaugggaaucaau

SEQ ID NO: 1419075 - RNA, 19 nt, Homo sapiens
gcaguguuuccuaaaugua

SEQ ID NO: 1419076 - RNA, 19 nt, Homo sapiens
aaacccaccuacaugacaa

SEQ ID NO: 1419077 - RNA, 19 nt, Homo sapiens
aagcagaaccucccagaau

SEQ ID NO: 1419078 - RNA, 19 nt, Homo sapiens
ggauaccccugaacuagaa

SEQ ID NO: 1419079 - RNA, 19 nt, Homo sapiens
guaacaaggaaacaagaga

SEQ ID NO: 1419080 - RNA, 19 nt, Homo sapiens
gggcugccguucuccugaa

SEQ ID NO: 1419081 - RNA, 19 nt, Homo sapiens
gaagacaucaccucaucag

SEQ ID NO: 1419082 - RNA, 19 nt, Homo sapiens
gaacacuggguuagagagu

SEQ ID NO: 1419083 - RNA, 19 nt, Homo sapiens
ggugaacacuggguuagag

SEQ ID NO: 1419084 - RNA, 19 nt, Homo sapiens
gaacuggugacuaugaaac

SEQ ID NO: 1419085 - RNA, 19 nt, Homo sapiens
ccagagagugcaugcagaa

SEQ ID NO: 1419086 - RNA, 19 nt, Homo sapiens
cagcgugucugaagauacu

SEQ ID NO: 1419087 - RNA, 19 nt, Homo sapiens
agaaggaggagaagaacaa

SEQ ID NO: 1419088 - RNA, 19 nt, Homo sapiens
gagaguaacaaggaaacaa

SEQ ID NO: 1419089 - RNA, 19 nt, Homo sapiens
ugaggacaggucacaauuu

SEQ ID NO: 1419090 - RNA, 19 nt, Homo sapiens
ugagagaucacacuacaag

SEQ ID NO: 1419091 - RNA, 19 nt, Homo sapiens
uaacaaggaaacaagagau

SEQ ID NO: 1419092 - RNA, 19 nt, Homo sapiens
gcaggaaaacugugggaua

SEQ ID NO: 1419093 - RNA, 19 nt, Homo sapiens
gagcggccauggagaacag

SEQ ID NO: 1419094 - RNA, 19 nt, Homo sapiens
caaggaaacaagagauagu

SEQ ID NO: 1419095 - RNA, 19 nt, Homo sapiens
gaugggaaucaaugaaugu

SEQ ID NO: 1419096 - RNA, 19 nt, Homo sapiens
gacaggaugggaaucaaug

SEQ ID NO: 1419097 - RNA, 19 nt, Homo sapiens
gaagcaaugcauccuacau

SEQ ID NO: 1419098 - RNA, 19 nt, Homo sapiens
gcuauggucaagucuauca

SEQ ID NO: 1419099 - RNA, 19 nt, Homo sapiens
ggaacccggagcaugauga

SEQ ID NO: 1419100 - RNA, 19 nt, Homo sapiens
gagguggaagugaacauga

SEQ ID NO: 1419101 - RNA, 19 nt, Homo sapiens
ucaacuagaaggaggagaa

SEQ ID NO: 1419102 - RNA, 19 nt, Homo sapiens
gggauaguagucucucuga

SEQ ID NO: 1419103 - RNA, 19 nt, Homo sapiens
aaucagcaguauauacauc

SEQ ID NO: 1419104 - RNA, 19 nt, Homo sapiens
acagaacuggugacuauga

SEQ ID NO: 1419105 - RNA, 19 nt, Homo sapiens
agacagaaaggccauuuua

SEQ ID NO: 1419106 - RNA, 19 nt, Homo sapiens
cccaguggccagaaucaua

SEQ ID NO: 1419107 - RNA, 19 nt, Homo sapiens
agcagaaccucccagaaug

SEQ ID NO: 1419108 - RNA, 19 nt, Homo sapiens
cagcugagagaucacacua

SEQ ID NO: 1419109 - RNA, 19 nt, Homo sapiens
acccauaugugugaagaaa

SEQ ID NO: 1419110 - RNA, 19 nt, Homo sapiens
caaauaaccuucuguguca

SEQ ID NO: 1419111 - RNA, 19 nt, Homo sapiens
gaaauccaauggcagauaa

SEQ ID NO: 1419112 - RNA, 19 nt, Homo sapiens
gaaaggacauuaggaaaga

SEQ ID NO: 1419113 - RNA, 19 nt, Homo sapiens
gaagaugucuccauguuuc

SEQ ID NO: 1419114 - RNA, 19 nt, Homo sapiens
acaaauagcccucuuauga

SEQ ID NO: 1419115 - RNA, 19 nt, Homo sapiens
gaaugaaguugguggauug

SEQ ID NO: 1419116 - RNA, 19 nt, Homo sapiens
gauuugacauuccugcuua

SEQ ID NO: 1419117 - RNA, 19 nt, Homo sapiens
ucacagaguucucauguau

SEQ ID NO: 1419118 - RNA, 19 nt, Homo sapiens
ggaguauacugaagaagaa

SEQ ID NO: 1419119 - RNA, 19 nt, Homo sapiens
ggccauggguuauaaauau

SEQ ID NO: 1419120 - RNA, 19 nt, Homo sapiens
ugucauggcuuggcuaaua

SEQ ID NO: 1419121 - RNA, 19 nt, Homo sapiens
gaaagacaccagaaguauu

SEQ ID NO: 1419122 - RNA, 19 nt, Homo sapiens
caaauggaauuauguaggu

SEQ ID NO: 1419123 - RNA, 19 nt, Homo sapiens
aaacuucccaucacaauaa

SEQ ID NO: 1419124 - RNA, 19 nt, Homo sapiens
caggaagccuacuuuguuu

SEQ ID NO: 1419125 - RNA, 19 nt, Homo sapiens
ggacuggccuacagagugu

SEQ ID NO: 1419126 - RNA, 19 nt, Homo sapiens
gaaccugaguuaugacaag

SEQ ID NO: 1419127 - RNA, 19 nt, Homo sapiens
gaaacuucccaucacaaua

SEQ ID NO: 1419128 - RNA, 19 nt, Homo sapiens
gaagaucucugaguuagac

SEQ ID NO: 1419129 - RNA, 19 nt, Homo sapiens
cagugaagcuguuuccauu

SEQ ID NO: 1419130 - RNA, 19 nt, Homo sapiens
gcagauaaccugaaauaac

SEQ ID NO: 1419131 - RNA, 19 nt, Homo sapiens
aagaagagcuagaggaugu

SEQ ID NO: 1419132 - RNA, 19 nt, Homo sapiens
uaacacagcaguuggaaug

SEQ ID NO: 1419133 - RNA, 19 nt, Homo sapiens
cgacagagaagaaaguauu

SEQ ID NO: 1419134 - RNA, 19 nt, Homo sapiens
ugaaguugguggauuggua

SEQ ID NO: 1419135 - RNA, 19 nt, Homo sapiens
ugagauaaacccagaauug

SEQ ID NO: 1419136 - RNA, 19 nt, Homo sapiens
ugacaaggcaugugugaaa

SEQ ID NO: 1419137 - RNA, 19 nt, Homo sapiens
guucugagguugaaaucuu

SEQ ID NO: 1419138 - RNA, 19 nt, Homo sapiens
uguagaaccugaguuauga

SEQ ID NO: 1419139 - RNA, 19 nt, Homo sapiens
ccaggaagccuacuuuguu

SEQ ID NO: 1419140 - RNA, 19 nt, Homo sapiens
ggacauguuccacuacuug

SEQ ID NO: 1419141 - RNA, 19 nt, Homo sapiens
caaugugccucaacucgaa

SEQ ID NO: 1419142 - RNA, 19 nt, Homo sapiens
uaaccaaacugcaucuagu

SEQ ID NO: 1419143 - RNA, 19 nt, Homo sapiens
uuacaggaaugccuuauca

SEQ ID NO: 1419144 - RNA, 19 nt, Homo sapiens
ugacauuccugcuuagugu

SEQ ID NO: 1419145 - RNA, 19 nt, Homo sapiens
ggacuccuuuccuccauug

SEQ ID NO: 1419146 - RNA, 19 nt, Homo sapiens
gaaaguauuuuguggaugu

SEQ ID NO: 1419147 - RNA, 19 nt, Homo sapiens
ggaaaggacauuaggaaag

SEQ ID NO: 1419148 - RNA, 19 nt, Homo sapiens
cugcagagaaagaauauua

SEQ ID NO: 1419149 - RNA, 19 nt, Homo sapiens
gauaaacccagaauuguag

SEQ ID NO: 1419150 - RNA, 19 nt, Homo sapiens
gaaguugguggauugguaa

SEQ ID NO: 1419151 - RNA, 19 nt, Homo sapiens
cagauaaccugaaauaacg

SEQ ID NO: 1419152 - RNA, 19 nt, Homo sapiens
uaacaaauagcccucuuau

SEQ ID NO: 1419153 - RNA, 19 nt, Homo sapiens
guaacaaauagcccucuua

SEQ ID NO: 1419154 - RNA, 19 nt, Homo sapiens
aaagacaccagaaguauug

SEQ ID NO: 1419155 - RNA, 19 nt, Homo sapiens
ggaagaagagcuagaggau

SEQ ID NO: 1419156 - RNA, 19 nt, Homo sapiens
cuuggcagcucaacacuaa

SEQ ID NO: 1419157 - RNA, 19 nt, Homo sapiens
caaucaaucuugggacuau

SEQ ID NO: 1419158 - RNA, 19 nt, Homo sapiens
uacagugugugaugcuuua

SEQ ID NO: 1419159 - RNA, 19 nt, Homo sapiens
gagauaaacccagaauugu

SEQ ID NO: 1419160 - RNA, 19 nt, Homo sapiens
aaagacaacuugcuuacag

SEQ ID NO: 1419161 - RNA, 19 nt, Homo sapiens
aaagaaaggucuggcuuca

SEQ ID NO: 1419162 - RNA, 19 nt, Homo sapiens
ucgaagaugucuccauguu

SEQ ID NO: 1419163 - RNA, 19 nt, Homo sapiens
caggaaaucucggcgaaga

SEQ ID NO: 1419164 - RNA, 19 nt, Homo sapiens
cauauugaauccaggaaau

SEQ ID NO: 1419165 - RNA, 19 nt, Homo sapiens
uggcagauaaccugaaaua

SEQ ID NO: 1419166 - RNA, 19 nt, Homo sapiens
gcagcucaacacuaaauaa

SEQ ID NO: 1419167 - RNA, 19 nt, Homo sapiens
ccucuguguucauuagaua

SEQ ID NO: 1419168 - RNA, 19 nt, Homo sapiens
aaauagcccucuuaugagu

SEQ ID NO: 1419169 - RNA, 19 nt, Homo sapiens
uaaagcaccauaagaaauc

SEQ ID NO: 1419170 - RNA, 19 nt, Homo sapiens
uauaccaucuuguaacuca

SEQ ID NO: 1419171 - RNA, 19 nt, Homo sapiens
gugugaugcuuuaaacaaa

SEQ ID NO: 1419172 - RNA, 19 nt, Homo sapiens
caacuugcuuacaggaaug

SEQ ID NO: 1419173 - RNA, 19 nt, Homo sapiens
gaagagcaucagcuacuug

SEQ ID NO: 1419174 - RNA, 19 nt, Homo sapiens
gucauggcuuggcuaauaa

SEQ ID NO: 1419175 - RNA, 19 nt, Homo sapiens
uagcagcaguucagucaau

SEQ ID NO: 1419176 - RNA, 19 nt, Homo sapiens
cgacuugaauacagugugu

SEQ ID NO: 1419177 - RNA, 19 nt, Homo sapiens
agacaaaugcucucacaga

SEQ ID NO: 1419178 - RNA, 19 nt, Homo sapiens
uagaggaugugcccugguu

SEQ ID NO: 1419179 - RNA, 19 nt, Homo sapiens
cagagaacauuuggacaga

SEQ ID NO: 1419180 - RNA, 19 nt, Homo sapiens
cacagcaguuggaaugauu

SEQ ID NO: 1419181 - RNA, 19 nt, Homo sapiens
ucccucugcugacuaaaua

SEQ ID NO: 1419182 - RNA, 19 nt, Homo sapiens
gguggaguauacugaagaa

SEQ ID NO: 1419183 - RNA, 19 nt, Homo sapiens
gaaguucugagguugaaau

SEQ ID NO: 1419184 - RNA, 19 nt, Homo sapiens
agaaugaaguugguggauu

SEQ ID NO: 1419185 - RNA, 19 nt, Homo sapiens
acuaaacaguggacaauca

SEQ ID NO: 1419186 - RNA, 19 nt, Homo sapiens
agauaaacccagaauugua

SEQ ID NO: 1419187 - RNA, 19 nt, Homo sapiens
cagcucaacacuaaauaaa

SEQ ID NO: 1419188 - RNA, 19 nt, Homo sapiens
gcagcgacuugaauacagu

SEQ ID NO: 1419189 - RNA, 19 nt, Homo sapiens
caacaagggaagcagcaaa

SEQ ID NO: 1419190 - RNA, 19 nt, Homo sapiens
gaagauguucagaaacuag

SEQ ID NO: 1419191 - RNA, 19 nt, Homo sapiens
gcagagaaagaauauuaca

SEQ ID NO: 1419192 - RNA, 19 nt, Homo sapiens
ugaaagacaccagaaguau

SEQ ID NO: 1419193 - RNA, 19 nt, Homo sapiens
ggaagccuacuuuguuuca

SEQ ID NO: 1419194 - RNA, 19 nt, Homo sapiens
ucucugaguuagacaaaug

SEQ ID NO: 1419195 - RNA, 19 nt, Homo sapiens
cggaagaucucugaguuag

SEQ ID NO: 1419196 - RNA, 19 nt, Homo sapiens
caaauagcccucuuaugag

SEQ ID NO: 1419197 - RNA, 19 nt, Homo sapiens
gcaugcaauuccauauauc

SEQ ID NO: 1419198 - RNA, 19 nt, Homo sapiens
gcaguucagucaaugucau

SEQ ID NO: 1419199 - RNA, 19 nt, Homo sapiens
ugaggccgguggcuggaua

SEQ ID NO: 1419200 - RNA, 19 nt, Homo sapiens
gacagagaagaaaguauuu

SEQ ID NO: 1419201 - RNA, 19 nt, Homo sapiens
acagaguucucauguaugg

SEQ ID NO: 1419202 - RNA, 19 nt, Homo sapiens
gcucaacacuaaauaaacc

SEQ ID NO: 1419203 - RNA, 19 nt, Homo sapiens
gaacauuuggacagaggaa

SEQ ID NO: 1419204 - RNA, 19 nt, Homo sapiens
gauaaccugaaauaacgua

SEQ ID NO: 1419205 - RNA, 19 nt, Homo sapiens
cgaagagcaucagcuacuu

SEQ ID NO: 1419206 - RNA, 19 nt, Homo sapiens
cgaagaugucuccauguuu

SEQ ID NO: 1419207 - RNA, 19 nt, Homo sapiens
gcugaccacccaggauuua

SEQ ID NO: 1419208 - RNA, 19 nt, Homo sapiens
gguugaguauuuacacaau

SEQ ID NO: 1419209 - RNA, 19 nt, Homo sapiens
gcuaauaagcaugcaauuc

SEQ ID NO: 1419210 - RNA, 19 nt, Homo sapiens
gagaagaucuuguuaauag

SEQ ID NO: 1419211 - RNA, 19 nt, Homo sapiens
guaaugaagucucuacaaa

SEQ ID NO: 1419212 - RNA, 19 nt, Homo sapiens
gaaagaacuuaaagagcua

SEQ ID NO: 1419213 - RNA, 19 nt, Homo sapiens
gagacuggcuuuccacaaa

SEQ ID NO: 1419214 - RNA, 19 nt, Homo sapiens
gcuugcagcugccaucuua

SEQ ID NO: 1419215 - RNA, 19 nt, Homo sapiens
ucaaaugcaucucuguaua

SEQ ID NO: 1419216 - RNA, 19 nt, Homo sapiens
gauaggguuucucuuguaa

SEQ ID NO: 1419217 - RNA, 19 nt, Homo sapiens
caaagaagccguacucugu

SEQ ID NO: 1419218 - RNA, 19 nt, Homo sapiens
gagaaggacuggaauguac

SEQ ID NO: 1419219 - RNA, 19 nt, Homo sapiens
ggagggaaguggauccauu

SEQ ID NO: 1419220 - RNA, 19 nt, Homo sapiens
ccaacacacuuucuauuug

SEQ ID NO: 1419221 - RNA, 19 nt, Homo sapiens
ggcaagagguucacucguu

SEQ ID NO: 1419222 - RNA, 19 nt, Homo sapiens
gaaugucuaucaucagaau

SEQ ID NO: 1419223 - RNA, 19 nt, Homo sapiens
ggaaguggauccauuucug

SEQ ID NO: 1419224 - RNA, 19 nt, Homo sapiens
ggagaagaucuuguuaaua

SEQ ID NO: 1419225 - RNA, 19 nt, Homo sapiens
ugugaaaccucaaguccua

SEQ ID NO: 1419226 - RNA, 19 nt, Homo sapiens
caacacacuuucuauuugg

SEQ ID NO: 1419227 - RNA, 19 nt, Homo sapiens
gaccacugcuugccaauca

SEQ ID NO: 1419228 - RNA, 19 nt, Homo sapiens
gcaaagcaggcacaaagaa

SEQ ID NO: 1419229 - RNA, 19 nt, Homo sapiens
ggagaaggacuggaaugua

SEQ ID NO: 1419230 - RNA, 19 nt, Homo sapiens
caggaguaaugaauaguaa

SEQ ID NO: 1419231 - RNA, 19 nt, Homo sapiens
gggcacagcucuucugacu

SEQ ID NO: 1419232 - RNA, 19 nt, Homo sapiens
ugauaggguuucucuugua

SEQ ID NO: 1419233 - RNA, 19 nt, Homo sapiens
guaccaggaguaaugaaua

SEQ ID NO: 1419234 - RNA, 19 nt, Homo sapiens
uagaagcccugagaaagaa

SEQ ID NO: 1419235 - RNA, 19 nt, Homo sapiens
gcaaggcacuaugcuagau

SEQ ID NO: 1419236 - RNA, 19 nt, Homo sapiens
caaauuggguuagcuacau

SEQ ID NO: 1419237 - RNA, 19 nt, Homo sapiens
uggagaagaucuuguuaau

SEQ ID NO: 1419238 - RNA, 19 nt, Homo sapiens
cagcucaccuucucucuuc

SEQ ID NO: 1419239 - RNA, 19 nt, Homo sapiens
guggauccauuucugcuaa

SEQ ID NO: 1419240 - RNA, 19 nt, Homo sapiens
gcacaaagaagccguacuc

SEQ ID NO: 1419241 - RNA, 19 nt, Homo sapiens
cuucgugccuuuccuguaa

SEQ ID NO: 1419242 - RNA, 19 nt, Homo sapiens
ggaaggcuuucucuaggau

SEQ ID NO: 1419243 - RNA, 19 nt, Homo sapiens
ggguuucucuuguaaugaa

SEQ ID NO: 1419244 - RNA, 19 nt, Homo sapiens
gcucagcucucuccaucug

SEQ ID NO: 1419245 - RNA, 19 nt, Homo sapiens
cuaaggaaauucuagucaa

SEQ ID NO: 1419246 - RNA, 19 nt, Homo sapiens
gggaaggcuuucucuagga

SEQ ID NO: 1419247 - RNA, 19 nt, Homo sapiens
cuacaucucugcuaaacag

SEQ ID NO: 1419248 - RNA, 19 nt, Homo sapiens
gagggaaguggauccauuu

SEQ ID NO: 1419249 - RNA, 19 nt, Homo sapiens
caacaacucugggcaaagc

SEQ ID NO: 1419250 - RNA, 19 nt, Homo sapiens
gggugcaccuccugaagaa

SEQ ID NO: 1419251 - RNA, 19 nt, Homo sapiens
gaagaggaggccagucaga

SEQ ID NO: 1419252 - RNA, 19 nt, Homo sapiens
gggcaaagcaggcacaaag

SEQ ID NO: 1419253 - RNA, 19 nt, Homo sapiens
ugaagucucuacaaauugg

SEQ ID NO: 1419254 - RNA, 19 nt, Homo sapiens
gcaucucuguauagacaaa

SEQ ID NO: 1419255 - RNA, 19 nt, Homo sapiens
gaaauucuagucaaaugca

SEQ ID NO: 1419256 - RNA, 19 nt, Homo sapiens
gaaauagugggcagcuaga

SEQ ID NO: 1419257 - RNA, 19 nt, Homo sapiens
caaaugcaucucuguauag

SEQ ID NO: 1419258 - RNA, 19 nt, Homo sapiens
cuagaagcccugagaaaga

SEQ ID NO: 1419259 - RNA, 19 nt, Homo sapiens
caucucugcuaaacaguug

SEQ ID NO: 1419260 - RNA, 19 nt, Homo sapiens
guugauaggguuucucuug

SEQ ID NO: 1419261 - RNA, 19 nt, Homo sapiens
gcacuaaugggcuccuuuc

SEQ ID NO: 1419262 - RNA, 19 nt, Homo sapiens
ggagagaacauuguggaau

SEQ ID NO: 1419263 - RNA, 19 nt, Homo sapiens
ccaggaguaaugaauagua

SEQ ID NO: 1419264 - RNA, 19 nt, Homo sapiens
uaggguuucucuuguaaug

SEQ ID NO: 1419265 - RNA, 19 nt, Homo sapiens
caccauugcuuuccauucu

SEQ ID NO: 1419266 - RNA, 19 nt, Homo sapiens
ccuccaggcuucagucuuc

SEQ ID NO: 1419267 - RNA, 19 nt, Homo sapiens
gggaagaggaggccaguca

SEQ ID NO: 1419268 - RNA, 19 nt, Homo sapiens
gaagcgaccaccugagcaa

SEQ ID NO: 1419269 - RNA, 19 nt, Homo sapiens
ccaaggcagugggaaauag

SEQ ID NO: 1419270 - RNA, 19 nt, Homo sapiens
gcacccaccucaggcuaug

SEQ ID NO: 1419271 - RNA, 19 nt, Homo sapiens
ucucacuccuugacaugua

SEQ ID NO: 1419272 - RNA, 19 nt, Homo sapiens
ccccaggccuguauauuua

SEQ ID NO: 1419273 - RNA, 19 nt, Homo sapiens
guacaaggcaggcauccau

SEQ ID NO: 1419274 - RNA, 19 nt, Homo sapiens
ugagaaagaacuuaaagag

SEQ ID NO: 1419275 - RNA, 19 nt, Homo sapiens
aaaugcaucucuguauaga

SEQ ID NO: 1419276 - RNA, 19 nt, Homo sapiens
gcuaaggaaauucuaguca

SEQ ID NO: 1419277 - RNA, 19 nt, Homo sapiens
cuacaaauuggguuagcua

SEQ ID NO: 1419278 - RNA, 19 nt, Homo sapiens
guggagaagaucuuguuaa

SEQ ID NO: 1419279 - RNA, 19 nt, Homo sapiens
aggaaauucuagucaaaug

SEQ ID NO: 1419280 - RNA, 19 nt, Homo sapiens
cuacaccucucuggacaug

SEQ ID NO: 1419281 - RNA, 19 nt, Homo sapiens
uaacguuggauccuccuuu

SEQ ID NO: 1419282 - RNA, 19 nt, Homo sapiens
gcagcgugcagcaaauuug

SEQ ID NO: 1419283 - RNA, 19 nt, Homo sapiens
uaccaggaguaaugaauag

SEQ ID NO: 1419284 - RNA, 19 nt, Homo sapiens
gggaaauagugggcagcua

SEQ ID NO: 1419285 - RNA, 19 nt, Homo sapiens
ccuacuccauggugggaua

SEQ ID NO: 1419286 - RNA, 19 nt, Homo sapiens
gcuucagucuucccaacuu

SEQ ID NO: 1419287 - RNA, 19 nt, Homo sapiens
caacacuauuucuccaucu

SEQ ID NO: 1419288 - RNA, 19 nt, Homo sapiens
gcccugagaaagaacuuaa

SEQ ID NO: 1419289 - RNA, 19 nt, Homo sapiens
caaagcaggcacaaagaag

SEQ ID NO: 1419290 - RNA, 19 nt, Homo sapiens
uccacaaacucucaucuca

SEQ ID NO: 1419291 - RNA, 19 nt, Homo sapiens
gaugggguaucucuugauu

SEQ ID NO: 1419292 - RNA, 19 nt, Homo sapiens
aggaggaaguucacuaugg

SEQ ID NO: 1419293 - RNA, 19 nt, Homo sapiens
accaacacacuuucuauuu

SEQ ID NO: 1419294 - RNA, 19 nt, Homo sapiens
caccaacacacuuucuauu

SEQ ID NO: 1419295 - RNA, 19 nt, Homo sapiens
gcgaccaccugagcaaaca

SEQ ID NO: 1419296 - RNA, 19 nt, Homo sapiens
gcaccugaaggcccacuug

SEQ ID NO: 1419297 - RNA, 19 nt, Homo sapiens
caccuacccaucugacuuu

SEQ ID NO: 1419298 - RNA, 19 nt, Homo sapiens
uaacaggaggacauugguu

SEQ ID NO: 1419299 - RNA, 19 nt, Homo sapiens
augcaucucuguauagaca

SEQ ID NO: 1419300 - RNA, 19 nt, Homo sapiens
cuucuuacaccauugcuuu

SEQ ID NO: 1419301 - RNA, 19 nt, Homo sapiens
gcaaggcuucgcaccugaa

SEQ ID NO: 1419302 - RNA, 19 nt, Homo sapiens
gccccaagaugucuauaaa

SEQ ID NO: 1419303 - RNA, 19 nt, Homo sapiens
gggagaaggacuggaaugu

SEQ ID NO: 1419304 - RNA, 19 nt, Homo sapiens
gccagaagcugugaaaccu

SEQ ID NO: 1419305 - RNA, 19 nt, Homo sapiens
caccuucucucuucaccau

SEQ ID NO: 1419306 - RNA, 19 nt, Homo sapiens
gcacucacacccgggagaa

SEQ ID NO: 1419307 - RNA, 19 nt, Homo sapiens
gugcaccuccugaagaaug

SEQ ID NO: 1419308 - RNA, 19 nt, Homo sapiens
gucaaaugcaucucuguau

SEQ ID NO: 1419309 - RNA, 19 nt, Homo sapiens
cuauguaccaggaguaaug

SEQ ID NO: 1419310 - RNA, 19 nt, Homo sapiens
ggauucagcuucuucauuu

SEQ ID NO: 1419311 - RNA, 19 nt, Homo sapiens
ccaaaucucugccguaugu

SEQ ID NO: 1419312 - RNA, 19 nt, Homo sapiens
gaaguuguauugagcaaga

SEQ ID NO: 1419313 - RNA, 19 nt, Homo sapiens
caauggaaaugcacaguaa

SEQ ID NO: 1419314 - RNA, 19 nt, Homo sapiens
gaauaccuaucucaucaaa

SEQ ID NO: 1419315 - RNA, 19 nt, Homo sapiens
cucagaagcuuccaaauaa

SEQ ID NO: 1419316 - RNA, 19 nt, Homo sapiens
gcaagaacccucauacuca

SEQ ID NO: 1419317 - RNA, 19 nt, Homo sapiens
caacauaguuacagaacau

SEQ ID NO: 1419318 - RNA, 19 nt, Homo sapiens
gcacaacucacuacucuga

SEQ ID NO: 1419319 - RNA, 19 nt, Homo sapiens
aaucagggcuugcagguuu

SEQ ID NO: 1419320 - RNA, 19 nt, Homo sapiens
gagcugaaauuagucauca

SEQ ID NO: 1419321 - RNA, 19 nt, Homo sapiens
gcacuuggauucagcuucu

SEQ ID NO: 1419322 - RNA, 19 nt, Homo sapiens
gaugacagaaguuguauug

SEQ ID NO: 1419323 - RNA, 19 nt, Homo sapiens
gcaagcaaauuggcuacuu

SEQ ID NO: 1419324 - RNA, 19 nt, Homo sapiens
auaccuaucucaucaaaug

SEQ ID NO: 1419325 - RNA, 19 nt, Homo sapiens
gggcacaacucacuacucu

SEQ ID NO: 1419326 - RNA, 19 nt, Homo sapiens
gaugaagacugggauaaag

SEQ ID NO: 1419327 - RNA, 19 nt, Homo sapiens
ugacagaaguuguauugag

SEQ ID NO: 1419328 - RNA, 19 nt, Homo sapiens
ucagaagcuuccaaauaaa

SEQ ID NO: 1419329 - RNA, 19 nt, Homo sapiens
guaaacucccugugacuuu

SEQ ID NO: 1419330 - RNA, 19 nt, Homo sapiens
agacugggauaaagauuug

SEQ ID NO: 1419331 - RNA, 19 nt, Homo sapiens
acucagaagcuuccaaaua

SEQ ID NO: 1419332 - RNA, 19 nt, Homo sapiens
aaacugacaagcacacuuu

SEQ ID NO: 1419333 - RNA, 19 nt, Homo sapiens
gcugaaauuagucaucaua

SEQ ID NO: 1419334 - RNA, 19 nt, Homo sapiens
cugaauaccuaucucauca

SEQ ID NO: 1419335 - RNA, 19 nt, Homo sapiens
cugagaagcuauugcaaug

SEQ ID NO: 1419336 - RNA, 19 nt, Homo sapiens
gcaacauaguuacagaaca

SEQ ID NO: 1419337 - RNA, 19 nt, Homo sapiens
cuuaucaucuuaucaagug

SEQ ID NO: 1419338 - RNA, 19 nt, Homo sapiens
ucacuacucugacaacaac

SEQ ID NO: 1419339 - RNA, 19 nt, Homo sapiens
ccaggagccuuagacaaga

SEQ ID NO: 1419340 - RNA, 19 nt, Homo sapiens
caacauggaagaaacuuac

SEQ ID NO: 1419341 - RNA, 19 nt, Homo sapiens
cgagcaacauaguuacaga

SEQ ID NO: 1419342 - RNA, 19 nt, Homo sapiens
aaccaaaccaggagccuua

SEQ ID NO: 1419343 - RNA, 19 nt, Homo sapiens
ccaccgagcacuuggauuc

SEQ ID NO: 1419344 - RNA, 19 nt, Homo sapiens
gaagacugggauaaagauu

SEQ ID NO: 1419345 - RNA, 19 nt, Homo sapiens
gggcuugcagguuuccuua

SEQ ID NO: 1419346 - RNA, 19 nt, Homo sapiens
uaaacucccugugacuuuc

SEQ ID NO: 1419347 - RNA, 19 nt, Homo sapiens
cuuaucaagugcagaaaga

SEQ ID NO: 1419348 - RNA, 19 nt, Homo sapiens
gcaaugccccuaugacaaa

SEQ ID NO: 1419349 - RNA, 19 nt, Homo sapiens
gcaugcgaguucccaaauc

SEQ ID NO: 1419350 - RNA, 19 nt, Homo sapiens
gagcaacauaguuacagaa

SEQ ID NO: 1419351 - RNA, 19 nt, Homo sapiens
aauaguaaacucccuguga

SEQ ID NO: 1419352 - RNA, 19 nt, Homo sapiens
uaacugaauaccuaucuca

SEQ ID NO: 1419353 - RNA, 19 nt, Homo sapiens
cguauguucugccauggaa

SEQ ID NO: 1419354 - RNA, 19 nt, Homo sapiens
ccugcgagcaacauaguua

SEQ ID NO: 1419355 - RNA, 19 nt, Homo sapiens
caucuuaucaagugcagaa

SEQ ID NO: 1419356 - RNA, 19 nt, Homo sapiens
gcuugcagguuuccuuauc

SEQ ID NO: 1419357 - RNA, 19 nt, Homo sapiens
ccaacauggaagaaacuua

SEQ ID NO: 1419358 - RNA, 19 nt, Homo sapiens
gcgaugaagacugggauaa

SEQ ID NO: 1419359 - RNA, 19 nt, Homo sapiens
ccagguuccucgagcugaa

SEQ ID NO: 1419360 - RNA, 19 nt, Homo sapiens
cagguuuccuuaucaucuu

SEQ ID NO: 1419361 - RNA, 19 nt, Homo sapiens
caaaugccagacccuagaa

SEQ ID NO: 1419362 - RNA, 19 nt, Homo sapiens
ucaaaugccagacccuaga

SEQ ID NO: 1419363 - RNA, 19 nt, Homo sapiens
gcagguuuccuuaucaucu

SEQ ID NO: 1419364 - RNA, 19 nt, Homo sapiens
ucccaaaucucugccguau

SEQ ID NO: 1419365 - RNA, 19 nt, Homo sapiens
cgaugaagacugggauaaa

SEQ ID NO: 1419366 - RNA, 19 nt, Homo sapiens
guuccucgagcugaaauua

SEQ ID NO: 1419367 - RNA, 19 nt, Homo sapiens
acaauggaaaugcacagua

SEQ ID NO: 1419368 - RNA, 19 nt, Homo sapiens
caugcgaguucccaaaucu

SEQ ID NO: 1419369 - RNA, 19 nt, Homo sapiens
cagaaguuguauugagcaa

SEQ ID NO: 1419370 - RNA, 19 nt, Homo sapiens
guauugagcaagauguugu

SEQ ID NO: 1419371 - RNA, 19 nt, Homo sapiens
ugugaugacagaaguugua

SEQ ID NO: 1419372 - RNA, 19 nt, Homo sapiens
acaacucacuacucugaca

SEQ ID NO: 1419373 - RNA, 19 nt, Homo sapiens
gauucagcuucuucauuuc

SEQ ID NO: 1419374 - RNA, 19 nt, Homo sapiens
gaacccucauacucagaag

SEQ ID NO: 1419375 - RNA, 19 nt, Homo sapiens
cuacuugucccuucaaugc

SEQ ID NO: 1419376 - RNA, 19 nt, Homo sapiens
ccuugaauccucauuuaau

SEQ ID NO: 1419377 - RNA, 19 nt, Homo sapiens
aagacugggauaaagauuu

SEQ ID NO: 1419378 - RNA, 19 nt, Homo sapiens
gacuguugcuucuucuucu

SEQ ID NO: 1419379 - RNA, 19 nt, Homo sapiens
guaacugaauaccuaucuc

SEQ ID NO: 1419380 - RNA, 19 nt, Homo sapiens
ccuggacccugagaagcua

SEQ ID NO: 1419381 - RNA, 19 nt, Homo sapiens
uggauucagcuucuucauu

SEQ ID NO: 1419382 - RNA, 19 nt, Homo sapiens
uaaugcaagaacccucaua

SEQ ID NO: 1419383 - RNA, 19 nt, Homo sapiens
ccccuugaauccucauuua

SEQ ID NO: 1419384 - RNA, 19 nt, Homo sapiens
ccugugacuuuccaaacug

SEQ ID NO: 1419385 - RNA, 19 nt, Homo sapiens
cuucuucauuuccaacaug

SEQ ID NO: 1419386 - RNA, 19 nt, Homo sapiens
caacucacuacucugacaa

SEQ ID NO: 1419387 - RNA, 19 nt, Homo sapiens
ugaagacugggauaaagau

SEQ ID NO: 1419388 - RNA, 19 nt, Homo sapiens
uaucaagugcagaaagaau

SEQ ID NO: 1419389 - RNA, 19 nt, Homo sapiens
caaacugacaagcacacuu

SEQ ID NO: 1419390 - RNA, 19 nt, Homo sapiens
ucaagugcagaaagaauca

SEQ ID NO: 1419391 - RNA, 19 nt, Homo sapiens
uaccaguggguucucauuu

SEQ ID NO: 1419392 - RNA, 19 nt, Homo sapiens
ccugagaagcuauugcaau

SEQ ID NO: 1419393 - RNA, 19 nt, Homo sapiens
cagaagcuuccaaauaaac

SEQ ID NO: 1419394 - RNA, 19 nt, Homo sapiens
agguuuccuuaucaucuua

SEQ ID NO: 1419395 - RNA, 19 nt, Homo sapiens
auacucagaagcuuccaaa

SEQ ID NO: 1419396 - RNA, 19 nt, Homo sapiens
gauaugagguggagauuaa

SEQ ID NO: 1419397 - RNA, 19 nt, Homo sapiens
caaguuagcuacugucuga

SEQ ID NO: 1419398 - RNA, 19 nt, Homo sapiens
ccacccaccuccuucauua

SEQ ID NO: 1419399 - RNA, 19 nt, Homo sapiens
gagaauccauccucuguga

SEQ ID NO: 1419400 - RNA, 19 nt, Homo sapiens
cuacauagcuucugacucu

SEQ ID NO: 1419401 - RNA, 19 nt, Homo sapiens
gcaaugagcauccuuggaa

SEQ ID NO: 1419402 - RNA, 19 nt, Homo sapiens
cagcaucuauuuccucuuu

SEQ ID NO: 1419403 - RNA, 19 nt, Homo sapiens
acacaaggaucuaugcuuu

SEQ ID NO: 1419404 - RNA, 19 nt, Homo sapiens
ggacaaagacaucaaguuc

SEQ ID NO: 1419405 - RNA, 19 nt, Homo sapiens
ggaaucggcguauuucuuu

SEQ ID NO: 1419406 - RNA, 19 nt, Homo sapiens
gaugagggcagcguaauua

SEQ ID NO: 1419407 - RNA, 19 nt, Homo sapiens
ggaagcagcuggagacacu

SEQ ID NO: 1419408 - RNA, 19 nt, Homo sapiens
caccuucccuguuuccuua

SEQ ID NO: 1419409 - RNA, 19 nt, Homo sapiens
aaacaacuuugcaggauga

SEQ ID NO: 1419410 - RNA, 19 nt, Homo sapiens
gcacaacagcagagaauga

SEQ ID NO: 1419411 - RNA, 19 nt, Homo sapiens
uaaagacucugaauuucug

SEQ ID NO: 1419412 - RNA, 19 nt, Homo sapiens
ccaagaggcugcugaacug

SEQ ID NO: 1419413 - RNA, 19 nt, Homo sapiens
caaguucgccuccuucauu

SEQ ID NO: 1419414 - RNA, 19 nt, Homo sapiens
ggacuaacgacuucucauu

SEQ ID NO: 1419415 - RNA, 19 nt, Homo sapiens
uaaggaagcugugaucauc

SEQ ID NO: 1419416 - RNA, 19 nt, Homo sapiens
ggagggaaucggcguauuu

SEQ ID NO: 1419417 - RNA, 19 nt, Homo sapiens
cuacacauauugccuccua

SEQ ID NO: 1419418 - RNA, 19 nt, Homo sapiens
guaagcagguggugagaag

SEQ ID NO: 1419419 - RNA, 19 nt, Homo sapiens
guaauuacauugccuuuug

SEQ ID NO: 1419420 - RNA, 19 nt, Homo sapiens
caaaagggcugucaaaguc

SEQ ID NO: 1419421 - RNA, 19 nt, Homo sapiens
agcaauagcuaccaucauu

SEQ ID NO: 1419422 - RNA, 19 nt, Homo sapiens
guaguacacucaacugucu

SEQ ID NO: 1419423 - RNA, 19 nt, Homo sapiens
gcaauagcuaccaucauuu

SEQ ID NO: 1419424 - RNA, 19 nt, Homo sapiens
gaaguuagacagccuuuac

SEQ ID NO: 1419425 - RNA, 19 nt, Homo sapiens
caggaugucuggugagaau

SEQ ID NO: 1419426 - RNA, 19 nt, Homo sapiens
caggaugacgccaauauuu

SEQ ID NO: 1419427 - RNA, 19 nt, Homo sapiens
ccagacacccuacacauau

SEQ ID NO: 1419428 - RNA, 19 nt, Homo sapiens
ggaggcacaagccauuaua

SEQ ID NO: 1419429 - RNA, 19 nt, Homo sapiens
ucaaggugcugaacgacaa

SEQ ID NO: 1419430 - RNA, 19 nt, Homo sapiens
gacuaacgacuucucauuu

SEQ ID NO: 1419431 - RNA, 19 nt, Homo sapiens
gaaacuggcccuggacaug

SEQ ID NO: 1419432 - RNA, 19 nt, Homo sapiens
ggugugagaucgggaaugu

SEQ ID NO: 1419433 - RNA, 19 nt, Homo sapiens
gaggagaucgcccugaaga

SEQ ID NO: 1419434 - RNA, 19 nt, Homo sapiens
cugaacaacugcaagaaga

SEQ ID NO: 1419435 - RNA, 19 nt, Homo sapiens
gccagacacccuacacaua

SEQ ID NO: 1419436 - RNA, 19 nt, Homo sapiens
gcacccaucuccacaaagc

SEQ ID NO: 1419437 - RNA, 19 nt, Homo sapiens
ggaagaagaggugacuuug

SEQ ID NO: 1419438 - RNA, 19 nt, Homo sapiens
acauggagauugccaccua

SEQ ID NO: 1419439 - RNA, 19 nt, Homo sapiens
ggacuguggguaugugauu

SEQ ID NO: 1419440 - RNA, 19 nt, Homo sapiens
gcaaagaagaugcaaugag

SEQ ID NO: 1419441 - RNA, 19 nt, Homo sapiens
caauagcuaccaucauuug

SEQ ID NO: 1419442 - RNA, 19 nt, Homo sapiens
gcuacugucugagagguuu

SEQ ID NO: 1419443 - RNA, 19 nt, Homo sapiens
caacagcagagaaugaguu

SEQ ID NO: 1419444 - RNA, 19 nt, Homo sapiens
guggaggacuauaagaaga

SEQ ID NO: 1419445 - RNA, 19 nt, Homo sapiens
gcaggaugacgccaauauu

SEQ ID NO: 1419446 - RNA, 19 nt, Homo sapiens
ccaggucacugucaacaag

SEQ ID NO: 1419447 - RNA, 19 nt, Homo sapiens
cagacacccuacacauauu

SEQ ID NO: 1419448 - RNA, 19 nt, Homo sapiens
aggaugacgccaauauuua

SEQ ID NO: 1419449 - RNA, 19 nt, Homo sapiens
gcugugaucaucccuagaa

SEQ ID NO: 1419450 - RNA, 19 nt, Homo sapiens
uagcuaccaucauuuguca

SEQ ID NO: 1419451 - RNA, 19 nt, Homo sapiens
agaaacaacuuugcaggau

SEQ ID NO: 1419452 - RNA, 19 nt, Homo sapiens
gugaucaucccuagaaaga

SEQ ID NO: 1419453 - RNA, 19 nt, Homo sapiens
gacaucaaguuccucaagu

SEQ ID NO: 1419454 - RNA, 19 nt, Homo sapiens
cagcagagaaugaguuugu

SEQ ID NO: 1419455 - RNA, 19 nt, Homo sapiens
gcucaggguguaaauauuc

SEQ ID NO: 1419456 - RNA, 19 nt, Homo sapiens
gggaaucggcguauuucuu

SEQ ID NO: 1419457 - RNA, 19 nt, Homo sapiens
ucucauccauuccugcaaa

SEQ ID NO: 1419458 - RNA, 19 nt, Homo sapiens
ggaugacgccaauauuuag

SEQ ID NO: 1419459 - RNA, 19 nt, Homo sapiens
cacaagccauuauaaccuu

SEQ ID NO: 1419460 - RNA, 19 nt, Homo sapiens
cagaggauccggugugaga

SEQ ID NO: 1419461 - RNA, 19 nt, Homo sapiens
ggaggacuauaagaagaga

SEQ ID NO: 1419462 - RNA, 19 nt, Homo sapiens
cggcguauuucuuucaaug

SEQ ID NO: 1419463 - RNA, 19 nt, Homo sapiens
agaauggcagcaucuauuu

SEQ ID NO: 1419464 - RNA, 19 nt, Homo sapiens
gcguauuucuuucaaugug

SEQ ID NO: 1419465 - RNA, 19 nt, Homo sapiens
aaagccaagugaaggugua

SEQ ID NO: 1419466 - RNA, 19 nt, Homo sapiens
gagacaaugcccugaagga

SEQ ID NO: 1419467 - RNA, 19 nt, Homo sapiens
cauauugccuccuauucuc

SEQ ID NO: 1419468 - RNA, 19 nt, Homo sapiens
gcacaagccauuauaaccu

SEQ ID NO: 1419469 - RNA, 19 nt, Homo sapiens
gaggcacaagccauuauaa

SEQ ID NO: 1419470 - RNA, 19 nt, Homo sapiens
cauguggacuaacgacuuc

SEQ ID NO: 1419471 - RNA, 19 nt, Homo sapiens
gcugagguccgcaugcauu

SEQ ID NO: 1419472 - RNA, 19 nt, Homo sapiens
ucaaguuccucaagugucu

SEQ ID NO: 1419473 - RNA, 19 nt, Homo sapiens
uggacucacuggacaaaga

SEQ ID NO: 1419474 - RNA, 19 nt, Homo sapiens
aagaauggcagcaucuauu

SEQ ID NO: 1419475 - RNA, 19 nt, Homo sapiens
gugagcaucucugucauca

SEQ ID NO: 1419476 - RNA, 19 nt, Homo sapiens
gcgagaugguggagcugaa

SEQ ID NO: 1419477 - RNA, 19 nt, Homo sapiens
gggaucugguggaggacua

SEQ ID NO: 1419478 - RNA, 19 nt, Homo sapiens
gaaccuggagcccauccuu

SEQ ID NO: 1419479 - RNA, 19 nt, Homo sapiens
gaaucggcguauuucuuuc

SEQ ID NO: 1419480 - RNA, 19 nt, Homo sapiens
uggaagaagaggugacuuu

SEQ ID NO: 1419481 - RNA, 19 nt, Homo sapiens
ucacccaccucagcacuug

SEQ ID NO: 1419482 - RNA, 19 nt, Homo sapiens
gggagacaaugcccugaag

SEQ ID NO: 1419483 - RNA, 19 nt, Homo sapiens
gaucgggaaugugaagaag

SEQ ID NO: 1419484 - RNA, 19 nt, Homo sapiens
gcgcacaacagcagagaau

SEQ ID NO: 1419485 - RNA, 19 nt, Homo sapiens
ggugacacgagaccuguaa

SEQ ID NO: 1419486 - RNA, 19 nt, Homo sapiens
ucgcucagauccagacuca

SEQ ID NO: 1419487 - RNA, 19 nt, Homo sapiens
ugucguggcucagggugua

SEQ ID NO: 1419488 - RNA, 19 nt, Homo sapiens
guggguaugugauuugucu

SEQ ID NO: 1419489 - RNA, 19 nt, Homo sapiens
gagggcagcguaauuacau

SEQ ID NO: 1419490 - RNA, 19 nt, Homo sapiens
gaagaagaggugacuuugc

SEQ ID NO: 1419491 - RNA, 19 nt, Homo sapiens
cagcaucccagcaaggaaa

SEQ ID NO: 1419492 - RNA, 19 nt, Homo sapiens
gcauggugacgaccugaaa

SEQ ID NO: 1419493 - RNA, 19 nt, Homo sapiens
gaccugaacaacugcaaga

SEQ ID NO: 1419494 - RNA, 19 nt, Homo sapiens
gaauggcagcaucuauuuc

SEQ ID NO: 1419495 - RNA, 19 nt, Homo sapiens
uaagaauggcagcaucuau

SEQ ID NO: 1419496 - RNA, 19 nt, Homo sapiens
ggaaucagcucaauauguu

SEQ ID NO: 1419497 - RNA, 19 nt, Homo sapiens
ccacaagucugucuccuuu

SEQ ID NO: 1419498 - RNA, 19 nt, Homo sapiens
gagcagcaauaauaacuuu

SEQ ID NO: 1419499 - RNA, 19 nt, Homo sapiens
ugacauugguggauaaauu

SEQ ID NO: 1419500 - RNA, 19 nt, Homo sapiens
ggaaagauacucagugaau

SEQ ID NO: 1419501 - RNA, 19 nt, Homo sapiens
gaaagauacucagugaaug

SEQ ID NO: 1419502 - RNA, 19 nt, Homo sapiens
ggagauggcuuugacuuuc

SEQ ID NO: 1419503 - RNA, 19 nt, Homo sapiens
caaauaagcccacaacagu

SEQ ID NO: 1419504 - RNA, 19 nt, Homo sapiens
gagaugaugcuguaguuaa

SEQ ID NO: 1419505 - RNA, 19 nt, Homo sapiens
acacagacacuuuaucuaa

SEQ ID NO: 1419506 - RNA, 19 nt, Homo sapiens
guaacucucugggauguaa

SEQ ID NO: 1419507 - RNA, 19 nt, Homo sapiens
gcagguacuuggaugcauu

SEQ ID NO: 1419508 - RNA, 19 nt, Homo sapiens
ggucacaucuggugcugaa

SEQ ID NO: 1419509 - RNA, 19 nt, Homo sapiens
caaacgaaguguuaaugug

SEQ ID NO: 1419510 - RNA, 19 nt, Homo sapiens
ggaaguuucuggcaacaca

SEQ ID NO: 1419511 - RNA, 19 nt, Homo sapiens
auagggacauugugaauuu

SEQ ID NO: 1419512 - RNA, 19 nt, Homo sapiens
cuaaauaccucuccaucau

SEQ ID NO: 1419513 - RNA, 19 nt, Homo sapiens
ucaaacaguuagcaaaguu

SEQ ID NO: 1419514 - RNA, 19 nt, Homo sapiens
gugaauaccuuaauguucu

SEQ ID NO: 1419515 - RNA, 19 nt, Homo sapiens
gcauaaacacagacacuuu

SEQ ID NO: 1419516 - RNA, 19 nt, Homo sapiens
ccacacacaucaccacaug

SEQ ID NO: 1419517 - RNA, 19 nt, Homo sapiens
ggaaauaaccggcaaaaug

SEQ ID NO: 1419518 - RNA, 19 nt, Homo sapiens
gaaagacuacgagaagaaa

SEQ ID NO: 1419519 - RNA, 19 nt, Homo sapiens
gacauguucucaccuauca

SEQ ID NO: 1419520 - RNA, 19 nt, Homo sapiens
caagacaucugugcagugu

SEQ ID NO: 1419521 - RNA, 19 nt, Homo sapiens
agacaucugugcaguguau

SEQ ID NO: 1419522 - RNA, 19 nt, Homo sapiens
gauagcaucuucugucacu

SEQ ID NO: 1419523 - RNA, 19 nt, Homo sapiens
gaaauugaagcccaguuga

SEQ ID NO: 1419524 - RNA, 19 nt, Homo sapiens
gcugaaaguggaaaucuaa

SEQ ID NO: 1419525 - RNA, 19 nt, Homo sapiens
gggaagugaugaguccaua

SEQ ID NO: 1419526 - RNA, 19 nt, Homo sapiens
uaaaggcuguucaaauaag

SEQ ID NO: 1419527 - RNA, 19 nt, Homo sapiens
guaagcggaggccuaaaua

SEQ ID NO: 1419528 - RNA, 19 nt, Homo sapiens
caucagugcucacaagaca

SEQ ID NO: 1419529 - RNA, 19 nt, Homo sapiens
uagcaaaguuggucacauc

SEQ ID NO: 1419530 - RNA, 19 nt, Homo sapiens
uaugggaucuccagggaaa

SEQ ID NO: 1419531 - RNA, 19 nt, Homo sapiens
ugaaguacuccuuguuuaa

SEQ ID NO: 1419532 - RNA, 19 nt, Homo sapiens
uugaaguacuccuuguuua

SEQ ID NO: 1419533 - RNA, 19 nt, Homo sapiens
cagagaugaugcuguaguu

SEQ ID NO: 1419534 - RNA, 19 nt, Homo sapiens
cuacauugcuucuggaucu

SEQ ID NO: 1419535 - RNA, 19 nt, Homo sapiens
guucaucgaucucuuaagg

SEQ ID NO: 1419536 - RNA, 19 nt, Homo sapiens
aaacgaaguguuaauguga

SEQ ID NO: 1419537 - RNA, 19 nt, Homo sapiens
caaaauaguugucucaagu

SEQ ID NO: 1419538 - RNA, 19 nt, Homo sapiens
gcaacugaaugaaaugcau

SEQ ID NO: 1419539 - RNA, 19 nt, Homo sapiens
uaacagcugagucuaagaa

SEQ ID NO: 1419540 - RNA, 19 nt, Homo sapiens
uuuaguggcugaaauugaa

SEQ ID NO: 1419541 - RNA, 19 nt, Homo sapiens
ggaaacguuggaugacuuu

SEQ ID NO: 1419542 - RNA, 19 nt, Homo sapiens
gccagagaaugaaauugaa

SEQ ID NO: 1419543 - RNA, 19 nt, Homo sapiens
aaacaggaaucuaaagacu

SEQ ID NO: 1419544 - RNA, 19 nt, Homo sapiens
gaauugcucuuuguaacca

SEQ ID NO: 1419545 - RNA, 19 nt, Homo sapiens
ggauguaaauagucagagu

SEQ ID NO: 1419546 - RNA, 19 nt, Homo sapiens
ccucagauuugcuucauca

SEQ ID NO: 1419547 - RNA, 19 nt, Homo sapiens
guggaggaguucagaauuc

SEQ ID NO: 1419548 - RNA, 19 nt, Homo sapiens
cuggaaagauacucaguga

SEQ ID NO: 1419549 - RNA, 19 nt, Homo sapiens
caaguaagaagcuagugaa

SEQ ID NO: 1419550 - RNA, 19 nt, Homo sapiens
ccauaacuuugacagugua

SEQ ID NO: 1419551 - RNA, 19 nt, Homo sapiens
aaagauacucagugaauga

SEQ ID NO: 1419552 - RNA, 19 nt, Homo sapiens
ggaaagaggaaaaugaaaa

SEQ ID NO: 1419553 - RNA, 19 nt, Homo sapiens
uaguuuaggugacauguuc

SEQ ID NO: 1419554 - RNA, 19 nt, Homo sapiens
gaccaucagugcucacaag

SEQ ID NO: 1419555 - RNA, 19 nt, Homo sapiens
guccauaccauaacuuuga

SEQ ID NO: 1419556 - RNA, 19 nt, Homo sapiens
uaaauagucagaguccaua

SEQ ID NO: 1419557 - RNA, 19 nt, Homo sapiens
cauggaaucagcucaauau

SEQ ID NO: 1419558 - RNA, 19 nt, Homo sapiens
caucuaaccaaacaagaaa

SEQ ID NO: 1419559 - RNA, 19 nt, Homo sapiens
caggauuucuccagcuuug

SEQ ID NO: 1419560 - RNA, 19 nt, Homo sapiens
ccacaacagugaacaaacg

SEQ ID NO: 1419561 - RNA, 19 nt, Homo sapiens
guaagaagcuagugaaaac

SEQ ID NO: 1419562 - RNA, 19 nt, Homo sapiens
gguaguaaccagucuguuc

SEQ ID NO: 1419563 - RNA, 19 nt, Homo sapiens
aaauaguugucucaaguug

SEQ ID NO: 1419564 - RNA, 19 nt, Homo sapiens
gccgacagcauuggaaaua

SEQ ID NO: 1419565 - RNA, 19 nt, Homo sapiens
gaagcccaguugauaugug

SEQ ID NO: 1419566 - RNA, 19 nt, Homo sapiens
gaaaacaggaaucuaaaga

SEQ ID NO: 1419567 - RNA, 19 nt, Homo sapiens
guacuccacuguucuuacu

SEQ ID NO: 1419568 - RNA, 19 nt, Homo sapiens
uaacugcgguagauuucau

SEQ ID NO: 1419569 - RNA, 19 nt, Homo sapiens
ucuaugacauugguggaua

SEQ ID NO: 1419570 - RNA, 19 nt, Homo sapiens
gaaguacuccuuguuuaag

SEQ ID NO: 1419571 - RNA, 19 nt, Homo sapiens
uguuggagcagcaauaaua

SEQ ID NO: 1419572 - RNA, 19 nt, Homo sapiens
ugaaagacuacgagaagaa

SEQ ID NO: 1419573 - RNA, 19 nt, Homo sapiens
cauaugcaacugaaugaaa

SEQ ID NO: 1419574 - RNA, 19 nt, Homo sapiens
caaccuaugacaucagcua

SEQ ID NO: 1419575 - RNA, 19 nt, Homo sapiens
gagauggcuuugacuuucu

SEQ ID NO: 1419576 - RNA, 19 nt, Homo sapiens
aaacacagacacuuuaucu

SEQ ID NO: 1419577 - RNA, 19 nt, Homo sapiens
gcaccugccacguccauug

SEQ ID NO: 1419578 - RNA, 19 nt, Homo sapiens
aaguggagaugauuaaaca

SEQ ID NO: 1419579 - RNA, 19 nt, Homo sapiens
gcaaguggagaugauuaaa

SEQ ID NO: 1419580 - RNA, 19 nt, Homo sapiens
gguaagcggaggccuaaau

SEQ ID NO: 1419581 - RNA, 19 nt, Homo sapiens
cucagugaaugaagguuua

SEQ ID NO: 1419582 - RNA, 19 nt, Homo sapiens
cgacagcauuggaaauaac

SEQ ID NO: 1419583 - RNA, 19 nt, Homo sapiens
ccacguccauugccacagu

SEQ ID NO: 1419584 - RNA, 19 nt, Homo sapiens
gcaggaaaaccucagauuu

SEQ ID NO: 1419585 - RNA, 19 nt, Homo sapiens
guaaaccuguuccacuuuu

SEQ ID NO: 1419586 - RNA, 19 nt, Homo sapiens
ugucucaaguugcaaaugu

SEQ ID NO: 1419587 - RNA, 19 nt, Homo sapiens
ccaguucacucucagaaaa

SEQ ID NO: 1419588 - RNA, 19 nt, Homo sapiens
cuaaagacuccuucaaaca

SEQ ID NO: 1419589 - RNA, 19 nt, Homo sapiens
ucuaaagacuccuucaaac

SEQ ID NO: 1419590 - RNA, 19 nt, Homo sapiens
ggaaacagacaguggaaaa

SEQ ID NO: 1419591 - RNA, 19 nt, Homo sapiens
gacacuuuaucuaaggaaa

SEQ ID NO: 1419592 - RNA, 19 nt, Homo sapiens
auguugaaaucaccaguua

SEQ ID NO: 1419593 - RNA, 19 nt, Homo sapiens
ucucuuaguggugaaauua

SEQ ID NO: 1419594 - RNA, 19 nt, Homo sapiens
uaaagacuccuucaaacag

SEQ ID NO: 1419595 - RNA, 19 nt, Homo sapiens
cuaugacauugguggauaa

SEQ ID NO: 1419596 - RNA, 19 nt, Homo sapiens
gaagauagcacacuaagaa

SEQ ID NO: 1419597 - RNA, 19 nt, Homo sapiens
ucaaguaacuguccaaauu

SEQ ID NO: 1419598 - RNA, 19 nt, Homo sapiens
guaauucccugcagguuaa

SEQ ID NO: 1419599 - RNA, 19 nt, Homo sapiens
gaaagcagugucugaaaua

SEQ ID NO: 1419600 - RNA, 19 nt, Homo sapiens
gaagagaagccuagaagaa

SEQ ID NO: 1419601 - RNA, 19 nt, Homo sapiens
cuaauaaacuuuccgacua

SEQ ID NO: 1419602 - RNA, 19 nt, Homo sapiens
gcucacaccuguaauccua

SEQ ID NO: 1419603 - RNA, 19 nt, Homo sapiens
uaaaugagauguccacaca

SEQ ID NO: 1419604 - RNA, 19 nt, Homo sapiens
gauagcacacuaagaaaua

SEQ ID NO: 1419605 - RNA, 19 nt, Homo sapiens
gcaaagccuuaaugagaaa

SEQ ID NO: 1419606 - RNA, 19 nt, Homo sapiens
ggaacagcaugcccucuuu

SEQ ID NO: 1419607 - RNA, 19 nt, Homo sapiens
gaaggaauucaguaugaua

SEQ ID NO: 1419608 - RNA, 19 nt, Homo sapiens
caaguaacuguccaaauua

SEQ ID NO: 1419609 - RNA, 19 nt, Homo sapiens
gaagaggugcucacucaaa

SEQ ID NO: 1419610 - RNA, 19 nt, Homo sapiens
gaugaagaucugacuaaua

SEQ ID NO: 1419611 - RNA, 19 nt, Homo sapiens
gaagaucuccugcgaguag

SEQ ID NO: 1419612 - RNA, 19 nt, Homo sapiens
gggagagccuggugccuuu

SEQ ID NO: 1419613 - RNA, 19 nt, Homo sapiens
gcagauguuuaauauggaa

SEQ ID NO: 1419614 - RNA, 19 nt, Homo sapiens
gguaauucccugcagguua

SEQ ID NO: 1419615 - RNA, 19 nt, Homo sapiens
ugaaagcagugucugaaau

SEQ ID NO: 1419616 - RNA, 19 nt, Homo sapiens
gaaacuagaaaccaaugaa

SEQ ID NO: 1419617 - RNA, 19 nt, Homo sapiens
guauuuaccacuucacuaa

SEQ ID NO: 1419618 - RNA, 19 nt, Homo sapiens
gacaugaguuugcuagauc

SEQ ID NO: 1419619 - RNA, 19 nt, Homo sapiens
caaccaaguucaugggaau

SEQ ID NO: 1419620 - RNA, 19 nt, Homo sapiens
ggaagaugauaugcugaaa

SEQ ID NO: 1419621 - RNA, 19 nt, Homo sapiens
cagcugagcaggaaauaaa

SEQ ID NO: 1419622 - RNA, 19 nt, Homo sapiens
ggaaguauccaaccuccaa

SEQ ID NO: 1419623 - RNA, 19 nt, Homo sapiens
aaugagauguccacacaaa

SEQ ID NO: 1419624 - RNA, 19 nt, Homo sapiens
gcuaggcucugauacaaag

SEQ ID NO: 1419625 - RNA, 19 nt, Homo sapiens
ccaguucacuuucuuaggu

SEQ ID NO: 1419626 - RNA, 19 nt, Homo sapiens
gcuauucacucuguucuca

SEQ ID NO: 1419627 - RNA, 19 nt, Homo sapiens
cagcuaggcucugauacaa

SEQ ID NO: 1419628 - RNA, 19 nt, Homo sapiens
ggaaaaccaauaccaguua

SEQ ID NO: 1419629 - RNA, 19 nt, Homo sapiens
ugacuaugcagauguuuaa

SEQ ID NO: 1419630 - RNA, 19 nt, Homo sapiens
gauacaaaggcaauugaaa

SEQ ID NO: 1419631 - RNA, 19 nt, Homo sapiens
cauggucucuagaugguuu

SEQ ID NO: 1419632 - RNA, 19 nt, Homo sapiens
ggacaucaucauuaauuuc

SEQ ID NO: 1419633 - RNA, 19 nt, Homo sapiens
gaagaucugacuaauaaac

SEQ ID NO: 1419634 - RNA, 19 nt, Homo sapiens
caaaggcaauugaaaaguu

SEQ ID NO: 1419635 - RNA, 19 nt, Homo sapiens
gugaagagccggaagaagu

SEQ ID NO: 1419636 - RNA, 19 nt, Homo sapiens
gauccauggucucuagaug

SEQ ID NO: 1419637 - RNA, 19 nt, Homo sapiens
aaagcagugucugaaauaa

SEQ ID NO: 1419638 - RNA, 19 nt, Homo sapiens
gaacagcaugcccucuuug

SEQ ID NO: 1419639 - RNA, 19 nt, Homo sapiens
uaaaggaauugguggugau

SEQ ID NO: 1419640 - RNA, 19 nt, Homo sapiens
uaauaaacuuuccgacuac

SEQ ID NO: 1419641 - RNA, 19 nt, Homo sapiens
ugcaaagccuuaaugagaa

SEQ ID NO: 1419642 - RNA, 19 nt, Homo sapiens
cagaaaagcuugagucuac

SEQ ID NO: 1419643 - RNA, 19 nt, Homo sapiens
acagauacuuguaagacuu

SEQ ID NO: 1419644 - RNA, 19 nt, Homo sapiens
guacccacauauauugaug

SEQ ID NO: 1419645 - RNA, 19 nt, Homo sapiens
agagaagccuagaagaaau

SEQ ID NO: 1419646 - RNA, 19 nt, Homo sapiens
aagcuugagucuacugaaa

SEQ ID NO: 1419647 - RNA, 19 nt, Homo sapiens
caagacacauuugccaaca

SEQ ID NO: 1419648 - RNA, 19 nt, Homo sapiens
ggaagagaagccuagaaga

SEQ ID NO: 1419649 - RNA, 19 nt, Homo sapiens
agacacauuugccaacaau

SEQ ID NO: 1419650 - RNA, 19 nt, Homo sapiens
ccaaugaauuccaacaacu

SEQ ID NO: 1419651 - RNA, 19 nt, Homo sapiens
agaaaccaaugaauuccaa

SEQ ID NO: 1419652 - RNA, 19 nt, Homo sapiens
ccaacuguguuagacauga

SEQ ID NO: 1419653 - RNA, 19 nt, Homo sapiens
cgacuacgaacccaaaguu

SEQ ID NO: 1419654 - RNA, 19 nt, Homo sapiens
aagagaagccuagaagaaa

SEQ ID NO: 1419655 - RNA, 19 nt, Homo sapiens
ggaugcaaagccuuaauga

SEQ ID NO: 1419656 - RNA, 19 nt, Homo sapiens
ggugaaacccugucucuac

SEQ ID NO: 1419657 - RNA, 19 nt, Homo sapiens
uuugauacgccucaucuua

SEQ ID NO: 1419658 - RNA, 19 nt, Homo sapiens
gcagcuaggcucugauaca

SEQ ID NO: 1419659 - RNA, 19 nt, Homo sapiens
gcuaaaagauuuggaagau

SEQ ID NO: 1419660 - RNA, 19 nt, Homo sapiens
gagaagccuagaagaaaug

SEQ ID NO: 1419661 - RNA, 19 nt, Homo sapiens
gaggugggcagaucacgaa

SEQ ID NO: 1419662 - RNA, 19 nt, Homo sapiens
ugagauguccacacaaaug

SEQ ID NO: 1419663 - RNA, 19 nt, Homo sapiens
guccauugauuuugaguua

SEQ ID NO: 1419664 - RNA, 19 nt, Homo sapiens
cuacgaacccaaaguugaa

SEQ ID NO: 1419665 - RNA, 19 nt, Homo sapiens
ggaagauagcacacuaaga

SEQ ID NO: 1419666 - RNA, 19 nt, Homo sapiens
augcaaagccuuaaugaga

SEQ ID NO: 1419667 - RNA, 19 nt, Homo sapiens
augaagaggugcucacuca

SEQ ID NO: 1419668 - RNA, 19 nt, Homo sapiens
agacaugaguuugcuagau

SEQ ID NO: 1419669 - RNA, 19 nt, Homo sapiens
uaaagccugggaaacauuu

SEQ ID NO: 1419670 - RNA, 19 nt, Homo sapiens
aaagaguauuuaccacuuc

SEQ ID NO: 1419671 - RNA, 19 nt, Homo sapiens
acacauuugccaacaauug

SEQ ID NO: 1419672 - RNA, 19 nt, Homo sapiens
ccuggugccuuugcuauga

SEQ ID NO: 1419673 - RNA, 19 nt, Homo sapiens
agcagugucugaaauaaug

SEQ ID NO: 1419674 - RNA, 19 nt, Homo sapiens
gaagaugauaugcugaaag

SEQ ID NO: 1419675 - RNA, 19 nt, Homo sapiens
augcagauguuuaauaugg

SEQ ID NO: 1419676 - RNA, 19 nt, Homo sapiens
gaauuccaacaacuucaaa

SEQ ID NO: 1419677 - RNA, 19 nt, Homo sapiens
gugccuuugcuaugaauua

SEQ ID NO: 1419678 - RNA, 19 nt, Homo sapiens
aggccuuucuuaggaauua

SEQ ID NO: 1419679 - RNA, 19 nt, Homo sapiens
caaugaauuccaacaacuu

SEQ ID NO: 1419680 - RNA, 19 nt, Homo sapiens
caguucacuuucuuaggua

SEQ ID NO: 1419681 - RNA, 19 nt, Homo sapiens
caugacauuuauucugaug

SEQ ID NO: 1419682 - RNA, 19 nt, Homo sapiens
gugaaacccugucucuacu

SEQ ID NO: 1419683 - RNA, 19 nt, Homo sapiens
gaagucaggagaucaagac

SEQ ID NO: 1419684 - RNA, 19 nt, Homo sapiens
ucucauaccuuuucuguca

SEQ ID NO: 1419685 - RNA, 19 nt, Homo sapiens
gcugaaagcagugucugaa

SEQ ID NO: 1419686 - RNA, 19 nt, Homo sapiens
gucaggagaucaagaccau

SEQ ID NO: 1419687 - RNA, 19 nt, Homo sapiens
ccuguaauccuagcacuuu

SEQ ID NO: 1419688 - RNA, 19 nt, Homo sapiens
uaaacuuuccgacuacgaa

SEQ ID NO: 1419689 - RNA, 19 nt, Homo sapiens
gaggugcucacucaaagga

SEQ ID NO: 1419690 - RNA, 19 nt, Homo sapiens
agacuugacuaugcagaug

SEQ ID NO: 1419691 - RNA, 19 nt, Homo sapiens
acuagaaaccaaugaauuc

SEQ ID NO: 1419692 - RNA, 19 nt, Homo sapiens
cagauacuuguaagacuuu

SEQ ID NO: 1419693 - RNA, 19 nt, Homo sapiens
ccacacaaccaaguucaug

SEQ ID NO: 1419694 - RNA, 19 nt, Homo sapiens
aagaugauaugcugaaagc

SEQ ID NO: 1419695 - RNA, 19 nt, Homo sapiens
aagaggugcucacucaaag

SEQ ID NO: 1419696 - RNA, 19 nt, Homo sapiens
gagcagaacuuuauuauuc

SEQ ID NO: 1419697 - RNA, 19 nt, Homo sapiens
gaacaacauugaacuagaa

SEQ ID NO: 1419698 - RNA, 19 nt, Homo sapiens
gcaagcacuuuaaagauuu

SEQ ID NO: 1419699 - RNA, 19 nt, Homo sapiens
gcagucacauccaacuuua

SEQ ID NO: 1419700 - RNA, 19 nt, Homo sapiens
ggaagaauagcgugaauaa

SEQ ID NO: 1419701 - RNA, 19 nt, Homo sapiens
gaacaacaguguggaauag

SEQ ID NO: 1419702 - RNA, 19 nt, Homo sapiens
ggaauaaucuuucuuugcu

SEQ ID NO: 1419703 - RNA, 19 nt, Homo sapiens
uaacauacauucccuuugg

SEQ ID NO: 1419704 - RNA, 19 nt, Homo sapiens
ggaacaacauugaacuaga

SEQ ID NO: 1419705 - RNA, 19 nt, Homo sapiens
guggaauaguucugaauua

SEQ ID NO: 1419706 - RNA, 19 nt, Homo sapiens
gcugauaccuucgguuauu

SEQ ID NO: 1419707 - RNA, 19 nt, Homo sapiens
gaacaagagacuaauuaga

SEQ ID NO: 1419708 - RNA, 19 nt, Homo sapiens
gaauaguucugaauuaugc

SEQ ID NO: 1419709 - RNA, 19 nt, Homo sapiens
ucaaaugcaucaaagagaa

SEQ ID NO: 1419710 - RNA, 19 nt, Homo sapiens
gcaaggaaguuauuguuuu

SEQ ID NO: 1419711 - RNA, 19 nt, Homo sapiens
cuuuagagcuguauaacua

SEQ ID NO: 1419712 - RNA, 19 nt, Homo sapiens
gaaguaacauuguauucgu

SEQ ID NO: 1419713 - RNA, 19 nt, Homo sapiens
aaacaaaguccuucaauuc

SEQ ID NO: 1419714 - RNA, 19 nt, Homo sapiens
acaaaguccuucaauucua

SEQ ID NO: 1419715 - RNA, 19 nt, Homo sapiens
gaaagugguccuugugaug

SEQ ID NO: 1419716 - RNA, 19 nt, Homo sapiens
gguguucgaucucaaguau

SEQ ID NO: 1419717 - RNA, 19 nt, Homo sapiens
aagaauagcgugaauaaug

SEQ ID NO: 1419718 - RNA, 19 nt, Homo sapiens
gaagcaaguaggauuugua

SEQ ID NO: 1419719 - RNA, 19 nt, Homo sapiens
ugagcuaacuuucuuauac

SEQ ID NO: 1419720 - RNA, 19 nt, Homo sapiens
gggcucaccuucacauugu

SEQ ID NO: 1419721 - RNA, 19 nt, Homo sapiens
uaaaauaccuggaacaaca

SEQ ID NO: 1419722 - RNA, 19 nt, Homo sapiens
gcacggaagcugagcagaa

SEQ ID NO: 1419723 - RNA, 19 nt, Homo sapiens
gauaacauacauucccuuu

SEQ ID NO: 1419724 - RNA, 19 nt, Homo sapiens
gauggaaggaauaaucuuu

SEQ ID NO: 1419725 - RNA, 19 nt, Homo sapiens
ugcaagcacuuuaaagauu

SEQ ID NO: 1419726 - RNA, 19 nt, Homo sapiens
cagcugauaccuucgguua

SEQ ID NO: 1419727 - RNA, 19 nt, Homo sapiens
ggauuacucgaccucauua

SEQ ID NO: 1419728 - RNA, 19 nt, Homo sapiens
gcaaguaggauuuguaaaa

SEQ ID NO: 1419729 - RNA, 19 nt, Homo sapiens
gcaaagcucaaaugcauca

SEQ ID NO: 1419730 - RNA, 19 nt, Homo sapiens
gaucucaaguauuucugaa

SEQ ID NO: 1419731 - RNA, 19 nt, Homo sapiens
ucuggugcaugaaacauua

SEQ ID NO: 1419732 - RNA, 19 nt, Homo sapiens
uguucgaucucaaguauuu

SEQ ID NO: 1419733 - RNA, 19 nt, Homo sapiens
uacucgaccucauuacuua

SEQ ID NO: 1419734 - RNA, 19 nt, Homo sapiens
ucacauuguuaguucauga

SEQ ID NO: 1419735 - RNA, 19 nt, Homo sapiens
ucaaagaugggauauucua

SEQ ID NO: 1419736 - RNA, 19 nt, Homo sapiens
ugauguuccuuguaacuuu

SEQ ID NO: 1419737 - RNA, 19 nt, Homo sapiens
gaagcugagcagaacuuua

SEQ ID NO: 1419738 - RNA, 19 nt, Homo sapiens
caaaguccuucaauucuac

SEQ ID NO: 1419739 - RNA, 19 nt, Homo sapiens
ggaauaguucugaauuaug

SEQ ID NO: 1419740 - RNA, 19 nt, Homo sapiens
gagcuaacuuucuuauacu

SEQ ID NO: 1419741 - RNA, 19 nt, Homo sapiens
ggagaaaacuguguuguuc

SEQ ID NO: 1419742 - RNA, 19 nt, Homo sapiens
gaaugaacccgacaacucu

SEQ ID NO: 1419743 - RNA, 19 nt, Homo sapiens
gcugagcagaacuuuauua

SEQ ID NO: 1419744 - RNA, 19 nt, Homo sapiens
gggagcaccuggaacuguu

SEQ ID NO: 1419745 - RNA, 19 nt, Homo sapiens
gaaugcauguauggaagaa

SEQ ID NO: 1419746 - RNA, 19 nt, Homo sapiens
gauguuccuuguaacuuug

SEQ ID NO: 1419747 - RNA, 19 nt, Homo sapiens
ggagagccuuccaguccaa

SEQ ID NO: 1419748 - RNA, 19 nt, Homo sapiens
caaguuguuuggugacuca

SEQ ID NO: 1419749 - RNA, 19 nt, Homo sapiens
ugcaaucucuuugucauuu

SEQ ID NO: 1419750 - RNA, 19 nt, Homo sapiens
gaauaaugcaaucucuuug

SEQ ID NO: 1419751 - RNA, 19 nt, Homo sapiens
augcauguauggaagaaua

SEQ ID NO: 1419752 - RNA, 19 nt, Homo sapiens
gaagggagcaccuggaacu

SEQ ID NO: 1419753 - RNA, 19 nt, Homo sapiens
acccaggugugcuucauua

SEQ ID NO: 1419754 - RNA, 19 nt, Homo sapiens
caaagaugggauauucuaa

SEQ ID NO: 1419755 - RNA, 19 nt, Homo sapiens
gaaaacaugcugguucaua

SEQ ID NO: 1419756 - RNA, 19 nt, Homo sapiens
gaacuagaaacucagaaag

SEQ ID NO: 1419757 - RNA, 19 nt, Homo sapiens
aaacuguguuguucuuguu

SEQ ID NO: 1419758 - RNA, 19 nt, Homo sapiens
agaguauucuggcauaaga

SEQ ID NO: 1419759 - RNA, 19 nt, Homo sapiens
gaacuguuguccuauugac

SEQ ID NO: 1419760 - RNA, 19 nt, Homo sapiens
caucaaagagaaaucagaa

SEQ ID NO: 1419761 - RNA, 19 nt, Homo sapiens
acaacaguguggaauaguu

SEQ ID NO: 1419762 - RNA, 19 nt, Homo sapiens
caauuggugugcacugaau

SEQ ID NO: 1419763 - RNA, 19 nt, Homo sapiens
cgagacaacauguguguau

SEQ ID NO: 1419764 - RNA, 19 nt, Homo sapiens
gagacuaauuagacaaugg

SEQ ID NO: 1419765 - RNA, 19 nt, Homo sapiens
acaagagacuaauuagaca

SEQ ID NO: 1419766 - RNA, 19 nt, Homo sapiens
gugcaugaaacauuaauug

SEQ ID NO: 1419767 - RNA, 19 nt, Homo sapiens
acauugaacuagaaacuca

SEQ ID NO: 1419768 - RNA, 19 nt, Homo sapiens
aaaugggccuggaaugaug

SEQ ID NO: 1419769 - RNA, 19 nt, Homo sapiens
gagacaacauguguguaug

SEQ ID NO: 1419770 - RNA, 19 nt, Homo sapiens
aagcugagcagaacuuuau

SEQ ID NO: 1419771 - RNA, 19 nt, Homo sapiens
gggcugagagugaaaggaa

SEQ ID NO: 1419772 - RNA, 19 nt, Homo sapiens
cacaggagugcacaaguua

SEQ ID NO: 1419773 - RNA, 19 nt, Homo sapiens
caaccagaaauuaugcuuu

SEQ ID NO: 1419774 - RNA, 19 nt, Homo sapiens
caagcacuuuaaagauuug

SEQ ID NO: 1419775 - RNA, 19 nt, Homo sapiens
auucaaagaugggauauuc

SEQ ID NO: 1419776 - RNA, 19 nt, Homo sapiens
gcacugaaugcauguaugg

SEQ ID NO: 1419777 - RNA, 19 nt, Homo sapiens
gagaugagaaugccaaagg

SEQ ID NO: 1419778 - RNA, 19 nt, Homo sapiens
ggacuuagagaugagaaug

SEQ ID NO: 1419779 - RNA, 19 nt, Homo sapiens
caaaugcaucaaagagaaa

SEQ ID NO: 1419780 - RNA, 19 nt, Homo sapiens
caaggaaguuauuguuuug

SEQ ID NO: 1419781 - RNA, 19 nt, Homo sapiens
gggauuacucgaccucauu

SEQ ID NO: 1419782 - RNA, 19 nt, Homo sapiens
cucagacucuuagcucuua

SEQ ID NO: 1419783 - RNA, 19 nt, Homo sapiens
ccauugaacaagagacuaa

SEQ ID NO: 1419784 - RNA, 19 nt, Homo sapiens
gaaauauacucuggggaaa

SEQ ID NO: 1419785 - RNA, 19 nt, Homo sapiens
gcaugaaacauuaauugca

SEQ ID NO: 1419786 - RNA, 19 nt, Homo sapiens
gcuaacgacuggauaaaau

SEQ ID NO: 1419787 - RNA, 19 nt, Homo sapiens
gcucaccuucacauuguua

SEQ ID NO: 1419788 - RNA, 19 nt, Homo sapiens
aauaugguggucuuucuua

SEQ ID NO: 1419789 - RNA, 19 nt, Homo sapiens
ggcagucacauccaacuuu

SEQ ID NO: 1419790 - RNA, 19 nt, Homo sapiens
agaacaacaguguggaaua

SEQ ID NO: 1419791 - RNA, 19 nt, Homo sapiens
agaauagcgugaauaaugc

SEQ ID NO: 1419792 - RNA, 19 nt, Homo sapiens
guguguagauaaugugguu

SEQ ID NO: 1419793 - RNA, 19 nt, Homo sapiens
gauaaaugggccuggaaug

SEQ ID NO: 1419794 - RNA, 19 nt, Homo sapiens
gaagaauagcgugaauaau

SEQ ID NO: 1419795 - RNA, 19 nt, Homo sapiens
acugguaccuuucuaaucu

SEQ ID NO: 1419796 - RNA, 19 nt, Homo sapiens
gacaauauccaaggcauua

SEQ ID NO: 1419797 - RNA, 19 nt, Homo sapiens
gcgcauuucuggucucauc

SEQ ID NO: 1419798 - RNA, 19 nt, Homo sapiens
ggaaggugcugcgggacaa

SEQ ID NO: 1419799 - RNA, 19 nt, Homo sapiens
gcgcugugauuucagaaug

SEQ ID NO: 1419800 - RNA, 19 nt, Homo sapiens
ggucgcacccuuuaugguu

SEQ ID NO: 1419801 - RNA, 19 nt, Homo sapiens
ggacaauauccaaggcauu

SEQ ID NO: 1419802 - RNA, 19 nt, Homo sapiens
ucaaagucuuccuggagaa

SEQ ID NO: 1419803 - RNA, 19 nt, Homo sapiens
ugaguaggcgcugugauuu

SEQ ID NO: 1419804 - RNA, 19 nt, Homo sapiens
gucgcacccuuuaugguuu

SEQ ID NO: 1419805 - RNA, 19 nt, Homo sapiens
gcauuucuggucucaucua

SEQ ID NO: 1419806 - RNA, 19 nt, Homo sapiens
ggccauggaugugguguac

SEQ ID NO: 1419807 - RNA, 19 nt, Homo sapiens
cugaguaggcgcugugauu

SEQ ID NO: 1419808 - RNA, 19 nt, Homo sapiens
aguaggcgcugugauuuca

SEQ ID NO: 1419809 - RNA, 19 nt, Homo sapiens
gaguaggcgcugugauuuc
